United States Patent 7,341,835 (METHODS OF ANALYSIS OF ALTERNATIVE SPLICING IN MOUSE) - sequence listing, part 22

SEQ ID NO: 837855 - DNA, 25 bp, Mus musculus
ttatcccggaactgcaaggtgttgg

SEQ ID NO: 837856 - DNA, 25 bp, Mus musculus
ttatccctagaaccagctagctact

SEQ ID NO: 837857 - DNA, 25 bp, Mus musculus
ttatccctagaagcagctagctact

SEQ ID NO: 837858 - DNA, 25 bp, Mus musculus
ttatccctggaactgtgctcctgtg

SEQ ID NO: 837859 - DNA, 25 bp, Mus musculus
ttatccctggaagtgtgctcctgtg

SEQ ID NO: 837860 - DNA, 25 bp, Mus musculus
ttatcccttcagctctacatcagag

SEQ ID NO: 837861 - DNA, 25 bp, Mus musculus
ttatcccttcaggtctacatcagag

SEQ ID NO: 837862 - DNA, 25 bp, Mus musculus
ttatccgatgaactcacacacaaca

SEQ ID NO: 837863 - DNA, 25 bp, Mus musculus
ttatccgatgaagtcacacacaaca

SEQ ID NO: 837864 - DNA, 25 bp, Mus musculus
ttatccgcgagaccgaaaccaccaa

SEQ ID NO: 837865 - DNA, 25 bp, Mus musculus
ttatccgcgagagcgaaaccaccaa

SEQ ID NO: 837866 - DNA, 25 bp, Mus musculus
ttatccggagacaaaccctggacgc

SEQ ID NO: 837867 - DNA, 25 bp, Mus musculus
ttatccggagactaaccctggacgc

SEQ ID NO: 837868 - DNA, 25 bp, Mus musculus
ttatccttcaccatacagtattgcc

SEQ ID NO: 837869 - DNA, 25 bp, Mus musculus
ttatccttcaccttacagtattgcc

SEQ ID NO: 837870 - DNA, 25 bp, Mus musculus
ttatcgaacactatcccaatgaggg

SEQ ID NO: 837871 - DNA, 25 bp, Mus musculus
ttatcgaacactttcccaatgaggg

SEQ ID NO: 837872 - DNA, 25 bp, Mus musculus
ttatcgagagcccaccagagctcct

SEQ ID NO: 837873 - DNA, 25 bp, Mus musculus
ttatcgagagccgaccagagctcct

SEQ ID NO: 837874 - DNA, 25 bp, Mus musculus
ttatcgcatagaaaaccagacttgc

SEQ ID NO: 837875 - DNA, 25 bp, Mus musculus
ttatcgcatagataaccagacttgc

SEQ ID NO: 837876 - DNA, 25 bp, Mus musculus
ttatcgccaaggatgcaaacacctg

SEQ ID NO: 837877 - DNA, 25 bp, Mus musculus
ttatcgccaaggttgcaaacacctg

SEQ ID NO: 837878 - DNA, 25 bp, Mus musculus
ttatcgctgagacctgtggcaaccg

SEQ ID NO: 837879 - DNA, 25 bp, Mus musculus
ttatcgctgagagctgtggcaaccg

SEQ ID NO: 837880 - DNA, 25 bp, Mus musculus
ttatcgctgggcaactgggcacagg

SEQ ID NO: 837881 - DNA, 25 bp, Mus musculus
ttatcgctgggctactgggcacagg

SEQ ID NO: 837882 - DNA, 25 bp, Mus musculus
ttatcggaaggaatccaccaagcag

SEQ ID NO: 837883 - DNA, 25 bp, Mus musculus
ttatcggaaggattccaccaagcag

SEQ ID NO: 837884 - DNA, 25 bp, Mus musculus
ttatcgggacagaccgcgtagcctg

SEQ ID NO: 837885 - DNA, 25 bp, Mus musculus
ttatcgggacagtccgcgtagcctg

SEQ ID NO: 837886 - DNA, 25 bp, Mus musculus
ttatcgtagttgagaatattctggc

SEQ ID NO: 837887 - DNA, 25 bp, Mus musculus
ttatcgtagttgtgaatattctggc

SEQ ID NO: 837888 - DNA, 25 bp, Mus musculus
ttatctacagagagacataccccag

SEQ ID NO: 837889 - DNA, 25 bp, Mus musculus
ttatctacagagtgacataccccag

SEQ ID NO: 837890 - DNA, 25 bp, Mus musculus
ttatctcaagacagggataggtggg

SEQ ID NO: 837891 - DNA, 25 bp, Mus musculus
ttatctcaagactgggataggtggg

SEQ ID NO: 837892 - DNA, 25 bp, Mus musculus
ttatctcctatgaccgcactctggt

SEQ ID NO: 837893 - DNA, 25 bp, Mus musculus
ttatctcctatgtccgcactctggt

SEQ ID NO: 837894 - DNA, 25 bp, Mus musculus
ttatctctgtggatgagtatgtgcc

SEQ ID NO: 837895 - DNA, 25 bp, Mus musculus
ttatctctgtggttgagtatgtgcc

SEQ ID NO: 837896 - DNA, 25 bp, Mus musculus
ttatctgcacgaaaaagacagactg

SEQ ID NO: 837897 - DNA, 25 bp, Mus musculus
ttatctgcacgataaagacagactg

SEQ ID NO: 837898 - DNA, 25 bp, Mus musculus
ttatctgcgaaccactcccgaaatc

SEQ ID NO: 837899 - DNA, 25 bp, Mus musculus
ttatctgcgaacgactcccgaaatc

SEQ ID NO: 837900 - DNA, 25 bp, Mus musculus
ttatctggagcactttggaacttcc

SEQ ID NO: 837901 - DNA, 25 bp, Mus musculus
ttatctggagcagtttggaacttcc

SEQ ID NO: 837902 - DNA, 25 bp, Mus musculus
ttatctgtgaacattcggctaaggt

SEQ ID NO: 837903 - DNA, 25 bp, Mus musculus
ttatctgtgaactttcggctaaggt

SEQ ID NO: 837904 - DNA, 25 bp, Mus musculus
ttatctgtgagaccgatcaccccaa

SEQ ID NO: 837905 - DNA, 25 bp, Mus musculus
ttatctgtgagagcgatcaccccaa

SEQ ID NO: 837906 - DNA, 25 bp, Mus musculus
ttatcttccgtaacgccttcacgtc

SEQ ID NO: 837907 - DNA, 25 bp, Mus musculus
ttatcttccgtatcgccttcacgtc

SEQ ID NO: 837908 - DNA, 25 bp, Mus musculus
ttatcttcctgaaccagcttcctgg

SEQ ID NO: 837909 - DNA, 25 bp, Mus musculus
ttatcttcctgatccagcttcctgg

SEQ ID NO: 837910 - DNA, 25 bp, Mus musculus
ttatcttctgatcctgaggttttgc

SEQ ID NO: 837911 - DNA, 25 bp, Mus musculus
ttatcttctgatgctgaggttttgc

SEQ ID NO: 837912 - DNA, 25 bp, Mus musculus
ttatctttgagtaaatggagccagc

SEQ ID NO: 837913 - DNA, 25 bp, Mus musculus
ttatctttgagttaatggagccagc

SEQ ID NO: 837914 - DNA, 25 bp, Mus musculus
ttatcttttagcacgcatttttgtt

SEQ ID NO: 837915 - DNA, 25 bp, Mus musculus
ttatcttttagctcgcatttttgtt

SEQ ID NO: 837916 - DNA, 25 bp, Mus musculus
ttatgaacagccctgattgtggaca

SEQ ID NO: 837917 - DNA, 25 bp, Mus musculus
ttatgaacagccgtgattgtggaca

SEQ ID NO: 837918 - DNA, 25 bp, Mus musculus
ttatgaacccttcgtctgcatctat

SEQ ID NO: 837919 - DNA, 25 bp, Mus musculus
ttatgaacccttggtctgcatctat

SEQ ID NO: 837920 - DNA, 25 bp, Mus musculus
ttatgaactgaacggcaaagacctg

SEQ ID NO: 837921 - DNA, 25 bp, Mus musculus
ttatgaactgaagggcaaagacctg

SEQ ID NO: 837922 - DNA, 25 bp, Mus musculus
ttatgaagagaacctcgaggccagc

SEQ ID NO: 837923 - DNA, 25 bp, Mus musculus
ttatgaagagaagctcgaggccagc

SEQ ID NO: 837924 - DNA, 25 bp, Mus musculus
ttatgaagaggcaggtcatggcccg

SEQ ID NO: 837925 - DNA, 25 bp, Mus musculus
ttatgaagaggctggtcatggcccg

SEQ ID NO: 837926 - DNA, 25 bp, Mus musculus
ttatgaaggagcctgaatcaccagg

SEQ ID NO: 837927 - DNA, 25 bp, Mus musculus
ttatgaaggagcgtgaatcaccagg

SEQ ID NO: 837928 - DNA, 25 bp, Mus musculus
ttatgaaggtgtatactgtgaaatc

SEQ ID NO: 837929 - DNA, 25 bp, Mus musculus
ttatgaaggtgtttactgtgaaatc

SEQ ID NO: 837930 - DNA, 25 bp, Mus musculus
ttatgaatgaacagggagaataccc

SEQ ID NO: 837931 - DNA, 25 bp, Mus musculus
ttatgaatgaactgggagaataccc

SEQ ID NO: 837932 - DNA, 25 bp, Mus musculus
ttatgacaaagtagactatctgagc

SEQ ID NO: 837933 - DNA, 25 bp, Mus musculus
ttatgacaaagttgactatctgagc

SEQ ID NO: 837934 - DNA, 25 bp, Mus musculus
ttatgacacgctacagtattgcgac

SEQ ID NO: 837935 - DNA, 25 bp, Mus musculus
ttatgacacgcttcagtattgcgac

SEQ ID NO: 837936 - DNA, 25 bp, Mus musculus
ttatgacaggtgcaaaaacaccttg

SEQ ID NO: 837937 - DNA, 25 bp, Mus musculus
ttatgacaggtggaaaaacaccttg

SEQ ID NO: 837938 - DNA, 25 bp, Mus musculus
ttatgacatagacccaaacgccggg

SEQ ID NO: 837939 - DNA, 25 bp, Mus musculus
ttatgacatagagccaaacgccggg

SEQ ID NO: 837940 - DNA, 25 bp, Mus musculus
ttatgacatgcaccgattacatccc

SEQ ID NO: 837941 - DNA, 25 bp, Mus musculus
ttatgacatgcagcgattacatccc

SEQ ID NO: 837942 - DNA, 25 bp, Mus musculus
ttatgaccagctacccaaagactcc

SEQ ID NO: 837943 - DNA, 25 bp, Mus musculus
ttatgaccagcttcccaaagactcc

SEQ ID NO: 837944 - DNA, 25 bp, Mus musculus
ttatgaccccatcgatgaaattcag

SEQ ID NO: 837945 - DNA, 25 bp, Mus musculus
ttatgaccccatggatgaaattcag

SEQ ID NO: 837946 - DNA, 25 bp, Mus musculus
ttatgacccgacaacagctgctcta

SEQ ID NO: 837947 - DNA, 25 bp, Mus musculus
ttatgacccgactacagctgctcta

SEQ ID NO: 837948 - DNA, 25 bp, Mus musculus
ttatgacctgatcagccgttttaag

SEQ ID NO: 837949 - DNA, 25 bp, Mus musculus
ttatgacctgatgagccgttttaag

SEQ ID NO: 837950 - DNA, 25 bp, Mus musculus
ttatgacgttgcagccccgctgtga

SEQ ID NO: 837951 - DNA, 25 bp, Mus musculus
ttatgacgttgctgccccgctgtga

SEQ ID NO: 837952 - DNA, 25 bp, Mus musculus
ttatgactcagaacgtagggccagc

SEQ ID NO: 837953 - DNA, 25 bp, Mus musculus
ttatgactcagatcgtagggccagc

SEQ ID NO: 837954 - DNA, 25 bp, Mus musculus
ttatgagcatccctgtgcagggaga

SEQ ID NO: 837955 - DNA, 25 bp, Mus musculus
ttatgagcatccgtgtgcagggaga

SEQ ID NO: 837956 - DNA, 25 bp, Mus musculus
ttatgagccagaacctaatatagtc

SEQ ID NO: 837957 - DNA, 25 bp, Mus musculus
ttatgagccagatcctaatatagtc

SEQ ID NO: 837958 - DNA, 25 bp, Mus musculus
ttatgagctgagagatggagcttcg

SEQ ID NO: 837959 - DNA, 25 bp, Mus musculus
ttatgagctgagtgatggagcttcg

SEQ ID NO: 837960 - DNA, 25 bp, Mus musculus
ttatgagctggcacaccaacgacac

SEQ ID NO: 837961 - DNA, 25 bp, Mus musculus
ttatgagctggctcaccaacgacac

SEQ ID NO: 837962 - DNA, 25 bp, Mus musculus
ttatgaggcctaccatctctatccg

SEQ ID NO: 837963 - DNA, 25 bp, Mus musculus
ttatgaggcctagcatctctatccg

SEQ ID NO: 837964 - DNA, 25 bp, Mus musculus
ttatgagggccaccagttccggtca

SEQ ID NO: 837965 - DNA, 25 bp, Mus musculus
ttatgagggccagcagttccggtca

SEQ ID NO: 837966 - DNA, 25 bp, Mus musculus
ttatgagtatcgagaagaggtccac

SEQ ID NO: 837967 - DNA, 25 bp, Mus musculus
ttatgagtatcgtgaagaggtccac

SEQ ID NO: 837968 - DNA, 25 bp, Mus musculus
ttatgatagaggaacgaacctggac

SEQ ID NO: 837969 - DNA, 25 bp, Mus musculus
ttatgatagaggtacgaacctggac

SEQ ID NO: 837970 - DNA, 25 bp, Mus musculus
ttatgatcacagacggccctggtgg

SEQ ID NO: 837971 - DNA, 25 bp, Mus musculus
ttatgatcacagtcggccctggtgg

SEQ ID NO: 837972 - DNA, 25 bp, Mus musculus
ttatgatgcctgagccaccgcgaag

SEQ ID NO: 837973 - DNA, 25 bp, Mus musculus
ttatgatgcctgtgccaccgcgaag

SEQ ID NO: 837974 - DNA, 25 bp, Mus musculus
ttatgcaaagcacggaacgagagat

SEQ ID NO: 837975 - DNA, 25 bp, Mus musculus
ttatgcaaagcagggaacgagagat

SEQ ID NO: 837976 - DNA, 25 bp, Mus musculus
ttatgcaaagccaacacgttagagg

SEQ ID NO: 837977 - DNA, 25 bp, Mus musculus
ttatgcaaagcctacacgttagagg

SEQ ID NO: 837978 - DNA, 25 bp, Mus musculus
ttatgcaactgacaccccggcgata

SEQ ID NO: 837979 - DNA, 25 bp, Mus musculus
ttatgcaactgagaccccggcgata

SEQ ID NO: 837980 - DNA, 25 bp, Mus musculus
ttatgcacaaaacggctcagagact

SEQ ID NO: 837981 - DNA, 25 bp, Mus musculus
ttatgcacaaaagggctcagagact

SEQ ID NO: 837982 - DNA, 25 bp, Mus musculus
ttatgcagcctccaaggatgcccgt

SEQ ID NO: 837983 - DNA, 25 bp, Mus musculus
ttatgcagcctcgaaggatgcccgt

SEQ ID NO: 837984 - DNA, 25 bp, Mus musculus
ttatgcaggaaacccgtggacagcc

SEQ ID NO: 837985 - DNA, 25 bp, Mus musculus
ttatgcaggaaagccgtggacagcc

SEQ ID NO: 837986 - DNA, 25 bp, Mus musculus
ttatgcatggaacaaaacgcaccga

SEQ ID NO: 837987 - DNA, 25 bp, Mus musculus
ttatgcatggaagaaaacgcaccga

SEQ ID NO: 837988 - DNA, 25 bp, Mus musculus
ttatgcatggcgaatgtcgcgaagg

SEQ ID NO: 837989 - DNA, 25 bp, Mus musculus
ttatgcatggcgtatgtcgcgaagg

SEQ ID NO: 837990 - DNA, 25 bp, Mus musculus
ttatgcctgcggagtcagggccagt

SEQ ID NO: 837991 - DNA, 25 bp, Mus musculus
ttatgcctgcggtgtcagggccagt

SEQ ID NO: 837992 - DNA, 25 bp, Mus musculus
ttatgctcagaccaaaacctcagtg

SEQ ID NO: 837993 - DNA, 25 bp, Mus musculus
ttatgctcagacgaaaacctcagtg

SEQ ID NO: 837994 - DNA, 25 bp, Mus musculus
ttatgctgaattaggtgcccgggtc

SEQ ID NO: 837995 - DNA, 25 bp, Mus musculus
ttatgctgaatttggtgcccgggtc

SEQ ID NO: 837996 - DNA, 25 bp, Mus musculus
ttatgctgacttcatgaatattctc

SEQ ID NO: 837997 - DNA, 25 bp, Mus musculus
ttatgctgacttgatgaatattctc

SEQ ID NO: 837998 - DNA, 25 bp, Mus musculus
ttatgctggaggcagtcagctcagc

SEQ ID NO: 837999 - DNA, 25 bp, Mus musculus
ttatgctggagggagtcagctcagc

SEQ ID NO: 838000 - DNA, 25 bp, Mus musculus
ttatggaaagctcggcgacaccaac

SEQ ID NO: 838001 - DNA, 25 bp, Mus musculus
ttatggaaagctgggcgacaccaac

SEQ ID NO: 838002 - DNA, 25 bp, Mus musculus
ttatggaaattgaggtgtctgcccc

SEQ ID NO: 838003 - DNA, 25 bp, Mus musculus
ttatggaaattgtggtgtctgcccc

SEQ ID NO: 838004 - DNA, 25 bp, Mus musculus
ttatggaacctgactgcacactgca

SEQ ID NO: 838005 - DNA, 25 bp, Mus musculus
ttatggaacctgtctgcacactgca

SEQ ID NO: 838006 - DNA, 25 bp, Mus musculus
ttatggaatacaaaactcacaccga

SEQ ID NO: 838007 - DNA, 25 bp, Mus musculus
ttatggaatacataactcacaccga

SEQ ID NO: 838008 - DNA, 25 bp, Mus musculus
ttatggaatactctgggtgtctgca

SEQ ID NO: 838009 - DNA, 25 bp, Mus musculus
ttatggaatactgtgggtgtctgca

SEQ ID NO: 838010 - DNA, 25 bp, Mus musculus
ttatggaattctccgctcaaggaca

SEQ ID NO: 838011 - DNA, 25 bp, Mus musculus
ttatggaattctgcgctcaaggaca

SEQ ID NO: 838012 - DNA, 25 bp, Mus musculus
ttatggacaccaagcaaaaattgtg

SEQ ID NO: 838013 - DNA, 25 bp, Mus musculus
ttatggacaccatgcaaaaattgtg

SEQ ID NO: 838014 - DNA, 25 bp, Mus musculus
ttatggacactacccagtgggcaga

SEQ ID NO: 838015 - DNA, 25 bp, Mus musculus
ttatggacactagccagtgggcaga

SEQ ID NO: 838016 - DNA, 25 bp, Mus musculus
ttatggactatcagttaagattgga

SEQ ID NO: 838017 - DNA, 25 bp, Mus musculus
ttatggactatctgttaagattgga

SEQ ID NO: 838018 - DNA, 25 bp, Mus musculus
ttatggactcaacgcacaattttta

SEQ ID NO: 838019 - DNA, 25 bp, Mus musculus
ttatggactcaaggcacaattttta

SEQ ID NO: 838020 - DNA, 25 bp, Mus musculus
ttatggagaaataggtgccacttcc

SEQ ID NO: 838021 - DNA, 25 bp, Mus musculus
ttatggagaaattggtgccacttcc

SEQ ID NO: 838022 - DNA, 25 bp, Mus musculus
ttatggagctgcagttaaaactgcc

SEQ ID NO: 838023 - DNA, 25 bp, Mus musculus
ttatggagctgctgttaaaactgcc

SEQ ID NO: 838024 - DNA, 25 bp, Mus musculus
ttatggatcccaacgatgtgaagat

SEQ ID NO: 838025 - DNA, 25 bp, Mus musculus
ttatggatcccacagtgacactgat

SEQ ID NO: 838026 - DNA, 25 bp, Mus musculus
ttatggatcccagagtgacactgat

SEQ ID NO: 838027 - DNA, 25 bp, Mus musculus
ttatggatcccatcgatgtgaagat

SEQ ID NO: 838028 - DNA, 25 bp, Mus musculus
ttatggatcgctcggtaatggacct

SEQ ID NO: 838029 - DNA, 25 bp, Mus musculus
ttatggatcgctgggtaatggacct

SEQ ID NO: 838030 - DNA, 25 bp, Mus musculus
ttatggcaaaagagccatagctccc

SEQ ID NO: 838031 - DNA, 25 bp, Mus musculus
ttatggcaaaagtgccatagctccc

SEQ ID NO: 838032 - DNA, 25 bp, Mus musculus
ttatggccactccaaccagctacgg

SEQ ID NO: 838033 - DNA, 25 bp, Mus musculus
ttatggccactcgaaccagctacgg

SEQ ID NO: 838034 - DNA, 25 bp, Mus musculus
ttatggccagagacccaagtgcgcc

SEQ ID NO: 838035 - DNA, 25 bp, Mus musculus
ttatggccagagtcccaagtgcgcc

SEQ ID NO: 838036 - DNA, 25 bp, Mus musculus
ttatggctgcttaggacccgcgtgc

SEQ ID NO: 838037 - DNA, 25 bp, Mus musculus
ttatggctgctttggacccgcgtgc

SEQ ID NO: 838038 - DNA, 25 bp, Mus musculus
ttatggctgggaacatcgccatcta

SEQ ID NO: 838039 - DNA, 25 bp, Mus musculus
ttatggctgggatcatcgccatcta

SEQ ID NO: 838040 - DNA, 25 bp, Mus musculus
ttatgggacagacgctatcatctac

SEQ ID NO: 838041 - DNA, 25 bp, Mus musculus
ttatgggacagaggctatcatctac

SEQ ID NO: 838042 - DNA, 25 bp, Mus musculus
ttatgggacagtcgagccacaggat

SEQ ID NO: 838043 - DNA, 25 bp, Mus musculus
ttatgggacagtggagccacaggat

SEQ ID NO: 838044 - DNA, 25 bp, Mus musculus
ttatgggactacatcagaaactgca

SEQ ID NO: 838045 - DNA, 25 bp, Mus musculus
ttatgggactacttcagaaactgca

SEQ ID NO: 838046 - DNA, 25 bp, Mus musculus
ttatgggatggaagacaagaatcca

SEQ ID NO: 838047 - DNA, 25 bp, Mus musculus
ttatgggatggatgacaagaatcca

SEQ ID NO: 838048 - DNA, 25 bp, Mus musculus
ttatgggccaggcattcgagttgat

SEQ ID NO: 838049 - DNA, 25 bp, Mus musculus
ttatgggccagggattcgagttgat

SEQ ID NO: 838050 - DNA, 25 bp, Mus musculus
ttatgggtactgctgctttttctcg

SEQ ID NO: 838051 - DNA, 25 bp, Mus musculus
ttatgggtactggtgctttttctcg

SEQ ID NO: 838052 - DNA, 25 bp, Mus musculus
ttatgggtggatcgcagctcttcgc

SEQ ID NO: 838053 - DNA, 25 bp, Mus musculus
ttatgggtggatggcagctcttcgc

SEQ ID NO: 838054 - DNA, 25 bp, Mus musculus
ttatgggtggcactgtttcagattg

SEQ ID NO: 838055 - DNA, 25 bp, Mus musculus
ttatgggtggcagtgtttcagattg

SEQ ID NO: 838056 - DNA, 25 bp, Mus musculus
ttatggtctctaaaagaagatgatc

SEQ ID NO: 838057 - DNA, 25 bp, Mus musculus
ttatggtctctataagaagatgatc

SEQ ID NO: 838058 - DNA, 25 bp, Mus musculus
ttatggtgtgggagcaggtttcttt

SEQ ID NO: 838059 - DNA, 25 bp, Mus musculus
ttatggtgtgggtgcaggtttcttt

SEQ ID NO: 838060 - DNA, 25 bp, Mus musculus
ttatggttcaggaagattaccacgg

SEQ ID NO: 838061 - DNA, 25 bp, Mus musculus
ttatggttcaggtagattaccacgg

SEQ ID NO: 838062 - DNA, 25 bp, Mus musculus
ttatgtacaaagatgcagggccagc

SEQ ID NO: 838063 - DNA, 25 bp, Mus musculus
ttatgtacaaagttgcagggccagc

SEQ ID NO: 838064 - DNA, 25 bp, Mus musculus
ttatgtatatagcttcttagctcag

SEQ ID NO: 838065 - DNA, 25 bp, Mus musculus
ttatgtatataggttcttagctcag

SEQ ID NO: 838066 - DNA, 25 bp, Mus musculus
ttatgtatctgaaagcttccaggag

SEQ ID NO: 838067 - DNA, 25 bp, Mus musculus
ttatgtatctgatagcttccaggag

SEQ ID NO: 838068 - DNA, 25 bp, Mus musculus
ttatgtcaaactactaagccccgga

SEQ ID NO: 838069 - DNA, 25 bp, Mus musculus
ttatgtcaaacttctaagccccgga

SEQ ID NO: 838070 - DNA, 25 bp, Mus musculus
ttatgtcaaggtcaaagtggagccc

SEQ ID NO: 838071 - DNA, 25 bp, Mus musculus
ttatgtcaaggtgaaagtggagccc

SEQ ID NO: 838072 - DNA, 25 bp, Mus musculus
ttatgtcagacaaggtctcgtgtgg

SEQ ID NO: 838073 - DNA, 25 bp, Mus musculus
ttatgtcagacatggtctcgtgtgg

SEQ ID NO: 838074 - DNA, 25 bp, Mus musculus
ttatgtcagtagctcagaggcgatg

SEQ ID NO: 838075 - DNA, 25 bp, Mus musculus
ttatgtcagtaggtcagaggcgatg

SEQ ID NO: 838076 - DNA, 25 bp, Mus musculus
ttatgtcccgccacaagacctacag

SEQ ID NO: 838077 - DNA, 25 bp, Mus musculus
ttatgtcccgcctcaagacctacag

SEQ ID NO: 838078 - DNA, 25 bp, Mus musculus
ttatgtccttcgcagttacctggtg

SEQ ID NO: 838079 - DNA, 25 bp, Mus musculus
ttatgtccttcggagttacctggtg

SEQ ID NO: 838080 - DNA, 25 bp, Mus musculus
ttatgtcgccatcgagggaagtgca

SEQ ID NO: 838081 - DNA, 25 bp, Mus musculus
ttatgtcgccatggagggaagtgca

SEQ ID NO: 838082 - DNA, 25 bp, Mus musculus
ttatgtctagaacatctattaacgg

SEQ ID NO: 838083 - DNA, 25 bp, Mus musculus
ttatgtctagaagatctattaacgg

SEQ ID NO: 838084 - DNA, 25 bp, Mus musculus
ttatgtctttggatggacagggaca

SEQ ID NO: 838085 - DNA, 25 bp, Mus musculus
ttatgtctttggttggacagggaca

SEQ ID NO: 838086 - DNA, 25 bp, Mus musculus
ttatgtgaatcactcctttgcccct

SEQ ID NO: 838087 - DNA, 25 bp, Mus musculus
ttatgtgaatcagtcctttgcccct

SEQ ID NO: 838088 - DNA, 25 bp, Mus musculus
ttatgtggcagtccatcccaggcag

SEQ ID NO: 838089 - DNA, 25 bp, Mus musculus
ttatgtggcagtgcatcccaggcag

SEQ ID NO: 838090 - DNA, 25 bp, Mus musculus
ttatgtgggagcacagcttttggga

SEQ ID NO: 838091 - DNA, 25 bp, Mus musculus
ttatgtgggagctcagcttttggga

SEQ ID NO: 838092 - DNA, 25 bp, Mus musculus
ttatgtgggaggcatgtcacacccg

SEQ ID NO: 838093 - DNA, 25 bp, Mus musculus
ttatgtgggagggatgtcacacccg

SEQ ID NO: 838094 - DNA, 25 bp, Mus musculus
ttatgtggtcctactacctcttgct

SEQ ID NO: 838095 - DNA, 25 bp, Mus musculus
ttatgtggtccttctacctcttgct

SEQ ID NO: 838096 - DNA, 25 bp, Mus musculus
ttatgttgcaataggagctgatgaa

SEQ ID NO: 838097 - DNA, 25 bp, Mus musculus
ttatgttgcaattggagctgatgaa

SEQ ID NO: 838098 - DNA, 25 bp, Mus musculus
ttatgttggcgcagccaccgtgggt

SEQ ID NO: 838099 - DNA, 25 bp, Mus musculus
ttatgttggcgctgccaccgtgggt

SEQ ID NO: 838100 - DNA, 25 bp, Mus musculus
ttatgtttgatgagatgagccccgg

SEQ ID NO: 838101 - DNA, 25 bp, Mus musculus
ttatgtttgatgtgatgagccccgg

SEQ ID NO: 838102 - DNA, 25 bp, Mus musculus
ttatgttttcctcttcgttatgacg

SEQ ID NO: 838103 - DNA, 25 bp, Mus musculus
ttatgttttcctgttcgttatgacg

SEQ ID NO: 838104 - DNA, 25 bp, Mus musculus
ttatgtttttggagaactgctggag

SEQ ID NO: 838105 - DNA, 25 bp, Mus musculus
ttatgtttttggtgaactgctggag

SEQ ID NO: 838106 - DNA, 25 bp, Mus musculus
ttattaagccgcagctgtggtcctg

SEQ ID NO: 838107 - DNA, 25 bp, Mus musculus
ttattaagccgctgctgtggtcctg

SEQ ID NO: 838108 - DNA, 25 bp, Mus musculus
ttattaatccctcacctctgccaga

SEQ ID NO: 838109 - DNA, 25 bp, Mus musculus
ttattaatccctgacctctgccaga

SEQ ID NO: 838110 - DNA, 25 bp, Mus musculus
ttattacaaaagcagcctgggaagt

SEQ ID NO: 838111 - DNA, 25 bp, Mus musculus
ttattacaaaaggagcctgggaagt

SEQ ID NO: 838112 - DNA, 25 bp, Mus musculus
ttattacaaggtcggcaaaaagtca

SEQ ID NO: 838113 - DNA, 25 bp, Mus musculus
ttattacaaggtgggcaaaaagtca

SEQ ID NO: 838114 - DNA, 25 bp, Mus musculus
ttattatcaagtacacaccaacagt

SEQ ID NO: 838115 - DNA, 25 bp, Mus musculus
ttattatcaagttcacaccaacagt

SEQ ID NO: 838116 - DNA, 25 bp, Mus musculus
ttattatcaggacatgcccacagct

SEQ ID NO: 838117 - DNA, 25 bp, Mus musculus
ttattatcaggagatgcccacagct

SEQ ID NO: 838118 - DNA, 25 bp, Mus musculus
ttattcaaaaacaaacctcctgatg

SEQ ID NO: 838119 - DNA, 25 bp, Mus musculus
ttattcaaaaactaacctcctgatg

SEQ ID NO: 838120 - DNA, 25 bp, Mus musculus
ttattcacagagattcatcatttgg

SEQ ID NO: 838121 - DNA, 25 bp, Mus musculus
ttattcacagagtttcatcatttgg

SEQ ID NO: 838122 - DNA, 25 bp, Mus musculus
ttattcaccagccagttatgagtca

SEQ ID NO: 838123 - DNA, 25 bp, Mus musculus
ttattcaccagcgagttatgagtca

SEQ ID NO: 838124 - DNA, 25 bp, Mus musculus
ttattcatcatcagcgccaatgaag

SEQ ID NO: 838125 - DNA, 25 bp, Mus musculus
ttattcatcatctgcgccaatgaag

SEQ ID NO: 838126 - DNA, 25 bp, Mus musculus
ttattccaaatgactaccaaggagt

SEQ ID NO: 838127 - DNA, 25 bp, Mus musculus
ttattccaaatgtctaccaaggagt

SEQ ID NO: 838128 - DNA, 25 bp, Mus musculus
ttattccaactacaagacctaagga

SEQ ID NO: 838129 - DNA, 25 bp, Mus musculus
ttattccaactagaagacctaagga

SEQ ID NO: 838130 - DNA, 25 bp, Mus musculus
ttattccacgacagctatgtgacaa

SEQ ID NO: 838131 - DNA, 25 bp, Mus musculus
ttattccacgactgctatgtgacaa

SEQ ID NO: 838132 - DNA, 25 bp, Mus musculus
ttattccagagaaacagatactcag

SEQ ID NO: 838133 - DNA, 25 bp, Mus musculus
ttattccagagatacagatactcag

SEQ ID NO: 838134 - DNA, 25 bp, Mus musculus
ttattcccacaaaaccaagagcgct

SEQ ID NO: 838135 - DNA, 25 bp, Mus musculus
ttattcccacaataccaagagcgct

SEQ ID NO: 838136 - DNA, 25 bp, Mus musculus
ttattcccttttctgccgggcccag

SEQ ID NO: 838137 - DNA, 25 bp, Mus musculus
ttattcccttttgtgccgggcccag

SEQ ID NO: 838138 - DNA, 25 bp, Mus musculus
ttattccgaggaaagtgtgaccagg

SEQ ID NO: 838139 - DNA, 25 bp, Mus musculus
ttattccgaggatagtgtgaccagg

SEQ ID NO: 838140 - DNA, 25 bp, Mus musculus
ttattcgcaggtctcctcccgagga

SEQ ID NO: 838141 - DNA, 25 bp, Mus musculus
ttattcgcaggtgtcctcccgagga

SEQ ID NO: 838142 - DNA, 25 bp, Mus musculus
ttattctaaacgacactggccaggg

SEQ ID NO: 838143 - DNA, 25 bp, Mus musculus
ttattctaaacgtcactggccaggg

SEQ ID NO: 838144 - DNA, 25 bp, Mus musculus
ttattctcctgtcggagcttccatg

SEQ ID NO: 838145 - DNA, 25 bp, Mus musculus
ttattctcctgtgggagcttccatg

SEQ ID NO: 838146 - DNA, 25 bp, Mus musculus
ttattctgaaaaccccatgaactgg

SEQ ID NO: 838147 - DNA, 25 bp, Mus musculus
ttattctgaaaagcccatgaactgg

SEQ ID NO: 838148 - DNA, 25 bp, Mus musculus
ttattctttagaacctaagtgcgag

SEQ ID NO: 838149 - DNA, 25 bp, Mus musculus
ttattctttagatcctaagtgcgag

SEQ ID NO: 838150 - DNA, 25 bp, Mus musculus
ttattgaaaacgcagtaagcatgca

SEQ ID NO: 838151 - DNA, 25 bp, Mus musculus
ttattgaaaacggagtaagcatgca

SEQ ID NO: 838152 - DNA, 25 bp, Mus musculus
ttattgaccaatcaaaactgcatgc

SEQ ID NO: 838153 - DNA, 25 bp, Mus musculus
ttattgaccaatgaaaactgcatgc

SEQ ID NO: 838154 - DNA, 25 bp, Mus musculus
ttattgagagcaaccctagggagcc

SEQ ID NO: 838155 - DNA, 25 bp, Mus musculus
ttattgagagcatccctagggagcc

SEQ ID NO: 838156 - DNA, 25 bp, Mus musculus
ttattgataaaaaagcgtgttcctt

SEQ ID NO: 838157 - DNA, 25 bp, Mus musculus
ttattgataaaatagcgtgttcctt

SEQ ID NO: 838158 - DNA, 25 bp, Mus musculus
ttattgatactgagagctttgccca

SEQ ID NO: 838159 - DNA, 25 bp, Mus musculus
ttattgatactgtgagctttgccca

SEQ ID NO: 838160 - DNA, 25 bp, Mus musculus
ttattgataggaaattgactagact

SEQ ID NO: 838161 - DNA, 25 bp, Mus musculus
ttattgataggatattgactagact

SEQ ID NO: 838162 - DNA, 25 bp, Mus musculus
ttattgcattctcgtctggccgagc

SEQ ID NO: 838163 - DNA, 25 bp, Mus musculus
ttattgcattctggtctggccgagc

SEQ ID NO: 838164 - DNA, 25 bp, Mus musculus
ttattgcccagcatgagaatgtcct

SEQ ID NO: 838165 - DNA, 25 bp, Mus musculus
ttattgcccagcttgagaatgtcct

SEQ ID NO: 838166 - DNA, 25 bp, Mus musculus
ttattgctgcctatccctgacccag

SEQ ID NO: 838167 - DNA, 25 bp, Mus musculus
ttattgctgcctttccctgacccag

SEQ ID NO: 838168 - DNA, 25 bp, Mus musculus
ttattgctgggacaagcttcggcgt

SEQ ID NO: 838169 - DNA, 25 bp, Mus musculus
ttattgctgggagaagcttcggcgt

SEQ ID NO: 838170 - DNA, 25 bp, Mus musculus
ttattggaaacaaccttcagataga

SEQ ID NO: 838171 - DNA, 25 bp, Mus musculus
ttattggaaacatccttcagataga

SEQ ID NO: 838172 - DNA, 25 bp, Mus musculus
ttattgggaagaacctcaccccagg

SEQ ID NO: 838173 - DNA, 25 bp, Mus musculus
ttattgggaagatcctcaccccagg

SEQ ID NO: 838174 - DNA, 25 bp, Mus musculus
ttattgggtctcaggagtacttcca

SEQ ID NO: 838175 - DNA, 25 bp, Mus musculus
ttattgggtctctggagtacttcca

SEQ ID NO: 838176 - DNA, 25 bp, Mus musculus
ttattggtggagatgatctctcaac

SEQ ID NO: 838177 - DNA, 25 bp, Mus musculus
ttattggtggagttgatctctcaac

SEQ ID NO: 838178 - DNA, 25 bp, Mus musculus
ttattgtcgacaaccccaaagacgc

SEQ ID NO: 838179 - DNA, 25 bp, Mus musculus
ttattgtcgacatccccaaagacgc

SEQ ID NO: 838180 - DNA, 25 bp, Mus musculus
ttattgtgtccaacatcaacagctc

SEQ ID NO: 838181 - DNA, 25 bp, Mus musculus
ttattgtgtccatcatcaacagctc

SEQ ID NO: 838182 - DNA, 25 bp, Mus musculus
ttatttaaatggaaacacctcacag

SEQ ID NO: 838183 - DNA, 25 bp, Mus musculus
ttatttaaatggtaacacctcacag

SEQ ID NO: 838184 - DNA, 25 bp, Mus musculus
ttatttaagcaaaatgtgtttccag

SEQ ID NO: 838185 - DNA, 25 bp, Mus musculus
ttatttaagcaatatgtgtttccag

SEQ ID NO: 838186 - DNA, 25 bp, Mus musculus
ttatttcatacgcaccgagctggga

SEQ ID NO: 838187 - DNA, 25 bp, Mus musculus
ttatttcatacggaccgagctggga

SEQ ID NO: 838188 - DNA, 25 bp, Mus musculus
ttatttcattaacatcttagacctg

SEQ ID NO: 838189 - DNA, 25 bp, Mus musculus
ttatttcattaagatcttagacctg

SEQ ID NO: 838190 - DNA, 25 bp, Mus musculus
ttatttccccgacagagtttgttga

SEQ ID NO: 838191 - DNA, 25 bp, Mus musculus
ttatttccccgagagagtttgttga

SEQ ID NO: 838192 - DNA, 25 bp, Mus musculus
ttatttctccatccaccgatatgaa

SEQ ID NO: 838193 - DNA, 25 bp, Mus musculus
ttatttctccatgcaccgatatgaa

SEQ ID NO: 838194 - DNA, 25 bp, Mus musculus
ttatttctgtccagctccacttggg

SEQ ID NO: 838195 - DNA, 25 bp, Mus musculus
ttatttctgtcctgctccacttggg

SEQ ID NO: 838196 - DNA, 25 bp, Mus musculus
ttatttctgtttagttccgacgaga

SEQ ID NO: 838197 - DNA, 25 bp, Mus musculus
ttatttctgttttgttccgacgaga

SEQ ID NO: 838198 - DNA, 25 bp, Mus musculus
ttatttgaatagatcactagtgcgc

SEQ ID NO: 838199 - DNA, 25 bp, Mus musculus
ttatttgaatagttcactagtgcgc

SEQ ID NO: 838200 - DNA, 25 bp, Mus musculus
ttatttgactatcgcactaaccacc

SEQ ID NO: 838201 - DNA, 25 bp, Mus musculus
ttatttgactatggcactaaccacc

SEQ ID NO: 838202 - DNA, 25 bp, Mus musculus
ttatttgcatcccatccttcagcgc

SEQ ID NO: 838203 - DNA, 25 bp, Mus musculus
ttatttgcatccgatccttcagcgc

SEQ ID NO: 838204 - DNA, 25 bp, Mus musculus
ttatttgggatacctatacgacaaa

SEQ ID NO: 838205 - DNA, 25 bp, Mus musculus
ttatttgggatagctatacgacaaa

SEQ ID NO: 838206 - DNA, 25 bp, Mus musculus
ttatttgtgggcacgagagaaggcc

SEQ ID NO: 838207 - DNA, 25 bp, Mus musculus
ttatttgtgggctcgagagaaggcc

SEQ ID NO: 838208 - DNA, 25 bp, Mus musculus
ttattttcttatcttaagaggttgc

SEQ ID NO: 838209 - DNA, 25 bp, Mus musculus
ttattttcttatgttaagaggttgc

SEQ ID NO: 838210 - DNA, 25 bp, Mus musculus
ttattttgttcaccctgtgaccaga

SEQ ID NO: 838211 - DNA, 25 bp, Mus musculus
ttattttgttcagcctgtgaccaga

SEQ ID NO: 838212 - DNA, 25 bp, Mus musculus
ttcaaaacaaaacatcctcctggga

SEQ ID NO: 838213 - DNA, 25 bp, Mus musculus
ttcaaaacaaaagatcctcctggga

SEQ ID NO: 838214 - DNA, 25 bp, Mus musculus
ttcaaaacaccaccgaaagtgggtc

SEQ ID NO: 838215 - DNA, 25 bp, Mus musculus
ttcaaaacaccagcgaaagtgggtc

SEQ ID NO: 838216 - DNA, 25 bp, Mus musculus
ttcaaaaccaaccacctgttcttct

SEQ ID NO: 838217 - DNA, 25 bp, Mus musculus
ttcaaaaccaacgacctgttcttct

SEQ ID NO: 838218 - DNA, 25 bp, Mus musculus
ttcaaaaccgttcatggcatgaaag

SEQ ID NO: 838219 - DNA, 25 bp, Mus musculus
ttcaaaaccgttgatggcatgaaag

SEQ ID NO: 838220 - DNA, 25 bp, Mus musculus
ttcaaaagtctcattgaagtagaat

SEQ ID NO: 838221 - DNA, 25 bp, Mus musculus
ttcaaaagtctctttgaagtagaat

SEQ ID NO: 838222 - DNA, 25 bp, Mus musculus
ttcaaaatactgaatggttcatccc

SEQ ID NO: 838223 - DNA, 25 bp, Mus musculus
ttcaaaatactgtatggttcatccc

SEQ ID NO: 838224 - DNA, 25 bp, Mus musculus
ttcaaaatagaaacctgggctggag

SEQ ID NO: 838225 - DNA, 25 bp, Mus musculus
ttcaaaatagaatcctgggctggag

SEQ ID NO: 838226 - DNA, 25 bp, Mus musculus
ttcaaaatgagacaagtatgaagac

SEQ ID NO: 838227 - DNA, 25 bp, Mus musculus
ttcaaaatgagagaagtatgaagac

SEQ ID NO: 838228 - DNA, 25 bp, Mus musculus
ttcaaaatgtctcggaatggcagag

SEQ ID NO: 838229 - DNA, 25 bp, Mus musculus
ttcaaaatgtctgggaatggcagag

SEQ ID NO: 838230 - DNA, 25 bp, Mus musculus
ttcaaaatgtggctaaaagttacct

SEQ ID NO: 838231 - DNA, 25 bp, Mus musculus
ttcaaaatgtgggtaaaagttacct

SEQ ID NO: 838232 - DNA, 25 bp, Mus musculus
ttcaaaattgaacgccaggagagtc

SEQ ID NO: 838233 - DNA, 25 bp, Mus musculus
ttcaaaattgaaggccaggagagtc

SEQ ID NO: 838234 - DNA, 25 bp, Mus musculus
ttcaaaatttaaagaatgccactcc

SEQ ID NO: 838235 - DNA, 25 bp, Mus musculus
ttcaaaatttaatgaatgccactcc

SEQ ID NO: 838236 - DNA, 25 bp, Mus musculus
ttcaaacagagaatttcttctgtgg

SEQ ID NO: 838237 - DNA, 25 bp, Mus musculus
ttcaaacagagattttcttctgtgg

SEQ ID NO: 838238 - DNA, 25 bp, Mus musculus
ttcaaacatccacgtgggagacctc

SEQ ID NO: 838239 - DNA, 25 bp, Mus musculus
ttcaaacatccaggtgggagacctc

SEQ ID NO: 838240 - DNA, 25 bp, Mus musculus
ttcaaacccagaagtactactccag

SEQ ID NO: 838241 - DNA, 25 bp, Mus musculus
ttcaaacccagatgtactactccag

SEQ ID NO: 838242 - DNA, 25 bp, Mus musculus
ttcaaaccccgaaaacagcgaagag

SEQ ID NO: 838243 - DNA, 25 bp, Mus musculus
ttcaaaccccgataacagcgaagag

SEQ ID NO: 838244 - DNA, 25 bp, Mus musculus
ttcaaaccgacgcacgctgctgggc

SEQ ID NO: 838245 - DNA, 25 bp, Mus musculus
ttcaaaccgacggacgctgctgggc

SEQ ID NO: 838246 - DNA, 25 bp, Mus musculus
ttcaaacctcacaaagcacaatgta

SEQ ID NO: 838247 - DNA, 25 bp, Mus musculus
ttcaaacctcactaagcacaatgta

SEQ ID NO: 838248 - DNA, 25 bp, Mus musculus
ttcaaacctttgagggccaggaatg

SEQ ID NO: 838249 - DNA, 25 bp, Mus musculus
ttcaaacctttgtgggccaggaatg

SEQ ID NO: 838250 - DNA, 25 bp, Mus musculus
ttcaaagagcagatcttggacggag

SEQ ID NO: 838251 - DNA, 25 bp, Mus musculus
ttcaaagagcagttcttggacggag

SEQ ID NO: 838252 - DNA, 25 bp, Mus musculus
ttcaaagagcgtctgctacagaccc

SEQ ID NO: 838253 - DNA, 25 bp, Mus musculus
ttcaaagagcgtgtgctacagaccc

SEQ ID NO: 838254 - DNA, 25 bp, Mus musculus
ttcaaagaggagaaacggccagggc

SEQ ID NO: 838255 - DNA, 25 bp, Mus musculus
ttcaaagaggagtaacggccagggc

SEQ ID NO: 838256 - DNA, 25 bp, Mus musculus
ttcaaagagtgaagcccgtgccgtg

SEQ ID NO: 838257 - DNA, 25 bp, Mus musculus
ttcaaagagtgatgcccgtgccgtg

SEQ ID NO: 838258 - DNA, 25 bp, Mus musculus
ttcaaagataagcaacgcaccacaa

SEQ ID NO: 838259 - DNA, 25 bp, Mus musculus
ttcaaagataaggaacgcaccacaa

SEQ ID NO: 838260 - DNA, 25 bp, Mus musculus
ttcaaagcagtgacgaccgacgcat

SEQ ID NO: 838261 - DNA, 25 bp, Mus musculus
ttcaaagcagtgtcgaccgacgcat

SEQ ID NO: 838262 - DNA, 25 bp, Mus musculus
ttcaaagccagacatgattttacag

SEQ ID NO: 838263 - DNA, 25 bp, Mus musculus
ttcaaagccagagatgattttacag

SEQ ID NO: 838264 - DNA, 25 bp, Mus musculus
ttcaaagcctttcacaagcacatga

SEQ ID NO: 838265 - DNA, 25 bp, Mus musculus
ttcaaagcctttgacaagcacatga

SEQ ID NO: 838266 - DNA, 25 bp, Mus musculus
ttcaaaggccttaccgtcgctgggt

SEQ ID NO: 838267 - DNA, 25 bp, Mus musculus
ttcaaaggcctttccgtcgctgggt

SEQ ID NO: 838268 - DNA, 25 bp, Mus musculus
ttcaaagtccttataacggtgatat

SEQ ID NO: 838269 - DNA, 25 bp, Mus musculus
ttcaaagtccttttaacggtgatat

SEQ ID NO: 838270 - DNA, 25 bp, Mus musculus
ttcaaagtctacacccaaaagtcag

SEQ ID NO: 838271 - DNA, 25 bp, Mus musculus
ttcaaagtctactcccaaaagtcag

SEQ ID NO: 838272 - DNA, 25 bp, Mus musculus
ttcaaagtctgaaaggtctagttct

SEQ ID NO: 838273 - DNA, 25 bp, Mus musculus
ttcaaagtctgataggtctagttct

SEQ ID NO: 838274 - DNA, 25 bp, Mus musculus
ttcaaagtggccacctccgacctgg

SEQ ID NO: 838275 - DNA, 25 bp, Mus musculus
ttcaaagtggcctcctccgacctgg

SEQ ID NO: 838276 - DNA, 25 bp, Mus musculus
ttcaaagttccaatggatgtcatct

SEQ ID NO: 838277 - DNA, 25 bp, Mus musculus
ttcaaagttccattggatgtcatct

SEQ ID NO: 838278 - DNA, 25 bp, Mus musculus
ttcaaagttcctatgaacaccgtgg

SEQ ID NO: 838279 - DNA, 25 bp, Mus musculus
ttcaaagttcctttgaacaccgtgg

SEQ ID NO: 838280 - DNA, 25 bp, Mus musculus
ttcaaagttgtacagacagatccca

SEQ ID NO: 838281 - DNA, 25 bp, Mus musculus
ttcaaagttgtagagacagatccca

SEQ ID NO: 838282 - DNA, 25 bp, Mus musculus
ttcaaatatcctcaacgaacaggag

SEQ ID NO: 838283 - DNA, 25 bp, Mus musculus
ttcaaatatcctgaacgaacaggag

SEQ ID NO: 838284 - DNA, 25 bp, Mus musculus
ttcaaatccaaccaagccaacagtg

SEQ ID NO: 838285 - DNA, 25 bp, Mus musculus
ttcaaatccaacgaagccaacagtg

SEQ ID NO: 838286 - DNA, 25 bp, Mus musculus
ttcaaatgaatgcacagggcggccc

SEQ ID NO: 838287 - DNA, 25 bp, Mus musculus
ttcaaatgaatggacagggcggccc

SEQ ID NO: 838288 - DNA, 25 bp, Mus musculus
ttcaaatgcccacgagcaagtcctg

SEQ ID NO: 838289 - DNA, 25 bp, Mus musculus
ttcaaatgcccaggagcaagtcctg

SEQ ID NO: 838290 - DNA, 25 bp, Mus musculus
ttcaaatgtcgtatccctcaccctg

SEQ ID NO: 838291 - DNA, 25 bp, Mus musculus
ttcaaatgtcgtttccctcaccctg

SEQ ID NO: 838292 - DNA, 25 bp, Mus musculus
ttcaacaaagcaagtgtccatcctg

SEQ ID NO: 838293 - DNA, 25 bp, Mus musculus
ttcaacaaagcatgtgtccatcctg

SEQ ID NO: 838294 - DNA, 25 bp, Mus musculus
ttcaacaacatgcttctgtattgtg

SEQ ID NO: 838295 - DNA, 25 bp, Mus musculus
ttcaacaacatggttctgtattgtg

SEQ ID NO: 838296 - DNA, 25 bp, Mus musculus
ttcaacaaccggctaaatcaccgtg

SEQ ID NO: 838297 - DNA, 25 bp, Mus musculus
ttcaacaaccgggtaaatcaccgtg

SEQ ID NO: 838298 - DNA, 25 bp, Mus musculus
ttcaacaacgaacccaatctcaaag

SEQ ID NO: 838299 - DNA, 25 bp, Mus musculus
ttcaacaacgaagccaatctcaaag

SEQ ID NO: 838300 - DNA, 25 bp, Mus musculus
ttcaacaagactatgcagcccctgc

SEQ ID NO: 838301 - DNA, 25 bp, Mus musculus
ttcaacaagactttgcagcccctgc

SEQ ID NO: 838302 - DNA, 25 bp, Mus musculus
ttcaacaaggacctgctggccacct

SEQ ID NO: 838303 - DNA, 25 bp, Mus musculus
ttcaacaaggacgtgctggccacct

SEQ ID NO: 838304 - DNA, 25 bp, Mus musculus
ttcaacaaggcgcagaaacacgtgc

SEQ ID NO: 838305 - DNA, 25 bp, Mus musculus
ttcaacaaggcggagaaacacgtgc

SEQ ID NO: 838306 - DNA, 25 bp, Mus musculus
ttcaacaattgcaacagcttcagca

SEQ ID NO: 838307 - DNA, 25 bp, Mus musculus
ttcaacaattgctacagcttcagca

SEQ ID NO: 838308 - DNA, 25 bp, Mus musculus
ttcaacacacatcagggaaggcccc

SEQ ID NO: 838309 - DNA, 25 bp, Mus musculus
ttcaacacacatgagggaaggcccc

SEQ ID NO: 838310 - DNA, 25 bp, Mus musculus
ttcaacactgaccaaggatcagcct

SEQ ID NO: 838311 - DNA, 25 bp, Mus musculus
ttcaacactgacgaaggatcagcct

SEQ ID NO: 838312 - DNA, 25 bp, Mus musculus
ttcaacagaaggaccgcgtgctgct

SEQ ID NO: 838313 - DNA, 25 bp, Mus musculus
ttcaacagaaggcagagccctggcc

SEQ ID NO: 838314 - DNA, 25 bp, Mus musculus
ttcaacagaagggagagccctggcc

SEQ ID NO: 838315 - DNA, 25 bp, Mus musculus
ttcaacagaaggtccgcgtgctgct

SEQ ID NO: 838316 - DNA, 25 bp, Mus musculus
ttcaacagccgtatcctcacgcatg

SEQ ID NO: 838317 - DNA, 25 bp, Mus musculus
ttcaacagccgtttcctcacgcatg

SEQ ID NO: 838318 - DNA, 25 bp, Mus musculus
ttcaacatgtttcaccacccgattc

SEQ ID NO: 838319 - DNA, 25 bp, Mus musculus
ttcaacatgtttgaccacccgattc

SEQ ID NO: 838320 - DNA, 25 bp, Mus musculus
ttcaaccacgctcaatgtggctcag

SEQ ID NO: 838321 - DNA, 25 bp, Mus musculus
ttcaaccacgctgaatgtggctcag

SEQ ID NO: 838322 - DNA, 25 bp, Mus musculus
ttcaaccagcatcttcgagtcggct

SEQ ID NO: 838323 - DNA, 25 bp, Mus musculus
ttcaaccagcatgttcgagtcggct

SEQ ID NO: 838324 - DNA, 25 bp, Mus musculus
ttcaaccagcttatggcagcactca

SEQ ID NO: 838325 - DNA, 25 bp, Mus musculus
ttcaaccagcttttggcagcactca

SEQ ID NO: 838326 - DNA, 25 bp, Mus musculus
ttcaacccgtccacagcaggaaact

SEQ ID NO: 838327 - DNA, 25 bp, Mus musculus
ttcaacccgtcctcagcaggaaact

SEQ ID NO: 838328 - DNA, 25 bp, Mus musculus
ttcaaccctggcagtgtggtgattg

SEQ ID NO: 838329 - DNA, 25 bp, Mus musculus
ttcaaccctggctgtgtggtgattg

SEQ ID NO: 838330 - DNA, 25 bp, Mus musculus
ttcaacccttgacatgcgaccatac

SEQ ID NO: 838331 - DNA, 25 bp, Mus musculus
ttcaacccttgagatgcgaccatac

SEQ ID NO: 838332 - DNA, 25 bp, Mus musculus
ttcaaccggacccaactgggcgatt

SEQ ID NO: 838333 - DNA, 25 bp, Mus musculus
ttcaaccggaccgaactgggcgatt

SEQ ID NO: 838334 - DNA, 25 bp, Mus musculus
ttcaaccgggagctgagaggcatcc

SEQ ID NO: 838335 - DNA, 25 bp, Mus musculus
ttcaaccgggaggtgagaggcatcc

SEQ ID NO: 838336 - DNA, 25 bp, Mus musculus
ttcaacctctatccagaaacatttg

SEQ ID NO: 838337 - DNA, 25 bp, Mus musculus
ttcaacctctatgcagaaacatttg

SEQ ID NO: 838338 - DNA, 25 bp, Mus musculus
ttcaacctgcccaccaagactgagt

SEQ ID NO: 838339 - DNA, 25 bp, Mus musculus
ttcaacctgccctccaagactgagt

SEQ ID NO: 838340 - DNA, 25 bp, Mus musculus
ttcaacgcaggtagaactgaacatc

SEQ ID NO: 838341 - DNA, 25 bp, Mus musculus
ttcaacgcaggttgaactgaacatc

SEQ ID NO: 838342 - DNA, 25 bp, Mus musculus
ttcaacgccttcaggacaatcccgg

SEQ ID NO: 838343 - DNA, 25 bp, Mus musculus
ttcaacgccttctggacaatcccgg

SEQ ID NO: 838344 - DNA, 25 bp, Mus musculus
ttcaacgctggcagacttactatcc

SEQ ID NO: 838345 - DNA, 25 bp, Mus musculus
ttcaacgctggctgacttactatcc

SEQ ID NO: 838346 - DNA, 25 bp, Mus musculus
ttcaacggcgtgcacttcgagggca

SEQ ID NO: 838347 - DNA, 25 bp, Mus musculus
ttcaacggcgtggacttcgagggca

SEQ ID NO: 838348 - DNA, 25 bp, Mus musculus
ttcaacgtctttcaaggcatcatgg

SEQ ID NO: 838349 - DNA, 25 bp, Mus musculus
ttcaacgtctttgaaggcatcatgg

SEQ ID NO: 838350 - DNA, 25 bp, Mus musculus
ttcaactacgtgctcatgcaattgc

SEQ ID NO: 838351 - DNA, 25 bp, Mus musculus
ttcaactacgtggtcatgcaattgc

SEQ ID NO: 838352 - DNA, 25 bp, Mus musculus
ttcaactgcgcacaaggcgtccaac

SEQ ID NO: 838353 - DNA, 25 bp, Mus musculus
ttcaactgcgcagaaggcgtccaac

SEQ ID NO: 838354 - DNA, 25 bp, Mus musculus
ttcaacttctacatcctgcttctcg

SEQ ID NO: 838355 - DNA, 25 bp, Mus musculus
ttcaacttctacttcctgcttctcg

SEQ ID NO: 838356 - DNA, 25 bp, Mus musculus
ttcaacttctctccagagacggtgg

SEQ ID NO: 838357 - DNA, 25 bp, Mus musculus
ttcaacttctctgcagagacggtgg

SEQ ID NO: 838358 - DNA, 25 bp, Mus musculus
ttcaacttgggcatctcgggcaagt

SEQ ID NO: 838359 - DNA, 25 bp, Mus musculus
ttcaacttgggcttctcgggcaagt

SEQ ID NO: 838360 - DNA, 25 bp, Mus musculus
ttcaagaaagaacctacccaaaggt

SEQ ID NO: 838361 - DNA, 25 bp, Mus musculus
ttcaagaaagaagctacccaaaggt

SEQ ID NO: 838362 - DNA, 25 bp, Mus musculus
ttcaagaaagcacgatggaccatag

SEQ ID NO: 838363 - DNA, 25 bp, Mus musculus
ttcaagaaagcaggatggaccatag

SEQ ID NO: 838364 - DNA, 25 bp, Mus musculus
ttcaagaaatagaggataaatctgg

SEQ ID NO: 838365 - DNA, 25 bp, Mus musculus
ttcaagaaatagtggataaatctgg

SEQ ID NO: 838366 - DNA, 25 bp, Mus musculus
ttcaagaacagtagccccgagactc

SEQ ID NO: 838367 - DNA, 25 bp, Mus musculus
ttcaagaacagttgccccgagactc

SEQ ID NO: 838368 - DNA, 25 bp, Mus musculus
ttcaagaacatccaggccaacatta

SEQ ID NO: 838369 - DNA, 25 bp, Mus musculus
ttcaagaacatcgaggccaacatta

SEQ ID NO: 838370 - DNA, 25 bp, Mus musculus
ttcaagaacgtgctcagcaaccggc

SEQ ID NO: 838371 - DNA, 25 bp, Mus musculus
ttcaagaacgtggtcagcaaccggc

SEQ ID NO: 838372 - DNA, 25 bp, Mus musculus
ttcaagaacttgctgcagagaaatc

SEQ ID NO: 838373 - DNA, 25 bp, Mus musculus
ttcaagaacttggtgcagagaaatc

SEQ ID NO: 838374 - DNA, 25 bp, Mus musculus
ttcaagaagacaaaggatatgatgg

SEQ ID NO: 838375 - DNA, 25 bp, Mus musculus
ttcaagaagacataggatatgatgg

SEQ ID NO: 838376 - DNA, 25 bp, Mus musculus
ttcaagacacaaagaaaaccatcca

SEQ ID NO: 838377 - DNA, 25 bp, Mus musculus
ttcaagacacaatgaaaaccatcca

SEQ ID NO: 838378 - DNA, 25 bp, Mus musculus
ttcaagacatggagtgtgtgccctg

SEQ ID NO: 838379 - DNA, 25 bp, Mus musculus
ttcaagacatggtgtgtgtgccctg

SEQ ID NO: 838380 - DNA, 25 bp, Mus musculus
ttcaagaccgacagttagcatgttc

SEQ ID NO: 838381 - DNA, 25 bp, Mus musculus
ttcaagaccgactgttagcatgttc

SEQ ID NO: 838382 - DNA, 25 bp, Mus musculus
ttcaagactggtctgccaccaagca

SEQ ID NO: 838383 - DNA, 25 bp, Mus musculus
ttcaagactggtgtgccaccaagca

SEQ ID NO: 838384 - DNA, 25 bp, Mus musculus
ttcaagagaatgaagctggaggccc

SEQ ID NO: 838385 - DNA, 25 bp, Mus musculus
ttcaagagaatgtagctggaggccc

SEQ ID NO: 838386 - DNA, 25 bp, Mus musculus
ttcaagaggaaaatctccgttgtct

SEQ ID NO: 838387 - DNA, 25 bp, Mus musculus
ttcaagaggaaattctccgttgtct

SEQ ID NO: 838388 - DNA, 25 bp, Mus musculus
ttcaagaggaagcacgttgccttgt

SEQ ID NO: 838389 - DNA, 25 bp, Mus musculus
ttcaagaggaaggacgttgccttgt

SEQ ID NO: 838390 - DNA, 25 bp, Mus musculus
ttcaagaggacactacgcaaagacc

SEQ ID NO: 838391 - DNA, 25 bp, Mus musculus
ttcaagaggacagtacgcaaagacc

SEQ ID NO: 838392 - DNA, 25 bp, Mus musculus
ttcaagagggaaatgaaaactaaag

SEQ ID NO: 838393 - DNA, 25 bp, Mus musculus
ttcaagagggaattgaaaactaaag

SEQ ID NO: 838394 - DNA, 25 bp, Mus musculus
ttcaagagtcgacccatccggacac

SEQ ID NO: 838395 - DNA, 25 bp, Mus musculus
ttcaagagtcgagccatccggacac

SEQ ID NO: 838396 - DNA, 25 bp, Mus musculus
ttcaagagttatcccttcacacagg

SEQ ID NO: 838397 - DNA, 25 bp, Mus musculus
ttcaagagttatgccttcacacagg

SEQ ID NO: 838398 - DNA, 25 bp, Mus musculus
ttcaagagttcccacaatctggcag

SEQ ID NO: 838399 - DNA, 25 bp, Mus musculus
ttcaagagttccgacaatctggcag

SEQ ID NO: 838400 - DNA, 25 bp, Mus musculus
ttcaagatcagacatgccaagtgcc

SEQ ID NO: 838401 - DNA, 25 bp, Mus musculus
ttcaagatcagagatgccaagtgcc

SEQ ID NO: 838402 - DNA, 25 bp, Mus musculus
ttcaagatccagaagacccggctgc

SEQ ID NO: 838403 - DNA, 25 bp, Mus musculus
ttcaagatccagtagacccggctgc

SEQ ID NO: 838404 - DNA, 25 bp, Mus musculus
ttcaagatccgcatggaacctgacg

SEQ ID NO: 838405 - DNA, 25 bp, Mus musculus
ttcaagatccgcttggaacctgacg

SEQ ID NO: 838406 - DNA, 25 bp, Mus musculus
ttcaagatcctgcaccgggtcacca

SEQ ID NO: 838407 - DNA, 25 bp, Mus musculus
ttcaagatcctggaccgggtcacca

SEQ ID NO: 838408 - DNA, 25 bp, Mus musculus
ttcaagatcgcactaatgttgggtc

SEQ ID NO: 838409 - DNA, 25 bp, Mus musculus
ttcaagatcgcagtaatgttgggtc

SEQ ID NO: 838410 - DNA, 25 bp, Mus musculus
ttcaagatctggatgcagcctgtga

SEQ ID NO: 838411 - DNA, 25 bp, Mus musculus
ttcaagatctggttgcagcctgtga

SEQ ID NO: 838412 - DNA, 25 bp, Mus musculus
ttcaagattctcaccgtctgggccc

SEQ ID NO: 838413 - DNA, 25 bp, Mus musculus
ttcaagattctctccgtctgggccc

SEQ ID NO: 838414 - DNA, 25 bp, Mus musculus
ttcaagcagacgacttcctccagga

SEQ ID NO: 838415 - DNA, 25 bp, Mus musculus
ttcaagcagacgtcttcctccagga

SEQ ID NO: 838416 - DNA, 25 bp, Mus musculus
ttcaagcaggaacatcccgaagctc

SEQ ID NO: 838417 - DNA, 25 bp, Mus musculus
ttcaagcaggaagatcccgaagctc

SEQ ID NO: 838418 - DNA, 25 bp, Mus musculus
ttcaagcatgccatctgtaatgcag

SEQ ID NO: 838419 - DNA, 25 bp, Mus musculus
ttcaagcatgccttctgtaatgcag

SEQ ID NO: 838420 - DNA, 25 bp, Mus musculus
ttcaagccaatgacgtgggcatcca

SEQ ID NO: 838421 - DNA, 25 bp, Mus musculus
ttcaagccaatgtcgtgggcatcca

SEQ ID NO: 838422 - DNA, 25 bp, Mus musculus
ttcaagccagcgagtgtgcgtcgcc

SEQ ID NO: 838423 - DNA, 25 bp, Mus musculus
ttcaagccagcgtgtgtgcgtcgcc

SEQ ID NO: 838424 - DNA, 25 bp, Mus musculus
ttcaagccaggcaactgggttggtg

SEQ ID NO: 838425 - DNA, 25 bp, Mus musculus
ttcaagccaggctactgggttggtg

SEQ ID NO: 838426 - DNA, 25 bp, Mus musculus
ttcaagcccaaccagacgcggacgt

SEQ ID NO: 838427 - DNA, 25 bp, Mus musculus
ttcaagcccaacgagacgcggacgt

SEQ ID NO: 838428 - DNA, 25 bp, Mus musculus
ttcaagcccattctctccaaggata

SEQ ID NO: 838429 - DNA, 25 bp, Mus musculus
ttcaagcccattgtctccaaggata

SEQ ID NO: 838430 - DNA, 25 bp, Mus musculus
ttcaagcccttactgaggaccagag

SEQ ID NO: 838431 - DNA, 25 bp, Mus musculus
ttcaagcccttagtgaggaccagag

SEQ ID NO: 838432 - DNA, 25 bp, Mus musculus
ttcaagcgcagcctgcggaggaacc

SEQ ID NO: 838433 - DNA, 25 bp, Mus musculus
ttcaagcgcagcgtgcggaggaacc

SEQ ID NO: 838434 - DNA, 25 bp, Mus musculus
ttcaagcgtaaaccacgaagtggga

SEQ ID NO: 838435 - DNA, 25 bp, Mus musculus
ttcaagcgtaaagcacgaagtggga

SEQ ID NO: 838436 - DNA, 25 bp, Mus musculus
ttcaagcgtgatccgcaaggccagc

SEQ ID NO: 838437 - DNA, 25 bp, Mus musculus
ttcaagcgtgatgcgcaaggccagc

SEQ ID NO: 838438 - DNA, 25 bp, Mus musculus
ttcaagcgtttgatcgagtcatgcc

SEQ ID NO: 838439 - DNA, 25 bp, Mus musculus
ttcaagcgtttgttcgagtcatgcc

SEQ ID NO: 838440 - DNA, 25 bp, Mus musculus
ttcaagctcttgcattagaatctcg

SEQ ID NO: 838441 - DNA, 25 bp, Mus musculus
ttcaagctcttggattagaatctcg

SEQ ID NO: 838442 - DNA, 25 bp, Mus musculus
ttcaagctggctatcctcatctact

SEQ ID NO: 838443 - DNA, 25 bp, Mus musculus
ttcaagctggctttcctcatctact

SEQ ID NO: 838444 - DNA, 25 bp, Mus musculus
ttcaagctggtgatcctgggagagc

SEQ ID NO: 838445 - DNA, 25 bp, Mus musculus
ttcaagctggtgttcctgggagagc

SEQ ID NO: 838446 - DNA, 25 bp, Mus musculus
ttcaagctgtacacgccgaaggagc

SEQ ID NO: 838447 - DNA, 25 bp, Mus musculus
ttcaagctgtactcgccgaaggagc

SEQ ID NO: 838448 - DNA, 25 bp, Mus musculus
ttcaagctgttgaaagagggccacc

SEQ ID NO: 838449 - DNA, 25 bp, Mus musculus
ttcaagctgttgtaagagggccacc

SEQ ID NO: 838450 - DNA, 25 bp, Mus musculus
ttcaaggaaaataccgctgtttcgc

SEQ ID NO: 838451 - DNA, 25 bp, Mus musculus
ttcaaggaaaattccgctgtttcgc

SEQ ID NO: 838452 - DNA, 25 bp, Mus musculus
ttcaaggaaggacacagctactact

SEQ ID NO: 838453 - DNA, 25 bp, Mus musculus
ttcaaggaaggagacagctactact

SEQ ID NO: 838454 - DNA, 25 bp, Mus musculus
ttcaaggactgaccgccagccgcgt

SEQ ID NO: 838455 - DNA, 25 bp, Mus musculus
ttcaaggactgagcgccagccgcgt

SEQ ID NO: 838456 - DNA, 25 bp, Mus musculus
ttcaaggactgtaccgaggctataa

SEQ ID NO: 838457 - DNA, 25 bp, Mus musculus
ttcaaggactgttccgaggctataa

SEQ ID NO: 838458 - DNA, 25 bp, Mus musculus
ttcaaggagaccagacatcactagg

SEQ ID NO: 838459 - DNA, 25 bp, Mus musculus
ttcaaggagacctgacatcactagg

SEQ ID NO: 838460 - DNA, 25 bp, Mus musculus
ttcaaggagatcagaatctctactc

SEQ ID NO: 838461 - DNA, 25 bp, Mus musculus
ttcaaggagatcagcccggctggga

SEQ ID NO: 838462 - DNA, 25 bp, Mus musculus
ttcaaggagatctgaatctctactc

SEQ ID NO: 838463 - DNA, 25 bp, Mus musculus
ttcaaggagatctgcccggctggga

SEQ ID NO: 838464 - DNA, 25 bp, Mus musculus
ttcaaggatggacgctctaccacgg

SEQ ID NO: 838465 - DNA, 25 bp, Mus musculus
ttcaaggatggaggctctaccacgg

SEQ ID NO: 838466 - DNA, 25 bp, Mus musculus
ttcaaggcactactcagagcaaagc

SEQ ID NO: 838467 - DNA, 25 bp, Mus musculus
ttcaaggcactagtcagagcaaagc

SEQ ID NO: 838468 - DNA, 25 bp, Mus musculus
ttcaaggcgtctctggccacgctga

SEQ ID NO: 838469 - DNA, 25 bp, Mus musculus
ttcaaggcgtctgtggccacgctga

SEQ ID NO: 838470 - DNA, 25 bp, Mus musculus
ttcaagggatagaatagaaacgacc

SEQ ID NO: 838471 - DNA, 25 bp, Mus musculus
ttcaagggatagtatagaaacgacc

SEQ ID NO: 838472 - DNA, 25 bp, Mus musculus
ttcaagggcaccaatggcagccacg

SEQ ID NO: 838473 - DNA, 25 bp, Mus musculus
ttcaagggcacctatggcagccacg

SEQ ID NO: 838474 - DNA, 25 bp, Mus musculus
ttcaaggtctcacgcttcttcctct

SEQ ID NO: 838475 - DNA, 25 bp, Mus musculus
ttcaaggtctcaggcttcttcctct

SEQ ID NO: 838476 - DNA, 25 bp, Mus musculus
ttcaaggttactacgcggagtgggc

SEQ ID NO: 838477 - DNA, 25 bp, Mus musculus
ttcaaggttacttcgcggagtgggc

SEQ ID NO: 838478 - DNA, 25 bp, Mus musculus
ttcaagtacctaagtcctggcacca

SEQ ID NO: 838479 - DNA, 25 bp, Mus musculus
ttcaagtacctatgtcctggcacca

SEQ ID NO: 838480 - DNA, 25 bp, Mus musculus
ttcaagtacttcctgcaaggcatgg

SEQ ID NO: 838481 - DNA, 25 bp, Mus musculus
ttcaagtacttcgtgcaaggcatgg

SEQ ID NO: 838482 - DNA, 25 bp, Mus musculus
ttcaagtcaactaagtccgttccca

SEQ ID NO: 838483 - DNA, 25 bp, Mus musculus
ttcaagtcaacttagtccgttccca

SEQ ID NO: 838484 - DNA, 25 bp, Mus musculus
ttcaagtcaatcagaaagtcccagc

SEQ ID NO: 838485 - DNA, 25 bp, Mus musculus
ttcaagtcaatctgaaagtcccagc

SEQ ID NO: 838486 - DNA, 25 bp, Mus musculus
ttcaagtccaccctgccagatgctg

SEQ ID NO: 838487 - DNA, 25 bp, Mus musculus
ttcaagtccaccgtgccagatgctg

SEQ ID NO: 838488 - DNA, 25 bp, Mus musculus
ttcaagtgaacacaaggtctgggag

SEQ ID NO: 838489 - DNA, 25 bp, Mus musculus
ttcaagtgaacagaaggtctgggag

SEQ ID NO: 838490 - DNA, 25 bp, Mus musculus
ttcaagtgagctcttgcgtactgta

SEQ ID NO: 838491 - DNA, 25 bp, Mus musculus
ttcaagtgagctgttgcgtactgta

SEQ ID NO: 838492 - DNA, 25 bp, Mus musculus
ttcaagtgcagacccgcatgtatca

SEQ ID NO: 838493 - DNA, 25 bp, Mus musculus
ttcaagtgcagagccgcatgtatca

SEQ ID NO: 838494 - DNA, 25 bp, Mus musculus
ttcaagtgcccgacgagtgggacac

SEQ ID NO: 838495 - DNA, 25 bp, Mus musculus
ttcaagtgcccgtcgagtgggacac

SEQ ID NO: 838496 - DNA, 25 bp, Mus musculus
ttcaagtggccaagagctctgcagc

SEQ ID NO: 838497 - DNA, 25 bp, Mus musculus
ttcaagtggccatgagctctgcagc

SEQ ID NO: 838498 - DNA, 25 bp, Mus musculus
ttcaagttcgcacggacgtcacgtc

SEQ ID NO: 838499 - DNA, 25 bp, Mus musculus
ttcaagttcgcagggacgtcacgtc

SEQ ID NO: 838500 - DNA, 25 bp, Mus musculus
ttcaagttgataatggaggtgggca

SEQ ID NO: 838501 - DNA, 25 bp, Mus musculus
ttcaagttgatattggaggtgggca

SEQ ID NO: 838502 - DNA, 25 bp, Mus musculus
ttcaagtttcttcgctcagaggccg

SEQ ID NO: 838503 - DNA, 25 bp, Mus musculus
ttcaagtttcttggctcagaggccg

SEQ ID NO: 838504 - DNA, 25 bp, Mus musculus
ttcaataaatgaaaaggtgccgcag

SEQ ID NO: 838505 - DNA, 25 bp, Mus musculus
ttcaataaatgataaggtgccgcag

SEQ ID NO: 838506 - DNA, 25 bp, Mus musculus
ttcaataagaaacttcctgccggtc

SEQ ID NO: 838507 - DNA, 25 bp, Mus musculus
ttcaataagaaagttcctgccggtc

SEQ ID NO: 838508 - DNA, 25 bp, Mus musculus
ttcaataagcatcccgagaagatcg

SEQ ID NO: 838509 - DNA, 25 bp, Mus musculus
ttcaataagcatgccgagaagatcg

SEQ ID NO: 838510 - DNA, 25 bp, Mus musculus
ttcaatacccggactcaggtcacca

SEQ ID NO: 838511 - DNA, 25 bp, Mus musculus
ttcaatacccggtctcaggtcacca

SEQ ID NO: 838512 - DNA, 25 bp, Mus musculus
ttcaataccggccacgctacatcgt

SEQ ID NO: 838513 - DNA, 25 bp, Mus musculus
ttcaataccggcgacgctacatcgt

SEQ ID NO: 838514 - DNA, 25 bp, Mus musculus
ttcaatcatttgaggcatcttggcc

SEQ ID NO: 838515 - DNA, 25 bp, Mus musculus
ttcaatcatttgtggcatcttggcc

SEQ ID NO: 838516 - DNA, 25 bp, Mus musculus
ttcaatctctctcggcatcgttcct

SEQ ID NO: 838517 - DNA, 25 bp, Mus musculus
ttcaatctctctgggcatcgttcct

SEQ ID NO: 838518 - DNA, 25 bp, Mus musculus
ttcaatctgccaatgtgcaaagctg

SEQ ID NO: 838519 - DNA, 25 bp, Mus musculus
ttcaatctgccattgtgcaaagctg

SEQ ID NO: 838520 - DNA, 25 bp, Mus musculus
ttcaatgacatccacaagttcaggg

SEQ ID NO: 838521 - DNA, 25 bp, Mus musculus
ttcaatgacatcgacaagttcaggg

SEQ ID NO: 838522 - DNA, 25 bp, Mus musculus
ttcaatgactatacagccacgctgt

SEQ ID NO: 838523 - DNA, 25 bp, Mus musculus
ttcaatgactatccggccaccctgt

SEQ ID NO: 838524 - DNA, 25 bp, Mus musculus
ttcaatgactatgcggccaccctgt

SEQ ID NO: 838525 - DNA, 25 bp, Mus musculus
ttcaatgactattcagccacgctgt

SEQ ID NO: 838526 - DNA, 25 bp, Mus musculus
ttcaatgagatacgaaacctgggcc

SEQ ID NO: 838527 - DNA, 25 bp, Mus musculus
ttcaatgagataggaaacctgggcc

SEQ ID NO: 838528 - DNA, 25 bp, Mus musculus
ttcaatgctcccatcgatgttggca

SEQ ID NO: 838529 - DNA, 25 bp, Mus musculus
ttcaatgctcccttcgatgttggca

SEQ ID NO: 838530 - DNA, 25 bp, Mus musculus
ttcaatgctgccaatgtcaccgacc

SEQ ID NO: 838531 - DNA, 25 bp, Mus musculus
ttcaatgctgcctatgtcaccgacc

SEQ ID NO: 838532 - DNA, 25 bp, Mus musculus
ttcaatgctgtacgcgatggcatag

SEQ ID NO: 838533 - DNA, 25 bp, Mus musculus
ttcaatgctgtaggcgatggcatag

SEQ ID NO: 838534 - DNA, 25 bp, Mus musculus
ttcaatggagcccagtgcaaggccg

SEQ ID NO: 838535 - DNA, 25 bp, Mus musculus
ttcaatggagccgagtgcaaggccg

SEQ ID NO: 838536 - DNA, 25 bp, Mus musculus
ttcaatgtcatcaacacctgggctc

SEQ ID NO: 838537 - DNA, 25 bp, Mus musculus
ttcaatgtcatctacacctgggctc

SEQ ID NO: 838538 - DNA, 25 bp, Mus musculus
ttcaatgtcggcagaagacctggaa

SEQ ID NO: 838539 - DNA, 25 bp, Mus musculus
ttcaatgtcggctgaagacctggaa

SEQ ID NO: 838540 - DNA, 25 bp, Mus musculus
ttcaatgtgacgcagatggatgctg

SEQ ID NO: 838541 - DNA, 25 bp, Mus musculus
ttcaatgtgacggagatggatgctg

SEQ ID NO: 838542 - DNA, 25 bp, Mus musculus
ttcaatgtggagactgttgaataca

SEQ ID NO: 838543 - DNA, 25 bp, Mus musculus
ttcaatgtggagtctgttgaataca

SEQ ID NO: 838544 - DNA, 25 bp, Mus musculus
ttcaattatacaccagggcatctgg

SEQ ID NO: 838545 - DNA, 25 bp, Mus musculus
ttcaattatacagcagggcatctgg

SEQ ID NO: 838546 - DNA, 25 bp, Mus musculus
ttcaattcctatcagctgggctccc

SEQ ID NO: 838547 - DNA, 25 bp, Mus musculus
ttcaattcctatgagctgggctccc

SEQ ID NO: 838548 - DNA, 25 bp, Mus musculus
ttcaattgctgacaagaaagtgcag

SEQ ID NO: 838549 - DNA, 25 bp, Mus musculus
ttcaattgctgagaagaaagtgcag

SEQ ID NO: 838550 - DNA, 25 bp, Mus musculus
ttcacaaatccgctacgatgctgtg

SEQ ID NO: 838551 - DNA, 25 bp, Mus musculus
ttcacaaatccggtacgatgctgtg

SEQ ID NO: 838552 - DNA, 25 bp, Mus musculus
ttcacaacaaagatatctcttgggc

SEQ ID NO: 838553 - DNA, 25 bp, Mus musculus
ttcacaacaaagttatctcttgggc

SEQ ID NO: 838554 - DNA, 25 bp, Mus musculus
ttcacaacgtgaagcccgaatgtct

SEQ ID NO: 838555 - DNA, 25 bp, Mus musculus
ttcacaacgtgatgcccgaatgtct

SEQ ID NO: 838556 - DNA, 25 bp, Mus musculus
ttcacaaggagacgcagatactgat

SEQ ID NO: 838557 - DNA, 25 bp, Mus musculus
ttcacaaggagaggcagatactgat

SEQ ID NO: 838558 - DNA, 25 bp, Mus musculus
ttcacaaggccgatgaggtcacact

SEQ ID NO: 838559 - DNA, 25 bp, Mus musculus
ttcacaaggccgttgaggtcacact

SEQ ID NO: 838560 - DNA, 25 bp, Mus musculus
ttcacaatcggcatctcttcaaaga

SEQ ID NO: 838561 - DNA, 25 bp, Mus musculus
ttcacaatcggcttctcttcaaaga

SEQ ID NO: 838562 - DNA, 25 bp, Mus musculus
ttcacaatggagaccagtacaagaa

SEQ ID NO: 838563 - DNA, 25 bp, Mus musculus
ttcacaatggagtccagtacaagaa

SEQ ID NO: 838564 - DNA, 25 bp, Mus musculus
ttcacacaacgaactagaaaagcac

SEQ ID NO: 838565 - DNA, 25 bp, Mus musculus
ttcacacaacgatctagaaaagcac

SEQ ID NO: 838566 - DNA, 25 bp, Mus musculus
ttcacacacgttaccttaatcagct

SEQ ID NO: 838567 - DNA, 25 bp, Mus musculus
ttcacacacgtttccttaatcagct

SEQ ID NO: 838568 - DNA, 25 bp, Mus musculus
ttcacacactgcacagatgctcggg

SEQ ID NO: 838569 - DNA, 25 bp, Mus musculus
ttcacacactgctcagatgctcggg

SEQ ID NO: 838570 - DNA, 25 bp, Mus musculus
ttcacacatcttcagcgagaaggca

SEQ ID NO: 838571 - DNA, 25 bp, Mus musculus
ttcacacatcttgagcgagaaggca

SEQ ID NO: 838572 - DNA, 25 bp, Mus musculus
ttcacaccacagaaatccctagaag

SEQ ID NO: 838573 - DNA, 25 bp, Mus musculus
ttcacaccacagtaatccctagaag

SEQ ID NO: 838574 - DNA, 25 bp, Mus musculus
ttcacacccgggaagccacacaatg

SEQ ID NO: 838575 - DNA, 25 bp, Mus musculus
ttcacacccgggtagccacacaatg

SEQ ID NO: 838576 - DNA, 25 bp, Mus musculus
ttcacaccgagtcttcagccaggta

SEQ ID NO: 838577 - DNA, 25 bp, Mus musculus
ttcacaccgagtgttcagccaggta

SEQ ID NO: 838578 - DNA, 25 bp, Mus musculus
ttcacacctgatcagtctctggacg

SEQ ID NO: 838579 - DNA, 25 bp, Mus musculus
ttcacacctgatgagtctctggacg

SEQ ID NO: 838580 - DNA, 25 bp, Mus musculus
ttcacacctgcaactcagtaggagg

SEQ ID NO: 838581 - DNA, 25 bp, Mus musculus
ttcacacctgcatctcagtaggagg

SEQ ID NO: 838582 - DNA, 25 bp, Mus musculus
ttcacacgaaacaagctgacgagtt

SEQ ID NO: 838583 - DNA, 25 bp, Mus musculus
ttcacacgaaactagctgacgagtt

SEQ ID NO: 838584 - DNA, 25 bp, Mus musculus
ttcacactccatccagatgtcagca

SEQ ID NO: 838585 - DNA, 25 bp, Mus musculus
ttcacactccatgcagatgtcagca

SEQ ID NO: 838586 - DNA, 25 bp, Mus musculus
ttcacactcgctaaggtatttctac

SEQ ID NO: 838587 - DNA, 25 bp, Mus musculus
ttcacactcgcttaggtatttctac

SEQ ID NO: 838588 - DNA, 25 bp, Mus musculus
ttcacacttgaaaaaggctttgtcc

SEQ ID NO: 838589 - DNA, 25 bp, Mus musculus
ttcacacttgaataaggctttgtcc

SEQ ID NO: 838590 - DNA, 25 bp, Mus musculus
ttcacagaaattcggcctatgtctt

SEQ ID NO: 838591 - DNA, 25 bp, Mus musculus
ttcacagaaattgggcctatgtctt

SEQ ID NO: 838592 - DNA, 25 bp, Mus musculus
ttcacagacctaatcaagaaatgga

SEQ ID NO: 838593 - DNA, 25 bp, Mus musculus
ttcacagacctattcaagaaatgga

SEQ ID NO: 838594 - DNA, 25 bp, Mus musculus
ttcacagactccattgttcaactgt

SEQ ID NO: 838595 - DNA, 25 bp, Mus musculus
ttcacagactcctttgttcaactgt

SEQ ID NO: 838596 - DNA, 25 bp, Mus musculus
ttcacagagacacccgccgtatttg

SEQ ID NO: 838597 - DNA, 25 bp, Mus musculus
ttcacagagacagccgccgtatttg

SEQ ID NO: 838598 - DNA, 25 bp, Mus musculus
ttcacagaggcgaagcactatcacg

SEQ ID NO: 838599 - DNA, 25 bp, Mus musculus
ttcacagaggcgtagcactatcacg

SEQ ID NO: 838600 - DNA, 25 bp, Mus musculus
ttcacagagtgacagcaattcattc

SEQ ID NO: 838601 - DNA, 25 bp, Mus musculus
ttcacagagtgagagcaattcattc

SEQ ID NO: 838602 - DNA, 25 bp, Mus musculus
ttcacagcctgtaggtctcgaacac

SEQ ID NO: 838603 - DNA, 25 bp, Mus musculus
ttcacagcctgttggtctcgaacac

SEQ ID NO: 838604 - DNA, 25 bp, Mus musculus
ttcacagcttgacttactgccccag

SEQ ID NO: 838605 - DNA, 25 bp, Mus musculus
ttcacagcttgagttactgccccag

SEQ ID NO: 838606 - DNA, 25 bp, Mus musculus
ttcacaggatgacgccaccagtgcc

SEQ ID NO: 838607 - DNA, 25 bp, Mus musculus
ttcacaggatgaggccaccagtgcc

SEQ ID NO: 838608 - DNA, 25 bp, Mus musculus
ttcacaggcattaccttcagcgcct

SEQ ID NO: 838609 - DNA, 25 bp, Mus musculus
ttcacaggcatttccttcagcgcct

SEQ ID NO: 838610 - DNA, 25 bp, Mus musculus
ttcacaggctggacagaaaacatca

SEQ ID NO: 838611 - DNA, 25 bp, Mus musculus
ttcacaggctggtcagaaaacatca

SEQ ID NO: 838612 - DNA, 25 bp, Mus musculus
ttcacagggatgaaccttttggttc

SEQ ID NO: 838613 - DNA, 25 bp, Mus musculus
ttcacagggatgtaccttttggttc

SEQ ID NO: 838614 - DNA, 25 bp, Mus musculus
ttcacagggcaccagcgggaaatca

SEQ ID NO: 838615 - DNA, 25 bp, Mus musculus
ttcacagggcacgagcgggaaatca

SEQ ID NO: 838616 - DNA, 25 bp, Mus musculus
ttcacaggtctaagtacagaaaata

SEQ ID NO: 838617 - DNA, 25 bp, Mus musculus
ttcacaggtctatgtacagaaaata

SEQ ID NO: 838618 - DNA, 25 bp, Mus musculus
ttcacagtcaagatctaccctcctg

SEQ ID NO: 838619 - DNA, 25 bp, Mus musculus
ttcacagtcaagttctaccctcctg

SEQ ID NO: 838620 - DNA, 25 bp, Mus musculus
ttcacagtcctaaaacgataccaga

SEQ ID NO: 838621 - DNA, 25 bp, Mus musculus
ttcacagtcctataacgataccaga

SEQ ID NO: 838622 - DNA, 25 bp, Mus musculus
ttcacagtggtgactgtcttcaatt

SEQ ID NO: 838623 - DNA, 25 bp, Mus musculus
ttcacagtggtgtctgtcttcaatt

SEQ ID NO: 838624 - DNA, 25 bp, Mus musculus
ttcacagttagacatggctacatcc

SEQ ID NO: 838625 - DNA, 25 bp, Mus musculus
ttcacagttagagatggctacatcc

SEQ ID NO: 838626 - DNA, 25 bp, Mus musculus
ttcacatcattgcaggagtcattgc

SEQ ID NO: 838627 - DNA, 25 bp, Mus musculus
ttcacatcattggaggagtcattgc

SEQ ID NO: 838628 - DNA, 25 bp, Mus musculus
ttcacatccacgcaggcggctttgt

SEQ ID NO: 838629 - DNA, 25 bp, Mus musculus
ttcacatccacggaggcggctttgt

SEQ ID NO: 838630 - DNA, 25 bp, Mus musculus
ttcacatctgacaatggtatccctt

SEQ ID NO: 838631 - DNA, 25 bp, Mus musculus
ttcacatctgactatggtatccctt

SEQ ID NO: 838632 - DNA, 25 bp, Mus musculus
ttcacatgcctaatttcatcaccgg

SEQ ID NO: 838633 - DNA, 25 bp, Mus musculus
ttcacatgcctattttcatcaccgg

SEQ ID NO: 838634 - DNA, 25 bp, Mus musculus
ttcacatgctccctatgccaggaga

SEQ ID NO: 838635 - DNA, 25 bp, Mus musculus
ttcacatgctccgtatgccaggaga

SEQ ID NO: 838636 - DNA, 25 bp, Mus musculus
ttcacatgtcttcgccgtgatggga

SEQ ID NO: 838637 - DNA, 25 bp, Mus musculus
ttcacatgtcttggccgtgatggga

SEQ ID NO: 838638 - DNA, 25 bp, Mus musculus
ttcacattaacaagccaagaagagt

SEQ ID NO: 838639 - DNA, 25 bp, Mus musculus
ttcacattaacatgccaagaagagt

SEQ ID NO: 838640 - DNA, 25 bp, Mus musculus
ttcaccaaaggcaagcgaggcaagc

SEQ ID NO: 838641 - DNA, 25 bp, Mus musculus
ttcaccaaaggctagcgaggcaagc

SEQ ID NO: 838642 - DNA, 25 bp, Mus musculus
ttcaccaaccaaatgggcatcgggc

SEQ ID NO: 838643 - DNA, 25 bp, Mus musculus
ttcaccaaccaattgggcatcgggc

SEQ ID NO: 838644 - DNA, 25 bp, Mus musculus
ttcaccaacgatcagggaagacaag

SEQ ID NO: 838645 - DNA, 25 bp, Mus musculus
ttcaccaacgatgagggaagacaag

SEQ ID NO: 838646 - DNA, 25 bp, Mus musculus
ttcaccaacgccaccgatgatgatg

SEQ ID NO: 838647 - DNA, 25 bp, Mus musculus
ttcaccaacgcctccgatgatgatg

SEQ ID NO: 838648 - DNA, 25 bp, Mus musculus
ttcaccaactaaaactgccaaaacg

SEQ ID NO: 838649 - DNA, 25 bp, Mus musculus
ttcaccaactaatactgccaaaacg

SEQ ID NO: 838650 - DNA, 25 bp, Mus musculus
ttcaccaagaagcagtctaccgcga

SEQ ID NO: 838651 - DNA, 25 bp, Mus musculus
ttcaccaagaaggagtctaccgcga

SEQ ID NO: 838652 - DNA, 25 bp, Mus musculus
ttcaccaagcttcaccgcattggca

SEQ ID NO: 838653 - DNA, 25 bp, Mus musculus
ttcaccaagcttgaccgcattggca

SEQ ID NO: 838654 - DNA, 25 bp, Mus musculus
ttcaccaagtacattcgtagagctt

SEQ ID NO: 838655 - DNA, 25 bp, Mus musculus
ttcaccaagtactttcgtagagctt

SEQ ID NO: 838656 - DNA, 25 bp, Mus musculus
ttcaccaatctccagtcacagaagg

SEQ ID NO: 838657 - DNA, 25 bp, Mus musculus
ttcaccaatctcgagtcacagaagg

SEQ ID NO: 838658 - DNA, 25 bp, Mus musculus
ttcaccacagccaaaggacaaaatt

SEQ ID NO: 838659 - DNA, 25 bp, Mus musculus
ttcaccacagcctaaggacaaaatt

SEQ ID NO: 838660 - DNA, 25 bp, Mus musculus
ttcaccacataaagatcaacagaga

SEQ ID NO: 838661 - DNA, 25 bp, Mus musculus
ttcaccacataatgatcaacagaga

SEQ ID NO: 838662 - DNA, 25 bp, Mus musculus
ttcaccacccacagagaacactaaa

SEQ ID NO: 838663 - DNA, 25 bp, Mus musculus
ttcaccacccactgagaacactaaa

SEQ ID NO: 838664 - DNA, 25 bp, Mus musculus
ttcaccagcaaccagcctggacgga

SEQ ID NO: 838665 - DNA, 25 bp, Mus musculus
ttcaccagcaacgagcctggacgga

SEQ ID NO: 838666 - DNA, 25 bp, Mus musculus
ttcaccaggaccatatgaaaggtat

SEQ ID NO: 838667 - DNA, 25 bp, Mus musculus
ttcaccaggaccttatgaaaggtat

SEQ ID NO: 838668 - DNA, 25 bp, Mus musculus
ttcaccatacaccttatccaaacgg

SEQ ID NO: 838669 - DNA, 25 bp, Mus musculus
ttcaccatacacgttatccaaacgg

SEQ ID NO: 838670 - DNA, 25 bp, Mus musculus
ttcaccatgaccagtgagaccaaca

SEQ ID NO: 838671 - DNA, 25 bp, Mus musculus
ttcaccatgacctgtgagaccaaca

SEQ ID NO: 838672 - DNA, 25 bp, Mus musculus
ttcaccatgacgctggcccgagtct

SEQ ID NO: 838673 - DNA, 25 bp, Mus musculus
ttcaccatgacggtggcccgagtct

SEQ ID NO: 838674 - DNA, 25 bp, Mus musculus
ttcaccatgattctggccctggagc

SEQ ID NO: 838675 - DNA, 25 bp, Mus musculus
ttcaccatgattgtggccctggagc

SEQ ID NO: 838676 - DNA, 25 bp, Mus musculus
ttcaccatgccactgactcaacagt

SEQ ID NO: 838677 - DNA, 25 bp, Mus musculus
ttcaccatgccagtgactcaacagt

SEQ ID NO: 838678 - DNA, 25 bp, Mus musculus
ttcaccatggatatctacacgcgcc

SEQ ID NO: 838679 - DNA, 25 bp, Mus musculus
ttcaccatggatttctacacgcgcc

SEQ ID NO: 838680 - DNA, 25 bp, Mus musculus
ttcaccattatcattgagccctttg

SEQ ID NO: 838681 - DNA, 25 bp, Mus musculus
ttcaccattatctttgagccctttg

SEQ ID NO: 838682 - DNA, 25 bp, Mus musculus
ttcacccaggtgatcgacagctacg

SEQ ID NO: 838683 - DNA, 25 bp, Mus musculus
ttcacccaggtgttcgacagctacg

SEQ ID NO: 838684 - DNA, 25 bp, Mus musculus
ttcacccgccaaactaaaggagagt

SEQ ID NO: 838685 - DNA, 25 bp, Mus musculus
ttcacccgccaatctaaaggagagt

SEQ ID NO: 838686 - DNA, 25 bp, Mus musculus
ttcacccgcgtgaacggacccgaag

SEQ ID NO: 838687 - DNA, 25 bp, Mus musculus
ttcacccgcgtgtacggacccgaag

SEQ ID NO: 838688 - DNA, 25 bp, Mus musculus
ttcacccggaagaggcagcgcgagc

SEQ ID NO: 838689 - DNA, 25 bp, Mus musculus
ttcacccggaagtggcagcgcgagc

SEQ ID NO: 838690 - DNA, 25 bp, Mus musculus
ttcaccctcagcatcagcaacaagt

SEQ ID NO: 838691 - DNA, 25 bp, Mus musculus
ttcaccctcagcttcagcaacaagt

SEQ ID NO: 838692 - DNA, 25 bp, Mus musculus
ttcaccgaatccctcgtgggcggaa

SEQ ID NO: 838693 - DNA, 25 bp, Mus musculus
ttcaccgaatccgtcgtgggcggaa

SEQ ID NO: 838694 - DNA, 25 bp, Mus musculus
ttcaccgactgcagcttgtgtgtgg

SEQ ID NO: 838695 - DNA, 25 bp, Mus musculus
ttcaccgactgctgcttgtgtgtgg

SEQ ID NO: 838696 - DNA, 25 bp, Mus musculus
ttcaccgagcagatctacaacgaga

SEQ ID NO: 838697 - DNA, 25 bp, Mus musculus
ttcaccgagcagttctacaacgaga

SEQ ID NO: 838698 - DNA, 25 bp, Mus musculus
ttcaccgatacacacacattttggg

SEQ ID NO: 838699 - DNA, 25 bp, Mus musculus
ttcaccgatacagacacattttggg

SEQ ID NO: 838700 - DNA, 25 bp, Mus musculus
ttcaccgatgctcagtaacaccttc

SEQ ID NO: 838701 - DNA, 25 bp, Mus musculus
ttcaccgatgctgagtaacaccttc

SEQ ID NO: 838702 - DNA, 25 bp, Mus musculus
ttcaccgcccacaaacaggatgtgt

SEQ ID NO: 838703 - DNA, 25 bp, Mus musculus
ttcaccgcccactaacaggatgtgt

SEQ ID NO: 838704 - DNA, 25 bp, Mus musculus
ttcaccggaatcagctcatcaatgc

SEQ ID NO: 838705 - DNA, 25 bp, Mus musculus
ttcaccggaatctgctcatcaatgc

SEQ ID NO: 838706 - DNA, 25 bp, Mus musculus
ttcaccggcttcagggattctaacc

SEQ ID NO: 838707 - DNA, 25 bp, Mus musculus
ttcaccggcttctgggattctaacc

SEQ ID NO: 838708 - DNA, 25 bp, Mus musculus
ttcaccgtcactcttccagaaaaga

SEQ ID NO: 838709 - DNA, 25 bp, Mus musculus
ttcaccgtcactgttccagaaaaga

SEQ ID NO: 838710 - DNA, 25 bp, Mus musculus
ttcaccgtccgtccgacgagtgaga

SEQ ID NO: 838711 - DNA, 25 bp, Mus musculus
ttcaccgtccgtgcgacgagtgaga

SEQ ID NO: 838712 - DNA, 25 bp, Mus musculus
ttcaccgtgattagaaactttccag

SEQ ID NO: 838713 - DNA, 25 bp, Mus musculus
ttcaccgtgatttgaaactttccag

SEQ ID NO: 838714 - DNA, 25 bp, Mus musculus
ttcaccgttcttaagcgctaccaga

SEQ ID NO: 838715 - DNA, 25 bp, Mus musculus
ttcaccgttctttagcgctaccaga

SEQ ID NO: 838716 - DNA, 25 bp, Mus musculus
ttcacctacaagcagagtacaatca

SEQ ID NO: 838717 - DNA, 25 bp, Mus musculus
ttcacctacaaggagagtacaatca

SEQ ID NO: 838718 - DNA, 25 bp, Mus musculus
ttcacctcccgtctggcatgagcgg

SEQ ID NO: 838719 - DNA, 25 bp, Mus musculus
ttcacctcccgtgtggcatgagcgg

SEQ ID NO: 838720 - DNA, 25 bp, Mus musculus
ttcacctcgccacgtagcaaagagg

SEQ ID NO: 838721 - DNA, 25 bp, Mus musculus
ttcacctcgccaggtagcaaagagg

SEQ ID NO: 838722 - DNA, 25 bp, Mus musculus
ttcacctctgcacggagtcacggct

SEQ ID NO: 838723 - DNA, 25 bp, Mus musculus
ttcacctctgcagggagtcacggct

SEQ ID NO: 838724 - DNA, 25 bp, Mus musculus
ttcacctctgcgagccctgggcgtt

SEQ ID NO: 838725 - DNA, 25 bp, Mus musculus
ttcacctctgcgtgccctgggcgtt

SEQ ID NO: 838726 - DNA, 25 bp, Mus musculus
ttcacctgaggtctccggccgggct

SEQ ID NO: 838727 - DNA, 25 bp, Mus musculus
ttcacctgaggtgtccggccgggct

SEQ ID NO: 838728 - DNA, 25 bp, Mus musculus
ttcacctgctgcatggcgtcagcgg

SEQ ID NO: 838729 - DNA, 25 bp, Mus musculus
ttcacctgctgcttggcgtcagcgg

SEQ ID NO: 838730 - DNA, 25 bp, Mus musculus
ttcacctgggtcacgggctactttg

SEQ ID NO: 838731 - DNA, 25 bp, Mus musculus
ttcacctgggtctcgggctactttg

SEQ ID NO: 838732 - DNA, 25 bp, Mus musculus
ttcacctgtcaccttgcgccagaag

SEQ ID NO: 838733 - DNA, 25 bp, Mus musculus
ttcacctgtcacgttgcgccagaag

SEQ ID NO: 838734 - DNA, 25 bp, Mus musculus
ttcaccttacacagagtaatcagga

SEQ ID NO: 838735 - DNA, 25 bp, Mus musculus
ttcaccttacactgagtaatcagga

SEQ ID NO: 838736 - DNA, 25 bp, Mus musculus
ttcaccttatgcagtgacaagaaca

SEQ ID NO: 838737 - DNA, 25 bp, Mus musculus
ttcaccttatgctgtgacaagaaca

SEQ ID NO: 838738 - DNA, 25 bp, Mus musculus
ttcaccttcaacatgggcttctcgg

SEQ ID NO: 838739 - DNA, 25 bp, Mus musculus
ttcaccttcaacttgggcttctcgg

SEQ ID NO: 838740 - DNA, 25 bp, Mus musculus
ttcaccttcaagaacctccacttca

SEQ ID NO: 838741 - DNA, 25 bp, Mus musculus
ttcaccttcaagtacctccacttca

SEQ ID NO: 838742 - DNA, 25 bp, Mus musculus
ttcaccttccgtagccccgaggaag

SEQ ID NO: 838743 - DNA, 25 bp, Mus musculus
ttcaccttccgttgccccgaggaag

SEQ ID NO: 838744 - DNA, 25 bp, Mus musculus
ttcaccttcgatcatgcccagcagg

SEQ ID NO: 838745 - DNA, 25 bp, Mus musculus
ttcaccttcgatgatgcccagcagg

SEQ ID NO: 838746 - DNA, 25 bp, Mus musculus
ttcaccttgaaacccagaaggagag

SEQ ID NO: 838747 - DNA, 25 bp, Mus musculus
ttcaccttgaaagccagaaggagag

SEQ ID NO: 838748 - DNA, 25 bp, Mus musculus
ttcaccttgcatcgccgggctatct

SEQ ID NO: 838749 - DNA, 25 bp, Mus musculus
ttcaccttgcatggccgggctatct

SEQ ID NO: 838750 - DNA, 25 bp, Mus musculus
ttcacctttcttcgaaataggaggc

SEQ ID NO: 838751 - DNA, 25 bp, Mus musculus
ttcacctttcttggaaataggaggc

SEQ ID NO: 838752 - DNA, 25 bp, Mus musculus
ttcacgatagaaaacaagactcccc

SEQ ID NO: 838753 - DNA, 25 bp, Mus musculus
ttcacgatagaatacaagactcccc

SEQ ID NO: 838754 - DNA, 25 bp, Mus musculus
ttcacgatggacagcgcagcgccca

SEQ ID NO: 838755 - DNA, 25 bp, Mus musculus
ttcacgatggactgcgcagcgccca

SEQ ID NO: 838756 - DNA, 25 bp, Mus musculus
ttcacgcacggcatccagaacatag

SEQ ID NO: 838757 - DNA, 25 bp, Mus musculus
ttcacgcacggcttccagaacatag

SEQ ID NO: 838758 - DNA, 25 bp, Mus musculus
ttcacgccttacagctgggtacgct

SEQ ID NO: 838759 - DNA, 25 bp, Mus musculus
ttcacgccttactgctgggtacgct

SEQ ID NO: 838760 - DNA, 25 bp, Mus musculus
ttcacgctctcgctggccgtaggtg

SEQ ID NO: 838761 - DNA, 25 bp, Mus musculus
ttcacgctctcggtggccgtaggtg

SEQ ID NO: 838762 - DNA, 25 bp, Mus musculus
ttcacgctggatcaggccgagcgcc

SEQ ID NO: 838763 - DNA, 25 bp, Mus musculus
ttcacgctggatgaggccgagcgcc

SEQ ID NO: 838764 - DNA, 25 bp, Mus musculus
ttcacggcagccaggacaacaatgc

SEQ ID NO: 838765 - DNA, 25 bp, Mus musculus
ttcacggcagcctggacaacaatgc

SEQ ID NO: 838766 - DNA, 25 bp, Mus musculus
ttcacggcgtccatgagcagaacta

SEQ ID NO: 838767 - DNA, 25 bp, Mus musculus
ttcacggcgtccttgagcagaacta

SEQ ID NO: 838768 - DNA, 25 bp, Mus musculus
ttcacggctatcatcaggagctctc

SEQ ID NO: 838769 - DNA, 25 bp, Mus musculus
ttcacggctatcttcaggagctctc

SEQ ID NO: 838770 - DNA, 25 bp, Mus musculus
ttcacgggacccagctgtgagacag

SEQ ID NO: 838771 - DNA, 25 bp, Mus musculus
ttcacgggaccctgctgtgagacag

SEQ ID NO: 838772 - DNA, 25 bp, Mus musculus
ttcacgggatagaaaatcaatgtcc

SEQ ID NO: 838773 - DNA, 25 bp, Mus musculus
ttcacgggatagtaaatcaatgtcc

SEQ ID NO: 838774 - DNA, 25 bp, Mus musculus
ttcacgggtgccagacaagaaaagt

SEQ ID NO: 838775 - DNA, 25 bp, Mus musculus
ttcacgggtgcctgacaagaaaagt

SEQ ID NO: 838776 - DNA, 25 bp, Mus musculus
ttcacggtctacaagcttggcagag

SEQ ID NO: 838777 - DNA, 25 bp, Mus musculus
ttcacggtctactagcttggcagag

SEQ ID NO: 838778 - DNA, 25 bp, Mus musculus
ttcacggtgacccaacaagcaaggg

SEQ ID NO: 838779 - DNA, 25 bp, Mus musculus
ttcacggtgaccgaacaagcaaggg

SEQ ID NO: 838780 - DNA, 25 bp, Mus musculus
ttcacggtgtgccaccctacagtac

SEQ ID NO: 838781 - DNA, 25 bp, Mus musculus
ttcacggtgtgcgaccctacagtac

SEQ ID NO: 838782 - DNA, 25 bp, Mus musculus
ttcacgtacgcgctgagcgcagctg

SEQ ID NO: 838783 - DNA, 25 bp, Mus musculus
ttcacgtacgcggtgagcgcagctg

SEQ ID NO: 838784 - DNA, 25 bp, Mus musculus
ttcacgtactatcgagtgtccgccc

SEQ ID NO: 838785 - DNA, 25 bp, Mus musculus
ttcacgtactatggagtgtccgccc

SEQ ID NO: 838786 - DNA, 25 bp, Mus musculus
ttcacgtatcgtaacctggcactct

SEQ ID NO: 838787 - DNA, 25 bp, Mus musculus
ttcacgtatcgttacctggcactct

SEQ ID NO: 838788 - DNA, 25 bp, Mus musculus
ttcacgtccggaagctgaagagcta

SEQ ID NO: 838789 - DNA, 25 bp, Mus musculus
ttcacgtccggatgctgaagagcta

SEQ ID NO: 838790 - DNA, 25 bp, Mus musculus
ttcacgttcaccatgttaaatgtgc

SEQ ID NO: 838791 - DNA, 25 bp, Mus musculus
ttcacgttcaccttgttaaatgtgc

SEQ ID NO: 838792 - DNA, 25 bp, Mus musculus
ttcactaatccacgtggcttgtttt

SEQ ID NO: 838793 - DNA, 25 bp, Mus musculus
ttcactaatccaggtggcttgtttt

SEQ ID NO: 838794 - DNA, 25 bp, Mus musculus
ttcactacgaggcaaggccgcctgg

SEQ ID NO: 838795 - DNA, 25 bp, Mus musculus
ttcactacgagggaaggccgcctgg

SEQ ID NO: 838796 - DNA, 25 bp, Mus musculus
ttcactagacaacaatggaactcag

SEQ ID NO: 838797 - DNA, 25 bp, Mus musculus
ttcactagacaagaatggaactcag

SEQ ID NO: 838798 - DNA, 25 bp, Mus musculus
ttcactagctggcaatcggtctcca

SEQ ID NO: 838799 - DNA, 25 bp, Mus musculus
ttcactagctgggaatcggtctcca

SEQ ID NO: 838800 - DNA, 25 bp, Mus musculus
ttcactaggctcagggtgcctcttc

SEQ ID NO: 838801 - DNA, 25 bp, Mus musculus
ttcactaggctctgggtgcctcttc

SEQ ID NO: 838802 - DNA, 25 bp, Mus musculus
ttcactagggacacctgggaggcga

SEQ ID NO: 838803 - DNA, 25 bp, Mus musculus
ttcactagggactcctgggaggcga

SEQ ID NO: 838804 - DNA, 25 bp, Mus musculus
ttcactatgataactgaggaggctt

SEQ ID NO: 838805 - DNA, 25 bp, Mus musculus
ttcactatgatatctgaggaggctt

SEQ ID NO: 838806 - DNA, 25 bp, Mus musculus
ttcactcaccataggactcctgcgt

SEQ ID NO: 838807 - DNA, 25 bp, Mus musculus
ttcactcaccattggactcctgcgt

SEQ ID NO: 838808 - DNA, 25 bp, Mus musculus
ttcactccttacctagctctcaagt

SEQ ID NO: 838809 - DNA, 25 bp, Mus musculus
ttcactccttacgtagctctcaagt

SEQ ID NO: 838810 - DNA, 25 bp, Mus musculus
ttcactcgtcttccgcgtgatttgc

SEQ ID NO: 838811 - DNA, 25 bp, Mus musculus
ttcactcgtcttgcgcgtgatttgc

SEQ ID NO: 838812 - DNA, 25 bp, Mus musculus
ttcactctcaccaaaggcggccggt

SEQ ID NO: 838813 - DNA, 25 bp, Mus musculus
ttcactctcacctaaggcggccggt

SEQ ID NO: 838814 - DNA, 25 bp, Mus musculus
ttcactctctcaacatcatctacag

SEQ ID NO: 838815 - DNA, 25 bp, Mus musculus
ttcactctctcatcatcatctacag

SEQ ID NO: 838816 - DNA, 25 bp, Mus musculus
ttcactctggagcagctgtgtctca

SEQ ID NO: 838817 - DNA, 25 bp, Mus musculus
ttcactctggaggagctgtgtctca

SEQ ID NO: 838818 - DNA, 25 bp, Mus musculus
ttcactgaacgcatgatggcctact

SEQ ID NO: 838819 - DNA, 25 bp, Mus musculus
ttcactgaacgcttgatggcctact

SEQ ID NO: 838820 - DNA, 25 bp, Mus musculus
ttcactgacaagactaaactcccaa

SEQ ID NO: 838821 - DNA, 25 bp, Mus musculus
ttcactgacaagtctaaactcccaa

SEQ ID NO: 838822 - DNA, 25 bp, Mus musculus
ttcactgagggcaaagaagagacct

SEQ ID NO: 838823 - DNA, 25 bp, Mus musculus
ttcactgagggctaagaagagacct

SEQ ID NO: 838824 - DNA, 25 bp, Mus musculus
ttcactgatgctaatcagcagtgtg

SEQ ID NO: 838825 - DNA, 25 bp, Mus musculus
ttcactgatgctctcatccgggagc

SEQ ID NO: 838826 - DNA, 25 bp, Mus musculus
ttcactgatgctgtcatccgggagc

SEQ ID NO: 838827 - DNA, 25 bp, Mus musculus
ttcactgatgcttatcagcagtgtg

SEQ ID NO: 838828 - DNA, 25 bp, Mus musculus
ttcactgcagacaatgcagcaggac

SEQ ID NO: 838829 - DNA, 25 bp, Mus musculus
ttcactgcagactatgcagcaggac

SEQ ID NO: 838830 - DNA, 25 bp, Mus musculus
ttcactgcctctaggtaaccctgtg

SEQ ID NO: 838831 - DNA, 25 bp, Mus musculus
ttcactgcctcttggtaaccctgtg

SEQ ID NO: 838832 - DNA, 25 bp, Mus musculus
ttcactgcttccagggcaacattca

SEQ ID NO: 838833 - DNA, 25 bp, Mus musculus
ttcactgcttcctgggcaacattca

SEQ ID NO: 838834 - DNA, 25 bp, Mus musculus
ttcactggaagactatacatcattc

SEQ ID NO: 838835 - DNA, 25 bp, Mus musculus
ttcactggaagagtatacatcattc

SEQ ID NO: 838836 - DNA, 25 bp, Mus musculus
ttcactggacccaatattatggctc

SEQ ID NO: 838837 - DNA, 25 bp, Mus musculus
ttcactggaccctatattatggctc

SEQ ID NO: 838838 - DNA, 25 bp, Mus musculus
ttcactggagagaatttaacagctc

SEQ ID NO: 838839 - DNA, 25 bp, Mus musculus
ttcactggagagtatttaacagctc

SEQ ID NO: 838840 - DNA, 25 bp, Mus musculus
ttcactggagtgcacgatgccagcg

SEQ ID NO: 838841 - DNA, 25 bp, Mus musculus
ttcactggagtggacgatgccagcg

SEQ ID NO: 838842 - DNA, 25 bp, Mus musculus
ttcactggctcacccgttctaacat

SEQ ID NO: 838843 - DNA, 25 bp, Mus musculus
ttcactggctcagccgttctaacat

SEQ ID NO: 838844 - DNA, 25 bp, Mus musculus
ttcactgggcggcatctgggaaact

SEQ ID NO: 838845 - DNA, 25 bp, Mus musculus
ttcactgggcgggatctgggaaact

SEQ ID NO: 838846 - DNA, 25 bp, Mus musculus
ttcactgtggttaggatataatccc

SEQ ID NO: 838847 - DNA, 25 bp, Mus musculus
ttcactgtggtttggatataatccc

SEQ ID NO: 838848 - DNA, 25 bp, Mus musculus
ttcacttcctgtcgaggtacctgca

SEQ ID NO: 838849 - DNA, 25 bp, Mus musculus
ttcacttcctgtggaggtacctgca

SEQ ID NO: 838850 - DNA, 25 bp, Mus musculus
ttcacttggaggactgcactaacag

SEQ ID NO: 838851 - DNA, 25 bp, Mus musculus
ttcacttggaggtctgcactaacag

SEQ ID NO: 838852 - DNA, 25 bp, Mus musculus
ttcacttgttctcacacagtgctgc

SEQ ID NO: 838853 - DNA, 25 bp, Mus musculus
ttcacttgttctgacacagtgctgc

SEQ ID NO: 838854 - DNA, 25 bp, Mus musculus
ttcactttagtcacagcagctggga

SEQ ID NO: 838855 - DNA, 25 bp, Mus musculus
ttcactttagtctcagcagctggga

SEQ ID NO: 838856 - DNA, 25 bp, Mus musculus
ttcagaaaaagtccgggacatacca

SEQ ID NO: 838857 - DNA, 25 bp, Mus musculus
ttcagaaaaagtctctcaacattag

SEQ ID NO: 838858 - DNA, 25 bp, Mus musculus
ttcagaaaaagtgcgggacatacca

SEQ ID NO: 838859 - DNA, 25 bp, Mus musculus
ttcagaaaaagtgtctcaacattag

SEQ ID NO: 838860 - DNA, 25 bp, Mus musculus
ttcagaaaacggagacgcgcttggc

SEQ ID NO: 838861 - DNA, 25 bp, Mus musculus
ttcagaaaacggtgacgcgcttggc

SEQ ID NO: 838862 - DNA, 25 bp, Mus musculus
ttcagaaacttcctaacaacaaggc

SEQ ID NO: 838863 - DNA, 25 bp, Mus musculus
ttcagaaacttcgtaacaacaaggc

SEQ ID NO: 838864 - DNA, 25 bp, Mus musculus
ttcagaaaggtcaggtagattcccc

SEQ ID NO: 838865 - DNA, 25 bp, Mus musculus
ttcagaaaggtctggtagattcccc

SEQ ID NO: 838866 - DNA, 25 bp, Mus musculus
ttcagaaagtccatgaagcactgca

SEQ ID NO: 838867 - DNA, 25 bp, Mus musculus
ttcagaaagtccttgaagcactgca

SEQ ID NO: 838868 - DNA, 25 bp, Mus musculus
ttcagaaatagaatccacttgggcc

SEQ ID NO: 838869 - DNA, 25 bp, Mus musculus
ttcagaaatagattccacttgggcc

SEQ ID NO: 838870 - DNA, 25 bp, Mus musculus
ttcagaacacgacccactgggtgag

SEQ ID NO: 838871 - DNA, 25 bp, Mus musculus
ttcagaacacgagccactgggtgag

SEQ ID NO: 838872 - DNA, 25 bp, Mus musculus
ttcagaaccaatagaggcacagttg

SEQ ID NO: 838873 - DNA, 25 bp, Mus musculus
ttcagaaccaattgaggcacagttg

SEQ ID NO: 838874 - DNA, 25 bp, Mus musculus
ttcagaaccgtgacctggatgcccg

SEQ ID NO: 838875 - DNA, 25 bp, Mus musculus
ttcagaaccgtgtcctggatgcccg

SEQ ID NO: 838876 - DNA, 25 bp, Mus musculus
ttcagaacctggagtgccacagtgg

SEQ ID NO: 838877 - DNA, 25 bp, Mus musculus
ttcagaacctggtgtgccacagtgg

SEQ ID NO: 838878 - DNA, 25 bp, Mus musculus
ttcagaactccaatctccccgagag

SEQ ID NO: 838879 - DNA, 25 bp, Mus musculus
ttcagaactccattctccccgagag

SEQ ID NO: 838880 - DNA, 25 bp, Mus musculus
ttcagaagacgaagacgatcaagag

SEQ ID NO: 838881 - DNA, 25 bp, Mus musculus
ttcagaagacgatgacgatcaagag

SEQ ID NO: 838882 - DNA, 25 bp, Mus musculus
ttcagaagagaacccaaacgcacga

SEQ ID NO: 838883 - DNA, 25 bp, Mus musculus
ttcagaagagaagccaaacgcacga

SEQ ID NO: 838884 - DNA, 25 bp, Mus musculus
ttcagaagccggcactggctggact

SEQ ID NO: 838885 - DNA, 25 bp, Mus musculus
ttcagaagccgggactggctggact

SEQ ID NO: 838886 - DNA, 25 bp, Mus musculus
ttcagaagctacctgcagaaggacc

SEQ ID NO: 838887 - DNA, 25 bp, Mus musculus
ttcagaagctacgtgcagaaggacc

SEQ ID NO: 838888 - DNA, 25 bp, Mus musculus
ttcagaaggatgcaagtctctgtac

SEQ ID NO: 838889 - DNA, 25 bp, Mus musculus
ttcagaaggatggaagtctctgtac

SEQ ID NO: 838890 - DNA, 25 bp, Mus musculus
ttcagaaggattcagacaacgtacc

SEQ ID NO: 838891 - DNA, 25 bp, Mus musculus
ttcagaaggattgagacaacgtacc

SEQ ID NO: 838892 - DNA, 25 bp, Mus musculus
ttcagaagtaccattaacctgaaga

SEQ ID NO: 838893 - DNA, 25 bp, Mus musculus
ttcagaagtacctttaacctgaaga

SEQ ID NO: 838894 - DNA, 25 bp, Mus musculus
ttcagaagttgaccaagaactggcc

SEQ ID NO: 838895 - DNA, 25 bp, Mus musculus
ttcagaagttgagcaagaactggcc

SEQ ID NO: 838896 - DNA, 25 bp, Mus musculus
ttcagaatgacaagggacgtggccc

SEQ ID NO: 838897 - DNA, 25 bp, Mus musculus
ttcagaatgacatgggacgtggccc

SEQ ID NO: 838898 - DNA, 25 bp, Mus musculus
ttcagaattccaactgttcccctga

SEQ ID NO: 838899 - DNA, 25 bp, Mus musculus
ttcagaattccatctgttcccctga

SEQ ID NO: 838900 - DNA, 25 bp, Mus musculus
ttcagacaaccgatggatctgccaa

SEQ ID NO: 838901 - DNA, 25 bp, Mus musculus
ttcagacaaccgttggatctgccaa

SEQ ID NO: 838902 - DNA, 25 bp, Mus musculus
ttcagacaatgaccttcagcaagca

SEQ ID NO: 838903 - DNA, 25 bp, Mus musculus
ttcagacaatgagcttcagcaagca

SEQ ID NO: 838904 - DNA, 25 bp, Mus musculus
ttcagacaatggatcggatgatggc

SEQ ID NO: 838905 - DNA, 25 bp, Mus musculus
ttcagacaatggttcggatgatggc

SEQ ID NO: 838906 - DNA, 25 bp, Mus musculus
ttcagacaccatagagcaaccaggg

SEQ ID NO: 838907 - DNA, 25 bp, Mus musculus
ttcagacaccattgagcaaccaggg

SEQ ID NO: 838908 - DNA, 25 bp, Mus musculus
ttcagacactgaaggcctgcacctc

SEQ ID NO: 838909 - DNA, 25 bp, Mus musculus
ttcagacactgatggcctgcacctc

SEQ ID NO: 838910 - DNA, 25 bp, Mus musculus
ttcagacatctgcagcacctacctg

SEQ ID NO: 838911 - DNA, 25 bp, Mus musculus
ttcagacatctggagcacctacctg

SEQ ID NO: 838912 - DNA, 25 bp, Mus musculus
ttcagaccaccgacctgtgtatggc

SEQ ID NO: 838913 - DNA, 25 bp, Mus musculus
ttcagaccaccgtcctgtgtatggc

SEQ ID NO: 838914 - DNA, 25 bp, Mus musculus
ttcagaccatcgcaatgagcagagc

SEQ ID NO: 838915 - DNA, 25 bp, Mus musculus
ttcagaccatcggaatgagcagagc

SEQ ID NO: 838916 - DNA, 25 bp, Mus musculus
ttcagacccagacagagctgatgtc

SEQ ID NO: 838917 - DNA, 25 bp, Mus musculus
ttcagacccagagagagctgatgtc

SEQ ID NO: 838918 - DNA, 25 bp, Mus musculus
ttcagaccgcggaggccctgaggct

SEQ ID NO: 838919 - DNA, 25 bp, Mus musculus
ttcagaccgcggtggccctgaggct

SEQ ID NO: 838920 - DNA, 25 bp, Mus musculus
ttcagaccgggcacttttgatggct

SEQ ID NO: 838921 - DNA, 25 bp, Mus musculus
ttcagaccgggctcttttgatggct

SEQ ID NO: 838922 - DNA, 25 bp, Mus musculus
ttcagacgaagaagggaattctcag

SEQ ID NO: 838923 - DNA, 25 bp, Mus musculus
ttcagacgaagatgggaattctcag

SEQ ID NO: 838924 - DNA, 25 bp, Mus musculus
ttcagacgctatcacacggatcagg

SEQ ID NO: 838925 - DNA, 25 bp, Mus musculus
ttcagacgctatgacacggatcagg

SEQ ID NO: 838926 - DNA, 25 bp, Mus musculus
ttcagactacgaactcacctacaac

SEQ ID NO: 838927 - DNA, 25 bp, Mus musculus
ttcagactacgatctcacctacaac

SEQ ID NO: 838928 - DNA, 25 bp, Mus musculus
ttcagactcccaagcccagagtggc

SEQ ID NO: 838929 - DNA, 25 bp, Mus musculus
ttcagactcccatgcccagagtggc

SEQ ID NO: 838930 - DNA, 25 bp, Mus musculus
ttcagactggatactctcagtgcca

SEQ ID NO: 838931 - DNA, 25 bp, Mus musculus
ttcagactggattctctcagtgcca

SEQ ID NO: 838932 - DNA, 25 bp, Mus musculus
ttcagactggcgagttcctgggctg

SEQ ID NO: 838933 - DNA, 25 bp, Mus musculus
ttcagactggcgtgttcctgggctg

SEQ ID NO: 838934 - DNA, 25 bp, Mus musculus
ttcagacttcaacacactggcgcca

SEQ ID NO: 838935 - DNA, 25 bp, Mus musculus
ttcagacttcaagacactggcgcca

SEQ ID NO: 838936 - DNA, 25 bp, Mus musculus
ttcagacttgggagtggctctcgcc

SEQ ID NO: 838937 - DNA, 25 bp, Mus musculus
ttcagacttgggtgtggctctcgcc

SEQ ID NO: 838938 - DNA, 25 bp, Mus musculus
ttcagactttgaacagcaaagctcc

SEQ ID NO: 838939 - DNA, 25 bp, Mus musculus
ttcagactttgatcagcaaagctcc

SEQ ID NO: 838940 - DNA, 25 bp, Mus musculus
ttcagagaacagaaaagcatccgac

SEQ ID NO: 838941 - DNA, 25 bp, Mus musculus
ttcagagaacagtaaagcatccgac

SEQ ID NO: 838942 - DNA, 25 bp, Mus musculus
ttcagagatcttcgcaggcttcgtg

SEQ ID NO: 838943 - DNA, 25 bp, Mus musculus
ttcagagatcttggcaggcttcgtg

SEQ ID NO: 838944 - DNA, 25 bp, Mus musculus
ttcagagatgcccagtacagtgtcc

SEQ ID NO: 838945 - DNA, 25 bp, Mus musculus
ttcagagatgccgagtacagtgtcc

SEQ ID NO: 838946 - DNA, 25 bp, Mus musculus
ttcagagcaactaggtggttcaccg

SEQ ID NO: 838947 - DNA, 25 bp, Mus musculus
ttcagagcaacttggtggttcaccg

SEQ ID NO: 838948 - DNA, 25 bp, Mus musculus
ttcagagcaatccactactgccaga

SEQ ID NO: 838949 - DNA, 25 bp, Mus musculus
ttcagagcaatcgactactgccaga

SEQ ID NO: 838950 - DNA, 25 bp, Mus musculus
ttcagagcagaaccggacactagca

SEQ ID NO: 838951 - DNA, 25 bp, Mus musculus
ttcagagcagaagcggacactagca

SEQ ID NO: 838952 - DNA, 25 bp, Mus musculus
ttcagagccccacccggtgatcttt

SEQ ID NO: 838953 - DNA, 25 bp, Mus musculus
ttcagagccccagccggtgatcttt

SEQ ID NO: 838954 - DNA, 25 bp, Mus musculus
ttcagagcgatgcatgctgcttcag

SEQ ID NO: 838955 - DNA, 25 bp, Mus musculus
ttcagagcgatggatgctgcttcag

SEQ ID NO: 838956 - DNA, 25 bp, Mus musculus
ttcagagcgtctcgcaaaatacaac

SEQ ID NO: 838957 - DNA, 25 bp, Mus musculus
ttcagagcgtctggcaaaatacaac

SEQ ID NO: 838958 - DNA, 25 bp, Mus musculus
ttcagagctccaaggacgctgggcc

SEQ ID NO: 838959 - DNA, 25 bp, Mus musculus
ttcagagctccatggacgctgggcc

SEQ ID NO: 838960 - DNA, 25 bp, Mus musculus
ttcagaggaaatctagtggtgacta

SEQ ID NO: 838961 - DNA, 25 bp, Mus musculus
ttcagaggaaatgtagtggtgacta

SEQ ID NO: 838962 - DNA, 25 bp, Mus musculus
ttcagaggagatactctccttcccc

SEQ ID NO: 838963 - DNA, 25 bp, Mus musculus
ttcagaggagattctctccttcccc

SEQ ID NO: 838964 - DNA, 25 bp, Mus musculus
ttcagaggccccacttagcacaggg

SEQ ID NO: 838965 - DNA, 25 bp, Mus musculus
ttcagaggcccctcttagcacaggg

SEQ ID NO: 838966 - DNA, 25 bp, Mus musculus
ttcagaggggtacactccgcagaca

SEQ ID NO: 838967 - DNA, 25 bp, Mus musculus
ttcagaggggtagactccgcagaca

SEQ ID NO: 838968 - DNA, 25 bp, Mus musculus
ttcagaggttgtcctgcagctcccc

SEQ ID NO: 838969 - DNA, 25 bp, Mus musculus
ttcagaggttgtgctgcagctcccc

SEQ ID NO: 838970 - DNA, 25 bp, Mus musculus
ttcagatactccctggacacctatg

SEQ ID NO: 838971 - DNA, 25 bp, Mus musculus
ttcagatactccgtggacacctatg

SEQ ID NO: 838972 - DNA, 25 bp, Mus musculus
ttcagatcggatcacacactgcggt

SEQ ID NO: 838973 - DNA, 25 bp, Mus musculus
ttcagatcggatgacacactgcggt

SEQ ID NO: 838974 - DNA, 25 bp, Mus musculus
ttcagatctgaaactcaacggaccc

SEQ ID NO: 838975 - DNA, 25 bp, Mus musculus
ttcagatctgaatctcaacggaccc

SEQ ID NO: 838976 - DNA, 25 bp, Mus musculus
ttcagatgagcccacggcgacagaa

SEQ ID NO: 838977 - DNA, 25 bp, Mus musculus
ttcagatgagccgacggcgacagaa

SEQ ID NO: 838978 - DNA, 25 bp, Mus musculus
ttcagatgatgtcccaatggtgctg

SEQ ID NO: 838979 - DNA, 25 bp, Mus musculus
ttcagatgatgtgccaatggtgctg

SEQ ID NO: 838980 - DNA, 25 bp, Mus musculus
ttcagatgcattagctacattcaag

SEQ ID NO: 838981 - DNA, 25 bp, Mus musculus
ttcagatgcatttgctacattcaag

SEQ ID NO: 838982 - DNA, 25 bp, Mus musculus
ttcagatgccctactgggatgctgg

SEQ ID NO: 838983 - DNA, 25 bp, Mus musculus
ttcagatgcccttctgggatgctgg

SEQ ID NO: 838984 - DNA, 25 bp, Mus musculus
ttcagatgccgtcatttctacagag

SEQ ID NO: 838985 - DNA, 25 bp, Mus musculus
ttcagatgccgtgatttctacagag

SEQ ID NO: 838986 - DNA, 25 bp, Mus musculus
ttcagatgctgtatacaccagcagc

SEQ ID NO: 838987 - DNA, 25 bp, Mus musculus
ttcagatgctgtttacaccagcagc

SEQ ID NO: 838988 - DNA, 25 bp, Mus musculus
ttcagatggaaaagattgttcgagc

SEQ ID NO: 838989 - DNA, 25 bp, Mus musculus
ttcagatggaaatgattgttcgagc

SEQ ID NO: 838990 - DNA, 25 bp, Mus musculus
ttcagatgggaacagtcatattgac

SEQ ID NO: 838991 - DNA, 25 bp, Mus musculus
ttcagatgggaagagtcatattgac

SEQ ID NO: 838992 - DNA, 25 bp, Mus musculus
ttcagattctacaaaagaaccgctg

SEQ ID NO: 838993 - DNA, 25 bp, Mus musculus
ttcagattctactaaagaaccgctg

SEQ ID NO: 838994 - DNA, 25 bp, Mus musculus
ttcagattctgaaaaccagggctct

SEQ ID NO: 838995 - DNA, 25 bp, Mus musculus
ttcagattctgataaccagggctct

SEQ ID NO: 838996 - DNA, 25 bp, Mus musculus
ttcagatttcaacccgaacgctggc

SEQ ID NO: 838997 - DNA, 25 bp, Mus musculus
ttcagatttcaagccgaacgctggc

SEQ ID NO: 838998 - DNA, 25 bp, Mus musculus
ttcagcaaaatacgagtacaccgtc

SEQ ID NO: 838999 - DNA, 25 bp, Mus musculus
ttcagcaaaataggagtacaccgtc

SEQ ID NO: 839000 - DNA, 25 bp, Mus musculus
ttcagcaacaagacagcaaacatgg

SEQ ID NO: 839001 - DNA, 25 bp, Mus musculus
ttcagcaacaagtcagcaaacatgg

SEQ ID NO: 839002 - DNA, 25 bp, Mus musculus
ttcagcaatgaaaatacccaagcag

SEQ ID NO: 839003 - DNA, 25 bp, Mus musculus
ttcagcaatgaatatacccaagcag

SEQ ID NO: 839004 - DNA, 25 bp, Mus musculus
ttcagcaccatcaagttaaaagcag

SEQ ID NO: 839005 - DNA, 25 bp, Mus musculus
ttcagcaccatctagttaaaagcag

SEQ ID NO: 839006 - DNA, 25 bp, Mus musculus
ttcagcaccgaaaaggagatcctgc

SEQ ID NO: 839007 - DNA, 25 bp, Mus musculus
ttcagcaccgaataggagatcctgc

SEQ ID NO: 839008 - DNA, 25 bp, Mus musculus
ttcagcacctccaacattgggccaa

SEQ ID NO: 839009 - DNA, 25 bp, Mus musculus
ttcagcacctcctacattgggccaa

SEQ ID NO: 839010 - DNA, 25 bp, Mus musculus
ttcagcacgaaacgacgcataccgg

SEQ ID NO: 839011 - DNA, 25 bp, Mus musculus
ttcagcacgaaaggacgcataccgg

SEQ ID NO: 839012 - DNA, 25 bp, Mus musculus
ttcagcactcgaaaacattcttggg

SEQ ID NO: 839013 - DNA, 25 bp, Mus musculus
ttcagcactcgataacattcttggg

SEQ ID NO: 839014 - DNA, 25 bp, Mus musculus
ttcagcactgccacaatctaaaagg

SEQ ID NO: 839015 - DNA, 25 bp, Mus musculus
ttcagcactgcctcaatctaaaagg

SEQ ID NO: 839016 - DNA, 25 bp, Mus musculus
ttcagcagataaagcgtctgacggg

SEQ ID NO: 839017 - DNA, 25 bp, Mus musculus
ttcagcagataatgcgtctgacggg

SEQ ID NO: 839018 - DNA, 25 bp, Mus musculus
ttcagcagggcactggtttgctgta

SEQ ID NO: 839019 - DNA, 25 bp, Mus musculus
ttcagcagggcagtggtttgctgta

SEQ ID NO: 839020 - DNA, 25 bp, Mus musculus
ttcagcataactcgatccacatatg

SEQ ID NO: 839021 - DNA, 25 bp, Mus musculus
ttcagcataactggatccacatatg

SEQ ID NO: 839022 - DNA, 25 bp, Mus musculus
ttcagcataagcaaggacacagctg

SEQ ID NO: 839023 - DNA, 25 bp, Mus musculus
ttcagcataagctaggacacagctg

SEQ ID NO: 839024 - DNA, 25 bp, Mus musculus
ttcagcatgaagaccctcatcgccg

SEQ ID NO: 839025 - DNA, 25 bp, Mus musculus
ttcagcatgaagtccctcatcgccg

SEQ ID NO: 839026 - DNA, 25 bp, Mus musculus
ttcagcatgatgcactgtggactgc

SEQ ID NO: 839027 - DNA, 25 bp, Mus musculus
ttcagcatgatggactgtggactgc

SEQ ID NO: 839028 - DNA, 25 bp, Mus musculus
ttcagcattgcactgcccatcctgg

SEQ ID NO: 839029 - DNA, 25 bp, Mus musculus
ttcagcattgcagtgcccatcctgg

SEQ ID NO: 839030 - DNA, 25 bp, Mus musculus
ttcagcattgtcagtgtaacggcct

SEQ ID NO: 839031 - DNA, 25 bp, Mus musculus
ttcagcattgtctgtgtaacggcct

SEQ ID NO: 839032 - DNA, 25 bp, Mus musculus
ttcagccaaagcaagcagctaaaga

SEQ ID NO: 839033 - DNA, 25 bp, Mus musculus
ttcagccaaagctagcagctaaaga

SEQ ID NO: 839034 - DNA, 25 bp, Mus musculus
ttcagccaacctatcatccaagcgg

SEQ ID NO: 839035 - DNA, 25 bp, Mus musculus
ttcagccaacctttcatccaagcgg

SEQ ID NO: 839036 - DNA, 25 bp, Mus musculus
ttcagccaatccagtgcaggctctc

SEQ ID NO: 839037 - DNA, 25 bp, Mus musculus
ttcagccaatcctgtgcaggctctc

SEQ ID NO: 839038 - DNA, 25 bp, Mus musculus
ttcagccacgtcaccagtctgagtc

SEQ ID NO: 839039 - DNA, 25 bp, Mus musculus
ttcagccacgtctccagtctgagtc

SEQ ID NO: 839040 - DNA, 25 bp, Mus musculus
ttcagccatcggcatgccagcggaa

SEQ ID NO: 839041 - DNA, 25 bp, Mus musculus
ttcagccatcgggatgccagcggaa

SEQ ID NO: 839042 - DNA, 25 bp, Mus musculus
ttcagccatgatcactgccatcttc

SEQ ID NO: 839043 - DNA, 25 bp, Mus musculus
ttcagccatgatgactgccatcttc

SEQ ID NO: 839044 - DNA, 25 bp, Mus musculus
ttcagcccagcacgctcagtagagg

SEQ ID NO: 839045 - DNA, 25 bp, Mus musculus
ttcagcccagcaggctcagtagagg

SEQ ID NO: 839046 - DNA, 25 bp, Mus musculus
ttcagccccaaacaacatcacagtg

SEQ ID NO: 839047 - DNA, 25 bp, Mus musculus
ttcagccccaaagaacatcacagtg

SEQ ID NO: 839048 - DNA, 25 bp, Mus musculus
ttcagccccaacagcaaacaaattg

SEQ ID NO: 839049 - DNA, 25 bp, Mus musculus
ttcagccccaactgcaaacaaattg

SEQ ID NO: 839050 - DNA, 25 bp, Mus musculus
ttcagccccgtaaaacagttccttg

SEQ ID NO: 839051 - DNA, 25 bp, Mus musculus
ttcagccccgtataacagttccttg

SEQ ID NO: 839052 - DNA, 25 bp, Mus musculus
ttcagccctgagaacacaaggaagg

SEQ ID NO: 839053 - DNA, 25 bp, Mus musculus
ttcagccctgagtacacaaggaagg

SEQ ID NO: 839054 - DNA, 25 bp, Mus musculus
ttcagccgagaccactcaaaaatct

SEQ ID NO: 839055 - DNA, 25 bp, Mus musculus
ttcagccgagacgactcaaaaatct

SEQ ID NO: 839056 - DNA, 25 bp, Mus musculus
ttcagccgcccacttacattagagg

SEQ ID NO: 839057 - DNA, 25 bp, Mus musculus
ttcagccgcccagttacattagagg

SEQ ID NO: 839058 - DNA, 25 bp, Mus musculus
ttcagccgctgtcatagcatctcct

SEQ ID NO: 839059 - DNA, 25 bp, Mus musculus
ttcagccgctgtgatagcatctcct

SEQ ID NO: 839060 - DNA, 25 bp, Mus musculus
ttcagccggcggatctattacagcg

SEQ ID NO: 839061 - DNA, 25 bp, Mus musculus
ttcagccggcggttctattacagcg

SEQ ID NO: 839062 - DNA, 25 bp, Mus musculus
ttcagccgggatcagctgtcacaga

SEQ ID NO: 839063 - DNA, 25 bp, Mus musculus
ttcagccgggatcttgcctggacca

SEQ ID NO: 839064 - DNA, 25 bp, Mus musculus
ttcagccgggatgagctgtcacaga

SEQ ID NO: 839065 - DNA, 25 bp, Mus musculus
ttcagccgggatgttgcctggacca

SEQ ID NO: 839066 - DNA, 25 bp, Mus musculus
ttcagcctcaccatcgcgtgcatgg

SEQ ID NO: 839067 - DNA, 25 bp, Mus musculus
ttcagcctcaccttcgcgtgcatgg

SEQ ID NO: 839068 - DNA, 25 bp, Mus musculus
ttcagcctgatgcatatgagcaaac

SEQ ID NO: 839069 - DNA, 25 bp, Mus musculus
ttcagcctgatggatatgagcaaac

SEQ ID NO: 839070 - DNA, 25 bp, Mus musculus
ttcagcctgtgtctctacccagcgg

SEQ ID NO: 839071 - DNA, 25 bp, Mus musculus
ttcagcctgtgtgtctacccagcgg

SEQ ID NO: 839072 - DNA, 25 bp, Mus musculus
ttcagccttaggaaacactctggtc

SEQ ID NO: 839073 - DNA, 25 bp, Mus musculus
ttcagccttaggtaacactctggtc

SEQ ID NO: 839074 - DNA, 25 bp, Mus musculus
ttcagcgaagaacccaacaggaggt

SEQ ID NO: 839075 - DNA, 25 bp, Mus musculus
ttcagcgaagaagccaacaggaggt

SEQ ID NO: 839076 - DNA, 25 bp, Mus musculus
ttcagcgcagcaaggacatggtgtg

SEQ ID NO: 839077 - DNA, 25 bp, Mus musculus
ttcagcgcagcatggacatggtgtg

SEQ ID NO: 839078 - DNA, 25 bp, Mus musculus
ttcagcgccagcaactcgactatgg

SEQ ID NO: 839079 - DNA, 25 bp, Mus musculus
ttcagcgccagctactcgactatgg

SEQ ID NO: 839080 - DNA, 25 bp, Mus musculus
ttcagcgcctctcgagacaagacag

SEQ ID NO: 839081 - DNA, 25 bp, Mus musculus
ttcagcgcctctggagacaagacag

SEQ ID NO: 839082 - DNA, 25 bp, Mus musculus
ttcagcgctggtcaaatacaaagca

SEQ ID NO: 839083 - DNA, 25 bp, Mus musculus
ttcagcgctggtgaaatacaaagca

SEQ ID NO: 839084 - DNA, 25 bp, Mus musculus
ttcagcggaaacatgcggcaaattt

SEQ ID NO: 839085 - DNA, 25 bp, Mus musculus
ttcagcggaaacttgcggcaaattt

SEQ ID NO: 839086 - DNA, 25 bp, Mus musculus
ttcagcggaaagagatctgcatccc

SEQ ID NO: 839087 - DNA, 25 bp, Mus musculus
ttcagcggaaagtgatctgcatccc

SEQ ID NO: 839088 - DNA, 25 bp, Mus musculus
ttcagcggcatcacctataacctgg

SEQ ID NO: 839089 - DNA, 25 bp, Mus musculus
ttcagcggcatccatgatcatctca

SEQ ID NO: 839090 - DNA, 25 bp, Mus musculus
ttcagcggcatcgatgatcatctca

SEQ ID NO: 839091 - DNA, 25 bp, Mus musculus
ttcagcggcatctcctataacctgg

SEQ ID NO: 839092 - DNA, 25 bp, Mus musculus
ttcagcgggcacctcaatttccaga

SEQ ID NO: 839093 - DNA, 25 bp, Mus musculus
ttcagcgggcacgtcaatttccaga

SEQ ID NO: 839094 - DNA, 25 bp, Mus musculus
ttcagcgtcccaattgtctatgaga

SEQ ID NO: 839095 - DNA, 25 bp, Mus musculus
ttcagcgtcccatttgtctatgaga

SEQ ID NO: 839096 - DNA, 25 bp, Mus musculus
ttcagcgtgatgagcgtggacgcca

SEQ ID NO: 839097 - DNA, 25 bp, Mus musculus
ttcagcgtgatgtgcgtggacgcca

SEQ ID NO: 839098 - DNA, 25 bp, Mus musculus
ttcagctaccagcacgccattgaag

SEQ ID NO: 839099 - DNA, 25 bp, Mus musculus
ttcagctaccaggacgccattgaag

SEQ ID NO: 839100 - DNA, 25 bp, Mus musculus
ttcagctatcctaaactgttgtctc

SEQ ID NO: 839101 - DNA, 25 bp, Mus musculus
ttcagctatccttaactgttgtctc

SEQ ID NO: 839102 - DNA, 25 bp, Mus musculus
ttcagctcagttcttcaactacaag

SEQ ID NO: 839103 - DNA, 25 bp, Mus musculus
ttcagctcagttgttcaactacaag

SEQ ID NO: 839104 - DNA, 25 bp, Mus musculus
ttcagctccaaaacctgcacagaca

SEQ ID NO: 839105 - DNA, 25 bp, Mus musculus
ttcagctccaaatcctgcacagaca

SEQ ID NO: 839106 - DNA, 25 bp, Mus musculus
ttcagctccaccatcgtccatgtgg

SEQ ID NO: 839107 - DNA, 25 bp, Mus musculus
ttcagctccaccttcgtccatgtgg

SEQ ID NO: 839108 - DNA, 25 bp, Mus musculus
ttcagctccagaaggctaggctgcc

SEQ ID NO: 839109 - DNA, 25 bp, Mus musculus
ttcagctccagatggctaggctgcc

SEQ ID NO: 839110 - DNA, 25 bp, Mus musculus
ttcagctccccgagtggagataagt

SEQ ID NO: 839111 - DNA, 25 bp, Mus musculus
ttcagctccccgtgtggagataagt

SEQ ID NO: 839112 - DNA, 25 bp, Mus musculus
ttcagctcccgaacccagggcatga

SEQ ID NO: 839113 - DNA, 25 bp, Mus musculus
ttcagctcccgatcccagggcatga

SEQ ID NO: 839114 - DNA, 25 bp, Mus musculus
ttcagctccctgactttctgaaaga

SEQ ID NO: 839115 - DNA, 25 bp, Mus musculus
ttcagctccctgtctttctgaaaga

SEQ ID NO: 839116 - DNA, 25 bp, Mus musculus
ttcagctctcaccttataacctcag

SEQ ID NO: 839117 - DNA, 25 bp, Mus musculus
ttcagctctcacgttataacctcag

SEQ ID NO: 839118 - DNA, 25 bp, Mus musculus
ttcagctgaatgcactgaagcccag

SEQ ID NO: 839119 - DNA, 25 bp, Mus musculus
ttcagctgaatggactgaagcccag

SEQ ID NO: 839120 - DNA, 25 bp, Mus musculus
ttcagctgcatcctactctacattg

SEQ ID NO: 839121 - DNA, 25 bp, Mus musculus
ttcagctgcatcgtactctacattg

SEQ ID NO: 839122 - DNA, 25 bp, Mus musculus
ttcagctgccgaaagctccgggaga

SEQ ID NO: 839123 - DNA, 25 bp, Mus musculus
ttcagctgccgatagctccgggaga

SEQ ID NO: 839124 - DNA, 25 bp, Mus musculus
ttcagctgctgaatgaacatgaccc

SEQ ID NO: 839125 - DNA, 25 bp, Mus musculus
ttcagctgctgattgaacatgaccc

SEQ ID NO: 839126 - DNA, 25 bp, Mus musculus
ttcagctggagcatcgaggaccgtc

SEQ ID NO: 839127 - DNA, 25 bp, Mus musculus
ttcagctggagcttcgaggaccgtc

SEQ ID NO: 839128 - DNA, 25 bp, Mus musculus
ttcagctgtggacgccgtgtcagcc

SEQ ID NO: 839129 - DNA, 25 bp, Mus musculus
ttcagctgtggaggccgtgtcagcc

SEQ ID NO: 839130 - DNA, 25 bp, Mus musculus
ttcagcttcctcatgggcatgaccg

SEQ ID NO: 839131 - DNA, 25 bp, Mus musculus
ttcagcttcctcttgggcatgaccg

SEQ ID NO: 839132 - DNA, 25 bp, Mus musculus
ttcagcttcgagatcccctttgagc

SEQ ID NO: 839133 - DNA, 25 bp, Mus musculus
ttcagcttcgagttcccctttgagc

SEQ ID NO: 839134 - DNA, 25 bp, Mus musculus
ttcagcttgagcatcaacctccaca

SEQ ID NO: 839135 - DNA, 25 bp, Mus musculus
ttcagcttgagcttcaacctccaca

SEQ ID NO: 839136 - DNA, 25 bp, Mus musculus
ttcagcttgtacagccgagtccagg

SEQ ID NO: 839137 - DNA, 25 bp, Mus musculus
ttcagcttgtactgccgagtccagg

SEQ ID NO: 839138 - DNA, 25 bp, Mus musculus
ttcagctttagaaacacactggaag

SEQ ID NO: 839139 - DNA, 25 bp, Mus musculus
ttcagctttagatacacactggaag

SEQ ID NO: 839140 - DNA, 25 bp, Mus musculus
ttcagctttcggcacagcagcggca

SEQ ID NO: 839141 - DNA, 25 bp, Mus musculus
ttcagctttcgggacagcagcggca

SEQ ID NO: 839142 - DNA, 25 bp, Mus musculus
ttcaggaacgagctggctgttttgc

SEQ ID NO: 839143 - DNA, 25 bp, Mus musculus
ttcaggaacgaggtggctgttttgc

SEQ ID NO: 839144 - DNA, 25 bp, Mus musculus
ttcaggaacgtcacctgataacact

SEQ ID NO: 839145 - DNA, 25 bp, Mus musculus
ttcaggaacgtctcctgataacact

SEQ ID NO: 839146 - DNA, 25 bp, Mus musculus
ttcaggaactatacctcgcccacaa

SEQ ID NO: 839147 - DNA, 25 bp, Mus musculus
ttcaggaactattcctcgcccacaa

SEQ ID NO: 839148 - DNA, 25 bp, Mus musculus
ttcaggaactggaagataagaaaga

SEQ ID NO: 839149 - DNA, 25 bp, Mus musculus
ttcaggaactggtagataagaaaga

SEQ ID NO: 839150 - DNA, 25 bp, Mus musculus
ttcaggaagaatctgttacttttcg

SEQ ID NO: 839151 - DNA, 25 bp, Mus musculus
ttcaggaagaatgtgttacttttcg

SEQ ID NO: 839152 - DNA, 25 bp, Mus musculus
ttcaggaagataccaccaagtgtcc

SEQ ID NO: 839153 - DNA, 25 bp, Mus musculus
ttcaggaagatagcaccaagtgtcc

SEQ ID NO: 839154 - DNA, 25 bp, Mus musculus
ttcaggaattcccacagagggcagt

SEQ ID NO: 839155 - DNA, 25 bp, Mus musculus
ttcaggaattccgacagagggcagt

SEQ ID NO: 839156 - DNA, 25 bp, Mus musculus
ttcaggacagacatagaaacagaag

SEQ ID NO: 839157 - DNA, 25 bp, Mus musculus
ttcaggacagacttagaaacagaag

SEQ ID NO: 839158 - DNA, 25 bp, Mus musculus
ttcaggaccgtcaccatggagttgt

SEQ ID NO: 839159 - DNA, 25 bp, Mus musculus
ttcaggaccgtctccatggagttgt

SEQ ID NO: 839160 - DNA, 25 bp, Mus musculus
ttcaggactcgcaacgttttcattg

SEQ ID NO: 839161 - DNA, 25 bp, Mus musculus
ttcaggactcgctacgttttcattg

SEQ ID NO: 839162 - DNA, 25 bp, Mus musculus
ttcaggagacacactggctgctact

SEQ ID NO: 839163 - DNA, 25 bp, Mus musculus
ttcaggagacactctggctgctact

SEQ ID NO: 839164 - DNA, 25 bp, Mus musculus
ttcaggagacatccgtaaagcgctg

SEQ ID NO: 839165 - DNA, 25 bp, Mus musculus
ttcaggagacatgcgtaaagcgctg

SEQ ID NO: 839166 - DNA, 25 bp, Mus musculus
ttcaggagcaacatcaagaccatgt

SEQ ID NO: 839167 - DNA, 25 bp, Mus musculus
ttcaggagcaacttcaagaccatgt

SEQ ID NO: 839168 - DNA, 25 bp, Mus musculus
ttcaggagccacacaaagcagcaac

SEQ ID NO: 839169 - DNA, 25 bp, Mus musculus
ttcaggagccactcaaagcagcaac

SEQ ID NO: 839170 - DNA, 25 bp, Mus musculus
ttcaggagctgtcgtgggatcacac

SEQ ID NO: 839171 - DNA, 25 bp, Mus musculus
ttcaggagctgtggtgggatcacac

SEQ ID NO: 839172 - DNA, 25 bp, Mus musculus
ttcaggaggagacccatcacctggt

SEQ ID NO: 839173 - DNA, 25 bp, Mus musculus
ttcaggaggagagccatcacctggt

SEQ ID NO: 839174 - DNA, 25 bp, Mus musculus
ttcaggaggtatacaaccagttcag

SEQ ID NO: 839175 - DNA, 25 bp, Mus musculus
ttcaggaggtattcaaccagttcag

SEQ ID NO: 839176 - DNA, 25 bp, Mus musculus
ttcaggagttggagcagtgctcctc

SEQ ID NO: 839177 - DNA, 25 bp, Mus musculus
ttcaggagttggtgcagtgctcctc

SEQ ID NO: 839178 - DNA, 25 bp, Mus musculus
ttcaggatcagccagaccaacctgt

SEQ ID NO: 839179 - DNA, 25 bp, Mus musculus
ttcaggatcagcgagaccaacctgt

SEQ ID NO: 839180 - DNA, 25 bp, Mus musculus
ttcaggatcgtcacgggttggagcc

SEQ ID NO: 839181 - DNA, 25 bp, Mus musculus
ttcaggatcgtctcgggttggagcc

SEQ ID NO: 839182 - DNA, 25 bp, Mus musculus
ttcaggatctcaagcccatctctcg

SEQ ID NO: 839183 - DNA, 25 bp, Mus musculus
ttcaggatctcatgcccatctctcg

SEQ ID NO: 839184 - DNA, 25 bp, Mus musculus
ttcaggatgatgcaggcaccgctca

SEQ ID NO: 839185 - DNA, 25 bp, Mus musculus
ttcaggatgatggaggcaccgctca

SEQ ID NO: 839186 - DNA, 25 bp, Mus musculus
ttcaggatggaacgtagagagacac

SEQ ID NO: 839187 - DNA, 25 bp, Mus musculus
ttcaggatggaaggtagagagacac

SEQ ID NO: 839188 - DNA, 25 bp, Mus musculus
ttcaggattacacaacacctcccag

SEQ ID NO: 839189 - DNA, 25 bp, Mus musculus
ttcaggattacagaacacctcccag

SEQ ID NO: 839190 - DNA, 25 bp, Mus musculus
ttcaggattttgatgcatgcagggc

SEQ ID NO: 839191 - DNA, 25 bp, Mus musculus
ttcaggattttgttgcatgcagggc

SEQ ID NO: 839192 - DNA, 25 bp, Mus musculus
ttcaggcaacgtcttctaccatggg

SEQ ID NO: 839193 - DNA, 25 bp, Mus musculus
ttcaggcaacgtgttctaccatggg

SEQ ID NO: 839194 - DNA, 25 bp, Mus musculus
ttcaggcaagaacgcggtcagcaac

SEQ ID NO: 839195 - DNA, 25 bp, Mus musculus
ttcaggcaagaaggcggtcagcaac

SEQ ID NO: 839196 - DNA, 25 bp, Mus musculus
ttcaggcaagagcatgttgaggacc

SEQ ID NO: 839197 - DNA, 25 bp, Mus musculus
ttcaggcaagaggatgttgaggacc

SEQ ID NO: 839198 - DNA, 25 bp, Mus musculus
ttcaggcactggcacctcgaggtgt

SEQ ID NO: 839199 - DNA, 25 bp, Mus musculus
ttcaggcactgggacctcgaggtgt

SEQ ID NO: 839200 - DNA, 25 bp, Mus musculus
ttcaggcagagcattagaaggcccg

SEQ ID NO: 839201 - DNA, 25 bp, Mus musculus
ttcaggcagagctttagaaggcccg

SEQ ID NO: 839202 - DNA, 25 bp, Mus musculus
ttcaggcagatgcattggcagtcct

SEQ ID NO: 839203 - DNA, 25 bp, Mus musculus
ttcaggcagatggattggcagtcct

SEQ ID NO: 839204 - DNA, 25 bp, Mus musculus
ttcaggcagcttctccctgaggtcc

SEQ ID NO: 839205 - DNA, 25 bp, Mus musculus
ttcaggcagcttgtccctgaggtcc

SEQ ID NO: 839206 - DNA, 25 bp, Mus musculus
ttcaggcagttgacgctgggctcca

SEQ ID NO: 839207 - DNA, 25 bp, Mus musculus
ttcaggcagttgtcgctgggctcca

SEQ ID NO: 839208 - DNA, 25 bp, Mus musculus
ttcaggccatctccggagagaagaa

SEQ ID NO: 839209 - DNA, 25 bp, Mus musculus
ttcaggccatctgcggagagaagaa

SEQ ID NO: 839210 - DNA, 25 bp, Mus musculus
ttcaggcctaaccaacaagtgtctt

SEQ ID NO: 839211 - DNA, 25 bp, Mus musculus
ttcaggcctaacgaacaagtgtctt

SEQ ID NO: 839212 - DNA, 25 bp, Mus musculus
ttcaggcctttgaaggccgggatgc

SEQ ID NO: 839213 - DNA, 25 bp, Mus musculus
ttcaggcctttgtaggccgggatgc

SEQ ID NO: 839214 - DNA, 25 bp, Mus musculus
ttcaggcgaaacagcgatctgcggc

SEQ ID NO: 839215 - DNA, 25 bp, Mus musculus
ttcaggcgaaactgcgatctgcggc

SEQ ID NO: 839216 - DNA, 25 bp, Mus musculus
ttcaggctcatgaggcccctgtcgt

SEQ ID NO: 839217 - DNA, 25 bp, Mus musculus
ttcaggctcatgtggcccctgtcgt

SEQ ID NO: 839218 - DNA, 25 bp, Mus musculus
ttcaggctctccactgtccttcggt

SEQ ID NO: 839219 - DNA, 25 bp, Mus musculus
ttcaggctctcctctgtccttcggt

SEQ ID NO: 839220 - DNA, 25 bp, Mus musculus
ttcaggctctggaactccacacact

SEQ ID NO: 839221 - DNA, 25 bp, Mus musculus
ttcaggctctggtactccacacact

SEQ ID NO: 839222 - DNA, 25 bp, Mus musculus
ttcaggctgagaacatggaggctgc

SEQ ID NO: 839223 - DNA, 25 bp, Mus musculus
ttcaggctgagatcatggaggctgc

SEQ ID NO: 839224 - DNA, 25 bp, Mus musculus
ttcagggaacgaccgagcacattct

SEQ ID NO: 839225 - DNA, 25 bp, Mus musculus
ttcagggaacgagcgagcacattct

SEQ ID NO: 839226 - DNA, 25 bp, Mus musculus
ttcagggaatccaaaactatcacag

SEQ ID NO: 839227 - DNA, 25 bp, Mus musculus
ttcagggaatcctaaactatcacag

SEQ ID NO: 839228 - DNA, 25 bp, Mus musculus
ttcagggactccagtgctcgcttct

SEQ ID NO: 839229 - DNA, 25 bp, Mus musculus
ttcagggactcctgtgctcgcttct

SEQ ID NO: 839230 - DNA, 25 bp, Mus musculus
ttcagggagcggagtctctctcgca

SEQ ID NO: 839231 - DNA, 25 bp, Mus musculus
ttcagggagcggtgtctctctcgca

SEQ ID NO: 839232 - DNA, 25 bp, Mus musculus
ttcagggagggacattaaaaagcga

SEQ ID NO: 839233 - DNA, 25 bp, Mus musculus
ttcagggagggagattaaaaagcga

SEQ ID NO: 839234 - DNA, 25 bp, Mus musculus
ttcagggatccaccagttactcggt

SEQ ID NO: 839235 - DNA, 25 bp, Mus musculus
ttcagggatccagcagttactcggt

SEQ ID NO: 839236 - DNA, 25 bp, Mus musculus
ttcagggcagcaacggtgacaagag

SEQ ID NO: 839237 - DNA, 25 bp, Mus musculus
ttcagggcagcatcggtgacaagag

SEQ ID NO: 839238 - DNA, 25 bp, Mus musculus
ttcagggcatcgctattgatcagct

SEQ ID NO: 839239 - DNA, 25 bp, Mus musculus
ttcagggcatcggtattgatcagct

SEQ ID NO: 839240 - DNA, 25 bp, Mus musculus
ttcagggccacgcactttgaccact

SEQ ID NO: 839241 - DNA, 25 bp, Mus musculus
ttcagggccacggactttgaccact

SEQ ID NO: 839242 - DNA, 25 bp, Mus musculus
ttcagggccattaacatgccccaga

SEQ ID NO: 839243 - DNA, 25 bp, Mus musculus
ttcagggccatttacatgccccaga

SEQ ID NO: 839244 - DNA, 25 bp, Mus musculus
ttcagggccctgaagaagactgctg

SEQ ID NO: 839245 - DNA, 25 bp, Mus musculus
ttcagggccctgtagaagactgctg

SEQ ID NO: 839246 - DNA, 25 bp, Mus musculus
ttcagggcctgactgcaacgccaaa

SEQ ID NO: 839247 - DNA, 25 bp, Mus musculus
ttcagggcctgagtgcaacgccaaa

SEQ ID NO: 839248 - DNA, 25 bp, Mus musculus
ttcagggtccagcaactcaggatcc

SEQ ID NO: 839249 - DNA, 25 bp, Mus musculus
ttcagggtccaggaactcaggatcc

SEQ ID NO: 839250 - DNA, 25 bp, Mus musculus
ttcagggtcctcaaagacagcagcc

SEQ ID NO: 839251 - DNA, 25 bp, Mus musculus
ttcagggtcctctaagacagcagcc

SEQ ID NO: 839252 - DNA, 25 bp, Mus musculus
ttcagggtttagaaaatccaattca

SEQ ID NO: 839253 - DNA, 25 bp, Mus musculus
ttcagggtttagtaaatccaattca

SEQ ID NO: 839254 - DNA, 25 bp, Mus musculus
ttcaggtaaaggatgccccagccgt

SEQ ID NO: 839255 - DNA, 25 bp, Mus musculus
ttcaggtaaaggttgccccagccgt

SEQ ID NO: 839256 - DNA, 25 bp, Mus musculus
ttcaggtactggcacattaggttct

SEQ ID NO: 839257 - DNA, 25 bp, Mus musculus
ttcaggtactgggacattaggttct

SEQ ID NO: 839258 - DNA, 25 bp, Mus musculus
ttcaggtagagcagttcctggcgga

SEQ ID NO: 839259 - DNA, 25 bp, Mus musculus
ttcaggtagagctgttcctggcgga

SEQ ID NO: 839260 - DNA, 25 bp, Mus musculus
ttcaggtagcctcatggcagcggcc

SEQ ID NO: 839261 - DNA, 25 bp, Mus musculus
ttcaggtagcctgatggcagcggcc

SEQ ID NO: 839262 - DNA, 25 bp, Mus musculus
ttcaggtgcaaaccactaaccctca

SEQ ID NO: 839263 - DNA, 25 bp, Mus musculus
ttcaggtgcaaagcactaaccctca

SEQ ID NO: 839264 - DNA, 25 bp, Mus musculus
ttcaggtgcctcaacttttccagtg

SEQ ID NO: 839265 - DNA, 25 bp, Mus musculus
ttcaggtgcctctacttttccagtg

SEQ ID NO: 839266 - DNA, 25 bp, Mus musculus
ttcaggtgtagaatggaaaaactgt

SEQ ID NO: 839267 - DNA, 25 bp, Mus musculus
ttcaggtgtagattggaaaaactgt

SEQ ID NO: 839268 - DNA, 25 bp, Mus musculus
ttcaggtgtcaaagcctgggctgag

SEQ ID NO: 839269 - DNA, 25 bp, Mus musculus
ttcaggtgtcaatgcctgggctgag

SEQ ID NO: 839270 - DNA, 25 bp, Mus musculus
ttcaggtgtcagactccacctacga

SEQ ID NO: 839271 - DNA, 25 bp, Mus musculus
ttcaggtgtcagtctccacctacga

SEQ ID NO: 839272 - DNA, 25 bp, Mus musculus
ttcaggttagctcgatgagccccac

SEQ ID NO: 839273 - DNA, 25 bp, Mus musculus
ttcaggttagctggatgagccccac

SEQ ID NO: 839274 - DNA, 25 bp, Mus musculus
ttcaggttctgaagagtctcatgtg

SEQ ID NO: 839275 - DNA, 25 bp, Mus musculus
ttcaggttctgatgagtctcatgtg

SEQ ID NO: 839276 - DNA, 25 bp, Mus musculus
ttcagtaccagtctctaccagccaa

SEQ ID NO: 839277 - DNA, 25 bp, Mus musculus
ttcagtaccagtgtctaccagccaa

SEQ ID NO: 839278 - DNA, 25 bp, Mus musculus
ttcagtaccgcaaaggctgcagcca

SEQ ID NO: 839279 - DNA, 25 bp, Mus musculus
ttcagtaccgcataggctgcagcca

SEQ ID NO: 839280 - DNA, 25 bp, Mus musculus
ttcagtaccgccagctagacaggaa

SEQ ID NO: 839281 - DNA, 25 bp, Mus musculus
ttcagtaccgcctgctagacaggaa

SEQ ID NO: 839282 - DNA, 25 bp, Mus musculus
ttcagtagacaaacactcctggtgt

SEQ ID NO: 839283 - DNA, 25 bp, Mus musculus
ttcagtagacaatcactcctggtgt

SEQ ID NO: 839284 - DNA, 25 bp, Mus musculus
ttcagtatcctgctgagcaactggg

SEQ ID NO: 839285 - DNA, 25 bp, Mus musculus
ttcagtatcctggtgagcaactggg

SEQ ID NO: 839286 - DNA, 25 bp, Mus musculus
ttcagtatgaaaccagcgagccagc

SEQ ID NO: 839287 - DNA, 25 bp, Mus musculus
ttcagtatgaaagcagcgagccagc

SEQ ID NO: 839288 - DNA, 25 bp, Mus musculus
ttcagtcaccagctagagcgcagct

SEQ ID NO: 839289 - DNA, 25 bp, Mus musculus
ttcagtcaccaggtagagcgcagct

SEQ ID NO: 839290 - DNA, 25 bp, Mus musculus
ttcagtcagcggaacgccaagatcc

SEQ ID NO: 839291 - DNA, 25 bp, Mus musculus
ttcagtcagcggtacgccaagatcc

SEQ ID NO: 839292 - DNA, 25 bp, Mus musculus
ttcagtcagctcagccccagtggtc

SEQ ID NO: 839293 - DNA, 25 bp, Mus musculus
ttcagtcagctctgccccagtggtc

SEQ ID NO: 839294 - DNA, 25 bp, Mus musculus
ttcagtcagtaacagcccggattat

SEQ ID NO: 839295 - DNA, 25 bp, Mus musculus
ttcagtcagtaagagcccggattat

SEQ ID NO: 839296 - DNA, 25 bp, Mus musculus
ttcagtccaggcaccctgtgacagc

SEQ ID NO: 839297 - DNA, 25 bp, Mus musculus
ttcagtccaggctccctgtgacagc

SEQ ID NO: 839298 - DNA, 25 bp, Mus musculus
ttcagtccatcaacggcttgcagcg

SEQ ID NO: 839299 - DNA, 25 bp, Mus musculus
ttcagtccatcatcggcttgcagcg

SEQ ID NO: 839300 - DNA, 25 bp, Mus musculus
ttcagtccatctccaatgctctggg

SEQ ID NO: 839301 - DNA, 25 bp, Mus musculus
ttcagtccatctgcaatgctctggg

SEQ ID NO: 839302 - DNA, 25 bp, Mus musculus
ttcagtccctatcactacagccagt

SEQ ID NO: 839303 - DNA, 25 bp, Mus musculus
ttcagtccctatgactacagccagt

SEQ ID NO: 839304 - DNA, 25 bp, Mus musculus
ttcagtccgggtaccagcctgttgc

SEQ ID NO: 839305 - DNA, 25 bp, Mus musculus
ttcagtccgggttccagcctgttgc

SEQ ID NO: 839306 - DNA, 25 bp, Mus musculus
ttcagtcctgcgcattgcattttac

SEQ ID NO: 839307 - DNA, 25 bp, Mus musculus
ttcagtcctgcggattgcattttac

SEQ ID NO: 839308 - DNA, 25 bp, Mus musculus
ttcagtctccggcacagcaaggagg

SEQ ID NO: 839309 - DNA, 25 bp, Mus musculus
ttcagtctccgggacagcaaggagg

SEQ ID NO: 839310 - DNA, 25 bp, Mus musculus
ttcagtctcctcatgttttatcgag

SEQ ID NO: 839311 - DNA, 25 bp, Mus musculus
ttcagtctcctcttgttttatcgag

SEQ ID NO: 839312 - DNA, 25 bp, Mus musculus
ttcagtctgataacagcatgtgaac

SEQ ID NO: 839313 - DNA, 25 bp, Mus musculus
ttcagtctgatatcagcatgtgaac

SEQ ID NO: 839314 - DNA, 25 bp, Mus musculus
ttcagtgacacgaaggaagcatccc

SEQ ID NO: 839315 - DNA, 25 bp, Mus musculus
ttcagtgacacgtaggaagcatccc

SEQ ID NO: 839316 - DNA, 25 bp, Mus musculus
ttcagtgaccctactcccaaattcg

SEQ ID NO: 839317 - DNA, 25 bp, Mus musculus
ttcagtgacccttctcccaaattcg

SEQ ID NO: 839318 - DNA, 25 bp, Mus musculus
ttcagtgagcgccacgttatggcca

SEQ ID NO: 839319 - DNA, 25 bp, Mus musculus
ttcagtgagcgcgacgttatggcca

SEQ ID NO: 839320 - DNA, 25 bp, Mus musculus
ttcagtgcaaagagccacatccagg

SEQ ID NO: 839321 - DNA, 25 bp, Mus musculus
ttcagtgcaaagtgccacatccagg

SEQ ID NO: 839322 - DNA, 25 bp, Mus musculus
ttcagtgcagtcagccattccccag

SEQ ID NO: 839323 - DNA, 25 bp, Mus musculus
ttcagtgcagtctgccattccccag

SEQ ID NO: 839324 - DNA, 25 bp, Mus musculus
ttcagtgcatgcaacacctggtacc

SEQ ID NO: 839325 - DNA, 25 bp, Mus musculus
ttcagtgcatgctacacctggtacc

SEQ ID NO: 839326 - DNA, 25 bp, Mus musculus
ttcagtgccaacagggtcgtgggca

SEQ ID NO: 839327 - DNA, 25 bp, Mus musculus
ttcagtgccaactgggtcgtgggca

SEQ ID NO: 839328 - DNA, 25 bp, Mus musculus
ttcagtgcgatgaagtacgagcagg

SEQ ID NO: 839329 - DNA, 25 bp, Mus musculus
ttcagtgcgatgtagtacgagcagg

SEQ ID NO: 839330 - DNA, 25 bp, Mus musculus
ttcagtgcgccccaggaattgaact

SEQ ID NO: 839331 - DNA, 25 bp, Mus musculus
ttcagtgcgcccgaggaattgaact

SEQ ID NO: 839332 - DNA, 25 bp, Mus musculus
ttcagtgctacgcagcccaaggcca

SEQ ID NO: 839333 - DNA, 25 bp, Mus musculus
ttcagtgctacggagcccaaggcca

SEQ ID NO: 839334 - DNA, 25 bp, Mus musculus
ttcagtggaataaactaccctgtgg

SEQ ID NO: 839335 - DNA, 25 bp, Mus musculus
ttcagtggaatatactaccctgtgg

SEQ ID NO: 839336 - DNA, 25 bp, Mus musculus
ttcagtggacaacggctgtgcgccc

SEQ ID NO: 839337 - DNA, 25 bp, Mus musculus
ttcagtggacaagggctgtgcgccc

SEQ ID NO: 839338 - DNA, 25 bp, Mus musculus
ttcagtggaggacatgcaaactgag

SEQ ID NO: 839339 - DNA, 25 bp, Mus musculus
ttcagtggaggagatgcaaactgag

SEQ ID NO: 839340 - DNA, 25 bp, Mus musculus
ttcagtggaggcaacagaaacccgg

SEQ ID NO: 839341 - DNA, 25 bp, Mus musculus
ttcagtggaggctacagaaacccgg

SEQ ID NO: 839342 - DNA, 25 bp, Mus musculus
ttcagtggcaacctgctggttagcc

SEQ ID NO: 839343 - DNA, 25 bp, Mus musculus
ttcagtggcaacgtgctggttagcc

SEQ ID NO: 839344 - DNA, 25 bp, Mus musculus
ttcagtggcataccagacaatgttg

SEQ ID NO: 839345 - DNA, 25 bp, Mus musculus
ttcagtggcatagcagacaatgttg

SEQ ID NO: 839346 - DNA, 25 bp, Mus musculus
ttcagtggctacagcagcgtgccag

SEQ ID NO: 839347 - DNA, 25 bp, Mus musculus
ttcagtggctactgcagcgtgccag

SEQ ID NO: 839348 - DNA, 25 bp, Mus musculus
ttcagtgtaacacggaagcaggtcc

SEQ ID NO: 839349 - DNA, 25 bp, Mus musculus
ttcagtgtaacagggaagcaggtcc

SEQ ID NO: 839350 - DNA, 25 bp, Mus musculus
ttcagtgtactacgaacattttacc

SEQ ID NO: 839351 - DNA, 25 bp, Mus musculus
ttcagtgtactaggaacattttacc

SEQ ID NO: 839352 - DNA, 25 bp, Mus musculus
ttcagtgtggctcccaacgtccggg

SEQ ID NO: 839353 - DNA, 25 bp, Mus musculus
ttcagtgtggctgccaacgtccggg

SEQ ID NO: 839354 - DNA, 25 bp, Mus musculus
ttcagttaagagatagagatcatcc

SEQ ID NO: 839355 - DNA, 25 bp, Mus musculus
ttcagttaagagttagagatcatcc

SEQ ID NO: 839356 - DNA, 25 bp, Mus musculus
ttcagttatgaactagctaggaaaa

SEQ ID NO: 839357 - DNA, 25 bp, Mus musculus
ttcagttatgaagtagctaggaaaa

SEQ ID NO: 839358 - DNA, 25 bp, Mus musculus
ttcagttcccttcttgattgccaag

SEQ ID NO: 839359 - DNA, 25 bp, Mus musculus
ttcagttcccttgttgattgccaag

SEQ ID NO: 839360 - DNA, 25 bp, Mus musculus
ttcagttctcaacccattccagatg

SEQ ID NO: 839361 - DNA, 25 bp, Mus musculus
ttcagttctcaagccattccagatg

SEQ ID NO: 839362 - DNA, 25 bp, Mus musculus
ttcagttgtctgcagcgccaccctg

SEQ ID NO: 839363 - DNA, 25 bp, Mus musculus
ttcagttgtctggagcgccaccctg

SEQ ID NO: 839364 - DNA, 25 bp, Mus musculus
ttcagtttccaaaatggctacggat

SEQ ID NO: 839365 - DNA, 25 bp, Mus musculus
ttcagtttccaatatggctacggat

SEQ ID NO: 839366 - DNA, 25 bp, Mus musculus
ttcagtttccctacccaatgtaatt

SEQ ID NO: 839367 - DNA, 25 bp, Mus musculus
ttcagtttcccttcccaatgtaatt

SEQ ID NO: 839368 - DNA, 25 bp, Mus musculus
ttcagtttctcacaaaccctttgag

SEQ ID NO: 839369 - DNA, 25 bp, Mus musculus
ttcagtttctcagaaaccctttgag

SEQ ID NO: 839370 - DNA, 25 bp, Mus musculus
ttcataaaaccaaagtctcaagcct

SEQ ID NO: 839371 - DNA, 25 bp, Mus musculus
ttcataaaaccatagtctcaagcct

SEQ ID NO: 839372 - DNA, 25 bp, Mus musculus
ttcataaaagaacccatgcaaatca

SEQ ID NO: 839373 - DNA, 25 bp, Mus musculus
ttcataaaagaagccatgcaaatca

SEQ ID NO: 839374 - DNA, 25 bp, Mus musculus
ttcataacggatactaacggaagac

SEQ ID NO: 839375 - DNA, 25 bp, Mus musculus
ttcataacggattctaacggaagac

SEQ ID NO: 839376 - DNA, 25 bp, Mus musculus
ttcataactggcaaagtgagttcca

SEQ ID NO: 839377 - DNA, 25 bp, Mus musculus
ttcataactggctaagtgagttcca

SEQ ID NO: 839378 - DNA, 25 bp, Mus musculus
ttcatacaaggtcggtgattatcac

SEQ ID NO: 839379 - DNA, 25 bp, Mus musculus
ttcatacaaggtgggtgattatcac

SEQ ID NO: 839380 - DNA, 25 bp, Mus musculus
ttcatacccgagatagccccaaatg

SEQ ID NO: 839381 - DNA, 25 bp, Mus musculus
ttcatacccgagttagccccaaatg

SEQ ID NO: 839382 - DNA, 25 bp, Mus musculus
ttcatacctcagcaagaactagttg

SEQ ID NO: 839383 - DNA, 25 bp, Mus musculus
ttcatacctcagctgctgtcacggc

SEQ ID NO: 839384 - DNA, 25 bp, Mus musculus
ttcatacctcaggaagaactagttg

SEQ ID NO: 839385 - DNA, 25 bp, Mus musculus
ttcatacctcaggtgctgtcacggc

SEQ ID NO: 839386 - DNA, 25 bp, Mus musculus
ttcatactggacaacacagtgccag

SEQ ID NO: 839387 - DNA, 25 bp, Mus musculus
ttcatactggactacacagtgccag

SEQ ID NO: 839388 - DNA, 25 bp, Mus musculus
ttcatagacgccatctccttcttgt

SEQ ID NO: 839389 - DNA, 25 bp, Mus musculus
ttcatagacgccttctccttcttgt

SEQ ID NO: 839390 - DNA, 25 bp, Mus musculus
ttcatagagagacaaccgtgttggc

SEQ ID NO: 839391 - DNA, 25 bp, Mus musculus
ttcatagagagagaaccgtgttggc

SEQ ID NO: 839392 - DNA, 25 bp, Mus musculus
ttcatagagatgagtgttgagcagg

SEQ ID NO: 839393 - DNA, 25 bp, Mus musculus
ttcatagagatgtgtgttgagcagg

SEQ ID NO: 839394 - DNA, 25 bp, Mus musculus
ttcatagcgggcctatgcgtcctga

SEQ ID NO: 839395 - DNA, 25 bp, Mus musculus
ttcatagcgggcgtatgcgtcctga

SEQ ID NO: 839396 - DNA, 25 bp, Mus musculus
ttcatagctgccagcacagagaaga

SEQ ID NO: 839397 - DNA, 25 bp, Mus musculus
ttcatagctgcctgcacagagaaga

SEQ ID NO: 839398 - DNA, 25 bp, Mus musculus
ttcataggcccgagggtgccagcaa

SEQ ID NO: 839399 - DNA, 25 bp, Mus musculus
ttcataggcccgtgggtgccagcaa

SEQ ID NO: 839400 - DNA, 25 bp, Mus musculus
ttcatagtagaaatgcagttagcag

SEQ ID NO: 839401 - DNA, 25 bp, Mus musculus
ttcatagtagaattgcagttagcag

SEQ ID NO: 839402 - DNA, 25 bp, Mus musculus
ttcatagtcgtcctgatgtatcgct

SEQ ID NO: 839403 - DNA, 25 bp, Mus musculus
ttcatagtcgtcgtgatgtatcgct

SEQ ID NO: 839404 - DNA, 25 bp, Mus musculus
ttcatagttggaccttgcacttggg

SEQ ID NO: 839405 - DNA, 25 bp, Mus musculus
ttcatagttggagcttgcacttggg

SEQ ID NO: 839406 - DNA, 25 bp, Mus musculus
ttcatatcagcacggtgggtcctcc

SEQ ID NO: 839407 - DNA, 25 bp, Mus musculus
ttcatatcagcagggtgggtcctcc

SEQ ID NO: 839408 - DNA, 25 bp, Mus musculus
ttcatatctgggaaagcatcaaaga

SEQ ID NO: 839409 - DNA, 25 bp, Mus musculus
ttcatatctgggtaagcatcaaaga

SEQ ID NO: 839410 - DNA, 25 bp, Mus musculus
ttcatatgatgaaagcactctcccc

SEQ ID NO: 839411 - DNA, 25 bp, Mus musculus
ttcatatgatgatagcactctcccc

SEQ ID NO: 839412 - DNA, 25 bp, Mus musculus
ttcatatgtcacaggctggcccgtc

SEQ ID NO: 839413 - DNA, 25 bp, Mus musculus
ttcatatgtcactggctggcccgtc

SEQ ID NO: 839414 - DNA, 25 bp, Mus musculus
ttcatattcagcaggagggcaggcc

SEQ ID NO: 839415 - DNA, 25 bp, Mus musculus
ttcatattcagctggagggcaggcc

SEQ ID NO: 839416 - DNA, 25 bp, Mus musculus
ttcatcaacacccagcaaattctgc

SEQ ID NO: 839417 - DNA, 25 bp, Mus musculus
ttcatcaacaccgagcaaattctgc

SEQ ID NO: 839418 - DNA, 25 bp, Mus musculus
ttcatcaacatcaagacgctcaatg

SEQ ID NO: 839419 - DNA, 25 bp, Mus musculus
ttcatcaacatctagacgctcaatg

SEQ ID NO: 839420 - DNA, 25 bp, Mus musculus
ttcatcaaccgtaagtgcttgtttc

SEQ ID NO: 839421 - DNA, 25 bp, Mus musculus
ttcatcaaccgttagtgcttgtttc

SEQ ID NO: 839422 - DNA, 25 bp, Mus musculus
ttcatcaagataatacacagaggca

SEQ ID NO: 839423 - DNA, 25 bp, Mus musculus
ttcatcaagatattacacagaggca

SEQ ID NO: 839424 - DNA, 25 bp, Mus musculus
ttcatcaagctcatcggcatggcca

SEQ ID NO: 839425 - DNA, 25 bp, Mus musculus
ttcatcaagctcttcggcatggcca

SEQ ID NO: 839426 - DNA, 25 bp, Mus musculus
ttcatcacaagtactcggcaaattg

SEQ ID NO: 839427 - DNA, 25 bp, Mus musculus
ttcatcacaagttctcggcaaattg

SEQ ID NO: 839428 - DNA, 25 bp, Mus musculus
ttcatcacaatccatcagtctggcc

SEQ ID NO: 839429 - DNA, 25 bp, Mus musculus
ttcatcacaatcgatcagtctggcc

SEQ ID NO: 839430 - DNA, 25 bp, Mus musculus
ttcatcacagtgatgcttgcgagga

SEQ ID NO: 839431 - DNA, 25 bp, Mus musculus
ttcatcacagtgttgcttgcgagga

SEQ ID NO: 839432 - DNA, 25 bp, Mus musculus
ttcatcaccagtattggaggcagcg

SEQ ID NO: 839433 - DNA, 25 bp, Mus musculus
ttcatcaccagttttggaggcagcg

SEQ ID NO: 839434 - DNA, 25 bp, Mus musculus
ttcatcacccgcaagtcactgatcg

SEQ ID NO: 839435 - DNA, 25 bp, Mus musculus
ttcatcacccgctagtcactgatcg

SEQ ID NO: 839436 - DNA, 25 bp, Mus musculus
ttcatcacctatagagatcactggg

SEQ ID NO: 839437 - DNA, 25 bp, Mus musculus
ttcatcacctatcacgactatgacc

SEQ ID NO: 839438 - DNA, 25 bp, Mus musculus
ttcatcacctatgacgactatgacc

SEQ ID NO: 839439 - DNA, 25 bp, Mus musculus
ttcatcacctattgagatcactggg

SEQ ID NO: 839440 - DNA, 25 bp, Mus musculus
ttcatcacggtaagaaggatgtgaa

SEQ ID NO: 839441 - DNA, 25 bp, Mus musculus
ttcatcacggtatgaaggatgtgaa

SEQ ID NO: 839442 - DNA, 25 bp, Mus musculus
ttcatcacttggacgaatgcccaca

SEQ ID NO: 839443 - DNA, 25 bp, Mus musculus
ttcatcacttggtcgaatgcccaca

SEQ ID NO: 839444 - DNA, 25 bp, Mus musculus
ttcatcagaaatacacgtccattgg

SEQ ID NO: 839445 - DNA, 25 bp, Mus musculus
ttcatcagaaattcacgtccattgg

SEQ ID NO: 839446 - DNA, 25 bp, Mus musculus
ttcatcagctggcacggaggtgact

SEQ ID NO: 839447 - DNA, 25 bp, Mus musculus
ttcatcagctgggacggaggtgact

SEQ ID NO: 839448 - DNA, 25 bp, Mus musculus
ttcatcaggaatcgcctcaagaggg

SEQ ID NO: 839449 - DNA, 25 bp, Mus musculus
ttcatcaggaatggcctcaagaggg

SEQ ID NO: 839450 - DNA, 25 bp, Mus musculus
ttcatcagtggtcctaaggagatct

SEQ ID NO: 839451 - DNA, 25 bp, Mus musculus
ttcatcagtggtgctaaggagatct

SEQ ID NO: 839452 - DNA, 25 bp, Mus musculus
ttcatcatcattctgtacgaagggc

SEQ ID NO: 839453 - DNA, 25 bp, Mus musculus
ttcatcatcattgtgtacgaagggc

SEQ ID NO: 839454 - DNA, 25 bp, Mus musculus
ttcatcatccagcacttcgcgggca

SEQ ID NO: 839455 - DNA, 25 bp, Mus musculus
ttcatcatccaggacttcgcgggca

SEQ ID NO: 839456 - DNA, 25 bp, Mus musculus
ttcatcatggtaacccctacgctga

SEQ ID NO: 839457 - DNA, 25 bp, Mus musculus
ttcatcatggtatcccctacgctga

SEQ ID NO: 839458 - DNA, 25 bp, Mus musculus
ttcatccagggcagcatcgtcttgc

SEQ ID NO: 839459 - DNA, 25 bp, Mus musculus
ttcatccagggctgcatcgtcttgc

SEQ ID NO: 839460 - DNA, 25 bp, Mus musculus
ttcatccatgtgctcaagaagacag

SEQ ID NO: 839461 - DNA, 25 bp, Mus musculus
ttcatccatgtggtcaagaagacag

SEQ ID NO: 839462 - DNA, 25 bp, Mus musculus
ttcatcccaggacaagagtgctacc

SEQ ID NO: 839463 - DNA, 25 bp, Mus musculus
ttcatcccaggagaagagtgctacc

SEQ ID NO: 839464 - DNA, 25 bp, Mus musculus
ttcatccccagtatggctgtcggag

SEQ ID NO: 839465 - DNA, 25 bp, Mus musculus
ttcatccccagtttggctgtcggag

SEQ ID NO: 839466 - DNA, 25 bp, Mus musculus
ttcatccctggcctcggaaatgggc

SEQ ID NO: 839467 - DNA, 25 bp, Mus musculus
ttcatccctggcgtcggaaatgggc

SEQ ID NO: 839468 - DNA, 25 bp, Mus musculus
ttcatccgagacattctcttgagcc

SEQ ID NO: 839469 - DNA, 25 bp, Mus musculus
ttcatccgagactttctcttgagcc

SEQ ID NO: 839470 - DNA, 25 bp, Mus musculus
ttcatccgctccagatacaacctgg

SEQ ID NO: 839471 - DNA, 25 bp, Mus musculus
ttcatccgctcctgatacaacctgg

SEQ ID NO: 839472 - DNA, 25 bp, Mus musculus
ttcatcctatctaagatccgggccc

SEQ ID NO: 839473 - DNA, 25 bp, Mus musculus
ttcatcctatcttagatccgggccc

SEQ ID NO: 839474 - DNA, 25 bp, Mus musculus
ttcatcctcaccagtgcgctgggct

SEQ ID NO: 839475 - DNA, 25 bp, Mus musculus
ttcatcctcacctgtgcgctgggct

SEQ ID NO: 839476 - DNA, 25 bp, Mus musculus
ttcatcctgcgcctggccgaggacg

SEQ ID NO: 839477 - DNA, 25 bp, Mus musculus
ttcatcctgcgcgtggccgaggacg

SEQ ID NO: 839478 - DNA, 25 bp, Mus musculus
ttcatcgaatacatcaagagccagc

SEQ ID NO: 839479 - DNA, 25 bp, Mus musculus
ttcatcgaatacttcaagagccagc

SEQ ID NO: 839480 - DNA, 25 bp, Mus musculus
ttcatcgagacaacagcagcactgc

SEQ ID NO: 839481 - DNA, 25 bp, Mus musculus
ttcatcgagacatcagcagcactgc

SEQ ID NO: 839482 - DNA, 25 bp, Mus musculus
ttcatcgcgctcctcagcctgtggg

SEQ ID NO: 839483 - DNA, 25 bp, Mus musculus
ttcatcgcgctcgtcagcctgtggg

SEQ ID NO: 839484 - DNA, 25 bp, Mus musculus
ttcatcggcatcatcatcatccttg

SEQ ID NO: 839485 - DNA, 25 bp, Mus musculus
ttcatcggcatcttcatcatccttg

SEQ ID NO: 839486 - DNA, 25 bp, Mus musculus
ttcatcggcgagatcaccagcacat

SEQ ID NO: 839487 - DNA, 25 bp, Mus musculus
ttcatcggcgagttcaccagcacat

SEQ ID NO: 839488 - DNA, 25 bp, Mus musculus
ttcatcggctgaacctaggatctgg

SEQ ID NO: 839489 - DNA, 25 bp, Mus musculus
ttcatcggctgatcctaggatctgg

SEQ ID NO: 839490 - DNA, 25 bp, Mus musculus
ttcatcggctgcattacggctccca

SEQ ID NO: 839491 - DNA, 25 bp, Mus musculus
ttcatcggctgctttacggctccca

SEQ ID NO: 839492 - DNA, 25 bp, Mus musculus
ttcatcgggactccaggcagtggcc

SEQ ID NO: 839493 - DNA, 25 bp, Mus musculus
ttcatcgggactgcaggcagtggcc

SEQ ID NO: 839494 - DNA, 25 bp, Mus musculus
ttcatcgtggcgctgtccgtggctt

SEQ ID NO: 839495 - DNA, 25 bp, Mus musculus
ttcatcgtggcggtgtccgtggctt

SEQ ID NO: 839496 - DNA, 25 bp, Mus musculus
ttcatcgtggtgcagggcttgtaca

SEQ ID NO: 839497 - DNA, 25 bp, Mus musculus
ttcatcgtggtggagggcttgtaca

SEQ ID NO: 839498 - DNA, 25 bp, Mus musculus
ttcatctacaagaggcagcgtctcc

SEQ ID NO: 839499 - DNA, 25 bp, Mus musculus
ttcatctacaagtggcagcgtctcc

SEQ ID NO: 839500 - DNA, 25 bp, Mus musculus
ttcatctacagtctcttcatgaagc

SEQ ID NO: 839501 - DNA, 25 bp, Mus musculus
ttcatctacagtgtcttcatgaagc

SEQ ID NO: 839502 - DNA, 25 bp, Mus musculus
ttcatctacgagagaagtaggaaaa

SEQ ID NO: 839503 - DNA, 25 bp, Mus musculus
ttcatctacgagtgaagtaggaaaa

SEQ ID NO: 839504 - DNA, 25 bp, Mus musculus
ttcatctacttcaggaaccagaaag

SEQ ID NO: 839505 - DNA, 25 bp, Mus musculus
ttcatctacttctggaaccagaaag

SEQ ID NO: 839506 - DNA, 25 bp, Mus musculus
ttcatctatggcacaacctgcctca

SEQ ID NO: 839507 - DNA, 25 bp, Mus musculus
ttcatctatggctcaacctgcctca

SEQ ID NO: 839508 - DNA, 25 bp, Mus musculus
ttcatctccatgcagtgccgggagc

SEQ ID NO: 839509 - DNA, 25 bp, Mus musculus
ttcatctccatggagtgccgggagc

SEQ ID NO: 839510 - DNA, 25 bp, Mus musculus
ttcatctctaccaaggctggctagc

SEQ ID NO: 839511 - DNA, 25 bp, Mus musculus
ttcatctctacctaggctggctagc

SEQ ID NO: 839512 - DNA, 25 bp, Mus musculus
ttcatctgacagacccaagtcagcg

SEQ ID NO: 839513 - DNA, 25 bp, Mus musculus
ttcatctgacagtcccaagtcagcg

SEQ ID NO: 839514 - DNA, 25 bp, Mus musculus
ttcatctgccagaccctccattgga

SEQ ID NO: 839515 - DNA, 25 bp, Mus musculus
ttcatctgccagtccctccattgga

SEQ ID NO: 839516 - DNA, 25 bp, Mus musculus
ttcatctggatccagtgcagctaga

SEQ ID NO: 839517 - DNA, 25 bp, Mus musculus
ttcatctggatcgagtgcagctaga

SEQ ID NO: 839518 - DNA, 25 bp, Mus musculus
ttcatctgtcatccccaaaggaaaa

SEQ ID NO: 839519 - DNA, 25 bp, Mus musculus
ttcatctgtcatgcccaaaggaaaa

SEQ ID NO: 839520 - DNA, 25 bp, Mus musculus
ttcatcttagcaacgagagggctgc

SEQ ID NO: 839521 - DNA, 25 bp, Mus musculus
ttcatcttagcatcgagagggctgc

SEQ ID NO: 839522 - DNA, 25 bp, Mus musculus
ttcatcttcacgcttaccattgggt

SEQ ID NO: 839523 - DNA, 25 bp, Mus musculus
ttcatcttcacggttaccattgggt

SEQ ID NO: 839524 - DNA, 25 bp, Mus musculus
ttcatcttcatgagcggcaggcacc

SEQ ID NO: 839525 - DNA, 25 bp, Mus musculus
ttcatcttcatgtgcggcaggcacc

SEQ ID NO: 839526 - DNA, 25 bp, Mus musculus
ttcatcttccacagccaaccgaggt

SEQ ID NO: 839527 - DNA, 25 bp, Mus musculus
ttcatcttccactgccaaccgaggt

SEQ ID NO: 839528 - DNA, 25 bp, Mus musculus
ttcatcttccatcgctcaatttacc

SEQ ID NO: 839529 - DNA, 25 bp, Mus musculus
ttcatcttccatggctcaatttacc

SEQ ID NO: 839530 - DNA, 25 bp, Mus musculus
ttcatcttgggaccgctatacagca

SEQ ID NO: 839531 - DNA, 25 bp, Mus musculus
ttcatcttgggagcgctatacagca

SEQ ID NO: 839532 - DNA, 25 bp, Mus musculus
ttcatcttgggcatccttatcatcc

SEQ ID NO: 839533 - DNA, 25 bp, Mus musculus
ttcatcttgggcttccttatcatcc

SEQ ID NO: 839534 - DNA, 25 bp, Mus musculus
ttcatgaaaactacgggatcgtgga

SEQ ID NO: 839535 - DNA, 25 bp, Mus musculus
ttcatgaaaacttcgggatcgtgga

SEQ ID NO: 839536 - DNA, 25 bp, Mus musculus
ttcatgaagaaactacaaccaacag

SEQ ID NO: 839537 - DNA, 25 bp, Mus musculus
ttcatgaagaaagtacaaccaacag

SEQ ID NO: 839538 - DNA, 25 bp, Mus musculus
ttcatgaagagaattacctttgcag

SEQ ID NO: 839539 - DNA, 25 bp, Mus musculus
ttcatgaagagatttacctttgcag

SEQ ID NO: 839540 - DNA, 25 bp, Mus musculus
ttcatgaagctgaatcagcgctcca

SEQ ID NO: 839541 - DNA, 25 bp, Mus musculus
ttcatgaagctgtatcagcgctcca

SEQ ID NO: 839542 - DNA, 25 bp, Mus musculus
ttcatgaaggaacgctgtatcacag

SEQ ID NO: 839543 - DNA, 25 bp, Mus musculus
ttcatgaaggaaggctgtatcacag

SEQ ID NO: 839544 - DNA, 25 bp, Mus musculus
ttcatgaagtggaccattcctgcct

SEQ ID NO: 839545 - DNA, 25 bp, Mus musculus
ttcatgaagtggtccattcctgcct

SEQ ID NO: 839546 - DNA, 25 bp, Mus musculus
ttcatgacaaccatactcactccga

SEQ ID NO: 839547 - DNA, 25 bp, Mus musculus
ttcatgacaaccttactcactccga

SEQ ID NO: 839548 - DNA, 25 bp, Mus musculus
ttcatgacagtgacataatgatgag

SEQ ID NO: 839549 - DNA, 25 bp, Mus musculus
ttcatgacagtgtcataatgatgag

SEQ ID NO: 839550 - DNA, 25 bp, Mus musculus
ttcatgaccactatggaggccggga

SEQ ID NO: 839551 - DNA, 25 bp, Mus musculus
ttcatgaccactttggaggccggga

SEQ ID NO: 839552 - DNA, 25 bp, Mus musculus
ttcatgacgctcatgtgcgtgaccc

SEQ ID NO: 839553 - DNA, 25 bp, Mus musculus
ttcatgacgctcttgtgcgtgaccc

SEQ ID NO: 839554 - DNA, 25 bp, Mus musculus
ttcatgactgtgaccctgagcctct

SEQ ID NO: 839555 - DNA, 25 bp, Mus musculus
ttcatgactgtgtccctgagcctct

SEQ ID NO: 839556 - DNA, 25 bp, Mus musculus
ttcatgagcacgcagccgctgtctg

SEQ ID NO: 839557 - DNA, 25 bp, Mus musculus
ttcatgagcacggagccgctgtctg

SEQ ID NO: 839558 - DNA, 25 bp, Mus musculus
ttcatgatgctgctccagcttctgg

SEQ ID NO: 839559 - DNA, 25 bp, Mus musculus
ttcatgatgctggtccagcttctgg

SEQ ID NO: 839560 - DNA, 25 bp, Mus musculus
ttcatgcccgctactctcagtatgt

SEQ ID NO: 839561 - DNA, 25 bp, Mus musculus
ttcatgcccgcttctctcagtatgt

SEQ ID NO: 839562 - DNA, 25 bp, Mus musculus
ttcatgccctataggttaacccaac

SEQ ID NO: 839563 - DNA, 25 bp, Mus musculus
ttcatgccctattggttaacccaac

SEQ ID NO: 839564 - DNA, 25 bp, Mus musculus
ttcatgcctaccatcttgtcccgat

SEQ ID NO: 839565 - DNA, 25 bp, Mus musculus
ttcatgcctaccttcttgtcccgat

SEQ ID NO: 839566 - DNA, 25 bp, Mus musculus
ttcatgccttttactgcagggccca

SEQ ID NO: 839567 - DNA, 25 bp, Mus musculus
ttcatgccttttcgcttggaaggga

SEQ ID NO: 839568 - DNA, 25 bp, Mus musculus
ttcatgccttttggcttggaaggga

SEQ ID NO: 839569 - DNA, 25 bp, Mus musculus
ttcatgcctttttctgcagggccca

SEQ ID NO: 839570 - DNA, 25 bp, Mus musculus
ttcatgctgaccaatctcaagtggg

SEQ ID NO: 839571 - DNA, 25 bp, Mus musculus
ttcatgctgacctatctcaagtggg

SEQ ID NO: 839572 - DNA, 25 bp, Mus musculus
ttcatgcttgctctgtctaggttcc

SEQ ID NO: 839573 - DNA, 25 bp, Mus musculus
ttcatgcttgctgtgtctaggttcc

SEQ ID NO: 839574 - DNA, 25 bp, Mus musculus
ttcatggaactcattttgtgggtac

SEQ ID NO: 839575 - DNA, 25 bp, Mus musculus
ttcatggaactctttttgtgggtac

SEQ ID NO: 839576 - DNA, 25 bp, Mus musculus
ttcatggaagctccaattcttcagg

SEQ ID NO: 839577 - DNA, 25 bp, Mus musculus
ttcatggaagctgcaattcttcagg

SEQ ID NO: 839578 - DNA, 25 bp, Mus musculus
ttcatggaatcaaacacgccacggg

SEQ ID NO: 839579 - DNA, 25 bp, Mus musculus
ttcatggaatcatacacgccacggg

SEQ ID NO: 839580 - DNA, 25 bp, Mus musculus
ttcatggacacccagaaatttggca

SEQ ID NO: 839581 - DNA, 25 bp, Mus musculus
ttcatggacaccgagaaatttggca

SEQ ID NO: 839582 - DNA, 25 bp, Mus musculus
ttcatggaccagctgcgtgccttcc

SEQ ID NO: 839583 - DNA, 25 bp, Mus musculus
ttcatggaccaggtgcgtgccttcc

SEQ ID NO: 839584 - DNA, 25 bp, Mus musculus
ttcatggactggatacttcgtggca

SEQ ID NO: 839585 - DNA, 25 bp, Mus musculus
ttcatggactggttacttcgtggca

SEQ ID NO: 839586 - DNA, 25 bp, Mus musculus
ttcatggagatgaacaccaggctac

SEQ ID NO: 839587 - DNA, 25 bp, Mus musculus
ttcatggagatgtacaccaggctac

SEQ ID NO: 839588 - DNA, 25 bp, Mus musculus
ttcatggattgtagccgccctgcat

SEQ ID NO: 839589 - DNA, 25 bp, Mus musculus
ttcatggattgttgccgccctgcat

SEQ ID NO: 839590 - DNA, 25 bp, Mus musculus
ttcatggcatacaaggacaggtgcc

SEQ ID NO: 839591 - DNA, 25 bp, Mus musculus
ttcatggcatactaggacaggtgcc

SEQ ID NO: 839592 - DNA, 25 bp, Mus musculus
ttcatggccccgcacattgaggcag

SEQ ID NO: 839593 - DNA, 25 bp, Mus musculus
ttcatggccccggacattgaggcag

SEQ ID NO: 839594 - DNA, 25 bp, Mus musculus
ttcatggcgtcactggatcactcca

SEQ ID NO: 839595 - DNA, 25 bp, Mus musculus
ttcatggcgtcagtggatcactcca

SEQ ID NO: 839596 - DNA, 25 bp, Mus musculus
ttcatggctggacgcaatgactgcc

SEQ ID NO: 839597 - DNA, 25 bp, Mus musculus
ttcatggctggacttcttgttggag

SEQ ID NO: 839598 - DNA, 25 bp, Mus musculus
ttcatggctggaggcaatgactgcc

SEQ ID NO: 839599 - DNA, 25 bp, Mus musculus
ttcatggctggagttcttgttggag

SEQ ID NO: 839600 - DNA, 25 bp, Mus musculus
ttcatgggagacattgtggaccgtg

SEQ ID NO: 839601 - DNA, 25 bp, Mus musculus
ttcatgggagactttgtggaccgtg

SEQ ID NO: 839602 - DNA, 25 bp, Mus musculus
ttcatggtactgctgagcagctctg

SEQ ID NO: 839603 - DNA, 25 bp, Mus musculus
ttcatggtactggtgagcagctctg

SEQ ID NO: 839604 - DNA, 25 bp, Mus musculus
ttcatgtatggcaatcagcctggcc

SEQ ID NO: 839605 - DNA, 25 bp, Mus musculus
ttcatgtatggctatcagcctggcc

SEQ ID NO: 839606 - DNA, 25 bp, Mus musculus
ttcatgtcggctctgcaggtgctcg

SEQ ID NO: 839607 - DNA, 25 bp, Mus musculus
ttcatgtcggctgtgcaggtgctcg

SEQ ID NO: 839608 - DNA, 25 bp, Mus musculus
ttcatgtcttgaaggcccaggtgac

SEQ ID NO: 839609 - DNA, 25 bp, Mus musculus
ttcatgtcttgatggcccaggtgac

SEQ ID NO: 839610 - DNA, 25 bp, Mus musculus
ttcatgtgacagctgttgctgccct

SEQ ID NO: 839611 - DNA, 25 bp, Mus musculus
ttcatgtgacaggtgttgctgccct

SEQ ID NO: 839612 - DNA, 25 bp, Mus musculus
ttcatgtgcaacctggccctcagca

SEQ ID NO: 839613 - DNA, 25 bp, Mus musculus
ttcatgtgcaacgtggccctcagca

SEQ ID NO: 839614 - DNA, 25 bp, Mus musculus
ttcatgtgtgttaccaatagttcag

SEQ ID NO: 839615 - DNA, 25 bp, Mus musculus
ttcatgtgtgtttccaatagttcag

SEQ ID NO: 839616 - DNA, 25 bp, Mus musculus
ttcatgttgtgtctgagccggcatt

SEQ ID NO: 839617 - DNA, 25 bp, Mus musculus
ttcatgttgtgtgtgagccggcatt

SEQ ID NO: 839618 - DNA, 25 bp, Mus musculus
ttcatgtttgacagggtgctggcac

SEQ ID NO: 839619 - DNA, 25 bp, Mus musculus
ttcatgtttgactgggtgctggcac

SEQ ID NO: 839620 - DNA, 25 bp, Mus musculus
ttcattaagccacacaagccaaatg

SEQ ID NO: 839621 - DNA, 25 bp, Mus musculus
ttcattaagccagacaagccaaatg

SEQ ID NO: 839622 - DNA, 25 bp, Mus musculus
ttcattacagatagaattcgccagg

SEQ ID NO: 839623 - DNA, 25 bp, Mus musculus
ttcattacagattgaattcgccagg

SEQ ID NO: 839624 - DNA, 25 bp, Mus musculus
ttcattacagcaacaaaattaggaa

SEQ ID NO: 839625 - DNA, 25 bp, Mus musculus
ttcattacagcatcaaaattaggaa

SEQ ID NO: 839626 - DNA, 25 bp, Mus musculus
ttcattaccgtacgcaccggtcacg

SEQ ID NO: 839627 - DNA, 25 bp, Mus musculus
ttcattaccgtaggcaccggtcacg

SEQ ID NO: 839628 - DNA, 25 bp, Mus musculus
ttcattcaagacaaagtccattcca

SEQ ID NO: 839629 - DNA, 25 bp, Mus musculus
ttcattcaagactaagtccattcca

SEQ ID NO: 839630 - DNA, 25 bp, Mus musculus
ttcattcagaagcatggaagtctct

SEQ ID NO: 839631 - DNA, 25 bp, Mus musculus
ttcattcagaaggatggaagtctct

SEQ ID NO: 839632 - DNA, 25 bp, Mus musculus
ttcattcagattcttaaagcatgcc

SEQ ID NO: 839633 - DNA, 25 bp, Mus musculus
ttcattcagattgttaaagcatgcc

SEQ ID NO: 839634 - DNA, 25 bp, Mus musculus
ttcattccgtcgcagccagaaggag

SEQ ID NO: 839635 - DNA, 25 bp, Mus musculus
ttcattccgtcggagccagaaggag

SEQ ID NO: 839636 - DNA, 25 bp, Mus musculus
ttcattccttctctacaccgggatg

SEQ ID NO: 839637 - DNA, 25 bp, Mus musculus
ttcattccttctgtacaccgggatg

SEQ ID NO: 839638 - DNA, 25 bp, Mus musculus
ttcattcgaaagaaagtacctgcca

SEQ ID NO: 839639 - DNA, 25 bp, Mus musculus
ttcattcgaaagtaagtacctgcca

SEQ ID NO: 839640 - DNA, 25 bp, Mus musculus
ttcattctccctaggaggcgcttcc

SEQ ID NO: 839641 - DNA, 25 bp, Mus musculus
ttcattctcccttggaggcgcttcc

SEQ ID NO: 839642 - DNA, 25 bp, Mus musculus
ttcattgaagaaattcggaaacacc

SEQ ID NO: 839643 - DNA, 25 bp, Mus musculus
ttcattgaagaatttcggaaacacc

SEQ ID NO: 839644 - DNA, 25 bp, Mus musculus
ttcattgaagatcaccgccggcggg

SEQ ID NO: 839645 - DNA, 25 bp, Mus musculus
ttcattgaagatgaccgccggcggg

SEQ ID NO: 839646 - DNA, 25 bp, Mus musculus
ttcattgaggccactgagcgcttca

SEQ ID NO: 839647 - DNA, 25 bp, Mus musculus
ttcattgaggcctctgagcgcttca

SEQ ID NO: 839648 - DNA, 25 bp, Mus musculus
ttcattgagtcaccccgctggtact

SEQ ID NO: 839649 - DNA, 25 bp, Mus musculus
ttcattgagtcagcccgctggtact

SEQ ID NO: 839650 - DNA, 25 bp, Mus musculus
ttcattgcctggcacaagggctcca

SEQ ID NO: 839651 - DNA, 25 bp, Mus musculus
ttcattgcctgggacaagggctcca

SEQ ID NO: 839652 - DNA, 25 bp, Mus musculus
ttcattgctcagagcccggacctta

SEQ ID NO: 839653 - DNA, 25 bp, Mus musculus
ttcattgctcagtgcccggacctta

SEQ ID NO: 839654 - DNA, 25 bp, Mus musculus
ttcattggcaccatcaaggcttttg

SEQ ID NO: 839655 - DNA, 25 bp, Mus musculus
ttcattggcaccttcaaggcttttg

SEQ ID NO: 839656 - DNA, 25 bp, Mus musculus
ttcattgtaactccacaaacacggg

SEQ ID NO: 839657 - DNA, 25 bp, Mus musculus
ttcattgtaactgcacaaacacggg

SEQ ID NO: 839658 - DNA, 25 bp, Mus musculus
ttcattgtgttcagagggcctggca

SEQ ID NO: 839659 - DNA, 25 bp, Mus musculus
ttcattgtgttctgagggcctggca

SEQ ID NO: 839660 - DNA, 25 bp, Mus musculus
ttcatttaacccattcacttgagga

SEQ ID NO: 839661 - DNA, 25 bp, Mus musculus
ttcatttaaccctttcacttgagga

SEQ ID NO: 839662 - DNA, 25 bp, Mus musculus
ttcatttacaccacaggaaccgaag

SEQ ID NO: 839663 - DNA, 25 bp, Mus musculus
ttcatttacacctcaggaaccgaag

SEQ ID NO: 839664 - DNA, 25 bp, Mus musculus
ttcatttatgatcggaagacgggag

SEQ ID NO: 839665 - DNA, 25 bp, Mus musculus
ttcatttatgatgggaagacgggag

SEQ ID NO: 839666 - DNA, 25 bp, Mus musculus
ttcatttccaaactcattgactgct

SEQ ID NO: 839667 - DNA, 25 bp, Mus musculus
ttcatttccaaagtcattgactgct

SEQ ID NO: 839668 - DNA, 25 bp, Mus musculus
ttcatttcctctctcttactcaaca

SEQ ID NO: 839669 - DNA, 25 bp, Mus musculus
ttcatttcctctgtcttactcaaca

SEQ ID NO: 839670 - DNA, 25 bp, Mus musculus
ttcatttcgctgcatacatctacaa

SEQ ID NO: 839671 - DNA, 25 bp, Mus musculus
ttcatttcgctggatacatctacaa

SEQ ID NO: 839672 - DNA, 25 bp, Mus musculus
ttcatttctctaagtcagctcccag

SEQ ID NO: 839673 - DNA, 25 bp, Mus musculus
ttcatttctctatgtcagctcccag

SEQ ID NO: 839674 - DNA, 25 bp, Mus musculus
ttcatttctgcacccgagagggatg

SEQ ID NO: 839675 - DNA, 25 bp, Mus musculus
ttcatttctgcagccgagagggatg

SEQ ID NO: 839676 - DNA, 25 bp, Mus musculus
ttcatttcttaaagtcagcgtgacc

SEQ ID NO: 839677 - DNA, 25 bp, Mus musculus
ttcatttcttaatgtcagcgtgacc

SEQ ID NO: 839678 - DNA, 25 bp, Mus musculus
ttcattttctacaggcttggtcact

SEQ ID NO: 839679 - DNA, 25 bp, Mus musculus
ttcattttctactggcttggtcact

SEQ ID NO: 839680 - DNA, 25 bp, Mus musculus
ttcatttttgagactgtattcccca

SEQ ID NO: 839681 - DNA, 25 bp, Mus musculus
ttcatttttgagtctgtattcccca

SEQ ID NO: 839682 - DNA, 25 bp, Mus musculus
ttccaaaagctaattgatgtgcagt

SEQ ID NO: 839683 - DNA, 25 bp, Mus musculus
ttccaaaagctatttgatgtgcagt

SEQ ID NO: 839684 - DNA, 25 bp, Mus musculus
ttccaaaagtttctggactccctgt

SEQ ID NO: 839685 - DNA, 25 bp, Mus musculus
ttccaaaagtttgtggactccctgt

SEQ ID NO: 839686 - DNA, 25 bp, Mus musculus
ttccaaaatgatccaaatcaacctg

SEQ ID NO: 839687 - DNA, 25 bp, Mus musculus
ttccaaaatgatgcaaatcaacctg

SEQ ID NO: 839688 - DNA, 25 bp, Mus musculus
ttccaaaccgtcagcaaaaagagct

SEQ ID NO: 839689 - DNA, 25 bp, Mus musculus
ttccaaaccgtctgcaaaaagagct

SEQ ID NO: 839690 - DNA, 25 bp, Mus musculus
ttccaaacgcttccagatcccctgg

SEQ ID NO: 839691 - DNA, 25 bp, Mus musculus
ttccaaacgcttgcagatcccctgg

SEQ ID NO: 839692 - DNA, 25 bp, Mus musculus
ttccaaactgtgaccgcaacggcaa

SEQ ID NO: 839693 - DNA, 25 bp, Mus musculus
ttccaaactgtgtccgcaacggcaa

SEQ ID NO: 839694 - DNA, 25 bp, Mus musculus
ttccaaagaatgaccacaacctctt

SEQ ID NO: 839695 - DNA, 25 bp, Mus musculus
ttccaaagaatgtccacaacctctt

SEQ ID NO: 839696 - DNA, 25 bp, Mus musculus
ttccaaagcagtccaagggagcgcc

SEQ ID NO: 839697 - DNA, 25 bp, Mus musculus
ttccaaagcagtgcaagggagcgcc

SEQ ID NO: 839698 - DNA, 25 bp, Mus musculus
ttccaaagtcctcgctgacagatgc

SEQ ID NO: 839699 - DNA, 25 bp, Mus musculus
ttccaaagtcctggctgacagatgc

SEQ ID NO: 839700 - DNA, 25 bp, Mus musculus
ttccaaagtgcaccgttgcgcagtt

SEQ ID NO: 839701 - DNA, 25 bp, Mus musculus
ttccaaagtgcagcgttgcgcagtt

SEQ ID NO: 839702 - DNA, 25 bp, Mus musculus
ttccaaatgggtcgcccgggatgct

SEQ ID NO: 839703 - DNA, 25 bp, Mus musculus
ttccaaatgggtggcccgggatgct

SEQ ID NO: 839704 - DNA, 25 bp, Mus musculus
ttccaacaaggcaagacagggtgcc

SEQ ID NO: 839705 - DNA, 25 bp, Mus musculus
ttccaacaaggctagacagggtgcc

SEQ ID NO: 839706 - DNA, 25 bp, Mus musculus
ttccaacaaggtcccagtggaccct

SEQ ID NO: 839707 - DNA, 25 bp, Mus musculus
ttccaacaaggtgccagtggaccct

SEQ ID NO: 839708 - DNA, 25 bp, Mus musculus
ttccaaccacatcatgttgaacatc

SEQ ID NO: 839709 - DNA, 25 bp, Mus musculus
ttccaaccacatgatgttgaacatc

SEQ ID NO: 839710 - DNA, 25 bp, Mus musculus
ttccaaccatgaattgcctgatgtc

SEQ ID NO: 839711 - DNA, 25 bp, Mus musculus
ttccaaccatgatttgcctgatgtc

SEQ ID NO: 839712 - DNA, 25 bp, Mus musculus
ttccaacccaggagctatcaacaca

SEQ ID NO: 839713 - DNA, 25 bp, Mus musculus
ttccaacccaggtgctatcaacaca

SEQ ID NO: 839714 - DNA, 25 bp, Mus musculus
ttccaaccctctatgtggtccattg

SEQ ID NO: 839715 - DNA, 25 bp, Mus musculus
ttccaaccctctttgtggtccattg

SEQ ID NO: 839716 - DNA, 25 bp, Mus musculus
ttccaacgagggattcaggtccgtg

SEQ ID NO: 839717 - DNA, 25 bp, Mus musculus
ttccaacgagggtttcaggtccgtg

SEQ ID NO: 839718 - DNA, 25 bp, Mus musculus
ttccaactgggacacagaacaagcc

SEQ ID NO: 839719 - DNA, 25 bp, Mus musculus
ttccaactgggagacagaacaagcc

SEQ ID NO: 839720 - DNA, 25 bp, Mus musculus
ttccaactgtctccgcgtggcacga

SEQ ID NO: 839721 - DNA, 25 bp, Mus musculus
ttccaactgtctgcgcgtggcacga

SEQ ID NO: 839722 - DNA, 25 bp, Mus musculus
ttccaagaagtacggcgggagctac

SEQ ID NO: 839723 - DNA, 25 bp, Mus musculus
ttccaagaagtagggcgggagctac

SEQ ID NO: 839724 - DNA, 25 bp, Mus musculus
ttccaagactaccacagctttgtga

SEQ ID NO: 839725 - DNA, 25 bp, Mus musculus
ttccaagactacgacagctttgtga

SEQ ID NO: 839726 - DNA, 25 bp, Mus musculus
ttccaagagacgaggctcgcagaag

SEQ ID NO: 839727 - DNA, 25 bp, Mus musculus
ttccaagagacgtggctcgcagaag

SEQ ID NO: 839728 - DNA, 25 bp, Mus musculus
ttccaagagagcagaggtgatcacg

SEQ ID NO: 839729 - DNA, 25 bp, Mus musculus
ttccaagagagcctaggcgactcgg

SEQ ID NO: 839730 - DNA, 25 bp, Mus musculus
ttccaagagagcgtaggcgactcgg

SEQ ID NO: 839731 - DNA, 25 bp, Mus musculus
ttccaagagagctgaggtgatcacg

SEQ ID NO: 839732 - DNA, 25 bp, Mus musculus
ttccaagagtggaccagagggtgac

SEQ ID NO: 839733 - DNA, 25 bp, Mus musculus
ttccaagagtggtccagagggtgac

SEQ ID NO: 839734 - DNA, 25 bp, Mus musculus
ttccaagcgccacaagcaagaacct

SEQ ID NO: 839735 - DNA, 25 bp, Mus musculus
ttccaagcgccagaagcaagaacct

SEQ ID NO: 839736 - DNA, 25 bp, Mus musculus
ttccaagctctcagggaaccggaac

SEQ ID NO: 839737 - DNA, 25 bp, Mus musculus
ttccaagctctctgggaaccggaac

SEQ ID NO: 839738 - DNA, 25 bp, Mus musculus
ttccaaggcatcactccggagcgag

SEQ ID NO: 839739 - DNA, 25 bp, Mus musculus
ttccaaggcatctctccggagcgag

SEQ ID NO: 839740 - DNA, 25 bp, Mus musculus
ttccaaggcgatcagctgaaaaaca

SEQ ID NO: 839741 - DNA, 25 bp, Mus musculus
ttccaaggcgatgagctgaaaaaca

SEQ ID NO: 839742 - DNA, 25 bp, Mus musculus
ttccaagggcagagtctcctctgcc

SEQ ID NO: 839743 - DNA, 25 bp, Mus musculus
ttccaagggcagtgtctcctctgcc

SEQ ID NO: 839744 - DNA, 25 bp, Mus musculus
ttccaagtatatcaaggagtctcca

SEQ ID NO: 839745 - DNA, 25 bp, Mus musculus
ttccaagtatatgaaggagtctcca

SEQ ID NO: 839746 - DNA, 25 bp, Mus musculus
ttccaagtcaggaccagcacaggac

SEQ ID NO: 839747 - DNA, 25 bp, Mus musculus
ttccaagtcaggtccagcacaggac

SEQ ID NO: 839748 - DNA, 25 bp, Mus musculus
ttccaagtgcgacccagcagctctg

SEQ ID NO: 839749 - DNA, 25 bp, Mus musculus
ttccaagtgcgagccagcagctctg

SEQ ID NO: 839750 - DNA, 25 bp, Mus musculus
ttccaagtgtttagagcctcatctc

SEQ ID NO: 839751 - DNA, 25 bp, Mus musculus
ttccaagtgttttgagcctcatctc

SEQ ID NO: 839752 - DNA, 25 bp, Mus musculus
ttccaataacaacgccatgacaacg

SEQ ID NO: 839753 - DNA, 25 bp, Mus musculus
ttccaataacaaggccatgacaacg

SEQ ID NO: 839754 - DNA, 25 bp, Mus musculus
ttccaatagcccagaagcacttcgg

SEQ ID NO: 839755 - DNA, 25 bp, Mus musculus
ttccaatagccctgaagcacttcgg

SEQ ID NO: 839756 - DNA, 25 bp, Mus musculus
ttccaatgcaggacaggataggctg

SEQ ID NO: 839757 - DNA, 25 bp, Mus musculus
ttccaatgcaggtcaggataggctg

SEQ ID NO: 839758 - DNA, 25 bp, Mus musculus
ttccaatgcccaacgaggaggccag

SEQ ID NO: 839759 - DNA, 25 bp, Mus musculus
ttccaatgcccatcgaggaggccag

SEQ ID NO: 839760 - DNA, 25 bp, Mus musculus
ttccaatgctgaccagatgcgcaag

SEQ ID NO: 839761 - DNA, 25 bp, Mus musculus
ttccaatgctgagcagatgcgcaag

SEQ ID NO: 839762 - DNA, 25 bp, Mus musculus
ttccaatggacaccacggagcagct

SEQ ID NO: 839763 - DNA, 25 bp, Mus musculus
ttccaatggacagcacggagcagct

SEQ ID NO: 839764 - DNA, 25 bp, Mus musculus
ttccaatgttggaactgagtgttcc

SEQ ID NO: 839765 - DNA, 25 bp, Mus musculus
ttccaatgttggtactgagtgttcc

SEQ ID NO: 839766 - DNA, 25 bp, Mus musculus
ttccacaaccgcactgtgctagctg

SEQ ID NO: 839767 - DNA, 25 bp, Mus musculus
ttccacaaccgctctgtgctagctg

SEQ ID NO: 839768 - DNA, 25 bp, Mus musculus
ttccacaagaaaacgcagcggcggt

SEQ ID NO: 839769 - DNA, 25 bp, Mus musculus
ttccacaagaaatcgcagcggcggt

SEQ ID NO: 839770 - DNA, 25 bp, Mus musculus
ttccacaagaccagtttccactgca

SEQ ID NO: 839771 - DNA, 25 bp, Mus musculus
ttccacaagacctgtttccactgca

SEQ ID NO: 839772 - DNA, 25 bp, Mus musculus
ttccacaagcggaaggtagagcgca

SEQ ID NO: 839773 - DNA, 25 bp, Mus musculus
ttccacaagcggtaggtagagcgca

SEQ ID NO: 839774 - DNA, 25 bp, Mus musculus
ttccacacgtcgctttctggacggc

SEQ ID NO: 839775 - DNA, 25 bp, Mus musculus
ttccacacgtcggtttctggacggc

SEQ ID NO: 839776 - DNA, 25 bp, Mus musculus
ttccacactattaaatctggtcccc

SEQ ID NO: 839777 - DNA, 25 bp, Mus musculus
ttccacactatttaatctggtcccc

SEQ ID NO: 839778 - DNA, 25 bp, Mus musculus
ttccacactggacacactgcttttt

SEQ ID NO: 839779 - DNA, 25 bp, Mus musculus
ttccacactggagacactgcttttt

SEQ ID NO: 839780 - DNA, 25 bp, Mus musculus
ttccacactgggaggagctggagct

SEQ ID NO: 839781 - DNA, 25 bp, Mus musculus
ttccacactgggtggagctggagct

SEQ ID NO: 839782 - DNA, 25 bp, Mus musculus
ttccacagaaaccagtaacgccatg

SEQ ID NO: 839783 - DNA, 25 bp, Mus musculus
ttccacagaaacgagtaacgccatg

SEQ ID NO: 839784 - DNA, 25 bp, Mus musculus
ttccacagcgcgcagtcgcagttgt

SEQ ID NO: 839785 - DNA, 25 bp, Mus musculus
ttccacagcgcggagtcgcagttgt

SEQ ID NO: 839786 - DNA, 25 bp, Mus musculus
ttccacagggtgatcccagccttca

SEQ ID NO: 839787 - DNA, 25 bp, Mus musculus
ttccacagggtgttcccagccttca

SEQ ID NO: 839788 - DNA, 25 bp, Mus musculus
ttccacagttttctgtacatgaaag

SEQ ID NO: 839789 - DNA, 25 bp, Mus musculus
ttccacagttttgtgtacatgaaag

SEQ ID NO: 839790 - DNA, 25 bp, Mus musculus
ttccacatcaaactcaaggaccagg

SEQ ID NO: 839791 - DNA, 25 bp, Mus musculus
ttccacatcaaagtcaaggaccagg

SEQ ID NO: 839792 - DNA, 25 bp, Mus musculus
ttccaccaaaataagcacccatgtt

SEQ ID NO: 839793 - DNA, 25 bp, Mus musculus
ttccaccaaaattagcacccatgtt

SEQ ID NO: 839794 - DNA, 25 bp, Mus musculus
ttccaccccatccaggagtacatgg

SEQ ID NO: 839795 - DNA, 25 bp, Mus musculus
ttccaccccatcgaggagtacatgg

SEQ ID NO: 839796 - DNA, 25 bp, Mus musculus
ttccaccggagacctactgccaatg

SEQ ID NO: 839797 - DNA, 25 bp, Mus musculus
ttccaccggagagctactgccaatg

SEQ ID NO: 839798 - DNA, 25 bp, Mus musculus
ttccacctctctccagaggtcagat

SEQ ID NO: 839799 - DNA, 25 bp, Mus musculus
ttccacctctctgcagaggtcagat

SEQ ID NO: 839800 - DNA, 25 bp, Mus musculus
ttccacctttgaagtgcccatcttc

SEQ ID NO: 839801 - DNA, 25 bp, Mus musculus
ttccacctttgatgtgcccatcttc

SEQ ID NO: 839802 - DNA, 25 bp, Mus musculus
ttccacgacgtgcacctggtgcctg

SEQ ID NO: 839803 - DNA, 25 bp, Mus musculus
ttccacgacgtggacctggtgcctg

SEQ ID NO: 839804 - DNA, 25 bp, Mus musculus
ttccacgagcttcgtgcagtacaaa

SEQ ID NO: 839805 - DNA, 25 bp, Mus musculus
ttccacgagcttggtgcagtacaaa

SEQ ID NO: 839806 - DNA, 25 bp, Mus musculus
ttccacgaggaccatgaggtccagc

SEQ ID NO: 839807 - DNA, 25 bp, Mus musculus
ttccacgaggacgatgaggtccagc

SEQ ID NO: 839808 - DNA, 25 bp, Mus musculus
ttccacgccagtacacaacagtggg

SEQ ID NO: 839809 - DNA, 25 bp, Mus musculus
ttccacgccagttcacaacagtggg

SEQ ID NO: 839810 - DNA, 25 bp, Mus musculus
ttccacgcgttccagaccgcggagg

SEQ ID NO: 839811 - DNA, 25 bp, Mus musculus
ttccacgcgttcgagaccgcggagg

SEQ ID NO: 839812 - DNA, 25 bp, Mus musculus
ttccacggccccatctccagggtga

SEQ ID NO: 839813 - DNA, 25 bp, Mus musculus
ttccacggccccttctccagggtga

SEQ ID NO: 839814 - DNA, 25 bp, Mus musculus
ttccacgggagaactttgcatgacg

SEQ ID NO: 839815 - DNA, 25 bp, Mus musculus
ttccacgggagatctttgcatgacg

SEQ ID NO: 839816 - DNA, 25 bp, Mus musculus
ttccacgggcagcatcgacatggtg

SEQ ID NO: 839817 - DNA, 25 bp, Mus musculus
ttccacgggcaggatcgacatggtg

SEQ ID NO: 839818 - DNA, 25 bp, Mus musculus
ttccacgggtatctatgaagcactg

SEQ ID NO: 839819 - DNA, 25 bp, Mus musculus
ttccacgggtatgtatgaagcactg

SEQ ID NO: 839820 - DNA, 25 bp, Mus musculus
ttccacggtgaaaactaaaacactg

SEQ ID NO: 839821 - DNA, 25 bp, Mus musculus
ttccacggtgaatactaaaacactg

SEQ ID NO: 839822 - DNA, 25 bp, Mus musculus
ttccacgtgcgtctacggtcctggg

SEQ ID NO: 839823 - DNA, 25 bp, Mus musculus
ttccacgtgcgtgtacggtcctggg

SEQ ID NO: 839824 - DNA, 25 bp, Mus musculus
ttccacgtgtggaacgactgctgga

SEQ ID NO: 839825 - DNA, 25 bp, Mus musculus
ttccacgtgtggtacgactgctgga

SEQ ID NO: 839826 - DNA, 25 bp, Mus musculus
ttccacgttctgagcgcaccactga

SEQ ID NO: 839827 - DNA, 25 bp, Mus musculus
ttccacgttctgtgcgcaccactga

SEQ ID NO: 839828 - DNA, 25 bp, Mus musculus
ttccactaccaacacagttatagca

SEQ ID NO: 839829 - DNA, 25 bp, Mus musculus
ttccactaccaagacagttatagca

SEQ ID NO: 839830 - DNA, 25 bp, Mus musculus
ttccactggactcggctgaagtgca

SEQ ID NO: 839831 - DNA, 25 bp, Mus musculus
ttccactggactgggctgaagtgca

SEQ ID NO: 839832 - DNA, 25 bp, Mus musculus
ttccactgggagaagacgaggcttg

SEQ ID NO: 839833 - DNA, 25 bp, Mus musculus
ttccactgggagtagacgaggcttg

SEQ ID NO: 839834 - DNA, 25 bp, Mus musculus
ttccactgttgtcgcagcaacaact

SEQ ID NO: 839835 - DNA, 25 bp, Mus musculus
ttccactgttgtggcagcaacaact

SEQ ID NO: 839836 - DNA, 25 bp, Mus musculus
ttccacttctatctccagggtagag

SEQ ID NO: 839837 - DNA, 25 bp, Mus musculus
ttccacttctatgtccagggtagag

SEQ ID NO: 839838 - DNA, 25 bp, Mus musculus
ttccactttgatatcctgaagccct

SEQ ID NO: 839839 - DNA, 25 bp, Mus musculus
ttccactttgatttcctgaagccct

SEQ ID NO: 839840 - DNA, 25 bp, Mus musculus
ttccagaaagaacgcttcaacatcg

SEQ ID NO: 839841 - DNA, 25 bp, Mus musculus
ttccagaaagaaggcttcaacatcg

SEQ ID NO: 839842 - DNA, 25 bp, Mus musculus
ttccagaaccaaactcacgccaaga

SEQ ID NO: 839843 - DNA, 25 bp, Mus musculus
ttccagaaccaatctcacgccaaga

SEQ ID NO: 839844 - DNA, 25 bp, Mus musculus
ttccagaaccccaagcagatctgct

SEQ ID NO: 839845 - DNA, 25 bp, Mus musculus
ttccagaacccctagcagatctgct

SEQ ID NO: 839846 - DNA, 25 bp, Mus musculus
ttccagaactggctccaaagagctt

SEQ ID NO: 839847 - DNA, 25 bp, Mus musculus
ttccagaactgggtccaaagagctt

SEQ ID NO: 839848 - DNA, 25 bp, Mus musculus
ttccagaagggccagactaataccc

SEQ ID NO: 839849 - DNA, 25 bp, Mus musculus
ttccagaagggcgagactaataccc

SEQ ID NO: 839850 - DNA, 25 bp, Mus musculus
ttccagaagggtcaaaggactaacg

SEQ ID NO: 839851 - DNA, 25 bp, Mus musculus
ttccagaagggtgaaaggactaacg

SEQ ID NO: 839852 - DNA, 25 bp, Mus musculus
ttccagaagtggctaatagcaaact

SEQ ID NO: 839853 - DNA, 25 bp, Mus musculus
ttccagaagtgggtaatagcaaact

SEQ ID NO: 839854 - DNA, 25 bp, Mus musculus
ttccagacagaactccggaagatcc

SEQ ID NO: 839855 - DNA, 25 bp, Mus musculus
ttccagacagaagtccggaagatcc

SEQ ID NO: 839856 - DNA, 25 bp, Mus musculus
ttccagacaggcaacaagacgctga

SEQ ID NO: 839857 - DNA, 25 bp, Mus musculus
ttccagacaggctacaagacgctga

SEQ ID NO: 839858 - DNA, 25 bp, Mus musculus
ttccagaccgcgcagggcatccgga

SEQ ID NO: 839859 - DNA, 25 bp, Mus musculus
ttccagaccgcggagggcatccgga

SEQ ID NO: 839860 - DNA, 25 bp, Mus musculus
ttccagactctgaaactgcaggagc

SEQ ID NO: 839861 - DNA, 25 bp, Mus musculus
ttccagactctgtaactgcaggagc

SEQ ID NO: 839862 - DNA, 25 bp, Mus musculus
ttccagacttcacggcttacctctt

SEQ ID NO: 839863 - DNA, 25 bp, Mus musculus
ttccagacttcagggcttacctctt

SEQ ID NO: 839864 - DNA, 25 bp, Mus musculus
ttccagagacaacggaaaccactgt

SEQ ID NO: 839865 - DNA, 25 bp, Mus musculus
ttccagagacaagggaaaccactgt

SEQ ID NO: 839866 - DNA, 25 bp, Mus musculus
ttccagagactgatcccaagcaggg

SEQ ID NO: 839867 - DNA, 25 bp, Mus musculus
ttccagagactgttcccaagcaggg

SEQ ID NO: 839868 - DNA, 25 bp, Mus musculus
ttccagagccataaagagaagagcg

SEQ ID NO: 839869 - DNA, 25 bp, Mus musculus
ttccagagccattaagagaagagcg

SEQ ID NO: 839870 - DNA, 25 bp, Mus musculus
ttccagagcgctcagcctgattggc

SEQ ID NO: 839871 - DNA, 25 bp, Mus musculus
ttccagagcgctgagcctgattggc

SEQ ID NO: 839872 - DNA, 25 bp, Mus musculus
ttccagagcttaccatctccaggga

SEQ ID NO: 839873 - DNA, 25 bp, Mus musculus
ttccagagcttagcatctccaggga

SEQ ID NO: 839874 - DNA, 25 bp, Mus musculus
ttccagaggaagaaggtgagtacag

SEQ ID NO: 839875 - DNA, 25 bp, Mus musculus
ttccagaggaagtaggtgagtacag

SEQ ID NO: 839876 - DNA, 25 bp, Mus musculus
ttccagagtctacagttccggctgc

SEQ ID NO: 839877 - DNA, 25 bp, Mus musculus
ttccagagtctagagttccggctgc

SEQ ID NO: 839878 - DNA, 25 bp, Mus musculus
ttccagagtgggaccgtaatcgtcc

SEQ ID NO: 839879 - DNA, 25 bp, Mus musculus
ttccagagtgggtccgtaatcgtcc

SEQ ID NO: 839880 - DNA, 25 bp, Mus musculus
ttccagagtgttaggagtagtccaa

SEQ ID NO: 839881 - DNA, 25 bp, Mus musculus
ttccagagtgtttggagtagtccaa

SEQ ID NO: 839882 - DNA, 25 bp, Mus musculus
ttccagatagctaccggttcttcgg

SEQ ID NO: 839883 - DNA, 25 bp, Mus musculus
ttccagatagcttccggttcttcgg

SEQ ID NO: 839884 - DNA, 25 bp, Mus musculus
ttccagatatctcccctgtgagcgc

SEQ ID NO: 839885 - DNA, 25 bp, Mus musculus
ttccagatatctgccctgtgagcgc

SEQ ID NO: 839886 - DNA, 25 bp, Mus musculus
ttccagatcctactgaagaccggtg

SEQ ID NO: 839887 - DNA, 25 bp, Mus musculus
ttccagatcctagtgaagaccggtg

SEQ ID NO: 839888 - DNA, 25 bp, Mus musculus
ttccagatgcaaccaacaacccgat

SEQ ID NO: 839889 - DNA, 25 bp, Mus musculus
ttccagatgcaagcaacaacccgat

SEQ ID NO: 839890 - DNA, 25 bp, Mus musculus
ttccagatgcacacggtggagctgc

SEQ ID NO: 839891 - DNA, 25 bp, Mus musculus
ttccagatgcactcggtggagctgc

SEQ ID NO: 839892 - DNA, 25 bp, Mus musculus
ttccagatgcctccgaaaaataggg

SEQ ID NO: 839893 - DNA, 25 bp, Mus musculus
ttccagatgcctgcgaaaaataggg

SEQ ID NO: 839894 - DNA, 25 bp, Mus musculus
ttccagattttaagtcggcaggtgt

SEQ ID NO: 839895 - DNA, 25 bp, Mus musculus
ttccagattttatgtcggcaggtgt

SEQ ID NO: 839896 - DNA, 25 bp, Mus musculus
ttccagcaaaagacccagagtgagc

SEQ ID NO: 839897 - DNA, 25 bp, Mus musculus
ttccagcaaaagtcccagagtgagc

SEQ ID NO: 839898 - DNA, 25 bp, Mus musculus
ttccagcactcacagaacagcttgt

SEQ ID NO: 839899 - DNA, 25 bp, Mus musculus
ttccagcactcagagaacagcttgt

SEQ ID NO: 839900 - DNA, 25 bp, Mus musculus
ttccagcagaaactccacggccatt

SEQ ID NO: 839901 - DNA, 25 bp, Mus musculus
ttccagcagaaagtccacggccatt

SEQ ID NO: 839902 - DNA, 25 bp, Mus musculus
ttccagcagcaaagtaagcagcaga

SEQ ID NO: 839903 - DNA, 25 bp, Mus musculus
ttccagcagcaatgtaagcagcaga

SEQ ID NO: 839904 - DNA, 25 bp, Mus musculus
ttccagcagcgtattcagagtgaag

SEQ ID NO: 839905 - DNA, 25 bp, Mus musculus
ttccagcagcgttttcagagtgaag

SEQ ID NO: 839906 - DNA, 25 bp, Mus musculus
ttccagcagggaatcccgagtgtgg

SEQ ID NO: 839907 - DNA, 25 bp, Mus musculus
ttccagcagggattcccgagtgtgg

SEQ ID NO: 839908 - DNA, 25 bp, Mus musculus
ttccagcaggtgcattagatgggct

SEQ ID NO: 839909 - DNA, 25 bp, Mus musculus
ttccagcaggtggattagatgggct

SEQ ID NO: 839910 - DNA, 25 bp, Mus musculus
ttccagcatggtcaccgccatgggt

SEQ ID NO: 839911 - DNA, 25 bp, Mus musculus
ttccagcatggtgaccgccatgggt

SEQ ID NO: 839912 - DNA, 25 bp, Mus musculus
ttccagccaagtatgtggaggtcct

SEQ ID NO: 839913 - DNA, 25 bp, Mus musculus
ttccagccaagtttgtggaggtcct

SEQ ID NO: 839914 - DNA, 25 bp, Mus musculus
ttccagcccactctggcagcaaagg

SEQ ID NO: 839915 - DNA, 25 bp, Mus musculus
ttccagcccactgtggcagcaaagg

SEQ ID NO: 839916 - DNA, 25 bp, Mus musculus
ttccagccccttcctcaggtcaaaa

SEQ ID NO: 839917 - DNA, 25 bp, Mus musculus
ttccagccccttgctcaggtcaaaa

SEQ ID NO: 839918 - DNA, 25 bp, Mus musculus
ttccagcgagatcccagtgatcggc

SEQ ID NO: 839919 - DNA, 25 bp, Mus musculus
ttccagcgagatgccagtgatcggc

SEQ ID NO: 839920 - DNA, 25 bp, Mus musculus
ttccagcgccacatctgccgggagg

SEQ ID NO: 839921 - DNA, 25 bp, Mus musculus
ttccagcgccacttctgccgggagg

SEQ ID NO: 839922 - DNA, 25 bp, Mus musculus
ttccagcgcgctctagcaaggtgtt

SEQ ID NO: 839923 - DNA, 25 bp, Mus musculus
ttccagcgcgctgtagcaaggtgtt

SEQ ID NO: 839924 - DNA, 25 bp, Mus musculus
ttccagcggaaactgttacacatcc

SEQ ID NO: 839925 - DNA, 25 bp, Mus musculus
ttccagcggaaagtgttacacatcc

SEQ ID NO: 839926 - DNA, 25 bp, Mus musculus
ttccagcgggccaagtgcaaagatc

SEQ ID NO: 839927 - DNA, 25 bp, Mus musculus
ttccagcgggcctagtgcaaagatc

SEQ ID NO: 839928 - DNA, 25 bp, Mus musculus
ttccagctacggacatccagtgcca

SEQ ID NO: 839929 - DNA, 25 bp, Mus musculus
ttccagctacggtcatccagtgcca

SEQ ID NO: 839930 - DNA, 25 bp, Mus musculus
ttccagctagtccagcgcctggcgg

SEQ ID NO: 839931 - DNA, 25 bp, Mus musculus
ttccagctagtcgagcgcctggcgg

SEQ ID NO: 839932 - DNA, 25 bp, Mus musculus
ttccagctgaagacaattaacctgc

SEQ ID NO: 839933 - DNA, 25 bp, Mus musculus
ttccagctgaagtcaattaacctgc

SEQ ID NO: 839934 - DNA, 25 bp, Mus musculus
ttccagctgccactattcttcttca

SEQ ID NO: 839935 - DNA, 25 bp, Mus musculus
ttccagctgccagtattcttcttca

SEQ ID NO: 839936 - DNA, 25 bp, Mus musculus
ttccagctggagatcgaccgcgaca

SEQ ID NO: 839937 - DNA, 25 bp, Mus musculus
ttccagctggagttcgaccgcgaca

SEQ ID NO: 839938 - DNA, 25 bp, Mus musculus
ttccagctggtgacaggacgcacat

SEQ ID NO: 839939 - DNA, 25 bp, Mus musculus
ttccagctggtgcacacggcacgga

SEQ ID NO: 839940 - DNA, 25 bp, Mus musculus
ttccagctggtggacacggcacgga

SEQ ID NO: 839941 - DNA, 25 bp, Mus musculus
ttccagctggtgtcaggacgcacat

SEQ ID NO: 839942 - DNA, 25 bp, Mus musculus
ttccaggaaagcaacaggatgtact

SEQ ID NO: 839943 - DNA, 25 bp, Mus musculus
ttccaggaaagctacaggatgtact

SEQ ID NO: 839944 - DNA, 25 bp, Mus musculus
ttccaggaaatgaacatagaactca

SEQ ID NO: 839945 - DNA, 25 bp, Mus musculus
ttccaggaaatgtacatagaactca

SEQ ID NO: 839946 - DNA, 25 bp, Mus musculus
ttccaggaagacagccactatgtct

SEQ ID NO: 839947 - DNA, 25 bp, Mus musculus
ttccaggaagactgccactatgtct

SEQ ID NO: 839948 - DNA, 25 bp, Mus musculus
ttccaggaatggacagccggaagca

SEQ ID NO: 839949 - DNA, 25 bp, Mus musculus
ttccaggaatggtcagccggaagca

SEQ ID NO: 839950 - DNA, 25 bp, Mus musculus
ttccaggacacaatgcccaagcagc

SEQ ID NO: 839951 - DNA, 25 bp, Mus musculus
ttccaggacacattgcccaagcagc

SEQ ID NO: 839952 - DNA, 25 bp, Mus musculus
ttccaggacctacttaatatgcgtc

SEQ ID NO: 839953 - DNA, 25 bp, Mus musculus
ttccaggacctagttaatatgcgtc

SEQ ID NO: 839954 - DNA, 25 bp, Mus musculus
ttccaggacctcagtcacttccaag

SEQ ID NO: 839955 - DNA, 25 bp, Mus musculus
ttccaggacctctgtcacttccaag

SEQ ID NO: 839956 - DNA, 25 bp, Mus musculus
ttccaggacctgctccgctacggga

SEQ ID NO: 839957 - DNA, 25 bp, Mus musculus
ttccaggacctggtccgctacggga

SEQ ID NO: 839958 - DNA, 25 bp, Mus musculus
ttccaggactatctgagtctacagg

SEQ ID NO: 839959 - DNA, 25 bp, Mus musculus
ttccaggactatgtgagtctacagg

SEQ ID NO: 839960 - DNA, 25 bp, Mus musculus
ttccaggagcctagggactaaccct

SEQ ID NO: 839961 - DNA, 25 bp, Mus musculus
ttccaggagccttgggactaaccct

SEQ ID NO: 839962 - DNA, 25 bp, Mus musculus
ttccaggagtgaaaccagctttagt

SEQ ID NO: 839963 - DNA, 25 bp, Mus musculus
ttccaggagtgataccagctttagt

SEQ ID NO: 839964 - DNA, 25 bp, Mus musculus
ttccaggatcaaagtgaagagccag

SEQ ID NO: 839965 - DNA, 25 bp, Mus musculus
ttccaggatcaatgtgaagagccag

SEQ ID NO: 839966 - DNA, 25 bp, Mus musculus
ttccaggatgtacggccgcaggccc

SEQ ID NO: 839967 - DNA, 25 bp, Mus musculus
ttccaggatgtagggccgcaggccc

SEQ ID NO: 839968 - DNA, 25 bp, Mus musculus
ttccaggatgtcagatttgtcagca

SEQ ID NO: 839969 - DNA, 25 bp, Mus musculus
ttccaggatgtctgatttgtcagca

SEQ ID NO: 839970 - DNA, 25 bp, Mus musculus
ttccaggcattccttaactactacc

SEQ ID NO: 839971 - DNA, 25 bp, Mus musculus
ttccaggcattcgttaactactacc

SEQ ID NO: 839972 - DNA, 25 bp, Mus musculus
ttccaggccatgctgctcaagcagg

SEQ ID NO: 839973 - DNA, 25 bp, Mus musculus
ttccaggccatggtgctcaagcagg

SEQ ID NO: 839974 - DNA, 25 bp, Mus musculus
ttccaggcctccctactgcaggtgt

SEQ ID NO: 839975 - DNA, 25 bp, Mus musculus
ttccaggcctccgtactgcaggtgt

SEQ ID NO: 839976 - DNA, 25 bp, Mus musculus
ttccaggccttccaggagaacatgg

SEQ ID NO: 839977 - DNA, 25 bp, Mus musculus
ttccaggccttcgaggagaacatgg

SEQ ID NO: 839978 - DNA, 25 bp, Mus musculus
ttccaggcgagccaggacaaagtgt

SEQ ID NO: 839979 - DNA, 25 bp, Mus musculus
ttccaggcgagcgaggacaaagtgt

SEQ ID NO: 839980 - DNA, 25 bp, Mus musculus
ttccaggctcacaaggctatcttag

SEQ ID NO: 839981 - DNA, 25 bp, Mus musculus
ttccaggctcactaggctatcttag

SEQ ID NO: 839982 - DNA, 25 bp, Mus musculus
ttccaggcttcaagatcagaggcag

SEQ ID NO: 839983 - DNA, 25 bp, Mus musculus
ttccaggcttcatgatcagaggcag

SEQ ID NO: 839984 - DNA, 25 bp, Mus musculus
ttccagggaagcaagctcctccaga

SEQ ID NO: 839985 - DNA, 25 bp, Mus musculus
ttccagggaagctagctcctccaga

SEQ ID NO: 839986 - DNA, 25 bp, Mus musculus
ttccagggacggagctactttgagg

SEQ ID NO: 839987 - DNA, 25 bp, Mus musculus
ttccagggacggtgctactttgagg

SEQ ID NO: 839988 - DNA, 25 bp, Mus musculus
ttccagggactcctgtgaagtgcac

SEQ ID NO: 839989 - DNA, 25 bp, Mus musculus
ttccagggactcgtgtgaagtgcac

SEQ ID NO: 839990 - DNA, 25 bp, Mus musculus
ttccagggatgcagcaaggcacacg

SEQ ID NO: 839991 - DNA, 25 bp, Mus musculus
ttccagggatgctgcaaggcacacg

SEQ ID NO: 839992 - DNA, 25 bp, Mus musculus
ttccagggcgctcacgcatgcttgc

SEQ ID NO: 839993 - DNA, 25 bp, Mus musculus
ttccagggcgctgacgcatgcttgc

SEQ ID NO: 839994 - DNA, 25 bp, Mus musculus
ttccaggtccgtcacacctatgaaa

SEQ ID NO: 839995 - DNA, 25 bp, Mus musculus
ttccaggtccgtgacacctatgaaa

SEQ ID NO: 839996 - DNA, 25 bp, Mus musculus
ttccaggtcgcccttggctgcactg

SEQ ID NO: 839997 - DNA, 25 bp, Mus musculus
ttccaggtcgccgttggctgcactg

SEQ ID NO: 839998 - DNA, 25 bp, Mus musculus
ttccaggtgacacacacgattcacg

SEQ ID NO: 839999 - DNA, 25 bp, Mus musculus
ttccaggtgacagacacgattcacg

SEQ ID NO: 840000 - DNA, 25 bp, Mus musculus
ttccaggtgcaactgctccgggtct

SEQ ID NO: 840001 - DNA, 25 bp, Mus musculus
ttccaggtgcaagtgctccgggtct

SEQ ID NO: 840002 - DNA, 25 bp, Mus musculus
ttccagtaaactccgcggcctgctg

SEQ ID NO: 840003 - DNA, 25 bp, Mus musculus
ttccagtaaactgcgcggcctgctg

SEQ ID NO: 840004 - DNA, 25 bp, Mus musculus
ttccagtacacaagaccatgggtcc

SEQ ID NO: 840005 - DNA, 25 bp, Mus musculus
ttccagtacacatgaccatgggtcc

SEQ ID NO: 840006 - DNA, 25 bp, Mus musculus
ttccagtatgatccctttccccttt

SEQ ID NO: 840007 - DNA, 25 bp, Mus musculus
ttccagtatgatgcctttccccttt

SEQ ID NO: 840008 - DNA, 25 bp, Mus musculus
ttccagtatgttccggtaggttccc

SEQ ID NO: 840009 - DNA, 25 bp, Mus musculus
ttccagtatgttgcggtaggttccc

SEQ ID NO: 840010 - DNA, 25 bp, Mus musculus
ttccagtcaagtcgatggctcctga

SEQ ID NO: 840011 - DNA, 25 bp, Mus musculus
ttccagtcaagtggatggctcctga

SEQ ID NO: 840012 - DNA, 25 bp, Mus musculus
ttccagtgatccactagaaggaaga

SEQ ID NO: 840013 - DNA, 25 bp, Mus musculus
ttccagtgatcctctagaaggaaga

SEQ ID NO: 840014 - DNA, 25 bp, Mus musculus
ttccagtgcaatccgttaacatccg

SEQ ID NO: 840015 - DNA, 25 bp, Mus musculus
ttccagtgcaatgcgttaacatccg

SEQ ID NO: 840016 - DNA, 25 bp, Mus musculus
ttccagtgcctcatcaacccagcag

SEQ ID NO: 840017 - DNA, 25 bp, Mus musculus
ttccagtgcctcttcaacccagcag

SEQ ID NO: 840018 - DNA, 25 bp, Mus musculus
ttccagtggagtcagcagcgtgact

SEQ ID NO: 840019 - DNA, 25 bp, Mus musculus
ttccagtggagtgagcagcgtgact

SEQ ID NO: 840020 - DNA, 25 bp, Mus musculus
ttccagtgtgaacgacatgagccca

SEQ ID NO: 840021 - DNA, 25 bp, Mus musculus
ttccagtgtgaaggacatgagccca

SEQ ID NO: 840022 - DNA, 25 bp, Mus musculus
ttccagttgctgatgagaagtacac

SEQ ID NO: 840023 - DNA, 25 bp, Mus musculus
ttccagttgctgttgagaagtacac

SEQ ID NO: 840024 - DNA, 25 bp, Mus musculus
ttccagttgtatcctaacacatccc

SEQ ID NO: 840025 - DNA, 25 bp, Mus musculus
ttccagttgtatgctaacacatccc

SEQ ID NO: 840026 - DNA, 25 bp, Mus musculus
ttccataccttcaaccctggcattg

SEQ ID NO: 840027 - DNA, 25 bp, Mus musculus
ttccataccttctaccctggcattg

SEQ ID NO: 840028 - DNA, 25 bp, Mus musculus
ttccatattggtagggaggagttgt

SEQ ID NO: 840029 - DNA, 25 bp, Mus musculus
ttccatattggttgggaggagttgt

SEQ ID NO: 840030 - DNA, 25 bp, Mus musculus
ttccatcaaggccaaggatgacagt

SEQ ID NO: 840031 - DNA, 25 bp, Mus musculus
ttccatcaaggcgaaggatgacagt

SEQ ID NO: 840032 - DNA, 25 bp, Mus musculus
ttccatcaggagagacggcaaacag

SEQ ID NO: 840033 - DNA, 25 bp, Mus musculus
ttccatcaggagtgacggcaaacag

SEQ ID NO: 840034 - DNA, 25 bp, Mus musculus
ttccatcagtggatgccaacattgg

SEQ ID NO: 840035 - DNA, 25 bp, Mus musculus
ttccatcagtggttgccaacattgg

SEQ ID NO: 840036 - DNA, 25 bp, Mus musculus
ttccatccaattcgacgggctggtt

SEQ ID NO: 840037 - DNA, 25 bp, Mus musculus
ttccatccaattggacgggctggtt

SEQ ID NO: 840038 - DNA, 25 bp, Mus musculus
ttccatccacgacgcctggactgat

SEQ ID NO: 840039 - DNA, 25 bp, Mus musculus
ttccatccacgaggcctggactgat

SEQ ID NO: 840040 - DNA, 25 bp, Mus musculus
ttccatccagggactccggataatg

SEQ ID NO: 840041 - DNA, 25 bp, Mus musculus
ttccatccagggtctccggataatg

SEQ ID NO: 840042 - DNA, 25 bp, Mus musculus
ttccatcctgttagaatctggctac

SEQ ID NO: 840043 - DNA, 25 bp, Mus musculus
ttccatcctgtttgaatctggctac

SEQ ID NO: 840044 - DNA, 25 bp, Mus musculus
ttccatcgaggtcgcaatctgaaat

SEQ ID NO: 840045 - DNA, 25 bp, Mus musculus
ttccatcgaggtggcaatctgaaat

SEQ ID NO: 840046 - DNA, 25 bp, Mus musculus
ttccatcgggctcaagtgcctggag

SEQ ID NO: 840047 - DNA, 25 bp, Mus musculus
ttccatcgggctgaagtgcctggag

SEQ ID NO: 840048 - DNA, 25 bp, Mus musculus
ttccatcggtgtccgaggcaaatgg

SEQ ID NO: 840049 - DNA, 25 bp, Mus musculus
ttccatcggtgtgcgaggcaaatgg

SEQ ID NO: 840050 - DNA, 25 bp, Mus musculus
ttccatctaagactgtcaaagaggg

SEQ ID NO: 840051 - DNA, 25 bp, Mus musculus
ttccatctaagagtgtcaaagaggg

SEQ ID NO: 840052 - DNA, 25 bp, Mus musculus
ttccatctgataaagaatgcatgag

SEQ ID NO: 840053 - DNA, 25 bp, Mus musculus
ttccatctgatatagaatgcatgag

SEQ ID NO: 840054 - DNA, 25 bp, Mus musculus
ttccatctggaaaggcaggtcctgc

SEQ ID NO: 840055 - DNA, 25 bp, Mus musculus
ttccatctggaatggcaggtcctgc

SEQ ID NO: 840056 - DNA, 25 bp, Mus musculus
ttccatgattccactctgccttggt

SEQ ID NO: 840057 - DNA, 25 bp, Mus musculus
ttccatgattcctctctgccttggt

SEQ ID NO: 840058 - DNA, 25 bp, Mus musculus
ttccatgcagaacacaaacacggct

SEQ ID NO: 840059 - DNA, 25 bp, Mus musculus
ttccatgcagaagacaaacacggct

SEQ ID NO: 840060 - DNA, 25 bp, Mus musculus
ttccatgcagggaatgtcaaccttg

SEQ ID NO: 840061 - DNA, 25 bp, Mus musculus
ttccatgcagggtatgtcaaccttg

SEQ ID NO: 840062 - DNA, 25 bp, Mus musculus
ttccatgcctcacgtaagagacggg

SEQ ID NO: 840063 - DNA, 25 bp, Mus musculus
ttccatgcctcaggtaagagacggg

SEQ ID NO: 840064 - DNA, 25 bp, Mus musculus
ttccatgcctcgaatgccaaatctc

SEQ ID NO: 840065 - DNA, 25 bp, Mus musculus
ttccatgcctcgtatgccaaatctc

SEQ ID NO: 840066 - DNA, 25 bp, Mus musculus
ttccatggcgagctcagtgcagatg

SEQ ID NO: 840067 - DNA, 25 bp, Mus musculus
ttccatggcgaggtcagtgcagatg

SEQ ID NO: 840068 - DNA, 25 bp, Mus musculus
ttccatggtaaaaagctgaaactgg

SEQ ID NO: 840069 - DNA, 25 bp, Mus musculus
ttccatggtaaatagctgaaactgg

SEQ ID NO: 840070 - DNA, 25 bp, Mus musculus
ttccatggtatgaggcaaaaagcac

SEQ ID NO: 840071 - DNA, 25 bp, Mus musculus
ttccatggtatgtggcaaaaagcac

SEQ ID NO: 840072 - DNA, 25 bp, Mus musculus
ttccatggtgtaatgggcaaagatg

SEQ ID NO: 840073 - DNA, 25 bp, Mus musculus
ttccatggtgtattgggcaaagatg

SEQ ID NO: 840074 - DNA, 25 bp, Mus musculus
ttccatgtctcaactgaagaatgtg

SEQ ID NO: 840075 - DNA, 25 bp, Mus musculus
ttccatgtctcatctgaagaatgtg

SEQ ID NO: 840076 - DNA, 25 bp, Mus musculus
ttccattcacaacccgttgttggat

SEQ ID NO: 840077 - DNA, 25 bp, Mus musculus
ttccattcacaagccgttgttggat

SEQ ID NO: 840078 - DNA, 25 bp, Mus musculus
ttccattggcttacaccgagtagag

SEQ ID NO: 840079 - DNA, 25 bp, Mus musculus
ttccattggctttcaccgagtagag

SEQ ID NO: 840080 - DNA, 25 bp, Mus musculus
ttccattggtgacgagacagactcc

SEQ ID NO: 840081 - DNA, 25 bp, Mus musculus
ttccattggtgaggagacagactcc

SEQ ID NO: 840082 - DNA, 25 bp, Mus musculus
ttccatttgtgtactctgctgccgg

SEQ ID NO: 840083 - DNA, 25 bp, Mus musculus
ttccatttgtgttctctgctgccgg

SEQ ID NO: 840084 - DNA, 25 bp, Mus musculus
ttccatttttgaccaaagcttctct

SEQ ID NO: 840085 - DNA, 25 bp, Mus musculus
ttccatttttgagcaaagcttctct

SEQ ID NO: 840086 - DNA, 25 bp, Mus musculus
ttcccaaaacaaaactgcactccac

SEQ ID NO: 840087 - DNA, 25 bp, Mus musculus
ttcccaaaacaatactgcactccac

SEQ ID NO: 840088 - DNA, 25 bp, Mus musculus
ttcccaaaccaactgcctggaatgg

SEQ ID NO: 840089 - DNA, 25 bp, Mus musculus
ttcccaaaccaagtgcctggaatgg

SEQ ID NO: 840090 - DNA, 25 bp, Mus musculus
ttcccaaagttgagcaagaaaaagg

SEQ ID NO: 840091 - DNA, 25 bp, Mus musculus
ttcccaaagttgtgcaagaaaaagg

SEQ ID NO: 840092 - DNA, 25 bp, Mus musculus
ttcccaacacaacggctgggagggc

SEQ ID NO: 840093 - DNA, 25 bp, Mus musculus
ttcccaacacaagggctgggagggc

SEQ ID NO: 840094 - DNA, 25 bp, Mus musculus
ttcccaacacgacatccctgggagg

SEQ ID NO: 840095 - DNA, 25 bp, Mus musculus
ttcccaacacgagatccctgggagg

SEQ ID NO: 840096 - DNA, 25 bp, Mus musculus
ttcccaacctggctgatggtgatgg

SEQ ID NO: 840097 - DNA, 25 bp, Mus musculus
ttcccaacctgggtgatggtgatgg

SEQ ID NO: 840098 - DNA, 25 bp, Mus musculus
ttcccaacgacgctgagctcctatt

SEQ ID NO: 840099 - DNA, 25 bp, Mus musculus
ttcccaacgacggtgagctcctatt

SEQ ID NO: 840100 - DNA, 25 bp, Mus musculus
ttcccaagcactccaggttctggag

SEQ ID NO: 840101 - DNA, 25 bp, Mus musculus
ttcccaagcactgcaggttctggag

SEQ ID NO: 840102 - DNA, 25 bp, Mus musculus
ttcccaaggaccattcaggagctgg

SEQ ID NO: 840103 - DNA, 25 bp, Mus musculus
ttcccaaggacctttcaggagctgg

SEQ ID NO: 840104 - DNA, 25 bp, Mus musculus
ttcccaagtgcacagaagggctgct

SEQ ID NO: 840105 - DNA, 25 bp, Mus musculus
ttcccaagtgcagagaagggctgct

SEQ ID NO: 840106 - DNA, 25 bp, Mus musculus
ttcccaatgatcctcgtggccaaca

SEQ ID NO: 840107 - DNA, 25 bp, Mus musculus
ttcccaatgatcgtcgtggccaaca

SEQ ID NO: 840108 - DNA, 25 bp, Mus musculus
ttcccaatgctgaactaacagggtc

SEQ ID NO: 840109 - DNA, 25 bp, Mus musculus
ttcccaatgctgtactaacagggtc

SEQ ID NO: 840110 - DNA, 25 bp, Mus musculus
ttcccacaagaaagaagttccactc

SEQ ID NO: 840111 - DNA, 25 bp, Mus musculus
ttcccacaagaatgaagttccactc

SEQ ID NO: 840112 - DNA, 25 bp, Mus musculus
ttcccacacggtcgaattattgcca

SEQ ID NO: 840113 - DNA, 25 bp, Mus musculus
ttcccacacggtggaattattgcca

SEQ ID NO: 840114 - DNA, 25 bp, Mus musculus
ttcccacagcaacaaggagaagacg

SEQ ID NO: 840115 - DNA, 25 bp, Mus musculus
ttcccacagcaagaaggagaagacg

SEQ ID NO: 840116 - DNA, 25 bp, Mus musculus
ttcccacatgatcccacgaagactg

SEQ ID NO: 840117 - DNA, 25 bp, Mus musculus
ttcccacatgatgccacgaagactg

SEQ ID NO: 840118 - DNA, 25 bp, Mus musculus
ttcccaccgcggagttcgacgggat

SEQ ID NO: 840119 - DNA, 25 bp, Mus musculus
ttcccaccgcggtgttcgacgggat

SEQ ID NO: 840120 - DNA, 25 bp, Mus musculus
ttcccacctggaagctggatccgca

SEQ ID NO: 840121 - DNA, 25 bp, Mus musculus
ttcccacctggatgctggatccgca

SEQ ID NO: 840122 - DNA, 25 bp, Mus musculus
ttcccactggacacagttgaggtcc

SEQ ID NO: 840123 - DNA, 25 bp, Mus musculus
ttcccactggactcagttgaggtcc

SEQ ID NO: 840124 - DNA, 25 bp, Mus musculus
ttcccactggttctccgaataaagc

SEQ ID NO: 840125 - DNA, 25 bp, Mus musculus
ttcccactggttgtccgaataaagc

SEQ ID NO: 840126 - DNA, 25 bp, Mus musculus
ttcccagaaggaagagcactgctgg

SEQ ID NO: 840127 - DNA, 25 bp, Mus musculus
ttcccagaaggatgagcactgctgg

SEQ ID NO: 840128 - DNA, 25 bp, Mus musculus
ttcccagaccggagggcaaccttgc

SEQ ID NO: 840129 - DNA, 25 bp, Mus musculus
ttcccagaccggtgggcaaccttgc

SEQ ID NO: 840130 - DNA, 25 bp, Mus musculus
ttcccagagatgctggacaccctct

SEQ ID NO: 840131 - DNA, 25 bp, Mus musculus
ttcccagagatggtggacaccctct

SEQ ID NO: 840132 - DNA, 25 bp, Mus musculus
ttcccagagctgaatcaactcctag

SEQ ID NO: 840133 - DNA, 25 bp, Mus musculus
ttcccagagctgtatcaactcctag

SEQ ID NO: 840134 - DNA, 25 bp, Mus musculus
ttcccagaggcacagaatagaaagt

SEQ ID NO: 840135 - DNA, 25 bp, Mus musculus
ttcccagaggcagagaatagaaagt

SEQ ID NO: 840136 - DNA, 25 bp, Mus musculus
ttcccagcaaacaccagcttatgga

SEQ ID NO: 840137 - DNA, 25 bp, Mus musculus
ttcccagcaaactccagcttatgga

SEQ ID NO: 840138 - DNA, 25 bp, Mus musculus
ttcccagcagagatcgacttgaacc

SEQ ID NO: 840139 - DNA, 25 bp, Mus musculus
ttcccagcagagttcgacttgaacc

SEQ ID NO: 840140 - DNA, 25 bp, Mus musculus
ttcccagcatcaagagggcctggat

SEQ ID NO: 840141 - DNA, 25 bp, Mus musculus
ttcccagcatcatgagggcctggat

SEQ ID NO: 840142 - DNA, 25 bp, Mus musculus
ttcccagcctccaatattaaagcac

SEQ ID NO: 840143 - DNA, 25 bp, Mus musculus
ttcccagcctcctatattaaagcac

SEQ ID NO: 840144 - DNA, 25 bp, Mus musculus
ttcccagcggaaactgaacagtcaa

SEQ ID NO: 840145 - DNA, 25 bp, Mus musculus
ttcccagcggaatctgaacagtcaa

SEQ ID NO: 840146 - DNA, 25 bp, Mus musculus
ttcccagcgggccaccggtattgga

SEQ ID NO: 840147 - DNA, 25 bp, Mus musculus
ttcccagcgggcgaccggtattgga

SEQ ID NO: 840148 - DNA, 25 bp, Mus musculus
ttcccagcgtcacaggccgtggttc

SEQ ID NO: 840149 - DNA, 25 bp, Mus musculus
ttcccagcgtcagaggccgtggttc

SEQ ID NO: 840150 - DNA, 25 bp, Mus musculus
ttcccagcgtttcaagcttttgcta

SEQ ID NO: 840151 - DNA, 25 bp, Mus musculus
ttcccagcgtttgaagcttttgcta

SEQ ID NO: 840152 - DNA, 25 bp, Mus musculus
ttcccaggctctactgaaccctgtg

SEQ ID NO: 840153 - DNA, 25 bp, Mus musculus
ttcccaggctcttctgaaccctgtg

SEQ ID NO: 840154 - DNA, 25 bp, Mus musculus
ttcccagggagaaacccacgactgt

SEQ ID NO: 840155 - DNA, 25 bp, Mus musculus
ttcccagggagatacccacgactgt

SEQ ID NO: 840156 - DNA, 25 bp, Mus musculus
ttcccaggtgttcgaccaagacccg

SEQ ID NO: 840157 - DNA, 25 bp, Mus musculus
ttcccaggtgttggaccaagacccg

SEQ ID NO: 840158 - DNA, 25 bp, Mus musculus
ttcccaggttttccagcctctttgg

SEQ ID NO: 840159 - DNA, 25 bp, Mus musculus
ttcccaggttttgcagcctctttgg

SEQ ID NO: 840160 - DNA, 25 bp, Mus musculus
ttcccagtacaaaagaccctaacag

SEQ ID NO: 840161 - DNA, 25 bp, Mus musculus
ttcccagtacaaccaagcgtaaatg

SEQ ID NO: 840162 - DNA, 25 bp, Mus musculus
ttcccagtacaagcaagcgtaaatg

SEQ ID NO: 840163 - DNA, 25 bp, Mus musculus
ttcccagtacaatagaccctaacag

SEQ ID NO: 840164 - DNA, 25 bp, Mus musculus
ttcccagtcaagaggtgcccacctg

SEQ ID NO: 840165 - DNA, 25 bp, Mus musculus
ttcccagtcaagtggtgcccacctg

SEQ ID NO: 840166 - DNA, 25 bp, Mus musculus
ttcccagtgataccgcgtagcagcg

SEQ ID NO: 840167 - DNA, 25 bp, Mus musculus
ttcccagtgatagcgcgtagcagcg

SEQ ID NO: 840168 - DNA, 25 bp, Mus musculus
ttcccagtggcccaagccgaggctg

SEQ ID NO: 840169 - DNA, 25 bp, Mus musculus
ttcccagtggccgaagccgaggctg

SEQ ID NO: 840170 - DNA, 25 bp, Mus musculus
ttcccatagtgaacgggcagatcca

SEQ ID NO: 840171 - DNA, 25 bp, Mus musculus
ttcccatagtgatcgggcagatcca

SEQ ID NO: 840172 - DNA, 25 bp, Mus musculus
ttcccatccttccttaaggctaagg

SEQ ID NO: 840173 - DNA, 25 bp, Mus musculus
ttcccatccttcgttaaggctaagg

SEQ ID NO: 840174 - DNA, 25 bp, Mus musculus
ttcccatctgacctaggatccctgg

SEQ ID NO: 840175 - DNA, 25 bp, Mus musculus
ttcccatctgacgtaggatccctgg

SEQ ID NO: 840176 - DNA, 25 bp, Mus musculus
ttcccatgaaagagcagcacatgcg

SEQ ID NO: 840177 - DNA, 25 bp, Mus musculus
ttcccatgaaagtgcagcacatgcg

SEQ ID NO: 840178 - DNA, 25 bp, Mus musculus
ttcccatgcttcagactccggtgga

SEQ ID NO: 840179 - DNA, 25 bp, Mus musculus
ttcccatgcttctgactccggtgga

SEQ ID NO: 840180 - DNA, 25 bp, Mus musculus
ttcccatggcccagtggacgtggtg

SEQ ID NO: 840181 - DNA, 25 bp, Mus musculus
ttcccatggccctgtggacgtggtg

SEQ ID NO: 840182 - DNA, 25 bp, Mus musculus
ttcccatgtgtgcaaggatccagct

SEQ ID NO: 840183 - DNA, 25 bp, Mus musculus
ttcccatgtgtggaaggatccagct

SEQ ID NO: 840184 - DNA, 25 bp, Mus musculus
ttcccattatagagacagcctgcag

SEQ ID NO: 840185 - DNA, 25 bp, Mus musculus
ttcccattatagtgacagcctgcag

SEQ ID NO: 840186 - DNA, 25 bp, Mus musculus
ttcccattgggaccatccttgccat

SEQ ID NO: 840187 - DNA, 25 bp, Mus musculus
ttcccattgggagcatccttgccat

SEQ ID NO: 840188 - DNA, 25 bp, Mus musculus
ttccccaaatacagtgaacctgtag

SEQ ID NO: 840189 - DNA, 25 bp, Mus musculus
ttccccaaatactgtgaacctgtag

SEQ ID NO: 840190 - DNA, 25 bp, Mus musculus
ttccccaaccaaagccaaactggag

SEQ ID NO: 840191 - DNA, 25 bp, Mus musculus
ttccccaaccaatgccaaactggag

SEQ ID NO: 840192 - DNA, 25 bp, Mus musculus
ttccccaacgggacagcgtcgtgtc

SEQ ID NO: 840193 - DNA, 25 bp, Mus musculus
ttccccaacgggtcagcgtcgtgtc

SEQ ID NO: 840194 - DNA, 25 bp, Mus musculus
ttccccaagctgaattcattcatag

SEQ ID NO: 840195 - DNA, 25 bp, Mus musculus
ttccccaagctgtattcattcatag

SEQ ID NO: 840196 - DNA, 25 bp, Mus musculus
ttccccacaggaacttctgcaggtg

SEQ ID NO: 840197 - DNA, 25 bp, Mus musculus
ttccccacaggatcttctgcaggtg

SEQ ID NO: 840198 - DNA, 25 bp, Mus musculus
ttccccacccagcttatgatgataa

SEQ ID NO: 840199 - DNA, 25 bp, Mus musculus
ttccccacccaggttatgatgataa

SEQ ID NO: 840200 - DNA, 25 bp, Mus musculus
ttccccacggagctacaccggaagg

SEQ ID NO: 840201 - DNA, 25 bp, Mus musculus
ttccccacggaggtacaccggaagg

SEQ ID NO: 840202 - DNA, 25 bp, Mus musculus
ttccccactgcacggcggtggacag

SEQ ID NO: 840203 - DNA, 25 bp, Mus musculus
ttccccactgcagggcggtggacag

SEQ ID NO: 840204 - DNA, 25 bp, Mus musculus
ttccccactggcctcaagtggagct

SEQ ID NO: 840205 - DNA, 25 bp, Mus musculus
ttccccactggcgtcaagtggagct

SEQ ID NO: 840206 - DNA, 25 bp, Mus musculus
ttccccactttgatcagtaccctgt

SEQ ID NO: 840207 - DNA, 25 bp, Mus musculus
ttccccactttgttcagtaccctgt

SEQ ID NO: 840208 - DNA, 25 bp, Mus musculus
ttccccagaaacacgcaggcagtta

SEQ ID NO: 840209 - DNA, 25 bp, Mus musculus
ttccccagaaactcgcaggcagtta

SEQ ID NO: 840210 - DNA, 25 bp, Mus musculus
ttccccagacccaggctggtgggca

SEQ ID NO: 840211 - DNA, 25 bp, Mus musculus
ttccccagaccctggctggtgggca

SEQ ID NO: 840212 - DNA, 25 bp, Mus musculus
ttccccagagcaaggagacgctgct

SEQ ID NO: 840213 - DNA, 25 bp, Mus musculus
ttccccagagcatggagacgctgct

SEQ ID NO: 840214 - DNA, 25 bp, Mus musculus
ttccccaggcataccttcttggtca

SEQ ID NO: 840215 - DNA, 25 bp, Mus musculus
ttccccaggcattccttcttggtca

SEQ ID NO: 840216 - DNA, 25 bp, Mus musculus
ttccccagggagaagtggcagcgca

SEQ ID NO: 840217 - DNA, 25 bp, Mus musculus
ttccccagggagtagtggcagcgca

SEQ ID NO: 840218 - DNA, 25 bp, Mus musculus
ttccccagggtcatgccgttatcca

SEQ ID NO: 840219 - DNA, 25 bp, Mus musculus
ttccccagggtcttgccgttatcca

SEQ ID NO: 840220 - DNA, 25 bp, Mus musculus
ttccccagtataaatatgctgcggg

SEQ ID NO: 840221 - DNA, 25 bp, Mus musculus
ttccccagtatatatatgctgcggg

SEQ ID NO: 840222 - DNA, 25 bp, Mus musculus
ttccccattcgcctcataggcgagt

SEQ ID NO: 840223 - DNA, 25 bp, Mus musculus
ttccccattcgcgtcataggcgagt

SEQ ID NO: 840224 - DNA, 25 bp, Mus musculus
ttccccattgagagctccaagcact

SEQ ID NO: 840225 - DNA, 25 bp, Mus musculus
ttccccattgagtgctccaagcact

SEQ ID NO: 840226 - DNA, 25 bp, Mus musculus
ttcccccaagccagaagggcacgag

SEQ ID NO: 840227 - DNA, 25 bp, Mus musculus
ttcccccaagcctgaagggcacgag

SEQ ID NO: 840228 - DNA, 25 bp, Mus musculus
ttccccgctcgtaggcttcagtgca

SEQ ID NO: 840229 - DNA, 25 bp, Mus musculus
ttccccgctcgttggcttcagtgca

SEQ ID NO: 840230 - DNA, 25 bp, Mus musculus
ttccccggagctcagctaccgaagg

SEQ ID NO: 840231 - DNA, 25 bp, Mus musculus
ttccccggagctcgtgtgtgatccc

SEQ ID NO: 840232 - DNA, 25 bp, Mus musculus
ttccccggagctgagctaccgaagg

SEQ ID NO: 840233 - DNA, 25 bp, Mus musculus
ttccccggagctggtgtgtgatccc

SEQ ID NO: 840234 - DNA, 25 bp, Mus musculus
ttccccggcccaatcagaacgtggt

SEQ ID NO: 840235 - DNA, 25 bp, Mus musculus
ttccccggcccattcagaacgtggt

SEQ ID NO: 840236 - DNA, 25 bp, Mus musculus
ttccccgtaggacgtaccatgcggg

SEQ ID NO: 840237 - DNA, 25 bp, Mus musculus
ttccccgtaggaggtaccatgcggg

SEQ ID NO: 840238 - DNA, 25 bp, Mus musculus
ttcccctacagtacatgggctgtgt

SEQ ID NO: 840239 - DNA, 25 bp, Mus musculus
ttcccctacagttcatgggctgtgt

SEQ ID NO: 840240 - DNA, 25 bp, Mus musculus
ttcccctagatgctggagaaagcct

SEQ ID NO: 840241 - DNA, 25 bp, Mus musculus
ttcccctagatggtggagaaagcct

SEQ ID NO: 840242 - DNA, 25 bp, Mus musculus
ttcccctataagaactgcaagacgg

SEQ ID NO: 840243 - DNA, 25 bp, Mus musculus
ttcccctataagtactgcaagacgg

SEQ ID NO: 840244 - DNA, 25 bp, Mus musculus
ttcccctatgtacgtgaatatgacc

SEQ ID NO: 840245 - DNA, 25 bp, Mus musculus
ttcccctatgtaggtgaatatgacc

SEQ ID NO: 840246 - DNA, 25 bp, Mus musculus
ttcccctcggtgctagatatgctcc

SEQ ID NO: 840247 - DNA, 25 bp, Mus musculus
ttcccctcggtggtagatatgctcc

SEQ ID NO: 840248 - DNA, 25 bp, Mus musculus
ttcccctgacttctccggaggtgtg

SEQ ID NO: 840249 - DNA, 25 bp, Mus musculus
ttcccctgacttgtccggaggtgtg

SEQ ID NO: 840250 - DNA, 25 bp, Mus musculus
ttcccctgagatagaagagatggct

SEQ ID NO: 840251 - DNA, 25 bp, Mus musculus
ttcccctgagattgaagagatggct

SEQ ID NO: 840252 - DNA, 25 bp, Mus musculus
ttcccctggagaatgcatccatcct

SEQ ID NO: 840253 - DNA, 25 bp, Mus musculus
ttcccctggagattgcatccatcct

SEQ ID NO: 840254 - DNA, 25 bp, Mus musculus
ttcccctgtgctcgtacggctacat

SEQ ID NO: 840255 - DNA, 25 bp, Mus musculus
ttcccctgtgctggtacggctacat

SEQ ID NO: 840256 - DNA, 25 bp, Mus musculus
ttccccttactgcagagacccgaag

SEQ ID NO: 840257 - DNA, 25 bp, Mus musculus
ttccccttactggagagacccgaag

SEQ ID NO: 840258 - DNA, 25 bp, Mus musculus
ttccccttcctgaactgcttcgtgg

SEQ ID NO: 840259 - DNA, 25 bp, Mus musculus
ttccccttcctgtactgcttcgtgg

SEQ ID NO: 840260 - DNA, 25 bp, Mus musculus
ttccccttcgtcaccgggctgagaa

SEQ ID NO: 840261 - DNA, 25 bp, Mus musculus
ttccccttcgtctccgggctgagaa

SEQ ID NO: 840262 - DNA, 25 bp, Mus musculus
ttccccttcttgaaatccatgccga

SEQ ID NO: 840263 - DNA, 25 bp, Mus musculus
ttccccttcttgtaatccatgccga

SEQ ID NO: 840264 - DNA, 25 bp, Mus musculus
ttccccttgtgcaatagaagcgaga

SEQ ID NO: 840265 - DNA, 25 bp, Mus musculus
ttccccttgtgctatagaagcgaga

SEQ ID NO: 840266 - DNA, 25 bp, Mus musculus
ttcccctttggcaggctcagcggct

SEQ ID NO: 840267 - DNA, 25 bp, Mus musculus
ttcccctttggctggctcagcggct

SEQ ID NO: 840268 - DNA, 25 bp, Mus musculus
ttcccgaactgaacgggacatcaag

SEQ ID NO: 840269 - DNA, 25 bp, Mus musculus
ttcccgaactgatcgggacatcaag

SEQ ID NO: 840270 - DNA, 25 bp, Mus musculus
ttcccgacgagaacttcacactgaa

SEQ ID NO: 840271 - DNA, 25 bp, Mus musculus
ttcccgacgagatcttcacactgaa

SEQ ID NO: 840272 - DNA, 25 bp, Mus musculus
ttcccgactggacatgacaacgctg

SEQ ID NO: 840273 - DNA, 25 bp, Mus musculus
ttcccgactggagatgacaacgctg

SEQ ID NO: 840274 - DNA, 25 bp, Mus musculus
ttcccgagcgaaagcgtaagcgcct

SEQ ID NO: 840275 - DNA, 25 bp, Mus musculus
ttcccgagcgaatgcgtaagcgcct

SEQ ID NO: 840276 - DNA, 25 bp, Mus musculus
ttcccgaggaatacctggatcccca

SEQ ID NO: 840277 - DNA, 25 bp, Mus musculus
ttcccgaggaattcctggatcccca

SEQ ID NO: 840278 - DNA, 25 bp, Mus musculus
ttcccgagtggaaatgcctttgcca

SEQ ID NO: 840279 - DNA, 25 bp, Mus musculus
ttcccgagtggatatgcctttgcca

SEQ ID NO: 840280 - DNA, 25 bp, Mus musculus
ttcccgcaaactctggatccagttc

SEQ ID NO: 840281 - DNA, 25 bp, Mus musculus
ttcccgcaaactgtggatccagttc

SEQ ID NO: 840282 - DNA, 25 bp, Mus musculus
ttcccgcacttcagatactccgtgg

SEQ ID NO: 840283 - DNA, 25 bp, Mus musculus
ttcccgcacttctgatactccgtgg

SEQ ID NO: 840284 - DNA, 25 bp, Mus musculus
ttcccgcagcggagatcgcggacgc

SEQ ID NO: 840285 - DNA, 25 bp, Mus musculus
ttcccgcagcggtgatcgcggacgc

SEQ ID NO: 840286 - DNA, 25 bp, Mus musculus
ttcccgcatcctacagaacattcag

SEQ ID NO: 840287 - DNA, 25 bp, Mus musculus
ttcccgcatccttcagaacattcag

SEQ ID NO: 840288 - DNA, 25 bp, Mus musculus
ttcccgccccaacagcagccagatt

SEQ ID NO: 840289 - DNA, 25 bp, Mus musculus
ttcccgccccaagagcagccagatt

SEQ ID NO: 840290 - DNA, 25 bp, Mus musculus
ttcccgcgggctaccaggtctgcgg

SEQ ID NO: 840291 - DNA, 25 bp, Mus musculus
ttcccgcgggcttccaggtctgcgg

SEQ ID NO: 840292 - DNA, 25 bp, Mus musculus
ttcccgctcctgatgcaagcatgga

SEQ ID NO: 840293 - DNA, 25 bp, Mus musculus
ttcccgctcctgttgcaagcatgga

SEQ ID NO: 840294 - DNA, 25 bp, Mus musculus
ttcccggaagatcgatcggccatcc

SEQ ID NO: 840295 - DNA, 25 bp, Mus musculus
ttcccggaagatggatcggccatcc

SEQ ID NO: 840296 - DNA, 25 bp, Mus musculus
ttcccggagatactgtggtcactgg

SEQ ID NO: 840297 - DNA, 25 bp, Mus musculus
ttcccggagatagtgtggtcactgg

SEQ ID NO: 840298 - DNA, 25 bp, Mus musculus
ttcccggagatcacgaagatgttgg

SEQ ID NO: 840299 - DNA, 25 bp, Mus musculus
ttcccggagatctcgaagatgttgg

SEQ ID NO: 840300 - DNA, 25 bp, Mus musculus
ttcccggagccgcaagggctgtcta

SEQ ID NO: 840301 - DNA, 25 bp, Mus musculus
ttcccggagccggaagggctgtcta

SEQ ID NO: 840302 - DNA, 25 bp, Mus musculus
ttcccggagcggaagtctgcctgct

SEQ ID NO: 840303 - DNA, 25 bp, Mus musculus
ttcccggagcggtagtctgcctgct

SEQ ID NO: 840304 - DNA, 25 bp, Mus musculus
ttcccggattctccagtctgcgagg

SEQ ID NO: 840305 - DNA, 25 bp, Mus musculus
ttcccggattctgcagtctgcgagg

SEQ ID NO: 840306 - DNA, 25 bp, Mus musculus
ttcccggcgacaccgaagagagttc

SEQ ID NO: 840307 - DNA, 25 bp, Mus musculus
ttcccggcgacagcgaagagagttc

SEQ ID NO: 840308 - DNA, 25 bp, Mus musculus
ttcccgggaatgcaagctgatgaaa

SEQ ID NO: 840309 - DNA, 25 bp, Mus musculus
ttcccgggaatggaagctgatgaaa

SEQ ID NO: 840310 - DNA, 25 bp, Mus musculus
ttcccgggagggacacactgaagtg

SEQ ID NO: 840311 - DNA, 25 bp, Mus musculus
ttcccgggagggtcacactgaagtg

SEQ ID NO: 840312 - DNA, 25 bp, Mus musculus
ttcccgggcaggatgcgtctctgcc

SEQ ID NO: 840313 - DNA, 25 bp, Mus musculus
ttcccgggcaggttgcgtctctgcc

SEQ ID NO: 840314 - DNA, 25 bp, Mus musculus
ttcccggtgccacaggatacagggt

SEQ ID NO: 840315 - DNA, 25 bp, Mus musculus
ttcccggtgccagaggatacagggt

SEQ ID NO: 840316 - DNA, 25 bp, Mus musculus
ttcccgtcaattatgctgagttctc

SEQ ID NO: 840317 - DNA, 25 bp, Mus musculus
ttcccgtcaattttgctgagttctc

SEQ ID NO: 840318 - DNA, 25 bp, Mus musculus
ttcccgtctaacagagcgtgctctg

SEQ ID NO: 840319 - DNA, 25 bp, Mus musculus
ttcccgtctaactgagcgtgctctg

SEQ ID NO: 840320 - DNA, 25 bp, Mus musculus
ttcccgtgagaacgacctctcgttc

SEQ ID NO: 840321 - DNA, 25 bp, Mus musculus
ttcccgtgagaaggacctctcgttc

SEQ ID NO: 840322 - DNA, 25 bp, Mus musculus
ttcccgttcaccaatgagagcaagc

SEQ ID NO: 840323 - DNA, 25 bp, Mus musculus
ttcccgttcacctatgagagcaagc

SEQ ID NO: 840324 - DNA, 25 bp, Mus musculus
ttcccgtttgccatgcttctggtgc

SEQ ID NO: 840325 - DNA, 25 bp, Mus musculus
ttcccgtttgccttgcttctggtgc

SEQ ID NO: 840326 - DNA, 25 bp, Mus musculus
ttccctaacatacactgtgcagcac

SEQ ID NO: 840327 - DNA, 25 bp, Mus musculus
ttccctaacatagactgtgcagcac

SEQ ID NO: 840328 - DNA, 25 bp, Mus musculus
ttccctaagccaagctcagcagtac

SEQ ID NO: 840329 - DNA, 25 bp, Mus musculus
ttccctaagccatgctcagcagtac

SEQ ID NO: 840330 - DNA, 25 bp, Mus musculus
ttccctaatcagatggagaacaatg

SEQ ID NO: 840331 - DNA, 25 bp, Mus musculus
ttccctaatcagttggagaacaatg

SEQ ID NO: 840332 - DNA, 25 bp, Mus musculus
ttccctatctgtcacctgtcttcaa

SEQ ID NO: 840333 - DNA, 25 bp, Mus musculus
ttccctatctgtgacctgtcttcaa

SEQ ID NO: 840334 - DNA, 25 bp, Mus musculus
ttccctatggatcgacacgcttgtc

SEQ ID NO: 840335 - DNA, 25 bp, Mus musculus
ttccctatggatggacacgcttgtc

SEQ ID NO: 840336 - DNA, 25 bp, Mus musculus
ttccctcagggaccccaagacaaag

SEQ ID NO: 840337 - DNA, 25 bp, Mus musculus
ttccctcagggagcccaagacaaag

SEQ ID NO: 840338 - DNA, 25 bp, Mus musculus
ttccctcagggtcttcgtgaatgcc

SEQ ID NO: 840339 - DNA, 25 bp, Mus musculus
ttccctcagggtgttcgtgaatgcc

SEQ ID NO: 840340 - DNA, 25 bp, Mus musculus
ttccctccaacacagattacccggg

SEQ ID NO: 840341 - DNA, 25 bp, Mus musculus
ttccctccaacagagattacccggg

SEQ ID NO: 840342 - DNA, 25 bp, Mus musculus
ttccctcccaagctgctaggctgag

SEQ ID NO: 840343 - DNA, 25 bp, Mus musculus
ttccctcccaaggtgctaggctgag

SEQ ID NO: 840344 - DNA, 25 bp, Mus musculus
ttccctcccagaaaacaatgccttg

SEQ ID NO: 840345 - DNA, 25 bp, Mus musculus
ttccctcccagataacaatgccttg

SEQ ID NO: 840346 - DNA, 25 bp, Mus musculus
ttccctcctcggagaaagctgccat

SEQ ID NO: 840347 - DNA, 25 bp, Mus musculus
ttccctcctcggtgaaagctgccat

SEQ ID NO: 840348 - DNA, 25 bp, Mus musculus
ttccctcgctggcttcagtgactac

SEQ ID NO: 840349 - DNA, 25 bp, Mus musculus
ttccctcgctgggttcagtgactac

SEQ ID NO: 840350 - DNA, 25 bp, Mus musculus
ttccctcgggacatgatcgacttag

SEQ ID NO: 840351 - DNA, 25 bp, Mus musculus
ttccctcgggacttgatcgacttag

SEQ ID NO: 840352 - DNA, 25 bp, Mus musculus
ttccctctcagccataggctgcaaa

SEQ ID NO: 840353 - DNA, 25 bp, Mus musculus
ttccctctcagcgataggctgcaaa

SEQ ID NO: 840354 - DNA, 25 bp, Mus musculus
ttccctctccggattgggcctgtgg

SEQ ID NO: 840355 - DNA, 25 bp, Mus musculus
ttccctctccggtttgggcctgtgg

SEQ ID NO: 840356 - DNA, 25 bp, Mus musculus
ttccctctgtgcagtgggaccaagg

SEQ ID NO: 840357 - DNA, 25 bp, Mus musculus
ttccctctgtgctgtgggaccaagg

SEQ ID NO: 840358 - DNA, 25 bp, Mus musculus
ttccctcttcagctagcagcgggcg

SEQ ID NO: 840359 - DNA, 25 bp, Mus musculus
ttccctcttcaggtagcagcgggcg

SEQ ID NO: 840360 - DNA, 25 bp, Mus musculus
ttccctcttcccagcggattctgag

SEQ ID NO: 840361 - DNA, 25 bp, Mus musculus
ttccctcttccctgcggattctgag

SEQ ID NO: 840362 - DNA, 25 bp, Mus musculus
ttccctcttcttagagcctgtgctg

SEQ ID NO: 840363 - DNA, 25 bp, Mus musculus
ttccctcttctttgagcctgtgctg

SEQ ID NO: 840364 - DNA, 25 bp, Mus musculus
ttccctgaagaacacacaagaaagg

SEQ ID NO: 840365 - DNA, 25 bp, Mus musculus
ttccctgaagaagacacaagaaagg

SEQ ID NO: 840366 - DNA, 25 bp, Mus musculus
ttccctgaggctattgactatgggc

SEQ ID NO: 840367 - DNA, 25 bp, Mus musculus
ttccctgaggcttttgactatgggc

SEQ ID NO: 840368 - DNA, 25 bp, Mus musculus
ttccctgagtggcaagggcaaccct

SEQ ID NO: 840369 - DNA, 25 bp, Mus musculus
ttccctgagtgggaagggcaaccct

SEQ ID NO: 840370 - DNA, 25 bp, Mus musculus
ttccctgatttcaccaaccctgaga

SEQ ID NO: 840371 - DNA, 25 bp, Mus musculus
ttccctgatttctccaaccctgaga

SEQ ID NO: 840372 - DNA, 25 bp, Mus musculus
ttccctgatttgactccagggtacc

SEQ ID NO: 840373 - DNA, 25 bp, Mus musculus
ttccctgatttgtctccagggtacc

SEQ ID NO: 840374 - DNA, 25 bp, Mus musculus
ttccctgccatcagagagctagttg

SEQ ID NO: 840375 - DNA, 25 bp, Mus musculus
ttccctgccatctgagagctagttg

SEQ ID NO: 840376 - DNA, 25 bp, Mus musculus
ttccctgcctctcggtgctatgcgt

SEQ ID NO: 840377 - DNA, 25 bp, Mus musculus
ttccctgcctctgggtgctatgcgt

SEQ ID NO: 840378 - DNA, 25 bp, Mus musculus
ttccctggagaacgatatcaaacca

SEQ ID NO: 840379 - DNA, 25 bp, Mus musculus
ttccctggagaaggatatcaaacca

SEQ ID NO: 840380 - DNA, 25 bp, Mus musculus
ttccctggagcacgagatcctcctg

SEQ ID NO: 840381 - DNA, 25 bp, Mus musculus
ttccctggagcaggagatcctcctg

SEQ ID NO: 840382 - DNA, 25 bp, Mus musculus
ttccctggcgagatagaagctgccc

SEQ ID NO: 840383 - DNA, 25 bp, Mus musculus
ttccctggcgagttagaagctgccc

SEQ ID NO: 840384 - DNA, 25 bp, Mus musculus
ttccctgggaggaggcttccactgc

SEQ ID NO: 840385 - DNA, 25 bp, Mus musculus
ttccctgggaggtggcttccactgc

SEQ ID NO: 840386 - DNA, 25 bp, Mus musculus
ttccctggtcagacaggacctcgag

SEQ ID NO: 840387 - DNA, 25 bp, Mus musculus
ttccctggtcagtcaggacctcgag

SEQ ID NO: 840388 - DNA, 25 bp, Mus musculus
ttccctggtctaacgacccgatgtg

SEQ ID NO: 840389 - DNA, 25 bp, Mus musculus
ttccctggtctatcgacccgatgtg

SEQ ID NO: 840390 - DNA, 25 bp, Mus musculus
ttccctggtgatcaggaagcggtta

SEQ ID NO: 840391 - DNA, 25 bp, Mus musculus
ttccctggtgatgaggaagcggtta

SEQ ID NO: 840392 - DNA, 25 bp, Mus musculus
ttccctggtggtatcggtagcgact

SEQ ID NO: 840393 - DNA, 25 bp, Mus musculus
ttccctggtggtttcggtagcgact

SEQ ID NO: 840394 - DNA, 25 bp, Mus musculus
ttccctgtaattaagcaggcttaag

SEQ ID NO: 840395 - DNA, 25 bp, Mus musculus
ttccctgtaatttagcaggcttaag

SEQ ID NO: 840396 - DNA, 25 bp, Mus musculus
ttccctgtgctgctgctagagaggc

SEQ ID NO: 840397 - DNA, 25 bp, Mus musculus
ttccctgtgctggtgctagagaggc

SEQ ID NO: 840398 - DNA, 25 bp, Mus musculus
ttccctgttaccacagccagaagag

SEQ ID NO: 840399 - DNA, 25 bp, Mus musculus
ttccctgttacctcagccagaagag

SEQ ID NO: 840400 - DNA, 25 bp, Mus musculus
ttcccttacggcaagtgaagattca

SEQ ID NO: 840401 - DNA, 25 bp, Mus musculus
ttcccttacggctagtgaagattca

SEQ ID NO: 840402 - DNA, 25 bp, Mus musculus
ttcccttatatgacgcacccttcag

SEQ ID NO: 840403 - DNA, 25 bp, Mus musculus
ttcccttatatgtcgcacccttcag

SEQ ID NO: 840404 - DNA, 25 bp, Mus musculus
ttcccttcagggaaccagggtggag

SEQ ID NO: 840405 - DNA, 25 bp, Mus musculus
ttcccttcagggtaccagggtggag

SEQ ID NO: 840406 - DNA, 25 bp, Mus musculus
ttcccttcagttccgaaggaatgtt

SEQ ID NO: 840407 - DNA, 25 bp, Mus musculus
ttcccttcagttgcgaaggaatgtt

SEQ ID NO: 840408 - DNA, 25 bp, Mus musculus
ttcccttctctacgcacttcggagg

SEQ ID NO: 840409 - DNA, 25 bp, Mus musculus
ttcccttctctaggcacttcggagg

SEQ ID NO: 840410 - DNA, 25 bp, Mus musculus
ttcccttcttgtactgccttacaga

SEQ ID NO: 840411 - DNA, 25 bp, Mus musculus
ttcccttcttgttctgccttacaga

SEQ ID NO: 840412 - DNA, 25 bp, Mus musculus
ttcccttggcatccgcattcacatt

SEQ ID NO: 840413 - DNA, 25 bp, Mus musculus
ttcccttggcatgcgcattcacatt

SEQ ID NO: 840414 - DNA, 25 bp, Mus musculus
ttcccttgggatagaaatttttatg

SEQ ID NO: 840415 - DNA, 25 bp, Mus musculus
ttcccttgggattgaaatttttatg

SEQ ID NO: 840416 - DNA, 25 bp, Mus musculus
ttccctttgcatcacccagtgtggt

SEQ ID NO: 840417 - DNA, 25 bp, Mus musculus
ttccctttgcatgacccagtgtggt

SEQ ID NO: 840418 - DNA, 25 bp, Mus musculus
ttccctttgctgaaaacaatgtcaa

SEQ ID NO: 840419 - DNA, 25 bp, Mus musculus
ttccctttgctgtaaacaatgtcaa

SEQ ID NO: 840420 - DNA, 25 bp, Mus musculus
ttccgaaacgtcatagacagtgagg

SEQ ID NO: 840421 - DNA, 25 bp, Mus musculus
ttccgaaacgtcttagacagtgagg

SEQ ID NO: 840422 - DNA, 25 bp, Mus musculus
ttccgaaaggagaggagcggacttc

SEQ ID NO: 840423 - DNA, 25 bp, Mus musculus
ttccgaaaggagtggagcggacttc

SEQ ID NO: 840424 - DNA, 25 bp, Mus musculus
ttccgaacagttcaagcgaagcagg

SEQ ID NO: 840425 - DNA, 25 bp, Mus musculus
ttccgaacagttgaagcgaagcagg

SEQ ID NO: 840426 - DNA, 25 bp, Mus musculus
ttccgaaccatcaccgtgcgagaca

SEQ ID NO: 840427 - DNA, 25 bp, Mus musculus
ttccgaaccatctccgtgcgagaca

SEQ ID NO: 840428 - DNA, 25 bp, Mus musculus
ttccgaagactaaaggaattggtct

SEQ ID NO: 840429 - DNA, 25 bp, Mus musculus
ttccgaagactataggaattggtct

SEQ ID NO: 840430 - DNA, 25 bp, Mus musculus
ttccgaagagtgaacggttgcatgg

SEQ ID NO: 840431 - DNA, 25 bp, Mus musculus
ttccgaagagtgtacggttgcatgg

SEQ ID NO: 840432 - DNA, 25 bp, Mus musculus
ttccgaagatataagcaagtgctcc

SEQ ID NO: 840433 - DNA, 25 bp, Mus musculus
ttccgaagatattagcaagtgctcc

SEQ ID NO: 840434 - DNA, 25 bp, Mus musculus
ttccgaaggctgaggtgaaactgga

SEQ ID NO: 840435 - DNA, 25 bp, Mus musculus
ttccgaaggctgtggtgaaactgga

SEQ ID NO: 840436 - DNA, 25 bp, Mus musculus
ttccgaagggatctggtgaagaccc

SEQ ID NO: 840437 - DNA, 25 bp, Mus musculus
ttccgaagggatgtggtgaagaccc

SEQ ID NO: 840438 - DNA, 25 bp, Mus musculus
ttccgaaggtttcccggtggctcat

SEQ ID NO: 840439 - DNA, 25 bp, Mus musculus
ttccgaaggtttgccggtggctcat

SEQ ID NO: 840440 - DNA, 25 bp, Mus musculus
ttccgaatgattaagttagctggtc

SEQ ID NO: 840441 - DNA, 25 bp, Mus musculus
ttccgaatgatttagttagctggtc

SEQ ID NO: 840442 - DNA, 25 bp, Mus musculus
ttccgacagggacggactaggcact

SEQ ID NO: 840443 - DNA, 25 bp, Mus musculus
ttccgacagggagggactaggcact

SEQ ID NO: 840444 - DNA, 25 bp, Mus musculus
ttccgacaggtccaaggctcagaga

SEQ ID NO: 840445 - DNA, 25 bp, Mus musculus
ttccgacaggtcgaaggctcagaga

SEQ ID NO: 840446 - DNA, 25 bp, Mus musculus
ttccgacgagatatcaccaagtgtc

SEQ ID NO: 840447 - DNA, 25 bp, Mus musculus
ttccgacgagatttcaccaagtgtc

SEQ ID NO: 840448 - DNA, 25 bp, Mus musculus
ttccgactcctgaagcgatgcgctg

SEQ ID NO: 840449 - DNA, 25 bp, Mus musculus
ttccgactcctgtagcgatgcgctg

SEQ ID NO: 840450 - DNA, 25 bp, Mus musculus
ttccgactcggaatccgacatgacg

SEQ ID NO: 840451 - DNA, 25 bp, Mus musculus
ttccgactcggattccgacatgacg

SEQ ID NO: 840452 - DNA, 25 bp, Mus musculus
ttccgagaatttcacaaagacaagg

SEQ ID NO: 840453 - DNA, 25 bp, Mus musculus
ttccgagaatttgacaaagacaagg

SEQ ID NO: 840454 - DNA, 25 bp, Mus musculus
ttccgagccgaccactggatgctgt

SEQ ID NO: 840455 - DNA, 25 bp, Mus musculus
ttccgagccgacgactggatgctgt

SEQ ID NO: 840456 - DNA, 25 bp, Mus musculus
ttccgagcctccaggtccagagcag

SEQ ID NO: 840457 - DNA, 25 bp, Mus musculus
ttccgagcctcctggtccagagcag

SEQ ID NO: 840458 - DNA, 25 bp, Mus musculus
ttccgagcctgtcagatgggacaca

SEQ ID NO: 840459 - DNA, 25 bp, Mus musculus
ttccgagcctgtgagatgggacaca

SEQ ID NO: 840460 - DNA, 25 bp, Mus musculus
ttccgagcgctacgaagccatgagc

SEQ ID NO: 840461 - DNA, 25 bp, Mus musculus
ttccgagcgctaggaagccatgagc

SEQ ID NO: 840462 - DNA, 25 bp, Mus musculus
ttccgagctccacgacaccagtttg

SEQ ID NO: 840463 - DNA, 25 bp, Mus musculus
ttccgagctccaggacaccagtttg

SEQ ID NO: 840464 - DNA, 25 bp, Mus musculus
ttccgagctcggcaatcgctaccat

SEQ ID NO: 840465 - DNA, 25 bp, Mus musculus
ttccgagctcgggaatcgctaccat

SEQ ID NO: 840466 - DNA, 25 bp, Mus musculus
ttccgaggagacaaaggagatattg

SEQ ID NO: 840467 - DNA, 25 bp, Mus musculus
ttccgaggagactaaggagatattg

SEQ ID NO: 840468 - DNA, 25 bp, Mus musculus
ttccgaggatgcaaaaggacttatt

SEQ ID NO: 840469 - DNA, 25 bp, Mus musculus
ttccgaggatgctaaaggacttatt

SEQ ID NO: 840470 - DNA, 25 bp, Mus musculus
ttccgagggtcaccaagatgtcgag

SEQ ID NO: 840471 - DNA, 25 bp, Mus musculus
ttccgagggtcagcaagatgtcgag

SEQ ID NO: 840472 - DNA, 25 bp, Mus musculus
ttccgagtccgacgggtcgctgact

SEQ ID NO: 840473 - DNA, 25 bp, Mus musculus
ttccgagtccgaggggtcgctgact

SEQ ID NO: 840474 - DNA, 25 bp, Mus musculus
ttccgagtcttccactgcacacagt

SEQ ID NO: 840475 - DNA, 25 bp, Mus musculus
ttccgagtcttcgactgcacacagt

SEQ ID NO: 840476 - DNA, 25 bp, Mus musculus
ttccgatcacatacctgaccattgg

SEQ ID NO: 840477 - DNA, 25 bp, Mus musculus
ttccgatcacattcctgaccattgg

SEQ ID NO: 840478 - DNA, 25 bp, Mus musculus
ttccgatgaagacgtgtacacagct

SEQ ID NO: 840479 - DNA, 25 bp, Mus musculus
ttccgatgaagaggtgtacacagct

SEQ ID NO: 840480 - DNA, 25 bp, Mus musculus
ttccgattccgaactaagacccgag

SEQ ID NO: 840481 - DNA, 25 bp, Mus musculus
ttccgattccgatctaagacccgag

SEQ ID NO: 840482 - DNA, 25 bp, Mus musculus
ttccgcaacggccagtacgccgagg

SEQ ID NO: 840483 - DNA, 25 bp, Mus musculus
ttccgcaacggcgagtacgccgagg

SEQ ID NO: 840484 - DNA, 25 bp, Mus musculus
ttccgcaatagacctgttcccgtct

SEQ ID NO: 840485 - DNA, 25 bp, Mus musculus
ttccgcaatagagctgttcccgtct

SEQ ID NO: 840486 - DNA, 25 bp, Mus musculus
ttccgcaatggccagtacggcgaag

SEQ ID NO: 840487 - DNA, 25 bp, Mus musculus
ttccgcaatggcgagtacggcgaag

SEQ ID NO: 840488 - DNA, 25 bp, Mus musculus
ttccgcaggattccgaagttctctg

SEQ ID NO: 840489 - DNA, 25 bp, Mus musculus
ttccgcaggattgcgaagttctctg

SEQ ID NO: 840490 - DNA, 25 bp, Mus musculus
ttccgcatgtacagcaagggcgcct

SEQ ID NO: 840491 - DNA, 25 bp, Mus musculus
ttccgcatgtactgcaagggcgcct

SEQ ID NO: 840492 - DNA, 25 bp, Mus musculus
ttccgccccggccttgtttctgaga

SEQ ID NO: 840493 - DNA, 25 bp, Mus musculus
ttccgccccggcgttgtttctgaga

SEQ ID NO: 840494 - DNA, 25 bp, Mus musculus
ttccgcctcatcaatatcatccatg

SEQ ID NO: 840495 - DNA, 25 bp, Mus musculus
ttccgcctcatctatatcatccatg

SEQ ID NO: 840496 - DNA, 25 bp, Mus musculus
ttccgcctgcacaggcaacctgagg

SEQ ID NO: 840497 - DNA, 25 bp, Mus musculus
ttccgcctgcactggcaacctgagg

SEQ ID NO: 840498 - DNA, 25 bp, Mus musculus
ttccgcgagcccatccgtctgaaga

SEQ ID NO: 840499 - DNA, 25 bp, Mus musculus
ttccgcgagcccttccgtctgaaga

SEQ ID NO: 840500 - DNA, 25 bp, Mus musculus
ttccgcgcgatgcagaccggatgct

SEQ ID NO: 840501 - DNA, 25 bp, Mus musculus
ttccgcgcgatggagaccggatgct

SEQ ID NO: 840502 - DNA, 25 bp, Mus musculus
ttccgcttcatcaagaccccagagt

SEQ ID NO: 840503 - DNA, 25 bp, Mus musculus
ttccgcttcatctagaccccagagt

SEQ ID NO: 840504 - DNA, 25 bp, Mus musculus
ttccgcttgaaccaaaaatggtgag

SEQ ID NO: 840505 - DNA, 25 bp, Mus musculus
ttccgcttgaacgaaaaatggtgag

SEQ ID NO: 840506 - DNA, 25 bp, Mus musculus
ttccgctttgatcccgacaacgtca

SEQ ID NO: 840507 - DNA, 25 bp, Mus musculus
ttccgctttgatgccgacaacgtca

SEQ ID NO: 840508 - DNA, 25 bp, Mus musculus
ttccggaaactcagggactacgctg

SEQ ID NO: 840509 - DNA, 25 bp, Mus musculus
ttccggaaactctgggactacgctg

SEQ ID NO: 840510 - DNA, 25 bp, Mus musculus
ttccggaacactaccctaagccatg

SEQ ID NO: 840511 - DNA, 25 bp, Mus musculus
ttccggaacacttccctaagccatg

SEQ ID NO: 840512 - DNA, 25 bp, Mus musculus
ttccggaagacacgccacatcattg

SEQ ID NO: 840513 - DNA, 25 bp, Mus musculus
ttccggaagacaggccacatcattg

SEQ ID NO: 840514 - DNA, 25 bp, Mus musculus
ttccggaagttgcagcttactggcc

SEQ ID NO: 840515 - DNA, 25 bp, Mus musculus
ttccggaagttggagcttactggcc

SEQ ID NO: 840516 - DNA, 25 bp, Mus musculus
ttccggaatgccaagatggtcaatc

SEQ ID NO: 840517 - DNA, 25 bp, Mus musculus
ttccggaatgcctagatggtcaatc

SEQ ID NO: 840518 - DNA, 25 bp, Mus musculus
ttccggaattatcacaacattacag

SEQ ID NO: 840519 - DNA, 25 bp, Mus musculus
ttccggaattatgacaacattacag

SEQ ID NO: 840520 - DNA, 25 bp, Mus musculus
ttccggacacacctggaagaaaagc

SEQ ID NO: 840521 - DNA, 25 bp, Mus musculus
ttccggacacacgtggaagaaaagc

SEQ ID NO: 840522 - DNA, 25 bp, Mus musculus
ttccggaccagactggcaacgtcac

SEQ ID NO: 840523 - DNA, 25 bp, Mus musculus
ttccggaccagagtggcaacgtcac

SEQ ID NO: 840524 - DNA, 25 bp, Mus musculus
ttccggacggaacaagtccacaccg

SEQ ID NO: 840525 - DNA, 25 bp, Mus musculus
ttccggacggaagaagtccacaccg

SEQ ID NO: 840526 - DNA, 25 bp, Mus musculus
ttccggagcacgaggaggactacct

SEQ ID NO: 840527 - DNA, 25 bp, Mus musculus
ttccggagcacgtggaggactacct

SEQ ID NO: 840528 - DNA, 25 bp, Mus musculus
ttccggaggcacatcagcatgggca

SEQ ID NO: 840529 - DNA, 25 bp, Mus musculus
ttccggaggcacttcagcatgggca

SEQ ID NO: 840530 - DNA, 25 bp, Mus musculus
ttccggatcttcaacccggaccaag

SEQ ID NO: 840531 - DNA, 25 bp, Mus musculus
ttccggatcttctacccggaccaag

SEQ ID NO: 840532 - DNA, 25 bp, Mus musculus
ttccggcagagcaagctcacccatg

SEQ ID NO: 840533 - DNA, 25 bp, Mus musculus
ttccggcagagctagctcacccatg

SEQ ID NO: 840534 - DNA, 25 bp, Mus musculus
ttccggcattcgcagaaggcaggtt

SEQ ID NO: 840535 - DNA, 25 bp, Mus musculus
ttccggcattcggagaaggcaggtt

SEQ ID NO: 840536 - DNA, 25 bp, Mus musculus
ttccggcggacacccatgtgtttgt

SEQ ID NO: 840537 - DNA, 25 bp, Mus musculus
ttccggcggacagccatgtgtttgt

SEQ ID NO: 840538 - DNA, 25 bp, Mus musculus
ttccggctgtatcgtcctcacctgg

SEQ ID NO: 840539 - DNA, 25 bp, Mus musculus
ttccggctgtatggtcctcacctgg

SEQ ID NO: 840540 - DNA, 25 bp, Mus musculus
ttccggcttccgcagtgacactagc

SEQ ID NO: 840541 - DNA, 25 bp, Mus musculus
ttccggcttccggagtgacactagc

SEQ ID NO: 840542 - DNA, 25 bp, Mus musculus
ttccgggaaaagcacaacattcgtc

SEQ ID NO: 840543 - DNA, 25 bp, Mus musculus
ttccgggaaaaggacaacattcgtc

SEQ ID NO: 840544 - DNA, 25 bp, Mus musculus
ttccgggactgccagagcggacctt

SEQ ID NO: 840545 - DNA, 25 bp, Mus musculus
ttccgggactgcgagagcggacctt

SEQ ID NO: 840546 - DNA, 25 bp, Mus musculus
ttccgggagatgaccctcagcttcc

SEQ ID NO: 840547 - DNA, 25 bp, Mus musculus
ttccgggagatgtccctcagcttcc

SEQ ID NO: 840548 - DNA, 25 bp, Mus musculus
ttccgggatggccacagttccacgg

SEQ ID NO: 840549 - DNA, 25 bp, Mus musculus
ttccgggatggcgacagttccacgg

SEQ ID NO: 840550 - DNA, 25 bp, Mus musculus
ttccgggctgctcaagaggcgtttt

SEQ ID NO: 840551 - DNA, 25 bp, Mus musculus
ttccgggctgctgaagaggcgtttt

SEQ ID NO: 840552 - DNA, 25 bp, Mus musculus
ttccgggtcagacagcgtacaagat

SEQ ID NO: 840553 - DNA, 25 bp, Mus musculus
ttccgggtcagagagcgtacaagat

SEQ ID NO: 840554 - DNA, 25 bp, Mus musculus
ttccgggtgccaaagatcgctgaat

SEQ ID NO: 840555 - DNA, 25 bp, Mus musculus
ttccgggtgccatagatcgctgaat

SEQ ID NO: 840556 - DNA, 25 bp, Mus musculus
ttccgggttcttaccgttgcacgtg

SEQ ID NO: 840557 - DNA, 25 bp, Mus musculus
ttccgggttctttccgttgcacgtg

SEQ ID NO: 840558 - DNA, 25 bp, Mus musculus
ttccggtaccagagtgcagcaagct

SEQ ID NO: 840559 - DNA, 25 bp, Mus musculus
ttccggtaccagtgtgcagcaagct

SEQ ID NO: 840560 - DNA, 25 bp, Mus musculus
ttccggtgaagaatgaatacccctc

SEQ ID NO: 840561 - DNA, 25 bp, Mus musculus
ttccggtgaagattgaatacccctc

SEQ ID NO: 840562 - DNA, 25 bp, Mus musculus
ttccggtgccatcactcctgctggt

SEQ ID NO: 840563 - DNA, 25 bp, Mus musculus
ttccggtgccatgactcctgctggt

SEQ ID NO: 840564 - DNA, 25 bp, Mus musculus
ttccggtgtggcacgcattgggaaa

SEQ ID NO: 840565 - DNA, 25 bp, Mus musculus
ttccggtgtggctcgcattgggaaa

SEQ ID NO: 840566 - DNA, 25 bp, Mus musculus
ttccggtgtgtcctctcagagacga

SEQ ID NO: 840567 - DNA, 25 bp, Mus musculus
ttccggtgtgtcgtctcagagacga

SEQ ID NO: 840568 - DNA, 25 bp, Mus musculus
ttccgtaacgccatcacgtctgtca

SEQ ID NO: 840569 - DNA, 25 bp, Mus musculus
ttccgtaacgccttcacgtctgtca

SEQ ID NO: 840570 - DNA, 25 bp, Mus musculus
ttccgtaagactaaggcagctccct

SEQ ID NO: 840571 - DNA, 25 bp, Mus musculus
ttccgtaagacttaggcagctccct

SEQ ID NO: 840572 - DNA, 25 bp, Mus musculus
ttccgtaatccaaaggccaaatgag

SEQ ID NO: 840573 - DNA, 25 bp, Mus musculus
ttccgtaatccataggccaaatgag

SEQ ID NO: 840574 - DNA, 25 bp, Mus musculus
ttccgtatcctcagctgcccgaagt

SEQ ID NO: 840575 - DNA, 25 bp, Mus musculus
ttccgtatcctctgctgcccgaagt

SEQ ID NO: 840576 - DNA, 25 bp, Mus musculus
ttccgtcagggacaagcaagcacct

SEQ ID NO: 840577 - DNA, 25 bp, Mus musculus
ttccgtcagggagaagcaagcacct

SEQ ID NO: 840578 - DNA, 25 bp, Mus musculus
ttccgtcgtggcagtggctcagctt

SEQ ID NO: 840579 - DNA, 25 bp, Mus musculus
ttccgtcgtggctgtggctcagctt

SEQ ID NO: 840580 - DNA, 25 bp, Mus musculus
ttccgtctcattcttgaaatcgaac

SEQ ID NO: 840581 - DNA, 25 bp, Mus musculus
ttccgtctcattgttgaaatcgaac

SEQ ID NO: 840582 - DNA, 25 bp, Mus musculus
ttccgtctctggcagaacgcgctgc

SEQ ID NO: 840583 - DNA, 25 bp, Mus musculus
ttccgtctctgggagaacgcgctgc

SEQ ID NO: 840584 - DNA, 25 bp, Mus musculus
ttccgtctggtgcagctatctggag

SEQ ID NO: 840585 - DNA, 25 bp, Mus musculus
ttccgtctggtggagctatctggag

SEQ ID NO: 840586 - DNA, 25 bp, Mus musculus
ttccgtgaactgacagtcggcctga

SEQ ID NO: 840587 - DNA, 25 bp, Mus musculus
ttccgtgaactgtcagtcggcctga

SEQ ID NO: 840588 - DNA, 25 bp, Mus musculus
ttccgtgagattattgagacactca

SEQ ID NO: 840589 - DNA, 25 bp, Mus musculus
ttccgtgagatttttgagacactca

SEQ ID NO: 840590 - DNA, 25 bp, Mus musculus
ttccgtgccttccatctggacctgg

SEQ ID NO: 840591 - DNA, 25 bp, Mus musculus
ttccgtgccttcgatctggacctgg

SEQ ID NO: 840592 - DNA, 25 bp, Mus musculus
ttccgtggaacacgcgtccgtgttg

SEQ ID NO: 840593 - DNA, 25 bp, Mus musculus
ttccgtggaacaggcgtccgtgttg

SEQ ID NO: 840594 - DNA, 25 bp, Mus musculus
ttccgtggctaccaggagaaccacc

SEQ ID NO: 840595 - DNA, 25 bp, Mus musculus
ttccgtggctacgaggagaaccacc

SEQ ID NO: 840596 - DNA, 25 bp, Mus musculus
ttccgttcaggtccaccgcatcgag

SEQ ID NO: 840597 - DNA, 25 bp, Mus musculus
ttccgttcaggtgcaccgcatcgag

SEQ ID NO: 840598 - DNA, 25 bp, Mus musculus
ttccgttccaacaagcaataccgca

SEQ ID NO: 840599 - DNA, 25 bp, Mus musculus
ttccgttccaactagcaataccgca

SEQ ID NO: 840600 - DNA, 25 bp, Mus musculus
ttcctaaaggaaagacaggcatctg

SEQ ID NO: 840601 - DNA, 25 bp, Mus musculus
ttcctaaaggaatgacaggcatctg

SEQ ID NO: 840602 - DNA, 25 bp, Mus musculus
ttcctaaccatacgttcccgtctgt

SEQ ID NO: 840603 - DNA, 25 bp, Mus musculus
ttcctaaccataggttcccgtctgt

SEQ ID NO: 840604 - DNA, 25 bp, Mus musculus
ttcctaactaggcaagacagctgcc

SEQ ID NO: 840605 - DNA, 25 bp, Mus musculus
ttcctaactagggaagacagctgcc

SEQ ID NO: 840606 - DNA, 25 bp, Mus musculus
ttcctaagcattctctgttcccgga

SEQ ID NO: 840607 - DNA, 25 bp, Mus musculus
ttcctaagcattgtctgttcccgga

SEQ ID NO: 840608 - DNA, 25 bp, Mus musculus
ttcctaaggacacccagattgcgtg

SEQ ID NO: 840609 - DNA, 25 bp, Mus musculus
ttcctaaggacagccagattgcgtg

SEQ ID NO: 840610 - DNA, 25 bp, Mus musculus
ttcctaagtcgcagggatccatggg

SEQ ID NO: 840611 - DNA, 25 bp, Mus musculus
ttcctaagtcgctgggatccatggg

SEQ ID NO: 840612 - DNA, 25 bp, Mus musculus
ttcctaatggctatggccacgtttt

SEQ ID NO: 840613 - DNA, 25 bp, Mus musculus
ttcctaatggctttggccacgtttt

SEQ ID NO: 840614 - DNA, 25 bp, Mus musculus
ttcctacaagtgagtcagaaagatt

SEQ ID NO: 840615 - DNA, 25 bp, Mus musculus
ttcctacaagtgtgtcagaaagatt

SEQ ID NO: 840616 - DNA, 25 bp, Mus musculus
ttcctacaatggcaaaagatgccca

SEQ ID NO: 840617 - DNA, 25 bp, Mus musculus
ttcctacaatgggaaaagatgccca

SEQ ID NO: 840618 - DNA, 25 bp, Mus musculus
ttcctacacactactggcgccaagg

SEQ ID NO: 840619 - DNA, 25 bp, Mus musculus
ttcctacacacttctggcgccaagg

SEQ ID NO: 840620 - DNA, 25 bp, Mus musculus
ttcctacgccagagcatttgcagtg

SEQ ID NO: 840621 - DNA, 25 bp, Mus musculus
ttcctacgccagtgcatttgcagtg

SEQ ID NO: 840622 - DNA, 25 bp, Mus musculus
ttcctacgtgttccctggagttgct

SEQ ID NO: 840623 - DNA, 25 bp, Mus musculus
ttcctacgtgttgcctggagttgct

SEQ ID NO: 840624 - DNA, 25 bp, Mus musculus
ttcctactctgtccaggctgaaagg

SEQ ID NO: 840625 - DNA, 25 bp, Mus musculus
ttcctactctgtgcaggctgaaagg

SEQ ID NO: 840626 - DNA, 25 bp, Mus musculus
ttcctacttaccactggcacacatg

SEQ ID NO: 840627 - DNA, 25 bp, Mus musculus
ttcctacttacctctggcacacatg

SEQ ID NO: 840628 - DNA, 25 bp, Mus musculus
ttcctagaggaactcctggcttctg

SEQ ID NO: 840629 - DNA, 25 bp, Mus musculus
ttcctagaggaagtcctggcttctg

SEQ ID NO: 840630 - DNA, 25 bp, Mus musculus
ttcctagatagaccagaagaactgg

SEQ ID NO: 840631 - DNA, 25 bp, Mus musculus
ttcctagatagagcagaagaactgg

SEQ ID NO: 840632 - DNA, 25 bp, Mus musculus
ttcctagcacgtactcacagtattg

SEQ ID NO: 840633 - DNA, 25 bp, Mus musculus
ttcctagcacgttctcacagtattg

SEQ ID NO: 840634 - DNA, 25 bp, Mus musculus
ttcctagcactgacatggcaggtgt

SEQ ID NO: 840635 - DNA, 25 bp, Mus musculus
ttcctagcactgtcatggcaggtgt

SEQ ID NO: 840636 - DNA, 25 bp, Mus musculus
ttcctagcgttcagcatcatgctca

SEQ ID NO: 840637 - DNA, 25 bp, Mus musculus
ttcctagcgttctgcatcatgctca

SEQ ID NO: 840638 - DNA, 25 bp, Mus musculus
ttcctaggcgcgcacactgcagggc

SEQ ID NO: 840639 - DNA, 25 bp, Mus musculus
ttcctaggcgcggacactgcagggc

SEQ ID NO: 840640 - DNA, 25 bp, Mus musculus
ttcctatcactaccaagtagaactg

SEQ ID NO: 840641 - DNA, 25 bp, Mus musculus
ttcctatcactagcaagtagaactg

SEQ ID NO: 840642 - DNA, 25 bp, Mus musculus
ttcctatgttggctgggagcctgcc

SEQ ID NO: 840643 - DNA, 25 bp, Mus musculus
ttcctatgttgggtgggagcctgcc

SEQ ID NO: 840644 - DNA, 25 bp, Mus musculus
ttcctcaaacaaatcctagacggtg

SEQ ID NO: 840645 - DNA, 25 bp, Mus musculus
ttcctcaaacaattcctagacggtg

SEQ ID NO: 840646 - DNA, 25 bp, Mus musculus
ttcctcaaatatcagttcgacatcg

SEQ ID NO: 840647 - DNA, 25 bp, Mus musculus
ttcctcaaatatgagttcgacatcg

SEQ ID NO: 840648 - DNA, 25 bp, Mus musculus
ttcctcaaccagaggcagaaccagg

SEQ ID NO: 840649 - DNA, 25 bp, Mus musculus
ttcctcaaccagtggcagaaccagg

SEQ ID NO: 840650 - DNA, 25 bp, Mus musculus
ttcctcaactccaagcgtgagatcg

SEQ ID NO: 840651 - DNA, 25 bp, Mus musculus
ttcctcaactcctagcgtgagatcg

SEQ ID NO: 840652 - DNA, 25 bp, Mus musculus
ttcctcaagagacactgctttaacc

SEQ ID NO: 840653 - DNA, 25 bp, Mus musculus
ttcctcaagagagactgctttaacc

SEQ ID NO: 840654 - DNA, 25 bp, Mus musculus
ttcctcacaaggcaaaagaagctac

SEQ ID NO: 840655 - DNA, 25 bp, Mus musculus
ttcctcacaagggaaaagaagctac

SEQ ID NO: 840656 - DNA, 25 bp, Mus musculus
ttcctcacaggtaccacgagtcatg

SEQ ID NO: 840657 - DNA, 25 bp, Mus musculus
ttcctcacaggttccacgagtcatg

SEQ ID NO: 840658 - DNA, 25 bp, Mus musculus
ttcctcatgaagctgattaaccgcc

SEQ ID NO: 840659 - DNA, 25 bp, Mus musculus
ttcctcatgaaggtgattaaccgcc

SEQ ID NO: 840660 - DNA, 25 bp, Mus musculus
ttcctcatgaggctgctggactcct

SEQ ID NO: 840661 - DNA, 25 bp, Mus musculus
ttcctcatgagggtgctggactcct

SEQ ID NO: 840662 - DNA, 25 bp, Mus musculus
ttcctccaagatatggacagagaga

SEQ ID NO: 840663 - DNA, 25 bp, Mus musculus
ttcctccaagatttggacagagaga

SEQ ID NO: 840664 - DNA, 25 bp, Mus musculus
ttcctccaatgtagatgccgccttg

SEQ ID NO: 840665 - DNA, 25 bp, Mus musculus
ttcctccaatgttgatgccgccttg

SEQ ID NO: 840666 - DNA, 25 bp, Mus musculus
ttcctccacgcgctgcggttacact

SEQ ID NO: 840667 - DNA, 25 bp, Mus musculus
ttcctccacgcggtgcggttacact

SEQ ID NO: 840668 - DNA, 25 bp, Mus musculus
ttcctccacgtaacttgatgatcga

SEQ ID NO: 840669 - DNA, 25 bp, Mus musculus
ttcctccacgtatcttgatgatcga

SEQ ID NO: 840670 - DNA, 25 bp, Mus musculus
ttcctccacgtcagtggatctgcag

SEQ ID NO: 840671 - DNA, 25 bp, Mus musculus
ttcctccacgtctgtggatctgcag

SEQ ID NO: 840672 - DNA, 25 bp, Mus musculus
ttcctccagagaccttcgtggttct

SEQ ID NO: 840673 - DNA, 25 bp, Mus musculus
ttcctccagagagcttcgtggttct

SEQ ID NO: 840674 - DNA, 25 bp, Mus musculus
ttcctccaggacaatactttgctga

SEQ ID NO: 840675 - DNA, 25 bp, Mus musculus
ttcctccaggactatactttgctga

SEQ ID NO: 840676 - DNA, 25 bp, Mus musculus
ttcctccctgtcatagatcaacggg

SEQ ID NO: 840677 - DNA, 25 bp, Mus musculus
ttcctccctgtcttagatcaacggg

SEQ ID NO: 840678 - DNA, 25 bp, Mus musculus
ttcctcccttccaccggagctgctg

SEQ ID NO: 840679 - DNA, 25 bp, Mus musculus
ttcctcccttcctccggagctgctg

SEQ ID NO: 840680 - DNA, 25 bp, Mus musculus
ttcctccgacagctctgccagctgg

SEQ ID NO: 840681 - DNA, 25 bp, Mus musculus
ttcctccgacaggtctgccagctgg

SEQ ID NO: 840682 - DNA, 25 bp, Mus musculus
ttcctccgcctaaggcaggtgggag

SEQ ID NO: 840683 - DNA, 25 bp, Mus musculus
ttcctccgcctatggcaggtgggag

SEQ ID NO: 840684 - DNA, 25 bp, Mus musculus
ttcctcctgaagatcaggatggctc

SEQ ID NO: 840685 - DNA, 25 bp, Mus musculus
ttcctcctgaagttcaggatggctc

SEQ ID NO: 840686 - DNA, 25 bp, Mus musculus
ttcctcctggccatgataggctcca

SEQ ID NO: 840687 - DNA, 25 bp, Mus musculus
ttcctcctggccttgataggctcca

SEQ ID NO: 840688 - DNA, 25 bp, Mus musculus
ttcctcctgggcagctttgtcgtgc

SEQ ID NO: 840689 - DNA, 25 bp, Mus musculus
ttcctcctgggctgctttgtcgtgc

SEQ ID NO: 840690 - DNA, 25 bp, Mus musculus
ttcctccttcacactagcaaaaaga

SEQ ID NO: 840691 - DNA, 25 bp, Mus musculus
ttcctccttcactctagcaaaaaga

SEQ ID NO: 840692 - DNA, 25 bp, Mus musculus
ttcctcgcatggctgggccagccag

SEQ ID NO: 840693 - DNA, 25 bp, Mus musculus
ttcctcgcatgggtgggccagccag

SEQ ID NO: 840694 - DNA, 25 bp, Mus musculus
ttcctcggccgaacatggcagcgct

SEQ ID NO: 840695 - DNA, 25 bp, Mus musculus
ttcctcggccgatcatggcagcgct

SEQ ID NO: 840696 - DNA, 25 bp, Mus musculus
ttcctcggcgtcacggagcgagcgc

SEQ ID NO: 840697 - DNA, 25 bp, Mus musculus
ttcctcggcgtctcggagcgagcgc

SEQ ID NO: 840698 - DNA, 25 bp, Mus musculus
ttcctcgtaagtcatcagagccgct

SEQ ID NO: 840699 - DNA, 25 bp, Mus musculus
ttcctcgtaagtgatcagagccgct

SEQ ID NO: 840700 - DNA, 25 bp, Mus musculus
ttcctcgtggtaaaactacagagag

SEQ ID NO: 840701 - DNA, 25 bp, Mus musculus
ttcctcgtggtataactacagagag

SEQ ID NO: 840702 - DNA, 25 bp, Mus musculus
ttcctcgttcgacagagccagagcc

SEQ ID NO: 840703 - DNA, 25 bp, Mus musculus
ttcctcgttcgagagagccagagcc

SEQ ID NO: 840704 - DNA, 25 bp, Mus musculus
ttcctctacaccaatggcaagtgcg

SEQ ID NO: 840705 - DNA, 25 bp, Mus musculus
ttcctctacacctatggcaagtgcg

SEQ ID NO: 840706 - DNA, 25 bp, Mus musculus
ttcctctccgaacggctggtaactt

SEQ ID NO: 840707 - DNA, 25 bp, Mus musculus
ttcctctccgaagggctggtaactt

SEQ ID NO: 840708 - DNA, 25 bp, Mus musculus
ttcctctctaccaaggcttcctgat

SEQ ID NO: 840709 - DNA, 25 bp, Mus musculus
ttcctctctacctaggcttcctgat

SEQ ID NO: 840710 - DNA, 25 bp, Mus musculus
ttcctctgcctgagttccctgagca

SEQ ID NO: 840711 - DNA, 25 bp, Mus musculus
ttcctctgcctgtgttccctgagca

SEQ ID NO: 840712 - DNA, 25 bp, Mus musculus
ttcctctgcgaaaccaaatcggagg

SEQ ID NO: 840713 - DNA, 25 bp, Mus musculus
ttcctctgcgaatccaaatcggagg

SEQ ID NO: 840714 - DNA, 25 bp, Mus musculus
ttcctcttatacagcaatatgactg

SEQ ID NO: 840715 - DNA, 25 bp, Mus musculus
ttcctcttatactgcaatatgactg

SEQ ID NO: 840716 - DNA, 25 bp, Mus musculus
ttcctcttccgactaacggtgacca

SEQ ID NO: 840717 - DNA, 25 bp, Mus musculus
ttcctcttccgagtaacggtgacca

SEQ ID NO: 840718 - DNA, 25 bp, Mus musculus
ttcctctttcaactgcatcttcctg

SEQ ID NO: 840719 - DNA, 25 bp, Mus musculus
ttcctctttcaagtgcatcttcctg

SEQ ID NO: 840720 - DNA, 25 bp, Mus musculus
ttcctgaacatcaatgagcctgact

SEQ ID NO: 840721 - DNA, 25 bp, Mus musculus
ttcctgaacatctatgagcctgact

SEQ ID NO: 840722 - DNA, 25 bp, Mus musculus
ttcctgaactgcatcgtggaggagc

SEQ ID NO: 840723 - DNA, 25 bp, Mus musculus
ttcctgaactgcttcgtggaggagc

SEQ ID NO: 840724 - DNA, 25 bp, Mus musculus
ttcctgaagcagagcgcctcatcgt

SEQ ID NO: 840725 - DNA, 25 bp, Mus musculus
ttcctgaagcagtgcgcctcatcgt

SEQ ID NO: 840726 - DNA, 25 bp, Mus musculus
ttcctgaaggacattctgcacaagg

SEQ ID NO: 840727 - DNA, 25 bp, Mus musculus
ttcctgaaggactttctgcacaagg

SEQ ID NO: 840728 - DNA, 25 bp, Mus musculus
ttcctgaaggctcgtcgcaagtgtg

SEQ ID NO: 840729 - DNA, 25 bp, Mus musculus
ttcctgaaggctggtcgcaagtgtg

SEQ ID NO: 840730 - DNA, 25 bp, Mus musculus
ttcctgaagttgaagccctgctggc

SEQ ID NO: 840731 - DNA, 25 bp, Mus musculus
ttcctgaagttgtagccctgctggc

SEQ ID NO: 840732 - DNA, 25 bp, Mus musculus
ttcctgacatctaagggactcccag

SEQ ID NO: 840733 - DNA, 25 bp, Mus musculus
ttcctgacatcttagggactcccag

SEQ ID NO: 840734 - DNA, 25 bp, Mus musculus
ttcctgacattgaggatttctgtga

SEQ ID NO: 840735 - DNA, 25 bp, Mus musculus
ttcctgacattgtggatttctgtga

SEQ ID NO: 840736 - DNA, 25 bp, Mus musculus
ttcctgaccaagaaaacccgcggag

SEQ ID NO: 840737 - DNA, 25 bp, Mus musculus
ttcctgaccaagtaaacccgcggag

SEQ ID NO: 840738 - DNA, 25 bp, Mus musculus
ttcctgaccatcagcagctgaaaga

SEQ ID NO: 840739 - DNA, 25 bp, Mus musculus
ttcctgaccatctgcagctgaaaga

SEQ ID NO: 840740 - DNA, 25 bp, Mus musculus
ttcctgacctagcaaacctgtgtgg

SEQ ID NO: 840741 - DNA, 25 bp, Mus musculus
ttcctgacctaggaaacctgtgtgg

SEQ ID NO: 840742 - DNA, 25 bp, Mus musculus
ttcctgactctgcagttgctagtgc

SEQ ID NO: 840743 - DNA, 25 bp, Mus musculus
ttcctgactctggagttgctagtgc

SEQ ID NO: 840744 - DNA, 25 bp, Mus musculus
ttcctgagaactagagaggttcaca

SEQ ID NO: 840745 - DNA, 25 bp, Mus musculus
ttcctgagaacttgagaggttcaca

SEQ ID NO: 840746 - DNA, 25 bp, Mus musculus
ttcctgagaagtcgaccccagaggt

SEQ ID NO: 840747 - DNA, 25 bp, Mus musculus
ttcctgagaagtggaccccagaggt

SEQ ID NO: 840748 - DNA, 25 bp, Mus musculus
ttcctgagagacagggaatccccat

SEQ ID NO: 840749 - DNA, 25 bp, Mus musculus
ttcctgagagactgggaatccccat

SEQ ID NO: 840750 - DNA, 25 bp, Mus musculus
ttcctgagagcacagcctcaaaggc

SEQ ID NO: 840751 - DNA, 25 bp, Mus musculus
ttcctgagagcagagcctcaaaggc

SEQ ID NO: 840752 - DNA, 25 bp, Mus musculus
ttcctgagccagagatactgcccag

SEQ ID NO: 840753 - DNA, 25 bp, Mus musculus
ttcctgagccagtgatactgcccag

SEQ ID NO: 840754 - DNA, 25 bp, Mus musculus
ttcctgagctccatccgggtgccat

SEQ ID NO: 840755 - DNA, 25 bp, Mus musculus
ttcctgagctccttccgggtgccat

SEQ ID NO: 840756 - DNA, 25 bp, Mus musculus
ttcctgaggacgacagagaaaaacg

SEQ ID NO: 840757 - DNA, 25 bp, Mus musculus
ttcctgaggacgtcagagaaaaacg

SEQ ID NO: 840758 - DNA, 25 bp, Mus musculus
ttcctgagtaccatggagaaacgga

SEQ ID NO: 840759 - DNA, 25 bp, Mus musculus
ttcctgagtaccttggagaaacgga

SEQ ID NO: 840760 - DNA, 25 bp, Mus musculus
ttcctgagtctgagcagggaggccc

SEQ ID NO: 840761 - DNA, 25 bp, Mus musculus
ttcctgagtctgtgcagggaggccc

SEQ ID NO: 840762 - DNA, 25 bp, Mus musculus
ttcctgataactagctgtgtgagcc

SEQ ID NO: 840763 - DNA, 25 bp, Mus musculus
ttcctgataacttgctgtgtgagcc

SEQ ID NO: 840764 - DNA, 25 bp, Mus musculus
ttcctgatctgcagctgccccgaat

SEQ ID NO: 840765 - DNA, 25 bp, Mus musculus
ttcctgatctgctgctgccccgaat

SEQ ID NO: 840766 - DNA, 25 bp, Mus musculus
ttcctgatgatgaccagcctatcgc

SEQ ID NO: 840767 - DNA, 25 bp, Mus musculus
ttcctgatgatgtccagcctatcgc

SEQ ID NO: 840768 - DNA, 25 bp, Mus musculus
ttcctgatgctgctggacccgctca

SEQ ID NO: 840769 - DNA, 25 bp, Mus musculus
ttcctgatgctggtggacccgctca

SEQ ID NO: 840770 - DNA, 25 bp, Mus musculus
ttcctgatggttagcccgaggcagg

SEQ ID NO: 840771 - DNA, 25 bp, Mus musculus
ttcctgatggtttgcccgaggcagg

SEQ ID NO: 840772 - DNA, 25 bp, Mus musculus
ttcctgatttgaaaagaagcagcgg

SEQ ID NO: 840773 - DNA, 25 bp, Mus musculus
ttcctgatttgataagaagcagcgg

SEQ ID NO: 840774 - DNA, 25 bp, Mus musculus
ttcctgcacaaacccaaggataaga

SEQ ID NO: 840775 - DNA, 25 bp, Mus musculus
ttcctgcacaaagccaaggataaga

SEQ ID NO: 840776 - DNA, 25 bp, Mus musculus
ttcctgcacactacattggctggta

SEQ ID NO: 840777 - DNA, 25 bp, Mus musculus
ttcctgcacacttcattggctggta

SEQ ID NO: 840778 - DNA, 25 bp, Mus musculus
ttcctgcacatcctgctgccagttg

SEQ ID NO: 840779 - DNA, 25 bp, Mus musculus
ttcctgcacatcgtgctgccagttg

SEQ ID NO: 840780 - DNA, 25 bp, Mus musculus
ttcctgcaccagagccctgtgggac

SEQ ID NO: 840781 - DNA, 25 bp, Mus musculus
ttcctgcaccagtgccctgtgggac

SEQ ID NO: 840782 - DNA, 25 bp, Mus musculus
ttcctgcagcagcacaaaaaggaag

SEQ ID NO: 840783 - DNA, 25 bp, Mus musculus
ttcctgcagcaggacaaaaaggaag

SEQ ID NO: 840784 - DNA, 25 bp, Mus musculus
ttcctgcagcggctaactgaataca

SEQ ID NO: 840785 - DNA, 25 bp, Mus musculus
ttcctgcagcgggtaactgaataca

SEQ ID NO: 840786 - DNA, 25 bp, Mus musculus
ttcctgcaggtgcatggccgagcct

SEQ ID NO: 840787 - DNA, 25 bp, Mus musculus
ttcctgcaggtggatggccgagcct

SEQ ID NO: 840788 - DNA, 25 bp, Mus musculus
ttcctgcagtaaaatgggagacaga

SEQ ID NO: 840789 - DNA, 25 bp, Mus musculus
ttcctgcagtaatatgggagacaga

SEQ ID NO: 840790 - DNA, 25 bp, Mus musculus
ttcctgcagtctactgagcctgagt

SEQ ID NO: 840791 - DNA, 25 bp, Mus musculus
ttcctgcagtcttctgagcctgagt

SEQ ID NO: 840792 - DNA, 25 bp, Mus musculus
ttcctgccagaactgtattctctca

SEQ ID NO: 840793 - DNA, 25 bp, Mus musculus
ttcctgccagaagtgtattctctca

SEQ ID NO: 840794 - DNA, 25 bp, Mus musculus
ttcctgcccagcagttacctgccgc

SEQ ID NO: 840795 - DNA, 25 bp, Mus musculus
ttcctgcccagctgttacctgccgc

SEQ ID NO: 840796 - DNA, 25 bp, Mus musculus
ttcctgcccggactgtgaactcatc

SEQ ID NO: 840797 - DNA, 25 bp, Mus musculus
ttcctgcccggagtgtgaactcatc

SEQ ID NO: 840798 - DNA, 25 bp, Mus musculus
ttcctgccctacaagacactggtct

SEQ ID NO: 840799 - DNA, 25 bp, Mus musculus
ttcctgccctactagacactggtct

SEQ ID NO: 840800 - DNA, 25 bp, Mus musculus
ttcctgccctgtaagataaaagttt

SEQ ID NO: 840801 - DNA, 25 bp, Mus musculus
ttcctgccctgttagataaaagttt

SEQ ID NO: 840802 - DNA, 25 bp, Mus musculus
ttcctgccggccagcatgctgtggg

SEQ ID NO: 840803 - DNA, 25 bp, Mus musculus
ttcctgccggcctgcatgctgtggg

SEQ ID NO: 840804 - DNA, 25 bp, Mus musculus
ttcctgcctacgagaggctcaactg

SEQ ID NO: 840805 - DNA, 25 bp, Mus musculus
ttcctgcctacgtgaggctcaactg

SEQ ID NO: 840806 - DNA, 25 bp, Mus musculus
ttcctgcctcagaagccattcttca

SEQ ID NO: 840807 - DNA, 25 bp, Mus musculus
ttcctgcctcagtagccattcttca

SEQ ID NO: 840808 - DNA, 25 bp, Mus musculus
ttcctgcgccaaacttgggtgaagg

SEQ ID NO: 840809 - DNA, 25 bp, Mus musculus
ttcctgcgccaatcttgggtgaagg

SEQ ID NO: 840810 - DNA, 25 bp, Mus musculus
ttcctgcggataaagacagcacttc

SEQ ID NO: 840811 - DNA, 25 bp, Mus musculus
ttcctgcggatatagacagcacttc

SEQ ID NO: 840812 - DNA, 25 bp, Mus musculus
ttcctgcggcagatggcgcagccct

SEQ ID NO: 840813 - DNA, 25 bp, Mus musculus
ttcctgcggcagttggcgcagccct

SEQ ID NO: 840814 - DNA, 25 bp, Mus musculus
ttcctgcggcgccttagggaccatg

SEQ ID NO: 840815 - DNA, 25 bp, Mus musculus
ttcctgcggcgcgttagggaccatg

SEQ ID NO: 840816 - DNA, 25 bp, Mus musculus
ttcctgcgggaactatctgtcatga

SEQ ID NO: 840817 - DNA, 25 bp, Mus musculus
ttcctgcgggaagtatctgtcatga

SEQ ID NO: 840818 - DNA, 25 bp, Mus musculus
ttcctgcgggcacctaaggaccaga

SEQ ID NO: 840819 - DNA, 25 bp, Mus musculus
ttcctgcgggcagctaaggaccaga

SEQ ID NO: 840820 - DNA, 25 bp, Mus musculus
ttcctgcgtgtgcaccttggtggtc

SEQ ID NO: 840821 - DNA, 25 bp, Mus musculus
ttcctgcgtgtggaccttggtggtc

SEQ ID NO: 840822 - DNA, 25 bp, Mus musculus
ttcctgctcagtcgtcctctggctg

SEQ ID NO: 840823 - DNA, 25 bp, Mus musculus
ttcctgctcagtggtcctctggctg

SEQ ID NO: 840824 - DNA, 25 bp, Mus musculus
ttcctgctcttcactaccttttatc

SEQ ID NO: 840825 - DNA, 25 bp, Mus musculus
ttcctgctcttctctaccttttatc

SEQ ID NO: 840826 - DNA, 25 bp, Mus musculus
ttcctgctgcatctgagcctgtgat

SEQ ID NO: 840827 - DNA, 25 bp, Mus musculus
ttcctgctgcatgtgagcctgtgat

SEQ ID NO: 840828 - DNA, 25 bp, Mus musculus
ttcctgctgcttcccctggtggttg

SEQ ID NO: 840829 - DNA, 25 bp, Mus musculus
ttcctgctgcttgccctggtggttg

SEQ ID NO: 840830 - DNA, 25 bp, Mus musculus
ttcctgctgtacaaccaagggccag

SEQ ID NO: 840831 - DNA, 25 bp, Mus musculus
ttcctgctgtactaccaagggccag

SEQ ID NO: 840832 - DNA, 25 bp, Mus musculus
ttcctgcttctgcttttcgtggcag

SEQ ID NO: 840833 - DNA, 25 bp, Mus musculus
ttcctgcttctggttttcgtggcag

SEQ ID NO: 840834 - DNA, 25 bp, Mus musculus
ttcctgcttttgaggcaggacctcc

SEQ ID NO: 840835 - DNA, 25 bp, Mus musculus
ttcctgcttttgtggcaggacctcc

SEQ ID NO: 840836 - DNA, 25 bp, Mus musculus
ttcctggaacatccacctatgccat

SEQ ID NO: 840837 - DNA, 25 bp, Mus musculus
ttcctggaacatgcacctatgccat

SEQ ID NO: 840838 - DNA, 25 bp, Mus musculus
ttcctggaagatcttaggcatgcac

SEQ ID NO: 840839 - DNA, 25 bp, Mus musculus
ttcctggaagatgttaggcatgcac

SEQ ID NO: 840840 - DNA, 25 bp, Mus musculus
ttcctggaattcaaatctgagtggg

SEQ ID NO: 840841 - DNA, 25 bp, Mus musculus
ttcctggaattctaatctgagtggg

SEQ ID NO: 840842 - DNA, 25 bp, Mus musculus
ttcctggacaggaaccacttgtctt

SEQ ID NO: 840843 - DNA, 25 bp, Mus musculus
ttcctggacaggtaccacttgtctt

SEQ ID NO: 840844 - DNA, 25 bp, Mus musculus
ttcctggacctcctgagtgtcttca

SEQ ID NO: 840845 - DNA, 25 bp, Mus musculus
ttcctggacctcgtgagtgtcttca

SEQ ID NO: 840846 - DNA, 25 bp, Mus musculus
ttcctggacgtcagtgggactttcc

SEQ ID NO: 840847 - DNA, 25 bp, Mus musculus
ttcctggacgtctgtgggactttcc

SEQ ID NO: 840848 - DNA, 25 bp, Mus musculus
ttcctggactggacagagaggctag

SEQ ID NO: 840849 - DNA, 25 bp, Mus musculus
ttcctggactggtcagagaggctag

SEQ ID NO: 840850 - DNA, 25 bp, Mus musculus
ttcctggagaacagctacaacccgc

SEQ ID NO: 840851 - DNA, 25 bp, Mus musculus
ttcctggagaactgctacaacccgc

SEQ ID NO: 840852 - DNA, 25 bp, Mus musculus
ttcctggagacgacagccctcgact

SEQ ID NO: 840853 - DNA, 25 bp, Mus musculus
ttcctggagacgtcagccctcgact

SEQ ID NO: 840854 - DNA, 25 bp, Mus musculus
ttcctggaggtcactcagggcaccg

SEQ ID NO: 840855 - DNA, 25 bp, Mus musculus
ttcctggaggtctctcagggcaccg

SEQ ID NO: 840856 - DNA, 25 bp, Mus musculus
ttcctggatgtaagcacaggattga

SEQ ID NO: 840857 - DNA, 25 bp, Mus musculus
ttcctggatgtatgcacaggattga

SEQ ID NO: 840858 - DNA, 25 bp, Mus musculus
ttcctggattatatcatgggtggct

SEQ ID NO: 840859 - DNA, 25 bp, Mus musculus
ttcctggattatttcatgggtggct

SEQ ID NO: 840860 - DNA, 25 bp, Mus musculus
ttcctggcacatcagcgcttccagt

SEQ ID NO: 840861 - DNA, 25 bp, Mus musculus
ttcctggcacatgagcgcttccagt

SEQ ID NO: 840862 - DNA, 25 bp, Mus musculus
ttcctggcagccaaggacctgcctt

SEQ ID NO: 840863 - DNA, 25 bp, Mus musculus
ttcctggcagcctaggacctgcctt

SEQ ID NO: 840864 - DNA, 25 bp, Mus musculus
ttcctggccaaccagtggcaagtct

SEQ ID NO: 840865 - DNA, 25 bp, Mus musculus
ttcctggccaacgagtggcaagtct

SEQ ID NO: 840866 - DNA, 25 bp, Mus musculus
ttcctggccgagaaggagtcattga

SEQ ID NO: 840867 - DNA, 25 bp, Mus musculus
ttcctggccgagtaggagtcattga

SEQ ID NO: 840868 - DNA, 25 bp, Mus musculus
ttcctggctgagcttgttgctggca

SEQ ID NO: 840869 - DNA, 25 bp, Mus musculus
ttcctggctgaggttgttgctggca

SEQ ID NO: 840870 - DNA, 25 bp, Mus musculus
ttcctgggaacgagcgaccagacct

SEQ ID NO: 840871 - DNA, 25 bp, Mus musculus
ttcctgggaacgtgcgaccagacct

SEQ ID NO: 840872 - DNA, 25 bp, Mus musculus
ttcctgggaagcagaagacccaacc

SEQ ID NO: 840873 - DNA, 25 bp, Mus musculus
ttcctgggaagctgaagacccaacc

SEQ ID NO: 840874 - DNA, 25 bp, Mus musculus
ttcctgggagatacaagaaaaggct

SEQ ID NO: 840875 - DNA, 25 bp, Mus musculus
ttcctgggagattcaagaaaaggct

SEQ ID NO: 840876 - DNA, 25 bp, Mus musculus
ttcctgggcacaccagtcctggagc

SEQ ID NO: 840877 - DNA, 25 bp, Mus musculus
ttcctgggcacagcagtcctggagc

SEQ ID NO: 840878 - DNA, 25 bp, Mus musculus
ttcctgggccctaagaagagacgtc

SEQ ID NO: 840879 - DNA, 25 bp, Mus musculus
ttcctgggcccttagaagagacgtc

SEQ ID NO: 840880 - DNA, 25 bp, Mus musculus
ttcctgggccgcagcgcagagtaca

SEQ ID NO: 840881 - DNA, 25 bp, Mus musculus
ttcctgggccgctgcgcagagtaca

SEQ ID NO: 840882 - DNA, 25 bp, Mus musculus
ttcctgggcctgcagttggcgatta

SEQ ID NO: 840883 - DNA, 25 bp, Mus musculus
ttcctgggcctggagttggcgatta

SEQ ID NO: 840884 - DNA, 25 bp, Mus musculus
ttcctgggcgagaccaagcaggaga

SEQ ID NO: 840885 - DNA, 25 bp, Mus musculus
ttcctgggcgagtccaagcaggaga

SEQ ID NO: 840886 - DNA, 25 bp, Mus musculus
ttcctgggctcaatcatattcctgg

SEQ ID NO: 840887 - DNA, 25 bp, Mus musculus
ttcctgggctcattcatattcctgg

SEQ ID NO: 840888 - DNA, 25 bp, Mus musculus
ttcctggtatatcactatgactcca

SEQ ID NO: 840889 - DNA, 25 bp, Mus musculus
ttcctggtatatgactatgactcca

SEQ ID NO: 840890 - DNA, 25 bp, Mus musculus
ttcctggtcaaacttgaattctcct

SEQ ID NO: 840891 - DNA, 25 bp, Mus musculus
ttcctggtcaaagttgaattctcct

SEQ ID NO: 840892 - DNA, 25 bp, Mus musculus
ttcctggtcaggaagccgtccgacc

SEQ ID NO: 840893 - DNA, 25 bp, Mus musculus
ttcctggtcaggtagccgtccgacc

SEQ ID NO: 840894 - DNA, 25 bp, Mus musculus
ttcctggtgcggcactcgagcacca

SEQ ID NO: 840895 - DNA, 25 bp, Mus musculus
ttcctggtgcggcagagtgagtccc

SEQ ID NO: 840896 - DNA, 25 bp, Mus musculus
ttcctggtgcgggactcgagcacca

SEQ ID NO: 840897 - DNA, 25 bp, Mus musculus
ttcctggtgcgggagagtgagtccc

SEQ ID NO: 840898 - DNA, 25 bp, Mus musculus
ttcctggtgtcgcagagagccgtcc

SEQ ID NO: 840899 - DNA, 25 bp, Mus musculus
ttcctggtgtcggagagagccgtcc

SEQ ID NO: 840900 - DNA, 25 bp, Mus musculus
ttcctggtgtgcagccaaggcttcg

SEQ ID NO: 840901 - DNA, 25 bp, Mus musculus
ttcctggtgtgctgccaaggcttcg

SEQ ID NO: 840902 - DNA, 25 bp, Mus musculus
ttcctggttcaacactactttgtgc

SEQ ID NO: 840903 - DNA, 25 bp, Mus musculus
ttcctggttcaagactactttgtgc

SEQ ID NO: 840904 - DNA, 25 bp, Mus musculus
ttcctggttcctatctgagtcagaa

SEQ ID NO: 840905 - DNA, 25 bp, Mus musculus
ttcctggttcctttctgagtcagaa

SEQ ID NO: 840906 - DNA, 25 bp, Mus musculus
ttcctggttcgcctggtctcaagga

SEQ ID NO: 840907 - DNA, 25 bp, Mus musculus
ttcctggttcgcgtggtctcaagga

SEQ ID NO: 840908 - DNA, 25 bp, Mus musculus
ttcctggttgatatgtcagagctct

SEQ ID NO: 840909 - DNA, 25 bp, Mus musculus
ttcctggttgatttgtcagagctct

SEQ ID NO: 840910 - DNA, 25 bp, Mus musculus
ttcctggtttatcagggccagcagt

SEQ ID NO: 840911 - DNA, 25 bp, Mus musculus
ttcctggtttatgagggccagcagt

SEQ ID NO: 840912 - DNA, 25 bp, Mus musculus
ttcctggtttgacgaggctgttcag

SEQ ID NO: 840913 - DNA, 25 bp, Mus musculus
ttcctggtttgaggaggctgttcag

SEQ ID NO: 840914 - DNA, 25 bp, Mus musculus
ttcctgtaatggacaaacttgatgc

SEQ ID NO: 840915 - DNA, 25 bp, Mus musculus
ttcctgtaatggtcaaacttgatgc

SEQ ID NO: 840916 - DNA, 25 bp, Mus musculus
ttcctgtcccaacatgagatacaag

SEQ ID NO: 840917 - DNA, 25 bp, Mus musculus
ttcctgtcccaagatgagatacaag

SEQ ID NO: 840918 - DNA, 25 bp, Mus musculus
ttcctgtccctcatggagagtggct

SEQ ID NO: 840919 - DNA, 25 bp, Mus musculus
ttcctgtccctcttggagagtggct

SEQ ID NO: 840920 - DNA, 25 bp, Mus musculus
ttcctgtccgagatccgggctctgc

SEQ ID NO: 840921 - DNA, 25 bp, Mus musculus
ttcctgtccgagttccgggctctgc

SEQ ID NO: 840922 - DNA, 25 bp, Mus musculus
ttcctgtccggaaccttcatagcca

SEQ ID NO: 840923 - DNA, 25 bp, Mus musculus
ttcctgtccggatccttcatagcca

SEQ ID NO: 840924 - DNA, 25 bp, Mus musculus
ttcctgtccggtcagcgtcgaacga

SEQ ID NO: 840925 - DNA, 25 bp, Mus musculus
ttcctgtccggtgagcgtcgaacga

SEQ ID NO: 840926 - DNA, 25 bp, Mus musculus
ttcctgtctggcaggaaacatggcg

SEQ ID NO: 840927 - DNA, 25 bp, Mus musculus
ttcctgtctggctggaaacatggcg

SEQ ID NO: 840928 - DNA, 25 bp, Mus musculus
ttcctgtgatgccagggagcataga

SEQ ID NO: 840929 - DNA, 25 bp, Mus musculus
ttcctgtgatgcgagggagcataga

SEQ ID NO: 840930 - DNA, 25 bp, Mus musculus
ttcctgtgcaggagttcttccagga

SEQ ID NO: 840931 - DNA, 25 bp, Mus musculus
ttcctgtgcaggtgttcttccagga

SEQ ID NO: 840932 - DNA, 25 bp, Mus musculus
ttcctgtgccctcacgacatgactg

SEQ ID NO: 840933 - DNA, 25 bp, Mus musculus
ttcctgtgccctgacgacatgactg

SEQ ID NO: 840934 - DNA, 25 bp, Mus musculus
ttcctgtgctcccagtaggtgggtt

SEQ ID NO: 840935 - DNA, 25 bp, Mus musculus
ttcctgtgctccgagtaggtgggtt

SEQ ID NO: 840936 - DNA, 25 bp, Mus musculus
ttcctgtgctgcctgcgcgacattc

SEQ ID NO: 840937 - DNA, 25 bp, Mus musculus
ttcctgtgctgcgtgcgcgacattc

SEQ ID NO: 840938 - DNA, 25 bp, Mus musculus
ttcctgtggcgccttgcgacatgga

SEQ ID NO: 840939 - DNA, 25 bp, Mus musculus
ttcctgtggcgcgttgcgacatgga

SEQ ID NO: 840940 - DNA, 25 bp, Mus musculus
ttcctgtgttgtccgcgccctggac

SEQ ID NO: 840941 - DNA, 25 bp, Mus musculus
ttcctgtgttgtgcgcgccctggac

SEQ ID NO: 840942 - DNA, 25 bp, Mus musculus
ttcctgttatatatgaacggcatca

SEQ ID NO: 840943 - DNA, 25 bp, Mus musculus
ttcctgttatatttgaacggcatca

SEQ ID NO: 840944 - DNA, 25 bp, Mus musculus
ttcctgttcaccaatgtcctgctgg

SEQ ID NO: 840945 - DNA, 25 bp, Mus musculus
ttcctgttcacctatgtcctgctgg

SEQ ID NO: 840946 - DNA, 25 bp, Mus musculus
ttcctgttcattctgggagtcacct

SEQ ID NO: 840947 - DNA, 25 bp, Mus musculus
ttcctgttcattgtgggagtcacct

SEQ ID NO: 840948 - DNA, 25 bp, Mus musculus
ttcctgttccctcgagcttcattct

SEQ ID NO: 840949 - DNA, 25 bp, Mus musculus
ttcctgttccctggagcttcattct

SEQ ID NO: 840950 - DNA, 25 bp, Mus musculus
ttcctgttctgtagccgttccaact

SEQ ID NO: 840951 - DNA, 25 bp, Mus musculus
ttcctgttctgttgccgttccaact

SEQ ID NO: 840952 - DNA, 25 bp, Mus musculus
ttcctgttgcgcagcagacccgctt

SEQ ID NO: 840953 - DNA, 25 bp, Mus musculus
ttcctgttgcgctgcagacccgctt

SEQ ID NO: 840954 - DNA, 25 bp, Mus musculus
ttccttacaggacgcccggagaggt

SEQ ID NO: 840955 - DNA, 25 bp, Mus musculus
ttccttacaggaggcccggagaggt

SEQ ID NO: 840956 - DNA, 25 bp, Mus musculus
ttccttagccccagcgggaagctag

SEQ ID NO: 840957 - DNA, 25 bp, Mus musculus
ttccttagcccctgcgggaagctag

SEQ ID NO: 840958 - DNA, 25 bp, Mus musculus
ttccttagcggcagagcctggccca

SEQ ID NO: 840959 - DNA, 25 bp, Mus musculus
ttccttagcggctgagcctggccca

SEQ ID NO: 840960 - DNA, 25 bp, Mus musculus
ttccttcacggaatgggagatacag

SEQ ID NO: 840961 - DNA, 25 bp, Mus musculus
ttccttcacggattgggagatacag

SEQ ID NO: 840962 - DNA, 25 bp, Mus musculus
ttccttcagactcaactgggccact

SEQ ID NO: 840963 - DNA, 25 bp, Mus musculus
ttccttcagactgaactgggccact

SEQ ID NO: 840964 - DNA, 25 bp, Mus musculus
ttccttcagctcctggttccttcag

SEQ ID NO: 840965 - DNA, 25 bp, Mus musculus
ttccttcagctcgtggttccttcag

SEQ ID NO: 840966 - DNA, 25 bp, Mus musculus
ttccttccaaagagcagcgttgcgc

SEQ ID NO: 840967 - DNA, 25 bp, Mus musculus
ttccttccaaagtgcagcgttgcgc

SEQ ID NO: 840968 - DNA, 25 bp, Mus musculus
ttccttccaacaagtggctccatgc

SEQ ID NO: 840969 - DNA, 25 bp, Mus musculus
ttccttccaacatgtggctccatgc

SEQ ID NO: 840970 - DNA, 25 bp, Mus musculus
ttccttccatgcaggccacacaaga

SEQ ID NO: 840971 - DNA, 25 bp, Mus musculus
ttccttccatgctggccacacaaga

SEQ ID NO: 840972 - DNA, 25 bp, Mus musculus
ttccttcccaggctgtgtctcgtgt

SEQ ID NO: 840973 - DNA, 25 bp, Mus musculus
ttccttcccagggtgtgtctcgtgt

SEQ ID NO: 840974 - DNA, 25 bp, Mus musculus
ttccttcctgcacagtgtggaaaat

SEQ ID NO: 840975 - DNA, 25 bp, Mus musculus
ttccttcctgcagagtgtggaaaat

SEQ ID NO: 840976 - DNA, 25 bp, Mus musculus
ttccttcgggcgagtgccttaccca

SEQ ID NO: 840977 - DNA, 25 bp, Mus musculus
ttccttcgggcgtgtgccttaccca

SEQ ID NO: 840978 - DNA, 25 bp, Mus musculus
ttccttctcctcatcgcggtggcag

SEQ ID NO: 840979 - DNA, 25 bp, Mus musculus
ttccttctcctccagaggtggccat

SEQ ID NO: 840980 - DNA, 25 bp, Mus musculus
ttccttctcctcgagaggtggccat

SEQ ID NO: 840981 - DNA, 25 bp, Mus musculus
ttccttctcctcttcgcggtggcag

SEQ ID NO: 840982 - DNA, 25 bp, Mus musculus
ttccttctgaagaggttaagcagag

SEQ ID NO: 840983 - DNA, 25 bp, Mus musculus
ttccttctgaagtggttaagcagag

SEQ ID NO: 840984 - DNA, 25 bp, Mus musculus
ttccttctggagaacgtcaggaact

SEQ ID NO: 840985 - DNA, 25 bp, Mus musculus
ttccttctggagtacgtcaggaact

SEQ ID NO: 840986 - DNA, 25 bp, Mus musculus
ttccttctggcacaagtctcttggg

SEQ ID NO: 840987 - DNA, 25 bp, Mus musculus
ttccttctggcagaagtctcttggg

SEQ ID NO: 840988 - DNA, 25 bp, Mus musculus
ttccttctgggcagtagcaactttg

SEQ ID NO: 840989 - DNA, 25 bp, Mus musculus
ttccttctgggctgtagcaactttg

SEQ ID NO: 840990 - DNA, 25 bp, Mus musculus
ttccttctgttcagcctgctgcaaa

SEQ ID NO: 840991 - DNA, 25 bp, Mus musculus
ttccttctgttctgcctgctgcaaa

SEQ ID NO: 840992 - DNA, 25 bp, Mus musculus
ttccttgcatccagcagtacctaaa

SEQ ID NO: 840993 - DNA, 25 bp, Mus musculus
ttccttgcatcctgcagtacctaaa

SEQ ID NO: 840994 - DNA, 25 bp, Mus musculus
ttccttgccaagaagatagcatctt

SEQ ID NO: 840995 - DNA, 25 bp, Mus musculus
ttccttgccaagtagatagcatctt

SEQ ID NO: 840996 - DNA, 25 bp, Mus musculus
ttccttgccgagagctacaacctct

SEQ ID NO: 840997 - DNA, 25 bp, Mus musculus
ttccttgccgagtgctacaacctct

SEQ ID NO: 840998 - DNA, 25 bp, Mus musculus
ttccttgtggaacctctgtgcttct

SEQ ID NO: 840999 - DNA, 25 bp, Mus musculus
ttccttgtggaagctctgtgcttct

SEQ ID NO: 841000 - DNA, 25 bp, Mus musculus
ttccttgttggccagcaggtgacgc

SEQ ID NO: 841001 - DNA, 25 bp, Mus musculus
ttccttgttggcgagcaggtgacgc

SEQ ID NO: 841002 - DNA, 25 bp, Mus musculus
ttccttgttggtcgctgggtttcag

SEQ ID NO: 841003 - DNA, 25 bp, Mus musculus
ttccttgttggtggctgggtttcag

SEQ ID NO: 841004 - DNA, 25 bp, Mus musculus
ttcctttcacaacgcccagcagtgg

SEQ ID NO: 841005 - DNA, 25 bp, Mus musculus
ttcctttcacaaggcccagcagtgg

SEQ ID NO: 841006 - DNA, 25 bp, Mus musculus
ttcctttcccaacgtatgagaatga

SEQ ID NO: 841007 - DNA, 25 bp, Mus musculus
ttcctttcccaaggtatgagaatga

SEQ ID NO: 841008 - DNA, 25 bp, Mus musculus
ttcctttgaaagaatggcatctgaa

SEQ ID NO: 841009 - DNA, 25 bp, Mus musculus
ttcctttgaaagtatggcatctgaa

SEQ ID NO: 841010 - DNA, 25 bp, Mus musculus
ttcctttgagataggtgcgtggact

SEQ ID NO: 841011 - DNA, 25 bp, Mus musculus
ttcctttgagattggtgcgtggact

SEQ ID NO: 841012 - DNA, 25 bp, Mus musculus
ttcctttgcaatacagtgtagtaga

SEQ ID NO: 841013 - DNA, 25 bp, Mus musculus
ttcctttgcaattcagtgtagtaga

SEQ ID NO: 841014 - DNA, 25 bp, Mus musculus
ttcctttggctgcagccagctagaa

SEQ ID NO: 841015 - DNA, 25 bp, Mus musculus
ttcctttggctggagccagctagaa

SEQ ID NO: 841016 - DNA, 25 bp, Mus musculus
ttccttttggaccacttgctcagtg

SEQ ID NO: 841017 - DNA, 25 bp, Mus musculus
ttccttttggacgacttgctcagtg

SEQ ID NO: 841018 - DNA, 25 bp, Mus musculus
ttccttttgtggcttgagagaatca

SEQ ID NO: 841019 - DNA, 25 bp, Mus musculus
ttccttttgtgggttgagagaatca

SEQ ID NO: 841020 - DNA, 25 bp, Mus musculus
ttcgaaaaagccagccgcatcttat

SEQ ID NO: 841021 - DNA, 25 bp, Mus musculus
ttcgaaaaagcctgccgcatcttat

SEQ ID NO: 841022 - DNA, 25 bp, Mus musculus
ttcgaaaagaagagggaagatttga

SEQ ID NO: 841023 - DNA, 25 bp, Mus musculus
ttcgaaaagaagtgggaagatttga

SEQ ID NO: 841024 - DNA, 25 bp, Mus musculus
ttcgaaacagtgcatcgctggcggc

SEQ ID NO: 841025 - DNA, 25 bp, Mus musculus
ttcgaaacagtggatcgctggcggc

SEQ ID NO: 841026 - DNA, 25 bp, Mus musculus
ttcgaaagtaagaacctgccagacc

SEQ ID NO: 841027 - DNA, 25 bp, Mus musculus
ttcgaaagtaagtacctgccagacc

SEQ ID NO: 841028 - DNA, 25 bp, Mus musculus
ttcgaaatatgcagaacgcagaaat

SEQ ID NO: 841029 - DNA, 25 bp, Mus musculus
ttcgaaatatgctgaacgcagaaat

SEQ ID NO: 841030 - DNA, 25 bp, Mus musculus
ttcgaacgcctacctctaacgagga

SEQ ID NO: 841031 - DNA, 25 bp, Mus musculus
ttcgaacgcctagctctaacgagga

SEQ ID NO: 841032 - DNA, 25 bp, Mus musculus
ttcgaaggacggagagctgcttaca

SEQ ID NO: 841033 - DNA, 25 bp, Mus musculus
ttcgaaggacggattatttctgtcc

SEQ ID NO: 841034 - DNA, 25 bp, Mus musculus
ttcgaaggacggtgagctgcttaca

SEQ ID NO: 841035 - DNA, 25 bp, Mus musculus
ttcgaaggacggtttatttctgtcc

SEQ ID NO: 841036 - DNA, 25 bp, Mus musculus
ttcgaaggcgccatcatagcgctat

SEQ ID NO: 841037 - DNA, 25 bp, Mus musculus
ttcgaaggcgccttcatagcgctat

SEQ ID NO: 841038 - DNA, 25 bp, Mus musculus
ttcgaaggctctcgacgcagcaaga

SEQ ID NO: 841039 - DNA, 25 bp, Mus musculus
ttcgaaggctctggacgcagcaaga

SEQ ID NO: 841040 - DNA, 25 bp, Mus musculus
ttcgaagtcagtcagggtgcacaag

SEQ ID NO: 841041 - DNA, 25 bp, Mus musculus
ttcgaagtcagtgagggtgcacaag

SEQ ID NO: 841042 - DNA, 25 bp, Mus musculus
ttcgaagtctttcacctcaacatga

SEQ ID NO: 841043 - DNA, 25 bp, Mus musculus
ttcgaagtctttgacctcaacatga

SEQ ID NO: 841044 - DNA, 25 bp, Mus musculus
ttcgaagtgaggaaagcaggtcgtc

SEQ ID NO: 841045 - DNA, 25 bp, Mus musculus
ttcgaagtgaggtaagcaggtcgtc

SEQ ID NO: 841046 - DNA, 25 bp, Mus musculus
ttcgaataaaggagacggcgcaggc

SEQ ID NO: 841047 - DNA, 25 bp, Mus musculus
ttcgaataaaggtgacggcgcaggc

SEQ ID NO: 841048 - DNA, 25 bp, Mus musculus
ttcgaataccggatagtgccggcgc

SEQ ID NO: 841049 - DNA, 25 bp, Mus musculus
ttcgaataccggttagtgccggcgc

SEQ ID NO: 841050 - DNA, 25 bp, Mus musculus
ttcgaatccctgagggcctgtttga

SEQ ID NO: 841051 - DNA, 25 bp, Mus musculus
ttcgaatccctgtgggcctgtttga

SEQ ID NO: 841052 - DNA, 25 bp, Mus musculus
ttcgaatgaaccaggaaaacgggag

SEQ ID NO: 841053 - DNA, 25 bp, Mus musculus
ttcgaatgaacctggaaaacgggag

SEQ ID NO: 841054 - DNA, 25 bp, Mus musculus
ttcgaatggataacgatgatgtcac

SEQ ID NO: 841055 - DNA, 25 bp, Mus musculus
ttcgaatggatatcgatgatgtcac

SEQ ID NO: 841056 - DNA, 25 bp, Mus musculus
ttcgacacggaccacaatggagctg

SEQ ID NO: 841057 - DNA, 25 bp, Mus musculus
ttcgacacggacgacaatggagctg

SEQ ID NO: 841058 - DNA, 25 bp, Mus musculus
ttcgaccaaattaaccaagcctttg

SEQ ID NO: 841059 - DNA, 25 bp, Mus musculus
ttcgaccaaatttaccaagcctttg

SEQ ID NO: 841060 - DNA, 25 bp, Mus musculus
ttcgaccagtacatccggctgacgg

SEQ ID NO: 841061 - DNA, 25 bp, Mus musculus
ttcgaccagtacttccggctgacgg

SEQ ID NO: 841062 - DNA, 25 bp, Mus musculus
ttcgaccattcccagatgatgtctg

SEQ ID NO: 841063 - DNA, 25 bp, Mus musculus
ttcgaccattccgagatgatgtctg

SEQ ID NO: 841064 - DNA, 25 bp, Mus musculus
ttcgaccccaataagctggcacctt

SEQ ID NO: 841065 - DNA, 25 bp, Mus musculus
ttcgaccccaattagctggcacctt

SEQ ID NO: 841066 - DNA, 25 bp, Mus musculus
ttcgaccgcgtgaacacacaccaga

SEQ ID NO: 841067 - DNA, 25 bp, Mus musculus
ttcgaccgcgtgtacacacaccaga

SEQ ID NO: 841068 - DNA, 25 bp, Mus musculus
ttcgaccgggacctgaccttggctg

SEQ ID NO: 841069 - DNA, 25 bp, Mus musculus
ttcgaccgggacgtgaccttggctg

SEQ ID NO: 841070 - DNA, 25 bp, Mus musculus
ttcgacctcctcaggctgattcaag

SEQ ID NO: 841071 - DNA, 25 bp, Mus musculus
ttcgacctcctctggctgattcaag

SEQ ID NO: 841072 - DNA, 25 bp, Mus musculus
ttcgacgccggccaattcgcaggct

SEQ ID NO: 841073 - DNA, 25 bp, Mus musculus
ttcgacgccggcgaattcgcaggct

SEQ ID NO: 841074 - DNA, 25 bp, Mus musculus
ttcgacggcaagcacggccttctgg

SEQ ID NO: 841075 - DNA, 25 bp, Mus musculus
ttcgacggcaaggacggccttctgg

SEQ ID NO: 841076 - DNA, 25 bp, Mus musculus
ttcgacggcgacatcgcaaggaaga

SEQ ID NO: 841077 - DNA, 25 bp, Mus musculus
ttcgacggcgacttcgcaaggaaga

SEQ ID NO: 841078 - DNA, 25 bp, Mus musculus
ttcgacgtggtgaccgccttctcct

SEQ ID NO: 841079 - DNA, 25 bp, Mus musculus
ttcgacgtggtgtccgccttctcct

SEQ ID NO: 841080 - DNA, 25 bp, Mus musculus
ttcgactgcaagaccgatgcctgcc

SEQ ID NO: 841081 - DNA, 25 bp, Mus musculus
ttcgactgcaagtccgatgcctgcc

SEQ ID NO: 841082 - DNA, 25 bp, Mus musculus
ttcgacttcagcactttcttccgag

SEQ ID NO: 841083 - DNA, 25 bp, Mus musculus
ttcgacttcagctctttcttccgag

SEQ ID NO: 841084 - DNA, 25 bp, Mus musculus
ttcgactttcgtcacttgactttag

SEQ ID NO: 841085 - DNA, 25 bp, Mus musculus
ttcgactttcgtgacttgactttag

SEQ ID NO: 841086 - DNA, 25 bp, Mus musculus
ttcgagaacgctctgagtgccggct

SEQ ID NO: 841087 - DNA, 25 bp, Mus musculus
ttcgagaacgctgtgagtgccggct

SEQ ID NO: 841088 - DNA, 25 bp, Mus musculus
ttcgagaagacgactgcgtggagcc

SEQ ID NO: 841089 - DNA, 25 bp, Mus musculus
ttcgagaagacgtctgcgtggagcc

SEQ ID NO: 841090 - DNA, 25 bp, Mus musculus
ttcgagaagatcacgcacgtcgggt

SEQ ID NO: 841091 - DNA, 25 bp, Mus musculus
ttcgagaagatctcgcacgtcgggt

SEQ ID NO: 841092 - DNA, 25 bp, Mus musculus
ttcgagaaggttctccagccaactg

SEQ ID NO: 841093 - DNA, 25 bp, Mus musculus
ttcgagaaggttgtccagccaactg

SEQ ID NO: 841094 - DNA, 25 bp, Mus musculus
ttcgagaagtgccaggattcctgga

SEQ ID NO: 841095 - DNA, 25 bp, Mus musculus
ttcgagaagtgcgaggattcctgga

SEQ ID NO: 841096 - DNA, 25 bp, Mus musculus
ttcgagacctcaccatcaggctggg

SEQ ID NO: 841097 - DNA, 25 bp, Mus musculus
ttcgagacctcagcatcaggctggg

SEQ ID NO: 841098 - DNA, 25 bp, Mus musculus
ttcgagagcaaaaccgacaagacat

SEQ ID NO: 841099 - DNA, 25 bp, Mus musculus
ttcgagagcaaatccgacaagacat

SEQ ID NO: 841100 - DNA, 25 bp, Mus musculus
ttcgagagccacatcgccagagcca

SEQ ID NO: 841101 - DNA, 25 bp, Mus musculus
ttcgagagccacttcgccagagcca

SEQ ID NO: 841102 - DNA, 25 bp, Mus musculus
ttcgagcacccaagttagcacaggc

SEQ ID NO: 841103 - DNA, 25 bp, Mus musculus
ttcgagcacccatgttagcacaggc

SEQ ID NO: 841104 - DNA, 25 bp, Mus musculus
ttcgagcagtggaagatgttcggcc

SEQ ID NO: 841105 - DNA, 25 bp, Mus musculus
ttcgagcagtggtagatgttcggcc

SEQ ID NO: 841106 - DNA, 25 bp, Mus musculus
ttcgagccaggaagtctcttagact

SEQ ID NO: 841107 - DNA, 25 bp, Mus musculus
ttcgagccaggatgtctcttagact

SEQ ID NO: 841108 - DNA, 25 bp, Mus musculus
ttcgagcgacacctttcttggccca

SEQ ID NO: 841109 - DNA, 25 bp, Mus musculus
ttcgagcgacacgtttcttggccca

SEQ ID NO: 841110 - DNA, 25 bp, Mus musculus
ttcgagcgcttcacacgcgtgctgg

SEQ ID NO: 841111 - DNA, 25 bp, Mus musculus
ttcgagcgcttctcacgcgtgctgg

SEQ ID NO: 841112 - DNA, 25 bp, Mus musculus
ttcgagcggaccaataggaaaggct

SEQ ID NO: 841113 - DNA, 25 bp, Mus musculus
ttcgagcggacctataggaaaggct

SEQ ID NO: 841114 - DNA, 25 bp, Mus musculus
ttcgagctaggtacttgggctgccc

SEQ ID NO: 841115 - DNA, 25 bp, Mus musculus
ttcgagctaggttcttgggctgccc

SEQ ID NO: 841116 - DNA, 25 bp, Mus musculus
ttcgagctcctgattttccggaaca

SEQ ID NO: 841117 - DNA, 25 bp, Mus musculus
ttcgagctcctgtttttccggaaca

SEQ ID NO: 841118 - DNA, 25 bp, Mus musculus
ttcgagctgatgaggtacgtctgca

SEQ ID NO: 841119 - DNA, 25 bp, Mus musculus
ttcgagctgatgtggtacgtctgca

SEQ ID NO: 841120 - DNA, 25 bp, Mus musculus
ttcgagctgcagctcagagcccaac

SEQ ID NO: 841121 - DNA, 25 bp, Mus musculus
ttcgagctgcaggtcagagcccaac

SEQ ID NO: 841122 - DNA, 25 bp, Mus musculus
ttcgagctgctcaatcccatgatgg

SEQ ID NO: 841123 - DNA, 25 bp, Mus musculus
ttcgagctgctctatcccatgatgg

SEQ ID NO: 841124 - DNA, 25 bp, Mus musculus
ttcgagctgggcatagctacacggt

SEQ ID NO: 841125 - DNA, 25 bp, Mus musculus
ttcgagctgggcttagctacacggt

SEQ ID NO: 841126 - DNA, 25 bp, Mus musculus
ttcgaggaagccatacctaagtcct

SEQ ID NO: 841127 - DNA, 25 bp, Mus musculus
ttcgaggaagccttacctaagtcct

SEQ ID NO: 841128 - DNA, 25 bp, Mus musculus
ttcgaggaggaaccttataaaaatg

SEQ ID NO: 841129 - DNA, 25 bp, Mus musculus
ttcgaggaggaagcttataaaaatg

SEQ ID NO: 841130 - DNA, 25 bp, Mus musculus
ttcgaggccctgctcgtctgcagtg

SEQ ID NO: 841131 - DNA, 25 bp, Mus musculus
ttcgaggccctggtcgtctgcagtg

SEQ ID NO: 841132 - DNA, 25 bp, Mus musculus
ttcgaggctggaatagcaatcatgc

SEQ ID NO: 841133 - DNA, 25 bp, Mus musculus
ttcgaggctggattagcaatcatgc

SEQ ID NO: 841134 - DNA, 25 bp, Mus musculus
ttcgagggacgcacctattcggcct

SEQ ID NO: 841135 - DNA, 25 bp, Mus musculus
ttcgagggacgctcctattcggcct

SEQ ID NO: 841136 - DNA, 25 bp, Mus musculus
ttcgagggccgccagacagtcagcc

SEQ ID NO: 841137 - DNA, 25 bp, Mus musculus
ttcgagggccgcgagacagtcagcc

SEQ ID NO: 841138 - DNA, 25 bp, Mus musculus
ttcgagggtcaacccaacgacagag

SEQ ID NO: 841139 - DNA, 25 bp, Mus musculus
ttcgagggtcaagccaacgacagag

SEQ ID NO: 841140 - DNA, 25 bp, Mus musculus
ttcgagggtcacacctgtgaacgcg

SEQ ID NO: 841141 - DNA, 25 bp, Mus musculus
ttcgagggtcactcctgtgaacgcg

SEQ ID NO: 841142 - DNA, 25 bp, Mus musculus
ttcgaggtccaccagaagacctact

SEQ ID NO: 841143 - DNA, 25 bp, Mus musculus
ttcgaggtccacgagaagacctact

SEQ ID NO: 841144 - DNA, 25 bp, Mus musculus
ttcgaggtccagatgcacttccgcg

SEQ ID NO: 841145 - DNA, 25 bp, Mus musculus
ttcgaggtccagttgcacttccgcg

SEQ ID NO: 841146 - DNA, 25 bp, Mus musculus
ttcgaggtctttcggcactaccagc

SEQ ID NO: 841147 - DNA, 25 bp, Mus musculus
ttcgaggtctttgggcactaccagc

SEQ ID NO: 841148 - DNA, 25 bp, Mus musculus
ttcgaggtgaagagtacagcagacg

SEQ ID NO: 841149 - DNA, 25 bp, Mus musculus
ttcgaggtgaagtgtacagcagacg

SEQ ID NO: 841150 - DNA, 25 bp, Mus musculus
ttcgagtaccttccacagctcaagg

SEQ ID NO: 841151 - DNA, 25 bp, Mus musculus
ttcgagtaccttgcacagctcaagg

SEQ ID NO: 841152 - DNA, 25 bp, Mus musculus
ttcgagtcaagaactccactgaagt

SEQ ID NO: 841153 - DNA, 25 bp, Mus musculus
ttcgagtcaagatctccactgaagt

SEQ ID NO: 841154 - DNA, 25 bp, Mus musculus
ttcgagtcaccaagcagtacctgcc

SEQ ID NO: 841155 - DNA, 25 bp, Mus musculus
ttcgagtcaccatgcagtacctgcc

SEQ ID NO: 841156 - DNA, 25 bp, Mus musculus
ttcgagtcatgcctactgatgactt

SEQ ID NO: 841157 - DNA, 25 bp, Mus musculus
ttcgagtcatgcgtactgatgactt

SEQ ID NO: 841158 - DNA, 25 bp, Mus musculus
ttcgagtcgggaatgcagacggcca

SEQ ID NO: 841159 - DNA, 25 bp, Mus musculus
ttcgagtcgggattgcagacggcca

SEQ ID NO: 841160 - DNA, 25 bp, Mus musculus
ttcgagttaatccaagagtgagcaa

SEQ ID NO: 841161 - DNA, 25 bp, Mus musculus
ttcgagttaatcgaagagtgagcaa

SEQ ID NO: 841162 - DNA, 25 bp, Mus musculus
ttcgagttggccatctccttagacc

SEQ ID NO: 841163 - DNA, 25 bp, Mus musculus
ttcgagttggccttctccttagacc

SEQ ID NO: 841164 - DNA, 25 bp, Mus musculus
ttcgatatgataactaccggctgca

SEQ ID NO: 841165 - DNA, 25 bp, Mus musculus
ttcgatatgatatctaccggctgca

SEQ ID NO: 841166 - DNA, 25 bp, Mus musculus
ttcgatctgaggaaggccgggacat

SEQ ID NO: 841167 - DNA, 25 bp, Mus musculus
ttcgatctgaggtaggccgggacat

SEQ ID NO: 841168 - DNA, 25 bp, Mus musculus
ttcgatctggaacacacgatggacg

SEQ ID NO: 841169 - DNA, 25 bp, Mus musculus
ttcgatctggaagacacgatggacg

SEQ ID NO: 841170 - DNA, 25 bp, Mus musculus
ttcgatgaccccacctatgtcaaca

SEQ ID NO: 841171 - DNA, 25 bp, Mus musculus
ttcgatgacccctcctatgtcaaca

SEQ ID NO: 841172 - DNA, 25 bp, Mus musculus
ttcgatgagggaataccacccatcc

SEQ ID NO: 841173 - DNA, 25 bp, Mus musculus
ttcgatgagggattaccacccatcc

SEQ ID NO: 841174 - DNA, 25 bp, Mus musculus
ttcgatgatgcccagcaggaggaca

SEQ ID NO: 841175 - DNA, 25 bp, Mus musculus
ttcgatgatgccgagcaggaggaca

SEQ ID NO: 841176 - DNA, 25 bp, Mus musculus
ttcgatgcccaactcattcaagagg

SEQ ID NO: 841177 - DNA, 25 bp, Mus musculus
ttcgatgcccaagtcattcaagagg

SEQ ID NO: 841178 - DNA, 25 bp, Mus musculus
ttcgatgctgctacgctgcacacct

SEQ ID NO: 841179 - DNA, 25 bp, Mus musculus
ttcgatgctgcttcgctgcacacct

SEQ ID NO: 841180 - DNA, 25 bp, Mus musculus
ttcgatgtggagacgcaccctgaag

SEQ ID NO: 841181 - DNA, 25 bp, Mus musculus
ttcgatgtggagtcgcaccctgaag

SEQ ID NO: 841182 - DNA, 25 bp, Mus musculus
ttcgattccatgaaaccaatcacat

SEQ ID NO: 841183 - DNA, 25 bp, Mus musculus
ttcgattccatgtaaccaatcacat

SEQ ID NO: 841184 - DNA, 25 bp, Mus musculus
ttcgcaaaattgcagaggcagaggc

SEQ ID NO: 841185 - DNA, 25 bp, Mus musculus
ttcgcaaaattggagaggcagaggc

SEQ ID NO: 841186 - DNA, 25 bp, Mus musculus
ttcgcaaagcggaggaacaagtcca

SEQ ID NO: 841187 - DNA, 25 bp, Mus musculus
ttcgcaaagcggtggaacaagtcca

SEQ ID NO: 841188 - DNA, 25 bp, Mus musculus
ttcgcaagctggaaaatgccatata

SEQ ID NO: 841189 - DNA, 25 bp, Mus musculus
ttcgcaagctggtaaatgccatata

SEQ ID NO: 841190 - DNA, 25 bp, Mus musculus
ttcgcaaggctgaatcgaagagacg

SEQ ID NO: 841191 - DNA, 25 bp, Mus musculus
ttcgcaaggctgtatcgaagagacg

SEQ ID NO: 841192 - DNA, 25 bp, Mus musculus
ttcgcaagtcttccggcgcgagtgt

SEQ ID NO: 841193 - DNA, 25 bp, Mus musculus
ttcgcaagtcttgcggcgcgagtgt

SEQ ID NO: 841194 - DNA, 25 bp, Mus musculus
ttcgcaataccaaggacagtcctgt

SEQ ID NO: 841195 - DNA, 25 bp, Mus musculus
ttcgcaataccatggacagtcctgt

SEQ ID NO: 841196 - DNA, 25 bp, Mus musculus
ttcgcacaccggatcttcgccgagt

SEQ ID NO: 841197 - DNA, 25 bp, Mus musculus
ttcgcacaccggttcttcgccgagt

SEQ ID NO: 841198 - DNA, 25 bp, Mus musculus
ttcgcagccctgaccgagaggttca

SEQ ID NO: 841199 - DNA, 25 bp, Mus musculus
ttcgcagccctgtccgagaggttca

SEQ ID NO: 841200 - DNA, 25 bp, Mus musculus
ttcgcaggaggcaaaacataccact

SEQ ID NO: 841201 - DNA, 25 bp, Mus musculus
ttcgcaggaggctaaacataccact

SEQ ID NO: 841202 - DNA, 25 bp, Mus musculus
ttcgcaggtaatagtcatatcttga

SEQ ID NO: 841203 - DNA, 25 bp, Mus musculus
ttcgcaggtaattgtcatatcttga

SEQ ID NO: 841204 - DNA, 25 bp, Mus musculus
ttcgcaggtggcctcacgggtcctc

SEQ ID NO: 841205 - DNA, 25 bp, Mus musculus
ttcgcaggtggcgtcacgggtcctc

SEQ ID NO: 841206 - DNA, 25 bp, Mus musculus
ttcgcatcagggagatcaaaagacg

SEQ ID NO: 841207 - DNA, 25 bp, Mus musculus
ttcgcatcagggtgatcaaaagacg

SEQ ID NO: 841208 - DNA, 25 bp, Mus musculus
ttcgcatcctcaaccatcgtgcggg

SEQ ID NO: 841209 - DNA, 25 bp, Mus musculus
ttcgcatcctcatccatcgtgcggg

SEQ ID NO: 841210 - DNA, 25 bp, Mus musculus
ttcgcatgaggaagaaccctggcct

SEQ ID NO: 841211 - DNA, 25 bp, Mus musculus
ttcgcatgaggatgaaccctggcct

SEQ ID NO: 841212 - DNA, 25 bp, Mus musculus
ttcgccaatgccctgagcaagttcg

SEQ ID NO: 841213 - DNA, 25 bp, Mus musculus
ttcgccaatgccgtgagcaagttcg

SEQ ID NO: 841214 - DNA, 25 bp, Mus musculus
ttcgccagaaccacttttagctccg

SEQ ID NO: 841215 - DNA, 25 bp, Mus musculus
ttcgccagaacctcttttagctccg

SEQ ID NO: 841216 - DNA, 25 bp, Mus musculus
ttcgccagagaccagggcaaaatct

SEQ ID NO: 841217 - DNA, 25 bp, Mus musculus
ttcgccagagacgagggcaaaatct

SEQ ID NO: 841218 - DNA, 25 bp, Mus musculus
ttcgccagccaacccaatatggtgg

SEQ ID NO: 841219 - DNA, 25 bp, Mus musculus
ttcgccagccaagccaatatggtgg

SEQ ID NO: 841220 - DNA, 25 bp, Mus musculus
ttcgccatgggaaacaactgttaca

SEQ ID NO: 841221 - DNA, 25 bp, Mus musculus
ttcgccatgggacgtttccccagta

SEQ ID NO: 841222 - DNA, 25 bp, Mus musculus
ttcgccatgggaggtttccccagta

SEQ ID NO: 841223 - DNA, 25 bp, Mus musculus
ttcgccatgggatacaactgttaca

SEQ ID NO: 841224 - DNA, 25 bp, Mus musculus
ttcgcccagaagagaggaacttgga

SEQ ID NO: 841225 - DNA, 25 bp, Mus musculus
ttcgcccagaagtgaggaacttgga

SEQ ID NO: 841226 - DNA, 25 bp, Mus musculus
ttcgcccaggagagcgcctcatcgg

SEQ ID NO: 841227 - DNA, 25 bp, Mus musculus
ttcgcccaggagtgcgcctcatcgg

SEQ ID NO: 841228 - DNA, 25 bp, Mus musculus
ttcgcccgcatcaaagccgtggagt

SEQ ID NO: 841229 - DNA, 25 bp, Mus musculus
ttcgcccgcatctaagccgtggagt

SEQ ID NO: 841230 - DNA, 25 bp, Mus musculus
ttcgcccgggtgaccatgtatgtgg

SEQ ID NO: 841231 - DNA, 25 bp, Mus musculus
ttcgcccgggtgtccatgtatgtgg

SEQ ID NO: 841232 - DNA, 25 bp, Mus musculus
ttcgccctggaacagagctgcgctc

SEQ ID NO: 841233 - DNA, 25 bp, Mus musculus
ttcgccctggaagagagctgcgctc

SEQ ID NO: 841234 - DNA, 25 bp, Mus musculus
ttcgccgagttccagaagcagcacg

SEQ ID NO: 841235 - DNA, 25 bp, Mus musculus
ttcgccgagttcgagaagcagcacg

SEQ ID NO: 841236 - DNA, 25 bp, Mus musculus
ttcgccgatttcctagcgtgccgag

SEQ ID NO: 841237 - DNA, 25 bp, Mus musculus
ttcgccgatttcgtagcgtgccgag

SEQ ID NO: 841238 - DNA, 25 bp, Mus musculus
ttcgccgcttcaaccctcgggctga

SEQ ID NO: 841239 - DNA, 25 bp, Mus musculus
ttcgccgcttcatccctcgggctga

SEQ ID NO: 841240 - DNA, 25 bp, Mus musculus
ttcgccgtagtcaagagcctttctc

SEQ ID NO: 841241 - DNA, 25 bp, Mus musculus
ttcgccgtagtctagagcctttctc

SEQ ID NO: 841242 - DNA, 25 bp, Mus musculus
ttcgccgttaccagggagccatcgc

SEQ ID NO: 841243 - DNA, 25 bp, Mus musculus
ttcgccgttacctgggagccatcgc

SEQ ID NO: 841244 - DNA, 25 bp, Mus musculus
ttcgccgttccgaatccgccatggg

SEQ ID NO: 841245 - DNA, 25 bp, Mus musculus
ttcgccgttccgtatccgccatggg

SEQ ID NO: 841246 - DNA, 25 bp, Mus musculus
ttcgcctctcctcgattgtaggaga

SEQ ID NO: 841247 - DNA, 25 bp, Mus musculus
ttcgcctctcctggattgtaggaga

SEQ ID NO: 841248 - DNA, 25 bp, Mus musculus
ttcgccttctaacgtttgtgccaga

SEQ ID NO: 841249 - DNA, 25 bp, Mus musculus
ttcgccttctaaggtttgtgccaga

SEQ ID NO: 841250 - DNA, 25 bp, Mus musculus
ttcgcgaggcccacgagctcctggg

SEQ ID NO: 841251 - DNA, 25 bp, Mus musculus
ttcgcgaggccctcgagctcctggg

SEQ ID NO: 841252 - DNA, 25 bp, Mus musculus
ttcgcgatcaccacctcggcgtgag

SEQ ID NO: 841253 - DNA, 25 bp, Mus musculus
ttcgcgatcacctcctcggcgtgag

SEQ ID NO: 841254 - DNA, 25 bp, Mus musculus
ttcgcgccaattacggttggccggc

SEQ ID NO: 841255 - DNA, 25 bp, Mus musculus
ttcgcgccaatttcggttggccggc

SEQ ID NO: 841256 - DNA, 25 bp, Mus musculus
ttcgcgcgcgccatcgcggtgtggg

SEQ ID NO: 841257 - DNA, 25 bp, Mus musculus
ttcgcgcgcgccttcgcggtgtggg

SEQ ID NO: 841258 - DNA, 25 bp, Mus musculus
ttcgcgctcagcagtgctgaatgct

SEQ ID NO: 841259 - DNA, 25 bp, Mus musculus
ttcgcgctcagctgtgctgaatgct

SEQ ID NO: 841260 - DNA, 25 bp, Mus musculus
ttcgcgctgctcaaggtgctgggca

SEQ ID NO: 841261 - DNA, 25 bp, Mus musculus
ttcgcgctgctctaggtgctgggca

SEQ ID NO: 841262 - DNA, 25 bp, Mus musculus
ttcgcgctggagcagacactcgagt

SEQ ID NO: 841263 - DNA, 25 bp, Mus musculus
ttcgcgctggaggagacactcgagt

SEQ ID NO: 841264 - DNA, 25 bp, Mus musculus
ttcgcggagactctcgtggatcttc

SEQ ID NO: 841265 - DNA, 25 bp, Mus musculus
ttcgcggagactgtcgtggatcttc

SEQ ID NO: 841266 - DNA, 25 bp, Mus musculus
ttcgcggaggctcctagctgccgct

SEQ ID NO: 841267 - DNA, 25 bp, Mus musculus
ttcgcggaggctgctagctgccgct

SEQ ID NO: 841268 - DNA, 25 bp, Mus musculus
ttcgcgtgaagaactcggtgaagga

SEQ ID NO: 841269 - DNA, 25 bp, Mus musculus
ttcgcgtgaagatctcggtgaagga

SEQ ID NO: 841270 - DNA, 25 bp, Mus musculus
ttcgctatgaccatgtactgccagg

SEQ ID NO: 841271 - DNA, 25 bp, Mus musculus
ttcgctatgaccttgtactgccagg

SEQ ID NO: 841272 - DNA, 25 bp, Mus musculus
ttcgctatgcagattggctggacaa

SEQ ID NO: 841273 - DNA, 25 bp, Mus musculus
ttcgctatgcagtttggctggacaa

SEQ ID NO: 841274 - DNA, 25 bp, Mus musculus
ttcgctcagcacaatgggctgcaaa

SEQ ID NO: 841275 - DNA, 25 bp, Mus musculus
ttcgctcagcactatgggctgcaaa

SEQ ID NO: 841276 - DNA, 25 bp, Mus musculus
ttcgctccagcactctgactctgag

SEQ ID NO: 841277 - DNA, 25 bp, Mus musculus
ttcgctccagcagtctgactctgag

SEQ ID NO: 841278 - DNA, 25 bp, Mus musculus
ttcgctccggcactgggatgtccgt

SEQ ID NO: 841279 - DNA, 25 bp, Mus musculus
ttcgctccggcagtgggatgtccgt

SEQ ID NO: 841280 - DNA, 25 bp, Mus musculus
ttcgctcctacgcaagtcgggaagg

SEQ ID NO: 841281 - DNA, 25 bp, Mus musculus
ttcgctcctacggaagtcgggaagg

SEQ ID NO: 841282 - DNA, 25 bp, Mus musculus
ttcgctcctcgactggacaatctgc

SEQ ID NO: 841283 - DNA, 25 bp, Mus musculus
ttcgctcctcgagtggacaatctgc

SEQ ID NO: 841284 - DNA, 25 bp, Mus musculus
ttcgctcgcacaagacaagctcagt

SEQ ID NO: 841285 - DNA, 25 bp, Mus musculus
ttcgctcgcacatgacaagctcagt

SEQ ID NO: 841286 - DNA, 25 bp, Mus musculus
ttcgctctaggaagctgtggtcccc

SEQ ID NO: 841287 - DNA, 25 bp, Mus musculus
ttcgctctaggatgctgtggtcccc

SEQ ID NO: 841288 - DNA, 25 bp, Mus musculus
ttcgctctctgacagagctgcagga

SEQ ID NO: 841289 - DNA, 25 bp, Mus musculus
ttcgctctctgagagagctgcagga

SEQ ID NO: 841290 - DNA, 25 bp, Mus musculus
ttcgctctgcggctctggttgacgt

SEQ ID NO: 841291 - DNA, 25 bp, Mus musculus
ttcgctctgcgggtctggttgacgt

SEQ ID NO: 841292 - DNA, 25 bp, Mus musculus
ttcgctgaaggaccgctacaagtag

SEQ ID NO: 841293 - DNA, 25 bp, Mus musculus
ttcgctgaaggagcgctacaagtag

SEQ ID NO: 841294 - DNA, 25 bp, Mus musculus
ttcgctgagagactttataaatcca

SEQ ID NO: 841295 - DNA, 25 bp, Mus musculus
ttcgctgagagagtttataaatcca

SEQ ID NO: 841296 - DNA, 25 bp, Mus musculus
ttcgctgcagaacccaagtttttca

SEQ ID NO: 841297 - DNA, 25 bp, Mus musculus
ttcgctgcagaagccaagtttttca

SEQ ID NO: 841298 - DNA, 25 bp, Mus musculus
ttcgctgcgcgcactccggctaggg

SEQ ID NO: 841299 - DNA, 25 bp, Mus musculus
ttcgctgcgcgctctccggctaggg

SEQ ID NO: 841300 - DNA, 25 bp, Mus musculus
ttcgctgctcacaggcagacttcca

SEQ ID NO: 841301 - DNA, 25 bp, Mus musculus
ttcgctgctcactggcagacttcca

SEQ ID NO: 841302 - DNA, 25 bp, Mus musculus
ttcgctgctgaaagagtgagtcctg

SEQ ID NO: 841303 - DNA, 25 bp, Mus musculus
ttcgctgctgaatgagtgagtcctg

SEQ ID NO: 841304 - DNA, 25 bp, Mus musculus
ttcgctgtgagcagccccgctgtga

SEQ ID NO: 841305 - DNA, 25 bp, Mus musculus
ttcgctgtgagctgccccgctgtga

SEQ ID NO: 841306 - DNA, 25 bp, Mus musculus
ttcgctgtgtgcacggagcaccgag

SEQ ID NO: 841307 - DNA, 25 bp, Mus musculus
ttcgctgtgtgctcggagcaccgag

SEQ ID NO: 841308 - DNA, 25 bp, Mus musculus
ttcgcttcgccgcacggtactgggc

SEQ ID NO: 841309 - DNA, 25 bp, Mus musculus
ttcgcttcgccggacggtactgggc

SEQ ID NO: 841310 - DNA, 25 bp, Mus musculus
ttcgcttgaattcctcggccgcctt

SEQ ID NO: 841311 - DNA, 25 bp, Mus musculus
ttcgcttgaattgctcggccgcctt

SEQ ID NO: 841312 - DNA, 25 bp, Mus musculus
ttcgcttgagctcccctgagagtct

SEQ ID NO: 841313 - DNA, 25 bp, Mus musculus
ttcgcttgagctgccctgagagtct

SEQ ID NO: 841314 - DNA, 25 bp, Mus musculus
ttcggaaatcccacccgtgagcagg

SEQ ID NO: 841315 - DNA, 25 bp, Mus musculus
ttcggaaatccctcccgtgagcagg

SEQ ID NO: 841316 - DNA, 25 bp, Mus musculus
ttcggaacggcgcaagcaaacctgt

SEQ ID NO: 841317 - DNA, 25 bp, Mus musculus
ttcggaacggcggaagcaaacctgt

SEQ ID NO: 841318 - DNA, 25 bp, Mus musculus
ttcggaagacaaacctcagacctta

SEQ ID NO: 841319 - DNA, 25 bp, Mus musculus
ttcggaagacaatcctcagacctta

SEQ ID NO: 841320 - DNA, 25 bp, Mus musculus
ttcggaagatgaaatgggagcagat

SEQ ID NO: 841321 - DNA, 25 bp, Mus musculus
ttcggaagatgatatgggagcagat

SEQ ID NO: 841322 - DNA, 25 bp, Mus musculus
ttcggaagcacaaatgccgtcgtcg

SEQ ID NO: 841323 - DNA, 25 bp, Mus musculus
ttcggaagcacatatgccgtcgtcg

SEQ ID NO: 841324 - DNA, 25 bp, Mus musculus
ttcggaatggcaaggccgtcatcag

SEQ ID NO: 841325 - DNA, 25 bp, Mus musculus
ttcggaatggcatggccgtcatcag

SEQ ID NO: 841326 - DNA, 25 bp, Mus musculus
ttcggacaagcacctcctcaagagc

SEQ ID NO: 841327 - DNA, 25 bp, Mus musculus
ttcggacaagcagctcctcaagagc

SEQ ID NO: 841328 - DNA, 25 bp, Mus musculus
ttcggacagtgtccagcctgctcag

SEQ ID NO: 841329 - DNA, 25 bp, Mus musculus
ttcggacagtgtgcagcctgctcag

SEQ ID NO: 841330 - DNA, 25 bp, Mus musculus
ttcggacccagtcctatgactacag

SEQ ID NO: 841331 - DNA, 25 bp, Mus musculus
ttcggacccagtgctatgactacag

SEQ ID NO: 841332 - DNA, 25 bp, Mus musculus
ttcggaccgcggagacctgcgtgct

SEQ ID NO: 841333 - DNA, 25 bp, Mus musculus
ttcggaccgcggtgacctgcgtgct

SEQ ID NO: 841334 - DNA, 25 bp, Mus musculus
ttcggacctacacctggatcgccgg

SEQ ID NO: 841335 - DNA, 25 bp, Mus musculus
ttcggacctacagctggatcgccgg

SEQ ID NO: 841336 - DNA, 25 bp, Mus musculus
ttcggactcattccgggaccaggca

SEQ ID NO: 841337 - DNA, 25 bp, Mus musculus
ttcggactcattgcgggaccaggca

SEQ ID NO: 841338 - DNA, 25 bp, Mus musculus
ttcggagacaggctctgccgcatgc

SEQ ID NO: 841339 - DNA, 25 bp, Mus musculus
ttcggagacagggtctgccgcatgc

SEQ ID NO: 841340 - DNA, 25 bp, Mus musculus
ttcggagactccagacaatcgcctt

SEQ ID NO: 841341 - DNA, 25 bp, Mus musculus
ttcggagactcctgacaatcgcctt

SEQ ID NO: 841342 - DNA, 25 bp, Mus musculus
ttcggagaggcccttatccagcagt

SEQ ID NO: 841343 - DNA, 25 bp, Mus musculus
ttcggagaggccgttatccagcagt

SEQ ID NO: 841344 - DNA, 25 bp, Mus musculus
ttcggagattttcggcacggcattt

SEQ ID NO: 841345 - DNA, 25 bp, Mus musculus
ttcggagattttgggcacggcattt

SEQ ID NO: 841346 - DNA, 25 bp, Mus musculus
ttcggagcctcaaccagggttcgag

SEQ ID NO: 841347 - DNA, 25 bp, Mus musculus
ttcggagcctcatccagggttcgag

SEQ ID NO: 841348 - DNA, 25 bp, Mus musculus
ttcggagcctgtatggcacacctga

SEQ ID NO: 841349 - DNA, 25 bp, Mus musculus
ttcggagcctgtttggcacacctga

SEQ ID NO: 841350 - DNA, 25 bp, Mus musculus
ttcggagcgacgcactgccgcagct

SEQ ID NO: 841351 - DNA, 25 bp, Mus musculus
ttcggagcgacggactgccgcagct

SEQ ID NO: 841352 - DNA, 25 bp, Mus musculus
ttcggagctgggacactaggagtcc

SEQ ID NO: 841353 - DNA, 25 bp, Mus musculus
ttcggagctgggtcactaggagtcc

SEQ ID NO: 841354 - DNA, 25 bp, Mus musculus
ttcggaggaccaagcactgcagctg

SEQ ID NO: 841355 - DNA, 25 bp, Mus musculus
ttcggaggaccatgcactgcagctg

SEQ ID NO: 841356 - DNA, 25 bp, Mus musculus
ttcggaggagcacgttttacagaga

SEQ ID NO: 841357 - DNA, 25 bp, Mus musculus
ttcggaggagcaggttttacagaga

SEQ ID NO: 841358 - DNA, 25 bp, Mus musculus
ttcggagtccccaacgccaatagca

SEQ ID NO: 841359 - DNA, 25 bp, Mus musculus
ttcggagtcccctacgccaatagca

SEQ ID NO: 841360 - DNA, 25 bp, Mus musculus
ttcggagttcctatgaacaggacag

SEQ ID NO: 841361 - DNA, 25 bp, Mus musculus
ttcggagttcctttgaacaggacag

SEQ ID NO: 841362 - DNA, 25 bp, Mus musculus
ttcggatctcctagagaatgccctg

SEQ ID NO: 841363 - DNA, 25 bp, Mus musculus
ttcggatctccttgagaatgccctg

SEQ ID NO: 841364 - DNA, 25 bp, Mus musculus
ttcggatgattgagaatgggagcct

SEQ ID NO: 841365 - DNA, 25 bp, Mus musculus
ttcggatgattgtgaatgggagcct

SEQ ID NO: 841366 - DNA, 25 bp, Mus musculus
ttcggatgcgacaagtgcggtgcct

SEQ ID NO: 841367 - DNA, 25 bp, Mus musculus
ttcggatgcgactagtgcggtgcct

SEQ ID NO: 841368 - DNA, 25 bp, Mus musculus
ttcggatggtagacattgtggagaa

SEQ ID NO: 841369 - DNA, 25 bp, Mus musculus
ttcggatggtagtcattgtggagaa

SEQ ID NO: 841370 - DNA, 25 bp, Mus musculus
ttcggattggctccgtttgccgcca

SEQ ID NO: 841371 - DNA, 25 bp, Mus musculus
ttcggattggctgcgtttgccgcca

SEQ ID NO: 841372 - DNA, 25 bp, Mus musculus
ttcggattttctcgcatggaagtgg

SEQ ID NO: 841373 - DNA, 25 bp, Mus musculus
ttcggattttctggcatggaagtgg

SEQ ID NO: 841374 - DNA, 25 bp, Mus musculus
ttcggcaagatcaaagaggacaaga

SEQ ID NO: 841375 - DNA, 25 bp, Mus musculus
ttcggcaagatctaagaggacaaga

SEQ ID NO: 841376 - DNA, 25 bp, Mus musculus
ttcggcaagcttcgtgtcctgctga

SEQ ID NO: 841377 - DNA, 25 bp, Mus musculus
ttcggcaagcttggtgtcctgctga

SEQ ID NO: 841378 - DNA, 25 bp, Mus musculus
ttcggcactcggctcagcatcgcgg

SEQ ID NO: 841379 - DNA, 25 bp, Mus musculus
ttcggcactcgggtcagcatcgcgg

SEQ ID NO: 841380 - DNA, 25 bp, Mus musculus
ttcggcagagtcacagcccgatgtc

SEQ ID NO: 841381 - DNA, 25 bp, Mus musculus
ttcggcagagtctcagcccgatgtc

SEQ ID NO: 841382 - DNA, 25 bp, Mus musculus
ttcggcagcatcatgaacctggtgc

SEQ ID NO: 841383 - DNA, 25 bp, Mus musculus
ttcggcagcatcttgaacctggtgc

SEQ ID NO: 841384 - DNA, 25 bp, Mus musculus
ttcggcagctgaagctggacaatca

SEQ ID NO: 841385 - DNA, 25 bp, Mus musculus
ttcggcagctgatgctggacaatca

SEQ ID NO: 841386 - DNA, 25 bp, Mus musculus
ttcggcagtgtcagggccggcggat

SEQ ID NO: 841387 - DNA, 25 bp, Mus musculus
ttcggcagtgtctgggccggcggat

SEQ ID NO: 841388 - DNA, 25 bp, Mus musculus
ttcggcatccctcagcgcagtcgag

SEQ ID NO: 841389 - DNA, 25 bp, Mus musculus
ttcggcatccctgagcgcagtcgag

SEQ ID NO: 841390 - DNA, 25 bp, Mus musculus
ttcggcatccgtattgacatcctgg

SEQ ID NO: 841391 - DNA, 25 bp, Mus musculus
ttcggcatccgttttgacatcctgg

SEQ ID NO: 841392 - DNA, 25 bp, Mus musculus
ttcggcccatttacaaggccttcaa

SEQ ID NO: 841393 - DNA, 25 bp, Mus musculus
ttcggcccattttcaaggccttcaa

SEQ ID NO: 841394 - DNA, 25 bp, Mus musculus
ttcggcccctttcgataaagtctgc

SEQ ID NO: 841395 - DNA, 25 bp, Mus musculus
ttcggcccctttggataaagtctgc

SEQ ID NO: 841396 - DNA, 25 bp, Mus musculus
ttcggcccttgtcggaagtacaacg

SEQ ID NO: 841397 - DNA, 25 bp, Mus musculus
ttcggcccttgtgggaagtacaacg

SEQ ID NO: 841398 - DNA, 25 bp, Mus musculus
ttcggcctcatgaatgatttgaagg

SEQ ID NO: 841399 - DNA, 25 bp, Mus musculus
ttcggcctcatgtatgatttgaagg

SEQ ID NO: 841400 - DNA, 25 bp, Mus musculus
ttcggcctgcccctgaaactctgga

SEQ ID NO: 841401 - DNA, 25 bp, Mus musculus
ttcggcctgcccgtgaaactctgga

SEQ ID NO: 841402 - DNA, 25 bp, Mus musculus
ttcggcctggctcgagacatcatga

SEQ ID NO: 841403 - DNA, 25 bp, Mus musculus
ttcggcctggctggagacatcatga

SEQ ID NO: 841404 - DNA, 25 bp, Mus musculus
ttcggcctgtagaagagaagcccag

SEQ ID NO: 841405 - DNA, 25 bp, Mus musculus
ttcggcctgtagtagagaagcccag

SEQ ID NO: 841406 - DNA, 25 bp, Mus musculus
ttcggcgcggaaagtggcctgttcc

SEQ ID NO: 841407 - DNA, 25 bp, Mus musculus
ttcggcgcggaatgtggcctgttcc

SEQ ID NO: 841408 - DNA, 25 bp, Mus musculus
ttcggcgcgtcgactgtccagagtc

SEQ ID NO: 841409 - DNA, 25 bp, Mus musculus
ttcggcgcgtcgtctgtccagagtc

SEQ ID NO: 841410 - DNA, 25 bp, Mus musculus
ttcggcgtgcagaagtggacttgga

SEQ ID NO: 841411 - DNA, 25 bp, Mus musculus
ttcggcgtgcagtagtggacttgga

SEQ ID NO: 841412 - DNA, 25 bp, Mus musculus
ttcggctcggctcgcccatttcagt

SEQ ID NO: 841413 - DNA, 25 bp, Mus musculus
ttcggctcggctggcccatttcagt

SEQ ID NO: 841414 - DNA, 25 bp, Mus musculus
ttcggctgctgcactatcacctgca

SEQ ID NO: 841415 - DNA, 25 bp, Mus musculus
ttcggctgctgctctatcacctgca

SEQ ID NO: 841416 - DNA, 25 bp, Mus musculus
ttcggcttcgtgattgcctgttatg

SEQ ID NO: 841417 - DNA, 25 bp, Mus musculus
ttcggcttcgtgtttgcctgttatg

SEQ ID NO: 841418 - DNA, 25 bp, Mus musculus
ttcggctttacgcacagtgactgca

SEQ ID NO: 841419 - DNA, 25 bp, Mus musculus
ttcggctttacggacagtgactgca

SEQ ID NO: 841420 - DNA, 25 bp, Mus musculus
ttcggcttttctcggttcagtctcc

SEQ ID NO: 841421 - DNA, 25 bp, Mus musculus
ttcggcttttctgggttcagtctcc

SEQ ID NO: 841422 - DNA, 25 bp, Mus musculus
ttcgggaacaagacgttgtcatcac

SEQ ID NO: 841423 - DNA, 25 bp, Mus musculus
ttcgggaacaagtcgttgtcatcac

SEQ ID NO: 841424 - DNA, 25 bp, Mus musculus
ttcgggaatccgctgaggaaattca

SEQ ID NO: 841425 - DNA, 25 bp, Mus musculus
ttcgggaatccggtgaggaaattca

SEQ ID NO: 841426 - DNA, 25 bp, Mus musculus
ttcgggaatcgtcagcctggccccg

SEQ ID NO: 841427 - DNA, 25 bp, Mus musculus
ttcgggaatcgtgagcctggccccg

SEQ ID NO: 841428 - DNA, 25 bp, Mus musculus
ttcgggaattaaaagctcggatgcg

SEQ ID NO: 841429 - DNA, 25 bp, Mus musculus
ttcgggaattaatagctcggatgcg

SEQ ID NO: 841430 - DNA, 25 bp, Mus musculus
ttcgggaattccaccgtgcccggcg

SEQ ID NO: 841431 - DNA, 25 bp, Mus musculus
ttcgggaattcctccgtgcccggcg

SEQ ID NO: 841432 - DNA, 25 bp, Mus musculus
ttcgggactccgctgtctccgtggc

SEQ ID NO: 841433 - DNA, 25 bp, Mus musculus
ttcgggactccggtgtctccgtggc

SEQ ID NO: 841434 - DNA, 25 bp, Mus musculus
ttcgggactttgagcgtcaggagat

SEQ ID NO: 841435 - DNA, 25 bp, Mus musculus
ttcgggactttgtgcgtcaggagat

SEQ ID NO: 841436 - DNA, 25 bp, Mus musculus
ttcgggagatcgagtcccagacagg

SEQ ID NO: 841437 - DNA, 25 bp, Mus musculus
ttcgggagatcgtgtcccagacagg

SEQ ID NO: 841438 - DNA, 25 bp, Mus musculus
ttcgggagcggacaccctttttcag

SEQ ID NO: 841439 - DNA, 25 bp, Mus musculus
ttcgggagcggagaccctttttcag

SEQ ID NO: 841440 - DNA, 25 bp, Mus musculus
ttcgggagtcgcagctgttggactt

SEQ ID NO: 841441 - DNA, 25 bp, Mus musculus
ttcgggagtcgctgctgttggactt

SEQ ID NO: 841442 - DNA, 25 bp, Mus musculus
ttcgggcacagaaaaaacagtcttg

SEQ ID NO: 841443 - DNA, 25 bp, Mus musculus
ttcgggcacagataaaacagtcttg

SEQ ID NO: 841444 - DNA, 25 bp, Mus musculus
ttcgggccaccacagacggagagac

SEQ ID NO: 841445 - DNA, 25 bp, Mus musculus
ttcgggccaccagagacggagagac

SEQ ID NO: 841446 - DNA, 25 bp, Mus musculus
ttcgggccacttcgagttaatgtcc

SEQ ID NO: 841447 - DNA, 25 bp, Mus musculus
ttcgggccacttggagttaatgtcc

SEQ ID NO: 841448 - DNA, 25 bp, Mus musculus
ttcgggccctccagcaaacatggca

SEQ ID NO: 841449 - DNA, 25 bp, Mus musculus
ttcgggccctcctgcaaacatggca

SEQ ID NO: 841450 - DNA, 25 bp, Mus musculus
ttcgggcctgttccagagttctcag

SEQ ID NO: 841451 - DNA, 25 bp, Mus musculus
ttcgggcctgttgcagagttctcag

SEQ ID NO: 841452 - DNA, 25 bp, Mus musculus
ttcgggctccagaacattccaccaa

SEQ ID NO: 841453 - DNA, 25 bp, Mus musculus
ttcgggctccagtacattccaccaa

SEQ ID NO: 841454 - DNA, 25 bp, Mus musculus
ttcgggctgcccaagcggacagtaa

SEQ ID NO: 841455 - DNA, 25 bp, Mus musculus
ttcgggctgccctagcggacagtaa

SEQ ID NO: 841456 - DNA, 25 bp, Mus musculus
ttcgggctttccaagacccttacat

SEQ ID NO: 841457 - DNA, 25 bp, Mus musculus
ttcgggctttcctagacccttacat

SEQ ID NO: 841458 - DNA, 25 bp, Mus musculus
ttcgggtcagccaccttaaacttcg

SEQ ID NO: 841459 - DNA, 25 bp, Mus musculus
ttcgggtcagcctccttaaacttcg

SEQ ID NO: 841460 - DNA, 25 bp, Mus musculus
ttcgggtccagcaccgggccctaga

SEQ ID NO: 841461 - DNA, 25 bp, Mus musculus
ttcgggtccagctccgggccctaga

SEQ ID NO: 841462 - DNA, 25 bp, Mus musculus
ttcgggtccagtcagcgcctcggaa

SEQ ID NO: 841463 - DNA, 25 bp, Mus musculus
ttcgggtccagtgagcgcctcggaa

SEQ ID NO: 841464 - DNA, 25 bp, Mus musculus
ttcgggtcgttcaggcgtcgttgaa

SEQ ID NO: 841465 - DNA, 25 bp, Mus musculus
ttcgggtcgttctggcgtcgttgaa

SEQ ID NO: 841466 - DNA, 25 bp, Mus musculus
ttcgggtctcagatggagcccctgc

SEQ ID NO: 841467 - DNA, 25 bp, Mus musculus
ttcgggtctcagttggagcccctgc

SEQ ID NO: 841468 - DNA, 25 bp, Mus musculus
ttcgggtgatgaaccctatccaggg

SEQ ID NO: 841469 - DNA, 25 bp, Mus musculus
ttcgggtgatgatccctatccaggg

SEQ ID NO: 841470 - DNA, 25 bp, Mus musculus
ttcgggtgctggacttaggcagccc

SEQ ID NO: 841471 - DNA, 25 bp, Mus musculus
ttcgggtgctggtcttaggcagccc

SEQ ID NO: 841472 - DNA, 25 bp, Mus musculus
ttcgggttcaagagaggcaaggaca

SEQ ID NO: 841473 - DNA, 25 bp, Mus musculus
ttcgggttcaagtgaggcaaggaca

SEQ ID NO: 841474 - DNA, 25 bp, Mus musculus
ttcggtagcgacagattctcagagc

SEQ ID NO: 841475 - DNA, 25 bp, Mus musculus
ttcggtagcgactgattctcagagc

SEQ ID NO: 841476 - DNA, 25 bp, Mus musculus
ttcggtaggttcacgatgacggagc

SEQ ID NO: 841477 - DNA, 25 bp, Mus musculus
ttcggtaggttctcgatgacggagc

SEQ ID NO: 841478 - DNA, 25 bp, Mus musculus
ttcggtatcgcccaagcttcgtgtc

SEQ ID NO: 841479 - DNA, 25 bp, Mus musculus
ttcggtatcgccgaagcttcgtgtc

SEQ ID NO: 841480 - DNA, 25 bp, Mus musculus
ttcggtccaaacatgctcaacacgg

SEQ ID NO: 841481 - DNA, 25 bp, Mus musculus
ttcggtccaaacttgctcaacacgg

SEQ ID NO: 841482 - DNA, 25 bp, Mus musculus
ttcggtccgaagaccatgagcgcgg

SEQ ID NO: 841483 - DNA, 25 bp, Mus musculus
ttcggtccgaagtccatgagcgcgg

SEQ ID NO: 841484 - DNA, 25 bp, Mus musculus
ttcggtcgttcaagccagaggacgg

SEQ ID NO: 841485 - DNA, 25 bp, Mus musculus
ttcggtcgttcatgccagaggacgg

SEQ ID NO: 841486 - DNA, 25 bp, Mus musculus
ttcggtctgactagcagccgctgca

SEQ ID NO: 841487 - DNA, 25 bp, Mus musculus
ttcggtctgacttgcagccgctgca

SEQ ID NO: 841488 - DNA, 25 bp, Mus musculus
ttcggtgcggccaaggcagtgacaa

SEQ ID NO: 841489 - DNA, 25 bp, Mus musculus
ttcggtgcggcctaggcagtgacaa

SEQ ID NO: 841490 - DNA, 25 bp, Mus musculus
ttcggtgctaggaggagactgtctc

SEQ ID NO: 841491 - DNA, 25 bp, Mus musculus
ttcggtgctaggtggagactgtctc

SEQ ID NO: 841492 - DNA, 25 bp, Mus musculus
ttcggtggcacacaaaccgtgggca

SEQ ID NO: 841493 - DNA, 25 bp, Mus musculus
ttcggtggcacagaaaccgtgggca

SEQ ID NO: 841494 - DNA, 25 bp, Mus musculus
ttcggtggccctactctggcaagac

SEQ ID NO: 841495 - DNA, 25 bp, Mus musculus
ttcggtggcccttctctggcaagac

SEQ ID NO: 841496 - DNA, 25 bp, Mus musculus
ttcggtgtcgtacgcatccccgtga

SEQ ID NO: 841497 - DNA, 25 bp, Mus musculus
ttcggtgtcgtaggcatccccgtga

SEQ ID NO: 841498 - DNA, 25 bp, Mus musculus
ttcggtgttggtaagcactgtgcca

SEQ ID NO: 841499 - DNA, 25 bp, Mus musculus
ttcggtgttggttagcactgtgcca

SEQ ID NO: 841500 - DNA, 25 bp, Mus musculus
ttcggttcactgatcctcatcttca

SEQ ID NO: 841501 - DNA, 25 bp, Mus musculus
ttcggttcactgttcctcatcttca

SEQ ID NO: 841502 - DNA, 25 bp, Mus musculus
ttcggttgcgacacagtctaggttc

SEQ ID NO: 841503 - DNA, 25 bp, Mus musculus
ttcggttgcgactcagtctaggttc

SEQ ID NO: 841504 - DNA, 25 bp, Mus musculus
ttcgtaagtactctctgggcactgg

SEQ ID NO: 841505 - DNA, 25 bp, Mus musculus
ttcgtaagtactgtctgggcactgg

SEQ ID NO: 841506 - DNA, 25 bp, Mus musculus
ttcgtaatgctgacgtcattgctgg

SEQ ID NO: 841507 - DNA, 25 bp, Mus musculus
ttcgtaatgctgtcgtcattgctgg

SEQ ID NO: 841508 - DNA, 25 bp, Mus musculus
ttcgtacaacaaacagagaatgcct

SEQ ID NO: 841509 - DNA, 25 bp, Mus musculus
ttcgtacaacaatcagagaatgcct

SEQ ID NO: 841510 - DNA, 25 bp, Mus musculus
ttcgtacacaacatccaggagagta

SEQ ID NO: 841511 - DNA, 25 bp, Mus musculus
ttcgtacacaacttccaggagagta

SEQ ID NO: 841512 - DNA, 25 bp, Mus musculus
ttcgtaccggtaccatctcggtggg

SEQ ID NO: 841513 - DNA, 25 bp, Mus musculus
ttcgtaccggtagcatctcggtggg

SEQ ID NO: 841514 - DNA, 25 bp, Mus musculus
ttcgtactgcttcgttgtaaaacct

SEQ ID NO: 841515 - DNA, 25 bp, Mus musculus
ttcgtactgcttggttgtaaaacct

SEQ ID NO: 841516 - DNA, 25 bp, Mus musculus
ttcgtacttgttctcgctggcccgg

SEQ ID NO: 841517 - DNA, 25 bp, Mus musculus
ttcgtacttgttgtcgctggcccgg

SEQ ID NO: 841518 - DNA, 25 bp, Mus musculus
ttcgtagctagaaaacggagggaat

SEQ ID NO: 841519 - DNA, 25 bp, Mus musculus
ttcgtagctagataacggagggaat

SEQ ID NO: 841520 - DNA, 25 bp, Mus musculus
ttcgtaggaagaacgtacaggctca

SEQ ID NO: 841521 - DNA, 25 bp, Mus musculus
ttcgtaggaagatcgtacaggctca

SEQ ID NO: 841522 - DNA, 25 bp, Mus musculus
ttcgtatacctgagcaacctgctgt

SEQ ID NO: 841523 - DNA, 25 bp, Mus musculus
ttcgtatacctgtgcaacctgctgt

SEQ ID NO: 841524 - DNA, 25 bp, Mus musculus
ttcgtcagtgtcagctgcgggcacg

SEQ ID NO: 841525 - DNA, 25 bp, Mus musculus
ttcgtcagtgtctgctgcgggcacg

SEQ ID NO: 841526 - DNA, 25 bp, Mus musculus
ttcgtcatgcgtagtttccaggtga

SEQ ID NO: 841527 - DNA, 25 bp, Mus musculus
ttcgtcatgcgttgtttccaggtga

SEQ ID NO: 841528 - DNA, 25 bp, Mus musculus
ttcgtccacccgacctggaagagcg

SEQ ID NO: 841529 - DNA, 25 bp, Mus musculus
ttcgtccacccgtcctggaagagcg

SEQ ID NO: 841530 - DNA, 25 bp, Mus musculus
ttcgtccccacgcagagctacggaa

SEQ ID NO: 841531 - DNA, 25 bp, Mus musculus
ttcgtccccacggagagctacggaa

SEQ ID NO: 841532 - DNA, 25 bp, Mus musculus
ttcgtcggcgacagtgtgaagaagt

SEQ ID NO: 841533 - DNA, 25 bp, Mus musculus
ttcgtcggcgactgtgtgaagaagt

SEQ ID NO: 841534 - DNA, 25 bp, Mus musculus
ttcgtcgtccgcaataagcccgatg

SEQ ID NO: 841535 - DNA, 25 bp, Mus musculus
ttcgtcgtccgctataagcccgatg

SEQ ID NO: 841536 - DNA, 25 bp, Mus musculus
ttcgtctagctgattccgatcctgg

SEQ ID NO: 841537 - DNA, 25 bp, Mus musculus
ttcgtctagctgtttccgatcctgg

SEQ ID NO: 841538 - DNA, 25 bp, Mus musculus
ttcgtctcggcgacctggagcggcc

SEQ ID NO: 841539 - DNA, 25 bp, Mus musculus
ttcgtctcggcgtcctggagcggcc

SEQ ID NO: 841540 - DNA, 25 bp, Mus musculus
ttcgtctctacgcacaaagcttcat

SEQ ID NO: 841541 - DNA, 25 bp, Mus musculus
ttcgtctctacggacaaagcttcat

SEQ ID NO: 841542 - DNA, 25 bp, Mus musculus
ttcgtctgctcgctgggcctgacac

SEQ ID NO: 841543 - DNA, 25 bp, Mus musculus
ttcgtctgctcggtgggcctgacac

SEQ ID NO: 841544 - DNA, 25 bp, Mus musculus
ttcgtctggagtcgcgacaggctga

SEQ ID NO: 841545 - DNA, 25 bp, Mus musculus
ttcgtctggagtggcgacaggctga

SEQ ID NO: 841546 - DNA, 25 bp, Mus musculus
ttcgtgaacaagcaacaggcccacg

SEQ ID NO: 841547 - DNA, 25 bp, Mus musculus
ttcgtgaacaaggaacaggcccacg

SEQ ID NO: 841548 - DNA, 25 bp, Mus musculus
ttcgtgaaccggagtccctctcctt

SEQ ID NO: 841549 - DNA, 25 bp, Mus musculus
ttcgtgaaccggtgtccctctcctt

SEQ ID NO: 841550 - DNA, 25 bp, Mus musculus
ttcgtgaaggagagttcacacatca

SEQ ID NO: 841551 - DNA, 25 bp, Mus musculus
ttcgtgaaggagtgttcacacatca

SEQ ID NO: 841552 - DNA, 25 bp, Mus musculus
ttcgtgaagtccataaatgaagagg

SEQ ID NO: 841553 - DNA, 25 bp, Mus musculus
ttcgtgaagtccttaaatgaagagg

SEQ ID NO: 841554 - DNA, 25 bp, Mus musculus
ttcgtgacgactcagtttgagcctt

SEQ ID NO: 841555 - DNA, 25 bp, Mus musculus
ttcgtgacgactgagtttgagcctt

SEQ ID NO: 841556 - DNA, 25 bp, Mus musculus
ttcgtgacttgactttagagacagc

SEQ ID NO: 841557 - DNA, 25 bp, Mus musculus
ttcgtgacttgagtttagagacagc

SEQ ID NO: 841558 - DNA, 25 bp, Mus musculus
ttcgtgagatgaccgacccttcgca

SEQ ID NO: 841559 - DNA, 25 bp, Mus musculus
ttcgtgagatgagcgacccttcgca

SEQ ID NO: 841560 - DNA, 25 bp, Mus musculus
ttcgtgaggatacagaaggttttct

SEQ ID NO: 841561 - DNA, 25 bp, Mus musculus
ttcgtgaggatagagaaggttttct

SEQ ID NO: 841562 - DNA, 25 bp, Mus musculus
ttcgtgcagcgcctgttccgcgacg

SEQ ID NO: 841563 - DNA, 25 bp, Mus musculus
ttcgtgcagcgcgtgttccgcgacg

SEQ ID NO: 841564 - DNA, 25 bp, Mus musculus
ttcgtgcagctgatgcccatcctca

SEQ ID NO: 841565 - DNA, 25 bp, Mus musculus
ttcgtgcagctgttgcccatcctca

SEQ ID NO: 841566 - DNA, 25 bp, Mus musculus
ttcgtgcgcgcaacgcgtacctaca

SEQ ID NO: 841567 - DNA, 25 bp, Mus musculus
ttcgtgcgcgcatcgcgtacctaca

SEQ ID NO: 841568 - DNA, 25 bp, Mus musculus
ttcgtgcgctgcagtcagtggtgca

SEQ ID NO: 841569 - DNA, 25 bp, Mus musculus
ttcgtgcgctgctgtcagtggtgca

SEQ ID NO: 841570 - DNA, 25 bp, Mus musculus
ttcgtgctaggcaaggatctctacc

SEQ ID NO: 841571 - DNA, 25 bp, Mus musculus
ttcgtgctaggctaggatctctacc

SEQ ID NO: 841572 - DNA, 25 bp, Mus musculus
ttcgtgctggacaacaatgcagggc

SEQ ID NO: 841573 - DNA, 25 bp, Mus musculus
ttcgtgctggactacaatgcagggc

SEQ ID NO: 841574 - DNA, 25 bp, Mus musculus
ttcgtggacgctagagaaagggaac

SEQ ID NO: 841575 - DNA, 25 bp, Mus musculus
ttcgtggacgcttgagaaagggaac

SEQ ID NO: 841576 - DNA, 25 bp, Mus musculus
ttcgtggaggtgatctattagcttc

SEQ ID NO: 841577 - DNA, 25 bp, Mus musculus
ttcgtggaggtgttctattagcttc

SEQ ID NO: 841578 - DNA, 25 bp, Mus musculus
ttcgtggtccgcaaccagaagccca

SEQ ID NO: 841579 - DNA, 25 bp, Mus musculus
ttcgtggtccgctaccagaagccca

SEQ ID NO: 841580 - DNA, 25 bp, Mus musculus
ttcgtggttttcaccaaatgaaaag

SEQ ID NO: 841581 - DNA, 25 bp, Mus musculus
ttcgtggttttctccaaatgaaaag

SEQ ID NO: 841582 - DNA, 25 bp, Mus musculus
ttcgtgtagcctaggatgatgtttg

SEQ ID NO: 841583 - DNA, 25 bp, Mus musculus
ttcgtgtagccttggatgatgtttg

SEQ ID NO: 841584 - DNA, 25 bp, Mus musculus
ttcgtgtcccttaggcaactcccta

SEQ ID NO: 841585 - DNA, 25 bp, Mus musculus
ttcgtgtccctttggcaactcccta

SEQ ID NO: 841586 - DNA, 25 bp, Mus musculus
ttcgtgtctgacaagagaccccaga

SEQ ID NO: 841587 - DNA, 25 bp, Mus musculus
ttcgtgtctgactagagaccccaga

SEQ ID NO: 841588 - DNA, 25 bp, Mus musculus
ttcgtgtgtcctacagggcgccctg

SEQ ID NO: 841589 - DNA, 25 bp, Mus musculus
ttcgtgtgtccttcagggcgccctg

SEQ ID NO: 841590 - DNA, 25 bp, Mus musculus
ttcgtgttcgccagcatctcctacg

SEQ ID NO: 841591 - DNA, 25 bp, Mus musculus
ttcgtgttcgcctgcatctcctacg

SEQ ID NO: 841592 - DNA, 25 bp, Mus musculus
ttcgttacgagacgcagaccacctg

SEQ ID NO: 841593 - DNA, 25 bp, Mus musculus
ttcgttacgagaggcagaccacctg

SEQ ID NO: 841594 - DNA, 25 bp, Mus musculus
ttcgttagaggcactcagcagggct

SEQ ID NO: 841595 - DNA, 25 bp, Mus musculus
ttcgttagaggctctcagcagggct

SEQ ID NO: 841596 - DNA, 25 bp, Mus musculus
ttcgttcagccactggcgccgagga

SEQ ID NO: 841597 - DNA, 25 bp, Mus musculus
ttcgttcagccagtggcgccgagga

SEQ ID NO: 841598 - DNA, 25 bp, Mus musculus
ttcgttctggagacccagtgtgggt

SEQ ID NO: 841599 - DNA, 25 bp, Mus musculus
ttcgttctggagtcccagtgtgggt

SEQ ID NO: 841600 - DNA, 25 bp, Mus musculus
ttcgttcttaccatgcaaccgctgg

SEQ ID NO: 841601 - DNA, 25 bp, Mus musculus
ttcgttcttaccttgcaaccgctgg

SEQ ID NO: 841602 - DNA, 25 bp, Mus musculus
ttctaaaaccctcgcgcatctggct

SEQ ID NO: 841603 - DNA, 25 bp, Mus musculus
ttctaaaaccctggcgcatctggct

SEQ ID NO: 841604 - DNA, 25 bp, Mus musculus
ttctaaaagaatagccagcgatgcc

SEQ ID NO: 841605 - DNA, 25 bp, Mus musculus
ttctaaaagaattgccagcgatgcc

SEQ ID NO: 841606 - DNA, 25 bp, Mus musculus
ttctaaaccacgaggacgcgtcggg

SEQ ID NO: 841607 - DNA, 25 bp, Mus musculus
ttctaaaccacgtggacgcgtcggg

SEQ ID NO: 841608 - DNA, 25 bp, Mus musculus
ttctaaagccacatcatataggact

SEQ ID NO: 841609 - DNA, 25 bp, Mus musculus
ttctaaagccacttcatataggact

SEQ ID NO: 841610 - DNA, 25 bp, Mus musculus
ttctaaagcgccctaagcggagcct

SEQ ID NO: 841611 - DNA, 25 bp, Mus musculus
ttctaaagcgccgtaagcggagcct

SEQ ID NO: 841612 - DNA, 25 bp, Mus musculus
ttctaaatggttacagcacaaataa

SEQ ID NO: 841613 - DNA, 25 bp, Mus musculus
ttctaaatggtttcagcacaaataa

SEQ ID NO: 841614 - DNA, 25 bp, Mus musculus
ttctaacagagaccaccggaaaaga

SEQ ID NO: 841615 - DNA, 25 bp, Mus musculus
ttctaacagagagcaccggaaaaga

SEQ ID NO: 841616 - DNA, 25 bp, Mus musculus
ttctaacattgcaccagctgatcct

SEQ ID NO: 841617 - DNA, 25 bp, Mus musculus
ttctaacattgctccagctgatcct

SEQ ID NO: 841618 - DNA, 25 bp, Mus musculus
ttctaacgaccccaggcaggacctg

SEQ ID NO: 841619 - DNA, 25 bp, Mus musculus
ttctaacgacccgaggcaggacctg

SEQ ID NO: 841620 - DNA, 25 bp, Mus musculus
ttctaactcaagacctttgctaagt

SEQ ID NO: 841621 - DNA, 25 bp, Mus musculus
ttctaactcaagtcctttgctaagt

SEQ ID NO: 841622 - DNA, 25 bp, Mus musculus
ttctaacttatacgacaactccggg

SEQ ID NO: 841623 - DNA, 25 bp, Mus musculus
ttctaacttataggacaactccggg

SEQ ID NO: 841624 - DNA, 25 bp, Mus musculus
ttctaagggaaaataccaccatggt

SEQ ID NO: 841625 - DNA, 25 bp, Mus musculus
ttctaagggaaattaccaccatggt

SEQ ID NO: 841626 - DNA, 25 bp, Mus musculus
ttctaagtggcccaggcttgtttgg

SEQ ID NO: 841627 - DNA, 25 bp, Mus musculus
ttctaagtggccgaggcttgtttgg

SEQ ID NO: 841628 - DNA, 25 bp, Mus musculus
ttctaatcctggagtctgtgacccc

SEQ ID NO: 841629 - DNA, 25 bp, Mus musculus
ttctaatcctggtgtctgtgacccc

SEQ ID NO: 841630 - DNA, 25 bp, Mus musculus
ttctaatgtgaaagcaagtcctaag

SEQ ID NO: 841631 - DNA, 25 bp, Mus musculus
ttctaatgtgaatgcaagtcctaag

SEQ ID NO: 841632 - DNA, 25 bp, Mus musculus
ttctacaaaatacgtaaggtggcag

SEQ ID NO: 841633 - DNA, 25 bp, Mus musculus
ttctacaaaataggtaaggtggcag

SEQ ID NO: 841634 - DNA, 25 bp, Mus musculus
ttctacaaccccatgaccggtgaga

SEQ ID NO: 841635 - DNA, 25 bp, Mus musculus
ttctacaaccccttgaccggtgaga

SEQ ID NO: 841636 - DNA, 25 bp, Mus musculus
ttctacaacttgcagggacggaggt

SEQ ID NO: 841637 - DNA, 25 bp, Mus musculus
ttctacaacttggagggacggaggt

SEQ ID NO: 841638 - DNA, 25 bp, Mus musculus
ttctacaagcatcagagctgtggcc

SEQ ID NO: 841639 - DNA, 25 bp, Mus musculus
ttctacaagcatgagagctgtggcc

SEQ ID NO: 841640 - DNA, 25 bp, Mus musculus
ttctacaccaaacggcgggccttgg

SEQ ID NO: 841641 - DNA, 25 bp, Mus musculus
ttctacaccaaagggcgggccttgg

SEQ ID NO: 841642 - DNA, 25 bp, Mus musculus
ttctacactatgctggagagccttg

SEQ ID NO: 841643 - DNA, 25 bp, Mus musculus
ttctacactatggtggagagccttg

SEQ ID NO: 841644 - DNA, 25 bp, Mus musculus
ttctacactgcacaggtggcgagcg

SEQ ID NO: 841645 - DNA, 25 bp, Mus musculus
ttctacactgcagaggtggcgagcg

SEQ ID NO: 841646 - DNA, 25 bp, Mus musculus
ttctacagaactccataatatctgc

SEQ ID NO: 841647 - DNA, 25 bp, Mus musculus
ttctacagaactgcataatatctgc

SEQ ID NO: 841648 - DNA, 25 bp, Mus musculus
ttctacagatctccgacctgatccg

SEQ ID NO: 841649 - DNA, 25 bp, Mus musculus
ttctacagatctgcgacctgatccg

SEQ ID NO: 841650 - DNA, 25 bp, Mus musculus
ttctacagcaacatcttccgctggg

SEQ ID NO: 841651 - DNA, 25 bp, Mus musculus
ttctacagcaacttcttccgctggg

SEQ ID NO: 841652 - DNA, 25 bp, Mus musculus
ttctacagggacatcatcaccaccg

SEQ ID NO: 841653 - DNA, 25 bp, Mus musculus
ttctacagggacttcatcaccaccg

SEQ ID NO: 841654 - DNA, 25 bp, Mus musculus
ttctacagggccagttcggacccac

SEQ ID NO: 841655 - DNA, 25 bp, Mus musculus
ttctacagggcctgttcggacccac

SEQ ID NO: 841656 - DNA, 25 bp, Mus musculus
ttctacagtgagcaggaacgcgacg

SEQ ID NO: 841657 - DNA, 25 bp, Mus musculus
ttctacagtgaggaggaacgcgacg

SEQ ID NO: 841658 - DNA, 25 bp, Mus musculus
ttctacatacgaagacccctgccag

SEQ ID NO: 841659 - DNA, 25 bp, Mus musculus
ttctacatacgatgacccctgccag

SEQ ID NO: 841660 - DNA, 25 bp, Mus musculus
ttctacattcaacgcggcgactggg

SEQ ID NO: 841661 - DNA, 25 bp, Mus musculus
ttctacattcaaggcggcgactggg

SEQ ID NO: 841662 - DNA, 25 bp, Mus musculus
ttctaccacaagagctgcaagacgg

SEQ ID NO: 841663 - DNA, 25 bp, Mus musculus
ttctaccacaagtgctgcaagacgg

SEQ ID NO: 841664 - DNA, 25 bp, Mus musculus
ttctaccacccaccgggagagagca

SEQ ID NO: 841665 - DNA, 25 bp, Mus musculus
ttctaccacccagcgggagagagca

SEQ ID NO: 841666 - DNA, 25 bp, Mus musculus
ttctaccagccgacgtgcatcgtgc

SEQ ID NO: 841667 - DNA, 25 bp, Mus musculus
ttctaccagccgtcgtgcatcgtgc

SEQ ID NO: 841668 - DNA, 25 bp, Mus musculus
ttctaccagcctcacaaggaaagga

SEQ ID NO: 841669 - DNA, 25 bp, Mus musculus
ttctaccagcctgacaaggaaagga

SEQ ID NO: 841670 - DNA, 25 bp, Mus musculus
ttctaccccactagacagctgctgg

SEQ ID NO: 841671 - DNA, 25 bp, Mus musculus
ttctaccccacttgacagctgctgg

SEQ ID NO: 841672 - DNA, 25 bp, Mus musculus
ttctacccggacaaggcctggtact

SEQ ID NO: 841673 - DNA, 25 bp, Mus musculus
ttctacccggactaggcctggtact

SEQ ID NO: 841674 - DNA, 25 bp, Mus musculus
ttctaccggaagctgacgggactgc

SEQ ID NO: 841675 - DNA, 25 bp, Mus musculus
ttctaccggaaggtgacgggactgc

SEQ ID NO: 841676 - DNA, 25 bp, Mus musculus
ttctaccgtttcctgaagccgtggc

SEQ ID NO: 841677 - DNA, 25 bp, Mus musculus
ttctaccgtttcgtgaagccgtggc

SEQ ID NO: 841678 - DNA, 25 bp, Mus musculus
ttctacctcactcaccgggtcatga

SEQ ID NO: 841679 - DNA, 25 bp, Mus musculus
ttctacctcactgaccgggtcatga

SEQ ID NO: 841680 - DNA, 25 bp, Mus musculus
ttctacctcaggcagactcgggcgg

SEQ ID NO: 841681 - DNA, 25 bp, Mus musculus
ttctacctcagggagactcgggcgg

SEQ ID NO: 841682 - DNA, 25 bp, Mus musculus
ttctacctccagagttggtgccacg

SEQ ID NO: 841683 - DNA, 25 bp, Mus musculus
ttctacctccagtgttggtgccacg

SEQ ID NO: 841684 - DNA, 25 bp, Mus musculus
ttctacctctgtctgttttctgggc

SEQ ID NO: 841685 - DNA, 25 bp, Mus musculus
ttctacctctgtgtgttttctgggc

SEQ ID NO: 841686 - DNA, 25 bp, Mus musculus
ttctacctgattcggtactgctggc

SEQ ID NO: 841687 - DNA, 25 bp, Mus musculus
ttctacctgattgggtactgctggc

SEQ ID NO: 841688 - DNA, 25 bp, Mus musculus
ttctacctggcacagatcacactag

SEQ ID NO: 841689 - DNA, 25 bp, Mus musculus
ttctacctggcagagatcacactag

SEQ ID NO: 841690 - DNA, 25 bp, Mus musculus
ttctacctggtcaacgtcattgccc

SEQ ID NO: 841691 - DNA, 25 bp, Mus musculus
ttctacctggtctacgtcattgccc

SEQ ID NO: 841692 - DNA, 25 bp, Mus musculus
ttctacgagggacactgctacatcg

SEQ ID NO: 841693 - DNA, 25 bp, Mus musculus
ttctacgagggagactgctacatcg

SEQ ID NO: 841694 - DNA, 25 bp, Mus musculus
ttctacgcggcgcagatcgtcctga

SEQ ID NO: 841695 - DNA, 25 bp, Mus musculus
ttctacgcggcggagatcgtcctga

SEQ ID NO: 841696 - DNA, 25 bp, Mus musculus
ttctacggcatcatgggagccctgg

SEQ ID NO: 841697 - DNA, 25 bp, Mus musculus
ttctacggcatcttgggagccctgg

SEQ ID NO: 841698 - DNA, 25 bp, Mus musculus
ttctacgtcaacctacattaacgtg

SEQ ID NO: 841699 - DNA, 25 bp, Mus musculus
ttctacgtcaacgtacattaacgtg

SEQ ID NO: 841700 - DNA, 25 bp, Mus musculus
ttctacgtggcaaccagaaggtggc

SEQ ID NO: 841701 - DNA, 25 bp, Mus musculus
ttctacgtggcatccagaaggtggc

SEQ ID NO: 841702 - DNA, 25 bp, Mus musculus
ttctactacaaaagcaccaagggct

SEQ ID NO: 841703 - DNA, 25 bp, Mus musculus
ttctactacaaatgcaccaagggct

SEQ ID NO: 841704 - DNA, 25 bp, Mus musculus
ttctactcagtgcttccacaactgg

SEQ ID NO: 841705 - DNA, 25 bp, Mus musculus
ttctactcagtggttccacaactgg

SEQ ID NO: 841706 - DNA, 25 bp, Mus musculus
ttctactccaaaaaggaaagacgct

SEQ ID NO: 841707 - DNA, 25 bp, Mus musculus
ttctactccaaataggaaagacgct

SEQ ID NO: 841708 - DNA, 25 bp, Mus musculus
ttctactccttgcaaatgcctatca

SEQ ID NO: 841709 - DNA, 25 bp, Mus musculus
ttctactccttggaaatgcctatca

SEQ ID NO: 841710 - DNA, 25 bp, Mus musculus
ttctactcggatcctcatgaatcag

SEQ ID NO: 841711 - DNA, 25 bp, Mus musculus
ttctactcggatgctcatgaatcag

SEQ ID NO: 841712 - DNA, 25 bp, Mus musculus
ttctactcgtctatttgctgtgctg

SEQ ID NO: 841713 - DNA, 25 bp, Mus musculus
ttctactcgtctttttgctgtgctg

SEQ ID NO: 841714 - DNA, 25 bp, Mus musculus
ttctactcgtgcattccagctgtcc

SEQ ID NO: 841715 - DNA, 25 bp, Mus musculus
ttctactcgtgctttccagctgtcc

SEQ ID NO: 841716 - DNA, 25 bp, Mus musculus
ttctactcttctcggcagcatgcca

SEQ ID NO: 841717 - DNA, 25 bp, Mus musculus
ttctactcttctgggcagcatgcca

SEQ ID NO: 841718 - DNA, 25 bp, Mus musculus
ttctactgcagaacaaggccccatc

SEQ ID NO: 841719 - DNA, 25 bp, Mus musculus
ttctactgcagatcaaggccccatc

SEQ ID NO: 841720 - DNA, 25 bp, Mus musculus
ttctactgcctcaggaacacaagtt

SEQ ID NO: 841721 - DNA, 25 bp, Mus musculus
ttctactgcctctggaacacaagtt

SEQ ID NO: 841722 - DNA, 25 bp, Mus musculus
ttctacttcggtctgccttcgagca

SEQ ID NO: 841723 - DNA, 25 bp, Mus musculus
ttctacttcggtgtgccttcgagca

SEQ ID NO: 841724 - DNA, 25 bp, Mus musculus
ttctactttttgagatgtctcctgg

SEQ ID NO: 841725 - DNA, 25 bp, Mus musculus
ttctactttttgtgatgtctcctgg

SEQ ID NO: 841726 - DNA, 25 bp, Mus musculus
ttctagaactccacgtgatgtttct

SEQ ID NO: 841727 - DNA, 25 bp, Mus musculus
ttctagaactcctcgtgatgtttct

SEQ ID NO: 841728 - DNA, 25 bp, Mus musculus
ttctagaagaagagctgtcgagcct

SEQ ID NO: 841729 - DNA, 25 bp, Mus musculus
ttctagaagaagtgctgtcgagcct

SEQ ID NO: 841730 - DNA, 25 bp, Mus musculus
ttctagaagcccatggactgaaacc

SEQ ID NO: 841731 - DNA, 25 bp, Mus musculus
ttctagaagcccttggactgaaacc

SEQ ID NO: 841732 - DNA, 25 bp, Mus musculus
ttctagacagccactgcagcacggt

SEQ ID NO: 841733 - DNA, 25 bp, Mus musculus
ttctagacagcctctgcagcacggt

SEQ ID NO: 841734 - DNA, 25 bp, Mus musculus
ttctagagcgcaaggccaggaagcc

SEQ ID NO: 841735 - DNA, 25 bp, Mus musculus
ttctagagcgcatggccaggaagcc

SEQ ID NO: 841736 - DNA, 25 bp, Mus musculus
ttctagccaataataaaactttaat

SEQ ID NO: 841737 - DNA, 25 bp, Mus musculus
ttctagccaatattaaaactttaat

SEQ ID NO: 841738 - DNA, 25 bp, Mus musculus
ttctagccacgtctagcgcccttgg

SEQ ID NO: 841739 - DNA, 25 bp, Mus musculus
ttctagccacgtgtagcgcccttgg

SEQ ID NO: 841740 - DNA, 25 bp, Mus musculus
ttctagcgcaggctcatccgcctag

SEQ ID NO: 841741 - DNA, 25 bp, Mus musculus
ttctagcgcagggtcatccgcctag

SEQ ID NO: 841742 - DNA, 25 bp, Mus musculus
ttctagcggtcgctctacccgagcg

SEQ ID NO: 841743 - DNA, 25 bp, Mus musculus
ttctagcggtcggtctacccgagcg

SEQ ID NO: 841744 - DNA, 25 bp, Mus musculus
ttctaggaaaaaagctagggccgag

SEQ ID NO: 841745 - DNA, 25 bp, Mus musculus
ttctaggaaaaatgctagggccgag

SEQ ID NO: 841746 - DNA, 25 bp, Mus musculus
ttctaggagagccaaggacctcttt

SEQ ID NO: 841747 - DNA, 25 bp, Mus musculus
ttctaggagagcgaaggacctcttt

SEQ ID NO: 841748 - DNA, 25 bp, Mus musculus
ttctagggcgctagcaaatgggtgt

SEQ ID NO: 841749 - DNA, 25 bp, Mus musculus
ttctagggcgcttgcaaatgggtgt

SEQ ID NO: 841750 - DNA, 25 bp, Mus musculus
ttctaggtataaaaacgtggcgcac

SEQ ID NO: 841751 - DNA, 25 bp, Mus musculus
ttctaggtataataacgtggcgcac

SEQ ID NO: 841752 - DNA, 25 bp, Mus musculus
ttctaggtcataagtccctttccca

SEQ ID NO: 841753 - DNA, 25 bp, Mus musculus
ttctaggtcatatgtccctttccca

SEQ ID NO: 841754 - DNA, 25 bp, Mus musculus
ttctaggtcttaaagtggaagaggc

SEQ ID NO: 841755 - DNA, 25 bp, Mus musculus
ttctaggtcttatagtggaagaggc

SEQ ID NO: 841756 - DNA, 25 bp, Mus musculus
ttctaggttaatccaacttccaggg

SEQ ID NO: 841757 - DNA, 25 bp, Mus musculus
ttctaggttaatgcaacttccaggg

SEQ ID NO: 841758 - DNA, 25 bp, Mus musculus
ttctagtacctgagaaaaggtgcag

SEQ ID NO: 841759 - DNA, 25 bp, Mus musculus
ttctagtacctgtgaaaaggtgcag

SEQ ID NO: 841760 - DNA, 25 bp, Mus musculus
ttctagtgacctcggctcgggatgc

SEQ ID NO: 841761 - DNA, 25 bp, Mus musculus
ttctagtgacctgggctcgggatgc

SEQ ID NO: 841762 - DNA, 25 bp, Mus musculus
ttctagtgagacaattaaatctaac

SEQ ID NO: 841763 - DNA, 25 bp, Mus musculus
ttctagtgagactattaaatctaac

SEQ ID NO: 841764 - DNA, 25 bp, Mus musculus
ttctagtgagccctacatcagagca

SEQ ID NO: 841765 - DNA, 25 bp, Mus musculus
ttctagtgagccgtacatcagagca

SEQ ID NO: 841766 - DNA, 25 bp, Mus musculus
ttctagtgcgcactggtcacaaccg

SEQ ID NO: 841767 - DNA, 25 bp, Mus musculus
ttctagtgcgcagtggtcacaaccg

SEQ ID NO: 841768 - DNA, 25 bp, Mus musculus
ttctagttcattaaggactttgccc

SEQ ID NO: 841769 - DNA, 25 bp, Mus musculus
ttctagttcatttaggactttgccc

SEQ ID NO: 841770 - DNA, 25 bp, Mus musculus
ttctatatacccaggcgccatgcca

SEQ ID NO: 841771 - DNA, 25 bp, Mus musculus
ttctatataccctggcgccatgcca

SEQ ID NO: 841772 - DNA, 25 bp, Mus musculus
ttctatcactgtcgatggagaagaa

SEQ ID NO: 841773 - DNA, 25 bp, Mus musculus
ttctatcactgtggatggagaagaa

SEQ ID NO: 841774 - DNA, 25 bp, Mus musculus
ttctatcagcctagcctaagcaggc

SEQ ID NO: 841775 - DNA, 25 bp, Mus musculus
ttctatcagccttgcctaagcaggc

SEQ ID NO: 841776 - DNA, 25 bp, Mus musculus
ttctatcagcggctggtggagttca

SEQ ID NO: 841777 - DNA, 25 bp, Mus musculus
ttctatcagcgggtggtggagttca

SEQ ID NO: 841778 - DNA, 25 bp, Mus musculus
ttctatcagctgctctcaggcgcct

SEQ ID NO: 841779 - DNA, 25 bp, Mus musculus
ttctatcagctggtctcaggcgcct

SEQ ID NO: 841780 - DNA, 25 bp, Mus musculus
ttctatccgtggcacaccggcggtg

SEQ ID NO: 841781 - DNA, 25 bp, Mus musculus
ttctatccgtgggacaccggcggtg

SEQ ID NO: 841782 - DNA, 25 bp, Mus musculus
ttctatcggcggagctcgcgtcctc

SEQ ID NO: 841783 - DNA, 25 bp, Mus musculus
ttctatcggcggtgctcgcgtcctc

SEQ ID NO: 841784 - DNA, 25 bp, Mus musculus
ttctatcgtgatccaggccgtgtcc

SEQ ID NO: 841785 - DNA, 25 bp, Mus musculus
ttctatcgtgatgcaggccgtgtcc

SEQ ID NO: 841786 - DNA, 25 bp, Mus musculus
ttctatctgtgaacagaagctgcag

SEQ ID NO: 841787 - DNA, 25 bp, Mus musculus
ttctatctgtgatcagaagctgcag

SEQ ID NO: 841788 - DNA, 25 bp, Mus musculus
ttctatgaaaggctgcatgagagca

SEQ ID NO: 841789 - DNA, 25 bp, Mus musculus
ttctatgaaagggtgcatgagagca

SEQ ID NO: 841790 - DNA, 25 bp, Mus musculus
ttctatgaaggcaacggacagaccg

SEQ ID NO: 841791 - DNA, 25 bp, Mus musculus
ttctatgaaggctacggacagaccg

SEQ ID NO: 841792 - DNA, 25 bp, Mus musculus
ttctatgaccctcaagctggctcgg

SEQ ID NO: 841793 - DNA, 25 bp, Mus musculus
ttctatgaccctgaagctggctcgg

SEQ ID NO: 841794 - DNA, 25 bp, Mus musculus
ttctatgcctccagaaatgcagctt

SEQ ID NO: 841795 - DNA, 25 bp, Mus musculus
ttctatgcctcctgaaatgcagctt

SEQ ID NO: 841796 - DNA, 25 bp, Mus musculus
ttctatgcctggcagcaccgagaga

SEQ ID NO: 841797 - DNA, 25 bp, Mus musculus
ttctatgcctgggagcaccgagaga

SEQ ID NO: 841798 - DNA, 25 bp, Mus musculus
ttctatggcacacgcctcatcgctg

SEQ ID NO: 841799 - DNA, 25 bp, Mus musculus
ttctatggcacaggcctcatcgctg

SEQ ID NO: 841800 - DNA, 25 bp, Mus musculus
ttctatgtgcaacatgtggagactg

SEQ ID NO: 841801 - DNA, 25 bp, Mus musculus
ttctatgtgcaagatgtggagactg

SEQ ID NO: 841802 - DNA, 25 bp, Mus musculus
ttctatgtggccatgaatcgcaggg

SEQ ID NO: 841803 - DNA, 25 bp, Mus musculus
ttctatgtggccttgaatcgcaggg

SEQ ID NO: 841804 - DNA, 25 bp, Mus musculus
ttctattcaaatcccaagacagttg

SEQ ID NO: 841805 - DNA, 25 bp, Mus musculus
ttctattcaaatgccaagacagttg

SEQ ID NO: 841806 - DNA, 25 bp, Mus musculus
ttctattggctcaaactcacattcg

SEQ ID NO: 841807 - DNA, 25 bp, Mus musculus
ttctattggctctaactcacattcg

SEQ ID NO: 841808 - DNA, 25 bp, Mus musculus
ttctattgtaagagcaacagcaagc

SEQ ID NO: 841809 - DNA, 25 bp, Mus musculus
ttctattgtaagtgcaacagcaagc

SEQ ID NO: 841810 - DNA, 25 bp, Mus musculus
ttctatttccagagtgaaggacatg

SEQ ID NO: 841811 - DNA, 25 bp, Mus musculus
ttctatttccagtgtgaaggacatg

SEQ ID NO: 841812 - DNA, 25 bp, Mus musculus
ttctatttggctaggttacaggcac

SEQ ID NO: 841813 - DNA, 25 bp, Mus musculus
ttctatttggcttggttacaggcac

SEQ ID NO: 841814 - DNA, 25 bp, Mus musculus
ttctcaaaacgaataagctcagtgg

SEQ ID NO: 841815 - DNA, 25 bp, Mus musculus
ttctcaaaacgattaagctcagtgg

SEQ ID NO: 841816 - DNA, 25 bp, Mus musculus
ttctcaaaatgaataaggagtgtga

SEQ ID NO: 841817 - DNA, 25 bp, Mus musculus
ttctcaaaatgattaaggagtgtga

SEQ ID NO: 841818 - DNA, 25 bp, Mus musculus
ttctcaaaatttcagggccttcatt

SEQ ID NO: 841819 - DNA, 25 bp, Mus musculus
ttctcaaaatttgagggccttcatt

SEQ ID NO: 841820 - DNA, 25 bp, Mus musculus
ttctcaaacacaaggccaaagctag

SEQ ID NO: 841821 - DNA, 25 bp, Mus musculus
ttctcaaacacatggccaaagctag

SEQ ID NO: 841822 - DNA, 25 bp, Mus musculus
ttctcaaacataaagcggccttttc

SEQ ID NO: 841823 - DNA, 25 bp, Mus musculus
ttctcaaacatatagcggccttttc

SEQ ID NO: 841824 - DNA, 25 bp, Mus musculus
ttctcaaagggcagaaatgcctgca

SEQ ID NO: 841825 - DNA, 25 bp, Mus musculus
ttctcaaagggctgaaatgcctgca

SEQ ID NO: 841826 - DNA, 25 bp, Mus musculus
ttctcaaagtcacaagggagccctc

SEQ ID NO: 841827 - DNA, 25 bp, Mus musculus
ttctcaaagtcagaagggagccctc

SEQ ID NO: 841828 - DNA, 25 bp, Mus musculus
ttctcaacaagtccgaaacctgggt

SEQ ID NO: 841829 - DNA, 25 bp, Mus musculus
ttctcaacaagtgcgaaacctgggt

SEQ ID NO: 841830 - DNA, 25 bp, Mus musculus
ttctcaacactgaactcgtgcctgt

SEQ ID NO: 841831 - DNA, 25 bp, Mus musculus
ttctcaacactgtactcgtgcctgt

SEQ ID NO: 841832 - DNA, 25 bp, Mus musculus
ttctcaacagccactaccctgatgt

SEQ ID NO: 841833 - DNA, 25 bp, Mus musculus
ttctcaacagcctctaccctgatgt

SEQ ID NO: 841834 - DNA, 25 bp, Mus musculus
ttctcaagaaccctgataccgtcct

SEQ ID NO: 841835 - DNA, 25 bp, Mus musculus
ttctcaagaaccgtgataccgtcct

SEQ ID NO: 841836 - DNA, 25 bp, Mus musculus
ttctcaagatctctttccgccgcag

SEQ ID NO: 841837 - DNA, 25 bp, Mus musculus
ttctcaagatctgtttccgccgcag

SEQ ID NO: 841838 - DNA, 25 bp, Mus musculus
ttctcaagcgctacctggtgctgaa

SEQ ID NO: 841839 - DNA, 25 bp, Mus musculus
ttctcaagcgcttcctggtgctgaa

SEQ ID NO: 841840 - DNA, 25 bp, Mus musculus
ttctcaaggaaacaggttgtgttta

SEQ ID NO: 841841 - DNA, 25 bp, Mus musculus
ttctcaaggaaagaggttgtgttta

SEQ ID NO: 841842 - DNA, 25 bp, Mus musculus
ttctcaaggatacaatggtgaacag

SEQ ID NO: 841843 - DNA, 25 bp, Mus musculus
ttctcaaggatagaatggtgaacag

SEQ ID NO: 841844 - DNA, 25 bp, Mus musculus
ttctcaaggctacgcagagcatgtc

SEQ ID NO: 841845 - DNA, 25 bp, Mus musculus
ttctcaaggctaggcagagcatgtc

SEQ ID NO: 841846 - DNA, 25 bp, Mus musculus
ttctcaaggtcaacaaagttgataa

SEQ ID NO: 841847 - DNA, 25 bp, Mus musculus
ttctcaaggtcatcaaagttgataa

SEQ ID NO: 841848 - DNA, 25 bp, Mus musculus
ttctcaaggtttccggctgtatcgt

SEQ ID NO: 841849 - DNA, 25 bp, Mus musculus
ttctcaaggtttgcggctgtatcgt

SEQ ID NO: 841850 - DNA, 25 bp, Mus musculus
ttctcaagtttcatgaagtggtcca

SEQ ID NO: 841851 - DNA, 25 bp, Mus musculus
ttctcaagtttcttgaagtggtcca

SEQ ID NO: 841852 - DNA, 25 bp, Mus musculus
ttctcaatagtgaccttctgcgcca

SEQ ID NO: 841853 - DNA, 25 bp, Mus musculus
ttctcaatagtgtccttctgcgcca

SEQ ID NO: 841854 - DNA, 25 bp, Mus musculus
ttctcacaatggcaaagagttcacg

SEQ ID NO: 841855 - DNA, 25 bp, Mus musculus
ttctcacaatgggaaagagttcacg

SEQ ID NO: 841856 - DNA, 25 bp, Mus musculus
ttctcacaggaaaggcttgccccat

SEQ ID NO: 841857 - DNA, 25 bp, Mus musculus
ttctcacaggaatggcttgccccat

SEQ ID NO: 841858 - DNA, 25 bp, Mus musculus
ttctcaccagtcctcagaatgacct

SEQ ID NO: 841859 - DNA, 25 bp, Mus musculus
ttctcaccagtcgtcagaatgacct

SEQ ID NO: 841860 - DNA, 25 bp, Mus musculus
ttctcacgacgtccgctatgggtca

SEQ ID NO: 841861 - DNA, 25 bp, Mus musculus
ttctcacgacgtgcgctatgggtca

SEQ ID NO: 841862 - DNA, 25 bp, Mus musculus
ttctcacgcagtcttcaacatcatc

SEQ ID NO: 841863 - DNA, 25 bp, Mus musculus
ttctcacgcagtgttcaacatcatc

SEQ ID NO: 841864 - DNA, 25 bp, Mus musculus
ttctcacggcgtcgtgcatttgggc

SEQ ID NO: 841865 - DNA, 25 bp, Mus musculus
ttctcacggcgtggtgcatttgggc

SEQ ID NO: 841866 - DNA, 25 bp, Mus musculus
ttctcactccttagacaaaaatcgc

SEQ ID NO: 841867 - DNA, 25 bp, Mus musculus
ttctcactcctttgacaaaaatcgc

SEQ ID NO: 841868 - DNA, 25 bp, Mus musculus
ttctcactgattcaactgctcacag

SEQ ID NO: 841869 - DNA, 25 bp, Mus musculus
ttctcactgattgaactgctcacag

SEQ ID NO: 841870 - DNA, 25 bp, Mus musculus
ttctcactgggcatgggttttggca

SEQ ID NO: 841871 - DNA, 25 bp, Mus musculus
ttctcactgggcttgggttttggca

SEQ ID NO: 841872 - DNA, 25 bp, Mus musculus
ttctcactgtggatgggaggctctg

SEQ ID NO: 841873 - DNA, 25 bp, Mus musculus
ttctcactgtggttgggaggctctg

SEQ ID NO: 841874 - DNA, 25 bp, Mus musculus
ttctcagaccccaggtccaggaagc

SEQ ID NO: 841875 - DNA, 25 bp, Mus musculus
ttctcagacccctggtccaggaagc

SEQ ID NO: 841876 - DNA, 25 bp, Mus musculus
ttctcagactcgaagcagcagcaca

SEQ ID NO: 841877 - DNA, 25 bp, Mus musculus
ttctcagactcgtagcagcagcaca

SEQ ID NO: 841878 - DNA, 25 bp, Mus musculus
ttctcagagaagaagtatctgtggg

SEQ ID NO: 841879 - DNA, 25 bp, Mus musculus
ttctcagagaagtagtatctgtggg

SEQ ID NO: 841880 - DNA, 25 bp, Mus musculus
ttctcagagcgcattttcatcgcgg

SEQ ID NO: 841881 - DNA, 25 bp, Mus musculus
ttctcagagcgctttttcatcgcgg

SEQ ID NO: 841882 - DNA, 25 bp, Mus musculus
ttctcagagggacaagtcattattc

SEQ ID NO: 841883 - DNA, 25 bp, Mus musculus
ttctcagagggagaagtcattattc

SEQ ID NO: 841884 - DNA, 25 bp, Mus musculus
ttctcagccaccctgggtatcggat

SEQ ID NO: 841885 - DNA, 25 bp, Mus musculus
ttctcagccaccgtgggtatcggat

SEQ ID NO: 841886 - DNA, 25 bp, Mus musculus
ttctcagctctcatgatcatcccag

SEQ ID NO: 841887 - DNA, 25 bp, Mus musculus
ttctcagctctcttgatcatcccag

SEQ ID NO: 841888 - DNA, 25 bp, Mus musculus
ttctcagctgcacagcactccaatg

SEQ ID NO: 841889 - DNA, 25 bp, Mus musculus
ttctcagctgcagagcactccaatg

SEQ ID NO: 841890 - DNA, 25 bp, Mus musculus
ttctcaggaggcaaacatctgtttt

SEQ ID NO: 841891 - DNA, 25 bp, Mus musculus
ttctcaggaggctaacatctgtttt

SEQ ID NO: 841892 - DNA, 25 bp, Mus musculus
ttctcaggcacacataggcgcacag

SEQ ID NO: 841893 - DNA, 25 bp, Mus musculus
ttctcaggcacagataggcgcacag

SEQ ID NO: 841894 - DNA, 25 bp, Mus musculus
ttctcagggcccaccatcgaggacg

SEQ ID NO: 841895 - DNA, 25 bp, Mus musculus
ttctcagggccctccatcgaggacg

SEQ ID NO: 841896 - DNA, 25 bp, Mus musculus
ttctcagtagagcaggagcgctttt

SEQ ID NO: 841897 - DNA, 25 bp, Mus musculus
ttctcagtagaggaggagcgctttt

SEQ ID NO: 841898 - DNA, 25 bp, Mus musculus
ttctcagtcatgaaagttggaatgg

SEQ ID NO: 841899 - DNA, 25 bp, Mus musculus
ttctcagtcatgtaagttggaatgg

SEQ ID NO: 841900 - DNA, 25 bp, Mus musculus
ttctcagtccgacctgggtacgctg

SEQ ID NO: 841901 - DNA, 25 bp, Mus musculus
ttctcagtccgagctgggtacgctg

SEQ ID NO: 841902 - DNA, 25 bp, Mus musculus
ttctcagtgcagctttgcaccatcc

SEQ ID NO: 841903 - DNA, 25 bp, Mus musculus
ttctcagtgcaggtttgcaccatcc

SEQ ID NO: 841904 - DNA, 25 bp, Mus musculus
ttctcagtgctgatgcgggccatgc

SEQ ID NO: 841905 - DNA, 25 bp, Mus musculus
ttctcagtgctgttgcgggccatgc

SEQ ID NO: 841906 - DNA, 25 bp, Mus musculus
ttctcagtggttcgccagcacgaag

SEQ ID NO: 841907 - DNA, 25 bp, Mus musculus
ttctcagtggttggccagcacgaag

SEQ ID NO: 841908 - DNA, 25 bp, Mus musculus
ttctcagttggtcggctgagaagcc

SEQ ID NO: 841909 - DNA, 25 bp, Mus musculus
ttctcagttggtgggctgagaagcc

SEQ ID NO: 841910 - DNA, 25 bp, Mus musculus
ttctcatagcccagaatgggctcca

SEQ ID NO: 841911 - DNA, 25 bp, Mus musculus
ttctcatagccctgaatgggctcca

SEQ ID NO: 841912 - DNA, 25 bp, Mus musculus
ttctcataggcaccagggacaggct

SEQ ID NO: 841913 - DNA, 25 bp, Mus musculus
ttctcataggcagcagggacaggct

SEQ ID NO: 841914 - DNA, 25 bp, Mus musculus
ttctcatatctcactcctagctggt

SEQ ID NO: 841915 - DNA, 25 bp, Mus musculus
ttctcatatctctctcctagctggt

SEQ ID NO: 841916 - DNA, 25 bp, Mus musculus
ttctcatattgtcaagaaacacgag

SEQ ID NO: 841917 - DNA, 25 bp, Mus musculus
ttctcatattgtgaagaaacacgag

SEQ ID NO: 841918 - DNA, 25 bp, Mus musculus
ttctcatcgcagacacttctactgc

SEQ ID NO: 841919 - DNA, 25 bp, Mus musculus
ttctcatcgcagtcacttctactgc

SEQ ID NO: 841920 - DNA, 25 bp, Mus musculus
ttctcatcgtggactgggatgtgca

SEQ ID NO: 841921 - DNA, 25 bp, Mus musculus
ttctcatcgtggagaagtatgaccc

SEQ ID NO: 841922 - DNA, 25 bp, Mus musculus
ttctcatcgtggtctgggatgtgca

SEQ ID NO: 841923 - DNA, 25 bp, Mus musculus
ttctcatcgtggtgaagtatgaccc

SEQ ID NO: 841924 - DNA, 25 bp, Mus musculus
ttctcatgagaaactccggaggcag

SEQ ID NO: 841925 - DNA, 25 bp, Mus musculus
ttctcatgagaatctccggaggcag

SEQ ID NO: 841926 - DNA, 25 bp, Mus musculus
ttctcatgccagaacaccaagggct

SEQ ID NO: 841927 - DNA, 25 bp, Mus musculus
ttctcatgccagtacaccaagggct

SEQ ID NO: 841928 - DNA, 25 bp, Mus musculus
ttctcatggcggacttcaacaagga

SEQ ID NO: 841929 - DNA, 25 bp, Mus musculus
ttctcatggcggtcttcaacaagga

SEQ ID NO: 841930 - DNA, 25 bp, Mus musculus
ttctcatggctgaggcaaaatatcc

SEQ ID NO: 841931 - DNA, 25 bp, Mus musculus
ttctcatggctgtggcaaaatatcc

SEQ ID NO: 841932 - DNA, 25 bp, Mus musculus
ttctcattgcagcttggaacaagtt

SEQ ID NO: 841933 - DNA, 25 bp, Mus musculus
ttctcattgcaggttggaacaagtt

SEQ ID NO: 841934 - DNA, 25 bp, Mus musculus
ttctcattgcctccagggaagcacc

SEQ ID NO: 841935 - DNA, 25 bp, Mus musculus
ttctcattgcctgcagggaagcacc

SEQ ID NO: 841936 - DNA, 25 bp, Mus musculus
ttctccaaaaacacggtgaggatgg

SEQ ID NO: 841937 - DNA, 25 bp, Mus musculus
ttctccaaaaactcggtgaggatgg

SEQ ID NO: 841938 - DNA, 25 bp, Mus musculus
ttctccaaaggacaccgtcatgtca

SEQ ID NO: 841939 - DNA, 25 bp, Mus musculus
ttctccaaaggagaccgtcatgtca

SEQ ID NO: 841940 - DNA, 25 bp, Mus musculus
ttctccaacagacaaatgaaattct

SEQ ID NO: 841941 - DNA, 25 bp, Mus musculus
ttctccaacagagaaatgaaattct

SEQ ID NO: 841942 - DNA, 25 bp, Mus musculus
ttctccaccagaacaagcacacgtg

SEQ ID NO: 841943 - DNA, 25 bp, Mus musculus
ttctccaccagatcaagcacacgtg

SEQ ID NO: 841944 - DNA, 25 bp, Mus musculus
ttctccacccatcctatttactatg

SEQ ID NO: 841945 - DNA, 25 bp, Mus musculus
ttctccacccatgctatttactatg

SEQ ID NO: 841946 - DNA, 25 bp, Mus musculus
ttctccactacacaggaccgcggag

SEQ ID NO: 841947 - DNA, 25 bp, Mus musculus
ttctccactacagaggaccgcggag

SEQ ID NO: 841948 - DNA, 25 bp, Mus musculus
ttctccactctacgaacatttcagc

SEQ ID NO: 841949 - DNA, 25 bp, Mus musculus
ttctccactctaggaacatttcagc

SEQ ID NO: 841950 - DNA, 25 bp, Mus musculus
ttctccagaaaacgacagtaaatca

SEQ ID NO: 841951 - DNA, 25 bp, Mus musculus
ttctccagaaaaggacagtaaatca

SEQ ID NO: 841952 - DNA, 25 bp, Mus musculus
ttctccagagttacagtgaccacca

SEQ ID NO: 841953 - DNA, 25 bp, Mus musculus
ttctccagagtttcagtgaccacca

SEQ ID NO: 841954 - DNA, 25 bp, Mus musculus
ttctccagcatacgtggacagccga

SEQ ID NO: 841955 - DNA, 25 bp, Mus musculus
ttctccagcataggtggacagccga

SEQ ID NO: 841956 - DNA, 25 bp, Mus musculus
ttctccagccaacaagcgaaaactc

SEQ ID NO: 841957 - DNA, 25 bp, Mus musculus
ttctccagccaagaagcgaaaactc

SEQ ID NO: 841958 - DNA, 25 bp, Mus musculus
ttctccagcccgcaagagctgggcg

SEQ ID NO: 841959 - DNA, 25 bp, Mus musculus
ttctccagcccggaagagctgggcg

SEQ ID NO: 841960 - DNA, 25 bp, Mus musculus
ttctccagcgatcagtcattcgcca

SEQ ID NO: 841961 - DNA, 25 bp, Mus musculus
ttctccagcgatgagtcattcgcca

SEQ ID NO: 841962 - DNA, 25 bp, Mus musculus
ttctccaggaagctgacggaggctg

SEQ ID NO: 841963 - DNA, 25 bp, Mus musculus
ttctccaggaaggtgacggaggctg

SEQ ID NO: 841964 - DNA, 25 bp, Mus musculus
ttctccaggcaacgattagtgggca

SEQ ID NO: 841965 - DNA, 25 bp, Mus musculus
ttctccaggcaaggattagtgggca

SEQ ID NO: 841966 - DNA, 25 bp, Mus musculus
ttctccaggccacagtccgagcagg

SEQ ID NO: 841967 - DNA, 25 bp, Mus musculus
ttctccaggccagagtccgagcagg

SEQ ID NO: 841968 - DNA, 25 bp, Mus musculus
ttctccaggccgacaacaagctgct

SEQ ID NO: 841969 - DNA, 25 bp, Mus musculus
ttctccaggccgtcaacaagctgct

SEQ ID NO: 841970 - DNA, 25 bp, Mus musculus
ttctccaggcgtacctgctgctgac

SEQ ID NO: 841971 - DNA, 25 bp, Mus musculus
ttctccaggcgttcctgctgctgac

SEQ ID NO: 841972 - DNA, 25 bp, Mus musculus
ttctccagggaacagcccaggcaca

SEQ ID NO: 841973 - DNA, 25 bp, Mus musculus
ttctccagggaagagcccaggcaca

SEQ ID NO: 841974 - DNA, 25 bp, Mus musculus
ttctccatacagagttcgatgccca

SEQ ID NO: 841975 - DNA, 25 bp, Mus musculus
ttctccatacagtgttcgatgccca

SEQ ID NO: 841976 - DNA, 25 bp, Mus musculus
ttctccatcgccacgccaggaaagt

SEQ ID NO: 841977 - DNA, 25 bp, Mus musculus
ttctccatcgcctcgccaggaaagt

SEQ ID NO: 841978 - DNA, 25 bp, Mus musculus
ttctccatctatcgcttcaaggcca

SEQ ID NO: 841979 - DNA, 25 bp, Mus musculus
ttctccatctatggcttcaaggcca

SEQ ID NO: 841980 - DNA, 25 bp, Mus musculus
ttctccatctccagaaggacacagg

SEQ ID NO: 841981 - DNA, 25 bp, Mus musculus
ttctccatctcctgaaggacacagg

SEQ ID NO: 841982 - DNA, 25 bp, Mus musculus
ttctccatggaaacataaccaagca

SEQ ID NO: 841983 - DNA, 25 bp, Mus musculus
ttctccatggaatcataaccaagca

SEQ ID NO: 841984 - DNA, 25 bp, Mus musculus
ttctccatgggacaggcggtaccct

SEQ ID NO: 841985 - DNA, 25 bp, Mus musculus
ttctccatgggagaggcggtaccct

SEQ ID NO: 841986 - DNA, 25 bp, Mus musculus
ttctccatgttcactatgctgtatc

SEQ ID NO: 841987 - DNA, 25 bp, Mus musculus
ttctccatgttctctatgctgtatc

SEQ ID NO: 841988 - DNA, 25 bp, Mus musculus
ttctccattgagcaaatcgaggtgg

SEQ ID NO: 841989 - DNA, 25 bp, Mus musculus
ttctccattgaggaaatcgaggtgg

SEQ ID NO: 841990 - DNA, 25 bp, Mus musculus
ttctccatttaaccccgttttggat

SEQ ID NO: 841991 - DNA, 25 bp, Mus musculus
ttctccatttaagcccgttttggat

SEQ ID NO: 841992 - DNA, 25 bp, Mus musculus
ttctcccacctacggcggattggaa

SEQ ID NO: 841993 - DNA, 25 bp, Mus musculus
ttctcccacctagggcggattggaa

SEQ ID NO: 841994 - DNA, 25 bp, Mus musculus
ttctcccactggacgggatactcaa

SEQ ID NO: 841995 - DNA, 25 bp, Mus musculus
ttctcccactggtcgggatactcaa

SEQ ID NO: 841996 - DNA, 25 bp, Mus musculus
ttctccccacacatggaggaagcac

SEQ ID NO: 841997 - DNA, 25 bp, Mus musculus
ttctccccacacttggaggaagcac

SEQ ID NO: 841998 - DNA, 25 bp, Mus musculus
ttctccccagtaataagcactcata

SEQ ID NO: 841999 - DNA, 25 bp, Mus musculus
ttctccccagtattaagcactcata

SEQ ID NO: 842000 - DNA, 25 bp, Mus musculus
ttctccccgagaaagtacacctagg

SEQ ID NO: 842001 - DNA, 25 bp, Mus musculus
ttctccccgagatagtacacctagg

SEQ ID NO: 842002 - DNA, 25 bp, Mus musculus
ttctccccgccaaggactgctgtga

SEQ ID NO: 842003 - DNA, 25 bp, Mus musculus
ttctccccgccatggactgctgtga

SEQ ID NO: 842004 - DNA, 25 bp, Mus musculus
ttctcccgagagagagacttcctgc

SEQ ID NO: 842005 - DNA, 25 bp, Mus musculus
ttctcccgagagtgagacttcctgc

SEQ ID NO: 842006 - DNA, 25 bp, Mus musculus
ttctcccgctgccacatggacggag

SEQ ID NO: 842007 - DNA, 25 bp, Mus musculus
ttctcccgctgccaggaagctgttg

SEQ ID NO: 842008 - DNA, 25 bp, Mus musculus
ttctcccgctgcgacatggacggag

SEQ ID NO: 842009 - DNA, 25 bp, Mus musculus
ttctcccgctgcgaggaagctgttg

SEQ ID NO: 842010 - DNA, 25 bp, Mus musculus
ttctcccggataacacaacctgcgg

SEQ ID NO: 842011 - DNA, 25 bp, Mus musculus
ttctcccggatatcacaacctgcgg

SEQ ID NO: 842012 - DNA, 25 bp, Mus musculus
ttctccctaggacgcgcttccatga

SEQ ID NO: 842013 - DNA, 25 bp, Mus musculus
ttctccctaggaggcgcttccatga

SEQ ID NO: 842014 - DNA, 25 bp, Mus musculus
ttctccctagtgatgtgcctcctgt

SEQ ID NO: 842015 - DNA, 25 bp, Mus musculus
ttctccctagtgttgtgcctcctgt

SEQ ID NO: 842016 - DNA, 25 bp, Mus musculus
ttctccctgccaagtcggtggacca

SEQ ID NO: 842017 - DNA, 25 bp, Mus musculus
ttctccctgccatgtcggtggacca

SEQ ID NO: 842018 - DNA, 25 bp, Mus musculus
ttctccgaagttagagaagtccaaa

SEQ ID NO: 842019 - DNA, 25 bp, Mus musculus
ttctccgaagtttgagaagtccaaa

SEQ ID NO: 842020 - DNA, 25 bp, Mus musculus
ttctccgaatcaccttggaaagaca

SEQ ID NO: 842021 - DNA, 25 bp, Mus musculus
ttctccgaatcagcttggaaagaca

SEQ ID NO: 842022 - DNA, 25 bp, Mus musculus
ttctccgagaagataaaaaaggcac

SEQ ID NO: 842023 - DNA, 25 bp, Mus musculus
ttctccgagaagttaaaaaaggcac

SEQ ID NO: 842024 - DNA, 25 bp, Mus musculus
ttctccgagagacgaataagcgaca

SEQ ID NO: 842025 - DNA, 25 bp, Mus musculus
ttctccgagagaggaataagcgaca

SEQ ID NO: 842026 - DNA, 25 bp, Mus musculus
ttctccgcaggtcgtgacggtcact

SEQ ID NO: 842027 - DNA, 25 bp, Mus musculus
ttctccgcaggtggtgacggtcact

SEQ ID NO: 842028 - DNA, 25 bp, Mus musculus
ttctccgcatggatcccgcagagcg

SEQ ID NO: 842029 - DNA, 25 bp, Mus musculus
ttctccgcatggttcccgcagagcg

SEQ ID NO: 842030 - DNA, 25 bp, Mus musculus
ttctccgccaagagggactatgaca

SEQ ID NO: 842031 - DNA, 25 bp, Mus musculus
ttctccgccaagtgggactatgaca

SEQ ID NO: 842032 - DNA, 25 bp, Mus musculus
ttctccgggtggagaccgctgcgtc

SEQ ID NO: 842033 - DNA, 25 bp, Mus musculus
ttctccgggtggtgaccgctgcgtc

SEQ ID NO: 842034 - DNA, 25 bp, Mus musculus
ttctccgtggcgctgctacctgttt

SEQ ID NO: 842035 - DNA, 25 bp, Mus musculus
ttctccgtggcggtgctacctgttt

SEQ ID NO: 842036 - DNA, 25 bp, Mus musculus
ttctccgtgtgtcagatcatgtgca

SEQ ID NO: 842037 - DNA, 25 bp, Mus musculus
ttctccgtgtgtgagatcatgtgca

SEQ ID NO: 842038 - DNA, 25 bp, Mus musculus
ttctcctcaaaaagtgaatcccgac

SEQ ID NO: 842039 - DNA, 25 bp, Mus musculus
ttctcctcaaaatgtgaatcccgac

SEQ ID NO: 842040 - DNA, 25 bp, Mus musculus
ttctcctctgacaaccggcagattg

SEQ ID NO: 842041 - DNA, 25 bp, Mus musculus
ttctcctctgactaccggcagattg

SEQ ID NO: 842042 - DNA, 25 bp, Mus musculus
ttctcctgcaagcactgtgacaggg

SEQ ID NO: 842043 - DNA, 25 bp, Mus musculus
ttctcctgcaaggactgtgacaggg

SEQ ID NO: 842044 - DNA, 25 bp, Mus musculus
ttctcctggcagctaaggttggacc

SEQ ID NO: 842045 - DNA, 25 bp, Mus musculus
ttctcctggcaggtaaggttggacc

SEQ ID NO: 842046 - DNA, 25 bp, Mus musculus
ttctcctggttgcttcatgaggccc

SEQ ID NO: 842047 - DNA, 25 bp, Mus musculus
ttctcctggttggttcatgaggccc

SEQ ID NO: 842048 - DNA, 25 bp, Mus musculus
ttctccttgcctcactgcttacagg

SEQ ID NO: 842049 - DNA, 25 bp, Mus musculus
ttctccttgcctgactgcttacagg

SEQ ID NO: 842050 - DNA, 25 bp, Mus musculus
ttctcctttgccaggccgggagggc

SEQ ID NO: 842051 - DNA, 25 bp, Mus musculus
ttctcctttgcctggccgggagggc

SEQ ID NO: 842052 - DNA, 25 bp, Mus musculus
ttctcgacttcaaaggatacatgct

SEQ ID NO: 842053 - DNA, 25 bp, Mus musculus
ttctcgacttcataggatacatgct

SEQ ID NO: 842054 - DNA, 25 bp, Mus musculus
ttctcgagctgcctgctcgcgtacg

SEQ ID NO: 842055 - DNA, 25 bp, Mus musculus
ttctcgagctgcgtgctcgcgtacg

SEQ ID NO: 842056 - DNA, 25 bp, Mus musculus
ttctcgatcggaaactggtggtgcg

SEQ ID NO: 842057 - DNA, 25 bp, Mus musculus
ttctcgatcggatactggtggtgcg

SEQ ID NO: 842058 - DNA, 25 bp, Mus musculus
ttctcgatgtccacgagttcaacca

SEQ ID NO: 842059 - DNA, 25 bp, Mus musculus
ttctcgatgtcctcgagttcaacca

SEQ ID NO: 842060 - DNA, 25 bp, Mus musculus
ttctcgcacgcacaatgcaagtgga

SEQ ID NO: 842061 - DNA, 25 bp, Mus musculus
ttctcgcacgcagaatgcaagtgga

SEQ ID NO: 842062 - DNA, 25 bp, Mus musculus
ttctcgcacttccaccagttcatag

SEQ ID NO: 842063 - DNA, 25 bp, Mus musculus
ttctcgcacttcgaccagttcatag

SEQ ID NO: 842064 - DNA, 25 bp, Mus musculus
ttctcgccaggaaatcggcggcggc

SEQ ID NO: 842065 - DNA, 25 bp, Mus musculus
ttctcgccaggatatcggcggcggc

SEQ ID NO: 842066 - DNA, 25 bp, Mus musculus
ttctcgcctcgaccctataaataca

SEQ ID NO: 842067 - DNA, 25 bp, Mus musculus
ttctcgcctcgagcctataaataca

SEQ ID NO: 842068 - DNA, 25 bp, Mus musculus
ttctcgctcctacatggcacctgtg

SEQ ID NO: 842069 - DNA, 25 bp, Mus musculus
ttctcgctcctagatggcacctgtg

SEQ ID NO: 842070 - DNA, 25 bp, Mus musculus
ttctcgctgcaaaaggaagagttgc

SEQ ID NO: 842071 - DNA, 25 bp, Mus musculus
ttctcgctgcaataggaagagttgc

SEQ ID NO: 842072 - DNA, 25 bp, Mus musculus
ttctcggacaatcaggcagaccgtg

SEQ ID NO: 842073 - DNA, 25 bp, Mus musculus
ttctcggacaatgaggcagaccgtg

SEQ ID NO: 842074 - DNA, 25 bp, Mus musculus
ttctcggacattatcaacaccagcg

SEQ ID NO: 842075 - DNA, 25 bp, Mus musculus
ttctcggacattttcaacaccagcg

SEQ ID NO: 842076 - DNA, 25 bp, Mus musculus
ttctcggacccaacctgaacttgag

SEQ ID NO: 842077 - DNA, 25 bp, Mus musculus
ttctcggacccatcctgaacttgag

SEQ ID NO: 842078 - DNA, 25 bp, Mus musculus
ttctcggagtctcgaatgctgagaa

SEQ ID NO: 842079 - DNA, 25 bp, Mus musculus
ttctcggagtctggaatgctgagaa

SEQ ID NO: 842080 - DNA, 25 bp, Mus musculus
ttctcggatccaagaccacctgttg

SEQ ID NO: 842081 - DNA, 25 bp, Mus musculus
ttctcggatccatgaccacctgttg

SEQ ID NO: 842082 - DNA, 25 bp, Mus musculus
ttctcggctccgctataatagatct

SEQ ID NO: 842083 - DNA, 25 bp, Mus musculus
ttctcggctccggtataatagatct

SEQ ID NO: 842084 - DNA, 25 bp, Mus musculus
ttctcgggcaagatctatcataccg

SEQ ID NO: 842085 - DNA, 25 bp, Mus musculus
ttctcgggcaagttctatcataccg

SEQ ID NO: 842086 - DNA, 25 bp, Mus musculus
ttctcgggtgcccacgggaactgta

SEQ ID NO: 842087 - DNA, 25 bp, Mus musculus
ttctcgggtgccgacgggaactgta

SEQ ID NO: 842088 - DNA, 25 bp, Mus musculus
ttctcggtaaatcctgcaagccaat

SEQ ID NO: 842089 - DNA, 25 bp, Mus musculus
ttctcggtaaatgctgcaagccaat

SEQ ID NO: 842090 - DNA, 25 bp, Mus musculus
ttctcggtggacaggtggtctttcg

SEQ ID NO: 842091 - DNA, 25 bp, Mus musculus
ttctcggtggactggtggtctttcg

SEQ ID NO: 842092 - DNA, 25 bp, Mus musculus
ttctcggtgtgtcagtcctgccctc

SEQ ID NO: 842093 - DNA, 25 bp, Mus musculus
ttctcggtgtgtgagtcctgccctc

SEQ ID NO: 842094 - DNA, 25 bp, Mus musculus
ttctcgtggaaacaaagttattaca

SEQ ID NO: 842095 - DNA, 25 bp, Mus musculus
ttctcgtggaaagaaagttattaca

SEQ ID NO: 842096 - DNA, 25 bp, Mus musculus
ttctcgtgggccagatcaaccagca

SEQ ID NO: 842097 - DNA, 25 bp, Mus musculus
ttctcgtgggcctgatcaaccagca

SEQ ID NO: 842098 - DNA, 25 bp, Mus musculus
ttctctaaaactaacaagttgcagg

SEQ ID NO: 842099 - DNA, 25 bp, Mus musculus
ttctctaaaacttacaagttgcagg

SEQ ID NO: 842100 - DNA, 25 bp, Mus musculus
ttctctaattgtctccgtgttcctc

SEQ ID NO: 842101 - DNA, 25 bp, Mus musculus
ttctctaattgtgtccgtgttcctc

SEQ ID NO: 842102 - DNA, 25 bp, Mus musculus
ttctctacaataattggagttggtg

SEQ ID NO: 842103 - DNA, 25 bp, Mus musculus
ttctctacaatatttggagttggtg

SEQ ID NO: 842104 - DNA, 25 bp, Mus musculus
ttctctacagaaacactgtgcccca

SEQ ID NO: 842105 - DNA, 25 bp, Mus musculus
ttctctacagaatcactgtgcccca

SEQ ID NO: 842106 - DNA, 25 bp, Mus musculus
ttctctacagatcaaaacgtgtcac

SEQ ID NO: 842107 - DNA, 25 bp, Mus musculus
ttctctacagatgaaaacgtgtcac

SEQ ID NO: 842108 - DNA, 25 bp, Mus musculus
ttctctacattacatggagagccgg

SEQ ID NO: 842109 - DNA, 25 bp, Mus musculus
ttctctacattagatggagagccgg

SEQ ID NO: 842110 - DNA, 25 bp, Mus musculus
ttctctaccgacagatgtcatcatg

SEQ ID NO: 842111 - DNA, 25 bp, Mus musculus
ttctctaccgactgatgtcatcatg

SEQ ID NO: 842112 - DNA, 25 bp, Mus musculus
ttctctagatttacaaattacagat

SEQ ID NO: 842113 - DNA, 25 bp, Mus musculus
ttctctagattttcaaattacagat

SEQ ID NO: 842114 - DNA, 25 bp, Mus musculus
ttctctagctgtctgtcctaccggg

SEQ ID NO: 842115 - DNA, 25 bp, Mus musculus
ttctctagctgtgtgtcctaccggg

SEQ ID NO: 842116 - DNA, 25 bp, Mus musculus
ttctctaggaccagcactggaaccc

SEQ ID NO: 842117 - DNA, 25 bp, Mus musculus
ttctctaggacctgcactggaaccc

SEQ ID NO: 842118 - DNA, 25 bp, Mus musculus
ttctctatagcccaaaagaaggaca

SEQ ID NO: 842119 - DNA, 25 bp, Mus musculus
ttctctatagccgaaaagaaggaca

SEQ ID NO: 842120 - DNA, 25 bp, Mus musculus
ttctctatatggaatgccaaacagc

SEQ ID NO: 842121 - DNA, 25 bp, Mus musculus
ttctctatatggtatgccaaacagc

SEQ ID NO: 842122 - DNA, 25 bp, Mus musculus
ttctctcagattctgaacctgaaag

SEQ ID NO: 842123 - DNA, 25 bp, Mus musculus
ttctctcagattgtgaacctgaaag

SEQ ID NO: 842124 - DNA, 25 bp, Mus musculus
ttctctcagcacaggccgggaaagt

SEQ ID NO: 842125 - DNA, 25 bp, Mus musculus
ttctctcagcactggccgggaaagt

SEQ ID NO: 842126 - DNA, 25 bp, Mus musculus
ttctctcagtatctgcccgggactg

SEQ ID NO: 842127 - DNA, 25 bp, Mus musculus
ttctctcagtatgtgcccgggactg

SEQ ID NO: 842128 - DNA, 25 bp, Mus musculus
ttctctcagtgcctccatgaggagt

SEQ ID NO: 842129 - DNA, 25 bp, Mus musculus
ttctctcagtgcgtccatgaggagt

SEQ ID NO: 842130 - DNA, 25 bp, Mus musculus
ttctctccaataagcctctctactt

SEQ ID NO: 842131 - DNA, 25 bp, Mus musculus
ttctctccaatatgcctctctactt

SEQ ID NO: 842132 - DNA, 25 bp, Mus musculus
ttctctccacggagctaagttgaca

SEQ ID NO: 842133 - DNA, 25 bp, Mus musculus
ttctctccacggtgctaagttgaca

SEQ ID NO: 842134 - DNA, 25 bp, Mus musculus
ttctctccacgtcggaagtcaggct

SEQ ID NO: 842135 - DNA, 25 bp, Mus musculus
ttctctccacgtgggaagtcaggct

SEQ ID NO: 842136 - DNA, 25 bp, Mus musculus
ttctctcccagaacatccacttttg

SEQ ID NO: 842137 - DNA, 25 bp, Mus musculus
ttctctcccagatcatccacttttg

SEQ ID NO: 842138 - DNA, 25 bp, Mus musculus
ttctctcccgcaccctggaggaggg

SEQ ID NO: 842139 - DNA, 25 bp, Mus musculus
ttctctcccgcagcctggaggaggg

SEQ ID NO: 842140 - DNA, 25 bp, Mus musculus
ttctctccgaagagcgtagcgaccc

SEQ ID NO: 842141 - DNA, 25 bp, Mus musculus
ttctctccgaagtgcgtagcgaccc

SEQ ID NO: 842142 - DNA, 25 bp, Mus musculus
ttctctccgctgaagaacgctgacc

SEQ ID NO: 842143 - DNA, 25 bp, Mus musculus
ttctctccgctgtagaacgctgacc

SEQ ID NO: 842144 - DNA, 25 bp, Mus musculus
ttctctcggactattggtcatgaag

SEQ ID NO: 842145 - DNA, 25 bp, Mus musculus
ttctctcggacttttggtcatgaag

SEQ ID NO: 842146 - DNA, 25 bp, Mus musculus
ttctctcggaggacgccatcctcat

SEQ ID NO: 842147 - DNA, 25 bp, Mus musculus
ttctctcggaggtcgccatcctcat

SEQ ID NO: 842148 - DNA, 25 bp, Mus musculus
ttctctcggatcaaggatggctgtc

SEQ ID NO: 842149 - DNA, 25 bp, Mus musculus
ttctctcggatctaggatggctgtc

SEQ ID NO: 842150 - DNA, 25 bp, Mus musculus
ttctctctcctcagcttattgtcag

SEQ ID NO: 842151 - DNA, 25 bp, Mus musculus
ttctctctcctctgcttattgtcag

SEQ ID NO: 842152 - DNA, 25 bp, Mus musculus
ttctctcttacccacatcttcttag

SEQ ID NO: 842153 - DNA, 25 bp, Mus musculus
ttctctcttaccgacatcttcttag

SEQ ID NO: 842154 - DNA, 25 bp, Mus musculus
ttctctcttcttagccggtgacgcc

SEQ ID NO: 842155 - DNA, 25 bp, Mus musculus
ttctctcttctttgccggtgacgcc

SEQ ID NO: 842156 - DNA, 25 bp, Mus musculus
ttctctgaaaccaaatgaccagatc

SEQ ID NO: 842157 - DNA, 25 bp, Mus musculus
ttctctgaaacctaatgaccagatc

SEQ ID NO: 842158 - DNA, 25 bp, Mus musculus
ttctctgacatccttgttgtacccc

SEQ ID NO: 842159 - DNA, 25 bp, Mus musculus
ttctctgacatcgttgttgtacccc

SEQ ID NO: 842160 - DNA, 25 bp, Mus musculus
ttctctgagaagagagtatcggtca

SEQ ID NO: 842161 - DNA, 25 bp, Mus musculus
ttctctgagaagtgagtatcggtca

SEQ ID NO: 842162 - DNA, 25 bp, Mus musculus
ttctctgagaggaaaatactgaagc

SEQ ID NO: 842163 - DNA, 25 bp, Mus musculus
ttctctgagaggtaaatactgaagc

SEQ ID NO: 842164 - DNA, 25 bp, Mus musculus
ttctctgatcatcggcccgtgtgct

SEQ ID NO: 842165 - DNA, 25 bp, Mus musculus
ttctctgatcatgggcccgtgtgct

SEQ ID NO: 842166 - DNA, 25 bp, Mus musculus
ttctctgatgagatccccgtggagc

SEQ ID NO: 842167 - DNA, 25 bp, Mus musculus
ttctctgatgagttccccgtggagc

SEQ ID NO: 842168 - DNA, 25 bp, Mus musculus
ttctctgcacaccaccgcgagtgga

SEQ ID NO: 842169 - DNA, 25 bp, Mus musculus
ttctctgcacacgaccgcgagtgga

SEQ ID NO: 842170 - DNA, 25 bp, Mus musculus
ttctctgcccgcaagatgatggctg

SEQ ID NO: 842171 - DNA, 25 bp, Mus musculus
ttctctgcccgctagatgatggctg

SEQ ID NO: 842172 - DNA, 25 bp, Mus musculus
ttctctgccctgactccaagcatat

SEQ ID NO: 842173 - DNA, 25 bp, Mus musculus
ttctctgccctgtctccaagcatat

SEQ ID NO: 842174 - DNA, 25 bp, Mus musculus
ttctctggagctattcgggacccgt

SEQ ID NO: 842175 - DNA, 25 bp, Mus musculus
ttctctggagcttttcgggacccgt

SEQ ID NO: 842176 - DNA, 25 bp, Mus musculus
ttctctgggagaagctaacaaggga

SEQ ID NO: 842177 - DNA, 25 bp, Mus musculus
ttctctgggagatgctaacaaggga

SEQ ID NO: 842178 - DNA, 25 bp, Mus musculus
ttctctgggattcctgtcctgcctc

SEQ ID NO: 842179 - DNA, 25 bp, Mus musculus
ttctctgggattgctgtcctgcctc

SEQ ID NO: 842180 - DNA, 25 bp, Mus musculus
ttctctggttctcggaatagactgg

SEQ ID NO: 842181 - DNA, 25 bp, Mus musculus
ttctctggttctgggaatagactgg

SEQ ID NO: 842182 - DNA, 25 bp, Mus musculus
ttctctgtagacatcgtctgtcttg

SEQ ID NO: 842183 - DNA, 25 bp, Mus musculus
ttctctgtagacttcgtctgtcttg

SEQ ID NO: 842184 - DNA, 25 bp, Mus musculus
ttctctgtcagtactcgtcaccaca

SEQ ID NO: 842185 - DNA, 25 bp, Mus musculus
ttctctgtcagttctcgtcaccaca

SEQ ID NO: 842186 - DNA, 25 bp, Mus musculus
ttctctgtctgtcgttggagcagcc

SEQ ID NO: 842187 - DNA, 25 bp, Mus musculus
ttctctgtctgtggttggagcagcc

SEQ ID NO: 842188 - DNA, 25 bp, Mus musculus
ttctctgtgtccacctcggatctga

SEQ ID NO: 842189 - DNA, 25 bp, Mus musculus
ttctctgtgtcctcctcggatctga

SEQ ID NO: 842190 - DNA, 25 bp, Mus musculus
ttctctgttgaactccagaatctgc

SEQ ID NO: 842191 - DNA, 25 bp, Mus musculus
ttctctgttgaagtccagaatctgc

SEQ ID NO: 842192 - DNA, 25 bp, Mus musculus
ttctctgtttgtaagcctgcgaagg

SEQ ID NO: 842193 - DNA, 25 bp, Mus musculus
ttctctgtttgttagcctgcgaagg

SEQ ID NO: 842194 - DNA, 25 bp, Mus musculus
ttctcttaaagaccagacaacgctc

SEQ ID NO: 842195 - DNA, 25 bp, Mus musculus
ttctcttaaagagcagacaacgctc

SEQ ID NO: 842196 - DNA, 25 bp, Mus musculus
ttctcttaaatcacagcccagggaa

SEQ ID NO: 842197 - DNA, 25 bp, Mus musculus
ttctcttaaatctcagcccagggaa

SEQ ID NO: 842198 - DNA, 25 bp, Mus musculus
ttctcttaggcaactgtgcatttcc

SEQ ID NO: 842199 - DNA, 25 bp, Mus musculus
ttctcttaggcatctgtgcatttcc

SEQ ID NO: 842200 - DNA, 25 bp, Mus musculus
ttctcttcaccacgacaaaacaggc

SEQ ID NO: 842201 - DNA, 25 bp, Mus musculus
ttctcttcaccaggacaaaacaggc

SEQ ID NO: 842202 - DNA, 25 bp, Mus musculus
ttctcttctgcacatcatttcccag

SEQ ID NO: 842203 - DNA, 25 bp, Mus musculus
ttctcttctgcagatcatttcccag

SEQ ID NO: 842204 - DNA, 25 bp, Mus musculus
ttctcttgaggacgttccactctga

SEQ ID NO: 842205 - DNA, 25 bp, Mus musculus
ttctcttgaggaggttccactctga

SEQ ID NO: 842206 - DNA, 25 bp, Mus musculus
ttctcttgctaaccaagcctgaaga

SEQ ID NO: 842207 - DNA, 25 bp, Mus musculus
ttctcttgctaagcaagcctgaaga

SEQ ID NO: 842208 - DNA, 25 bp, Mus musculus
ttctctttctacatcctgaggaccg

SEQ ID NO: 842209 - DNA, 25 bp, Mus musculus
ttctctttctacttcctgaggaccg

SEQ ID NO: 842210 - DNA, 25 bp, Mus musculus
ttctctttgcttccctcaggcgttt

SEQ ID NO: 842211 - DNA, 25 bp, Mus musculus
ttctctttgcttgcctcaggcgttt

SEQ ID NO: 842212 - DNA, 25 bp, Mus musculus
ttctgaaaaacaccaacctgcggca

SEQ ID NO: 842213 - DNA, 25 bp, Mus musculus
ttctgaaaaacagcaacctgcggca

SEQ ID NO: 842214 - DNA, 25 bp, Mus musculus
ttctgaaagttgctgggaagaagat

SEQ ID NO: 842215 - DNA, 25 bp, Mus musculus
ttctgaaagttggtgggaagaagat

SEQ ID NO: 842216 - DNA, 25 bp, Mus musculus
ttctgaaatctgacacctccggagc

SEQ ID NO: 842217 - DNA, 25 bp, Mus musculus
ttctgaaatctgtcacctccggagc

SEQ ID NO: 842218 - DNA, 25 bp, Mus musculus
ttctgaactacacgaggaccctcag

SEQ ID NO: 842219 - DNA, 25 bp, Mus musculus
ttctgaactacaggaggaccctcag

SEQ ID NO: 842220 - DNA, 25 bp, Mus musculus
ttctgaactacccaaaacgtgcctg

SEQ ID NO: 842221 - DNA, 25 bp, Mus musculus
ttctgaactaccgaaaacgtgcctg

SEQ ID NO: 842222 - DNA, 25 bp, Mus musculus
ttctgaagaccacggtgggattgat

SEQ ID NO: 842223 - DNA, 25 bp, Mus musculus
ttctgaagaccagggtgggattgat

SEQ ID NO: 842224 - DNA, 25 bp, Mus musculus
ttctgaagcagacatctggtgccaa

SEQ ID NO: 842225 - DNA, 25 bp, Mus musculus
ttctgaagcagagatctggtgccaa

SEQ ID NO: 842226 - DNA, 25 bp, Mus musculus
ttctgaagcgacagcctccactttg

SEQ ID NO: 842227 - DNA, 25 bp, Mus musculus
ttctgaagcgactgcctccactttg

SEQ ID NO: 842228 - DNA, 25 bp, Mus musculus
ttctgaagcggaaccccactcagcg

SEQ ID NO: 842229 - DNA, 25 bp, Mus musculus
ttctgaagcggatccccactcagcg

SEQ ID NO: 842230 - DNA, 25 bp, Mus musculus
ttctgaaggagaaacccattccaca

SEQ ID NO: 842231 - DNA, 25 bp, Mus musculus
ttctgaaggagatacccattccaca

SEQ ID NO: 842232 - DNA, 25 bp, Mus musculus
ttctgaaggatgagagaccatccat

SEQ ID NO: 842233 - DNA, 25 bp, Mus musculus
ttctgaaggatgtgagaccatccat

SEQ ID NO: 842234 - DNA, 25 bp, Mus musculus
ttctgaaggcttcagtaattactcc

SEQ ID NO: 842235 - DNA, 25 bp, Mus musculus
ttctgaaggcttccccaaaattcta

SEQ ID NO: 842236 - DNA, 25 bp, Mus musculus
ttctgaaggcttgagtaattactcc

SEQ ID NO: 842237 - DNA, 25 bp, Mus musculus
ttctgaaggcttgcccaaaattcta

SEQ ID NO: 842238 - DNA, 25 bp, Mus musculus
ttctgaagtagcaaaggagagcagc

SEQ ID NO: 842239 - DNA, 25 bp, Mus musculus
ttctgaagtagctaaggagagcagc

SEQ ID NO: 842240 - DNA, 25 bp, Mus musculus
ttctgaagtcccaacagggtctggc

SEQ ID NO: 842241 - DNA, 25 bp, Mus musculus
ttctgaagtccctacagggtctggc

SEQ ID NO: 842242 - DNA, 25 bp, Mus musculus
ttctgaagtttgcatgggagaccac

SEQ ID NO: 842243 - DNA, 25 bp, Mus musculus
ttctgaagtttggatgggagaccac

SEQ ID NO: 842244 - DNA, 25 bp, Mus musculus
ttctgaatcagacggaggaccaccg

SEQ ID NO: 842245 - DNA, 25 bp, Mus musculus
ttctgaatcagagggaggaccaccg

SEQ ID NO: 842246 - DNA, 25 bp, Mus musculus
ttctgaatcatgaaaaggcccacag

SEQ ID NO: 842247 - DNA, 25 bp, Mus musculus
ttctgaatcatgtaaaggcccacag

SEQ ID NO: 842248 - DNA, 25 bp, Mus musculus
ttctgaatctccagaagaacacacc

SEQ ID NO: 842249 - DNA, 25 bp, Mus musculus
ttctgaatctcctgaagaacacacc

SEQ ID NO: 842250 - DNA, 25 bp, Mus musculus
ttctgaatctttctggccaccaaga

SEQ ID NO: 842251 - DNA, 25 bp, Mus musculus
ttctgaatctttgtggccaccaaga

SEQ ID NO: 842252 - DNA, 25 bp, Mus musculus
ttctgaatgaccaaataaagcagct

SEQ ID NO: 842253 - DNA, 25 bp, Mus musculus
ttctgaatgacctaataaagcagct

SEQ ID NO: 842254 - DNA, 25 bp, Mus musculus
ttctgacaatgcagcatctcttgct

SEQ ID NO: 842255 - DNA, 25 bp, Mus musculus
ttctgacaatgctgcatctcttgct

SEQ ID NO: 842256 - DNA, 25 bp, Mus musculus
ttctgacactgacgacgtgaccaag

SEQ ID NO: 842257 - DNA, 25 bp, Mus musculus
ttctgacactgaggacgtgaccaag

SEQ ID NO: 842258 - DNA, 25 bp, Mus musculus
ttctgaccaaagagtgagttcactg

SEQ ID NO: 842259 - DNA, 25 bp, Mus musculus
ttctgaccaaagtgtgagttcactg

SEQ ID NO: 842260 - DNA, 25 bp, Mus musculus
ttctgaccaatgaacacagctgact

SEQ ID NO: 842261 - DNA, 25 bp, Mus musculus
ttctgaccaatgtacacagctgact

SEQ ID NO: 842262 - DNA, 25 bp, Mus musculus
ttctgaccaccacggtaacttctct

SEQ ID NO: 842263 - DNA, 25 bp, Mus musculus
ttctgaccaccagggtaacttctct

SEQ ID NO: 842264 - DNA, 25 bp, Mus musculus
ttctgaccatgaagaaagacgagct

SEQ ID NO: 842265 - DNA, 25 bp, Mus musculus
ttctgaccatgatgaaagacgagct

SEQ ID NO: 842266 - DNA, 25 bp, Mus musculus
ttctgaccttttcaaacggtttgag

SEQ ID NO: 842267 - DNA, 25 bp, Mus musculus
ttctgaccttttgaaacggtttgag

SEQ ID NO: 842268 - DNA, 25 bp, Mus musculus
ttctgacgatgaagacgtgtgttga

SEQ ID NO: 842269 - DNA, 25 bp, Mus musculus
ttctgacgatgatgacgtgtgttga

SEQ ID NO: 842270 - DNA, 25 bp, Mus musculus
ttctgacgattacagaggctgtgtg

SEQ ID NO: 842271 - DNA, 25 bp, Mus musculus
ttctgacgattagagaggctgtgtg

SEQ ID NO: 842272 - DNA, 25 bp, Mus musculus
ttctgactccagccatgtccacgat

SEQ ID NO: 842273 - DNA, 25 bp, Mus musculus
ttctgactccaggcatgtccacgat

SEQ ID NO: 842274 - DNA, 25 bp, Mus musculus
ttctgactccggaggaagtgatgtg

SEQ ID NO: 842275 - DNA, 25 bp, Mus musculus
ttctgactccggtggaagtgatgtg

SEQ ID NO: 842276 - DNA, 25 bp, Mus musculus
ttctgactccttcctccaacacaca

SEQ ID NO: 842277 - DNA, 25 bp, Mus musculus
ttctgactccttgctccaacacaca

SEQ ID NO: 842278 - DNA, 25 bp, Mus musculus
ttctgactgcagaaggctgtgggct

SEQ ID NO: 842279 - DNA, 25 bp, Mus musculus
ttctgactgcagtaggctgtgggct

SEQ ID NO: 842280 - DNA, 25 bp, Mus musculus
ttctgactggtcctattttctgaaa

SEQ ID NO: 842281 - DNA, 25 bp, Mus musculus
ttctgactggtcgtattttctgaaa

SEQ ID NO: 842282 - DNA, 25 bp, Mus musculus
ttctgactgtcactgaaatattgga

SEQ ID NO: 842283 - DNA, 25 bp, Mus musculus
ttctgactgtcagtgaaatattgga

SEQ ID NO: 842284 - DNA, 25 bp, Mus musculus
ttctgacttccacgccagtgctctc

SEQ ID NO: 842285 - DNA, 25 bp, Mus musculus
ttctgacttccaggccagtgctctc

SEQ ID NO: 842286 - DNA, 25 bp, Mus musculus
ttctgagaaataaatgccgtcttcc

SEQ ID NO: 842287 - DNA, 25 bp, Mus musculus
ttctgagaaatatatgccgtcttcc

SEQ ID NO: 842288 - DNA, 25 bp, Mus musculus
ttctgagaagtcagagaccatgagg

SEQ ID NO: 842289 - DNA, 25 bp, Mus musculus
ttctgagaagtctgagaccatgagg

SEQ ID NO: 842290 - DNA, 25 bp, Mus musculus
ttctgagacagtcattacatctgta

SEQ ID NO: 842291 - DNA, 25 bp, Mus musculus
ttctgagacagtgattacatctgta

SEQ ID NO: 842292 - DNA, 25 bp, Mus musculus
ttctgagaggatccaggacaacgcc

SEQ ID NO: 842293 - DNA, 25 bp, Mus musculus
ttctgagaggatgcaggacaacgcc

SEQ ID NO: 842294 - DNA, 25 bp, Mus musculus
ttctgagatgaaccagctgattgac

SEQ ID NO: 842295 - DNA, 25 bp, Mus musculus
ttctgagatgaagcagctgattgac

SEQ ID NO: 842296 - DNA, 25 bp, Mus musculus
ttctgagatttcatggctctccttg

SEQ ID NO: 842297 - DNA, 25 bp, Mus musculus
ttctgagatttcttggctctccttg

SEQ ID NO: 842298 - DNA, 25 bp, Mus musculus
ttctgagcaacaactcggactgtga

SEQ ID NO: 842299 - DNA, 25 bp, Mus musculus
ttctgagcaacatctcggactgtga

SEQ ID NO: 842300 - DNA, 25 bp, Mus musculus
ttctgagcaattctggctctgctga

SEQ ID NO: 842301 - DNA, 25 bp, Mus musculus
ttctgagcaattgtggctctgctga

SEQ ID NO: 842302 - DNA, 25 bp, Mus musculus
ttctgagcagatcctcctgccagcg

SEQ ID NO: 842303 - DNA, 25 bp, Mus musculus
ttctgagcagatgctcctgccagcg

SEQ ID NO: 842304 - DNA, 25 bp, Mus musculus
ttctgagcctgtaggtccttctagc

SEQ ID NO: 842305 - DNA, 25 bp, Mus musculus
ttctgagcctgttggtccttctagc

SEQ ID NO: 842306 - DNA, 25 bp, Mus musculus
ttctgagcgcaccactgaactgggt

SEQ ID NO: 842307 - DNA, 25 bp, Mus musculus
ttctgagcgcacgactgaactgggt

SEQ ID NO: 842308 - DNA, 25 bp, Mus musculus
ttctgagctcgtcgacacgtacacg

SEQ ID NO: 842309 - DNA, 25 bp, Mus musculus
ttctgagctcgtggacacgtacacg

SEQ ID NO: 842310 - DNA, 25 bp, Mus musculus
ttctgagctggtcgcaaagatcaag

SEQ ID NO: 842311 - DNA, 25 bp, Mus musculus
ttctgagctggtggcaaagatcaag

SEQ ID NO: 842312 - DNA, 25 bp, Mus musculus
ttctgagctgtcaaacccctccgaa

SEQ ID NO: 842313 - DNA, 25 bp, Mus musculus
ttctgagctgtctaacccctccgaa

SEQ ID NO: 842314 - DNA, 25 bp, Mus musculus
ttctgagcttcgcaaggatgacttc

SEQ ID NO: 842315 - DNA, 25 bp, Mus musculus
ttctgagcttcggaaggatgacttc

SEQ ID NO: 842316 - DNA, 25 bp, Mus musculus
ttctgaggagaccataaagcttctg

SEQ ID NO: 842317 - DNA, 25 bp, Mus musculus
ttctgaggagacgataaagcttctg

SEQ ID NO: 842318 - DNA, 25 bp, Mus musculus
ttctgagtgccccaggagtgcttct

SEQ ID NO: 842319 - DNA, 25 bp, Mus musculus
ttctgagtgcccgaggagtgcttct

SEQ ID NO: 842320 - DNA, 25 bp, Mus musculus
ttctgagttcctccgcttcaaatgg

SEQ ID NO: 842321 - DNA, 25 bp, Mus musculus
ttctgagttcctgcgcttcaaatgg

SEQ ID NO: 842322 - DNA, 25 bp, Mus musculus
ttctgatcaacaagagttggagcca

SEQ ID NO: 842323 - DNA, 25 bp, Mus musculus
ttctgatcaacatgagttggagcca

SEQ ID NO: 842324 - DNA, 25 bp, Mus musculus
ttctgatcacagaagtcttcctagg

SEQ ID NO: 842325 - DNA, 25 bp, Mus musculus
ttctgatcacagtagtcttcctagg

SEQ ID NO: 842326 - DNA, 25 bp, Mus musculus
ttctgatcagttagtctgaagtggg

SEQ ID NO: 842327 - DNA, 25 bp, Mus musculus
ttctgatcagtttgtctgaagtggg

SEQ ID NO: 842328 - DNA, 25 bp, Mus musculus
ttctgatccagacaccgcccagtta

SEQ ID NO: 842329 - DNA, 25 bp, Mus musculus
ttctgatccagagaccgcccagtta

SEQ ID NO: 842330 - DNA, 25 bp, Mus musculus
ttctgatcctgtcgaaaggatgcag

SEQ ID NO: 842331 - DNA, 25 bp, Mus musculus
ttctgatcctgtggaaaggatgcag

SEQ ID NO: 842332 - DNA, 25 bp, Mus musculus
ttctgatctccacgtaaccatcttg

SEQ ID NO: 842333 - DNA, 25 bp, Mus musculus
ttctgatctccaggtaaccatcttg

SEQ ID NO: 842334 - DNA, 25 bp, Mus musculus
ttctgatgctgaacagtgaaaacct

SEQ ID NO: 842335 - DNA, 25 bp, Mus musculus
ttctgatgctgatcagtgaaaacct

SEQ ID NO: 842336 - DNA, 25 bp, Mus musculus
ttctgattcccacgatgctaaccag

SEQ ID NO: 842337 - DNA, 25 bp, Mus musculus
ttctgattcccaggatgctaaccag

SEQ ID NO: 842338 - DNA, 25 bp, Mus musculus
ttctgattgggaactggaccggtga

SEQ ID NO: 842339 - DNA, 25 bp, Mus musculus
ttctgattgggatctggaccggtga

SEQ ID NO: 842340 - DNA, 25 bp, Mus musculus
ttctgcaaacggaagtgggaggaag

SEQ ID NO: 842341 - DNA, 25 bp, Mus musculus
ttctgcaaacggtagtgggaggaag

SEQ ID NO: 842342 - DNA, 25 bp, Mus musculus
ttctgcaactccacccagagagtcg

SEQ ID NO: 842343 - DNA, 25 bp, Mus musculus
ttctgcaactcctcccagagagtcg

SEQ ID NO: 842344 - DNA, 25 bp, Mus musculus
ttctgcaactgacctactttgccag

SEQ ID NO: 842345 - DNA, 25 bp, Mus musculus
ttctgcaactgagctactttgccag

SEQ ID NO: 842346 - DNA, 25 bp, Mus musculus
ttctgcaagtctcatcgaaacagta

SEQ ID NO: 842347 - DNA, 25 bp, Mus musculus
ttctgcaagtctgatcgaaacagta

SEQ ID NO: 842348 - DNA, 25 bp, Mus musculus
ttctgcaagtgcatccggagaggtc

SEQ ID NO: 842349 - DNA, 25 bp, Mus musculus
ttctgcaagtgcttccggagaggtc

SEQ ID NO: 842350 - DNA, 25 bp, Mus musculus
ttctgcagcgggaccccggagtttg

SEQ ID NO: 842351 - DNA, 25 bp, Mus musculus
ttctgcagcgggtccccggagtttg

SEQ ID NO: 842352 - DNA, 25 bp, Mus musculus
ttctgcagggcacagatgtcatcag

SEQ ID NO: 842353 - DNA, 25 bp, Mus musculus
ttctgcagggcagagatgtcatcag

SEQ ID NO: 842354 - DNA, 25 bp, Mus musculus
ttctgcagggtgaaggaccccaact

SEQ ID NO: 842355 - DNA, 25 bp, Mus musculus
ttctgcagggtgtaggaccccaact

SEQ ID NO: 842356 - DNA, 25 bp, Mus musculus
ttctgcagtacacccacatactgga

SEQ ID NO: 842357 - DNA, 25 bp, Mus musculus
ttctgcagtacagccacatactgga

SEQ ID NO: 842358 - DNA, 25 bp, Mus musculus
ttctgcagtctacatacgcaacacc

SEQ ID NO: 842359 - DNA, 25 bp, Mus musculus
ttctgcagtctagatacgcaacacc

SEQ ID NO: 842360 - DNA, 25 bp, Mus musculus
ttctgcagttcaaagggtccatgct

SEQ ID NO: 842361 - DNA, 25 bp, Mus musculus
ttctgcagttcatagggtccatgct

SEQ ID NO: 842362 - DNA, 25 bp, Mus musculus
ttctgcataagcagccccgagaagt

SEQ ID NO: 842363 - DNA, 25 bp, Mus musculus
ttctgcataagctgccccgagaagt

SEQ ID NO: 842364 - DNA, 25 bp, Mus musculus
ttctgcatcaacatccctggtcact

SEQ ID NO: 842365 - DNA, 25 bp, Mus musculus
ttctgcatcaacttccctggtcact

SEQ ID NO: 842366 - DNA, 25 bp, Mus musculus
ttctgcatgaaaagaaacctcattg

SEQ ID NO: 842367 - DNA, 25 bp, Mus musculus
ttctgcatgaaatgaaacctcattg

SEQ ID NO: 842368 - DNA, 25 bp, Mus musculus
ttctgcatgacgaacctgatcccgg

SEQ ID NO: 842369 - DNA, 25 bp, Mus musculus
ttctgcatgacgatcggcggcggca

SEQ ID NO: 842370 - DNA, 25 bp, Mus musculus
ttctgcatgacgtacctgatcccgg

SEQ ID NO: 842371 - DNA, 25 bp, Mus musculus
ttctgcatgacgttcggcggcggca

SEQ ID NO: 842372 - DNA, 25 bp, Mus musculus
ttctgccaaagcaatggagtggatc

SEQ ID NO: 842373 - DNA, 25 bp, Mus musculus
ttctgccaaagctatggagtggatc

SEQ ID NO: 842374 - DNA, 25 bp, Mus musculus
ttctgccaacatccctgagcactgg

SEQ ID NO: 842375 - DNA, 25 bp, Mus musculus
ttctgccaacatgcctgagcactgg

SEQ ID NO: 842376 - DNA, 25 bp, Mus musculus
ttctgccacctcaaccctgagattg

SEQ ID NO: 842377 - DNA, 25 bp, Mus musculus
ttctgccacctctaccctgagattg

SEQ ID NO: 842378 - DNA, 25 bp, Mus musculus
ttctgccagcacagcagggacctct

SEQ ID NO: 842379 - DNA, 25 bp, Mus musculus
ttctgccagcactgcagggacctct

SEQ ID NO: 842380 - DNA, 25 bp, Mus musculus
ttctgccagggaagctgggccccaa

SEQ ID NO: 842381 - DNA, 25 bp, Mus musculus
ttctgccagggatgctgggccccaa

SEQ ID NO: 842382 - DNA, 25 bp, Mus musculus
ttctgccctctgaacccaaagactg

SEQ ID NO: 842383 - DNA, 25 bp, Mus musculus
ttctgccctctgtacccaaagactg

SEQ ID NO: 842384 - DNA, 25 bp, Mus musculus
ttctgccgccgtccctatgaaaggg

SEQ ID NO: 842385 - DNA, 25 bp, Mus musculus
ttctgccgccgtgcctatgaaaggg

SEQ ID NO: 842386 - DNA, 25 bp, Mus musculus
ttctgccgggctccagagctccgtg

SEQ ID NO: 842387 - DNA, 25 bp, Mus musculus
ttctgccgggctgcagagctccgtg

SEQ ID NO: 842388 - DNA, 25 bp, Mus musculus
ttctgcctcaatccctctggaaaac

SEQ ID NO: 842389 - DNA, 25 bp, Mus musculus
ttctgcctcaatgcctctggaaaac

SEQ ID NO: 842390 - DNA, 25 bp, Mus musculus
ttctgcctgagtccaagagacacag

SEQ ID NO: 842391 - DNA, 25 bp, Mus musculus
ttctgcctgagtgcaagagacacag

SEQ ID NO: 842392 - DNA, 25 bp, Mus musculus
ttctgcctgggaagggaaccctcat

SEQ ID NO: 842393 - DNA, 25 bp, Mus musculus
ttctgcctgggatgggaaccctcat

SEQ ID NO: 842394 - DNA, 25 bp, Mus musculus
ttctgcctgtggatgagggcttacc

SEQ ID NO: 842395 - DNA, 25 bp, Mus musculus
ttctgcctgtggttgagggcttacc

SEQ ID NO: 842396 - DNA, 25 bp, Mus musculus
ttctgccttctaactacaactttga

SEQ ID NO: 842397 - DNA, 25 bp, Mus musculus
ttctgccttctatctacaactttga

SEQ ID NO: 842398 - DNA, 25 bp, Mus musculus
ttctgcgaccagaggtagtgtcatt

SEQ ID NO: 842399 - DNA, 25 bp, Mus musculus
ttctgcgaccagtggtagtgtcatt

SEQ ID NO: 842400 - DNA, 25 bp, Mus musculus
ttctgcgaggagagaccaatgacca

SEQ ID NO: 842401 - DNA, 25 bp, Mus musculus
ttctgcgaggagtgaccaatgacca

SEQ ID NO: 842402 - DNA, 25 bp, Mus musculus
ttctgcggaatgctcctggcggact

SEQ ID NO: 842403 - DNA, 25 bp, Mus musculus
ttctgcggaatggtcctggcggact

SEQ ID NO: 842404 - DNA, 25 bp, Mus musculus
ttctgcggcactccgtgatggttga

SEQ ID NO: 842405 - DNA, 25 bp, Mus musculus
ttctgcggcactgcgtgatggttga

SEQ ID NO: 842406 - DNA, 25 bp, Mus musculus
ttctgcggctgccaaggctccgcgt

SEQ ID NO: 842407 - DNA, 25 bp, Mus musculus
ttctgcggctgcgaaggctccgcgt

SEQ ID NO: 842408 - DNA, 25 bp, Mus musculus
ttctgcggtcgcctcattttctccg

SEQ ID NO: 842409 - DNA, 25 bp, Mus musculus
ttctgcggtcgcgtcattttctccg

SEQ ID NO: 842410 - DNA, 25 bp, Mus musculus
ttctgcgtcgtcaccgagcgtcttt

SEQ ID NO: 842411 - DNA, 25 bp, Mus musculus
ttctgcgtcgtctccgagcgtcttt

SEQ ID NO: 842412 - DNA, 25 bp, Mus musculus
ttctgctatcttcctggccatgctc

SEQ ID NO: 842413 - DNA, 25 bp, Mus musculus
ttctgctatcttgctggccatgctc

SEQ ID NO: 842414 - DNA, 25 bp, Mus musculus
ttctgctattctctgagaccgaggg

SEQ ID NO: 842415 - DNA, 25 bp, Mus musculus
ttctgctattctgtgagaccgaggg

SEQ ID NO: 842416 - DNA, 25 bp, Mus musculus
ttctgctcccgtaacacaggcgcat

SEQ ID NO: 842417 - DNA, 25 bp, Mus musculus
ttctgctcccgttacacaggcgcat

SEQ ID NO: 842418 - DNA, 25 bp, Mus musculus
ttctgctcttaacagccacaaggac

SEQ ID NO: 842419 - DNA, 25 bp, Mus musculus
ttctgctcttaagagccacaaggac

SEQ ID NO: 842420 - DNA, 25 bp, Mus musculus
ttctgctcttctctatgcctcacag

SEQ ID NO: 842421 - DNA, 25 bp, Mus musculus
ttctgctcttctgtatgcctcacag

SEQ ID NO: 842422 - DNA, 25 bp, Mus musculus
ttctgctgccctcccaagctgcctg

SEQ ID NO: 842423 - DNA, 25 bp, Mus musculus
ttctgctgccctgccaagctgcctg

SEQ ID NO: 842424 - DNA, 25 bp, Mus musculus
ttctgctgcgggagactgtcaatca

SEQ ID NO: 842425 - DNA, 25 bp, Mus musculus
ttctgctgcgggtgactgtcaatca

SEQ ID NO: 842426 - DNA, 25 bp, Mus musculus
ttctgctgctcgatgccgggctggt

SEQ ID NO: 842427 - DNA, 25 bp, Mus musculus
ttctgctgctcgttgccgggctggt

SEQ ID NO: 842428 - DNA, 25 bp, Mus musculus
ttctgctgctctccctccagatgga

SEQ ID NO: 842429 - DNA, 25 bp, Mus musculus
ttctgctgctctgcctccagatgga

SEQ ID NO: 842430 - DNA, 25 bp, Mus musculus
ttctgctggagaacgccaaactggc

SEQ ID NO: 842431 - DNA, 25 bp, Mus musculus
ttctgctggagatcgccaaactggc

SEQ ID NO: 842432 - DNA, 25 bp, Mus musculus
ttctgctggattagcatgggttctc

SEQ ID NO: 842433 - DNA, 25 bp, Mus musculus
ttctgctggatttgcatgggttctc

SEQ ID NO: 842434 - DNA, 25 bp, Mus musculus
ttctgctggtaccagaggccttcct

SEQ ID NO: 842435 - DNA, 25 bp, Mus musculus
ttctgctggtacgagaggccttcct

SEQ ID NO: 842436 - DNA, 25 bp, Mus musculus
ttctgctgtgggacaggaggcctct

SEQ ID NO: 842437 - DNA, 25 bp, Mus musculus
ttctgctgtgggtcaggaggcctct

SEQ ID NO: 842438 - DNA, 25 bp, Mus musculus
ttctgcttacccacgacagctagag

SEQ ID NO: 842439 - DNA, 25 bp, Mus musculus
ttctgcttaccctcgacagctagag

SEQ ID NO: 842440 - DNA, 25 bp, Mus musculus
ttctgcttcaggagaaacggaagcc

SEQ ID NO: 842441 - DNA, 25 bp, Mus musculus
ttctgcttcaggtgaaacggaagcc

SEQ ID NO: 842442 - DNA, 25 bp, Mus musculus
ttctgcttgtgacacgctcatctcc

SEQ ID NO: 842443 - DNA, 25 bp, Mus musculus
ttctgcttgtgagacgctcatctcc

SEQ ID NO: 842444 - DNA, 25 bp, Mus musculus
ttctgcttgtgcaaccctatgcggg

SEQ ID NO: 842445 - DNA, 25 bp, Mus musculus
ttctgcttgtgcctttgctactgag

SEQ ID NO: 842446 - DNA, 25 bp, Mus musculus
ttctgcttgtgcgtttgctactgag

SEQ ID NO: 842447 - DNA, 25 bp, Mus musculus
ttctgcttgtgctaccctatgcggg

SEQ ID NO: 842448 - DNA, 25 bp, Mus musculus
ttctgcttttgtcatgggttggccc

SEQ ID NO: 842449 - DNA, 25 bp, Mus musculus
ttctgcttttgtgatgggttggccc

SEQ ID NO: 842450 - DNA, 25 bp, Mus musculus
ttctggaaattcaagcacactgtgc

SEQ ID NO: 842451 - DNA, 25 bp, Mus musculus
ttctggaaattctagcacactgtgc

SEQ ID NO: 842452 - DNA, 25 bp, Mus musculus
ttctggaatggactcgggccgccca

SEQ ID NO: 842453 - DNA, 25 bp, Mus musculus
ttctggaatggagtcgggccgccca

SEQ ID NO: 842454 - DNA, 25 bp, Mus musculus
ttctggaattctcccgccaggcggc

SEQ ID NO: 842455 - DNA, 25 bp, Mus musculus
ttctggaattctgccgccaggcggc

SEQ ID NO: 842456 - DNA, 25 bp, Mus musculus
ttctggacaccccatctactggagt

SEQ ID NO: 842457 - DNA, 25 bp, Mus musculus
ttctggacacccgatctactggagt

SEQ ID NO: 842458 - DNA, 25 bp, Mus musculus
ttctggacagcaagactagggcaca

SEQ ID NO: 842459 - DNA, 25 bp, Mus musculus
ttctggacagcatgactagggcaca

SEQ ID NO: 842460 - DNA, 25 bp, Mus musculus
ttctggacattcacaagatgaacca

SEQ ID NO: 842461 - DNA, 25 bp, Mus musculus
ttctggacattctcaagatgaacca

SEQ ID NO: 842462 - DNA, 25 bp, Mus musculus
ttctggaccgccagagatgtatgag

SEQ ID NO: 842463 - DNA, 25 bp, Mus musculus
ttctggaccgcctgagatgtatgag

SEQ ID NO: 842464 - DNA, 25 bp, Mus musculus
ttctggaccgtcagcaaggagacca

SEQ ID NO: 842465 - DNA, 25 bp, Mus musculus
ttctggaccgtctgcaaggagacca

SEQ ID NO: 842466 - DNA, 25 bp, Mus musculus
ttctggacctggctaggacccgcag

SEQ ID NO: 842467 - DNA, 25 bp, Mus musculus
ttctggacctgggtaggacccgcag

SEQ ID NO: 842468 - DNA, 25 bp, Mus musculus
ttctggaccttccagacgggctgca

SEQ ID NO: 842469 - DNA, 25 bp, Mus musculus
ttctggaccttcgagacgggctgca

SEQ ID NO: 842470 - DNA, 25 bp, Mus musculus
ttctggactcggaccgcctcacctt

SEQ ID NO: 842471 - DNA, 25 bp, Mus musculus
ttctggactcggtccgcctcacctt

SEQ ID NO: 842472 - DNA, 25 bp, Mus musculus
ttctggactcttcctgtcagtgtgc

SEQ ID NO: 842473 - DNA, 25 bp, Mus musculus
ttctggactcttgctgtcagtgtgc

SEQ ID NO: 842474 - DNA, 25 bp, Mus musculus
ttctggagacccagtgtgggtcaca

SEQ ID NO: 842475 - DNA, 25 bp, Mus musculus
ttctggagaccctgtgtgggtcaca

SEQ ID NO: 842476 - DNA, 25 bp, Mus musculus
ttctggagacggagcaggcctatgt

SEQ ID NO: 842477 - DNA, 25 bp, Mus musculus
ttctggagacggtgcaggcctatgt

SEQ ID NO: 842478 - DNA, 25 bp, Mus musculus
ttctggagactcatcaagttgtgca

SEQ ID NO: 842479 - DNA, 25 bp, Mus musculus
ttctggagactcttcaagttgtgca

SEQ ID NO: 842480 - DNA, 25 bp, Mus musculus
ttctggagagcacctagcgccgcca

SEQ ID NO: 842481 - DNA, 25 bp, Mus musculus
ttctggagagcagctagcgccgcca

SEQ ID NO: 842482 - DNA, 25 bp, Mus musculus
ttctggagcacaaggctgtagtgag

SEQ ID NO: 842483 - DNA, 25 bp, Mus musculus
ttctggagcacatggctgtagtgag

SEQ ID NO: 842484 - DNA, 25 bp, Mus musculus
ttctggaggatcacaaaccacggag

SEQ ID NO: 842485 - DNA, 25 bp, Mus musculus
ttctggaggatctcaaaccacggag

SEQ ID NO: 842486 - DNA, 25 bp, Mus musculus
ttctggaggcagctgatagactacg

SEQ ID NO: 842487 - DNA, 25 bp, Mus musculus
ttctggaggcaggtgatagactacg

SEQ ID NO: 842488 - DNA, 25 bp, Mus musculus
ttctggaggcttatgagtgccctgc

SEQ ID NO: 842489 - DNA, 25 bp, Mus musculus
ttctggaggcttttgagtgccctgc

SEQ ID NO: 842490 - DNA, 25 bp, Mus musculus
ttctggaggtctcgcctgcaagccc

SEQ ID NO: 842491 - DNA, 25 bp, Mus musculus
ttctggaggtctggcctgcaagccc

SEQ ID NO: 842492 - DNA, 25 bp, Mus musculus
ttctggagtctaatgaaagcataca

SEQ ID NO: 842493 - DNA, 25 bp, Mus musculus
ttctggagtctattgaaagcataca

SEQ ID NO: 842494 - DNA, 25 bp, Mus musculus
ttctggagttgcagccagcgctgcc

SEQ ID NO: 842495 - DNA, 25 bp, Mus musculus
ttctggagttgctgccagcgctgcc

SEQ ID NO: 842496 - DNA, 25 bp, Mus musculus
ttctggataggactacaggatctcc

SEQ ID NO: 842497 - DNA, 25 bp, Mus musculus
ttctggataggagtacaggatctcc

SEQ ID NO: 842498 - DNA, 25 bp, Mus musculus
ttctggatattgactggtgtcccca

SEQ ID NO: 842499 - DNA, 25 bp, Mus musculus
ttctggatattgtctggtgtcccca

SEQ ID NO: 842500 - DNA, 25 bp, Mus musculus
ttctggatggagcattcccatgacc

SEQ ID NO: 842501 - DNA, 25 bp, Mus musculus
ttctggatggaggattcccatgacc

SEQ ID NO: 842502 - DNA, 25 bp, Mus musculus
ttctggatgtggacacctgtggacc

SEQ ID NO: 842503 - DNA, 25 bp, Mus musculus
ttctggatgtggtcacctgtggacc

SEQ ID NO: 842504 - DNA, 25 bp, Mus musculus
ttctggattctacaaccattgaaat

SEQ ID NO: 842505 - DNA, 25 bp, Mus musculus
ttctggattctagaaccattgaaat

SEQ ID NO: 842506 - DNA, 25 bp, Mus musculus
ttctggatttggcaatgagtgtgct

SEQ ID NO: 842507 - DNA, 25 bp, Mus musculus
ttctggatttgggaatgagtgtgct

SEQ ID NO: 842508 - DNA, 25 bp, Mus musculus
ttctggcaaacaaggaaggactttg

SEQ ID NO: 842509 - DNA, 25 bp, Mus musculus
ttctggcaaacatggaaggactttg

SEQ ID NO: 842510 - DNA, 25 bp, Mus musculus
ttctggcaaaggacattcgggacag

SEQ ID NO: 842511 - DNA, 25 bp, Mus musculus
ttctggcaaaggtcattcgggacag

SEQ ID NO: 842512 - DNA, 25 bp, Mus musculus
ttctggcaagtactgggctctggac

SEQ ID NO: 842513 - DNA, 25 bp, Mus musculus
ttctggcaagtagtgggctctggac

SEQ ID NO: 842514 - DNA, 25 bp, Mus musculus
ttctggcaccgaagccacatccaga

SEQ ID NO: 842515 - DNA, 25 bp, Mus musculus
ttctggcaccgatgccacatccaga

SEQ ID NO: 842516 - DNA, 25 bp, Mus musculus
ttctggcactgacaagtggctgtga

SEQ ID NO: 842517 - DNA, 25 bp, Mus musculus
ttctggcactgagaagtggctgtga

SEQ ID NO: 842518 - DNA, 25 bp, Mus musculus
ttctggcagctgacgacagtgcatg

SEQ ID NO: 842519 - DNA, 25 bp, Mus musculus
ttctggcagctgtcgacagtgcatg

SEQ ID NO: 842520 - DNA, 25 bp, Mus musculus
ttctggcagtagatgaacgaatgtc

SEQ ID NO: 842521 - DNA, 25 bp, Mus musculus
ttctggcagtagttgaacgaatgtc

SEQ ID NO: 842522 - DNA, 25 bp, Mus musculus
ttctggcatcgtccttgagagggtt

SEQ ID NO: 842523 - DNA, 25 bp, Mus musculus
ttctggcatcgtgcttgagagggtt

SEQ ID NO: 842524 - DNA, 25 bp, Mus musculus
ttctggcattctcccaggaagatgc

SEQ ID NO: 842525 - DNA, 25 bp, Mus musculus
ttctggcattctgccaggaagatgc

SEQ ID NO: 842526 - DNA, 25 bp, Mus musculus
ttctggccaccaagacgtcgtgaga

SEQ ID NO: 842527 - DNA, 25 bp, Mus musculus
ttctggccaccatgacgtcgtgaga

SEQ ID NO: 842528 - DNA, 25 bp, Mus musculus
ttctggccagcaacttcatcagtcc

SEQ ID NO: 842529 - DNA, 25 bp, Mus musculus
ttctggccagcatcttcatcagtcc

SEQ ID NO: 842530 - DNA, 25 bp, Mus musculus
ttctggccagccctacgtgagcaag

SEQ ID NO: 842531 - DNA, 25 bp, Mus musculus
ttctggccagccgtacgtgagcaag

SEQ ID NO: 842532 - DNA, 25 bp, Mus musculus
ttctggccccaccttaaggcttcta

SEQ ID NO: 842533 - DNA, 25 bp, Mus musculus
ttctggccccacgttaaggcttcta

SEQ ID NO: 842534 - DNA, 25 bp, Mus musculus
ttctggcccctgagacagttccaat

SEQ ID NO: 842535 - DNA, 25 bp, Mus musculus
ttctggcccctgtgacagttccaat

SEQ ID NO: 842536 - DNA, 25 bp, Mus musculus
ttctggcccgcacaaagggaaggaa

SEQ ID NO: 842537 - DNA, 25 bp, Mus musculus
ttctggcccgcagaaagggaaggaa

SEQ ID NO: 842538 - DNA, 25 bp, Mus musculus
ttctggccgaggagcctgcgtttag

SEQ ID NO: 842539 - DNA, 25 bp, Mus musculus
ttctggccgaggtgcctgcgtttag

SEQ ID NO: 842540 - DNA, 25 bp, Mus musculus
ttctggcgagatctgaagaagactg

SEQ ID NO: 842541 - DNA, 25 bp, Mus musculus
ttctggcgagatgtgaagaagactg

SEQ ID NO: 842542 - DNA, 25 bp, Mus musculus
ttctggcgtcgtagaatccggtgtg

SEQ ID NO: 842543 - DNA, 25 bp, Mus musculus
ttctggcgtcgttgaatccggtgtg

SEQ ID NO: 842544 - DNA, 25 bp, Mus musculus
ttctggctacaaaacaagagacgta

SEQ ID NO: 842545 - DNA, 25 bp, Mus musculus
ttctggctacaatacaagagacgta

SEQ ID NO: 842546 - DNA, 25 bp, Mus musculus
ttctggctctgcagaatctaccatt

SEQ ID NO: 842547 - DNA, 25 bp, Mus musculus
ttctggctctgcctggcactgcctg

SEQ ID NO: 842548 - DNA, 25 bp, Mus musculus
ttctggctctgcgtggcactgcctg

SEQ ID NO: 842549 - DNA, 25 bp, Mus musculus
ttctggctctgctgaatctaccatt

SEQ ID NO: 842550 - DNA, 25 bp, Mus musculus
ttctggctgagacccttgagctcca

SEQ ID NO: 842551 - DNA, 25 bp, Mus musculus
ttctggctgagagccttgagctcca

SEQ ID NO: 842552 - DNA, 25 bp, Mus musculus
ttctggctgcgcatctaggcaggaa

SEQ ID NO: 842553 - DNA, 25 bp, Mus musculus
ttctggctgcgcttctaggcaggaa

SEQ ID NO: 842554 - DNA, 25 bp, Mus musculus
ttctggctgctaagactgttgagga

SEQ ID NO: 842555 - DNA, 25 bp, Mus musculus
ttctggctgctatgactgttgagga

SEQ ID NO: 842556 - DNA, 25 bp, Mus musculus
ttctggctgcttctcctgacccggg

SEQ ID NO: 842557 - DNA, 25 bp, Mus musculus
ttctggctgcttgtcctgacccggg

SEQ ID NO: 842558 - DNA, 25 bp, Mus musculus
ttctggctgtctccctggtacgtgt

SEQ ID NO: 842559 - DNA, 25 bp, Mus musculus
ttctggctgtctgcctggtacgtgt

SEQ ID NO: 842560 - DNA, 25 bp, Mus musculus
ttctggctttgcagatagtaattcc

SEQ ID NO: 842561 - DNA, 25 bp, Mus musculus
ttctggctttgctgatagtaattcc

SEQ ID NO: 842562 - DNA, 25 bp, Mus musculus
ttctgggacctgaattgtgcggcac

SEQ ID NO: 842563 - DNA, 25 bp, Mus musculus
ttctgggacctgtattgtgcggcac

SEQ ID NO: 842564 - DNA, 25 bp, Mus musculus
ttctgggacgacaagggttccctag

SEQ ID NO: 842565 - DNA, 25 bp, Mus musculus
ttctgggacgactagggttccctag

SEQ ID NO: 842566 - DNA, 25 bp, Mus musculus
ttctgggacgagaactgctgctgct

SEQ ID NO: 842567 - DNA, 25 bp, Mus musculus
ttctgggacgagtactgctgctgct

SEQ ID NO: 842568 - DNA, 25 bp, Mus musculus
ttctgggactacatccggctggcct

SEQ ID NO: 842569 - DNA, 25 bp, Mus musculus
ttctgggactacttccggctggcct

SEQ ID NO: 842570 - DNA, 25 bp, Mus musculus
ttctgggactgcagggtagtttgaa

SEQ ID NO: 842571 - DNA, 25 bp, Mus musculus
ttctgggactgctgggtagtttgaa

SEQ ID NO: 842572 - DNA, 25 bp, Mus musculus
ttctgggagcaaacctgcagcccag

SEQ ID NO: 842573 - DNA, 25 bp, Mus musculus
ttctgggagcaatcctgcagcccag

SEQ ID NO: 842574 - DNA, 25 bp, Mus musculus
ttctgggataacaggtgtgagtcac

SEQ ID NO: 842575 - DNA, 25 bp, Mus musculus
ttctgggataactggtgtgagtcac

SEQ ID NO: 842576 - DNA, 25 bp, Mus musculus
ttctgggatcctcagagtctggtgt

SEQ ID NO: 842577 - DNA, 25 bp, Mus musculus
ttctgggatcctgagagtctggtgt

SEQ ID NO: 842578 - DNA, 25 bp, Mus musculus
ttctgggatgctcggcaccccttag

SEQ ID NO: 842579 - DNA, 25 bp, Mus musculus
ttctgggatgctgggcaccccttag

SEQ ID NO: 842580 - DNA, 25 bp, Mus musculus
ttctgggatgtcatcccatcttggc

SEQ ID NO: 842581 - DNA, 25 bp, Mus musculus
ttctgggatgtcttcccatcttggc

SEQ ID NO: 842582 - DNA, 25 bp, Mus musculus
ttctgggcagacagctttcaccacc

SEQ ID NO: 842583 - DNA, 25 bp, Mus musculus
ttctgggcagactgctttcaccacc

SEQ ID NO: 842584 - DNA, 25 bp, Mus musculus
ttctgggcagtgagttccagagccc

SEQ ID NO: 842585 - DNA, 25 bp, Mus musculus
ttctgggcagtgtgttccagagccc

SEQ ID NO: 842586 - DNA, 25 bp, Mus musculus
ttctgggctcgtagttgtggctgct

SEQ ID NO: 842587 - DNA, 25 bp, Mus musculus
ttctgggctcgttgttgtggctgct

SEQ ID NO: 842588 - DNA, 25 bp, Mus musculus
ttctgggtggtgcatcagacccact

SEQ ID NO: 842589 - DNA, 25 bp, Mus musculus
ttctgggtggtggatcagacccact

SEQ ID NO: 842590 - DNA, 25 bp, Mus musculus
ttctgggttaagcagctgcgcagtt

SEQ ID NO: 842591 - DNA, 25 bp, Mus musculus
ttctgggttaaggagctgcgcagtt

SEQ ID NO: 842592 - DNA, 25 bp, Mus musculus
ttctggtaaggtactcggaggagct

SEQ ID NO: 842593 - DNA, 25 bp, Mus musculus
ttctggtaaggttctcggaggagct

SEQ ID NO: 842594 - DNA, 25 bp, Mus musculus
ttctggtacagccatgaacagtgct

SEQ ID NO: 842595 - DNA, 25 bp, Mus musculus
ttctggtacagcgatgaacagtgct

SEQ ID NO: 842596 - DNA, 25 bp, Mus musculus
ttctggtatctcaccagttcttgaa

SEQ ID NO: 842597 - DNA, 25 bp, Mus musculus
ttctggtatctctccagttcttgaa

SEQ ID NO: 842598 - DNA, 25 bp, Mus musculus
ttctggtcactgcatcctctggagc

SEQ ID NO: 842599 - DNA, 25 bp, Mus musculus
ttctggtcactggatcctctggagc

SEQ ID NO: 842600 - DNA, 25 bp, Mus musculus
ttctggtcagcgaggctctgagcca

SEQ ID NO: 842601 - DNA, 25 bp, Mus musculus
ttctggtcagcgtggctctgagcca

SEQ ID NO: 842602 - DNA, 25 bp, Mus musculus
ttctggtccagaacccctggtgggc

SEQ ID NO: 842603 - DNA, 25 bp, Mus musculus
ttctggtccagatcccctggtgggc

SEQ ID NO: 842604 - DNA, 25 bp, Mus musculus
ttctggtcctatcaggagacctcag

SEQ ID NO: 842605 - DNA, 25 bp, Mus musculus
ttctggtcctatgaggagacctcag

SEQ ID NO: 842606 - DNA, 25 bp, Mus musculus
ttctggtcctggacggccgagttcc

SEQ ID NO: 842607 - DNA, 25 bp, Mus musculus
ttctggtcctggtcggccgagttcc

SEQ ID NO: 842608 - DNA, 25 bp, Mus musculus
ttctggtctctccacatgctgctgt

SEQ ID NO: 842609 - DNA, 25 bp, Mus musculus
ttctggtctctcgacatgctgctgt

SEQ ID NO: 842610 - DNA, 25 bp, Mus musculus
ttctggtctggacccaaacgctgtc

SEQ ID NO: 842611 - DNA, 25 bp, Mus musculus
ttctggtctggagccaaacgctgtc

SEQ ID NO: 842612 - DNA, 25 bp, Mus musculus
ttctggtgcagacttccagtacctc

SEQ ID NO: 842613 - DNA, 25 bp, Mus musculus
ttctggtgcagagttccagtacctc

SEQ ID NO: 842614 - DNA, 25 bp, Mus musculus
ttctggtggaagagccaccccttgg

SEQ ID NO: 842615 - DNA, 25 bp, Mus musculus
ttctggtggaagtgccaccccttgg

SEQ ID NO: 842616 - DNA, 25 bp, Mus musculus
ttctggtggacacagaggccatcat

SEQ ID NO: 842617 - DNA, 25 bp, Mus musculus
ttctggtggacagagaggccatcat

SEQ ID NO: 842618 - DNA, 25 bp, Mus musculus
ttctggtgttgcaaggcacaggtgt

SEQ ID NO: 842619 - DNA, 25 bp, Mus musculus
ttctggtgttgctaggcacaggtgt

SEQ ID NO: 842620 - DNA, 25 bp, Mus musculus
ttctggttccctcgcagccatcgtg

SEQ ID NO: 842621 - DNA, 25 bp, Mus musculus
ttctggttccctggcagccatcgtg

SEQ ID NO: 842622 - DNA, 25 bp, Mus musculus
ttctggttgccacaccggcacggat

SEQ ID NO: 842623 - DNA, 25 bp, Mus musculus
ttctggttgccagaccggcacggat

SEQ ID NO: 842624 - DNA, 25 bp, Mus musculus
ttctggtttcaacgcaatcgataca

SEQ ID NO: 842625 - DNA, 25 bp, Mus musculus
ttctggtttcaaggcaatcgataca

SEQ ID NO: 842626 - DNA, 25 bp, Mus musculus
ttctgtaactccagagaagcaggcc

SEQ ID NO: 842627 - DNA, 25 bp, Mus musculus
ttctgtaactcctgagaagcaggcc

SEQ ID NO: 842628 - DNA, 25 bp, Mus musculus
ttctgtacagaaaatgagtgagcct

SEQ ID NO: 842629 - DNA, 25 bp, Mus musculus
ttctgtacagaatatgagtgagcct

SEQ ID NO: 842630 - DNA, 25 bp, Mus musculus
ttctgtacccagagattccaaagaa

SEQ ID NO: 842631 - DNA, 25 bp, Mus musculus
ttctgtacccagtgattccaaagaa

SEQ ID NO: 842632 - DNA, 25 bp, Mus musculus
ttctgtagactcagggctgtgatgg

SEQ ID NO: 842633 - DNA, 25 bp, Mus musculus
ttctgtagactctgggctgtgatgg

SEQ ID NO: 842634 - DNA, 25 bp, Mus musculus
ttctgtagtgaaataaaagctaaca

SEQ ID NO: 842635 - DNA, 25 bp, Mus musculus
ttctgtagtgaattaaaagctaaca

SEQ ID NO: 842636 - DNA, 25 bp, Mus musculus
ttctgtatattcagacggacaaagg

SEQ ID NO: 842637 - DNA, 25 bp, Mus musculus
ttctgtatattctgacggacaaagg

SEQ ID NO: 842638 - DNA, 25 bp, Mus musculus
ttctgtatgcgcctctgacagccct

SEQ ID NO: 842639 - DNA, 25 bp, Mus musculus
ttctgtatgcgcgtctgacagccct

SEQ ID NO: 842640 - DNA, 25 bp, Mus musculus
ttctgtattgtgaaccccgagtcct

SEQ ID NO: 842641 - DNA, 25 bp, Mus musculus
ttctgtattgtgtaccccgagtcct

SEQ ID NO: 842642 - DNA, 25 bp, Mus musculus
ttctgtcaaaccagggaagaaacct

SEQ ID NO: 842643 - DNA, 25 bp, Mus musculus
ttctgtcaaacctgggaagaaacct

SEQ ID NO: 842644 - DNA, 25 bp, Mus musculus
ttctgtcaatgacactgcactccct

SEQ ID NO: 842645 - DNA, 25 bp, Mus musculus
ttctgtcaatgagactgcactccct

SEQ ID NO: 842646 - DNA, 25 bp, Mus musculus
ttctgtcagatcagatgagcgcccg

SEQ ID NO: 842647 - DNA, 25 bp, Mus musculus
ttctgtcagatctgatgagcgcccg

SEQ ID NO: 842648 - DNA, 25 bp, Mus musculus
ttctgtcccgctatcctgtctgttg

SEQ ID NO: 842649 - DNA, 25 bp, Mus musculus
ttctgtcccgctttcctgtctgttg

SEQ ID NO: 842650 - DNA, 25 bp, Mus musculus
ttctgtccgagtcctccaagctgca

SEQ ID NO: 842651 - DNA, 25 bp, Mus musculus
ttctgtccgagtgctccaagctgca

SEQ ID NO: 842652 - DNA, 25 bp, Mus musculus
ttctgtcctcgccttctgtcgatta

SEQ ID NO: 842653 - DNA, 25 bp, Mus musculus
ttctgtcctcgcgttctgtcgatta

SEQ ID NO: 842654 - DNA, 25 bp, Mus musculus
ttctgtccttggagtcggagcccta

SEQ ID NO: 842655 - DNA, 25 bp, Mus musculus
ttctgtccttggtgtcggagcccta

SEQ ID NO: 842656 - DNA, 25 bp, Mus musculus
ttctgtcggactagaggagttcttc

SEQ ID NO: 842657 - DNA, 25 bp, Mus musculus
ttctgtcggacttgaggagttcttc

SEQ ID NO: 842658 - DNA, 25 bp, Mus musculus
ttctgtctcagaccgtgcggcaagc

SEQ ID NO: 842659 - DNA, 25 bp, Mus musculus
ttctgtctcagagcgtgcggcaagc

SEQ ID NO: 842660 - DNA, 25 bp, Mus musculus
ttctgtctcagtcccggcgggttgt

SEQ ID NO: 842661 - DNA, 25 bp, Mus musculus
ttctgtctcagtgccggcgggttgt

SEQ ID NO: 842662 - DNA, 25 bp, Mus musculus
ttctgtctccgcagggagtggcacc

SEQ ID NO: 842663 - DNA, 25 bp, Mus musculus
ttctgtctccgctgggagtggcacc

SEQ ID NO: 842664 - DNA, 25 bp, Mus musculus
ttctgtcttaggcagtgagctactt

SEQ ID NO: 842665 - DNA, 25 bp, Mus musculus
ttctgtcttagggagtgagctactt

SEQ ID NO: 842666 - DNA, 25 bp, Mus musculus
ttctgtcttatcaggaagtcggtct

SEQ ID NO: 842667 - DNA, 25 bp, Mus musculus
ttctgtcttatctggaagtcggtct

SEQ ID NO: 842668 - DNA, 25 bp, Mus musculus
ttctgtcttcttccactctccgatg

SEQ ID NO: 842669 - DNA, 25 bp, Mus musculus
ttctgtcttcttgcactctccgatg

SEQ ID NO: 842670 - DNA, 25 bp, Mus musculus
ttctgtgaacagacgggccagaagg

SEQ ID NO: 842671 - DNA, 25 bp, Mus musculus
ttctgtgaacagtcgggccagaagg

SEQ ID NO: 842672 - DNA, 25 bp, Mus musculus
ttctgtgaagcgctggccatctatg

SEQ ID NO: 842673 - DNA, 25 bp, Mus musculus
ttctgtgaagcggtggccatctatg

SEQ ID NO: 842674 - DNA, 25 bp, Mus musculus
ttctgtgaagctctgccggcaagca

SEQ ID NO: 842675 - DNA, 25 bp, Mus musculus
ttctgtgaagctgtgccggcaagca

SEQ ID NO: 842676 - DNA, 25 bp, Mus musculus
ttctgtgaaggaccctgtcactggc

SEQ ID NO: 842677 - DNA, 25 bp, Mus musculus
ttctgtgaaggagcctgtcactggc

SEQ ID NO: 842678 - DNA, 25 bp, Mus musculus
ttctgtgactccctacagccctgta

SEQ ID NO: 842679 - DNA, 25 bp, Mus musculus
ttctgtgactccgtacagccctgta

SEQ ID NO: 842680 - DNA, 25 bp, Mus musculus
ttctgtgatggcctcacccacgacc

SEQ ID NO: 842681 - DNA, 25 bp, Mus musculus
ttctgtgatggcgtcacccacgacc

SEQ ID NO: 842682 - DNA, 25 bp, Mus musculus
ttctgtgcaacgctgaggattaccg

SEQ ID NO: 842683 - DNA, 25 bp, Mus musculus
ttctgtgcaacggtgaggattaccg

SEQ ID NO: 842684 - DNA, 25 bp, Mus musculus
ttctgtgccctcacaggttccgctg

SEQ ID NO: 842685 - DNA, 25 bp, Mus musculus
ttctgtgccctctcaggttccgctg

SEQ ID NO: 842686 - DNA, 25 bp, Mus musculus
ttctgtgcgctgagccccggtgtgt

SEQ ID NO: 842687 - DNA, 25 bp, Mus musculus
ttctgtgcgctgtgccccggtgtgt

SEQ ID NO: 842688 - DNA, 25 bp, Mus musculus
ttctgtgctacaatagagcaggcac

SEQ ID NO: 842689 - DNA, 25 bp, Mus musculus
ttctgtgctacattagagcaggcac

SEQ ID NO: 842690 - DNA, 25 bp, Mus musculus
ttctgtgctcttcgctataatcatc

SEQ ID NO: 842691 - DNA, 25 bp, Mus musculus
ttctgtgctcttggctataatcatc

SEQ ID NO: 842692 - DNA, 25 bp, Mus musculus
ttctgtgctgtgctataattctcga

SEQ ID NO: 842693 - DNA, 25 bp, Mus musculus
ttctgtgctgtggtataattctcga

SEQ ID NO: 842694 - DNA, 25 bp, Mus musculus
ttctgtggaagtctatgcatgggca

SEQ ID NO: 842695 - DNA, 25 bp, Mus musculus
ttctgtggaagtgtatgcatgggca

SEQ ID NO: 842696 - DNA, 25 bp, Mus musculus
ttctgtggacacactacagtattgc

SEQ ID NO: 842697 - DNA, 25 bp, Mus musculus
ttctgtggacactctacagtattgc

SEQ ID NO: 842698 - DNA, 25 bp, Mus musculus
ttctgtggagaaacttcaagagaaa

SEQ ID NO: 842699 - DNA, 25 bp, Mus musculus
ttctgtggagaatcttcaagagaaa

SEQ ID NO: 842700 - DNA, 25 bp, Mus musculus
ttctgtggcgatctggactgtcccg

SEQ ID NO: 842701 - DNA, 25 bp, Mus musculus
ttctgtggcgatgtggactgtcccg

SEQ ID NO: 842702 - DNA, 25 bp, Mus musculus
ttctgtggctggatcgttctagggc

SEQ ID NO: 842703 - DNA, 25 bp, Mus musculus
ttctgtggctggttcgttctagggc

SEQ ID NO: 842704 - DNA, 25 bp, Mus musculus
ttctgtgggcagacgctgacattca

SEQ ID NO: 842705 - DNA, 25 bp, Mus musculus
ttctgtgggcagtcgctgacattca

SEQ ID NO: 842706 - DNA, 25 bp, Mus musculus
ttctgttattatcaggagatgccca

SEQ ID NO: 842707 - DNA, 25 bp, Mus musculus
ttctgttattatgaggagatgccca

SEQ ID NO: 842708 - DNA, 25 bp, Mus musculus
ttctgttcactacctggccacctgg

SEQ ID NO: 842709 - DNA, 25 bp, Mus musculus
ttctgttcactagctggccacctgg

SEQ ID NO: 842710 - DNA, 25 bp, Mus musculus
ttctgttccagaacccgcccggagt

SEQ ID NO: 842711 - DNA, 25 bp, Mus musculus
ttctgttccagatcccgcccggagt

SEQ ID NO: 842712 - DNA, 25 bp, Mus musculus
ttctgttctgggacactcgggaggc

SEQ ID NO: 842713 - DNA, 25 bp, Mus musculus
ttctgttctgggtcactcgggaggc

SEQ ID NO: 842714 - DNA, 25 bp, Mus musculus
ttctgttctgtgcataggcacggag

SEQ ID NO: 842715 - DNA, 25 bp, Mus musculus
ttctgttctgtggataggcacggag

SEQ ID NO: 842716 - DNA, 25 bp, Mus musculus
ttctgttgactaaggcaaaaagtcc

SEQ ID NO: 842717 - DNA, 25 bp, Mus musculus
ttctgttgactatggcaaaaagtcc

SEQ ID NO: 842718 - DNA, 25 bp, Mus musculus
ttctgttgatgccatttagagtgga

SEQ ID NO: 842719 - DNA, 25 bp, Mus musculus
ttctgttgatgcgatttagagtgga

SEQ ID NO: 842720 - DNA, 25 bp, Mus musculus
ttctgttgcctcctgcccaaatggg

SEQ ID NO: 842721 - DNA, 25 bp, Mus musculus
ttctgttgcctcgtgcccaaatggg

SEQ ID NO: 842722 - DNA, 25 bp, Mus musculus
ttctgttggcgtcccacctggaaga

SEQ ID NO: 842723 - DNA, 25 bp, Mus musculus
ttctgttggcgtgccacctggaaga

SEQ ID NO: 842724 - DNA, 25 bp, Mus musculus
ttctgttggtccagggactctgcgg

SEQ ID NO: 842725 - DNA, 25 bp, Mus musculus
ttctgttggtcctgggactctgcgg

SEQ ID NO: 842726 - DNA, 25 bp, Mus musculus
ttctgttgtgttcacttgcaacctc

SEQ ID NO: 842727 - DNA, 25 bp, Mus musculus
ttctgttgtgttgacttgcaacctc

SEQ ID NO: 842728 - DNA, 25 bp, Mus musculus
ttctgtttctgcaagcctcgggagc

SEQ ID NO: 842729 - DNA, 25 bp, Mus musculus
ttctgtttctgctagcctcgggagc

SEQ ID NO: 842730 - DNA, 25 bp, Mus musculus
ttctgtttggtgaccgagagcagcg

SEQ ID NO: 842731 - DNA, 25 bp, Mus musculus
ttctgtttggtgtccgagagcagcg

SEQ ID NO: 842732 - DNA, 25 bp, Mus musculus
ttctgtttgtgaattcagactacga

SEQ ID NO: 842733 - DNA, 25 bp, Mus musculus
ttctgtttgtgatttcagactacga

SEQ ID NO: 842734 - DNA, 25 bp, Mus musculus
ttctgttttgcacagccgtgttggg

SEQ ID NO: 842735 - DNA, 25 bp, Mus musculus
ttctgttttgcagagccgtgttggg

SEQ ID NO: 842736 - DNA, 25 bp, Mus musculus
ttcttaaaacgaccacctgctttcc

SEQ ID NO: 842737 - DNA, 25 bp, Mus musculus
ttcttaaaacgagcacctgctttcc

SEQ ID NO: 842738 - DNA, 25 bp, Mus musculus
ttcttaaaatagaaacctggaagag

SEQ ID NO: 842739 - DNA, 25 bp, Mus musculus
ttcttaaaatagtaacctggaagag

SEQ ID NO: 842740 - DNA, 25 bp, Mus musculus
ttcttaaaggctagccggccgcttc

SEQ ID NO: 842741 - DNA, 25 bp, Mus musculus
ttcttaaaggcttgccggccgcttc

SEQ ID NO: 842742 - DNA, 25 bp, Mus musculus
ttcttaaagggccagcccgccggag

SEQ ID NO: 842743 - DNA, 25 bp, Mus musculus
ttcttaaagggcgagcccgccggag

SEQ ID NO: 842744 - DNA, 25 bp, Mus musculus
ttcttaagaagcctgtggtagactg

SEQ ID NO: 842745 - DNA, 25 bp, Mus musculus
ttcttaagaagcgtgtggtagactg

SEQ ID NO: 842746 - DNA, 25 bp, Mus musculus
ttcttaagtcccagcattctgctgg

SEQ ID NO: 842747 - DNA, 25 bp, Mus musculus
ttcttaagtccctgcattctgctgg

SEQ ID NO: 842748 - DNA, 25 bp, Mus musculus
ttcttaatgcatcgccagaggatgt

SEQ ID NO: 842749 - DNA, 25 bp, Mus musculus
ttcttaatgcatggccagaggatgt

SEQ ID NO: 842750 - DNA, 25 bp, Mus musculus
ttcttaatggagacaacgaccatcg

SEQ ID NO: 842751 - DNA, 25 bp, Mus musculus
ttcttaatggagtcaacgaccatcg

SEQ ID NO: 842752 - DNA, 25 bp, Mus musculus
ttcttaatggtcaggcacaggggct

SEQ ID NO: 842753 - DNA, 25 bp, Mus musculus
ttcttaatggtctggcacaggggct

SEQ ID NO: 842754 - DNA, 25 bp, Mus musculus
ttcttacaaacaccgactctcattg

SEQ ID NO: 842755 - DNA, 25 bp, Mus musculus
ttcttacaaacagcgactctcattg

SEQ ID NO: 842756 - DNA, 25 bp, Mus musculus
ttcttacagtctcaaagcaacaaga

SEQ ID NO: 842757 - DNA, 25 bp, Mus musculus
ttcttacagtctgaaagcaacaaga

SEQ ID NO: 842758 - DNA, 25 bp, Mus musculus
ttcttaccacacaattgaccagcga

SEQ ID NO: 842759 - DNA, 25 bp, Mus musculus
ttcttaccacactattgaccagcga

SEQ ID NO: 842760 - DNA, 25 bp, Mus musculus
ttcttactacaaaggcacagtttta

SEQ ID NO: 842761 - DNA, 25 bp, Mus musculus
ttcttactacaatggcacagtttta

SEQ ID NO: 842762 - DNA, 25 bp, Mus musculus
ttcttactgagaaaggagccattgg

SEQ ID NO: 842763 - DNA, 25 bp, Mus musculus
ttcttactgagataggagccattgg

SEQ ID NO: 842764 - DNA, 25 bp, Mus musculus
ttcttagattctacgactctgcagc

SEQ ID NO: 842765 - DNA, 25 bp, Mus musculus
ttcttagattcttcgactctgcagc

SEQ ID NO: 842766 - DNA, 25 bp, Mus musculus
ttcttagcccatagccagtgccctg

SEQ ID NO: 842767 - DNA, 25 bp, Mus musculus
ttcttagcccattgccagtgccctg

SEQ ID NO: 842768 - DNA, 25 bp, Mus musculus
ttcttagctcctcgttagaccacca

SEQ ID NO: 842769 - DNA, 25 bp, Mus musculus
ttcttagctcctggttagaccacca

SEQ ID NO: 842770 - DNA, 25 bp, Mus musculus
ttcttaggcttgactccatcgggag

SEQ ID NO: 842771 - DNA, 25 bp, Mus musculus
ttcttaggcttgtctccatcgggag

SEQ ID NO: 842772 - DNA, 25 bp, Mus musculus
ttcttagtagaacgcctggactcgc

SEQ ID NO: 842773 - DNA, 25 bp, Mus musculus
ttcttagtagaaggcctggactcgc

SEQ ID NO: 842774 - DNA, 25 bp, Mus musculus
ttcttagtatgtatccaaatttggg

SEQ ID NO: 842775 - DNA, 25 bp, Mus musculus
ttcttagtatgtttccaaatttggg

SEQ ID NO: 842776 - DNA, 25 bp, Mus musculus
ttcttagtcagacatgcatccagca

SEQ ID NO: 842777 - DNA, 25 bp, Mus musculus
ttcttagtcagagatgcatccagca

SEQ ID NO: 842778 - DNA, 25 bp, Mus musculus
ttcttagtccgtacaagctgagcaa

SEQ ID NO: 842779 - DNA, 25 bp, Mus musculus
ttcttagtccgttcaagctgagcaa

SEQ ID NO: 842780 - DNA, 25 bp, Mus musculus
ttcttatggcagcatctgacccctg

SEQ ID NO: 842781 - DNA, 25 bp, Mus musculus
ttcttatggcaggatctgacccctg

SEQ ID NO: 842782 - DNA, 25 bp, Mus musculus
ttcttcaaaggcaccacgtcgggtg

SEQ ID NO: 842783 - DNA, 25 bp, Mus musculus
ttcttcaaaggctccacgtcgggtg

SEQ ID NO: 842784 - DNA, 25 bp, Mus musculus
ttcttcaaccagaaatgtgaggacc

SEQ ID NO: 842785 - DNA, 25 bp, Mus musculus
ttcttcaaccagtaatgtgaggacc

SEQ ID NO: 842786 - DNA, 25 bp, Mus musculus
ttcttcaaccgcaccacggatgtga

SEQ ID NO: 842787 - DNA, 25 bp, Mus musculus
ttcttcaaccgctccacggatgtga

SEQ ID NO: 842788 - DNA, 25 bp, Mus musculus
ttcttcaatggaaggctccatccct

SEQ ID NO: 842789 - DNA, 25 bp, Mus musculus
ttcttcaatggatggctccatccct

SEQ ID NO: 842790 - DNA, 25 bp, Mus musculus
ttcttcacacagcacgccgctgtga

SEQ ID NO: 842791 - DNA, 25 bp, Mus musculus
ttcttcacacaggacgccgctgtga

SEQ ID NO: 842792 - DNA, 25 bp, Mus musculus
ttcttcacacatccacgcttctatg

SEQ ID NO: 842793 - DNA, 25 bp, Mus musculus
ttcttcacacatgcacgcttctatg

SEQ ID NO: 842794 - DNA, 25 bp, Mus musculus
ttcttcacatgtcttggccgtgatg

SEQ ID NO: 842795 - DNA, 25 bp, Mus musculus
ttcttcacatgtgttggccgtgatg

SEQ ID NO: 842796 - DNA, 25 bp, Mus musculus
ttcttcaccatcatggcttctgtga

SEQ ID NO: 842797 - DNA, 25 bp, Mus musculus
ttcttcaccatcttggcttctgtga

SEQ ID NO: 842798 - DNA, 25 bp, Mus musculus
ttcttcaccttcatggctcagctgg

SEQ ID NO: 842799 - DNA, 25 bp, Mus musculus
ttcttcaccttcttggctcagctgg

SEQ ID NO: 842800 - DNA, 25 bp, Mus musculus
ttcttcactgatcggacacttcggg

SEQ ID NO: 842801 - DNA, 25 bp, Mus musculus
ttcttcactgatgggacacttcggg

SEQ ID NO: 842802 - DNA, 25 bp, Mus musculus
ttcttcagcaagagaccccaggaga

SEQ ID NO: 842803 - DNA, 25 bp, Mus musculus
ttcttcagcaagtgaccccaggaga

SEQ ID NO: 842804 - DNA, 25 bp, Mus musculus
ttcttcaggctgacaagcacgggag

SEQ ID NO: 842805 - DNA, 25 bp, Mus musculus
ttcttcaggctgtcaagcacgggag

SEQ ID NO: 842806 - DNA, 25 bp, Mus musculus
ttcttcagtgctcagcaatccaact

SEQ ID NO: 842807 - DNA, 25 bp, Mus musculus
ttcttcagtgctgagcaatccaact

SEQ ID NO: 842808 - DNA, 25 bp, Mus musculus
ttcttcatccaaccatgtcgtggag

SEQ ID NO: 842809 - DNA, 25 bp, Mus musculus
ttcttcatccaagcatgtcgtggag

SEQ ID NO: 842810 - DNA, 25 bp, Mus musculus
ttcttcatcctactggctgtccgtc

SEQ ID NO: 842811 - DNA, 25 bp, Mus musculus
ttcttcatcctagtggctgtccgtc

SEQ ID NO: 842812 - DNA, 25 bp, Mus musculus
ttcttcatcttcctgctctggaagc

SEQ ID NO: 842813 - DNA, 25 bp, Mus musculus
ttcttcatcttcgtgctctggaagc

SEQ ID NO: 842814 - DNA, 25 bp, Mus musculus
ttcttcatctttcgagcccagtttg

SEQ ID NO: 842815 - DNA, 25 bp, Mus musculus
ttcttcatctttggagcccagtttg

SEQ ID NO: 842816 - DNA, 25 bp, Mus musculus
ttcttcatgttgctaacactgggta

SEQ ID NO: 842817 - DNA, 25 bp, Mus musculus
ttcttcatgttggtaacactgggta

SEQ ID NO: 842818 - DNA, 25 bp, Mus musculus
ttcttccaaatgctttggtgggaag

SEQ ID NO: 842819 - DNA, 25 bp, Mus musculus
ttcttccaaatggtttggtgggaag

SEQ ID NO: 842820 - DNA, 25 bp, Mus musculus
ttcttccagaacactaccttcagct

SEQ ID NO: 842821 - DNA, 25 bp, Mus musculus
ttcttccagaactctaccttcagct

SEQ ID NO: 842822 - DNA, 25 bp, Mus musculus
ttcttccagcagaacgaactggacc

SEQ ID NO: 842823 - DNA, 25 bp, Mus musculus
ttcttccagcagtacgaactggacc

SEQ ID NO: 842824 - DNA, 25 bp, Mus musculus
ttcttccagcatcttgaaatgcacc

SEQ ID NO: 842825 - DNA, 25 bp, Mus musculus
ttcttccagcatgttgaaatgcacc

SEQ ID NO: 842826 - DNA, 25 bp, Mus musculus
ttcttccagcccacacagtggcatg

SEQ ID NO: 842827 - DNA, 25 bp, Mus musculus
ttcttccagccctcacagtggcatg

SEQ ID NO: 842828 - DNA, 25 bp, Mus musculus
ttcttccagctcaggtacaaccagg

SEQ ID NO: 842829 - DNA, 25 bp, Mus musculus
ttcttccagctctggtacaaccagg

SEQ ID NO: 842830 - DNA, 25 bp, Mus musculus
ttcttcccaggaccagttacggctg

SEQ ID NO: 842831 - DNA, 25 bp, Mus musculus
ttcttcccaggagcagttacggctg

SEQ ID NO: 842832 - DNA, 25 bp, Mus musculus
ttcttcccgctgatggcctcttcat

SEQ ID NO: 842833 - DNA, 25 bp, Mus musculus
ttcttcccgctgttggcctcttcat

SEQ ID NO: 842834 - DNA, 25 bp, Mus musculus
ttcttcccggatcaccctagcttaa

SEQ ID NO: 842835 - DNA, 25 bp, Mus musculus
ttcttcccggatgaccctagcttaa

SEQ ID NO: 842836 - DNA, 25 bp, Mus musculus
ttcttccctggccagttagaagctg

SEQ ID NO: 842837 - DNA, 25 bp, Mus musculus
ttcttccctggcgagttagaagctg

SEQ ID NO: 842838 - DNA, 25 bp, Mus musculus
ttcttccgccctcacaatgaggaag

SEQ ID NO: 842839 - DNA, 25 bp, Mus musculus
ttcttccgccctgacaatgaggaag

SEQ ID NO: 842840 - DNA, 25 bp, Mus musculus
ttcttcctcagtataaaaaagcttg

SEQ ID NO: 842841 - DNA, 25 bp, Mus musculus
ttcttcctcagtttaaaaaagcttg

SEQ ID NO: 842842 - DNA, 25 bp, Mus musculus
ttcttcctcggcagttctgcgcttg

SEQ ID NO: 842843 - DNA, 25 bp, Mus musculus
ttcttcctcggctgttctgcgcttg

SEQ ID NO: 842844 - DNA, 25 bp, Mus musculus
ttcttcctgggcacggtcacgtggt

SEQ ID NO: 842845 - DNA, 25 bp, Mus musculus
ttcttcctgggctcggtcacgtggt

SEQ ID NO: 842846 - DNA, 25 bp, Mus musculus
ttcttcgaacgccagctcagaagct

SEQ ID NO: 842847 - DNA, 25 bp, Mus musculus
ttcttcgaacgcgagctcagaagct

SEQ ID NO: 842848 - DNA, 25 bp, Mus musculus
ttcttcgagagccacatcgccagag

SEQ ID NO: 842849 - DNA, 25 bp, Mus musculus
ttcttcgagagcgacatcgccagag

SEQ ID NO: 842850 - DNA, 25 bp, Mus musculus
ttcttcgagtttcgctttgtgatcc

SEQ ID NO: 842851 - DNA, 25 bp, Mus musculus
ttcttcgagtttggctttgtgatcc

SEQ ID NO: 842852 - DNA, 25 bp, Mus musculus
ttcttcgcaggcagtgttctgccca

SEQ ID NO: 842853 - DNA, 25 bp, Mus musculus
ttcttcgcaggctgtgttctgccca

SEQ ID NO: 842854 - DNA, 25 bp, Mus musculus
ttcttcgccagacatgaacttaaag

SEQ ID NO: 842855 - DNA, 25 bp, Mus musculus
ttcttcgccagagatgaacttaaag

SEQ ID NO: 842856 - DNA, 25 bp, Mus musculus
ttcttcgctgaccagcctatccaga

SEQ ID NO: 842857 - DNA, 25 bp, Mus musculus
ttcttcgctgacgagcctatccaga

SEQ ID NO: 842858 - DNA, 25 bp, Mus musculus
ttcttcggtgcgagggcgagtgctg

SEQ ID NO: 842859 - DNA, 25 bp, Mus musculus
ttcttcggtgcgtgggcgagtgctg

SEQ ID NO: 842860 - DNA, 25 bp, Mus musculus
ttcttcgtgatgagtgattacagag

SEQ ID NO: 842861 - DNA, 25 bp, Mus musculus
ttcttcgtgatgtgtgattacagag

SEQ ID NO: 842862 - DNA, 25 bp, Mus musculus
ttcttcgtggagcagctagccaacg

SEQ ID NO: 842863 - DNA, 25 bp, Mus musculus
ttcttcgtggaggagctagccaacg

SEQ ID NO: 842864 - DNA, 25 bp, Mus musculus
ttcttcgtgtctcccaaggaggttc

SEQ ID NO: 842865 - DNA, 25 bp, Mus musculus
ttcttcgtgtctgccaaggaggttc

SEQ ID NO: 842866 - DNA, 25 bp, Mus musculus
ttcttcgtgtgtcctacagggcgcc

SEQ ID NO: 842867 - DNA, 25 bp, Mus musculus
ttcttcgtgtgtgctacagggcgcc

SEQ ID NO: 842868 - DNA, 25 bp, Mus musculus
ttcttctacccgctcatgctgatgc

SEQ ID NO: 842869 - DNA, 25 bp, Mus musculus
ttcttctacccggtcatgctgatgc

SEQ ID NO: 842870 - DNA, 25 bp, Mus musculus
ttcttctatgaacggtcgagatggg

SEQ ID NO: 842871 - DNA, 25 bp, Mus musculus
ttcttctatgaagggtcgagatggg

SEQ ID NO: 842872 - DNA, 25 bp, Mus musculus
ttcttctcagcgcaggagtcgcgct

SEQ ID NO: 842873 - DNA, 25 bp, Mus musculus
ttcttctcagcggaggagtcgcgct

SEQ ID NO: 842874 - DNA, 25 bp, Mus musculus
ttcttctcaggcagatggatgtctg

SEQ ID NO: 842875 - DNA, 25 bp, Mus musculus
ttcttctcaggctgatggatgtctg

SEQ ID NO: 842876 - DNA, 25 bp, Mus musculus
ttcttctccaatacaacagacgtcg

SEQ ID NO: 842877 - DNA, 25 bp, Mus musculus
ttcttctccaattcaacagacgtcg

SEQ ID NO: 842878 - DNA, 25 bp, Mus musculus
ttcttctccagccatgagtcattcg

SEQ ID NO: 842879 - DNA, 25 bp, Mus musculus
ttcttctccagcgatgagtcattcg

SEQ ID NO: 842880 - DNA, 25 bp, Mus musculus
ttcttctctacccacagatgtcatc

SEQ ID NO: 842881 - DNA, 25 bp, Mus musculus
ttcttctctaccgacagatgtcatc

SEQ ID NO: 842882 - DNA, 25 bp, Mus musculus
ttcttctctggcattgggtcctttg

SEQ ID NO: 842883 - DNA, 25 bp, Mus musculus
ttcttctctggctttgggtcctttg

SEQ ID NO: 842884 - DNA, 25 bp, Mus musculus
ttcttctgggttcggattagagcgt

SEQ ID NO: 842885 - DNA, 25 bp, Mus musculus
ttcttctgggttgggattagagcgt

SEQ ID NO: 842886 - DNA, 25 bp, Mus musculus
ttcttcttcatacaacagtgctgtg

SEQ ID NO: 842887 - DNA, 25 bp, Mus musculus
ttcttcttcatagaacagtgctgtg

SEQ ID NO: 842888 - DNA, 25 bp, Mus musculus
ttcttcttccgcacagcgggtttcc

SEQ ID NO: 842889 - DNA, 25 bp, Mus musculus
ttcttcttccgctcagcgggtttcc

SEQ ID NO: 842890 - DNA, 25 bp, Mus musculus
ttcttcttggcaccgagaggtcccg

SEQ ID NO: 842891 - DNA, 25 bp, Mus musculus
ttcttcttggcagcgagaggtcccg

SEQ ID NO: 842892 - DNA, 25 bp, Mus musculus
ttcttgaacaagcattataagcaag

SEQ ID NO: 842893 - DNA, 25 bp, Mus musculus
ttcttgaacaaggattataagcaag

SEQ ID NO: 842894 - DNA, 25 bp, Mus musculus
ttcttgaacatcatcccattgagaa

SEQ ID NO: 842895 - DNA, 25 bp, Mus musculus
ttcttgaacatcttcccattgagaa

SEQ ID NO: 842896 - DNA, 25 bp, Mus musculus
ttcttgaaccggcaatatgagtcct

SEQ ID NO: 842897 - DNA, 25 bp, Mus musculus
ttcttgaaccgggaatatgagtcct

SEQ ID NO: 842898 - DNA, 25 bp, Mus musculus
ttcttgaagcccctgctgattggtg

SEQ ID NO: 842899 - DNA, 25 bp, Mus musculus
ttcttgaagcccgtgctgattggtg

SEQ ID NO: 842900 - DNA, 25 bp, Mus musculus
ttcttgaccaaaatgtggcacccca

SEQ ID NO: 842901 - DNA, 25 bp, Mus musculus
ttcttgaccaaattgtggcacccca

SEQ ID NO: 842902 - DNA, 25 bp, Mus musculus
ttcttgaccatgatggccagaaaga

SEQ ID NO: 842903 - DNA, 25 bp, Mus musculus
ttcttgaccatgttggccagaaaga

SEQ ID NO: 842904 - DNA, 25 bp, Mus musculus
ttcttgacctatcggcggctgcagc

SEQ ID NO: 842905 - DNA, 25 bp, Mus musculus
ttcttgacctatgggcggctgcagc

SEQ ID NO: 842906 - DNA, 25 bp, Mus musculus
ttcttgcaaaggacagcccagctca

SEQ ID NO: 842907 - DNA, 25 bp, Mus musculus
ttcttgcaaaggtcagcccagctca

SEQ ID NO: 842908 - DNA, 25 bp, Mus musculus
ttcttgcagagacgtcacttgggcc

SEQ ID NO: 842909 - DNA, 25 bp, Mus musculus
ttcttgcagagaggtcacttgggcc

SEQ ID NO: 842910 - DNA, 25 bp, Mus musculus
ttcttgcagatacagcgctaggaaa

SEQ ID NO: 842911 - DNA, 25 bp, Mus musculus
ttcttgcagatagagcgctaggaaa

SEQ ID NO: 842912 - DNA, 25 bp, Mus musculus
ttcttgccacagcagttcaggaaga

SEQ ID NO: 842913 - DNA, 25 bp, Mus musculus
ttcttgccacaggagttcaggaaga

SEQ ID NO: 842914 - DNA, 25 bp, Mus musculus
ttcttgccacctcgcaagcgtggag

SEQ ID NO: 842915 - DNA, 25 bp, Mus musculus
ttcttgccacctggcaagcgtggag

SEQ ID NO: 842916 - DNA, 25 bp, Mus musculus
ttcttgccgatcatctaccgcctgg

SEQ ID NO: 842917 - DNA, 25 bp, Mus musculus
ttcttgccgatcttctaccgcctgg

SEQ ID NO: 842918 - DNA, 25 bp, Mus musculus
ttcttgcgcacgcatcagctggatg

SEQ ID NO: 842919 - DNA, 25 bp, Mus musculus
ttcttgcgcacggatcagctggatg

SEQ ID NO: 842920 - DNA, 25 bp, Mus musculus
ttcttgcggttacggtgaagacacc

SEQ ID NO: 842921 - DNA, 25 bp, Mus musculus
ttcttgcggttagggtgaagacacc

SEQ ID NO: 842922 - DNA, 25 bp, Mus musculus
ttcttgctaaacagcaatgccatgg

SEQ ID NO: 842923 - DNA, 25 bp, Mus musculus
ttcttgctaaactgcaatgccatgg

SEQ ID NO: 842924 - DNA, 25 bp, Mus musculus
ttcttgctgcggacggtggcaccac

SEQ ID NO: 842925 - DNA, 25 bp, Mus musculus
ttcttgctgcggtcggtggcaccac

SEQ ID NO: 842926 - DNA, 25 bp, Mus musculus
ttcttgcttggacctcagacaacaa

SEQ ID NO: 842927 - DNA, 25 bp, Mus musculus
ttcttgcttggagctcagacaacaa

SEQ ID NO: 842928 - DNA, 25 bp, Mus musculus
ttcttgcttgttcggacccaaattg

SEQ ID NO: 842929 - DNA, 25 bp, Mus musculus
ttcttgcttgttgggacccaaattg

SEQ ID NO: 842930 - DNA, 25 bp, Mus musculus
ttcttggaatgccaggaaacacggg

SEQ ID NO: 842931 - DNA, 25 bp, Mus musculus
ttcttggaatgcgaggaaacacggg

SEQ ID NO: 842932 - DNA, 25 bp, Mus musculus
ttcttggaatgtcggctgcctgcat

SEQ ID NO: 842933 - DNA, 25 bp, Mus musculus
ttcttggaatgtgggctgcctgcat

SEQ ID NO: 842934 - DNA, 25 bp, Mus musculus
ttcttggacagcagagaaatccatt

SEQ ID NO: 842935 - DNA, 25 bp, Mus musculus
ttcttggacagctgagaaatccatt

SEQ ID NO: 842936 - DNA, 25 bp, Mus musculus
ttcttggatgataagttctctcgga

SEQ ID NO: 842937 - DNA, 25 bp, Mus musculus
ttcttggatgattagttctctcgga

SEQ ID NO: 842938 - DNA, 25 bp, Mus musculus
ttcttggatggcagcgccagttaca

SEQ ID NO: 842939 - DNA, 25 bp, Mus musculus
ttcttggatggctgcgccagttaca

SEQ ID NO: 842940 - DNA, 25 bp, Mus musculus
ttcttggcagcgagaggtcccgcag

SEQ ID NO: 842941 - DNA, 25 bp, Mus musculus
ttcttggcagcgtgaggtcccgcag

SEQ ID NO: 842942 - DNA, 25 bp, Mus musculus
ttcttggcagtcagcagtctgcgga

SEQ ID NO: 842943 - DNA, 25 bp, Mus musculus
ttcttggcagtctgcagtctgcgga

SEQ ID NO: 842944 - DNA, 25 bp, Mus musculus
ttcttgggcaccactccaaccttgt

SEQ ID NO: 842945 - DNA, 25 bp, Mus musculus
ttcttgggcacctctccaaccttgt

SEQ ID NO: 842946 - DNA, 25 bp, Mus musculus
ttcttgggtacaaaaaaggccagca

SEQ ID NO: 842947 - DNA, 25 bp, Mus musculus
ttcttgggtacataaaaggccagca

SEQ ID NO: 842948 - DNA, 25 bp, Mus musculus
ttcttggtataacccaggctgagaa

SEQ ID NO: 842949 - DNA, 25 bp, Mus musculus
ttcttggtataagccaggctgagaa

SEQ ID NO: 842950 - DNA, 25 bp, Mus musculus
ttcttggtgaacagagtgcaggacc

SEQ ID NO: 842951 - DNA, 25 bp, Mus musculus
ttcttggtgaactgagtgcaggacc

SEQ ID NO: 842952 - DNA, 25 bp, Mus musculus
ttcttggtgctgagatgtgatgtga

SEQ ID NO: 842953 - DNA, 25 bp, Mus musculus
ttcttggtgctgtgatgtgatgtga

SEQ ID NO: 842954 - DNA, 25 bp, Mus musculus
ttcttggtggtaacgaagaagagag

SEQ ID NO: 842955 - DNA, 25 bp, Mus musculus
ttcttggtggtatcgaagaagagag

SEQ ID NO: 842956 - DNA, 25 bp, Mus musculus
ttcttgtagaaaatcttatgaggcc

SEQ ID NO: 842957 - DNA, 25 bp, Mus musculus
ttcttgtagaaattcttatgaggcc

SEQ ID NO: 842958 - DNA, 25 bp, Mus musculus
ttcttgtatctcagcctaggacacc

SEQ ID NO: 842959 - DNA, 25 bp, Mus musculus
ttcttgtatctctgcctaggacacc

SEQ ID NO: 842960 - DNA, 25 bp, Mus musculus
ttcttgtcatggagagcctcctgcc

SEQ ID NO: 842961 - DNA, 25 bp, Mus musculus
ttcttgtcatggtgagcctcctgcc

SEQ ID NO: 842962 - DNA, 25 bp, Mus musculus
ttcttgtcccgtccctaggtccttg

SEQ ID NO: 842963 - DNA, 25 bp, Mus musculus
ttcttgtcccgtgcctaggtccttg

SEQ ID NO: 842964 - DNA, 25 bp, Mus musculus
ttcttgtctcagagagcagtagaga

SEQ ID NO: 842965 - DNA, 25 bp, Mus musculus
ttcttgtctcagtgagcagtagaga

SEQ ID NO: 842966 - DNA, 25 bp, Mus musculus
ttcttgtctctcacaggacactggg

SEQ ID NO: 842967 - DNA, 25 bp, Mus musculus
ttcttgtctctctcaggacactggg

SEQ ID NO: 842968 - DNA, 25 bp, Mus musculus
ttcttgtgttacagaaaaaggcgcc

SEQ ID NO: 842969 - DNA, 25 bp, Mus musculus
ttcttgtgttactgaaaaaggcgcc

SEQ ID NO: 842970 - DNA, 25 bp, Mus musculus
ttcttgttgtcacaggccaaagctg

SEQ ID NO: 842971 - DNA, 25 bp, Mus musculus
ttcttgttgtcagaggccaaagctg

SEQ ID NO: 842972 - DNA, 25 bp, Mus musculus
ttcttgtttgatcgcttgacaaatg

SEQ ID NO: 842973 - DNA, 25 bp, Mus musculus
ttcttgtttgatggcttgacaaatg

SEQ ID NO: 842974 - DNA, 25 bp, Mus musculus
ttctttaagattaccatgtgagggc

SEQ ID NO: 842975 - DNA, 25 bp, Mus musculus
ttctttaagatttccatgtgagggc

SEQ ID NO: 842976 - DNA, 25 bp, Mus musculus
ttctttaagccgctctcgccaaagg

SEQ ID NO: 842977 - DNA, 25 bp, Mus musculus
ttctttaagccggtctcgccaaagg

SEQ ID NO: 842978 - DNA, 25 bp, Mus musculus
ttctttagatccaaagtgcgagtag

SEQ ID NO: 842979 - DNA, 25 bp, Mus musculus
ttctttagatcctaagtgcgagtag

SEQ ID NO: 842980 - DNA, 25 bp, Mus musculus
ttctttatccggagcaccttggcca

SEQ ID NO: 842981 - DNA, 25 bp, Mus musculus
ttctttatccggtgcaccttggcca

SEQ ID NO: 842982 - DNA, 25 bp, Mus musculus
ttctttatctctatagcattcggag

SEQ ID NO: 842983 - DNA, 25 bp, Mus musculus
ttctttatctctttagcattcggag

SEQ ID NO: 842984 - DNA, 25 bp, Mus musculus
ttctttatctgacccacactcgatg

SEQ ID NO: 842985 - DNA, 25 bp, Mus musculus
ttctttatctgagccacactcgatg

SEQ ID NO: 842986 - DNA, 25 bp, Mus musculus
ttctttcccaatccgtcggatgcga

SEQ ID NO: 842987 - DNA, 25 bp, Mus musculus
ttctttcccaatgcgtcggatgcga

SEQ ID NO: 842988 - DNA, 25 bp, Mus musculus
ttctttcccttgactccgctggaca

SEQ ID NO: 842989 - DNA, 25 bp, Mus musculus
ttctttcccttgtctccgctggaca

SEQ ID NO: 842990 - DNA, 25 bp, Mus musculus
ttctttcctagaacgctcctgccgg

SEQ ID NO: 842991 - DNA, 25 bp, Mus musculus
ttctttcctagatcgctcctgccgg

SEQ ID NO: 842992 - DNA, 25 bp, Mus musculus
ttctttccttcacgctcggtcgcgg

SEQ ID NO: 842993 - DNA, 25 bp, Mus musculus
ttctttccttcaggctcggtcgcgg

SEQ ID NO: 842994 - DNA, 25 bp, Mus musculus
ttctttcggaaaacatggagtttgc

SEQ ID NO: 842995 - DNA, 25 bp, Mus musculus
ttctttcggaaatcatggagtttgc

SEQ ID NO: 842996 - DNA, 25 bp, Mus musculus
ttctttcggcgaactattcggctga

SEQ ID NO: 842997 - DNA, 25 bp, Mus musculus
ttctttcggcgatctattcggctga

SEQ ID NO: 842998 - DNA, 25 bp, Mus musculus
ttctttctagaacaatgagatgctc

SEQ ID NO: 842999 - DNA, 25 bp, Mus musculus
ttctttctagaagaatgagatgctc

SEQ ID NO: 843000 - DNA, 25 bp, Mus musculus
ttctttctgcccagctggtgtgcca

SEQ ID NO: 843001 - DNA, 25 bp, Mus musculus
ttctttctgccctgctggtgtgcca

SEQ ID NO: 843002 - DNA, 25 bp, Mus musculus
ttctttctggcccaaacggagcagg

SEQ ID NO: 843003 - DNA, 25 bp, Mus musculus
ttctttctggccgaaacggagcagg

SEQ ID NO: 843004 - DNA, 25 bp, Mus musculus
ttctttctttagcacaagtgacgca

SEQ ID NO: 843005 - DNA, 25 bp, Mus musculus
ttctttctttaggacaagtgacgca

SEQ ID NO: 843006 - DNA, 25 bp, Mus musculus
ttctttgaatccagaagctggcaaa

SEQ ID NO: 843007 - DNA, 25 bp, Mus musculus
ttctttgaatcctgaagctggcaaa

SEQ ID NO: 843008 - DNA, 25 bp, Mus musculus
ttctttgatgccctggaccatgtca

SEQ ID NO: 843009 - DNA, 25 bp, Mus musculus
ttctttgatgccgtggaccatgtca

SEQ ID NO: 843010 - DNA, 25 bp, Mus musculus
ttctttgcagacacagcaacagcat

SEQ ID NO: 843011 - DNA, 25 bp, Mus musculus
ttctttgcagactcagcaacagcat

SEQ ID NO: 843012 - DNA, 25 bp, Mus musculus
ttctttgccaaactgaactgccgac

SEQ ID NO: 843013 - DNA, 25 bp, Mus musculus
ttctttgccaaagtgaactgccgac

SEQ ID NO: 843014 - DNA, 25 bp, Mus musculus
ttctttggcaccaccgagccaggca

SEQ ID NO: 843015 - DNA, 25 bp, Mus musculus
ttctttggcacctccgagccaggca

SEQ ID NO: 843016 - DNA, 25 bp, Mus musculus
ttctttggctttacccactggtcaa

SEQ ID NO: 843017 - DNA, 25 bp, Mus musculus
ttctttggcttttcccactggtcaa

SEQ ID NO: 843018 - DNA, 25 bp, Mus musculus
ttctttgtatccaggccttagtgat

SEQ ID NO: 843019 - DNA, 25 bp, Mus musculus
ttctttgtatcctggccttagtgat

SEQ ID NO: 843020 - DNA, 25 bp, Mus musculus
ttctttgtcttcaacatgctgctgc

SEQ ID NO: 843021 - DNA, 25 bp, Mus musculus
ttctttgtcttctacatgctgctgc

SEQ ID NO: 843022 - DNA, 25 bp, Mus musculus
ttcttttaaaacaagatgccgtcgg

SEQ ID NO: 843023 - DNA, 25 bp, Mus musculus
ttcttttaaaactagatgccgtcgg

SEQ ID NO: 843024 - DNA, 25 bp, Mus musculus
ttcttttaaccaagtcactcgagcc

SEQ ID NO: 843025 - DNA, 25 bp, Mus musculus
ttcttttaaccatgtcactcgagcc

SEQ ID NO: 843026 - DNA, 25 bp, Mus musculus
ttcttttcagaactgaagcctgctg

SEQ ID NO: 843027 - DNA, 25 bp, Mus musculus
ttcttttcagaagtgaagcctgctg

SEQ ID NO: 843028 - DNA, 25 bp, Mus musculus
ttcttttgaagaaaaaccatggcgg

SEQ ID NO: 843029 - DNA, 25 bp, Mus musculus
ttcttttgaagataaaccatggcgg

SEQ ID NO: 843030 - DNA, 25 bp, Mus musculus
ttcttttgaatgcagatgccatctc

SEQ ID NO: 843031 - DNA, 25 bp, Mus musculus
ttcttttgaatggagatgccatctc

SEQ ID NO: 843032 - DNA, 25 bp, Mus musculus
ttcttttggagcaacgacccgcctt

SEQ ID NO: 843033 - DNA, 25 bp, Mus musculus
ttcttttggagctacgacccgcctt

SEQ ID NO: 843034 - DNA, 25 bp, Mus musculus
ttctttttagatccgagggaggcca

SEQ ID NO: 843035 - DNA, 25 bp, Mus musculus
ttctttttagatgcgagggaggcca

SEQ ID NO: 843036 - DNA, 25 bp, Mus musculus
ttgaaaaaaccaataatcagcaaag

SEQ ID NO: 843037 - DNA, 25 bp, Mus musculus
ttgaaaaaaccattaatcagcaaag

SEQ ID NO: 843038 - DNA, 25 bp, Mus musculus
ttgaaaaaatgaatgggatgcttct

SEQ ID NO: 843039 - DNA, 25 bp, Mus musculus
ttgaaaaaatgattgggatgcttct

SEQ ID NO: 843040 - DNA, 25 bp, Mus musculus
ttgaaaaaatggctcaaggagctga

SEQ ID NO: 843041 - DNA, 25 bp, Mus musculus
ttgaaaaaatgggtcaaggagctga

SEQ ID NO: 843042 - DNA, 25 bp, Mus musculus
ttgaaaaagagtctactgaccacca

SEQ ID NO: 843043 - DNA, 25 bp, Mus musculus
ttgaaaaagagtgtactgaccacca

SEQ ID NO: 843044 - DNA, 25 bp, Mus musculus
ttgaaaaccgacagaagaagctgga

SEQ ID NO: 843045 - DNA, 25 bp, Mus musculus
ttgaaaaccgactgaagaagctgga

SEQ ID NO: 843046 - DNA, 25 bp, Mus musculus
ttgaaaacgaggctcactgcgactt

SEQ ID NO: 843047 - DNA, 25 bp, Mus musculus
ttgaaaacgagggtcactgcgactt

SEQ ID NO: 843048 - DNA, 25 bp, Mus musculus
ttgaaaacggtgacgaacaacttga

SEQ ID NO: 843049 - DNA, 25 bp, Mus musculus
ttgaaaacggtgtcgaacaacttga

SEQ ID NO: 843050 - DNA, 25 bp, Mus musculus
ttgaaaactcttcgttatgggaaga

SEQ ID NO: 843051 - DNA, 25 bp, Mus musculus
ttgaaaactcttggttatgggaaga

SEQ ID NO: 843052 - DNA, 25 bp, Mus musculus
ttgaaaagcagaacagagccacgag

SEQ ID NO: 843053 - DNA, 25 bp, Mus musculus
ttgaaaagcagatcagagccacgag

SEQ ID NO: 843054 - DNA, 25 bp, Mus musculus
ttgaaaagcccacgctgataataaa

SEQ ID NO: 843055 - DNA, 25 bp, Mus musculus
ttgaaaagcccaggctgataataaa

SEQ ID NO: 843056 - DNA, 25 bp, Mus musculus
ttgaaaaggagaaagcagaaattga

SEQ ID NO: 843057 - DNA, 25 bp, Mus musculus
ttgaaaaggagatagcagaaattga

SEQ ID NO: 843058 - DNA, 25 bp, Mus musculus
ttgaaaatcgctcggcgaattgcag

SEQ ID NO: 843059 - DNA, 25 bp, Mus musculus
ttgaaaatcgctgggcgaattgcag

SEQ ID NO: 843060 - DNA, 25 bp, Mus musculus
ttgaaaatgaacatgtagaactgca

SEQ ID NO: 843061 - DNA, 25 bp, Mus musculus
ttgaaaatgaacttgtagaactgca

SEQ ID NO: 843062 - DNA, 25 bp, Mus musculus
ttgaaaatgaagacaacggtcgtgc

SEQ ID NO: 843063 - DNA, 25 bp, Mus musculus
ttgaaaatgaagtcaacggtcgtgc

SEQ ID NO: 843064 - DNA, 25 bp, Mus musculus
ttgaaaatggctccctcagtgacat

SEQ ID NO: 843065 - DNA, 25 bp, Mus musculus
ttgaaaatggctgcctcagtgacat

SEQ ID NO: 843066 - DNA, 25 bp, Mus musculus
ttgaaacaccccataaagaaatagg

SEQ ID NO: 843067 - DNA, 25 bp, Mus musculus
ttgaaacaccccttaaagaaatagg

SEQ ID NO: 843068 - DNA, 25 bp, Mus musculus
ttgaaacagtggacacaggatccct

SEQ ID NO: 843069 - DNA, 25 bp, Mus musculus
ttgaaacagtggtcacaggatccct

SEQ ID NO: 843070 - DNA, 25 bp, Mus musculus
ttgaaaccaatgcacccatagactc

SEQ ID NO: 843071 - DNA, 25 bp, Mus musculus
ttgaaaccaatggacccatagactc

SEQ ID NO: 843072 - DNA, 25 bp, Mus musculus
ttgaaaccgttgctgtaaccaagag

SEQ ID NO: 843073 - DNA, 25 bp, Mus musculus
ttgaaaccgttggtgtaaccaagag

SEQ ID NO: 843074 - DNA, 25 bp, Mus musculus
ttgaaacgcttgaaggaggaggcta

SEQ ID NO: 843075 - DNA, 25 bp, Mus musculus
ttgaaacgcttgtaggaggaggcta

SEQ ID NO: 843076 - DNA, 25 bp, Mus musculus
ttgaaacttcacctagttccgtggc

SEQ ID NO: 843077 - DNA, 25 bp, Mus musculus
ttgaaacttcacgtagttccgtggc

SEQ ID NO: 843078 - DNA, 25 bp, Mus musculus
ttgaaagaagcaaatgagatcttgc

SEQ ID NO: 843079 - DNA, 25 bp, Mus musculus
ttgaaagaagcatatgagatcttgc

SEQ ID NO: 843080 - DNA, 25 bp, Mus musculus
ttgaaagactcgctgctggacaacc

SEQ ID NO: 843081 - DNA, 25 bp, Mus musculus
ttgaaagactcggtgctggacaacc

SEQ ID NO: 843082 - DNA, 25 bp, Mus musculus
ttgaaagactggaggaaatcctgtg

SEQ ID NO: 843083 - DNA, 25 bp, Mus musculus
ttgaaagactggtggaaatcctgtg

SEQ ID NO: 843084 - DNA, 25 bp, Mus musculus
ttgaaagagactcactcttggctaa

SEQ ID NO: 843085 - DNA, 25 bp, Mus musculus
ttgaaagagactgactcttggctaa

SEQ ID NO: 843086 - DNA, 25 bp, Mus musculus
ttgaaagggattaggccaggaccga

SEQ ID NO: 843087 - DNA, 25 bp, Mus musculus
ttgaaagggatttggccaggaccga

SEQ ID NO: 843088 - DNA, 25 bp, Mus musculus
ttgaaagggcaaaagcggcagtaga

SEQ ID NO: 843089 - DNA, 25 bp, Mus musculus
ttgaaagggcaatagcggcagtaga

SEQ ID NO: 843090 - DNA, 25 bp, Mus musculus
ttgaaagtgactacctggctgtgct

SEQ ID NO: 843091 - DNA, 25 bp, Mus musculus
ttgaaagtgacttcctggctgtgct

SEQ ID NO: 843092 - DNA, 25 bp, Mus musculus
ttgaaatacaacagctagagaattc

SEQ ID NO: 843093 - DNA, 25 bp, Mus musculus
ttgaaatacaactgctagagaattc

SEQ ID NO: 843094 - DNA, 25 bp, Mus musculus
ttgaaatagactagaactcagcctg

SEQ ID NO: 843095 - DNA, 25 bp, Mus musculus
ttgaaatagacttgaactcagcctg

SEQ ID NO: 843096 - DNA, 25 bp, Mus musculus
ttgaaatcgtgacgacatctcggac

SEQ ID NO: 843097 - DNA, 25 bp, Mus musculus
ttgaaatcgtgaggacatctcggac

SEQ ID NO: 843098 - DNA, 25 bp, Mus musculus
ttgaaatctgtgctcccaggtggag

SEQ ID NO: 843099 - DNA, 25 bp, Mus musculus
ttgaaatctgtggtcccaggtggag

SEQ ID NO: 843100 - DNA, 25 bp, Mus musculus
ttgaaatgagtaccacaggctgggt

SEQ ID NO: 843101 - DNA, 25 bp, Mus musculus
ttgaaatgagtagcacaggctgggt

SEQ ID NO: 843102 - DNA, 25 bp, Mus musculus
ttgaaatgcaccagcggtctgagca

SEQ ID NO: 843103 - DNA, 25 bp, Mus musculus
ttgaaatgcacctgcggtctgagca

SEQ ID NO: 843104 - DNA, 25 bp, Mus musculus
ttgaaatgctggacatgaaatatcc

SEQ ID NO: 843105 - DNA, 25 bp, Mus musculus
ttgaaatgctggtcatgaaatatcc

SEQ ID NO: 843106 - DNA, 25 bp, Mus musculus
ttgaaatggaaacggtccttgtcgg

SEQ ID NO: 843107 - DNA, 25 bp, Mus musculus
ttgaaatggaaagggtccttgtcgg

SEQ ID NO: 843108 - DNA, 25 bp, Mus musculus
ttgaaatggctacggttctctgtaa

SEQ ID NO: 843109 - DNA, 25 bp, Mus musculus
ttgaaatggctagggttctctgtaa

SEQ ID NO: 843110 - DNA, 25 bp, Mus musculus
ttgaaatgggccacgtgagagcacg

SEQ ID NO: 843111 - DNA, 25 bp, Mus musculus
ttgaaatgggcctcgtgagagcacg

SEQ ID NO: 843112 - DNA, 25 bp, Mus musculus
ttgaaatgttttaggtgcatcaagc

SEQ ID NO: 843113 - DNA, 25 bp, Mus musculus
ttgaaatgtttttggtgcatcaagc

SEQ ID NO: 843114 - DNA, 25 bp, Mus musculus
ttgaaattaaataagcagtgtggcc

SEQ ID NO: 843115 - DNA, 25 bp, Mus musculus
ttgaaattaaattagcagtgtggcc

SEQ ID NO: 843116 - DNA, 25 bp, Mus musculus
ttgaaattcagccaaagcaagcagc

SEQ ID NO: 843117 - DNA, 25 bp, Mus musculus
ttgaaattcagcgaaagcaagcagc

SEQ ID NO: 843118 - DNA, 25 bp, Mus musculus
ttgaaatttaaaaccatggagagcg

SEQ ID NO: 843119 - DNA, 25 bp, Mus musculus
ttgaaatttaaatccatggagagcg

SEQ ID NO: 843120 - DNA, 25 bp, Mus musculus
ttgaacaagctaccccaaacacaca

SEQ ID NO: 843121 - DNA, 25 bp, Mus musculus
ttgaacaagctagcccaaacacaca

SEQ ID NO: 843122 - DNA, 25 bp, Mus musculus
ttgaacaatcacatccttaacaggg

SEQ ID NO: 843123 - DNA, 25 bp, Mus musculus
ttgaacaatcacttccttaacaggg

SEQ ID NO: 843124 - DNA, 25 bp, Mus musculus
ttgaacacagtgctactatgaggtc

SEQ ID NO: 843125 - DNA, 25 bp, Mus musculus
ttgaacacagtggtactatgaggtc

SEQ ID NO: 843126 - DNA, 25 bp, Mus musculus
ttgaacaccggcagatgatggagca

SEQ ID NO: 843127 - DNA, 25 bp, Mus musculus
ttgaacaccggctgatgatggagca

SEQ ID NO: 843128 - DNA, 25 bp, Mus musculus
ttgaacagagcaataagtctgagac

SEQ ID NO: 843129 - DNA, 25 bp, Mus musculus
ttgaacagagcattaagtctgagac

SEQ ID NO: 843130 - DNA, 25 bp, Mus musculus
ttgaacagcacgagcctaattggca

SEQ ID NO: 843131 - DNA, 25 bp, Mus musculus
ttgaacagcacgtgcctaattggca

SEQ ID NO: 843132 - DNA, 25 bp, Mus musculus
ttgaacaggacacgccgaagcattg

SEQ ID NO: 843133 - DNA, 25 bp, Mus musculus
ttgaacaggacaggccgaagcattg

SEQ ID NO: 843134 - DNA, 25 bp, Mus musculus
ttgaacaggtttatccccttatcag

SEQ ID NO: 843135 - DNA, 25 bp, Mus musculus
ttgaacaggtttttccccttatcag

SEQ ID NO: 843136 - DNA, 25 bp, Mus musculus
ttgaacagtgtgcagcgctacgacg

SEQ ID NO: 843137 - DNA, 25 bp, Mus musculus
ttgaacagtgtggagcgctacgacg

SEQ ID NO: 843138 - DNA, 25 bp, Mus musculus
ttgaacatctgaaccatgattctgt

SEQ ID NO: 843139 - DNA, 25 bp, Mus musculus
ttgaacatctgatccatgattctgt

SEQ ID NO: 843140 - DNA, 25 bp, Mus musculus
ttgaacatgaccctgtgccccagcg

SEQ ID NO: 843141 - DNA, 25 bp, Mus musculus
ttgaacatgaccgtgtgccccagcg

SEQ ID NO: 843142 - DNA, 25 bp, Mus musculus
ttgaacatggagcatattgaagtgt

SEQ ID NO: 843143 - DNA, 25 bp, Mus musculus
ttgaacatggaggatattgaagtgt

SEQ ID NO: 843144 - DNA, 25 bp, Mus musculus
ttgaacatgggcaagcggtgtcctt

SEQ ID NO: 843145 - DNA, 25 bp, Mus musculus
ttgaacatgggctagcggtgtcctt

SEQ ID NO: 843146 - DNA, 25 bp, Mus musculus
ttgaaccaggaaccagcggagcccg

SEQ ID NO: 843147 - DNA, 25 bp, Mus musculus
ttgaaccaggaagcagcggagcccg

SEQ ID NO: 843148 - DNA, 25 bp, Mus musculus
ttgaaccaggctaccagccaggtgg

SEQ ID NO: 843149 - DNA, 25 bp, Mus musculus
ttgaaccaggcttccagccaggtgg

SEQ ID NO: 843150 - DNA, 25 bp, Mus musculus
ttgaaccagtatcgctgaccctcgc

SEQ ID NO: 843151 - DNA, 25 bp, Mus musculus
ttgaaccagtatggctgaccctcgc

SEQ ID NO: 843152 - DNA, 25 bp, Mus musculus
ttgaacccattgatgtagaagaagg

SEQ ID NO: 843153 - DNA, 25 bp, Mus musculus
ttgaacccattgttgtagaagaagg

SEQ ID NO: 843154 - DNA, 25 bp, Mus musculus
ttgaaccccagcaagggccgggaca

SEQ ID NO: 843155 - DNA, 25 bp, Mus musculus
ttgaaccccagctagggccgggaca

SEQ ID NO: 843156 - DNA, 25 bp, Mus musculus
ttgaaccccttgcaggactggctgc

SEQ ID NO: 843157 - DNA, 25 bp, Mus musculus
ttgaaccccttggaggactggctgc

SEQ ID NO: 843158 - DNA, 25 bp, Mus musculus
ttgaacctctggaccctcctgctgg

SEQ ID NO: 843159 - DNA, 25 bp, Mus musculus
ttgaacctctggtccctcctgctgg

SEQ ID NO: 843160 - DNA, 25 bp, Mus musculus
ttgaacgaagaacaagatttaacat

SEQ ID NO: 843161 - DNA, 25 bp, Mus musculus
ttgaacgaagaagaagatttaacat

SEQ ID NO: 843162 - DNA, 25 bp, Mus musculus
ttgaacgaccacaaaaggagcctgt

SEQ ID NO: 843163 - DNA, 25 bp, Mus musculus
ttgaacgaccactaaaggagcctgt

SEQ ID NO: 843164 - DNA, 25 bp, Mus musculus
ttgaacgcccttcccctaggtggct

SEQ ID NO: 843165 - DNA, 25 bp, Mus musculus
ttgaacgcccttgccctaggtggct

SEQ ID NO: 843166 - DNA, 25 bp, Mus musculus
ttgaacgcctggatctggacctcac

SEQ ID NO: 843167 - DNA, 25 bp, Mus musculus
ttgaacgcctggttctggacctcac

SEQ ID NO: 843168 - DNA, 25 bp, Mus musculus
ttgaacgcttcccaacaggccagac

SEQ ID NO: 843169 - DNA, 25 bp, Mus musculus
ttgaacgcttccgaacaggccagac

SEQ ID NO: 843170 - DNA, 25 bp, Mus musculus
ttgaacgggcctccagcactctgtg

SEQ ID NO: 843171 - DNA, 25 bp, Mus musculus
ttgaacgggcctgcagcactctgtg

SEQ ID NO: 843172 - DNA, 25 bp, Mus musculus
ttgaacgtagaactcagtcgctacc

SEQ ID NO: 843173 - DNA, 25 bp, Mus musculus
ttgaacgtagaagtcagtcgctacc

SEQ ID NO: 843174 - DNA, 25 bp, Mus musculus
ttgaactaaatgcacttgctgtcaa

SEQ ID NO: 843175 - DNA, 25 bp, Mus musculus
ttgaactaaatggacttgctgtcaa

SEQ ID NO: 843176 - DNA, 25 bp, Mus musculus
ttgaactacaggcaagatgaatact

SEQ ID NO: 843177 - DNA, 25 bp, Mus musculus
ttgaactacagggaagatgaatact

SEQ ID NO: 843178 - DNA, 25 bp, Mus musculus
ttgaactcattgaagagccctccgg

SEQ ID NO: 843179 - DNA, 25 bp, Mus musculus
ttgaactcattgtagagccctccgg

SEQ ID NO: 843180 - DNA, 25 bp, Mus musculus
ttgaactgctgacccgagagttgcg

SEQ ID NO: 843181 - DNA, 25 bp, Mus musculus
ttgaactgctgagccgagagttgcg

SEQ ID NO: 843182 - DNA, 25 bp, Mus musculus
ttgaacttccgaacctcatcctgca

SEQ ID NO: 843183 - DNA, 25 bp, Mus musculus
ttgaacttccgatcctcatcctgca

SEQ ID NO: 843184 - DNA, 25 bp, Mus musculus
ttgaacttgattagaagaccaggct

SEQ ID NO: 843185 - DNA, 25 bp, Mus musculus
ttgaacttgatttgaagaccaggct

SEQ ID NO: 843186 - DNA, 25 bp, Mus musculus
ttgaacttgccgacacttgtgagcg

SEQ ID NO: 843187 - DNA, 25 bp, Mus musculus
ttgaacttgccgtcacttgtgagcg

SEQ ID NO: 843188 - DNA, 25 bp, Mus musculus
ttgaactttccaaaacctagcgagg

SEQ ID NO: 843189 - DNA, 25 bp, Mus musculus
ttgaactttccataacctagcgagg

SEQ ID NO: 843190 - DNA, 25 bp, Mus musculus
ttgaagaaaagaacacacagagctc

SEQ ID NO: 843191 - DNA, 25 bp, Mus musculus
ttgaagaaaagatcacacagagctc

SEQ ID NO: 843192 - DNA, 25 bp, Mus musculus
ttgaagaacacccactgtttgagcg

SEQ ID NO: 843193 - DNA, 25 bp, Mus musculus
ttgaagaacaccgactgtttgagcg

SEQ ID NO: 843194 - DNA, 25 bp, Mus musculus
ttgaagaacctcaccagccatgacc

SEQ ID NO: 843195 - DNA, 25 bp, Mus musculus
ttgaagaacctctccagccatgacc

SEQ ID NO: 843196 - DNA, 25 bp, Mus musculus
ttgaagaaggaacagataaagcaga

SEQ ID NO: 843197 - DNA, 25 bp, Mus musculus
ttgaagaaggaagagataaagcaga

SEQ ID NO: 843198 - DNA, 25 bp, Mus musculus
ttgaagaaggatcaagtcttgctac

SEQ ID NO: 843199 - DNA, 25 bp, Mus musculus
ttgaagaaggatgaagtcttgctac

SEQ ID NO: 843200 - DNA, 25 bp, Mus musculus
ttgaagaagttaaccggcaggctgg

SEQ ID NO: 843201 - DNA, 25 bp, Mus musculus
ttgaagaagttatccggcaggctgg

SEQ ID NO: 843202 - DNA, 25 bp, Mus musculus
ttgaagaatgggacacaagtccatg

SEQ ID NO: 843203 - DNA, 25 bp, Mus musculus
ttgaagaatgggtcacaagtccatg

SEQ ID NO: 843204 - DNA, 25 bp, Mus musculus
ttgaagacaaatcggcctatgcact

SEQ ID NO: 843205 - DNA, 25 bp, Mus musculus
ttgaagacaaatgggcctatgcact

SEQ ID NO: 843206 - DNA, 25 bp, Mus musculus
ttgaagacattacagctgaacttga

SEQ ID NO: 843207 - DNA, 25 bp, Mus musculus
ttgaagacattagagctgaacttga

SEQ ID NO: 843208 - DNA, 25 bp, Mus musculus
ttgaagacgggcaccagcaacctcc

SEQ ID NO: 843209 - DNA, 25 bp, Mus musculus
ttgaagacgggctccagcaacctcc

SEQ ID NO: 843210 - DNA, 25 bp, Mus musculus
ttgaagaggacaactgctctgacac

SEQ ID NO: 843211 - DNA, 25 bp, Mus musculus
ttgaagaggacatctgctctgacac

SEQ ID NO: 843212 - DNA, 25 bp, Mus musculus
ttgaagaggcaccacatcacggagg

SEQ ID NO: 843213 - DNA, 25 bp, Mus musculus
ttgaagaggcacgacatcacggagg

SEQ ID NO: 843214 - DNA, 25 bp, Mus musculus
ttgaagaggctccaagaagaactcg

SEQ ID NO: 843215 - DNA, 25 bp, Mus musculus
ttgaagaggctcgaagaagaactcg

SEQ ID NO: 843216 - DNA, 25 bp, Mus musculus
ttgaagagttctcagcgccaccagg

SEQ ID NO: 843217 - DNA, 25 bp, Mus musculus
ttgaagagttctgagcgccaccagg

SEQ ID NO: 843218 - DNA, 25 bp, Mus musculus
ttgaagatgacgacaggctggagca

SEQ ID NO: 843219 - DNA, 25 bp, Mus musculus
ttgaagatgacgtcaggctggagca

SEQ ID NO: 843220 - DNA, 25 bp, Mus musculus
ttgaagatgagcagccgccaaccct

SEQ ID NO: 843221 - DNA, 25 bp, Mus musculus
ttgaagatgagctgccgccaaccct

SEQ ID NO: 843222 - DNA, 25 bp, Mus musculus
ttgaagatgtagatgcgttttactc

SEQ ID NO: 843223 - DNA, 25 bp, Mus musculus
ttgaagatgtagttgcgttttactc

SEQ ID NO: 843224 - DNA, 25 bp, Mus musculus
ttgaagcactacacgacaccgagat

SEQ ID NO: 843225 - DNA, 25 bp, Mus musculus
ttgaagcactactcgacaccgagat

SEQ ID NO: 843226 - DNA, 25 bp, Mus musculus
ttgaagcagatgaggccttggattc

SEQ ID NO: 843227 - DNA, 25 bp, Mus musculus
ttgaagcagatgtggccttggattc

SEQ ID NO: 843228 - DNA, 25 bp, Mus musculus
ttgaagcagtcactaccatcgatgt

SEQ ID NO: 843229 - DNA, 25 bp, Mus musculus
ttgaagcagtcagtaccatcgatgt

SEQ ID NO: 843230 - DNA, 25 bp, Mus musculus
ttgaagccaacgcagaactaaaggt

SEQ ID NO: 843231 - DNA, 25 bp, Mus musculus
ttgaagccaacggagaactaaaggt

SEQ ID NO: 843232 - DNA, 25 bp, Mus musculus
ttgaagcctagtcccgcgcgatggc

SEQ ID NO: 843233 - DNA, 25 bp, Mus musculus
ttgaagcctagtgccgcgcgatggc

SEQ ID NO: 843234 - DNA, 25 bp, Mus musculus
ttgaagcggcatcgagttcaggaat

SEQ ID NO: 843235 - DNA, 25 bp, Mus musculus
ttgaagcggcatggagttcaggaat

SEQ ID NO: 843236 - DNA, 25 bp, Mus musculus
ttgaagctaacacacatacctgatg

SEQ ID NO: 843237 - DNA, 25 bp, Mus musculus
ttgaagctaacagacatacctgatg

SEQ ID NO: 843238 - DNA, 25 bp, Mus musculus
ttgaagctagggatttatgcagatg

SEQ ID NO: 843239 - DNA, 25 bp, Mus musculus
ttgaagctagggttttatgcagatg

SEQ ID NO: 843240 - DNA, 25 bp, Mus musculus
ttgaagctggcacgccctcagctgg

SEQ ID NO: 843241 - DNA, 25 bp, Mus musculus
ttgaagctggcaggccctcagctgg

SEQ ID NO: 843242 - DNA, 25 bp, Mus musculus
ttgaagctggctccacaagggacac

SEQ ID NO: 843243 - DNA, 25 bp, Mus musculus
ttgaagctggctgcacaagggacac

SEQ ID NO: 843244 - DNA, 25 bp, Mus musculus
ttgaagcttactcctgatgccaagt

SEQ ID NO: 843245 - DNA, 25 bp, Mus musculus
ttgaagcttactgctgatgccaagt

SEQ ID NO: 843246 - DNA, 25 bp, Mus musculus
ttgaaggaccggcagcagctctaca

SEQ ID NO: 843247 - DNA, 25 bp, Mus musculus
ttgaaggaccgggagcagctctaca

SEQ ID NO: 843248 - DNA, 25 bp, Mus musculus
ttgaaggactaaaacgcttaatgac

SEQ ID NO: 843249 - DNA, 25 bp, Mus musculus
ttgaaggactaatacgcttaatgac

SEQ ID NO: 843250 - DNA, 25 bp, Mus musculus
ttgaaggagacaacattagcggcgt

SEQ ID NO: 843251 - DNA, 25 bp, Mus musculus
ttgaaggagacatcattagcggcgt

SEQ ID NO: 843252 - DNA, 25 bp, Mus musculus
ttgaaggagactaggaacgcacgga

SEQ ID NO: 843253 - DNA, 25 bp, Mus musculus
ttgaaggagacttggaacgcacgga

SEQ ID NO: 843254 - DNA, 25 bp, Mus musculus
ttgaaggagtcgatctcagagacaa

SEQ ID NO: 843255 - DNA, 25 bp, Mus musculus
ttgaaggagtcgttctcagagacaa

SEQ ID NO: 843256 - DNA, 25 bp, Mus musculus
ttgaaggataagctcaggaaggcac

SEQ ID NO: 843257 - DNA, 25 bp, Mus musculus
ttgaaggataaggtcaggaaggcac

SEQ ID NO: 843258 - DNA, 25 bp, Mus musculus
ttgaaggcactacaaagtgttggac

SEQ ID NO: 843259 - DNA, 25 bp, Mus musculus
ttgaaggcactagaaagtgttggac

SEQ ID NO: 843260 - DNA, 25 bp, Mus musculus
ttgaaggccccgaagagctcagccg

SEQ ID NO: 843261 - DNA, 25 bp, Mus musculus
ttgaaggccccgtagagctcagccg

SEQ ID NO: 843262 - DNA, 25 bp, Mus musculus
ttgaaggctacaaacaagataaaag

SEQ ID NO: 843263 - DNA, 25 bp, Mus musculus
ttgaaggctacatacaagataaaag

SEQ ID NO: 843264 - DNA, 25 bp, Mus musculus
ttgaagggatttccctccgcctctc

SEQ ID NO: 843265 - DNA, 25 bp, Mus musculus
ttgaagggatttgcctccgcctctc

SEQ ID NO: 843266 - DNA, 25 bp, Mus musculus
ttgaagggcggaacaagttctctgc

SEQ ID NO: 843267 - DNA, 25 bp, Mus musculus
ttgaagggcggatcaagttctctgc

SEQ ID NO: 843268 - DNA, 25 bp, Mus musculus
ttgaaggtagtcatggccgggaccc

SEQ ID NO: 843269 - DNA, 25 bp, Mus musculus
ttgaaggtagtcttggccgggaccc

SEQ ID NO: 843270 - DNA, 25 bp, Mus musculus
ttgaaggtgacacccgttacattgc

SEQ ID NO: 843271 - DNA, 25 bp, Mus musculus
ttgaaggtgacagccgttacattgc

SEQ ID NO: 843272 - DNA, 25 bp, Mus musculus
ttgaaggtggtaagactcgctgtct

SEQ ID NO: 843273 - DNA, 25 bp, Mus musculus
ttgaaggtggtatgactcgctgtct

SEQ ID NO: 843274 - DNA, 25 bp, Mus musculus
ttgaaggtgtagacctgcgagataa

SEQ ID NO: 843275 - DNA, 25 bp, Mus musculus
ttgaaggtgtagtcctgcgagataa

SEQ ID NO: 843276 - DNA, 25 bp, Mus musculus
ttgaagtacagaatgacgaggtggc

SEQ ID NO: 843277 - DNA, 25 bp, Mus musculus
ttgaagtacagattgacgaggtggc

SEQ ID NO: 843278 - DNA, 25 bp, Mus musculus
ttgaagtcagacacagctccgccat

SEQ ID NO: 843279 - DNA, 25 bp, Mus musculus
ttgaagtcagactcagctccgccat

SEQ ID NO: 843280 - DNA, 25 bp, Mus musculus
ttgaagtcgactatccaatgatagt

SEQ ID NO: 843281 - DNA, 25 bp, Mus musculus
ttgaagtcgactttccaatgatagt

SEQ ID NO: 843282 - DNA, 25 bp, Mus musculus
ttgaagtcttcgaggcttatttgcc

SEQ ID NO: 843283 - DNA, 25 bp, Mus musculus
ttgaagtcttcgtggcttatttgcc

SEQ ID NO: 843284 - DNA, 25 bp, Mus musculus
ttgaagtgacgaagttgggacaagc

SEQ ID NO: 843285 - DNA, 25 bp, Mus musculus
ttgaagtgacgatgttgggacaagc

SEQ ID NO: 843286 - DNA, 25 bp, Mus musculus
ttgaagtgatcgagactgagaagac

SEQ ID NO: 843287 - DNA, 25 bp, Mus musculus
ttgaagtgatcgtgactgagaagac

SEQ ID NO: 843288 - DNA, 25 bp, Mus musculus
ttgaagttgactatagtaagcccta

SEQ ID NO: 843289 - DNA, 25 bp, Mus musculus
ttgaagttgactttagtaagcccta

SEQ ID NO: 843290 - DNA, 25 bp, Mus musculus
ttgaagttggcaaggaatttgatgc

SEQ ID NO: 843291 - DNA, 25 bp, Mus musculus
ttgaagttggcatggaatttgatgc

SEQ ID NO: 843292 - DNA, 25 bp, Mus musculus
ttgaataagaagaatggtggtggtt

SEQ ID NO: 843293 - DNA, 25 bp, Mus musculus
ttgaataagaagtatggtggtggtt

SEQ ID NO: 843294 - DNA, 25 bp, Mus musculus
ttgaatacatctccacccaacagaa

SEQ ID NO: 843295 - DNA, 25 bp, Mus musculus
ttgaatacatctgcacccaacagaa

SEQ ID NO: 843296 - DNA, 25 bp, Mus musculus
ttgaatacttttcggaagacaccct

SEQ ID NO: 843297 - DNA, 25 bp, Mus musculus
ttgaatacttttgggaagacaccct

SEQ ID NO: 843298 - DNA, 25 bp, Mus musculus
ttgaatccttttcttagagcttgtg

SEQ ID NO: 843299 - DNA, 25 bp, Mus musculus
ttgaatccttttgttagagcttgtg

SEQ ID NO: 843300 - DNA, 25 bp, Mus musculus
ttgaatcggtagcaaaggaagctga

SEQ ID NO: 843301 - DNA, 25 bp, Mus musculus
ttgaatcggtaggaaaggaagctga

SEQ ID NO: 843302 - DNA, 25 bp, Mus musculus
ttgaatctgaacctaaagcggcggg

SEQ ID NO: 843303 - DNA, 25 bp, Mus musculus
ttgaatctgaacgtaaagcggcggg

SEQ ID NO: 843304 - DNA, 25 bp, Mus musculus
ttgaatgcagatcccatctcatctg

SEQ ID NO: 843305 - DNA, 25 bp, Mus musculus
ttgaatgcagatgccatctcatctg

SEQ ID NO: 843306 - DNA, 25 bp, Mus musculus
ttgaatgccactcgcagccaatggt

SEQ ID NO: 843307 - DNA, 25 bp, Mus musculus
ttgaatgccactggcagccaatggt

SEQ ID NO: 843308 - DNA, 25 bp, Mus musculus
ttgaatgcggctcccaaaagggcca

SEQ ID NO: 843309 - DNA, 25 bp, Mus musculus
ttgaatgcggctgccaaaagggcca

SEQ ID NO: 843310 - DNA, 25 bp, Mus musculus
ttgaatggatgactgggcggcggcc

SEQ ID NO: 843311 - DNA, 25 bp, Mus musculus
ttgaatggatgagtgggcggcggcc

SEQ ID NO: 843312 - DNA, 25 bp, Mus musculus
ttgaatggctgtagacccagggcac

SEQ ID NO: 843313 - DNA, 25 bp, Mus musculus
ttgaatggctgttgacccagggcac

SEQ ID NO: 843314 - DNA, 25 bp, Mus musculus
ttgaatgtctcccagaggacaaaga

SEQ ID NO: 843315 - DNA, 25 bp, Mus musculus
ttgaatgtctccgagaggacaaaga

SEQ ID NO: 843316 - DNA, 25 bp, Mus musculus
ttgaatgtgccaagaccctctccct

SEQ ID NO: 843317 - DNA, 25 bp, Mus musculus
ttgaatgtgccatgaccctctccct

SEQ ID NO: 843318 - DNA, 25 bp, Mus musculus
ttgaatgttaatctccaagtcaaca

SEQ ID NO: 843319 - DNA, 25 bp, Mus musculus
ttgaatgttaatgtccaagtcaaca

SEQ ID NO: 843320 - DNA, 25 bp, Mus musculus
ttgaattcagtcagctctgccccag

SEQ ID NO: 843321 - DNA, 25 bp, Mus musculus
ttgaattcagtctgctctgccccag

SEQ ID NO: 843322 - DNA, 25 bp, Mus musculus
ttgaattcattgacaagcagttggc

SEQ ID NO: 843323 - DNA, 25 bp, Mus musculus
ttgaattcattgtcaagcagttggc

SEQ ID NO: 843324 - DNA, 25 bp, Mus musculus
ttgaattccgggctcccaatgggct

SEQ ID NO: 843325 - DNA, 25 bp, Mus musculus
ttgaattccggggtcccaatgggct

SEQ ID NO: 843326 - DNA, 25 bp, Mus musculus
ttgaattggctaaacaaatcacatc

SEQ ID NO: 843327 - DNA, 25 bp, Mus musculus
ttgaattggctatacaaatcacatc

SEQ ID NO: 843328 - DNA, 25 bp, Mus musculus
ttgacaaacaaccagttgagcacgc

SEQ ID NO: 843329 - DNA, 25 bp, Mus musculus
ttgacaaacaacgagttgagcacgc

SEQ ID NO: 843330 - DNA, 25 bp, Mus musculus
ttgacaaagggccagccacattcta

SEQ ID NO: 843331 - DNA, 25 bp, Mus musculus
ttgacaaagggcctggaaagactgt

SEQ ID NO: 843332 - DNA, 25 bp, Mus musculus
ttgacaaagggcgagccacattcta

SEQ ID NO: 843333 - DNA, 25 bp, Mus musculus
ttgacaaagggcgtggaaagactgt

SEQ ID NO: 843334 - DNA, 25 bp, Mus musculus
ttgacaaagggtccgaagcctgcca

SEQ ID NO: 843335 - DNA, 25 bp, Mus musculus
ttgacaaagggtgcgaagcctgcca

SEQ ID NO: 843336 - DNA, 25 bp, Mus musculus
ttgacaaccccaacattgtgaaact

SEQ ID NO: 843337 - DNA, 25 bp, Mus musculus
ttgacaaccccatcattgtgaaact

SEQ ID NO: 843338 - DNA, 25 bp, Mus musculus
ttgacaacctggaggacgaagagca

SEQ ID NO: 843339 - DNA, 25 bp, Mus musculus
ttgacaacctggtggacgaagagca

SEQ ID NO: 843340 - DNA, 25 bp, Mus musculus
ttgacaacgaggaacagccatccgg

SEQ ID NO: 843341 - DNA, 25 bp, Mus musculus
ttgacaacgaggtacagccatccgg

SEQ ID NO: 843342 - DNA, 25 bp, Mus musculus
ttgacaactttaacccagggtggct

SEQ ID NO: 843343 - DNA, 25 bp, Mus musculus
ttgacaactttatcccagggtggct

SEQ ID NO: 843344 - DNA, 25 bp, Mus musculus
ttgacaaggctgctctgtagatctg

SEQ ID NO: 843345 - DNA, 25 bp, Mus musculus
ttgacaaggctggtctgtagatctg

SEQ ID NO: 843346 - DNA, 25 bp, Mus musculus
ttgacaatccccacggcgatgggcg

SEQ ID NO: 843347 - DNA, 25 bp, Mus musculus
ttgacaatcccctcggcgatgggcg

SEQ ID NO: 843348 - DNA, 25 bp, Mus musculus
ttgacaatctggctgctggccttgt

SEQ ID NO: 843349 - DNA, 25 bp, Mus musculus
ttgacaatctgggtgctggccttgt

SEQ ID NO: 843350 - DNA, 25 bp, Mus musculus
ttgacaattgctcgcccatgctaag

SEQ ID NO: 843351 - DNA, 25 bp, Mus musculus
ttgacaattgctggcccatgctaag

SEQ ID NO: 843352 - DNA, 25 bp, Mus musculus
ttgacacaatggaagaccatgctgg

SEQ ID NO: 843353 - DNA, 25 bp, Mus musculus
ttgacacaatggtagaccatgctgg

SEQ ID NO: 843354 - DNA, 25 bp, Mus musculus
ttgacacactggagaccacttgcca

SEQ ID NO: 843355 - DNA, 25 bp, Mus musculus
ttgacacactggtgaccacttgcca

SEQ ID NO: 843356 - DNA, 25 bp, Mus musculus
ttgacacaggcgacggcagagagat

SEQ ID NO: 843357 - DNA, 25 bp, Mus musculus
ttgacacaggcgtcggcagagagat

SEQ ID NO: 843358 - DNA, 25 bp, Mus musculus
ttgacacatacgcacctcaaacctg

SEQ ID NO: 843359 - DNA, 25 bp, Mus musculus
ttgacacatacggacctcaaacctg

SEQ ID NO: 843360 - DNA, 25 bp, Mus musculus
ttgacaccaatgcagctggagatgc

SEQ ID NO: 843361 - DNA, 25 bp, Mus musculus
ttgacaccaatggagctggagatgc

SEQ ID NO: 843362 - DNA, 25 bp, Mus musculus
ttgacacccgctacagcatccggga

SEQ ID NO: 843363 - DNA, 25 bp, Mus musculus
ttgacacccgcttcagcatccggga

SEQ ID NO: 843364 - DNA, 25 bp, Mus musculus
ttgacacccgggacaccatccttgg

SEQ ID NO: 843365 - DNA, 25 bp, Mus musculus
ttgacacccgggtcaccatccttgg

SEQ ID NO: 843366 - DNA, 25 bp, Mus musculus
ttgacaccctacaaaccggaacctg

SEQ ID NO: 843367 - DNA, 25 bp, Mus musculus
ttgacaccctactaaccggaacctg

SEQ ID NO: 843368 - DNA, 25 bp, Mus musculus
ttgacacgctcaagaccaaatggag

SEQ ID NO: 843369 - DNA, 25 bp, Mus musculus
ttgacacgctcatgaccaaatggag

SEQ ID NO: 843370 - DNA, 25 bp, Mus musculus
ttgacactgattcagctctgggaag

SEQ ID NO: 843371 - DNA, 25 bp, Mus musculus
ttgacactgattgagctctgggaag

SEQ ID NO: 843372 - DNA, 25 bp, Mus musculus
ttgacagaatgtccccgcatgcacc

SEQ ID NO: 843373 - DNA, 25 bp, Mus musculus
ttgacagaatgtgcccgcatgcacc

SEQ ID NO: 843374 - DNA, 25 bp, Mus musculus
ttgacagagatgataaatgcattcg

SEQ ID NO: 843375 - DNA, 25 bp, Mus musculus
ttgacagagatgttaaatgcattcg

SEQ ID NO: 843376 - DNA, 25 bp, Mus musculus
ttgacagagcatcctcggtggccag

SEQ ID NO: 843377 - DNA, 25 bp, Mus musculus
ttgacagagcatgctcggtggccag

SEQ ID NO: 843378 - DNA, 25 bp, Mus musculus
ttgacagattcaaagggtacttgcc

SEQ ID NO: 843379 - DNA, 25 bp, Mus musculus
ttgacagattcatagggtacttgcc

SEQ ID NO: 843380 - DNA, 25 bp, Mus musculus
ttgacagccagcatgtcatccacaa

SEQ ID NO: 843381 - DNA, 25 bp, Mus musculus
ttgacagccagcttgtcatccacaa

SEQ ID NO: 843382 - DNA, 25 bp, Mus musculus
ttgacaggaccacgagcggctcttt

SEQ ID NO: 843383 - DNA, 25 bp, Mus musculus
ttgacaggaccaggagcggctcttt

SEQ ID NO: 843384 - DNA, 25 bp, Mus musculus
ttgacaggctacaatgagagcaagc

SEQ ID NO: 843385 - DNA, 25 bp, Mus musculus
ttgacaggctactatgagagcaagc

SEQ ID NO: 843386 - DNA, 25 bp, Mus musculus
ttgacatactgaagctgctagcagc

SEQ ID NO: 843387 - DNA, 25 bp, Mus musculus
ttgacatactgatgctgctagcagc

SEQ ID NO: 843388 - DNA, 25 bp, Mus musculus
ttgacatatggcactcccagctcgc

SEQ ID NO: 843389 - DNA, 25 bp, Mus musculus
ttgacatatggctctcccagctcgc

SEQ ID NO: 843390 - DNA, 25 bp, Mus musculus
ttgacatcacacaaagcccccaaag

SEQ ID NO: 843391 - DNA, 25 bp, Mus musculus
ttgacatcacactaagcccccaaag

SEQ ID NO: 843392 - DNA, 25 bp, Mus musculus
ttgacatcactgagcgccagatcgc

SEQ ID NO: 843393 - DNA, 25 bp, Mus musculus
ttgacatcactgtgcgccagatcgc

SEQ ID NO: 843394 - DNA, 25 bp, Mus musculus
ttgacatcagtgaaaccgatttccg

SEQ ID NO: 843395 - DNA, 25 bp, Mus musculus
ttgacatcagtgtaaccgatttccg

SEQ ID NO: 843396 - DNA, 25 bp, Mus musculus
ttgacatcatggcatctctctcacc

SEQ ID NO: 843397 - DNA, 25 bp, Mus musculus
ttgacatcatgggatctctctcacc

SEQ ID NO: 843398 - DNA, 25 bp, Mus musculus
ttgacatccactacggctcaggaag

SEQ ID NO: 843399 - DNA, 25 bp, Mus musculus
ttgacatccacttcggctcaggaag

SEQ ID NO: 843400 - DNA, 25 bp, Mus musculus
ttgacatctctgctgtagtagacaa

SEQ ID NO: 843401 - DNA, 25 bp, Mus musculus
ttgacatctctggtgtagtagacaa

SEQ ID NO: 843402 - DNA, 25 bp, Mus musculus
ttgacatgaatgataacagagctcg

SEQ ID NO: 843403 - DNA, 25 bp, Mus musculus
ttgacatgaatgttaacagagctcg

SEQ ID NO: 843404 - DNA, 25 bp, Mus musculus
ttgacatggctgacaatgagatctt

SEQ ID NO: 843405 - DNA, 25 bp, Mus musculus
ttgacatggctgtcaatgagatctt

SEQ ID NO: 843406 - DNA, 25 bp, Mus musculus
ttgacatgggtcctgaccccgcagc

SEQ ID NO: 843407 - DNA, 25 bp, Mus musculus
ttgacatgggtcgtgaccccgcagc

SEQ ID NO: 843408 - DNA, 25 bp, Mus musculus
ttgacatgtacacagaaggagtggc

SEQ ID NO: 843409 - DNA, 25 bp, Mus musculus
ttgacatgtacagagaaggagtggc

SEQ ID NO: 843410 - DNA, 25 bp, Mus musculus
ttgacattcggcagtacgtgcgcac

SEQ ID NO: 843411 - DNA, 25 bp, Mus musculus
ttgacattcggctgtacgtgcgcac

SEQ ID NO: 843412 - DNA, 25 bp, Mus musculus
ttgacattggatcgtacacagtgag

SEQ ID NO: 843413 - DNA, 25 bp, Mus musculus
ttgacattggatggtacacagtgag

SEQ ID NO: 843414 - DNA, 25 bp, Mus musculus
ttgacatttggtcagttgggtgcat

SEQ ID NO: 843415 - DNA, 25 bp, Mus musculus
ttgacatttggtgagttgggtgcat

SEQ ID NO: 843416 - DNA, 25 bp, Mus musculus
ttgaccaaggcactgaacagcctct

SEQ ID NO: 843417 - DNA, 25 bp, Mus musculus
ttgaccaaggcagtgaacagcctct

SEQ ID NO: 843418 - DNA, 25 bp, Mus musculus
ttgaccaataagaattcagatcgga

SEQ ID NO: 843419 - DNA, 25 bp, Mus musculus
ttgaccaataagtattcagatcgga

SEQ ID NO: 843420 - DNA, 25 bp, Mus musculus
ttgaccacgaacaccatagcaccat

SEQ ID NO: 843421 - DNA, 25 bp, Mus musculus
ttgaccacgaactccatagcaccat

SEQ ID NO: 843422 - DNA, 25 bp, Mus musculus
ttgaccacgcccaactggcctgagt

SEQ ID NO: 843423 - DNA, 25 bp, Mus musculus
ttgaccacgccctactggcctgagt

SEQ ID NO: 843424 - DNA, 25 bp, Mus musculus
ttgaccactatgatgggattgcccg

SEQ ID NO: 843425 - DNA, 25 bp, Mus musculus
ttgaccactatgttgggattgcccg

SEQ ID NO: 843426 - DNA, 25 bp, Mus musculus
ttgaccaggcagctcatgacactgg

SEQ ID NO: 843427 - DNA, 25 bp, Mus musculus
ttgaccaggcaggtcatgacactgg

SEQ ID NO: 843428 - DNA, 25 bp, Mus musculus
ttgaccagggcacaaccatcctgag

SEQ ID NO: 843429 - DNA, 25 bp, Mus musculus
ttgaccagggcagaaccatcctgag

SEQ ID NO: 843430 - DNA, 25 bp, Mus musculus
ttgaccagtggaacaaagtcatcga

SEQ ID NO: 843431 - DNA, 25 bp, Mus musculus
ttgaccagtggatcaaagtcatcga

SEQ ID NO: 843432 - DNA, 25 bp, Mus musculus
ttgaccagttttcggccatcaaccg

SEQ ID NO: 843433 - DNA, 25 bp, Mus musculus
ttgaccagttttgggccatcaaccg

SEQ ID NO: 843434 - DNA, 25 bp, Mus musculus
ttgaccataataagtgtgcagcaga

SEQ ID NO: 843435 - DNA, 25 bp, Mus musculus
ttgaccataatatgtgtgcagcaga

SEQ ID NO: 843436 - DNA, 25 bp, Mus musculus
ttgaccatgtccagatgatagtgct

SEQ ID NO: 843437 - DNA, 25 bp, Mus musculus
ttgaccatgtcctgatgatagtgct

SEQ ID NO: 843438 - DNA, 25 bp, Mus musculus
ttgacccaaaggcactcaggtggtg

SEQ ID NO: 843439 - DNA, 25 bp, Mus musculus
ttgacccaaagggactcaggtggtg

SEQ ID NO: 843440 - DNA, 25 bp, Mus musculus
ttgacccaagcaatatgccccctgg

SEQ ID NO: 843441 - DNA, 25 bp, Mus musculus
ttgacccaagcattatgccccctgg

SEQ ID NO: 843442 - DNA, 25 bp, Mus musculus
ttgacccaggctcggcaccgataag

SEQ ID NO: 843443 - DNA, 25 bp, Mus musculus
ttgacccaggctgggcaccgataag

SEQ ID NO: 843444 - DNA, 25 bp, Mus musculus
ttgaccccaaatcagaaccagcagg

SEQ ID NO: 843445 - DNA, 25 bp, Mus musculus
ttgaccccaaatgagaaccagcagg

SEQ ID NO: 843446 - DNA, 25 bp, Mus musculus
ttgacccgaacacaaagaagaactg

SEQ ID NO: 843447 - DNA, 25 bp, Mus musculus
ttgacccgaacagaaagaagaactg

SEQ ID NO: 843448 - DNA, 25 bp, Mus musculus
ttgacccgagggaataaagaagagg

SEQ ID NO: 843449 - DNA, 25 bp, Mus musculus
ttgacccgagggtataaagaagagg

SEQ ID NO: 843450 - DNA, 25 bp, Mus musculus
ttgacccgcaggcagactgacgcgc

SEQ ID NO: 843451 - DNA, 25 bp, Mus musculus
ttgacccgcagggagactgacgcgc

SEQ ID NO: 843452 - DNA, 25 bp, Mus musculus
ttgacccggcggctgaaaatcaaag

SEQ ID NO: 843453 - DNA, 25 bp, Mus musculus
ttgacccggcgggtgaaaatcaaag

SEQ ID NO: 843454 - DNA, 25 bp, Mus musculus
ttgacccggtgacgaccaagaagct

SEQ ID NO: 843455 - DNA, 25 bp, Mus musculus
ttgacccggtgaggaccaagaagct

SEQ ID NO: 843456 - DNA, 25 bp, Mus musculus
ttgaccctgaacaaccaacagatga

SEQ ID NO: 843457 - DNA, 25 bp, Mus musculus
ttgaccctgaactaccaacagatga

SEQ ID NO: 843458 - DNA, 25 bp, Mus musculus
ttgacccttctacatacgatgaccc

SEQ ID NO: 843459 - DNA, 25 bp, Mus musculus
ttgacccttctagatacgatgaccc

SEQ ID NO: 843460 - DNA, 25 bp, Mus musculus
ttgaccctttttactggcaacccag

SEQ ID NO: 843461 - DNA, 25 bp, Mus musculus
ttgacccttttttctggcaacccag

SEQ ID NO: 843462 - DNA, 25 bp, Mus musculus
ttgaccgagattatgtgctcaagtc

SEQ ID NO: 843463 - DNA, 25 bp, Mus musculus
ttgaccgagattttgtgctcaagtc

SEQ ID NO: 843464 - DNA, 25 bp, Mus musculus
ttgaccgagcctcagaataccagct

SEQ ID NO: 843465 - DNA, 25 bp, Mus musculus
ttgaccgagcctgagaataccagct

SEQ ID NO: 843466 - DNA, 25 bp, Mus musculus
ttgaccgagtctacacccaccagag

SEQ ID NO: 843467 - DNA, 25 bp, Mus musculus
ttgaccgagtcttcacccaccagag

SEQ ID NO: 843468 - DNA, 25 bp, Mus musculus
ttgaccgagtgcaccggtgctatgg

SEQ ID NO: 843469 - DNA, 25 bp, Mus musculus
ttgaccgagtgctccggtgctatgg

SEQ ID NO: 843470 - DNA, 25 bp, Mus musculus
ttgaccgcagttctccagaagcgct

SEQ ID NO: 843471 - DNA, 25 bp, Mus musculus
ttgaccgcagttgtccagaagcgct

SEQ ID NO: 843472 - DNA, 25 bp, Mus musculus
ttgaccgcggttctccaggacgtga

SEQ ID NO: 843473 - DNA, 25 bp, Mus musculus
ttgaccgcggttgtccaggacgtga

SEQ ID NO: 843474 - DNA, 25 bp, Mus musculus
ttgaccggatctacacacaccagag

SEQ ID NO: 843475 - DNA, 25 bp, Mus musculus
ttgaccggatcttcacacaccagag

SEQ ID NO: 843476 - DNA, 25 bp, Mus musculus
ttgaccgggagcagcagctagccaa

SEQ ID NO: 843477 - DNA, 25 bp, Mus musculus
ttgaccgggagctgcagctagccaa

SEQ ID NO: 843478 - DNA, 25 bp, Mus musculus
ttgacctaaagaccattgcacttcg

SEQ ID NO: 843479 - DNA, 25 bp, Mus musculus
ttgacctaaagagcattgcacttcg

SEQ ID NO: 843480 - DNA, 25 bp, Mus musculus
ttgacctaacctcgagccggcaagg

SEQ ID NO: 843481 - DNA, 25 bp, Mus musculus
ttgacctaacctggagccggcaagg

SEQ ID NO: 843482 - DNA, 25 bp, Mus musculus
ttgacctagggaagacaacgtagct

SEQ ID NO: 843483 - DNA, 25 bp, Mus musculus
ttgacctagggatgacaacgtagct

SEQ ID NO: 843484 - DNA, 25 bp, Mus musculus
ttgacctccgtgcagaccaggagct

SEQ ID NO: 843485 - DNA, 25 bp, Mus musculus
ttgacctccgtggagaccaggagct

SEQ ID NO: 843486 - DNA, 25 bp, Mus musculus
ttgacctggcctcgcagtatgggcc

SEQ ID NO: 843487 - DNA, 25 bp, Mus musculus
ttgacctggcctggcagtatgggcc

SEQ ID NO: 843488 - DNA, 25 bp, Mus musculus
ttgacctgggctatcgctttgatgt

SEQ ID NO: 843489 - DNA, 25 bp, Mus musculus
ttgacctgggctttcgctttgatgt

SEQ ID NO: 843490 - DNA, 25 bp, Mus musculus
ttgacctgtcagctccacaaatagg

SEQ ID NO: 843491 - DNA, 25 bp, Mus musculus
ttgacctgtcaggtccacaaatagg

SEQ ID NO: 843492 - DNA, 25 bp, Mus musculus
ttgaccttccgccacgtggccgttg

SEQ ID NO: 843493 - DNA, 25 bp, Mus musculus
ttgaccttccgcgacgtggccgttg

SEQ ID NO: 843494 - DNA, 25 bp, Mus musculus
ttgaccttctctacatttccttggg

SEQ ID NO: 843495 - DNA, 25 bp, Mus musculus
ttgaccttctcttcatttccttggg

SEQ ID NO: 843496 - DNA, 25 bp, Mus musculus
ttgaccttgcccaaaaccagaagga

SEQ ID NO: 843497 - DNA, 25 bp, Mus musculus
ttgaccttgccctaaaccagaagga

SEQ ID NO: 843498 - DNA, 25 bp, Mus musculus
ttgaccttgggcatctgacacagcg

SEQ ID NO: 843499 - DNA, 25 bp, Mus musculus
ttgaccttgggcttctgacacagcg

SEQ ID NO: 843500 - DNA, 25 bp, Mus musculus
ttgacgaaaataacaaggaccactt

SEQ ID NO: 843501 - DNA, 25 bp, Mus musculus
ttgacgaaaatatcaaggaccactt

SEQ ID NO: 843502 - DNA, 25 bp, Mus musculus
ttgacgaaagctcccagactggtgg

SEQ ID NO: 843503 - DNA, 25 bp, Mus musculus
ttgacgaaagctgccagactggtgg

SEQ ID NO: 843504 - DNA, 25 bp, Mus musculus
ttgacgaacgagacaaagcatctag

SEQ ID NO: 843505 - DNA, 25 bp, Mus musculus
ttgacgaacgagtcaaagcatctag

SEQ ID NO: 843506 - DNA, 25 bp, Mus musculus
ttgacgagagcgagcttggacagac

SEQ ID NO: 843507 - DNA, 25 bp, Mus musculus
ttgacgagagcgtgcttggacagac

SEQ ID NO: 843508 - DNA, 25 bp, Mus musculus
ttgacgagaggacatgtgtccagtt

SEQ ID NO: 843509 - DNA, 25 bp, Mus musculus
ttgacgagaggagatgtgtccagtt

SEQ ID NO: 843510 - DNA, 25 bp, Mus musculus
ttgacgatgagaccctgaggcttcg

SEQ ID NO: 843511 - DNA, 25 bp, Mus musculus
ttgacgatgagagcctgaggcttcg

SEQ ID NO: 843512 - DNA, 25 bp, Mus musculus
ttgacgatgtcccatttaagatagg

SEQ ID NO: 843513 - DNA, 25 bp, Mus musculus
ttgacgatgtccgatttaagatagg

SEQ ID NO: 843514 - DNA, 25 bp, Mus musculus
ttgacgcaggtgctaagccaagcca

SEQ ID NO: 843515 - DNA, 25 bp, Mus musculus
ttgacgcaggtggtaagccaagcca

SEQ ID NO: 843516 - DNA, 25 bp, Mus musculus
ttgacgcagtctccggccactgctg

SEQ ID NO: 843517 - DNA, 25 bp, Mus musculus
ttgacgcagtctgcggccactgctg

SEQ ID NO: 843518 - DNA, 25 bp, Mus musculus
ttgacgcgggtccttcttgtgcaga

SEQ ID NO: 843519 - DNA, 25 bp, Mus musculus
ttgacgcgggtcgttcttgtgcaga

SEQ ID NO: 843520 - DNA, 25 bp, Mus musculus
ttgacggacccgcaagcctaatcac

SEQ ID NO: 843521 - DNA, 25 bp, Mus musculus
ttgacggacccggaagcctaatcac

SEQ ID NO: 843522 - DNA, 25 bp, Mus musculus
ttgacgggatctaccggaaccccat

SEQ ID NO: 843523 - DNA, 25 bp, Mus musculus
ttgacgggatcttccggaaccccat

SEQ ID NO: 843524 - DNA, 25 bp, Mus musculus
ttgacgtcatgcagacacagcctgt

SEQ ID NO: 843525 - DNA, 25 bp, Mus musculus
ttgacgtcatgctgacacagcctgt

SEQ ID NO: 843526 - DNA, 25 bp, Mus musculus
ttgacgttcacacccggctgcagat

SEQ ID NO: 843527 - DNA, 25 bp, Mus musculus
ttgacgttcacagccggctgcagat

SEQ ID NO: 843528 - DNA, 25 bp, Mus musculus
ttgactaagataaagctgaccacgc

SEQ ID NO: 843529 - DNA, 25 bp, Mus musculus
ttgactaagatatagctgaccacgc

SEQ ID NO: 843530 - DNA, 25 bp, Mus musculus
ttgactatatgaataaactgtacca

SEQ ID NO: 843531 - DNA, 25 bp, Mus musculus
ttgactatatgattaaactgtacca

SEQ ID NO: 843532 - DNA, 25 bp, Mus musculus
ttgactatggaccttgtgacccgcc

SEQ ID NO: 843533 - DNA, 25 bp, Mus musculus
ttgactatggacgttgtgacccgcc

SEQ ID NO: 843534 - DNA, 25 bp, Mus musculus
ttgactatgggcagctgagcccaca

SEQ ID NO: 843535 - DNA, 25 bp, Mus musculus
ttgactatgggctgctgagcccaca

SEQ ID NO: 843536 - DNA, 25 bp, Mus musculus
ttgactatttggatgcacatggaag

SEQ ID NO: 843537 - DNA, 25 bp, Mus musculus
ttgactatttggttgcacatggaag

SEQ ID NO: 843538 - DNA, 25 bp, Mus musculus
ttgactcacatgacgacagagatga

SEQ ID NO: 843539 - DNA, 25 bp, Mus musculus
ttgactcacatgtcgacagagatga

SEQ ID NO: 843540 - DNA, 25 bp, Mus musculus
ttgactcagagacatcggccagcac

SEQ ID NO: 843541 - DNA, 25 bp, Mus musculus
ttgactcagagagatcggccagcac

SEQ ID NO: 843542 - DNA, 25 bp, Mus musculus
ttgactcaggccaacagtgttgcag

SEQ ID NO: 843543 - DNA, 25 bp, Mus musculus
ttgactcaggcctacagtgttgcag

SEQ ID NO: 843544 - DNA, 25 bp, Mus musculus
ttgactcccaagatgccatagcaac

SEQ ID NO: 843545 - DNA, 25 bp, Mus musculus
ttgactcccaagttgccatagcaac

SEQ ID NO: 843546 - DNA, 25 bp, Mus musculus
ttgactcgggagcagaagtttgaaa

SEQ ID NO: 843547 - DNA, 25 bp, Mus musculus
ttgactcgggaggagaagtttgaaa

SEQ ID NO: 843548 - DNA, 25 bp, Mus musculus
ttgactctactcagcataccagcca

SEQ ID NO: 843549 - DNA, 25 bp, Mus musculus
ttgactctactctgcataccagcca

SEQ ID NO: 843550 - DNA, 25 bp, Mus musculus
ttgactctgcagctatcatagaaga

SEQ ID NO: 843551 - DNA, 25 bp, Mus musculus
ttgactctgcaggtatcatagaaga

SEQ ID NO: 843552 - DNA, 25 bp, Mus musculus
ttgactctggagcaggcatatagct

SEQ ID NO: 843553 - DNA, 25 bp, Mus musculus
ttgactctggaggaggcatatagct

SEQ ID NO: 843554 - DNA, 25 bp, Mus musculus
ttgactgacagcagctccgccgtgc

SEQ ID NO: 843555 - DNA, 25 bp, Mus musculus
ttgactgacagctgctccgccgtgc

SEQ ID NO: 843556 - DNA, 25 bp, Mus musculus
ttgactgacccaactgtaataaaag

SEQ ID NO: 843557 - DNA, 25 bp, Mus musculus
ttgactgacccatctgtaataaaag

SEQ ID NO: 843558 - DNA, 25 bp, Mus musculus
ttgactgggctcctaagagcgaccg

SEQ ID NO: 843559 - DNA, 25 bp, Mus musculus
ttgactgggctcgtaagagcgaccg

SEQ ID NO: 843560 - DNA, 25 bp, Mus musculus
ttgactggtttgacagactcccaag

SEQ ID NO: 843561 - DNA, 25 bp, Mus musculus
ttgactggtttgtcagactcccaag

SEQ ID NO: 843562 - DNA, 25 bp, Mus musculus
ttgactgtgcagctctttgcattcc

SEQ ID NO: 843563 - DNA, 25 bp, Mus musculus
ttgactgtgcaggtctttgcattcc

SEQ ID NO: 843564 - DNA, 25 bp, Mus musculus
ttgactgtggagatgacgtcaatga

SEQ ID NO: 843565 - DNA, 25 bp, Mus musculus
ttgactgtggagttgacgtcaatga

SEQ ID NO: 843566 - DNA, 25 bp, Mus musculus
ttgacttacaagcactccggagtag

SEQ ID NO: 843567 - DNA, 25 bp, Mus musculus
ttgacttacaaggactccggagtag

SEQ ID NO: 843568 - DNA, 25 bp, Mus musculus
ttgacttcaaagacaaactggaaga

SEQ ID NO: 843569 - DNA, 25 bp, Mus musculus
ttgacttcaaagtcaaactggaaga

SEQ ID NO: 843570 - DNA, 25 bp, Mus musculus
ttgacttccttgctgagaaggacca

SEQ ID NO: 843571 - DNA, 25 bp, Mus musculus
ttgacttccttggtgagaaggacca

SEQ ID NO: 843572 - DNA, 25 bp, Mus musculus
ttgacttcgctactcggtgacgcgg

SEQ ID NO: 843573 - DNA, 25 bp, Mus musculus
ttgacttcgctagtcggtgacgcgg

SEQ ID NO: 843574 - DNA, 25 bp, Mus musculus
ttgacttgagagacaatggagactt

SEQ ID NO: 843575 - DNA, 25 bp, Mus musculus
ttgacttgagagtcaatggagactt

SEQ ID NO: 843576 - DNA, 25 bp, Mus musculus
ttgacttgataaacaacttgcttca

SEQ ID NO: 843577 - DNA, 25 bp, Mus musculus
ttgacttgataatcaacttgcttca

SEQ ID NO: 843578 - DNA, 25 bp, Mus musculus
ttgacttgtaaaaccaactggctcc

SEQ ID NO: 843579 - DNA, 25 bp, Mus musculus
ttgacttgtaaatccaactggctcc

SEQ ID NO: 843580 - DNA, 25 bp, Mus musculus
ttgactttcactcttcgccaagggc

SEQ ID NO: 843581 - DNA, 25 bp, Mus musculus
ttgactttcactgttcgccaagggc

SEQ ID NO: 843582 - DNA, 25 bp, Mus musculus
ttgactttccccaagaccagctggc

SEQ ID NO: 843583 - DNA, 25 bp, Mus musculus
ttgactttcccctagaccagctggc

SEQ ID NO: 843584 - DNA, 25 bp, Mus musculus
ttgactttgggaatgcgggcacccc

SEQ ID NO: 843585 - DNA, 25 bp, Mus musculus
ttgactttgggattgcgggcacccc

SEQ ID NO: 843586 - DNA, 25 bp, Mus musculus
ttgagaaacggcctcaggagttgtt

SEQ ID NO: 843587 - DNA, 25 bp, Mus musculus
ttgagaaacggcgtcaggagttgtt

SEQ ID NO: 843588 - DNA, 25 bp, Mus musculus
ttgagaaagggtagagatacactcc

SEQ ID NO: 843589 - DNA, 25 bp, Mus musculus
ttgagaaagggttgagatacactcc

SEQ ID NO: 843590 - DNA, 25 bp, Mus musculus
ttgagaacacctctgaaccttacgg

SEQ ID NO: 843591 - DNA, 25 bp, Mus musculus
ttgagaacacctgtgaaccttacgg

SEQ ID NO: 843592 - DNA, 25 bp, Mus musculus
ttgagaacacgcagtgggccggcac

SEQ ID NO: 843593 - DNA, 25 bp, Mus musculus
ttgagaacacgctgtgggccggcac

SEQ ID NO: 843594 - DNA, 25 bp, Mus musculus
ttgagaaccccacggtagttcagcc

SEQ ID NO: 843595 - DNA, 25 bp, Mus musculus
ttgagaaccccagggtagttcagcc

SEQ ID NO: 843596 - DNA, 25 bp, Mus musculus
ttgagaactctcatcgcctccgctg

SEQ ID NO: 843597 - DNA, 25 bp, Mus musculus
ttgagaactctcttcgcctccgctg

SEQ ID NO: 843598 - DNA, 25 bp, Mus musculus
ttgagaactgtccaggcctctggca

SEQ ID NO: 843599 - DNA, 25 bp, Mus musculus
ttgagaactgtcgaggcctctggca

SEQ ID NO: 843600 - DNA, 25 bp, Mus musculus
ttgagaagaagaatggccgaggaca

SEQ ID NO: 843601 - DNA, 25 bp, Mus musculus
ttgagaagaagattggccgaggaca

SEQ ID NO: 843602 - DNA, 25 bp, Mus musculus
ttgagaagctgtcttctcacctctc

SEQ ID NO: 843603 - DNA, 25 bp, Mus musculus
ttgagaagctgtgttctcacctctc

SEQ ID NO: 843604 - DNA, 25 bp, Mus musculus
ttgagaagtaaactcttggccggac

SEQ ID NO: 843605 - DNA, 25 bp, Mus musculus
ttgagaagtaaagtcttggccggac

SEQ ID NO: 843606 - DNA, 25 bp, Mus musculus
ttgagaatcagacccaagtcctgga

SEQ ID NO: 843607 - DNA, 25 bp, Mus musculus
ttgagaatcagagccaagtcctgga

SEQ ID NO: 843608 - DNA, 25 bp, Mus musculus
ttgagacaactgatgcaagcctcaa

SEQ ID NO: 843609 - DNA, 25 bp, Mus musculus
ttgagacaactgttgcaagcctcaa

SEQ ID NO: 843610 - DNA, 25 bp, Mus musculus
ttgagacaatgtcgatgctagcaga

SEQ ID NO: 843611 - DNA, 25 bp, Mus musculus
ttgagacaatgtggatgctagcaga

SEQ ID NO: 843612 - DNA, 25 bp, Mus musculus
ttgagacacgcaagaatgatgcctt

SEQ ID NO: 843613 - DNA, 25 bp, Mus musculus
ttgagacacgcatgaatgatgcctt

SEQ ID NO: 843614 - DNA, 25 bp, Mus musculus
ttgagacatactctgtgaccctggc

SEQ ID NO: 843615 - DNA, 25 bp, Mus musculus
ttgagacatactgtgtgaccctggc

SEQ ID NO: 843616 - DNA, 25 bp, Mus musculus
ttgagaccaaggaagcccagagggc

SEQ ID NO: 843617 - DNA, 25 bp, Mus musculus
ttgagaccaaggtagcccagagggc

SEQ ID NO: 843618 - DNA, 25 bp, Mus musculus
ttgagaccacagcaaagaccacctg

SEQ ID NO: 843619 - DNA, 25 bp, Mus musculus
ttgagaccacaggaaagaccacctg

SEQ ID NO: 843620 - DNA, 25 bp, Mus musculus
ttgagacccacaagactgatccacc

SEQ ID NO: 843621 - DNA, 25 bp, Mus musculus
ttgagacccacatgactgatccacc

SEQ ID NO: 843622 - DNA, 25 bp, Mus musculus
ttgagacccatcaaagcaagatgag

SEQ ID NO: 843623 - DNA, 25 bp, Mus musculus
ttgagacccatctaagcaagatgag

SEQ ID NO: 843624 - DNA, 25 bp, Mus musculus
ttgagacgcctgagggaaaccacca

SEQ ID NO: 843625 - DNA, 25 bp, Mus musculus
ttgagacgcctgtgggaaaccacca

SEQ ID NO: 843626 - DNA, 25 bp, Mus musculus
ttgagacggcgcagcccaggattcc

SEQ ID NO: 843627 - DNA, 25 bp, Mus musculus
ttgagacggcgctgcccaggattcc

SEQ ID NO: 843628 - DNA, 25 bp, Mus musculus
ttgagagacactaacagcaattgct

SEQ ID NO: 843629 - DNA, 25 bp, Mus musculus
ttgagagacacttacagcaattgct

SEQ ID NO: 843630 - DNA, 25 bp, Mus musculus
ttgagagagctgatggccgccgcct

SEQ ID NO: 843631 - DNA, 25 bp, Mus musculus
ttgagagagctgttggccgccgcct

SEQ ID NO: 843632 - DNA, 25 bp, Mus musculus
ttgagagcaccaaggaccaaagtgg

SEQ ID NO: 843633 - DNA, 25 bp, Mus musculus
ttgagagcaccatggaccaaagtgg

SEQ ID NO: 843634 - DNA, 25 bp, Mus musculus
ttgagagcagtgctgccaagctaaa

SEQ ID NO: 843635 - DNA, 25 bp, Mus musculus
ttgagagcagtggtgccaagctaaa

SEQ ID NO: 843636 - DNA, 25 bp, Mus musculus
ttgagagctaccctgacccctttgg

SEQ ID NO: 843637 - DNA, 25 bp, Mus musculus
ttgagagctaccgtgacccctttgg

SEQ ID NO: 843638 - DNA, 25 bp, Mus musculus
ttgagagctcgtctccccgggctcg

SEQ ID NO: 843639 - DNA, 25 bp, Mus musculus
ttgagagctcgtgtccccgggctcg

SEQ ID NO: 843640 - DNA, 25 bp, Mus musculus
ttgagaggcaaaagaaccaatcatt

SEQ ID NO: 843641 - DNA, 25 bp, Mus musculus
ttgagaggcaaatgaaccaatcatt

SEQ ID NO: 843642 - DNA, 25 bp, Mus musculus
ttgagagtggtgaatacaacaacac

SEQ ID NO: 843643 - DNA, 25 bp, Mus musculus
ttgagagtggtgtatacaacaacac

SEQ ID NO: 843644 - DNA, 25 bp, Mus musculus
ttgagagtgtctatagcaaggtgga

SEQ ID NO: 843645 - DNA, 25 bp, Mus musculus
ttgagagtgtctttagcaaggtgga

SEQ ID NO: 843646 - DNA, 25 bp, Mus musculus
ttgagagtttctcccagagcgcagc

SEQ ID NO: 843647 - DNA, 25 bp, Mus musculus
ttgagagtttctgccagagcgcagc

SEQ ID NO: 843648 - DNA, 25 bp, Mus musculus
ttgagatagacaacgaacccacaga

SEQ ID NO: 843649 - DNA, 25 bp, Mus musculus
ttgagatagacatcgaacccacaga

SEQ ID NO: 843650 - DNA, 25 bp, Mus musculus
ttgagatatgccctttaactctcct

SEQ ID NO: 843651 - DNA, 25 bp, Mus musculus
ttgagatatgccgtttaactctcct

SEQ ID NO: 843652 - DNA, 25 bp, Mus musculus
ttgagatcaatgaggcctttgcaag

SEQ ID NO: 843653 - DNA, 25 bp, Mus musculus
ttgagatcaatgtggcctttgcaag

SEQ ID NO: 843654 - DNA, 25 bp, Mus musculus
ttgagatcacttctgaggctccgtt

SEQ ID NO: 843655 - DNA, 25 bp, Mus musculus
ttgagatcacttgtgaggctccgtt

SEQ ID NO: 843656 - DNA, 25 bp, Mus musculus
ttgagatgaaagacatccatggctg

SEQ ID NO: 843657 - DNA, 25 bp, Mus musculus
ttgagatgaaagtcatccatggctg

SEQ ID NO: 843658 - DNA, 25 bp, Mus musculus
ttgagatggacaatcaggctgcagc

SEQ ID NO: 843659 - DNA, 25 bp, Mus musculus
ttgagatggacattcaggctgcagc

SEQ ID NO: 843660 - DNA, 25 bp, Mus musculus
ttgagatgtctcactgcatggcagg

SEQ ID NO: 843661 - DNA, 25 bp, Mus musculus
ttgagatgtctctctgcatggcagg

SEQ ID NO: 843662 - DNA, 25 bp, Mus musculus
ttgagattaacgacgtggagcctga

SEQ ID NO: 843663 - DNA, 25 bp, Mus musculus
ttgagattaacgtcgtggagcctga

SEQ ID NO: 843664 - DNA, 25 bp, Mus musculus
ttgagattcagaataaatccgaggg

SEQ ID NO: 843665 - DNA, 25 bp, Mus musculus
ttgagattcagattaaatccgaggg

SEQ ID NO: 843666 - DNA, 25 bp, Mus musculus
ttgagattcagtccatcagccgcgt

SEQ ID NO: 843667 - DNA, 25 bp, Mus musculus
ttgagattcagtgcatcagccgcgt

SEQ ID NO: 843668 - DNA, 25 bp, Mus musculus
ttgagcaagaagaattgggagctcc

SEQ ID NO: 843669 - DNA, 25 bp, Mus musculus
ttgagcaagaagtattgggagctcc

SEQ ID NO: 843670 - DNA, 25 bp, Mus musculus
ttgagcaagcttctatgagagccga

SEQ ID NO: 843671 - DNA, 25 bp, Mus musculus
ttgagcaagcttgtatgagagccga

SEQ ID NO: 843672 - DNA, 25 bp, Mus musculus
ttgagcagatctctaaaacaattcg

SEQ ID NO: 843673 - DNA, 25 bp, Mus musculus
ttgagcagatctgtaaaacaattcg

SEQ ID NO: 843674 - DNA, 25 bp, Mus musculus
ttgagcagcacacagtccgggccaa

SEQ ID NO: 843675 - DNA, 25 bp, Mus musculus
ttgagcagcacagagtccgggccaa

SEQ ID NO: 843676 - DNA, 25 bp, Mus musculus
ttgagcatcctgaacaatacctgtg

SEQ ID NO: 843677 - DNA, 25 bp, Mus musculus
ttgagcatcctgtacaatacctgtg

SEQ ID NO: 843678 - DNA, 25 bp, Mus musculus
ttgagcatgttccagacggcagtgt

SEQ ID NO: 843679 - DNA, 25 bp, Mus musculus
ttgagcatgttcgagacggcagtgt

SEQ ID NO: 843680 - DNA, 25 bp, Mus musculus
ttgagccacatgatctgtgaaggat

SEQ ID NO: 843681 - DNA, 25 bp, Mus musculus
ttgagccacatgttctgtgaaggat

SEQ ID NO: 843682 - DNA, 25 bp, Mus musculus
ttgagccagctccagcaaccagata

SEQ ID NO: 843683 - DNA, 25 bp, Mus musculus
ttgagccagctcgagcaaccagata

SEQ ID NO: 843684 - DNA, 25 bp, Mus musculus
ttgagcccgcggctcatccgcgtgt

SEQ ID NO: 843685 - DNA, 25 bp, Mus musculus
ttgagcccgcgggtcatccgcgtgt

SEQ ID NO: 843686 - DNA, 25 bp, Mus musculus
ttgagccctttgacgacaggacccc

SEQ ID NO: 843687 - DNA, 25 bp, Mus musculus
ttgagccctttgtcgacaggacccc

SEQ ID NO: 843688 - DNA, 25 bp, Mus musculus
ttgagccggctgaacacagcaacat

SEQ ID NO: 843689 - DNA, 25 bp, Mus musculus
ttgagccggctgtacacagcaacat

SEQ ID NO: 843690 - DNA, 25 bp, Mus musculus
ttgagccgggcacagaaacacagca

SEQ ID NO: 843691 - DNA, 25 bp, Mus musculus
ttgagccgggcagagaaacacagca

SEQ ID NO: 843692 - DNA, 25 bp, Mus musculus
ttgagccgggcgacatgttgctgca

SEQ ID NO: 843693 - DNA, 25 bp, Mus musculus
ttgagccgggcgtcatgttgctgca

SEQ ID NO: 843694 - DNA, 25 bp, Mus musculus
ttgagcctacggagactgtgtaccc

SEQ ID NO: 843695 - DNA, 25 bp, Mus musculus
ttgagcctacggtgactgtgtaccc

SEQ ID NO: 843696 - DNA, 25 bp, Mus musculus
ttgagccttaacagagtgcatgatg

SEQ ID NO: 843697 - DNA, 25 bp, Mus musculus
ttgagccttaactgagtgcatgatg

SEQ ID NO: 843698 - DNA, 25 bp, Mus musculus
ttgagcgcacctaccatgtggaaac

SEQ ID NO: 843699 - DNA, 25 bp, Mus musculus
ttgagcgcaccttccatgtggaaac

SEQ ID NO: 843700 - DNA, 25 bp, Mus musculus
ttgagcggacctctgaccacatctg

SEQ ID NO: 843701 - DNA, 25 bp, Mus musculus
ttgagcggacctgtgaccacatctg

SEQ ID NO: 843702 - DNA, 25 bp, Mus musculus
ttgagcgtcctcaggacgcctcagc

SEQ ID NO: 843703 - DNA, 25 bp, Mus musculus
ttgagcgtcctctggacgcctcagc

SEQ ID NO: 843704 - DNA, 25 bp, Mus musculus
ttgagctaagctaaaaccatgggaa

SEQ ID NO: 843705 - DNA, 25 bp, Mus musculus
ttgagctaagcttaaaccatgggaa

SEQ ID NO: 843706 - DNA, 25 bp, Mus musculus
ttgagctacatcagcccagtgaatg

SEQ ID NO: 843707 - DNA, 25 bp, Mus musculus
ttgagctacatctgcccagtgaatg

SEQ ID NO: 843708 - DNA, 25 bp, Mus musculus
ttgagctagcctaccagactgtcct

SEQ ID NO: 843709 - DNA, 25 bp, Mus musculus
ttgagctagccttccagactgtcct

SEQ ID NO: 843710 - DNA, 25 bp, Mus musculus
ttgagctgacctccccacgaatgtt

SEQ ID NO: 843711 - DNA, 25 bp, Mus musculus
ttgagctgacctgcccacgaatgtt

SEQ ID NO: 843712 - DNA, 25 bp, Mus musculus
ttgagctgcctgctgaccccaagtg

SEQ ID NO: 843713 - DNA, 25 bp, Mus musculus
ttgagctgcctggtgaccccaagtg

SEQ ID NO: 843714 - DNA, 25 bp, Mus musculus
ttgagctgctctatcggaccctgcc

SEQ ID NO: 843715 - DNA, 25 bp, Mus musculus
ttgagctgctctttcggaccctgcc

SEQ ID NO: 843716 - DNA, 25 bp, Mus musculus
ttgagctgggcgagatgttgcttat

SEQ ID NO: 843717 - DNA, 25 bp, Mus musculus
ttgagctgggcgtgatgttgcttat

SEQ ID NO: 843718 - DNA, 25 bp, Mus musculus
ttgagctgtatgacaatgcaccggg

SEQ ID NO: 843719 - DNA, 25 bp, Mus musculus
ttgagctgtatgtcaatgcaccggg

SEQ ID NO: 843720 - DNA, 25 bp, Mus musculus
ttgagcttcgcccagaggtacccga

SEQ ID NO: 843721 - DNA, 25 bp, Mus musculus
ttgagcttcgccgagaggtacccga

SEQ ID NO: 843722 - DNA, 25 bp, Mus musculus
ttgagcttctggactgacttcggga

SEQ ID NO: 843723 - DNA, 25 bp, Mus musculus
ttgagcttctggtctgacttcggga

SEQ ID NO: 843724 - DNA, 25 bp, Mus musculus
ttgagcttgaggcaaaacaggattc

SEQ ID NO: 843725 - DNA, 25 bp, Mus musculus
ttgagcttgagggaaaacaggattc

SEQ ID NO: 843726 - DNA, 25 bp, Mus musculus
ttgagcttggcgagcagctggacaa

SEQ ID NO: 843727 - DNA, 25 bp, Mus musculus
ttgagcttggcgtgcagctggacaa

SEQ ID NO: 843728 - DNA, 25 bp, Mus musculus
ttgaggaaaggaaacttcttggtgc

SEQ ID NO: 843729 - DNA, 25 bp, Mus musculus
ttgaggaaaggatacttcttggtgc

SEQ ID NO: 843730 - DNA, 25 bp, Mus musculus
ttgaggaaattcagaaacacctgtg

SEQ ID NO: 843731 - DNA, 25 bp, Mus musculus
ttgaggaaattctgaaacacctgtg

SEQ ID NO: 843732 - DNA, 25 bp, Mus musculus
ttgaggaactcaacgtcactcggcc

SEQ ID NO: 843733 - DNA, 25 bp, Mus musculus
ttgaggaactcatcgtcactcggcc

SEQ ID NO: 843734 - DNA, 25 bp, Mus musculus
ttgaggacagccatcgcctggccct

SEQ ID NO: 843735 - DNA, 25 bp, Mus musculus
ttgaggacagccttcgcctggccct

SEQ ID NO: 843736 - DNA, 25 bp, Mus musculus
ttgaggaccaccatcccagaagtac

SEQ ID NO: 843737 - DNA, 25 bp, Mus musculus
ttgaggaccaccttcccagaagtac

SEQ ID NO: 843738 - DNA, 25 bp, Mus musculus
ttgaggacccacatttctccagaag

SEQ ID NO: 843739 - DNA, 25 bp, Mus musculus
ttgaggacccacttttctccagaag

SEQ ID NO: 843740 - DNA, 25 bp, Mus musculus
ttgaggacccagattccaactttgg

SEQ ID NO: 843741 - DNA, 25 bp, Mus musculus
ttgaggacccagtttccaactttgg

SEQ ID NO: 843742 - DNA, 25 bp, Mus musculus
ttgaggaccttccagcaagatttgg

SEQ ID NO: 843743 - DNA, 25 bp, Mus musculus
ttgaggaccttcgagcaagatttgg

SEQ ID NO: 843744 - DNA, 25 bp, Mus musculus
ttgaggacgaagcaagccagccttt

SEQ ID NO: 843745 - DNA, 25 bp, Mus musculus
ttgaggacgaagcagtcctggacaa

SEQ ID NO: 843746 - DNA, 25 bp, Mus musculus
ttgaggacgaaggaagccagccttt

SEQ ID NO: 843747 - DNA, 25 bp, Mus musculus
ttgaggacgaaggagtcctggacaa

SEQ ID NO: 843748 - DNA, 25 bp, Mus musculus
ttgaggactgtgacaacgtggtgac

SEQ ID NO: 843749 - DNA, 25 bp, Mus musculus
ttgaggactgtgtcaacgtggtgac

SEQ ID NO: 843750 - DNA, 25 bp, Mus musculus
ttgaggagaatgatggtcaccaccc

SEQ ID NO: 843751 - DNA, 25 bp, Mus musculus
ttgaggagaatgttggtcaccaccc

SEQ ID NO: 843752 - DNA, 25 bp, Mus musculus
ttgaggagcataaccgggctttgga

SEQ ID NO: 843753 - DNA, 25 bp, Mus musculus
ttgaggagcatatccgggctttgga

SEQ ID NO: 843754 - DNA, 25 bp, Mus musculus
ttgaggagcgcccaaaacttcaccg

SEQ ID NO: 843755 - DNA, 25 bp, Mus musculus
ttgaggagcgccgaaaacttcaccg

SEQ ID NO: 843756 - DNA, 25 bp, Mus musculus
ttgaggagcttgaagacacttggct

SEQ ID NO: 843757 - DNA, 25 bp, Mus musculus
ttgaggagcttgtagacacttggct

SEQ ID NO: 843758 - DNA, 25 bp, Mus musculus
ttgaggaggaggaccgtttctacct

SEQ ID NO: 843759 - DNA, 25 bp, Mus musculus
ttgaggaggaggtccgtttctacct

SEQ ID NO: 843760 - DNA, 25 bp, Mus musculus
ttgaggaggcgcagaactccaaggc

SEQ ID NO: 843761 - DNA, 25 bp, Mus musculus
ttgaggaggcgctgaactccaaggc

SEQ ID NO: 843762 - DNA, 25 bp, Mus musculus
ttgaggatcctgatgaaaaagtagc

SEQ ID NO: 843763 - DNA, 25 bp, Mus musculus
ttgaggatcctgttgaaaaagtagc

SEQ ID NO: 843764 - DNA, 25 bp, Mus musculus
ttgaggcaacccatgagcgactgaa

SEQ ID NO: 843765 - DNA, 25 bp, Mus musculus
ttgaggcaacccttgagcgactgaa

SEQ ID NO: 843766 - DNA, 25 bp, Mus musculus
ttgaggcaatgtattatgaaaagca

SEQ ID NO: 843767 - DNA, 25 bp, Mus musculus
ttgaggcaatgttttatgaaaagca

SEQ ID NO: 843768 - DNA, 25 bp, Mus musculus
ttgaggcagcccaggctcttccggt

SEQ ID NO: 843769 - DNA, 25 bp, Mus musculus
ttgaggcagccctggctcttccggt

SEQ ID NO: 843770 - DNA, 25 bp, Mus musculus
ttgaggcatggactgagaccacagc

SEQ ID NO: 843771 - DNA, 25 bp, Mus musculus
ttgaggcatggagtgagaccacagc

SEQ ID NO: 843772 - DNA, 25 bp, Mus musculus
ttgaggccaggcagacacagggcat

SEQ ID NO: 843773 - DNA, 25 bp, Mus musculus
ttgaggccaggctgacacagggcat

SEQ ID NO: 843774 - DNA, 25 bp, Mus musculus
ttgaggccattgagcttccaataga

SEQ ID NO: 843775 - DNA, 25 bp, Mus musculus
ttgaggccattgtgcttccaataga

SEQ ID NO: 843776 - DNA, 25 bp, Mus musculus
ttgaggccgcccagaggtacaatga

SEQ ID NO: 843777 - DNA, 25 bp, Mus musculus
ttgaggccgccctgaggtacaatga

SEQ ID NO: 843778 - DNA, 25 bp, Mus musculus
ttgaggccgtcacccgagtccattt

SEQ ID NO: 843779 - DNA, 25 bp, Mus musculus
ttgaggccgtcagccgagtccattt

SEQ ID NO: 843780 - DNA, 25 bp, Mus musculus
ttgaggcctcgcaaggtcagcaccc

SEQ ID NO: 843781 - DNA, 25 bp, Mus musculus
ttgaggcctcgctaggtcagcaccc

SEQ ID NO: 843782 - DNA, 25 bp, Mus musculus
ttgaggcgaaccataggcactcctg

SEQ ID NO: 843783 - DNA, 25 bp, Mus musculus
ttgaggcgaaccttaggcactcctg

SEQ ID NO: 843784 - DNA, 25 bp, Mus musculus
ttgaggcggaaaacaaaggaggatc

SEQ ID NO: 843785 - DNA, 25 bp, Mus musculus
ttgaggcggaaatcaaaggaggatc

SEQ ID NO: 843786 - DNA, 25 bp, Mus musculus
ttgaggctaactcggctggctgctt

SEQ ID NO: 843787 - DNA, 25 bp, Mus musculus
ttgaggctaactgggctggctgctt

SEQ ID NO: 843788 - DNA, 25 bp, Mus musculus
ttgaggctatcacaacctccggctg

SEQ ID NO: 843789 - DNA, 25 bp, Mus musculus
ttgaggctatcagaacctccggctg

SEQ ID NO: 843790 - DNA, 25 bp, Mus musculus
ttgaggctcaccatgacagcatcat

SEQ ID NO: 843791 - DNA, 25 bp, Mus musculus
ttgaggctcaccttgacagcatcat

SEQ ID NO: 843792 - DNA, 25 bp, Mus musculus
ttgaggctccagaggagttggttcc

SEQ ID NO: 843793 - DNA, 25 bp, Mus musculus
ttgaggctccagtggagttggttcc

SEQ ID NO: 843794 - DNA, 25 bp, Mus musculus
ttgaggctctgcaactgcgagcaca

SEQ ID NO: 843795 - DNA, 25 bp, Mus musculus
ttgaggctctgctactgcgagcaca

SEQ ID NO: 843796 - DNA, 25 bp, Mus musculus
ttgaggctgtccctctgctgaggaa

SEQ ID NO: 843797 - DNA, 25 bp, Mus musculus
ttgaggctgtccgtctgctgaggaa

SEQ ID NO: 843798 - DNA, 25 bp, Mus musculus
ttgagggaaccaacgacggcctaga

SEQ ID NO: 843799 - DNA, 25 bp, Mus musculus
ttgagggaaccatcgacggcctaga

SEQ ID NO: 843800 - DNA, 25 bp, Mus musculus
ttgagggacctacacgaactctggg

SEQ ID NO: 843801 - DNA, 25 bp, Mus musculus
ttgagggacctagacgaactctggg

SEQ ID NO: 843802 - DNA, 25 bp, Mus musculus
ttgagggccgctcctactctgcctg

SEQ ID NO: 843803 - DNA, 25 bp, Mus musculus
ttgagggccgctgctactctgcctg

SEQ ID NO: 843804 - DNA, 25 bp, Mus musculus
ttgagggcgcctctgttatctcagg

SEQ ID NO: 843805 - DNA, 25 bp, Mus musculus
ttgagggcgcctgtgttatctcagg

SEQ ID NO: 843806 - DNA, 25 bp, Mus musculus
ttgagggttcaacccaccctgtggg

SEQ ID NO: 843807 - DNA, 25 bp, Mus musculus
ttgagggttcaagccaccctgtggg

SEQ ID NO: 843808 - DNA, 25 bp, Mus musculus
ttgaggtgagctacttggaaactga

SEQ ID NO: 843809 - DNA, 25 bp, Mus musculus
ttgaggtgagcttcttggaaactga

SEQ ID NO: 843810 - DNA, 25 bp, Mus musculus
ttgaggtgctcccttcagtcactgg

SEQ ID NO: 843811 - DNA, 25 bp, Mus musculus
ttgaggtgctccgttcagtcactgg

SEQ ID NO: 843812 - DNA, 25 bp, Mus musculus
ttgaggtgtataaggcccgaagcca

SEQ ID NO: 843813 - DNA, 25 bp, Mus musculus
ttgaggtgtatatggcccgaagcca

SEQ ID NO: 843814 - DNA, 25 bp, Mus musculus
ttgaggttcccaccgctgtgttccc

SEQ ID NO: 843815 - DNA, 25 bp, Mus musculus
ttgaggttcccagcgctgtgttccc

SEQ ID NO: 843816 - DNA, 25 bp, Mus musculus
ttgaggttgagtccgaagaagaccc

SEQ ID NO: 843817 - DNA, 25 bp, Mus musculus
ttgaggttgagtgcgaagaagaccc

SEQ ID NO: 843818 - DNA, 25 bp, Mus musculus
ttgaggttgctgagactcgtcccgg

SEQ ID NO: 843819 - DNA, 25 bp, Mus musculus
ttgaggttgctgtgactcgtcccgg

SEQ ID NO: 843820 - DNA, 25 bp, Mus musculus
ttgagtacaagtctgccaacagaga

SEQ ID NO: 843821 - DNA, 25 bp, Mus musculus
ttgagtacaagtgtgccaacagaga

SEQ ID NO: 843822 - DNA, 25 bp, Mus musculus
ttgagtacatgaagcacggggacct

SEQ ID NO: 843823 - DNA, 25 bp, Mus musculus
ttgagtacatgatgcacggggacct

SEQ ID NO: 843824 - DNA, 25 bp, Mus musculus
ttgagtcagcaacaaaacgaggagg

SEQ ID NO: 843825 - DNA, 25 bp, Mus musculus
ttgagtcagcaagaaaacgaggagg

SEQ ID NO: 843826 - DNA, 25 bp, Mus musculus
ttgagtcatgaaactgtaaccattg

SEQ ID NO: 843827 - DNA, 25 bp, Mus musculus
ttgagtcatgaatctgtaaccattg

SEQ ID NO: 843828 - DNA, 25 bp, Mus musculus
ttgagtccagaaattacaacagaag

SEQ ID NO: 843829 - DNA, 25 bp, Mus musculus
ttgagtccagaatttacaacagaag

SEQ ID NO: 843830 - DNA, 25 bp, Mus musculus
ttgagtcccagtccccacatcatgt

SEQ ID NO: 843831 - DNA, 25 bp, Mus musculus
ttgagtcccagtgcccacatcatgt

SEQ ID NO: 843832 - DNA, 25 bp, Mus musculus
ttgagtcctacacgacctggaagag

SEQ ID NO: 843833 - DNA, 25 bp, Mus musculus
ttgagtcctacaggacctggaagag

SEQ ID NO: 843834 - DNA, 25 bp, Mus musculus
ttgagtcctggaagttatgacacct

SEQ ID NO: 843835 - DNA, 25 bp, Mus musculus
ttgagtcctggatgttatgacacct

SEQ ID NO: 843836 - DNA, 25 bp, Mus musculus
ttgagtctatcaaggaagatgtgga

SEQ ID NO: 843837 - DNA, 25 bp, Mus musculus
ttgagtctatcatggaagatgtgga

SEQ ID NO: 843838 - DNA, 25 bp, Mus musculus
ttgagtctgaagaaatggagaacgg

SEQ ID NO: 843839 - DNA, 25 bp, Mus musculus
ttgagtctgaagtaatggagaacgg

SEQ ID NO: 843840 - DNA, 25 bp, Mus musculus
ttgagtctgaccctacctggcttcc

SEQ ID NO: 843841 - DNA, 25 bp, Mus musculus
ttgagtctgaccgtacctggcttcc

SEQ ID NO: 843842 - DNA, 25 bp, Mus musculus
ttgagtgcaatgagccagaatctgg

SEQ ID NO: 843843 - DNA, 25 bp, Mus musculus
ttgagtgcaatgtgccagaatctgg

SEQ ID NO: 843844 - DNA, 25 bp, Mus musculus
ttgagtggccgtcgctaagcaactc

SEQ ID NO: 843845 - DNA, 25 bp, Mus musculus
ttgagtggccgtggctaagcaactc

SEQ ID NO: 843846 - DNA, 25 bp, Mus musculus
ttgagttaatggagccagctaccca

SEQ ID NO: 843847 - DNA, 25 bp, Mus musculus
ttgagttaatggtgccagctaccca

SEQ ID NO: 843848 - DNA, 25 bp, Mus musculus
ttgagttccaccctctccttatcag

SEQ ID NO: 843849 - DNA, 25 bp, Mus musculus
ttgagttccaccgtctccttatcag

SEQ ID NO: 843850 - DNA, 25 bp, Mus musculus
ttgagttgacaaccttaaccaccac

SEQ ID NO: 843851 - DNA, 25 bp, Mus musculus
ttgagttgacaagcttaaccaccac

SEQ ID NO: 843852 - DNA, 25 bp, Mus musculus
ttgagttgggagatacaaagtcctc

SEQ ID NO: 843853 - DNA, 25 bp, Mus musculus
ttgagttgggagttacaaagtcctc

SEQ ID NO: 843854 - DNA, 25 bp, Mus musculus
ttgagtttactgacagaggcgggtc

SEQ ID NO: 843855 - DNA, 25 bp, Mus musculus
ttgagtttactgtcagaggcgggtc

SEQ ID NO: 843856 - DNA, 25 bp, Mus musculus
ttgagtttcagaatttcgagaggca

SEQ ID NO: 843857 - DNA, 25 bp, Mus musculus
ttgagtttcagattttcgagaggca

SEQ ID NO: 843858 - DNA, 25 bp, Mus musculus
ttgagtttgcatccagactggagac

SEQ ID NO: 843859 - DNA, 25 bp, Mus musculus
ttgagtttgcatgcagactggagac

SEQ ID NO: 843860 - DNA, 25 bp, Mus musculus
ttgagtttggtgattttcccgccat

SEQ ID NO: 843861 - DNA, 25 bp, Mus musculus
ttgagtttggtgtttttcccgccat

SEQ ID NO: 843862 - DNA, 25 bp, Mus musculus
ttgataaaccggacgctggtggagc

SEQ ID NO: 843863 - DNA, 25 bp, Mus musculus
ttgataaaccggtcgctggtggagc

SEQ ID NO: 843864 - DNA, 25 bp, Mus musculus
ttgataaagacacgagtggagtgat

SEQ ID NO: 843865 - DNA, 25 bp, Mus musculus
ttgataaagacaggagtggagtgat

SEQ ID NO: 843866 - DNA, 25 bp, Mus musculus
ttgataacaaaacgatagtgagcgg

SEQ ID NO: 843867 - DNA, 25 bp, Mus musculus
ttgataacaaaaggatagtgagcgg

SEQ ID NO: 843868 - DNA, 25 bp, Mus musculus
ttgatagacaagaacaccctaggct

SEQ ID NO: 843869 - DNA, 25 bp, Mus musculus
ttgatagacaagtacaccctaggct

SEQ ID NO: 843870 - DNA, 25 bp, Mus musculus
ttgatatacttcctagcgggctggc

SEQ ID NO: 843871 - DNA, 25 bp, Mus musculus
ttgatatacttcgtagcgggctggc

SEQ ID NO: 843872 - DNA, 25 bp, Mus musculus
ttgatatctgtgcacggaggcctcc

SEQ ID NO: 843873 - DNA, 25 bp, Mus musculus
ttgatatctgtggacggaggcctcc

SEQ ID NO: 843874 - DNA, 25 bp, Mus musculus
ttgatattacagatgtacaacctgg

SEQ ID NO: 843875 - DNA, 25 bp, Mus musculus
ttgatattacagttgtacaacctgg

SEQ ID NO: 843876 - DNA, 25 bp, Mus musculus
ttgatattccagaaggaagaagtgg

SEQ ID NO: 843877 - DNA, 25 bp, Mus musculus
ttgatattccagtaggaagaagtgg

SEQ ID NO: 843878 - DNA, 25 bp, Mus musculus
ttgatcaaccccagagcatcagact

SEQ ID NO: 843879 - DNA, 25 bp, Mus musculus
ttgatcaacccctgagcatcagact

SEQ ID NO: 843880 - DNA, 25 bp, Mus musculus
ttgatcacaagaacctggacctgga

SEQ ID NO: 843881 - DNA, 25 bp, Mus musculus
ttgatcacaagatcctggacctgga

SEQ ID NO: 843882 - DNA, 25 bp, Mus musculus
ttgatcataccacggtcgttctgca

SEQ ID NO: 843883 - DNA, 25 bp, Mus musculus
ttgatcataccagggtcgttctgca

SEQ ID NO: 843884 - DNA, 25 bp, Mus musculus
ttgatcatcctgagaaaaatgagcc

SEQ ID NO: 843885 - DNA, 25 bp, Mus musculus
ttgatcatcctgtgaaaaatgagcc

SEQ ID NO: 843886 - DNA, 25 bp, Mus musculus
ttgatcatgttaagagttggtggga

SEQ ID NO: 843887 - DNA, 25 bp, Mus musculus
ttgatcatgttatgagttggtggga

SEQ ID NO: 843888 - DNA, 25 bp, Mus musculus
ttgatcccctcaacatcaaacagaa

SEQ ID NO: 843889 - DNA, 25 bp, Mus musculus
ttgatcccctcatcatcaaacagaa

SEQ ID NO: 843890 - DNA, 25 bp, Mus musculus
ttgatccgaggaatggttttggacc

SEQ ID NO: 843891 - DNA, 25 bp, Mus musculus
ttgatccgaggattggttttggacc

SEQ ID NO: 843892 - DNA, 25 bp, Mus musculus
ttgatcctaactccaaggtgatgca

SEQ ID NO: 843893 - DNA, 25 bp, Mus musculus
ttgatcctaactgcaaggtgatgca

SEQ ID NO: 843894 - DNA, 25 bp, Mus musculus
ttgatcctcaccatccacgttttgg

SEQ ID NO: 843895 - DNA, 25 bp, Mus musculus
ttgatcctcaccttccacgttttgg

SEQ ID NO: 843896 - DNA, 25 bp, Mus musculus
ttgatcctctttatatggagcaaaa

SEQ ID NO: 843897 - DNA, 25 bp, Mus musculus
ttgatcctctttttatggagcaaaa

SEQ ID NO: 843898 - DNA, 25 bp, Mus musculus
ttgatcctgctaacctaagacctgg

SEQ ID NO: 843899 - DNA, 25 bp, Mus musculus
ttgatcctgctatcctaagacctgg

SEQ ID NO: 843900 - DNA, 25 bp, Mus musculus
ttgatcctgggacttgacagccaaa

SEQ ID NO: 843901 - DNA, 25 bp, Mus musculus
ttgatcctgggagttgacagccaaa

SEQ ID NO: 843902 - DNA, 25 bp, Mus musculus
ttgatccttagacaacatgcccacg

SEQ ID NO: 843903 - DNA, 25 bp, Mus musculus
ttgatccttagagaacatgcccacg

SEQ ID NO: 843904 - DNA, 25 bp, Mus musculus
ttgatcgtctctccgtgagacctac

SEQ ID NO: 843905 - DNA, 25 bp, Mus musculus
ttgatcgtctctgcgtgagacctac

SEQ ID NO: 843906 - DNA, 25 bp, Mus musculus
ttgatcgtgaatagcagaagaagaa

SEQ ID NO: 843907 - DNA, 25 bp, Mus musculus
ttgatcgtgaattgcagaagaagaa

SEQ ID NO: 843908 - DNA, 25 bp, Mus musculus
ttgatctacctgacaacctcaggcc

SEQ ID NO: 843909 - DNA, 25 bp, Mus musculus
ttgatctacctgtcaacctcaggcc

SEQ ID NO: 843910 - DNA, 25 bp, Mus musculus
ttgatctccgagatgaccccaaaac

SEQ ID NO: 843911 - DNA, 25 bp, Mus musculus
ttgatctccgagttgaccccaaaac

SEQ ID NO: 843912 - DNA, 25 bp, Mus musculus
ttgatctcgcgcaggcagccgcggc

SEQ ID NO: 843913 - DNA, 25 bp, Mus musculus
ttgatctcgcgctggcagccgcggc

SEQ ID NO: 843914 - DNA, 25 bp, Mus musculus
ttgatctctctactaaggacttacg

SEQ ID NO: 843915 - DNA, 25 bp, Mus musculus
ttgatctctctagtaaggacttacg

SEQ ID NO: 843916 - DNA, 25 bp, Mus musculus
ttgatctgacaactcctcctctagg

SEQ ID NO: 843917 - DNA, 25 bp, Mus musculus
ttgatctgacaagtcctcctctagg

SEQ ID NO: 843918 - DNA, 25 bp, Mus musculus
ttgatctgctcaacctcttccagac

SEQ ID NO: 843919 - DNA, 25 bp, Mus musculus
ttgatctgctcatcctcttccagac

SEQ ID NO: 843920 - DNA, 25 bp, Mus musculus
ttgatctgctgaaggctcgtgctgg

SEQ ID NO: 843921 - DNA, 25 bp, Mus musculus
ttgatctgctgatggctcgtgctgg

SEQ ID NO: 843922 - DNA, 25 bp, Mus musculus
ttgatctggatacaggaagaaaagc

SEQ ID NO: 843923 - DNA, 25 bp, Mus musculus
ttgatctggatagaggaagaaaagc

SEQ ID NO: 843924 - DNA, 25 bp, Mus musculus
ttgatctgtgtgacctgagaacaag

SEQ ID NO: 843925 - DNA, 25 bp, Mus musculus
ttgatctgtgtgtcctgagaacaag

SEQ ID NO: 843926 - DNA, 25 bp, Mus musculus
ttgatcttcgacatttgctctctag

SEQ ID NO: 843927 - DNA, 25 bp, Mus musculus
ttgatcttcgacttttgctctctag

SEQ ID NO: 843928 - DNA, 25 bp, Mus musculus
ttgatgaaaacgaactgaacatcgt

SEQ ID NO: 843929 - DNA, 25 bp, Mus musculus
ttgatgaaaacgtactgaacatcgt

SEQ ID NO: 843930 - DNA, 25 bp, Mus musculus
ttgatgaaatggacagtacacttgc

SEQ ID NO: 843931 - DNA, 25 bp, Mus musculus
ttgatgaaatggtcagtacacttgc

SEQ ID NO: 843932 - DNA, 25 bp, Mus musculus
ttgatgaagcaaaattggctgccct

SEQ ID NO: 843933 - DNA, 25 bp, Mus musculus
ttgatgaagcaatattggctgccct

SEQ ID NO: 843934 - DNA, 25 bp, Mus musculus
ttgatgaattttcccgaaagttcag

SEQ ID NO: 843935 - DNA, 25 bp, Mus musculus
ttgatgaattttgccgaaagttcag

SEQ ID NO: 843936 - DNA, 25 bp, Mus musculus
ttgatgactacactccagacaccat

SEQ ID NO: 843937 - DNA, 25 bp, Mus musculus
ttgatgactacagtccagacaccat

SEQ ID NO: 843938 - DNA, 25 bp, Mus musculus
ttgatgactgcaatgggaactggtg

SEQ ID NO: 843939 - DNA, 25 bp, Mus musculus
ttgatgactgcattgggaactggtg

SEQ ID NO: 843940 - DNA, 25 bp, Mus musculus
ttgatgagaaacaaaactctttgtg

SEQ ID NO: 843941 - DNA, 25 bp, Mus musculus
ttgatgagaaactaaactctttgtg

SEQ ID NO: 843942 - DNA, 25 bp, Mus musculus
ttgatgagctgacccggatctgtga

SEQ ID NO: 843943 - DNA, 25 bp, Mus musculus
ttgatgagctgagccggatctgtga

SEQ ID NO: 843944 - DNA, 25 bp, Mus musculus
ttgatgagctgtacggaggcctgca

SEQ ID NO: 843945 - DNA, 25 bp, Mus musculus
ttgatgagctgttcggaggcctgca

SEQ ID NO: 843946 - DNA, 25 bp, Mus musculus
ttgatgaggacaccacaggttcccc

SEQ ID NO: 843947 - DNA, 25 bp, Mus musculus
ttgatgaggacagcacaggttcccc

SEQ ID NO: 843948 - DNA, 25 bp, Mus musculus
ttgatgaggtgtcattccatagttc

SEQ ID NO: 843949 - DNA, 25 bp, Mus musculus
ttgatgaggtgtgattccatagttc

SEQ ID NO: 843950 - DNA, 25 bp, Mus musculus
ttgatgatcgaaaggaatggttaac

SEQ ID NO: 843951 - DNA, 25 bp, Mus musculus
ttgatgatcgaatggaatggttaac

SEQ ID NO: 843952 - DNA, 25 bp, Mus musculus
ttgatgcagacgacaaagattttag

SEQ ID NO: 843953 - DNA, 25 bp, Mus musculus
ttgatgcagacgtcaaagattttag

SEQ ID NO: 843954 - DNA, 25 bp, Mus musculus
ttgatgcatgcacggcaagcattct

SEQ ID NO: 843955 - DNA, 25 bp, Mus musculus
ttgatgcatgcagggcaagcattct

SEQ ID NO: 843956 - DNA, 25 bp, Mus musculus
ttgatgccaaaaagacagggcagct

SEQ ID NO: 843957 - DNA, 25 bp, Mus musculus
ttgatgccaaaatgacagggcagct

SEQ ID NO: 843958 - DNA, 25 bp, Mus musculus
ttgatgccaaggaacgggcagcagc

SEQ ID NO: 843959 - DNA, 25 bp, Mus musculus
ttgatgccaaggtacgggcagcagc

SEQ ID NO: 843960 - DNA, 25 bp, Mus musculus
ttgatgccatttagagtggaaagcc

SEQ ID NO: 843961 - DNA, 25 bp, Mus musculus
ttgatgccattttgagtggaaagcc

SEQ ID NO: 843962 - DNA, 25 bp, Mus musculus
ttgatgccgacaacgtcaagggcag

SEQ ID NO: 843963 - DNA, 25 bp, Mus musculus
ttgatgccgacatcgtcaagggcag

SEQ ID NO: 843964 - DNA, 25 bp, Mus musculus
ttgatgccttatcgagaattaaaga

SEQ ID NO: 843965 - DNA, 25 bp, Mus musculus
ttgatgccttatggagaattaaaga

SEQ ID NO: 843966 - DNA, 25 bp, Mus musculus
ttgatgcgttgcaggctgacctgac

SEQ ID NO: 843967 - DNA, 25 bp, Mus musculus
ttgatgcgttgctggctgacctgac

SEQ ID NO: 843968 - DNA, 25 bp, Mus musculus
ttgatgctggacaacacctcagtca

SEQ ID NO: 843969 - DNA, 25 bp, Mus musculus
ttgatgctggactacacctcagtca

SEQ ID NO: 843970 - DNA, 25 bp, Mus musculus
ttgatgcttatgaccagaaatgaag

SEQ ID NO: 843971 - DNA, 25 bp, Mus musculus
ttgatgcttatgtccagaaatgaag

SEQ ID NO: 843972 - DNA, 25 bp, Mus musculus
ttgatggaagaaacaacacgtcagc

SEQ ID NO: 843973 - DNA, 25 bp, Mus musculus
ttgatggaagaatcaacacgtcagc

SEQ ID NO: 843974 - DNA, 25 bp, Mus musculus
ttgatggaaggtatatcccacgggc

SEQ ID NO: 843975 - DNA, 25 bp, Mus musculus
ttgatggaaggtttatcccacgggc

SEQ ID NO: 843976 - DNA, 25 bp, Mus musculus
ttgatggagccaagacaatttggga

SEQ ID NO: 843977 - DNA, 25 bp, Mus musculus
ttgatggagccatgacaatttggga

SEQ ID NO: 843978 - DNA, 25 bp, Mus musculus
ttgatggcagttatgaaaaattacc

SEQ ID NO: 843979 - DNA, 25 bp, Mus musculus
ttgatggcagttttgaaaaattacc

SEQ ID NO: 843980 - DNA, 25 bp, Mus musculus
ttgatggcctcccaaagctggtctt

SEQ ID NO: 843981 - DNA, 25 bp, Mus musculus
ttgatggcctccgaaagctggtctt

SEQ ID NO: 843982 - DNA, 25 bp, Mus musculus
ttgatgggctgtaccgcatcagtgg

SEQ ID NO: 843983 - DNA, 25 bp, Mus musculus
ttgatgggctgttccgcatcagtgg

SEQ ID NO: 843984 - DNA, 25 bp, Mus musculus
ttgatggtggagatagaaggccctc

SEQ ID NO: 843985 - DNA, 25 bp, Mus musculus
ttgatggtggagttagaaggccctc

SEQ ID NO: 843986 - DNA, 25 bp, Mus musculus
ttgatgtcaagacagccctaggagc

SEQ ID NO: 843987 - DNA, 25 bp, Mus musculus
ttgatgtcaagagagccctaggagc

SEQ ID NO: 843988 - DNA, 25 bp, Mus musculus
ttgatgtggaacaatacaacaagct

SEQ ID NO: 843989 - DNA, 25 bp, Mus musculus
ttgatgtggaactatacaacaagct

SEQ ID NO: 843990 - DNA, 25 bp, Mus musculus
ttgatgttccaccttcacagccagg

SEQ ID NO: 843991 - DNA, 25 bp, Mus musculus
ttgatgttccacgttcacagccagg

SEQ ID NO: 843992 - DNA, 25 bp, Mus musculus
ttgatgttgcaaagacgaaagcact

SEQ ID NO: 843993 - DNA, 25 bp, Mus musculus
ttgatgttgcaatgacgaaagcact

SEQ ID NO: 843994 - DNA, 25 bp, Mus musculus
ttgattacctggcaaccatccgccg

SEQ ID NO: 843995 - DNA, 25 bp, Mus musculus
ttgattacctgggaaccatccgccg

SEQ ID NO: 843996 - DNA, 25 bp, Mus musculus
ttgattcagaaaatgcagccctacg

SEQ ID NO: 843997 - DNA, 25 bp, Mus musculus
ttgattcagaaattgcagccctacg

SEQ ID NO: 843998 - DNA, 25 bp, Mus musculus
ttgattcaggatcggtacacggccc

SEQ ID NO: 843999 - DNA, 25 bp, Mus musculus
ttgattcaggatgggtacacggccc

SEQ ID NO: 844000 - DNA, 25 bp, Mus musculus
ttgattcatgtaagatgtcgcgtgg

SEQ ID NO: 844001 - DNA, 25 bp, Mus musculus
ttgattcatgtatgatgtcgcgtgg

SEQ ID NO: 844002 - DNA, 25 bp, Mus musculus
ttgattccagtcatgacagaaagaa

SEQ ID NO: 844003 - DNA, 25 bp, Mus musculus
ttgattccagtcttgacagaaagaa

SEQ ID NO: 844004 - DNA, 25 bp, Mus musculus
ttgattccggacacggtggcgcgcc

SEQ ID NO: 844005 - DNA, 25 bp, Mus musculus
ttgattccggactcggtggcgcgcc

SEQ ID NO: 844006 - DNA, 25 bp, Mus musculus
ttgattcgtccacaaccttggctgg

SEQ ID NO: 844007 - DNA, 25 bp, Mus musculus
ttgattcgtccagaaccttggctgg

SEQ ID NO: 844008 - DNA, 25 bp, Mus musculus
ttgattcgtgctcgcctccaagaga

SEQ ID NO: 844009 - DNA, 25 bp, Mus musculus
ttgattcgtgctggcctccaagaga

SEQ ID NO: 844010 - DNA, 25 bp, Mus musculus
ttgattctaacaatgcaccagctga

SEQ ID NO: 844011 - DNA, 25 bp, Mus musculus
ttgattctaacattgcaccagctga

SEQ ID NO: 844012 - DNA, 25 bp, Mus musculus
ttgattctgacaatagcagtgtggg

SEQ ID NO: 844013 - DNA, 25 bp, Mus musculus
ttgattctgacattagcagtgtggg

SEQ ID NO: 844014 - DNA, 25 bp, Mus musculus
ttgattctgtatccgcctctgacag

SEQ ID NO: 844015 - DNA, 25 bp, Mus musculus
ttgattctgtatgcgcctctgacag

SEQ ID NO: 844016 - DNA, 25 bp, Mus musculus
ttgattctgtgtactcccgcctggt

SEQ ID NO: 844017 - DNA, 25 bp, Mus musculus
ttgattctgtgttctcccgcctggt

SEQ ID NO: 844018 - DNA, 25 bp, Mus musculus
ttgattgagggaaccatcgacggcc

SEQ ID NO: 844019 - DNA, 25 bp, Mus musculus
ttgattgagggatccatcgacggcc

SEQ ID NO: 844020 - DNA, 25 bp, Mus musculus
ttgattgcacaaatccgggaagttt

SEQ ID NO: 844021 - DNA, 25 bp, Mus musculus
ttgattgcacaattccgggaagttt

SEQ ID NO: 844022 - DNA, 25 bp, Mus musculus
ttgattgctgctctcgcctccgtgc

SEQ ID NO: 844023 - DNA, 25 bp, Mus musculus
ttgattgctgctgtcgcctccgtgc

SEQ ID NO: 844024 - DNA, 25 bp, Mus musculus
ttgattgcttcaccgtgccatcggc

SEQ ID NO: 844025 - DNA, 25 bp, Mus musculus
ttgattgcttcagcgtgccatcggc

SEQ ID NO: 844026 - DNA, 25 bp, Mus musculus
ttgattgggcttcccctgattggcc

SEQ ID NO: 844027 - DNA, 25 bp, Mus musculus
ttgattgggcttgccctgattggcc

SEQ ID NO: 844028 - DNA, 25 bp, Mus musculus
ttgattgtcctcacggacgtagaag

SEQ ID NO: 844029 - DNA, 25 bp, Mus musculus
ttgattgtcctctcggacgtagaag

SEQ ID NO: 844030 - DNA, 25 bp, Mus musculus
ttgatttcataaccccttagctgag

SEQ ID NO: 844031 - DNA, 25 bp, Mus musculus
ttgatttcataagcccttagctgag

SEQ ID NO: 844032 - DNA, 25 bp, Mus musculus
ttgatttcctggatctggtaacatg

SEQ ID NO: 844033 - DNA, 25 bp, Mus musculus
ttgatttcctggttctggtaacatg

SEQ ID NO: 844034 - DNA, 25 bp, Mus musculus
ttgattttgccaatcctcagaaagg

SEQ ID NO: 844035 - DNA, 25 bp, Mus musculus
ttgattttgccattcctcagaaagg

SEQ ID NO: 844036 - DNA, 25 bp, Mus musculus
ttgattttggtgaaagcgctcagct

SEQ ID NO: 844037 - DNA, 25 bp, Mus musculus
ttgattttggtgtaagcgctcagct

SEQ ID NO: 844038 - DNA, 25 bp, Mus musculus
ttgatttttaatcctcctcctccac

SEQ ID NO: 844039 - DNA, 25 bp, Mus musculus
ttgatttttaatgctcctcctccac

SEQ ID NO: 844040 - DNA, 25 bp, Mus musculus
ttgcaaaaagaaataaacatcttga

SEQ ID NO: 844041 - DNA, 25 bp, Mus musculus
ttgcaaaaagaattaaacatcttga

SEQ ID NO: 844042 - DNA, 25 bp, Mus musculus
ttgcaaaacataacatcgtagctct

SEQ ID NO: 844043 - DNA, 25 bp, Mus musculus
ttgcaaaacatatcatcgtagctct

SEQ ID NO: 844044 - DNA, 25 bp, Mus musculus
ttgcaaaatctactccctgaaggca

SEQ ID NO: 844045 - DNA, 25 bp, Mus musculus
ttgcaaaatctagtccctgaaggca

SEQ ID NO: 844046 - DNA, 25 bp, Mus musculus
ttgcaaacaacacgacggtggagcg

SEQ ID NO: 844047 - DNA, 25 bp, Mus musculus
ttgcaaacaacaggacggtggagcg

SEQ ID NO: 844048 - DNA, 25 bp, Mus musculus
ttgcaaagaagcatgggaagtctcc

SEQ ID NO: 844049 - DNA, 25 bp, Mus musculus
ttgcaaagaagcttgggaagtctcc

SEQ ID NO: 844050 - DNA, 25 bp, Mus musculus
ttgcaaagatgaccgcccgtccttt

SEQ ID NO: 844051 - DNA, 25 bp, Mus musculus
ttgcaaagatgagcgcccgtccttt

SEQ ID NO: 844052 - DNA, 25 bp, Mus musculus
ttgcaaagccagagcaccctcgggc

SEQ ID NO: 844053 - DNA, 25 bp, Mus musculus
ttgcaaagccagtgcaccctcgggc

SEQ ID NO: 844054 - DNA, 25 bp, Mus musculus
ttgcaacacgcacagaacactcatg

SEQ ID NO: 844055 - DNA, 25 bp, Mus musculus
ttgcaacacgcagagaacactcatg

SEQ ID NO: 844056 - DNA, 25 bp, Mus musculus
ttgcaacattgtacaagtcaccaag

SEQ ID NO: 844057 - DNA, 25 bp, Mus musculus
ttgcaacattgttcaagtcaccaag

SEQ ID NO: 844058 - DNA, 25 bp, Mus musculus
ttgcaaccacagatctacagcaaag

SEQ ID NO: 844059 - DNA, 25 bp, Mus musculus
ttgcaaccacagttctacagcaaag

SEQ ID NO: 844060 - DNA, 25 bp, Mus musculus
ttgcaaccgtgaccagtccctcttg

SEQ ID NO: 844061 - DNA, 25 bp, Mus musculus
ttgcaaccgtgagcagtccctcttg

SEQ ID NO: 844062 - DNA, 25 bp, Mus musculus
ttgcaactcgtcagcaagacagaac

SEQ ID NO: 844063 - DNA, 25 bp, Mus musculus
ttgcaactcgtctgcaagacagaac

SEQ ID NO: 844064 - DNA, 25 bp, Mus musculus
ttgcaactgaagagacgtggtcgtg

SEQ ID NO: 844065 - DNA, 25 bp, Mus musculus
ttgcaactgaagtgacgtggtcgtg

SEQ ID NO: 844066 - DNA, 25 bp, Mus musculus
ttgcaactgcgcagaccagaaggct

SEQ ID NO: 844067 - DNA, 25 bp, Mus musculus
ttgcaactgcgctgaccagaaggct

SEQ ID NO: 844068 - DNA, 25 bp, Mus musculus
ttgcaagagaataaagatcacagcc

SEQ ID NO: 844069 - DNA, 25 bp, Mus musculus
ttgcaagagaattaagatcacagcc

SEQ ID NO: 844070 - DNA, 25 bp, Mus musculus
ttgcaagaggtgcacaccattgaac

SEQ ID NO: 844071 - DNA, 25 bp, Mus musculus
ttgcaagaggtggacaccattgaac

SEQ ID NO: 844072 - DNA, 25 bp, Mus musculus
ttgcaagccagcctttttggtctgg

SEQ ID NO: 844073 - DNA, 25 bp, Mus musculus
ttgcaagccagcgtttttggtctgg

SEQ ID NO: 844074 - DNA, 25 bp, Mus musculus
ttgcaaggatccaattcgagaagtc

SEQ ID NO: 844075 - DNA, 25 bp, Mus musculus
ttgcaaggatcctattcgagaagtc

SEQ ID NO: 844076 - DNA, 25 bp, Mus musculus
ttgcaaggccctcctggaaaagtag

SEQ ID NO: 844077 - DNA, 25 bp, Mus musculus
ttgcaaggccctgctggaaaagtag

SEQ ID NO: 844078 - DNA, 25 bp, Mus musculus
ttgcaaggttttctgcctatgaaaa

SEQ ID NO: 844079 - DNA, 25 bp, Mus musculus
ttgcaaggttttgtgcctatgaaaa

SEQ ID NO: 844080 - DNA, 25 bp, Mus musculus
ttgcaagtattaaccagaaggatgg

SEQ ID NO: 844081 - DNA, 25 bp, Mus musculus
ttgcaagtattatccagaaggatgg

SEQ ID NO: 844082 - DNA, 25 bp, Mus musculus
ttgcaatcaagaagctcagccggcc

SEQ ID NO: 844083 - DNA, 25 bp, Mus musculus
ttgcaatcaagatgctcagccggcc

SEQ ID NO: 844084 - DNA, 25 bp, Mus musculus
ttgcaatcggagcagaccgtgagct

SEQ ID NO: 844085 - DNA, 25 bp, Mus musculus
ttgcaatcggaggagaccgtgagct

SEQ ID NO: 844086 - DNA, 25 bp, Mus musculus
ttgcaatctatgagggctatacccg

SEQ ID NO: 844087 - DNA, 25 bp, Mus musculus
ttgcaatctatgtgggctatacccg

SEQ ID NO: 844088 - DNA, 25 bp, Mus musculus
ttgcaatgccttcctgggctttggg

SEQ ID NO: 844089 - DNA, 25 bp, Mus musculus
ttgcaatgccttgctgggctttggg

SEQ ID NO: 844090 - DNA, 25 bp, Mus musculus
ttgcacaacgttcggacaatttaac

SEQ ID NO: 844091 - DNA, 25 bp, Mus musculus
ttgcacaacgttgggacaatttaac

SEQ ID NO: 844092 - DNA, 25 bp, Mus musculus
ttgcacaagaacagtgcccctgtcc

SEQ ID NO: 844093 - DNA, 25 bp, Mus musculus
ttgcacaagaactgtgcccctgtcc

SEQ ID NO: 844094 - DNA, 25 bp, Mus musculus
ttgcacaccggtcccacaagggagg

SEQ ID NO: 844095 - DNA, 25 bp, Mus musculus
ttgcacaccggtgccacaagggagg

SEQ ID NO: 844096 - DNA, 25 bp, Mus musculus
ttgcacagcaaaatacagtcatctg

SEQ ID NO: 844097 - DNA, 25 bp, Mus musculus
ttgcacagcaaattacagtcatctg

SEQ ID NO: 844098 - DNA, 25 bp, Mus musculus
ttgcacaggactccgggccgcgaca

SEQ ID NO: 844099 - DNA, 25 bp, Mus musculus
ttgcacaggactgcgggccgcgaca

SEQ ID NO: 844100 - DNA, 25 bp, Mus musculus
ttgcacagtcccagtctggtactgg

SEQ ID NO: 844101 - DNA, 25 bp, Mus musculus
ttgcacagtccctgtctggtactgg

SEQ ID NO: 844102 - DNA, 25 bp, Mus musculus
ttgcacatacacactggagcggcgg

SEQ ID NO: 844103 - DNA, 25 bp, Mus musculus
ttgcacatacactctggagcggcgg

SEQ ID NO: 844104 - DNA, 25 bp, Mus musculus
ttgcacatcagcagaccacactggg

SEQ ID NO: 844105 - DNA, 25 bp, Mus musculus
ttgcacatcagctgaccacactggg

SEQ ID NO: 844106 - DNA, 25 bp, Mus musculus
ttgcacatccctccgctgactggga

SEQ ID NO: 844107 - DNA, 25 bp, Mus musculus
ttgcacatccctgcgctgactggga

SEQ ID NO: 844108 - DNA, 25 bp, Mus musculus
ttgcaccctgacagatggaaccctg

SEQ ID NO: 844109 - DNA, 25 bp, Mus musculus
ttgcaccctgactgatggaaccctg

SEQ ID NO: 844110 - DNA, 25 bp, Mus musculus
ttgcacctcagcatcggaccaggag

SEQ ID NO: 844111 - DNA, 25 bp, Mus musculus
ttgcacctcagcttcggaccaggag

SEQ ID NO: 844112 - DNA, 25 bp, Mus musculus
ttgcacgagattcatgaggccagcc

SEQ ID NO: 844113 - DNA, 25 bp, Mus musculus
ttgcacgagattgatgaggccagcc

SEQ ID NO: 844114 - DNA, 25 bp, Mus musculus
ttgcacgatcgacgtggtttgctct

SEQ ID NO: 844115 - DNA, 25 bp, Mus musculus
ttgcacgatcgaggtggtttgctct

SEQ ID NO: 844116 - DNA, 25 bp, Mus musculus
ttgcacgcttagagtcgcgcgaccc

SEQ ID NO: 844117 - DNA, 25 bp, Mus musculus
ttgcacgcttagtgtcgcgcgaccc

SEQ ID NO: 844118 - DNA, 25 bp, Mus musculus
ttgcactatgcacctcagagtaact

SEQ ID NO: 844119 - DNA, 25 bp, Mus musculus
ttgcactatgcagctcagagtaact

SEQ ID NO: 844120 - DNA, 25 bp, Mus musculus
ttgcactcatcaccggcgcctatga

SEQ ID NO: 844121 - DNA, 25 bp, Mus musculus
ttgcactcatcagcggcgcctatga

SEQ ID NO: 844122 - DNA, 25 bp, Mus musculus
ttgcactgagggagctttgccgtat

SEQ ID NO: 844123 - DNA, 25 bp, Mus musculus
ttgcactgagggtgctttgccgtat

SEQ ID NO: 844124 - DNA, 25 bp, Mus musculus
ttgcactgggagacagccagggacc

SEQ ID NO: 844125 - DNA, 25 bp, Mus musculus
ttgcactgggagtcagccagggacc

SEQ ID NO: 844126 - DNA, 25 bp, Mus musculus
ttgcagaacgagatgaggctcaagg

SEQ ID NO: 844127 - DNA, 25 bp, Mus musculus
ttgcagaacgagttgaggctcaagg

SEQ ID NO: 844128 - DNA, 25 bp, Mus musculus
ttgcagaaggacatcacctcagcca

SEQ ID NO: 844129 - DNA, 25 bp, Mus musculus
ttgcagaaggacttcacctcagcca

SEQ ID NO: 844130 - DNA, 25 bp, Mus musculus
ttgcagacctcacatgtggacatcg

SEQ ID NO: 844131 - DNA, 25 bp, Mus musculus
ttgcagacctcagatgtggacatcg

SEQ ID NO: 844132 - DNA, 25 bp, Mus musculus
ttgcagacctgaaagtcttgaagat

SEQ ID NO: 844133 - DNA, 25 bp, Mus musculus
ttgcagacctgatagtcttgaagat

SEQ ID NO: 844134 - DNA, 25 bp, Mus musculus
ttgcagactcagatcaaggagaaag

SEQ ID NO: 844135 - DNA, 25 bp, Mus musculus
ttgcagactcagttcaaggagaaag

SEQ ID NO: 844136 - DNA, 25 bp, Mus musculus
ttgcagagaaaaaccgtcgggatgt

SEQ ID NO: 844137 - DNA, 25 bp, Mus musculus
ttgcagagaaaatccgtcgggatgt

SEQ ID NO: 844138 - DNA, 25 bp, Mus musculus
ttgcagagagctcagcccattcgct

SEQ ID NO: 844139 - DNA, 25 bp, Mus musculus
ttgcagagagctgagcccattcgct

SEQ ID NO: 844140 - DNA, 25 bp, Mus musculus
ttgcagagcgaccagcacagtggac

SEQ ID NO: 844141 - DNA, 25 bp, Mus musculus
ttgcagagcgacgagcacagtggac

SEQ ID NO: 844142 - DNA, 25 bp, Mus musculus
ttgcagagggaactttctcaagtgc

SEQ ID NO: 844143 - DNA, 25 bp, Mus musculus
ttgcagagggaagtttctcaagtgc

SEQ ID NO: 844144 - DNA, 25 bp, Mus musculus
ttgcagatgcggagccctcgtggct

SEQ ID NO: 844145 - DNA, 25 bp, Mus musculus
ttgcagatgcggtgccctcgtggct

SEQ ID NO: 844146 - DNA, 25 bp, Mus musculus
ttgcagatgttactgggattcctct

SEQ ID NO: 844147 - DNA, 25 bp, Mus musculus
ttgcagatgttagtgggattcctct

SEQ ID NO: 844148 - DNA, 25 bp, Mus musculus
ttgcagcaacaactaagacccgtgg

SEQ ID NO: 844149 - DNA, 25 bp, Mus musculus
ttgcagcaacaagtaagacccgtgg

SEQ ID NO: 844150 - DNA, 25 bp, Mus musculus
ttgcagcagggaaacaatgctattg

SEQ ID NO: 844151 - DNA, 25 bp, Mus musculus
ttgcagcagggatacaatgctattg

SEQ ID NO: 844152 - DNA, 25 bp, Mus musculus
ttgcagccccgcagtgaggacgtag

SEQ ID NO: 844153 - DNA, 25 bp, Mus musculus
ttgcagccccgctgtgaggacgtag

SEQ ID NO: 844154 - DNA, 25 bp, Mus musculus
ttgcagccctataacccgagaccat

SEQ ID NO: 844155 - DNA, 25 bp, Mus musculus
ttgcagccctattacccgagaccat

SEQ ID NO: 844156 - DNA, 25 bp, Mus musculus
ttgcagccgtcgattgattagtcgc

SEQ ID NO: 844157 - DNA, 25 bp, Mus musculus
ttgcagccgtcgtttgattagtcgc

SEQ ID NO: 844158 - DNA, 25 bp, Mus musculus
ttgcagcctgcaagcccaagtcggg

SEQ ID NO: 844159 - DNA, 25 bp, Mus musculus
ttgcagcctgcatgcccaagtcggg

SEQ ID NO: 844160 - DNA, 25 bp, Mus musculus
ttgcagcctgtcctccccgtggaga

SEQ ID NO: 844161 - DNA, 25 bp, Mus musculus
ttgcagcctgtcgtccccgtggaga

SEQ ID NO: 844162 - DNA, 25 bp, Mus musculus
ttgcagcgctcaccaccttctggta

SEQ ID NO: 844163 - DNA, 25 bp, Mus musculus
ttgcagcgctcagcaccttctggta

SEQ ID NO: 844164 - DNA, 25 bp, Mus musculus
ttgcagcggagcatctgaaaaatgc

SEQ ID NO: 844165 - DNA, 25 bp, Mus musculus
ttgcagcggagcttctgaaaaatgc

SEQ ID NO: 844166 - DNA, 25 bp, Mus musculus
ttgcagctatctatgacgtgaccct

SEQ ID NO: 844167 - DNA, 25 bp, Mus musculus
ttgcagctatctttgacgtgaccct

SEQ ID NO: 844168 - DNA, 25 bp, Mus musculus
ttgcagctcaagaaagttttgcatg

SEQ ID NO: 844169 - DNA, 25 bp, Mus musculus
ttgcagctcaagtaagttttgcatg

SEQ ID NO: 844170 - DNA, 25 bp, Mus musculus
ttgcagctccgtagaaggcgcggcc

SEQ ID NO: 844171 - DNA, 25 bp, Mus musculus
ttgcagctccgttgaaggcgcggcc

SEQ ID NO: 844172 - DNA, 25 bp, Mus musculus
ttgcaggaccgtcccagttccgtcg

SEQ ID NO: 844173 - DNA, 25 bp, Mus musculus
ttgcaggaccgtgccagttccgtcg

SEQ ID NO: 844174 - DNA, 25 bp, Mus musculus
ttgcaggcagcacgaattcaaggat

SEQ ID NO: 844175 - DNA, 25 bp, Mus musculus
ttgcaggcagcaggaattcaaggat

SEQ ID NO: 844176 - DNA, 25 bp, Mus musculus
ttgcaggccgtgagtcaccctgacc

SEQ ID NO: 844177 - DNA, 25 bp, Mus musculus
ttgcaggccgtgtgtcaccctgacc

SEQ ID NO: 844178 - DNA, 25 bp, Mus musculus
ttgcaggctgaacgattccctgtca

SEQ ID NO: 844179 - DNA, 25 bp, Mus musculus
ttgcaggctgaaggattccctgtca

SEQ ID NO: 844180 - DNA, 25 bp, Mus musculus
ttgcagggctggcacgtattatgat

SEQ ID NO: 844181 - DNA, 25 bp, Mus musculus
ttgcagggctgggacgtattatgat

SEQ ID NO: 844182 - DNA, 25 bp, Mus musculus
ttgcagggtccccaaaggaacccag

SEQ ID NO: 844183 - DNA, 25 bp, Mus musculus
ttgcagggtcccgaaaggaacccag

SEQ ID NO: 844184 - DNA, 25 bp, Mus musculus
ttgcagggtttgcagacactgctac

SEQ ID NO: 844185 - DNA, 25 bp, Mus musculus
ttgcagggtttggagacactgctac

SEQ ID NO: 844186 - DNA, 25 bp, Mus musculus
ttgcagtataacagcggcgaggagc

SEQ ID NO: 844187 - DNA, 25 bp, Mus musculus
ttgcagtataactgcggcgaggagc

SEQ ID NO: 844188 - DNA, 25 bp, Mus musculus
ttgcagtgaaccagtggaactgggc

SEQ ID NO: 844189 - DNA, 25 bp, Mus musculus
ttgcagtgaacctgtggaactgggc

SEQ ID NO: 844190 - DNA, 25 bp, Mus musculus
ttgcagtgtgatccaagcatggcag

SEQ ID NO: 844191 - DNA, 25 bp, Mus musculus
ttgcagtgtgatgcaagcatggcag

SEQ ID NO: 844192 - DNA, 25 bp, Mus musculus
ttgcagtgttgaagtgggtatttac

SEQ ID NO: 844193 - DNA, 25 bp, Mus musculus
ttgcagtgttgatgtgggtatttac

SEQ ID NO: 844194 - DNA, 25 bp, Mus musculus
ttgcagttaacaatcaaggaaccgt

SEQ ID NO: 844195 - DNA, 25 bp, Mus musculus
ttgcagttaacattcaaggaaccgt

SEQ ID NO: 844196 - DNA, 25 bp, Mus musculus
ttgcatatggtaaaagctagctttt

SEQ ID NO: 844197 - DNA, 25 bp, Mus musculus
ttgcatatggtataagctagctttt

SEQ ID NO: 844198 - DNA, 25 bp, Mus musculus
ttgcatatgtgcaccagcagctggg

SEQ ID NO: 844199 - DNA, 25 bp, Mus musculus
ttgcatatgtgctccagcagctggg

SEQ ID NO: 844200 - DNA, 25 bp, Mus musculus
ttgcatcatcagcagatggcggatc

SEQ ID NO: 844201 - DNA, 25 bp, Mus musculus
ttgcatcatcaggagatggcggatc

SEQ ID NO: 844202 - DNA, 25 bp, Mus musculus
ttgcatcatgtcaagctggaatatc

SEQ ID NO: 844203 - DNA, 25 bp, Mus musculus
ttgcatcatgtctagctggaatatc

SEQ ID NO: 844204 - DNA, 25 bp, Mus musculus
ttgcatcccgggacatggcggtccc

SEQ ID NO: 844205 - DNA, 25 bp, Mus musculus
ttgcatcccgggtcatggcggtccc

SEQ ID NO: 844206 - DNA, 25 bp, Mus musculus
ttgcatccgttcctctctaccaagg

SEQ ID NO: 844207 - DNA, 25 bp, Mus musculus
ttgcatccgttcgtctctaccaagg

SEQ ID NO: 844208 - DNA, 25 bp, Mus musculus
ttgcatcctatgctcggcccatctt

SEQ ID NO: 844209 - DNA, 25 bp, Mus musculus
ttgcatcctatggtcggcccatctt

SEQ ID NO: 844210 - DNA, 25 bp, Mus musculus
ttgcatcgatacaaaacactctact

SEQ ID NO: 844211 - DNA, 25 bp, Mus musculus
ttgcatcgatactaaacactctact

SEQ ID NO: 844212 - DNA, 25 bp, Mus musculus
ttgcatctgaagcaattctatctca

SEQ ID NO: 844213 - DNA, 25 bp, Mus musculus
ttgcatctgaaggaattctatctca

SEQ ID NO: 844214 - DNA, 25 bp, Mus musculus
ttgcatctgactctctgtcctcggg

SEQ ID NO: 844215 - DNA, 25 bp, Mus musculus
ttgcatctgactgtctgtcctcggg

SEQ ID NO: 844216 - DNA, 25 bp, Mus musculus
ttgcatgcgtcacctgcacaaggcg

SEQ ID NO: 844217 - DNA, 25 bp, Mus musculus
ttgcatgcgtcagctgcacaaggcg

SEQ ID NO: 844218 - DNA, 25 bp, Mus musculus
ttgcatggatgaccctcatctctgg

SEQ ID NO: 844219 - DNA, 25 bp, Mus musculus
ttgcatggatgagcctcatctctgg

SEQ ID NO: 844220 - DNA, 25 bp, Mus musculus
ttgcattaaataaggacgggactcc

SEQ ID NO: 844221 - DNA, 25 bp, Mus musculus
ttgcattaaatatggacgggactcc

SEQ ID NO: 844222 - DNA, 25 bp, Mus musculus
ttgcatttcgagaaggaactgtgga

SEQ ID NO: 844223 - DNA, 25 bp, Mus musculus
ttgcatttcgagtaggaactgtgga

SEQ ID NO: 844224 - DNA, 25 bp, Mus musculus
ttgccaaaccgaattgatatgaacg

SEQ ID NO: 844225 - DNA, 25 bp, Mus musculus
ttgccaaaccgatttgatatgaacg

SEQ ID NO: 844226 - DNA, 25 bp, Mus musculus
ttgccaaaccttctggacatggcgg

SEQ ID NO: 844227 - DNA, 25 bp, Mus musculus
ttgccaaaccttgtggacatggcgg

SEQ ID NO: 844228 - DNA, 25 bp, Mus musculus
ttgccaaagaagaaacgctgcagta

SEQ ID NO: 844229 - DNA, 25 bp, Mus musculus
ttgccaaagaagtaacgctgcagta

SEQ ID NO: 844230 - DNA, 25 bp, Mus musculus
ttgccaacactcctgataactgaat

SEQ ID NO: 844231 - DNA, 25 bp, Mus musculus
ttgccaacactcgtgataactgaat

SEQ ID NO: 844232 - DNA, 25 bp, Mus musculus
ttgccaacatgacccgggaaccctt

SEQ ID NO: 844233 - DNA, 25 bp, Mus musculus
ttgccaacatgagccgggaaccctt

SEQ ID NO: 844234 - DNA, 25 bp, Mus musculus
ttgccaaccatcacatgcaatctat

SEQ ID NO: 844235 - DNA, 25 bp, Mus musculus
ttgccaaccatctcatgcaatctat

SEQ ID NO: 844236 - DNA, 25 bp, Mus musculus
ttgccaacgcggatggcctcaccta

SEQ ID NO: 844237 - DNA, 25 bp, Mus musculus
ttgccaacgcggttggcctcaccta

SEQ ID NO: 844238 - DNA, 25 bp, Mus musculus
ttgccaacggcaccgatgacggtgc

SEQ ID NO: 844239 - DNA, 25 bp, Mus musculus
ttgccaacggcagcgatgacggtgc

SEQ ID NO: 844240 - DNA, 25 bp, Mus musculus
ttgccaacgggcatgtaaactggcc

SEQ ID NO: 844241 - DNA, 25 bp, Mus musculus
ttgccaacgggcttgtaaactggcc

SEQ ID NO: 844242 - DNA, 25 bp, Mus musculus
ttgccaagaaacaaccccagccata

SEQ ID NO: 844243 - DNA, 25 bp, Mus musculus
ttgccaagaaactaccccagccata

SEQ ID NO: 844244 - DNA, 25 bp, Mus musculus
ttgccaagacttacaaacaaagacg

SEQ ID NO: 844245 - DNA, 25 bp, Mus musculus
ttgccaagactttcaaacaaagacg

SEQ ID NO: 844246 - DNA, 25 bp, Mus musculus
ttgccaagtccacactgctgctaat

SEQ ID NO: 844247 - DNA, 25 bp, Mus musculus
ttgccaagtccagactgctgctaat

SEQ ID NO: 844248 - DNA, 25 bp, Mus musculus
ttgccaagtgagaacccgggtacag

SEQ ID NO: 844249 - DNA, 25 bp, Mus musculus
ttgccaagtgagtacccgggtacag

SEQ ID NO: 844250 - DNA, 25 bp, Mus musculus
ttgccaatacctatgcctgcaaggg

SEQ ID NO: 844251 - DNA, 25 bp, Mus musculus
ttgccaatacctttgcctgcaaggg

SEQ ID NO: 844252 - DNA, 25 bp, Mus musculus
ttgccaatattccagcagcagctgt

SEQ ID NO: 844253 - DNA, 25 bp, Mus musculus
ttgccaatattcgagcagcagctgt

SEQ ID NO: 844254 - DNA, 25 bp, Mus musculus
ttgccaatgcagcaggagccccgaa

SEQ ID NO: 844255 - DNA, 25 bp, Mus musculus
ttgccaatgcaggaggagccccgaa

SEQ ID NO: 844256 - DNA, 25 bp, Mus musculus
ttgccaatgggcacctgggtgacca

SEQ ID NO: 844257 - DNA, 25 bp, Mus musculus
ttgccaatgggctcctgggtgacca

SEQ ID NO: 844258 - DNA, 25 bp, Mus musculus
ttgccaatgtggagaaacagcttga

SEQ ID NO: 844259 - DNA, 25 bp, Mus musculus
ttgccaatgtggtgaaacagcttga

SEQ ID NO: 844260 - DNA, 25 bp, Mus musculus
ttgccaattcaaacgccatccagat

SEQ ID NO: 844261 - DNA, 25 bp, Mus musculus
ttgccaattcaatcgccatccagat

SEQ ID NO: 844262 - DNA, 25 bp, Mus musculus
ttgccacaaggcacatagacaatga

SEQ ID NO: 844263 - DNA, 25 bp, Mus musculus
ttgccacaaggctcatagacaatga

SEQ ID NO: 844264 - DNA, 25 bp, Mus musculus
ttgccacagctaccgctgatggcca

SEQ ID NO: 844265 - DNA, 25 bp, Mus musculus
ttgccacagctagcgctgatggcca

SEQ ID NO: 844266 - DNA, 25 bp, Mus musculus
ttgccacattcacatttctgacatt

SEQ ID NO: 844267 - DNA, 25 bp, Mus musculus
ttgccacattcagatttctgacatt

SEQ ID NO: 844268 - DNA, 25 bp, Mus musculus
ttgccacccagcatgagggcactgg

SEQ ID NO: 844269 - DNA, 25 bp, Mus musculus
ttgccacccagcttgagggcactgg

SEQ ID NO: 844270 - DNA, 25 bp, Mus musculus
ttgccacctgagccctttgagatgc

SEQ ID NO: 844271 - DNA, 25 bp, Mus musculus
ttgccacctgaggcctttgagatgc

SEQ ID NO: 844272 - DNA, 25 bp, Mus musculus
ttgccacgaggcaccccaaggtgca

SEQ ID NO: 844273 - DNA, 25 bp, Mus musculus
ttgccacgaggctccccaaggtgca

SEQ ID NO: 844274 - DNA, 25 bp, Mus musculus
ttgccactggctcagacgatgccac

SEQ ID NO: 844275 - DNA, 25 bp, Mus musculus
ttgccactggctgagacgatgccac

SEQ ID NO: 844276 - DNA, 25 bp, Mus musculus
ttgccactgttcagggacctccgag

SEQ ID NO: 844277 - DNA, 25 bp, Mus musculus
ttgccactgttctgggacctccgag

SEQ ID NO: 844278 - DNA, 25 bp, Mus musculus
ttgccagaaaacaccagaggaccct

SEQ ID NO: 844279 - DNA, 25 bp, Mus musculus
ttgccagaaaactccagaggaccct

SEQ ID NO: 844280 - DNA, 25 bp, Mus musculus
ttgccagaaagtcccgctctgagcc

SEQ ID NO: 844281 - DNA, 25 bp, Mus musculus
ttgccagaaagtgccgctctgagcc

SEQ ID NO: 844282 - DNA, 25 bp, Mus musculus
ttgccagaacacaggtagtaagcca

SEQ ID NO: 844283 - DNA, 25 bp, Mus musculus
ttgccagaacactggtagtaagcca

SEQ ID NO: 844284 - DNA, 25 bp, Mus musculus
ttgccagaactcacaagtattcagg

SEQ ID NO: 844285 - DNA, 25 bp, Mus musculus
ttgccagaactctcaagtattcagg

SEQ ID NO: 844286 - DNA, 25 bp, Mus musculus
ttgccagagacactgccccaggaaa

SEQ ID NO: 844287 - DNA, 25 bp, Mus musculus
ttgccagagacagtgccccaggaaa

SEQ ID NO: 844288 - DNA, 25 bp, Mus musculus
ttgccagatctcatacagcaaagcc

SEQ ID NO: 844289 - DNA, 25 bp, Mus musculus
ttgccagatctcttacagcaaagcc

SEQ ID NO: 844290 - DNA, 25 bp, Mus musculus
ttgccagattgcctcaaaggttgtg

SEQ ID NO: 844291 - DNA, 25 bp, Mus musculus
ttgccagattgcgtcaaaggttgtg

SEQ ID NO: 844292 - DNA, 25 bp, Mus musculus
ttgccagcaccccatacacaggtgt

SEQ ID NO: 844293 - DNA, 25 bp, Mus musculus
ttgccagcacccgatacacaggtgt

SEQ ID NO: 844294 - DNA, 25 bp, Mus musculus
ttgccagctcaacccacagagtatg

SEQ ID NO: 844295 - DNA, 25 bp, Mus musculus
ttgccagctcaagccacagagtatg

SEQ ID NO: 844296 - DNA, 25 bp, Mus musculus
ttgccaggctcaataacatgcatgg

SEQ ID NO: 844297 - DNA, 25 bp, Mus musculus
ttgccaggctcattaacatgcatgg

SEQ ID NO: 844298 - DNA, 25 bp, Mus musculus
ttgccaggtggaagtctgcagcatg

SEQ ID NO: 844299 - DNA, 25 bp, Mus musculus
ttgccaggtggatgtctgcagcatg

SEQ ID NO: 844300 - DNA, 25 bp, Mus musculus
ttgccagtgttgaggtctccttctt

SEQ ID NO: 844301 - DNA, 25 bp, Mus musculus
ttgccagtgttgtggtctccttctt

SEQ ID NO: 844302 - DNA, 25 bp, Mus musculus
ttgccataattactcacagccatga

SEQ ID NO: 844303 - DNA, 25 bp, Mus musculus
ttgccataattagtcacagccatga

SEQ ID NO: 844304 - DNA, 25 bp, Mus musculus
ttgccatagtatattcaaggattgt

SEQ ID NO: 844305 - DNA, 25 bp, Mus musculus
ttgccatagtattttcaaggattgt

SEQ ID NO: 844306 - DNA, 25 bp, Mus musculus
ttgccatcaaaaagtgacagaagag

SEQ ID NO: 844307 - DNA, 25 bp, Mus musculus
ttgccatcaaaatgtgacagaagag

SEQ ID NO: 844308 - DNA, 25 bp, Mus musculus
ttgccatcaactcggccggtggtct

SEQ ID NO: 844309 - DNA, 25 bp, Mus musculus
ttgccatcaactgggccggtggtct

SEQ ID NO: 844310 - DNA, 25 bp, Mus musculus
ttgccatcgtcactgcaaggagccg

SEQ ID NO: 844311 - DNA, 25 bp, Mus musculus
ttgccatcgtcagtgcaaggagccg

SEQ ID NO: 844312 - DNA, 25 bp, Mus musculus
ttgccatctccaagcacactgaaga

SEQ ID NO: 844313 - DNA, 25 bp, Mus musculus
ttgccatctccaccaacactttgag

SEQ ID NO: 844314 - DNA, 25 bp, Mus musculus
ttgccatctccagcaacactttgag

SEQ ID NO: 844315 - DNA, 25 bp, Mus musculus
ttgccatctccatgcacactgaaga

SEQ ID NO: 844316 - DNA, 25 bp, Mus musculus
ttgccatgaacaagtttggatacag

SEQ ID NO: 844317 - DNA, 25 bp, Mus musculus
ttgccatgaacatgtttggatacag

SEQ ID NO: 844318 - DNA, 25 bp, Mus musculus
ttgccatgcatcctgggaaccggtg

SEQ ID NO: 844319 - DNA, 25 bp, Mus musculus
ttgccatgcatcgtgggaaccggtg

SEQ ID NO: 844320 - DNA, 25 bp, Mus musculus
ttgccatgcttcaggtgctgctggt

SEQ ID NO: 844321 - DNA, 25 bp, Mus musculus
ttgccatgcttctggtgctgctggt

SEQ ID NO: 844322 - DNA, 25 bp, Mus musculus
ttgccatggcggaggctcctgcaag

SEQ ID NO: 844323 - DNA, 25 bp, Mus musculus
ttgccatggcggtggctcctgcaag

SEQ ID NO: 844324 - DNA, 25 bp, Mus musculus
ttgccatggttgagcctccccagga

SEQ ID NO: 844325 - DNA, 25 bp, Mus musculus
ttgccatggttgtgcctccccagga

SEQ ID NO: 844326 - DNA, 25 bp, Mus musculus
ttgccatgtgtaagaactcagaggg

SEQ ID NO: 844327 - DNA, 25 bp, Mus musculus
ttgccatgtgtatgaactcagaggg

SEQ ID NO: 844328 - DNA, 25 bp, Mus musculus
ttgccattaaacacagccctgtatg

SEQ ID NO: 844329 - DNA, 25 bp, Mus musculus
ttgccattaaactcagccctgtatg

SEQ ID NO: 844330 - DNA, 25 bp, Mus musculus
ttgccattggccagcgcctacggag

SEQ ID NO: 844331 - DNA, 25 bp, Mus musculus
ttgccattggcctgcgcctacggag

SEQ ID NO: 844332 - DNA, 25 bp, Mus musculus
ttgccattggctctctgatggacga

SEQ ID NO: 844333 - DNA, 25 bp, Mus musculus
ttgccattggctgtctgatggacga

SEQ ID NO: 844334 - DNA, 25 bp, Mus musculus
ttgcccaagcctagcctcacagaga

SEQ ID NO: 844335 - DNA, 25 bp, Mus musculus
ttgcccaagccttgcctcacagaga

SEQ ID NO: 844336 - DNA, 25 bp, Mus musculus
ttgcccaagggacgcgagcgctctc

SEQ ID NO: 844337 - DNA, 25 bp, Mus musculus
ttgcccaagggaggcgagcgctctc

SEQ ID NO: 844338 - DNA, 25 bp, Mus musculus
ttgcccaatcttcccgatctgaagg

SEQ ID NO: 844339 - DNA, 25 bp, Mus musculus
ttgcccaatcttgccgatctgaagg

SEQ ID NO: 844340 - DNA, 25 bp, Mus musculus
ttgcccaattccagggtgccgggac

SEQ ID NO: 844341 - DNA, 25 bp, Mus musculus
ttgcccaattcctgggtgccgggac

SEQ ID NO: 844342 - DNA, 25 bp, Mus musculus
ttgcccacgaccatgcctgagaatg

SEQ ID NO: 844343 - DNA, 25 bp, Mus musculus
ttgcccacgaccttgcctgagaatg

SEQ ID NO: 844344 - DNA, 25 bp, Mus musculus
ttgcccactgctcccggagagtctt

SEQ ID NO: 844345 - DNA, 25 bp, Mus musculus
ttgcccactgctgccggagagtctt

SEQ ID NO: 844346 - DNA, 25 bp, Mus musculus
ttgcccagcggtactgtcagtgcaa

SEQ ID NO: 844347 - DNA, 25 bp, Mus musculus
ttgcccagcggttctgtcagtgcaa

SEQ ID NO: 844348 - DNA, 25 bp, Mus musculus
ttgcccagcttaccattgctgagtg

SEQ ID NO: 844349 - DNA, 25 bp, Mus musculus
ttgcccagcttagcattgctgagtg

SEQ ID NO: 844350 - DNA, 25 bp, Mus musculus
ttgcccagtctgcttttccattaag

SEQ ID NO: 844351 - DNA, 25 bp, Mus musculus
ttgcccagtctggttttccattaag

SEQ ID NO: 844352 - DNA, 25 bp, Mus musculus
ttgcccatgaaactgcgggcactgg

SEQ ID NO: 844353 - DNA, 25 bp, Mus musculus
ttgcccatgaaagtgcgggcactgg

SEQ ID NO: 844354 - DNA, 25 bp, Mus musculus
ttgcccatgcaacaccaggatggcc

SEQ ID NO: 844355 - DNA, 25 bp, Mus musculus
ttgcccatgcaagaccaggatggcc

SEQ ID NO: 844356 - DNA, 25 bp, Mus musculus
ttgcccatttggatgctaccactgt

SEQ ID NO: 844357 - DNA, 25 bp, Mus musculus
ttgcccatttggttgctaccactgt

SEQ ID NO: 844358 - DNA, 25 bp, Mus musculus
ttgccccaaatcctaaaatcattcg

SEQ ID NO: 844359 - DNA, 25 bp, Mus musculus
ttgccccaaatcgtaaaatcattcg

SEQ ID NO: 844360 - DNA, 25 bp, Mus musculus
ttgcccctaagcaagatggctgcca

SEQ ID NO: 844361 - DNA, 25 bp, Mus musculus
ttgcccctaagctagatggctgcca

SEQ ID NO: 844362 - DNA, 25 bp, Mus musculus
ttgcccctcgacatggcctgcagag

SEQ ID NO: 844363 - DNA, 25 bp, Mus musculus
ttgcccctcgacttggcctgcagag

SEQ ID NO: 844364 - DNA, 25 bp, Mus musculus
ttgcccctgcttagtgcgagttccg

SEQ ID NO: 844365 - DNA, 25 bp, Mus musculus
ttgcccctgctttgtgcgagttccg

SEQ ID NO: 844366 - DNA, 25 bp, Mus musculus
ttgcccctgggaagagcttccaaca

SEQ ID NO: 844367 - DNA, 25 bp, Mus musculus
ttgcccctgggatgagcttccaaca

SEQ ID NO: 844368 - DNA, 25 bp, Mus musculus
ttgcccctggttatcttgctaggtc

SEQ ID NO: 844369 - DNA, 25 bp, Mus musculus
ttgcccctggttttcttgctaggtc

SEQ ID NO: 844370 - DNA, 25 bp, Mus musculus
ttgcccctttggacagcgacgccgg

SEQ ID NO: 844371 - DNA, 25 bp, Mus musculus
ttgcccctttggtcagcgacgccgg

SEQ ID NO: 844372 - DNA, 25 bp, Mus musculus
ttgcccgaaatgcatttactgtgct

SEQ ID NO: 844373 - DNA, 25 bp, Mus musculus
ttgcccgaaatggatttactgtgct

SEQ ID NO: 844374 - DNA, 25 bp, Mus musculus
ttgcccgactttcaccctggactgt

SEQ ID NO: 844375 - DNA, 25 bp, Mus musculus
ttgcccgactttgaccctggactgt

SEQ ID NO: 844376 - DNA, 25 bp, Mus musculus
ttgcccgagactctgagaacagctc

SEQ ID NO: 844377 - DNA, 25 bp, Mus musculus
ttgcccgagactgtgagaacagctc

SEQ ID NO: 844378 - DNA, 25 bp, Mus musculus
ttgccctcacaaagtgaaatgatgg

SEQ ID NO: 844379 - DNA, 25 bp, Mus musculus
ttgccctcacaatgtgaaatgatgg

SEQ ID NO: 844380 - DNA, 25 bp, Mus musculus
ttgccctcaggaccgtgcaggcagc

SEQ ID NO: 844381 - DNA, 25 bp, Mus musculus
ttgccctcaggagcgtgcaggcagc

SEQ ID NO: 844382 - DNA, 25 bp, Mus musculus
ttgccctccacaacctagaagctgt

SEQ ID NO: 844383 - DNA, 25 bp, Mus musculus
ttgccctccacatcctagaagctgt

SEQ ID NO: 844384 - DNA, 25 bp, Mus musculus
ttgccctctgggacactgtgtatct

SEQ ID NO: 844385 - DNA, 25 bp, Mus musculus
ttgccctctgggtcactgtgtatct

SEQ ID NO: 844386 - DNA, 25 bp, Mus musculus
ttgccctgatgcatcaccaaacgat

SEQ ID NO: 844387 - DNA, 25 bp, Mus musculus
ttgccctgatgcttcaccaaacgat

SEQ ID NO: 844388 - DNA, 25 bp, Mus musculus
ttgccctgcagaacatcaacagaga

SEQ ID NO: 844389 - DNA, 25 bp, Mus musculus
ttgccctgcagatcatcaacagaga

SEQ ID NO: 844390 - DNA, 25 bp, Mus musculus
ttgccctggacaacaatgttgtggt

SEQ ID NO: 844391 - DNA, 25 bp, Mus musculus
ttgccctggacatcaatgttgtggt

SEQ ID NO: 844392 - DNA, 25 bp, Mus musculus
ttgccctggcggctgatatttccag

SEQ ID NO: 844393 - DNA, 25 bp, Mus musculus
ttgccctggcgggtgatatttccag

SEQ ID NO: 844394 - DNA, 25 bp, Mus musculus
ttgcccttcagtaaaacaggatggt

SEQ ID NO: 844395 - DNA, 25 bp, Mus musculus
ttgcccttcagttaaacaggatggt

SEQ ID NO: 844396 - DNA, 25 bp, Mus musculus
ttgccctttagaaaaagcccagaag

SEQ ID NO: 844397 - DNA, 25 bp, Mus musculus
ttgccctttagataaagcccagaag

SEQ ID NO: 844398 - DNA, 25 bp, Mus musculus
ttgccgaattgacaagcccctgtgc

SEQ ID NO: 844399 - DNA, 25 bp, Mus musculus
ttgccgaattgagaagcccctgtgc

SEQ ID NO: 844400 - DNA, 25 bp, Mus musculus
ttgccgagcgcaaccactctggtta

SEQ ID NO: 844401 - DNA, 25 bp, Mus musculus
ttgccgagcgcatccactctggtta

SEQ ID NO: 844402 - DNA, 25 bp, Mus musculus
ttgccgcagccccgttctgtgtgga

SEQ ID NO: 844403 - DNA, 25 bp, Mus musculus
ttgccgcagcccggttctgtgtgga

SEQ ID NO: 844404 - DNA, 25 bp, Mus musculus
ttgccgcagtacatcagagcttgag

SEQ ID NO: 844405 - DNA, 25 bp, Mus musculus
ttgccgcagtacttcagagcttgag

SEQ ID NO: 844406 - DNA, 25 bp, Mus musculus
ttgccgccagctctactagacatgg

SEQ ID NO: 844407 - DNA, 25 bp, Mus musculus
ttgccgccagctgtactagacatgg

SEQ ID NO: 844408 - DNA, 25 bp, Mus musculus
ttgccgctttggagatccggaatgc

SEQ ID NO: 844409 - DNA, 25 bp, Mus musculus
ttgccgctttggtgatccggaatgc

SEQ ID NO: 844410 - DNA, 25 bp, Mus musculus
ttgccggcatgtcaccagcctgact

SEQ ID NO: 844411 - DNA, 25 bp, Mus musculus
ttgccggcatgtgaccagcctgact

SEQ ID NO: 844412 - DNA, 25 bp, Mus musculus
ttgccggccaccagaaggacgctca

SEQ ID NO: 844413 - DNA, 25 bp, Mus musculus
ttgccggccacctgaaggacgctca

SEQ ID NO: 844414 - DNA, 25 bp, Mus musculus
ttgccgggaggaaatgggtgaagtc

SEQ ID NO: 844415 - DNA, 25 bp, Mus musculus
ttgccgggaggatatgggtgaagtc

SEQ ID NO: 844416 - DNA, 25 bp, Mus musculus
ttgccgggccgacacggatcttcgc

SEQ ID NO: 844417 - DNA, 25 bp, Mus musculus
ttgccgggccgagacggatcttcgc

SEQ ID NO: 844418 - DNA, 25 bp, Mus musculus
ttgccggtgaacagcaggctctcct

SEQ ID NO: 844419 - DNA, 25 bp, Mus musculus
ttgccggtgaactgcaggctctcct

SEQ ID NO: 844420 - DNA, 25 bp, Mus musculus
ttgccgtcggtgcacctggatagtc

SEQ ID NO: 844421 - DNA, 25 bp, Mus musculus
ttgccgtcggtggacctggatagtc

SEQ ID NO: 844422 - DNA, 25 bp, Mus musculus
ttgccgtgcagaccgtttatgtgca

SEQ ID NO: 844423 - DNA, 25 bp, Mus musculus
ttgccgtgcagagcgtttatgtgca

SEQ ID NO: 844424 - DNA, 25 bp, Mus musculus
ttgcctactaccatggccttctggg

SEQ ID NO: 844425 - DNA, 25 bp, Mus musculus
ttgcctactaccttggccttctggg

SEQ ID NO: 844426 - DNA, 25 bp, Mus musculus
ttgcctagagggaaatcactggacc

SEQ ID NO: 844427 - DNA, 25 bp, Mus musculus
ttgcctagagggtaatcactggacc

SEQ ID NO: 844428 - DNA, 25 bp, Mus musculus
ttgcctagcctgcaggaagctcacg

SEQ ID NO: 844429 - DNA, 25 bp, Mus musculus
ttgcctagcctggaggaagctcacg

SEQ ID NO: 844430 - DNA, 25 bp, Mus musculus
ttgcctaggcaacggcaacaacttc

SEQ ID NO: 844431 - DNA, 25 bp, Mus musculus
ttgcctaggcaagggcaacaacttc

SEQ ID NO: 844432 - DNA, 25 bp, Mus musculus
ttgcctatagcaatttgtgggactt

SEQ ID NO: 844433 - DNA, 25 bp, Mus musculus
ttgcctatagcattttgtgggactt

SEQ ID NO: 844434 - DNA, 25 bp, Mus musculus
ttgcctatgccacacacagggctgc

SEQ ID NO: 844435 - DNA, 25 bp, Mus musculus
ttgcctatgccagacacagggctgc

SEQ ID NO: 844436 - DNA, 25 bp, Mus musculus
ttgcctctgtccagaccaacgcaag

SEQ ID NO: 844437 - DNA, 25 bp, Mus musculus
ttgcctctgtcctgaccaacgcaag

SEQ ID NO: 844438 - DNA, 25 bp, Mus musculus
ttgcctgaactgcaataaaggactc

SEQ ID NO: 844439 - DNA, 25 bp, Mus musculus
ttgcctgaactggaataaaggactc

SEQ ID NO: 844440 - DNA, 25 bp, Mus musculus
ttgcctgactcgcttggaccacaac

SEQ ID NO: 844441 - DNA, 25 bp, Mus musculus
ttgcctgactcggttggaccacaac

SEQ ID NO: 844442 - DNA, 25 bp, Mus musculus
ttgcctgatcagattggcttcatcc

SEQ ID NO: 844443 - DNA, 25 bp, Mus musculus
ttgcctgatcagtttggcttcatcc

SEQ ID NO: 844444 - DNA, 25 bp, Mus musculus
ttgcctgcagggaagcacccgcctt

SEQ ID NO: 844445 - DNA, 25 bp, Mus musculus
ttgcctgcagggtagcacccgcctt

SEQ ID NO: 844446 - DNA, 25 bp, Mus musculus
ttgcctgccctcattgtgggcctgg

SEQ ID NO: 844447 - DNA, 25 bp, Mus musculus
ttgcctgccctctttgtgggcctgg

SEQ ID NO: 844448 - DNA, 25 bp, Mus musculus
ttgcctgcgattacgactacctacg

SEQ ID NO: 844449 - DNA, 25 bp, Mus musculus
ttgcctgcgatttcgactacctacg

SEQ ID NO: 844450 - DNA, 25 bp, Mus musculus
ttgcctgcgtacaccatggagctgc

SEQ ID NO: 844451 - DNA, 25 bp, Mus musculus
ttgcctgcgtactccatggagctgc

SEQ ID NO: 844452 - DNA, 25 bp, Mus musculus
ttgcctgcgtgcatgttagtgcctg

SEQ ID NO: 844453 - DNA, 25 bp, Mus musculus
ttgcctgcgtgcttgttagtgcctg

SEQ ID NO: 844454 - DNA, 25 bp, Mus musculus
ttgcctgctatacccatgactgctg

SEQ ID NO: 844455 - DNA, 25 bp, Mus musculus
ttgcctgctatagccatgactgctg

SEQ ID NO: 844456 - DNA, 25 bp, Mus musculus
ttgcctgctgagcagcgacctggca

SEQ ID NO: 844457 - DNA, 25 bp, Mus musculus
ttgcctgctgaggagcgacctggca

SEQ ID NO: 844458 - DNA, 25 bp, Mus musculus
ttgcctggagcgataggtctcccag

SEQ ID NO: 844459 - DNA, 25 bp, Mus musculus
ttgcctggagcgttaggtctcccag

SEQ ID NO: 844460 - DNA, 25 bp, Mus musculus
ttgcctggccccacccgtgtgcatt

SEQ ID NO: 844461 - DNA, 25 bp, Mus musculus
ttgcctggcccctcccgtgtgcatt

SEQ ID NO: 844462 - DNA, 25 bp, Mus musculus
ttgcctgggtagaaggtcacgagcc

SEQ ID NO: 844463 - DNA, 25 bp, Mus musculus
ttgcctgggtagtaggtcacgagcc

SEQ ID NO: 844464 - DNA, 25 bp, Mus musculus
ttgcctgggtgactaatcttttgag

SEQ ID NO: 844465 - DNA, 25 bp, Mus musculus
ttgcctgggtgagtaatcttttgag

SEQ ID NO: 844466 - DNA, 25 bp, Mus musculus
ttgcctgtacacaggcttcctcttc

SEQ ID NO: 844467 - DNA, 25 bp, Mus musculus
ttgcctgtacactggcttcctcttc

SEQ ID NO: 844468 - DNA, 25 bp, Mus musculus
ttgcctgttttacacgctgactggg

SEQ ID NO: 844469 - DNA, 25 bp, Mus musculus
ttgcctgttttagacgctgactggg

SEQ ID NO: 844470 - DNA, 25 bp, Mus musculus
ttgccttaaataaaccctctcaact

SEQ ID NO: 844471 - DNA, 25 bp, Mus musculus
ttgccttaaatataccctctcaact

SEQ ID NO: 844472 - DNA, 25 bp, Mus musculus
ttgccttcacagacaagttctaccc

SEQ ID NO: 844473 - DNA, 25 bp, Mus musculus
ttgccttcacagtcaagttctaccc

SEQ ID NO: 844474 - DNA, 25 bp, Mus musculus
ttgccttccaggagccacataaggg

SEQ ID NO: 844475 - DNA, 25 bp, Mus musculus
ttgccttccaggtgccacataaggg

SEQ ID NO: 844476 - DNA, 25 bp, Mus musculus
ttgccttctcgcacggtgagcgccg

SEQ ID NO: 844477 - DNA, 25 bp, Mus musculus
ttgccttctcgctcggtgagcgccg

SEQ ID NO: 844478 - DNA, 25 bp, Mus musculus
ttgcctttatcaagggctgatgacc

SEQ ID NO: 844479 - DNA, 25 bp, Mus musculus
ttgcctttatcatgggctgatgacc

SEQ ID NO: 844480 - DNA, 25 bp, Mus musculus
ttgcctttgcagactcagttcaagg

SEQ ID NO: 844481 - DNA, 25 bp, Mus musculus
ttgcctttgcagtctcagttcaagg

SEQ ID NO: 844482 - DNA, 25 bp, Mus musculus
ttgccttttgccaccagagggagca

SEQ ID NO: 844483 - DNA, 25 bp, Mus musculus
ttgccttttgcctccagagggagca

SEQ ID NO: 844484 - DNA, 25 bp, Mus musculus
ttgcgaagtaaactccccgtgaccg

SEQ ID NO: 844485 - DNA, 25 bp, Mus musculus
ttgcgaagtaaagtccccgtgaccg

SEQ ID NO: 844486 - DNA, 25 bp, Mus musculus
ttgcgaatccaacgagaggaagcca

SEQ ID NO: 844487 - DNA, 25 bp, Mus musculus
ttgcgaatccaaggagaggaagcca

SEQ ID NO: 844488 - DNA, 25 bp, Mus musculus
ttgcgacccaatcggcgcgtcaagg

SEQ ID NO: 844489 - DNA, 25 bp, Mus musculus
ttgcgacccaatgggcgcgtcaagg

SEQ ID NO: 844490 - DNA, 25 bp, Mus musculus
ttgcgacggccactaatgcccggga

SEQ ID NO: 844491 - DNA, 25 bp, Mus musculus
ttgcgacggccagtaatgcccggga

SEQ ID NO: 844492 - DNA, 25 bp, Mus musculus
ttgcgactctccatgtctagttcag

SEQ ID NO: 844493 - DNA, 25 bp, Mus musculus
ttgcgactctccttgtctagttcag

SEQ ID NO: 844494 - DNA, 25 bp, Mus musculus
ttgcgacttcgcaaccgtgcagctg

SEQ ID NO: 844495 - DNA, 25 bp, Mus musculus
ttgcgacttcgctaccgtgcagctg

SEQ ID NO: 844496 - DNA, 25 bp, Mus musculus
ttgcgatacggcaaagccaaagctg

SEQ ID NO: 844497 - DNA, 25 bp, Mus musculus
ttgcgatacggctaagccaaagctg

SEQ ID NO: 844498 - DNA, 25 bp, Mus musculus
ttgcgccacttcacttaacagcagg

SEQ ID NO: 844499 - DNA, 25 bp, Mus musculus
ttgcgccacttctcttaacagcagg

SEQ ID NO: 844500 - DNA, 25 bp, Mus musculus
ttgcgccgaggtcagccgaggtggc

SEQ ID NO: 844501 - DNA, 25 bp, Mus musculus
ttgcgccgaggtgagccgaggtggc

SEQ ID NO: 844502 - DNA, 25 bp, Mus musculus
ttgcgcggcgccacgcttatggcgc

SEQ ID NO: 844503 - DNA, 25 bp, Mus musculus
ttgcgcggcgcctcgcttatggcgc

SEQ ID NO: 844504 - DNA, 25 bp, Mus musculus
ttgcgcggtcgtcgctcacaatgcg

SEQ ID NO: 844505 - DNA, 25 bp, Mus musculus
ttgcgcggtcgtggctcacaatgcg

SEQ ID NO: 844506 - DNA, 25 bp, Mus musculus
ttgcgcgtcatgaaccgcggccgct

SEQ ID NO: 844507 - DNA, 25 bp, Mus musculus
ttgcgcgtcatgtaccgcggccgct

SEQ ID NO: 844508 - DNA, 25 bp, Mus musculus
ttgcgctctggaccccatgctagat

SEQ ID NO: 844509 - DNA, 25 bp, Mus musculus
ttgcgctctggagcccatgctagat

SEQ ID NO: 844510 - DNA, 25 bp, Mus musculus
ttgcgctgcagacccgcttggcgaa

SEQ ID NO: 844511 - DNA, 25 bp, Mus musculus
ttgcgctgcagagccgcttggcgaa

SEQ ID NO: 844512 - DNA, 25 bp, Mus musculus
ttgcggaaactgaacccacccgatg

SEQ ID NO: 844513 - DNA, 25 bp, Mus musculus
ttgcggaaactgtacccacccgatg

SEQ ID NO: 844514 - DNA, 25 bp, Mus musculus
ttgcggaatataagcgagttcaagt

SEQ ID NO: 844515 - DNA, 25 bp, Mus musculus
ttgcggaatatatgcgagttcaagt

SEQ ID NO: 844516 - DNA, 25 bp, Mus musculus
ttgcggagctccacgaccgtgtcca

SEQ ID NO: 844517 - DNA, 25 bp, Mus musculus
ttgcggagctcctcgaccgtgtcca

SEQ ID NO: 844518 - DNA, 25 bp, Mus musculus
ttgcggaggaatacacccggctgga

SEQ ID NO: 844519 - DNA, 25 bp, Mus musculus
ttgcggaggaattcacccggctgga

SEQ ID NO: 844520 - DNA, 25 bp, Mus musculus
ttgcggatgaatccacaaggtggcc

SEQ ID NO: 844521 - DNA, 25 bp, Mus musculus
ttgcggatgaatgcacaaggtggcc

SEQ ID NO: 844522 - DNA, 25 bp, Mus musculus
ttgcggatggaacccggtgacccca

SEQ ID NO: 844523 - DNA, 25 bp, Mus musculus
ttgcggatggaagccggtgacccca

SEQ ID NO: 844524 - DNA, 25 bp, Mus musculus
ttgcggcacacacacggaaccggtg

SEQ ID NO: 844525 - DNA, 25 bp, Mus musculus
ttgcggcacacagacggaaccggtg

SEQ ID NO: 844526 - DNA, 25 bp, Mus musculus
ttgcggctgtcactcacagtcagga

SEQ ID NO: 844527 - DNA, 25 bp, Mus musculus
ttgcggctgtcagtcacagtcagga

SEQ ID NO: 844528 - DNA, 25 bp, Mus musculus
ttgcggtgctggaatttagagcgca

SEQ ID NO: 844529 - DNA, 25 bp, Mus musculus
ttgcggtgctggtatttagagcgca

SEQ ID NO: 844530 - DNA, 25 bp, Mus musculus
ttgcggttgccaatacctatgcctg

SEQ ID NO: 844531 - DNA, 25 bp, Mus musculus
ttgcggttgccattacctatgcctg

SEQ ID NO: 844532 - DNA, 25 bp, Mus musculus
ttgcgtagcctgatgcccaacagcc

SEQ ID NO: 844533 - DNA, 25 bp, Mus musculus
ttgcgtagcctgttgcccaacagcc

SEQ ID NO: 844534 - DNA, 25 bp, Mus musculus
ttgcgtcccttcctcttcggacttg

SEQ ID NO: 844535 - DNA, 25 bp, Mus musculus
ttgcgtcccttcgtcttcggacttg

SEQ ID NO: 844536 - DNA, 25 bp, Mus musculus
ttgcgtttcacccaatagggcaagg

SEQ ID NO: 844537 - DNA, 25 bp, Mus musculus
ttgcgtttcaccgaatagggcaagg

SEQ ID NO: 844538 - DNA, 25 bp, Mus musculus
ttgctaacggtacggcgagcctgct

SEQ ID NO: 844539 - DNA, 25 bp, Mus musculus
ttgctaacggtagggcgagcctgct

SEQ ID NO: 844540 - DNA, 25 bp, Mus musculus
ttgctaatgaaaatgaaagcctggg

SEQ ID NO: 844541 - DNA, 25 bp, Mus musculus
ttgctaatgaaattgaaagcctggg

SEQ ID NO: 844542 - DNA, 25 bp, Mus musculus
ttgctaatgcttcggctgcaggcct

SEQ ID NO: 844543 - DNA, 25 bp, Mus musculus
ttgctaatgcttgggctgcaggcct

SEQ ID NO: 844544 - DNA, 25 bp, Mus musculus
ttgctacaatagagagatggagagc

SEQ ID NO: 844545 - DNA, 25 bp, Mus musculus
ttgctacaatagtgagatggagagc

SEQ ID NO: 844546 - DNA, 25 bp, Mus musculus
ttgctacagaagattctaaaggagg

SEQ ID NO: 844547 - DNA, 25 bp, Mus musculus
ttgctacagaagtttctaaaggagg

SEQ ID NO: 844548 - DNA, 25 bp, Mus musculus
ttgctaccccgcctgaggtcatgtg

SEQ ID NO: 844549 - DNA, 25 bp, Mus musculus
ttgctaccccgcgtgaggtcatgtg

SEQ ID NO: 844550 - DNA, 25 bp, Mus musculus
ttgctactggctatgcctactacag

SEQ ID NO: 844551 - DNA, 25 bp, Mus musculus
ttgctactggctttgcctactacag

SEQ ID NO: 844552 - DNA, 25 bp, Mus musculus
ttgctacttacaactagatcccacc

SEQ ID NO: 844553 - DNA, 25 bp, Mus musculus
ttgctacttacatctagatcccacc

SEQ ID NO: 844554 - DNA, 25 bp, Mus musculus
ttgctagagaaacggcgggtctaca

SEQ ID NO: 844555 - DNA, 25 bp, Mus musculus
ttgctagagaaagggcgggtctaca

SEQ ID NO: 844556 - DNA, 25 bp, Mus musculus
ttgctagcctgcatcaacctttcct

SEQ ID NO: 844557 - DNA, 25 bp, Mus musculus
ttgctagcctgcttcaacctttcct

SEQ ID NO: 844558 - DNA, 25 bp, Mus musculus
ttgctagctggtccacacgcccttt

SEQ ID NO: 844559 - DNA, 25 bp, Mus musculus
ttgctagctggtgcacacgcccttt

SEQ ID NO: 844560 - DNA, 25 bp, Mus musculus
ttgctaggacttcgataagcgtggc

SEQ ID NO: 844561 - DNA, 25 bp, Mus musculus
ttgctaggacttggataagcgtggc

SEQ ID NO: 844562 - DNA, 25 bp, Mus musculus
ttgctaggaggtactccccaactcc

SEQ ID NO: 844563 - DNA, 25 bp, Mus musculus
ttgctaggaggttctccccaactcc

SEQ ID NO: 844564 - DNA, 25 bp, Mus musculus
ttgctagtgttgctgatcttggctg

SEQ ID NO: 844565 - DNA, 25 bp, Mus musculus
ttgctagtgttggtgatcttggctg

SEQ ID NO: 844566 - DNA, 25 bp, Mus musculus
ttgctatgcttgatgaaggatctca

SEQ ID NO: 844567 - DNA, 25 bp, Mus musculus
ttgctatgcttgttgaaggatctca

SEQ ID NO: 844568 - DNA, 25 bp, Mus musculus
ttgctcaaggaaacaggaactctgg

SEQ ID NO: 844569 - DNA, 25 bp, Mus musculus
ttgctcaaggaatcaggaactctgg

SEQ ID NO: 844570 - DNA, 25 bp, Mus musculus
ttgctcacagaaaggataacgacca

SEQ ID NO: 844571 - DNA, 25 bp, Mus musculus
ttgctcacagaatggataacgacca

SEQ ID NO: 844572 - DNA, 25 bp, Mus musculus
ttgctcaccacgaaccctggctgtg

SEQ ID NO: 844573 - DNA, 25 bp, Mus musculus
ttgctcaccacgtaccctggctgtg

SEQ ID NO: 844574 - DNA, 25 bp, Mus musculus
ttgctcacgggcctagttcgccacg

SEQ ID NO: 844575 - DNA, 25 bp, Mus musculus
ttgctcacgggcgtagttcgccacg

SEQ ID NO: 844576 - DNA, 25 bp, Mus musculus
ttgctcacttcaccccaaaggcctt

SEQ ID NO: 844577 - DNA, 25 bp, Mus musculus
ttgctcacttcagcccaaaggcctt

SEQ ID NO: 844578 - DNA, 25 bp, Mus musculus
ttgctcaggatgacatcagcaccat

SEQ ID NO: 844579 - DNA, 25 bp, Mus musculus
ttgctcaggatgtcatcagcaccat

SEQ ID NO: 844580 - DNA, 25 bp, Mus musculus
ttgctcaggcctcaattggagacac

SEQ ID NO: 844581 - DNA, 25 bp, Mus musculus
ttgctcaggcctgaattggagacac

SEQ ID NO: 844582 - DNA, 25 bp, Mus musculus
ttgctccaaggtctgagcaaactca

SEQ ID NO: 844583 - DNA, 25 bp, Mus musculus
ttgctccaaggtgtgagcaaactca

SEQ ID NO: 844584 - DNA, 25 bp, Mus musculus
ttgctcccggtgaggaagctcgctg

SEQ ID NO: 844585 - DNA, 25 bp, Mus musculus
ttgctcccggtgtggaagctcgctg

SEQ ID NO: 844586 - DNA, 25 bp, Mus musculus
ttgctccggccacattagtgactcc

SEQ ID NO: 844587 - DNA, 25 bp, Mus musculus
ttgctccggccagattagtgactcc

SEQ ID NO: 844588 - DNA, 25 bp, Mus musculus
ttgctccgggctcgttataaagggc

SEQ ID NO: 844589 - DNA, 25 bp, Mus musculus
ttgctccgggctggttataaagggc

SEQ ID NO: 844590 - DNA, 25 bp, Mus musculus
ttgctccgtattctccattgctctc

SEQ ID NO: 844591 - DNA, 25 bp, Mus musculus
ttgctccgtattgtccattgctctc

SEQ ID NO: 844592 - DNA, 25 bp, Mus musculus
ttgctccgtctacaggaaggacctc

SEQ ID NO: 844593 - DNA, 25 bp, Mus musculus
ttgctccgtctagaggaaggacctc

SEQ ID NO: 844594 - DNA, 25 bp, Mus musculus
ttgctcctacaccatcagactgtca

SEQ ID NO: 844595 - DNA, 25 bp, Mus musculus
ttgctcctacacgatcagactgtca

SEQ ID NO: 844596 - DNA, 25 bp, Mus musculus
ttgctcctacgtctgctggtttcgg

SEQ ID NO: 844597 - DNA, 25 bp, Mus musculus
ttgctcctacgtgtgctggtttcgg

SEQ ID NO: 844598 - DNA, 25 bp, Mus musculus
ttgctcctgcaacggccatgcgcga

SEQ ID NO: 844599 - DNA, 25 bp, Mus musculus
ttgctcctgcaagggccatgcgcga

SEQ ID NO: 844600 - DNA, 25 bp, Mus musculus
ttgctccttaagacagacaccttgg

SEQ ID NO: 844601 - DNA, 25 bp, Mus musculus
ttgctccttaagtcagacaccttgg

SEQ ID NO: 844602 - DNA, 25 bp, Mus musculus
ttgctcgcagctatggcatccccta

SEQ ID NO: 844603 - DNA, 25 bp, Mus musculus
ttgctcgcagctttggcatccccta

SEQ ID NO: 844604 - DNA, 25 bp, Mus musculus
ttgctcggtcgcctcgtcgcttgca

SEQ ID NO: 844605 - DNA, 25 bp, Mus musculus
ttgctcggtcgcgtcgtcgcttgca

SEQ ID NO: 844606 - DNA, 25 bp, Mus musculus
ttgctctgagcccacccagtacaag

SEQ ID NO: 844607 - DNA, 25 bp, Mus musculus
ttgctctgagccgacccagtacaag

SEQ ID NO: 844608 - DNA, 25 bp, Mus musculus
ttgctctgctctccctcatggattt

SEQ ID NO: 844609 - DNA, 25 bp, Mus musculus
ttgctctgctctgcctcatggattt

SEQ ID NO: 844610 - DNA, 25 bp, Mus musculus
ttgctctgctggcaggacacccttc

SEQ ID NO: 844611 - DNA, 25 bp, Mus musculus
ttgctctgctgggaggacacccttc

SEQ ID NO: 844612 - DNA, 25 bp, Mus musculus
ttgctctgttgcagcccctgggaac

SEQ ID NO: 844613 - DNA, 25 bp, Mus musculus
ttgctctgttgctgcccctgggaac

SEQ ID NO: 844614 - DNA, 25 bp, Mus musculus
ttgctcttctttaagatgttccgga

SEQ ID NO: 844615 - DNA, 25 bp, Mus musculus
ttgctcttcttttagatgttccgga

SEQ ID NO: 844616 - DNA, 25 bp, Mus musculus
ttgctgaacaacaggcagagatcta

SEQ ID NO: 844617 - DNA, 25 bp, Mus musculus
ttgctgaacaactggcagagatcta

SEQ ID NO: 844618 - DNA, 25 bp, Mus musculus
ttgctgaacagacacagcatgagga

SEQ ID NO: 844619 - DNA, 25 bp, Mus musculus
ttgctgaacagagacagcatgagga

SEQ ID NO: 844620 - DNA, 25 bp, Mus musculus
ttgctgaactcaatgagacctggga

SEQ ID NO: 844621 - DNA, 25 bp, Mus musculus
ttgctgaactcattgagacctggga

SEQ ID NO: 844622 - DNA, 25 bp, Mus musculus
ttgctgaagtgcctgtaaaagagtc

SEQ ID NO: 844623 - DNA, 25 bp, Mus musculus
ttgctgaagtgcgtgtaaaagagtc

SEQ ID NO: 844624 - DNA, 25 bp, Mus musculus
ttgctgaatatcatgctgcagagag

SEQ ID NO: 844625 - DNA, 25 bp, Mus musculus
ttgctgaatatcttgctgcagagag

SEQ ID NO: 844626 - DNA, 25 bp, Mus musculus
ttgctgaatgttaccctgtcttgag

SEQ ID NO: 844627 - DNA, 25 bp, Mus musculus
ttgctgaatgtttccctgtcttgag

SEQ ID NO: 844628 - DNA, 25 bp, Mus musculus
ttgctgacagtgctgagccctccag

SEQ ID NO: 844629 - DNA, 25 bp, Mus musculus
ttgctgacagtggtgagccctccag

SEQ ID NO: 844630 - DNA, 25 bp, Mus musculus
ttgctgacgcctacaccggctagtg

SEQ ID NO: 844631 - DNA, 25 bp, Mus musculus
ttgctgacgccttcaccggctagtg

SEQ ID NO: 844632 - DNA, 25 bp, Mus musculus
ttgctgactacaaaccccaggacgg

SEQ ID NO: 844633 - DNA, 25 bp, Mus musculus
ttgctgactacataccccaggacgg

SEQ ID NO: 844634 - DNA, 25 bp, Mus musculus
ttgctgagaaacaaacaggcccaat

SEQ ID NO: 844635 - DNA, 25 bp, Mus musculus
ttgctgagaaactaacaggcccaat

SEQ ID NO: 844636 - DNA, 25 bp, Mus musculus
ttgctgagactcctcccggcgtcgg

SEQ ID NO: 844637 - DNA, 25 bp, Mus musculus
ttgctgagactcgtcccggcgtcgg

SEQ ID NO: 844638 - DNA, 25 bp, Mus musculus
ttgctgagcactaccgggacctaca

SEQ ID NO: 844639 - DNA, 25 bp, Mus musculus
ttgctgagcacttccgggacctaca

SEQ ID NO: 844640 - DNA, 25 bp, Mus musculus
ttgctgagggccctgatcgacattg

SEQ ID NO: 844641 - DNA, 25 bp, Mus musculus
ttgctgagggccgtgatcgacattg

SEQ ID NO: 844642 - DNA, 25 bp, Mus musculus
ttgctgagtaccatgccagtgagaa

SEQ ID NO: 844643 - DNA, 25 bp, Mus musculus
ttgctgagtaccttgccagtgagaa

SEQ ID NO: 844644 - DNA, 25 bp, Mus musculus
ttgctgagttcaagttgatcccagg

SEQ ID NO: 844645 - DNA, 25 bp, Mus musculus
ttgctgagttcatgttgatcccagg

SEQ ID NO: 844646 - DNA, 25 bp, Mus musculus
ttgctgagttggacaccctgaatga

SEQ ID NO: 844647 - DNA, 25 bp, Mus musculus
ttgctgagttggtcaccctgaatga

SEQ ID NO: 844648 - DNA, 25 bp, Mus musculus
ttgctgatcgcgatggcgaggtctt

SEQ ID NO: 844649 - DNA, 25 bp, Mus musculus
ttgctgatcgcgttggcgaggtctt

SEQ ID NO: 844650 - DNA, 25 bp, Mus musculus
ttgctgatgagcaacgccaacgacg

SEQ ID NO: 844651 - DNA, 25 bp, Mus musculus
ttgctgatgagctacgccaacgacg

SEQ ID NO: 844652 - DNA, 25 bp, Mus musculus
ttgctgatgcctcaaaaagtgtgca

SEQ ID NO: 844653 - DNA, 25 bp, Mus musculus
ttgctgatgcctgaaaaagtgtgca

SEQ ID NO: 844654 - DNA, 25 bp, Mus musculus
ttgctgcaaattccacagtattttg

SEQ ID NO: 844655 - DNA, 25 bp, Mus musculus
ttgctgcaaattgcacagtattttg

SEQ ID NO: 844656 - DNA, 25 bp, Mus musculus
ttgctgcaactcctggcagccttgg

SEQ ID NO: 844657 - DNA, 25 bp, Mus musculus
ttgctgcaactcgtggcagccttgg

SEQ ID NO: 844658 - DNA, 25 bp, Mus musculus
ttgctgcagcgcctaaagaccctgc

SEQ ID NO: 844659 - DNA, 25 bp, Mus musculus
ttgctgcagcgcgtaaagaccctgc

SEQ ID NO: 844660 - DNA, 25 bp, Mus musculus
ttgctgcagtatactagatctccag

SEQ ID NO: 844661 - DNA, 25 bp, Mus musculus
ttgctgcagtattctagatctccag

SEQ ID NO: 844662 - DNA, 25 bp, Mus musculus
ttgctgcagttcaagcggtcgctct

SEQ ID NO: 844663 - DNA, 25 bp, Mus musculus
ttgctgcagttcctccgcctggatg

SEQ ID NO: 844664 - DNA, 25 bp, Mus musculus
ttgctgcagttcgtccgcctggatg

SEQ ID NO: 844665 - DNA, 25 bp, Mus musculus
ttgctgcagttctagcggtcgctct

SEQ ID NO: 844666 - DNA, 25 bp, Mus musculus
ttgctgccatctcccgtggcctgga

SEQ ID NO: 844667 - DNA, 25 bp, Mus musculus
ttgctgccatctgccgtggcctgga

SEQ ID NO: 844668 - DNA, 25 bp, Mus musculus
ttgctgccctccaagctcagtctgt

SEQ ID NO: 844669 - DNA, 25 bp, Mus musculus
ttgctgccctcctagctcagtctgt

SEQ ID NO: 844670 - DNA, 25 bp, Mus musculus
ttgctgccgatgaaagaagacttgg

SEQ ID NO: 844671 - DNA, 25 bp, Mus musculus
ttgctgccgatgtaagaagacttgg

SEQ ID NO: 844672 - DNA, 25 bp, Mus musculus
ttgctgcctccgctggccgggatga

SEQ ID NO: 844673 - DNA, 25 bp, Mus musculus
ttgctgcctccggtggccgggatga

SEQ ID NO: 844674 - DNA, 25 bp, Mus musculus
ttgctgccttgaactcctactttgg

SEQ ID NO: 844675 - DNA, 25 bp, Mus musculus
ttgctgccttgatctcctactttgg

SEQ ID NO: 844676 - DNA, 25 bp, Mus musculus
ttgctgcgctgtcggatttgctttg

SEQ ID NO: 844677 - DNA, 25 bp, Mus musculus
ttgctgcgctgtgggatttgctttg

SEQ ID NO: 844678 - DNA, 25 bp, Mus musculus
ttgctgcgttctaggccgcgccctt

SEQ ID NO: 844679 - DNA, 25 bp, Mus musculus
ttgctgcgttcttggccgcgccctt

SEQ ID NO: 844680 - DNA, 25 bp, Mus musculus
ttgctgctcattctcggcctcctgg

SEQ ID NO: 844681 - DNA, 25 bp, Mus musculus
ttgctgctcattgtcggcctcctgg

SEQ ID NO: 844682 - DNA, 25 bp, Mus musculus
ttgctgctcctacccactttgtgct

SEQ ID NO: 844683 - DNA, 25 bp, Mus musculus
ttgctgctcctagccactttgtgct

SEQ ID NO: 844684 - DNA, 25 bp, Mus musculus
ttgctgcttcgtcaatgtgtgtgga

SEQ ID NO: 844685 - DNA, 25 bp, Mus musculus
ttgctgcttcgtgaatgtgtgtgga

SEQ ID NO: 844686 - DNA, 25 bp, Mus musculus
ttgctgcttttgacccggcggctga

SEQ ID NO: 844687 - DNA, 25 bp, Mus musculus
ttgctgcttttgtcccggcggctga

SEQ ID NO: 844688 - DNA, 25 bp, Mus musculus
ttgctggacagaactgtgaagaaaa

SEQ ID NO: 844689 - DNA, 25 bp, Mus musculus
ttgctggacagatctgtgaagaaaa

SEQ ID NO: 844690 - DNA, 25 bp, Mus musculus
ttgctggaggcacggacgacctcta

SEQ ID NO: 844691 - DNA, 25 bp, Mus musculus
ttgctggaggcagggacgacctcta

SEQ ID NO: 844692 - DNA, 25 bp, Mus musculus
ttgctggcagtgacagaaggcccca

SEQ ID NO: 844693 - DNA, 25 bp, Mus musculus
ttgctggcagtgtcagaaggcccca

SEQ ID NO: 844694 - DNA, 25 bp, Mus musculus
ttgctggcctggaccagacagtcct

SEQ ID NO: 844695 - DNA, 25 bp, Mus musculus
ttgctggcctggtccagacagtcct

SEQ ID NO: 844696 - DNA, 25 bp, Mus musculus
ttgctggcgggaattctgcatctcg

SEQ ID NO: 844697 - DNA, 25 bp, Mus musculus
ttgctggcgggatttctgcatctcg

SEQ ID NO: 844698 - DNA, 25 bp, Mus musculus
ttgctggctagtcccctctgggtcc

SEQ ID NO: 844699 - DNA, 25 bp, Mus musculus
ttgctggctagtgccctctgggtcc

SEQ ID NO: 844700 - DNA, 25 bp, Mus musculus
ttgctggctcagcaagcccgataag

SEQ ID NO: 844701 - DNA, 25 bp, Mus musculus
ttgctggctcaggaagcccgataag

SEQ ID NO: 844702 - DNA, 25 bp, Mus musculus
ttgctgggacacaaacgaccacagc

SEQ ID NO: 844703 - DNA, 25 bp, Mus musculus
ttgctgggacactaacgaccacagc

SEQ ID NO: 844704 - DNA, 25 bp, Mus musculus
ttgctgggccctatgacaaaggtga

SEQ ID NO: 844705 - DNA, 25 bp, Mus musculus
ttgctgggccctttgacaaaggtga

SEQ ID NO: 844706 - DNA, 25 bp, Mus musculus
ttgctgggctgcagagcaacgtctt

SEQ ID NO: 844707 - DNA, 25 bp, Mus musculus
ttgctgggctgctgagcaacgtctt

SEQ ID NO: 844708 - DNA, 25 bp, Mus musculus
ttgctggtcttcacctgcctcaact

SEQ ID NO: 844709 - DNA, 25 bp, Mus musculus
ttgctggtcttctcctgcctcaact

SEQ ID NO: 844710 - DNA, 25 bp, Mus musculus
ttgctggttatgatggcaatgccag

SEQ ID NO: 844711 - DNA, 25 bp, Mus musculus
ttgctggttatgttggcaatgccag

SEQ ID NO: 844712 - DNA, 25 bp, Mus musculus
ttgctgtaaaagcttccggcgctac

SEQ ID NO: 844713 - DNA, 25 bp, Mus musculus
ttgctgtaaaaggttccggcgctac

SEQ ID NO: 844714 - DNA, 25 bp, Mus musculus
ttgctgtaccgaccccgctactttg

SEQ ID NO: 844715 - DNA, 25 bp, Mus musculus
ttgctgtaccgagcccgctactttg

SEQ ID NO: 844716 - DNA, 25 bp, Mus musculus
ttgctgtcaagaacctcagccgcag

SEQ ID NO: 844717 - DNA, 25 bp, Mus musculus
ttgctgtcaagatcctcagccgcag

SEQ ID NO: 844718 - DNA, 25 bp, Mus musculus
ttgctgtcaatgcatcgtcgtcttc

SEQ ID NO: 844719 - DNA, 25 bp, Mus musculus
ttgctgtcaatggatcgtcgtcttc

SEQ ID NO: 844720 - DNA, 25 bp, Mus musculus
ttgctgtcccctccaggagactagg

SEQ ID NO: 844721 - DNA, 25 bp, Mus musculus
ttgctgtcccctgcaggagactagg

SEQ ID NO: 844722 - DNA, 25 bp, Mus musculus
ttgctgtccctaagggtgaggccca

SEQ ID NO: 844723 - DNA, 25 bp, Mus musculus
ttgctgtccctatgggtgaggccca

SEQ ID NO: 844724 - DNA, 25 bp, Mus musculus
ttgctgtcctgtcaaagaagccaga

SEQ ID NO: 844725 - DNA, 25 bp, Mus musculus
ttgctgtcctgtgaaagaagccaga

SEQ ID NO: 844726 - DNA, 25 bp, Mus musculus
ttgctgtcgactattcattggatga

SEQ ID NO: 844727 - DNA, 25 bp, Mus musculus
ttgctgtcgacttttcattggatga

SEQ ID NO: 844728 - DNA, 25 bp, Mus musculus
ttgctgtgaaccagagccgccagct

SEQ ID NO: 844729 - DNA, 25 bp, Mus musculus
ttgctgtgaacctgagccgccagct

SEQ ID NO: 844730 - DNA, 25 bp, Mus musculus
ttgctgtggtcacctcactaaccag

SEQ ID NO: 844731 - DNA, 25 bp, Mus musculus
ttgctgtggtcagctcactaaccag

SEQ ID NO: 844732 - DNA, 25 bp, Mus musculus
ttgctgtggtgcacgccccatctcg

SEQ ID NO: 844733 - DNA, 25 bp, Mus musculus
ttgctgtggtgctcgccccatctcg

SEQ ID NO: 844734 - DNA, 25 bp, Mus musculus
ttgctgtgtatgcaaaagaagaaag

SEQ ID NO: 844735 - DNA, 25 bp, Mus musculus
ttgctgtgtatggaaaagaagaaag

SEQ ID NO: 844736 - DNA, 25 bp, Mus musculus
ttgctgttctggctgaggccatcta

SEQ ID NO: 844737 - DNA, 25 bp, Mus musculus
ttgctgttctgggtgaggccatcta

SEQ ID NO: 844738 - DNA, 25 bp, Mus musculus
ttgcttaagaagacaattggttcca

SEQ ID NO: 844739 - DNA, 25 bp, Mus musculus
ttgcttaagaagtcaattggttcca

SEQ ID NO: 844740 - DNA, 25 bp, Mus musculus
ttgcttacaggtatgtgacaagaag

SEQ ID NO: 844741 - DNA, 25 bp, Mus musculus
ttgcttacaggtttgtgacaagaag

SEQ ID NO: 844742 - DNA, 25 bp, Mus musculus
ttgcttacagtgctctgggaagcca

SEQ ID NO: 844743 - DNA, 25 bp, Mus musculus
ttgcttacagtggtctgggaagcca

SEQ ID NO: 844744 - DNA, 25 bp, Mus musculus
ttgcttacatgcagcttgtcctcag

SEQ ID NO: 844745 - DNA, 25 bp, Mus musculus
ttgcttacatgctgcttgtcctcag

SEQ ID NO: 844746 - DNA, 25 bp, Mus musculus
ttgcttatctacctgatgcgtatgg

SEQ ID NO: 844747 - DNA, 25 bp, Mus musculus
ttgcttatctacgtgatgcgtatgg

SEQ ID NO: 844748 - DNA, 25 bp, Mus musculus
ttgcttatttaacagtgctggacag

SEQ ID NO: 844749 - DNA, 25 bp, Mus musculus
ttgcttatttaagagtgctggacag

SEQ ID NO: 844750 - DNA, 25 bp, Mus musculus
ttgcttcacttgcaactcggccttg

SEQ ID NO: 844751 - DNA, 25 bp, Mus musculus
ttgcttcacttggaactcggccttg

SEQ ID NO: 844752 - DNA, 25 bp, Mus musculus
ttgcttcatggaatggagaactttc

SEQ ID NO: 844753 - DNA, 25 bp, Mus musculus
ttgcttcatggattggagaactttc

SEQ ID NO: 844754 - DNA, 25 bp, Mus musculus
ttgcttccataacacagcatctggc

SEQ ID NO: 844755 - DNA, 25 bp, Mus musculus
ttgcttccataagacagcatctggc

SEQ ID NO: 844756 - DNA, 25 bp, Mus musculus
ttgcttcccaaaaccaaaggaatct

SEQ ID NO: 844757 - DNA, 25 bp, Mus musculus
ttgcttcccaaatccaaaggaatct

SEQ ID NO: 844758 - DNA, 25 bp, Mus musculus
ttgcttcctggtatgacgaggctgt

SEQ ID NO: 844759 - DNA, 25 bp, Mus musculus
ttgcttcctggtttgacgaggctgt

SEQ ID NO: 844760 - DNA, 25 bp, Mus musculus
ttgcttcgggcaagtagtcatggct

SEQ ID NO: 844761 - DNA, 25 bp, Mus musculus
ttgcttcgggcatgtagtcatggct

SEQ ID NO: 844762 - DNA, 25 bp, Mus musculus
ttgcttctacgtactgtccattgag

SEQ ID NO: 844763 - DNA, 25 bp, Mus musculus
ttgcttctacgttctgtccattgag

SEQ ID NO: 844764 - DNA, 25 bp, Mus musculus
ttgcttctcgccaggaaatcggcgg

SEQ ID NO: 844765 - DNA, 25 bp, Mus musculus
ttgcttctcgcctggaaatcggcgg

SEQ ID NO: 844766 - DNA, 25 bp, Mus musculus
ttgcttctgagcacagacagagcct

SEQ ID NO: 844767 - DNA, 25 bp, Mus musculus
ttgcttctgagctcagacagagcct

SEQ ID NO: 844768 - DNA, 25 bp, Mus musculus
ttgcttctgcgcacacgcttgggtt

SEQ ID NO: 844769 - DNA, 25 bp, Mus musculus
ttgcttctgcgctcacgcttgggtt

SEQ ID NO: 844770 - DNA, 25 bp, Mus musculus
ttgcttcttgcgcacggatcagctg

SEQ ID NO: 844771 - DNA, 25 bp, Mus musculus
ttgcttcttgcggacggatcagctg

SEQ ID NO: 844772 - DNA, 25 bp, Mus musculus
ttgcttctttcccttgactccgctg

SEQ ID NO: 844773 - DNA, 25 bp, Mus musculus
ttgcttctttccgttgactccgctg

SEQ ID NO: 844774 - DNA, 25 bp, Mus musculus
ttgcttgaactcattgaagagccct

SEQ ID NO: 844775 - DNA, 25 bp, Mus musculus
ttgcttgaactctttgaagagccct

SEQ ID NO: 844776 - DNA, 25 bp, Mus musculus
ttgcttgaatgtatcaggtttcccc

SEQ ID NO: 844777 - DNA, 25 bp, Mus musculus
ttgcttgaatgtttcaggtttcccc

SEQ ID NO: 844778 - DNA, 25 bp, Mus musculus
ttgcttgagatgaagaaactaggac

SEQ ID NO: 844779 - DNA, 25 bp, Mus musculus
ttgcttgagatgtagaaactaggac

SEQ ID NO: 844780 - DNA, 25 bp, Mus musculus
ttgcttgcagatcaacatgacacac

SEQ ID NO: 844781 - DNA, 25 bp, Mus musculus
ttgcttgcagatgaacatgacacac

SEQ ID NO: 844782 - DNA, 25 bp, Mus musculus
ttgcttgcgccacttctcttaacag

SEQ ID NO: 844783 - DNA, 25 bp, Mus musculus
ttgcttgcgccagttctcttaacag

SEQ ID NO: 844784 - DNA, 25 bp, Mus musculus
ttgcttgctcttcgcctgggagctc

SEQ ID NO: 844785 - DNA, 25 bp, Mus musculus
ttgcttgctcttggcctgggagctc

SEQ ID NO: 844786 - DNA, 25 bp, Mus musculus
ttgcttggactaaacgacactgcag

SEQ ID NO: 844787 - DNA, 25 bp, Mus musculus
ttgcttggactatacgacactgcag

SEQ ID NO: 844788 - DNA, 25 bp, Mus musculus
ttgcttggcagcactttcttgtaaa

SEQ ID NO: 844789 - DNA, 25 bp, Mus musculus
ttgcttggcagctctttcttgtaaa

SEQ ID NO: 844790 - DNA, 25 bp, Mus musculus
ttgcttgggctgatgcgccagcacg

SEQ ID NO: 844791 - DNA, 25 bp, Mus musculus
ttgcttgggctgttgcgccagcacg

SEQ ID NO: 844792 - DNA, 25 bp, Mus musculus
ttgcttgtgaaaccatctgaccttt

SEQ ID NO: 844793 - DNA, 25 bp, Mus musculus
ttgcttgtgaaagcatctgaccttt

SEQ ID NO: 844794 - DNA, 25 bp, Mus musculus
ttgctttcactaccagaatctatca

SEQ ID NO: 844795 - DNA, 25 bp, Mus musculus
ttgctttcactagcagaatctatca

SEQ ID NO: 844796 - DNA, 25 bp, Mus musculus
ttgctttctgacaatgcagcatctc

SEQ ID NO: 844797 - DNA, 25 bp, Mus musculus
ttgctttctgactatgcagcatctc

SEQ ID NO: 844798 - DNA, 25 bp, Mus musculus
ttgctttgatcaagccgagcgggct

SEQ ID NO: 844799 - DNA, 25 bp, Mus musculus
ttgctttgatcatgccgagcgggct

SEQ ID NO: 844800 - DNA, 25 bp, Mus musculus
ttgctttggagaagaatggcctgat

SEQ ID NO: 844801 - DNA, 25 bp, Mus musculus
ttgctttggagatgaatggcctgat

SEQ ID NO: 844802 - DNA, 25 bp, Mus musculus
ttgctttggaggcaacacagctgac

SEQ ID NO: 844803 - DNA, 25 bp, Mus musculus
ttgctttggagggaacacagctgac

SEQ ID NO: 844804 - DNA, 25 bp, Mus musculus
ttgctttgtgaacaggaacagaggt

SEQ ID NO: 844805 - DNA, 25 bp, Mus musculus
ttgctttgtgaagaggaacagaggt

SEQ ID NO: 844806 - DNA, 25 bp, Mus musculus
ttgcttttaccacaagaaggaggag

SEQ ID NO: 844807 - DNA, 25 bp, Mus musculus
ttgcttttaccagaagaaggaggag

SEQ ID NO: 844808 - DNA, 25 bp, Mus musculus
ttgcttttaggacgtccaggcagga

SEQ ID NO: 844809 - DNA, 25 bp, Mus musculus
ttgcttttaggaggtccaggcagga

SEQ ID NO: 844810 - DNA, 25 bp, Mus musculus
ttgcttttgaagctccgtttccttg

SEQ ID NO: 844811 - DNA, 25 bp, Mus musculus
ttgcttttgaaggtccgtttccttg

SEQ ID NO: 844812 - DNA, 25 bp, Mus musculus
ttggaaaaatttcgagacagctctg

SEQ ID NO: 844813 - DNA, 25 bp, Mus musculus
ttggaaaaatttggagacagctctg

SEQ ID NO: 844814 - DNA, 25 bp, Mus musculus
ttggaaaacctgagtcatgacagag

SEQ ID NO: 844815 - DNA, 25 bp, Mus musculus
ttggaaaacctgtgtcatgacagag

SEQ ID NO: 844816 - DNA, 25 bp, Mus musculus
ttggaaaagaacagagacacattca

SEQ ID NO: 844817 - DNA, 25 bp, Mus musculus
ttggaaaagaactgagacacattca

SEQ ID NO: 844818 - DNA, 25 bp, Mus musculus
ttggaaaatcctccataggaatggc

SEQ ID NO: 844819 - DNA, 25 bp, Mus musculus
ttggaaaatcctgcataggaatggc

SEQ ID NO: 844820 - DNA, 25 bp, Mus musculus
ttggaaaccaaaatacataaagagg

SEQ ID NO: 844821 - DNA, 25 bp, Mus musculus
ttggaaaccaaattacataaagagg

SEQ ID NO: 844822 - DNA, 25 bp, Mus musculus
ttggaaacccaaatagccaagtgga

SEQ ID NO: 844823 - DNA, 25 bp, Mus musculus
ttggaaacccaattagccaagtgga

SEQ ID NO: 844824 - DNA, 25 bp, Mus musculus
ttggaaactgatagacatcatggca

SEQ ID NO: 844825 - DNA, 25 bp, Mus musculus
ttggaaactgattgacatcatggca

SEQ ID NO: 844826 - DNA, 25 bp, Mus musculus
ttggaaactgcacttgataaatgac

SEQ ID NO: 844827 - DNA, 25 bp, Mus musculus
ttggaaactgcagttgataaatgac

SEQ ID NO: 844828 - DNA, 25 bp, Mus musculus
ttggaaagaggacccctattgccgt

SEQ ID NO: 844829 - DNA, 25 bp, Mus musculus
ttggaaagaggagccctattgccgt

SEQ ID NO: 844830 - DNA, 25 bp, Mus musculus
ttggaaaggcttcacctgagcaaca

SEQ ID NO: 844831 - DNA, 25 bp, Mus musculus
ttggaaaggcttgacctgagcaaca

SEQ ID NO: 844832 - DNA, 25 bp, Mus musculus
ttggaaagtcctcccttctccttag

SEQ ID NO: 844833 - DNA, 25 bp, Mus musculus
ttggaaagtcctgccttctccttag

SEQ ID NO: 844834 - DNA, 25 bp, Mus musculus
ttggaaagttttagggccatgcaca

SEQ ID NO: 844835 - DNA, 25 bp, Mus musculus
ttggaaagtttttgggccatgcaca

SEQ ID NO: 844836 - DNA, 25 bp, Mus musculus
ttggaaatatccatcagatcaatgt

SEQ ID NO: 844837 - DNA, 25 bp, Mus musculus
ttggaaatatccttcagatcaatgt

SEQ ID NO: 844838 - DNA, 25 bp, Mus musculus
ttggaaatgcagaccgctggattgc

SEQ ID NO: 844839 - DNA, 25 bp, Mus musculus
ttggaaatgcagtccgctggattgc

SEQ ID NO: 844840 - DNA, 25 bp, Mus musculus
ttggaaattccaagtccagccttgc

SEQ ID NO: 844841 - DNA, 25 bp, Mus musculus
ttggaaattccatgtccagccttgc

SEQ ID NO: 844842 - DNA, 25 bp, Mus musculus
ttggaacaagagagaggagaactgc

SEQ ID NO: 844843 - DNA, 25 bp, Mus musculus
ttggaacaagagtgaggagaactgc

SEQ ID NO: 844844 - DNA, 25 bp, Mus musculus
ttggaacaaggaaggcaggccgact

SEQ ID NO: 844845 - DNA, 25 bp, Mus musculus
ttggaacaaggatggcaggccgact

SEQ ID NO: 844846 - DNA, 25 bp, Mus musculus
ttggaacaccgaatgaggacacgtg

SEQ ID NO: 844847 - DNA, 25 bp, Mus musculus
ttggaacaccgattgaggacacgtg

SEQ ID NO: 844848 - DNA, 25 bp, Mus musculus
ttggaacagcgcaaggagagaaact

SEQ ID NO: 844849 - DNA, 25 bp, Mus musculus
ttggaacagcgctaggagagaaact

SEQ ID NO: 844850 - DNA, 25 bp, Mus musculus
ttggaacatcacagtacatttcaag

SEQ ID NO: 844851 - DNA, 25 bp, Mus musculus
ttggaacatcactgtacatttcaag

SEQ ID NO: 844852 - DNA, 25 bp, Mus musculus
ttggaaccaagaattctgccaaagc

SEQ ID NO: 844853 - DNA, 25 bp, Mus musculus
ttggaaccaagatttctgccaaagc

SEQ ID NO: 844854 - DNA, 25 bp, Mus musculus
ttggaaccatggacgaccgggcaga

SEQ ID NO: 844855 - DNA, 25 bp, Mus musculus
ttggaaccatggtcgaccgggcaga

SEQ ID NO: 844856 - DNA, 25 bp, Mus musculus
ttggaacctggtactcctggagctg

SEQ ID NO: 844857 - DNA, 25 bp, Mus musculus
ttggaacctggttctcctggagctg

SEQ ID NO: 844858 - DNA, 25 bp, Mus musculus
ttggaacctgtgatcagcacaatgc

SEQ ID NO: 844859 - DNA, 25 bp, Mus musculus
ttggaacctgtgttcagcacaatgc

SEQ ID NO: 844860 - DNA, 25 bp, Mus musculus
ttggaacgcgcaccagaacgaggtt

SEQ ID NO: 844861 - DNA, 25 bp, Mus musculus
ttggaacgcgcagcagaacgaggtt

SEQ ID NO: 844862 - DNA, 25 bp, Mus musculus
ttggaactagaacgaaaggagcaga

SEQ ID NO: 844863 - DNA, 25 bp, Mus musculus
ttggaactagaaggaaaggagcaga

SEQ ID NO: 844864 - DNA, 25 bp, Mus musculus
ttggaactcaaaccccagaatggca

SEQ ID NO: 844865 - DNA, 25 bp, Mus musculus
ttggaactcaaagcccagaatggca

SEQ ID NO: 844866 - DNA, 25 bp, Mus musculus
ttggaactctgacccatggatggag

SEQ ID NO: 844867 - DNA, 25 bp, Mus musculus
ttggaactctgagccatggatggag

SEQ ID NO: 844868 - DNA, 25 bp, Mus musculus
ttggaagaaaacatccaggaccaag

SEQ ID NO: 844869 - DNA, 25 bp, Mus musculus
ttggaagaaaacttccaggaccaag

SEQ ID NO: 844870 - DNA, 25 bp, Mus musculus
ttggaagacatgatcgatgccctcg

SEQ ID NO: 844871 - DNA, 25 bp, Mus musculus
ttggaagacatgttcgatgccctcg

SEQ ID NO: 844872 - DNA, 25 bp, Mus musculus
ttggaagactggcaagactccgtga

SEQ ID NO: 844873 - DNA, 25 bp, Mus musculus
ttggaagactgggaagactccgtga

SEQ ID NO: 844874 - DNA, 25 bp, Mus musculus
ttggaagcttgtcagctgacctggt

SEQ ID NO: 844875 - DNA, 25 bp, Mus musculus
ttggaagcttgtgagctgacctggt

SEQ ID NO: 844876 - DNA, 25 bp, Mus musculus
ttggaaggattacaagtagcttggc

SEQ ID NO: 844877 - DNA, 25 bp, Mus musculus
ttggaaggattagaagtagcttggc

SEQ ID NO: 844878 - DNA, 25 bp, Mus musculus
ttggaagtggagaaaaagttactca

SEQ ID NO: 844879 - DNA, 25 bp, Mus musculus
ttggaagtggagtaaaagttactca

SEQ ID NO: 844880 - DNA, 25 bp, Mus musculus
ttggaagttttcagcgctggtcaaa

SEQ ID NO: 844881 - DNA, 25 bp, Mus musculus
ttggaagttttctgcgctggtcaaa

SEQ ID NO: 844882 - DNA, 25 bp, Mus musculus
ttggaatagtgtcgtttcacagcac

SEQ ID NO: 844883 - DNA, 25 bp, Mus musculus
ttggaatagtgtggtttcacagcac

SEQ ID NO: 844884 - DNA, 25 bp, Mus musculus
ttggaatataatcctccactggcag

SEQ ID NO: 844885 - DNA, 25 bp, Mus musculus
ttggaatataatgctccactggcag

SEQ ID NO: 844886 - DNA, 25 bp, Mus musculus
ttggaatattaaccccgggagtggc

SEQ ID NO: 844887 - DNA, 25 bp, Mus musculus
ttggaatattaagcccgggagtggc

SEQ ID NO: 844888 - DNA, 25 bp, Mus musculus
ttggaatccagcactttttaaagaa

SEQ ID NO: 844889 - DNA, 25 bp, Mus musculus
ttggaatccagctctttttaaagaa

SEQ ID NO: 844890 - DNA, 25 bp, Mus musculus
ttggaatcctatctggtccacacca

SEQ ID NO: 844891 - DNA, 25 bp, Mus musculus
ttggaatcctatgtggtccacacca

SEQ ID NO: 844892 - DNA, 25 bp, Mus musculus
ttggaatcttcacctcagagtggag

SEQ ID NO: 844893 - DNA, 25 bp, Mus musculus
ttggaatcttcagctcagagtggag

SEQ ID NO: 844894 - DNA, 25 bp, Mus musculus
ttggaatgtaaacgcggcccctgtg

SEQ ID NO: 844895 - DNA, 25 bp, Mus musculus
ttggaatgtaaaggcggcccctgtg

SEQ ID NO: 844896 - DNA, 25 bp, Mus musculus
ttggaattatgtcgcccttgacaac

SEQ ID NO: 844897 - DNA, 25 bp, Mus musculus
ttggaattatgtggcccttgacaac

SEQ ID NO: 844898 - DNA, 25 bp, Mus musculus
ttggaattgatcacaccttttcagt

SEQ ID NO: 844899 - DNA, 25 bp, Mus musculus
ttggaattgatctcaccttttcagt

SEQ ID NO: 844900 - DNA, 25 bp, Mus musculus
ttggacaaaattcgattgaaccttc

SEQ ID NO: 844901 - DNA, 25 bp, Mus musculus
ttggacaaaattggattgaaccttc

SEQ ID NO: 844902 - DNA, 25 bp, Mus musculus
ttggacaacaacaagctgtcccggg

SEQ ID NO: 844903 - DNA, 25 bp, Mus musculus
ttggacaacaactagctgtcccggg

SEQ ID NO: 844904 - DNA, 25 bp, Mus musculus
ttggacaacatgattggaccacgag

SEQ ID NO: 844905 - DNA, 25 bp, Mus musculus
ttggacaacatgtttggaccacgag

SEQ ID NO: 844906 - DNA, 25 bp, Mus musculus
ttggacaactccagacctccagtaa

SEQ ID NO: 844907 - DNA, 25 bp, Mus musculus
ttggacaactcctgacctccagtaa

SEQ ID NO: 844908 - DNA, 25 bp, Mus musculus
ttggacaatagccaccagtcttagc

SEQ ID NO: 844909 - DNA, 25 bp, Mus musculus
ttggacaatagcgaccagtcttagc

SEQ ID NO: 844910 - DNA, 25 bp, Mus musculus
ttggacaatggcatggcgcggactc

SEQ ID NO: 844911 - DNA, 25 bp, Mus musculus
ttggacaatggcttggcgcggactc

SEQ ID NO: 844912 - DNA, 25 bp, Mus musculus
ttggacacggaactcaatgaagtct

SEQ ID NO: 844913 - DNA, 25 bp, Mus musculus
ttggacacggaagtcaatgaagtct

SEQ ID NO: 844914 - DNA, 25 bp, Mus musculus
ttggacagagagattaaaaagtggc

SEQ ID NO: 844915 - DNA, 25 bp, Mus musculus
ttggacagagagtttaaaaagtggc

SEQ ID NO: 844916 - DNA, 25 bp, Mus musculus
ttggacagattcatcgaacgccagc

SEQ ID NO: 844917 - DNA, 25 bp, Mus musculus
ttggacagattcttcgaacgccagc

SEQ ID NO: 844918 - DNA, 25 bp, Mus musculus
ttggacagccatcgagcacattgac

SEQ ID NO: 844919 - DNA, 25 bp, Mus musculus
ttggacagccatggagcacattgac

SEQ ID NO: 844920 - DNA, 25 bp, Mus musculus
ttggacaggcgaactcagagagacc

SEQ ID NO: 844921 - DNA, 25 bp, Mus musculus
ttggacaggcgatctcagagagacc

SEQ ID NO: 844922 - DNA, 25 bp, Mus musculus
ttggacagtgagctggtgacccctc

SEQ ID NO: 844923 - DNA, 25 bp, Mus musculus
ttggacagtgaggtggtgacccctc

SEQ ID NO: 844924 - DNA, 25 bp, Mus musculus
ttggacagtggacctacccacacca

SEQ ID NO: 844925 - DNA, 25 bp, Mus musculus
ttggacagtggagctacccacacca

SEQ ID NO: 844926 - DNA, 25 bp, Mus musculus
ttggacagtggtataccagaaggag

SEQ ID NO: 844927 - DNA, 25 bp, Mus musculus
ttggacagtggtttaccagaaggag

SEQ ID NO: 844928 - DNA, 25 bp, Mus musculus
ttggacccacccagaacagctttat

SEQ ID NO: 844929 - DNA, 25 bp, Mus musculus
ttggacccaccctgaacagctttat

SEQ ID NO: 844930 - DNA, 25 bp, Mus musculus
ttggaccccaatcgctgtgagagct

SEQ ID NO: 844931 - DNA, 25 bp, Mus musculus
ttggaccccaatggctgtgagagct

SEQ ID NO: 844932 - DNA, 25 bp, Mus musculus
ttggaccctcacaggacttccgtcg

SEQ ID NO: 844933 - DNA, 25 bp, Mus musculus
ttggaccctcactggacttccgtcg

SEQ ID NO: 844934 - DNA, 25 bp, Mus musculus
ttggaccgcaaacccaatgttgaac

SEQ ID NO: 844935 - DNA, 25 bp, Mus musculus
ttggaccgcaaagccaatgttgaac

SEQ ID NO: 844936 - DNA, 25 bp, Mus musculus
ttggaccgccatctaagaatccaca

SEQ ID NO: 844937 - DNA, 25 bp, Mus musculus
ttggaccgccatgtaagaatccaca

SEQ ID NO: 844938 - DNA, 25 bp, Mus musculus
ttggaccgcgggagcctctcgaaca

SEQ ID NO: 844939 - DNA, 25 bp, Mus musculus
ttggaccgcgggtgcctctcgaaca

SEQ ID NO: 844940 - DNA, 25 bp, Mus musculus
ttggaccggtctcggatccgatccc

SEQ ID NO: 844941 - DNA, 25 bp, Mus musculus
ttggaccggtctgggatccgatccc

SEQ ID NO: 844942 - DNA, 25 bp, Mus musculus
ttggacctagatcgcctattgcggc

SEQ ID NO: 844943 - DNA, 25 bp, Mus musculus
ttggacctagatggcctattgcggc

SEQ ID NO: 844944 - DNA, 25 bp, Mus musculus
ttggacctgatgaggcgcctgcctc

SEQ ID NO: 844945 - DNA, 25 bp, Mus musculus
ttggacctgatgtggcgcctgcctc

SEQ ID NO: 844946 - DNA, 25 bp, Mus musculus
ttggacctgcgaccacagtctcacg

SEQ ID NO: 844947 - DNA, 25 bp, Mus musculus
ttggacctgcgagcacagtctcacg

SEQ ID NO: 844948 - DNA, 25 bp, Mus musculus
ttggacgagatgcatcagctggaca

SEQ ID NO: 844949 - DNA, 25 bp, Mus musculus
ttggacgagatggatcagctggaca

SEQ ID NO: 844950 - DNA, 25 bp, Mus musculus
ttggacgagcccctcgacctaaagc

SEQ ID NO: 844951 - DNA, 25 bp, Mus musculus
ttggacgagcccgtcgacctaaagc

SEQ ID NO: 844952 - DNA, 25 bp, Mus musculus
ttggacgcttctccggcaccttcag

SEQ ID NO: 844953 - DNA, 25 bp, Mus musculus
ttggacgcttctgcggcaccttcag

SEQ ID NO: 844954 - DNA, 25 bp, Mus musculus
ttggactaccctcaccatgctcggt

SEQ ID NO: 844955 - DNA, 25 bp, Mus musculus
ttggactaccctgaccatgctcggt

SEQ ID NO: 844956 - DNA, 25 bp, Mus musculus
ttggactagctcatctcatggccct

SEQ ID NO: 844957 - DNA, 25 bp, Mus musculus
ttggactagctcttctcatggccct

SEQ ID NO: 844958 - DNA, 25 bp, Mus musculus
ttggactatacgacactgcaggaca

SEQ ID NO: 844959 - DNA, 25 bp, Mus musculus
ttggactatacgtcactgcaggaca

SEQ ID NO: 844960 - DNA, 25 bp, Mus musculus
ttggactccatcagaggcttctcca

SEQ ID NO: 844961 - DNA, 25 bp, Mus musculus
ttggactccatctgaggcttctcca

SEQ ID NO: 844962 - DNA, 25 bp, Mus musculus
ttggactccgaaatctggaccctgc

SEQ ID NO: 844963 - DNA, 25 bp, Mus musculus
ttggactccgaattctggaccctgc

SEQ ID NO: 844964 - DNA, 25 bp, Mus musculus
ttggactctttgacaaccgctttgg

SEQ ID NO: 844965 - DNA, 25 bp, Mus musculus
ttggactctttgtcaaccgctttgg

SEQ ID NO: 844966 - DNA, 25 bp, Mus musculus
ttggactgccctacaacaacggcct

SEQ ID NO: 844967 - DNA, 25 bp, Mus musculus
ttggactgcccttcaacaacggcct

SEQ ID NO: 844968 - DNA, 25 bp, Mus musculus
ttggactgctgaaggcccagcagga

SEQ ID NO: 844969 - DNA, 25 bp, Mus musculus
ttggactgctgatggcccagcagga

SEQ ID NO: 844970 - DNA, 25 bp, Mus musculus
ttggactgggatcgagcctgcttca

SEQ ID NO: 844971 - DNA, 25 bp, Mus musculus
ttggactgggatggagcctgcttca

SEQ ID NO: 844972 - DNA, 25 bp, Mus musculus
ttggacttacagcatcacgggtacc

SEQ ID NO: 844973 - DNA, 25 bp, Mus musculus
ttggacttacaggatcacgggtacc

SEQ ID NO: 844974 - DNA, 25 bp, Mus musculus
ttggacttccctcagtacgacggtg

SEQ ID NO: 844975 - DNA, 25 bp, Mus musculus
ttggacttccctgagtacgacggtg

SEQ ID NO: 844976 - DNA, 25 bp, Mus musculus
ttggacttcttgcatggcagcgcca

SEQ ID NO: 844977 - DNA, 25 bp, Mus musculus
ttggacttcttggatggcagcgcca

SEQ ID NO: 844978 - DNA, 25 bp, Mus musculus
ttggacttgactcgacagtggctcc

SEQ ID NO: 844979 - DNA, 25 bp, Mus musculus
ttggacttgactggacagtggctcc

SEQ ID NO: 844980 - DNA, 25 bp, Mus musculus
ttggacttggaccacgggcgctggg

SEQ ID NO: 844981 - DNA, 25 bp, Mus musculus
ttggacttggacgacgggcgctggg

SEQ ID NO: 844982 - DNA, 25 bp, Mus musculus
ttggagaaaaccctcagaagagttt

SEQ ID NO: 844983 - DNA, 25 bp, Mus musculus
ttggagaaaaccgtcagaagagttt

SEQ ID NO: 844984 - DNA, 25 bp, Mus musculus
ttggagaaaagcagaagtctgctct

SEQ ID NO: 844985 - DNA, 25 bp, Mus musculus
ttggagaaaagctgaagtctgctct

SEQ ID NO: 844986 - DNA, 25 bp, Mus musculus
ttggagaaacagctcatggacactc

SEQ ID NO: 844987 - DNA, 25 bp, Mus musculus
ttggagaaacaggtcatggacactc

SEQ ID NO: 844988 - DNA, 25 bp, Mus musculus
ttggagaaagagagtaaaaatgaac

SEQ ID NO: 844989 - DNA, 25 bp, Mus musculus
ttggagaaagagtgtaaaaatgaac

SEQ ID NO: 844990 - DNA, 25 bp, Mus musculus
ttggagaacccacacagacagtccc

SEQ ID NO: 844991 - DNA, 25 bp, Mus musculus
ttggagaacccagacagacagtccc

SEQ ID NO: 844992 - DNA, 25 bp, Mus musculus
ttggagaactaaagatgccgggttg

SEQ ID NO: 844993 - DNA, 25 bp, Mus musculus
ttggagaactaatgatgccgggttg

SEQ ID NO: 844994 - DNA, 25 bp, Mus musculus
ttggagaatgaacagcccgtgcatt

SEQ ID NO: 844995 - DNA, 25 bp, Mus musculus
ttggagaatgaagagcccgtgcatt

SEQ ID NO: 844996 - DNA, 25 bp, Mus musculus
ttggagacaccaagcgtgccacacc

SEQ ID NO: 844997 - DNA, 25 bp, Mus musculus
ttggagacaccatgcgtgccacacc

SEQ ID NO: 844998 - DNA, 25 bp, Mus musculus
ttggagaccctgcacaacggcaagc

SEQ ID NO: 844999 - DNA, 25 bp, Mus musculus
ttggagaccctggacaacggcaagc

SEQ ID NO: 845000 - DNA, 25 bp, Mus musculus
ttggagaccgccatgtcttcagtgc

SEQ ID NO: 845001 - DNA, 25 bp, Mus musculus
ttggagaccgccttgtcttcagtgc

SEQ ID NO: 845002 - DNA, 25 bp, Mus musculus
ttggagacggaaccgctacaaggaa

SEQ ID NO: 845003 - DNA, 25 bp, Mus musculus
ttggagacggaagcgctacaaggaa

SEQ ID NO: 845004 - DNA, 25 bp, Mus musculus
ttggagagagcacacgtcctctcgg

SEQ ID NO: 845005 - DNA, 25 bp, Mus musculus
ttggagagagcagacgtcctctcgg

SEQ ID NO: 845006 - DNA, 25 bp, Mus musculus
ttggagagcactcagtctcgactgg

SEQ ID NO: 845007 - DNA, 25 bp, Mus musculus
ttggagagcactgagtctcgactgg

SEQ ID NO: 845008 - DNA, 25 bp, Mus musculus
ttggagagctctcattcggaagttc

SEQ ID NO: 845009 - DNA, 25 bp, Mus musculus
ttggagagctctgattcggaagttc

SEQ ID NO: 845010 - DNA, 25 bp, Mus musculus
ttggagaggatcctcggctcagccc

SEQ ID NO: 845011 - DNA, 25 bp, Mus musculus
ttggagaggatcgtcggctcagccc

SEQ ID NO: 845012 - DNA, 25 bp, Mus musculus
ttggagatctagagacaagtggact

SEQ ID NO: 845013 - DNA, 25 bp, Mus musculus
ttggagatctagtgacaagtggact

SEQ ID NO: 845014 - DNA, 25 bp, Mus musculus
ttggagatgccgagctggaaagctc

SEQ ID NO: 845015 - DNA, 25 bp, Mus musculus
ttggagatgccgtgctggaaagctc

SEQ ID NO: 845016 - DNA, 25 bp, Mus musculus
ttggagatggacaccctacagccac

SEQ ID NO: 845017 - DNA, 25 bp, Mus musculus
ttggagatggactccctacagccac

SEQ ID NO: 845018 - DNA, 25 bp, Mus musculus
ttggagattactccggaccgaagca

SEQ ID NO: 845019 - DNA, 25 bp, Mus musculus
ttggagattactgcggaccgaagca

SEQ ID NO: 845020 - DNA, 25 bp, Mus musculus
ttggagcaacatcccctttatcacg

SEQ ID NO: 845021 - DNA, 25 bp, Mus musculus
ttggagcaacatgccctttatcacg

SEQ ID NO: 845022 - DNA, 25 bp, Mus musculus
ttggagcaactcctttatgggaatc

SEQ ID NO: 845023 - DNA, 25 bp, Mus musculus
ttggagcaactcgtttatgggaatc

SEQ ID NO: 845024 - DNA, 25 bp, Mus musculus
ttggagcaccgccagagaggccgca

SEQ ID NO: 845025 - DNA, 25 bp, Mus musculus
ttggagcaccgcgagagaggccgca

SEQ ID NO: 845026 - DNA, 25 bp, Mus musculus
ttggagcagatgaactctgtgatgc

SEQ ID NO: 845027 - DNA, 25 bp, Mus musculus
ttggagcagatgtactctgtgatgc

SEQ ID NO: 845028 - DNA, 25 bp, Mus musculus
ttggagcaggccaactgtgcgctct

SEQ ID NO: 845029 - DNA, 25 bp, Mus musculus
ttggagcaggcctactgtgcgctct

SEQ ID NO: 845030 - DNA, 25 bp, Mus musculus
ttggagcagtgaagaacccgaggaa

SEQ ID NO: 845031 - DNA, 25 bp, Mus musculus
ttggagcagtgatgaacccgaggaa

SEQ ID NO: 845032 - DNA, 25 bp, Mus musculus
ttggagccaaaaactggagacccag

SEQ ID NO: 845033 - DNA, 25 bp, Mus musculus
ttggagccaaaatctggagacccag

SEQ ID NO: 845034 - DNA, 25 bp, Mus musculus
ttggagccaccaagaggtccatggt

SEQ ID NO: 845035 - DNA, 25 bp, Mus musculus
ttggagccaccatgaggtccatggt

SEQ ID NO: 845036 - DNA, 25 bp, Mus musculus
ttggagcccagtatgtgctgactgt

SEQ ID NO: 845037 - DNA, 25 bp, Mus musculus
ttggagcccagtttgtgctgactgt

SEQ ID NO: 845038 - DNA, 25 bp, Mus musculus
ttggagcccgctctgccttcatggg

SEQ ID NO: 845039 - DNA, 25 bp, Mus musculus
ttggagcccgctgtgccttcatggg

SEQ ID NO: 845040 - DNA, 25 bp, Mus musculus
ttggagccggaaatgacacactggc

SEQ ID NO: 845041 - DNA, 25 bp, Mus musculus
ttggagccggaattgacacactggc

SEQ ID NO: 845042 - DNA, 25 bp, Mus musculus
ttggagccggagaccatcgcctgtg

SEQ ID NO: 845043 - DNA, 25 bp, Mus musculus
ttggagccggagtccatcgcctgtg

SEQ ID NO: 845044 - DNA, 25 bp, Mus musculus
ttggagcctagcagcaaggaaccct

SEQ ID NO: 845045 - DNA, 25 bp, Mus musculus
ttggagcctagctgcaaggaaccct

SEQ ID NO: 845046 - DNA, 25 bp, Mus musculus
ttggagcctctcagttcgccagcaa

SEQ ID NO: 845047 - DNA, 25 bp, Mus musculus
ttggagcctctctgttcgccagcaa

SEQ ID NO: 845048 - DNA, 25 bp, Mus musculus
ttggagccttcacaaaaaccctttg

SEQ ID NO: 845049 - DNA, 25 bp, Mus musculus
ttggagccttcagaaaaaccctttg

SEQ ID NO: 845050 - DNA, 25 bp, Mus musculus
ttggagcgcgccatcacctagcctt

SEQ ID NO: 845051 - DNA, 25 bp, Mus musculus
ttggagcgcgccttcacctagcctt

SEQ ID NO: 845052 - DNA, 25 bp, Mus musculus
ttggagctatttacaaatcgattca

SEQ ID NO: 845053 - DNA, 25 bp, Mus musculus
ttggagctattttcaaatcgattca

SEQ ID NO: 845054 - DNA, 25 bp, Mus musculus
ttggagctcactcgtttaaaagtgt

SEQ ID NO: 845055 - DNA, 25 bp, Mus musculus
ttggagctcactggtttaaaagtgt

SEQ ID NO: 845056 - DNA, 25 bp, Mus musculus
ttggagctcccaaggctggcaatgg

SEQ ID NO: 845057 - DNA, 25 bp, Mus musculus
ttggagctcccatggctggcaatgg

SEQ ID NO: 845058 - DNA, 25 bp, Mus musculus
ttggagctgtggcactccctggccc

SEQ ID NO: 845059 - DNA, 25 bp, Mus musculus
ttggagctgtgggactccctggccc

SEQ ID NO: 845060 - DNA, 25 bp, Mus musculus
ttggaggaacgaactaagaatggag

SEQ ID NO: 845061 - DNA, 25 bp, Mus musculus
ttggaggaacgatctaagaatggag

SEQ ID NO: 845062 - DNA, 25 bp, Mus musculus
ttggaggaagtcactgcgtagaacc

SEQ ID NO: 845063 - DNA, 25 bp, Mus musculus
ttggaggaagtctctgcgtagaacc

SEQ ID NO: 845064 - DNA, 25 bp, Mus musculus
ttggaggaatccagacaaagccggc

SEQ ID NO: 845065 - DNA, 25 bp, Mus musculus
ttggaggaatcctgacaaagccggc

SEQ ID NO: 845066 - DNA, 25 bp, Mus musculus
ttggaggaccaacttcattcacctg

SEQ ID NO: 845067 - DNA, 25 bp, Mus musculus
ttggaggaccaagttcattcacctg

SEQ ID NO: 845068 - DNA, 25 bp, Mus musculus
ttggaggagagcactccgcgccaag

SEQ ID NO: 845069 - DNA, 25 bp, Mus musculus
ttggaggagagctctccgcgccaag

SEQ ID NO: 845070 - DNA, 25 bp, Mus musculus
ttggaggagccaagcaacgagtcat

SEQ ID NO: 845071 - DNA, 25 bp, Mus musculus
ttggaggagccatgcaacgagtcat

SEQ ID NO: 845072 - DNA, 25 bp, Mus musculus
ttggaggagcgaactccacagccca

SEQ ID NO: 845073 - DNA, 25 bp, Mus musculus
ttggaggagcgatctccacagccca

SEQ ID NO: 845074 - DNA, 25 bp, Mus musculus
ttggaggaggtcacccgggaactct

SEQ ID NO: 845075 - DNA, 25 bp, Mus musculus
ttggaggaggtctcccgggaactct

SEQ ID NO: 845076 - DNA, 25 bp, Mus musculus
ttggaggatcctaaacaggatgggt

SEQ ID NO: 845077 - DNA, 25 bp, Mus musculus
ttggaggatcctcaagaactttgtc

SEQ ID NO: 845078 - DNA, 25 bp, Mus musculus
ttggaggatcctgaagaactttgtc

SEQ ID NO: 845079 - DNA, 25 bp, Mus musculus
ttggaggatccttaacaggatgggt

SEQ ID NO: 845080 - DNA, 25 bp, Mus musculus
ttggaggcagtcagtcaggagcaca

SEQ ID NO: 845081 - DNA, 25 bp, Mus musculus
ttggaggcagtctgtcaggagcaca

SEQ ID NO: 845082 - DNA, 25 bp, Mus musculus
ttggaggcccctcagttgggtacca

SEQ ID NO: 845083 - DNA, 25 bp, Mus musculus
ttggaggcccctgagttgggtacca

SEQ ID NO: 845084 - DNA, 25 bp, Mus musculus
ttggaggcgacaaattgtggcccat

SEQ ID NO: 845085 - DNA, 25 bp, Mus musculus
ttggaggcgacatattgtggcccat

SEQ ID NO: 845086 - DNA, 25 bp, Mus musculus
ttggaggcggccatgaccatctcag

SEQ ID NO: 845087 - DNA, 25 bp, Mus musculus
ttggaggcggccttgaccatctcag

SEQ ID NO: 845088 - DNA, 25 bp, Mus musculus
ttggaggctgccaccaaggatcggc

SEQ ID NO: 845089 - DNA, 25 bp, Mus musculus
ttggaggctgcctccaaggatcggc

SEQ ID NO: 845090 - DNA, 25 bp, Mus musculus
ttggaggtccccactgatcccaggg

SEQ ID NO: 845091 - DNA, 25 bp, Mus musculus
ttggaggtcccctctgatcccaggg

SEQ ID NO: 845092 - DNA, 25 bp, Mus musculus
ttggaggtgctgatggcctctgctt

SEQ ID NO: 845093 - DNA, 25 bp, Mus musculus
ttggaggtgctgttggcctctgctt

SEQ ID NO: 845094 - DNA, 25 bp, Mus musculus
ttggagtaaaacaagtgcttactgg

SEQ ID NO: 845095 - DNA, 25 bp, Mus musculus
ttggagtaaaactagtgcttactgg

SEQ ID NO: 845096 - DNA, 25 bp, Mus musculus
ttggagtaaagcaaccaattgcaga

SEQ ID NO: 845097 - DNA, 25 bp, Mus musculus
ttggagtaaagctaccaattgcaga

SEQ ID NO: 845098 - DNA, 25 bp, Mus musculus
ttggagtagaacaaaccagcgcctg

SEQ ID NO: 845099 - DNA, 25 bp, Mus musculus
ttggagtagaactaaccagcgcctg

SEQ ID NO: 845100 - DNA, 25 bp, Mus musculus
ttggagtagtccaaatgctgagact

SEQ ID NO: 845101 - DNA, 25 bp, Mus musculus
ttggagtagtcctaatgctgagact

SEQ ID NO: 845102 - DNA, 25 bp, Mus musculus
ttggagtatgccaagcgggctgcac

SEQ ID NO: 845103 - DNA, 25 bp, Mus musculus
ttggagtatgcctagcgggctgcac

SEQ ID NO: 845104 - DNA, 25 bp, Mus musculus
ttggagtcgatcctccacttccata

SEQ ID NO: 845105 - DNA, 25 bp, Mus musculus
ttggagtcgatcgtccacttccata

SEQ ID NO: 845106 - DNA, 25 bp, Mus musculus
ttggagtctacgagcgctcggaact

SEQ ID NO: 845107 - DNA, 25 bp, Mus musculus
ttggagtctacgtgcgctcggaact

SEQ ID NO: 845108 - DNA, 25 bp, Mus musculus
ttggagtgagatcaggaacatctct

SEQ ID NO: 845109 - DNA, 25 bp, Mus musculus
ttggagtgagatgaggaacatctct

SEQ ID NO: 845110 - DNA, 25 bp, Mus musculus
ttggagtgaggcaaaaatgggacca

SEQ ID NO: 845111 - DNA, 25 bp, Mus musculus
ttggagtgaggctaaaatgggacca

SEQ ID NO: 845112 - DNA, 25 bp, Mus musculus
ttggagtgtcccactggcaggccgc

SEQ ID NO: 845113 - DNA, 25 bp, Mus musculus
ttggagtgtccctctggcaggccgc

SEQ ID NO: 845114 - DNA, 25 bp, Mus musculus
ttggagttaagtattcggagaaaca

SEQ ID NO: 845115 - DNA, 25 bp, Mus musculus
ttggagttaagttttcggagaaaca

SEQ ID NO: 845116 - DNA, 25 bp, Mus musculus
ttggagttatccatatgagcactca

SEQ ID NO: 845117 - DNA, 25 bp, Mus musculus
ttggagttatccttatgagcactca

SEQ ID NO: 845118 - DNA, 25 bp, Mus musculus
ttggagttcgagcactcacaggacc

SEQ ID NO: 845119 - DNA, 25 bp, Mus musculus
ttggagttcgaggactcacaggacc

SEQ ID NO: 845120 - DNA, 25 bp, Mus musculus
ttggagttctacaccccagaggcag

SEQ ID NO: 845121 - DNA, 25 bp, Mus musculus
ttggagttctactccccagaggcag

SEQ ID NO: 845122 - DNA, 25 bp, Mus musculus
ttggagttgcatcaattcgtctttg

SEQ ID NO: 845123 - DNA, 25 bp, Mus musculus
ttggagttgcatgaattcgtctttg

SEQ ID NO: 845124 - DNA, 25 bp, Mus musculus
ttggataaccaccaaatgactaatc

SEQ ID NO: 845125 - DNA, 25 bp, Mus musculus
ttggataaccacgaaatgactaatc

SEQ ID NO: 845126 - DNA, 25 bp, Mus musculus
ttggataccacacgagtgagcctca

SEQ ID NO: 845127 - DNA, 25 bp, Mus musculus
ttggataccacaggagtgagcctca

SEQ ID NO: 845128 - DNA, 25 bp, Mus musculus
ttggatactgccaacgacgagctgg

SEQ ID NO: 845129 - DNA, 25 bp, Mus musculus
ttggatactgcctacgacgagctgg

SEQ ID NO: 845130 - DNA, 25 bp, Mus musculus
ttggatagaaaacgcagatactccc

SEQ ID NO: 845131 - DNA, 25 bp, Mus musculus
ttggatagaaaaggcagatactccc

SEQ ID NO: 845132 - DNA, 25 bp, Mus musculus
ttggatcatacaaacaagatgcatg

SEQ ID NO: 845133 - DNA, 25 bp, Mus musculus
ttggatcatacatacaagatgcatg

SEQ ID NO: 845134 - DNA, 25 bp, Mus musculus
ttggatccagctcgagtcaacgtgc

SEQ ID NO: 845135 - DNA, 25 bp, Mus musculus
ttggatccagctggagtcaacgtgc

SEQ ID NO: 845136 - DNA, 25 bp, Mus musculus
ttggatcctcgtctctgcaagaaag

SEQ ID NO: 845137 - DNA, 25 bp, Mus musculus
ttggatcctcgtgtctgcaagaaag

SEQ ID NO: 845138 - DNA, 25 bp, Mus musculus
ttggatccttggaacaggctatgct

SEQ ID NO: 845139 - DNA, 25 bp, Mus musculus
ttggatccttggtacaggctatgct

SEQ ID NO: 845140 - DNA, 25 bp, Mus musculus
ttggatcgggaacgactcctcccag

SEQ ID NO: 845141 - DNA, 25 bp, Mus musculus
ttggatcgggaaggactcctcccag

SEQ ID NO: 845142 - DNA, 25 bp, Mus musculus
ttggatcgttgcagggtgtcatcgc

SEQ ID NO: 845143 - DNA, 25 bp, Mus musculus
ttggatcgttgctgggtgtcatcgc

SEQ ID NO: 845144 - DNA, 25 bp, Mus musculus
ttggatctcaccctttctctgcgaa

SEQ ID NO: 845145 - DNA, 25 bp, Mus musculus
ttggatctcaccgtttctctgcgaa

SEQ ID NO: 845146 - DNA, 25 bp, Mus musculus
ttggatgaacctacgggatgccgaa

SEQ ID NO: 845147 - DNA, 25 bp, Mus musculus
ttggatgaaccttcgggatgccgaa

SEQ ID NO: 845148 - DNA, 25 bp, Mus musculus
ttggatgaatgtcccttccctggag

SEQ ID NO: 845149 - DNA, 25 bp, Mus musculus
ttggatgaatgtgccttccctggag

SEQ ID NO: 845150 - DNA, 25 bp, Mus musculus
ttggatgactcacaggagccgtccc

SEQ ID NO: 845151 - DNA, 25 bp, Mus musculus
ttggatgactcagaggagccgtccc

SEQ ID NO: 845152 - DNA, 25 bp, Mus musculus
ttggatgagaacatcaaggcctgct

SEQ ID NO: 845153 - DNA, 25 bp, Mus musculus
ttggatgagaacttcaaggcctgct

SEQ ID NO: 845154 - DNA, 25 bp, Mus musculus
ttggatgagagcctcgccgaacccc

SEQ ID NO: 845155 - DNA, 25 bp, Mus musculus
ttggatgagagcgtcgccgaacccc

SEQ ID NO: 845156 - DNA, 25 bp, Mus musculus
ttggatgagccaactgtcaaacgcg

SEQ ID NO: 845157 - DNA, 25 bp, Mus musculus
ttggatgagccatctgtcaaacgcg

SEQ ID NO: 845158 - DNA, 25 bp, Mus musculus
ttggatgatacaaggcctgtgagtc

SEQ ID NO: 845159 - DNA, 25 bp, Mus musculus
ttggatgatacatggcctgtgagtc

SEQ ID NO: 845160 - DNA, 25 bp, Mus musculus
ttggatgatgttagtccatctgcct

SEQ ID NO: 845161 - DNA, 25 bp, Mus musculus
ttggatgatgtttgtccatctgcct

SEQ ID NO: 845162 - DNA, 25 bp, Mus musculus
ttggatggtgcaacggattttaaag

SEQ ID NO: 845163 - DNA, 25 bp, Mus musculus
ttggatggtgcatcggattttaaag

SEQ ID NO: 845164 - DNA, 25 bp, Mus musculus
ttggattcaagtagggtttcccgag

SEQ ID NO: 845165 - DNA, 25 bp, Mus musculus
ttggattcaagttgggtttcccgag

SEQ ID NO: 845166 - DNA, 25 bp, Mus musculus
ttggattcccaaaaaagagcagtag

SEQ ID NO: 845167 - DNA, 25 bp, Mus musculus
ttggattcccaataaagagcagtag

SEQ ID NO: 845168 - DNA, 25 bp, Mus musculus
ttggattctccaagaggcgctggac

SEQ ID NO: 845169 - DNA, 25 bp, Mus musculus
ttggattctccatgaggcgctggac

SEQ ID NO: 845170 - DNA, 25 bp, Mus musculus
ttggattggaccaattccgcagcga

SEQ ID NO: 845171 - DNA, 25 bp, Mus musculus
ttggattggacctattccgcagcga

SEQ ID NO: 845172 - DNA, 25 bp, Mus musculus
ttggatttcctcactgacaggtaaa

SEQ ID NO: 845173 - DNA, 25 bp, Mus musculus
ttggatttcctctctgacaggtaaa

SEQ ID NO: 845174 - DNA, 25 bp, Mus musculus
ttggatttgtaacctttgaaaggca

SEQ ID NO: 845175 - DNA, 25 bp, Mus musculus
ttggatttgtaagctttgaaaggca

SEQ ID NO: 845176 - DNA, 25 bp, Mus musculus
ttggatttgtttcccaacgtagtcc

SEQ ID NO: 845177 - DNA, 25 bp, Mus musculus
ttggatttgtttgccaacgtagtcc

SEQ ID NO: 845178 - DNA, 25 bp, Mus musculus
ttggattttctaatcacacctggcc

SEQ ID NO: 845179 - DNA, 25 bp, Mus musculus
ttggattttctattcacacctggcc

SEQ ID NO: 845180 - DNA, 25 bp, Mus musculus
ttggcaaagacgagtcagatgagaa

SEQ ID NO: 845181 - DNA, 25 bp, Mus musculus
ttggcaaagacgtgtcagatgagaa

SEQ ID NO: 845182 - DNA, 25 bp, Mus musculus
ttggcaaccagaacgccaggttccg

SEQ ID NO: 845183 - DNA, 25 bp, Mus musculus
ttggcaaccagatcgccaggttccg

SEQ ID NO: 845184 - DNA, 25 bp, Mus musculus
ttggcaacgatcctcgcccagagct

SEQ ID NO: 845185 - DNA, 25 bp, Mus musculus
ttggcaacgatcgtcgcccagagct

SEQ ID NO: 845186 - DNA, 25 bp, Mus musculus
ttggcaagagttagaccgcatctgt

SEQ ID NO: 845187 - DNA, 25 bp, Mus musculus
ttggcaagagtttgaccgcatctgt

SEQ ID NO: 845188 - DNA, 25 bp, Mus musculus
ttggcaaggtctctgaactcacggc

SEQ ID NO: 845189 - DNA, 25 bp, Mus musculus
ttggcaaggtctgtgaactcacggc

SEQ ID NO: 845190 - DNA, 25 bp, Mus musculus
ttggcaagtccaaactctgctttct

SEQ ID NO: 845191 - DNA, 25 bp, Mus musculus
ttggcaagtccatactctgctttct

SEQ ID NO: 845192 - DNA, 25 bp, Mus musculus
ttggcacaagatcgcggaggattca

SEQ ID NO: 845193 - DNA, 25 bp, Mus musculus
ttggcacaagatggcggaggattca

SEQ ID NO: 845194 - DNA, 25 bp, Mus musculus
ttggcacagcccattggataacagt

SEQ ID NO: 845195 - DNA, 25 bp, Mus musculus
ttggcacagccctttggataacagt

SEQ ID NO: 845196 - DNA, 25 bp, Mus musculus
ttggcacatctccatattcaccacg

SEQ ID NO: 845197 - DNA, 25 bp, Mus musculus
ttggcacatctcgatattcaccacg

SEQ ID NO: 845198 - DNA, 25 bp, Mus musculus
ttggcaccaaccaagaggattatgc

SEQ ID NO: 845199 - DNA, 25 bp, Mus musculus
ttggcaccaacctagaggattatgc

SEQ ID NO: 845200 - DNA, 25 bp, Mus musculus
ttggcaccagagacggatgaagcag

SEQ ID NO: 845201 - DNA, 25 bp, Mus musculus
ttggcaccagagtcggatgaagcag

SEQ ID NO: 845202 - DNA, 25 bp, Mus musculus
ttggcaccccggatgtcccgggctg

SEQ ID NO: 845203 - DNA, 25 bp, Mus musculus
ttggcaccccggttgtcccgggctg

SEQ ID NO: 845204 - DNA, 25 bp, Mus musculus
ttggcaccgacaccgagacagagat

SEQ ID NO: 845205 - DNA, 25 bp, Mus musculus
ttggcaccgacagcgagacagagat

SEQ ID NO: 845206 - DNA, 25 bp, Mus musculus
ttggcacctcctatcttaggtcact

SEQ ID NO: 845207 - DNA, 25 bp, Mus musculus
ttggcacctcctttcttaggtcact

SEQ ID NO: 845208 - DNA, 25 bp, Mus musculus
ttggcacgaagcacctgaaggtgcc

SEQ ID NO: 845209 - DNA, 25 bp, Mus musculus
ttggcacgaagctcctgaaggtgcc

SEQ ID NO: 845210 - DNA, 25 bp, Mus musculus
ttggcacgccccagctttagtccat

SEQ ID NO: 845211 - DNA, 25 bp, Mus musculus
ttggcacgcccctgctttagtccat

SEQ ID NO: 845212 - DNA, 25 bp, Mus musculus
ttggcacgtgttattatattcagga

SEQ ID NO: 845213 - DNA, 25 bp, Mus musculus
ttggcacgtgtttttatattcagga

SEQ ID NO: 845214 - DNA, 25 bp, Mus musculus
ttggcacgttttctcattgatgaag

SEQ ID NO: 845215 - DNA, 25 bp, Mus musculus
ttggcacgttttgtcattgatgaag

SEQ ID NO: 845216 - DNA, 25 bp, Mus musculus
ttggcactcggaagcttctttgacg

SEQ ID NO: 845217 - DNA, 25 bp, Mus musculus
ttggcactcggatgcttctttgacg

SEQ ID NO: 845218 - DNA, 25 bp, Mus musculus
ttggcactgcagatgtacggctgcc

SEQ ID NO: 845219 - DNA, 25 bp, Mus musculus
ttggcactgcagttgtacggctgcc

SEQ ID NO: 845220 - DNA, 25 bp, Mus musculus
ttggcagaacccaagagcctcaggc

SEQ ID NO: 845221 - DNA, 25 bp, Mus musculus
ttggcagaaccctagagcctcaggc

SEQ ID NO: 845222 - DNA, 25 bp, Mus musculus
ttggcagaagcgctgagaaccccta

SEQ ID NO: 845223 - DNA, 25 bp, Mus musculus
ttggcagaagcggtgagaaccccta

SEQ ID NO: 845224 - DNA, 25 bp, Mus musculus
ttggcagaagtacctgagcacgtgc

SEQ ID NO: 845225 - DNA, 25 bp, Mus musculus
ttggcagaagtagctgagcacgtgc

SEQ ID NO: 845226 - DNA, 25 bp, Mus musculus
ttggcagacctgctctccgagatgg

SEQ ID NO: 845227 - DNA, 25 bp, Mus musculus
ttggcagacctggtctccgagatgg

SEQ ID NO: 845228 - DNA, 25 bp, Mus musculus
ttggcagagccacggagatacccct

SEQ ID NO: 845229 - DNA, 25 bp, Mus musculus
ttggcagagccagggagatacccct

SEQ ID NO: 845230 - DNA, 25 bp, Mus musculus
ttggcagatcccaatgtgaagcttc

SEQ ID NO: 845231 - DNA, 25 bp, Mus musculus
ttggcagatccctatgtgaagcttc

SEQ ID NO: 845232 - DNA, 25 bp, Mus musculus
ttggcagcacaaaattccctctgag

SEQ ID NO: 845233 - DNA, 25 bp, Mus musculus
ttggcagcacaatattccctctgag

SEQ ID NO: 845234 - DNA, 25 bp, Mus musculus
ttggcagctatgacacacacgagac

SEQ ID NO: 845235 - DNA, 25 bp, Mus musculus
ttggcagctatgtcacacacgagac

SEQ ID NO: 845236 - DNA, 25 bp, Mus musculus
ttggcaggacgtagttctcacagca

SEQ ID NO: 845237 - DNA, 25 bp, Mus musculus
ttggcaggacgttgttctcacagca

SEQ ID NO: 845238 - DNA, 25 bp, Mus musculus
ttggcaggaggcaagttgattctgt

SEQ ID NO: 845239 - DNA, 25 bp, Mus musculus
ttggcaggaggctagttgattctgt

SEQ ID NO: 845240 - DNA, 25 bp, Mus musculus
ttggcagggaagattggcccagctt

SEQ ID NO: 845241 - DNA, 25 bp, Mus musculus
ttggcagggaagtttggcccagctt

SEQ ID NO: 845242 - DNA, 25 bp, Mus musculus
ttggcagtaccaacactgatgagcg

SEQ ID NO: 845243 - DNA, 25 bp, Mus musculus
ttggcagtaccatcactgatgagcg

SEQ ID NO: 845244 - DNA, 25 bp, Mus musculus
ttggcagtacccaccgaggaggaac

SEQ ID NO: 845245 - DNA, 25 bp, Mus musculus
ttggcagtaccctccgaggaggaac

SEQ ID NO: 845246 - DNA, 25 bp, Mus musculus
ttggcagtagatctgcagattccag

SEQ ID NO: 845247 - DNA, 25 bp, Mus musculus
ttggcagtagatgtgcagattccag

SEQ ID NO: 845248 - DNA, 25 bp, Mus musculus
ttggcagtcagcagtctgcggagct

SEQ ID NO: 845249 - DNA, 25 bp, Mus musculus
ttggcagtcagctgtctgcggagct

SEQ ID NO: 845250 - DNA, 25 bp, Mus musculus
ttggcagtggtaacaaactcaatgg

SEQ ID NO: 845251 - DNA, 25 bp, Mus musculus
ttggcagtggtatcaaactcaatgg

SEQ ID NO: 845252 - DNA, 25 bp, Mus musculus
ttggcatcaggcagctctctcagtc

SEQ ID NO: 845253 - DNA, 25 bp, Mus musculus
ttggcatcaggctgctctctcagtc

SEQ ID NO: 845254 - DNA, 25 bp, Mus musculus
ttggcatccaatcaagccctcggtg

SEQ ID NO: 845255 - DNA, 25 bp, Mus musculus
ttggcatccaatgaagccctcggtg

SEQ ID NO: 845256 - DNA, 25 bp, Mus musculus
ttggcatccgccacgctggacactg

SEQ ID NO: 845257 - DNA, 25 bp, Mus musculus
ttggcatccgcctcgctggacactg

SEQ ID NO: 845258 - DNA, 25 bp, Mus musculus
ttggcatcgcagcacaagacctcaa

SEQ ID NO: 845259 - DNA, 25 bp, Mus musculus
ttggcatcgcaggacaagacctcaa

SEQ ID NO: 845260 - DNA, 25 bp, Mus musculus
ttggcatcgcgcacaggatcgaggc

SEQ ID NO: 845261 - DNA, 25 bp, Mus musculus
ttggcatcgcgctcaggatcgaggc

SEQ ID NO: 845262 - DNA, 25 bp, Mus musculus
ttggcatctatgacagggtgcaagg

SEQ ID NO: 845263 - DNA, 25 bp, Mus musculus
ttggcatctatgtcagggtgcaagg

SEQ ID NO: 845264 - DNA, 25 bp, Mus musculus
ttggcatgacggcacaagctcctcc

SEQ ID NO: 845265 - DNA, 25 bp, Mus musculus
ttggcatgacgggacaagctcctcc

SEQ ID NO: 845266 - DNA, 25 bp, Mus musculus
ttggcatgcgcaatcacatttctct

SEQ ID NO: 845267 - DNA, 25 bp, Mus musculus
ttggcatgcgcattcacatttctct

SEQ ID NO: 845268 - DNA, 25 bp, Mus musculus
ttggcatgcttccagaatcacggct

SEQ ID NO: 845269 - DNA, 25 bp, Mus musculus
ttggcatgcttcgagaatcacggct

SEQ ID NO: 845270 - DNA, 25 bp, Mus musculus
ttggcatgggccagtctcctgataa

SEQ ID NO: 845271 - DNA, 25 bp, Mus musculus
ttggcatgggcctgtctcctgataa

SEQ ID NO: 845272 - DNA, 25 bp, Mus musculus
ttggcatggtgtacaccatggaggc

SEQ ID NO: 845273 - DNA, 25 bp, Mus musculus
ttggcatggtgttcaccatggaggc

SEQ ID NO: 845274 - DNA, 25 bp, Mus musculus
ttggcattatgtacagaggcaagga

SEQ ID NO: 845275 - DNA, 25 bp, Mus musculus
ttggcattatgttcagaggcaagga

SEQ ID NO: 845276 - DNA, 25 bp, Mus musculus
ttggccaacaacatgcaggaagcgc

SEQ ID NO: 845277 - DNA, 25 bp, Mus musculus
ttggccaacaacttgcaggaagcgc

SEQ ID NO: 845278 - DNA, 25 bp, Mus musculus
ttggccaacaccatctcccagtttg

SEQ ID NO: 845279 - DNA, 25 bp, Mus musculus
ttggccaacaccttctcccagtttg

SEQ ID NO: 845280 - DNA, 25 bp, Mus musculus
ttggccaactttaccactctggacc

SEQ ID NO: 845281 - DNA, 25 bp, Mus musculus
ttggccaacttttccactctggacc

SEQ ID NO: 845282 - DNA, 25 bp, Mus musculus
ttggccaagcctaaggctgcatggc

SEQ ID NO: 845283 - DNA, 25 bp, Mus musculus
ttggccaagccttaggctgcatggc

SEQ ID NO: 845284 - DNA, 25 bp, Mus musculus
ttggccaagctacaactgggatcgg

SEQ ID NO: 845285 - DNA, 25 bp, Mus musculus
ttggccaagctagaactgggatcgg

SEQ ID NO: 845286 - DNA, 25 bp, Mus musculus
ttggccaaggagagccccctttcac

SEQ ID NO: 845287 - DNA, 25 bp, Mus musculus
ttggccaaggagtgccccctttcac

SEQ ID NO: 845288 - DNA, 25 bp, Mus musculus
ttggccaatctcctggtcatggtgg

SEQ ID NO: 845289 - DNA, 25 bp, Mus musculus
ttggccaatctcgtggtcatggtgg

SEQ ID NO: 845290 - DNA, 25 bp, Mus musculus
ttggccacattcctgcggagcgtga

SEQ ID NO: 845291 - DNA, 25 bp, Mus musculus
ttggccacattcgtgcggagcgtga

SEQ ID NO: 845292 - DNA, 25 bp, Mus musculus
ttggccagccttcgacagtttctag

SEQ ID NO: 845293 - DNA, 25 bp, Mus musculus
ttggccagccttggacagtttctag

SEQ ID NO: 845294 - DNA, 25 bp, Mus musculus
ttggccaggcacctttgcaaccagt

SEQ ID NO: 845295 - DNA, 25 bp, Mus musculus
ttggccaggcacgtttgcaaccagt

SEQ ID NO: 845296 - DNA, 25 bp, Mus musculus
ttggccagtgtcatcgcagagaaga

SEQ ID NO: 845297 - DNA, 25 bp, Mus musculus
ttggccagtgtcttcgcagagaaga

SEQ ID NO: 845298 - DNA, 25 bp, Mus musculus
ttggccatcaatcgcatggacgtga

SEQ ID NO: 845299 - DNA, 25 bp, Mus musculus
ttggccatcaatggcatggacgtga

SEQ ID NO: 845300 - DNA, 25 bp, Mus musculus
ttggcccaacggaccgaggccgaag

SEQ ID NO: 845301 - DNA, 25 bp, Mus musculus
ttggcccaacggtccgaggccgaag

SEQ ID NO: 845302 - DNA, 25 bp, Mus musculus
ttggcccagaaaagctttaaaaact

SEQ ID NO: 845303 - DNA, 25 bp, Mus musculus
ttggcccagaaatgctttaaaaact

SEQ ID NO: 845304 - DNA, 25 bp, Mus musculus
ttggcccagagtatcagcaagatct

SEQ ID NO: 845305 - DNA, 25 bp, Mus musculus
ttggcccagagtttcagcaagatct

SEQ ID NO: 845306 - DNA, 25 bp, Mus musculus
ttggcccagcgaagctcgtcagctg

SEQ ID NO: 845307 - DNA, 25 bp, Mus musculus
ttggcccagcgatgctcgtcagctg

SEQ ID NO: 845308 - DNA, 25 bp, Mus musculus
ttggcccagctcatgaattcaagcg

SEQ ID NO: 845309 - DNA, 25 bp, Mus musculus
ttggcccagctcttgaattcaagcg

SEQ ID NO: 845310 - DNA, 25 bp, Mus musculus
ttggcccgagccatgatccggaagc

SEQ ID NO: 845311 - DNA, 25 bp, Mus musculus
ttggcccgagccttgatccggaagc

SEQ ID NO: 845312 - DNA, 25 bp, Mus musculus
ttggcccgaggaacacacagtcttc

SEQ ID NO: 845313 - DNA, 25 bp, Mus musculus
ttggcccgaggatcacacagtcttc

SEQ ID NO: 845314 - DNA, 25 bp, Mus musculus
ttggcccgagtaccccttcctgaga

SEQ ID NO: 845315 - DNA, 25 bp, Mus musculus
ttggcccgagtagcccttcctgaga

SEQ ID NO: 845316 - DNA, 25 bp, Mus musculus
ttggccctctcccaggttacaagca

SEQ ID NO: 845317 - DNA, 25 bp, Mus musculus
ttggccctctccgaggttacaagca

SEQ ID NO: 845318 - DNA, 25 bp, Mus musculus
ttggccctgacgcacagacaaaccg

SEQ ID NO: 845319 - DNA, 25 bp, Mus musculus
ttggccctgacggacagacaaaccg

SEQ ID NO: 845320 - DNA, 25 bp, Mus musculus
ttggccctgactcagatctatagtg

SEQ ID NO: 845321 - DNA, 25 bp, Mus musculus
ttggccctgactgagatctatagtg

SEQ ID NO: 845322 - DNA, 25 bp, Mus musculus
ttggccctgccgatcgtggtcacct

SEQ ID NO: 845323 - DNA, 25 bp, Mus musculus
ttggccctgccgttcgtggtcacct

SEQ ID NO: 845324 - DNA, 25 bp, Mus musculus
ttggccctgttgagcatctttcagg

SEQ ID NO: 845325 - DNA, 25 bp, Mus musculus
ttggccctgttgtgcatctttcagg

SEQ ID NO: 845326 - DNA, 25 bp, Mus musculus
ttggccgcagatcgcaaacattgtg

SEQ ID NO: 845327 - DNA, 25 bp, Mus musculus
ttggccgcagatggcaaacattgtg

SEQ ID NO: 845328 - DNA, 25 bp, Mus musculus
ttggccgccatgcaagctgtcctgt

SEQ ID NO: 845329 - DNA, 25 bp, Mus musculus
ttggccgccatggaagctgtcctgt

SEQ ID NO: 845330 - DNA, 25 bp, Mus musculus
ttggccggacccagataccacgcta

SEQ ID NO: 845331 - DNA, 25 bp, Mus musculus
ttggccggaccctgataccacgcta

SEQ ID NO: 845332 - DNA, 25 bp, Mus musculus
ttggccgggtcaactctacttggat

SEQ ID NO: 845333 - DNA, 25 bp, Mus musculus
ttggccgggtcatctctacttggat

SEQ ID NO: 845334 - DNA, 25 bp, Mus musculus
ttggccggtactcttcacaacggat

SEQ ID NO: 845335 - DNA, 25 bp, Mus musculus
ttggccggtactgttcacaacggat

SEQ ID NO: 845336 - DNA, 25 bp, Mus musculus
ttggccgtcgagagtgctcaccagg

SEQ ID NO: 845337 - DNA, 25 bp, Mus musculus
ttggccgtcgagtgtgctcaccagg

SEQ ID NO: 845338 - DNA, 25 bp, Mus musculus
ttggccgtgctgagcgcaaactgca

SEQ ID NO: 845339 - DNA, 25 bp, Mus musculus
ttggccgtgctgtgcgcaaactgca

SEQ ID NO: 845340 - DNA, 25 bp, Mus musculus
ttggcctagctacaatctacagcta

SEQ ID NO: 845341 - DNA, 25 bp, Mus musculus
ttggcctagctagaatctacagcta

SEQ ID NO: 845342 - DNA, 25 bp, Mus musculus
ttggcctagctgagcgcgcaccgcg

SEQ ID NO: 845343 - DNA, 25 bp, Mus musculus
ttggcctagctgtgcgcgcaccgcg

SEQ ID NO: 845344 - DNA, 25 bp, Mus musculus
ttggcctcagttcggaccagcaggt

SEQ ID NO: 845345 - DNA, 25 bp, Mus musculus
ttggcctcagttgggaccagcaggt

SEQ ID NO: 845346 - DNA, 25 bp, Mus musculus
ttggcctcattgaaatctctacggg

SEQ ID NO: 845347 - DNA, 25 bp, Mus musculus
ttggcctcattgtaatctctacggg

SEQ ID NO: 845348 - DNA, 25 bp, Mus musculus
ttggcctcccttccagagactacta

SEQ ID NO: 845349 - DNA, 25 bp, Mus musculus
ttggcctcccttgcagagactacta

SEQ ID NO: 845350 - DNA, 25 bp, Mus musculus
ttggcctccgggaagtgtggtactt

SEQ ID NO: 845351 - DNA, 25 bp, Mus musculus
ttggcctccgggtagtgtggtactt

SEQ ID NO: 845352 - DNA, 25 bp, Mus musculus
ttggcctctgaccacaaagacatcc

SEQ ID NO: 845353 - DNA, 25 bp, Mus musculus
ttggcctctgacgacaaagacatcc

SEQ ID NO: 845354 - DNA, 25 bp, Mus musculus
ttggcctgcgacattccagcatgca

SEQ ID NO: 845355 - DNA, 25 bp, Mus musculus
ttggcctgcgactttccagcatgca

SEQ ID NO: 845356 - DNA, 25 bp, Mus musculus
ttggcctgggccctcacgcttactg

SEQ ID NO: 845357 - DNA, 25 bp, Mus musculus
ttggcctgggccgtcacgcttactg

SEQ ID NO: 845358 - DNA, 25 bp, Mus musculus
ttggcctggtacacaaggaggaaat

SEQ ID NO: 845359 - DNA, 25 bp, Mus musculus
ttggcctggtactcaaggaggaaat

SEQ ID NO: 845360 - DNA, 25 bp, Mus musculus
ttggccttcaggctgcccttcctgg

SEQ ID NO: 845361 - DNA, 25 bp, Mus musculus
ttggccttcagggtgcccttcctgg

SEQ ID NO: 845362 - DNA, 25 bp, Mus musculus
ttggccttgatgctcggaacagcct

SEQ ID NO: 845363 - DNA, 25 bp, Mus musculus
ttggccttgatggtcggaacagcct

SEQ ID NO: 845364 - DNA, 25 bp, Mus musculus
ttggccttgccacgcaggcagacag

SEQ ID NO: 845365 - DNA, 25 bp, Mus musculus
ttggccttgccaggcaggcagacag

SEQ ID NO: 845366 - DNA, 25 bp, Mus musculus
ttggccttggtgagcgccttgactt

SEQ ID NO: 845367 - DNA, 25 bp, Mus musculus
ttggccttggtgtgcgccttgactt

SEQ ID NO: 845368 - DNA, 25 bp, Mus musculus
ttggcctttgcacaggcctgaaaaa

SEQ ID NO: 845369 - DNA, 25 bp, Mus musculus
ttggcctttgcagaggcctgaaaaa

SEQ ID NO: 845370 - DNA, 25 bp, Mus musculus
ttggcgaattaacggctgctggcct

SEQ ID NO: 845371 - DNA, 25 bp, Mus musculus
ttggcgaattaagggctgctggcct

SEQ ID NO: 845372 - DNA, 25 bp, Mus musculus
ttggcgacaccaaggtccaccaggc

SEQ ID NO: 845373 - DNA, 25 bp, Mus musculus
ttggcgacaccatggtccaccaggc

SEQ ID NO: 845374 - DNA, 25 bp, Mus musculus
ttggcgaccgcaccctaagtctgtc

SEQ ID NO: 845375 - DNA, 25 bp, Mus musculus
ttggcgaccgcagcctaagtctgtc

SEQ ID NO: 845376 - DNA, 25 bp, Mus musculus
ttggcgaccttcaggtagcagtggt

SEQ ID NO: 845377 - DNA, 25 bp, Mus musculus
ttggcgaccttctggtagcagtggt

SEQ ID NO: 845378 - DNA, 25 bp, Mus musculus
ttggcgactaggaccttgtgcacgc

SEQ ID NO: 845379 - DNA, 25 bp, Mus musculus
ttggcgactaggtccttgtgcacgc

SEQ ID NO: 845380 - DNA, 25 bp, Mus musculus
ttggcgagaacaacgcagacatggg

SEQ ID NO: 845381 - DNA, 25 bp, Mus musculus
ttggcgagaacatcgcagacatggg

SEQ ID NO: 845382 - DNA, 25 bp, Mus musculus
ttggcgagacccacgaggaggcttt

SEQ ID NO: 845383 - DNA, 25 bp, Mus musculus
ttggcgagaccctcgaggaggcttt

SEQ ID NO: 845384 - DNA, 25 bp, Mus musculus
ttggcgaggttgaagccccaaggct

SEQ ID NO: 845385 - DNA, 25 bp, Mus musculus
ttggcgaggttgtagccccaaggct

SEQ ID NO: 845386 - DNA, 25 bp, Mus musculus
ttggcgataagtcgaaaacgagaac

SEQ ID NO: 845387 - DNA, 25 bp, Mus musculus
ttggcgataagtggaaaacgagaac

SEQ ID NO: 845388 - DNA, 25 bp, Mus musculus
ttggcgcctactcaggtacccacag

SEQ ID NO: 845389 - DNA, 25 bp, Mus musculus
ttggcgcctactgaggtacccacag

SEQ ID NO: 845390 - DNA, 25 bp, Mus musculus
ttggcgctatggcacaaccactgcc

SEQ ID NO: 845391 - DNA, 25 bp, Mus musculus
ttggcgctatgggacaaccactgcc

SEQ ID NO: 845392 - DNA, 25 bp, Mus musculus
ttggcgcttggtccttcaaccggac

SEQ ID NO: 845393 - DNA, 25 bp, Mus musculus
ttggcgcttggtgcttcaaccggac

SEQ ID NO: 845394 - DNA, 25 bp, Mus musculus
ttggcgctttcaccctcgggatgct

SEQ ID NO: 845395 - DNA, 25 bp, Mus musculus
ttggcgctttcagcctcgggatgct

SEQ ID NO: 845396 - DNA, 25 bp, Mus musculus
ttggcggagccgacaagtatcactc

SEQ ID NO: 845397 - DNA, 25 bp, Mus musculus
ttggcggagccgtcaagtatcactc

SEQ ID NO: 845398 - DNA, 25 bp, Mus musculus
ttggcggagctcaacagttcagcag

SEQ ID NO: 845399 - DNA, 25 bp, Mus musculus
ttggcggagctctacagttcagcag

SEQ ID NO: 845400 - DNA, 25 bp, Mus musculus
ttggcggcacgcctgctgttcagca

SEQ ID NO: 845401 - DNA, 25 bp, Mus musculus
ttggcggcacgcgtgctgttcagca

SEQ ID NO: 845402 - DNA, 25 bp, Mus musculus
ttggcgggtaacactatcggactct

SEQ ID NO: 845403 - DNA, 25 bp, Mus musculus
ttggcgggtaactctatcggactct

SEQ ID NO: 845404 - DNA, 25 bp, Mus musculus
ttggcgggtaatactatcgggatat

SEQ ID NO: 845405 - DNA, 25 bp, Mus musculus
ttggcgggtaattctatcgggatat

SEQ ID NO: 845406 - DNA, 25 bp, Mus musculus
ttggcggtcgcaccttggctcccag

SEQ ID NO: 845407 - DNA, 25 bp, Mus musculus
ttggcggtcgcagcttggctcccag

SEQ ID NO: 845408 - DNA, 25 bp, Mus musculus
ttggcggtctgtctatcaagaagga

SEQ ID NO: 845409 - DNA, 25 bp, Mus musculus
ttggcggtctgtgtatcaagaagga

SEQ ID NO: 845410 - DNA, 25 bp, Mus musculus
ttggcggtgacgagagaaaaatcct

SEQ ID NO: 845411 - DNA, 25 bp, Mus musculus
ttggcggtgacgtgagaaaaatcct

SEQ ID NO: 845412 - DNA, 25 bp, Mus musculus
ttggcggtgtgcacctcgattttac

SEQ ID NO: 845413 - DNA, 25 bp, Mus musculus
ttggcggtgtgccacactccacacg

SEQ ID NO: 845414 - DNA, 25 bp, Mus musculus
ttggcggtgtgcgacactccacacg

SEQ ID NO: 845415 - DNA, 25 bp, Mus musculus
ttggcggtgtgctcctcgattttac

SEQ ID NO: 845416 - DNA, 25 bp, Mus musculus
ttggcgtcccaaaacctgaggctca

SEQ ID NO: 845417 - DNA, 25 bp, Mus musculus
ttggcgtcccaatacctgaggctca

SEQ ID NO: 845418 - DNA, 25 bp, Mus musculus
ttggcgtccgatccaccatgatgcc

SEQ ID NO: 845419 - DNA, 25 bp, Mus musculus
ttggcgtccgatgcaccatgatgcc

SEQ ID NO: 845420 - DNA, 25 bp, Mus musculus
ttggcgtcctacatctgctaatggc

SEQ ID NO: 845421 - DNA, 25 bp, Mus musculus
ttggcgtcctacttctgctaatggc

SEQ ID NO: 845422 - DNA, 25 bp, Mus musculus
ttggcgtcgacgagctggacagaca

SEQ ID NO: 845423 - DNA, 25 bp, Mus musculus
ttggcgtcgacgtgctggacagaca

SEQ ID NO: 845424 - DNA, 25 bp, Mus musculus
ttggcgtgaagcattatgcaggaga

SEQ ID NO: 845425 - DNA, 25 bp, Mus musculus
ttggcgtgaagctttatgcaggaga

SEQ ID NO: 845426 - DNA, 25 bp, Mus musculus
ttggcgtgaagtccaaacactgcag

SEQ ID NO: 845427 - DNA, 25 bp, Mus musculus
ttggcgtgaagtgcaaacactgcag

SEQ ID NO: 845428 - DNA, 25 bp, Mus musculus
ttggcgtggtcaaagtcagaatcag

SEQ ID NO: 845429 - DNA, 25 bp, Mus musculus
ttggcgtggtcatagtcagaatcag

SEQ ID NO: 845430 - DNA, 25 bp, Mus musculus
ttggcgttccggctaaccaatcagg

SEQ ID NO: 845431 - DNA, 25 bp, Mus musculus
ttggcgttccgggtaaccaatcagg

SEQ ID NO: 845432 - DNA, 25 bp, Mus musculus
ttggcgttttgactgggaccagccc

SEQ ID NO: 845433 - DNA, 25 bp, Mus musculus
ttggcgttttgagtgggaccagccc

SEQ ID NO: 845434 - DNA, 25 bp, Mus musculus
ttggctaagcatcgaaggctgccag

SEQ ID NO: 845435 - DNA, 25 bp, Mus musculus
ttggctaagcatggaaggctgccag

SEQ ID NO: 845436 - DNA, 25 bp, Mus musculus
ttggctaatgggatgagcctccagc

SEQ ID NO: 845437 - DNA, 25 bp, Mus musculus
ttggctaatgggttgagcctccagc

SEQ ID NO: 845438 - DNA, 25 bp, Mus musculus
ttggctacaggaatatccaccagga

SEQ ID NO: 845439 - DNA, 25 bp, Mus musculus
ttggctacaggattatccaccagga

SEQ ID NO: 845440 - DNA, 25 bp, Mus musculus
ttggctatcaacctgggctaccggc

SEQ ID NO: 845441 - DNA, 25 bp, Mus musculus
ttggctatcaacgtgggctaccggc

SEQ ID NO: 845442 - DNA, 25 bp, Mus musculus
ttggctcaattaagaaacatcaggg

SEQ ID NO: 845443 - DNA, 25 bp, Mus musculus
ttggctcaattatgaaacatcaggg

SEQ ID NO: 845444 - DNA, 25 bp, Mus musculus
ttggctcaggttaaaccatggaaga

SEQ ID NO: 845445 - DNA, 25 bp, Mus musculus
ttggctcaggtttaaccatggaaga

SEQ ID NO: 845446 - DNA, 25 bp, Mus musculus
ttggctccaccccaagaggactctg

SEQ ID NO: 845447 - DNA, 25 bp, Mus musculus
ttggctccacccgaagaggactctg

SEQ ID NO: 845448 - DNA, 25 bp, Mus musculus
ttggctccaggaattgtgcaggaat

SEQ ID NO: 845449 - DNA, 25 bp, Mus musculus
ttggctccaggatttgtgcaggaat

SEQ ID NO: 845450 - DNA, 25 bp, Mus musculus
ttggctccagggagtggacccatca

SEQ ID NO: 845451 - DNA, 25 bp, Mus musculus
ttggctccagggtgtggacccatca

SEQ ID NO: 845452 - DNA, 25 bp, Mus musculus
ttggctccctctcactgagagccaa

SEQ ID NO: 845453 - DNA, 25 bp, Mus musculus
ttggctccctctgactgagagccaa

SEQ ID NO: 845454 - DNA, 25 bp, Mus musculus
ttggctccgcggactcgtgttccag

SEQ ID NO: 845455 - DNA, 25 bp, Mus musculus
ttggctccgcggtctcgtgttccag

SEQ ID NO: 845456 - DNA, 25 bp, Mus musculus
ttggctccgtcacaatactccagag

SEQ ID NO: 845457 - DNA, 25 bp, Mus musculus
ttggctccgtcagaatactccagag

SEQ ID NO: 845458 - DNA, 25 bp, Mus musculus
ttggctccgtcgaagaacgctccac

SEQ ID NO: 845459 - DNA, 25 bp, Mus musculus
ttggctccgtcgtagaacgctccac

SEQ ID NO: 845460 - DNA, 25 bp, Mus musculus
ttggctccttcgaggacaaaacggt

SEQ ID NO: 845461 - DNA, 25 bp, Mus musculus
ttggctccttcgtggacaaaacggt

SEQ ID NO: 845462 - DNA, 25 bp, Mus musculus
ttggctcgagccatgctgggccccg

SEQ ID NO: 845463 - DNA, 25 bp, Mus musculus
ttggctcgagccttgctgggccccg

SEQ ID NO: 845464 - DNA, 25 bp, Mus musculus
ttggctcgatgcagaagtcccgagg

SEQ ID NO: 845465 - DNA, 25 bp, Mus musculus
ttggctcgatgctgaagtcccgagg

SEQ ID NO: 845466 - DNA, 25 bp, Mus musculus
ttggctctcaggagtctgaacacag

SEQ ID NO: 845467 - DNA, 25 bp, Mus musculus
ttggctctcaggtgtctgaacacag

SEQ ID NO: 845468 - DNA, 25 bp, Mus musculus
ttggctctcattatatgcctagagg

SEQ ID NO: 845469 - DNA, 25 bp, Mus musculus
ttggctctcattttatgcctagagg

SEQ ID NO: 845470 - DNA, 25 bp, Mus musculus
ttggctctctgaaggacgactactt

SEQ ID NO: 845471 - DNA, 25 bp, Mus musculus
ttggctctctgatggacgactactt

SEQ ID NO: 845472 - DNA, 25 bp, Mus musculus
ttggctctctgccagcggtactacc

SEQ ID NO: 845473 - DNA, 25 bp, Mus musculus
ttggctctctgcgagcggtactacc

SEQ ID NO: 845474 - DNA, 25 bp, Mus musculus
ttggctctgggactgacaccatccg

SEQ ID NO: 845475 - DNA, 25 bp, Mus musculus
ttggctctgggagtgacaccatccg

SEQ ID NO: 845476 - DNA, 25 bp, Mus musculus
ttggctctgtggagttagtgaccca

SEQ ID NO: 845477 - DNA, 25 bp, Mus musculus
ttggctctgtggtgttagtgaccca

SEQ ID NO: 845478 - DNA, 25 bp, Mus musculus
ttggctctttctcagtccgagctgg

SEQ ID NO: 845479 - DNA, 25 bp, Mus musculus
ttggctctttctgagtccgagctgg

SEQ ID NO: 845480 - DNA, 25 bp, Mus musculus
ttggctgaaacacgacgactggacc

SEQ ID NO: 845481 - DNA, 25 bp, Mus musculus
ttggctgaaacaggacgactggacc

SEQ ID NO: 845482 - DNA, 25 bp, Mus musculus
ttggctgactgactcctacccctga

SEQ ID NO: 845483 - DNA, 25 bp, Mus musculus
ttggctgactgagtcctacccctga

SEQ ID NO: 845484 - DNA, 25 bp, Mus musculus
ttggctgagatcacatgaggaccag

SEQ ID NO: 845485 - DNA, 25 bp, Mus musculus
ttggctgagatctcatgaggaccag

SEQ ID NO: 845486 - DNA, 25 bp, Mus musculus
ttggctgagtggcagaatatcacca

SEQ ID NO: 845487 - DNA, 25 bp, Mus musculus
ttggctgagtgggagaatatcacca

SEQ ID NO: 845488 - DNA, 25 bp, Mus musculus
ttggctgatgccaagtggcacaagc

SEQ ID NO: 845489 - DNA, 25 bp, Mus musculus
ttggctgatgcctagtggcacaagc

SEQ ID NO: 845490 - DNA, 25 bp, Mus musculus
ttggctgcccgcagcaggctctagc

SEQ ID NO: 845491 - DNA, 25 bp, Mus musculus
ttggctgcccgctgcaggctctagc

SEQ ID NO: 845492 - DNA, 25 bp, Mus musculus
ttggctgcgtttcccgccaccttgt

SEQ ID NO: 845493 - DNA, 25 bp, Mus musculus
ttggctgcgtttgccgccaccttgt

SEQ ID NO: 845494 - DNA, 25 bp, Mus musculus
ttggctgctgcgacatacgccccag

SEQ ID NO: 845495 - DNA, 25 bp, Mus musculus
ttggctgctgcgtcatacgccccag

SEQ ID NO: 845496 - DNA, 25 bp, Mus musculus
ttggctgcttgtccgcaaacacccg

SEQ ID NO: 845497 - DNA, 25 bp, Mus musculus
ttggctgcttgtgcgcaaacacccg

SEQ ID NO: 845498 - DNA, 25 bp, Mus musculus
ttggctggcagaccgccaaccggca

SEQ ID NO: 845499 - DNA, 25 bp, Mus musculus
ttggctggcagagcgccaaccggca

SEQ ID NO: 845500 - DNA, 25 bp, Mus musculus
ttggctggctctcactgaccctcga

SEQ ID NO: 845501 - DNA, 25 bp, Mus musculus
ttggctggctctgactgaccctcga

SEQ ID NO: 845502 - DNA, 25 bp, Mus musculus
ttggctgtgaacatctgcgccgccc

SEQ ID NO: 845503 - DNA, 25 bp, Mus musculus
ttggctgtgaacttctgcgccgccc

SEQ ID NO: 845504 - DNA, 25 bp, Mus musculus
ttggctgtgacaacacttgggtccc

SEQ ID NO: 845505 - DNA, 25 bp, Mus musculus
ttggctgtgacatcacttgggtccc

SEQ ID NO: 845506 - DNA, 25 bp, Mus musculus
ttggctgtgaccaactcctgctctg

SEQ ID NO: 845507 - DNA, 25 bp, Mus musculus
ttggctgtgacctactcctgctctg

SEQ ID NO: 845508 - DNA, 25 bp, Mus musculus
ttggctgtgctcagccaagtagagc

SEQ ID NO: 845509 - DNA, 25 bp, Mus musculus
ttggctgtgctctgccaagtagagc

SEQ ID NO: 845510 - DNA, 25 bp, Mus musculus
ttggctgtgggcagcgttctcccac

SEQ ID NO: 845511 - DNA, 25 bp, Mus musculus
ttggctgtgggctgcgttctcccac

SEQ ID NO: 845512 - DNA, 25 bp, Mus musculus
ttggctgtgtgtaagtgtggtctac

SEQ ID NO: 845513 - DNA, 25 bp, Mus musculus
ttggctgtgtgttagtgtggtctac

SEQ ID NO: 845514 - DNA, 25 bp, Mus musculus
ttggctgtgttcaagtcagccaagc

SEQ ID NO: 845515 - DNA, 25 bp, Mus musculus
ttggctgtgttctagtcagccaagc

SEQ ID NO: 845516 - DNA, 25 bp, Mus musculus
ttggcttaaccaagcagctcctgga

SEQ ID NO: 845517 - DNA, 25 bp, Mus musculus
ttggcttaaccatgcagctcctgga

SEQ ID NO: 845518 - DNA, 25 bp, Mus musculus
ttggcttcaaatccgtcgaagcagc

SEQ ID NO: 845519 - DNA, 25 bp, Mus musculus
ttggcttcaaatgcgtcgaagcagc

SEQ ID NO: 845520 - DNA, 25 bp, Mus musculus
ttggcttcgtcgcagggatcttcat

SEQ ID NO: 845521 - DNA, 25 bp, Mus musculus
ttggcttcgtcggagggatcttcat

SEQ ID NO: 845522 - DNA, 25 bp, Mus musculus
ttggcttctaggctacaaaagagcg

SEQ ID NO: 845523 - DNA, 25 bp, Mus musculus
ttggcttctagggtacaaaagagcg

SEQ ID NO: 845524 - DNA, 25 bp, Mus musculus
ttggcttctcttcatgatgggctgt

SEQ ID NO: 845525 - DNA, 25 bp, Mus musculus
ttggcttctcttgatgatgggctgt

SEQ ID NO: 845526 - DNA, 25 bp, Mus musculus
ttggcttcttcacatggcgcaagtc

SEQ ID NO: 845527 - DNA, 25 bp, Mus musculus
ttggcttcttcagatggcgcaagtc

SEQ ID NO: 845528 - DNA, 25 bp, Mus musculus
ttggcttgccctaggctttcctcac

SEQ ID NO: 845529 - DNA, 25 bp, Mus musculus
ttggcttgcccttggctttcctcac

SEQ ID NO: 845530 - DNA, 25 bp, Mus musculus
ttggcttggataaaatgttggtgga

SEQ ID NO: 845531 - DNA, 25 bp, Mus musculus
ttggcttggatataatgttggtgga

SEQ ID NO: 845532 - DNA, 25 bp, Mus musculus
ttggcttgggaaaagaaacatgact

SEQ ID NO: 845533 - DNA, 25 bp, Mus musculus
ttggcttgggaatagaaacatgact

SEQ ID NO: 845534 - DNA, 25 bp, Mus musculus
ttggcttgggagaccttggctgtaa

SEQ ID NO: 845535 - DNA, 25 bp, Mus musculus
ttggcttgggagtccttggctgtaa

SEQ ID NO: 845536 - DNA, 25 bp, Mus musculus
ttggcttgtgccatgcaaacattgc

SEQ ID NO: 845537 - DNA, 25 bp, Mus musculus
ttggcttgtgccttgcaaacattgc

SEQ ID NO: 845538 - DNA, 25 bp, Mus musculus
ttggctttagcgaagtaaccgaggc

SEQ ID NO: 845539 - DNA, 25 bp, Mus musculus
ttggctttagcgtagtaaccgaggc

SEQ ID NO: 845540 - DNA, 25 bp, Mus musculus
ttggcttttcccactggtcaacaca

SEQ ID NO: 845541 - DNA, 25 bp, Mus musculus
ttggcttttccctctggtcaacaca

SEQ ID NO: 845542 - DNA, 25 bp, Mus musculus
ttgggaaaacctcgctgggtctctg

SEQ ID NO: 845543 - DNA, 25 bp, Mus musculus
ttgggaaaacctggctgggtctctg

SEQ ID NO: 845544 - DNA, 25 bp, Mus musculus
ttgggaaaatggactcgggtcatga

SEQ ID NO: 845545 - DNA, 25 bp, Mus musculus
ttgggaaaatggtctcgggtcatga

SEQ ID NO: 845546 - DNA, 25 bp, Mus musculus
ttgggaaaattcaggccccatgtct

SEQ ID NO: 845547 - DNA, 25 bp, Mus musculus
ttgggaaaattctggccccatgtct

SEQ ID NO: 845548 - DNA, 25 bp, Mus musculus
ttgggaaacgtccaacccgcccatg

SEQ ID NO: 845549 - DNA, 25 bp, Mus musculus
ttgggaaacgtcgaacccgcccatg

SEQ ID NO: 845550 - DNA, 25 bp, Mus musculus
ttgggaaagcaaaactcacatcctg

SEQ ID NO: 845551 - DNA, 25 bp, Mus musculus
ttgggaaagcaatactcacatcctg

SEQ ID NO: 845552 - DNA, 25 bp, Mus musculus
ttgggaaagcagaacttccggtggc

SEQ ID NO: 845553 - DNA, 25 bp, Mus musculus
ttgggaaagcagtacttccggtggc

SEQ ID NO: 845554 - DNA, 25 bp, Mus musculus
ttgggaaatgcaagtgtttatcacc

SEQ ID NO: 845555 - DNA, 25 bp, Mus musculus
ttgggaaatgcatgtgtttatcacc

SEQ ID NO: 845556 - DNA, 25 bp, Mus musculus
ttgggaaatggaccactgatgacgt

SEQ ID NO: 845557 - DNA, 25 bp, Mus musculus
ttgggaaatggagcactgatgacgt

SEQ ID NO: 845558 - DNA, 25 bp, Mus musculus
ttgggaacaaccatagctgttggga

SEQ ID NO: 845559 - DNA, 25 bp, Mus musculus
ttgggaacaaccttagctgttggga

SEQ ID NO: 845560 - DNA, 25 bp, Mus musculus
ttgggaacccaaatagtgctgtctt

SEQ ID NO: 845561 - DNA, 25 bp, Mus musculus
ttgggaacccaattagtgctgtctt

SEQ ID NO: 845562 - DNA, 25 bp, Mus musculus
ttgggaacgggcagggccaccttct

SEQ ID NO: 845563 - DNA, 25 bp, Mus musculus
ttgggaacgggctgggccaccttct

SEQ ID NO: 845564 - DNA, 25 bp, Mus musculus
ttgggaagagctccacctaccctgg

SEQ ID NO: 845565 - DNA, 25 bp, Mus musculus
ttgggaagagctgcacctaccctgg

SEQ ID NO: 845566 - DNA, 25 bp, Mus musculus
ttgggaagagtgctaggtaaccatt

SEQ ID NO: 845567 - DNA, 25 bp, Mus musculus
ttgggaagagtggtaggtaaccatt

SEQ ID NO: 845568 - DNA, 25 bp, Mus musculus
ttgggaagcaacctgattgaaacac

SEQ ID NO: 845569 - DNA, 25 bp, Mus musculus
ttgggaagcaacgtgattgaaacac

SEQ ID NO: 845570 - DNA, 25 bp, Mus musculus
ttgggaaggacacctacgacagcac

SEQ ID NO: 845571 - DNA, 25 bp, Mus musculus
ttgggaaggacagctacgacagcac

SEQ ID NO: 845572 - DNA, 25 bp, Mus musculus
ttgggaagtcgtcgccaacgctgct

SEQ ID NO: 845573 - DNA, 25 bp, Mus musculus
ttgggaagtcgtggccaacgctgct

SEQ ID NO: 845574 - DNA, 25 bp, Mus musculus
ttgggaataatgacaaaaagccctg

SEQ ID NO: 845575 - DNA, 25 bp, Mus musculus
ttgggaataatgtcaaaaagccctg

SEQ ID NO: 845576 - DNA, 25 bp, Mus musculus
ttgggaatcggaatgaccctctcgg

SEQ ID NO: 845577 - DNA, 25 bp, Mus musculus
ttgggaatcggattgaccctctcgg

SEQ ID NO: 845578 - DNA, 25 bp, Mus musculus
ttgggaatgaccacctctgcccgcg

SEQ ID NO: 845579 - DNA, 25 bp, Mus musculus
ttgggaatgacctcctctgcccgcg

SEQ ID NO: 845580 - DNA, 25 bp, Mus musculus
ttgggaatgatgacgtccgaggcta

SEQ ID NO: 845581 - DNA, 25 bp, Mus musculus
ttgggaatgatgtcgtccgaggcta

SEQ ID NO: 845582 - DNA, 25 bp, Mus musculus
ttgggaatgtgactactgcagagaa

SEQ ID NO: 845583 - DNA, 25 bp, Mus musculus
ttgggaatgtgagtactgcagagaa

SEQ ID NO: 845584 - DNA, 25 bp, Mus musculus
ttgggacaagcgcaagaggtcgtac

SEQ ID NO: 845585 - DNA, 25 bp, Mus musculus
ttgggacaagcggaagaggtcgtac

SEQ ID NO: 845586 - DNA, 25 bp, Mus musculus
ttgggacacaagcatcgccaccaga

SEQ ID NO: 845587 - DNA, 25 bp, Mus musculus
ttgggacacaaggatcgccaccaga

SEQ ID NO: 845588 - DNA, 25 bp, Mus musculus
ttgggacactttcgaacttgcacag

SEQ ID NO: 845589 - DNA, 25 bp, Mus musculus
ttgggacactttggaacttgcacag

SEQ ID NO: 845590 - DNA, 25 bp, Mus musculus
ttgggacagagaaataatgcacatg

SEQ ID NO: 845591 - DNA, 25 bp, Mus musculus
ttgggacagagatataatgcacatg

SEQ ID NO: 845592 - DNA, 25 bp, Mus musculus
ttgggaccacctagggttgccctct

SEQ ID NO: 845593 - DNA, 25 bp, Mus musculus
ttgggaccaccttgggttgccctct

SEQ ID NO: 845594 - DNA, 25 bp, Mus musculus
ttgggaccgactacgtccaccaggg

SEQ ID NO: 845595 - DNA, 25 bp, Mus musculus
ttgggaccgacttcgtccaccaggg

SEQ ID NO: 845596 - DNA, 25 bp, Mus musculus
ttgggacctggcaacatgtgatgag

SEQ ID NO: 845597 - DNA, 25 bp, Mus musculus
ttgggacctggctacatgtgatgag

SEQ ID NO: 845598 - DNA, 25 bp, Mus musculus
ttgggactggagaaacgtccaaggc

SEQ ID NO: 845599 - DNA, 25 bp, Mus musculus
ttgggactggagtaacgtccaaggc

SEQ ID NO: 845600 - DNA, 25 bp, Mus musculus
ttgggacttctcacaaatacctggg

SEQ ID NO: 845601 - DNA, 25 bp, Mus musculus
ttgggacttctctcaaatacctggg

SEQ ID NO: 845602 - DNA, 25 bp, Mus musculus
ttgggacttgggatccatccagtgg

SEQ ID NO: 845603 - DNA, 25 bp, Mus musculus
ttgggacttgggttccatccagtgg

SEQ ID NO: 845604 - DNA, 25 bp, Mus musculus
ttgggagaaggaatcataactgata

SEQ ID NO: 845605 - DNA, 25 bp, Mus musculus
ttgggagaaggattcataactgata

SEQ ID NO: 845606 - DNA, 25 bp, Mus musculus
ttgggagacctcatcagtacttcac

SEQ ID NO: 845607 - DNA, 25 bp, Mus musculus
ttgggagacctcttcagtacttcac

SEQ ID NO: 845608 - DNA, 25 bp, Mus musculus
ttgggagagtacatgccaaagaccc

SEQ ID NO: 845609 - DNA, 25 bp, Mus musculus
ttgggagagtacttgccaaagaccc

SEQ ID NO: 845610 - DNA, 25 bp, Mus musculus
ttgggagatacaagccaagcatgtc

SEQ ID NO: 845611 - DNA, 25 bp, Mus musculus
ttgggagatacatgccaagcatgtc

SEQ ID NO: 845612 - DNA, 25 bp, Mus musculus
ttgggagatccgcttctccgctcct

SEQ ID NO: 845613 - DNA, 25 bp, Mus musculus
ttgggagatccggttctccgctcct

SEQ ID NO: 845614 - DNA, 25 bp, Mus musculus
ttgggagattaccaccaccttggag

SEQ ID NO: 845615 - DNA, 25 bp, Mus musculus
ttgggagattacgaccaccttggag

SEQ ID NO: 845616 - DNA, 25 bp, Mus musculus
ttgggagcagtgaaactcgtcaaag

SEQ ID NO: 845617 - DNA, 25 bp, Mus musculus
ttgggagcagtgtaactcgtcaaag

SEQ ID NO: 845618 - DNA, 25 bp, Mus musculus
ttgggagccagccaaaacgccggaa

SEQ ID NO: 845619 - DNA, 25 bp, Mus musculus
ttgggagccagcgaaaacgccggaa

SEQ ID NO: 845620 - DNA, 25 bp, Mus musculus
ttgggagccgtccaacactgctact

SEQ ID NO: 845621 - DNA, 25 bp, Mus musculus
ttgggagccgtcgaacactgctact

SEQ ID NO: 845622 - DNA, 25 bp, Mus musculus
ttgggagtctgcaccgtgcgctccg

SEQ ID NO: 845623 - DNA, 25 bp, Mus musculus
ttgggagtctgctccgtgcgctccg

SEQ ID NO: 845624 - DNA, 25 bp, Mus musculus
ttgggagttggtccgcaacctgcta

SEQ ID NO: 845625 - DNA, 25 bp, Mus musculus
ttgggagttggtgcgcaacctgcta

SEQ ID NO: 845626 - DNA, 25 bp, Mus musculus
ttgggatacgatcaggtaagagcat

SEQ ID NO: 845627 - DNA, 25 bp, Mus musculus
ttgggatacgatgaggtaagagcat

SEQ ID NO: 845628 - DNA, 25 bp, Mus musculus
ttgggatagctaaacgacaaataag

SEQ ID NO: 845629 - DNA, 25 bp, Mus musculus
ttgggatagctatacgacaaataag

SEQ ID NO: 845630 - DNA, 25 bp, Mus musculus
ttgggatcatgacaagactcctaac

SEQ ID NO: 845631 - DNA, 25 bp, Mus musculus
ttgggatcatgagaagactcctaac

SEQ ID NO: 845632 - DNA, 25 bp, Mus musculus
ttgggatcgacaaagccctggtgaa

SEQ ID NO: 845633 - DNA, 25 bp, Mus musculus
ttgggatcgacatagccctggtgaa

SEQ ID NO: 845634 - DNA, 25 bp, Mus musculus
ttgggatcggtgacaggcacaacga

SEQ ID NO: 845635 - DNA, 25 bp, Mus musculus
ttgggatcggtgtcaggcacaacga

SEQ ID NO: 845636 - DNA, 25 bp, Mus musculus
ttgggatgagtcactgcctcgcgct

SEQ ID NO: 845637 - DNA, 25 bp, Mus musculus
ttgggatgagtctctgcctcgcgct

SEQ ID NO: 845638 - DNA, 25 bp, Mus musculus
ttgggatgatctcttggcccgccgc

SEQ ID NO: 845639 - DNA, 25 bp, Mus musculus
ttgggatgatctgttggcccgccgc

SEQ ID NO: 845640 - DNA, 25 bp, Mus musculus
ttgggatgcctacggccatcgagat

SEQ ID NO: 845641 - DNA, 25 bp, Mus musculus
ttgggatgcctagggccatcgagat

SEQ ID NO: 845642 - DNA, 25 bp, Mus musculus
ttgggatgctcaagctgtccgccac

SEQ ID NO: 845643 - DNA, 25 bp, Mus musculus
ttgggatgctcatgctgtccgccac

SEQ ID NO: 845644 - DNA, 25 bp, Mus musculus
ttgggatgggagaagacaaagctaa

SEQ ID NO: 845645 - DNA, 25 bp, Mus musculus
ttgggatgggagtagacaaagctaa

SEQ ID NO: 845646 - DNA, 25 bp, Mus musculus
ttgggatgttcaagcagaggtcaga

SEQ ID NO: 845647 - DNA, 25 bp, Mus musculus
ttgggatgttcatgcagaggtcaga

SEQ ID NO: 845648 - DNA, 25 bp, Mus musculus
ttgggatttgacacccgggtcacca

SEQ ID NO: 845649 - DNA, 25 bp, Mus musculus
ttgggatttgactcccgggtcacca

SEQ ID NO: 845650 - DNA, 25 bp, Mus musculus
ttgggcagatcaagattgaaaacct

SEQ ID NO: 845651 - DNA, 25 bp, Mus musculus
ttgggcagatcatgattgaaaacct

SEQ ID NO: 845652 - DNA, 25 bp, Mus musculus
ttgggcagcgacagctccacggcca

SEQ ID NO: 845653 - DNA, 25 bp, Mus musculus
ttgggcagcgactgctccacggcca

SEQ ID NO: 845654 - DNA, 25 bp, Mus musculus
ttgggcaggctcagaaagagactac

SEQ ID NO: 845655 - DNA, 25 bp, Mus musculus
ttgggcaggctctgaaagagactac

SEQ ID NO: 845656 - DNA, 25 bp, Mus musculus
ttgggcagtacaaagccttctaaat

SEQ ID NO: 845657 - DNA, 25 bp, Mus musculus
ttgggcagtacatagccttctaaat

SEQ ID NO: 845658 - DNA, 25 bp, Mus musculus
ttgggcagtgaacaaacttggttcc

SEQ ID NO: 845659 - DNA, 25 bp, Mus musculus
ttgggcagtgaagaaacttggttcc

SEQ ID NO: 845660 - DNA, 25 bp, Mus musculus
ttgggcatggccatggcccggtcca

SEQ ID NO: 845661 - DNA, 25 bp, Mus musculus
ttgggcatggccttggcccggtcca

SEQ ID NO: 845662 - DNA, 25 bp, Mus musculus
ttgggccaacttcccaagcagctgg

SEQ ID NO: 845663 - DNA, 25 bp, Mus musculus
ttgggccaacttgccaagcagctgg

SEQ ID NO: 845664 - DNA, 25 bp, Mus musculus
ttgggccatggcagcggcaagctct

SEQ ID NO: 845665 - DNA, 25 bp, Mus musculus
ttgggccatggctgcggcaagctct

SEQ ID NO: 845666 - DNA, 25 bp, Mus musculus
ttgggccccacacgctttctttagc

SEQ ID NO: 845667 - DNA, 25 bp, Mus musculus
ttgggccccacaggctttctttagc

SEQ ID NO: 845668 - DNA, 25 bp, Mus musculus
ttgggccccttcactgttcccatgt

SEQ ID NO: 845669 - DNA, 25 bp, Mus musculus
ttgggccccttctctgttcccatgt

SEQ ID NO: 845670 - DNA, 25 bp, Mus musculus
ttgggccctcttcctaatccgacag

SEQ ID NO: 845671 - DNA, 25 bp, Mus musculus
ttgggccctcttgctaatccgacag

SEQ ID NO: 845672 - DNA, 25 bp, Mus musculus
ttgggcctatgtcttgcttcatctc

SEQ ID NO: 845673 - DNA, 25 bp, Mus musculus
ttgggcctatgtgttgcttcatctc

SEQ ID NO: 845674 - DNA, 25 bp, Mus musculus
ttgggcctcagtcgcaaggctgtcc

SEQ ID NO: 845675 - DNA, 25 bp, Mus musculus
ttgggcctcagtggcaaggctgtcc

SEQ ID NO: 845676 - DNA, 25 bp, Mus musculus
ttgggcctgacccagtcagagatcg

SEQ ID NO: 845677 - DNA, 25 bp, Mus musculus
ttgggcctgaccgagtcagagatcg

SEQ ID NO: 845678 - DNA, 25 bp, Mus musculus
ttgggcctgcggacgttggcctcat

SEQ ID NO: 845679 - DNA, 25 bp, Mus musculus
ttgggcctgcggtcgttggcctcat

SEQ ID NO: 845680 - DNA, 25 bp, Mus musculus
ttgggcgtcagcacggcctcccagg

SEQ ID NO: 845681 - DNA, 25 bp, Mus musculus
ttgggcgtcagctcggcctcccagg

SEQ ID NO: 845682 - DNA, 25 bp, Mus musculus
ttgggctaacgcaggagcaggcatt

SEQ ID NO: 845683 - DNA, 25 bp, Mus musculus
ttgggctaacgctggagcaggcatt

SEQ ID NO: 845684 - DNA, 25 bp, Mus musculus
ttgggctaccccaaataccagaagt

SEQ ID NO: 845685 - DNA, 25 bp, Mus musculus
ttgggctacccctaataccagaagt

SEQ ID NO: 845686 - DNA, 25 bp, Mus musculus
ttgggctgagcaaggagttcctgac

SEQ ID NO: 845687 - DNA, 25 bp, Mus musculus
ttgggctgagcatggagttcctgac

SEQ ID NO: 845688 - DNA, 25 bp, Mus musculus
ttgggctgagctatccaccggctgt

SEQ ID NO: 845689 - DNA, 25 bp, Mus musculus
ttgggctgagctttccaccggctgt

SEQ ID NO: 845690 - DNA, 25 bp, Mus musculus
ttgggctgatgcagggatcctgcat

SEQ ID NO: 845691 - DNA, 25 bp, Mus musculus
ttgggctgatgctgggatcctgcat

SEQ ID NO: 845692 - DNA, 25 bp, Mus musculus
ttgggctggcacctggtgtccacca

SEQ ID NO: 845693 - DNA, 25 bp, Mus musculus
ttgggctggcacgtggtgtccacca

SEQ ID NO: 845694 - DNA, 25 bp, Mus musculus
ttgggctgtgtgctattccagagaa

SEQ ID NO: 845695 - DNA, 25 bp, Mus musculus
ttgggctgtgtggtattccagagaa

SEQ ID NO: 845696 - DNA, 25 bp, Mus musculus
ttgggcttaagacgcactcccggta

SEQ ID NO: 845697 - DNA, 25 bp, Mus musculus
ttgggcttaagaggcactcccggta

SEQ ID NO: 845698 - DNA, 25 bp, Mus musculus
ttgggcttacttaccacaggatatg

SEQ ID NO: 845699 - DNA, 25 bp, Mus musculus
ttgggcttactttccacaggatatg

SEQ ID NO: 845700 - DNA, 25 bp, Mus musculus
ttgggctttgcaaggaaggagattc

SEQ ID NO: 845701 - DNA, 25 bp, Mus musculus
ttgggctttgcatggaaggagattc

SEQ ID NO: 845702 - DNA, 25 bp, Mus musculus
ttgggtaccatgcactgcatccacc

SEQ ID NO: 845703 - DNA, 25 bp, Mus musculus
ttgggtaccatggactgcatccacc

SEQ ID NO: 845704 - DNA, 25 bp, Mus musculus
ttgggtagcacaccttgtcctggac

SEQ ID NO: 845705 - DNA, 25 bp, Mus musculus
ttgggtagcacagcttgtcctggac

SEQ ID NO: 845706 - DNA, 25 bp, Mus musculus
ttgggtcaaggcaagcttcgcggac

SEQ ID NO: 845707 - DNA, 25 bp, Mus musculus
ttgggtcaaggctagcttcgcggac

SEQ ID NO: 845708 - DNA, 25 bp, Mus musculus
ttgggtcagccaaaggtccaggcta

SEQ ID NO: 845709 - DNA, 25 bp, Mus musculus
ttgggtcagccataggtccaggcta

SEQ ID NO: 845710 - DNA, 25 bp, Mus musculus
ttgggtcatgacctgcgcatacgct

SEQ ID NO: 845711 - DNA, 25 bp, Mus musculus
ttgggtcatgacgtgcgcatacgct

SEQ ID NO: 845712 - DNA, 25 bp, Mus musculus
ttgggtccatgtaccccacacgcat

SEQ ID NO: 845713 - DNA, 25 bp, Mus musculus
ttgggtccatgttccccacacgcat

SEQ ID NO: 845714 - DNA, 25 bp, Mus musculus
ttgggtccctaaaaatctcagaagc

SEQ ID NO: 845715 - DNA, 25 bp, Mus musculus
ttgggtccctaataatctcagaagc

SEQ ID NO: 845716 - DNA, 25 bp, Mus musculus
ttgggtcgagacaggaccacgccgt

SEQ ID NO: 845717 - DNA, 25 bp, Mus musculus
ttgggtcgagactggaccacgccgt

SEQ ID NO: 845718 - DNA, 25 bp, Mus musculus
ttgggtctagccaactggcaccggc

SEQ ID NO: 845719 - DNA, 25 bp, Mus musculus
ttgggtctagcctactggcaccggc

SEQ ID NO: 845720 - DNA, 25 bp, Mus musculus
ttgggtctctacactggtcagctgg

SEQ ID NO: 845721 - DNA, 25 bp, Mus musculus
ttgggtctctactctggtcagctgg

SEQ ID NO: 845722 - DNA, 25 bp, Mus musculus
ttgggtcttctcagcagctaagagg

SEQ ID NO: 845723 - DNA, 25 bp, Mus musculus
ttgggtcttctctgcagctaagagg

SEQ ID NO: 845724 - DNA, 25 bp, Mus musculus
ttgggtgagcacaggaccaaccgag

SEQ ID NO: 845725 - DNA, 25 bp, Mus musculus
ttgggtgagcactggaccaaccgag

SEQ ID NO: 845726 - DNA, 25 bp, Mus musculus
ttgggtgagcctcctggcttcctgc

SEQ ID NO: 845727 - DNA, 25 bp, Mus musculus
ttgggtgagcctgctggcttcctgc

SEQ ID NO: 845728 - DNA, 25 bp, Mus musculus
ttgggtgagggcaacagctccatca

SEQ ID NO: 845729 - DNA, 25 bp, Mus musculus
ttgggtgagggctacagctccatca

SEQ ID NO: 845730 - DNA, 25 bp, Mus musculus
ttgggtgccacgaggttaatatagg

SEQ ID NO: 845731 - DNA, 25 bp, Mus musculus
ttgggtgccacgtggttaatatagg

SEQ ID NO: 845732 - DNA, 25 bp, Mus musculus
ttgggtggcacaccgaaatccagtg

SEQ ID NO: 845733 - DNA, 25 bp, Mus musculus
ttgggtggcacagcgaaatccagtg

SEQ ID NO: 845734 - DNA, 25 bp, Mus musculus
ttgggtggctgtcccttgcctgtca

SEQ ID NO: 845735 - DNA, 25 bp, Mus musculus
ttgggtggctgtgccttgcctgtca

SEQ ID NO: 845736 - DNA, 25 bp, Mus musculus
ttgggtgggaacaaagaactgactg

SEQ ID NO: 845737 - DNA, 25 bp, Mus musculus
ttgggtgggaactaagaactgactg

SEQ ID NO: 845738 - DNA, 25 bp, Mus musculus
ttgggtgggcgcacctggcaaatac

SEQ ID NO: 845739 - DNA, 25 bp, Mus musculus
ttgggtgggcgctcctggcaaatac

SEQ ID NO: 845740 - DNA, 25 bp, Mus musculus
ttgggttcagcacctcgtcagaaaa

SEQ ID NO: 845741 - DNA, 25 bp, Mus musculus
ttgggttcagcagctcgtcagaaaa

SEQ ID NO: 845742 - DNA, 25 bp, Mus musculus
ttgggttggcagctcacacaggtcc

SEQ ID NO: 845743 - DNA, 25 bp, Mus musculus
ttgggttggcaggtcacacaggtcc

SEQ ID NO: 845744 - DNA, 25 bp, Mus musculus
ttgggttgggctacctgtcccattg

SEQ ID NO: 845745 - DNA, 25 bp, Mus musculus
ttgggttgggcttcctgtcccattg

SEQ ID NO: 845746 - DNA, 25 bp, Mus musculus
ttgggtttcataccccagagctgtc

SEQ ID NO: 845747 - DNA, 25 bp, Mus musculus
ttgggtttcatagcccagagctgtc

SEQ ID NO: 845748 - DNA, 25 bp, Mus musculus
ttgggtttctttccctgtctgtgga

SEQ ID NO: 845749 - DNA, 25 bp, Mus musculus
ttgggtttctttgcctgtctgtgga

SEQ ID NO: 845750 - DNA, 25 bp, Mus musculus
ttggtaaccactaggagcagggctg

SEQ ID NO: 845751 - DNA, 25 bp, Mus musculus
ttggtaaccacttggagcagggctg

SEQ ID NO: 845752 - DNA, 25 bp, Mus musculus
ttggtacagagaccggtctgatgct

SEQ ID NO: 845753 - DNA, 25 bp, Mus musculus
ttggtacagagagcggtctgatgct

SEQ ID NO: 845754 - DNA, 25 bp, Mus musculus
ttggtaccgtggctcgcctcagcat

SEQ ID NO: 845755 - DNA, 25 bp, Mus musculus
ttggtaccgtgggtcgcctcagcat

SEQ ID NO: 845756 - DNA, 25 bp, Mus musculus
ttggtaccttccatgtggcccacag

SEQ ID NO: 845757 - DNA, 25 bp, Mus musculus
ttggtaccttccttgtggcccacag

SEQ ID NO: 845758 - DNA, 25 bp, Mus musculus
ttggtactattgaccatgagaagag

SEQ ID NO: 845759 - DNA, 25 bp, Mus musculus
ttggtactattgtccatgagaagag

SEQ ID NO: 845760 - DNA, 25 bp, Mus musculus
ttggtagaagagagcaacgtgcaga

SEQ ID NO: 845761 - DNA, 25 bp, Mus musculus
ttggtagaagagtgcaacgtgcaga

SEQ ID NO: 845762 - DNA, 25 bp, Mus musculus
ttggtagcgcgcacagacagaatac

SEQ ID NO: 845763 - DNA, 25 bp, Mus musculus
ttggtagcgcgctcagacagaatac

SEQ ID NO: 845764 - DNA, 25 bp, Mus musculus
ttggtatcagtcaatcaggaaaaaa

SEQ ID NO: 845765 - DNA, 25 bp, Mus musculus
ttggtatcagtctatcaggaaaaaa

SEQ ID NO: 845766 - DNA, 25 bp, Mus musculus
ttggtatccccaattgcaacccaga

SEQ ID NO: 845767 - DNA, 25 bp, Mus musculus
ttggtatccccatttgcaacccaga

SEQ ID NO: 845768 - DNA, 25 bp, Mus musculus
ttggtatgcagaccactatggtcac

SEQ ID NO: 845769 - DNA, 25 bp, Mus musculus
ttggtatgcagagcactatggtcac

SEQ ID NO: 845770 - DNA, 25 bp, Mus musculus
ttggtattccatctgcccttgagca

SEQ ID NO: 845771 - DNA, 25 bp, Mus musculus
ttggtattccatgtgcccttgagca

SEQ ID NO: 845772 - DNA, 25 bp, Mus musculus
ttggtattgaacagacagactcgcc

SEQ ID NO: 845773 - DNA, 25 bp, Mus musculus
ttggtattgaactgacagactcgcc

SEQ ID NO: 845774 - DNA, 25 bp, Mus musculus
ttggtcacacagaccctagagccgg

SEQ ID NO: 845775 - DNA, 25 bp, Mus musculus
ttggtcacacagtccctagagccgg

SEQ ID NO: 845776 - DNA, 25 bp, Mus musculus
ttggtcaccaagcagtgccagcgac

SEQ ID NO: 845777 - DNA, 25 bp, Mus musculus
ttggtcaccaaggagtgccagcgac

SEQ ID NO: 845778 - DNA, 25 bp, Mus musculus
ttggtcatgaagatcaacttaatgg

SEQ ID NO: 845779 - DNA, 25 bp, Mus musculus
ttggtcatgaagttcaacttaatgg

SEQ ID NO: 845780 - DNA, 25 bp, Mus musculus
ttggtccagttgatcgatgcctcct

SEQ ID NO: 845781 - DNA, 25 bp, Mus musculus
ttggtccagttgttcgatgcctcct

SEQ ID NO: 845782 - DNA, 25 bp, Mus musculus
ttggtccagtttcccttgtgggaat

SEQ ID NO: 845783 - DNA, 25 bp, Mus musculus
ttggtccagtttgccttgtgggaat

SEQ ID NO: 845784 - DNA, 25 bp, Mus musculus
ttggtccatgggaaaccacgagaca

SEQ ID NO: 845785 - DNA, 25 bp, Mus musculus
ttggtccatgggtaaccacgagaca

SEQ ID NO: 845786 - DNA, 25 bp, Mus musculus
ttggtccatgtcacctctaggtcag

SEQ ID NO: 845787 - DNA, 25 bp, Mus musculus
ttggtccatgtctcctctaggtcag

SEQ ID NO: 845788 - DNA, 25 bp, Mus musculus
ttggtccctgggagctgaacacagc

SEQ ID NO: 845789 - DNA, 25 bp, Mus musculus
ttggtccctgggtgctgaacacagc

SEQ ID NO: 845790 - DNA, 25 bp, Mus musculus
ttggtccgcagactccacggcagct

SEQ ID NO: 845791 - DNA, 25 bp, Mus musculus
ttggtccgcagagtccacggcagct

SEQ ID NO: 845792 - DNA, 25 bp, Mus musculus
ttggtcctaagaatcgttcaattgg

SEQ ID NO: 845793 - DNA, 25 bp, Mus musculus
ttggtcctaagattcgttcaattgg

SEQ ID NO: 845794 - DNA, 25 bp, Mus musculus
ttggtcctacaacaagcccttagtt

SEQ ID NO: 845795 - DNA, 25 bp, Mus musculus
ttggtcctacaagaagcccttagtt

SEQ ID NO: 845796 - DNA, 25 bp, Mus musculus
ttggtcgcgccccaagtgtaacact

SEQ ID NO: 845797 - DNA, 25 bp, Mus musculus
ttggtcgcgcccgaagtgtaacact

SEQ ID NO: 845798 - DNA, 25 bp, Mus musculus
ttggtcgggatgagtctgctcagtc

SEQ ID NO: 845799 - DNA, 25 bp, Mus musculus
ttggtcgggatgtgtctgctcagtc

SEQ ID NO: 845800 - DNA, 25 bp, Mus musculus
ttggtcgggctgagtctctgcatca

SEQ ID NO: 845801 - DNA, 25 bp, Mus musculus
ttggtcgggctgtgtctctgcatca

SEQ ID NO: 845802 - DNA, 25 bp, Mus musculus
ttggtctcttcacccctgggttgtc

SEQ ID NO: 845803 - DNA, 25 bp, Mus musculus
ttggtctcttcagccctgggttgtc

SEQ ID NO: 845804 - DNA, 25 bp, Mus musculus
ttggtctgctgcatcaggtccaccc

SEQ ID NO: 845805 - DNA, 25 bp, Mus musculus
ttggtctgctgcttcaggtccaccc

SEQ ID NO: 845806 - DNA, 25 bp, Mus musculus
ttggtctggaaacattaaaaatcac

SEQ ID NO: 845807 - DNA, 25 bp, Mus musculus
ttggtctggaaagattaaaaatcac

SEQ ID NO: 845808 - DNA, 25 bp, Mus musculus
ttggtctggatacacttggctctgg

SEQ ID NO: 845809 - DNA, 25 bp, Mus musculus
ttggtctggatagacttggctctgg

SEQ ID NO: 845810 - DNA, 25 bp, Mus musculus
ttggtctgtaaacattccattggct

SEQ ID NO: 845811 - DNA, 25 bp, Mus musculus
ttggtctgtaaagattccattggct

SEQ ID NO: 845812 - DNA, 25 bp, Mus musculus
ttggtctgtgctccctaagagaaga

SEQ ID NO: 845813 - DNA, 25 bp, Mus musculus
ttggtctgtgctgcctaagagaaga

SEQ ID NO: 845814 - DNA, 25 bp, Mus musculus
ttggtcttcatcatccagtttggaa

SEQ ID NO: 845815 - DNA, 25 bp, Mus musculus
ttggtcttcatcttccagtttggaa

SEQ ID NO: 845816 - DNA, 25 bp, Mus musculus
ttggtgaaacagacccgaaagctgg

SEQ ID NO: 845817 - DNA, 25 bp, Mus musculus
ttggtgaaacagtcccgaaagctgg

SEQ ID NO: 845818 - DNA, 25 bp, Mus musculus
ttggtgaaggaactcagtcagtttc

SEQ ID NO: 845819 - DNA, 25 bp, Mus musculus
ttggtgaaggaagtcagtcagtttc

SEQ ID NO: 845820 - DNA, 25 bp, Mus musculus
ttggtgacaaagatcctgctgatat

SEQ ID NO: 845821 - DNA, 25 bp, Mus musculus
ttggtgacaaagttcctgctgatat

SEQ ID NO: 845822 - DNA, 25 bp, Mus musculus
ttggtgaccctgaaacagatccact

SEQ ID NO: 845823 - DNA, 25 bp, Mus musculus
ttggtgaccctgtaacagatccact

SEQ ID NO: 845824 - DNA, 25 bp, Mus musculus
ttggtgagaacaactgcctagcatc

SEQ ID NO: 845825 - DNA, 25 bp, Mus musculus
ttggtgagaacatctgcctagcatc

SEQ ID NO: 845826 - DNA, 25 bp, Mus musculus
ttggtgagagtgactttgctggctc

SEQ ID NO: 845827 - DNA, 25 bp, Mus musculus
ttggtgagagtgtctttgctggctc

SEQ ID NO: 845828 - DNA, 25 bp, Mus musculus
ttggtgagccacctactgaggagca

SEQ ID NO: 845829 - DNA, 25 bp, Mus musculus
ttggtgagccacgtactgaggagca

SEQ ID NO: 845830 - DNA, 25 bp, Mus musculus
ttggtgagcggcctccacccaaacg

SEQ ID NO: 845831 - DNA, 25 bp, Mus musculus
ttggtgagcggcgtccacccaaacg

SEQ ID NO: 845832 - DNA, 25 bp, Mus musculus
ttggtgaggcctaccctgccatctg

SEQ ID NO: 845833 - DNA, 25 bp, Mus musculus
ttggtgaggccttccctgccatctg

SEQ ID NO: 845834 - DNA, 25 bp, Mus musculus
ttggtgagtatgacttaggctgagc

SEQ ID NO: 845835 - DNA, 25 bp, Mus musculus
ttggtgagtatgtcttaggctgagc

SEQ ID NO: 845836 - DNA, 25 bp, Mus musculus
ttggtgatgctgaacctggactcgg

SEQ ID NO: 845837 - DNA, 25 bp, Mus musculus
ttggtgatgctgtacctggactcgg

SEQ ID NO: 845838 - DNA, 25 bp, Mus musculus
ttggtgcaatggactcgacatatgg

SEQ ID NO: 845839 - DNA, 25 bp, Mus musculus
ttggtgcaatggtctcgacatatgg

SEQ ID NO: 845840 - DNA, 25 bp, Mus musculus
ttggtgcaccgaacggaggagttct

SEQ ID NO: 845841 - DNA, 25 bp, Mus musculus
ttggtgcaccgatcggaggagttct

SEQ ID NO: 845842 - DNA, 25 bp, Mus musculus
ttggtgcatgtaatgaaggagtcgt

SEQ ID NO: 845843 - DNA, 25 bp, Mus musculus
ttggtgcatgtattgaaggagtcgt

SEQ ID NO: 845844 - DNA, 25 bp, Mus musculus
ttggtgccagtgaacagggtgaccc

SEQ ID NO: 845845 - DNA, 25 bp, Mus musculus
ttggtgccagtgtacagggtgaccc

SEQ ID NO: 845846 - DNA, 25 bp, Mus musculus
ttggtgcgcaacctgctagtgctgc

SEQ ID NO: 845847 - DNA, 25 bp, Mus musculus
ttggtgcgcaacgtgctagtgctgc

SEQ ID NO: 845848 - DNA, 25 bp, Mus musculus
ttggtgcggctgacctaaaccctga

SEQ ID NO: 845849 - DNA, 25 bp, Mus musculus
ttggtgcggctgtcctaaaccctga

SEQ ID NO: 845850 - DNA, 25 bp, Mus musculus
ttggtgctctcaccagtggggctca

SEQ ID NO: 845851 - DNA, 25 bp, Mus musculus
ttggtgctctcagcagtggggctca

SEQ ID NO: 845852 - DNA, 25 bp, Mus musculus
ttggtgctgagcaggaacttcgtgc

SEQ ID NO: 845853 - DNA, 25 bp, Mus musculus
ttggtgctgagctggaacttcgtgc

SEQ ID NO: 845854 - DNA, 25 bp, Mus musculus
ttggtggaaaaccaaaagcctgttg

SEQ ID NO: 845855 - DNA, 25 bp, Mus musculus
ttggtggaaaacgaaaagcctgttg

SEQ ID NO: 845856 - DNA, 25 bp, Mus musculus
ttggtggacctcagcttgtcaccac

SEQ ID NO: 845857 - DNA, 25 bp, Mus musculus
ttggtggacctccacaggtgtgaag

SEQ ID NO: 845858 - DNA, 25 bp, Mus musculus
ttggtggacctcgacaggtgtgaag

SEQ ID NO: 845859 - DNA, 25 bp, Mus musculus
ttggtggacctctgcttgtcaccac

SEQ ID NO: 845860 - DNA, 25 bp, Mus musculus
ttggtggccccaaaggacatgacat

SEQ ID NO: 845861 - DNA, 25 bp, Mus musculus
ttggtggccccataggacatgacat

SEQ ID NO: 845862 - DNA, 25 bp, Mus musculus
ttggtggcccgtacccgtttggcat

SEQ ID NO: 845863 - DNA, 25 bp, Mus musculus
ttggtggcccgttcccgtttggcat

SEQ ID NO: 845864 - DNA, 25 bp, Mus musculus
ttggtggcctgtacacagctgcgaa

SEQ ID NO: 845865 - DNA, 25 bp, Mus musculus
ttggtggcctgttcacagctgcgaa

SEQ ID NO: 845866 - DNA, 25 bp, Mus musculus
ttggtggccttaaagactccaaagg

SEQ ID NO: 845867 - DNA, 25 bp, Mus musculus
ttggtggccttatagactccaaagg

SEQ ID NO: 845868 - DNA, 25 bp, Mus musculus
ttggtggctactacctggcaggacg

SEQ ID NO: 845869 - DNA, 25 bp, Mus musculus
ttggtggctacttcctggcaggacg

SEQ ID NO: 845870 - DNA, 25 bp, Mus musculus
ttggtggctcttataaaaaaatggc

SEQ ID NO: 845871 - DNA, 25 bp, Mus musculus
ttggtggctcttttaaaaaaatggc

SEQ ID NO: 845872 - DNA, 25 bp, Mus musculus
ttggtggctgggagccccttgtcat

SEQ ID NO: 845873 - DNA, 25 bp, Mus musculus
ttggtggctgggtgccccttgtcat

SEQ ID NO: 845874 - DNA, 25 bp, Mus musculus
ttggtgggttatccgctgtctccag

SEQ ID NO: 845875 - DNA, 25 bp, Mus musculus
ttggtgggttatgcgctgtctccag

SEQ ID NO: 845876 - DNA, 25 bp, Mus musculus
ttggtggtaccacccttcctcggag

SEQ ID NO: 845877 - DNA, 25 bp, Mus musculus
ttggtggtaccagccttcctcggag

SEQ ID NO: 845878 - DNA, 25 bp, Mus musculus
ttggtggtgcagatagataatgcca

SEQ ID NO: 845879 - DNA, 25 bp, Mus musculus
ttggtggtgcagttagataatgcca

SEQ ID NO: 845880 - DNA, 25 bp, Mus musculus
ttggtggtgtgaccccatgactcac

SEQ ID NO: 845881 - DNA, 25 bp, Mus musculus
ttggtggtgtgagcccatgactcac

SEQ ID NO: 845882 - DNA, 25 bp, Mus musculus
ttggtgtactttacatcgtccagaa

SEQ ID NO: 845883 - DNA, 25 bp, Mus musculus
ttggtgtacttttcatcgtccagaa

SEQ ID NO: 845884 - DNA, 25 bp, Mus musculus
ttggtgtattcaccacatcgccctg

SEQ ID NO: 845885 - DNA, 25 bp, Mus musculus
ttggtgtattcagcacatcgccctg

SEQ ID NO: 845886 - DNA, 25 bp, Mus musculus
ttggtgtcacccagacacaacagag

SEQ ID NO: 845887 - DNA, 25 bp, Mus musculus
ttggtgtcaccctgacacaacagag

SEQ ID NO: 845888 - DNA, 25 bp, Mus musculus
ttggtgtccagtccgttgtttgccc

SEQ ID NO: 845889 - DNA, 25 bp, Mus musculus
ttggtgtccagtgcgttgtttgccc

SEQ ID NO: 845890 - DNA, 25 bp, Mus musculus
ttggtgtccttgaggccagtccctc

SEQ ID NO: 845891 - DNA, 25 bp, Mus musculus
ttggtgtccttgtggccagtccctc

SEQ ID NO: 845892 - DNA, 25 bp, Mus musculus
ttggtgtgaacaactttcagacttc

SEQ ID NO: 845893 - DNA, 25 bp, Mus musculus
ttggtgtgaacatctttcagacttc

SEQ ID NO: 845894 - DNA, 25 bp, Mus musculus
ttggtgtgcaacattctgtaccttc

SEQ ID NO: 845895 - DNA, 25 bp, Mus musculus
ttggtgtgcaactttctgtaccttc

SEQ ID NO: 845896 - DNA, 25 bp, Mus musculus
ttggtgtgcagcaactacaccccac

SEQ ID NO: 845897 - DNA, 25 bp, Mus musculus
ttggtgtgcagctactacaccccac

SEQ ID NO: 845898 - DNA, 25 bp, Mus musculus
ttggtgtggccaatgcagcacctcc

SEQ ID NO: 845899 - DNA, 25 bp, Mus musculus
ttggtgtggccattgcagcacctcc

SEQ ID NO: 845900 - DNA, 25 bp, Mus musculus
ttggtgtgggcaagaacccagcccc

SEQ ID NO: 845901 - DNA, 25 bp, Mus musculus
ttggtgtgggcatgaacccagcccc

SEQ ID NO: 845902 - DNA, 25 bp, Mus musculus
ttggtgtttgcaactggactatatc

SEQ ID NO: 845903 - DNA, 25 bp, Mus musculus
ttggtgtttgcatctggactatatc

SEQ ID NO: 845904 - DNA, 25 bp, Mus musculus
ttggttacgagaaagaccatcaaac

SEQ ID NO: 845905 - DNA, 25 bp, Mus musculus
ttggttacgagatagaccatcaaac

SEQ ID NO: 845906 - DNA, 25 bp, Mus musculus
ttggttaggaaaattgcagccctgt

SEQ ID NO: 845907 - DNA, 25 bp, Mus musculus
ttggttaggaaatttgcagccctgt

SEQ ID NO: 845908 - DNA, 25 bp, Mus musculus
ttggttatggctagccaatttctcg

SEQ ID NO: 845909 - DNA, 25 bp, Mus musculus
ttggttatggcttgccaatttctcg

SEQ ID NO: 845910 - DNA, 25 bp, Mus musculus
ttggttccagagacacattctccac

SEQ ID NO: 845911 - DNA, 25 bp, Mus musculus
ttggttccagagtcacattctccac

SEQ ID NO: 845912 - DNA, 25 bp, Mus musculus
ttggttcccctgagatagaagagat

SEQ ID NO: 845913 - DNA, 25 bp, Mus musculus
ttggttcccctgtgatagaagagat

SEQ ID NO: 845914 - DNA, 25 bp, Mus musculus
ttggttcctacaatgattgcccgtg

SEQ ID NO: 845915 - DNA, 25 bp, Mus musculus
ttggttcctacattgattgcccgtg

SEQ ID NO: 845916 - DNA, 25 bp, Mus musculus
ttggttcctgctctgacatgcctgc

SEQ ID NO: 845917 - DNA, 25 bp, Mus musculus
ttggttcctgctgtgacatgcctgc

SEQ ID NO: 845918 - DNA, 25 bp, Mus musculus
ttggttctagacagaagttggtttc

SEQ ID NO: 845919 - DNA, 25 bp, Mus musculus
ttggttctagactgaagttggtttc

SEQ ID NO: 845920 - DNA, 25 bp, Mus musculus
ttggttctgtgtcgccgcgctcgcc

SEQ ID NO: 845921 - DNA, 25 bp, Mus musculus
ttggttctgtgtggccgcgctcgcc

SEQ ID NO: 845922 - DNA, 25 bp, Mus musculus
ttggttgctcagagccaaatggtct

SEQ ID NO: 845923 - DNA, 25 bp, Mus musculus
ttggttgctcagtgccaaatggtct

SEQ ID NO: 845924 - DNA, 25 bp, Mus musculus
ttggttgctccaccccagacaactg

SEQ ID NO: 845925 - DNA, 25 bp, Mus musculus
ttggttgctccagcccagacaactg

SEQ ID NO: 845926 - DNA, 25 bp, Mus musculus
ttggttgctccgaagtacggcggct

SEQ ID NO: 845927 - DNA, 25 bp, Mus musculus
ttggttgctccgtagtacggcggct

SEQ ID NO: 845928 - DNA, 25 bp, Mus musculus
ttggtttctatgatgccaatgagac

SEQ ID NO: 845929 - DNA, 25 bp, Mus musculus
ttggtttctatgttgccaatgagac

SEQ ID NO: 845930 - DNA, 25 bp, Mus musculus
ttggtttctgaaacctgttacttga

SEQ ID NO: 845931 - DNA, 25 bp, Mus musculus
ttggtttctgaatcctgttacttga

SEQ ID NO: 845932 - DNA, 25 bp, Mus musculus
ttggttttcaagacatggagtgtgt

SEQ ID NO: 845933 - DNA, 25 bp, Mus musculus
ttggttttcaagtcatggagtgtgt

SEQ ID NO: 845934 - DNA, 25 bp, Mus musculus
ttggttttcatccagtgtgtgatca

SEQ ID NO: 845935 - DNA, 25 bp, Mus musculus
ttggttttcatcgagtgtgtgatca

SEQ ID NO: 845936 - DNA, 25 bp, Mus musculus
ttgtaaaaaagcagccacggagggc

SEQ ID NO: 845937 - DNA, 25 bp, Mus musculus
ttgtaaaaaagctgccacggagggc

SEQ ID NO: 845938 - DNA, 25 bp, Mus musculus
ttgtaaacaaacaggtatgcacttg

SEQ ID NO: 845939 - DNA, 25 bp, Mus musculus
ttgtaaacaaactggtatgcacttg

SEQ ID NO: 845940 - DNA, 25 bp, Mus musculus
ttgtaaacacatccctagtgcatgg

SEQ ID NO: 845941 - DNA, 25 bp, Mus musculus
ttgtaaacacatgcctagtgcatgg

SEQ ID NO: 845942 - DNA, 25 bp, Mus musculus
ttgtaaacgatacccaggctttatg

SEQ ID NO: 845943 - DNA, 25 bp, Mus musculus
ttgtaaacgatagccaggctttatg

SEQ ID NO: 845944 - DNA, 25 bp, Mus musculus
ttgtaaactgttcgccacagattct

SEQ ID NO: 845945 - DNA, 25 bp, Mus musculus
ttgtaaactgttggccacagattct

SEQ ID NO: 845946 - DNA, 25 bp, Mus musculus
ttgtaaagacagagaggtgaacgct

SEQ ID NO: 845947 - DNA, 25 bp, Mus musculus
ttgtaaagacagtgaggtgaacgct

SEQ ID NO: 845948 - DNA, 25 bp, Mus musculus
ttgtaaatccaactggctccatggc

SEQ ID NO: 845949 - DNA, 25 bp, Mus musculus
ttgtaaatccaagtggctccatggc

SEQ ID NO: 845950 - DNA, 25 bp, Mus musculus
ttgtaagcaccgagccctccaagct

SEQ ID NO: 845951 - DNA, 25 bp, Mus musculus
ttgtaagcaccgtgccctccaagct

SEQ ID NO: 845952 - DNA, 25 bp, Mus musculus
ttgtaagcagccacagccgaaacta

SEQ ID NO: 845953 - DNA, 25 bp, Mus musculus
ttgtaagcagcctcagccgaaacta

SEQ ID NO: 845954 - DNA, 25 bp, Mus musculus
ttgtaattgctgacaccaccatcga

SEQ ID NO: 845955 - DNA, 25 bp, Mus musculus
ttgtaattgctgtcaccaccatcga

SEQ ID NO: 845956 - DNA, 25 bp, Mus musculus
ttgtacagctggatctagactttaa

SEQ ID NO: 845957 - DNA, 25 bp, Mus musculus
ttgtacagctggttctagactttaa

SEQ ID NO: 845958 - DNA, 25 bp, Mus musculus
ttgtacatagctcccgtgtgccacc

SEQ ID NO: 845959 - DNA, 25 bp, Mus musculus
ttgtacatagctgccgtgtgccacc

SEQ ID NO: 845960 - DNA, 25 bp, Mus musculus
ttgtacatagtccagcgagctcgtg

SEQ ID NO: 845961 - DNA, 25 bp, Mus musculus
ttgtacatagtcgagcgagctcgtg

SEQ ID NO: 845962 - DNA, 25 bp, Mus musculus
ttgtaccaaccaagagcttcgggcc

SEQ ID NO: 845963 - DNA, 25 bp, Mus musculus
ttgtaccaaccatgagcttcgggcc

SEQ ID NO: 845964 - DNA, 25 bp, Mus musculus
ttgtaccagaagatgcagacgagca

SEQ ID NO: 845965 - DNA, 25 bp, Mus musculus
ttgtaccagaagttgcagacgagca

SEQ ID NO: 845966 - DNA, 25 bp, Mus musculus
ttgtaccataataaaacgatgcccc

SEQ ID NO: 845967 - DNA, 25 bp, Mus musculus
ttgtaccataattaaacgatgcccc

SEQ ID NO: 845968 - DNA, 25 bp, Mus musculus
ttgtacccgacacggatgggtctga

SEQ ID NO: 845969 - DNA, 25 bp, Mus musculus
ttgtacccgacagggatgggtctga

SEQ ID NO: 845970 - DNA, 25 bp, Mus musculus
ttgtaccgctatcgttacacccggg

SEQ ID NO: 845971 - DNA, 25 bp, Mus musculus
ttgtaccgctatggttacacccggg

SEQ ID NO: 845972 - DNA, 25 bp, Mus musculus
ttgtacctttcacaagacttgggac

SEQ ID NO: 845973 - DNA, 25 bp, Mus musculus
ttgtacctttcagaagacttgggac

SEQ ID NO: 845974 - DNA, 25 bp, Mus musculus
ttgtacgaacgacggaactgcagtg

SEQ ID NO: 845975 - DNA, 25 bp, Mus musculus
ttgtacgaacgagggaactgcagtg

SEQ ID NO: 845976 - DNA, 25 bp, Mus musculus
ttgtacgagcacatcaggacaccca

SEQ ID NO: 845977 - DNA, 25 bp, Mus musculus
ttgtacgagcacttcaggacaccca

SEQ ID NO: 845978 - DNA, 25 bp, Mus musculus
ttgtactctgggacatagctgagtg

SEQ ID NO: 845979 - DNA, 25 bp, Mus musculus
ttgtactctgggtcatagctgagtg

SEQ ID NO: 845980 - DNA, 25 bp, Mus musculus
ttgtactggagaatgtatcagagga

SEQ ID NO: 845981 - DNA, 25 bp, Mus musculus
ttgtactggagattgtatcagagga

SEQ ID NO: 845982 - DNA, 25 bp, Mus musculus
ttgtactggtttccgcctccgtcct

SEQ ID NO: 845983 - DNA, 25 bp, Mus musculus
ttgtactggtttgcgcctccgtcct

SEQ ID NO: 845984 - DNA, 25 bp, Mus musculus
ttgtactttatgcagaatggctcct

SEQ ID NO: 845985 - DNA, 25 bp, Mus musculus
ttgtactttatggagaatggctcct

SEQ ID NO: 845986 - DNA, 25 bp, Mus musculus
ttgtagaaagggaccgagcgatcct

SEQ ID NO: 845987 - DNA, 25 bp, Mus musculus
ttgtagaaagggtccgagcgatcct

SEQ ID NO: 845988 - DNA, 25 bp, Mus musculus
ttgtagcaagacattggaagcattc

SEQ ID NO: 845989 - DNA, 25 bp, Mus musculus
ttgtagcaagactttggaagcattc

SEQ ID NO: 845990 - DNA, 25 bp, Mus musculus
ttgtagccctggaagccgctaccac

SEQ ID NO: 845991 - DNA, 25 bp, Mus musculus
ttgtagccctggtagccgctaccac

SEQ ID NO: 845992 - DNA, 25 bp, Mus musculus
ttgtaggcaccaaggccgggaccac

SEQ ID NO: 845993 - DNA, 25 bp, Mus musculus
ttgtaggcaccatggccgggaccac

SEQ ID NO: 845994 - DNA, 25 bp, Mus musculus
ttgtaggcataactggagaacaact

SEQ ID NO: 845995 - DNA, 25 bp, Mus musculus
ttgtaggcataagtggagaacaact

SEQ ID NO: 845996 - DNA, 25 bp, Mus musculus
ttgtaggccgtgcacagaaaaaggt

SEQ ID NO: 845997 - DNA, 25 bp, Mus musculus
ttgtaggccgtggacagaaaaaggt

SEQ ID NO: 845998 - DNA, 25 bp, Mus musculus
ttgtaggggcctagaaacatctgaa

SEQ ID NO: 845999 - DNA, 25 bp, Mus musculus
ttgtaggggccttgaaacatctgaa

SEQ ID NO: 846000 - DNA, 25 bp, Mus musculus
ttgtagggtcgcacagatcccgggt

SEQ ID NO: 846001 - DNA, 25 bp, Mus musculus
ttgtagggtcgctcagatcccgggt

SEQ ID NO: 846002 - DNA, 25 bp, Mus musculus
ttgtaggtgaagagctaaaacagtt

SEQ ID NO: 846003 - DNA, 25 bp, Mus musculus
ttgtaggtgaagtgctaaaacagtt

SEQ ID NO: 846004 - DNA, 25 bp, Mus musculus
ttgtaggtgggcacgaggctcggcc

SEQ ID NO: 846005 - DNA, 25 bp, Mus musculus
ttgtaggtgggctcgaggctcggcc

SEQ ID NO: 846006 - DNA, 25 bp, Mus musculus
ttgtagttgcaaccagtctataagc

SEQ ID NO: 846007 - DNA, 25 bp, Mus musculus
ttgtagttgcaagcagtctataagc

SEQ ID NO: 846008 - DNA, 25 bp, Mus musculus
ttgtataccaagatctcggcccggc

SEQ ID NO: 846009 - DNA, 25 bp, Mus musculus
ttgtataccaagttctcggcccggc

SEQ ID NO: 846010 - DNA, 25 bp, Mus musculus
ttgtatcaaacaccgaggctcctgg

SEQ ID NO: 846011 - DNA, 25 bp, Mus musculus
ttgtatcaaacagcgaggctcctgg

SEQ ID NO: 846012 - DNA, 25 bp, Mus musculus
ttgtatccagacagcaaaaatcagc

SEQ ID NO: 846013 - DNA, 25 bp, Mus musculus
ttgtatccagactgcaaaaatcagc

SEQ ID NO: 846014 - DNA, 25 bp, Mus musculus
ttgtatcctggccttagtgattggg

SEQ ID NO: 846015 - DNA, 25 bp, Mus musculus
ttgtatcctggcgttagtgattggg

SEQ ID NO: 846016 - DNA, 25 bp, Mus musculus
ttgtatcgcactcgaacccgggttg

SEQ ID NO: 846017 - DNA, 25 bp, Mus musculus
ttgtatcgcactggaacccgggttg

SEQ ID NO: 846018 - DNA, 25 bp, Mus musculus
ttgtatcggaaaacccggtccccag

SEQ ID NO: 846019 - DNA, 25 bp, Mus musculus
ttgtatcggaaatcccggtccccag

SEQ ID NO: 846020 - DNA, 25 bp, Mus musculus
ttgtatctaccgagaatcttggctg

SEQ ID NO: 846021 - DNA, 25 bp, Mus musculus
ttgtatctaccgtgaatcttggctg

SEQ ID NO: 846022 - DNA, 25 bp, Mus musculus
ttgtatctcagacgtcacttttgtc

SEQ ID NO: 846023 - DNA, 25 bp, Mus musculus
ttgtatctcagaggtcacttttgtc

SEQ ID NO: 846024 - DNA, 25 bp, Mus musculus
ttgtatctccaacaccgcgtcgtac

SEQ ID NO: 846025 - DNA, 25 bp, Mus musculus
ttgtatctccaagaccgcgtcgtac

SEQ ID NO: 846026 - DNA, 25 bp, Mus musculus
ttgtatctcgagagcaagaactgca

SEQ ID NO: 846027 - DNA, 25 bp, Mus musculus
ttgtatctcgagtgcaagaactgca

SEQ ID NO: 846028 - DNA, 25 bp, Mus musculus
ttgtatctctgcctaggacacccca

SEQ ID NO: 846029 - DNA, 25 bp, Mus musculus
ttgtatctctgcgtaggacacccca

SEQ ID NO: 846030 - DNA, 25 bp, Mus musculus
ttgtatcttgcgattggccctcagc

SEQ ID NO: 846031 - DNA, 25 bp, Mus musculus
ttgtatcttgcgtttggccctcagc

SEQ ID NO: 846032 - DNA, 25 bp, Mus musculus
ttgtatgacataaacaaagatggct

SEQ ID NO: 846033 - DNA, 25 bp, Mus musculus
ttgtatgacatatacaaagatggct

SEQ ID NO: 846034 - DNA, 25 bp, Mus musculus
ttgtatgccttgcaggtaactcacc

SEQ ID NO: 846035 - DNA, 25 bp, Mus musculus
ttgtatgccttggaggtaactcacc

SEQ ID NO: 846036 - DNA, 25 bp, Mus musculus
ttgtatggacaaagcacttcgtacc

SEQ ID NO: 846037 - DNA, 25 bp, Mus musculus
ttgtatggacaatgcacttcgtacc

SEQ ID NO: 846038 - DNA, 25 bp, Mus musculus
ttgtcaaaatataaccaagagacca

SEQ ID NO: 846039 - DNA, 25 bp, Mus musculus
ttgtcaaaatattaccaagagacca

SEQ ID NO: 846040 - DNA, 25 bp, Mus musculus
ttgtcaaccgcaagaagagcaacca

SEQ ID NO: 846041 - DNA, 25 bp, Mus musculus
ttgtcaaccgcatgaagagcaacca

SEQ ID NO: 846042 - DNA, 25 bp, Mus musculus
ttgtcaaccggacccctgagacggt

SEQ ID NO: 846043 - DNA, 25 bp, Mus musculus
ttgtcaaccggagccctgagacggt

SEQ ID NO: 846044 - DNA, 25 bp, Mus musculus
ttgtcaacgggccgccactgccgga

SEQ ID NO: 846045 - DNA, 25 bp, Mus musculus
ttgtcaacgggcggccactgccgga

SEQ ID NO: 846046 - DNA, 25 bp, Mus musculus
ttgtcaagaacacgtaagagactct

SEQ ID NO: 846047 - DNA, 25 bp, Mus musculus
ttgtcaagaacaggtaagagactct

SEQ ID NO: 846048 - DNA, 25 bp, Mus musculus
ttgtcaaggctgctgaagtttattg

SEQ ID NO: 846049 - DNA, 25 bp, Mus musculus
ttgtcaaggctggtgaagtttattg

SEQ ID NO: 846050 - DNA, 25 bp, Mus musculus
ttgtcaatgtctccacggcaacgga

SEQ ID NO: 846051 - DNA, 25 bp, Mus musculus
ttgtcaatgtctgcacggcaacgga

SEQ ID NO: 846052 - DNA, 25 bp, Mus musculus
ttgtcacactagctgccagctacag

SEQ ID NO: 846053 - DNA, 25 bp, Mus musculus
ttgtcacactaggtgccagctacag

SEQ ID NO: 846054 - DNA, 25 bp, Mus musculus
ttgtcacaggtgagcaacgtgtgcc

SEQ ID NO: 846055 - DNA, 25 bp, Mus musculus
ttgtcacaggtgtgcaacgtgtgcc

SEQ ID NO: 846056 - DNA, 25 bp, Mus musculus
ttgtcaccaaagaccaagccacatg

SEQ ID NO: 846057 - DNA, 25 bp, Mus musculus
ttgtcaccaaagtccaagccacatg

SEQ ID NO: 846058 - DNA, 25 bp, Mus musculus
ttgtcaccacccactggactggact

SEQ ID NO: 846059 - DNA, 25 bp, Mus musculus
ttgtcaccaccctctggactggact

SEQ ID NO: 846060 - DNA, 25 bp, Mus musculus
ttgtcaccgcctcttctgatggaac

SEQ ID NO: 846061 - DNA, 25 bp, Mus musculus
ttgtcaccgcctgttctgatggaac

SEQ ID NO: 846062 - DNA, 25 bp, Mus musculus
ttgtcaccgtcaagctctcagggat

SEQ ID NO: 846063 - DNA, 25 bp, Mus musculus
ttgtcaccgtcatgctctcagggat

SEQ ID NO: 846064 - DNA, 25 bp, Mus musculus
ttgtcacctggaccagaatcgggtt

SEQ ID NO: 846065 - DNA, 25 bp, Mus musculus
ttgtcacctggagcagaatcgggtt

SEQ ID NO: 846066 - DNA, 25 bp, Mus musculus
ttgtcaccttctccgttatccttag

SEQ ID NO: 846067 - DNA, 25 bp, Mus musculus
ttgtcaccttctgcgttatccttag

SEQ ID NO: 846068 - DNA, 25 bp, Mus musculus
ttgtcacgggccccggcgttctgct

SEQ ID NO: 846069 - DNA, 25 bp, Mus musculus
ttgtcacgggccgcggcgttctgct

SEQ ID NO: 846070 - DNA, 25 bp, Mus musculus
ttgtcactcagtccattaaaatgat

SEQ ID NO: 846071 - DNA, 25 bp, Mus musculus
ttgtcactcagtgcattaaaatgat

SEQ ID NO: 846072 - DNA, 25 bp, Mus musculus
ttgtcactgggacagcactgtggct

SEQ ID NO: 846073 - DNA, 25 bp, Mus musculus
ttgtcactgggagagcactgtggct

SEQ ID NO: 846074 - DNA, 25 bp, Mus musculus
ttgtcagacttcaagataagcattg

SEQ ID NO: 846075 - DNA, 25 bp, Mus musculus
ttgtcagacttctagataagcattg

SEQ ID NO: 846076 - DNA, 25 bp, Mus musculus
ttgtcagatgcacacctccgggctg

SEQ ID NO: 846077 - DNA, 25 bp, Mus musculus
ttgtcagatgcagacctccgggctg

SEQ ID NO: 846078 - DNA, 25 bp, Mus musculus
ttgtcagcacccatagaagacctag

SEQ ID NO: 846079 - DNA, 25 bp, Mus musculus
ttgtcagcacccttagaagacctag

SEQ ID NO: 846080 - DNA, 25 bp, Mus musculus
ttgtcaggccccaacctgacatctg

SEQ ID NO: 846081 - DNA, 25 bp, Mus musculus
ttgtcaggcccctacctgacatctg

SEQ ID NO: 846082 - DNA, 25 bp, Mus musculus
ttgtcaggtgtcatgtcagcccagg

SEQ ID NO: 846083 - DNA, 25 bp, Mus musculus
ttgtcaggtgtcttgtcagcccagg

SEQ ID NO: 846084 - DNA, 25 bp, Mus musculus
ttgtcagtcaccaaagaataccgcc

SEQ ID NO: 846085 - DNA, 25 bp, Mus musculus
ttgtcagtcacctaagaataccgcc

SEQ ID NO: 846086 - DNA, 25 bp, Mus musculus
ttgtcagtgagaacaggagcaacca

SEQ ID NO: 846087 - DNA, 25 bp, Mus musculus
ttgtcagtgagatcaggagcaacca

SEQ ID NO: 846088 - DNA, 25 bp, Mus musculus
ttgtcatcaaacacctggcgcctct

SEQ ID NO: 846089 - DNA, 25 bp, Mus musculus
ttgtcatcaaactcctggcgcctct

SEQ ID NO: 846090 - DNA, 25 bp, Mus musculus
ttgtcatcagaaaatcgatgagctc

SEQ ID NO: 846091 - DNA, 25 bp, Mus musculus
ttgtcatcagaatatcgatgagctc

SEQ ID NO: 846092 - DNA, 25 bp, Mus musculus
ttgtcatggtgaccctcctgccgct

SEQ ID NO: 846093 - DNA, 25 bp, Mus musculus
ttgtcatggtgagcctcctgccgct

SEQ ID NO: 846094 - DNA, 25 bp, Mus musculus
ttgtcatgttccctgctaatggcag

SEQ ID NO: 846095 - DNA, 25 bp, Mus musculus
ttgtcatgttccgtgctaatggcag

SEQ ID NO: 846096 - DNA, 25 bp, Mus musculus
ttgtcattctggaagccaagaacct

SEQ ID NO: 846097 - DNA, 25 bp, Mus musculus
ttgtcattctggtagccaagaacct

SEQ ID NO: 846098 - DNA, 25 bp, Mus musculus
ttgtcattgcaaccgctgttggcgg

SEQ ID NO: 846099 - DNA, 25 bp, Mus musculus
ttgtcattgcaagcgctgttggcgg

SEQ ID NO: 846100 - DNA, 25 bp, Mus musculus
ttgtccaacaagaggagcctgtccc

SEQ ID NO: 846101 - DNA, 25 bp, Mus musculus
ttgtccaacaagtggagcctgtccc

SEQ ID NO: 846102 - DNA, 25 bp, Mus musculus
ttgtccaacactcggaaaagctcaa

SEQ ID NO: 846103 - DNA, 25 bp, Mus musculus
ttgtccaacactgggaaaagctcaa

SEQ ID NO: 846104 - DNA, 25 bp, Mus musculus
ttgtccaaggcccaggtaactacag

SEQ ID NO: 846105 - DNA, 25 bp, Mus musculus
ttgtccaaggccgaggtaactacag

SEQ ID NO: 846106 - DNA, 25 bp, Mus musculus
ttgtccaagtcaaaggagcccacgc

SEQ ID NO: 846107 - DNA, 25 bp, Mus musculus
ttgtccaagtcataggagcccacgc

SEQ ID NO: 846108 - DNA, 25 bp, Mus musculus
ttgtccagcacaagattcagaagac

SEQ ID NO: 846109 - DNA, 25 bp, Mus musculus
ttgtccagcacatgattcagaagac

SEQ ID NO: 846110 - DNA, 25 bp, Mus musculus
ttgtccagcagacccaggacgtcag

SEQ ID NO: 846111 - DNA, 25 bp, Mus musculus
ttgtccagcagagccaggacgtcag

SEQ ID NO: 846112 - DNA, 25 bp, Mus musculus
ttgtccatccaacaaagagcctcta

SEQ ID NO: 846113 - DNA, 25 bp, Mus musculus
ttgtccatccaagaaagagcctcta

SEQ ID NO: 846114 - DNA, 25 bp, Mus musculus
ttgtccatggccagtctctctctct

SEQ ID NO: 846115 - DNA, 25 bp, Mus musculus
ttgtccatggcctgtctctctctct

SEQ ID NO: 846116 - DNA, 25 bp, Mus musculus
ttgtccatggtgcaggcgttctgtc

SEQ ID NO: 846117 - DNA, 25 bp, Mus musculus
ttgtccatggtggaggcgttctgtc

SEQ ID NO: 846118 - DNA, 25 bp, Mus musculus
ttgtcccaagccaccagctacaacg

SEQ ID NO: 846119 - DNA, 25 bp, Mus musculus
ttgtcccaagcctccagctacaacg

SEQ ID NO: 846120 - DNA, 25 bp, Mus musculus
ttgtcccagctgattaaaggcgccg

SEQ ID NO: 846121 - DNA, 25 bp, Mus musculus
ttgtcccagctgtttaaaggcgccg

SEQ ID NO: 846122 - DNA, 25 bp, Mus musculus
ttgtccccagccctgactggtttgt

SEQ ID NO: 846123 - DNA, 25 bp, Mus musculus
ttgtccccagccgtgactggtttgt

SEQ ID NO: 846124 - DNA, 25 bp, Mus musculus
ttgtccccggagcacattgtcctgt

SEQ ID NO: 846125 - DNA, 25 bp, Mus musculus
ttgtccccggaggacattgtcctgt

SEQ ID NO: 846126 - DNA, 25 bp, Mus musculus
ttgtcccgcgtgacagagcccgtgt

SEQ ID NO: 846127 - DNA, 25 bp, Mus musculus
ttgtcccgcgtgtcagagcccgtgt

SEQ ID NO: 846128 - DNA, 25 bp, Mus musculus
ttgtcccgggctattgctgagttgg

SEQ ID NO: 846129 - DNA, 25 bp, Mus musculus
ttgtcccgggcttttgctgagttgg

SEQ ID NO: 846130 - DNA, 25 bp, Mus musculus
ttgtccgagagtatcagccgcatcg

SEQ ID NO: 846131 - DNA, 25 bp, Mus musculus
ttgtccgagagtttcagccgcatcg

SEQ ID NO: 846132 - DNA, 25 bp, Mus musculus
ttgtccgcccttctgatggccgtca

SEQ ID NO: 846133 - DNA, 25 bp, Mus musculus
ttgtccgcccttgtgatggccgtca

SEQ ID NO: 846134 - DNA, 25 bp, Mus musculus
ttgtccgccggtaggcgcggtctcc

SEQ ID NO: 846135 - DNA, 25 bp, Mus musculus
ttgtccgccggttggcgcggtctcc

SEQ ID NO: 846136 - DNA, 25 bp, Mus musculus
ttgtccgggcaacgagcttccgcac

SEQ ID NO: 846137 - DNA, 25 bp, Mus musculus
ttgtccgggcaaggagcttccgcac

SEQ ID NO: 846138 - DNA, 25 bp, Mus musculus
ttgtccgtcaaaaagattcgacagg

SEQ ID NO: 846139 - DNA, 25 bp, Mus musculus
ttgtccgtcaaatagattcgacagg

SEQ ID NO: 846140 - DNA, 25 bp, Mus musculus
ttgtcctcgcttccgtcagtctcgg

SEQ ID NO: 846141 - DNA, 25 bp, Mus musculus
ttgtcctcgcttgcgtcagtctcgg

SEQ ID NO: 846142 - DNA, 25 bp, Mus musculus
ttgtcctctaccacctcagcgtttg

SEQ ID NO: 846143 - DNA, 25 bp, Mus musculus
ttgtcctctacctcctcagcgtttg

SEQ ID NO: 846144 - DNA, 25 bp, Mus musculus
ttgtcctctatgacggatacactgg

SEQ ID NO: 846145 - DNA, 25 bp, Mus musculus
ttgtcctctatgtcggatacactgg

SEQ ID NO: 846146 - DNA, 25 bp, Mus musculus
ttgtcctctgagacccaacaggacg

SEQ ID NO: 846147 - DNA, 25 bp, Mus musculus
ttgtcctctgagtcccaacaggacg

SEQ ID NO: 846148 - DNA, 25 bp, Mus musculus
ttgtcctgacctctgctattgagca

SEQ ID NO: 846149 - DNA, 25 bp, Mus musculus
ttgtcctgacctgtgctattgagca

SEQ ID NO: 846150 - DNA, 25 bp, Mus musculus
ttgtcctgcttactacagattgcct

SEQ ID NO: 846151 - DNA, 25 bp, Mus musculus
ttgtcctgcttagtacagattgcct

SEQ ID NO: 846152 - DNA, 25 bp, Mus musculus
ttgtcctggagtctcctttttggtg

SEQ ID NO: 846153 - DNA, 25 bp, Mus musculus
ttgtcctggagtgtcctttttggtg

SEQ ID NO: 846154 - DNA, 25 bp, Mus musculus
ttgtcctgtatgactatgcagcccc

SEQ ID NO: 846155 - DNA, 25 bp, Mus musculus
ttgtcctgtatgtctatgcagcccc

SEQ ID NO: 846156 - DNA, 25 bp, Mus musculus
ttgtccttcgcacacaaatactgcg

SEQ ID NO: 846157 - DNA, 25 bp, Mus musculus
ttgtccttcgcagacaaatactgcg

SEQ ID NO: 846158 - DNA, 25 bp, Mus musculus
ttgtccttctctaggctgagctggc

SEQ ID NO: 846159 - DNA, 25 bp, Mus musculus
ttgtccttctcttggctgagctggc

SEQ ID NO: 846160 - DNA, 25 bp, Mus musculus
ttgtcctttgtgactcaaccctcgt

SEQ ID NO: 846161 - DNA, 25 bp, Mus musculus
ttgtcctttgtgtctcaaccctcgt

SEQ ID NO: 846162 - DNA, 25 bp, Mus musculus
ttgtccttttctctgttacagtgcc

SEQ ID NO: 846163 - DNA, 25 bp, Mus musculus
ttgtccttttctgtgttacagtgcc

SEQ ID NO: 846164 - DNA, 25 bp, Mus musculus
ttgtcgccctgaatctgcccagcag

SEQ ID NO: 846165 - DNA, 25 bp, Mus musculus
ttgtcgccctgattctgcccagcag

SEQ ID NO: 846166 - DNA, 25 bp, Mus musculus
ttgtcgcctttgcagaggaagcaga

SEQ ID NO: 846167 - DNA, 25 bp, Mus musculus
ttgtcgcctttggagaggaagcaga

SEQ ID NO: 846168 - DNA, 25 bp, Mus musculus
ttgtcgctgtggatgtaattactac

SEQ ID NO: 846169 - DNA, 25 bp, Mus musculus
ttgtcgctgtggttgtaattactac

SEQ ID NO: 846170 - DNA, 25 bp, Mus musculus
ttgtcgcttataccgcagttttgag

SEQ ID NO: 846171 - DNA, 25 bp, Mus musculus
ttgtcgcttatagcgcagttttgag

SEQ ID NO: 846172 - DNA, 25 bp, Mus musculus
ttgtcggacacaacctgctgctggt

SEQ ID NO: 846173 - DNA, 25 bp, Mus musculus
ttgtcggacacatcctgctgctggt

SEQ ID NO: 846174 - DNA, 25 bp, Mus musculus
ttgtcggaggagctcttctgtttcc

SEQ ID NO: 846175 - DNA, 25 bp, Mus musculus
ttgtcggaggaggtcttctgtttcc

SEQ ID NO: 846176 - DNA, 25 bp, Mus musculus
ttgtcggcaggcacttccgaaggac

SEQ ID NO: 846177 - DNA, 25 bp, Mus musculus
ttgtcggcaggctcttccgaaggac

SEQ ID NO: 846178 - DNA, 25 bp, Mus musculus
ttgtcggcctccagcagggagccct

SEQ ID NO: 846179 - DNA, 25 bp, Mus musculus
ttgtcggcctcctgcagggagccct

SEQ ID NO: 846180 - DNA, 25 bp, Mus musculus
ttgtcggctggccagacacgtcctc

SEQ ID NO: 846181 - DNA, 25 bp, Mus musculus
ttgtcggctggcgagacacgtcctc

SEQ ID NO: 846182 - DNA, 25 bp, Mus musculus
ttgtcgggcatccaagagcaggtca

SEQ ID NO: 846183 - DNA, 25 bp, Mus musculus
ttgtcgggcatcgaagagcaggtca

SEQ ID NO: 846184 - DNA, 25 bp, Mus musculus
ttgtctacctctcgttcctgtgcag

SEQ ID NO: 846185 - DNA, 25 bp, Mus musculus
ttgtctacctctggttcctgtgcag

SEQ ID NO: 846186 - DNA, 25 bp, Mus musculus
ttgtctactacaaggactgcgaccc

SEQ ID NO: 846187 - DNA, 25 bp, Mus musculus
ttgtctactacatggactgcgaccc

SEQ ID NO: 846188 - DNA, 25 bp, Mus musculus
ttgtctactccgacaccgacaaggc

SEQ ID NO: 846189 - DNA, 25 bp, Mus musculus
ttgtctactccgtcaccgacaaggc

SEQ ID NO: 846190 - DNA, 25 bp, Mus musculus
ttgtctactgcacgactagagaagc

SEQ ID NO: 846191 - DNA, 25 bp, Mus musculus
ttgtctactgcaggactagagaagc

SEQ ID NO: 846192 - DNA, 25 bp, Mus musculus
ttgtctacttttcgaaatgcaggaa

SEQ ID NO: 846193 - DNA, 25 bp, Mus musculus
ttgtctacttttggaaatgcaggaa

SEQ ID NO: 846194 - DNA, 25 bp, Mus musculus
ttgtctaggccactccccaggaact

SEQ ID NO: 846195 - DNA, 25 bp, Mus musculus
ttgtctaggccagtccccaggaact

SEQ ID NO: 846196 - DNA, 25 bp, Mus musculus
ttgtctatggttcctacgtggtcag

SEQ ID NO: 846197 - DNA, 25 bp, Mus musculus
ttgtctatggttgctacgtggtcag

SEQ ID NO: 846198 - DNA, 25 bp, Mus musculus
ttgtctcaaccgagagaggccagcg

SEQ ID NO: 846199 - DNA, 25 bp, Mus musculus
ttgtctcaaccgaggttgtcgtgtt

SEQ ID NO: 846200 - DNA, 25 bp, Mus musculus
ttgtctcaaccgtgagaggccagcg

SEQ ID NO: 846201 - DNA, 25 bp, Mus musculus
ttgtctcaaccgtggttgtcgtgtt

SEQ ID NO: 846202 - DNA, 25 bp, Mus musculus
ttgtctcaacctccggaatctgccg

SEQ ID NO: 846203 - DNA, 25 bp, Mus musculus
ttgtctcaacctgcggaatctgccg

SEQ ID NO: 846204 - DNA, 25 bp, Mus musculus
ttgtctcaatttagcctgaatcgcc

SEQ ID NO: 846205 - DNA, 25 bp, Mus musculus
ttgtctcaattttgcctgaatcgcc

SEQ ID NO: 846206 - DNA, 25 bp, Mus musculus
ttgtctcagagaacagcgtggtggc

SEQ ID NO: 846207 - DNA, 25 bp, Mus musculus
ttgtctcagagatcagcgtggtggc

SEQ ID NO: 846208 - DNA, 25 bp, Mus musculus
ttgtctcagctgctggttgagcctc

SEQ ID NO: 846209 - DNA, 25 bp, Mus musculus
ttgtctcagctggtggttgagcctc

SEQ ID NO: 846210 - DNA, 25 bp, Mus musculus
ttgtctcatgtgaccctagctggtt

SEQ ID NO: 846211 - DNA, 25 bp, Mus musculus
ttgtctcatgtgtccctagctggtt

SEQ ID NO: 846212 - DNA, 25 bp, Mus musculus
ttgtctccatccaggcactgaacaa

SEQ ID NO: 846213 - DNA, 25 bp, Mus musculus
ttgtctccatcctggcactgaacaa

SEQ ID NO: 846214 - DNA, 25 bp, Mus musculus
ttgtctcctgcaacaatgagaatgc

SEQ ID NO: 846215 - DNA, 25 bp, Mus musculus
ttgtctcctgcatcaatgagaatgc

SEQ ID NO: 846216 - DNA, 25 bp, Mus musculus
ttgtctcgggcgagatggcttcaag

SEQ ID NO: 846217 - DNA, 25 bp, Mus musculus
ttgtctcgggcgtgatggcttcaag

SEQ ID NO: 846218 - DNA, 25 bp, Mus musculus
ttgtctctagtaagcaccattgtgc

SEQ ID NO: 846219 - DNA, 25 bp, Mus musculus
ttgtctctagtatgcaccattgtgc

SEQ ID NO: 846220 - DNA, 25 bp, Mus musculus
ttgtctctgactacacagaccagaa

SEQ ID NO: 846221 - DNA, 25 bp, Mus musculus
ttgtctctgacttcacagaccagaa

SEQ ID NO: 846222 - DNA, 25 bp, Mus musculus
ttgtctctggaactcgatacaaggg

SEQ ID NO: 846223 - DNA, 25 bp, Mus musculus
ttgtctctggaagtcgatacaaggg

SEQ ID NO: 846224 - DNA, 25 bp, Mus musculus
ttgtctctgtgtcgctcgcagaccc

SEQ ID NO: 846225 - DNA, 25 bp, Mus musculus
ttgtctctgtgtggctcgcagaccc

SEQ ID NO: 846226 - DNA, 25 bp, Mus musculus
ttgtctcttacactggttgtcccca

SEQ ID NO: 846227 - DNA, 25 bp, Mus musculus
ttgtctcttacagtggttgtcccca

SEQ ID NO: 846228 - DNA, 25 bp, Mus musculus
ttgtctgaagggaaaggagtccaac

SEQ ID NO: 846229 - DNA, 25 bp, Mus musculus
ttgtctgaagggtaaggagtccaac

SEQ ID NO: 846230 - DNA, 25 bp, Mus musculus
ttgtctgagcctccgcggaggaccc

SEQ ID NO: 846231 - DNA, 25 bp, Mus musculus
ttgtctgagcctgcgcggaggaccc

SEQ ID NO: 846232 - DNA, 25 bp, Mus musculus
ttgtctgccctacccttctgcatat

SEQ ID NO: 846233 - DNA, 25 bp, Mus musculus
ttgtctgccctagccttctgcatat

SEQ ID NO: 846234 - DNA, 25 bp, Mus musculus
ttgtctgctgccatccaagctgttc

SEQ ID NO: 846235 - DNA, 25 bp, Mus musculus
ttgtctgctgccttccaagctgttc

SEQ ID NO: 846236 - DNA, 25 bp, Mus musculus
ttgtctggccaacccttgaaggaca

SEQ ID NO: 846237 - DNA, 25 bp, Mus musculus
ttgtctggccaagccttgaaggaca

SEQ ID NO: 846238 - DNA, 25 bp, Mus musculus
ttgtctgggttgcaaaagactccca

SEQ ID NO: 846239 - DNA, 25 bp, Mus musculus
ttgtctgggttggaaaagactccca

SEQ ID NO: 846240 - DNA, 25 bp, Mus musculus
ttgtctgtacgcctggagcagtgcc

SEQ ID NO: 846241 - DNA, 25 bp, Mus musculus
ttgtctgtacgcgtggagcagtgcc

SEQ ID NO: 846242 - DNA, 25 bp, Mus musculus
ttgtctgtgcgcaagtccacacctg

SEQ ID NO: 846243 - DNA, 25 bp, Mus musculus
ttgtctgtgcgctagtccacacctg

SEQ ID NO: 846244 - DNA, 25 bp, Mus musculus
ttgtcttcctcccttatgccgatga

SEQ ID NO: 846245 - DNA, 25 bp, Mus musculus
ttgtcttcctccgttatgccgatga

SEQ ID NO: 846246 - DNA, 25 bp, Mus musculus
ttgtcttgacagagcatcctcggtg

SEQ ID NO: 846247 - DNA, 25 bp, Mus musculus
ttgtcttgacagtgcatcctcggtg

SEQ ID NO: 846248 - DNA, 25 bp, Mus musculus
ttgtcttgcaaacccaatagctggt

SEQ ID NO: 846249 - DNA, 25 bp, Mus musculus
ttgtcttgcaaagccaatagctggt

SEQ ID NO: 846250 - DNA, 25 bp, Mus musculus
ttgtctttgtacaaagcatcgggtc

SEQ ID NO: 846251 - DNA, 25 bp, Mus musculus
ttgtctttgtactaagcatcgggtc

SEQ ID NO: 846252 - DNA, 25 bp, Mus musculus
ttgtgaaaatggacatacagatgtt

SEQ ID NO: 846253 - DNA, 25 bp, Mus musculus
ttgtgaaaatggtcatacagatgtt

SEQ ID NO: 846254 - DNA, 25 bp, Mus musculus
ttgtgaaatactaaaatcttccggg

SEQ ID NO: 846255 - DNA, 25 bp, Mus musculus
ttgtgaaatacttaaatcttccggg

SEQ ID NO: 846256 - DNA, 25 bp, Mus musculus
ttgtgaaatcccctctggctggaga

SEQ ID NO: 846257 - DNA, 25 bp, Mus musculus
ttgtgaaatcccgtctggctggaga

SEQ ID NO: 846258 - DNA, 25 bp, Mus musculus
ttgtgaacaaaaataatcgggctaa

SEQ ID NO: 846259 - DNA, 25 bp, Mus musculus
ttgtgaacaaaattaatcgggctaa

SEQ ID NO: 846260 - DNA, 25 bp, Mus musculus
ttgtgaacaactcgccattgagctc

SEQ ID NO: 846261 - DNA, 25 bp, Mus musculus
ttgtgaacaactggccattgagctc

SEQ ID NO: 846262 - DNA, 25 bp, Mus musculus
ttgtgaacacttcaggcggccctga

SEQ ID NO: 846263 - DNA, 25 bp, Mus musculus
ttgtgaacacttgaggcggccctga

SEQ ID NO: 846264 - DNA, 25 bp, Mus musculus
ttgtgaacccgtcttagtgccccgt

SEQ ID NO: 846265 - DNA, 25 bp, Mus musculus
ttgtgaacccgtgttagtgccccgt

SEQ ID NO: 846266 - DNA, 25 bp, Mus musculus
ttgtgaacttgtaccacgagctgat

SEQ ID NO: 846267 - DNA, 25 bp, Mus musculus
ttgtgaacttgttccacgagctgat

SEQ ID NO: 846268 - DNA, 25 bp, Mus musculus
ttgtgaactttgctccaccctgtga

SEQ ID NO: 846269 - DNA, 25 bp, Mus musculus
ttgtgaactttggtccaccctgtga

SEQ ID NO: 846270 - DNA, 25 bp, Mus musculus
ttgtgaagaagactcagcacaaagt

SEQ ID NO: 846271 - DNA, 25 bp, Mus musculus
ttgtgaagaagagtcagcacaaagt

SEQ ID NO: 846272 - DNA, 25 bp, Mus musculus
ttgtgaagaccgcagagacctgcaa

SEQ ID NO: 846273 - DNA, 25 bp, Mus musculus
ttgtgaagaccggagagacctgcaa

SEQ ID NO: 846274 - DNA, 25 bp, Mus musculus
ttgtgaagatctcctccaccgtctc

SEQ ID NO: 846275 - DNA, 25 bp, Mus musculus
ttgtgaagatctgctccaccgtctc

SEQ ID NO: 846276 - DNA, 25 bp, Mus musculus
ttgtgaagatgacaaagagtgacga

SEQ ID NO: 846277 - DNA, 25 bp, Mus musculus
ttgtgaagatgagaaagagtgacga

SEQ ID NO: 846278 - DNA, 25 bp, Mus musculus
ttgtgaaggactaccaagccctgat

SEQ ID NO: 846279 - DNA, 25 bp, Mus musculus
ttgtgaaggacttccaagccctgat

SEQ ID NO: 846280 - DNA, 25 bp, Mus musculus
ttgtgaatagcaccatccctgtggg

SEQ ID NO: 846281 - DNA, 25 bp, Mus musculus
ttgtgaatagcagcatccctgtggg

SEQ ID NO: 846282 - DNA, 25 bp, Mus musculus
ttgtgacaatgtcatcctggtgtgg

SEQ ID NO: 846283 - DNA, 25 bp, Mus musculus
ttgtgacaatgtgatcctggtgtgg

SEQ ID NO: 846284 - DNA, 25 bp, Mus musculus
ttgtgacagcctcaagccctgggca

SEQ ID NO: 846285 - DNA, 25 bp, Mus musculus
ttgtgacagcctgaagccctgggca

SEQ ID NO: 846286 - DNA, 25 bp, Mus musculus
ttgtgaccaacgagccctcagtctg

SEQ ID NO: 846287 - DNA, 25 bp, Mus musculus
ttgtgaccaacgtgccctcagtctg

SEQ ID NO: 846288 - DNA, 25 bp, Mus musculus
ttgtgaccctttagttcccctaatg

SEQ ID NO: 846289 - DNA, 25 bp, Mus musculus
ttgtgacccttttgttcccctaatg

SEQ ID NO: 846290 - DNA, 25 bp, Mus musculus
ttgtgaccggcaatctctccttcga

SEQ ID NO: 846291 - DNA, 25 bp, Mus musculus
ttgtgaccggcattctctccttcga

SEQ ID NO: 846292 - DNA, 25 bp, Mus musculus
ttgtgacgatccacatgaatgacta

SEQ ID NO: 846293 - DNA, 25 bp, Mus musculus
ttgtgacgatcctcatgaatgacta

SEQ ID NO: 846294 - DNA, 25 bp, Mus musculus
ttgtgactccacagaaaagagaccg

SEQ ID NO: 846295 - DNA, 25 bp, Mus musculus
ttgtgactccactgaaaagagaccg

SEQ ID NO: 846296 - DNA, 25 bp, Mus musculus
ttgtgactctctaaccagctggtca

SEQ ID NO: 846297 - DNA, 25 bp, Mus musculus
ttgtgactctcttaccagctggtca

SEQ ID NO: 846298 - DNA, 25 bp, Mus musculus
ttgtgacttttcacttgccctcagc

SEQ ID NO: 846299 - DNA, 25 bp, Mus musculus
ttgtgacttttctcttgccctcagc

SEQ ID NO: 846300 - DNA, 25 bp, Mus musculus
ttgtgagactttccaccttgtgcca

SEQ ID NO: 846301 - DNA, 25 bp, Mus musculus
ttgtgagactttgcaccttgtgcca

SEQ ID NO: 846302 - DNA, 25 bp, Mus musculus
ttgtgagatcaaaggtcgagaggcc

SEQ ID NO: 846303 - DNA, 25 bp, Mus musculus
ttgtgagatcaatggtcgagaggcc

SEQ ID NO: 846304 - DNA, 25 bp, Mus musculus
ttgtgagatgatccagaagtctgtg

SEQ ID NO: 846305 - DNA, 25 bp, Mus musculus
ttgtgagatgatgcagaagtctgtg

SEQ ID NO: 846306 - DNA, 25 bp, Mus musculus
ttgtgagcaccgaacaccagtgcca

SEQ ID NO: 846307 - DNA, 25 bp, Mus musculus
ttgtgagcaccgtacaccagtgcca

SEQ ID NO: 846308 - DNA, 25 bp, Mus musculus
ttgtgagcacgcaggcaaatgcctc

SEQ ID NO: 846309 - DNA, 25 bp, Mus musculus
ttgtgagcacgctggcaaatgcctc

SEQ ID NO: 846310 - DNA, 25 bp, Mus musculus
ttgtgagcagcaagccactcggacg

SEQ ID NO: 846311 - DNA, 25 bp, Mus musculus
ttgtgagcagcatgccactcggacg

SEQ ID NO: 846312 - DNA, 25 bp, Mus musculus
ttgtgagccaatcacctccaagaca

SEQ ID NO: 846313 - DNA, 25 bp, Mus musculus
ttgtgagccaatgacctccaagaca

SEQ ID NO: 846314 - DNA, 25 bp, Mus musculus
ttgtgagcccctctcagaactgtgt

SEQ ID NO: 846315 - DNA, 25 bp, Mus musculus
ttgtgagcccctgtcagaactgtgt

SEQ ID NO: 846316 - DNA, 25 bp, Mus musculus
ttgtgagcggccattgagttctagg

SEQ ID NO: 846317 - DNA, 25 bp, Mus musculus
ttgtgagcggcctttgagttctagg

SEQ ID NO: 846318 - DNA, 25 bp, Mus musculus
ttgtgaggcttcaggacatcctcag

SEQ ID NO: 846319 - DNA, 25 bp, Mus musculus
ttgtgaggcttctggacatcctcag

SEQ ID NO: 846320 - DNA, 25 bp, Mus musculus
ttgtgatcaggaaccaggatggaac

SEQ ID NO: 846321 - DNA, 25 bp, Mus musculus
ttgtgatcaggatccaggatggaac

SEQ ID NO: 846322 - DNA, 25 bp, Mus musculus
ttgtgatcgctaccctcccagagct

SEQ ID NO: 846323 - DNA, 25 bp, Mus musculus
ttgtgatcgctagcctcccagagct

SEQ ID NO: 846324 - DNA, 25 bp, Mus musculus
ttgtgatgccaaccatatccgaggg

SEQ ID NO: 846325 - DNA, 25 bp, Mus musculus
ttgtgatgccaagcatatccgaggg

SEQ ID NO: 846326 - DNA, 25 bp, Mus musculus
ttgtgatggagaagccgaacatacg

SEQ ID NO: 846327 - DNA, 25 bp, Mus musculus
ttgtgatggagatgccgaacatacg

SEQ ID NO: 846328 - DNA, 25 bp, Mus musculus
ttgtgatttggacctctgcccctgg

SEQ ID NO: 846329 - DNA, 25 bp, Mus musculus
ttgtgatttggagctctgcccctgg

SEQ ID NO: 846330 - DNA, 25 bp, Mus musculus
ttgtgcaagaacactgagccccagg

SEQ ID NO: 846331 - DNA, 25 bp, Mus musculus
ttgtgcaagaactctgagccccagg

SEQ ID NO: 846332 - DNA, 25 bp, Mus musculus
ttgtgcaagtggaggactcaaacgg

SEQ ID NO: 846333 - DNA, 25 bp, Mus musculus
ttgtgcaagtggtggactcaaacgg

SEQ ID NO: 846334 - DNA, 25 bp, Mus musculus
ttgtgcaccacacgcattcagtgtc

SEQ ID NO: 846335 - DNA, 25 bp, Mus musculus
ttgtgcaccacaggcattcagtgtc

SEQ ID NO: 846336 - DNA, 25 bp, Mus musculus
ttgtgcacttggaagatctttgatg

SEQ ID NO: 846337 - DNA, 25 bp, Mus musculus
ttgtgcacttggtagatctttgatg

SEQ ID NO: 846338 - DNA, 25 bp, Mus musculus
ttgtgcagtaccaacaccgcgtacc

SEQ ID NO: 846339 - DNA, 25 bp, Mus musculus
ttgtgcagtacctacaccgcgtacc

SEQ ID NO: 846340 - DNA, 25 bp, Mus musculus
ttgtgcagtacgcacacaccgcggc

SEQ ID NO: 846341 - DNA, 25 bp, Mus musculus
ttgtgcagtacggacacaccgcggc

SEQ ID NO: 846342 - DNA, 25 bp, Mus musculus
ttgtgccaacccagcgccagggact

SEQ ID NO: 846343 - DNA, 25 bp, Mus musculus
ttgtgccaaccctgcgccagggact

SEQ ID NO: 846344 - DNA, 25 bp, Mus musculus
ttgtgccaagccagcctaactgcag

SEQ ID NO: 846345 - DNA, 25 bp, Mus musculus
ttgtgccaagcctgcctaactgcag

SEQ ID NO: 846346 - DNA, 25 bp, Mus musculus
ttgtgccaagtgcttcctgtctagg

SEQ ID NO: 846347 - DNA, 25 bp, Mus musculus
ttgtgccaagtggttcctgtctagg

SEQ ID NO: 846348 - DNA, 25 bp, Mus musculus
ttgtgccacgacatcgaccaccgtg

SEQ ID NO: 846349 - DNA, 25 bp, Mus musculus
ttgtgccacgacttcgaccaccgtg

SEQ ID NO: 846350 - DNA, 25 bp, Mus musculus
ttgtgccagagtctacatctacact

SEQ ID NO: 846351 - DNA, 25 bp, Mus musculus
ttgtgccagagtgtacatctacact

SEQ ID NO: 846352 - DNA, 25 bp, Mus musculus
ttgtgccatgaaccctgctcgagac

SEQ ID NO: 846353 - DNA, 25 bp, Mus musculus
ttgtgccatgaagcctgctcgagac

SEQ ID NO: 846354 - DNA, 25 bp, Mus musculus
ttgtgccatttaagggcccctctgg

SEQ ID NO: 846355 - DNA, 25 bp, Mus musculus
ttgtgccatttatgggcccctctgg

SEQ ID NO: 846356 - DNA, 25 bp, Mus musculus
ttgtgcctgcaacctgacggcctag

SEQ ID NO: 846357 - DNA, 25 bp, Mus musculus
ttgtgcctgcaagctgacggcctag

SEQ ID NO: 846358 - DNA, 25 bp, Mus musculus
ttgtgccttctgaagaccagggtgg

SEQ ID NO: 846359 - DNA, 25 bp, Mus musculus
ttgtgccttctgtagaccagggtgg

SEQ ID NO: 846360 - DNA, 25 bp, Mus musculus
ttgtgcgcaatcagctgctagccct

SEQ ID NO: 846361 - DNA, 25 bp, Mus musculus
ttgtgcgcaatctgctgctagccct

SEQ ID NO: 846362 - DNA, 25 bp, Mus musculus
ttgtgcggcgccatcttaagccctc

SEQ ID NO: 846363 - DNA, 25 bp, Mus musculus
ttgtgcggcgccttcttaagccctc

SEQ ID NO: 846364 - DNA, 25 bp, Mus musculus
ttgtgcgggccacgctttcagtgcc

SEQ ID NO: 846365 - DNA, 25 bp, Mus musculus
ttgtgcgggccaggctttcagtgcc

SEQ ID NO: 846366 - DNA, 25 bp, Mus musculus
ttgtgctaaggaacaaccacgccct

SEQ ID NO: 846367 - DNA, 25 bp, Mus musculus
ttgtgctaaggatcaaccacgccct

SEQ ID NO: 846368 - DNA, 25 bp, Mus musculus
ttgtgctaccagctccctgcctgtg

SEQ ID NO: 846369 - DNA, 25 bp, Mus musculus
ttgtgctaccaggtccctgcctgtg

SEQ ID NO: 846370 - DNA, 25 bp, Mus musculus
ttgtgctcatcaattgtaatcggga

SEQ ID NO: 846371 - DNA, 25 bp, Mus musculus
ttgtgctcatcatttgtaatcggga

SEQ ID NO: 846372 - DNA, 25 bp, Mus musculus
ttgtgctcattaacattgacccgtg

SEQ ID NO: 846373 - DNA, 25 bp, Mus musculus
ttgtgctcattatcattgacccgtg

SEQ ID NO: 846374 - DNA, 25 bp, Mus musculus
ttgtgctccagacgagcagttcatc

SEQ ID NO: 846375 - DNA, 25 bp, Mus musculus
ttgtgctccagaggagcagttcatc

SEQ ID NO: 846376 - DNA, 25 bp, Mus musculus
ttgtgctcctcacggcgagtgcctc

SEQ ID NO: 846377 - DNA, 25 bp, Mus musculus
ttgtgctcctcagggcgagtgcctc

SEQ ID NO: 846378 - DNA, 25 bp, Mus musculus
ttgtgctgccccacgagaaattcca

SEQ ID NO: 846379 - DNA, 25 bp, Mus musculus
ttgtgctgcccctcgagaaattcca

SEQ ID NO: 846380 - DNA, 25 bp, Mus musculus
ttgtgctgctgtcctgattccagca

SEQ ID NO: 846381 - DNA, 25 bp, Mus musculus
ttgtgctgctgtgctgattccagca

SEQ ID NO: 846382 - DNA, 25 bp, Mus musculus
ttgtgctgggccagcacccagtcct

SEQ ID NO: 846383 - DNA, 25 bp, Mus musculus
ttgtgctgggcctgcacccagtcct

SEQ ID NO: 846384 - DNA, 25 bp, Mus musculus
ttgtgctggtagagaccatagctgt

SEQ ID NO: 846385 - DNA, 25 bp, Mus musculus
ttgtgctggtagtgaccatagctgt

SEQ ID NO: 846386 - DNA, 25 bp, Mus musculus
ttgtgctgtatacctgcctgggcct

SEQ ID NO: 846387 - DNA, 25 bp, Mus musculus
ttgtgctgtatagctgcctgggcct

SEQ ID NO: 846388 - DNA, 25 bp, Mus musculus
ttgtgctgtgaacaggcccgcagct

SEQ ID NO: 846389 - DNA, 25 bp, Mus musculus
ttgtgctgtgaagaggcccgcagct

SEQ ID NO: 846390 - DNA, 25 bp, Mus musculus
ttgtgcttctatcggcggtgctcgc

SEQ ID NO: 846391 - DNA, 25 bp, Mus musculus
ttgtgcttctatgggcggtgctcgc

SEQ ID NO: 846392 - DNA, 25 bp, Mus musculus
ttgtgcttgcacactttgtgccccg

SEQ ID NO: 846393 - DNA, 25 bp, Mus musculus
ttgtgcttgcactctttgtgccccg

SEQ ID NO: 846394 - DNA, 25 bp, Mus musculus
ttgtgctttaaaccaagagcccttc

SEQ ID NO: 846395 - DNA, 25 bp, Mus musculus
ttgtgctttaaagcaagagcccttc

SEQ ID NO: 846396 - DNA, 25 bp, Mus musculus
ttgtgctttcaacccatccttatgg

SEQ ID NO: 846397 - DNA, 25 bp, Mus musculus
ttgtgctttcaagccatccttatgg

SEQ ID NO: 846398 - DNA, 25 bp, Mus musculus
ttgtgcttttgtcccgtacagtggc

SEQ ID NO: 846399 - DNA, 25 bp, Mus musculus
ttgtgcttttgtgccgtacagtggc

SEQ ID NO: 846400 - DNA, 25 bp, Mus musculus
ttgtggaaggccaccggcataactc

SEQ ID NO: 846401 - DNA, 25 bp, Mus musculus
ttgtggaaggcctccggcataactc

SEQ ID NO: 846402 - DNA, 25 bp, Mus musculus
ttgtggacacaaactttgctttgga

SEQ ID NO: 846403 - DNA, 25 bp, Mus musculus
ttgtggacacaatctttgctttgga

SEQ ID NO: 846404 - DNA, 25 bp, Mus musculus
ttgtggacacacctccagggacctc

SEQ ID NO: 846405 - DNA, 25 bp, Mus musculus
ttgtggacacacgtccagggacctc

SEQ ID NO: 846406 - DNA, 25 bp, Mus musculus
ttgtggacagaaacagtggaatgct

SEQ ID NO: 846407 - DNA, 25 bp, Mus musculus
ttgtggacagaatcagtggaatgct

SEQ ID NO: 846408 - DNA, 25 bp, Mus musculus
ttgtggacgggaccacctgagcttt

SEQ ID NO: 846409 - DNA, 25 bp, Mus musculus
ttgtggacgggagcacctgagcttt

SEQ ID NO: 846410 - DNA, 25 bp, Mus musculus
ttgtggagaagcaaaaaggagaact

SEQ ID NO: 846411 - DNA, 25 bp, Mus musculus
ttgtggagaagctaaaaggagaact

SEQ ID NO: 846412 - DNA, 25 bp, Mus musculus
ttgtggagaatcaccgcacctacaa

SEQ ID NO: 846413 - DNA, 25 bp, Mus musculus
ttgtggagaatctccgcacctacaa

SEQ ID NO: 846414 - DNA, 25 bp, Mus musculus
ttgtggagatccctggccagaagta

SEQ ID NO: 846415 - DNA, 25 bp, Mus musculus
ttgtggagatccgtggccagaagta

SEQ ID NO: 846416 - DNA, 25 bp, Mus musculus
ttgtggatagcaagcgagttgcaat

SEQ ID NO: 846417 - DNA, 25 bp, Mus musculus
ttgtggatagcatgcgagttgcaat

SEQ ID NO: 846418 - DNA, 25 bp, Mus musculus
ttgtggatcagaccggcagcgcaca

SEQ ID NO: 846419 - DNA, 25 bp, Mus musculus
ttgtggatcagagcggcagcgcaca

SEQ ID NO: 846420 - DNA, 25 bp, Mus musculus
ttgtggatgagtctaagaactatga

SEQ ID NO: 846421 - DNA, 25 bp, Mus musculus
ttgtggatgagtgtaagaactatga

SEQ ID NO: 846422 - DNA, 25 bp, Mus musculus
ttgtggatgccacaccccaggagac

SEQ ID NO: 846423 - DNA, 25 bp, Mus musculus
ttgtggatgccagaccccaggagac

SEQ ID NO: 846424 - DNA, 25 bp, Mus musculus
ttgtggatgggcagaccttcaaggt

SEQ ID NO: 846425 - DNA, 25 bp, Mus musculus
ttgtggatgggctgaccttcaaggt

SEQ ID NO: 846426 - DNA, 25 bp, Mus musculus
ttgtggatgttgaacctaaggtgaa

SEQ ID NO: 846427 - DNA, 25 bp, Mus musculus
ttgtggatgttgtacctaaggtgaa

SEQ ID NO: 846428 - DNA, 25 bp, Mus musculus
ttgtggcaccgtataagatagagcg

SEQ ID NO: 846429 - DNA, 25 bp, Mus musculus
ttgtggcaccgtttaagatagagcg

SEQ ID NO: 846430 - DNA, 25 bp, Mus musculus
ttgtggccagctatgtttcataaat

SEQ ID NO: 846431 - DNA, 25 bp, Mus musculus
ttgtggccagctttgtttcataaat

SEQ ID NO: 846432 - DNA, 25 bp, Mus musculus
ttgtggcccaaaagaggccatggtg

SEQ ID NO: 846433 - DNA, 25 bp, Mus musculus
ttgtggcccaaatgaggccatggtg

SEQ ID NO: 846434 - DNA, 25 bp, Mus musculus
ttgtggcccaagcattcagttctgc

SEQ ID NO: 846435 - DNA, 25 bp, Mus musculus
ttgtggcccaaggattcagttctgc

SEQ ID NO: 846436 - DNA, 25 bp, Mus musculus
ttgtggcccacaaacagagcggctg

SEQ ID NO: 846437 - DNA, 25 bp, Mus musculus
ttgtggcccacatacagagcggctg

SEQ ID NO: 846438 - DNA, 25 bp, Mus musculus
ttgtggcccgacacattatccattt

SEQ ID NO: 846439 - DNA, 25 bp, Mus musculus
ttgtggcccgactcattatccattt

SEQ ID NO: 846440 - DNA, 25 bp, Mus musculus
ttgtggcccgatcactgtgaagacc

SEQ ID NO: 846441 - DNA, 25 bp, Mus musculus
ttgtggcccgatgactgtgaagacc

SEQ ID NO: 846442 - DNA, 25 bp, Mus musculus
ttgtggcccttactatgcacggccc

SEQ ID NO: 846443 - DNA, 25 bp, Mus musculus
ttgtggcccttagtatgcacggccc

SEQ ID NO: 846444 - DNA, 25 bp, Mus musculus
ttgtggccgaagagagaatgaagct

SEQ ID NO: 846445 - DNA, 25 bp, Mus musculus
ttgtggccgaagtgagaatgaagct

SEQ ID NO: 846446 - DNA, 25 bp, Mus musculus
ttgtggccgcatagagggccagcta

SEQ ID NO: 846447 - DNA, 25 bp, Mus musculus
ttgtggccgcattgagggccagcta

SEQ ID NO: 846448 - DNA, 25 bp, Mus musculus
ttgtggccgtcaacctctactttga

SEQ ID NO: 846449 - DNA, 25 bp, Mus musculus
ttgtggccgtcatcctctactttga

SEQ ID NO: 846450 - DNA, 25 bp, Mus musculus
ttgtggccgtctattccttcattgc

SEQ ID NO: 846451 - DNA, 25 bp, Mus musculus
ttgtggccgtcttttccttcattgc

SEQ ID NO: 846452 - DNA, 25 bp, Mus musculus
ttgtggcgtcagaatttggaaatca

SEQ ID NO: 846453 - DNA, 25 bp, Mus musculus
ttgtggcgtcagtatttggaaatca

SEQ ID NO: 846454 - DNA, 25 bp, Mus musculus
ttgtggctgcatccaatcttcgggc

SEQ ID NO: 846455 - DNA, 25 bp, Mus musculus
ttgtggctgcatgcaatcttcgggc

SEQ ID NO: 846456 - DNA, 25 bp, Mus musculus
ttgtggctgtaaatgttcctcctga

SEQ ID NO: 846457 - DNA, 25 bp, Mus musculus
ttgtggctgtaattgttcctcctga

SEQ ID NO: 846458 - DNA, 25 bp, Mus musculus
ttgtgggacctaagacagactagag

SEQ ID NO: 846459 - DNA, 25 bp, Mus musculus
ttgtgggacctatgacagactagag

SEQ ID NO: 846460 - DNA, 25 bp, Mus musculus
ttgtgggagatacataacaatccga

SEQ ID NO: 846461 - DNA, 25 bp, Mus musculus
ttgtgggagatagataacaatccga

SEQ ID NO: 846462 - DNA, 25 bp, Mus musculus
ttgtgggaggcaaaacaggtgccac

SEQ ID NO: 846463 - DNA, 25 bp, Mus musculus
ttgtgggaggcataacaggtgccac

SEQ ID NO: 846464 - DNA, 25 bp, Mus musculus
ttgtgggatacacgccatcggcaat

SEQ ID NO: 846465 - DNA, 25 bp, Mus musculus
ttgtgggatacaggccatcggcaat

SEQ ID NO: 846466 - DNA, 25 bp, Mus musculus
ttgtgggcagtgaaggtaagtataa

SEQ ID NO: 846467 - DNA, 25 bp, Mus musculus
ttgtgggcagtgtaggtaagtataa

SEQ ID NO: 846468 - DNA, 25 bp, Mus musculus
ttgtgggcatcgacagtctggacct

SEQ ID NO: 846469 - DNA, 25 bp, Mus musculus
ttgtgggcatcgtcagtctggacct

SEQ ID NO: 846470 - DNA, 25 bp, Mus musculus
ttgtgggctcccaactggcagtgat

SEQ ID NO: 846471 - DNA, 25 bp, Mus musculus
ttgtgggctccctactggcagtgat

SEQ ID NO: 846472 - DNA, 25 bp, Mus musculus
ttgtgggtaacaaaagagacattgc

SEQ ID NO: 846473 - DNA, 25 bp, Mus musculus
ttgtgggtaacataagagacattgc

SEQ ID NO: 846474 - DNA, 25 bp, Mus musculus
ttgtgggtcccacggccactttact

SEQ ID NO: 846475 - DNA, 25 bp, Mus musculus
ttgtgggtcccagggccactttact

SEQ ID NO: 846476 - DNA, 25 bp, Mus musculus
ttgtgggtccctcttcagcgcccgg

SEQ ID NO: 846477 - DNA, 25 bp, Mus musculus
ttgtgggtccctgttcagcgcccgg

SEQ ID NO: 846478 - DNA, 25 bp, Mus musculus
ttgtgggtgccaccccatacaccgg

SEQ ID NO: 846479 - DNA, 25 bp, Mus musculus
ttgtgggtgccagcccatacaccgg

SEQ ID NO: 846480 - DNA, 25 bp, Mus musculus
ttgtggtaaacacgagcagtcactc

SEQ ID NO: 846481 - DNA, 25 bp, Mus musculus
ttgtggtaaacaggagcagtcactc

SEQ ID NO: 846482 - DNA, 25 bp, Mus musculus
ttgtggtagcttcggaaacgtcgaa

SEQ ID NO: 846483 - DNA, 25 bp, Mus musculus
ttgtggtagcttgggaaacgtcgaa

SEQ ID NO: 846484 - DNA, 25 bp, Mus musculus
ttgtggtatcttacgagggctctgt

SEQ ID NO: 846485 - DNA, 25 bp, Mus musculus
ttgtggtatctttcgagggctctgt

SEQ ID NO: 846486 - DNA, 25 bp, Mus musculus
ttgtggtcaacgcactgaaggcagt

SEQ ID NO: 846487 - DNA, 25 bp, Mus musculus
ttgtggtcaacggactgaaggcagt

SEQ ID NO: 846488 - DNA, 25 bp, Mus musculus
ttgtggtcccctagcccttctgcag

SEQ ID NO: 846489 - DNA, 25 bp, Mus musculus
ttgtggtccccttgcccttctgcag

SEQ ID NO: 846490 - DNA, 25 bp, Mus musculus
ttgtggtcttcaccacaggagctcc

SEQ ID NO: 846491 - DNA, 25 bp, Mus musculus
ttgtggtcttcagcacaggagctcc

SEQ ID NO: 846492 - DNA, 25 bp, Mus musculus
ttgtggtggcgaagcatattatacc

SEQ ID NO: 846493 - DNA, 25 bp, Mus musculus
ttgtggtggcgatgcatattatacc

SEQ ID NO: 846494 - DNA, 25 bp, Mus musculus
ttgtggtggctcctacccagctcag

SEQ ID NO: 846495 - DNA, 25 bp, Mus musculus
ttgtggtggctcgtacccagctcag

SEQ ID NO: 846496 - DNA, 25 bp, Mus musculus
ttgtggtgtttgagcatcagacaga

SEQ ID NO: 846497 - DNA, 25 bp, Mus musculus
ttgtggtgtttgtgcatcagacaga

SEQ ID NO: 846498 - DNA, 25 bp, Mus musculus
ttgtggttgacaccaatgatcggga

SEQ ID NO: 846499 - DNA, 25 bp, Mus musculus
ttgtggttgacagcaatgatcggga

SEQ ID NO: 846500 - DNA, 25 bp, Mus musculus
ttgtggttgtaacccttgcatatgt

SEQ ID NO: 846501 - DNA, 25 bp, Mus musculus
ttgtggttgtaagccttgcatatgt

SEQ ID NO: 846502 - DNA, 25 bp, Mus musculus
ttgtgtaaggatattgagaacggca

SEQ ID NO: 846503 - DNA, 25 bp, Mus musculus
ttgtgtaaggattttgagaacggca

SEQ ID NO: 846504 - DNA, 25 bp, Mus musculus
ttgtgtacgtgaccctggacaactc

SEQ ID NO: 846505 - DNA, 25 bp, Mus musculus
ttgtgtacgtgagcctggacaactc

SEQ ID NO: 846506 - DNA, 25 bp, Mus musculus
ttgtgtagcatcagctacctgctgg

SEQ ID NO: 846507 - DNA, 25 bp, Mus musculus
ttgtgtagcatctgctacctgctgg

SEQ ID NO: 846508 - DNA, 25 bp, Mus musculus
ttgtgtataagtcacccgtggtgtc

SEQ ID NO: 846509 - DNA, 25 bp, Mus musculus
ttgtgtataagtgacccgtggtgtc

SEQ ID NO: 846510 - DNA, 25 bp, Mus musculus
ttgtgtatcttcagcacggcttgct

SEQ ID NO: 846511 - DNA, 25 bp, Mus musculus
ttgtgtatcttctgcacggcttgct

SEQ ID NO: 846512 - DNA, 25 bp, Mus musculus
ttgtgtatgccgaggacttcaacca

SEQ ID NO: 846513 - DNA, 25 bp, Mus musculus
ttgtgtatgccgtggacttcaacca

SEQ ID NO: 846514 - DNA, 25 bp, Mus musculus
ttgtgtatggccaggactgggcccc

SEQ ID NO: 846515 - DNA, 25 bp, Mus musculus
ttgtgtatggcctggactgggcccc

SEQ ID NO: 846516 - DNA, 25 bp, Mus musculus
ttgtgtcacgaacaaagcccctcaa

SEQ ID NO: 846517 - DNA, 25 bp, Mus musculus
ttgtgtcacgaagaaagcccctcaa

SEQ ID NO: 846518 - DNA, 25 bp, Mus musculus
ttgtgtcagcgtccagtccataaag

SEQ ID NO: 846519 - DNA, 25 bp, Mus musculus
ttgtgtcagcgtgcagtccataaag

SEQ ID NO: 846520 - DNA, 25 bp, Mus musculus
ttgtgtccggcaaccggaattccgg

SEQ ID NO: 846521 - DNA, 25 bp, Mus musculus
ttgtgtccggcatccggaattccgg

SEQ ID NO: 846522 - DNA, 25 bp, Mus musculus
ttgtgtcctacaatcatgagagtcg

SEQ ID NO: 846523 - DNA, 25 bp, Mus musculus
ttgtgtcctacattcatgagagtcg

SEQ ID NO: 846524 - DNA, 25 bp, Mus musculus
ttgtgtcctggacgcggcaaagcac

SEQ ID NO: 846525 - DNA, 25 bp, Mus musculus
ttgtgtcctggaggcggcaaagcac

SEQ ID NO: 846526 - DNA, 25 bp, Mus musculus
ttgtgtcggcagatgttgaatatgg

SEQ ID NO: 846527 - DNA, 25 bp, Mus musculus
ttgtgtcggcagttgttgaatatgg

SEQ ID NO: 846528 - DNA, 25 bp, Mus musculus
ttgtgtctcataccaagttgacgag

SEQ ID NO: 846529 - DNA, 25 bp, Mus musculus
ttgtgtctcatagcaagttgacgag

SEQ ID NO: 846530 - DNA, 25 bp, Mus musculus
ttgtgtctgcggcaactgtttgagt

SEQ ID NO: 846531 - DNA, 25 bp, Mus musculus
ttgtgtctgcgggaactgtttgagt

SEQ ID NO: 846532 - DNA, 25 bp, Mus musculus
ttgtgtctttacagactggcccggg

SEQ ID NO: 846533 - DNA, 25 bp, Mus musculus
ttgtgtctttactgactggcccggg

SEQ ID NO: 846534 - DNA, 25 bp, Mus musculus
ttgtgtgaacgacgtgattggcatc

SEQ ID NO: 846535 - DNA, 25 bp, Mus musculus
ttgtgtgaacgaggtgattggcatc

SEQ ID NO: 846536 - DNA, 25 bp, Mus musculus
ttgtgtgatttcagacatagcaaga

SEQ ID NO: 846537 - DNA, 25 bp, Mus musculus
ttgtgtgatttctgacatagcaaga

SEQ ID NO: 846538 - DNA, 25 bp, Mus musculus
ttgtgtgcacgaagcaaagcaaatc

SEQ ID NO: 846539 - DNA, 25 bp, Mus musculus
ttgtgtgcacgatgcaaagcaaatc

SEQ ID NO: 846540 - DNA, 25 bp, Mus musculus
ttgtgtgcacttctaagaatttggc

SEQ ID NO: 846541 - DNA, 25 bp, Mus musculus
ttgtgtgcacttgtaagaatttggc

SEQ ID NO: 846542 - DNA, 25 bp, Mus musculus
ttgtgtgcataacatcatcgtgggc

SEQ ID NO: 846543 - DNA, 25 bp, Mus musculus
ttgtgtgcataagatcatcgtgggc

SEQ ID NO: 846544 - DNA, 25 bp, Mus musculus
ttgtgtgcctgtctctagctcttcc

SEQ ID NO: 846545 - DNA, 25 bp, Mus musculus
ttgtgtgcctgtgtctagctcttcc

SEQ ID NO: 846546 - DNA, 25 bp, Mus musculus
ttgtgtgctcagaacctggagttga

SEQ ID NO: 846547 - DNA, 25 bp, Mus musculus
ttgtgtgctcagtacctggagttga

SEQ ID NO: 846548 - DNA, 25 bp, Mus musculus
ttgtgtgctctcatcgggccttccg

SEQ ID NO: 846549 - DNA, 25 bp, Mus musculus
ttgtgtgctctcttcgggccttccg

SEQ ID NO: 846550 - DNA, 25 bp, Mus musculus
ttgtgtgcttcaccaggcatgagcc

SEQ ID NO: 846551 - DNA, 25 bp, Mus musculus
ttgtgtgcttcagcaggcatgagcc

SEQ ID NO: 846552 - DNA, 25 bp, Mus musculus
ttgtgtggccatcatgcctcaaacc

SEQ ID NO: 846553 - DNA, 25 bp, Mus musculus
ttgtgtggccatgatgcctcaaacc

SEQ ID NO: 846554 - DNA, 25 bp, Mus musculus
ttgtgtggtctcagacggctgcgtc

SEQ ID NO: 846555 - DNA, 25 bp, Mus musculus
ttgtgtggtctctgacggctgcgtc

SEQ ID NO: 846556 - DNA, 25 bp, Mus musculus
ttgtgttacacccaagcagtgcttg

SEQ ID NO: 846557 - DNA, 25 bp, Mus musculus
ttgtgttacaccgaagcagtgcttg

SEQ ID NO: 846558 - DNA, 25 bp, Mus musculus
ttgtgttacctaaggcgcgggccct

SEQ ID NO: 846559 - DNA, 25 bp, Mus musculus
ttgtgttacctatggcgcgggccct

SEQ ID NO: 846560 - DNA, 25 bp, Mus musculus
ttgtgttactagatacactggaaca

SEQ ID NO: 846561 - DNA, 25 bp, Mus musculus
ttgtgttactagttacactggaaca

SEQ ID NO: 846562 - DNA, 25 bp, Mus musculus
ttgtgttactgaaaaaggcgcctcc

SEQ ID NO: 846563 - DNA, 25 bp, Mus musculus
ttgtgttactgataaaggcgcctcc

SEQ ID NO: 846564 - DNA, 25 bp, Mus musculus
ttgtgttgtggactttcctgtccca

SEQ ID NO: 846565 - DNA, 25 bp, Mus musculus
ttgtgttgtggagtttcctgtccca

SEQ ID NO: 846566 - DNA, 25 bp, Mus musculus
ttgtgtttcacaccatcgccctggg

SEQ ID NO: 846567 - DNA, 25 bp, Mus musculus
ttgtgtttcacagcatcgccctggg

SEQ ID NO: 846568 - DNA, 25 bp, Mus musculus
ttgtgtttgaagaggatggagtccc

SEQ ID NO: 846569 - DNA, 25 bp, Mus musculus
ttgtgtttgaagtggatggagtccc

SEQ ID NO: 846570 - DNA, 25 bp, Mus musculus
ttgtgtttggctaccggtgtgttgc

SEQ ID NO: 846571 - DNA, 25 bp, Mus musculus
ttgtgtttggcttccggtgtgttgc

SEQ ID NO: 846572 - DNA, 25 bp, Mus musculus
ttgtgtttttcacggacgaattcat

SEQ ID NO: 846573 - DNA, 25 bp, Mus musculus
ttgtgtttttcagggacgaattcat

SEQ ID NO: 846574 - DNA, 25 bp, Mus musculus
ttgttaaaagatatcagaagtgtct

SEQ ID NO: 846575 - DNA, 25 bp, Mus musculus
ttgttaaaagatttcagaagtgtct

SEQ ID NO: 846576 - DNA, 25 bp, Mus musculus
ttgttaaagataatccagctcggac

SEQ ID NO: 846577 - DNA, 25 bp, Mus musculus
ttgttaaagatattccagctcggac

SEQ ID NO: 846578 - DNA, 25 bp, Mus musculus
ttgttacagctcagctggttggtca

SEQ ID NO: 846579 - DNA, 25 bp, Mus musculus
ttgttacagctctgctggttggtca

SEQ ID NO: 846580 - DNA, 25 bp, Mus musculus
ttgttacccaaaacaggtatagccg

SEQ ID NO: 846581 - DNA, 25 bp, Mus musculus
ttgttacccaaatcaggtatagccg

SEQ ID NO: 846582 - DNA, 25 bp, Mus musculus
ttgttagactcccaccaacggaagt

SEQ ID NO: 846583 - DNA, 25 bp, Mus musculus
ttgttagactccgaccaacggaagt

SEQ ID NO: 846584 - DNA, 25 bp, Mus musculus
ttgttagtccaacgtcagatggaaa

SEQ ID NO: 846585 - DNA, 25 bp, Mus musculus
ttgttagtccaaggtcagatggaaa

SEQ ID NO: 846586 - DNA, 25 bp, Mus musculus
ttgttataggcgcaaagagagaaac

SEQ ID NO: 846587 - DNA, 25 bp, Mus musculus
ttgttataggcggaaagagagaaac

SEQ ID NO: 846588 - DNA, 25 bp, Mus musculus
ttgttatatgaacgcggcgctgcag

SEQ ID NO: 846589 - DNA, 25 bp, Mus musculus
ttgttatatgaaggcggcgctgcag

SEQ ID NO: 846590 - DNA, 25 bp, Mus musculus
ttgttatggtgaactgttctgcaaa

SEQ ID NO: 846591 - DNA, 25 bp, Mus musculus
ttgttatggtgatctgttctgcaaa

SEQ ID NO: 846592 - DNA, 25 bp, Mus musculus
ttgttatggttgagggctagtcacc

SEQ ID NO: 846593 - DNA, 25 bp, Mus musculus
ttgttatggttgtgggctagtcacc

SEQ ID NO: 846594 - DNA, 25 bp, Mus musculus
ttgttattctaacggtttctgacca

SEQ ID NO: 846595 - DNA, 25 bp, Mus musculus
ttgttattctaagggtttctgacca

SEQ ID NO: 846596 - DNA, 25 bp, Mus musculus
ttgttcaaagaacaattgccaggac

SEQ ID NO: 846597 - DNA, 25 bp, Mus musculus
ttgttcaaagaagaattgccaggac

SEQ ID NO: 846598 - DNA, 25 bp, Mus musculus
ttgttcaaggatcccagactatccc

SEQ ID NO: 846599 - DNA, 25 bp, Mus musculus
ttgttcaaggatgccagactatccc

SEQ ID NO: 846600 - DNA, 25 bp, Mus musculus
ttgttcacaggaagggaatggttac

SEQ ID NO: 846601 - DNA, 25 bp, Mus musculus
ttgttcacaggatgggaatggttac

SEQ ID NO: 846602 - DNA, 25 bp, Mus musculus
ttgttcaccaacaaaaactgccaaa

SEQ ID NO: 846603 - DNA, 25 bp, Mus musculus
ttgttcaccaactaaaactgccaaa

SEQ ID NO: 846604 - DNA, 25 bp, Mus musculus
ttgttcagaagcaacagagtgcaga

SEQ ID NO: 846605 - DNA, 25 bp, Mus musculus
ttgttcagaagctacagagtgcaga

SEQ ID NO: 846606 - DNA, 25 bp, Mus musculus
ttgttcagcacccttcctgtgggca

SEQ ID NO: 846607 - DNA, 25 bp, Mus musculus
ttgttcagcaccgttcctgtgggca

SEQ ID NO: 846608 - DNA, 25 bp, Mus musculus
ttgttcagtgtgacagccgtgccaa

SEQ ID NO: 846609 - DNA, 25 bp, Mus musculus
ttgttcagtgtgtcagccgtgccaa

SEQ ID NO: 846610 - DNA, 25 bp, Mus musculus
ttgttccaggtgaaagtgaggccag

SEQ ID NO: 846611 - DNA, 25 bp, Mus musculus
ttgttccaggtgtaagtgaggccag

SEQ ID NO: 846612 - DNA, 25 bp, Mus musculus
ttgttccccagacacaggactgcgg

SEQ ID NO: 846613 - DNA, 25 bp, Mus musculus
ttgttccccagagacaggactgcgg

SEQ ID NO: 846614 - DNA, 25 bp, Mus musculus
ttgttccccgagacgaccctgagca

SEQ ID NO: 846615 - DNA, 25 bp, Mus musculus
ttgttccccgagtcgaccctgagca

SEQ ID NO: 846616 - DNA, 25 bp, Mus musculus
ttgttccgtgacagtaggtggagaa

SEQ ID NO: 846617 - DNA, 25 bp, Mus musculus
ttgttccgtgactgtaggtggagaa

SEQ ID NO: 846618 - DNA, 25 bp, Mus musculus
ttgttcctagcgatctgcatcatgc

SEQ ID NO: 846619 - DNA, 25 bp, Mus musculus
ttgttcctagcgttctgcatcatgc

SEQ ID NO: 846620 - DNA, 25 bp, Mus musculus
ttgttcctcccaaggtgggaggccc

SEQ ID NO: 846621 - DNA, 25 bp, Mus musculus
ttgttcctcccatggtgggaggccc

SEQ ID NO: 846622 - DNA, 25 bp, Mus musculus
ttgttcctcttgaatgtgatcctcc

SEQ ID NO: 846623 - DNA, 25 bp, Mus musculus
ttgttcctcttgtatgtgatcctcc

SEQ ID NO: 846624 - DNA, 25 bp, Mus musculus
ttgttcctgcttcgctaaatttctc

SEQ ID NO: 846625 - DNA, 25 bp, Mus musculus
ttgttcctgcttggctaaatttctc

SEQ ID NO: 846626 - DNA, 25 bp, Mus musculus
ttgttcctggatcccggtattggct

SEQ ID NO: 846627 - DNA, 25 bp, Mus musculus
ttgttcctggatgccggtattggct

SEQ ID NO: 846628 - DNA, 25 bp, Mus musculus
ttgttccttcccaaggtgactcgga

SEQ ID NO: 846629 - DNA, 25 bp, Mus musculus
ttgttccttccctaggtgactcgga

SEQ ID NO: 846630 - DNA, 25 bp, Mus musculus
ttgttcgcagatccccagcagttac

SEQ ID NO: 846631 - DNA, 25 bp, Mus musculus
ttgttcgcagatgcccagcagttac

SEQ ID NO: 846632 - DNA, 25 bp, Mus musculus
ttgttcgctaccagttcacacctgc

SEQ ID NO: 846633 - DNA, 25 bp, Mus musculus
ttgttcgctacctgttcacacctgc

SEQ ID NO: 846634 - DNA, 25 bp, Mus musculus
ttgttcggctgcaccaggaacgcac

SEQ ID NO: 846635 - DNA, 25 bp, Mus musculus
ttgttcggctgctccaggaacgcac

SEQ ID NO: 846636 - DNA, 25 bp, Mus musculus
ttgttctacaagaacggccgcatcc

SEQ ID NO: 846637 - DNA, 25 bp, Mus musculus
ttgttctacaagtacggccgcatcc

SEQ ID NO: 846638 - DNA, 25 bp, Mus musculus
ttgttctggacgaggctgatgtgat

SEQ ID NO: 846639 - DNA, 25 bp, Mus musculus
ttgttctggacgtggctgatgtgat

SEQ ID NO: 846640 - DNA, 25 bp, Mus musculus
ttgttcttgggaacggtgacaggca

SEQ ID NO: 846641 - DNA, 25 bp, Mus musculus
ttgttcttgggatcggtgacaggca

SEQ ID NO: 846642 - DNA, 25 bp, Mus musculus
ttgttgaactttaccttgaacctct

SEQ ID NO: 846643 - DNA, 25 bp, Mus musculus
ttgttgaacttttccttgaacctct

SEQ ID NO: 846644 - DNA, 25 bp, Mus musculus
ttgttgaagcaccaggccagcatca

SEQ ID NO: 846645 - DNA, 25 bp, Mus musculus
ttgttgaagcacgaggccagcatca

SEQ ID NO: 846646 - DNA, 25 bp, Mus musculus
ttgttgaaggaccagccaaccctca

SEQ ID NO: 846647 - DNA, 25 bp, Mus musculus
ttgttgaaggacgagccaaccctca

SEQ ID NO: 846648 - DNA, 25 bp, Mus musculus
ttgttgaaggccaccaagatctgcg

SEQ ID NO: 846649 - DNA, 25 bp, Mus musculus
ttgttgaaggcctccaagatctgcg

SEQ ID NO: 846650 - DNA, 25 bp, Mus musculus
ttgttgaagtcgaaggacagatcac

SEQ ID NO: 846651 - DNA, 25 bp, Mus musculus
ttgttgaagtcgtaggacagatcac

SEQ ID NO: 846652 - DNA, 25 bp, Mus musculus
ttgttgaccgccagacatcctctgg

SEQ ID NO: 846653 - DNA, 25 bp, Mus musculus
ttgttgaccgcctgacatcctctgg

SEQ ID NO: 846654 - DNA, 25 bp, Mus musculus
ttgttgagaacaatggctgcccacc

SEQ ID NO: 846655 - DNA, 25 bp, Mus musculus
ttgttgagaacattggctgcccacc

SEQ ID NO: 846656 - DNA, 25 bp, Mus musculus
ttgttgagagtcagccagatgctgc

SEQ ID NO: 846657 - DNA, 25 bp, Mus musculus
ttgttgagagtctgccagatgctgc

SEQ ID NO: 846658 - DNA, 25 bp, Mus musculus
ttgttgcaaagacgagacaacttac

SEQ ID NO: 846659 - DNA, 25 bp, Mus musculus
ttgttgcaaagaggagacaacttac

SEQ ID NO: 846660 - DNA, 25 bp, Mus musculus
ttgttgcgacaacgcccagacccta

SEQ ID NO: 846661 - DNA, 25 bp, Mus musculus
ttgttgcgacaaggcccagacccta

SEQ ID NO: 846662 - DNA, 25 bp, Mus musculus
ttgttgctaacacgatgccctctca

SEQ ID NO: 846663 - DNA, 25 bp, Mus musculus
ttgttgctaacaggatgccctctca

SEQ ID NO: 846664 - DNA, 25 bp, Mus musculus
ttgttgctacagaagattctaaagg

SEQ ID NO: 846665 - DNA, 25 bp, Mus musculus
ttgttgctacagtagattctaaagg

SEQ ID NO: 846666 - DNA, 25 bp, Mus musculus
ttgttgctcagcactccatggacag

SEQ ID NO: 846667 - DNA, 25 bp, Mus musculus
ttgttgctcagctctccatggacag

SEQ ID NO: 846668 - DNA, 25 bp, Mus musculus
ttgttgctcggcaggatgaactagg

SEQ ID NO: 846669 - DNA, 25 bp, Mus musculus
ttgttgctcggctggatgaactagg

SEQ ID NO: 846670 - DNA, 25 bp, Mus musculus
ttgttgcttactcggaacgtgaaca

SEQ ID NO: 846671 - DNA, 25 bp, Mus musculus
ttgttgcttactgggaacgtgaaca

SEQ ID NO: 846672 - DNA, 25 bp, Mus musculus
ttgttggagacgcaaccgctacaag

SEQ ID NO: 846673 - DNA, 25 bp, Mus musculus
ttgttggagacggaaccgctacaag

SEQ ID NO: 846674 - DNA, 25 bp, Mus musculus
ttgttggataaaagcaagactctac

SEQ ID NO: 846675 - DNA, 25 bp, Mus musculus
ttgttggataaatgcaagactctac

SEQ ID NO: 846676 - DNA, 25 bp, Mus musculus
ttgttggccagcaggtgacgctagc

SEQ ID NO: 846677 - DNA, 25 bp, Mus musculus
ttgttggccagctggtgacgctagc

SEQ ID NO: 846678 - DNA, 25 bp, Mus musculus
ttgttgggctttcccttcctcagcc

SEQ ID NO: 846679 - DNA, 25 bp, Mus musculus
ttgttgggctttgccttcctcagcc

SEQ ID NO: 846680 - DNA, 25 bp, Mus musculus
ttgttggtagggaacaaatgtgacc

SEQ ID NO: 846681 - DNA, 25 bp, Mus musculus
ttgttggtagggtacaaatgtgacc

SEQ ID NO: 846682 - DNA, 25 bp, Mus musculus
ttgttgtaagttaccagccagccaa

SEQ ID NO: 846683 - DNA, 25 bp, Mus musculus
ttgttgtaagtttccagccagccaa

SEQ ID NO: 846684 - DNA, 25 bp, Mus musculus
ttgttgtcccagcaaagatctatac

SEQ ID NO: 846685 - DNA, 25 bp, Mus musculus
ttgttgtcccaggaaagatctatac

SEQ ID NO: 846686 - DNA, 25 bp, Mus musculus
ttgttgtctcatctgtccctagctg

SEQ ID NO: 846687 - DNA, 25 bp, Mus musculus
ttgttgtctcatgtgtccctagctg

SEQ ID NO: 846688 - DNA, 25 bp, Mus musculus
ttgttgtgactcacttaccagctgg

SEQ ID NO: 846689 - DNA, 25 bp, Mus musculus
ttgttgtgactctcttaccagctgg

SEQ ID NO: 846690 - DNA, 25 bp, Mus musculus
ttgttgttacacagacgggactggc

SEQ ID NO: 846691 - DNA, 25 bp, Mus musculus
ttgttgttacactgacgggactggc

SEQ ID NO: 846692 - DNA, 25 bp, Mus musculus
ttgtttaaggcccattcactggtgt

SEQ ID NO: 846693 - DNA, 25 bp, Mus musculus
ttgtttaaggccgattcactggtgt

SEQ ID NO: 846694 - DNA, 25 bp, Mus musculus
ttgtttactgttcccgggagacacc

SEQ ID NO: 846695 - DNA, 25 bp, Mus musculus
ttgtttactgttgccgggagacacc

SEQ ID NO: 846696 - DNA, 25 bp, Mus musculus
ttgtttagaagtacacatgcatgtc

SEQ ID NO: 846697 - DNA, 25 bp, Mus musculus
ttgtttagaagttcacatgcatgtc

SEQ ID NO: 846698 - DNA, 25 bp, Mus musculus
ttgtttagccccaattaaggtcgct

SEQ ID NO: 846699 - DNA, 25 bp, Mus musculus
ttgtttagcccctattaaggtcgct

SEQ ID NO: 846700 - DNA, 25 bp, Mus musculus
ttgtttagcctccatagagccccag

SEQ ID NO: 846701 - DNA, 25 bp, Mus musculus
ttgtttagcctcgatagagccccag

SEQ ID NO: 846702 - DNA, 25 bp, Mus musculus
ttgtttcaaaggcttgaaatgccct

SEQ ID NO: 846703 - DNA, 25 bp, Mus musculus
ttgtttcaaagggttgaaatgccct

SEQ ID NO: 846704 - DNA, 25 bp, Mus musculus
ttgtttcctctacagcgtgatctcg

SEQ ID NO: 846705 - DNA, 25 bp, Mus musculus
ttgtttcctctagagcgtgatctcg

SEQ ID NO: 846706 - DNA, 25 bp, Mus musculus
ttgtttctgaatccctgcttcggag

SEQ ID NO: 846707 - DNA, 25 bp, Mus musculus
ttgtttctgaatgcctgcttcggag

SEQ ID NO: 846708 - DNA, 25 bp, Mus musculus
ttgtttctggttcagcttcaagaga

SEQ ID NO: 846709 - DNA, 25 bp, Mus musculus
ttgtttctggttgagcttcaagaga

SEQ ID NO: 846710 - DNA, 25 bp, Mus musculus
ttgtttcttcaaagcagttatgcag

SEQ ID NO: 846711 - DNA, 25 bp, Mus musculus
ttgtttcttcaatgcagttatgcag

SEQ ID NO: 846712 - DNA, 25 bp, Mus musculus
ttgtttcttccaccgcggtgtctgc

SEQ ID NO: 846713 - DNA, 25 bp, Mus musculus
ttgtttcttccagcgcggtgtctgc

SEQ ID NO: 846714 - DNA, 25 bp, Mus musculus
ttgtttgaccaacagctctccccag

SEQ ID NO: 846715 - DNA, 25 bp, Mus musculus
ttgtttgaccaagagctctccccag

SEQ ID NO: 846716 - DNA, 25 bp, Mus musculus
ttgtttgaggacaacggcgctccgc

SEQ ID NO: 846717 - DNA, 25 bp, Mus musculus
ttgtttgaggactacggcgctccgc

SEQ ID NO: 846718 - DNA, 25 bp, Mus musculus
ttgtttgccaaacccagagtctccc

SEQ ID NO: 846719 - DNA, 25 bp, Mus musculus
ttgtttgccaaagccagagtctccc

SEQ ID NO: 846720 - DNA, 25 bp, Mus musculus
ttgtttgccaacctagtccacgtga

SEQ ID NO: 846721 - DNA, 25 bp, Mus musculus
ttgtttgccaacgtagtccacgtga

SEQ ID NO: 846722 - DNA, 25 bp, Mus musculus
ttgtttgccgccagacacttctcag

SEQ ID NO: 846723 - DNA, 25 bp, Mus musculus
ttgtttgccgcctgacacttctcag

SEQ ID NO: 846724 - DNA, 25 bp, Mus musculus
ttgtttgggcccacactccaggaga

SEQ ID NO: 846725 - DNA, 25 bp, Mus musculus
ttgtttgggccctcactccaggaga

SEQ ID NO: 846726 - DNA, 25 bp, Mus musculus
ttgtttgtaccaacgggccgcctgg

SEQ ID NO: 846727 - DNA, 25 bp, Mus musculus
ttgtttgtaccatcgggccgcctgg

SEQ ID NO: 846728 - DNA, 25 bp, Mus musculus
ttgtttgtgtgtctgggcccagatc

SEQ ID NO: 846729 - DNA, 25 bp, Mus musculus
ttgtttgtgtgtgtgggcccagatc

SEQ ID NO: 846730 - DNA, 25 bp, Mus musculus
ttgttttagcccagcaggcccctct

SEQ ID NO: 846731 - DNA, 25 bp, Mus musculus
ttgttttagccctgcaggcccctct

SEQ ID NO: 846732 - DNA, 25 bp, Mus musculus
ttgttttcccaacacaagggctggg

SEQ ID NO: 846733 - DNA, 25 bp, Mus musculus
ttgttttcccaagacaagggctggg

SEQ ID NO: 846734 - DNA, 25 bp, Mus musculus
ttgttttcctgaacatctatgagcc

SEQ ID NO: 846735 - DNA, 25 bp, Mus musculus
ttgttttcctgatcatctatgagcc

SEQ ID NO: 846736 - DNA, 25 bp, Mus musculus
ttgttttgcagtctgcccgcaacag

SEQ ID NO: 846737 - DNA, 25 bp, Mus musculus
ttgttttgcagtgtgcccgcaacag

SEQ ID NO: 846738 - DNA, 25 bp, Mus musculus
tttaaaaaatggaccgcattactga

SEQ ID NO: 846739 - DNA, 25 bp, Mus musculus
tttaaaaaatggtccgcattactga

SEQ ID NO: 846740 - DNA, 25 bp, Mus musculus
tttaaaacagaaacgagcagacctc

SEQ ID NO: 846741 - DNA, 25 bp, Mus musculus
tttaaaacagaatcgagcagacctc

SEQ ID NO: 846742 - DNA, 25 bp, Mus musculus
tttaaaactgctctacctgtgcaat

SEQ ID NO: 846743 - DNA, 25 bp, Mus musculus
tttaaaactgctgtacctgtgcaat

SEQ ID NO: 846744 - DNA, 25 bp, Mus musculus
tttaaaatcttacgctggtagacag

SEQ ID NO: 846745 - DNA, 25 bp, Mus musculus
tttaaaatcttaggctggtagacag

SEQ ID NO: 846746 - DNA, 25 bp, Mus musculus
tttaaaatgcagagggagggtgtct

SEQ ID NO: 846747 - DNA, 25 bp, Mus musculus
tttaaaatgcagtgggagggtgtct

SEQ ID NO: 846748 - DNA, 25 bp, Mus musculus
tttaaacaaatcctctgggaactag

SEQ ID NO: 846749 - DNA, 25 bp, Mus musculus
tttaaacaaatcgtctgggaactag

SEQ ID NO: 846750 - DNA, 25 bp, Mus musculus
tttaaacagtacacacagagtccac

SEQ ID NO: 846751 - DNA, 25 bp, Mus musculus
tttaaacagtactcacagagtccac

SEQ ID NO: 846752 - DNA, 25 bp, Mus musculus
tttaaacgccctcgcagagtaggcc

SEQ ID NO: 846753 - DNA, 25 bp, Mus musculus
tttaaacgccctggcagagtaggcc

SEQ ID NO: 846754 - DNA, 25 bp, Mus musculus
tttaaacggcagcaagatgcaactc

SEQ ID NO: 846755 - DNA, 25 bp, Mus musculus
tttaaacggcaggaagatgcaactc

SEQ ID NO: 846756 - DNA, 25 bp, Mus musculus
tttaaacgggagcttcgaaatctgg

SEQ ID NO: 846757 - DNA, 25 bp, Mus musculus
tttaaacgggaggttcgaaatctgg

SEQ ID NO: 846758 - DNA, 25 bp, Mus musculus
tttaaactactgaaccacaagtgga

SEQ ID NO: 846759 - DNA, 25 bp, Mus musculus
tttaaactactgtaccacaagtgga

SEQ ID NO: 846760 - DNA, 25 bp, Mus musculus
tttaaactctggcaatttgacttga

SEQ ID NO: 846761 - DNA, 25 bp, Mus musculus
tttaaactctgggaatttgacttga

SEQ ID NO: 846762 - DNA, 25 bp, Mus musculus
tttaaacttcttcctcaggtactcg

SEQ ID NO: 846763 - DNA, 25 bp, Mus musculus
tttaaacttcttgctcaggtactcg

SEQ ID NO: 846764 - DNA, 25 bp, Mus musculus
tttaaagacactaaccaaggacgat

SEQ ID NO: 846765 - DNA, 25 bp, Mus musculus
tttaaagacacttaccaaggacgat

SEQ ID NO: 846766 - DNA, 25 bp, Mus musculus
tttaaagacagcaggctaaaaagga

SEQ ID NO: 846767 - DNA, 25 bp, Mus musculus
tttaaagacagctggctaaaaagga

SEQ ID NO: 846768 - DNA, 25 bp, Mus musculus
tttaaagatcctctgtaccgggcga

SEQ ID NO: 846769 - DNA, 25 bp, Mus musculus
tttaaagatcctgtgtaccgggcga

SEQ ID NO: 846770 - DNA, 25 bp, Mus musculus
tttaaagatgctcctcagagggcgg

SEQ ID NO: 846771 - DNA, 25 bp, Mus musculus
tttaaagatgctgctcagagggcgg

SEQ ID NO: 846772 - DNA, 25 bp, Mus musculus
tttaaagccaagcaccgtcagacgg

SEQ ID NO: 846773 - DNA, 25 bp, Mus musculus
tttaaagccaaggaccgtcagacgg

SEQ ID NO: 846774 - DNA, 25 bp, Mus musculus
tttaaagccagcaccaagatcaagg

SEQ ID NO: 846775 - DNA, 25 bp, Mus musculus
tttaaagccagctccaagatcaagg

SEQ ID NO: 846776 - DNA, 25 bp, Mus musculus
tttaaagccatgatcaccaacgggc

SEQ ID NO: 846777 - DNA, 25 bp, Mus musculus
tttaaagccatgttcaccaacgggc

SEQ ID NO: 846778 - DNA, 25 bp, Mus musculus
tttaaagcggcgactggaacagctg

SEQ ID NO: 846779 - DNA, 25 bp, Mus musculus
tttaaagcggcgtctggaacagctg

SEQ ID NO: 846780 - DNA, 25 bp, Mus musculus
tttaaaggatgcacaggagaagctg

SEQ ID NO: 846781 - DNA, 25 bp, Mus musculus
tttaaaggatgctcaggagaagctg

SEQ ID NO: 846782 - DNA, 25 bp, Mus musculus
tttaaaggggcaccacccacggagg

SEQ ID NO: 846783 - DNA, 25 bp, Mus musculus
tttaaaggggcagcacccacggagg

SEQ ID NO: 846784 - DNA, 25 bp, Mus musculus
tttaaagtagtacgagactggacag

SEQ ID NO: 846785 - DNA, 25 bp, Mus musculus
tttaaagtagtaggagactggacag

SEQ ID NO: 846786 - DNA, 25 bp, Mus musculus
tttaaagtgcgtctgcccggttggc

SEQ ID NO: 846787 - DNA, 25 bp, Mus musculus
tttaaagtgcgtgtgcccggttggc

SEQ ID NO: 846788 - DNA, 25 bp, Mus musculus
tttaaagtgctaccgcctcggttcc

SEQ ID NO: 846789 - DNA, 25 bp, Mus musculus
tttaaagtgctagcgcctcggttcc

SEQ ID NO: 846790 - DNA, 25 bp, Mus musculus
tttaaataccgtaagcttcaagctt

SEQ ID NO: 846791 - DNA, 25 bp, Mus musculus
tttaaataccgttagcttcaagctt

SEQ ID NO: 846792 - DNA, 25 bp, Mus musculus
tttaaatgaaacctgactgccatct

SEQ ID NO: 846793 - DNA, 25 bp, Mus musculus
tttaaatgaaacgtgactgccatct

SEQ ID NO: 846794 - DNA, 25 bp, Mus musculus
tttaaatgaaagctgcgctatccct

SEQ ID NO: 846795 - DNA, 25 bp, Mus musculus
tttaaatgaaaggtgcgctatccct

SEQ ID NO: 846796 - DNA, 25 bp, Mus musculus
tttaaatggaaacacctcacagaag

SEQ ID NO: 846797 - DNA, 25 bp, Mus musculus
tttaaatggaaagacctcacagaag

SEQ ID NO: 846798 - DNA, 25 bp, Mus musculus
tttaaattcggtcgccactgcgagg

SEQ ID NO: 846799 - DNA, 25 bp, Mus musculus
tttaaattcggtggccactgcgagg

SEQ ID NO: 846800 - DNA, 25 bp, Mus musculus
tttaacaaaagtcacgtcatcaccg

SEQ ID NO: 846801 - DNA, 25 bp, Mus musculus
tttaacaaaagtgacgtcatcaccg

SEQ ID NO: 846802 - DNA, 25 bp, Mus musculus
tttaacaagtttcgctcctgggagc

SEQ ID NO: 846803 - DNA, 25 bp, Mus musculus
tttaacaagtttggctcctgggagc

SEQ ID NO: 846804 - DNA, 25 bp, Mus musculus
tttaacacttgtctccggcaaccgg

SEQ ID NO: 846805 - DNA, 25 bp, Mus musculus
tttaacacttgtgtccggcaaccgg

SEQ ID NO: 846806 - DNA, 25 bp, Mus musculus
tttaacagacctcccaagaccagga

SEQ ID NO: 846807 - DNA, 25 bp, Mus musculus
tttaacagacctgccaagaccagga

SEQ ID NO: 846808 - DNA, 25 bp, Mus musculus
tttaacagacgaccgtacatgagtc

SEQ ID NO: 846809 - DNA, 25 bp, Mus musculus
tttaacagacgagcgtacatgagtc

SEQ ID NO: 846810 - DNA, 25 bp, Mus musculus
tttaacagcagacagtttgcaagtc

SEQ ID NO: 846811 - DNA, 25 bp, Mus musculus
tttaacagcagagagtttgcaagtc

SEQ ID NO: 846812 - DNA, 25 bp, Mus musculus
tttaacagctcgaaatggctcccag

SEQ ID NO: 846813 - DNA, 25 bp, Mus musculus
tttaacagctcgtaatggctcccag

SEQ ID NO: 846814 - DNA, 25 bp, Mus musculus
tttaacaggaacaccacttcaaaat

SEQ ID NO: 846815 - DNA, 25 bp, Mus musculus
tttaacaggaactccacttcaaaat

SEQ ID NO: 846816 - DNA, 25 bp, Mus musculus
tttaacagggtaacaacgtggagac

SEQ ID NO: 846817 - DNA, 25 bp, Mus musculus
tttaacagggtatcaacgtggagac

SEQ ID NO: 846818 - DNA, 25 bp, Mus musculus
tttaacagtgcgatccatttgtggc

SEQ ID NO: 846819 - DNA, 25 bp, Mus musculus
tttaacagtgcgttccatttgtggc

SEQ ID NO: 846820 - DNA, 25 bp, Mus musculus
tttaacatctctcgccatgtcaacc

SEQ ID NO: 846821 - DNA, 25 bp, Mus musculus
tttaacatctctggccatgtcaacc

SEQ ID NO: 846822 - DNA, 25 bp, Mus musculus
tttaacatttaacgatcacagcatt

SEQ ID NO: 846823 - DNA, 25 bp, Mus musculus
tttaacatttaaggatcacagcatt

SEQ ID NO: 846824 - DNA, 25 bp, Mus musculus
tttaaccaagagacgggagccctca

SEQ ID NO: 846825 - DNA, 25 bp, Mus musculus
tttaaccaagagtcgggagccctca

SEQ ID NO: 846826 - DNA, 25 bp, Mus musculus
tttaaccaagcaccccgaggaagtg

SEQ ID NO: 846827 - DNA, 25 bp, Mus musculus
tttaaccaagcagcccgaggaagtg

SEQ ID NO: 846828 - DNA, 25 bp, Mus musculus
tttaaccatgaacagcttgagaggc

SEQ ID NO: 846829 - DNA, 25 bp, Mus musculus
tttaaccatgaagagcttgagaggc

SEQ ID NO: 846830 - DNA, 25 bp, Mus musculus
tttaaccgctccacctctgacatgg

SEQ ID NO: 846831 - DNA, 25 bp, Mus musculus
tttaaccgctcctcctctgacatgg

SEQ ID NO: 846832 - DNA, 25 bp, Mus musculus
tttaaccgcttcctacacgcctaag

SEQ ID NO: 846833 - DNA, 25 bp, Mus musculus
tttaaccgcttcgtacacgcctaag

SEQ ID NO: 846834 - DNA, 25 bp, Mus musculus
tttaacctctttctgttcagcccag

SEQ ID NO: 846835 - DNA, 25 bp, Mus musculus
tttaacctctttgtgttcagcccag

SEQ ID NO: 846836 - DNA, 25 bp, Mus musculus
tttaaccttccgaagatcttgtaga

SEQ ID NO: 846837 - DNA, 25 bp, Mus musculus
tttaaccttccgtagatcttgtaga

SEQ ID NO: 846838 - DNA, 25 bp, Mus musculus
tttaacggagctctgagtgacgact

SEQ ID NO: 846839 - DNA, 25 bp, Mus musculus
tttaacggagctgtgagtgacgact

SEQ ID NO: 846840 - DNA, 25 bp, Mus musculus
tttaacggcaatccccattcttcca

SEQ ID NO: 846841 - DNA, 25 bp, Mus musculus
tttaacggcaatgcccattcttcca

SEQ ID NO: 846842 - DNA, 25 bp, Mus musculus
tttaactggctgactgttctggtcc

SEQ ID NO: 846843 - DNA, 25 bp, Mus musculus
tttaactggctgtctgttctggtcc

SEQ ID NO: 846844 - DNA, 25 bp, Mus musculus
tttaactgtgagatcacaaacctgg

SEQ ID NO: 846845 - DNA, 25 bp, Mus musculus
tttaactgtgagttcacaaacctgg

SEQ ID NO: 846846 - DNA, 25 bp, Mus musculus
tttaactgtggcatcaccgctgctg

SEQ ID NO: 846847 - DNA, 25 bp, Mus musculus
tttaactgtggcttcaccgctgctg

SEQ ID NO: 846848 - DNA, 25 bp, Mus musculus
tttaactttggccagagtgaagcag

SEQ ID NO: 846849 - DNA, 25 bp, Mus musculus
tttaactttggcgagagtgaagcag

SEQ ID NO: 846850 - DNA, 25 bp, Mus musculus
tttaagaaagcactaggagcatgca

SEQ ID NO: 846851 - DNA, 25 bp, Mus musculus
tttaagaaagcagtaggagcatgca

SEQ ID NO: 846852 - DNA, 25 bp, Mus musculus
tttaagaaagccattgctgagctct

SEQ ID NO: 846853 - DNA, 25 bp, Mus musculus
tttaagaaagcctttgctgagctct

SEQ ID NO: 846854 - DNA, 25 bp, Mus musculus
tttaagaagtcccatggttgggttg

SEQ ID NO: 846855 - DNA, 25 bp, Mus musculus
tttaagaagtccgatggttgggttg

SEQ ID NO: 846856 - DNA, 25 bp, Mus musculus
tttaagacacctactgaccatgaag

SEQ ID NO: 846857 - DNA, 25 bp, Mus musculus
tttaagacaccttctgaccatgaag

SEQ ID NO: 846858 - DNA, 25 bp, Mus musculus
tttaagacctttcctgaacctggcc

SEQ ID NO: 846859 - DNA, 25 bp, Mus musculus
tttaagacctttgctgaacctggcc

SEQ ID NO: 846860 - DNA, 25 bp, Mus musculus
tttaagagccagagggaacgtccct

SEQ ID NO: 846861 - DNA, 25 bp, Mus musculus
tttaagagccagtgggaacgtccct

SEQ ID NO: 846862 - DNA, 25 bp, Mus musculus
tttaagattcagcacagctgtcccc

SEQ ID NO: 846863 - DNA, 25 bp, Mus musculus
tttaagattcaggacagctgtcccc

SEQ ID NO: 846864 - DNA, 25 bp, Mus musculus
tttaagatttccatgtgagggctgg

SEQ ID NO: 846865 - DNA, 25 bp, Mus musculus
tttaagatttccttgtgagggctgg

SEQ ID NO: 846866 - DNA, 25 bp, Mus musculus
tttaagcaaaaaccagccagccagt

SEQ ID NO: 846867 - DNA, 25 bp, Mus musculus
tttaagcaaaaagcagccagccagt

SEQ ID NO: 846868 - DNA, 25 bp, Mus musculus
tttaagcagaatacagagcactggg

SEQ ID NO: 846869 - DNA, 25 bp, Mus musculus
tttaagcagaattcagagcactggg

SEQ ID NO: 846870 - DNA, 25 bp, Mus musculus
tttaagcataatcatgtggctgacc

SEQ ID NO: 846871 - DNA, 25 bp, Mus musculus
tttaagcataatgatgtggctgacc

SEQ ID NO: 846872 - DNA, 25 bp, Mus musculus
tttaagccccgcctgggaagccatg

SEQ ID NO: 846873 - DNA, 25 bp, Mus musculus
tttaagccccgcgtgggaagccatg

SEQ ID NO: 846874 - DNA, 25 bp, Mus musculus
tttaagccggatactgcaagacttc

SEQ ID NO: 846875 - DNA, 25 bp, Mus musculus
tttaagccggattctgcaagacttc

SEQ ID NO: 846876 - DNA, 25 bp, Mus musculus
tttaagcctgaccaccgaattggag

SEQ ID NO: 846877 - DNA, 25 bp, Mus musculus
tttaagcctgacgaccgaattggag

SEQ ID NO: 846878 - DNA, 25 bp, Mus musculus
tttaagcgcgttaggctggcccgcc

SEQ ID NO: 846879 - DNA, 25 bp, Mus musculus
tttaagcgcgtttggctggcccgcc

SEQ ID NO: 846880 - DNA, 25 bp, Mus musculus
tttaagcggataacgggcacttcca

SEQ ID NO: 846881 - DNA, 25 bp, Mus musculus
tttaagcggatacacaaagatggac

SEQ ID NO: 846882 - DNA, 25 bp, Mus musculus
tttaagcggatagacaaagatggac

SEQ ID NO: 846883 - DNA, 25 bp, Mus musculus
tttaagcggatatcgggcacttcca

SEQ ID NO: 846884 - DNA, 25 bp, Mus musculus
tttaagctcgacaacagccgggacc

SEQ ID NO: 846885 - DNA, 25 bp, Mus musculus
tttaagctcgactacagccgggacc

SEQ ID NO: 846886 - DNA, 25 bp, Mus musculus
tttaagctgccgcagactcgggcct

SEQ ID NO: 846887 - DNA, 25 bp, Mus musculus
tttaagctgccggagactcgggcct

SEQ ID NO: 846888 - DNA, 25 bp, Mus musculus
tttaagctggctccggagaaagtgc

SEQ ID NO: 846889 - DNA, 25 bp, Mus musculus
tttaagctggctgcggagaaagtgc

SEQ ID NO: 846890 - DNA, 25 bp, Mus musculus
tttaagcttccaacaaagaatgaat

SEQ ID NO: 846891 - DNA, 25 bp, Mus musculus
tttaagcttccatcaaagaatgaat

SEQ ID NO: 846892 - DNA, 25 bp, Mus musculus
tttaagcttcggatctactggtaga

SEQ ID NO: 846893 - DNA, 25 bp, Mus musculus
tttaagcttcggttctactggtaga

SEQ ID NO: 846894 - DNA, 25 bp, Mus musculus
tttaagctttgcactcttcgggccg

SEQ ID NO: 846895 - DNA, 25 bp, Mus musculus
tttaagctttgctctcttcgggccg

SEQ ID NO: 846896 - DNA, 25 bp, Mus musculus
tttaaggaaagtcatgccatgttcg

SEQ ID NO: 846897 - DNA, 25 bp, Mus musculus
tttaaggaaagtgatgccatgttcg

SEQ ID NO: 846898 - DNA, 25 bp, Mus musculus
tttaaggaagtgaccgatggcgtcc

SEQ ID NO: 846899 - DNA, 25 bp, Mus musculus
tttaaggaagtgtccgatggcgtcc

SEQ ID NO: 846900 - DNA, 25 bp, Mus musculus
tttaaggaataaatatctaaccagc

SEQ ID NO: 846901 - DNA, 25 bp, Mus musculus
tttaaggaataattatctaaccagc

SEQ ID NO: 846902 - DNA, 25 bp, Mus musculus
tttaaggacgcacctgatgggccca

SEQ ID NO: 846903 - DNA, 25 bp, Mus musculus
tttaaggacgcagctgatgggccca

SEQ ID NO: 846904 - DNA, 25 bp, Mus musculus
tttaaggagcatcatctgagcgagg

SEQ ID NO: 846905 - DNA, 25 bp, Mus musculus
tttaaggagcatgatctgagcgagg

SEQ ID NO: 846906 - DNA, 25 bp, Mus musculus
tttaaggaggcacaaactttcccat

SEQ ID NO: 846907 - DNA, 25 bp, Mus musculus
tttaaggaggcagaaactttcccat

SEQ ID NO: 846908 - DNA, 25 bp, Mus musculus
tttaaggatgaaaggtgccagcaac

SEQ ID NO: 846909 - DNA, 25 bp, Mus musculus
tttaaggatgaatggtgccagcaac

SEQ ID NO: 846910 - DNA, 25 bp, Mus musculus
tttaaggcagtcacacaaacttttg

SEQ ID NO: 846911 - DNA, 25 bp, Mus musculus
tttaaggcagtctcacaaacttttg

SEQ ID NO: 846912 - DNA, 25 bp, Mus musculus
tttaaggccacactcaatgacagtg

SEQ ID NO: 846913 - DNA, 25 bp, Mus musculus
tttaaggccacagtcaatgacagtg

SEQ ID NO: 846914 - DNA, 25 bp, Mus musculus
tttaagggtcccctcaaatctgagg

SEQ ID NO: 846915 - DNA, 25 bp, Mus musculus
tttaagggtcccgtcaaatctgagg

SEQ ID NO: 846916 - DNA, 25 bp, Mus musculus
tttaagggttcaaatgcccacgagc

SEQ ID NO: 846917 - DNA, 25 bp, Mus musculus
tttaagggttcatatgcccacgagc

SEQ ID NO: 846918 - DNA, 25 bp, Mus musculus
tttaaggtggtgaatgttttggcag

SEQ ID NO: 846919 - DNA, 25 bp, Mus musculus
tttaaggtggtgtatgttttggcag

SEQ ID NO: 846920 - DNA, 25 bp, Mus musculus
tttaagtcctcaccacaagtctcag

SEQ ID NO: 846921 - DNA, 25 bp, Mus musculus
tttaagtcctcagcacaagtctcag

SEQ ID NO: 846922 - DNA, 25 bp, Mus musculus
tttaagtcggcacgtgtcacgctac

SEQ ID NO: 846923 - DNA, 25 bp, Mus musculus
tttaagtcggcaggtgtcacgctac

SEQ ID NO: 846924 - DNA, 25 bp, Mus musculus
tttaagtctgctaaagacgggcagc

SEQ ID NO: 846925 - DNA, 25 bp, Mus musculus
tttaagtctgcttaagacgggcagc

SEQ ID NO: 846926 - DNA, 25 bp, Mus musculus
tttaagtggaaaactgtcacagttg

SEQ ID NO: 846927 - DNA, 25 bp, Mus musculus
tttaagtggaaatctgtcacagttg

SEQ ID NO: 846928 - DNA, 25 bp, Mus musculus
tttaagtgtcctcaagcccttccgg

SEQ ID NO: 846929 - DNA, 25 bp, Mus musculus
tttaagtgtcctgaagcccttccgg

SEQ ID NO: 846930 - DNA, 25 bp, Mus musculus
tttaatacacaaacccattgtcctg

SEQ ID NO: 846931 - DNA, 25 bp, Mus musculus
tttaatacacaatcccattgtcctg

SEQ ID NO: 846932 - DNA, 25 bp, Mus musculus
tttaatacagccacactcaaaaagc

SEQ ID NO: 846933 - DNA, 25 bp, Mus musculus
tttaatacagcctcactcaaaaagc

SEQ ID NO: 846934 - DNA, 25 bp, Mus musculus
tttaatactccacccctgaagaagc

SEQ ID NO: 846935 - DNA, 25 bp, Mus musculus
tttaatactccagccctgaagaagc

SEQ ID NO: 846936 - DNA, 25 bp, Mus musculus
tttaatagaaataactaccacaggg

SEQ ID NO: 846937 - DNA, 25 bp, Mus musculus
tttaatagaaattactaccacaggg

SEQ ID NO: 846938 - DNA, 25 bp, Mus musculus
tttaatagacctcggagcctccttg

SEQ ID NO: 846939 - DNA, 25 bp, Mus musculus
tttaatagacctgggagcctccttg

SEQ ID NO: 846940 - DNA, 25 bp, Mus musculus
tttaatagtgagcaagatgccaaag

SEQ ID NO: 846941 - DNA, 25 bp, Mus musculus
tttaatagtgaggaagatgccaaag

SEQ ID NO: 846942 - DNA, 25 bp, Mus musculus
tttaatcagatgaaacccaaatcca

SEQ ID NO: 846943 - DNA, 25 bp, Mus musculus
tttaatcagatgtaacccaaatcca

SEQ ID NO: 846944 - DNA, 25 bp, Mus musculus
tttaatccctagcaaacaggtgcct

SEQ ID NO: 846945 - DNA, 25 bp, Mus musculus
tttaatccctaggaaacaggtgcct

SEQ ID NO: 846946 - DNA, 25 bp, Mus musculus
tttaatcgccttcggcaggaacaga

SEQ ID NO: 846947 - DNA, 25 bp, Mus musculus
tttaatcgccttgggcaggaacaga

SEQ ID NO: 846948 - DNA, 25 bp, Mus musculus
tttaatctgatgattctgtgctggg

SEQ ID NO: 846949 - DNA, 25 bp, Mus musculus
tttaatctgatgtttctgtgctggg

SEQ ID NO: 846950 - DNA, 25 bp, Mus musculus
tttaatgaagctccctcaactttgg

SEQ ID NO: 846951 - DNA, 25 bp, Mus musculus
tttaatgaagctgcctcaactttgg

SEQ ID NO: 846952 - DNA, 25 bp, Mus musculus
tttaatgaccatctctagccctaaa

SEQ ID NO: 846953 - DNA, 25 bp, Mus musculus
tttaatgaccatgtctagccctaaa

SEQ ID NO: 846954 - DNA, 25 bp, Mus musculus
tttaatgagccacatgccggcgtca

SEQ ID NO: 846955 - DNA, 25 bp, Mus musculus
tttaatgagccagatgccggcgtca

SEQ ID NO: 846956 - DNA, 25 bp, Mus musculus
tttaatgcccgccacttgggcggcc

SEQ ID NO: 846957 - DNA, 25 bp, Mus musculus
tttaatgcccgcgacttgggcggcc

SEQ ID NO: 846958 - DNA, 25 bp, Mus musculus
tttaatgcttctctagtacagagac

SEQ ID NO: 846959 - DNA, 25 bp, Mus musculus
tttaatgcttctgtagtacagagac

SEQ ID NO: 846960 - DNA, 25 bp, Mus musculus
tttaatgtctctctgttcgcccggc

SEQ ID NO: 846961 - DNA, 25 bp, Mus musculus
tttaatgtctctgtgttcgcccggc

SEQ ID NO: 846962 - DNA, 25 bp, Mus musculus
tttaatgtgccgatatccccggtgg

SEQ ID NO: 846963 - DNA, 25 bp, Mus musculus
tttaatgtgccgttatccccggtgg

SEQ ID NO: 846964 - DNA, 25 bp, Mus musculus
tttaattacagcaagtcccagtcgt

SEQ ID NO: 846965 - DNA, 25 bp, Mus musculus
tttaattacagctagtcccagtcgt

SEQ ID NO: 846966 - DNA, 25 bp, Mus musculus
tttaattatgccagggaccaccagc

SEQ ID NO: 846967 - DNA, 25 bp, Mus musculus
tttaattatgcctgggaccaccagc

SEQ ID NO: 846968 - DNA, 25 bp, Mus musculus
tttaattgtcaactacctccctcag

SEQ ID NO: 846969 - DNA, 25 bp, Mus musculus
tttaattgtcaagtacctccctcag

SEQ ID NO: 846970 - DNA, 25 bp, Mus musculus
tttacaaaactgcttggcagccccg

SEQ ID NO: 846971 - DNA, 25 bp, Mus musculus
tttacaaaactggttggcagccccg

SEQ ID NO: 846972 - DNA, 25 bp, Mus musculus
tttacaaagaaccaaacagagaagg

SEQ ID NO: 846973 - DNA, 25 bp, Mus musculus
tttacaaagaacgaaacagagaagg

SEQ ID NO: 846974 - DNA, 25 bp, Mus musculus
tttacaacaagaagaggtaccccag

SEQ ID NO: 846975 - DNA, 25 bp, Mus musculus
tttacaacaagatgaggtaccccag

SEQ ID NO: 846976 - DNA, 25 bp, Mus musculus
tttacaacatcaatggaggacttga

SEQ ID NO: 846977 - DNA, 25 bp, Mus musculus
tttacaacatcattggaggacttga

SEQ ID NO: 846978 - DNA, 25 bp, Mus musculus
tttacaaccacgacttcaagcccag

SEQ ID NO: 846979 - DNA, 25 bp, Mus musculus
tttacaaccacgtcttcaagcccag

SEQ ID NO: 846980 - DNA, 25 bp, Mus musculus
tttacaacctctcacccgacaggag

SEQ ID NO: 846981 - DNA, 25 bp, Mus musculus
tttacaacctctgacccgacaggag

SEQ ID NO: 846982 - DNA, 25 bp, Mus musculus
tttacaacgtggaccagagggacac

SEQ ID NO: 846983 - DNA, 25 bp, Mus musculus
tttacaacgtggtccagagggacac

SEQ ID NO: 846984 - DNA, 25 bp, Mus musculus
tttacaagaccaacgctcatgtgcg

SEQ ID NO: 846985 - DNA, 25 bp, Mus musculus
tttacaagaccatcgctcatgtgcg

SEQ ID NO: 846986 - DNA, 25 bp, Mus musculus
tttacaagattcctttgcagctcac

SEQ ID NO: 846987 - DNA, 25 bp, Mus musculus
tttacaagattcgtttgcagctcac

SEQ ID NO: 846988 - DNA, 25 bp, Mus musculus
tttacaagccatagaactacctggg

SEQ ID NO: 846989 - DNA, 25 bp, Mus musculus
tttacaagccattgaactacctggg

SEQ ID NO: 846990 - DNA, 25 bp, Mus musculus
tttacaagcggaacccgatccttcg

SEQ ID NO: 846991 - DNA, 25 bp, Mus musculus
tttacaagcggatcccgatccttcg

SEQ ID NO: 846992 - DNA, 25 bp, Mus musculus
tttacaagctaaccaacatgcccag

SEQ ID NO: 846993 - DNA, 25 bp, Mus musculus
tttacaagctaagcaacatgcccag

SEQ ID NO: 846994 - DNA, 25 bp, Mus musculus
tttacaagggccaacaatgctccaa

SEQ ID NO: 846995 - DNA, 25 bp, Mus musculus
tttacaagggcctacaatgctccaa

SEQ ID NO: 846996 - DNA, 25 bp, Mus musculus
tttacaatctgtatccttcaggatg

SEQ ID NO: 846997 - DNA, 25 bp, Mus musculus
tttacaatctgtttccttcaggatg

SEQ ID NO: 846998 - DNA, 25 bp, Mus musculus
tttacaatgtcacccgcggcaaggg

SEQ ID NO: 846999 - DNA, 25 bp, Mus musculus
tttacaatgtcagccgcggcaaggg

SEQ ID NO: 847000 - DNA, 25 bp, Mus musculus
tttacacagccgagtacagtgacag

SEQ ID NO: 847001 - DNA, 25 bp, Mus musculus
tttacacagccgtgtacagtgacag

SEQ ID NO: 847002 - DNA, 25 bp, Mus musculus
tttacacatgccctctcgtggatgg

SEQ ID NO: 847003 - DNA, 25 bp, Mus musculus
tttacacatgccgtctcgtggatgg

SEQ ID NO: 847004 - DNA, 25 bp, Mus musculus
tttacaccacagcaaccgaagagtg

SEQ ID NO: 847005 - DNA, 25 bp, Mus musculus
tttacaccacaggaaccgaagagtg

SEQ ID NO: 847006 - DNA, 25 bp, Mus musculus
tttacaccgtggagccaaaccgact

SEQ ID NO: 847007 - DNA, 25 bp, Mus musculus
tttacaccgtggtgccaaaccgact

SEQ ID NO: 847008 - DNA, 25 bp, Mus musculus
tttacacggacacggaaatctatgg

SEQ ID NO: 847009 - DNA, 25 bp, Mus musculus
tttacacggacagggaaatctatgg

SEQ ID NO: 847010 - DNA, 25 bp, Mus musculus
tttacactaagtccttcgtgaaaca

SEQ ID NO: 847011 - DNA, 25 bp, Mus musculus
tttacactaagtgcttcgtgaaaca

SEQ ID NO: 847012 - DNA, 25 bp, Mus musculus
tttacagaaaatctgctggcccatc

SEQ ID NO: 847013 - DNA, 25 bp, Mus musculus
tttacagaaaatgtgctggcccatc

SEQ ID NO: 847014 - DNA, 25 bp, Mus musculus
tttacagaagttaccctgccttcca

SEQ ID NO: 847015 - DNA, 25 bp, Mus musculus
tttacagaagtttccctgccttcca

SEQ ID NO: 847016 - DNA, 25 bp, Mus musculus
tttacagagtctagtgcaccaatgc

SEQ ID NO: 847017 - DNA, 25 bp, Mus musculus
tttacagagtcttgtgcaccaatgc

SEQ ID NO: 847018 - DNA, 25 bp, Mus musculus
tttacagagtttcatgaatgcatca

SEQ ID NO: 847019 - DNA, 25 bp, Mus musculus
tttacagagtttgatgaatgcatca

SEQ ID NO: 847020 - DNA, 25 bp, Mus musculus
tttacagcagatctggccccaaagg

SEQ ID NO: 847021 - DNA, 25 bp, Mus musculus
tttacagcagatgtggccccaaagg

SEQ ID NO: 847022 - DNA, 25 bp, Mus musculus
tttacagccacaaggtacgtcctgg

SEQ ID NO: 847023 - DNA, 25 bp, Mus musculus
tttacagccacatggtacgtcctgg

SEQ ID NO: 847024 - DNA, 25 bp, Mus musculus
tttacagctggcagatcctgacctg

SEQ ID NO: 847025 - DNA, 25 bp, Mus musculus
tttacagctggctgatcctgacctg

SEQ ID NO: 847026 - DNA, 25 bp, Mus musculus
tttacagtgactcagaagggatctc

SEQ ID NO: 847027 - DNA, 25 bp, Mus musculus
tttacagtgactgagaagggatctc

SEQ ID NO: 847028 - DNA, 25 bp, Mus musculus
tttacagtgctgagaagagctcccg

SEQ ID NO: 847029 - DNA, 25 bp, Mus musculus
tttacagtgctgtgaagagctcccg

SEQ ID NO: 847030 - DNA, 25 bp, Mus musculus
tttacagtgtggatgagctggtaga

SEQ ID NO: 847031 - DNA, 25 bp, Mus musculus
tttacagtgtggttgagctggtaga

SEQ ID NO: 847032 - DNA, 25 bp, Mus musculus
tttacatggcatcctacagcttcgg

SEQ ID NO: 847033 - DNA, 25 bp, Mus musculus
tttacatggcatgctacagcttcgg

SEQ ID NO: 847034 - DNA, 25 bp, Mus musculus
tttacatgttggagctcccgggtca

SEQ ID NO: 847035 - DNA, 25 bp, Mus musculus
tttacatgttggtgctcccgggtca

SEQ ID NO: 847036 - DNA, 25 bp, Mus musculus
tttacattgaacaccggctgatgat

SEQ ID NO: 847037 - DNA, 25 bp, Mus musculus
tttacattgaactccggctgatgat

SEQ ID NO: 847038 - DNA, 25 bp, Mus musculus
tttaccaagattattatccctgcct

SEQ ID NO: 847039 - DNA, 25 bp, Mus musculus
tttaccaagatttttatccctgcct

SEQ ID NO: 847040 - DNA, 25 bp, Mus musculus
tttaccaaggttatgacgctgacac

SEQ ID NO: 847041 - DNA, 25 bp, Mus musculus
tttaccaaggttttgacgctgacac

SEQ ID NO: 847042 - DNA, 25 bp, Mus musculus
tttaccacatacaagctcatgcaca

SEQ ID NO: 847043 - DNA, 25 bp, Mus musculus
tttaccacatactagctcatgcaca

SEQ ID NO: 847044 - DNA, 25 bp, Mus musculus
tttaccaccagtatctgatttgtgg

SEQ ID NO: 847045 - DNA, 25 bp, Mus musculus
tttaccaccagtttctgatttgtgg

SEQ ID NO: 847046 - DNA, 25 bp, Mus musculus
tttaccacggcccaacagagactgt

SEQ ID NO: 847047 - DNA, 25 bp, Mus musculus
tttaccacggccgaacagagactgt

SEQ ID NO: 847048 - DNA, 25 bp, Mus musculus
tttaccactgaccattatgttcgag

SEQ ID NO: 847049 - DNA, 25 bp, Mus musculus
tttaccactgacgattatgttcgag

SEQ ID NO: 847050 - DNA, 25 bp, Mus musculus
tttaccagaagccaccacttgagca

SEQ ID NO: 847051 - DNA, 25 bp, Mus musculus
tttaccagaagcgaccacttgagca

SEQ ID NO: 847052 - DNA, 25 bp, Mus musculus
tttaccagagcaagggtaaggcagg

SEQ ID NO: 847053 - DNA, 25 bp, Mus musculus
tttaccagagcatgggtaaggcagg

SEQ ID NO: 847054 - DNA, 25 bp, Mus musculus
tttaccagcaaacaaccccagaggg

SEQ ID NO: 847055 - DNA, 25 bp, Mus musculus
tttaccagcaaagaaccccagaggg

SEQ ID NO: 847056 - DNA, 25 bp, Mus musculus
tttaccagccacatctggttttagc

SEQ ID NO: 847057 - DNA, 25 bp, Mus musculus
tttaccagccacttctggttttagc

SEQ ID NO: 847058 - DNA, 25 bp, Mus musculus
tttaccagctcgacctagcagggct

SEQ ID NO: 847059 - DNA, 25 bp, Mus musculus
tttaccagctcgtcctagcagggct

SEQ ID NO: 847060 - DNA, 25 bp, Mus musculus
tttaccaggaggatcagattcgagc

SEQ ID NO: 847061 - DNA, 25 bp, Mus musculus
tttaccaggaggttcagattcgagc

SEQ ID NO: 847062 - DNA, 25 bp, Mus musculus
tttaccaggctccatctcattttcc

SEQ ID NO: 847063 - DNA, 25 bp, Mus musculus
tttaccaggctcgatctcattttcc

SEQ ID NO: 847064 - DNA, 25 bp, Mus musculus
tttaccagtgggacagctattcgcc

SEQ ID NO: 847065 - DNA, 25 bp, Mus musculus
tttaccagtgggtcagctattcgcc

SEQ ID NO: 847066 - DNA, 25 bp, Mus musculus
tttaccatccgtacagatttccctg

SEQ ID NO: 847067 - DNA, 25 bp, Mus musculus
tttaccatccgttcagatttccctg

SEQ ID NO: 847068 - DNA, 25 bp, Mus musculus
tttaccatgggaatgccaagaagcc

SEQ ID NO: 847069 - DNA, 25 bp, Mus musculus
tttaccatgggattgccaagaagcc

SEQ ID NO: 847070 - DNA, 25 bp, Mus musculus
tttaccatttggagtattcagcaca

SEQ ID NO: 847071 - DNA, 25 bp, Mus musculus
tttaccatttggtgtattcagcaca

SEQ ID NO: 847072 - DNA, 25 bp, Mus musculus
tttacccaagggagccaatgtctct

SEQ ID NO: 847073 - DNA, 25 bp, Mus musculus
tttacccaagggtgccaatgtctct

SEQ ID NO: 847074 - DNA, 25 bp, Mus musculus
tttacccatcgccttcgacttgctg

SEQ ID NO: 847075 - DNA, 25 bp, Mus musculus
tttacccatcgcgttcgacttgctg

SEQ ID NO: 847076 - DNA, 25 bp, Mus musculus
tttacccatgtgacctcagactctg

SEQ ID NO: 847077 - DNA, 25 bp, Mus musculus
tttacccatgtgtcctcagactctg

SEQ ID NO: 847078 - DNA, 25 bp, Mus musculus
tttacccccagcaagagccagaggg

SEQ ID NO: 847079 - DNA, 25 bp, Mus musculus
tttacccccagctagagccagaggg

SEQ ID NO: 847080 - DNA, 25 bp, Mus musculus
tttacccgaggtattgatatacaag

SEQ ID NO: 847081 - DNA, 25 bp, Mus musculus
tttacccgaggttttgatatacaag

SEQ ID NO: 847082 - DNA, 25 bp, Mus musculus
tttacccggagcacggaatttgctg

SEQ ID NO: 847083 - DNA, 25 bp, Mus musculus
tttacccggagctcggaatttgctg

SEQ ID NO: 847084 - DNA, 25 bp, Mus musculus
tttaccctctgaatctcattggcct

SEQ ID NO: 847085 - DNA, 25 bp, Mus musculus
tttaccctctgattctcattggcct

SEQ ID NO: 847086 - DNA, 25 bp, Mus musculus
tttaccctctttacattggatgatg

SEQ ID NO: 847087 - DNA, 25 bp, Mus musculus
tttaccctcttttcattggatgatg

SEQ ID NO: 847088 - DNA, 25 bp, Mus musculus
tttaccctgaacagaagctagctta

SEQ ID NO: 847089 - DNA, 25 bp, Mus musculus
tttaccctgaactgaagctagctta

SEQ ID NO: 847090 - DNA, 25 bp, Mus musculus
tttaccctgctcaactgcctgcagg

SEQ ID NO: 847091 - DNA, 25 bp, Mus musculus
tttaccctgctctactgcctgcagg

SEQ ID NO: 847092 - DNA, 25 bp, Mus musculus
tttaccggcccaaccttgaggaact

SEQ ID NO: 847093 - DNA, 25 bp, Mus musculus
tttaccggcccatccttgaggaact

SEQ ID NO: 847094 - DNA, 25 bp, Mus musculus
tttaccgtgggcagaggaacccagc

SEQ ID NO: 847095 - DNA, 25 bp, Mus musculus
tttaccgtgggctgaggaacccagc

SEQ ID NO: 847096 - DNA, 25 bp, Mus musculus
tttaccgtgtacagctctaaaagcc

SEQ ID NO: 847097 - DNA, 25 bp, Mus musculus
tttaccgtgtactgctctaaaagcc

SEQ ID NO: 847098 - DNA, 25 bp, Mus musculus
tttacctaagagattaagttcgact

SEQ ID NO: 847099 - DNA, 25 bp, Mus musculus
tttacctaagagtttaagttcgact

SEQ ID NO: 847100 - DNA, 25 bp, Mus musculus
tttacctaataccacaacggtagag

SEQ ID NO: 847101 - DNA, 25 bp, Mus musculus
tttacctaatacgacaacggtagag

SEQ ID NO: 847102 - DNA, 25 bp, Mus musculus
tttacctgaagtaacggtgtgacct

SEQ ID NO: 847103 - DNA, 25 bp, Mus musculus
tttacctgaagttacggtgtgacct

SEQ ID NO: 847104 - DNA, 25 bp, Mus musculus
tttacctgagaaacaaggagagctt

SEQ ID NO: 847105 - DNA, 25 bp, Mus musculus
tttacctgagaatcaaggagagctt

SEQ ID NO: 847106 - DNA, 25 bp, Mus musculus
tttacctgcaagagtgggacatccc

SEQ ID NO: 847107 - DNA, 25 bp, Mus musculus
tttacctgcaagtgtgggacatccc

SEQ ID NO: 847108 - DNA, 25 bp, Mus musculus
tttacctggaatcgaaagcacacag

SEQ ID NO: 847109 - DNA, 25 bp, Mus musculus
tttacctggaatggaaagcacacag

SEQ ID NO: 847110 - DNA, 25 bp, Mus musculus
tttacggacgagacctacctggagc

SEQ ID NO: 847111 - DNA, 25 bp, Mus musculus
tttacggacgagtcctacctggagc

SEQ ID NO: 847112 - DNA, 25 bp, Mus musculus
tttacggcaaagagaagttcttcgg

SEQ ID NO: 847113 - DNA, 25 bp, Mus musculus
tttacggcaaagtgaagttcttcgg

SEQ ID NO: 847114 - DNA, 25 bp, Mus musculus
tttacggccgtgctgccgcaaagcg

SEQ ID NO: 847115 - DNA, 25 bp, Mus musculus
tttacggccgtggtgccgcaaagcg

SEQ ID NO: 847116 - DNA, 25 bp, Mus musculus
tttacggtagccaaaacaagccctg

SEQ ID NO: 847117 - DNA, 25 bp, Mus musculus
tttacggtagcctaaacaagccctg

SEQ ID NO: 847118 - DNA, 25 bp, Mus musculus
tttacgttaacaccgctcgggactc

SEQ ID NO: 847119 - DNA, 25 bp, Mus musculus
tttacgttaacagcgctcgggactc

SEQ ID NO: 847120 - DNA, 25 bp, Mus musculus
tttactaagcatcgtctttcagcta

SEQ ID NO: 847121 - DNA, 25 bp, Mus musculus
tttactaagcatggtctttcagcta

SEQ ID NO: 847122 - DNA, 25 bp, Mus musculus
tttactaccggcaggctgatgagcc

SEQ ID NO: 847123 - DNA, 25 bp, Mus musculus
tttactaccggctggctgatgagcc

SEQ ID NO: 847124 - DNA, 25 bp, Mus musculus
tttactagacaactgcatgagaaaa

SEQ ID NO: 847125 - DNA, 25 bp, Mus musculus
tttactagacaagtgcatgagaaaa

SEQ ID NO: 847126 - DNA, 25 bp, Mus musculus
tttactagcctaaatccacaaacag

SEQ ID NO: 847127 - DNA, 25 bp, Mus musculus
tttactagcctatatccacaaacag

SEQ ID NO: 847128 - DNA, 25 bp, Mus musculus
tttactaggtcaagtctctcttaga

SEQ ID NO: 847129 - DNA, 25 bp, Mus musculus
tttactaggtcatgtctctcttaga

SEQ ID NO: 847130 - DNA, 25 bp, Mus musculus
tttactcaagaacctacatacccaa

SEQ ID NO: 847131 - DNA, 25 bp, Mus musculus
tttactcaagaagctacatacccaa

SEQ ID NO: 847132 - DNA, 25 bp, Mus musculus
tttactcacagtactttccacaggg

SEQ ID NO: 847133 - DNA, 25 bp, Mus musculus
tttactcacagttctttccacaggg

SEQ ID NO: 847134 - DNA, 25 bp, Mus musculus
tttactcagtagaagtcccagaaga

SEQ ID NO: 847135 - DNA, 25 bp, Mus musculus
tttactcagtagtagtcccagaaga

SEQ ID NO: 847136 - DNA, 25 bp, Mus musculus
tttactccgtagctgtgggcatttt

SEQ ID NO: 847137 - DNA, 25 bp, Mus musculus
tttactccgtaggtgtgggcatttt

SEQ ID NO: 847138 - DNA, 25 bp, Mus musculus
tttactcctgtgcaggctactgtgt

SEQ ID NO: 847139 - DNA, 25 bp, Mus musculus
tttactcctgtggaggctactgtgt

SEQ ID NO: 847140 - DNA, 25 bp, Mus musculus
tttactcgacctcatccagccttat

SEQ ID NO: 847141 - DNA, 25 bp, Mus musculus
tttactcgacctgatccagccttat

SEQ ID NO: 847142 - DNA, 25 bp, Mus musculus
tttactcgcagtattacaaccaacg

SEQ ID NO: 847143 - DNA, 25 bp, Mus musculus
tttactcgcagttttacaaccaacg

SEQ ID NO: 847144 - DNA, 25 bp, Mus musculus
tttactctactcctctgcagcctgg

SEQ ID NO: 847145 - DNA, 25 bp, Mus musculus
tttactctactcgtctgcagcctgg

SEQ ID NO: 847146 - DNA, 25 bp, Mus musculus
tttactctgtgtcttgcataacaag

SEQ ID NO: 847147 - DNA, 25 bp, Mus musculus
tttactctgtgtgttgcataacaag

SEQ ID NO: 847148 - DNA, 25 bp, Mus musculus
tttactcttagaagataatatcagg

SEQ ID NO: 847149 - DNA, 25 bp, Mus musculus
tttactcttagatgataatatcagg

SEQ ID NO: 847150 - DNA, 25 bp, Mus musculus
tttactcttccgacctgtaggccga

SEQ ID NO: 847151 - DNA, 25 bp, Mus musculus
tttactcttccgtcctgtaggccga

SEQ ID NO: 847152 - DNA, 25 bp, Mus musculus
tttactgactgcaggacaaactttg

SEQ ID NO: 847153 - DNA, 25 bp, Mus musculus
tttactgactgctggacaaactttg

SEQ ID NO: 847154 - DNA, 25 bp, Mus musculus
tttactgagaagctgacggccaacc

SEQ ID NO: 847155 - DNA, 25 bp, Mus musculus
tttactgagaaggtgacggccaacc

SEQ ID NO: 847156 - DNA, 25 bp, Mus musculus
tttactgatcctctggccaaagaag

SEQ ID NO: 847157 - DNA, 25 bp, Mus musculus
tttactgatcctgtggccaaagaag

SEQ ID NO: 847158 - DNA, 25 bp, Mus musculus
tttactggaccaatccaaggagggc

SEQ ID NO: 847159 - DNA, 25 bp, Mus musculus
tttactggaccattccaaggagggc

SEQ ID NO: 847160 - DNA, 25 bp, Mus musculus
tttactggagcgacgaggaagctgt

SEQ ID NO: 847161 - DNA, 25 bp, Mus musculus
tttactggagcgtcgaggaagctgt

SEQ ID NO: 847162 - DNA, 25 bp, Mus musculus
tttactggctcacaccacatggccg

SEQ ID NO: 847163 - DNA, 25 bp, Mus musculus
tttactggctcagaccacatggccg

SEQ ID NO: 847164 - DNA, 25 bp, Mus musculus
tttactggtgaacccaacactggct

SEQ ID NO: 847165 - DNA, 25 bp, Mus musculus
tttactggtgaagccaacactggct

SEQ ID NO: 847166 - DNA, 25 bp, Mus musculus
tttactgtccctccttcaatctagg

SEQ ID NO: 847167 - DNA, 25 bp, Mus musculus
tttactgtccctgcttcaatctagg

SEQ ID NO: 847168 - DNA, 25 bp, Mus musculus
tttactgtgagccagtccgtgacct

SEQ ID NO: 847169 - DNA, 25 bp, Mus musculus
tttactgtgagcgagtccgtgacct

SEQ ID NO: 847170 - DNA, 25 bp, Mus musculus
tttactgtgatcagtgacaagccag

SEQ ID NO: 847171 - DNA, 25 bp, Mus musculus
tttactgtgatctgtgacaagccag

SEQ ID NO: 847172 - DNA, 25 bp, Mus musculus
tttactgtgccactctgggtgtgaa

SEQ ID NO: 847173 - DNA, 25 bp, Mus musculus
tttactgtgccagtctgggtgtgaa

SEQ ID NO: 847174 - DNA, 25 bp, Mus musculus
tttactgtggaaacagccagtagag

SEQ ID NO: 847175 - DNA, 25 bp, Mus musculus
tttactgtggaatcagccagtagag

SEQ ID NO: 847176 - DNA, 25 bp, Mus musculus
tttacttacgttcgtgccttgttca

SEQ ID NO: 847177 - DNA, 25 bp, Mus musculus
tttacttacgttggtgccttgttca

SEQ ID NO: 847178 - DNA, 25 bp, Mus musculus
tttacttcttctcgctggtcctgca

SEQ ID NO: 847179 - DNA, 25 bp, Mus musculus
tttacttcttctggctggtcctgca

SEQ ID NO: 847180 - DNA, 25 bp, Mus musculus
tttacttggtaactgtaagcttgct

SEQ ID NO: 847181 - DNA, 25 bp, Mus musculus
tttacttggtaagtgtaagcttgct

SEQ ID NO: 847182 - DNA, 25 bp, Mus musculus
tttacttgtgctagccagttacccc

SEQ ID NO: 847183 - DNA, 25 bp, Mus musculus
tttacttgtgcttgccagttacccc

SEQ ID NO: 847184 - DNA, 25 bp, Mus musculus
tttactttgtccattgctacctgtg

SEQ ID NO: 847185 - DNA, 25 bp, Mus musculus
tttactttgtcctttgctacctgtg

SEQ ID NO: 847186 - DNA, 25 bp, Mus musculus
tttagaaaactgaggacggctactg

SEQ ID NO: 847187 - DNA, 25 bp, Mus musculus
tttagaaaactgtggacggctactg

SEQ ID NO: 847188 - DNA, 25 bp, Mus musculus
tttagaaagagccttcagtttccga

SEQ ID NO: 847189 - DNA, 25 bp, Mus musculus
tttagaaagagcgttcagtttccga

SEQ ID NO: 847190 - DNA, 25 bp, Mus musculus
tttagaacagttagataaaactccg

SEQ ID NO: 847191 - DNA, 25 bp, Mus musculus
tttagaacagtttgataaaactccg

SEQ ID NO: 847192 - DNA, 25 bp, Mus musculus
tttagaagggacagagagacatgtc

SEQ ID NO: 847193 - DNA, 25 bp, Mus musculus
tttagaagggactgagagacatgtc

SEQ ID NO: 847194 - DNA, 25 bp, Mus musculus
tttagaaggtaaagcccacagttgg

SEQ ID NO: 847195 - DNA, 25 bp, Mus musculus
tttagaaggtaatgcccacagttgg

SEQ ID NO: 847196 - DNA, 25 bp, Mus musculus
tttagaagtaaacctcgagcctcca

SEQ ID NO: 847197 - DNA, 25 bp, Mus musculus
tttagaagtaaagctcgagcctcca

SEQ ID NO: 847198 - DNA, 25 bp, Mus musculus
tttagaagtacacatgcatgtcact

SEQ ID NO: 847199 - DNA, 25 bp, Mus musculus
tttagaagtacagatgcatgtcact

SEQ ID NO: 847200 - DNA, 25 bp, Mus musculus
tttagaatctgacggtggcaacacc

SEQ ID NO: 847201 - DNA, 25 bp, Mus musculus
tttagaatctgagggtggcaacacc

SEQ ID NO: 847202 - DNA, 25 bp, Mus musculus
tttagaccaaaacgcatttcccagg

SEQ ID NO: 847203 - DNA, 25 bp, Mus musculus
tttagaccaaaaggcatttcccagg

SEQ ID NO: 847204 - DNA, 25 bp, Mus musculus
tttagaccaagaccaaagaattgtt

SEQ ID NO: 847205 - DNA, 25 bp, Mus musculus
tttagaccaagagcaaagaattgtt

SEQ ID NO: 847206 - DNA, 25 bp, Mus musculus
tttagaccccgtcctactggtgagg

SEQ ID NO: 847207 - DNA, 25 bp, Mus musculus
tttagaccccgtgctactggtgagg

SEQ ID NO: 847208 - DNA, 25 bp, Mus musculus
tttagacccgacatgatagacatgg

SEQ ID NO: 847209 - DNA, 25 bp, Mus musculus
tttagacccgacttgatagacatgg

SEQ ID NO: 847210 - DNA, 25 bp, Mus musculus
tttagaccgcatcctcactgtgaca

SEQ ID NO: 847211 - DNA, 25 bp, Mus musculus
tttagaccgcatgctcactgtgaca

SEQ ID NO: 847212 - DNA, 25 bp, Mus musculus
tttagactccaaccggcagtgcagg

SEQ ID NO: 847213 - DNA, 25 bp, Mus musculus
tttagactccaagcggcagtgcagg

SEQ ID NO: 847214 - DNA, 25 bp, Mus musculus
tttagacttccccaagcagccgggc

SEQ ID NO: 847215 - DNA, 25 bp, Mus musculus
tttagacttcccgaagcagccgggc

SEQ ID NO: 847216 - DNA, 25 bp, Mus musculus
tttagagaaatcacctgctgccttg

SEQ ID NO: 847217 - DNA, 25 bp, Mus musculus
tttagagaaatctcctgctgccttg

SEQ ID NO: 847218 - DNA, 25 bp, Mus musculus
tttagagaccaaagaggaccccgag

SEQ ID NO: 847219 - DNA, 25 bp, Mus musculus
tttagagaccaatgaggaccccgag

SEQ ID NO: 847220 - DNA, 25 bp, Mus musculus
tttagagccgctcaatgaggagacg

SEQ ID NO: 847221 - DNA, 25 bp, Mus musculus
tttagagccgctgaatgaggagacg

SEQ ID NO: 847222 - DNA, 25 bp, Mus musculus
tttagagcgggacagcgcggtgtcc

SEQ ID NO: 847223 - DNA, 25 bp, Mus musculus
tttagagcgggagagcgcggtgtcc

SEQ ID NO: 847224 - DNA, 25 bp, Mus musculus
tttagagtgcctcaagtaggagcga

SEQ ID NO: 847225 - DNA, 25 bp, Mus musculus
tttagagtgcctgaagtaggagcga

SEQ ID NO: 847226 - DNA, 25 bp, Mus musculus
tttagagttaccaaatgtagtgtgt

SEQ ID NO: 847227 - DNA, 25 bp, Mus musculus
tttagagttacctaatgtagtgtgt

SEQ ID NO: 847228 - DNA, 25 bp, Mus musculus
tttagagttcccaatgatcctggac

SEQ ID NO: 847229 - DNA, 25 bp, Mus musculus
tttagagttccctatgatcctggac

SEQ ID NO: 847230 - DNA, 25 bp, Mus musculus
tttagatcacccagcctgaacccat

SEQ ID NO: 847231 - DNA, 25 bp, Mus musculus
tttagatcaccctgcctgaacccat

SEQ ID NO: 847232 - DNA, 25 bp, Mus musculus
tttagcaaaaatctgtatagacagc

SEQ ID NO: 847233 - DNA, 25 bp, Mus musculus
tttagcaaaaatgtgtatagacagc

SEQ ID NO: 847234 - DNA, 25 bp, Mus musculus
tttagcaacacaacaagtgtgaggg

SEQ ID NO: 847235 - DNA, 25 bp, Mus musculus
tttagcaacacatcaagtgtgaggg

SEQ ID NO: 847236 - DNA, 25 bp, Mus musculus
tttagcaacctgactgatgctcgga

SEQ ID NO: 847237 - DNA, 25 bp, Mus musculus
tttagcaacctgtctgatgctcgga

SEQ ID NO: 847238 - DNA, 25 bp, Mus musculus
tttagcaacgaaatcacctttggga

SEQ ID NO: 847239 - DNA, 25 bp, Mus musculus
tttagcaacgaattcacctttggga

SEQ ID NO: 847240 - DNA, 25 bp, Mus musculus
tttagcaccgtcaagcccatgtacg

SEQ ID NO: 847241 - DNA, 25 bp, Mus musculus
tttagcaccgtctagcccatgtacg

SEQ ID NO: 847242 - DNA, 25 bp, Mus musculus
tttagcagcaagaagccatccatcc

SEQ ID NO: 847243 - DNA, 25 bp, Mus musculus
tttagcagcaagtagccatccatcc

SEQ ID NO: 847244 - DNA, 25 bp, Mus musculus
tttagcaggtggcaagcttcccgcc

SEQ ID NO: 847245 - DNA, 25 bp, Mus musculus
tttagcaggtgggaagcttcccgcc

SEQ ID NO: 847246 - DNA, 25 bp, Mus musculus
tttagcagtgaaccttcacagcgtc

SEQ ID NO: 847247 - DNA, 25 bp, Mus musculus
tttagcagtgaagcttcacagcgtc

SEQ ID NO: 847248 - DNA, 25 bp, Mus musculus
tttagcatatcacgaggtgtcggcg

SEQ ID NO: 847249 - DNA, 25 bp, Mus musculus
tttagcatatcaggaggtgtcggcg

SEQ ID NO: 847250 - DNA, 25 bp, Mus musculus
tttagcattataacaacagctcttc

SEQ ID NO: 847251 - DNA, 25 bp, Mus musculus
tttagcattatatcaacagctcttc

SEQ ID NO: 847252 - DNA, 25 bp, Mus musculus
tttagcattgatcaaaacgaactga

SEQ ID NO: 847253 - DNA, 25 bp, Mus musculus
tttagcattgatgaaaacgaactga

SEQ ID NO: 847254 - DNA, 25 bp, Mus musculus
tttagccaacgccttctactgccag

SEQ ID NO: 847255 - DNA, 25 bp, Mus musculus
tttagccaacgcgttctactgccag

SEQ ID NO: 847256 - DNA, 25 bp, Mus musculus
tttagccacaccaggactagtgtcc

SEQ ID NO: 847257 - DNA, 25 bp, Mus musculus
tttagccacacctggactagtgtcc

SEQ ID NO: 847258 - DNA, 25 bp, Mus musculus
tttagccacgtactgcggcgactgg

SEQ ID NO: 847259 - DNA, 25 bp, Mus musculus
tttagccacgtagtgcggcgactgg

SEQ ID NO: 847260 - DNA, 25 bp, Mus musculus
tttagccagtcgctcatatctctgg

SEQ ID NO: 847261 - DNA, 25 bp, Mus musculus
tttagccagtcggtcatatctctgg

SEQ ID NO: 847262 - DNA, 25 bp, Mus musculus
tttagccccagtcgatgatgcacct

SEQ ID NO: 847263 - DNA, 25 bp, Mus musculus
tttagccccagtggatgatgcacct

SEQ ID NO: 847264 - DNA, 25 bp, Mus musculus
tttagccttcagagtgaggctgtat

SEQ ID NO: 847265 - DNA, 25 bp, Mus musculus
tttagccttcagtgtgaggctgtat

SEQ ID NO: 847266 - DNA, 25 bp, Mus musculus
tttagcgtcctcaatacacccagct

SEQ ID NO: 847267 - DNA, 25 bp, Mus musculus
tttagcgtcctctatacacccagct

SEQ ID NO: 847268 - DNA, 25 bp, Mus musculus
tttagctacgggcatgagcttggcc

SEQ ID NO: 847269 - DNA, 25 bp, Mus musculus
tttagctacggggatgagcttggcc

SEQ ID NO: 847270 - DNA, 25 bp, Mus musculus
tttagctcaggtcccaccgatccga

SEQ ID NO: 847271 - DNA, 25 bp, Mus musculus
tttagctcaggtgccaccgatccga

SEQ ID NO: 847272 - DNA, 25 bp, Mus musculus
tttagctgagacaccagagcgttca

SEQ ID NO: 847273 - DNA, 25 bp, Mus musculus
tttagctgagactccagagcgttca

SEQ ID NO: 847274 - DNA, 25 bp, Mus musculus
tttagcttcgaaccccatcccaggt

SEQ ID NO: 847275 - DNA, 25 bp, Mus musculus
tttagcttcgaagcccatcccaggt

SEQ ID NO: 847276 - DNA, 25 bp, Mus musculus
tttaggaaagggacaaagcactgtg

SEQ ID NO: 847277 - DNA, 25 bp, Mus musculus
tttaggaaagggtcaaagcactgtg

SEQ ID NO: 847278 - DNA, 25 bp, Mus musculus
tttaggacacccctattggctgacc

SEQ ID NO: 847279 - DNA, 25 bp, Mus musculus
tttaggacacccgtattggctgacc

SEQ ID NO: 847280 - DNA, 25 bp, Mus musculus
tttaggacagaaaggaagaagggaa

SEQ ID NO: 847281 - DNA, 25 bp, Mus musculus
tttaggacagaatggaagaagggaa

SEQ ID NO: 847282 - DNA, 25 bp, Mus musculus
tttaggaccaatcagaactgcgccc

SEQ ID NO: 847283 - DNA, 25 bp, Mus musculus
tttaggaccaatgagaactgcgccc

SEQ ID NO: 847284 - DNA, 25 bp, Mus musculus
tttaggagagacacaccgcttgttc

SEQ ID NO: 847285 - DNA, 25 bp, Mus musculus
tttaggagagactcaccgcttgttc

SEQ ID NO: 847286 - DNA, 25 bp, Mus musculus
tttaggagccgtctttggtttctct

SEQ ID NO: 847287 - DNA, 25 bp, Mus musculus
tttaggagccgtgtttggtttctct

SEQ ID NO: 847288 - DNA, 25 bp, Mus musculus
tttaggagcgcgagtgtgacacggc

SEQ ID NO: 847289 - DNA, 25 bp, Mus musculus
tttaggagcgcgtgtgtgacacggc

SEQ ID NO: 847290 - DNA, 25 bp, Mus musculus
tttaggagctcccatccgggagcct

SEQ ID NO: 847291 - DNA, 25 bp, Mus musculus
tttaggagctccgatccgggagcct

SEQ ID NO: 847292 - DNA, 25 bp, Mus musculus
tttaggcactccaacacagtccgga

SEQ ID NO: 847293 - DNA, 25 bp, Mus musculus
tttaggcactcctacacagtccgga

SEQ ID NO: 847294 - DNA, 25 bp, Mus musculus
tttaggccagagcaacatcacggag

SEQ ID NO: 847295 - DNA, 25 bp, Mus musculus
tttaggccagaggaacatcacggag

SEQ ID NO: 847296 - DNA, 25 bp, Mus musculus
tttaggcctgggaacgtctcagacc

SEQ ID NO: 847297 - DNA, 25 bp, Mus musculus
tttaggcctgggtacgtctcagacc

SEQ ID NO: 847298 - DNA, 25 bp, Mus musculus
tttaggcttcaacgaaggacagacc

SEQ ID NO: 847299 - DNA, 25 bp, Mus musculus
tttaggcttcaaggaaggacagacc

SEQ ID NO: 847300 - DNA, 25 bp, Mus musculus
tttaggctttatagatacctggccc

SEQ ID NO: 847301 - DNA, 25 bp, Mus musculus
tttaggctttattgatacctggccc

SEQ ID NO: 847302 - DNA, 25 bp, Mus musculus
tttagggaaaccagggctgcccagg

SEQ ID NO: 847303 - DNA, 25 bp, Mus musculus
tttagggaaacctgggctgcccagg

SEQ ID NO: 847304 - DNA, 25 bp, Mus musculus
tttagggaaggcagtaaagcagcca

SEQ ID NO: 847305 - DNA, 25 bp, Mus musculus
tttagggaaggctgtaaagcagcca

SEQ ID NO: 847306 - DNA, 25 bp, Mus musculus
tttagggataaaccgcggccccgcg

SEQ ID NO: 847307 - DNA, 25 bp, Mus musculus
tttagggataaagcgcggccccgcg

SEQ ID NO: 847308 - DNA, 25 bp, Mus musculus
tttagggatggtattacggagccag

SEQ ID NO: 847309 - DNA, 25 bp, Mus musculus
tttagggatggttttacggagccag

SEQ ID NO: 847310 - DNA, 25 bp, Mus musculus
tttagggcatgtcgacgccttgtgc

SEQ ID NO: 847311 - DNA, 25 bp, Mus musculus
tttagggcatgtggacgccttgtgc

SEQ ID NO: 847312 - DNA, 25 bp, Mus musculus
tttaggggtgtcaccctggctcccg

SEQ ID NO: 847313 - DNA, 25 bp, Mus musculus
tttaggggtgtctccctggctcccg

SEQ ID NO: 847314 - DNA, 25 bp, Mus musculus
tttagggtagacagccccattcagg

SEQ ID NO: 847315 - DNA, 25 bp, Mus musculus
tttagggtagactgccccattcagg

SEQ ID NO: 847316 - DNA, 25 bp, Mus musculus
tttaggtcaacccattaagacacgg

SEQ ID NO: 847317 - DNA, 25 bp, Mus musculus
tttaggtcaaccgattaagacacgg

SEQ ID NO: 847318 - DNA, 25 bp, Mus musculus
tttaggttcctgaaaaacgatggca

SEQ ID NO: 847319 - DNA, 25 bp, Mus musculus
tttaggttcctgtaaaacgatggca

SEQ ID NO: 847320 - DNA, 25 bp, Mus musculus
tttaggttctcgcaagccaaaccag

SEQ ID NO: 847321 - DNA, 25 bp, Mus musculus
tttaggttctcggaagccaaaccag

SEQ ID NO: 847322 - DNA, 25 bp, Mus musculus
tttagtaactacatcaacgccatgt

SEQ ID NO: 847323 - DNA, 25 bp, Mus musculus
tttagtaactacttcaacgccatgt

SEQ ID NO: 847324 - DNA, 25 bp, Mus musculus
tttagtacatggctttcagaaaaag

SEQ ID NO: 847325 - DNA, 25 bp, Mus musculus
tttagtacatgggtttcagaaaaag

SEQ ID NO: 847326 - DNA, 25 bp, Mus musculus
tttagtactggccatcggcacctgc

SEQ ID NO: 847327 - DNA, 25 bp, Mus musculus
tttagtactggcgatcggcacctgc

SEQ ID NO: 847328 - DNA, 25 bp, Mus musculus
tttagtagtgaactgaaggaggcca

SEQ ID NO: 847329 - DNA, 25 bp, Mus musculus
tttagtagtgaagtgaaggaggcca

SEQ ID NO: 847330 - DNA, 25 bp, Mus musculus
tttagtataggaagtcagaccgacc

SEQ ID NO: 847331 - DNA, 25 bp, Mus musculus
tttagtataggatgtcagaccgacc

SEQ ID NO: 847332 - DNA, 25 bp, Mus musculus
tttagtcaagaaaccctcccgtttg

SEQ ID NO: 847333 - DNA, 25 bp, Mus musculus
tttagtcaagaatccctcccgtttg

SEQ ID NO: 847334 - DNA, 25 bp, Mus musculus
tttagtccaatgatgccttacggca

SEQ ID NO: 847335 - DNA, 25 bp, Mus musculus
tttagtccaatgttgccttacggca

SEQ ID NO: 847336 - DNA, 25 bp, Mus musculus
tttagtcgcctccagagatccgtgc

SEQ ID NO: 847337 - DNA, 25 bp, Mus musculus
tttagtcgcctcgagagatccgtgc

SEQ ID NO: 847338 - DNA, 25 bp, Mus musculus
tttagtctggagatgggccaatcac

SEQ ID NO: 847339 - DNA, 25 bp, Mus musculus
tttagtctggagttgggccaatcac

SEQ ID NO: 847340 - DNA, 25 bp, Mus musculus
tttagttctgctcatctcatccatg

SEQ ID NO: 847341 - DNA, 25 bp, Mus musculus
tttagttctgctgatctcatccatg

SEQ ID NO: 847342 - DNA, 25 bp, Mus musculus
tttagttggaaaaaccttatggttg

SEQ ID NO: 847343 - DNA, 25 bp, Mus musculus
tttagttggaaataccttatggttg

SEQ ID NO: 847344 - DNA, 25 bp, Mus musculus
tttagttttctgcagcattcttggg

SEQ ID NO: 847345 - DNA, 25 bp, Mus musculus
tttagttttctggagcattcttggg

SEQ ID NO: 847346 - DNA, 25 bp, Mus musculus
tttataaactggaaaaagagaggct

SEQ ID NO: 847347 - DNA, 25 bp, Mus musculus
tttataaactggtaaaagagaggct

SEQ ID NO: 847348 - DNA, 25 bp, Mus musculus
tttataaccaaccaagtcaggcagg

SEQ ID NO: 847349 - DNA, 25 bp, Mus musculus
tttataaccaacgaagtcaggcagg

SEQ ID NO: 847350 - DNA, 25 bp, Mus musculus
tttataagcaagactgatgctcaga

SEQ ID NO: 847351 - DNA, 25 bp, Mus musculus
tttataagcaagtctgatgctcaga

SEQ ID NO: 847352 - DNA, 25 bp, Mus musculus
tttataatgacgaggatgtgcagaa

SEQ ID NO: 847353 - DNA, 25 bp, Mus musculus
tttataatgacgtggatgtgcagaa

SEQ ID NO: 847354 - DNA, 25 bp, Mus musculus
tttatacactacagtcaacgatgag

SEQ ID NO: 847355 - DNA, 25 bp, Mus musculus
tttatacactactgtcaacgatgag

SEQ ID NO: 847356 - DNA, 25 bp, Mus musculus
tttatacaggaaaacaagacaagac

SEQ ID NO: 847357 - DNA, 25 bp, Mus musculus
tttatacaggaatacaagacaagac

SEQ ID NO: 847358 - DNA, 25 bp, Mus musculus
tttatacccaatacctatgacgccc

SEQ ID NO: 847359 - DNA, 25 bp, Mus musculus
tttatacccaattcctatgacgccc

SEQ ID NO: 847360 - DNA, 25 bp, Mus musculus
tttataccggaccatcttctccgac

SEQ ID NO: 847361 - DNA, 25 bp, Mus musculus
tttataccggacgatcttctccgac

SEQ ID NO: 847362 - DNA, 25 bp, Mus musculus
tttatacgtgtcatacccagcagcg

SEQ ID NO: 847363 - DNA, 25 bp, Mus musculus
tttatacgtgtcttacccagcagcg

SEQ ID NO: 847364 - DNA, 25 bp, Mus musculus
tttatagacggtcgcaaacagctca

SEQ ID NO: 847365 - DNA, 25 bp, Mus musculus
tttatagacggtggcaaacagctca

SEQ ID NO: 847366 - DNA, 25 bp, Mus musculus
tttatagatatcaacgaatgccgtc

SEQ ID NO: 847367 - DNA, 25 bp, Mus musculus
tttatagatatctacgaatgccgtc

SEQ ID NO: 847368 - DNA, 25 bp, Mus musculus
tttatagcacctcgacttaactttc

SEQ ID NO: 847369 - DNA, 25 bp, Mus musculus
tttatagcacctggacttaactttc

SEQ ID NO: 847370 - DNA, 25 bp, Mus musculus
tttatagcctagactgctacctttc

SEQ ID NO: 847371 - DNA, 25 bp, Mus musculus
tttatagcctagtctgctacctttc

SEQ ID NO: 847372 - DNA, 25 bp, Mus musculus
tttatagctacacgttggaggcaac

SEQ ID NO: 847373 - DNA, 25 bp, Mus musculus
tttatagctacaggttggaggcaac

SEQ ID NO: 847374 - DNA, 25 bp, Mus musculus
tttataggaaccagaaccacagcct

SEQ ID NO: 847375 - DNA, 25 bp, Mus musculus
tttataggaacctgaaccacagcct

SEQ ID NO: 847376 - DNA, 25 bp, Mus musculus
tttatagggttgagggatacaggcc

SEQ ID NO: 847377 - DNA, 25 bp, Mus musculus
tttatagggttgtgggatacaggcc

SEQ ID NO: 847378 - DNA, 25 bp, Mus musculus
tttatatcccaccagttatgcttgc

SEQ ID NO: 847379 - DNA, 25 bp, Mus musculus
tttatatcccacgagttatgcttgc

SEQ ID NO: 847380 - DNA, 25 bp, Mus musculus
tttatcaccaggatctagccaccgg

SEQ ID NO: 847381 - DNA, 25 bp, Mus musculus
tttatcaccaggttctagccaccgg

SEQ ID NO: 847382 - DNA, 25 bp, Mus musculus
tttatcaccgtccatgacccggcag

SEQ ID NO: 847383 - DNA, 25 bp, Mus musculus
tttatcaccgtcgatgacccggcag

SEQ ID NO: 847384 - DNA, 25 bp, Mus musculus
tttatcacgtgaagagaagaaggag

SEQ ID NO: 847385 - DNA, 25 bp, Mus musculus
tttatcacgtgatgagaagaaggag

SEQ ID NO: 847386 - DNA, 25 bp, Mus musculus
tttatcactccgaaaggaaggagat

SEQ ID NO: 847387 - DNA, 25 bp, Mus musculus
tttatcactccgtaaggaaggagat

SEQ ID NO: 847388 - DNA, 25 bp, Mus musculus
tttatcagactgaaatgttacgcca

SEQ ID NO: 847389 - DNA, 25 bp, Mus musculus
tttatcagactgtaatgttacgcca

SEQ ID NO: 847390 - DNA, 25 bp, Mus musculus
tttatcaggacccagaccagtttgc

SEQ ID NO: 847391 - DNA, 25 bp, Mus musculus
tttatcaggaccgagaccagtttgc

SEQ ID NO: 847392 - DNA, 25 bp, Mus musculus
tttatcatcctgaaactacccagct

SEQ ID NO: 847393 - DNA, 25 bp, Mus musculus
tttatcatcctgtaactacccagct

SEQ ID NO: 847394 - DNA, 25 bp, Mus musculus
tttatcatctacaaagttgggaacg

SEQ ID NO: 847395 - DNA, 25 bp, Mus musculus
tttatcatctactaagttgggaacg

SEQ ID NO: 847396 - DNA, 25 bp, Mus musculus
tttatcatggtaatgggagccatgc

SEQ ID NO: 847397 - DNA, 25 bp, Mus musculus
tttatcatggtattgggagccatgc

SEQ ID NO: 847398 - DNA, 25 bp, Mus musculus
tttatccaaccaaaccagactgaga

SEQ ID NO: 847399 - DNA, 25 bp, Mus musculus
tttatccaaccataccagactgaga

SEQ ID NO: 847400 - DNA, 25 bp, Mus musculus
tttatccacatgaagaaccatcttg

SEQ ID NO: 847401 - DNA, 25 bp, Mus musculus
tttatccacatgtagaaccatcttg

SEQ ID NO: 847402 - DNA, 25 bp, Mus musculus
tttatccaccgccacgatgaggcct

SEQ ID NO: 847403 - DNA, 25 bp, Mus musculus
tttatccaccgcgacgatgaggcct

SEQ ID NO: 847404 - DNA, 25 bp, Mus musculus
tttatccagattcaaagttctagca

SEQ ID NO: 847405 - DNA, 25 bp, Mus musculus
tttatccagattgaaagttctagca

SEQ ID NO: 847406 - DNA, 25 bp, Mus musculus
tttatccagtgtacaggatgtcgag

SEQ ID NO: 847407 - DNA, 25 bp, Mus musculus
tttatccagtgttcaggatgtcgag

SEQ ID NO: 847408 - DNA, 25 bp, Mus musculus
tttatcccgcttcccaaccattgat

SEQ ID NO: 847409 - DNA, 25 bp, Mus musculus
tttatcccgcttgccaaccattgat

SEQ ID NO: 847410 - DNA, 25 bp, Mus musculus
tttatccctagaagcagctagctac

SEQ ID NO: 847411 - DNA, 25 bp, Mus musculus
tttatccctagatgcagctagctac

SEQ ID NO: 847412 - DNA, 25 bp, Mus musculus
tttatccctttaccaagttgagaca

SEQ ID NO: 847413 - DNA, 25 bp, Mus musculus
tttatccctttagcaagttgagaca

SEQ ID NO: 847414 - DNA, 25 bp, Mus musculus
tttatcctatgcaccagcagcgatg

SEQ ID NO: 847415 - DNA, 25 bp, Mus musculus
tttatcctatgctccagcagcgatg

SEQ ID NO: 847416 - DNA, 25 bp, Mus musculus
tttatcgccatccttgctgctggag

SEQ ID NO: 847417 - DNA, 25 bp, Mus musculus
tttatcgccatcgttgctgctggag

SEQ ID NO: 847418 - DNA, 25 bp, Mus musculus
tttatcgctttgcacaaactaagcc

SEQ ID NO: 847419 - DNA, 25 bp, Mus musculus
tttatcgctttggacaaactaagcc

SEQ ID NO: 847420 - DNA, 25 bp, Mus musculus
tttatcggaggccaaaacttgcaca

SEQ ID NO: 847421 - DNA, 25 bp, Mus musculus
tttatcggaggcgaaaacttgcaca

SEQ ID NO: 847422 - DNA, 25 bp, Mus musculus
tttatcggcaggcaaactcagtgcg

SEQ ID NO: 847423 - DNA, 25 bp, Mus musculus
tttatcggcagggaaactcagtgcg

SEQ ID NO: 847424 - DNA, 25 bp, Mus musculus
tttatcgtgccaacagttgtcaaag

SEQ ID NO: 847425 - DNA, 25 bp, Mus musculus
tttatcgtgccatcagttgtcaaag

SEQ ID NO: 847426 - DNA, 25 bp, Mus musculus
tttatctacgctcgaaggaccccga

SEQ ID NO: 847427 - DNA, 25 bp, Mus musculus
tttatctacgctggaaggaccccga

SEQ ID NO: 847428 - DNA, 25 bp, Mus musculus
tttatctcaagacagggataggtgg

SEQ ID NO: 847429 - DNA, 25 bp, Mus musculus
tttatctcaagagagggataggtgg

SEQ ID NO: 847430 - DNA, 25 bp, Mus musculus
tttatctcaagtctcaactgaactg

SEQ ID NO: 847431 - DNA, 25 bp, Mus musculus
tttatctcaagtgtcaactgaactg

SEQ ID NO: 847432 - DNA, 25 bp, Mus musculus
tttatctgcacgataaagacagact

SEQ ID NO: 847433 - DNA, 25 bp, Mus musculus
tttatctgcacgttaaagacagact

SEQ ID NO: 847434 - DNA, 25 bp, Mus musculus
tttatctgcgaaccactcccgaaat

SEQ ID NO: 847435 - DNA, 25 bp, Mus musculus
tttatctgcgaagcactcccgaaat

SEQ ID NO: 847436 - DNA, 25 bp, Mus musculus
tttatctgggctcgctggaagtcac

SEQ ID NO: 847437 - DNA, 25 bp, Mus musculus
tttatctgggctggctggaagtcac

SEQ ID NO: 847438 - DNA, 25 bp, Mus musculus
tttatctgtataagggcacatacgc

SEQ ID NO: 847439 - DNA, 25 bp, Mus musculus
tttatctgtatatgggcacatacgc

SEQ ID NO: 847440 - DNA, 25 bp, Mus musculus
tttatcttagttcgctcatccacta

SEQ ID NO: 847441 - DNA, 25 bp, Mus musculus
tttatcttagttggctcatccacta

SEQ ID NO: 847442 - DNA, 25 bp, Mus musculus
tttatcttgtgactgctcgggctgc

SEQ ID NO: 847443 - DNA, 25 bp, Mus musculus
tttatcttgtgagtgctcgggctgc

SEQ ID NO: 847444 - DNA, 25 bp, Mus musculus
tttatctttcggcatggagacgtcc

SEQ ID NO: 847445 - DNA, 25 bp, Mus musculus
tttatctttcgggatggagacgtcc

SEQ ID NO: 847446 - DNA, 25 bp, Mus musculus
tttatgaagggacgatgtaaacttg

SEQ ID NO: 847447 - DNA, 25 bp, Mus musculus
tttatgaagggaggatgtaaacttg

SEQ ID NO: 847448 - DNA, 25 bp, Mus musculus
tttatgagggccagcagttccggtc

SEQ ID NO: 847449 - DNA, 25 bp, Mus musculus
tttatgagggcctgcagttccggtc

SEQ ID NO: 847450 - DNA, 25 bp, Mus musculus
tttatgcagaatcgctcctgtgagg

SEQ ID NO: 847451 - DNA, 25 bp, Mus musculus
tttatgcagaatggctcctgtgagg

SEQ ID NO: 847452 - DNA, 25 bp, Mus musculus
tttatgcatggcctatgtcgcgaag

SEQ ID NO: 847453 - DNA, 25 bp, Mus musculus
tttatgcatggcgtatgtcgcgaag

SEQ ID NO: 847454 - DNA, 25 bp, Mus musculus
tttatgctctacattacgagcgcca

SEQ ID NO: 847455 - DNA, 25 bp, Mus musculus
tttatgctctactttacgagcgcca

SEQ ID NO: 847456 - DNA, 25 bp, Mus musculus
tttatgctgccaaagtaactcgccc

SEQ ID NO: 847457 - DNA, 25 bp, Mus musculus
tttatgctgccatagtaactcgccc

SEQ ID NO: 847458 - DNA, 25 bp, Mus musculus
tttatgctgtgaccccactatcctg

SEQ ID NO: 847459 - DNA, 25 bp, Mus musculus
tttatgctgtgagcccactatcctg

SEQ ID NO: 847460 - DNA, 25 bp, Mus musculus
tttatggaagatcagtaccacactt

SEQ ID NO: 847461 - DNA, 25 bp, Mus musculus
tttatggaagatgagtaccacactt

SEQ ID NO: 847462 - DNA, 25 bp, Mus musculus
tttatggagtgaatctggaacctcc

SEQ ID NO: 847463 - DNA, 25 bp, Mus musculus
tttatggagtgattctggaacctcc

SEQ ID NO: 847464 - DNA, 25 bp, Mus musculus
tttatgggacctccgtaatctgaaa

SEQ ID NO: 847465 - DNA, 25 bp, Mus musculus
tttatgggacctgcgtaatctgaaa

SEQ ID NO: 847466 - DNA, 25 bp, Mus musculus
tttatggtaacccagctctctgttt

SEQ ID NO: 847467 - DNA, 25 bp, Mus musculus
tttatggtaaccgagctctctgttt

SEQ ID NO: 847468 - DNA, 25 bp, Mus musculus
tttatggtctccaatgcctgaacat

SEQ ID NO: 847469 - DNA, 25 bp, Mus musculus
tttatggtctcctatgcctgaacat

SEQ ID NO: 847470 - DNA, 25 bp, Mus musculus
tttatggtgtggctgcaggtttctt

SEQ ID NO: 847471 - DNA, 25 bp, Mus musculus
tttatggtgtgggtgcaggtttctt

SEQ ID NO: 847472 - DNA, 25 bp, Mus musculus
tttatgtacagtcgatccaaacttc

SEQ ID NO: 847473 - DNA, 25 bp, Mus musculus
tttatgtacagtggatccaaacttc

SEQ ID NO: 847474 - DNA, 25 bp, Mus musculus
tttatgtaccgccagcgcaatggca

SEQ ID NO: 847475 - DNA, 25 bp, Mus musculus
tttatgtaccgcgagcgcaatggca

SEQ ID NO: 847476 - DNA, 25 bp, Mus musculus
tttatgtcaggaaactggcccccga

SEQ ID NO: 847477 - DNA, 25 bp, Mus musculus
tttatgtcaggatactggcccccga

SEQ ID NO: 847478 - DNA, 25 bp, Mus musculus
tttatgtccactatctcccagaagg

SEQ ID NO: 847479 - DNA, 25 bp, Mus musculus
tttatgtccactttctcccagaagg

SEQ ID NO: 847480 - DNA, 25 bp, Mus musculus
tttatgtccagaaaagagcccaggc

SEQ ID NO: 847481 - DNA, 25 bp, Mus musculus
tttatgtccagataagagcccaggc

SEQ ID NO: 847482 - DNA, 25 bp, Mus musculus
tttatgtccaggagtcctgcacagc

SEQ ID NO: 847483 - DNA, 25 bp, Mus musculus
tttatgtccaggtgtcctgcacagc

SEQ ID NO: 847484 - DNA, 25 bp, Mus musculus
tttatgtcgggtcgcggtgtctccc

SEQ ID NO: 847485 - DNA, 25 bp, Mus musculus
tttatgtcgggtggcggtgtctccc

SEQ ID NO: 847486 - DNA, 25 bp, Mus musculus
tttatgtgaatcagtcctttgcccc

SEQ ID NO: 847487 - DNA, 25 bp, Mus musculus
tttatgtgaatctgtcctttgcccc

SEQ ID NO: 847488 - DNA, 25 bp, Mus musculus
tttatgtgccaaaccccaaagtgca

SEQ ID NO: 847489 - DNA, 25 bp, Mus musculus
tttatgtgccaatccccaaagtgca

SEQ ID NO: 847490 - DNA, 25 bp, Mus musculus
tttattaagtgcagaacaaaaggct

SEQ ID NO: 847491 - DNA, 25 bp, Mus musculus
tttattaagtgctgaacaaaaggct

SEQ ID NO: 847492 - DNA, 25 bp, Mus musculus
tttattaataaaacgcgcatgggca

SEQ ID NO: 847493 - DNA, 25 bp, Mus musculus
tttattaataaatcgcgcatgggca

SEQ ID NO: 847494 - DNA, 25 bp, Mus musculus
tttattacaccacagccattgaata

SEQ ID NO: 847495 - DNA, 25 bp, Mus musculus
tttattacaccagagccattgaata

SEQ ID NO: 847496 - DNA, 25 bp, Mus musculus
tttattacttgaaggccaacctggc

SEQ ID NO: 847497 - DNA, 25 bp, Mus musculus
tttattacttgatggccaacctggc

SEQ ID NO: 847498 - DNA, 25 bp, Mus musculus
tttattcaagttcccaggaatcttg

SEQ ID NO: 847499 - DNA, 25 bp, Mus musculus
tttattcaagttgccaggaatcttg

SEQ ID NO: 847500 - DNA, 25 bp, Mus musculus
tttattcacatcagacacagtgggc

SEQ ID NO: 847501 - DNA, 25 bp, Mus musculus
tttattcacatctgacacagtgggc

SEQ ID NO: 847502 - DNA, 25 bp, Mus musculus
tttattcatcatcagcgccaatgaa

SEQ ID NO: 847503 - DNA, 25 bp, Mus musculus
tttattcatcatgagcgccaatgaa

SEQ ID NO: 847504 - DNA, 25 bp, Mus musculus
tttattctgcaactctgatcgaaac

SEQ ID NO: 847505 - DNA, 25 bp, Mus musculus
tttattctgcaagtctgatcgaaac

SEQ ID NO: 847506 - DNA, 25 bp, Mus musculus
tttattgaaacgacttgaagctgtg

SEQ ID NO: 847507 - DNA, 25 bp, Mus musculus
tttattgaaacgtcttgaagctgtg

SEQ ID NO: 847508 - DNA, 25 bp, Mus musculus
tttattgaaactcgccaggatggtg

SEQ ID NO: 847509 - DNA, 25 bp, Mus musculus
tttattgaaactggccaggatggtg

SEQ ID NO: 847510 - DNA, 25 bp, Mus musculus
tttattgaatacatctacaagccag

SEQ ID NO: 847511 - DNA, 25 bp, Mus musculus
tttattgaatacttctacaagccag

SEQ ID NO: 847512 - DNA, 25 bp, Mus musculus
tttattgcaaggcaaatccttagga

SEQ ID NO: 847513 - DNA, 25 bp, Mus musculus
tttattgcaagggaaatccttagga

SEQ ID NO: 847514 - DNA, 25 bp, Mus musculus
tttattgctgatcaaatacagacag

SEQ ID NO: 847515 - DNA, 25 bp, Mus musculus
tttattgctgatgaaatacagacag

SEQ ID NO: 847516 - DNA, 25 bp, Mus musculus
tttattggaatacgaaacagtgacc

SEQ ID NO: 847517 - DNA, 25 bp, Mus musculus
tttattggaataggaaacagtgacc

SEQ ID NO: 847518 - DNA, 25 bp, Mus musculus
tttattgggaggaggctgtacagaa

SEQ ID NO: 847519 - DNA, 25 bp, Mus musculus
tttattgggaggtggctgtacagaa

SEQ ID NO: 847520 - DNA, 25 bp, Mus musculus
tttatttatggacacactgccagtg

SEQ ID NO: 847521 - DNA, 25 bp, Mus musculus
tttatttatggagacactgccagtg

SEQ ID NO: 847522 - DNA, 25 bp, Mus musculus
tttatttccaagacacagcccttgg

SEQ ID NO: 847523 - DNA, 25 bp, Mus musculus
tttatttccaagtcacagcccttgg

SEQ ID NO: 847524 - DNA, 25 bp, Mus musculus
tttatttgaagaccaggaagttctc

SEQ ID NO: 847525 - DNA, 25 bp, Mus musculus
tttatttgaagagcaggaagttctc

SEQ ID NO: 847526 - DNA, 25 bp, Mus musculus
tttatttgaattctggtggcgaagc

SEQ ID NO: 847527 - DNA, 25 bp, Mus musculus
tttatttgaattgtggtggcgaagc

SEQ ID NO: 847528 - DNA, 25 bp, Mus musculus
tttatttgtgcactagggcaggtgc

SEQ ID NO: 847529 - DNA, 25 bp, Mus musculus
tttatttgtgcagtagggcaggtgc

SEQ ID NO: 847530 - DNA, 25 bp, Mus musculus
tttattttaggtccttacagacaca

SEQ ID NO: 847531 - DNA, 25 bp, Mus musculus
tttattttaggtgcttacagacaca

SEQ ID NO: 847532 - DNA, 25 bp, Mus musculus
tttcaaacaaatcgcaagaatcggt

SEQ ID NO: 847533 - DNA, 25 bp, Mus musculus
tttcaaacaaatggcaagaatcggt

SEQ ID NO: 847534 - DNA, 25 bp, Mus musculus
tttcaaacctttctgggccaggaat

SEQ ID NO: 847535 - DNA, 25 bp, Mus musculus
tttcaaacctttgtgggccaggaat

SEQ ID NO: 847536 - DNA, 25 bp, Mus musculus
tttcaaagaaagacggacttagacg

SEQ ID NO: 847537 - DNA, 25 bp, Mus musculus
tttcaaagaaagtcggacttagacg

SEQ ID NO: 847538 - DNA, 25 bp, Mus musculus
tttcaaaggaagacactgatcagga

SEQ ID NO: 847539 - DNA, 25 bp, Mus musculus
tttcaaaggaagtcactgatcagga

SEQ ID NO: 847540 - DNA, 25 bp, Mus musculus
tttcaaaggcatccaggctcgagtc

SEQ ID NO: 847541 - DNA, 25 bp, Mus musculus
tttcaaaggcatgcaggctcgagtc

SEQ ID NO: 847542 - DNA, 25 bp, Mus musculus
tttcaaaggctgcacaactccctga

SEQ ID NO: 847543 - DNA, 25 bp, Mus musculus
tttcaaaggctggacaactccctga

SEQ ID NO: 847544 - DNA, 25 bp, Mus musculus
tttcaaagggagcttcgttactcac

SEQ ID NO: 847545 - DNA, 25 bp, Mus musculus
tttcaaagggaggttcgttactcac

SEQ ID NO: 847546 - DNA, 25 bp, Mus musculus
tttcaaaggtcccaggaaaatgtct

SEQ ID NO: 847547 - DNA, 25 bp, Mus musculus
tttcaaaggtccgaggaaaatgtct

SEQ ID NO: 847548 - DNA, 25 bp, Mus musculus
tttcaaagtgtcagaggccagcaag

SEQ ID NO: 847549 - DNA, 25 bp, Mus musculus
tttcaaagtgtctgaggccagcaag

SEQ ID NO: 847550 - DNA, 25 bp, Mus musculus
tttcaaagttccagtgtttgcacag

SEQ ID NO: 847551 - DNA, 25 bp, Mus musculus
tttcaaagttcctgtgtttgcacag

SEQ ID NO: 847552 - DNA, 25 bp, Mus musculus
tttcaaatgggcagttactccctga

SEQ ID NO: 847553 - DNA, 25 bp, Mus musculus
tttcaaatgggctgttactccctga

SEQ ID NO: 847554 - DNA, 25 bp, Mus musculus
tttcaacaacagcaaggttaccggg

SEQ ID NO: 847555 - DNA, 25 bp, Mus musculus
tttcaacaacaggaaggttaccggg

SEQ ID NO: 847556 - DNA, 25 bp, Mus musculus
tttcaacaagatccacacatgtacc

SEQ ID NO: 847557 - DNA, 25 bp, Mus musculus
tttcaacaagatgcacacatgtacc

SEQ ID NO: 847558 - DNA, 25 bp, Mus musculus
tttcaacaggaaccatcacagtgac

SEQ ID NO: 847559 - DNA, 25 bp, Mus musculus
tttcaacaggaagcatcacagtgac

SEQ ID NO: 847560 - DNA, 25 bp, Mus musculus
tttcaacagttgaccactcgcctgt

SEQ ID NO: 847561 - DNA, 25 bp, Mus musculus
tttcaacagttgtccactcgcctgt

SEQ ID NO: 847562 - DNA, 25 bp, Mus musculus
tttcaacatcttcgacattgaaggg

SEQ ID NO: 847563 - DNA, 25 bp, Mus musculus
tttcaacatcttggacattgaaggg

SEQ ID NO: 847564 - DNA, 25 bp, Mus musculus
tttcaacattgcagtgataatcccc

SEQ ID NO: 847565 - DNA, 25 bp, Mus musculus
tttcaacattgctgtgataatcccc

SEQ ID NO: 847566 - DNA, 25 bp, Mus musculus
tttcaaccgtgcatggatcagaggg

SEQ ID NO: 847567 - DNA, 25 bp, Mus musculus
tttcaaccgtgcttggatcagaggg

SEQ ID NO: 847568 - DNA, 25 bp, Mus musculus
tttcaacctaagagccgctgagcag

SEQ ID NO: 847569 - DNA, 25 bp, Mus musculus
tttcaacctaagtgccgctgagcag

SEQ ID NO: 847570 - DNA, 25 bp, Mus musculus
tttcaacctatgcagaacaacgaga

SEQ ID NO: 847571 - DNA, 25 bp, Mus musculus
tttcaacctatggagaacaacgaga

SEQ ID NO: 847572 - DNA, 25 bp, Mus musculus
tttcaaccttgtccgccggttggcg

SEQ ID NO: 847573 - DNA, 25 bp, Mus musculus
tttcaaccttgtgcgccggttggcg

SEQ ID NO: 847574 - DNA, 25 bp, Mus musculus
tttcaactgcacatacccgccagaa

SEQ ID NO: 847575 - DNA, 25 bp, Mus musculus
tttcaactgcacttacccgccagaa

SEQ ID NO: 847576 - DNA, 25 bp, Mus musculus
tttcaactgcgcacaaggcgtccaa

SEQ ID NO: 847577 - DNA, 25 bp, Mus musculus
tttcaactgcgctcaaggcgtccaa

SEQ ID NO: 847578 - DNA, 25 bp, Mus musculus
tttcaactttgacaaggagactgtg

SEQ ID NO: 847579 - DNA, 25 bp, Mus musculus
tttcaactttgagaaggagactgtg

SEQ ID NO: 847580 - DNA, 25 bp, Mus musculus
tttcaagaaaagaccatgagattgg

SEQ ID NO: 847581 - DNA, 25 bp, Mus musculus
tttcaagaaaagtccatgagattgg

SEQ ID NO: 847582 - DNA, 25 bp, Mus musculus
tttcaagaaactaccgagtcctctc

SEQ ID NO: 847583 - DNA, 25 bp, Mus musculus
tttcaagaaacttccgagtcctctc

SEQ ID NO: 847584 - DNA, 25 bp, Mus musculus
tttcaagaaagcaggatggaccata

SEQ ID NO: 847585 - DNA, 25 bp, Mus musculus
tttcaagaaagcatctatgtgcgtc

SEQ ID NO: 847586 - DNA, 25 bp, Mus musculus
tttcaagaaagctggatggaccata

SEQ ID NO: 847587 - DNA, 25 bp, Mus musculus
tttcaagaaagcttctatgtgcgtc

SEQ ID NO: 847588 - DNA, 25 bp, Mus musculus
tttcaagacatgcagtgtgtgccct

SEQ ID NO: 847589 - DNA, 25 bp, Mus musculus
tttcaagacatggagtgtgtgccct

SEQ ID NO: 847590 - DNA, 25 bp, Mus musculus
tttcaagcacagaagtgaaagtgaa

SEQ ID NO: 847591 - DNA, 25 bp, Mus musculus
tttcaagcacagtagtgaaagtgaa

SEQ ID NO: 847592 - DNA, 25 bp, Mus musculus
tttcaagcagaaagtaacagatgtc

SEQ ID NO: 847593 - DNA, 25 bp, Mus musculus
tttcaagcagaatgtaacagatgtc

SEQ ID NO: 847594 - DNA, 25 bp, Mus musculus
tttcaagcagccagcagaaaatgtt

SEQ ID NO: 847595 - DNA, 25 bp, Mus musculus
tttcaagcagcctgcagaaaatgtt

SEQ ID NO: 847596 - DNA, 25 bp, Mus musculus
tttcaagctcttccattagaatctc

SEQ ID NO: 847597 - DNA, 25 bp, Mus musculus
tttcaagctcttgcattagaatctc

SEQ ID NO: 847598 - DNA, 25 bp, Mus musculus
tttcaagctgttcaaagagggccac

SEQ ID NO: 847599 - DNA, 25 bp, Mus musculus
tttcaagctgttgaaagagggccac

SEQ ID NO: 847600 - DNA, 25 bp, Mus musculus
tttcaaggagatatactcacagttc

SEQ ID NO: 847601 - DNA, 25 bp, Mus musculus
tttcaaggagatttactcacagttc

SEQ ID NO: 847602 - DNA, 25 bp, Mus musculus
tttcaaggattgcaccggtgtcagc

SEQ ID NO: 847603 - DNA, 25 bp, Mus musculus
tttcaaggattggaccggtgtcagc

SEQ ID NO: 847604 - DNA, 25 bp, Mus musculus
tttcaagtgcccaatgtcacctatg

SEQ ID NO: 847605 - DNA, 25 bp, Mus musculus
tttcaagtgccctatgtcacctatg

SEQ ID NO: 847606 - DNA, 25 bp, Mus musculus
tttcaagtgtctcctctcagcgagg

SEQ ID NO: 847607 - DNA, 25 bp, Mus musculus
tttcaagtgtctgctctcagcgagg

SEQ ID NO: 847608 - DNA, 25 bp, Mus musculus
tttcaataacgtcggaactgccatc

SEQ ID NO: 847609 - DNA, 25 bp, Mus musculus
tttcaataacgtgggaactgccatc

SEQ ID NO: 847610 - DNA, 25 bp, Mus musculus
tttcaatatccgacaacaacaagac

SEQ ID NO: 847611 - DNA, 25 bp, Mus musculus
tttcaatatccgtcaacaacaagac

SEQ ID NO: 847612 - DNA, 25 bp, Mus musculus
tttcaatctgaccacaggaccagcc

SEQ ID NO: 847613 - DNA, 25 bp, Mus musculus
tttcaatctgacgacaggaccagcc

SEQ ID NO: 847614 - DNA, 25 bp, Mus musculus
tttcaatctgatactgcagtgttgc

SEQ ID NO: 847615 - DNA, 25 bp, Mus musculus
tttcaatctgattctgcagtgttgc

SEQ ID NO: 847616 - DNA, 25 bp, Mus musculus
tttcaatgtggacacagtagagtac

SEQ ID NO: 847617 - DNA, 25 bp, Mus musculus
tttcaatgtggagacagtagagtac

SEQ ID NO: 847618 - DNA, 25 bp, Mus musculus
tttcaattagaacgtggaagctgta

SEQ ID NO: 847619 - DNA, 25 bp, Mus musculus
tttcaattagaaggtggaagctgta

SEQ ID NO: 847620 - DNA, 25 bp, Mus musculus
tttcaattcatacccgagatagccc

SEQ ID NO: 847621 - DNA, 25 bp, Mus musculus
tttcaattcatagccgagatagccc

SEQ ID NO: 847622 - DNA, 25 bp, Mus musculus
tttcaatttgggagccctgtccgca

SEQ ID NO: 847623 - DNA, 25 bp, Mus musculus
tttcaatttgggtgccctgtccgca

SEQ ID NO: 847624 - DNA, 25 bp, Mus musculus
tttcaattttggaagcgcgcacaga

SEQ ID NO: 847625 - DNA, 25 bp, Mus musculus
tttcaattttggtagcgcgcacaga

SEQ ID NO: 847626 - DNA, 25 bp, Mus musculus
tttcacaaaagccactccactgtct

SEQ ID NO: 847627 - DNA, 25 bp, Mus musculus
tttcacaaaagcgactccactgtct

SEQ ID NO: 847628 - DNA, 25 bp, Mus musculus
tttcacaaacccagcatttcactgc

SEQ ID NO: 847629 - DNA, 25 bp, Mus musculus
tttcacaaaccctgcatttcactgc

SEQ ID NO: 847630 - DNA, 25 bp, Mus musculus
tttcacaaggcccagcagtggctgg

SEQ ID NO: 847631 - DNA, 25 bp, Mus musculus
tttcacaaggccgagcagtggctgg

SEQ ID NO: 847632 - DNA, 25 bp, Mus musculus
tttcacacaaagacggcggagctca

SEQ ID NO: 847633 - DNA, 25 bp, Mus musculus
tttcacacaaagtcggcggagctca

SEQ ID NO: 847634 - DNA, 25 bp, Mus musculus
tttcacaccctgctgatcaaagtgg

SEQ ID NO: 847635 - DNA, 25 bp, Mus musculus
tttcacaccctggtgatcaaagtgg

SEQ ID NO: 847636 - DNA, 25 bp, Mus musculus
tttcacacgatgatactcattcacg

SEQ ID NO: 847637 - DNA, 25 bp, Mus musculus
tttcacacgatgttactcattcacg

SEQ ID NO: 847638 - DNA, 25 bp, Mus musculus
tttcacagcagacaccagcgaggac

SEQ ID NO: 847639 - DNA, 25 bp, Mus musculus
tttcacagcagagaccagcgaggac

SEQ ID NO: 847640 - DNA, 25 bp, Mus musculus
tttcacagtctaagccgaaccgaac

SEQ ID NO: 847641 - DNA, 25 bp, Mus musculus
tttcacagtctatgccgaaccgaac

SEQ ID NO: 847642 - DNA, 25 bp, Mus musculus
tttcacatcccaagacctgtaagcc

SEQ ID NO: 847643 - DNA, 25 bp, Mus musculus
tttcacatcccatgacctgtaagcc

SEQ ID NO: 847644 - DNA, 25 bp, Mus musculus
tttcaccaacctcgtctactttggc

SEQ ID NO: 847645 - DNA, 25 bp, Mus musculus
tttcaccaacctggtctactttggc

SEQ ID NO: 847646 - DNA, 25 bp, Mus musculus
tttcaccaccatcggaactggagtc

SEQ ID NO: 847647 - DNA, 25 bp, Mus musculus
tttcaccaccatgggaactggagtc

SEQ ID NO: 847648 - DNA, 25 bp, Mus musculus
tttcaccatgaacgacaggcacaca

SEQ ID NO: 847649 - DNA, 25 bp, Mus musculus
tttcaccatgaaggacaggcacaca

SEQ ID NO: 847650 - DNA, 25 bp, Mus musculus
tttcaccatgcacggactgccagat

SEQ ID NO: 847651 - DNA, 25 bp, Mus musculus
tttcaccatgcagggactgccagat

SEQ ID NO: 847652 - DNA, 25 bp, Mus musculus
tttcacccaacacaacagatcctgg

SEQ ID NO: 847653 - DNA, 25 bp, Mus musculus
tttcacccaacagaacagatcctgg

SEQ ID NO: 847654 - DNA, 25 bp, Mus musculus
tttcacccaatacggcaaggcatct

SEQ ID NO: 847655 - DNA, 25 bp, Mus musculus
tttcacccaatagggcaaggcatct

SEQ ID NO: 847656 - DNA, 25 bp, Mus musculus
tttcacccactgcttcggagctggc

SEQ ID NO: 847657 - DNA, 25 bp, Mus musculus
tttcacccactggttcggagctggc

SEQ ID NO: 847658 - DNA, 25 bp, Mus musculus
tttcacccctccaggcacctgaagc

SEQ ID NO: 847659 - DNA, 25 bp, Mus musculus
tttcacccctcctggcacctgaagc

SEQ ID NO: 847660 - DNA, 25 bp, Mus musculus
tttcaccctgtaagagttctggcag

SEQ ID NO: 847661 - DNA, 25 bp, Mus musculus
tttcaccctgtatgagttctggcag

SEQ ID NO: 847662 - DNA, 25 bp, Mus musculus
tttcaccgagtcacgactgcttcag

SEQ ID NO: 847663 - DNA, 25 bp, Mus musculus
tttcaccgagtctcgactgcttcag

SEQ ID NO: 847664 - DNA, 25 bp, Mus musculus
tttcaccggaggcaaaagtccacag

SEQ ID NO: 847665 - DNA, 25 bp, Mus musculus
tttcaccggagggaaaagtccacag

SEQ ID NO: 847666 - DNA, 25 bp, Mus musculus
tttcaccggtacaattcctgtgatg

SEQ ID NO: 847667 - DNA, 25 bp, Mus musculus
tttcaccggtactattcctgtgatg

SEQ ID NO: 847668 - DNA, 25 bp, Mus musculus
tttcaccgttacactgtgcgggcca

SEQ ID NO: 847669 - DNA, 25 bp, Mus musculus
tttcaccgttactctgtgcgggcca

SEQ ID NO: 847670 - DNA, 25 bp, Mus musculus
tttcacctatctcgataagcgtagc

SEQ ID NO: 847671 - DNA, 25 bp, Mus musculus
tttcacctatctggataagcgtagc

SEQ ID NO: 847672 - DNA, 25 bp, Mus musculus
tttcacctgacgcaaggttgatcgt

SEQ ID NO: 847673 - DNA, 25 bp, Mus musculus
tttcacctgacggaaggttgatcgt

SEQ ID NO: 847674 - DNA, 25 bp, Mus musculus
tttcacctgtttcgacggcacagcc

SEQ ID NO: 847675 - DNA, 25 bp, Mus musculus
tttcacctgtttggacggcacagcc

SEQ ID NO: 847676 - DNA, 25 bp, Mus musculus
tttcacgggccaatgagtttactca

SEQ ID NO: 847677 - DNA, 25 bp, Mus musculus
tttcacgggccattgagtttactca

SEQ ID NO: 847678 - DNA, 25 bp, Mus musculus
tttcacgttgaactctcacctcctg

SEQ ID NO: 847679 - DNA, 25 bp, Mus musculus
tttcacgttgaagtctcacctcctg

SEQ ID NO: 847680 - DNA, 25 bp, Mus musculus
tttcactccttacgccttgggcggg

SEQ ID NO: 847681 - DNA, 25 bp, Mus musculus
tttcactccttaggccttgggcggg

SEQ ID NO: 847682 - DNA, 25 bp, Mus musculus
tttcactctcggaccacctcggtgt

SEQ ID NO: 847683 - DNA, 25 bp, Mus musculus
tttcactctcggtccacctcggtgt

SEQ ID NO: 847684 - DNA, 25 bp, Mus musculus
tttcactctggtcgatacggccagg

SEQ ID NO: 847685 - DNA, 25 bp, Mus musculus
tttcactctggtggatacggccagg

SEQ ID NO: 847686 - DNA, 25 bp, Mus musculus
tttcactgacctatgagccactctt

SEQ ID NO: 847687 - DNA, 25 bp, Mus musculus
tttcactgacctccaagaacagggt

SEQ ID NO: 847688 - DNA, 25 bp, Mus musculus
tttcactgacctgcaagaacagggt

SEQ ID NO: 847689 - DNA, 25 bp, Mus musculus
tttcactgacctttgagccactctt

SEQ ID NO: 847690 - DNA, 25 bp, Mus musculus
tttcactgatgcaaatcagcagtgt

SEQ ID NO: 847691 - DNA, 25 bp, Mus musculus
tttcactgatgctaatcagcagtgt

SEQ ID NO: 847692 - DNA, 25 bp, Mus musculus
tttcactgcaccaacactgggtaca

SEQ ID NO: 847693 - DNA, 25 bp, Mus musculus
tttcactgcacctacactgggtaca

SEQ ID NO: 847694 - DNA, 25 bp, Mus musculus
tttcactgggcacaaacacactggt

SEQ ID NO: 847695 - DNA, 25 bp, Mus musculus
tttcactgggcagaaacacactggt

SEQ ID NO: 847696 - DNA, 25 bp, Mus musculus
tttcactggtaaattgctgtaggac

SEQ ID NO: 847697 - DNA, 25 bp, Mus musculus
tttcactggtaatttgctgtaggac

SEQ ID NO: 847698 - DNA, 25 bp, Mus musculus
tttcacttgatgcatgatactgtca

SEQ ID NO: 847699 - DNA, 25 bp, Mus musculus
tttcacttgatggatgatactgtca

SEQ ID NO: 847700 - DNA, 25 bp, Mus musculus
tttcagaacgacaggaccgaggacg

SEQ ID NO: 847701 - DNA, 25 bp, Mus musculus
tttcagaacgactggaccgaggacg

SEQ ID NO: 847702 - DNA, 25 bp, Mus musculus
tttcagaagacaccacgctgacctg

SEQ ID NO: 847703 - DNA, 25 bp, Mus musculus
tttcagaagacagcacgctgacctg

SEQ ID NO: 847704 - DNA, 25 bp, Mus musculus
tttcagaatttccagaggcagtttg

SEQ ID NO: 847705 - DNA, 25 bp, Mus musculus
tttcagaatttcgagaggcagtttg

SEQ ID NO: 847706 - DNA, 25 bp, Mus musculus
tttcagacaatgagcttcagcaagc

SEQ ID NO: 847707 - DNA, 25 bp, Mus musculus
tttcagacaatgtgcttcagcaagc

SEQ ID NO: 847708 - DNA, 25 bp, Mus musculus
tttcagacctctaccggctttgtag

SEQ ID NO: 847709 - DNA, 25 bp, Mus musculus
tttcagacctcttccggctttgtag

SEQ ID NO: 847710 - DNA, 25 bp, Mus musculus
tttcagacctgacccggagcagtcg

SEQ ID NO: 847711 - DNA, 25 bp, Mus musculus
tttcagacctgagccggagcagtcg

SEQ ID NO: 847712 - DNA, 25 bp, Mus musculus
tttcagacgacactgggagcatgga

SEQ ID NO: 847713 - DNA, 25 bp, Mus musculus
tttcagacgacagtgggagcatgga

SEQ ID NO: 847714 - DNA, 25 bp, Mus musculus
tttcagacggcgcaggacgtcctag

SEQ ID NO: 847715 - DNA, 25 bp, Mus musculus
tttcagacggcggaggacgtcctag

SEQ ID NO: 847716 - DNA, 25 bp, Mus musculus
tttcagacttctacctccttcagtg

SEQ ID NO: 847717 - DNA, 25 bp, Mus musculus
tttcagacttcttcctccttcagtg

SEQ ID NO: 847718 - DNA, 25 bp, Mus musculus
tttcagagaaacctgtgaaattgct

SEQ ID NO: 847719 - DNA, 25 bp, Mus musculus
tttcagagaaacgtgtgaaattgct

SEQ ID NO: 847720 - DNA, 25 bp, Mus musculus
tttcagagggccaactgctcacaca

SEQ ID NO: 847721 - DNA, 25 bp, Mus musculus
tttcagagggcctactgctcacaca

SEQ ID NO: 847722 - DNA, 25 bp, Mus musculus
tttcagaggtgaaaagagccgggaa

SEQ ID NO: 847723 - DNA, 25 bp, Mus musculus
tttcagaggtgataagagccgggaa

SEQ ID NO: 847724 - DNA, 25 bp, Mus musculus
tttcagagtgcaaccattgggtggc

SEQ ID NO: 847725 - DNA, 25 bp, Mus musculus
tttcagagtgcatccattgggtggc

SEQ ID NO: 847726 - DNA, 25 bp, Mus musculus
tttcagatagaacctttgcccagtt

SEQ ID NO: 847727 - DNA, 25 bp, Mus musculus
tttcagatagaagctttgcccagtt

SEQ ID NO: 847728 - DNA, 25 bp, Mus musculus
tttcagatctgaaactcaacggacc

SEQ ID NO: 847729 - DNA, 25 bp, Mus musculus
tttcagatctgatactcaacggacc

SEQ ID NO: 847730 - DNA, 25 bp, Mus musculus
tttcagcagaagacgctgcgcatgt

SEQ ID NO: 847731 - DNA, 25 bp, Mus musculus
tttcagcagaagtcgctgcgcatgt

SEQ ID NO: 847732 - DNA, 25 bp, Mus musculus
tttcagcagagcaactggcacaccg

SEQ ID NO: 847733 - DNA, 25 bp, Mus musculus
tttcagcagagctactggcacaccg

SEQ ID NO: 847734 - DNA, 25 bp, Mus musculus
tttcagcagcaacccagccaggagg

SEQ ID NO: 847735 - DNA, 25 bp, Mus musculus
tttcagcagcaagccagccaggagg

SEQ ID NO: 847736 - DNA, 25 bp, Mus musculus
tttcagcagtgaccttaagaagctg

SEQ ID NO: 847737 - DNA, 25 bp, Mus musculus
tttcagcagtgagcttaagaagctg

SEQ ID NO: 847738 - DNA, 25 bp, Mus musculus
tttcagccaccaaggaaacagccat

SEQ ID NO: 847739 - DNA, 25 bp, Mus musculus
tttcagccaccatggaaacagccat

SEQ ID NO: 847740 - DNA, 25 bp, Mus musculus
tttcagccagatcggcgagcccagc

SEQ ID NO: 847741 - DNA, 25 bp, Mus musculus
tttcagccagatgggcgagcccagc

SEQ ID NO: 847742 - DNA, 25 bp, Mus musculus
tttcagccatcaaaatctcacaaga

SEQ ID NO: 847743 - DNA, 25 bp, Mus musculus
tttcagccatcataatctcacaaga

SEQ ID NO: 847744 - DNA, 25 bp, Mus musculus
tttcagccatgcacagactgtggtt

SEQ ID NO: 847745 - DNA, 25 bp, Mus musculus
tttcagccatgctcagactgtggtt

SEQ ID NO: 847746 - DNA, 25 bp, Mus musculus
tttcagccgcaaagaccccattggg

SEQ ID NO: 847747 - DNA, 25 bp, Mus musculus
tttcagccgcaatgaccccattggg

SEQ ID NO: 847748 - DNA, 25 bp, Mus musculus
tttcagccggctaccaaacactggg

SEQ ID NO: 847749 - DNA, 25 bp, Mus musculus
tttcagccggcttccaaacactggg

SEQ ID NO: 847750 - DNA, 25 bp, Mus musculus
tttcagccgggacccttttgtggtc

SEQ ID NO: 847751 - DNA, 25 bp, Mus musculus
tttcagccgggagccttttgtggtc

SEQ ID NO: 847752 - DNA, 25 bp, Mus musculus
tttcagcctcaactggtcttggtgg

SEQ ID NO: 847753 - DNA, 25 bp, Mus musculus
tttcagcctcaagtggtcttggtgg

SEQ ID NO: 847754 - DNA, 25 bp, Mus musculus
tttcagcctctgcagtccgtgccaa

SEQ ID NO: 847755 - DNA, 25 bp, Mus musculus
tttcagcctctggagtccgtgccaa

SEQ ID NO: 847756 - DNA, 25 bp, Mus musculus
tttcagcctcttaagcccagccagg

SEQ ID NO: 847757 - DNA, 25 bp, Mus musculus
tttcagcctctttagcccagccagg

SEQ ID NO: 847758 - DNA, 25 bp, Mus musculus
tttcagcctgaaacatctgccccgg

SEQ ID NO: 847759 - DNA, 25 bp, Mus musculus
tttcagcctgaatcatctgccccgg

SEQ ID NO: 847760 - DNA, 25 bp, Mus musculus
tttcagccttaaccagccacctgag

SEQ ID NO: 847761 - DNA, 25 bp, Mus musculus
tttcagccttaagcagccacctgag

SEQ ID NO: 847762 - DNA, 25 bp, Mus musculus
tttcagcgagcaagtcctacacaag

SEQ ID NO: 847763 - DNA, 25 bp, Mus musculus
tttcagcgagcatgtcctacacaag

SEQ ID NO: 847764 - DNA, 25 bp, Mus musculus
tttcagcgctggacaaatacaaagc

SEQ ID NO: 847765 - DNA, 25 bp, Mus musculus
tttcagcgctggtcaaatacaaagc

SEQ ID NO: 847766 - DNA, 25 bp, Mus musculus
tttcagctccccacaaaaacagaag

SEQ ID NO: 847767 - DNA, 25 bp, Mus musculus
tttcagctcccctcaaaaacagaag

SEQ ID NO: 847768 - DNA, 25 bp, Mus musculus
tttcagctccctcactttctgaaag

SEQ ID NO: 847769 - DNA, 25 bp, Mus musculus
tttcagctccctgactttctgaaag

SEQ ID NO: 847770 - DNA, 25 bp, Mus musculus
tttcagcttattcaactgtgtacgg

SEQ ID NO: 847771 - DNA, 25 bp, Mus musculus
tttcagcttattgaactgtgtacgg

SEQ ID NO: 847772 - DNA, 25 bp, Mus musculus
tttcagcttttaacccgcgcgggag

SEQ ID NO: 847773 - DNA, 25 bp, Mus musculus
tttcagcttttatcccgcgcgggag

SEQ ID NO: 847774 - DNA, 25 bp, Mus musculus
tttcagcttttcaggactgttgtcc

SEQ ID NO: 847775 - DNA, 25 bp, Mus musculus
tttcagcttttctggactgttgtcc

SEQ ID NO: 847776 - DNA, 25 bp, Mus musculus
tttcaggataagctaaacctctacc

SEQ ID NO: 847777 - DNA, 25 bp, Mus musculus
tttcaggataaggtaaacctctacc

SEQ ID NO: 847778 - DNA, 25 bp, Mus musculus
tttcaggccatccatgagccaccag

SEQ ID NO: 847779 - DNA, 25 bp, Mus musculus
tttcaggccatcgatgagccaccag

SEQ ID NO: 847780 - DNA, 25 bp, Mus musculus
tttcaggcggtaacttgggcatatg

SEQ ID NO: 847781 - DNA, 25 bp, Mus musculus
tttcaggcggtatcttgggcatatg

SEQ ID NO: 847782 - DNA, 25 bp, Mus musculus
tttcagggaagacccaagtcctgtt

SEQ ID NO: 847783 - DNA, 25 bp, Mus musculus
tttcagggaagagccaagtcctgtt

SEQ ID NO: 847784 - DNA, 25 bp, Mus musculus
tttcaggtcagactttcttccgggc

SEQ ID NO: 847785 - DNA, 25 bp, Mus musculus
tttcaggtcagagtttcttccgggc

SEQ ID NO: 847786 - DNA, 25 bp, Mus musculus
tttcaggtgactaggatgaccagac

SEQ ID NO: 847787 - DNA, 25 bp, Mus musculus
tttcaggtgacttggatgaccagac

SEQ ID NO: 847788 - DNA, 25 bp, Mus musculus
tttcaggtgtcactggccctggcca

SEQ ID NO: 847789 - DNA, 25 bp, Mus musculus
tttcaggtgtcagtggccctggcca

SEQ ID NO: 847790 - DNA, 25 bp, Mus musculus
tttcaggttcaacaagttttgctcc

SEQ ID NO: 847791 - DNA, 25 bp, Mus musculus
tttcaggttcaagaagttttgctcc

SEQ ID NO: 847792 - DNA, 25 bp, Mus musculus
tttcagtcacccctacgctgggaca

SEQ ID NO: 847793 - DNA, 25 bp, Mus musculus
tttcagtcacccgtacgctgggaca

SEQ ID NO: 847794 - DNA, 25 bp, Mus musculus
tttcagtcctaacggttgccgcgcg

SEQ ID NO: 847795 - DNA, 25 bp, Mus musculus
tttcagtcctaagggttgccgcgcg

SEQ ID NO: 847796 - DNA, 25 bp, Mus musculus
tttcagtgctctatgggtgctcccc

SEQ ID NO: 847797 - DNA, 25 bp, Mus musculus
tttcagtgctctttgggtgctcccc

SEQ ID NO: 847798 - DNA, 25 bp, Mus musculus
tttcagtggcctccaagttattcca

SEQ ID NO: 847799 - DNA, 25 bp, Mus musculus
tttcagtggcctgcaagttattcca

SEQ ID NO: 847800 - DNA, 25 bp, Mus musculus
tttcagttacctagacgatgtccca

SEQ ID NO: 847801 - DNA, 25 bp, Mus musculus
tttcagttaccttgacgatgtccca

SEQ ID NO: 847802 - DNA, 25 bp, Mus musculus
tttcagttgataagtgaacatagac

SEQ ID NO: 847803 - DNA, 25 bp, Mus musculus
tttcagttgatatgtgaacatagac

SEQ ID NO: 847804 - DNA, 25 bp, Mus musculus
tttcagtttcatatccgcggaccct

SEQ ID NO: 847805 - DNA, 25 bp, Mus musculus
tttcagtttcatttccgcggaccct

SEQ ID NO: 847806 - DNA, 25 bp, Mus musculus
tttcataaagcccaccacaggtata

SEQ ID NO: 847807 - DNA, 25 bp, Mus musculus
tttcataaagccgaccacaggtata

SEQ ID NO: 847808 - DNA, 25 bp, Mus musculus
tttcataaggatcctctgaagcccc

SEQ ID NO: 847809 - DNA, 25 bp, Mus musculus
tttcataaggatgctctgaagcccc

SEQ ID NO: 847810 - DNA, 25 bp, Mus musculus
tttcatagcaaaattaccatagtgc

SEQ ID NO: 847811 - DNA, 25 bp, Mus musculus
tttcatagcaaatttaccatagtgc

SEQ ID NO: 847812 - DNA, 25 bp, Mus musculus
tttcatagcagaccccagtgacggt

SEQ ID NO: 847813 - DNA, 25 bp, Mus musculus
tttcatagcagagcccagtgacggt

SEQ ID NO: 847814 - DNA, 25 bp, Mus musculus
tttcataggcgtcgctgagaaggcc

SEQ ID NO: 847815 - DNA, 25 bp, Mus musculus
tttcataggcgtggctgagaaggcc

SEQ ID NO: 847816 - DNA, 25 bp, Mus musculus
tttcatcacagaatagccctgaagc

SEQ ID NO: 847817 - DNA, 25 bp, Mus musculus
tttcatcacagattagccctgaagc

SEQ ID NO: 847818 - DNA, 25 bp, Mus musculus
tttcatcacatgcatcctcatccag

SEQ ID NO: 847819 - DNA, 25 bp, Mus musculus
tttcatcacatggatcctcatccag

SEQ ID NO: 847820 - DNA, 25 bp, Mus musculus
tttcatcacccgcaagtcactgatc

SEQ ID NO: 847821 - DNA, 25 bp, Mus musculus
tttcatcacccggaagtcactgatc

SEQ ID NO: 847822 - DNA, 25 bp, Mus musculus
tttcatcagatacaagggccaggag

SEQ ID NO: 847823 - DNA, 25 bp, Mus musculus
tttcatcagatagaagggccaggag

SEQ ID NO: 847824 - DNA, 25 bp, Mus musculus
tttcatcataaaatgcaagtagcac

SEQ ID NO: 847825 - DNA, 25 bp, Mus musculus
tttcatcataaattgcaagtagcac

SEQ ID NO: 847826 - DNA, 25 bp, Mus musculus
tttcatccaaaaagagataagggct

SEQ ID NO: 847827 - DNA, 25 bp, Mus musculus
tttcatccaaaatgagataagggct

SEQ ID NO: 847828 - DNA, 25 bp, Mus musculus
tttcatccaggaccacctagtgtca

SEQ ID NO: 847829 - DNA, 25 bp, Mus musculus
tttcatccaggagcacctagtgtca

SEQ ID NO: 847830 - DNA, 25 bp, Mus musculus
tttcatccatacacccggacaagca

SEQ ID NO: 847831 - DNA, 25 bp, Mus musculus
tttcatccatactcccggacaagca

SEQ ID NO: 847832 - DNA, 25 bp, Mus musculus
tttcatcccaggagctaggtcaggg

SEQ ID NO: 847833 - DNA, 25 bp, Mus musculus
tttcatcccaggtgctaggtcaggg

SEQ ID NO: 847834 - DNA, 25 bp, Mus musculus
tttcatcccctgacctatgaaggtg

SEQ ID NO: 847835 - DNA, 25 bp, Mus musculus
tttcatcccctgtcctatgaaggtg

SEQ ID NO: 847836 - DNA, 25 bp, Mus musculus
tttcatcctagacgcaaatccagat

SEQ ID NO: 847837 - DNA, 25 bp, Mus musculus
tttcatcctagaggcaaatccagat

SEQ ID NO: 847838 - DNA, 25 bp, Mus musculus
tttcatcgctgaccttgtggtggga

SEQ ID NO: 847839 - DNA, 25 bp, Mus musculus
tttcatcgctgagcttgtggtggga

SEQ ID NO: 847840 - DNA, 25 bp, Mus musculus
tttcatcgtgctatgtgctgctaca

SEQ ID NO: 847841 - DNA, 25 bp, Mus musculus
tttcatcgtgctttgtgctgctaca

SEQ ID NO: 847842 - DNA, 25 bp, Mus musculus
tttcatctacaactggcagcgtctc

SEQ ID NO: 847843 - DNA, 25 bp, Mus musculus
tttcatctacaagtggcagcgtctc

SEQ ID NO: 847844 - DNA, 25 bp, Mus musculus
tttcatctgcttcgttttctaccga

SEQ ID NO: 847845 - DNA, 25 bp, Mus musculus
tttcatctgcttggttttctaccga

SEQ ID NO: 847846 - DNA, 25 bp, Mus musculus
tttcatcttccacagccaaccgagg

SEQ ID NO: 847847 - DNA, 25 bp, Mus musculus
tttcatcttccagagccaaccgagg

SEQ ID NO: 847848 - DNA, 25 bp, Mus musculus
tttcatgccctaatggttaacccaa

SEQ ID NO: 847849 - DNA, 25 bp, Mus musculus
tttcatgccctattggttaacccaa

SEQ ID NO: 847850 - DNA, 25 bp, Mus musculus
tttcatgctgtgcagagcaagggca

SEQ ID NO: 847851 - DNA, 25 bp, Mus musculus
tttcatgctgtggagagcaagggca

SEQ ID NO: 847852 - DNA, 25 bp, Mus musculus
tttcatggacctacggtatgtgtgg

SEQ ID NO: 847853 - DNA, 25 bp, Mus musculus
tttcatggaccttcggtatgtgtgg

SEQ ID NO: 847854 - DNA, 25 bp, Mus musculus
tttcatggactaaggacgataagcc

SEQ ID NO: 847855 - DNA, 25 bp, Mus musculus
tttcatggactatggacgataagcc

SEQ ID NO: 847856 - DNA, 25 bp, Mus musculus
tttcatggcatacgcctgacgggcc

SEQ ID NO: 847857 - DNA, 25 bp, Mus musculus
tttcatggcataggcctgacgggcc

SEQ ID NO: 847858 - DNA, 25 bp, Mus musculus
tttcatggctctacttgtggctccc

SEQ ID NO: 847859 - DNA, 25 bp, Mus musculus
tttcatggctcttcttgtggctccc

SEQ ID NO: 847860 - DNA, 25 bp, Mus musculus
tttcatgtccttaccctgtgtgccc

SEQ ID NO: 847861 - DNA, 25 bp, Mus musculus
tttcatgtcctttccctgtgtgccc

SEQ ID NO: 847862 - DNA, 25 bp, Mus musculus
tttcattcagaacgatggaagtctc

SEQ ID NO: 847863 - DNA, 25 bp, Mus musculus
tttcattcagaaggatggaagtctc

SEQ ID NO: 847864 - DNA, 25 bp, Mus musculus
tttcattcccggatggtgtgtggca

SEQ ID NO: 847865 - DNA, 25 bp, Mus musculus
tttcattcccggttggtgtgtggca

SEQ ID NO: 847866 - DNA, 25 bp, Mus musculus
tttcattgaacaagaagccaatgag

SEQ ID NO: 847867 - DNA, 25 bp, Mus musculus
tttcattgaacatgaagccaatgag

SEQ ID NO: 847868 - DNA, 25 bp, Mus musculus
tttcattgcacacccggctcagctg

SEQ ID NO: 847869 - DNA, 25 bp, Mus musculus
tttcattgcacagccggctcagctg

SEQ ID NO: 847870 - DNA, 25 bp, Mus musculus
tttcattgttgcagagtcctcttgt

SEQ ID NO: 847871 - DNA, 25 bp, Mus musculus
tttcattgttgctgagtcctcttgt

SEQ ID NO: 847872 - DNA, 25 bp, Mus musculus
tttcatttacaacttggaaaacgag

SEQ ID NO: 847873 - DNA, 25 bp, Mus musculus
tttcatttacaagttggaaaacgag

SEQ ID NO: 847874 - DNA, 25 bp, Mus musculus
tttcatttatgaagggaagacggga

SEQ ID NO: 847875 - DNA, 25 bp, Mus musculus
tttcatttatgatgggaagacggga

SEQ ID NO: 847876 - DNA, 25 bp, Mus musculus
tttcatttcttcctgcaccagtgcc

SEQ ID NO: 847877 - DNA, 25 bp, Mus musculus
tttcatttcttcgtgcaccagtgcc

SEQ ID NO: 847878 - DNA, 25 bp, Mus musculus
tttccaaaacaaccaggcacttacg

SEQ ID NO: 847879 - DNA, 25 bp, Mus musculus
tttccaaaacaagcaggcacttacg

SEQ ID NO: 847880 - DNA, 25 bp, Mus musculus
tttccaaaagtcatggaaatgacag

SEQ ID NO: 847881 - DNA, 25 bp, Mus musculus
tttccaaaagtcttggaaatgacag

SEQ ID NO: 847882 - DNA, 25 bp, Mus musculus
tttccaaaatggctacggattttgc

SEQ ID NO: 847883 - DNA, 25 bp, Mus musculus
tttccaaaatgggtacggattttgc

SEQ ID NO: 847884 - DNA, 25 bp, Mus musculus
tttccaaagaaacagcagagcgatg

SEQ ID NO: 847885 - DNA, 25 bp, Mus musculus
tttccaaagaaagagcagagcgatg

SEQ ID NO: 847886 - DNA, 25 bp, Mus musculus
tttccaaagataatgggcccaacaa

SEQ ID NO: 847887 - DNA, 25 bp, Mus musculus
tttccaaagatattgggcccaacaa

SEQ ID NO: 847888 - DNA, 25 bp, Mus musculus
tttccaaagtatagcaccaatgaag

SEQ ID NO: 847889 - DNA, 25 bp, Mus musculus
tttccaaagtattgcaccaatgaag

SEQ ID NO: 847890 - DNA, 25 bp, Mus musculus
tttccaacaaccatatggcagatca

SEQ ID NO: 847891 - DNA, 25 bp, Mus musculus
tttccaacaaccttatggcagatca

SEQ ID NO: 847892 - DNA, 25 bp, Mus musculus
tttccaacagcgcagccacagtggt

SEQ ID NO: 847893 - DNA, 25 bp, Mus musculus
tttccaacagcggagccacagtggt

SEQ ID NO: 847894 - DNA, 25 bp, Mus musculus
tttccaactttgcatatagaggtcg

SEQ ID NO: 847895 - DNA, 25 bp, Mus musculus
tttccaactttggatatagaggtcg

SEQ ID NO: 847896 - DNA, 25 bp, Mus musculus
tttccaagatgacaaggcactaagg

SEQ ID NO: 847897 - DNA, 25 bp, Mus musculus
tttccaagatgagaaggcactaagg

SEQ ID NO: 847898 - DNA, 25 bp, Mus musculus
tttccaagcagaatacggactttcc

SEQ ID NO: 847899 - DNA, 25 bp, Mus musculus
tttccaagcagattacggactttcc

SEQ ID NO: 847900 - DNA, 25 bp, Mus musculus
tttccaaggatcaacggtagcgtag

SEQ ID NO: 847901 - DNA, 25 bp, Mus musculus
tttccaaggatctacggtagcgtag

SEQ ID NO: 847902 - DNA, 25 bp, Mus musculus
tttccaaggatgagatgaagagcac

SEQ ID NO: 847903 - DNA, 25 bp, Mus musculus
tttccaaggatgtgatgaagagcac

SEQ ID NO: 847904 - DNA, 25 bp, Mus musculus
tttccaaggcgaacagctgaaaaac

SEQ ID NO: 847905 - DNA, 25 bp, Mus musculus
tttccaaggcgatcagctgaaaaac

SEQ ID NO: 847906 - DNA, 25 bp, Mus musculus
tttccaatcgaaccctggagcctca

SEQ ID NO: 847907 - DNA, 25 bp, Mus musculus
tttccaatcgaagcctggagcctca

SEQ ID NO: 847908 - DNA, 25 bp, Mus musculus
tttccaatctggcttacctcagcct

SEQ ID NO: 847909 - DNA, 25 bp, Mus musculus
tttccaatctgggttacctcagcct

SEQ ID NO: 847910 - DNA, 25 bp, Mus musculus
tttccacactggacacactgctttt

SEQ ID NO: 847911 - DNA, 25 bp, Mus musculus
tttccacactggtcacactgctttt

SEQ ID NO: 847912 - DNA, 25 bp, Mus musculus
tttccacagtggagcacaacttcaa

SEQ ID NO: 847913 - DNA, 25 bp, Mus musculus
tttccacagtggtgcacaacttcaa

SEQ ID NO: 847914 - DNA, 25 bp, Mus musculus
tttccaccagatctgatcacgagca

SEQ ID NO: 847915 - DNA, 25 bp, Mus musculus
tttccaccagatgtgatcacgagca

SEQ ID NO: 847916 - DNA, 25 bp, Mus musculus
tttccaccagcacaaaccgaagcag

SEQ ID NO: 847917 - DNA, 25 bp, Mus musculus
tttccaccagcagaaaccgaagcag

SEQ ID NO: 847918 - DNA, 25 bp, Mus musculus
tttccacccaacctgtgcctttgtg

SEQ ID NO: 847919 - DNA, 25 bp, Mus musculus
tttccacccaacgtgtgcctttgtg

SEQ ID NO: 847920 - DNA, 25 bp, Mus musculus
tttccacccattcagaggacgcaga

SEQ ID NO: 847921 - DNA, 25 bp, Mus musculus
tttccacccattgagaggacgcaga

SEQ ID NO: 847922 - DNA, 25 bp, Mus musculus
tttccacctttgatgtgcccatctt

SEQ ID NO: 847923 - DNA, 25 bp, Mus musculus
tttccacctttgttgtgcccatctt

SEQ ID NO: 847924 - DNA, 25 bp, Mus musculus
tttccacggttacctcgcgacctgg

SEQ ID NO: 847925 - DNA, 25 bp, Mus musculus
tttccacggttagctcgcgacctgg

SEQ ID NO: 847926 - DNA, 25 bp, Mus musculus
tttccacgtaccaggtgatactcac

SEQ ID NO: 847927 - DNA, 25 bp, Mus musculus
tttccacgtacctggtgatactcac

SEQ ID NO: 847928 - DNA, 25 bp, Mus musculus
tttccactgcatctctcgatggctc

SEQ ID NO: 847929 - DNA, 25 bp, Mus musculus
tttccactgcatgtctcgatggctc

SEQ ID NO: 847930 - DNA, 25 bp, Mus musculus
tttccagaaaggaccccactagagg

SEQ ID NO: 847931 - DNA, 25 bp, Mus musculus
tttccagaaaggtccccactagagg

SEQ ID NO: 847932 - DNA, 25 bp, Mus musculus
tttccagagagacgcggcatttctc

SEQ ID NO: 847933 - DNA, 25 bp, Mus musculus
tttccagagagaggcggcatttctc

SEQ ID NO: 847934 - DNA, 25 bp, Mus musculus
tttccagagctcaggaccaaaggat

SEQ ID NO: 847935 - DNA, 25 bp, Mus musculus
tttccagagctctggaccaaaggat

SEQ ID NO: 847936 - DNA, 25 bp, Mus musculus
tttccagagctgaggcatcaaaacc

SEQ ID NO: 847937 - DNA, 25 bp, Mus musculus
tttccagagctgtggcatcaaaacc

SEQ ID NO: 847938 - DNA, 25 bp, Mus musculus
tttccagaggagataaaagatagga

SEQ ID NO: 847939 - DNA, 25 bp, Mus musculus
tttccagaggagttaaaagatagga

SEQ ID NO: 847940 - DNA, 25 bp, Mus musculus
tttccagaggcgctgaggaacccgc

SEQ ID NO: 847941 - DNA, 25 bp, Mus musculus
tttccagaggcggtgaggaacccgc

SEQ ID NO: 847942 - DNA, 25 bp, Mus musculus
tttccagaggtcaacgtgcctaccg

SEQ ID NO: 847943 - DNA, 25 bp, Mus musculus
tttccagaggtctacgtgcctaccg

SEQ ID NO: 847944 - DNA, 25 bp, Mus musculus
tttccagatgaacagcttagtgatg

SEQ ID NO: 847945 - DNA, 25 bp, Mus musculus
tttccagatgaagagcttagtgatg

SEQ ID NO: 847946 - DNA, 25 bp, Mus musculus
tttccagatggaataaaaaggcccg

SEQ ID NO: 847947 - DNA, 25 bp, Mus musculus
tttccagatggattaaaaaggcccg

SEQ ID NO: 847948 - DNA, 25 bp, Mus musculus
tttccagcagctaaacaccaggctc

SEQ ID NO: 847949 - DNA, 25 bp, Mus musculus
tttccagcagcttaacaccaggctc

SEQ ID NO: 847950 - DNA, 25 bp, Mus musculus
tttccagccaagattgtggaggtcc

SEQ ID NO: 847951 - DNA, 25 bp, Mus musculus
tttccagccaagtttgtggaggtcc

SEQ ID NO: 847952 - DNA, 25 bp, Mus musculus
tttccagcccgaaccagttgatcag

SEQ ID NO: 847953 - DNA, 25 bp, Mus musculus
tttccagcccgatccagttgatcag

SEQ ID NO: 847954 - DNA, 25 bp, Mus musculus
tttccagcctctcaatgggtacccg

SEQ ID NO: 847955 - DNA, 25 bp, Mus musculus
tttccagcctctgaatgggtacccg

SEQ ID NO: 847956 - DNA, 25 bp, Mus musculus
tttccagcgtgtcgaaaaagtccac

SEQ ID NO: 847957 - DNA, 25 bp, Mus musculus
tttccagcgtgtggaaaaagtccac

SEQ ID NO: 847958 - DNA, 25 bp, Mus musculus
tttccagctgttagtgatctgctaa

SEQ ID NO: 847959 - DNA, 25 bp, Mus musculus
tttccagctgtttgtgatctgctaa

SEQ ID NO: 847960 - DNA, 25 bp, Mus musculus
tttccaggagttcgacattagcgga

SEQ ID NO: 847961 - DNA, 25 bp, Mus musculus
tttccaggagttggacattagcgga

SEQ ID NO: 847962 - DNA, 25 bp, Mus musculus
tttccaggattaccgaaagctgagc

SEQ ID NO: 847963 - DNA, 25 bp, Mus musculus
tttccaggattagcgaaagctgagc

SEQ ID NO: 847964 - DNA, 25 bp, Mus musculus
tttccaggcagtaatggagtcccca

SEQ ID NO: 847965 - DNA, 25 bp, Mus musculus
tttccaggcagtcagagggtgattc

SEQ ID NO: 847966 - DNA, 25 bp, Mus musculus
tttccaggcagtgagagggtgattc

SEQ ID NO: 847967 - DNA, 25 bp, Mus musculus
tttccaggcagttatggagtcccca

SEQ ID NO: 847968 - DNA, 25 bp, Mus musculus
tttccaggccaaccaatccacattg

SEQ ID NO: 847969 - DNA, 25 bp, Mus musculus
tttccaggccaagcaatccacattg

SEQ ID NO: 847970 - DNA, 25 bp, Mus musculus
tttccagggactcctgtgaagtgca

SEQ ID NO: 847971 - DNA, 25 bp, Mus musculus
tttccagggactgctgtgaagtgca

SEQ ID NO: 847972 - DNA, 25 bp, Mus musculus
tttccagggagcaagaatgagggcc

SEQ ID NO: 847973 - DNA, 25 bp, Mus musculus
tttccagggagctagaatgagggcc

SEQ ID NO: 847974 - DNA, 25 bp, Mus musculus
tttccagggatacgcgcgctcagcg

SEQ ID NO: 847975 - DNA, 25 bp, Mus musculus
tttccagggataggcgcgctcagcg

SEQ ID NO: 847976 - DNA, 25 bp, Mus musculus
tttccagggcagaacagcagcagag

SEQ ID NO: 847977 - DNA, 25 bp, Mus musculus
tttccagggcagtacagcagcagag

SEQ ID NO: 847978 - DNA, 25 bp, Mus musculus
tttccaggttagaatcagaattctc

SEQ ID NO: 847979 - DNA, 25 bp, Mus musculus
tttccaggttagtatcagaattctc

SEQ ID NO: 847980 - DNA, 25 bp, Mus musculus
tttccagtaaacaccgcggcctgct

SEQ ID NO: 847981 - DNA, 25 bp, Mus musculus
tttccagtaaactccgcggcctgct

SEQ ID NO: 847982 - DNA, 25 bp, Mus musculus
tttccagtaggactagtcgtcgcgt

SEQ ID NO: 847983 - DNA, 25 bp, Mus musculus
tttccagtaggagtagtcgtcgcgt

SEQ ID NO: 847984 - DNA, 25 bp, Mus musculus
tttccagtcggacccctagagtcgg

SEQ ID NO: 847985 - DNA, 25 bp, Mus musculus
tttccagtcggagccctagagtcgg

SEQ ID NO: 847986 - DNA, 25 bp, Mus musculus
tttccagtggccctctctattgggt

SEQ ID NO: 847987 - DNA, 25 bp, Mus musculus
tttccagtggccgtctctattgggt

SEQ ID NO: 847988 - DNA, 25 bp, Mus musculus
tttccagtgtgaaggacatgagccc

SEQ ID NO: 847989 - DNA, 25 bp, Mus musculus
tttccagtgtgatggacatgagccc

SEQ ID NO: 847990 - DNA, 25 bp, Mus musculus
tttccataatggcagatcctggtcc

SEQ ID NO: 847991 - DNA, 25 bp, Mus musculus
tttccataatgggagatcctggtcc

SEQ ID NO: 847992 - DNA, 25 bp, Mus musculus
tttccatacagaagtgtcgggaggc

SEQ ID NO: 847993 - DNA, 25 bp, Mus musculus
tttccatacagatgtgtcgggaggc

SEQ ID NO: 847994 - DNA, 25 bp, Mus musculus
tttccatccagtagaaggaagtgac

SEQ ID NO: 847995 - DNA, 25 bp, Mus musculus
tttccatccagttgaaggaagtgac

SEQ ID NO: 847996 - DNA, 25 bp, Mus musculus
tttccatccgcaacaggagccagct

SEQ ID NO: 847997 - DNA, 25 bp, Mus musculus
tttccatccgcatcaggagccagct

SEQ ID NO: 847998 - DNA, 25 bp, Mus musculus
tttccatcctgtaagaatctggcta

SEQ ID NO: 847999 - DNA, 25 bp, Mus musculus
tttccatcctgttagaatctggcta

SEQ ID NO: 848000 - DNA, 25 bp, Mus musculus
tttccatcgagcaaatgcattgaaa

SEQ ID NO: 848001 - DNA, 25 bp, Mus musculus
tttccatcgagctaatgcattgaaa

SEQ ID NO: 848002 - DNA, 25 bp, Mus musculus
tttccatcggccataagcagctgct

SEQ ID NO: 848003 - DNA, 25 bp, Mus musculus
tttccatcggccttaagcagctgct

SEQ ID NO: 848004 - DNA, 25 bp, Mus musculus
tttccatgaagtcggcgggtactcg

SEQ ID NO: 848005 - DNA, 25 bp, Mus musculus
tttccatgaagtgggcgggtactcg

SEQ ID NO: 848006 - DNA, 25 bp, Mus musculus
tttccatgagcaagtgcttggagcc

SEQ ID NO: 848007 - DNA, 25 bp, Mus musculus
tttccatgagcatgtgcttggagcc

SEQ ID NO: 848008 - DNA, 25 bp, Mus musculus
tttccatgaggtcatgctggccctt

SEQ ID NO: 848009 - DNA, 25 bp, Mus musculus
tttccatgaggtgatgctggccctt

SEQ ID NO: 848010 - DNA, 25 bp, Mus musculus
tttccatgccaaacgtcaccatcat

SEQ ID NO: 848011 - DNA, 25 bp, Mus musculus
tttccatgccaatcgtcaccatcat

SEQ ID NO: 848012 - DNA, 25 bp, Mus musculus
tttccatgcgcgctccttcggttca

SEQ ID NO: 848013 - DNA, 25 bp, Mus musculus
tttccatgcgcggtccttcggttca

SEQ ID NO: 848014 - DNA, 25 bp, Mus musculus
tttccatggagaagtgagggtactt

SEQ ID NO: 848015 - DNA, 25 bp, Mus musculus
tttccatggagatgtgagggtactt

SEQ ID NO: 848016 - DNA, 25 bp, Mus musculus
tttccatggtaaaaagctgaaactg

SEQ ID NO: 848017 - DNA, 25 bp, Mus musculus
tttccatggtaataagctgaaactg

SEQ ID NO: 848018 - DNA, 25 bp, Mus musculus
tttccatggtgtaatgggcaaagat

SEQ ID NO: 848019 - DNA, 25 bp, Mus musculus
tttccatggtgttatgggcaaagat

SEQ ID NO: 848020 - DNA, 25 bp, Mus musculus
tttcccaaaccaactgcctggaatg

SEQ ID NO: 848021 - DNA, 25 bp, Mus musculus
tttcccaaaccatctgcctggaatg

SEQ ID NO: 848022 - DNA, 25 bp, Mus musculus
tttcccaagaatcccgatggaactg

SEQ ID NO: 848023 - DNA, 25 bp, Mus musculus
tttcccaagaatgccgatggaactg

SEQ ID NO: 848024 - DNA, 25 bp, Mus musculus
tttcccaatgtacgtgctgtgaagg

SEQ ID NO: 848025 - DNA, 25 bp, Mus musculus
tttcccaatgtaggtgctgtgaagg

SEQ ID NO: 848026 - DNA, 25 bp, Mus musculus
tttcccacagacaggttccacctgg

SEQ ID NO: 848027 - DNA, 25 bp, Mus musculus
tttcccacagactggttccacctgg

SEQ ID NO: 848028 - DNA, 25 bp, Mus musculus
tttcccacagcaatgaagcatccag

SEQ ID NO: 848029 - DNA, 25 bp, Mus musculus
tttcccacagcattgaagcatccag

SEQ ID NO: 848030 - DNA, 25 bp, Mus musculus
tttcccacaggtacgaacctcagat

SEQ ID NO: 848031 - DNA, 25 bp, Mus musculus
tttcccacaggttcgaacctcagat

SEQ ID NO: 848032 - DNA, 25 bp, Mus musculus
tttcccaccgtgatactgcatgcgc

SEQ ID NO: 848033 - DNA, 25 bp, Mus musculus
tttcccaccgtgttactgcatgcgc

SEQ ID NO: 848034 - DNA, 25 bp, Mus musculus
tttcccagaaggatgagcactgctg

SEQ ID NO: 848035 - DNA, 25 bp, Mus musculus
tttcccagaaggttgagcactgctg

SEQ ID NO: 848036 - DNA, 25 bp, Mus musculus
tttcccagacctaggtggagccctg

SEQ ID NO: 848037 - DNA, 25 bp, Mus musculus
tttcccagaccttggtggagccctg

SEQ ID NO: 848038 - DNA, 25 bp, Mus musculus
tttcccagccgtcttccgaagaata

SEQ ID NO: 848039 - DNA, 25 bp, Mus musculus
tttcccagccgtgttccgaagaata

SEQ ID NO: 848040 - DNA, 25 bp, Mus musculus
tttcccaggaagctctgggtccact

SEQ ID NO: 848041 - DNA, 25 bp, Mus musculus
tttcccaggaaggtctgggtccact

SEQ ID NO: 848042 - DNA, 25 bp, Mus musculus
tttcccagtctgcagtaaagaccaa

SEQ ID NO: 848043 - DNA, 25 bp, Mus musculus
tttcccagtctggagtaaagaccaa

SEQ ID NO: 848044 - DNA, 25 bp, Mus musculus
tttcccagtggacccacagaggatg

SEQ ID NO: 848045 - DNA, 25 bp, Mus musculus
tttcccagtggagccacagaggatg

SEQ ID NO: 848046 - DNA, 25 bp, Mus musculus
tttcccagtttgcagaacgagcctc

SEQ ID NO: 848047 - DNA, 25 bp, Mus musculus
tttcccagtttggagaacgagcctc

SEQ ID NO: 848048 - DNA, 25 bp, Mus musculus
tttcccatagttcgtcagaaaacac

SEQ ID NO: 848049 - DNA, 25 bp, Mus musculus
tttcccatagttggtcagaaaacac

SEQ ID NO: 848050 - DNA, 25 bp, Mus musculus
tttcccatggagacctgaggcaagg

SEQ ID NO: 848051 - DNA, 25 bp, Mus musculus
tttcccatggagtcctgaggcaagg

SEQ ID NO: 848052 - DNA, 25 bp, Mus musculus
tttcccatgggcaccaatgttctgg

SEQ ID NO: 848053 - DNA, 25 bp, Mus musculus
tttcccatgggctccaatgttctgg

SEQ ID NO: 848054 - DNA, 25 bp, Mus musculus
tttccccaggccagagaaagctgtg

SEQ ID NO: 848055 - DNA, 25 bp, Mus musculus
tttccccaggcctgagaaagctgtg

SEQ ID NO: 848056 - DNA, 25 bp, Mus musculus
tttccccatcgacgtgcgacattat

SEQ ID NO: 848057 - DNA, 25 bp, Mus musculus
tttccccatcgaggtgcgacattat

SEQ ID NO: 848058 - DNA, 25 bp, Mus musculus
tttccccgacgcagggcatggcgag

SEQ ID NO: 848059 - DNA, 25 bp, Mus musculus
tttccccgacgctgggcatggcgag

SEQ ID NO: 848060 - DNA, 25 bp, Mus musculus
tttccccgtggtccagttctgtgcg

SEQ ID NO: 848061 - DNA, 25 bp, Mus musculus
tttccccgtggtgcagttctgtgcg

SEQ ID NO: 848062 - DNA, 25 bp, Mus musculus
tttcccctacgtacaagtcctgaag

SEQ ID NO: 848063 - DNA, 25 bp, Mus musculus
tttcccctacgttcaagtcctgaag

SEQ ID NO: 848064 - DNA, 25 bp, Mus musculus
tttcccctatgtaggtgaatatgac

SEQ ID NO: 848065 - DNA, 25 bp, Mus musculus
tttcccctatgttggtgaatatgac

SEQ ID NO: 848066 - DNA, 25 bp, Mus musculus
tttcccctatttcagaggagagacg

SEQ ID NO: 848067 - DNA, 25 bp, Mus musculus
tttcccctatttgagaggagagacg

SEQ ID NO: 848068 - DNA, 25 bp, Mus musculus
tttcccctctgacccggagcagatt

SEQ ID NO: 848069 - DNA, 25 bp, Mus musculus
tttcccctctgagccggagcagatt

SEQ ID NO: 848070 - DNA, 25 bp, Mus musculus
tttcccgaccagagactgactgcac

SEQ ID NO: 848071 - DNA, 25 bp, Mus musculus
tttcccgaccagtgactgactgcac

SEQ ID NO: 848072 - DNA, 25 bp, Mus musculus
tttcccgacgagaacttcacactga

SEQ ID NO: 848073 - DNA, 25 bp, Mus musculus
tttcccgacgagtacttcacactga

SEQ ID NO: 848074 - DNA, 25 bp, Mus musculus
tttcccgcgaggacaggtagggtca

SEQ ID NO: 848075 - DNA, 25 bp, Mus musculus
tttcccgcgaggtcaggtagggtca

SEQ ID NO: 848076 - DNA, 25 bp, Mus musculus
tttcccgctggcatgtatgaggcac

SEQ ID NO: 848077 - DNA, 25 bp, Mus musculus
tttcccgctggcttgtatgaggcac

SEQ ID NO: 848078 - DNA, 25 bp, Mus musculus
tttcccggagatagtgtggtcactg

SEQ ID NO: 848079 - DNA, 25 bp, Mus musculus
tttcccggagattgtgtggtcactg

SEQ ID NO: 848080 - DNA, 25 bp, Mus musculus
tttcccgggatacctgcaactcaag

SEQ ID NO: 848081 - DNA, 25 bp, Mus musculus
tttcccgggatagctgcaactcaag

SEQ ID NO: 848082 - DNA, 25 bp, Mus musculus
tttcccgtcccaagtagcaaggctg

SEQ ID NO: 848083 - DNA, 25 bp, Mus musculus
tttcccgtcccatgtagcaaggctg

SEQ ID NO: 848084 - DNA, 25 bp, Mus musculus
tttccctaaaagaactagtcctgct

SEQ ID NO: 848085 - DNA, 25 bp, Mus musculus
tttccctaaaagtactagtcctgct

SEQ ID NO: 848086 - DNA, 25 bp, Mus musculus
tttccctatctgagacctgtcttca

SEQ ID NO: 848087 - DNA, 25 bp, Mus musculus
tttccctatctgtgacctgtcttca

SEQ ID NO: 848088 - DNA, 25 bp, Mus musculus
tttccctcagggagttcgtgaatgc

SEQ ID NO: 848089 - DNA, 25 bp, Mus musculus
tttccctcagggtgttcgtgaatgc

SEQ ID NO: 848090 - DNA, 25 bp, Mus musculus
tttccctcatgcagcccatggatag

SEQ ID NO: 848091 - DNA, 25 bp, Mus musculus
tttccctcatgctgcccatggatag

SEQ ID NO: 848092 - DNA, 25 bp, Mus musculus
tttccctccgggagcgtgactcttc

SEQ ID NO: 848093 - DNA, 25 bp, Mus musculus
tttccctccgggtgcgtgactcttc

SEQ ID NO: 848094 - DNA, 25 bp, Mus musculus
tttccctcctgtcgcaggatccagt

SEQ ID NO: 848095 - DNA, 25 bp, Mus musculus
tttccctcctgtggcaggatccagt

SEQ ID NO: 848096 - DNA, 25 bp, Mus musculus
tttccctggaaacgaacagcgctcc

SEQ ID NO: 848097 - DNA, 25 bp, Mus musculus
tttccctggaaaggaacagcgctcc

SEQ ID NO: 848098 - DNA, 25 bp, Mus musculus
tttccctggataactaccagaccac

SEQ ID NO: 848099 - DNA, 25 bp, Mus musculus
tttccctggatatctaccagaccac

SEQ ID NO: 848100 - DNA, 25 bp, Mus musculus
tttccctggcagatgtggagaggaa

SEQ ID NO: 848101 - DNA, 25 bp, Mus musculus
tttccctggcagttgtggagaggaa

SEQ ID NO: 848102 - DNA, 25 bp, Mus musculus
tttcccttcaaacgtgtgggatgtg

SEQ ID NO: 848103 - DNA, 25 bp, Mus musculus
tttcccttcaaaggtgtgggatgtg

SEQ ID NO: 848104 - DNA, 25 bp, Mus musculus
tttcccttcaccatcgagggacgct

SEQ ID NO: 848105 - DNA, 25 bp, Mus musculus
tttcccttcaccttcgagggacgct

SEQ ID NO: 848106 - DNA, 25 bp, Mus musculus
tttcccttgactccgctggacaaac

SEQ ID NO: 848107 - DNA, 25 bp, Mus musculus
tttcccttgactgcgctggacaaac

SEQ ID NO: 848108 - DNA, 25 bp, Mus musculus
tttccctttaagagatccattgtag

SEQ ID NO: 848109 - DNA, 25 bp, Mus musculus
tttccctttaagtgatccattgtag

SEQ ID NO: 848110 - DNA, 25 bp, Mus musculus
tttcccttttcgcaggagctactgg

SEQ ID NO: 848111 - DNA, 25 bp, Mus musculus
tttcccttttcggaggagctactgg

SEQ ID NO: 848112 - DNA, 25 bp, Mus musculus
tttccgaacagaccgtcctgtcaac

SEQ ID NO: 848113 - DNA, 25 bp, Mus musculus
tttccgaacagagcgtcctgtcaac

SEQ ID NO: 848114 - DNA, 25 bp, Mus musculus
tttccgaagatgatgggctcagcaa

SEQ ID NO: 848115 - DNA, 25 bp, Mus musculus
tttccgaagatgttgggctcagcaa

SEQ ID NO: 848116 - DNA, 25 bp, Mus musculus
tttccgaaggctcaatgaactacag

SEQ ID NO: 848117 - DNA, 25 bp, Mus musculus
tttccgaaggctgaatgaactacag

SEQ ID NO: 848118 - DNA, 25 bp, Mus musculus
tttccgaccatcagctcaaagactg

SEQ ID NO: 848119 - DNA, 25 bp, Mus musculus
tttccgaccatctgctcaaagactg

SEQ ID NO: 848120 - DNA, 25 bp, Mus musculus
tttccgacgcgcatggagtgaacta

SEQ ID NO: 848121 - DNA, 25 bp, Mus musculus
tttccgacgcgcttggagtgaacta

SEQ ID NO: 848122 - DNA, 25 bp, Mus musculus
tttccgagactcatcactgtttgat

SEQ ID NO: 848123 - DNA, 25 bp, Mus musculus
tttccgagactcttcactgtttgat

SEQ ID NO: 848124 - DNA, 25 bp, Mus musculus
tttccgagagtcaggcgcactgact

SEQ ID NO: 848125 - DNA, 25 bp, Mus musculus
tttccgagagtctggcgcactgact

SEQ ID NO: 848126 - DNA, 25 bp, Mus musculus
tttccgagcagaaggtacctgcacc

SEQ ID NO: 848127 - DNA, 25 bp, Mus musculus
tttccgagcagatggtacctgcacc

SEQ ID NO: 848128 - DNA, 25 bp, Mus musculus
tttccgagcgagcactgcgtgacgt

SEQ ID NO: 848129 - DNA, 25 bp, Mus musculus
tttccgagcgaggactgcgtgacgt

SEQ ID NO: 848130 - DNA, 25 bp, Mus musculus
tttccgagcgttcgatcgagaggct

SEQ ID NO: 848131 - DNA, 25 bp, Mus musculus
tttccgagcgttggatcgagaggct

SEQ ID NO: 848132 - DNA, 25 bp, Mus musculus
tttccgagctccaggacaccagttt

SEQ ID NO: 848133 - DNA, 25 bp, Mus musculus
tttccgagctcctggacaccagttt

SEQ ID NO: 848134 - DNA, 25 bp, Mus musculus
tttccgaggctacagtatccctgag

SEQ ID NO: 848135 - DNA, 25 bp, Mus musculus
tttccgaggctagagtatccctgag

SEQ ID NO: 848136 - DNA, 25 bp, Mus musculus
tttccgaggtcgcacagcagacttt

SEQ ID NO: 848137 - DNA, 25 bp, Mus musculus
tttccgaggtcggacagcagacttt

SEQ ID NO: 848138 - DNA, 25 bp, Mus musculus
tttccgagtctgcaaaaccttcccg

SEQ ID NO: 848139 - DNA, 25 bp, Mus musculus
tttccgagtctggaaaaccttcccg

SEQ ID NO: 848140 - DNA, 25 bp, Mus musculus
tttccgatagatcgctgcaggccgc

SEQ ID NO: 848141 - DNA, 25 bp, Mus musculus
tttccgatagatggctgcaggccgc

SEQ ID NO: 848142 - DNA, 25 bp, Mus musculus
tttccgcagacgcagggatgctacc

SEQ ID NO: 848143 - DNA, 25 bp, Mus musculus
tttccgcagacggagggatgctacc

SEQ ID NO: 848144 - DNA, 25 bp, Mus musculus
tttccgcagtacagtattgccacca

SEQ ID NO: 848145 - DNA, 25 bp, Mus musculus
tttccgcagtactgtattgccacca

SEQ ID NO: 848146 - DNA, 25 bp, Mus musculus
tttccgcatattatggatctgggtc

SEQ ID NO: 848147 - DNA, 25 bp, Mus musculus
tttccgcatattttggatctgggtc

SEQ ID NO: 848148 - DNA, 25 bp, Mus musculus
tttccgccacctagacttgtctgac

SEQ ID NO: 848149 - DNA, 25 bp, Mus musculus
tttccgccaccttgacttgtctgac

SEQ ID NO: 848150 - DNA, 25 bp, Mus musculus
tttccgccagcacagagattgcagc

SEQ ID NO: 848151 - DNA, 25 bp, Mus musculus
tttccgccagcagagagattgcagc

SEQ ID NO: 848152 - DNA, 25 bp, Mus musculus
tttccgctacggaggccgcatgctg

SEQ ID NO: 848153 - DNA, 25 bp, Mus musculus
tttccgctacggtggccgcatgctg

SEQ ID NO: 848154 - DNA, 25 bp, Mus musculus
tttccgcttcccaccagggcggtgg

SEQ ID NO: 848155 - DNA, 25 bp, Mus musculus
tttccgcttccctccagggcggtgg

SEQ ID NO: 848156 - DNA, 25 bp, Mus musculus
tttccggagatcctccgcctctttg

SEQ ID NO: 848157 - DNA, 25 bp, Mus musculus
tttccggagatcgtccgcctctttg

SEQ ID NO: 848158 - DNA, 25 bp, Mus musculus
tttccggattctcgagcctcttcag

SEQ ID NO: 848159 - DNA, 25 bp, Mus musculus
tttccggattctggagcctcttcag

SEQ ID NO: 848160 - DNA, 25 bp, Mus musculus
tttccggcagcgaacgctgagccct

SEQ ID NO: 848161 - DNA, 25 bp, Mus musculus
tttccggcagcgtacgctgagccct

SEQ ID NO: 848162 - DNA, 25 bp, Mus musculus
tttccggcaggtactccatggtgat

SEQ ID NO: 848163 - DNA, 25 bp, Mus musculus
tttccggcaggttctccatggtgat

SEQ ID NO: 848164 - DNA, 25 bp, Mus musculus
tttccggcggtcagaacgaagatgc

SEQ ID NO: 848165 - DNA, 25 bp, Mus musculus
tttccggcggtctgaacgaagatgc

SEQ ID NO: 848166 - DNA, 25 bp, Mus musculus
tttccggctgatacgtcgagtgagg

SEQ ID NO: 848167 - DNA, 25 bp, Mus musculus
tttccggctgattcgtcgagtgagg

SEQ ID NO: 848168 - DNA, 25 bp, Mus musculus
tttccgggacacacaggcggcggcc

SEQ ID NO: 848169 - DNA, 25 bp, Mus musculus
tttccgggacactcaggcggcggcc

SEQ ID NO: 848170 - DNA, 25 bp, Mus musculus
tttccggggcttcctgatacccaag

SEQ ID NO: 848171 - DNA, 25 bp, Mus musculus
tttccggggcttgctgatacccaag

SEQ ID NO: 848172 - DNA, 25 bp, Mus musculus
tttccggttcggagcctacttggtg

SEQ ID NO: 848173 - DNA, 25 bp, Mus musculus
tttccggttcggtgcctacttggtg

SEQ ID NO: 848174 - DNA, 25 bp, Mus musculus
tttccgtcacataaacctcgtggag

SEQ ID NO: 848175 - DNA, 25 bp, Mus musculus
tttccgtcacattaacctcgtggag

SEQ ID NO: 848176 - DNA, 25 bp, Mus musculus
tttccgtgctgaccggcaagacaac

SEQ ID NO: 848177 - DNA, 25 bp, Mus musculus
tttccgtgctgagcggcaagacaac

SEQ ID NO: 848178 - DNA, 25 bp, Mus musculus
tttccgtggctcatgcagcagcagc

SEQ ID NO: 848179 - DNA, 25 bp, Mus musculus
tttccgtggctcttgcagcagcagc

SEQ ID NO: 848180 - DNA, 25 bp, Mus musculus
tttccgtggtatcagtaaccagccc

SEQ ID NO: 848181 - DNA, 25 bp, Mus musculus
tttccgtggtatgagtaaccagccc

SEQ ID NO: 848182 - DNA, 25 bp, Mus musculus
tttccgtgtgcaccaaggcaagggc

SEQ ID NO: 848183 - DNA, 25 bp, Mus musculus
tttccgtgtgcagcaaggcaagggc

SEQ ID NO: 848184 - DNA, 25 bp, Mus musculus
tttccgttcagacagaggccagttc

SEQ ID NO: 848185 - DNA, 25 bp, Mus musculus
tttccgttcagagagaggccagttc

SEQ ID NO: 848186 - DNA, 25 bp, Mus musculus
tttccgttcaggcaagaaggcggtc

SEQ ID NO: 848187 - DNA, 25 bp, Mus musculus
tttccgttcagggaagaaggcggtc

SEQ ID NO: 848188 - DNA, 25 bp, Mus musculus
tttcctaaaaatagtgggatatgct

SEQ ID NO: 848189 - DNA, 25 bp, Mus musculus
tttcctaaaaattgtgggatatgct

SEQ ID NO: 848190 - DNA, 25 bp, Mus musculus
tttcctacacaacaatgagctcctg

SEQ ID NO: 848191 - DNA, 25 bp, Mus musculus
tttcctacacaagaatgagctcctg

SEQ ID NO: 848192 - DNA, 25 bp, Mus musculus
tttcctacagtgagaggccatcgcg

SEQ ID NO: 848193 - DNA, 25 bp, Mus musculus
tttcctacagtgtgaggccatcgcg

SEQ ID NO: 848194 - DNA, 25 bp, Mus musculus
tttcctaccagtcagcgtggctcac

SEQ ID NO: 848195 - DNA, 25 bp, Mus musculus
tttcctaccagtgagcgtggctcac

SEQ ID NO: 848196 - DNA, 25 bp, Mus musculus
tttcctaccggacgttcaatctggc

SEQ ID NO: 848197 - DNA, 25 bp, Mus musculus
tttcctaccggaggttcaatctggc

SEQ ID NO: 848198 - DNA, 25 bp, Mus musculus
tttcctactctgaccaggctgaaag

SEQ ID NO: 848199 - DNA, 25 bp, Mus musculus
tttcctactctgtccaggctgaaag

SEQ ID NO: 848200 - DNA, 25 bp, Mus musculus
tttcctatagctaaaccggacagcc

SEQ ID NO: 848201 - DNA, 25 bp, Mus musculus
tttcctatagcttaaccggacagcc

SEQ ID NO: 848202 - DNA, 25 bp, Mus musculus
tttcctatgtgcaatcctgctctcc

SEQ ID NO: 848203 - DNA, 25 bp, Mus musculus
tttcctatgtgctatcctgctctcc

SEQ ID NO: 848204 - DNA, 25 bp, Mus musculus
tttcctccaggacaacgttccgcag

SEQ ID NO: 848205 - DNA, 25 bp, Mus musculus
tttcctccaggagaacgttccgcag

SEQ ID NO: 848206 - DNA, 25 bp, Mus musculus
tttcctcccagaagcagctgtagcc

SEQ ID NO: 848207 - DNA, 25 bp, Mus musculus
tttcctcccagatgcagctgtagcc

SEQ ID NO: 848208 - DNA, 25 bp, Mus musculus
tttcctctccgacgccaatgctgag

SEQ ID NO: 848209 - DNA, 25 bp, Mus musculus
tttcctctccgaggccaatgctgag

SEQ ID NO: 848210 - DNA, 25 bp, Mus musculus
tttcctctgtgaccacaggcagggc

SEQ ID NO: 848211 - DNA, 25 bp, Mus musculus
tttcctctgtgagcacaggcagggc

SEQ ID NO: 848212 - DNA, 25 bp, Mus musculus
tttcctcttcccagaactgtgccgg

SEQ ID NO: 848213 - DNA, 25 bp, Mus musculus
tttcctcttccctgaactgtgccgg

SEQ ID NO: 848214 - DNA, 25 bp, Mus musculus
tttcctctttgtccctaggactcag

SEQ ID NO: 848215 - DNA, 25 bp, Mus musculus
tttcctctttgtgcctaggactcag

SEQ ID NO: 848216 - DNA, 25 bp, Mus musculus
tttcctgaacatctatgagcctgac

SEQ ID NO: 848217 - DNA, 25 bp, Mus musculus
tttcctgaacatgtatgagcctgac

SEQ ID NO: 848218 - DNA, 25 bp, Mus musculus
tttcctgaccccaacgtcaagtacg

SEQ ID NO: 848219 - DNA, 25 bp, Mus musculus
tttcctgacccctacgtcaagtacg

SEQ ID NO: 848220 - DNA, 25 bp, Mus musculus
tttcctgagaaaaagaattagagcc

SEQ ID NO: 848221 - DNA, 25 bp, Mus musculus
tttcctgagaaatagaattagagcc

SEQ ID NO: 848222 - DNA, 25 bp, Mus musculus
tttcctgagagcagagcctcaaagg

SEQ ID NO: 848223 - DNA, 25 bp, Mus musculus
tttcctgagagctgagcctcaaagg

SEQ ID NO: 848224 - DNA, 25 bp, Mus musculus
tttcctgagcccaacgtggcagggt

SEQ ID NO: 848225 - DNA, 25 bp, Mus musculus
tttcctgagccctacgtggcagggt

SEQ ID NO: 848226 - DNA, 25 bp, Mus musculus
tttcctgagccgcacccagagtgtc

SEQ ID NO: 848227 - DNA, 25 bp, Mus musculus
tttcctgagccggacccagagtgtc

SEQ ID NO: 848228 - DNA, 25 bp, Mus musculus
tttcctgagtttccggatccccaca

SEQ ID NO: 848229 - DNA, 25 bp, Mus musculus
tttcctgagtttgcggatccccaca

SEQ ID NO: 848230 - DNA, 25 bp, Mus musculus
tttcctgatccaattcaaagacggg

SEQ ID NO: 848231 - DNA, 25 bp, Mus musculus
tttcctgatccatttcaaagacggg

SEQ ID NO: 848232 - DNA, 25 bp, Mus musculus
tttcctgatgaaccgtcgcagttgg

SEQ ID NO: 848233 - DNA, 25 bp, Mus musculus
tttcctgatgaagcgtcgcagttgg

SEQ ID NO: 848234 - DNA, 25 bp, Mus musculus
tttcctgattctcgcaatttcaatg

SEQ ID NO: 848235 - DNA, 25 bp, Mus musculus
tttcctgattctggcaatttcaatg

SEQ ID NO: 848236 - DNA, 25 bp, Mus musculus
tttcctgcagaacgcgatcccgggc

SEQ ID NO: 848237 - DNA, 25 bp, Mus musculus
tttcctgcagaaggcgatcccgggc

SEQ ID NO: 848238 - DNA, 25 bp, Mus musculus
tttcctgccactacggcagctctga

SEQ ID NO: 848239 - DNA, 25 bp, Mus musculus
tttcctgccacttcggcagctctga

SEQ ID NO: 848240 - DNA, 25 bp, Mus musculus
tttcctgccggcctgcatgctgtgg

SEQ ID NO: 848241 - DNA, 25 bp, Mus musculus
tttcctgccggcgtgcatgctgtgg

SEQ ID NO: 848242 - DNA, 25 bp, Mus musculus
tttcctgcgtctcacctggattgtg

SEQ ID NO: 848243 - DNA, 25 bp, Mus musculus
tttcctgcgtctgacctggattgtg

SEQ ID NO: 848244 - DNA, 25 bp, Mus musculus
tttcctgctgaaccccaaattccct

SEQ ID NO: 848245 - DNA, 25 bp, Mus musculus
tttcctgctgaagcccaaattccct

SEQ ID NO: 848246 - DNA, 25 bp, Mus musculus
tttcctgctgcaacacctgggtcgt

SEQ ID NO: 848247 - DNA, 25 bp, Mus musculus
tttcctgctgcatcacctgggtcgt

SEQ ID NO: 848248 - DNA, 25 bp, Mus musculus
tttcctgctttgcttgtgaaggcca

SEQ ID NO: 848249 - DNA, 25 bp, Mus musculus
tttcctgctttggttgtgaaggcca

SEQ ID NO: 848250 - DNA, 25 bp, Mus musculus
tttcctggaagcaattgtttgcata

SEQ ID NO: 848251 - DNA, 25 bp, Mus musculus
tttcctggaagctattgtttgcata

SEQ ID NO: 848252 - DNA, 25 bp, Mus musculus
tttcctgggagccttgcggcctcag

SEQ ID NO: 848253 - DNA, 25 bp, Mus musculus
tttcctgggagcgttgcggcctcag

SEQ ID NO: 848254 - DNA, 25 bp, Mus musculus
tttcctgggatgatctttgccagta

SEQ ID NO: 848255 - DNA, 25 bp, Mus musculus
tttcctgggatgttctttgccagta

SEQ ID NO: 848256 - DNA, 25 bp, Mus musculus
tttcctgggctacatgctctctcaa

SEQ ID NO: 848257 - DNA, 25 bp, Mus musculus
tttcctgggctagatgctctctcaa

SEQ ID NO: 848258 - DNA, 25 bp, Mus musculus
tttcctgggtctcggaagccagaga

SEQ ID NO: 848259 - DNA, 25 bp, Mus musculus
tttcctgggtctgggaagccagaga

SEQ ID NO: 848260 - DNA, 25 bp, Mus musculus
tttcctggtttaagagggccagcag

SEQ ID NO: 848261 - DNA, 25 bp, Mus musculus
tttcctggtttatgagggccagcag

SEQ ID NO: 848262 - DNA, 25 bp, Mus musculus
tttcctgtactcaattaaccagacg

SEQ ID NO: 848263 - DNA, 25 bp, Mus musculus
tttcctgtactctattaaccagacg

SEQ ID NO: 848264 - DNA, 25 bp, Mus musculus
tttcctgtccatattccgcccaagt

SEQ ID NO: 848265 - DNA, 25 bp, Mus musculus
tttcctgtccattttccgcccaagt

SEQ ID NO: 848266 - DNA, 25 bp, Mus musculus
tttcctgtcttgcatcaaaaccagg

SEQ ID NO: 848267 - DNA, 25 bp, Mus musculus
tttcctgtcttggatcaaaaccagg

SEQ ID NO: 848268 - DNA, 25 bp, Mus musculus
tttcctgtgcaacagagctgggctt

SEQ ID NO: 848269 - DNA, 25 bp, Mus musculus
tttcctgtgcaagagagctgggctt

SEQ ID NO: 848270 - DNA, 25 bp, Mus musculus
tttcctgtgcagctgttcttccagg

SEQ ID NO: 848271 - DNA, 25 bp, Mus musculus
tttcctgtgcaggtgttcttccagg

SEQ ID NO: 848272 - DNA, 25 bp, Mus musculus
tttcctgtgggaagctcgacctcag

SEQ ID NO: 848273 - DNA, 25 bp, Mus musculus
tttcctgtgggatgctcgacctcag

SEQ ID NO: 848274 - DNA, 25 bp, Mus musculus
tttccttaagccagaggctcaggat

SEQ ID NO: 848275 - DNA, 25 bp, Mus musculus
tttccttaagcctgaggctcaggat

SEQ ID NO: 848276 - DNA, 25 bp, Mus musculus
tttccttagagaactgtacacagcc

SEQ ID NO: 848277 - DNA, 25 bp, Mus musculus
tttccttagagatctgtacacagcc

SEQ ID NO: 848278 - DNA, 25 bp, Mus musculus
tttccttagcggcagagcctggccc

SEQ ID NO: 848279 - DNA, 25 bp, Mus musculus
tttccttagcgggagagcctggccc

SEQ ID NO: 848280 - DNA, 25 bp, Mus musculus
tttccttatggacagcttacctttg

SEQ ID NO: 848281 - DNA, 25 bp, Mus musculus
tttccttatggactacctgctgcag

SEQ ID NO: 848282 - DNA, 25 bp, Mus musculus
tttccttatggagagcttacctttg

SEQ ID NO: 848283 - DNA, 25 bp, Mus musculus
tttccttatggagtacctgctgcag

SEQ ID NO: 848284 - DNA, 25 bp, Mus musculus
tttccttcacggattgggagataca

SEQ ID NO: 848285 - DNA, 25 bp, Mus musculus
tttccttcacggtttgggagataca

SEQ ID NO: 848286 - DNA, 25 bp, Mus musculus
tttccttccccaatcaccgtagtag

SEQ ID NO: 848287 - DNA, 25 bp, Mus musculus
tttccttccccattcaccgtagtag

SEQ ID NO: 848288 - DNA, 25 bp, Mus musculus
tttccttcctggcagtttcttccag

SEQ ID NO: 848289 - DNA, 25 bp, Mus musculus
tttccttcctgggagtttcttccag

SEQ ID NO: 848290 - DNA, 25 bp, Mus musculus
tttccttcgcagagggcgtccctca

SEQ ID NO: 848291 - DNA, 25 bp, Mus musculus
tttccttcgcagtgggcgtccctca

SEQ ID NO: 848292 - DNA, 25 bp, Mus musculus
tttccttcgcgcacagctgtgctga

SEQ ID NO: 848293 - DNA, 25 bp, Mus musculus
tttccttcgcgctcagctgtgctga

SEQ ID NO: 848294 - DNA, 25 bp, Mus musculus
tttccttcggcgcagaagcgagccg

SEQ ID NO: 848295 - DNA, 25 bp, Mus musculus
tttccttcggcggagaagcgagccg

SEQ ID NO: 848296 - DNA, 25 bp, Mus musculus
tttccttctaagacttgctgagttg

SEQ ID NO: 848297 - DNA, 25 bp, Mus musculus
tttccttctaagtcttgctgagttg

SEQ ID NO: 848298 - DNA, 25 bp, Mus musculus
tttccttctcctagctcaggactgg

SEQ ID NO: 848299 - DNA, 25 bp, Mus musculus
tttccttctcctcagcaagaactca

SEQ ID NO: 848300 - DNA, 25 bp, Mus musculus
tttccttctcctgagcaagaactca

SEQ ID NO: 848301 - DNA, 25 bp, Mus musculus
tttccttctccttgctcaggactgg

SEQ ID NO: 848302 - DNA, 25 bp, Mus musculus
tttccttctgaacttcatctaaggc

SEQ ID NO: 848303 - DNA, 25 bp, Mus musculus
tttccttctgaagttcatctaaggc

SEQ ID NO: 848304 - DNA, 25 bp, Mus musculus
tttccttgcttgcagcccgctgtgc

SEQ ID NO: 848305 - DNA, 25 bp, Mus musculus
tttccttgcttggagcccgctgtgc

SEQ ID NO: 848306 - DNA, 25 bp, Mus musculus
tttccttggcctcccgggctgaggc

SEQ ID NO: 848307 - DNA, 25 bp, Mus musculus
tttccttggcctgccgggctgaggc

SEQ ID NO: 848308 - DNA, 25 bp, Mus musculus
tttccttgttggcaaaagccatgga

SEQ ID NO: 848309 - DNA, 25 bp, Mus musculus
tttccttgttgggaaaagccatgga

SEQ ID NO: 848310 - DNA, 25 bp, Mus musculus
tttcctttcccaaggtatgagaatg

SEQ ID NO: 848311 - DNA, 25 bp, Mus musculus
tttcctttcccatggtatgagaatg

SEQ ID NO: 848312 - DNA, 25 bp, Mus musculus
tttcctttgcggcagcttcacgcaa

SEQ ID NO: 848313 - DNA, 25 bp, Mus musculus
tttcctttgcgggagcttcacgcaa

SEQ ID NO: 848314 - DNA, 25 bp, Mus musculus
tttcctttgcttctacgttctgtcc

SEQ ID NO: 848315 - DNA, 25 bp, Mus musculus
tttcctttgcttgtacgttctgtcc

SEQ ID NO: 848316 - DNA, 25 bp, Mus musculus
tttcctttggcacagtctgcgggtg

SEQ ID NO: 848317 - DNA, 25 bp, Mus musculus
tttcctttggcagagtctgcgggtg

SEQ ID NO: 848318 - DNA, 25 bp, Mus musculus
tttcctttttcccatagttggtcag

SEQ ID NO: 848319 - DNA, 25 bp, Mus musculus
tttcctttttccgatagttggtcag

SEQ ID NO: 848320 - DNA, 25 bp, Mus musculus
tttcgaaaccagctcctcaaaagct

SEQ ID NO: 848321 - DNA, 25 bp, Mus musculus
tttcgaaaccaggtcctcaaaagct

SEQ ID NO: 848322 - DNA, 25 bp, Mus musculus
tttcgaaatctgaaaaacaagcgcg

SEQ ID NO: 848323 - DNA, 25 bp, Mus musculus
tttcgaaatctgtaaaacaagcgcg

SEQ ID NO: 848324 - DNA, 25 bp, Mus musculus
tttcgaagccgtcaagggcgcctga

SEQ ID NO: 848325 - DNA, 25 bp, Mus musculus
tttcgaagccgtgaagggcgcctga

SEQ ID NO: 848326 - DNA, 25 bp, Mus musculus
tttcgaagcgaaactgggtgcagac

SEQ ID NO: 848327 - DNA, 25 bp, Mus musculus
tttcgaagcgaatctgggtgcagac

SEQ ID NO: 848328 - DNA, 25 bp, Mus musculus
tttcgaaggacgcagagctgcttac

SEQ ID NO: 848329 - DNA, 25 bp, Mus musculus
tttcgaaggacggagagctgcttac

SEQ ID NO: 848330 - DNA, 25 bp, Mus musculus
tttcgacggaaaaacaaggcagcgg

SEQ ID NO: 848331 - DNA, 25 bp, Mus musculus
tttcgacggaaatacaaggcagcgg

SEQ ID NO: 848332 - DNA, 25 bp, Mus musculus
tttcgagatcaaaaacaagaaagga

SEQ ID NO: 848333 - DNA, 25 bp, Mus musculus
tttcgagatcaataacaagaaagga

SEQ ID NO: 848334 - DNA, 25 bp, Mus musculus
tttcgaggccaacgcggttatcctg

SEQ ID NO: 848335 - DNA, 25 bp, Mus musculus
tttcgaggccaaggcggttatcctg

SEQ ID NO: 848336 - DNA, 25 bp, Mus musculus
tttcgagggctcagtgcgctggcaa

SEQ ID NO: 848337 - DNA, 25 bp, Mus musculus
tttcgagggctctgtgcgctggcaa

SEQ ID NO: 848338 - DNA, 25 bp, Mus musculus
tttcgagtgccccagatgaccctgg

SEQ ID NO: 848339 - DNA, 25 bp, Mus musculus
tttcgagtgcccgagatgaccctgg

SEQ ID NO: 848340 - DNA, 25 bp, Mus musculus
tttcgatatcgtctgaggaggccga

SEQ ID NO: 848341 - DNA, 25 bp, Mus musculus
tttcgatatcgtgtgaggaggccga

SEQ ID NO: 848342 - DNA, 25 bp, Mus musculus
tttcgatatgataactaccggctgc

SEQ ID NO: 848343 - DNA, 25 bp, Mus musculus
tttcgatatgattactaccggctgc

SEQ ID NO: 848344 - DNA, 25 bp, Mus musculus
tttcgatgaccaagaaccctttggg

SEQ ID NO: 848345 - DNA, 25 bp, Mus musculus
tttcgatgaccatgaaccctttggg

SEQ ID NO: 848346 - DNA, 25 bp, Mus musculus
tttcgattacttcaatagatacact

SEQ ID NO: 848347 - DNA, 25 bp, Mus musculus
tttcgattacttgaatagatacact

SEQ ID NO: 848348 - DNA, 25 bp, Mus musculus
tttcgcaagcatcctccgaaggcac

SEQ ID NO: 848349 - DNA, 25 bp, Mus musculus
tttcgcaagcatgctccgaaggcac

SEQ ID NO: 848350 - DNA, 25 bp, Mus musculus
tttcgcacccacacgggcaagtact

SEQ ID NO: 848351 - DNA, 25 bp, Mus musculus
tttcgcacccactcgggcaagtact

SEQ ID NO: 848352 - DNA, 25 bp, Mus musculus
tttcgcagagcaatcacctctgacc

SEQ ID NO: 848353 - DNA, 25 bp, Mus musculus
tttcgcagagcattcacctctgacc

SEQ ID NO: 848354 - DNA, 25 bp, Mus musculus
tttcgcaggtaaatgtcatatcttg

SEQ ID NO: 848355 - DNA, 25 bp, Mus musculus
tttcgcaggtaattgtcatatcttg

SEQ ID NO: 848356 - DNA, 25 bp, Mus musculus
tttcgcatcgtgcacgagacagccg

SEQ ID NO: 848357 - DNA, 25 bp, Mus musculus
tttcgcatcgtggacgagacagccg

SEQ ID NO: 848358 - DNA, 25 bp, Mus musculus
tttcgcctgctcagtggtccacgag

SEQ ID NO: 848359 - DNA, 25 bp, Mus musculus
tttcgcctgctctgtggtccacgag

SEQ ID NO: 848360 - DNA, 25 bp, Mus musculus
tttcgctcaagtcaccaacaaggct

SEQ ID NO: 848361 - DNA, 25 bp, Mus musculus
tttcgctcaagtgaccaacaaggct

SEQ ID NO: 848362 - DNA, 25 bp, Mus musculus
tttcgctgcctgagcgggaaccgtg

SEQ ID NO: 848363 - DNA, 25 bp, Mus musculus
tttcgctgcctgtgcgggaaccgtg

SEQ ID NO: 848364 - DNA, 25 bp, Mus musculus
tttcggaactgacgctcaagcacag

SEQ ID NO: 848365 - DNA, 25 bp, Mus musculus
tttcggaactgaggctcaagcacag

SEQ ID NO: 848366 - DNA, 25 bp, Mus musculus
tttcggaagagtccccaagagctgc

SEQ ID NO: 848367 - DNA, 25 bp, Mus musculus
tttcggaagagtgcccaagagctgc

SEQ ID NO: 848368 - DNA, 25 bp, Mus musculus
tttcggacaccccttgctgctcaga

SEQ ID NO: 848369 - DNA, 25 bp, Mus musculus
tttcggacacccgttgctgctcaga

SEQ ID NO: 848370 - DNA, 25 bp, Mus musculus
tttcggacgcgcagtgttcggtgca

SEQ ID NO: 848371 - DNA, 25 bp, Mus musculus
tttcggacgcgctgtgttcggtgca

SEQ ID NO: 848372 - DNA, 25 bp, Mus musculus
tttcggagactgcaatccagaccgt

SEQ ID NO: 848373 - DNA, 25 bp, Mus musculus
tttcggagactggaatccagaccgt

SEQ ID NO: 848374 - DNA, 25 bp, Mus musculus
tttcggagtgatcgtctcagtcagc

SEQ ID NO: 848375 - DNA, 25 bp, Mus musculus
tttcggagtgatggtctcagtcagc

SEQ ID NO: 848376 - DNA, 25 bp, Mus musculus
tttcggagtgctcctatggaccaag

SEQ ID NO: 848377 - DNA, 25 bp, Mus musculus
tttcggagtgctgctatggaccaag

SEQ ID NO: 848378 - DNA, 25 bp, Mus musculus
tttcggataaggcattatggacctg

SEQ ID NO: 848379 - DNA, 25 bp, Mus musculus
tttcggataagggattatggacctg

SEQ ID NO: 848380 - DNA, 25 bp, Mus musculus
tttcggatggaacctcaagaaccct

SEQ ID NO: 848381 - DNA, 25 bp, Mus musculus
tttcggatggaagctcaagaaccct

SEQ ID NO: 848382 - DNA, 25 bp, Mus musculus
tttcggcaacaaaacctttggccag

SEQ ID NO: 848383 - DNA, 25 bp, Mus musculus
tttcggcaacaatacctttggccag

SEQ ID NO: 848384 - DNA, 25 bp, Mus musculus
tttcggcaactcagtttggcccctg

SEQ ID NO: 848385 - DNA, 25 bp, Mus musculus
tttcggcaactctgtttggcccctg

SEQ ID NO: 848386 - DNA, 25 bp, Mus musculus
tttcggcagaggcacaaatcagtgc

SEQ ID NO: 848387 - DNA, 25 bp, Mus musculus
tttcggcagagggacaaatcagtgc

SEQ ID NO: 848388 - DNA, 25 bp, Mus musculus
tttcggcagtccaatgaataccatc

SEQ ID NO: 848389 - DNA, 25 bp, Mus musculus
tttcggcagtcctatgaataccatc

SEQ ID NO: 848390 - DNA, 25 bp, Mus musculus
tttcggccgaagaggctgcagagct

SEQ ID NO: 848391 - DNA, 25 bp, Mus musculus
tttcggccgaagtggctgcagagct

SEQ ID NO: 848392 - DNA, 25 bp, Mus musculus
tttcggcgaatcatgaacgtgacac

SEQ ID NO: 848393 - DNA, 25 bp, Mus musculus
tttcggcgaatcttgaacgtgacac

SEQ ID NO: 848394 - DNA, 25 bp, Mus musculus
tttcggctcgtccagagtaatttga

SEQ ID NO: 848395 - DNA, 25 bp, Mus musculus
tttcggctcgtcgagagtaatttga

SEQ ID NO: 848396 - DNA, 25 bp, Mus musculus
tttcgggagcaaagcagttaccacg

SEQ ID NO: 848397 - DNA, 25 bp, Mus musculus
tttcgggagcaatgcagttaccacg

SEQ ID NO: 848398 - DNA, 25 bp, Mus musculus
tttcgggccgtccttcgccaggaga

SEQ ID NO: 848399 - DNA, 25 bp, Mus musculus
tttcgggccgtcgttcgccaggaga

SEQ ID NO: 848400 - DNA, 25 bp, Mus musculus
tttcggtcacaaagccgagacctcc

SEQ ID NO: 848401 - DNA, 25 bp, Mus musculus
tttcggtcacaatgccgagacctcc

SEQ ID NO: 848402 - DNA, 25 bp, Mus musculus
tttcggtcctgaccaccgagcaggg

SEQ ID NO: 848403 - DNA, 25 bp, Mus musculus
tttcggtcctgagcaccgagcaggg

SEQ ID NO: 848404 - DNA, 25 bp, Mus musculus
tttcggtggccactgacctctatgg

SEQ ID NO: 848405 - DNA, 25 bp, Mus musculus
tttcggtggccagtgacctctatgg

SEQ ID NO: 848406 - DNA, 25 bp, Mus musculus
tttcggtgtcatcggcgcctcgtcc

SEQ ID NO: 848407 - DNA, 25 bp, Mus musculus
tttcggtgtcatgggcgcctcgtcc

SEQ ID NO: 848408 - DNA, 25 bp, Mus musculus
tttcggttacaccaatgggaactgg

SEQ ID NO: 848409 - DNA, 25 bp, Mus musculus
tttcggttacacgaatgggaactgg

SEQ ID NO: 848410 - DNA, 25 bp, Mus musculus
tttcgtaagggcacactgggtaagc

SEQ ID NO: 848411 - DNA, 25 bp, Mus musculus
tttcgtaagggctcactgggtaagc

SEQ ID NO: 848412 - DNA, 25 bp, Mus musculus
tttcgtcctccactgtatggcccag

SEQ ID NO: 848413 - DNA, 25 bp, Mus musculus
tttcgtcctccagtgtatggcccag

SEQ ID NO: 848414 - DNA, 25 bp, Mus musculus
tttcgtcgacaaaagccaacatgga

SEQ ID NO: 848415 - DNA, 25 bp, Mus musculus
tttcgtcgacaatagccaacatgga

SEQ ID NO: 848416 - DNA, 25 bp, Mus musculus
tttcgtcgccggaggtgtccttctc

SEQ ID NO: 848417 - DNA, 25 bp, Mus musculus
tttcgtcgccggtggtgtccttctc

SEQ ID NO: 848418 - DNA, 25 bp, Mus musculus
tttcgtctcaggattgctccgccgc

SEQ ID NO: 848419 - DNA, 25 bp, Mus musculus
tttcgtctcaggtttgctccgccgc

SEQ ID NO: 848420 - DNA, 25 bp, Mus musculus
tttcgtcttggcatcaaatccgtcg

SEQ ID NO: 848421 - DNA, 25 bp, Mus musculus
tttcgtcttggcttcaaatccgtcg

SEQ ID NO: 848422 - DNA, 25 bp, Mus musculus
tttcgtgaatgccacacttgtgcta

SEQ ID NO: 848423 - DNA, 25 bp, Mus musculus
tttcgtgaatgcgacacttgtgcta

SEQ ID NO: 848424 - DNA, 25 bp, Mus musculus
tttcgtgactcaagccctcatccag

SEQ ID NO: 848425 - DNA, 25 bp, Mus musculus
tttcgtgactcatgccctcatccag

SEQ ID NO: 848426 - DNA, 25 bp, Mus musculus
tttcgtgagatgaccgacccttcgc

SEQ ID NO: 848427 - DNA, 25 bp, Mus musculus
tttcgtgagatgtccgacccttcgc

SEQ ID NO: 848428 - DNA, 25 bp, Mus musculus
tttcgtgagcagatcctgggcggca

SEQ ID NO: 848429 - DNA, 25 bp, Mus musculus
tttcgtgagcagttcctgggcggca

SEQ ID NO: 848430 - DNA, 25 bp, Mus musculus
tttcgtgatcacagtctggaagctc

SEQ ID NO: 848431 - DNA, 25 bp, Mus musculus
tttcgtgatcactgtctggaagctc

SEQ ID NO: 848432 - DNA, 25 bp, Mus musculus
tttcgtggccaacgtgatgtgcgtt

SEQ ID NO: 848433 - DNA, 25 bp, Mus musculus
tttcgtggccaaggtgatgtgcgtt

SEQ ID NO: 848434 - DNA, 25 bp, Mus musculus
tttcgttgacgtccctggcttcctg

SEQ ID NO: 848435 - DNA, 25 bp, Mus musculus
tttcgttgacgtgcctggcttcctg

SEQ ID NO: 848436 - DNA, 25 bp, Mus musculus
tttcgttgtcatcattatactgagc

SEQ ID NO: 848437 - DNA, 25 bp, Mus musculus
tttcgttgtcatgattatactgagc

SEQ ID NO: 848438 - DNA, 25 bp, Mus musculus
tttcgttttgaaacttacttcactg

SEQ ID NO: 848439 - DNA, 25 bp, Mus musculus
tttcgttttgaatcttacttcactg

SEQ ID NO: 848440 - DNA, 25 bp, Mus musculus
tttctaaatggtaacagcacaaata

SEQ ID NO: 848441 - DNA, 25 bp, Mus musculus
tttctaaatggttacagcacaaata

SEQ ID NO: 848442 - DNA, 25 bp, Mus musculus
tttctaagacatcgccgtgcgcgtc

SEQ ID NO: 848443 - DNA, 25 bp, Mus musculus
tttctaagacatggccgtgcgcgtc

SEQ ID NO: 848444 - DNA, 25 bp, Mus musculus
tttctaagctataggcaaaaggtaa

SEQ ID NO: 848445 - DNA, 25 bp, Mus musculus
tttctaagctattggcaaaaggtaa

SEQ ID NO: 848446 - DNA, 25 bp, Mus musculus
tttctaaggaatccaaaatgctaca

SEQ ID NO: 848447 - DNA, 25 bp, Mus musculus
tttctaaggaatgcaaaatgctaca

SEQ ID NO: 848448 - DNA, 25 bp, Mus musculus
tttctaagtatgctgacctggccaa

SEQ ID NO: 848449 - DNA, 25 bp, Mus musculus
tttctaagtatggtgacctggccaa

SEQ ID NO: 848450 - DNA, 25 bp, Mus musculus
tttctaatcgaacggccaaatggag

SEQ ID NO: 848451 - DNA, 25 bp, Mus musculus
tttctaatcgaagggccaaatggag

SEQ ID NO: 848452 - DNA, 25 bp, Mus musculus
tttctaatggtgcaagtgaactgtg

SEQ ID NO: 848453 - DNA, 25 bp, Mus musculus
tttctaatggtggaagtgaactgtg

SEQ ID NO: 848454 - DNA, 25 bp, Mus musculus
tttctacaaacaacccttcgctgac

SEQ ID NO: 848455 - DNA, 25 bp, Mus musculus
tttctacaaacatcccttcgctgac

SEQ ID NO: 848456 - DNA, 25 bp, Mus musculus
tttctacaaatcacggcaggatccg

SEQ ID NO: 848457 - DNA, 25 bp, Mus musculus
tttctacaaatctcggcaggatccg

SEQ ID NO: 848458 - DNA, 25 bp, Mus musculus
tttctacaagctaatgatcagcagg

SEQ ID NO: 848459 - DNA, 25 bp, Mus musculus
tttctacaagcttatgatcagcagg

SEQ ID NO: 848460 - DNA, 25 bp, Mus musculus
tttctacaagtaaaaaacgtgctca

SEQ ID NO: 848461 - DNA, 25 bp, Mus musculus
tttctacaagtataaaacgtgctca

SEQ ID NO: 848462 - DNA, 25 bp, Mus musculus
tttctacactgtctgtcgggatctg

SEQ ID NO: 848463 - DNA, 25 bp, Mus musculus
tttctacactgtgtgtcgggatctg

SEQ ID NO: 848464 - DNA, 25 bp, Mus musculus
tttctacagcgacagcttcggtggc

SEQ ID NO: 848465 - DNA, 25 bp, Mus musculus
tttctacagcgagagcttcggtggc

SEQ ID NO: 848466 - DNA, 25 bp, Mus musculus
tttctacatggcctgcaatggccgc

SEQ ID NO: 848467 - DNA, 25 bp, Mus musculus
tttctacatggcgtgcaatggccgc

SEQ ID NO: 848468 - DNA, 25 bp, Mus musculus
tttctacccgtgcaacaagcatctc

SEQ ID NO: 848469 - DNA, 25 bp, Mus musculus
tttctacccgtggaacaagcatctc

SEQ ID NO: 848470 - DNA, 25 bp, Mus musculus
tttctacctcttctcatctgccagt

SEQ ID NO: 848471 - DNA, 25 bp, Mus musculus
tttctacctcttgtcatctgccagt

SEQ ID NO: 848472 - DNA, 25 bp, Mus musculus
tttctacctggcactggaggacggt

SEQ ID NO: 848473 - DNA, 25 bp, Mus musculus
tttctacctggctctggaggacggt

SEQ ID NO: 848474 - DNA, 25 bp, Mus musculus
tttctacctggtctttgagaagatg

SEQ ID NO: 848475 - DNA, 25 bp, Mus musculus
tttctacctggtgtttgagaagatg

SEQ ID NO: 848476 - DNA, 25 bp, Mus musculus
tttctacgtatcacatgcttcaggt

SEQ ID NO: 848477 - DNA, 25 bp, Mus musculus
tttctacgtatctcatgcttcaggt

SEQ ID NO: 848478 - DNA, 25 bp, Mus musculus
tttctactcgggacactcttcattc

SEQ ID NO: 848479 - DNA, 25 bp, Mus musculus
tttctactcgggtcactcttcattc

SEQ ID NO: 848480 - DNA, 25 bp, Mus musculus
tttctactgctcagggctccgcggt

SEQ ID NO: 848481 - DNA, 25 bp, Mus musculus
tttctactgctctgggctccgcggt

SEQ ID NO: 848482 - DNA, 25 bp, Mus musculus
tttctagacctgaagcagggacgct

SEQ ID NO: 848483 - DNA, 25 bp, Mus musculus
tttctagacctgtagcagggacgct

SEQ ID NO: 848484 - DNA, 25 bp, Mus musculus
tttctagagctgagtctcagagcag

SEQ ID NO: 848485 - DNA, 25 bp, Mus musculus
tttctagagctgtgtctcagagcag

SEQ ID NO: 848486 - DNA, 25 bp, Mus musculus
tttctagaggaaacagtggagcgca

SEQ ID NO: 848487 - DNA, 25 bp, Mus musculus
tttctagaggaatcagtggagcgca

SEQ ID NO: 848488 - DNA, 25 bp, Mus musculus
tttctagatcctaaaattgctcaga

SEQ ID NO: 848489 - DNA, 25 bp, Mus musculus
tttctagatccttaaattgctcaga

SEQ ID NO: 848490 - DNA, 25 bp, Mus musculus
tttctagcgcatcagaagatctggt

SEQ ID NO: 848491 - DNA, 25 bp, Mus musculus
tttctagcgcatgagaagatctggt

SEQ ID NO: 848492 - DNA, 25 bp, Mus musculus
tttctaggagctccggttctgtcgg

SEQ ID NO: 848493 - DNA, 25 bp, Mus musculus
tttctaggagctgcggttctgtcgg

SEQ ID NO: 848494 - DNA, 25 bp, Mus musculus
tttctagtatggaaggctgcctgcc

SEQ ID NO: 848495 - DNA, 25 bp, Mus musculus
tttctagtatggtaggctgcctgcc

SEQ ID NO: 848496 - DNA, 25 bp, Mus musculus
tttctataataaaccaccccagtgg

SEQ ID NO: 848497 - DNA, 25 bp, Mus musculus
tttctataataatccaccccagtgg

SEQ ID NO: 848498 - DNA, 25 bp, Mus musculus
tttctatatgatcacaaccaacgtg

SEQ ID NO: 848499 - DNA, 25 bp, Mus musculus
tttctatatgatgacaaccaacgtg

SEQ ID NO: 848500 - DNA, 25 bp, Mus musculus
tttctatcctctaggcttttgccgc

SEQ ID NO: 848501 - DNA, 25 bp, Mus musculus
tttctatcctcttggcttttgccgc

SEQ ID NO: 848502 - DNA, 25 bp, Mus musculus
tttctatctttcctgattctggcaa

SEQ ID NO: 848503 - DNA, 25 bp, Mus musculus
tttctatctttcgtgattctggcaa

SEQ ID NO: 848504 - DNA, 25 bp, Mus musculus
tttctatgagcgcagccggcagctg

SEQ ID NO: 848505 - DNA, 25 bp, Mus musculus
tttctatgagcggagccggcagctg

SEQ ID NO: 848506 - DNA, 25 bp, Mus musculus
tttctatggccacggccgtaagctg

SEQ ID NO: 848507 - DNA, 25 bp, Mus musculus
tttctatggccagggccgtaagctg

SEQ ID NO: 848508 - DNA, 25 bp, Mus musculus
tttctatggcgtaatgcaaagccta

SEQ ID NO: 848509 - DNA, 25 bp, Mus musculus
tttctatggcgttatgcaaagccta

SEQ ID NO: 848510 - DNA, 25 bp, Mus musculus
tttctattgtacagaagcaattcgc

SEQ ID NO: 848511 - DNA, 25 bp, Mus musculus
tttctattgtactgaagcaattcgc

SEQ ID NO: 848512 - DNA, 25 bp, Mus musculus
tttctcaaaattacagggccttcat

SEQ ID NO: 848513 - DNA, 25 bp, Mus musculus
tttctcaaaatttcagggccttcat

SEQ ID NO: 848514 - DNA, 25 bp, Mus musculus
tttctcaagggacgagtcgtttgaa

SEQ ID NO: 848515 - DNA, 25 bp, Mus musculus
tttctcaagggaggagtcgtttgaa

SEQ ID NO: 848516 - DNA, 25 bp, Mus musculus
tttctcaatatcaggaactctgcct

SEQ ID NO: 848517 - DNA, 25 bp, Mus musculus
tttctcaatatctggaactctgcct

SEQ ID NO: 848518 - DNA, 25 bp, Mus musculus
tttctcacagagatatcaccactat

SEQ ID NO: 848519 - DNA, 25 bp, Mus musculus
tttctcacagagttatcaccactat

SEQ ID NO: 848520 - DNA, 25 bp, Mus musculus
tttctcacagtcaccccagagtcgg

SEQ ID NO: 848521 - DNA, 25 bp, Mus musculus
tttctcacagtctccccagagtcgg

SEQ ID NO: 848522 - DNA, 25 bp, Mus musculus
tttctcacccataaaacagtcaact

SEQ ID NO: 848523 - DNA, 25 bp, Mus musculus
tttctcacccattaaacagtcaact

SEQ ID NO: 848524 - DNA, 25 bp, Mus musculus
tttctcactgatacaactgctcaca

SEQ ID NO: 848525 - DNA, 25 bp, Mus musculus
tttctcactgattcaactgctcaca

SEQ ID NO: 848526 - DNA, 25 bp, Mus musculus
tttctcactgttagagtgatctagg

SEQ ID NO: 848527 - DNA, 25 bp, Mus musculus
tttctcactgtttgagtgatctagg

SEQ ID NO: 848528 - DNA, 25 bp, Mus musculus
tttctcagactccaacgtcattgag

SEQ ID NO: 848529 - DNA, 25 bp, Mus musculus
tttctcagactcgaacgtcattgag

SEQ ID NO: 848530 - DNA, 25 bp, Mus musculus
tttctcagccataaatggccgcagg

SEQ ID NO: 848531 - DNA, 25 bp, Mus musculus
tttctcagccattaatggccgcagg

SEQ ID NO: 848532 - DNA, 25 bp, Mus musculus
tttctcagccccagagcaaatccag

SEQ ID NO: 848533 - DNA, 25 bp, Mus musculus
tttctcagcccctgagcaaatccag

SEQ ID NO: 848534 - DNA, 25 bp, Mus musculus
tttctcatctgcaatagctgctggg

SEQ ID NO: 848535 - DNA, 25 bp, Mus musculus
tttctcatctgctatagctgctggg

SEQ ID NO: 848536 - DNA, 25 bp, Mus musculus
tttctcatgatgcacccctggtaca

SEQ ID NO: 848537 - DNA, 25 bp, Mus musculus
tttctcatgatggacccctggtaca

SEQ ID NO: 848538 - DNA, 25 bp, Mus musculus
tttctcatgcagaacccaggtcgta

SEQ ID NO: 848539 - DNA, 25 bp, Mus musculus
tttctcatgcagtacccaggtcgta

SEQ ID NO: 848540 - DNA, 25 bp, Mus musculus
tttctcatttggctggcaaggcggt

SEQ ID NO: 848541 - DNA, 25 bp, Mus musculus
tttctcatttgggtggcaaggcggt

SEQ ID NO: 848542 - DNA, 25 bp, Mus musculus
tttctcccatttcctcagtgaacag

SEQ ID NO: 848543 - DNA, 25 bp, Mus musculus
tttctcccatttgctcagtgaacag

SEQ ID NO: 848544 - DNA, 25 bp, Mus musculus
tttctccctagtcatgtgcctcctg

SEQ ID NO: 848545 - DNA, 25 bp, Mus musculus
tttctccctagtgatgtgcctcctg

SEQ ID NO: 848546 - DNA, 25 bp, Mus musculus
tttctccctcaacatgataagttgt

SEQ ID NO: 848547 - DNA, 25 bp, Mus musculus
tttctccctcaagatgataagttgt

SEQ ID NO: 848548 - DNA, 25 bp, Mus musculus
tttctccctccgctggttgcaggag

SEQ ID NO: 848549 - DNA, 25 bp, Mus musculus
tttctccctccggtggttgcaggag

SEQ ID NO: 848550 - DNA, 25 bp, Mus musculus
tttctccgattaaatacgaaagcca

SEQ ID NO: 848551 - DNA, 25 bp, Mus musculus
tttctccgattatatacgaaagcca

SEQ ID NO: 848552 - DNA, 25 bp, Mus musculus
tttctccgcctcaaagttcttgtcc

SEQ ID NO: 848553 - DNA, 25 bp, Mus musculus
tttctccgcctctaagttcttgtcc

SEQ ID NO: 848554 - DNA, 25 bp, Mus musculus
tttctccggcctattgggcgccgcg

SEQ ID NO: 848555 - DNA, 25 bp, Mus musculus
tttctccggccttttgggcgccgcg

SEQ ID NO: 848556 - DNA, 25 bp, Mus musculus
tttctcctcaaaaaccccaatggtg

SEQ ID NO: 848557 - DNA, 25 bp, Mus musculus
tttctcctcaaataccccaatggtg

SEQ ID NO: 848558 - DNA, 25 bp, Mus musculus
tttctcctcatcaatacagtgtcac

SEQ ID NO: 848559 - DNA, 25 bp, Mus musculus
tttctcctcatctatacagtgtcac

SEQ ID NO: 848560 - DNA, 25 bp, Mus musculus
tttctcctcattactgtctgtacga

SEQ ID NO: 848561 - DNA, 25 bp, Mus musculus
tttctcctcatttctgtctgtacga

SEQ ID NO: 848562 - DNA, 25 bp, Mus musculus
tttctcgagctcactgagtcctttg

SEQ ID NO: 848563 - DNA, 25 bp, Mus musculus
tttctcgagctctctgagtcctttg

SEQ ID NO: 848564 - DNA, 25 bp, Mus musculus
tttctcgcgcccctaggagactacg

SEQ ID NO: 848565 - DNA, 25 bp, Mus musculus
tttctcgcgcccgtaggagactacg

SEQ ID NO: 848566 - DNA, 25 bp, Mus musculus
tttctctcacgacttggagagcact

SEQ ID NO: 848567 - DNA, 25 bp, Mus musculus
tttctctcacgagttggagagcact

SEQ ID NO: 848568 - DNA, 25 bp, Mus musculus
tttctctcagtcacgcacagcatcg

SEQ ID NO: 848569 - DNA, 25 bp, Mus musculus
tttctctcagtctcgcacagcatcg

SEQ ID NO: 848570 - DNA, 25 bp, Mus musculus
tttctctcatatcctgggaccagct

SEQ ID NO: 848571 - DNA, 25 bp, Mus musculus
tttctctcatatgctgggaccagct

SEQ ID NO: 848572 - DNA, 25 bp, Mus musculus
tttctctcctctagtccatggccag

SEQ ID NO: 848573 - DNA, 25 bp, Mus musculus
tttctctcctcttgtccatggccag

SEQ ID NO: 848574 - DNA, 25 bp, Mus musculus
tttctctcctgcagagatcgagtgc

SEQ ID NO: 848575 - DNA, 25 bp, Mus musculus
tttctctcctgctgagatcgagtgc

SEQ ID NO: 848576 - DNA, 25 bp, Mus musculus
tttctctccttcatgtcaagaccaa

SEQ ID NO: 848577 - DNA, 25 bp, Mus musculus
tttctctccttcttgtcaagaccaa

SEQ ID NO: 848578 - DNA, 25 bp, Mus musculus
tttctctctagacactcctgcgcca

SEQ ID NO: 848579 - DNA, 25 bp, Mus musculus
tttctctctagagactcctgcgcca

SEQ ID NO: 848580 - DNA, 25 bp, Mus musculus
tttctctctataaatcagattgagg

SEQ ID NO: 848581 - DNA, 25 bp, Mus musculus
tttctctctatatatcagattgagg

SEQ ID NO: 848582 - DNA, 25 bp, Mus musculus
tttctctgctagcagttgctgcata

SEQ ID NO: 848583 - DNA, 25 bp, Mus musculus
tttctctgctaggagttgctgcata

SEQ ID NO: 848584 - DNA, 25 bp, Mus musculus
tttctctggagcatttcgggacccg

SEQ ID NO: 848585 - DNA, 25 bp, Mus musculus
tttctctggagcttttcgggacccg

SEQ ID NO: 848586 - DNA, 25 bp, Mus musculus
tttctctgtgggagggctgtctgct

SEQ ID NO: 848587 - DNA, 25 bp, Mus musculus
tttctctgtgggtgggctgtctgct

SEQ ID NO: 848588 - DNA, 25 bp, Mus musculus
tttctctgttacctgtgggtcctgc

SEQ ID NO: 848589 - DNA, 25 bp, Mus musculus
tttctctgttacgtgtgggtcctgc

SEQ ID NO: 848590 - DNA, 25 bp, Mus musculus
tttctcttcaatccattcgacacgg

SEQ ID NO: 848591 - DNA, 25 bp, Mus musculus
tttctcttcaatgcattcgacacgg

SEQ ID NO: 848592 - DNA, 25 bp, Mus musculus
tttctcttgcaacacgcacagaaca

SEQ ID NO: 848593 - DNA, 25 bp, Mus musculus
tttctcttgcaagacgcacagaaca

SEQ ID NO: 848594 - DNA, 25 bp, Mus musculus
tttctcttggaccaggccaatgggc

SEQ ID NO: 848595 - DNA, 25 bp, Mus musculus
tttctcttggacgaggccaatgggc

SEQ ID NO: 848596 - DNA, 25 bp, Mus musculus
tttctcttggcaagaatggtcaagc

SEQ ID NO: 848597 - DNA, 25 bp, Mus musculus
tttctcttggcatgaatggtcaagc

SEQ ID NO: 848598 - DNA, 25 bp, Mus musculus
tttctgaaagagcatgaccaccttc

SEQ ID NO: 848599 - DNA, 25 bp, Mus musculus
tttctgaaagaggatgaccaccttc

SEQ ID NO: 848600 - DNA, 25 bp, Mus musculus
tttctgaacctcatgctgcacctcg

SEQ ID NO: 848601 - DNA, 25 bp, Mus musculus
tttctgaacctcttgctgcacctcg

SEQ ID NO: 848602 - DNA, 25 bp, Mus musculus
tttctgaactacacgaggaccctca

SEQ ID NO: 848603 - DNA, 25 bp, Mus musculus
tttctgaactactcgaggaccctca

SEQ ID NO: 848604 - DNA, 25 bp, Mus musculus
tttctgaacttcaggaacaaacagg

SEQ ID NO: 848605 - DNA, 25 bp, Mus musculus
tttctgaacttctggaacaaacagg

SEQ ID NO: 848606 - DNA, 25 bp, Mus musculus
tttctgaagacacttcgggctggcc

SEQ ID NO: 848607 - DNA, 25 bp, Mus musculus
tttctgaagacagttcgggctggcc

SEQ ID NO: 848608 - DNA, 25 bp, Mus musculus
tttctgaagagtcagtataaccctg

SEQ ID NO: 848609 - DNA, 25 bp, Mus musculus
tttctgaagagtgagtataaccctg

SEQ ID NO: 848610 - DNA, 25 bp, Mus musculus
tttctgaagcggaaccccactcagc

SEQ ID NO: 848611 - DNA, 25 bp, Mus musculus
tttctgaagcggtaccccactcagc

SEQ ID NO: 848612 - DNA, 25 bp, Mus musculus
tttctgaaggaactcactcgacaga

SEQ ID NO: 848613 - DNA, 25 bp, Mus musculus
tttctgaaggaagtcactcgacaga

SEQ ID NO: 848614 - DNA, 25 bp, Mus musculus
tttctgaaggctaacgggcagcgcg

SEQ ID NO: 848615 - DNA, 25 bp, Mus musculus
tttctgaaggcttacgggcagcgcg

SEQ ID NO: 848616 - DNA, 25 bp, Mus musculus
tttctgacaatgcagcatctcttgc

SEQ ID NO: 848617 - DNA, 25 bp, Mus musculus
tttctgacaatggagcatctcttgc

SEQ ID NO: 848618 - DNA, 25 bp, Mus musculus
tttctgacaggtctgtgcgccatca

SEQ ID NO: 848619 - DNA, 25 bp, Mus musculus
tttctgacaggtgtgtgcgccatca

SEQ ID NO: 848620 - DNA, 25 bp, Mus musculus
tttctgaccgagcaggcggtgttcc

SEQ ID NO: 848621 - DNA, 25 bp, Mus musculus
tttctgaccgaggaggcggtgttcc

SEQ ID NO: 848622 - DNA, 25 bp, Mus musculus
tttctgagacaacgatcgaaaagcg

SEQ ID NO: 848623 - DNA, 25 bp, Mus musculus
tttctgagacaaggatcgaaaagcg

SEQ ID NO: 848624 - DNA, 25 bp, Mus musculus
tttctgagacagacattacatctgt

SEQ ID NO: 848625 - DNA, 25 bp, Mus musculus
tttctgagacagtcattacatctgt

SEQ ID NO: 848626 - DNA, 25 bp, Mus musculus
tttctgagcaccagcccacaacaag

SEQ ID NO: 848627 - DNA, 25 bp, Mus musculus
tttctgagcacctgcccacaacaag

SEQ ID NO: 848628 - DNA, 25 bp, Mus musculus
tttctgagcagcctcactgtgcgcg

SEQ ID NO: 848629 - DNA, 25 bp, Mus musculus
tttctgagcagcgtcactgtgcgcg

SEQ ID NO: 848630 - DNA, 25 bp, Mus musculus
tttctgagcctcaagcatggcgggc

SEQ ID NO: 848631 - DNA, 25 bp, Mus musculus
tttctgagcctctagcatggcgggc

SEQ ID NO: 848632 - DNA, 25 bp, Mus musculus
tttctgaggacaccgctcggctgcc

SEQ ID NO: 848633 - DNA, 25 bp, Mus musculus
tttctgaggacagcgctcggctgcc

SEQ ID NO: 848634 - DNA, 25 bp, Mus musculus
tttctgaggagaccataaagcttct

SEQ ID NO: 848635 - DNA, 25 bp, Mus musculus
tttctgaggagagcataaagcttct

SEQ ID NO: 848636 - DNA, 25 bp, Mus musculus
tttctgaggatcaatggctttccca

SEQ ID NO: 848637 - DNA, 25 bp, Mus musculus
tttctgaggatctatggctttccca

SEQ ID NO: 848638 - DNA, 25 bp, Mus musculus
tttctgagggaacatcagctgacag

SEQ ID NO: 848639 - DNA, 25 bp, Mus musculus
tttctgagggaagatcagctgacag

SEQ ID NO: 848640 - DNA, 25 bp, Mus musculus
tttctgagggcaacattgatgtgtg

SEQ ID NO: 848641 - DNA, 25 bp, Mus musculus
tttctgagggcatcattgatgtgtg

SEQ ID NO: 848642 - DNA, 25 bp, Mus musculus
tttctgatccagagaggccttgaga

SEQ ID NO: 848643 - DNA, 25 bp, Mus musculus
tttctgatccagtgaggccttgaga

SEQ ID NO: 848644 - DNA, 25 bp, Mus musculus
tttctgatgcagaatcgagatccga

SEQ ID NO: 848645 - DNA, 25 bp, Mus musculus
tttctgatgcagtatcgagatccga

SEQ ID NO: 848646 - DNA, 25 bp, Mus musculus
tttctgcaacagagtctattgagat

SEQ ID NO: 848647 - DNA, 25 bp, Mus musculus
tttctgcaacagtgtctattgagat

SEQ ID NO: 848648 - DNA, 25 bp, Mus musculus
tttctgcagtcactgcaccggtgca

SEQ ID NO: 848649 - DNA, 25 bp, Mus musculus
tttctgcagtcagtgcaccggtgca

SEQ ID NO: 848650 - DNA, 25 bp, Mus musculus
tttctgcataagcaccatggtggat

SEQ ID NO: 848651 - DNA, 25 bp, Mus musculus
tttctgcataaggaccatggtggat

SEQ ID NO: 848652 - DNA, 25 bp, Mus musculus
tttctgcatccaccgtcagcttctg

SEQ ID NO: 848653 - DNA, 25 bp, Mus musculus
tttctgcatccagcgtcagcttctg

SEQ ID NO: 848654 - DNA, 25 bp, Mus musculus
tttctgcattctcgaggagttggcc

SEQ ID NO: 848655 - DNA, 25 bp, Mus musculus
tttctgcattctggaggagttggcc

SEQ ID NO: 848656 - DNA, 25 bp, Mus musculus
tttctgccgaggatacattgcgagc

SEQ ID NO: 848657 - DNA, 25 bp, Mus musculus
tttctgccgaggttacattgcgagc

SEQ ID NO: 848658 - DNA, 25 bp, Mus musculus
tttctgccgggcacagatctccatg

SEQ ID NO: 848659 - DNA, 25 bp, Mus musculus
tttctgccgggctcagatctccatg

SEQ ID NO: 848660 - DNA, 25 bp, Mus musculus
tttctgccttcaaagagtccctctt

SEQ ID NO: 848661 - DNA, 25 bp, Mus musculus
tttctgccttcatagagtccctctt

SEQ ID NO: 848662 - DNA, 25 bp, Mus musculus
tttctgctcatcaagggtggcagcg

SEQ ID NO: 848663 - DNA, 25 bp, Mus musculus
tttctgctcatctagggtggcagcg

SEQ ID NO: 848664 - DNA, 25 bp, Mus musculus
tttctgctccacacgttgccttcga

SEQ ID NO: 848665 - DNA, 25 bp, Mus musculus
tttctgctccactcgttgccttcga

SEQ ID NO: 848666 - DNA, 25 bp, Mus musculus
tttctgctcttaacagccacaagga

SEQ ID NO: 848667 - DNA, 25 bp, Mus musculus
tttctgctcttatcagccacaagga

SEQ ID NO: 848668 - DNA, 25 bp, Mus musculus
tttctgctgaatcccctgctactgc

SEQ ID NO: 848669 - DNA, 25 bp, Mus musculus
tttctgctgaatgccctgctactgc

SEQ ID NO: 848670 - DNA, 25 bp, Mus musculus
tttctgctgcggactcaggcagagc

SEQ ID NO: 848671 - DNA, 25 bp, Mus musculus
tttctgctgcggtctcaggcagagc

SEQ ID NO: 848672 - DNA, 25 bp, Mus musculus
tttctgctgggcctaagcctccggg

SEQ ID NO: 848673 - DNA, 25 bp, Mus musculus
tttctgctgggcgtaagcctccggg

SEQ ID NO: 848674 - DNA, 25 bp, Mus musculus
tttctgctgttaatgaggtcatggt

SEQ ID NO: 848675 - DNA, 25 bp, Mus musculus
tttctgctgttattgaggtcatggt

SEQ ID NO: 848676 - DNA, 25 bp, Mus musculus
tttctgcttgagaccctcaatcggc

SEQ ID NO: 848677 - DNA, 25 bp, Mus musculus
tttctgcttgagtccctcaatcggc

SEQ ID NO: 848678 - DNA, 25 bp, Mus musculus
tttctgcttggtcggcacggctgca

SEQ ID NO: 848679 - DNA, 25 bp, Mus musculus
tttctgcttggtgggcacggctgca

SEQ ID NO: 848680 - DNA, 25 bp, Mus musculus
tttctggaaattcccgacttggaca

SEQ ID NO: 848681 - DNA, 25 bp, Mus musculus
tttctggaaattgccgacttggaca

SEQ ID NO: 848682 - DNA, 25 bp, Mus musculus
tttctggaaccacaaggccggtgcg

SEQ ID NO: 848683 - DNA, 25 bp, Mus musculus
tttctggaaccagaaggccggtgcg

SEQ ID NO: 848684 - DNA, 25 bp, Mus musculus
tttctggacagacgattcatcaatt

SEQ ID NO: 848685 - DNA, 25 bp, Mus musculus
tttctggacagaggattcatcaatt

SEQ ID NO: 848686 - DNA, 25 bp, Mus musculus
tttctggagccgcacgagacattca

SEQ ID NO: 848687 - DNA, 25 bp, Mus musculus
tttctggagccggacgagacattca

SEQ ID NO: 848688 - DNA, 25 bp, Mus musculus
tttctggaggtcaggcctgcaagcc

SEQ ID NO: 848689 - DNA, 25 bp, Mus musculus
tttctggaggtctggcctgcaagcc

SEQ ID NO: 848690 - DNA, 25 bp, Mus musculus
tttctggatcatcaggccgaggctg

SEQ ID NO: 848691 - DNA, 25 bp, Mus musculus
tttctggatcatgaggccgaggctg

SEQ ID NO: 848692 - DNA, 25 bp, Mus musculus
tttctggcaagacaaaatgctgggc

SEQ ID NO: 848693 - DNA, 25 bp, Mus musculus
tttctggcaagagaaaatgctgggc

SEQ ID NO: 848694 - DNA, 25 bp, Mus musculus
tttctggcacccaaggaaccagtgg

SEQ ID NO: 848695 - DNA, 25 bp, Mus musculus
tttctggcaccctaggaaccagtgg

SEQ ID NO: 848696 - DNA, 25 bp, Mus musculus
tttctggccaccaagacgtcgtgag

SEQ ID NO: 848697 - DNA, 25 bp, Mus musculus
tttctggccacctagacgtcgtgag

SEQ ID NO: 848698 - DNA, 25 bp, Mus musculus
tttctggccacgacagcaccgtgaa

SEQ ID NO: 848699 - DNA, 25 bp, Mus musculus
tttctggccacgtcagcaccgtgaa

SEQ ID NO: 848700 - DNA, 25 bp, Mus musculus
tttctggcccaaacggagcagggag

SEQ ID NO: 848701 - DNA, 25 bp, Mus musculus
tttctggcccaatcggagcagggag

SEQ ID NO: 848702 - DNA, 25 bp, Mus musculus
tttctggctaaacgagagatctcga

SEQ ID NO: 848703 - DNA, 25 bp, Mus musculus
tttctggctaaaggagagatctcga

SEQ ID NO: 848704 - DNA, 25 bp, Mus musculus
tttctggctaagcaattgcaagcgg

SEQ ID NO: 848705 - DNA, 25 bp, Mus musculus
tttctggctaaggaattgcaagcgg

SEQ ID NO: 848706 - DNA, 25 bp, Mus musculus
tttctggctgctaagactgttgagg

SEQ ID NO: 848707 - DNA, 25 bp, Mus musculus
tttctggctgcttagactgttgagg

SEQ ID NO: 848708 - DNA, 25 bp, Mus musculus
tttctgggaaacaggagctggccag

SEQ ID NO: 848709 - DNA, 25 bp, Mus musculus
tttctgggaaactggagctggccag

SEQ ID NO: 848710 - DNA, 25 bp, Mus musculus
tttctgggacggatcaatgagatcg

SEQ ID NO: 848711 - DNA, 25 bp, Mus musculus
tttctgggacggttcaatgagatcg

SEQ ID NO: 848712 - DNA, 25 bp, Mus musculus
tttctgggtttccttgggctctgca

SEQ ID NO: 848713 - DNA, 25 bp, Mus musculus
tttctgggtttcgttgggctctgca

SEQ ID NO: 848714 - DNA, 25 bp, Mus musculus
tttctggtactgacacttacctggc

SEQ ID NO: 848715 - DNA, 25 bp, Mus musculus
tttctggtactgtcacttacctggc

SEQ ID NO: 848716 - DNA, 25 bp, Mus musculus
tttctggtccatagaaaggaataga

SEQ ID NO: 848717 - DNA, 25 bp, Mus musculus
tttctggtccattgaaaggaataga

SEQ ID NO: 848718 - DNA, 25 bp, Mus musculus
tttctggtccttataaaagctctgg

SEQ ID NO: 848719 - DNA, 25 bp, Mus musculus
tttctggtccttttaaaagctctgg

SEQ ID NO: 848720 - DNA, 25 bp, Mus musculus
tttctggtctcccctccaagcagat

SEQ ID NO: 848721 - DNA, 25 bp, Mus musculus
tttctggtctccgctccaagcagat

SEQ ID NO: 848722 - DNA, 25 bp, Mus musculus
tttctggtctgaccgacggaaccca

SEQ ID NO: 848723 - DNA, 25 bp, Mus musculus
tttctggtctgagcgacggaaccca

SEQ ID NO: 848724 - DNA, 25 bp, Mus musculus
tttctggtctggacccaaacgctgt

SEQ ID NO: 848725 - DNA, 25 bp, Mus musculus
tttctggtctggtcccaaacgctgt

SEQ ID NO: 848726 - DNA, 25 bp, Mus musculus
tttctggtgggcaatgtggatgaaa

SEQ ID NO: 848727 - DNA, 25 bp, Mus musculus
tttctggtgggctatgtggatgaaa

SEQ ID NO: 848728 - DNA, 25 bp, Mus musculus
tttctggttcagcttcaagagaaag

SEQ ID NO: 848729 - DNA, 25 bp, Mus musculus
tttctggttcaggttcaagagaaag

SEQ ID NO: 848730 - DNA, 25 bp, Mus musculus
tttctgtaaaccaagcgccatgctg

SEQ ID NO: 848731 - DNA, 25 bp, Mus musculus
tttctgtaaacctagcgccatgctg

SEQ ID NO: 848732 - DNA, 25 bp, Mus musculus
tttctgtaagtcaacggcaaacacc

SEQ ID NO: 848733 - DNA, 25 bp, Mus musculus
tttctgtaagtctacggcaaacacc

SEQ ID NO: 848734 - DNA, 25 bp, Mus musculus
tttctgtagagtctgccgcatggcc

SEQ ID NO: 848735 - DNA, 25 bp, Mus musculus
tttctgtagagtgtgccgcatggcc

SEQ ID NO: 848736 - DNA, 25 bp, Mus musculus
tttctgtccattcattccaggcctc

SEQ ID NO: 848737 - DNA, 25 bp, Mus musculus
tttctgtccattgattccaggcctc

SEQ ID NO: 848738 - DNA, 25 bp, Mus musculus
tttctgtggagcatgcggtcctaca

SEQ ID NO: 848739 - DNA, 25 bp, Mus musculus
tttctgtggagcttgcggtcctaca

SEQ ID NO: 848740 - DNA, 25 bp, Mus musculus
tttctgtggcaactcaggtcggctg

SEQ ID NO: 848741 - DNA, 25 bp, Mus musculus
tttctgtggcaagtcaggtcggctg

SEQ ID NO: 848742 - DNA, 25 bp, Mus musculus
tttctgtggcccagtacgcccttgc

SEQ ID NO: 848743 - DNA, 25 bp, Mus musculus
tttctgtggccctgtacgcccttgc

SEQ ID NO: 848744 - DNA, 25 bp, Mus musculus
tttctgtggcttatggtgcaccgat

SEQ ID NO: 848745 - DNA, 25 bp, Mus musculus
tttctgtggcttttggtgcaccgat

SEQ ID NO: 848746 - DNA, 25 bp, Mus musculus
tttctgtgtgcgagtcacctctaga

SEQ ID NO: 848747 - DNA, 25 bp, Mus musculus
tttctgtgtgcgtgtcacctctaga

SEQ ID NO: 848748 - DNA, 25 bp, Mus musculus
tttctgttctgtccataggcacgga

SEQ ID NO: 848749 - DNA, 25 bp, Mus musculus
tttctgttctgtgcataggcacgga

SEQ ID NO: 848750 - DNA, 25 bp, Mus musculus
tttctgttgactatggcaaaaagtc

SEQ ID NO: 848751 - DNA, 25 bp, Mus musculus
tttctgttgactttggcaaaaagtc

SEQ ID NO: 848752 - DNA, 25 bp, Mus musculus
tttctgtttgcacagaccgttcttg

SEQ ID NO: 848753 - DNA, 25 bp, Mus musculus
tttctgtttgcagagaccgttcttg

SEQ ID NO: 848754 - DNA, 25 bp, Mus musculus
tttcttacaggtaactatggatgca

SEQ ID NO: 848755 - DNA, 25 bp, Mus musculus
tttcttacaggtcaagcaagatgcc

SEQ ID NO: 848756 - DNA, 25 bp, Mus musculus
tttcttacaggtgaagcaagatgcc

SEQ ID NO: 848757 - DNA, 25 bp, Mus musculus
tttcttacaggttactatggatgca

SEQ ID NO: 848758 - DNA, 25 bp, Mus musculus
tttcttaccgaaatggcaccctctt

SEQ ID NO: 848759 - DNA, 25 bp, Mus musculus
tttcttaccgaattggcaccctctt

SEQ ID NO: 848760 - DNA, 25 bp, Mus musculus
tttcttatccgccagagcgaaacca

SEQ ID NO: 848761 - DNA, 25 bp, Mus musculus
tttcttatccgcgagagcgaaacca

SEQ ID NO: 848762 - DNA, 25 bp, Mus musculus
tttcttcaaagccagagatgatttt

SEQ ID NO: 848763 - DNA, 25 bp, Mus musculus
tttcttcaaagcgagagatgatttt

SEQ ID NO: 848764 - DNA, 25 bp, Mus musculus
tttcttcacctgacgcctggccagg

SEQ ID NO: 848765 - DNA, 25 bp, Mus musculus
tttcttcacctgtcgcctggccagg

SEQ ID NO: 848766 - DNA, 25 bp, Mus musculus
tttcttcaccttagcagggcgggaa

SEQ ID NO: 848767 - DNA, 25 bp, Mus musculus
tttcttcacctttgcagggcgggaa

SEQ ID NO: 848768 - DNA, 25 bp, Mus musculus
tttcttcagagccaacattcagaag

SEQ ID NO: 848769 - DNA, 25 bp, Mus musculus
tttcttcagagcgaacattcagaag

SEQ ID NO: 848770 - DNA, 25 bp, Mus musculus
tttcttcagcttcggcaaatgtgtg

SEQ ID NO: 848771 - DNA, 25 bp, Mus musculus
tttcttcagcttgggcaaatgtgtg

SEQ ID NO: 848772 - DNA, 25 bp, Mus musculus
tttcttcagtccctgctctcaaggg

SEQ ID NO: 848773 - DNA, 25 bp, Mus musculus
tttcttcagtccgtgctctcaaggg

SEQ ID NO: 848774 - DNA, 25 bp, Mus musculus
tttcttcccacgatgctaccgattg

SEQ ID NO: 848775 - DNA, 25 bp, Mus musculus
tttcttcccacgttgctaccgattg

SEQ ID NO: 848776 - DNA, 25 bp, Mus musculus
tttcttcccttacgacgaaatcgag

SEQ ID NO: 848777 - DNA, 25 bp, Mus musculus
tttcttcccttaggacgaaatcgag

SEQ ID NO: 848778 - DNA, 25 bp, Mus musculus
tttcttccggaaacattttcgctgg

SEQ ID NO: 848779 - DNA, 25 bp, Mus musculus
tttcttccggaatcattttcgctgg

SEQ ID NO: 848780 - DNA, 25 bp, Mus musculus
tttcttccttggaccgcagcaggta

SEQ ID NO: 848781 - DNA, 25 bp, Mus musculus
tttcttccttggtccgcagcaggta

SEQ ID NO: 848782 - DNA, 25 bp, Mus musculus
tttcttcgaaaaaagctcattggga

SEQ ID NO: 848783 - DNA, 25 bp, Mus musculus
tttcttcgaaaatagctcattggga

SEQ ID NO: 848784 - DNA, 25 bp, Mus musculus
tttcttcgggatcatcttcacctct

SEQ ID NO: 848785 - DNA, 25 bp, Mus musculus
tttcttcgggatgatcttcacctct

SEQ ID NO: 848786 - DNA, 25 bp, Mus musculus
tttcttcgtataccgctaacctagc

SEQ ID NO: 848787 - DNA, 25 bp, Mus musculus
tttcttcgtatagcgctaacctagc

SEQ ID NO: 848788 - DNA, 25 bp, Mus musculus
tttcttcgtgtcactttcggctggg

SEQ ID NO: 848789 - DNA, 25 bp, Mus musculus
tttcttcgtgtctctttcggctggg

SEQ ID NO: 848790 - DNA, 25 bp, Mus musculus
tttcttctatagacactggaatctg

SEQ ID NO: 848791 - DNA, 25 bp, Mus musculus
tttcttctatagtcactggaatctg

SEQ ID NO: 848792 - DNA, 25 bp, Mus musculus
tttcttcttccgcacagcgggtttc

SEQ ID NO: 848793 - DNA, 25 bp, Mus musculus
tttcttcttccggacagcgggtttc

SEQ ID NO: 848794 - DNA, 25 bp, Mus musculus
tttcttcttctacgtggtgtcccca

SEQ ID NO: 848795 - DNA, 25 bp, Mus musculus
tttcttcttctaggtggtgtcccca

SEQ ID NO: 848796 - DNA, 25 bp, Mus musculus
tttcttgaagctcctaagaccacga

SEQ ID NO: 848797 - DNA, 25 bp, Mus musculus
tttcttgaagctgctaagaccacga

SEQ ID NO: 848798 - DNA, 25 bp, Mus musculus
tttcttgaccacaggaaagaccgct

SEQ ID NO: 848799 - DNA, 25 bp, Mus musculus
tttcttgaccactggaaagaccgct

SEQ ID NO: 848800 - DNA, 25 bp, Mus musculus
tttcttgagcagaccagaggacgcg

SEQ ID NO: 848801 - DNA, 25 bp, Mus musculus
tttcttgagcagtccagaggacgcg

SEQ ID NO: 848802 - DNA, 25 bp, Mus musculus
tttcttgccgaaagcttgtctcaac

SEQ ID NO: 848803 - DNA, 25 bp, Mus musculus
tttcttgccgaatgcttgtctcaac

SEQ ID NO: 848804 - DNA, 25 bp, Mus musculus
tttcttgcctctccaaagaacaagt

SEQ ID NO: 848805 - DNA, 25 bp, Mus musculus
tttcttgcctctgcaaagaacaagt

SEQ ID NO: 848806 - DNA, 25 bp, Mus musculus
tttcttgcgggcctgccagatagcc

SEQ ID NO: 848807 - DNA, 25 bp, Mus musculus
tttcttgcgggcgtgccagatagcc

SEQ ID NO: 848808 - DNA, 25 bp, Mus musculus
tttcttgcttgtagggacccaaatt

SEQ ID NO: 848809 - DNA, 25 bp, Mus musculus
tttcttgcttgttgggacccaaatt

SEQ ID NO: 848810 - DNA, 25 bp, Mus musculus
tttcttggaaggaaggcaagactgg

SEQ ID NO: 848811 - DNA, 25 bp, Mus musculus
tttcttggaaggtaggcaagactgg

SEQ ID NO: 848812 - DNA, 25 bp, Mus musculus
tttcttggaagtagccgatgaggcc

SEQ ID NO: 848813 - DNA, 25 bp, Mus musculus
tttcttggaagttgccgatgaggcc

SEQ ID NO: 848814 - DNA, 25 bp, Mus musculus
tttcttgggagaattggatgttccg

SEQ ID NO: 848815 - DNA, 25 bp, Mus musculus
tttcttgggagatttggatgttccg

SEQ ID NO: 848816 - DNA, 25 bp, Mus musculus
tttcttggtcggcagacagcatccg

SEQ ID NO: 848817 - DNA, 25 bp, Mus musculus
tttcttggtcgggagacagcatccg

SEQ ID NO: 848818 - DNA, 25 bp, Mus musculus
tttcttggtctgagcttgaaggagc

SEQ ID NO: 848819 - DNA, 25 bp, Mus musculus
tttcttggtctgtgcttgaaggagc

SEQ ID NO: 848820 - DNA, 25 bp, Mus musculus
tttcttggtgaacagtggatcagaa

SEQ ID NO: 848821 - DNA, 25 bp, Mus musculus
tttcttggtgaagagtggatcagaa

SEQ ID NO: 848822 - DNA, 25 bp, Mus musculus
tttcttggttctagacagaagttgg

SEQ ID NO: 848823 - DNA, 25 bp, Mus musculus
tttcttggttcttgacagaagttgg

SEQ ID NO: 848824 - DNA, 25 bp, Mus musculus
tttcttgtatctctgcctaggacac

SEQ ID NO: 848825 - DNA, 25 bp, Mus musculus
tttcttgtatctgtgcctaggacac

SEQ ID NO: 848826 - DNA, 25 bp, Mus musculus
tttcttgtccctcttgtccctctgt

SEQ ID NO: 848827 - DNA, 25 bp, Mus musculus
tttcttgtccctgttgtccctctgt

SEQ ID NO: 848828 - DNA, 25 bp, Mus musculus
tttcttgtgtaaaccagagctgtcc

SEQ ID NO: 848829 - DNA, 25 bp, Mus musculus
tttcttgtgtaatccagagctgtcc

SEQ ID NO: 848830 - DNA, 25 bp, Mus musculus
tttcttgttgctcacgtctcctgaa

SEQ ID NO: 848831 - DNA, 25 bp, Mus musculus
tttcttgttgctgacgtctcctgaa

SEQ ID NO: 848832 - DNA, 25 bp, Mus musculus
tttcttgttgtcacaggccaaagct

SEQ ID NO: 848833 - DNA, 25 bp, Mus musculus
tttcttgttgtctcaggccaaagct

SEQ ID NO: 848834 - DNA, 25 bp, Mus musculus
tttctttacacaacagagttttggg

SEQ ID NO: 848835 - DNA, 25 bp, Mus musculus
tttctttacacatcagagttttggg

SEQ ID NO: 848836 - DNA, 25 bp, Mus musculus
tttctttccggtcgttggccgcctg

SEQ ID NO: 848837 - DNA, 25 bp, Mus musculus
tttctttccggtggttggccgcctg

SEQ ID NO: 848838 - DNA, 25 bp, Mus musculus
tttctttcctgtccgaggccgggct

SEQ ID NO: 848839 - DNA, 25 bp, Mus musculus
tttctttcctgtgcgaggccgggct

SEQ ID NO: 848840 - DNA, 25 bp, Mus musculus
tttctttgcagtccacctcaaggag

SEQ ID NO: 848841 - DNA, 25 bp, Mus musculus
tttctttgcagtgcacctcaaggag

SEQ ID NO: 848842 - DNA, 25 bp, Mus musculus
tttctttggatgctccggattggag

SEQ ID NO: 848843 - DNA, 25 bp, Mus musculus
tttctttggatggtccggattggag

SEQ ID NO: 848844 - DNA, 25 bp, Mus musculus
tttcttttagacacctttgtcctgg

SEQ ID NO: 848845 - DNA, 25 bp, Mus musculus
tttcttttagactcctttgtcctgg

SEQ ID NO: 848846 - DNA, 25 bp, Mus musculus
tttcttttgccaccactgatgagca

SEQ ID NO: 848847 - DNA, 25 bp, Mus musculus
tttcttttgccagcactgatgagca

SEQ ID NO: 848848 - DNA, 25 bp, Mus musculus
tttctttttctcaacagagctgggt

SEQ ID NO: 848849 - DNA, 25 bp, Mus musculus
tttctttttctctacagagctgggt

SEQ ID NO: 848850 - DNA, 25 bp, Mus musculus
tttctttttgtacagatgacagccg

SEQ ID NO: 848851 - DNA, 25 bp, Mus musculus
tttctttttgtagagatgacagccg

SEQ ID NO: 848852 - DNA, 25 bp, Mus musculus
tttgaaaaagagagtactgaccacc

SEQ ID NO: 848853 - DNA, 25 bp, Mus musculus
tttgaaaaagagtgtactgaccacc

SEQ ID NO: 848854 - DNA, 25 bp, Mus musculus
tttgaaaaccagctggacatgaaag

SEQ ID NO: 848855 - DNA, 25 bp, Mus musculus
tttgaaaaccaggtggacatgaaag

SEQ ID NO: 848856 - DNA, 25 bp, Mus musculus
tttgaaaaggctctggagcttctcc

SEQ ID NO: 848857 - DNA, 25 bp, Mus musculus
tttgaaaaggctgtggagcttctcc

SEQ ID NO: 848858 - DNA, 25 bp, Mus musculus
tttgaaaatatacagagccacttgg

SEQ ID NO: 848859 - DNA, 25 bp, Mus musculus
tttgaaaatatagagagccacttgg

SEQ ID NO: 848860 - DNA, 25 bp, Mus musculus
tttgaaaatgcacaccacagagagg

SEQ ID NO: 848861 - DNA, 25 bp, Mus musculus
tttgaaaatgcagaccacagagagg

SEQ ID NO: 848862 - DNA, 25 bp, Mus musculus
tttgaaaatggaaaagcgcgatgcc

SEQ ID NO: 848863 - DNA, 25 bp, Mus musculus
tttgaaaatggataagcgcgatgcc

SEQ ID NO: 848864 - DNA, 25 bp, Mus musculus
tttgaaaatgtgcaggtgttgacca

SEQ ID NO: 848865 - DNA, 25 bp, Mus musculus
tttgaaaatgtggaggtgttgacca

SEQ ID NO: 848866 - DNA, 25 bp, Mus musculus
tttgaaacagatcaacggtaccggc

SEQ ID NO: 848867 - DNA, 25 bp, Mus musculus
tttgaaacagatgaacggtaccggc

SEQ ID NO: 848868 - DNA, 25 bp, Mus musculus
tttgaaacatttcaaggcacctgga

SEQ ID NO: 848869 - DNA, 25 bp, Mus musculus
tttgaaacatttgaaggcacctgga

SEQ ID NO: 848870 - DNA, 25 bp, Mus musculus
tttgaaaccgacaacaacatcgtag

SEQ ID NO: 848871 - DNA, 25 bp, Mus musculus
tttgaaaccgactacaacatcgtag

SEQ ID NO: 848872 - DNA, 25 bp, Mus musculus
tttgaaacctagatcaagatccact

SEQ ID NO: 848873 - DNA, 25 bp, Mus musculus
tttgaaacctagttcaagatccact

SEQ ID NO: 848874 - DNA, 25 bp, Mus musculus
tttgaaacttgtcaagcgactctac

SEQ ID NO: 848875 - DNA, 25 bp, Mus musculus
tttgaaacttgtgaagcgactctac

SEQ ID NO: 848876 - DNA, 25 bp, Mus musculus
tttgaaagaccaccaggttctggat

SEQ ID NO: 848877 - DNA, 25 bp, Mus musculus
tttgaaagaccagcaggttctggat

SEQ ID NO: 848878 - DNA, 25 bp, Mus musculus
tttgaaagactgacccgggacaagt

SEQ ID NO: 848879 - DNA, 25 bp, Mus musculus
tttgaaagactgtcccgggacaagt

SEQ ID NO: 848880 - DNA, 25 bp, Mus musculus
tttgaaagcaaccagaggacttgca

SEQ ID NO: 848881 - DNA, 25 bp, Mus musculus
tttgaaagcaacgagaggacttgca

SEQ ID NO: 848882 - DNA, 25 bp, Mus musculus
tttgaaagcctcagtagtgaagagc

SEQ ID NO: 848883 - DNA, 25 bp, Mus musculus
tttgaaagcctctgtagtgaagagc

SEQ ID NO: 848884 - DNA, 25 bp, Mus musculus
tttgaaaggcaaactctaggaggct

SEQ ID NO: 848885 - DNA, 25 bp, Mus musculus
tttgaaaggcaatctctaggaggct

SEQ ID NO: 848886 - DNA, 25 bp, Mus musculus
tttgaaaggccccaagactttgact

SEQ ID NO: 848887 - DNA, 25 bp, Mus musculus
tttgaaaggcccgaagactttgact

SEQ ID NO: 848888 - DNA, 25 bp, Mus musculus
tttgaaaggcgtcagtgcagccgcc

SEQ ID NO: 848889 - DNA, 25 bp, Mus musculus
tttgaaaggcgtgagtgcagccgcc

SEQ ID NO: 848890 - DNA, 25 bp, Mus musculus
tttgaaagggcaaaagcggcagtag

SEQ ID NO: 848891 - DNA, 25 bp, Mus musculus
tttgaaagggcataagcggcagtag

SEQ ID NO: 848892 - DNA, 25 bp, Mus musculus
tttgaaatcagcaagaaagaaatgc

SEQ ID NO: 848893 - DNA, 25 bp, Mus musculus
tttgaaatcagctagaaagaaatgc

SEQ ID NO: 848894 - DNA, 25 bp, Mus musculus
tttgaaatccccacaactcccgaag

SEQ ID NO: 848895 - DNA, 25 bp, Mus musculus
tttgaaatcccctcaactcccgaag

SEQ ID NO: 848896 - DNA, 25 bp, Mus musculus
tttgaaatgcacacttctgagctgg

SEQ ID NO: 848897 - DNA, 25 bp, Mus musculus
tttgaaatgcactcttctgagctgg

SEQ ID NO: 848898 - DNA, 25 bp, Mus musculus
tttgaaattccacacaagtttgttg

SEQ ID NO: 848899 - DNA, 25 bp, Mus musculus
tttgaaattccagacaagtttgttg

SEQ ID NO: 848900 - DNA, 25 bp, Mus musculus
tttgaaattcttcgaatggcagaag

SEQ ID NO: 848901 - DNA, 25 bp, Mus musculus
tttgaaattcttggaatggcagaag

SEQ ID NO: 848902 - DNA, 25 bp, Mus musculus
tttgaacaagtgagggaaataaggc

SEQ ID NO: 848903 - DNA, 25 bp, Mus musculus
tttgaacaagtgtgggaaataaggc

SEQ ID NO: 848904 - DNA, 25 bp, Mus musculus
tttgaacaatggctgcgaaggcacc

SEQ ID NO: 848905 - DNA, 25 bp, Mus musculus
tttgaacaatgggtgcgaaggcacc

SEQ ID NO: 848906 - DNA, 25 bp, Mus musculus
tttgaacacggaatgaagaagccat

SEQ ID NO: 848907 - DNA, 25 bp, Mus musculus
tttgaacacggattgaagaagccat

SEQ ID NO: 848908 - DNA, 25 bp, Mus musculus
tttgaacacgtcaccagccgcaaca

SEQ ID NO: 848909 - DNA, 25 bp, Mus musculus
tttgaacacgtctccagccgcaaca

SEQ ID NO: 848910 - DNA, 25 bp, Mus musculus
tttgaacagactctcatgaactgtc

SEQ ID NO: 848911 - DNA, 25 bp, Mus musculus
tttgaacagactgtcatgaactgtc

SEQ ID NO: 848912 - DNA, 25 bp, Mus musculus
tttgaacagcatcaactcatcagat

SEQ ID NO: 848913 - DNA, 25 bp, Mus musculus
tttgaacagcatgaactcatcagat

SEQ ID NO: 848914 - DNA, 25 bp, Mus musculus
tttgaacagccgctttccaggagtg

SEQ ID NO: 848915 - DNA, 25 bp, Mus musculus
tttgaacagccggtttccaggagtg

SEQ ID NO: 848916 - DNA, 25 bp, Mus musculus
tttgaaccagatccaatatctcagc

SEQ ID NO: 848917 - DNA, 25 bp, Mus musculus
tttgaaccagatgcaatatctcagc

SEQ ID NO: 848918 - DNA, 25 bp, Mus musculus
tttgaaccatgaatcttttactcct

SEQ ID NO: 848919 - DNA, 25 bp, Mus musculus
tttgaaccatgattcttttactcct

SEQ ID NO: 848920 - DNA, 25 bp, Mus musculus
tttgaaccctacctctgggaataat

SEQ ID NO: 848921 - DNA, 25 bp, Mus musculus
tttgaaccctacgtctgggaataat

SEQ ID NO: 848922 - DNA, 25 bp, Mus musculus
tttgaaccgtaccacgacagtgcgc

SEQ ID NO: 848923 - DNA, 25 bp, Mus musculus
tttgaaccgtacgacgacagtgcgc

SEQ ID NO: 848924 - DNA, 25 bp, Mus musculus
tttgaacggcagcatagcctgccca

SEQ ID NO: 848925 - DNA, 25 bp, Mus musculus
tttgaacggcaggatagcctgccca

SEQ ID NO: 848926 - DNA, 25 bp, Mus musculus
tttgaacgtcttcaaccatgactaa

SEQ ID NO: 848927 - DNA, 25 bp, Mus musculus
tttgaacgtcttgaaccatgactaa

SEQ ID NO: 848928 - DNA, 25 bp, Mus musculus
tttgaactggaactttctgggaagg

SEQ ID NO: 848929 - DNA, 25 bp, Mus musculus
tttgaactggaagtttctgggaagg

SEQ ID NO: 848930 - DNA, 25 bp, Mus musculus
tttgaagaaattaacgccactgagc

SEQ ID NO: 848931 - DNA, 25 bp, Mus musculus
tttgaagaaatttacgccactgagc

SEQ ID NO: 848932 - DNA, 25 bp, Mus musculus
tttgaagaagcaattccttcgcagg

SEQ ID NO: 848933 - DNA, 25 bp, Mus musculus
tttgaagaagcatttccttcgcagg

SEQ ID NO: 848934 - DNA, 25 bp, Mus musculus
tttgaagaagcgatcactgcccagg

SEQ ID NO: 848935 - DNA, 25 bp, Mus musculus
tttgaagaagcgttcactgcccagg

SEQ ID NO: 848936 - DNA, 25 bp, Mus musculus
tttgaagaagtgactgaccggtccc

SEQ ID NO: 848937 - DNA, 25 bp, Mus musculus
tttgaagaagtgtctgaccggtccc

SEQ ID NO: 848938 - DNA, 25 bp, Mus musculus
tttgaagactgccgctggagctgta

SEQ ID NO: 848939 - DNA, 25 bp, Mus musculus
tttgaagactgcggctggagctgta

SEQ ID NO: 848940 - DNA, 25 bp, Mus musculus
tttgaagagaaccaagtgcctggga

SEQ ID NO: 848941 - DNA, 25 bp, Mus musculus
tttgaagagaacgaagtgcctggga

SEQ ID NO: 848942 - DNA, 25 bp, Mus musculus
tttgaagagccacgcagctacctgc

SEQ ID NO: 848943 - DNA, 25 bp, Mus musculus
tttgaagagccaggcagctacctgc

SEQ ID NO: 848944 - DNA, 25 bp, Mus musculus
tttgaagatgccctgttggctatag

SEQ ID NO: 848945 - DNA, 25 bp, Mus musculus
tttgaagatgccgtgttggctatag

SEQ ID NO: 848946 - DNA, 25 bp, Mus musculus
tttgaagattacagtttgaaacgag

SEQ ID NO: 848947 - DNA, 25 bp, Mus musculus
tttgaagattactgtttgaaacgag

SEQ ID NO: 848948 - DNA, 25 bp, Mus musculus
tttgaagcagaaccactaggaattg

SEQ ID NO: 848949 - DNA, 25 bp, Mus musculus
tttgaagcagaagcactaggaattg

SEQ ID NO: 848950 - DNA, 25 bp, Mus musculus
tttgaagcaggactgaaggttcaga

SEQ ID NO: 848951 - DNA, 25 bp, Mus musculus
tttgaagcaggagtgaaggttcaga

SEQ ID NO: 848952 - DNA, 25 bp, Mus musculus
tttgaagccaaaagccctccatggg

SEQ ID NO: 848953 - DNA, 25 bp, Mus musculus
tttgaagccaaatgccctccatggg

SEQ ID NO: 848954 - DNA, 25 bp, Mus musculus
tttgaagccctcatgaggatgctgg

SEQ ID NO: 848955 - DNA, 25 bp, Mus musculus
tttgaagccctcttgaggatgctgg

SEQ ID NO: 848956 - DNA, 25 bp, Mus musculus
tttgaagccttgaacctcagcttta

SEQ ID NO: 848957 - DNA, 25 bp, Mus musculus
tttgaagccttgtacctcagcttta

SEQ ID NO: 848958 - DNA, 25 bp, Mus musculus
tttgaagcgattccacgggcactgg

SEQ ID NO: 848959 - DNA, 25 bp, Mus musculus
tttgaagcgattgcacgggcactgg

SEQ ID NO: 848960 - DNA, 25 bp, Mus musculus
tttgaaggacacagcagtcctaacg

SEQ ID NO: 848961 - DNA, 25 bp, Mus musculus
tttgaaggacactgcagtcctaacg

SEQ ID NO: 848962 - DNA, 25 bp, Mus musculus
tttgaaggaccccagcgagctcctg

SEQ ID NO: 848963 - DNA, 25 bp, Mus musculus
tttgaaggacccgagcgagctcctg

SEQ ID NO: 848964 - DNA, 25 bp, Mus musculus
tttgaaggataacctcaggaaggca

SEQ ID NO: 848965 - DNA, 25 bp, Mus musculus
tttgaaggataagctcaggaaggca

SEQ ID NO: 848966 - DNA, 25 bp, Mus musculus
tttgaaggatatacatgatgaccag

SEQ ID NO: 848967 - DNA, 25 bp, Mus musculus
tttgaaggatattcatgatgaccag

SEQ ID NO: 848968 - DNA, 25 bp, Mus musculus
tttgaaggccttatcaagcagccag

SEQ ID NO: 848969 - DNA, 25 bp, Mus musculus
tttgaaggccttttcaagcagccag

SEQ ID NO: 848970 - DNA, 25 bp, Mus musculus
tttgaaggcggcacagaagccacag

SEQ ID NO: 848971 - DNA, 25 bp, Mus musculus
tttgaaggcggctcagaagccacag

SEQ ID NO: 848972 - DNA, 25 bp, Mus musculus
tttgaagggaaaactgaccgcacag

SEQ ID NO: 848973 - DNA, 25 bp, Mus musculus
tttgaagggaaatctgaccgcacag

SEQ ID NO: 848974 - DNA, 25 bp, Mus musculus
tttgaagggcaaagaaaatggaaat

SEQ ID NO: 848975 - DNA, 25 bp, Mus musculus
tttgaagggcaatgaaaatggaaat

SEQ ID NO: 848976 - DNA, 25 bp, Mus musculus
tttgaagtcatccacaaaccccagt

SEQ ID NO: 848977 - DNA, 25 bp, Mus musculus
tttgaagtcatcgacaaaccccagt

SEQ ID NO: 848978 - DNA, 25 bp, Mus musculus
tttgaagtggctcatacacatctat

SEQ ID NO: 848979 - DNA, 25 bp, Mus musculus
tttgaagtggctgatacacatctat

SEQ ID NO: 848980 - DNA, 25 bp, Mus musculus
tttgaagtgtctcaggttataccag

SEQ ID NO: 848981 - DNA, 25 bp, Mus musculus
tttgaagtgtctgaggttataccag

SEQ ID NO: 848982 - DNA, 25 bp, Mus musculus
tttgaagttccgatcgagcaaatcc

SEQ ID NO: 848983 - DNA, 25 bp, Mus musculus
tttgaagttccgttcgagcaaatcc

SEQ ID NO: 848984 - DNA, 25 bp, Mus musculus
tttgaataaagtagacaggctgctg

SEQ ID NO: 848985 - DNA, 25 bp, Mus musculus
tttgaataaagttgacaggctgctg

SEQ ID NO: 848986 - DNA, 25 bp, Mus musculus
tttgaatacaaaattgcaactggcc

SEQ ID NO: 848987 - DNA, 25 bp, Mus musculus
tttgaatacaaatttgcaactggcc

SEQ ID NO: 848988 - DNA, 25 bp, Mus musculus
tttgaatctcacagtaagggtcctg

SEQ ID NO: 848989 - DNA, 25 bp, Mus musculus
tttgaatctcactgtaagggtcctg

SEQ ID NO: 848990 - DNA, 25 bp, Mus musculus
tttgaatgaagacgtctgcagactg

SEQ ID NO: 848991 - DNA, 25 bp, Mus musculus
tttgaatgaagaggtctgcagactg

SEQ ID NO: 848992 - DNA, 25 bp, Mus musculus
tttgaatgcagaagccatctcatct

SEQ ID NO: 848993 - DNA, 25 bp, Mus musculus
tttgaatgcagatgccatctcatct

SEQ ID NO: 848994 - DNA, 25 bp, Mus musculus
tttgaatgcatcattattgctcatg

SEQ ID NO: 848995 - DNA, 25 bp, Mus musculus
tttgaatgcatctttattgctcatg

SEQ ID NO: 848996 - DNA, 25 bp, Mus musculus
tttgaatggaagcacctggtttctc

SEQ ID NO: 848997 - DNA, 25 bp, Mus musculus
tttgaatggaaggacctggtttctc

SEQ ID NO: 848998 - DNA, 25 bp, Mus musculus
tttgaattcagacggacaatatgga

SEQ ID NO: 848999 - DNA, 25 bp, Mus musculus
tttgaattcagagggacaatatgga

SEQ ID NO: 849000 - DNA, 25 bp, Mus musculus
tttgacaaatgcagcagtatgtgcg

SEQ ID NO: 849001 - DNA, 25 bp, Mus musculus
tttgacaaatgctgcagtatgtgcg

SEQ ID NO: 849002 - DNA, 25 bp, Mus musculus
tttgacaaccaacgaaatgccagcc

SEQ ID NO: 849003 - DNA, 25 bp, Mus musculus
tttgacaaccaaggaaatgccagcc

SEQ ID NO: 849004 - DNA, 25 bp, Mus musculus
tttgacaacccactctaccagaaga

SEQ ID NO: 849005 - DNA, 25 bp, Mus musculus
tttgacaacccagtctaccagaaga

SEQ ID NO: 849006 - DNA, 25 bp, Mus musculus
tttgacaacctgattggaaaccaca

SEQ ID NO: 849007 - DNA, 25 bp, Mus musculus
tttgacaacctgtttggaaaccaca

SEQ ID NO: 849008 - DNA, 25 bp, Mus musculus
tttgacaactggcttcagggccatg

SEQ ID NO: 849009 - DNA, 25 bp, Mus musculus
tttgacaactgggttcagggccatg

SEQ ID NO: 849010 - DNA, 25 bp, Mus musculus
tttgacaagatgattcgcaagcctg

SEQ ID NO: 849011 - DNA, 25 bp, Mus musculus
tttgacaagatgtttcgcaagcctg

SEQ ID NO: 849012 - DNA, 25 bp, Mus musculus
tttgacaaggccaggccctgggctg

SEQ ID NO: 849013 - DNA, 25 bp, Mus musculus
tttgacaaggcctggccctgggctg

SEQ ID NO: 849014 - DNA, 25 bp, Mus musculus
tttgacaattacagcgcccagagtg

SEQ ID NO: 849015 - DNA, 25 bp, Mus musculus
tttgacaattactgcgcccagagtg

SEQ ID NO: 849016 - DNA, 25 bp, Mus musculus
tttgacaccaaccagttcatccgag

SEQ ID NO: 849017 - DNA, 25 bp, Mus musculus
tttgacaccaacgagttcatccgag

SEQ ID NO: 849018 - DNA, 25 bp, Mus musculus
tttgacactgggagactgaaccctg

SEQ ID NO: 849019 - DNA, 25 bp, Mus musculus
tttgacactgggtgactgaaccctg

SEQ ID NO: 849020 - DNA, 25 bp, Mus musculus
tttgacagcttgcagccatcagttc

SEQ ID NO: 849021 - DNA, 25 bp, Mus musculus
tttgacagcttggagccatcagttc

SEQ ID NO: 849022 - DNA, 25 bp, Mus musculus
tttgacagtgccagcagaagagtca

SEQ ID NO: 849023 - DNA, 25 bp, Mus musculus
tttgacagtgcctgcagaagagtca

SEQ ID NO: 849024 - DNA, 25 bp, Mus musculus
tttgacatatttacacaacaggtgg

SEQ ID NO: 849025 - DNA, 25 bp, Mus musculus
tttgacatattttcacaacaggtgg

SEQ ID NO: 849026 - DNA, 25 bp, Mus musculus
tttgacatcatgacgggccagaccg

SEQ ID NO: 849027 - DNA, 25 bp, Mus musculus
tttgacatcatgtcgggccagaccg

SEQ ID NO: 849028 - DNA, 25 bp, Mus musculus
tttgacatctctccggttctccagg

SEQ ID NO: 849029 - DNA, 25 bp, Mus musculus
tttgacatctctgcggttctccagg

SEQ ID NO: 849030 - DNA, 25 bp, Mus musculus
tttgacatggctctcaatgagatct

SEQ ID NO: 849031 - DNA, 25 bp, Mus musculus
tttgacatggctgtcaatgagatct

SEQ ID NO: 849032 - DNA, 25 bp, Mus musculus
tttgacatgtttcctctgactcggg

SEQ ID NO: 849033 - DNA, 25 bp, Mus musculus
tttgacatgtttgctctgactcggg

SEQ ID NO: 849034 - DNA, 25 bp, Mus musculus
tttgacattgggaaggacacctacg

SEQ ID NO: 849035 - DNA, 25 bp, Mus musculus
tttgacattgggtaggacacctacg

SEQ ID NO: 849036 - DNA, 25 bp, Mus musculus
tttgaccaaggcaatgaggcacccg

SEQ ID NO: 849037 - DNA, 25 bp, Mus musculus
tttgaccaaggctatgaggcacccg

SEQ ID NO: 849038 - DNA, 25 bp, Mus musculus
tttgaccaccctcggaaaggtcatc

SEQ ID NO: 849039 - DNA, 25 bp, Mus musculus
tttgaccaccctgggaaaggtcatc

SEQ ID NO: 849040 - DNA, 25 bp, Mus musculus
tttgaccacgaacaccatagcacca

SEQ ID NO: 849041 - DNA, 25 bp, Mus musculus
tttgaccacgaagaccatagcacca

SEQ ID NO: 849042 - DNA, 25 bp, Mus musculus
tttgaccagcgtcccgtagagaacg

SEQ ID NO: 849043 - DNA, 25 bp, Mus musculus
tttgaccagcgtgccgtagagaacg

SEQ ID NO: 849044 - DNA, 25 bp, Mus musculus
tttgaccagcttatccttacactgg

SEQ ID NO: 849045 - DNA, 25 bp, Mus musculus
tttgaccagcttttccttacactgg

SEQ ID NO: 849046 - DNA, 25 bp, Mus musculus
tttgacccagagatcacccaggaag

SEQ ID NO: 849047 - DNA, 25 bp, Mus musculus
tttgacccagagttcacccaggaag

SEQ ID NO: 849048 - DNA, 25 bp, Mus musculus
tttgacccatttcagaaaccagcca

SEQ ID NO: 849049 - DNA, 25 bp, Mus musculus
tttgacccatttgagaaaccagcca

SEQ ID NO: 849050 - DNA, 25 bp, Mus musculus
tttgaccgagagatcctccccttca

SEQ ID NO: 849051 - DNA, 25 bp, Mus musculus
tttgaccgagagttcctccccttca

SEQ ID NO: 849052 - DNA, 25 bp, Mus musculus
tttgaccgagtcaacacccaccaga

SEQ ID NO: 849053 - DNA, 25 bp, Mus musculus
tttgaccgagtctacacccaccaga

SEQ ID NO: 849054 - DNA, 25 bp, Mus musculus
tttgaccgcagtcttaacattaagg

SEQ ID NO: 849055 - DNA, 25 bp, Mus musculus
tttgaccgcagtgttaacattaagg

SEQ ID NO: 849056 - DNA, 25 bp, Mus musculus
tttgaccgctgtcccagcttctcgg

SEQ ID NO: 849057 - DNA, 25 bp, Mus musculus
tttgaccgctgtgccagcttctcgg

SEQ ID NO: 849058 - DNA, 25 bp, Mus musculus
tttgaccgtgccctcagggcactgc

SEQ ID NO: 849059 - DNA, 25 bp, Mus musculus
tttgaccgtgccgtcagggcactgc

SEQ ID NO: 849060 - DNA, 25 bp, Mus musculus
tttgacctcaacatgaagatttcca

SEQ ID NO: 849061 - DNA, 25 bp, Mus musculus
tttgacctcaacttgaagatttcca

SEQ ID NO: 849062 - DNA, 25 bp, Mus musculus
tttgacctccgtccagaccaggagc

SEQ ID NO: 849063 - DNA, 25 bp, Mus musculus
tttgacctccgtgcagaccaggagc

SEQ ID NO: 849064 - DNA, 25 bp, Mus musculus
tttgacctgaagctggcgcacgttt

SEQ ID NO: 849065 - DNA, 25 bp, Mus musculus
tttgacctgaaggtggcgcacgttt

SEQ ID NO: 849066 - DNA, 25 bp, Mus musculus
tttgacctgagacagtggttcctgg

SEQ ID NO: 849067 - DNA, 25 bp, Mus musculus
tttgacctgagagagtggttcctgg

SEQ ID NO: 849068 - DNA, 25 bp, Mus musculus
tttgacctgctgatcctgggagtgg

SEQ ID NO: 849069 - DNA, 25 bp, Mus musculus
tttgacctgctgttcctgggagtgg

SEQ ID NO: 849070 - DNA, 25 bp, Mus musculus
tttgacctggccaggcagtatgggc

SEQ ID NO: 849071 - DNA, 25 bp, Mus musculus
tttgacctggcctggcagtatgggc

SEQ ID NO: 849072 - DNA, 25 bp, Mus musculus
tttgacctgggcattcgctttgatg

SEQ ID NO: 849073 - DNA, 25 bp, Mus musculus
tttgacctgggctttcgctttgatg

SEQ ID NO: 849074 - DNA, 25 bp, Mus musculus
tttgacctggtgcaccggagtctga

SEQ ID NO: 849075 - DNA, 25 bp, Mus musculus
tttgacctggtggaccggagtctga

SEQ ID NO: 849076 - DNA, 25 bp, Mus musculus
tttgacctgtgcctatacactgggc

SEQ ID NO: 849077 - DNA, 25 bp, Mus musculus
tttgacctgtgcgtatacactgggc

SEQ ID NO: 849078 - DNA, 25 bp, Mus musculus
tttgacgatgaccatcagggcccac

SEQ ID NO: 849079 - DNA, 25 bp, Mus musculus
tttgacgatgacgatcagggcccac

SEQ ID NO: 849080 - DNA, 25 bp, Mus musculus
tttgacgatgagaccctgaggcttc

SEQ ID NO: 849081 - DNA, 25 bp, Mus musculus
tttgacgatgagtccctgaggcttc

SEQ ID NO: 849082 - DNA, 25 bp, Mus musculus
tttgacgcagtcacccaggtcccgg

SEQ ID NO: 849083 - DNA, 25 bp, Mus musculus
tttgacgcagtctcccaggtcccgg

SEQ ID NO: 849084 - DNA, 25 bp, Mus musculus
tttgacgtccccaggatcagcattc

SEQ ID NO: 849085 - DNA, 25 bp, Mus musculus
tttgacgtcccctggatcagcattc

SEQ ID NO: 849086 - DNA, 25 bp, Mus musculus
tttgacgtggacaagaaaaatggtt

SEQ ID NO: 849087 - DNA, 25 bp, Mus musculus
tttgacgtggactagaaaaatggtt

SEQ ID NO: 849088 - DNA, 25 bp, Mus musculus
tttgacgtgtgtcacaccaatgctg

SEQ ID NO: 849089 - DNA, 25 bp, Mus musculus
tttgacgtgtgtgacaccaatgctg

SEQ ID NO: 849090 - DNA, 25 bp, Mus musculus
tttgactacgagaatgactgggccg

SEQ ID NO: 849091 - DNA, 25 bp, Mus musculus
tttgactacgagtatgactgggccg

SEQ ID NO: 849092 - DNA, 25 bp, Mus musculus
tttgactatttgcttgcacatggaa

SEQ ID NO: 849093 - DNA, 25 bp, Mus musculus
tttgactatttggttgcacatggaa

SEQ ID NO: 849094 - DNA, 25 bp, Mus musculus
tttgactcactcatcctgcttcagc

SEQ ID NO: 849095 - DNA, 25 bp, Mus musculus
tttgactcactcttcctgcttcagc

SEQ ID NO: 849096 - DNA, 25 bp, Mus musculus
tttgactcagaccagaaggcactag

SEQ ID NO: 849097 - DNA, 25 bp, Mus musculus
tttgactcagacgagaaggcactag

SEQ ID NO: 849098 - DNA, 25 bp, Mus musculus
tttgactcctatccccactttggca

SEQ ID NO: 849099 - DNA, 25 bp, Mus musculus
tttgactcctatgcccactttggca

SEQ ID NO: 849100 - DNA, 25 bp, Mus musculus
tttgactcggagctcgtaccacggc

SEQ ID NO: 849101 - DNA, 25 bp, Mus musculus
tttgactcggaggtcgtaccacggc

SEQ ID NO: 849102 - DNA, 25 bp, Mus musculus
tttgactcgggaccagaagtttgaa

SEQ ID NO: 849103 - DNA, 25 bp, Mus musculus
tttgactcgggagcagaagtttgaa

SEQ ID NO: 849104 - DNA, 25 bp, Mus musculus
tttgactctctgacagacctggtgg

SEQ ID NO: 849105 - DNA, 25 bp, Mus musculus
tttgactctctgtcagacctggtgg

SEQ ID NO: 849106 - DNA, 25 bp, Mus musculus
tttgactgcaacaccatctccacag

SEQ ID NO: 849107 - DNA, 25 bp, Mus musculus
tttgactgcaactccatctccacag

SEQ ID NO: 849108 - DNA, 25 bp, Mus musculus
tttgactggaacacgcccaagaaag

SEQ ID NO: 849109 - DNA, 25 bp, Mus musculus
tttgactggaactcgcccaagaaag

SEQ ID NO: 849110 - DNA, 25 bp, Mus musculus
tttgactggctacgccggagcctca

SEQ ID NO: 849111 - DNA, 25 bp, Mus musculus
tttgactggctaggccggagcctca

SEQ ID NO: 849112 - DNA, 25 bp, Mus musculus
tttgactgtcatatgacagcactga

SEQ ID NO: 849113 - DNA, 25 bp, Mus musculus
tttgactgtcatttgacagcactga

SEQ ID NO: 849114 - DNA, 25 bp, Mus musculus
tttgactgtgctccctggtcctgtg

SEQ ID NO: 849115 - DNA, 25 bp, Mus musculus
tttgactgtgctgcctggtcctgtg

SEQ ID NO: 849116 - DNA, 25 bp, Mus musculus
tttgactgtgtcatggtgctgctga

SEQ ID NO: 849117 - DNA, 25 bp, Mus musculus
tttgactgtgtcttggtgctgctga

SEQ ID NO: 849118 - DNA, 25 bp, Mus musculus
tttgacttcgctagtcggtgacgcg

SEQ ID NO: 849119 - DNA, 25 bp, Mus musculus
tttgacttcgcttgtcggtgacgcg

SEQ ID NO: 849120 - DNA, 25 bp, Mus musculus
tttgacttcgtcacggagacgccgc

SEQ ID NO: 849121 - DNA, 25 bp, Mus musculus
tttgacttcgtctcggagacgccgc

SEQ ID NO: 849122 - DNA, 25 bp, Mus musculus
tttgacttctgtcagcatgaccttg

SEQ ID NO: 849123 - DNA, 25 bp, Mus musculus
tttgacttctgtgagcatgaccttg

SEQ ID NO: 849124 - DNA, 25 bp, Mus musculus
tttgacttctttcagcagcaggatg

SEQ ID NO: 849125 - DNA, 25 bp, Mus musculus
tttgacttctttgagcagcaggatg

SEQ ID NO: 849126 - DNA, 25 bp, Mus musculus
tttgactttaaacgcgatccgctgg

SEQ ID NO: 849127 - DNA, 25 bp, Mus musculus
tttgactttaaaggcgatccgctgg

SEQ ID NO: 849128 - DNA, 25 bp, Mus musculus
tttgactttggccacaccatggtcc

SEQ ID NO: 849129 - DNA, 25 bp, Mus musculus
tttgactttggcgacaccatggtcc

SEQ ID NO: 849130 - DNA, 25 bp, Mus musculus
tttgagaaactgatccccgatgtgc

SEQ ID NO: 849131 - DNA, 25 bp, Mus musculus
tttgagaaactgttccccgatgtgc

SEQ ID NO: 849132 - DNA, 25 bp, Mus musculus
tttgagaaataaagtcgagacctgt

SEQ ID NO: 849133 - DNA, 25 bp, Mus musculus
tttgagaaataatgtcgagacctgt

SEQ ID NO: 849134 - DNA, 25 bp, Mus musculus
tttgagaacctcatgcagctggtgg

SEQ ID NO: 849135 - DNA, 25 bp, Mus musculus
tttgagaacctcttgcagctggtgg

SEQ ID NO: 849136 - DNA, 25 bp, Mus musculus
tttgagaactatatagccgacatcg

SEQ ID NO: 849137 - DNA, 25 bp, Mus musculus
tttgagaactatttagccgacatcg

SEQ ID NO: 849138 - DNA, 25 bp, Mus musculus
tttgagaagcggaccatgtcggccc

SEQ ID NO: 849139 - DNA, 25 bp, Mus musculus
tttgagaagcggtccatgtcggccc

SEQ ID NO: 849140 - DNA, 25 bp, Mus musculus
tttgagaaggcccacctggagtaga

SEQ ID NO: 849141 - DNA, 25 bp, Mus musculus
tttgagaaggccctgcgctatgccc

SEQ ID NO: 849142 - DNA, 25 bp, Mus musculus
tttgagaaggccgacctggagtaga

SEQ ID NO: 849143 - DNA, 25 bp, Mus musculus
tttgagaaggccgtgcgctatgccc

SEQ ID NO: 849144 - DNA, 25 bp, Mus musculus
tttgagacactcagggtagatgtat

SEQ ID NO: 849145 - DNA, 25 bp, Mus musculus
tttgagacactctgggtagatgtat

SEQ ID NO: 849146 - DNA, 25 bp, Mus musculus
tttgagacagaactctggaccaggc

SEQ ID NO: 849147 - DNA, 25 bp, Mus musculus
tttgagacagaagtctggaccaggc

SEQ ID NO: 849148 - DNA, 25 bp, Mus musculus
tttgagacctgtcacctagacaacg

SEQ ID NO: 849149 - DNA, 25 bp, Mus musculus
tttgagacctgtgacctagacaacg

SEQ ID NO: 849150 - DNA, 25 bp, Mus musculus
tttgagagagccaagttctgggtta

SEQ ID NO: 849151 - DNA, 25 bp, Mus musculus
tttgagagagccctgaaggactaca

SEQ ID NO: 849152 - DNA, 25 bp, Mus musculus
tttgagagagccgtgaaggactaca

SEQ ID NO: 849153 - DNA, 25 bp, Mus musculus
tttgagagagcctagttctgggtta

SEQ ID NO: 849154 - DNA, 25 bp, Mus musculus
tttgagagatcacgagaacaacctc

SEQ ID NO: 849155 - DNA, 25 bp, Mus musculus
tttgagagatcaggagaacaacctc

SEQ ID NO: 849156 - DNA, 25 bp, Mus musculus
tttgagagatcgaatccctgcctga

SEQ ID NO: 849157 - DNA, 25 bp, Mus musculus
tttgagagatcgtatccctgcctga

SEQ ID NO: 849158 - DNA, 25 bp, Mus musculus
tttgagagcacaaggaactatggcg

SEQ ID NO: 849159 - DNA, 25 bp, Mus musculus
tttgagagcacatggaactatggcg

SEQ ID NO: 849160 - DNA, 25 bp, Mus musculus
tttgagagcaggagcacatttccct

SEQ ID NO: 849161 - DNA, 25 bp, Mus musculus
tttgagagcaggtgcacatttccct

SEQ ID NO: 849162 - DNA, 25 bp, Mus musculus
tttgagaggaatcggctactccaca

SEQ ID NO: 849163 - DNA, 25 bp, Mus musculus
tttgagaggaatgggctactccaca

SEQ ID NO: 849164 - DNA, 25 bp, Mus musculus
tttgagaggtctctgtacagtgaca

SEQ ID NO: 849165 - DNA, 25 bp, Mus musculus
tttgagaggtctgtgtacagtgaca

SEQ ID NO: 849166 - DNA, 25 bp, Mus musculus
tttgagagtgcccagaaagcgtctg

SEQ ID NO: 849167 - DNA, 25 bp, Mus musculus
tttgagagtgccgagaaagcgtctg

SEQ ID NO: 849168 - DNA, 25 bp, Mus musculus
tttgagagtggaaaacgaagagttt

SEQ ID NO: 849169 - DNA, 25 bp, Mus musculus
tttgagagtggacgaactgcacacc

SEQ ID NO: 849170 - DNA, 25 bp, Mus musculus
tttgagagtggaggaactgcacacc

SEQ ID NO: 849171 - DNA, 25 bp, Mus musculus
tttgagagtggataacgaagagttt

SEQ ID NO: 849172 - DNA, 25 bp, Mus musculus
tttgagatacagacatagccgggcg

SEQ ID NO: 849173 - DNA, 25 bp, Mus musculus
tttgagatacagtcatagccgggcg

SEQ ID NO: 849174 - DNA, 25 bp, Mus musculus
tttgagatacgccacctgctcaggc

SEQ ID NO: 849175 - DNA, 25 bp, Mus musculus
tttgagatacgcgacctgctcaggc

SEQ ID NO: 849176 - DNA, 25 bp, Mus musculus
tttgagatatccctgaaagccctct

SEQ ID NO: 849177 - DNA, 25 bp, Mus musculus
tttgagatatccgtgaaagccctct

SEQ ID NO: 849178 - DNA, 25 bp, Mus musculus
tttgagatcaaaccctgcatgtgtg

SEQ ID NO: 849179 - DNA, 25 bp, Mus musculus
tttgagatcaaagcctgcatgtgtg

SEQ ID NO: 849180 - DNA, 25 bp, Mus musculus
tttgagatcaatcaggcctttgcaa

SEQ ID NO: 849181 - DNA, 25 bp, Mus musculus
tttgagatcaatgaggcctttgcaa

SEQ ID NO: 849182 - DNA, 25 bp, Mus musculus
tttgagatccgtctgtgagatggcc

SEQ ID NO: 849183 - DNA, 25 bp, Mus musculus
tttgagatccgtgtgtgagatggcc

SEQ ID NO: 849184 - DNA, 25 bp, Mus musculus
tttgagatgatgcatgccaaagcca

SEQ ID NO: 849185 - DNA, 25 bp, Mus musculus
tttgagatgatggatgccaaagcca

SEQ ID NO: 849186 - DNA, 25 bp, Mus musculus
tttgagatgccactcacctctgatc

SEQ ID NO: 849187 - DNA, 25 bp, Mus musculus
tttgagatgccagtcacctctgatc

SEQ ID NO: 849188 - DNA, 25 bp, Mus musculus
tttgagcacgtcatcgaagagctgc

SEQ ID NO: 849189 - DNA, 25 bp, Mus musculus
tttgagcacgtcttcgaagagctgc

SEQ ID NO: 849190 - DNA, 25 bp, Mus musculus
tttgagcactacaggcctgcaaggg

SEQ ID NO: 849191 - DNA, 25 bp, Mus musculus
tttgagcactactggcctgcaaggg

SEQ ID NO: 849192 - DNA, 25 bp, Mus musculus
tttgagcagagaaacgcggctggtc

SEQ ID NO: 849193 - DNA, 25 bp, Mus musculus
tttgagcagagatacgcggctggtc

SEQ ID NO: 849194 - DNA, 25 bp, Mus musculus
tttgagcagatcaccctggagtcgg

SEQ ID NO: 849195 - DNA, 25 bp, Mus musculus
tttgagcagatctccctggagtcgg

SEQ ID NO: 849196 - DNA, 25 bp, Mus musculus
tttgagcagcagcatgaagtgcagc

SEQ ID NO: 849197 - DNA, 25 bp, Mus musculus
tttgagcagcaggatgaagtgcagc

SEQ ID NO: 849198 - DNA, 25 bp, Mus musculus
tttgagcagcgtatgaatcaagcca

SEQ ID NO: 849199 - DNA, 25 bp, Mus musculus
tttgagcagcgtttgaatcaagcca

SEQ ID NO: 849200 - DNA, 25 bp, Mus musculus
tttgagcagtacacgccaggtggcc

SEQ ID NO: 849201 - DNA, 25 bp, Mus musculus
tttgagcagtactcgccaggtggcc

SEQ ID NO: 849202 - DNA, 25 bp, Mus musculus
tttgagcagtggacagagtctgatc

SEQ ID NO: 849203 - DNA, 25 bp, Mus musculus
tttgagcagtggtcagagtctgatc

SEQ ID NO: 849204 - DNA, 25 bp, Mus musculus
tttgagcatatacaccaggacctga

SEQ ID NO: 849205 - DNA, 25 bp, Mus musculus
tttgagcatatagaccaggacctga

SEQ ID NO: 849206 - DNA, 25 bp, Mus musculus
tttgagcatgtgcacaatgcccagc

SEQ ID NO: 849207 - DNA, 25 bp, Mus musculus
tttgagcatgtggacaatgcccagc

SEQ ID NO: 849208 - DNA, 25 bp, Mus musculus
tttgagccaggaagaaatccctctg

SEQ ID NO: 849209 - DNA, 25 bp, Mus musculus
tttgagccaggatgaaatccctctg

SEQ ID NO: 849210 - DNA, 25 bp, Mus musculus
tttgagccgtctcagaaccacagcc

SEQ ID NO: 849211 - DNA, 25 bp, Mus musculus
tttgagccgtctgagaaccacagcc

SEQ ID NO: 849212 - DNA, 25 bp, Mus musculus
tttgagcgaactcaacggcatggcc

SEQ ID NO: 849213 - DNA, 25 bp, Mus musculus
tttgagcgaactgaacggcatggcc

SEQ ID NO: 849214 - DNA, 25 bp, Mus musculus
tttgagcggacacattacccggatg

SEQ ID NO: 849215 - DNA, 25 bp, Mus musculus
tttgagcggacagattacccggatg

SEQ ID NO: 849216 - DNA, 25 bp, Mus musculus
tttgagcggcaccatgatgatgagc

SEQ ID NO: 849217 - DNA, 25 bp, Mus musculus
tttgagcggcacgatgatgatgagc

SEQ ID NO: 849218 - DNA, 25 bp, Mus musculus
tttgagctcacacgtgacttctgcc

SEQ ID NO: 849219 - DNA, 25 bp, Mus musculus
tttgagctcacaggtgacttctgcc

SEQ ID NO: 849220 - DNA, 25 bp, Mus musculus
tttgagctcgtaccaacagacctga

SEQ ID NO: 849221 - DNA, 25 bp, Mus musculus
tttgagctcgtagcaacagacctga

SEQ ID NO: 849222 - DNA, 25 bp, Mus musculus
tttgagctctcgagcccgcagtctg

SEQ ID NO: 849223 - DNA, 25 bp, Mus musculus
tttgagctctcgtgcccgcagtctg

SEQ ID NO: 849224 - DNA, 25 bp, Mus musculus
tttgagctgaatccagtttattctg

SEQ ID NO: 849225 - DNA, 25 bp, Mus musculus
tttgagctgaatgcagtttattctg

SEQ ID NO: 849226 - DNA, 25 bp, Mus musculus
tttgagctgggccagatgttgctta

SEQ ID NO: 849227 - DNA, 25 bp, Mus musculus
tttgagctgggcgagatgttgctta

SEQ ID NO: 849228 - DNA, 25 bp, Mus musculus
tttgagctgtgcaaggtactgcctg

SEQ ID NO: 849229 - DNA, 25 bp, Mus musculus
tttgagctgtgctaggtactgcctg

SEQ ID NO: 849230 - DNA, 25 bp, Mus musculus
tttgagcttggccagcagctggaca

SEQ ID NO: 849231 - DNA, 25 bp, Mus musculus
tttgagcttggcgagcagctggaca

SEQ ID NO: 849232 - DNA, 25 bp, Mus musculus
tttgagctttgcatcctggtgcaga

SEQ ID NO: 849233 - DNA, 25 bp, Mus musculus
tttgagctttgcttcctggtgcaga

SEQ ID NO: 849234 - DNA, 25 bp, Mus musculus
tttgaggaagacagtcagtcagaag

SEQ ID NO: 849235 - DNA, 25 bp, Mus musculus
tttgaggaagactgtcagtcagaag

SEQ ID NO: 849236 - DNA, 25 bp, Mus musculus
tttgaggaagtccaacggtccttga

SEQ ID NO: 849237 - DNA, 25 bp, Mus musculus
tttgaggaagtcgaacggtccttga

SEQ ID NO: 849238 - DNA, 25 bp, Mus musculus
tttgaggactcgctgttcgagcaga

SEQ ID NO: 849239 - DNA, 25 bp, Mus musculus
tttgaggactcggtgttcgagcaga

SEQ ID NO: 849240 - DNA, 25 bp, Mus musculus
tttgaggacttccaaaggaatagct

SEQ ID NO: 849241 - DNA, 25 bp, Mus musculus
tttgaggacttcgaaaggaatagct

SEQ ID NO: 849242 - DNA, 25 bp, Mus musculus
tttgaggagagcatgattgcagcga

SEQ ID NO: 849243 - DNA, 25 bp, Mus musculus
tttgaggagagcttgattgcagcga

SEQ ID NO: 849244 - DNA, 25 bp, Mus musculus
tttgaggagccactagttctccctg

SEQ ID NO: 849245 - DNA, 25 bp, Mus musculus
tttgaggagccagtagttctccctg

SEQ ID NO: 849246 - DNA, 25 bp, Mus musculus
tttgaggagtaactaccataactag

SEQ ID NO: 849247 - DNA, 25 bp, Mus musculus
tttgaggagtaagtaccataactag

SEQ ID NO: 849248 - DNA, 25 bp, Mus musculus
tttgaggagtcactgaactatgaag

SEQ ID NO: 849249 - DNA, 25 bp, Mus musculus
tttgaggagtcagtgaactatgaag

SEQ ID NO: 849250 - DNA, 25 bp, Mus musculus
tttgaggataaacgaagccaggctc

SEQ ID NO: 849251 - DNA, 25 bp, Mus musculus
tttgaggataaaggaagccaggctc

SEQ ID NO: 849252 - DNA, 25 bp, Mus musculus
tttgaggcagatcagccggacagca

SEQ ID NO: 849253 - DNA, 25 bp, Mus musculus
tttgaggcagatgagccggacagca

SEQ ID NO: 849254 - DNA, 25 bp, Mus musculus
tttgaggccgtcactcgcagcggtg

SEQ ID NO: 849255 - DNA, 25 bp, Mus musculus
tttgaggccgtctctcgcagcggtg

SEQ ID NO: 849256 - DNA, 25 bp, Mus musculus
tttgaggcctacctacaagaggagc

SEQ ID NO: 849257 - DNA, 25 bp, Mus musculus
tttgaggcctacgtacaagaggagc

SEQ ID NO: 849258 - DNA, 25 bp, Mus musculus
tttgaggccttcaatgcagcggagg

SEQ ID NO: 849259 - DNA, 25 bp, Mus musculus
tttgaggccttctatgcagcggagg

SEQ ID NO: 849260 - DNA, 25 bp, Mus musculus
tttgaggcgctcaattacgagacaa

SEQ ID NO: 849261 - DNA, 25 bp, Mus musculus
tttgaggcgctctattacgagacaa

SEQ ID NO: 849262 - DNA, 25 bp, Mus musculus
tttgaggcttcaagggaaaagctgc

SEQ ID NO: 849263 - DNA, 25 bp, Mus musculus
tttgaggcttcatgggaaaagctgc

SEQ ID NO: 849264 - DNA, 25 bp, Mus musculus
tttgaggcttccacgcatggctggg

SEQ ID NO: 849265 - DNA, 25 bp, Mus musculus
tttgaggcttcctcgcatggctggg

SEQ ID NO: 849266 - DNA, 25 bp, Mus musculus
tttgagggtctgctgaagaaccttg

SEQ ID NO: 849267 - DNA, 25 bp, Mus musculus
tttgagggtctggtgaagaaccttg

SEQ ID NO: 849268 - DNA, 25 bp, Mus musculus
tttgaggtcctcaccaaagtcctac

SEQ ID NO: 849269 - DNA, 25 bp, Mus musculus
tttgaggtcctctccaaagtcctac

SEQ ID NO: 849270 - DNA, 25 bp, Mus musculus
tttgaggtgcaacgctcggcactca

SEQ ID NO: 849271 - DNA, 25 bp, Mus musculus
tttgaggtgcaaggctcggcactca

SEQ ID NO: 849272 - DNA, 25 bp, Mus musculus
tttgagtaatggacaaatgggccag

SEQ ID NO: 849273 - DNA, 25 bp, Mus musculus
tttgagtaatggtcaaatgggccag

SEQ ID NO: 849274 - DNA, 25 bp, Mus musculus
tttgagtaccgtaggttcaacaaag

SEQ ID NO: 849275 - DNA, 25 bp, Mus musculus
tttgagtaccgttggttcaacaaag

SEQ ID NO: 849276 - DNA, 25 bp, Mus musculus
tttgagtactacatcccgacaccag

SEQ ID NO: 849277 - DNA, 25 bp, Mus musculus
tttgagtactacttcccgacaccag

SEQ ID NO: 849278 - DNA, 25 bp, Mus musculus
tttgagtatattcgagaccagaagg

SEQ ID NO: 849279 - DNA, 25 bp, Mus musculus
tttgagtatattggagaccagaagg

SEQ ID NO: 849280 - DNA, 25 bp, Mus musculus
tttgagtccatccaccaaggccatg

SEQ ID NO: 849281 - DNA, 25 bp, Mus musculus
tttgagtccatcgaccaaggccatg

SEQ ID NO: 849282 - DNA, 25 bp, Mus musculus
tttgagtccggcagacaatccttgc

SEQ ID NO: 849283 - DNA, 25 bp, Mus musculus
tttgagtccggctgacaatccttgc

SEQ ID NO: 849284 - DNA, 25 bp, Mus musculus
tttgagtctcatcggatcctccgcc

SEQ ID NO: 849285 - DNA, 25 bp, Mus musculus
tttgagtctcatgggatcctccgcc

SEQ ID NO: 849286 - DNA, 25 bp, Mus musculus
tttgagtgcttcaacgtcagtgtct

SEQ ID NO: 849287 - DNA, 25 bp, Mus musculus
tttgagtgcttctacgtcagtgtct

SEQ ID NO: 849288 - DNA, 25 bp, Mus musculus
tttgagtgtcccctgtctatgtttc

SEQ ID NO: 849289 - DNA, 25 bp, Mus musculus
tttgagtgtcccgtgtctatgtttc

SEQ ID NO: 849290 - DNA, 25 bp, Mus musculus
tttgagtgttcaaagatgaggccac

SEQ ID NO: 849291 - DNA, 25 bp, Mus musculus
tttgagtgttcatagatgaggccac

SEQ ID NO: 849292 - DNA, 25 bp, Mus musculus
tttgagtttcaacgctttctttagc

SEQ ID NO: 849293 - DNA, 25 bp, Mus musculus
tttgagtttcaaggctttctttagc

SEQ ID NO: 849294 - DNA, 25 bp, Mus musculus
tttgagtttgacctcttcaccaggc

SEQ ID NO: 849295 - DNA, 25 bp, Mus musculus
tttgagtttgacgtcttcaccaggc

SEQ ID NO: 849296 - DNA, 25 bp, Mus musculus
tttgataaaactccgtggcagtgcc

SEQ ID NO: 849297 - DNA, 25 bp, Mus musculus
tttgataaaactgcgtggcagtgcc

SEQ ID NO: 849298 - DNA, 25 bp, Mus musculus
tttgataaagatcgcgcattgacac

SEQ ID NO: 849299 - DNA, 25 bp, Mus musculus
tttgataaagatggcgcattgacac

SEQ ID NO: 849300 - DNA, 25 bp, Mus musculus
tttgatacatccagtgagccctgag

SEQ ID NO: 849301 - DNA, 25 bp, Mus musculus
tttgatacatcctgtgagccctgag

SEQ ID NO: 849302 - DNA, 25 bp, Mus musculus
tttgatacctttactcatcagcgcc

SEQ ID NO: 849303 - DNA, 25 bp, Mus musculus
tttgataccttttctcatcagcgcc

SEQ ID NO: 849304 - DNA, 25 bp, Mus musculus
tttgatacgtataagggcaagtcct

SEQ ID NO: 849305 - DNA, 25 bp, Mus musculus
tttgatacgtattagggcaagtcct

SEQ ID NO: 849306 - DNA, 25 bp, Mus musculus
tttgatactagccaaattgattcag

SEQ ID NO: 849307 - DNA, 25 bp, Mus musculus
tttgatactagcgaaattgattcag

SEQ ID NO: 849308 - DNA, 25 bp, Mus musculus
tttgatagagataatgctgatactg

SEQ ID NO: 849309 - DNA, 25 bp, Mus musculus
tttgatagagattatgctgatactg

SEQ ID NO: 849310 - DNA, 25 bp, Mus musculus
tttgatatgtcaacaaaggatcatg

SEQ ID NO: 849311 - DNA, 25 bp, Mus musculus
tttgatatgtcatcaaaggatcatg

SEQ ID NO: 849312 - DNA, 25 bp, Mus musculus
tttgatattgtcactggaactcgat

SEQ ID NO: 849313 - DNA, 25 bp, Mus musculus
tttgatattgtctctggaactcgat

SEQ ID NO: 849314 - DNA, 25 bp, Mus musculus
tttgatcaaagacgcaccatgtacc

SEQ ID NO: 849315 - DNA, 25 bp, Mus musculus
tttgatcaaagaggcaccatgtacc

SEQ ID NO: 849316 - DNA, 25 bp, Mus musculus
tttgatcagcggctcatggaacact

SEQ ID NO: 849317 - DNA, 25 bp, Mus musculus
tttgatcagcgggtcatggaacact

SEQ ID NO: 849318 - DNA, 25 bp, Mus musculus
tttgatcaggaacgactcgtggagc

SEQ ID NO: 849319 - DNA, 25 bp, Mus musculus
tttgatcaggaaggactcgtggagc

SEQ ID NO: 849320 - DNA, 25 bp, Mus musculus
tttgatcaggtgctagtgctcaacc

SEQ ID NO: 849321 - DNA, 25 bp, Mus musculus
tttgatcaggtggtagtgctcaacc

SEQ ID NO: 849322 - DNA, 25 bp, Mus musculus
tttgatccagtcactctcccagatg

SEQ ID NO: 849323 - DNA, 25 bp, Mus musculus
tttgatccagtctctctcccagatg

SEQ ID NO: 849324 - DNA, 25 bp, Mus musculus
tttgatccgattacagatccaaagg

SEQ ID NO: 849325 - DNA, 25 bp, Mus musculus
tttgatccgatttcagatccaaagg

SEQ ID NO: 849326 - DNA, 25 bp, Mus musculus
tttgatcgactcacagtgtttcggc

SEQ ID NO: 849327 - DNA, 25 bp, Mus musculus
tttgatcgactctcagtgtttcggc

SEQ ID NO: 849328 - DNA, 25 bp, Mus musculus
tttgatctctacacgaagtgccctg

SEQ ID NO: 849329 - DNA, 25 bp, Mus musculus
tttgatctctactcgaagtgccctg

SEQ ID NO: 849330 - DNA, 25 bp, Mus musculus
tttgatctgggtcgccagtacttga

SEQ ID NO: 849331 - DNA, 25 bp, Mus musculus
tttgatctgggtggccagtacttga

SEQ ID NO: 849332 - DNA, 25 bp, Mus musculus
tttgatgaaaagaagcttaaagccc

SEQ ID NO: 849333 - DNA, 25 bp, Mus musculus
tttgatgaaaagtagcttaaagccc

SEQ ID NO: 849334 - DNA, 25 bp, Mus musculus
tttgatgaacttaacaggcagtgcc

SEQ ID NO: 849335 - DNA, 25 bp, Mus musculus
tttgatgaactttacaggcagtgcc

SEQ ID NO: 849336 - DNA, 25 bp, Mus musculus
tttgatgaagcaatattggctgccc

SEQ ID NO: 849337 - DNA, 25 bp, Mus musculus
tttgatgaagcattattggctgccc

SEQ ID NO: 849338 - DNA, 25 bp, Mus musculus
tttgatgaccctctaccgacacctt

SEQ ID NO: 849339 - DNA, 25 bp, Mus musculus
tttgatgaccctgtaccgacacctt

SEQ ID NO: 849340 - DNA, 25 bp, Mus musculus
tttgatgacctaacgcttcccaccg

SEQ ID NO: 849341 - DNA, 25 bp, Mus musculus
tttgatgacctatcgcttcccaccg

SEQ ID NO: 849342 - DNA, 25 bp, Mus musculus
tttgatgacgatcgaaccctggaca

SEQ ID NO: 849343 - DNA, 25 bp, Mus musculus
tttgatgacgatggaaccctggaca

SEQ ID NO: 849344 - DNA, 25 bp, Mus musculus
tttgatgactctcaggacaatgcag

SEQ ID NO: 849345 - DNA, 25 bp, Mus musculus
tttgatgactctgaggacaatgcag

SEQ ID NO: 849346 - DNA, 25 bp, Mus musculus
tttgatgacttcacagaaggcagag

SEQ ID NO: 849347 - DNA, 25 bp, Mus musculus
tttgatgacttctcagaaggcagag

SEQ ID NO: 849348 - DNA, 25 bp, Mus musculus
tttgatgagatcctacgctgtgtct

SEQ ID NO: 849349 - DNA, 25 bp, Mus musculus
tttgatgagatcgtacgctgtgtct

SEQ ID NO: 849350 - DNA, 25 bp, Mus musculus
tttgatgatgctaacaaatctcagc

SEQ ID NO: 849351 - DNA, 25 bp, Mus musculus
tttgatgatgcttacaaatctcagc

SEQ ID NO: 849352 - DNA, 25 bp, Mus musculus
tttgatgatgtacaccgcacccttg

SEQ ID NO: 849353 - DNA, 25 bp, Mus musculus
tttgatgatgtagaccgcacccttg

SEQ ID NO: 849354 - DNA, 25 bp, Mus musculus
tttgatgcaagtagtaaagacagag

SEQ ID NO: 849355 - DNA, 25 bp, Mus musculus
tttgatgcaagttgtaaagacagag

SEQ ID NO: 849356 - DNA, 25 bp, Mus musculus
tttgatgcagcacaagggaagtgca

SEQ ID NO: 849357 - DNA, 25 bp, Mus musculus
tttgatgcagcagaagggaagtgca

SEQ ID NO: 849358 - DNA, 25 bp, Mus musculus
tttgatgccacaaacatcctcaaca

SEQ ID NO: 849359 - DNA, 25 bp, Mus musculus
tttgatgccacatacatcctcaaca

SEQ ID NO: 849360 - DNA, 25 bp, Mus musculus
tttgatgccattatgcaggctgccc

SEQ ID NO: 849361 - DNA, 25 bp, Mus musculus
tttgatgccattttgcaggctgccc

SEQ ID NO: 849362 - DNA, 25 bp, Mus musculus
tttgatgcccagacccacacactgg

SEQ ID NO: 849363 - DNA, 25 bp, Mus musculus
tttgatgcccagtcccacacactgg

SEQ ID NO: 849364 - DNA, 25 bp, Mus musculus
tttgatgccgacaacgtcaagggca

SEQ ID NO: 849365 - DNA, 25 bp, Mus musculus
tttgatgccgactacgtcaagggca

SEQ ID NO: 849366 - DNA, 25 bp, Mus musculus
tttgatgcgcagcaactgatcggcg

SEQ ID NO: 849367 - DNA, 25 bp, Mus musculus
tttgatgcgcaggaactgatcggcg

SEQ ID NO: 849368 - DNA, 25 bp, Mus musculus
tttgatgcgctcagccacagtgcca

SEQ ID NO: 849369 - DNA, 25 bp, Mus musculus
tttgatgcgctctgccacagtgcca

SEQ ID NO: 849370 - DNA, 25 bp, Mus musculus
tttgatgcggccacagaggtgccag

SEQ ID NO: 849371 - DNA, 25 bp, Mus musculus
tttgatgcggcctcagaggtgccag

SEQ ID NO: 849372 - DNA, 25 bp, Mus musculus
tttgatgctcggcaaagtcgacggc

SEQ ID NO: 849373 - DNA, 25 bp, Mus musculus
tttgatgctcgggaaagtcgacggc

SEQ ID NO: 849374 - DNA, 25 bp, Mus musculus
tttgatggcattctgtgagaggcaa

SEQ ID NO: 849375 - DNA, 25 bp, Mus musculus
tttgatggcattgtgtgagaggcaa

SEQ ID NO: 849376 - DNA, 25 bp, Mus musculus
tttgatggcgtgatggaagtattga

SEQ ID NO: 849377 - DNA, 25 bp, Mus musculus
tttgatggcgtgttggaagtattga

SEQ ID NO: 849378 - DNA, 25 bp, Mus musculus
tttgatgggcacacacgattgtagc

SEQ ID NO: 849379 - DNA, 25 bp, Mus musculus
tttgatgggcactcacgattgtagc

SEQ ID NO: 849380 - DNA, 25 bp, Mus musculus
tttgatgggcagacaggacccaagg

SEQ ID NO: 849381 - DNA, 25 bp, Mus musculus
tttgatgggcagtcaggacccaagg

SEQ ID NO: 849382 - DNA, 25 bp, Mus musculus
tttgatggttctcagcctccagagg

SEQ ID NO: 849383 - DNA, 25 bp, Mus musculus
tttgatggttctgagcctccagagg

SEQ ID NO: 849384 - DNA, 25 bp, Mus musculus
tttgatgtccctacaccactgctgg

SEQ ID NO: 849385 - DNA, 25 bp, Mus musculus
tttgatgtcccttcaccactgctgg

SEQ ID NO: 849386 - DNA, 25 bp, Mus musculus
tttgatgtgatcctaatagggacgg

SEQ ID NO: 849387 - DNA, 25 bp, Mus musculus
tttgatgtgatcgtaatagggacgg

SEQ ID NO: 849388 - DNA, 25 bp, Mus musculus
tttgatgtgcatctgaacgccttct

SEQ ID NO: 849389 - DNA, 25 bp, Mus musculus
tttgatgtgcatgtgaacgccttct

SEQ ID NO: 849390 - DNA, 25 bp, Mus musculus
tttgatgtgctcctgatgcccaatc

SEQ ID NO: 849391 - DNA, 25 bp, Mus musculus
tttgatgtgctcgtgatgcccaatc

SEQ ID NO: 849392 - DNA, 25 bp, Mus musculus
tttgatgtgtggatgggaaacagca

SEQ ID NO: 849393 - DNA, 25 bp, Mus musculus
tttgatgtgtggttgggaaacagca

SEQ ID NO: 849394 - DNA, 25 bp, Mus musculus
tttgattgcctacagtggatcagaa

SEQ ID NO: 849395 - DNA, 25 bp, Mus musculus
tttgattgcctagagtggatcagaa

SEQ ID NO: 849396 - DNA, 25 bp, Mus musculus
tttgatttccaaccagaatacggac

SEQ ID NO: 849397 - DNA, 25 bp, Mus musculus
tttgatttccaagcagaatacggac

SEQ ID NO: 849398 - DNA, 25 bp, Mus musculus
tttgcaaaaccacaaacactcccga

SEQ ID NO: 849399 - DNA, 25 bp, Mus musculus
tttgcaaaaccagaaacactcccga

SEQ ID NO: 849400 - DNA, 25 bp, Mus musculus
tttgcaaacaaacgtggcctcactg

SEQ ID NO: 849401 - DNA, 25 bp, Mus musculus
tttgcaaacaaaggtggcctcactg

SEQ ID NO: 849402 - DNA, 25 bp, Mus musculus
tttgcaaagacgagcgctaggtgcc

SEQ ID NO: 849403 - DNA, 25 bp, Mus musculus
tttgcaaagacgtgcgctaggtgcc

SEQ ID NO: 849404 - DNA, 25 bp, Mus musculus
tttgcaaagcccaactggtgctgga

SEQ ID NO: 849405 - DNA, 25 bp, Mus musculus
tttgcaaagccctactggtgctgga

SEQ ID NO: 849406 - DNA, 25 bp, Mus musculus
tttgcaaatggacgctccacaggcc

SEQ ID NO: 849407 - DNA, 25 bp, Mus musculus
tttgcaaatggaggctccacaggcc

SEQ ID NO: 849408 - DNA, 25 bp, Mus musculus
tttgcaacacttacagcaaggatgt

SEQ ID NO: 849409 - DNA, 25 bp, Mus musculus
tttgcaacactttcagcaaggatgt

SEQ ID NO: 849410 - DNA, 25 bp, Mus musculus
tttgcaaccgggaagaacgagtgtg

SEQ ID NO: 849411 - DNA, 25 bp, Mus musculus
tttgcaaccgggtagaacgagtgtg

SEQ ID NO: 849412 - DNA, 25 bp, Mus musculus
tttgcaacctatcgatctggtcaga

SEQ ID NO: 849413 - DNA, 25 bp, Mus musculus
tttgcaacctatggatctggtcaga

SEQ ID NO: 849414 - DNA, 25 bp, Mus musculus
tttgcaacgcaaaggagcgaggaag

SEQ ID NO: 849415 - DNA, 25 bp, Mus musculus
tttgcaacgcaatggagcgaggaag

SEQ ID NO: 849416 - DNA, 25 bp, Mus musculus
tttgcaacgttcatacagaggagga

SEQ ID NO: 849417 - DNA, 25 bp, Mus musculus
tttgcaacgttcttacagaggagga

SEQ ID NO: 849418 - DNA, 25 bp, Mus musculus
tttgcaactgcaacaagggccatgt

SEQ ID NO: 849419 - DNA, 25 bp, Mus musculus
tttgcaactgcatcaagggccatgt

SEQ ID NO: 849420 - DNA, 25 bp, Mus musculus
tttgcaagagaacgcaatgtgccca

SEQ ID NO: 849421 - DNA, 25 bp, Mus musculus
tttgcaagagaaggcaatgtgccca

SEQ ID NO: 849422 - DNA, 25 bp, Mus musculus
tttgcaagaggtcgtaccgcctctc

SEQ ID NO: 849423 - DNA, 25 bp, Mus musculus
tttgcaagaggtggtaccgcctctc

SEQ ID NO: 849424 - DNA, 25 bp, Mus musculus
tttgcaagccatctttgcatcccgt

SEQ ID NO: 849425 - DNA, 25 bp, Mus musculus
tttgcaagccatgtttgcatcccgt

SEQ ID NO: 849426 - DNA, 25 bp, Mus musculus
tttgcaagctttataacaggacacg

SEQ ID NO: 849427 - DNA, 25 bp, Mus musculus
tttgcaagctttttaacaggacacg

SEQ ID NO: 849428 - DNA, 25 bp, Mus musculus
tttgcaaggaatctgtagagcctga

SEQ ID NO: 849429 - DNA, 25 bp, Mus musculus
tttgcaaggaatgtgtagagcctga

SEQ ID NO: 849430 - DNA, 25 bp, Mus musculus
tttgcaagtacaagtctgagaccag

SEQ ID NO: 849431 - DNA, 25 bp, Mus musculus
tttgcaagtacatgtctgagaccag

SEQ ID NO: 849432 - DNA, 25 bp, Mus musculus
tttgcaataatcatttcggctgcca

SEQ ID NO: 849433 - DNA, 25 bp, Mus musculus
tttgcaataatcttttcggctgcca

SEQ ID NO: 849434 - DNA, 25 bp, Mus musculus
tttgcaatgaacatctgtgagcact

SEQ ID NO: 849435 - DNA, 25 bp, Mus musculus
tttgcaatgaacttctgtgagcact

SEQ ID NO: 849436 - DNA, 25 bp, Mus musculus
tttgcaatgcctccggactctacca

SEQ ID NO: 849437 - DNA, 25 bp, Mus musculus
tttgcaatgcctgcggactctacca

SEQ ID NO: 849438 - DNA, 25 bp, Mus musculus
tttgcacaatcacgcccacatttgg

SEQ ID NO: 849439 - DNA, 25 bp, Mus musculus
tttgcacaatcaggcccacatttgg

SEQ ID NO: 849440 - DNA, 25 bp, Mus musculus
tttgcacacggcatccgaacgccgg

SEQ ID NO: 849441 - DNA, 25 bp, Mus musculus
tttgcacacggcttccgaacgccgg

SEQ ID NO: 849442 - DNA, 25 bp, Mus musculus
tttgcacacgttaggcgctgggctc

SEQ ID NO: 849443 - DNA, 25 bp, Mus musculus
tttgcacacgtttggcgctgggctc

SEQ ID NO: 849444 - DNA, 25 bp, Mus musculus
tttgcacaggttcttgaaaacgtta

SEQ ID NO: 849445 - DNA, 25 bp, Mus musculus
tttgcacaggttgttgaaaacgtta

SEQ ID NO: 849446 - DNA, 25 bp, Mus musculus
tttgcacatcccaccgctgactggg

SEQ ID NO: 849447 - DNA, 25 bp, Mus musculus
tttgcacatccctccgctgactggg

SEQ ID NO: 849448 - DNA, 25 bp, Mus musculus
tttgcaccactcatctatgtggcct

SEQ ID NO: 849449 - DNA, 25 bp, Mus musculus
tttgcaccactcttctatgtggcct

SEQ ID NO: 849450 - DNA, 25 bp, Mus musculus
tttgcaccgcagctgttgaagtggc

SEQ ID NO: 849451 - DNA, 25 bp, Mus musculus
tttgcaccgcaggtgttgaagtggc

SEQ ID NO: 849452 - DNA, 25 bp, Mus musculus
tttgcacggcaaaatgcgagtgggc

SEQ ID NO: 849453 - DNA, 25 bp, Mus musculus
tttgcacggcaatatgcgagtgggc

SEQ ID NO: 849454 - DNA, 25 bp, Mus musculus
tttgcactccagagcgacctggacc

SEQ ID NO: 849455 - DNA, 25 bp, Mus musculus
tttgcactccagtgcgacctggacc

SEQ ID NO: 849456 - DNA, 25 bp, Mus musculus
tttgcactgaaacccagagttgtct

SEQ ID NO: 849457 - DNA, 25 bp, Mus musculus
tttgcactgaaagccagagttgtct

SEQ ID NO: 849458 - DNA, 25 bp, Mus musculus
tttgcactgcccaacattcgtgatg

SEQ ID NO: 849459 - DNA, 25 bp, Mus musculus
tttgcactgccctacattcgtgatg

SEQ ID NO: 849460 - DNA, 25 bp, Mus musculus
tttgcagacaaaacgaattggtggg

SEQ ID NO: 849461 - DNA, 25 bp, Mus musculus
tttgcagacaaatcgaattggtggg

SEQ ID NO: 849462 - DNA, 25 bp, Mus musculus
tttgcagacacgaagtacccatggg

SEQ ID NO: 849463 - DNA, 25 bp, Mus musculus
tttgcagacacgtagtacccatggg

SEQ ID NO: 849464 - DNA, 25 bp, Mus musculus
tttgcagacatccatataattggag

SEQ ID NO: 849465 - DNA, 25 bp, Mus musculus
tttgcagacatcgatataattggag

SEQ ID NO: 849466 - DNA, 25 bp, Mus musculus
tttgcagactcacttcaaggagaaa

SEQ ID NO: 849467 - DNA, 25 bp, Mus musculus
tttgcagactcagttcaaggagaaa

SEQ ID NO: 849468 - DNA, 25 bp, Mus musculus
tttgcagacttcctcgtctatgatg

SEQ ID NO: 849469 - DNA, 25 bp, Mus musculus
tttgcagacttcgtcgtctatgatg

SEQ ID NO: 849470 - DNA, 25 bp, Mus musculus
tttgcagaggacaccgataggagat

SEQ ID NO: 849471 - DNA, 25 bp, Mus musculus
tttgcagaggactccgataggagat

SEQ ID NO: 849472 - DNA, 25 bp, Mus musculus
tttgcagatggcctcatcctgctcc

SEQ ID NO: 849473 - DNA, 25 bp, Mus musculus
tttgcagatggcgtcatcctgctcc

SEQ ID NO: 849474 - DNA, 25 bp, Mus musculus
tttgcagattccaagggcgatgtgg

SEQ ID NO: 849475 - DNA, 25 bp, Mus musculus
tttgcagattcctagggcgatgtgg

SEQ ID NO: 849476 - DNA, 25 bp, Mus musculus
tttgcagcactcaaggtccagggac

SEQ ID NO: 849477 - DNA, 25 bp, Mus musculus
tttgcagcactctaggtccagggac

SEQ ID NO: 849478 - DNA, 25 bp, Mus musculus
tttgcagcagcacaggaaatagcca

SEQ ID NO: 849479 - DNA, 25 bp, Mus musculus
tttgcagcagcagaggaaatagcca

SEQ ID NO: 849480 - DNA, 25 bp, Mus musculus
tttgcagcatcactttttgaaagat

SEQ ID NO: 849481 - DNA, 25 bp, Mus musculus
tttgcagcatcagtttttgaaagat

SEQ ID NO: 849482 - DNA, 25 bp, Mus musculus
tttgcagccccgaactattacggct

SEQ ID NO: 849483 - DNA, 25 bp, Mus musculus
tttgcagccccgtactattacggct

SEQ ID NO: 849484 - DNA, 25 bp, Mus musculus
tttgcagccgccagaatttgcacag

SEQ ID NO: 849485 - DNA, 25 bp, Mus musculus
tttgcagccgcctgaatttgcacag

SEQ ID NO: 849486 - DNA, 25 bp, Mus musculus
tttgcagccgtcaccttggtcctgt

SEQ ID NO: 849487 - DNA, 25 bp, Mus musculus
tttgcagccgtctccttggtcctgt

SEQ ID NO: 849488 - DNA, 25 bp, Mus musculus
tttgcagctggcagctcccgagaag

SEQ ID NO: 849489 - DNA, 25 bp, Mus musculus
tttgcagctggctgctcccgagaag

SEQ ID NO: 849490 - DNA, 25 bp, Mus musculus
tttgcaggcccaaggatgctgtgct

SEQ ID NO: 849491 - DNA, 25 bp, Mus musculus
tttgcaggcccatggatgctgtgct

SEQ ID NO: 849492 - DNA, 25 bp, Mus musculus
tttgcaggcgccatgtacatcctgg

SEQ ID NO: 849493 - DNA, 25 bp, Mus musculus
tttgcaggcgccttgtacatcctgg

SEQ ID NO: 849494 - DNA, 25 bp, Mus musculus
tttgcagtctgtctcccttcgaagt

SEQ ID NO: 849495 - DNA, 25 bp, Mus musculus
tttgcagtctgtgtcccttcgaagt

SEQ ID NO: 849496 - DNA, 25 bp, Mus musculus
tttgcagtggtcaaacttgccaggc

SEQ ID NO: 849497 - DNA, 25 bp, Mus musculus
tttgcagtggtctaacttgccaggc

SEQ ID NO: 849498 - DNA, 25 bp, Mus musculus
tttgcagttgctcaacctgtttgcc

SEQ ID NO: 849499 - DNA, 25 bp, Mus musculus
tttgcagttgctgaacctgtttgcc

SEQ ID NO: 849500 - DNA, 25 bp, Mus musculus
tttgcataatgtagagcgagccgtg

SEQ ID NO: 849501 - DNA, 25 bp, Mus musculus
tttgcataatgttgagcgagccgtg

SEQ ID NO: 849502 - DNA, 25 bp, Mus musculus
tttgcatagatcaggccaaactaga

SEQ ID NO: 849503 - DNA, 25 bp, Mus musculus
tttgcatagatctggccaaactaga

SEQ ID NO: 849504 - DNA, 25 bp, Mus musculus
tttgcatcaacaccgtcggctccta

SEQ ID NO: 849505 - DNA, 25 bp, Mus musculus
tttgcatcaacagcgtcggctccta

SEQ ID NO: 849506 - DNA, 25 bp, Mus musculus
tttgcatcacccagtgtggtgccag

SEQ ID NO: 849507 - DNA, 25 bp, Mus musculus
tttgcatcaccctgtgtggtgccag

SEQ ID NO: 849508 - DNA, 25 bp, Mus musculus
tttgcatcatgtcaagctggaatat

SEQ ID NO: 849509 - DNA, 25 bp, Mus musculus
tttgcatcatgtgaagctggaatat

SEQ ID NO: 849510 - DNA, 25 bp, Mus musculus
tttgcatcgctgcactgccctaggc

SEQ ID NO: 849511 - DNA, 25 bp, Mus musculus
tttgcatcgctggactgccctaggc

SEQ ID NO: 849512 - DNA, 25 bp, Mus musculus
tttgcatcttgtatcccgggatacc

SEQ ID NO: 849513 - DNA, 25 bp, Mus musculus
tttgcatcttgtttcccgggatacc

SEQ ID NO: 849514 - DNA, 25 bp, Mus musculus
tttgcatgaaggattccagggaatt

SEQ ID NO: 849515 - DNA, 25 bp, Mus musculus
tttgcatgaaggtttccagggaatt

SEQ ID NO: 849516 - DNA, 25 bp, Mus musculus
tttgcatgacgacgacagctgccag

SEQ ID NO: 849517 - DNA, 25 bp, Mus musculus
tttgcatgacgaggacagctgccag

SEQ ID NO: 849518 - DNA, 25 bp, Mus musculus
tttgcatgcaaacaacatcatccac

SEQ ID NO: 849519 - DNA, 25 bp, Mus musculus
tttgcatgcaaagaacatcatccac

SEQ ID NO: 849520 - DNA, 25 bp, Mus musculus
tttgcatgctgcacaatgtggccga

SEQ ID NO: 849521 - DNA, 25 bp, Mus musculus
tttgcatgctgctcaatgtggccga

SEQ ID NO: 849522 - DNA, 25 bp, Mus musculus
tttgcatggagacattgcacagtca

SEQ ID NO: 849523 - DNA, 25 bp, Mus musculus
tttgcatggagagattgcacagtca

SEQ ID NO: 849524 - DNA, 25 bp, Mus musculus
tttgcatgtgcccaaggcaggcgtc

SEQ ID NO: 849525 - DNA, 25 bp, Mus musculus
tttgcatgtgccgaaggcaggcgtc

SEQ ID NO: 849526 - DNA, 25 bp, Mus musculus
tttgcatttgctaaagagcacaagg

SEQ ID NO: 849527 - DNA, 25 bp, Mus musculus
tttgcatttgcttaagagcacaagg

SEQ ID NO: 849528 - DNA, 25 bp, Mus musculus
tttgccaaagccacggaaacaggaa

SEQ ID NO: 849529 - DNA, 25 bp, Mus musculus
tttgccaaagcctcggaaacaggaa

SEQ ID NO: 849530 - DNA, 25 bp, Mus musculus
tttgccaaaggcatctcctctggaa

SEQ ID NO: 849531 - DNA, 25 bp, Mus musculus
tttgccaaaggcttctcctctggaa

SEQ ID NO: 849532 - DNA, 25 bp, Mus musculus
tttgccaaatggaatggatgccgat

SEQ ID NO: 849533 - DNA, 25 bp, Mus musculus
tttgccaaatggtatggatgccgat

SEQ ID NO: 849534 - DNA, 25 bp, Mus musculus
tttgccaacaaacacggaagacacg

SEQ ID NO: 849535 - DNA, 25 bp, Mus musculus
tttgccaacaaagacggaagacacg

SEQ ID NO: 849536 - DNA, 25 bp, Mus musculus
tttgccaacggtcaatgaacgagac

SEQ ID NO: 849537 - DNA, 25 bp, Mus musculus
tttgccaacggtgaatgaacgagac

SEQ ID NO: 849538 - DNA, 25 bp, Mus musculus
tttgccaacgtactccacgtgaagt

SEQ ID NO: 849539 - DNA, 25 bp, Mus musculus
tttgccaacgtagtccacgtgaagt

SEQ ID NO: 849540 - DNA, 25 bp, Mus musculus
tttgccaagccaacataccagcatg

SEQ ID NO: 849541 - DNA, 25 bp, Mus musculus
tttgccaagccatcataccagcatg

SEQ ID NO: 849542 - DNA, 25 bp, Mus musculus
tttgccaagcctcggacgatgtgtt

SEQ ID NO: 849543 - DNA, 25 bp, Mus musculus
tttgccaagcctgggacgatgtgtt

SEQ ID NO: 849544 - DNA, 25 bp, Mus musculus
tttgccaagcttatataccaacctg

SEQ ID NO: 849545 - DNA, 25 bp, Mus musculus
tttgccaagcttttataccaacctg

SEQ ID NO: 849546 - DNA, 25 bp, Mus musculus
tttgccaaggtgaagttggcccggc

SEQ ID NO: 849547 - DNA, 25 bp, Mus musculus
tttgccaaggtgtagttggcccggc

SEQ ID NO: 849548 - DNA, 25 bp, Mus musculus
tttgccaatcccagaataagcggag

SEQ ID NO: 849549 - DNA, 25 bp, Mus musculus
tttgccaatccctgaataagcggag

SEQ ID NO: 849550 - DNA, 25 bp, Mus musculus
tttgccaatcggaatgcatttcgtc

SEQ ID NO: 849551 - DNA, 25 bp, Mus musculus
tttgccaatcggtatgcatttcgtc

SEQ ID NO: 849552 - DNA, 25 bp, Mus musculus
tttgccaatgtgatccctagctcag

SEQ ID NO: 849553 - DNA, 25 bp, Mus musculus
tttgccaatgtgttccctagctcag

SEQ ID NO: 849554 - DNA, 25 bp, Mus musculus
tttgccacatctcaggaacaaactg

SEQ ID NO: 849555 - DNA, 25 bp, Mus musculus
tttgccacatctgaggaacaaactg

SEQ ID NO: 849556 - DNA, 25 bp, Mus musculus
tttgccacgtatcctggaactccag

SEQ ID NO: 849557 - DNA, 25 bp, Mus musculus
tttgccacgtatgctggaactccag

SEQ ID NO: 849558 - DNA, 25 bp, Mus musculus
tttgccacgttgcaaggctcatgtc

SEQ ID NO: 849559 - DNA, 25 bp, Mus musculus
tttgccacgttggaaggctcatgtc

SEQ ID NO: 849560 - DNA, 25 bp, Mus musculus
tttgccactgagcaacacccgtatg

SEQ ID NO: 849561 - DNA, 25 bp, Mus musculus
tttgccactgaggaacacccgtatg

SEQ ID NO: 849562 - DNA, 25 bp, Mus musculus
tttgccactgcgcaaagggtaactg

SEQ ID NO: 849563 - DNA, 25 bp, Mus musculus
tttgccactgcggaaagggtaactg

SEQ ID NO: 849564 - DNA, 25 bp, Mus musculus
tttgccagatatcgctcagtaaaag

SEQ ID NO: 849565 - DNA, 25 bp, Mus musculus
tttgccagatatggctcagtaaaag

SEQ ID NO: 849566 - DNA, 25 bp, Mus musculus
tttgccagcacgatcctgcaccttg

SEQ ID NO: 849567 - DNA, 25 bp, Mus musculus
tttgccagcacgttcctgcaccttg

SEQ ID NO: 849568 - DNA, 25 bp, Mus musculus
tttgccagccgccagagcttacatg

SEQ ID NO: 849569 - DNA, 25 bp, Mus musculus
tttgccagccgcgagagcttacatg

SEQ ID NO: 849570 - DNA, 25 bp, Mus musculus
tttgccagcggcagtccttttgatc

SEQ ID NO: 849571 - DNA, 25 bp, Mus musculus
tttgccagcggctgtccttttgatc

SEQ ID NO: 849572 - DNA, 25 bp, Mus musculus
tttgccaggacgcaattacactttc

SEQ ID NO: 849573 - DNA, 25 bp, Mus musculus
tttgccaggacggaattacactttc

SEQ ID NO: 849574 - DNA, 25 bp, Mus musculus
tttgccagggcaccaaggacttgta

SEQ ID NO: 849575 - DNA, 25 bp, Mus musculus
tttgccagggcagcaaggacttgta

SEQ ID NO: 849576 - DNA, 25 bp, Mus musculus
tttgccagtcagatcaacctgagcg

SEQ ID NO: 849577 - DNA, 25 bp, Mus musculus
tttgccagtcagttcaacctgagcg

SEQ ID NO: 849578 - DNA, 25 bp, Mus musculus
tttgccataaaacaaatgtgtctgt

SEQ ID NO: 849579 - DNA, 25 bp, Mus musculus
tttgccataaaagaaatgtgtctgt

SEQ ID NO: 849580 - DNA, 25 bp, Mus musculus
tttgccataattagtcacagccatg

SEQ ID NO: 849581 - DNA, 25 bp, Mus musculus
tttgccataatttgtcacagccatg

SEQ ID NO: 849582 - DNA, 25 bp, Mus musculus
tttgccatactgaaaggtgcctacc

SEQ ID NO: 849583 - DNA, 25 bp, Mus musculus
tttgccatactgtaaggtgcctacc

SEQ ID NO: 849584 - DNA, 25 bp, Mus musculus
tttgccatcagcaaacaaatgcact

SEQ ID NO: 849585 - DNA, 25 bp, Mus musculus
tttgccatcagctaacaaatgcact

SEQ ID NO: 849586 - DNA, 25 bp, Mus musculus
tttgccatccgtccagacaagaagt

SEQ ID NO: 849587 - DNA, 25 bp, Mus musculus
tttgccatccgtgcagacaagaagt

SEQ ID NO: 849588 - DNA, 25 bp, Mus musculus
tttgccatcctaatggctcagtacc

SEQ ID NO: 849589 - DNA, 25 bp, Mus musculus
tttgccatcctattggctcagtacc

SEQ ID NO: 849590 - DNA, 25 bp, Mus musculus
tttgccatcgtacgaggaatgggct

SEQ ID NO: 849591 - DNA, 25 bp, Mus musculus
tttgccatcgtaggaggaatgggct

SEQ ID NO: 849592 - DNA, 25 bp, Mus musculus
tttgccatctttatcccagctgcta

SEQ ID NO: 849593 - DNA, 25 bp, Mus musculus
tttgccatctttttcccagctgcta

SEQ ID NO: 849594 - DNA, 25 bp, Mus musculus
tttgccatgaaaagggatgtccaag

SEQ ID NO: 849595 - DNA, 25 bp, Mus musculus
tttgccatgaaatgggatgtccaag

SEQ ID NO: 849596 - DNA, 25 bp, Mus musculus
tttgccatgcgacccttcttcggct

SEQ ID NO: 849597 - DNA, 25 bp, Mus musculus
tttgccatgcgagccttcttcggct

SEQ ID NO: 849598 - DNA, 25 bp, Mus musculus
tttgccatgttgaggcacggagccc

SEQ ID NO: 849599 - DNA, 25 bp, Mus musculus
tttgccatgttgtggcacggagccc

SEQ ID NO: 849600 - DNA, 25 bp, Mus musculus
tttgccattaagatctccaaccatg

SEQ ID NO: 849601 - DNA, 25 bp, Mus musculus
tttgccattaagttctccaaccatg

SEQ ID NO: 849602 - DNA, 25 bp, Mus musculus
tttgccattcctcagaaaggcagct

SEQ ID NO: 849603 - DNA, 25 bp, Mus musculus
tttgccattcctgagaaaggcagct

SEQ ID NO: 849604 - DNA, 25 bp, Mus musculus
tttgccattggcatcgtcggagatg

SEQ ID NO: 849605 - DNA, 25 bp, Mus musculus
tttgccattggcttcgtcggagatg

SEQ ID NO: 849606 - DNA, 25 bp, Mus musculus
tttgccatttgacatatactgctga

SEQ ID NO: 849607 - DNA, 25 bp, Mus musculus
tttgccatttgagatatactgctga

SEQ ID NO: 849608 - DNA, 25 bp, Mus musculus
tttgccattttcagcagaagacgct

SEQ ID NO: 849609 - DNA, 25 bp, Mus musculus
tttgccattttctgcagaagacgct

SEQ ID NO: 849610 - DNA, 25 bp, Mus musculus
tttgccatttttcccgacgcctatg

SEQ ID NO: 849611 - DNA, 25 bp, Mus musculus
tttgccatttttgccgacgcctatg

SEQ ID NO: 849612 - DNA, 25 bp, Mus musculus
tttgcccaactcatgtgagcatggt

SEQ ID NO: 849613 - DNA, 25 bp, Mus musculus
tttgcccaactcttgtgagcatggt

SEQ ID NO: 849614 - DNA, 25 bp, Mus musculus
tttgcccaccttatagtgctgagga

SEQ ID NO: 849615 - DNA, 25 bp, Mus musculus
tttgcccaccttttagtgctgagga

SEQ ID NO: 849616 - DNA, 25 bp, Mus musculus
tttgcccagaagctggtcccagacc

SEQ ID NO: 849617 - DNA, 25 bp, Mus musculus
tttgcccagaaggtggtcccagacc

SEQ ID NO: 849618 - DNA, 25 bp, Mus musculus
tttgcccagaccaatgggttgactg

SEQ ID NO: 849619 - DNA, 25 bp, Mus musculus
tttgcccagacctatgggttgactg

SEQ ID NO: 849620 - DNA, 25 bp, Mus musculus
tttgcccagagtatgatcctaccca

SEQ ID NO: 849621 - DNA, 25 bp, Mus musculus
tttgcccagagtttgatcctaccca

SEQ ID NO: 849622 - DNA, 25 bp, Mus musculus
tttgcccagatgctcaaggatggag

SEQ ID NO: 849623 - DNA, 25 bp, Mus musculus
tttgcccagatggtcaaggatggag

SEQ ID NO: 849624 - DNA, 25 bp, Mus musculus
tttgcccagcggaactgtcagtgca

SEQ ID NO: 849625 - DNA, 25 bp, Mus musculus
tttgcccagcggcaactgctggaga

SEQ ID NO: 849626 - DNA, 25 bp, Mus musculus
tttgcccagcgggaactgctggaga

SEQ ID NO: 849627 - DNA, 25 bp, Mus musculus
tttgcccagcggtactgtcagtgca

SEQ ID NO: 849628 - DNA, 25 bp, Mus musculus
tttgcccagtttcccacatccgtgg

SEQ ID NO: 849629 - DNA, 25 bp, Mus musculus
tttgcccagtttgccacatccgtgg

SEQ ID NO: 849630 - DNA, 25 bp, Mus musculus
tttgcccatttgcatgctaccactg

SEQ ID NO: 849631 - DNA, 25 bp, Mus musculus
tttgcccatttggatgctaccactg

SEQ ID NO: 849632 - DNA, 25 bp, Mus musculus
tttgccccacctaccctggacctgg

SEQ ID NO: 849633 - DNA, 25 bp, Mus musculus
tttgccccaccttccctggacctgg

SEQ ID NO: 849634 - DNA, 25 bp, Mus musculus
tttgccccagaacatatccacattc

SEQ ID NO: 849635 - DNA, 25 bp, Mus musculus
tttgccccagaagatatccacattc

SEQ ID NO: 849636 - DNA, 25 bp, Mus musculus
tttgccccgtctccgcagagcggag

SEQ ID NO: 849637 - DNA, 25 bp, Mus musculus
tttgccccgtctgcgcagagcggag

SEQ ID NO: 849638 - DNA, 25 bp, Mus musculus
tttgcccctatgctgcagtgggaga

SEQ ID NO: 849639 - DNA, 25 bp, Mus musculus
tttgcccctatggtgcagtgggaga

SEQ ID NO: 849640 - DNA, 25 bp, Mus musculus
tttgcccctgctcaccagttcagtg

SEQ ID NO: 849641 - DNA, 25 bp, Mus musculus
tttgcccctgctgaccagttcagtg

SEQ ID NO: 849642 - DNA, 25 bp, Mus musculus
tttgcccctgggaagagcttccaac

SEQ ID NO: 849643 - DNA, 25 bp, Mus musculus
tttgcccctgggtagagcttccaac

SEQ ID NO: 849644 - DNA, 25 bp, Mus musculus
tttgccccttggaagtggaagtgtc

SEQ ID NO: 849645 - DNA, 25 bp, Mus musculus
tttgccccttggtagtggaagtgtc

SEQ ID NO: 849646 - DNA, 25 bp, Mus musculus
tttgcccgctttctggcagtctgga

SEQ ID NO: 849647 - DNA, 25 bp, Mus musculus
tttgcccgctttgtggcagtctgga

SEQ ID NO: 849648 - DNA, 25 bp, Mus musculus
tttgccctacccaggttgacgactg

SEQ ID NO: 849649 - DNA, 25 bp, Mus musculus
tttgccctaccctggttgacgactg

SEQ ID NO: 849650 - DNA, 25 bp, Mus musculus
tttgccctcgctattccctggaaga

SEQ ID NO: 849651 - DNA, 25 bp, Mus musculus
tttgccctcgcttttccctggaaga

SEQ ID NO: 849652 - DNA, 25 bp, Mus musculus
tttgccctctggcagtctggagaca

SEQ ID NO: 849653 - DNA, 25 bp, Mus musculus
tttgccctctgggagtctggagaca

SEQ ID NO: 849654 - DNA, 25 bp, Mus musculus
tttgccctgctgacgctcactgtgt

SEQ ID NO: 849655 - DNA, 25 bp, Mus musculus
tttgccctgctgctgcgaaggaacc

SEQ ID NO: 849656 - DNA, 25 bp, Mus musculus
tttgccctgctggtgcgaaggaacc

SEQ ID NO: 849657 - DNA, 25 bp, Mus musculus
tttgccctgctgtcgctcactgtgt

SEQ ID NO: 849658 - DNA, 25 bp, Mus musculus
tttgcccttcagataaacaggatgg

SEQ ID NO: 849659 - DNA, 25 bp, Mus musculus
tttgcccttcagttaaacaggatgg

SEQ ID NO: 849660 - DNA, 25 bp, Mus musculus
tttgccgacccacaggatcacagga

SEQ ID NO: 849661 - DNA, 25 bp, Mus musculus
tttgccgacccagaggatcacagga

SEQ ID NO: 849662 - DNA, 25 bp, Mus musculus
tttgccgagatgctccacttccagg

SEQ ID NO: 849663 - DNA, 25 bp, Mus musculus
tttgccgagatggtccacttccagg

SEQ ID NO: 849664 - DNA, 25 bp, Mus musculus
tttgccgatatccatcggagccgag

SEQ ID NO: 849665 - DNA, 25 bp, Mus musculus
tttgccgatatcgatcggagccgag

SEQ ID NO: 849666 - DNA, 25 bp, Mus musculus
tttgccggaggacacgcgagtgggc

SEQ ID NO: 849667 - DNA, 25 bp, Mus musculus
tttgccggaggagacgcgagtgggc

SEQ ID NO: 849668 - DNA, 25 bp, Mus musculus
tttgccggcaaaccagctcagtacc

SEQ ID NO: 849669 - DNA, 25 bp, Mus musculus
tttgccggcaaagcagctcagtacc

SEQ ID NO: 849670 - DNA, 25 bp, Mus musculus
tttgccggccgcaggtacctgcaga

SEQ ID NO: 849671 - DNA, 25 bp, Mus musculus
tttgccggccgctggtacctgcaga

SEQ ID NO: 849672 - DNA, 25 bp, Mus musculus
tttgccggcttcagttccagatccc

SEQ ID NO: 849673 - DNA, 25 bp, Mus musculus
tttgccggcttctgttccagatccc

SEQ ID NO: 849674 - DNA, 25 bp, Mus musculus
tttgccgggtggatggagtatacca

SEQ ID NO: 849675 - DNA, 25 bp, Mus musculus
tttgccgggtggttggagtatacca

SEQ ID NO: 849676 - DNA, 25 bp, Mus musculus
tttgccgtgccccagaacagctcgg

SEQ ID NO: 849677 - DNA, 25 bp, Mus musculus
tttgccgtgcccgagaacagctcgg

SEQ ID NO: 849678 - DNA, 25 bp, Mus musculus
tttgcctagaagaaagggactttga

SEQ ID NO: 849679 - DNA, 25 bp, Mus musculus
tttgcctagaagtaagggactttga

SEQ ID NO: 849680 - DNA, 25 bp, Mus musculus
tttgcctatccgaccaaaggacagc

SEQ ID NO: 849681 - DNA, 25 bp, Mus musculus
tttgcctatccgtccaaaggacagc

SEQ ID NO: 849682 - DNA, 25 bp, Mus musculus
tttgcctatgggacctatgcggact

SEQ ID NO: 849683 - DNA, 25 bp, Mus musculus
tttgcctatgggtcctatgcggact

SEQ ID NO: 849684 - DNA, 25 bp, Mus musculus
tttgcctcaacacggctatggaact

SEQ ID NO: 849685 - DNA, 25 bp, Mus musculus
tttgcctcaacagggctatggaact

SEQ ID NO: 849686 - DNA, 25 bp, Mus musculus
tttgcctcagctagtcccacagatg

SEQ ID NO: 849687 - DNA, 25 bp, Mus musculus
tttgcctcagcttgtcccacagatg

SEQ ID NO: 849688 - DNA, 25 bp, Mus musculus
tttgcctcccacagttcagaccaag

SEQ ID NO: 849689 - DNA, 25 bp, Mus musculus
tttgcctcccactgttcagaccaag

SEQ ID NO: 849690 - DNA, 25 bp, Mus musculus
tttgcctcgggtcttcgcagtcagg

SEQ ID NO: 849691 - DNA, 25 bp, Mus musculus
tttgcctcgggtgttcgcagtcagg

SEQ ID NO: 849692 - DNA, 25 bp, Mus musculus
tttgcctctgaacagtgtcccgagg

SEQ ID NO: 849693 - DNA, 25 bp, Mus musculus
tttgcctctgaagagtgtcccgagg

SEQ ID NO: 849694 - DNA, 25 bp, Mus musculus
tttgcctgaataagaagatttggga

SEQ ID NO: 849695 - DNA, 25 bp, Mus musculus
tttgcctgaatatgaagatttggga

SEQ ID NO: 849696 - DNA, 25 bp, Mus musculus
tttgcctgagaaaacagatcaaccc

SEQ ID NO: 849697 - DNA, 25 bp, Mus musculus
tttgcctgagaatacagatcaaccc

SEQ ID NO: 849698 - DNA, 25 bp, Mus musculus
tttgcctgcaggcagatgctatggc

SEQ ID NO: 849699 - DNA, 25 bp, Mus musculus
tttgcctgcagggagatgctatggc

SEQ ID NO: 849700 - DNA, 25 bp, Mus musculus
tttgcctgccaacggaactggactg

SEQ ID NO: 849701 - DNA, 25 bp, Mus musculus
tttgcctgccaagggaactggactg

SEQ ID NO: 849702 - DNA, 25 bp, Mus musculus
tttgcctgcgcaaagcttgccacag

SEQ ID NO: 849703 - DNA, 25 bp, Mus musculus
tttgcctgcgcatagcttgccacag

SEQ ID NO: 849704 - DNA, 25 bp, Mus musculus
tttgcctggagccataggtctccca

SEQ ID NO: 849705 - DNA, 25 bp, Mus musculus
tttgcctggagcgataggtctccca

SEQ ID NO: 849706 - DNA, 25 bp, Mus musculus
tttgcctgggctccttaggctgcaa

SEQ ID NO: 849707 - DNA, 25 bp, Mus musculus
tttgcctgggctgcttaggctgcaa

SEQ ID NO: 849708 - DNA, 25 bp, Mus musculus
tttgcctgtacactggcttcctctt

SEQ ID NO: 849709 - DNA, 25 bp, Mus musculus
tttgcctgtacagtggcttcctctt

SEQ ID NO: 849710 - DNA, 25 bp, Mus musculus
tttgcctgtgtgcagacaacagtgc

SEQ ID NO: 849711 - DNA, 25 bp, Mus musculus
tttgcctgtgtggagacaacagtgc

SEQ ID NO: 849712 - DNA, 25 bp, Mus musculus
tttgcctgttggacaatggtgaccc

SEQ ID NO: 849713 - DNA, 25 bp, Mus musculus
tttgcctgttggtcaatggtgaccc

SEQ ID NO: 849714 - DNA, 25 bp, Mus musculus
tttgccttcaatcccaagaccagtt

SEQ ID NO: 849715 - DNA, 25 bp, Mus musculus
tttgccttcaatgccaagaccagtt

SEQ ID NO: 849716 - DNA, 25 bp, Mus musculus
tttgccttcctcaattggccagctc

SEQ ID NO: 849717 - DNA, 25 bp, Mus musculus
tttgccttcctctattggccagctc

SEQ ID NO: 849718 - DNA, 25 bp, Mus musculus
tttgccttctccaatggctacctcg

SEQ ID NO: 849719 - DNA, 25 bp, Mus musculus
tttgccttctcctatggctacctcg

SEQ ID NO: 849720 - DNA, 25 bp, Mus musculus
tttgccttgtttcagtacaacggac

SEQ ID NO: 849721 - DNA, 25 bp, Mus musculus
tttgccttgtttgagtacaacggac

SEQ ID NO: 849722 - DNA, 25 bp, Mus musculus
tttgcctttaaaaaccagaatcaga

SEQ ID NO: 849723 - DNA, 25 bp, Mus musculus
tttgcctttaaataccagaatcaga

SEQ ID NO: 849724 - DNA, 25 bp, Mus musculus
tttgcctttgctcacaaggaccggg

SEQ ID NO: 849725 - DNA, 25 bp, Mus musculus
tttgcctttgctgacaaggaccggg

SEQ ID NO: 849726 - DNA, 25 bp, Mus musculus
tttgcgacactacctgagtcttcag

SEQ ID NO: 849727 - DNA, 25 bp, Mus musculus
tttgcgacactagctgagtcttcag

SEQ ID NO: 849728 - DNA, 25 bp, Mus musculus
tttgcgaggtgtcgaaagactactt

SEQ ID NO: 849729 - DNA, 25 bp, Mus musculus
tttgcgaggtgtggaaagactactt

SEQ ID NO: 849730 - DNA, 25 bp, Mus musculus
tttgcgatggaaatctccagctgaa

SEQ ID NO: 849731 - DNA, 25 bp, Mus musculus
tttgcgatggaattctccagctgaa

SEQ ID NO: 849732 - DNA, 25 bp, Mus musculus
tttgcgatggcactggacgtgcctc

SEQ ID NO: 849733 - DNA, 25 bp, Mus musculus
tttgcgatggcagtggacgtgcctc

SEQ ID NO: 849734 - DNA, 25 bp, Mus musculus
tttgcgcaagtgagagctccggatc

SEQ ID NO: 849735 - DNA, 25 bp, Mus musculus
tttgcgcaagtgtgagctccggatc

SEQ ID NO: 849736 - DNA, 25 bp, Mus musculus
tttgcgccagtgatctgcaagcgga

SEQ ID NO: 849737 - DNA, 25 bp, Mus musculus
tttgcgccagtgttctgcaagcgga

SEQ ID NO: 849738 - DNA, 25 bp, Mus musculus
tttgcgccttacacctccaatggga

SEQ ID NO: 849739 - DNA, 25 bp, Mus musculus
tttgcgccttactcctccaatggga

SEQ ID NO: 849740 - DNA, 25 bp, Mus musculus
tttgcgcgctggacgctcggcttct

SEQ ID NO: 849741 - DNA, 25 bp, Mus musculus
tttgcgcgctggtcgctcggcttct

SEQ ID NO: 849742 - DNA, 25 bp, Mus musculus
tttgcggaagagaattatcctttct

SEQ ID NO: 849743 - DNA, 25 bp, Mus musculus
tttgcggaagagtattatcctttct

SEQ ID NO: 849744 - DNA, 25 bp, Mus musculus
tttgcggaggaaatcacccggctgg

SEQ ID NO: 849745 - DNA, 25 bp, Mus musculus
tttgcggaggaattcacccggctgg

SEQ ID NO: 849746 - DNA, 25 bp, Mus musculus
tttgcggagtttaatcagcttgtaa

SEQ ID NO: 849747 - DNA, 25 bp, Mus musculus
tttgcggagttttatcagcttgtaa

SEQ ID NO: 849748 - DNA, 25 bp, Mus musculus
tttgcggatactctcacactcctgt

SEQ ID NO: 849749 - DNA, 25 bp, Mus musculus
tttgcggatactgtcacactcctgt

SEQ ID NO: 849750 - DNA, 25 bp, Mus musculus
tttgcggatggacgacagaaaaaga

SEQ ID NO: 849751 - DNA, 25 bp, Mus musculus
tttgcggatggaggacagaaaaaga

SEQ ID NO: 849752 - DNA, 25 bp, Mus musculus
tttgcggcccctctgggaacaggta

SEQ ID NO: 849753 - DNA, 25 bp, Mus musculus
tttgcggcccctgtgggaacaggta

SEQ ID NO: 849754 - DNA, 25 bp, Mus musculus
tttgcggctgcgaccagaatccatg

SEQ ID NO: 849755 - DNA, 25 bp, Mus musculus
tttgcggctgcgtccagaatccatg

SEQ ID NO: 849756 - DNA, 25 bp, Mus musculus
tttgcggctgtcactcacagtcagg

SEQ ID NO: 849757 - DNA, 25 bp, Mus musculus
tttgcggctgtctctcacagtcagg

SEQ ID NO: 849758 - DNA, 25 bp, Mus musculus
tttgcgggacaacggctacatcaaa

SEQ ID NO: 849759 - DNA, 25 bp, Mus musculus
tttgcgggacaagggctacatcaaa

SEQ ID NO: 849760 - DNA, 25 bp, Mus musculus
tttgcgggcactagctgggcttcgt

SEQ ID NO: 849761 - DNA, 25 bp, Mus musculus
tttgcgggcacttgctgggcttcgt

SEQ ID NO: 849762 - DNA, 25 bp, Mus musculus
tttgcgggcatgacttttgccgtgg

SEQ ID NO: 849763 - DNA, 25 bp, Mus musculus
tttgcgggcatgtcttttgccgtgg

SEQ ID NO: 849764 - DNA, 25 bp, Mus musculus
tttgcgggccttaccatggccagtt

SEQ ID NO: 849765 - DNA, 25 bp, Mus musculus
tttgcgggcctttccatggccagtt

SEQ ID NO: 849766 - DNA, 25 bp, Mus musculus
tttgcggtacagacccacggagtgg

SEQ ID NO: 849767 - DNA, 25 bp, Mus musculus
tttgcggtacagtcccacggagtgg

SEQ ID NO: 849768 - DNA, 25 bp, Mus musculus
tttgcggtatgcagccgcagccaag

SEQ ID NO: 849769 - DNA, 25 bp, Mus musculus
tttgcggtatgctgccgcagccaag

SEQ ID NO: 849770 - DNA, 25 bp, Mus musculus
tttgcggtgagcattggctactggc

SEQ ID NO: 849771 - DNA, 25 bp, Mus musculus
tttgcggtgagctttggctactggc

SEQ ID NO: 849772 - DNA, 25 bp, Mus musculus
tttgcggtgcaaccaatatgcggat

SEQ ID NO: 849773 - DNA, 25 bp, Mus musculus
tttgcggtgcaagcaatatgcggat

SEQ ID NO: 849774 - DNA, 25 bp, Mus musculus
tttgcggtgctgctatttagagcgc

SEQ ID NO: 849775 - DNA, 25 bp, Mus musculus
tttgcggtgctggtatttagagcgc

SEQ ID NO: 849776 - DNA, 25 bp, Mus musculus
tttgcggtggatccccaggcgccca

SEQ ID NO: 849777 - DNA, 25 bp, Mus musculus
tttgcggtggatgcccaggcgccca

SEQ ID NO: 849778 - DNA, 25 bp, Mus musculus
tttgcggtggttaccggtttgcaga

SEQ ID NO: 849779 - DNA, 25 bp, Mus musculus
tttgcggtggtttccggtttgcaga

SEQ ID NO: 849780 - DNA, 25 bp, Mus musculus
tttgcggtttttctgggacaacaag

SEQ ID NO: 849781 - DNA, 25 bp, Mus musculus
tttgcggtttttgtgggacaacaag

SEQ ID NO: 849782 - DNA, 25 bp, Mus musculus
tttgcgtagaaaaagcacagctctg

SEQ ID NO: 849783 - DNA, 25 bp, Mus musculus
tttgcgtagaaatagcacagctctg

SEQ ID NO: 849784 - DNA, 25 bp, Mus musculus
tttgcgtcacttaaagcgtcctgct

SEQ ID NO: 849785 - DNA, 25 bp, Mus musculus
tttgcgtcactttaagcgtcctgct

SEQ ID NO: 849786 - DNA, 25 bp, Mus musculus
tttgcgtccgccatcttcactagaa

SEQ ID NO: 849787 - DNA, 25 bp, Mus musculus
tttgcgtccgccttcttcactagaa

SEQ ID NO: 849788 - DNA, 25 bp, Mus musculus
tttgcgtgtggcacgccacttccag

SEQ ID NO: 849789 - DNA, 25 bp, Mus musculus
tttgcgtgtggctcgccacttccag

SEQ ID NO: 849790 - DNA, 25 bp, Mus musculus
tttgcgttgcccaactggaactttg

SEQ ID NO: 849791 - DNA, 25 bp, Mus musculus
tttgcgttgccctactggaactttg

SEQ ID NO: 849792 - DNA, 25 bp, Mus musculus
tttgctaaggatcgacattttgccc

SEQ ID NO: 849793 - DNA, 25 bp, Mus musculus
tttgctaaggatggacattttgccc

SEQ ID NO: 849794 - DNA, 25 bp, Mus musculus
tttgctaccctcaacagctaccgag

SEQ ID NO: 849795 - DNA, 25 bp, Mus musculus
tttgctaccctctacagctaccgag

SEQ ID NO: 849796 - DNA, 25 bp, Mus musculus
tttgctaccttgacagcccgcctga

SEQ ID NO: 849797 - DNA, 25 bp, Mus musculus
tttgctaccttgtcagcccgcctga

SEQ ID NO: 849798 - DNA, 25 bp, Mus musculus
tttgctacgcccaaagacaggctct

SEQ ID NO: 849799 - DNA, 25 bp, Mus musculus
tttgctacgccctaagacaggctct

SEQ ID NO: 849800 - DNA, 25 bp, Mus musculus
tttgctactccccagcatttggtgc

SEQ ID NO: 849801 - DNA, 25 bp, Mus musculus
tttgctactcccgagcatttggtgc

SEQ ID NO: 849802 - DNA, 25 bp, Mus musculus
tttgctagaactctaatccctgcca

SEQ ID NO: 849803 - DNA, 25 bp, Mus musculus
tttgctagaactcttgggctctgca

SEQ ID NO: 849804 - DNA, 25 bp, Mus musculus
tttgctagaactgtaatccctgcca

SEQ ID NO: 849805 - DNA, 25 bp, Mus musculus
tttgctagaactgttgggctctgca

SEQ ID NO: 849806 - DNA, 25 bp, Mus musculus
tttgctagccagaatcctgactgtc

SEQ ID NO: 849807 - DNA, 25 bp, Mus musculus
tttgctagccagtatcctgactgtc

SEQ ID NO: 849808 - DNA, 25 bp, Mus musculus
tttgctaggagaaatagatgctgtc

SEQ ID NO: 849809 - DNA, 25 bp, Mus musculus
tttgctaggagatatagatgctgtc

SEQ ID NO: 849810 - DNA, 25 bp, Mus musculus
tttgctagtgctacgcctatgcgcc

SEQ ID NO: 849811 - DNA, 25 bp, Mus musculus
tttgctagtgcttcgcctatgcgcc

SEQ ID NO: 849812 - DNA, 25 bp, Mus musculus
tttgctatcaacattgacccagaaa

SEQ ID NO: 849813 - DNA, 25 bp, Mus musculus
tttgctatcaactttgacccagaaa

SEQ ID NO: 849814 - DNA, 25 bp, Mus musculus
tttgctcaaaggctccgcagtggag

SEQ ID NO: 849815 - DNA, 25 bp, Mus musculus
tttgctcaaagggtccgcagtggag

SEQ ID NO: 849816 - DNA, 25 bp, Mus musculus
tttgctcacagaatggataacgacc

SEQ ID NO: 849817 - DNA, 25 bp, Mus musculus
tttgctcacagattggataacgacc

SEQ ID NO: 849818 - DNA, 25 bp, Mus musculus
tttgctcaccagactatcagtgctt

SEQ ID NO: 849819 - DNA, 25 bp, Mus musculus
tttgctcaccagtctatcagtgctt

SEQ ID NO: 849820 - DNA, 25 bp, Mus musculus
tttgctcagcagacagaatcatgac

SEQ ID NO: 849821 - DNA, 25 bp, Mus musculus
tttgctcagcagtcagaatcatgac

SEQ ID NO: 849822 - DNA, 25 bp, Mus musculus
tttgctcagggtccgatgttcgcga

SEQ ID NO: 849823 - DNA, 25 bp, Mus musculus
tttgctcagggtgcgatgttcgcga

SEQ ID NO: 849824 - DNA, 25 bp, Mus musculus
tttgctccaagtacttttatgacca

SEQ ID NO: 849825 - DNA, 25 bp, Mus musculus
tttgctccaagttcttttatgacca

SEQ ID NO: 849826 - DNA, 25 bp, Mus musculus
tttgctccggccacattagtgactc

SEQ ID NO: 849827 - DNA, 25 bp, Mus musculus
tttgctccggcctcattagtgactc

SEQ ID NO: 849828 - DNA, 25 bp, Mus musculus
tttgctcctggaccaggcccggcaa

SEQ ID NO: 849829 - DNA, 25 bp, Mus musculus
tttgctcctggagcaggcccggcaa

SEQ ID NO: 849830 - DNA, 25 bp, Mus musculus
tttgctcgaaggctcggtctcctga

SEQ ID NO: 849831 - DNA, 25 bp, Mus musculus
tttgctcgaagggtcggtctcctga

SEQ ID NO: 849832 - DNA, 25 bp, Mus musculus
tttgctcggcagcacttccaagaca

SEQ ID NO: 849833 - DNA, 25 bp, Mus musculus
tttgctcggcaggacttccaagaca

SEQ ID NO: 849834 - DNA, 25 bp, Mus musculus
tttgctcgggcgcacaagcgtggta

SEQ ID NO: 849835 - DNA, 25 bp, Mus musculus
tttgctcgggcggacaagcgtggta

SEQ ID NO: 849836 - DNA, 25 bp, Mus musculus
tttgctctaagaccaaggaggttga

SEQ ID NO: 849837 - DNA, 25 bp, Mus musculus
tttgctctaagagcaaggaggttga

SEQ ID NO: 849838 - DNA, 25 bp, Mus musculus
tttgctctatgcctgcttcatcctg

SEQ ID NO: 849839 - DNA, 25 bp, Mus musculus
tttgctctatgcgtgcttcatcctg

SEQ ID NO: 849840 - DNA, 25 bp, Mus musculus
tttgctctcagaaacctaaggagag

SEQ ID NO: 849841 - DNA, 25 bp, Mus musculus
tttgctctcagatacctaaggagag

SEQ ID NO: 849842 - DNA, 25 bp, Mus musculus
tttgctctcagcattggtgccctcg

SEQ ID NO: 849843 - DNA, 25 bp, Mus musculus
tttgctctcagctttggtgccctcg

SEQ ID NO: 849844 - DNA, 25 bp, Mus musculus
tttgctctctgtaacatgctgtcga

SEQ ID NO: 849845 - DNA, 25 bp, Mus musculus
tttgctctctgttacatgctgtcga

SEQ ID NO: 849846 - DNA, 25 bp, Mus musculus
tttgctctgagcactatgaccagct

SEQ ID NO: 849847 - DNA, 25 bp, Mus musculus
tttgctctgagctctatgaccagct

SEQ ID NO: 849848 - DNA, 25 bp, Mus musculus
tttgctctgctcagcctcatggatt

SEQ ID NO: 849849 - DNA, 25 bp, Mus musculus
tttgctctgctctgcctcatggatt

SEQ ID NO: 849850 - DNA, 25 bp, Mus musculus
tttgctctgtaaagcatttcagatg

SEQ ID NO: 849851 - DNA, 25 bp, Mus musculus
tttgctctgtaatgcatttcagatg

SEQ ID NO: 849852 - DNA, 25 bp, Mus musculus
tttgctcttcgacaagtcattcaga

SEQ ID NO: 849853 - DNA, 25 bp, Mus musculus
tttgctcttcgagaagtcattcaga

SEQ ID NO: 849854 - DNA, 25 bp, Mus musculus
tttgctcttcttatagatgttccgg

SEQ ID NO: 849855 - DNA, 25 bp, Mus musculus
tttgctcttcttttagatgttccgg

SEQ ID NO: 849856 - DNA, 25 bp, Mus musculus
tttgctcttgacagcagagacatcc

SEQ ID NO: 849857 - DNA, 25 bp, Mus musculus
tttgctcttgactgcagagacatcc

SEQ ID NO: 849858 - DNA, 25 bp, Mus musculus
tttgctgaacataaagaaatccaga

SEQ ID NO: 849859 - DNA, 25 bp, Mus musculus
tttgctgaacattaagaaatccaga

SEQ ID NO: 849860 - DNA, 25 bp, Mus musculus
tttgctgaactgctacaccagtgtt

SEQ ID NO: 849861 - DNA, 25 bp, Mus musculus
tttgctgaactggtacaccagtgtt

SEQ ID NO: 849862 - DNA, 25 bp, Mus musculus
tttgctgacattccctacaactacc

SEQ ID NO: 849863 - DNA, 25 bp, Mus musculus
tttgctgacattgcctacaactacc

SEQ ID NO: 849864 - DNA, 25 bp, Mus musculus
tttgctgaccaaatacctgcctggt

SEQ ID NO: 849865 - DNA, 25 bp, Mus musculus
tttgctgaccaattacctgcctggt

SEQ ID NO: 849866 - DNA, 25 bp, Mus musculus
tttgctgagcgcagtacttactggg

SEQ ID NO: 849867 - DNA, 25 bp, Mus musculus
tttgctgagcgcatcagacccatgg

SEQ ID NO: 849868 - DNA, 25 bp, Mus musculus
tttgctgagcgctgtacttactggg

SEQ ID NO: 849869 - DNA, 25 bp, Mus musculus
tttgctgagcgcttcagacccatgg

SEQ ID NO: 849870 - DNA, 25 bp, Mus musculus
tttgctgagtaccttgccagtgaga

SEQ ID NO: 849871 - DNA, 25 bp, Mus musculus
tttgctgagtacgttgccagtgaga

SEQ ID NO: 849872 - DNA, 25 bp, Mus musculus
tttgctgatagtaattccttggaga

SEQ ID NO: 849873 - DNA, 25 bp, Mus musculus
tttgctgatagttattccttggaga

SEQ ID NO: 849874 - DNA, 25 bp, Mus musculus
tttgctgatgctctggacctgttca

SEQ ID NO: 849875 - DNA, 25 bp, Mus musculus
tttgctgatgctgtggacctgttca

SEQ ID NO: 849876 - DNA, 25 bp, Mus musculus
tttgctgcacaaccggctccatggc

SEQ ID NO: 849877 - DNA, 25 bp, Mus musculus
tttgctgcacaagcggctccatggc

SEQ ID NO: 849878 - DNA, 25 bp, Mus musculus
tttgctgcaggacgctacatgcccc

SEQ ID NO: 849879 - DNA, 25 bp, Mus musculus
tttgctgcaggaggctacatgcccc

SEQ ID NO: 849880 - DNA, 25 bp, Mus musculus
tttgctgcatgcagcatgacaccca

SEQ ID NO: 849881 - DNA, 25 bp, Mus musculus
tttgctgcatgctgcatgacaccca

SEQ ID NO: 849882 - DNA, 25 bp, Mus musculus
tttgctgccttccaagagcccaagc

SEQ ID NO: 849883 - DNA, 25 bp, Mus musculus
tttgctgccttcgaagagcccaagc

SEQ ID NO: 849884 - DNA, 25 bp, Mus musculus
tttgctgcggacacttctcttccag

SEQ ID NO: 849885 - DNA, 25 bp, Mus musculus
tttgctgcggactcttctcttccag

SEQ ID NO: 849886 - DNA, 25 bp, Mus musculus
tttgctgctgcacagaacaaggtgg

SEQ ID NO: 849887 - DNA, 25 bp, Mus musculus
tttgctgctgcagagaacaaggtgg

SEQ ID NO: 849888 - DNA, 25 bp, Mus musculus
tttgctgctgccaccattgggcagg

SEQ ID NO: 849889 - DNA, 25 bp, Mus musculus
tttgctgctgcctccattgggcagg

SEQ ID NO: 849890 - DNA, 25 bp, Mus musculus
tttgctgcttttcacccggcggctg

SEQ ID NO: 849891 - DNA, 25 bp, Mus musculus
tttgctgcttttgacccggcggctg

SEQ ID NO: 849892 - DNA, 25 bp, Mus musculus
tttgctggaaacagctggcatcaag

SEQ ID NO: 849893 - DNA, 25 bp, Mus musculus
tttgctggaaactgctggcatcaag

SEQ ID NO: 849894 - DNA, 25 bp, Mus musculus
tttgctggaagcaggcgaaggactc

SEQ ID NO: 849895 - DNA, 25 bp, Mus musculus
tttgctggaagctggcgaaggactc

SEQ ID NO: 849896 - DNA, 25 bp, Mus musculus
tttgctggaattcctgttggtgcag

SEQ ID NO: 849897 - DNA, 25 bp, Mus musculus
tttgctggaattgctgttggtgcag

SEQ ID NO: 849898 - DNA, 25 bp, Mus musculus
tttgctggagagctcctaggctacg

SEQ ID NO: 849899 - DNA, 25 bp, Mus musculus
tttgctggagaggtcctaggctacg

SEQ ID NO: 849900 - DNA, 25 bp, Mus musculus
tttgctggccgtccagagcaccagt

SEQ ID NO: 849901 - DNA, 25 bp, Mus musculus
tttgctggccgtgcagagcaccagt

SEQ ID NO: 849902 - DNA, 25 bp, Mus musculus
tttgctggctttcgccgagaacgca

SEQ ID NO: 849903 - DNA, 25 bp, Mus musculus
tttgctggctttggccgagaacgca

SEQ ID NO: 849904 - DNA, 25 bp, Mus musculus
tttgctgggactcaaactgacttga

SEQ ID NO: 849905 - DNA, 25 bp, Mus musculus
tttgctgggactgaaactgacttga

SEQ ID NO: 849906 - DNA, 25 bp, Mus musculus
tttgctggtgatccgaagtcgtcca

SEQ ID NO: 849907 - DNA, 25 bp, Mus musculus
tttgctggtgatgcgaagtcgtcca

SEQ ID NO: 849908 - DNA, 25 bp, Mus musculus
tttgctgtctgtcacgtggacgctc

SEQ ID NO: 849909 - DNA, 25 bp, Mus musculus
tttgctgtctgtcatggataaccac

SEQ ID NO: 849910 - DNA, 25 bp, Mus musculus
tttgctgtctgtgacgtggacgctc

SEQ ID NO: 849911 - DNA, 25 bp, Mus musculus
tttgctgtctgtgatggataaccac

SEQ ID NO: 849912 - DNA, 25 bp, Mus musculus
tttgctgtgcacaagaaccgggtac

SEQ ID NO: 849913 - DNA, 25 bp, Mus musculus
tttgctgtgcactagaaccgggtac

SEQ ID NO: 849914 - DNA, 25 bp, Mus musculus
tttgctgtgccaaagccctgaaata

SEQ ID NO: 849915 - DNA, 25 bp, Mus musculus
tttgctgtgccatagccctgaaata

SEQ ID NO: 849916 - DNA, 25 bp, Mus musculus
tttgctgtgggcatcaaggcccggc

SEQ ID NO: 849917 - DNA, 25 bp, Mus musculus
tttgctgtgggcttcaaggcccggc

SEQ ID NO: 849918 - DNA, 25 bp, Mus musculus
tttgctgttggtctgcagcaactac

SEQ ID NO: 849919 - DNA, 25 bp, Mus musculus
tttgctgttggtgtgcagcaactac

SEQ ID NO: 849920 - DNA, 25 bp, Mus musculus
tttgcttaaggcaggatggtccagg

SEQ ID NO: 849921 - DNA, 25 bp, Mus musculus
tttgcttaaggctggatggtccagg

SEQ ID NO: 849922 - DNA, 25 bp, Mus musculus
tttgcttagacgaaaaacactagcc

SEQ ID NO: 849923 - DNA, 25 bp, Mus musculus
tttgcttagacgtaaaacactagcc

SEQ ID NO: 849924 - DNA, 25 bp, Mus musculus
tttgcttcactgacgggaagacggt

SEQ ID NO: 849925 - DNA, 25 bp, Mus musculus
tttgcttcactgtcgggaagacggt

SEQ ID NO: 849926 - DNA, 25 bp, Mus musculus
tttgcttcatgcaggagcgccagaa

SEQ ID NO: 849927 - DNA, 25 bp, Mus musculus
tttgcttcatgctggagcgccagaa

SEQ ID NO: 849928 - DNA, 25 bp, Mus musculus
tttgcttcctggagcagaggtcaga

SEQ ID NO: 849929 - DNA, 25 bp, Mus musculus
tttgcttcctggtgcagaggtcaga

SEQ ID NO: 849930 - DNA, 25 bp, Mus musculus
tttgcttctacaaagatcagtgatg

SEQ ID NO: 849931 - DNA, 25 bp, Mus musculus
tttgcttctacatagatcagtgatg

SEQ ID NO: 849932 - DNA, 25 bp, Mus musculus
tttgcttctcatacagccctgaagg

SEQ ID NO: 849933 - DNA, 25 bp, Mus musculus
tttgcttctcattcagccctgaagg

SEQ ID NO: 849934 - DNA, 25 bp, Mus musculus
tttgcttctccacgcgcgtgagcgg

SEQ ID NO: 849935 - DNA, 25 bp, Mus musculus
tttgcttctccaggcgcgtgagcgg

SEQ ID NO: 849936 - DNA, 25 bp, Mus musculus
tttgcttgaagccaggacccctgag

SEQ ID NO: 849937 - DNA, 25 bp, Mus musculus
tttgcttgaagcgaggacccctgag

SEQ ID NO: 849938 - DNA, 25 bp, Mus musculus
tttgcttgccccagggtgcggactt

SEQ ID NO: 849939 - DNA, 25 bp, Mus musculus
tttgcttgcccctgggtgcggactt

SEQ ID NO: 849940 - DNA, 25 bp, Mus musculus
tttgcttgctacaagatggtaatca

SEQ ID NO: 849941 - DNA, 25 bp, Mus musculus
tttgcttgctactagatggtaatca

SEQ ID NO: 849942 - DNA, 25 bp, Mus musculus
tttgctttacagatgggctttgctg

SEQ ID NO: 849943 - DNA, 25 bp, Mus musculus
tttgctttacagttgggctttgctg

SEQ ID NO: 849944 - DNA, 25 bp, Mus musculus
tttgctttggcacgatctcgacagg

SEQ ID NO: 849945 - DNA, 25 bp, Mus musculus
tttgctttggcaggatctcgacagg

SEQ ID NO: 849946 - DNA, 25 bp, Mus musculus
tttgctttgtaaacttgagaacact

SEQ ID NO: 849947 - DNA, 25 bp, Mus musculus
tttgctttgtaatcttgagaacact

SEQ ID NO: 849948 - DNA, 25 bp, Mus musculus
tttgctttgtcgcatgaagcataca

SEQ ID NO: 849949 - DNA, 25 bp, Mus musculus
tttgctttgtcggatgaagcataca

SEQ ID NO: 849950 - DNA, 25 bp, Mus musculus
tttggaaaacttagacagcgcggca

SEQ ID NO: 849951 - DNA, 25 bp, Mus musculus
tttggaaaacttcgccgcaaagatg

SEQ ID NO: 849952 - DNA, 25 bp, Mus musculus
tttggaaaacttggccgcaaagatg

SEQ ID NO: 849953 - DNA, 25 bp, Mus musculus
tttggaaaactttgacagcgcggca

SEQ ID NO: 849954 - DNA, 25 bp, Mus musculus
tttggaaacaaacgccctagctctc

SEQ ID NO: 849955 - DNA, 25 bp, Mus musculus
tttggaaacaaaggccctagctctc

SEQ ID NO: 849956 - DNA, 25 bp, Mus musculus
tttggaaacaagcaccgaaatgtca

SEQ ID NO: 849957 - DNA, 25 bp, Mus musculus
tttggaaacaaggaccgaaatgtca

SEQ ID NO: 849958 - DNA, 25 bp, Mus musculus
tttggaaagcaacacatagacaacc

SEQ ID NO: 849959 - DNA, 25 bp, Mus musculus
tttggaaagcaaccctcaggttctc

SEQ ID NO: 849960 - DNA, 25 bp, Mus musculus
tttggaaagcaagacatagacaacc

SEQ ID NO: 849961 - DNA, 25 bp, Mus musculus
tttggaaagcaagcctcaggttctc

SEQ ID NO: 849962 - DNA, 25 bp, Mus musculus
tttggaaagttcatcatactacagc

SEQ ID NO: 849963 - DNA, 25 bp, Mus musculus
tttggaaagttcttcatactacagc

SEQ ID NO: 849964 - DNA, 25 bp, Mus musculus
tttggaaatgcacgaaactcccatc

SEQ ID NO: 849965 - DNA, 25 bp, Mus musculus
tttggaaatgcaggaaactcccatc

SEQ ID NO: 849966 - DNA, 25 bp, Mus musculus
tttggaaccaagactagagtgggcc

SEQ ID NO: 849967 - DNA, 25 bp, Mus musculus
tttggaaccaagtctagagtgggcc

SEQ ID NO: 849968 - DNA, 25 bp, Mus musculus
tttggaaccacaatctccccgtggg

SEQ ID NO: 849969 - DNA, 25 bp, Mus musculus
tttggaaccacattctccccgtggg

SEQ ID NO: 849970 - DNA, 25 bp, Mus musculus
tttggaaccattagaacagcacgtg

SEQ ID NO: 849971 - DNA, 25 bp, Mus musculus
tttggaaccatttgaacagcacgtg

SEQ ID NO: 849972 - DNA, 25 bp, Mus musculus
tttggaagagagaagagtccatctg

SEQ ID NO: 849973 - DNA, 25 bp, Mus musculus
tttggaagagagtagagtccatctg

SEQ ID NO: 849974 - DNA, 25 bp, Mus musculus
tttggaagagcacgcctctgcgcca

SEQ ID NO: 849975 - DNA, 25 bp, Mus musculus
tttggaagagcaggcctctgcgcca

SEQ ID NO: 849976 - DNA, 25 bp, Mus musculus
tttggaagagtcatctcgtcaggga

SEQ ID NO: 849977 - DNA, 25 bp, Mus musculus
tttggaagagtcttctcgtcaggga

SEQ ID NO: 849978 - DNA, 25 bp, Mus musculus
tttggaagatgtaggtcccagggca

SEQ ID NO: 849979 - DNA, 25 bp, Mus musculus
tttggaagatgttggtcccagggca

SEQ ID NO: 849980 - DNA, 25 bp, Mus musculus
tttggaaggaggattctgagcacgc

SEQ ID NO: 849981 - DNA, 25 bp, Mus musculus
tttggaaggaggtttctgagcacgc

SEQ ID NO: 849982 - DNA, 25 bp, Mus musculus
tttggaaggattacaagtagcttgg

SEQ ID NO: 849983 - DNA, 25 bp, Mus musculus
tttggaaggatttcaagtagcttgg

SEQ ID NO: 849984 - DNA, 25 bp, Mus musculus
tttggaataggactgttaggatgac

SEQ ID NO: 849985 - DNA, 25 bp, Mus musculus
tttggaataggagtgttaggatgac

SEQ ID NO: 849986 - DNA, 25 bp, Mus musculus
tttggaatcaagattcccagccggc

SEQ ID NO: 849987 - DNA, 25 bp, Mus musculus
tttggaatcaagtttcccagccggc

SEQ ID NO: 849988 - DNA, 25 bp, Mus musculus
tttggaatccacaacacagtatttg

SEQ ID NO: 849989 - DNA, 25 bp, Mus musculus
tttggaatccactacacagtatttg

SEQ ID NO: 849990 - DNA, 25 bp, Mus musculus
tttggaatccagcagaacagcgcgg

SEQ ID NO: 849991 - DNA, 25 bp, Mus musculus
tttggaatccaggagaacagcgcgg

SEQ ID NO: 849992 - DNA, 25 bp, Mus musculus
tttggaatccctagtgagaaccgag

SEQ ID NO: 849993 - DNA, 25 bp, Mus musculus
tttggaatcccttgtgagaaccgag

SEQ ID NO: 849994 - DNA, 25 bp, Mus musculus
tttggaatctctagctcatgtctgg

SEQ ID NO: 849995 - DNA, 25 bp, Mus musculus
tttggaatctcttgctcatgtctgg

SEQ ID NO: 849996 - DNA, 25 bp, Mus musculus
tttggaatgattctctcctcggcac

SEQ ID NO: 849997 - DNA, 25 bp, Mus musculus
tttggaatgattgtctcctcggcac

SEQ ID NO: 849998 - DNA, 25 bp, Mus musculus
tttggaatgccacttgctgccctgg

SEQ ID NO: 849999 - DNA, 25 bp, Mus musculus
tttggaatgccagttgctgccctgg

SEQ ID NO: 850000 - DNA, 25 bp, Mus musculus
tttggacaaagcaatcactgcccag

SEQ ID NO: 850001 - DNA, 25 bp, Mus musculus
tttggacaaagctatcactgcccag

SEQ ID NO: 850002 - DNA, 25 bp, Mus musculus
tttggacaactcctgacctccagta

SEQ ID NO: 850003 - DNA, 25 bp, Mus musculus
tttggacaactcgtgacctccagta

SEQ ID NO: 850004 - DNA, 25 bp, Mus musculus
tttggacacataccattcccctgcg

SEQ ID NO: 850005 - DNA, 25 bp, Mus musculus
tttggacacatagcattcccctgcg

SEQ ID NO: 850006 - DNA, 25 bp, Mus musculus
tttggacaccaactactaggttggg

SEQ ID NO: 850007 - DNA, 25 bp, Mus musculus
tttggacaccaagtactaggttggg

SEQ ID NO: 850008 - DNA, 25 bp, Mus musculus
tttggacagaggagctaatgccagc

SEQ ID NO: 850009 - DNA, 25 bp, Mus musculus
tttggacagaggtgctaatgccagc

SEQ ID NO: 850010 - DNA, 25 bp, Mus musculus
tttggacagcaacactggaagttct

SEQ ID NO: 850011 - DNA, 25 bp, Mus musculus
tttggacagcaagactggaagttct

SEQ ID NO: 850012 - DNA, 25 bp, Mus musculus
tttggacagcgacgccggctaccca

SEQ ID NO: 850013 - DNA, 25 bp, Mus musculus
tttggacagcgaggccggctaccca

SEQ ID NO: 850014 - DNA, 25 bp, Mus musculus
tttggacagtggagctacccacacc

SEQ ID NO: 850015 - DNA, 25 bp, Mus musculus
tttggacagtggtgctacccacacc

SEQ ID NO: 850016 - DNA, 25 bp, Mus musculus
tttggaccaatccaatacaaaggcc

SEQ ID NO: 850017 - DNA, 25 bp, Mus musculus
tttggaccaatcgaatacaaaggcc

SEQ ID NO: 850018 - DNA, 25 bp, Mus musculus
tttggaccatggagcccgtcatcca

SEQ ID NO: 850019 - DNA, 25 bp, Mus musculus
tttggaccatggtgcccgtcatcca

SEQ ID NO: 850020 - DNA, 25 bp, Mus musculus
tttggacccgcgagctccagcaggg

SEQ ID NO: 850021 - DNA, 25 bp, Mus musculus
tttggacccgcgtgctccagcaggg

SEQ ID NO: 850022 - DNA, 25 bp, Mus musculus
tttggacctgtgacagatgtggaga

SEQ ID NO: 850023 - DNA, 25 bp, Mus musculus
tttggacctgtgtcagatgtggaga

SEQ ID NO: 850024 - DNA, 25 bp, Mus musculus
tttggaccttccaatgcagagatca

SEQ ID NO: 850025 - DNA, 25 bp, Mus musculus
tttggaccttcctatgcagagatca

SEQ ID NO: 850026 - DNA, 25 bp, Mus musculus
tttggacgcattcgtcgtctggtgc

SEQ ID NO: 850027 - DNA, 25 bp, Mus musculus
tttggacgcattggtcgtctggtgc

SEQ ID NO: 850028 - DNA, 25 bp, Mus musculus
tttggactagagaaacagcctgaat

SEQ ID NO: 850029 - DNA, 25 bp, Mus musculus
tttggactagagtaacagcctgaat

SEQ ID NO: 850030 - DNA, 25 bp, Mus musculus
tttggactcgggacagcccatgatg

SEQ ID NO: 850031 - DNA, 25 bp, Mus musculus
tttggactcgggtcagcccatgatg

SEQ ID NO: 850032 - DNA, 25 bp, Mus musculus
tttggactctcacaaacctttcaga

SEQ ID NO: 850033 - DNA, 25 bp, Mus musculus
tttggactctcagaaacctttcaga

SEQ ID NO: 850034 - DNA, 25 bp, Mus musculus
tttggactgcctccaagataccagg

SEQ ID NO: 850035 - DNA, 25 bp, Mus musculus
tttggactgcctgcaagataccagg

SEQ ID NO: 850036 - DNA, 25 bp, Mus musculus
tttggactgctgaaggcccagcagg

SEQ ID NO: 850037 - DNA, 25 bp, Mus musculus
tttggactgctgtaggcccagcagg

SEQ ID NO: 850038 - DNA, 25 bp, Mus musculus
tttggactgtgcacggcactggtgc

SEQ ID NO: 850039 - DNA, 25 bp, Mus musculus
tttggactgtgctcggcactggtgc

SEQ ID NO: 850040 - DNA, 25 bp, Mus musculus
tttggagaagttaggcgaggcaaat

SEQ ID NO: 850041 - DNA, 25 bp, Mus musculus
tttggagaagtttggcgaggcaaat

SEQ ID NO: 850042 - DNA, 25 bp, Mus musculus
tttggagaatcgagcagagacacgc

SEQ ID NO: 850043 - DNA, 25 bp, Mus musculus
tttggagaatcgtgcagagacacgc

SEQ ID NO: 850044 - DNA, 25 bp, Mus musculus
tttggagaattcagccatgggtgct

SEQ ID NO: 850045 - DNA, 25 bp, Mus musculus
tttggagaattctgccatgggtgct

SEQ ID NO: 850046 - DNA, 25 bp, Mus musculus
tttggagaattgacaaccacctagt

SEQ ID NO: 850047 - DNA, 25 bp, Mus musculus
tttggagaattgtcaaccacctagt

SEQ ID NO: 850048 - DNA, 25 bp, Mus musculus
tttggagacaaaagtgaccactagc

SEQ ID NO: 850049 - DNA, 25 bp, Mus musculus
tttggagacaaatgtgaccactagc

SEQ ID NO: 850050 - DNA, 25 bp, Mus musculus
tttggagaccgacgctgttatcagc

SEQ ID NO: 850051 - DNA, 25 bp, Mus musculus
tttggagaccgaggctgttatcagc

SEQ ID NO: 850052 - DNA, 25 bp, Mus musculus
tttggagagctacttctgcctaggc

SEQ ID NO: 850053 - DNA, 25 bp, Mus musculus
tttggagagctagttctgcctaggc

SEQ ID NO: 850054 - DNA, 25 bp, Mus musculus
tttggagatcctagagcagatgaat

SEQ ID NO: 850055 - DNA, 25 bp, Mus musculus
tttggagatccttgagcagatgaat

SEQ ID NO: 850056 - DNA, 25 bp, Mus musculus
tttggagcaactcccatctgtgttg

SEQ ID NO: 850057 - DNA, 25 bp, Mus musculus
tttggagcaactgccatctgtgttg

SEQ ID NO: 850058 - DNA, 25 bp, Mus musculus
tttggagccatgctgaactacatca

SEQ ID NO: 850059 - DNA, 25 bp, Mus musculus
tttggagccatggtgaactacatca

SEQ ID NO: 850060 - DNA, 25 bp, Mus musculus
tttggagctgggaactccggctcca

SEQ ID NO: 850061 - DNA, 25 bp, Mus musculus
tttggagctgggtactccggctcca

SEQ ID NO: 850062 - DNA, 25 bp, Mus musculus
tttggagctgtcatcttatgggaca

SEQ ID NO: 850063 - DNA, 25 bp, Mus musculus
tttggagctgtcttcttatgggaca

SEQ ID NO: 850064 - DNA, 25 bp, Mus musculus
tttggaggcactacgccacaagcgt

SEQ ID NO: 850065 - DNA, 25 bp, Mus musculus
tttggaggcacttcgccacaagcgt

SEQ ID NO: 850066 - DNA, 25 bp, Mus musculus
tttggaggcagtcacactgccgttg

SEQ ID NO: 850067 - DNA, 25 bp, Mus musculus
tttggaggcagtgacactgccgttg

SEQ ID NO: 850068 - DNA, 25 bp, Mus musculus
tttggagggaacacagctgacgatg

SEQ ID NO: 850069 - DNA, 25 bp, Mus musculus
tttggagggaactcagctgacgatg

SEQ ID NO: 850070 - DNA, 25 bp, Mus musculus
tttggaggtgatacaaccgacagct

SEQ ID NO: 850071 - DNA, 25 bp, Mus musculus
tttggaggtgattcaaccgacagct

SEQ ID NO: 850072 - DNA, 25 bp, Mus musculus
tttggaggtgggaacacacaccagg

SEQ ID NO: 850073 - DNA, 25 bp, Mus musculus
tttggaggtgggtacacacaccagg

SEQ ID NO: 850074 - DNA, 25 bp, Mus musculus
tttggagtaaaactagtgcttactg

SEQ ID NO: 850075 - DNA, 25 bp, Mus musculus
tttggagtaaaagtagtgcttactg

SEQ ID NO: 850076 - DNA, 25 bp, Mus musculus
tttggagtacccctgtctatgccgc

SEQ ID NO: 850077 - DNA, 25 bp, Mus musculus
tttggagtacccgtgtctatgccgc

SEQ ID NO: 850078 - DNA, 25 bp, Mus musculus
tttggagtcaagcaaagcctacaac

SEQ ID NO: 850079 - DNA, 25 bp, Mus musculus
tttggagtcaaggaaagcctacaac

SEQ ID NO: 850080 - DNA, 25 bp, Mus musculus
tttggagtcacacaagctaaagacg

SEQ ID NO: 850081 - DNA, 25 bp, Mus musculus
tttggagtcacagaagctaaagacg

SEQ ID NO: 850082 - DNA, 25 bp, Mus musculus
tttggagtcctcagcgagaccttgt

SEQ ID NO: 850083 - DNA, 25 bp, Mus musculus
tttggagtcctctgcgagaccttgt

SEQ ID NO: 850084 - DNA, 25 bp, Mus musculus
tttggagtctacctgcgctcggaac

SEQ ID NO: 850085 - DNA, 25 bp, Mus musculus
tttggagtctacgtgcgctcggaac

SEQ ID NO: 850086 - DNA, 25 bp, Mus musculus
tttggagtgcccacccgcattggct

SEQ ID NO: 850087 - DNA, 25 bp, Mus musculus
tttggagtgccctcccgcattggct

SEQ ID NO: 850088 - DNA, 25 bp, Mus musculus
tttggagtgctcatgtgggagatct

SEQ ID NO: 850089 - DNA, 25 bp, Mus musculus
tttggagtgctcttgtgggagatct

SEQ ID NO: 850090 - DNA, 25 bp, Mus musculus
tttggagtgtaaaccggctgctccg

SEQ ID NO: 850091 - DNA, 25 bp, Mus musculus
tttggagtgtaatccggctgctccg

SEQ ID NO: 850092 - DNA, 25 bp, Mus musculus
tttggagttgcaagaattcgtcttt

SEQ ID NO: 850093 - DNA, 25 bp, Mus musculus
tttggagttgcatgaattcgtcttt

SEQ ID NO: 850094 - DNA, 25 bp, Mus musculus
tttggataaaagagaaagaagtgcg

SEQ ID NO: 850095 - DNA, 25 bp, Mus musculus
tttggataaaagtgaaagaagtgcg

SEQ ID NO: 850096 - DNA, 25 bp, Mus musculus
tttggatacttgagcatcgagtcgg

SEQ ID NO: 850097 - DNA, 25 bp, Mus musculus
tttggatacttgtgcatcgagtcgg

SEQ ID NO: 850098 - DNA, 25 bp, Mus musculus
tttggatactttcaggtcacccacg

SEQ ID NO: 850099 - DNA, 25 bp, Mus musculus
tttggatactttgaggtcacccacg

SEQ ID NO: 850100 - DNA, 25 bp, Mus musculus
tttggatagtcgcaggcagttctgt

SEQ ID NO: 850101 - DNA, 25 bp, Mus musculus
tttggatagtcggaggcagttctgt

SEQ ID NO: 850102 - DNA, 25 bp, Mus musculus
tttggatatccgcatgcctcagggc

SEQ ID NO: 850103 - DNA, 25 bp, Mus musculus
tttggatatccggatgcctcagggc

SEQ ID NO: 850104 - DNA, 25 bp, Mus musculus
tttggatcaacaagtcaattaagtg

SEQ ID NO: 850105 - DNA, 25 bp, Mus musculus
tttggatcaacatgtcaattaagtg

SEQ ID NO: 850106 - DNA, 25 bp, Mus musculus
tttggatcagaaattagccctggct

SEQ ID NO: 850107 - DNA, 25 bp, Mus musculus
tttggatcagaatttagccctggct

SEQ ID NO: 850108 - DNA, 25 bp, Mus musculus
tttggatcatacatacaagatgcat

SEQ ID NO: 850109 - DNA, 25 bp, Mus musculus
tttggatcatacttacaagatgcat

SEQ ID NO: 850110 - DNA, 25 bp, Mus musculus
tttggatccaagagtaagagccctc

SEQ ID NO: 850111 - DNA, 25 bp, Mus musculus
tttggatccaagtgtaagagccctc

SEQ ID NO: 850112 - DNA, 25 bp, Mus musculus
tttggatccacaaagagaaacacca

SEQ ID NO: 850113 - DNA, 25 bp, Mus musculus
tttggatccacatagagaaacacca

SEQ ID NO: 850114 - DNA, 25 bp, Mus musculus
tttggatccattcaagagacaacaa

SEQ ID NO: 850115 - DNA, 25 bp, Mus musculus
tttggatccattgaagagacaacaa

SEQ ID NO: 850116 - DNA, 25 bp, Mus musculus
tttggatcccaaacaaagaatattt

SEQ ID NO: 850117 - DNA, 25 bp, Mus musculus
tttggatcccaatcaaagaatattt

SEQ ID NO: 850118 - DNA, 25 bp, Mus musculus
tttggatcccgactcgcatctggta

SEQ ID NO: 850119 - DNA, 25 bp, Mus musculus
tttggatcccgagtcgcatctggta

SEQ ID NO: 850120 - DNA, 25 bp, Mus musculus
tttggatcttggaaacaacgccctg

SEQ ID NO: 850121 - DNA, 25 bp, Mus musculus
tttggatcttggtaacaacgccctg

SEQ ID NO: 850122 - DNA, 25 bp, Mus musculus
tttggatgaggaacgtctggaagat

SEQ ID NO: 850123 - DNA, 25 bp, Mus musculus
tttggatgaggatcgtctggaagat

SEQ ID NO: 850124 - DNA, 25 bp, Mus musculus
tttggatgagtacaacctggtgcgc

SEQ ID NO: 850125 - DNA, 25 bp, Mus musculus
tttggatgagtagaacctggtgcgc

SEQ ID NO: 850126 - DNA, 25 bp, Mus musculus
tttggatgccatagagaaagcccag

SEQ ID NO: 850127 - DNA, 25 bp, Mus musculus
tttggatgccattgagaaagcccag

SEQ ID NO: 850128 - DNA, 25 bp, Mus musculus
tttggatgcgcgctggctcaactgt

SEQ ID NO: 850129 - DNA, 25 bp, Mus musculus
tttggatgcgcggtggctcaactgt

SEQ ID NO: 850130 - DNA, 25 bp, Mus musculus
tttggatggtgcaacggattttaaa

SEQ ID NO: 850131 - DNA, 25 bp, Mus musculus
tttggatggtgcctatcattgctct

SEQ ID NO: 850132 - DNA, 25 bp, Mus musculus
tttggatggtgcgtatcattgctct

SEQ ID NO: 850133 - DNA, 25 bp, Mus musculus
tttggatggtgctacggattttaaa

SEQ ID NO: 850134 - DNA, 25 bp, Mus musculus
tttggatgtgctactggccctggag

SEQ ID NO: 850135 - DNA, 25 bp, Mus musculus
tttggatgtgcttctggccctggag

SEQ ID NO: 850136 - DNA, 25 bp, Mus musculus
tttggattaagcagaaacccatctc

SEQ ID NO: 850137 - DNA, 25 bp, Mus musculus
tttggattaagctgaaacccatctc

SEQ ID NO: 850138 - DNA, 25 bp, Mus musculus
tttggattacaaaatgaccactgtg

SEQ ID NO: 850139 - DNA, 25 bp, Mus musculus
tttggattacaatatgaccactgtg

SEQ ID NO: 850140 - DNA, 25 bp, Mus musculus
tttggattactgctgaaggacattg

SEQ ID NO: 850141 - DNA, 25 bp, Mus musculus
tttggattactggtgaaggacattg

SEQ ID NO: 850142 - DNA, 25 bp, Mus musculus
tttggattctccagctgcaccctgc

SEQ ID NO: 850143 - DNA, 25 bp, Mus musculus
tttggattctcctgctgcaccctgc

SEQ ID NO: 850144 - DNA, 25 bp, Mus musculus
tttggattgcaaaggccacgtcaga

SEQ ID NO: 850145 - DNA, 25 bp, Mus musculus
tttggattgcaatggccacgtcaga

SEQ ID NO: 850146 - DNA, 25 bp, Mus musculus
tttggattgccacctagaggtggca

SEQ ID NO: 850147 - DNA, 25 bp, Mus musculus
tttggattgccagctagaggtggca

SEQ ID NO: 850148 - DNA, 25 bp, Mus musculus
tttggatttgtaagctttgaaaggc

SEQ ID NO: 850149 - DNA, 25 bp, Mus musculus
tttggatttgtatgctttgaaaggc

SEQ ID NO: 850150 - DNA, 25 bp, Mus musculus
tttggattttacagaagtggccaag

SEQ ID NO: 850151 - DNA, 25 bp, Mus musculus
tttggattttactgaagtggccaag

SEQ ID NO: 850152 - DNA, 25 bp, Mus musculus
tttggcaaaggcactcacttcttgg

SEQ ID NO: 850153 - DNA, 25 bp, Mus musculus
tttggcaaaggctctcacttcttgg

SEQ ID NO: 850154 - DNA, 25 bp, Mus musculus
tttggcaacagtcaagtcacgctgg

SEQ ID NO: 850155 - DNA, 25 bp, Mus musculus
tttggcaacagtgaagtcacgctgg

SEQ ID NO: 850156 - DNA, 25 bp, Mus musculus
tttggcaagaacactagtggctgga

SEQ ID NO: 850157 - DNA, 25 bp, Mus musculus
tttggcaagaactctagtggctgga

SEQ ID NO: 850158 - DNA, 25 bp, Mus musculus
tttggcaaggtgaagcagtttgact

SEQ ID NO: 850159 - DNA, 25 bp, Mus musculus
tttggcaaggtgtagcagtttgact

SEQ ID NO: 850160 - DNA, 25 bp, Mus musculus
tttggcaagtctcacaagtctccgg

SEQ ID NO: 850161 - DNA, 25 bp, Mus musculus
tttggcaagtctgacaagtctccgg

SEQ ID NO: 850162 - DNA, 25 bp, Mus musculus
tttggcacagagctcactaacagct

SEQ ID NO: 850163 - DNA, 25 bp, Mus musculus
tttggcacagaggtcactaacagct

SEQ ID NO: 850164 - DNA, 25 bp, Mus musculus
tttggcaccacacgaaactgtgctg

SEQ ID NO: 850165 - DNA, 25 bp, Mus musculus
tttggcaccacaggaaactgtgctg

SEQ ID NO: 850166 - DNA, 25 bp, Mus musculus
tttggcaccacccacattgatctca

SEQ ID NO: 850167 - DNA, 25 bp, Mus musculus
tttggcaccaccgacattgatctca

SEQ ID NO: 850168 - DNA, 25 bp, Mus musculus
tttggcactctgctctacactatta

SEQ ID NO: 850169 - DNA, 25 bp, Mus musculus
tttggcactctggtctacactatta

SEQ ID NO: 850170 - DNA, 25 bp, Mus musculus
tttggcactgatcgatgacgctggt

SEQ ID NO: 850171 - DNA, 25 bp, Mus musculus
tttggcactgatggatgacgctggt

SEQ ID NO: 850172 - DNA, 25 bp, Mus musculus
tttggcagaagcatgtgaaatctag

SEQ ID NO: 850173 - DNA, 25 bp, Mus musculus
tttggcagaagcttgtgaaatctag

SEQ ID NO: 850174 - DNA, 25 bp, Mus musculus
tttggcagcatccactcttccgagg

SEQ ID NO: 850175 - DNA, 25 bp, Mus musculus
tttggcagcatcgactcttccgagg

SEQ ID NO: 850176 - DNA, 25 bp, Mus musculus
tttggcagccatcgaaaccccttgt

SEQ ID NO: 850177 - DNA, 25 bp, Mus musculus
tttggcagccatggaaaccccttgt

SEQ ID NO: 850178 - DNA, 25 bp, Mus musculus
tttggcagcctgatcgcttttgcca

SEQ ID NO: 850179 - DNA, 25 bp, Mus musculus
tttggcagcctgttcgcttttgcca

SEQ ID NO: 850180 - DNA, 25 bp, Mus musculus
tttggcagcggtcagaggcttttac

SEQ ID NO: 850181 - DNA, 25 bp, Mus musculus
tttggcagcggtgagaggcttttac

SEQ ID NO: 850182 - DNA, 25 bp, Mus musculus
tttggcatactcatgtgggaagtga

SEQ ID NO: 850183 - DNA, 25 bp, Mus musculus
tttggcatactcttgtgggaagtga

SEQ ID NO: 850184 - DNA, 25 bp, Mus musculus
tttggcatcaagcactgggtgacgc

SEQ ID NO: 850185 - DNA, 25 bp, Mus musculus
tttggcatcaaggactgggtgacgc

SEQ ID NO: 850186 - DNA, 25 bp, Mus musculus
tttggcatcaggaggagcaacagga

SEQ ID NO: 850187 - DNA, 25 bp, Mus musculus
tttggcatcaggtggagcaacagga

SEQ ID NO: 850188 - DNA, 25 bp, Mus musculus
tttggcatcagtcgccgccttgttg

SEQ ID NO: 850189 - DNA, 25 bp, Mus musculus
tttggcatcagtggccgccttgttg

SEQ ID NO: 850190 - DNA, 25 bp, Mus musculus
tttggcatgcagaaggccaccttct

SEQ ID NO: 850191 - DNA, 25 bp, Mus musculus
tttggcatgcagtaggccaccttct

SEQ ID NO: 850192 - DNA, 25 bp, Mus musculus
tttggccaagctaattgctcaggct

SEQ ID NO: 850193 - DNA, 25 bp, Mus musculus
tttggccaagcttattgctcaggct

SEQ ID NO: 850194 - DNA, 25 bp, Mus musculus
tttggccaaggaccagcgactcaac

SEQ ID NO: 850195 - DNA, 25 bp, Mus musculus
tttggccaaggagcagcgactcaac

SEQ ID NO: 850196 - DNA, 25 bp, Mus musculus
tttggccaatgaagacaccccacag

SEQ ID NO: 850197 - DNA, 25 bp, Mus musculus
tttggccaatgatgacaccccacag

SEQ ID NO: 850198 - DNA, 25 bp, Mus musculus
tttggccacagcatttgatacaaca

SEQ ID NO: 850199 - DNA, 25 bp, Mus musculus
tttggccacagcttttgatacaaca

SEQ ID NO: 850200 - DNA, 25 bp, Mus musculus
tttggccacctgctttccctggata

SEQ ID NO: 850201 - DNA, 25 bp, Mus musculus
tttggccacctggtttccctggata

SEQ ID NO: 850202 - DNA, 25 bp, Mus musculus
tttggccacgccatgtgcctgcaac

SEQ ID NO: 850203 - DNA, 25 bp, Mus musculus
tttggccacgccttgtgcctgcaac

SEQ ID NO: 850204 - DNA, 25 bp, Mus musculus
tttggccagagaccctaacagaagg

SEQ ID NO: 850205 - DNA, 25 bp, Mus musculus
tttggccagagagcctaacagaagg

SEQ ID NO: 850206 - DNA, 25 bp, Mus musculus
tttggccagccaagagcaacagatg

SEQ ID NO: 850207 - DNA, 25 bp, Mus musculus
tttggccagccatgagcaacagatg

SEQ ID NO: 850208 - DNA, 25 bp, Mus musculus
tttggccagggcaccattattggtg

SEQ ID NO: 850209 - DNA, 25 bp, Mus musculus
tttggccagggctccattattggtg

SEQ ID NO: 850210 - DNA, 25 bp, Mus musculus
tttggccattgacctccagggagca

SEQ ID NO: 850211 - DNA, 25 bp, Mus musculus
tttggccattgagctccagggagca

SEQ ID NO: 850212 - DNA, 25 bp, Mus musculus
tttggcccctgtcggcggcgttcct

SEQ ID NO: 850213 - DNA, 25 bp, Mus musculus
tttggcccctgtgggcggcgttcct

SEQ ID NO: 850214 - DNA, 25 bp, Mus musculus
tttggccgaggcatggatattgagc

SEQ ID NO: 850215 - DNA, 25 bp, Mus musculus
tttggccgaggcttggatattgagc

SEQ ID NO: 850216 - DNA, 25 bp, Mus musculus
tttggccgatggcatgagacaaaag

SEQ ID NO: 850217 - DNA, 25 bp, Mus musculus
tttggccgatgggatgagacaaaag

SEQ ID NO: 850218 - DNA, 25 bp, Mus musculus
tttggccgctcaacagcggctgtgg

SEQ ID NO: 850219 - DNA, 25 bp, Mus musculus
tttggccgctcacgagaataccagc

SEQ ID NO: 850220 - DNA, 25 bp, Mus musculus
tttggccgctcaggagaataccagc

SEQ ID NO: 850221 - DNA, 25 bp, Mus musculus
tttggccgctcatcagcggctgtgg

SEQ ID NO: 850222 - DNA, 25 bp, Mus musculus
tttggccgggtcatctctacttgga

SEQ ID NO: 850223 - DNA, 25 bp, Mus musculus
tttggccgggtcttctctacttgga

SEQ ID NO: 850224 - DNA, 25 bp, Mus musculus
tttggcctcggtctgctaggcacca

SEQ ID NO: 850225 - DNA, 25 bp, Mus musculus
tttggcctcggtgtgctaggcacca

SEQ ID NO: 850226 - DNA, 25 bp, Mus musculus
tttggcctctcactggtcatctggg

SEQ ID NO: 850227 - DNA, 25 bp, Mus musculus
tttggcctctcagtggtcatctggg

SEQ ID NO: 850228 - DNA, 25 bp, Mus musculus
tttggcctggctcgagatgtgcaca

SEQ ID NO: 850229 - DNA, 25 bp, Mus musculus
tttggcctggctggagatgtgcaca

SEQ ID NO: 850230 - DNA, 25 bp, Mus musculus
tttggccttggtcttggaattgctt

SEQ ID NO: 850231 - DNA, 25 bp, Mus musculus
tttggccttggtgttggaattgctt

SEQ ID NO: 850232 - DNA, 25 bp, Mus musculus
tttggcgcagaaatttgtgggtagc

SEQ ID NO: 850233 - DNA, 25 bp, Mus musculus
tttggcgcagaattttgtgggtagc

SEQ ID NO: 850234 - DNA, 25 bp, Mus musculus
tttggcgccgagatccgaaggttct

SEQ ID NO: 850235 - DNA, 25 bp, Mus musculus
tttggcgccgagttccgaaggttct

SEQ ID NO: 850236 - DNA, 25 bp, Mus musculus
tttggcgctgaccagatattgaagc

SEQ ID NO: 850237 - DNA, 25 bp, Mus musculus
tttggcgctgacgagatattgaagc

SEQ ID NO: 850238 - DNA, 25 bp, Mus musculus
tttggctacagcacagtggtctgtg

SEQ ID NO: 850239 - DNA, 25 bp, Mus musculus
tttggctacagctcagtggtctgtg

SEQ ID NO: 850240 - DNA, 25 bp, Mus musculus
tttggctaccgtctggccctgtacg

SEQ ID NO: 850241 - DNA, 25 bp, Mus musculus
tttggctaccgtgtggccctgtacg

SEQ ID NO: 850242 - DNA, 25 bp, Mus musculus
tttggctacctgaaccaagagggaa

SEQ ID NO: 850243 - DNA, 25 bp, Mus musculus
tttggctacctgtaccaagagggaa

SEQ ID NO: 850244 - DNA, 25 bp, Mus musculus
tttggctacttcatcacagcctgtg

SEQ ID NO: 850245 - DNA, 25 bp, Mus musculus
tttggctacttcttcacagcctgtg

SEQ ID NO: 850246 - DNA, 25 bp, Mus musculus
tttggctagcatagcaatcaactgc

SEQ ID NO: 850247 - DNA, 25 bp, Mus musculus
tttggctagcattgcaatcaactgc

SEQ ID NO: 850248 - DNA, 25 bp, Mus musculus
tttggctaggttactgcggtcgcgt

SEQ ID NO: 850249 - DNA, 25 bp, Mus musculus
tttggctaggtttctgcggtcgcgt

SEQ ID NO: 850250 - DNA, 25 bp, Mus musculus
tttggctatatcaacagtgagaatg

SEQ ID NO: 850251 - DNA, 25 bp, Mus musculus
tttggctatatctacagtgagaatg

SEQ ID NO: 850252 - DNA, 25 bp, Mus musculus
tttggctcaaagataataaatgtcg

SEQ ID NO: 850253 - DNA, 25 bp, Mus musculus
tttggctcaaagttaataaatgtcg

SEQ ID NO: 850254 - DNA, 25 bp, Mus musculus
tttggctccccactgggcctggtgc

SEQ ID NO: 850255 - DNA, 25 bp, Mus musculus
tttggctccccagtgggcctggtgc

SEQ ID NO: 850256 - DNA, 25 bp, Mus musculus
tttggctcgcccctcagtgatctgc

SEQ ID NO: 850257 - DNA, 25 bp, Mus musculus
tttggctcgcccgtcagtgatctgc

SEQ ID NO: 850258 - DNA, 25 bp, Mus musculus
tttggctcgtacatggcatactcgt

SEQ ID NO: 850259 - DNA, 25 bp, Mus musculus
tttggctcgtacttggcatactcgt

SEQ ID NO: 850260 - DNA, 25 bp, Mus musculus
tttggctctcccagcctgcagtgac

SEQ ID NO: 850261 - DNA, 25 bp, Mus musculus
tttggctctccctgcctgcagtgac

SEQ ID NO: 850262 - DNA, 25 bp, Mus musculus
tttggctgcagccagctagaagcca

SEQ ID NO: 850263 - DNA, 25 bp, Mus musculus
tttggctgcagcgagctagaagcca

SEQ ID NO: 850264 - DNA, 25 bp, Mus musculus
tttggctgcccgcagcaggctctag

SEQ ID NO: 850265 - DNA, 25 bp, Mus musculus
tttggctgcccggagcaggctctag

SEQ ID NO: 850266 - DNA, 25 bp, Mus musculus
tttggctgctacctcccgctattgg

SEQ ID NO: 850267 - DNA, 25 bp, Mus musculus
tttggctgctacgtcccgctattgg

SEQ ID NO: 850268 - DNA, 25 bp, Mus musculus
tttggctggctcagcggctacttgg

SEQ ID NO: 850269 - DNA, 25 bp, Mus musculus
tttggctggctctgcggctacttgg

SEQ ID NO: 850270 - DNA, 25 bp, Mus musculus
tttggctgtcccaaaacgttctact

SEQ ID NO: 850271 - DNA, 25 bp, Mus musculus
tttggctgtccctaaacgttctact

SEQ ID NO: 850272 - DNA, 25 bp, Mus musculus
tttggctgtcggcagcccttagtcg

SEQ ID NO: 850273 - DNA, 25 bp, Mus musculus
tttggctgtcgggagcccttagtcg

SEQ ID NO: 850274 - DNA, 25 bp, Mus musculus
tttggcttagctcgagacattcatc

SEQ ID NO: 850275 - DNA, 25 bp, Mus musculus
tttggcttagctggagacattcatc

SEQ ID NO: 850276 - DNA, 25 bp, Mus musculus
tttggcttttcccactggtcaacac

SEQ ID NO: 850277 - DNA, 25 bp, Mus musculus
tttggcttttccgactggtcaacac

SEQ ID NO: 850278 - DNA, 25 bp, Mus musculus
tttgggaaagaacagctatctgaca

SEQ ID NO: 850279 - DNA, 25 bp, Mus musculus
tttgggaaagaagagctatctgaca

SEQ ID NO: 850280 - DNA, 25 bp, Mus musculus
tttgggaaagctaccctgtctggct

SEQ ID NO: 850281 - DNA, 25 bp, Mus musculus
tttgggaaagcttccctgtctggct

SEQ ID NO: 850282 - DNA, 25 bp, Mus musculus
tttgggaacaaccatagctgttggg

SEQ ID NO: 850283 - DNA, 25 bp, Mus musculus
tttgggaacaacgatagctgttggg

SEQ ID NO: 850284 - DNA, 25 bp, Mus musculus
tttgggaacccaaatagtgctgtct

SEQ ID NO: 850285 - DNA, 25 bp, Mus musculus
tttgggaacccatatagtgctgtct

SEQ ID NO: 850286 - DNA, 25 bp, Mus musculus
tttgggaacgtgatcaaagcacacc

SEQ ID NO: 850287 - DNA, 25 bp, Mus musculus
tttgggaacgtgttcaaagcacacc

SEQ ID NO: 850288 - DNA, 25 bp, Mus musculus
tttgggaactggctcttagatggtt

SEQ ID NO: 850289 - DNA, 25 bp, Mus musculus
tttgggaactgggtcttagatggtt

SEQ ID NO: 850290 - DNA, 25 bp, Mus musculus
tttgggaaggccacaatgttgctga

SEQ ID NO: 850291 - DNA, 25 bp, Mus musculus
tttgggaaggcctcaatgttgctga

SEQ ID NO: 850292 - DNA, 25 bp, Mus musculus
tttgggacaacaccagagatctatg

SEQ ID NO: 850293 - DNA, 25 bp, Mus musculus
tttgggacaacagcagagatctatg

SEQ ID NO: 850294 - DNA, 25 bp, Mus musculus
tttgggacaagaagcgctcgacgtt

SEQ ID NO: 850295 - DNA, 25 bp, Mus musculus
tttgggacaagatgcgctcgacgtt

SEQ ID NO: 850296 - DNA, 25 bp, Mus musculus
tttgggacaatccattctgcgacca

SEQ ID NO: 850297 - DNA, 25 bp, Mus musculus
tttgggacaatcgattctgcgacca

SEQ ID NO: 850298 - DNA, 25 bp, Mus musculus
tttgggacactaccaataagcagtg

SEQ ID NO: 850299 - DNA, 25 bp, Mus musculus
tttgggacactagcaataagcagtg

SEQ ID NO: 850300 - DNA, 25 bp, Mus musculus
tttgggacagagatcacggaccatt

SEQ ID NO: 850301 - DNA, 25 bp, Mus musculus
tttgggacagagttcacggaccatt

SEQ ID NO: 850302 - DNA, 25 bp, Mus musculus
tttgggacagttacgagaagaggtt

SEQ ID NO: 850303 - DNA, 25 bp, Mus musculus
tttgggacagtttcgagaagaggtt

SEQ ID NO: 850304 - DNA, 25 bp, Mus musculus
tttgggaccagcaatattaaggagc

SEQ ID NO: 850305 - DNA, 25 bp, Mus musculus
tttgggaccagctatattaaggagc

SEQ ID NO: 850306 - DNA, 25 bp, Mus musculus
tttgggacccaaagctggagatgag

SEQ ID NO: 850307 - DNA, 25 bp, Mus musculus
tttgggacccaatgctggagatgag

SEQ ID NO: 850308 - DNA, 25 bp, Mus musculus
tttgggaccggtctgatagagcact

SEQ ID NO: 850309 - DNA, 25 bp, Mus musculus
tttgggaccggtgtgatagagcact

SEQ ID NO: 850310 - DNA, 25 bp, Mus musculus
tttgggacctatcttggcaacgatc

SEQ ID NO: 850311 - DNA, 25 bp, Mus musculus
tttgggacctatgttggcaacgatc

SEQ ID NO: 850312 - DNA, 25 bp, Mus musculus
tttgggactggacaatgctttgttt

SEQ ID NO: 850313 - DNA, 25 bp, Mus musculus
tttgggactggagaatgctttgttt

SEQ ID NO: 850314 - DNA, 25 bp, Mus musculus
tttgggagaaacagagccaacgcct

SEQ ID NO: 850315 - DNA, 25 bp, Mus musculus
tttgggagaaactgagccaacgcct

SEQ ID NO: 850316 - DNA, 25 bp, Mus musculus
tttgggagaaatcacgaaagtacca

SEQ ID NO: 850317 - DNA, 25 bp, Mus musculus
tttgggagaaatgacgaaagtacca

SEQ ID NO: 850318 - DNA, 25 bp, Mus musculus
tttgggagaacaccacttatgtact

SEQ ID NO: 850319 - DNA, 25 bp, Mus musculus
tttgggagaacagcacttatgtact

SEQ ID NO: 850320 - DNA, 25 bp, Mus musculus
tttgggagaactagcatgtgacccc

SEQ ID NO: 850321 - DNA, 25 bp, Mus musculus
tttgggagaacttgcatgtgacccc

SEQ ID NO: 850322 - DNA, 25 bp, Mus musculus
tttgggagagatcctgccagcttcc

SEQ ID NO: 850323 - DNA, 25 bp, Mus musculus
tttgggagagatgctgccagcttcc

SEQ ID NO: 850324 - DNA, 25 bp, Mus musculus
tttgggagatttcttggctacacag

SEQ ID NO: 850325 - DNA, 25 bp, Mus musculus
tttgggagatttgttggctacacag

SEQ ID NO: 850326 - DNA, 25 bp, Mus musculus
tttgggagcaagatcacacagatct

SEQ ID NO: 850327 - DNA, 25 bp, Mus musculus
tttgggagcaagttcacacagatct

SEQ ID NO: 850328 - DNA, 25 bp, Mus musculus
tttgggagccggagctctccttccg

SEQ ID NO: 850329 - DNA, 25 bp, Mus musculus
tttgggagccggtgctctccttccg

SEQ ID NO: 850330 - DNA, 25 bp, Mus musculus
tttgggagccttcggaaagcaccgt

SEQ ID NO: 850331 - DNA, 25 bp, Mus musculus
tttgggagccttgggaaagcaccgt

SEQ ID NO: 850332 - DNA, 25 bp, Mus musculus
tttgggagtgacctgaagaactcac

SEQ ID NO: 850333 - DNA, 25 bp, Mus musculus
tttgggagtgaccttgttgagaatc

SEQ ID NO: 850334 - DNA, 25 bp, Mus musculus
tttgggagtgacgtgaagaactcac

SEQ ID NO: 850335 - DNA, 25 bp, Mus musculus
tttgggagtgacgttgttgagaatc

SEQ ID NO: 850336 - DNA, 25 bp, Mus musculus
tttgggatacgtctacagagcaaag

SEQ ID NO: 850337 - DNA, 25 bp, Mus musculus
tttgggatacgtgtacagagcaaag

SEQ ID NO: 850338 - DNA, 25 bp, Mus musculus
tttgggatcagaacagactgttgga

SEQ ID NO: 850339 - DNA, 25 bp, Mus musculus
tttgggatcagatcagactgttgga

SEQ ID NO: 850340 - DNA, 25 bp, Mus musculus
tttgggatgaccagctagcatctca

SEQ ID NO: 850341 - DNA, 25 bp, Mus musculus
tttgggatgacctgctagcatctca

SEQ ID NO: 850342 - DNA, 25 bp, Mus musculus
tttgggattggcaacagcgacacgg

SEQ ID NO: 850343 - DNA, 25 bp, Mus musculus
tttgggattggctacagcgacacgg

SEQ ID NO: 850344 - DNA, 25 bp, Mus musculus
tttgggcaacgtctggcgtttcccg

SEQ ID NO: 850345 - DNA, 25 bp, Mus musculus
tttgggcaacgtgtggcgtttcccg

SEQ ID NO: 850346 - DNA, 25 bp, Mus musculus
tttgggcaaggacaatttccaggca

SEQ ID NO: 850347 - DNA, 25 bp, Mus musculus
tttgggcaaggagaatttccaggca

SEQ ID NO: 850348 - DNA, 25 bp, Mus musculus
tttgggcaatacataccttgcattg

SEQ ID NO: 850349 - DNA, 25 bp, Mus musculus
tttgggcaatacttaccttgcattg

SEQ ID NO: 850350 - DNA, 25 bp, Mus musculus
tttgggcagtacaaagccttctaaa

SEQ ID NO: 850351 - DNA, 25 bp, Mus musculus
tttgggcagtactaagccttctaaa

SEQ ID NO: 850352 - DNA, 25 bp, Mus musculus
tttgggccactgacttcagcagcca

SEQ ID NO: 850353 - DNA, 25 bp, Mus musculus
tttgggccactgcaccgccaagaga

SEQ ID NO: 850354 - DNA, 25 bp, Mus musculus
tttgggccactggaccgccaagaga

SEQ ID NO: 850355 - DNA, 25 bp, Mus musculus
tttgggccactgtcttcagcagcca

SEQ ID NO: 850356 - DNA, 25 bp, Mus musculus
tttgggccagaccactaacagcatg

SEQ ID NO: 850357 - DNA, 25 bp, Mus musculus
tttgggccagacgactaacagcatg

SEQ ID NO: 850358 - DNA, 25 bp, Mus musculus
tttgggccagttcgcttggataaaa

SEQ ID NO: 850359 - DNA, 25 bp, Mus musculus
tttgggccagttggcttggataaaa

SEQ ID NO: 850360 - DNA, 25 bp, Mus musculus
tttgggccccgaatatcgtcggtga

SEQ ID NO: 850361 - DNA, 25 bp, Mus musculus
tttgggccccgattatcgtcggtga

SEQ ID NO: 850362 - DNA, 25 bp, Mus musculus
tttgggccctgcagatgtgctggct

SEQ ID NO: 850363 - DNA, 25 bp, Mus musculus
tttgggccctgctgatgtgctggct

SEQ ID NO: 850364 - DNA, 25 bp, Mus musculus
tttgggcctgatcgaagtttactgg

SEQ ID NO: 850365 - DNA, 25 bp, Mus musculus
tttgggcctgatggaagtttactgg

SEQ ID NO: 850366 - DNA, 25 bp, Mus musculus
tttgggcggacaccccacaacacag

SEQ ID NO: 850367 - DNA, 25 bp, Mus musculus
tttgggcggacagcccacaacacag

SEQ ID NO: 850368 - DNA, 25 bp, Mus musculus
tttgggctcagccagtaacctgact

SEQ ID NO: 850369 - DNA, 25 bp, Mus musculus
tttgggctcagcgagtaacctgact

SEQ ID NO: 850370 - DNA, 25 bp, Mus musculus
tttgggctcagtatccacgagagtg

SEQ ID NO: 850371 - DNA, 25 bp, Mus musculus
tttgggctcagtttccacgagagtg

SEQ ID NO: 850372 - DNA, 25 bp, Mus musculus
tttgggctccacaacttaacctggt

SEQ ID NO: 850373 - DNA, 25 bp, Mus musculus
tttgggctccactacttaacctggt

SEQ ID NO: 850374 - DNA, 25 bp, Mus musculus
tttgggctgagcaaggagttcctga

SEQ ID NO: 850375 - DNA, 25 bp, Mus musculus
tttgggctgagctaggagttcctga

SEQ ID NO: 850376 - DNA, 25 bp, Mus musculus
tttgggctgatcaccagtctccgag

SEQ ID NO: 850377 - DNA, 25 bp, Mus musculus
tttgggctgatctccagtctccgag

SEQ ID NO: 850378 - DNA, 25 bp, Mus musculus
tttgggctgcatctgagtcgaatga

SEQ ID NO: 850379 - DNA, 25 bp, Mus musculus
tttgggctgcatgtgagtcgaatga

SEQ ID NO: 850380 - DNA, 25 bp, Mus musculus
tttgggctggccaagtgcaatggca

SEQ ID NO: 850381 - DNA, 25 bp, Mus musculus
tttgggctggcctagtgcaatggca

SEQ ID NO: 850382 - DNA, 25 bp, Mus musculus
tttgggctgtcaccttcgggcccag

SEQ ID NO: 850383 - DNA, 25 bp, Mus musculus
tttgggctgtcagcttcgggcccag

SEQ ID NO: 850384 - DNA, 25 bp, Mus musculus
tttgggctgtgtcgtattccagaga

SEQ ID NO: 850385 - DNA, 25 bp, Mus musculus
tttgggctgtgtggtattccagaga

SEQ ID NO: 850386 - DNA, 25 bp, Mus musculus
tttgggcttgatcgatccggccttg

SEQ ID NO: 850387 - DNA, 25 bp, Mus musculus
tttgggcttgatggatccggccttg

SEQ ID NO: 850388 - DNA, 25 bp, Mus musculus
tttgggctttggcatgctgtgtata

SEQ ID NO: 850389 - DNA, 25 bp, Mus musculus
tttgggctttgggatgctgtgtata

SEQ ID NO: 850390 - DNA, 25 bp, Mus musculus
tttgggtaggtcagcggacttgctt

SEQ ID NO: 850391 - DNA, 25 bp, Mus musculus
tttgggtaggtctgcggacttgctt

SEQ ID NO: 850392 - DNA, 25 bp, Mus musculus
tttgggtcaaatccaaggccttaat

SEQ ID NO: 850393 - DNA, 25 bp, Mus musculus
tttgggtcaaatgcaaggccttaat

SEQ ID NO: 850394 - DNA, 25 bp, Mus musculus
tttgggtcagacattcaggagaagc

SEQ ID NO: 850395 - DNA, 25 bp, Mus musculus
tttgggtcagactttcaggagaagc

SEQ ID NO: 850396 - DNA, 25 bp, Mus musculus
tttgggtccagcaaaataacagaag

SEQ ID NO: 850397 - DNA, 25 bp, Mus musculus
tttgggtccagctaaataacagaag

SEQ ID NO: 850398 - DNA, 25 bp, Mus musculus
tttgggtccatgaaccccacacgca

SEQ ID NO: 850399 - DNA, 25 bp, Mus musculus
tttgggtccatgtaccccacacgca

SEQ ID NO: 850400 - DNA, 25 bp, Mus musculus
tttgggtgagatctttcagtgtcac

SEQ ID NO: 850401 - DNA, 25 bp, Mus musculus
tttgggtgagatgtttcagtgtcac

SEQ ID NO: 850402 - DNA, 25 bp, Mus musculus
tttgggtgatcaccgactgtgcctc

SEQ ID NO: 850403 - DNA, 25 bp, Mus musculus
tttgggtgatcagcgactgtgcctc

SEQ ID NO: 850404 - DNA, 25 bp, Mus musculus
tttgggtggcttcgatttaaagcga

SEQ ID NO: 850405 - DNA, 25 bp, Mus musculus
tttgggtggcttggatttaaagcga

SEQ ID NO: 850406 - DNA, 25 bp, Mus musculus
tttgggttcagcagctcgtcagaaa

SEQ ID NO: 850407 - DNA, 25 bp, Mus musculus
tttgggttcagctgctcgtcagaaa

SEQ ID NO: 850408 - DNA, 25 bp, Mus musculus
tttggtaaagaacataacctgtggg

SEQ ID NO: 850409 - DNA, 25 bp, Mus musculus
tttggtaaagaagataacctgtggg

SEQ ID NO: 850410 - DNA, 25 bp, Mus musculus
tttggtaaccaaagcagccgtggga

SEQ ID NO: 850411 - DNA, 25 bp, Mus musculus
tttggtaaccaatgcagccgtggga

SEQ ID NO: 850412 - DNA, 25 bp, Mus musculus
tttggtacagaaccgccttccacac

SEQ ID NO: 850413 - DNA, 25 bp, Mus musculus
tttggtacagaagcgccttccacac

SEQ ID NO: 850414 - DNA, 25 bp, Mus musculus
tttggtatcacaagccgagactgga

SEQ ID NO: 850415 - DNA, 25 bp, Mus musculus
tttggtatcacatgccgagactgga

SEQ ID NO: 850416 - DNA, 25 bp, Mus musculus
tttggtatgcttaagaccaagagca

SEQ ID NO: 850417 - DNA, 25 bp, Mus musculus
tttggtatgctttagaccaagagca

SEQ ID NO: 850418 - DNA, 25 bp, Mus musculus
tttggtatggatccctcccggcccg

SEQ ID NO: 850419 - DNA, 25 bp, Mus musculus
tttggtatggatgcctcccggcccg

SEQ ID NO: 850420 - DNA, 25 bp, Mus musculus
tttggtattcatcacaatccatcag

SEQ ID NO: 850421 - DNA, 25 bp, Mus musculus
tttggtattcatgacaatccatcag

SEQ ID NO: 850422 - DNA, 25 bp, Mus musculus
tttggtatttggacacatagtgtag

SEQ ID NO: 850423 - DNA, 25 bp, Mus musculus
tttggtatttggtcacatagtgtag

SEQ ID NO: 850424 - DNA, 25 bp, Mus musculus
tttggtcaccctctggttgaaagcc

SEQ ID NO: 850425 - DNA, 25 bp, Mus musculus
tttggtcaccctgtggttgaaagcc

SEQ ID NO: 850426 - DNA, 25 bp, Mus musculus
tttggtcactttaaagccgcataac

SEQ ID NO: 850427 - DNA, 25 bp, Mus musculus
tttggtcacttttaagccgcataac

SEQ ID NO: 850428 - DNA, 25 bp, Mus musculus
tttggtcagttgagaaggagatctt

SEQ ID NO: 850429 - DNA, 25 bp, Mus musculus
tttggtcagttgtgaaggagatctt

SEQ ID NO: 850430 - DNA, 25 bp, Mus musculus
tttggtcgccatcaaagaaattctg

SEQ ID NO: 850431 - DNA, 25 bp, Mus musculus
tttggtcgccatgaaagaaattctg

SEQ ID NO: 850432 - DNA, 25 bp, Mus musculus
tttggtcgggaacaagatcgtgttt

SEQ ID NO: 850433 - DNA, 25 bp, Mus musculus
tttggtcgggaagaagatcgtgttt

SEQ ID NO: 850434 - DNA, 25 bp, Mus musculus
tttggtctcggacctccagactact

SEQ ID NO: 850435 - DNA, 25 bp, Mus musculus
tttggtctcggagctccagactact

SEQ ID NO: 850436 - DNA, 25 bp, Mus musculus
tttggtctctgcatcccgggataag

SEQ ID NO: 850437 - DNA, 25 bp, Mus musculus
tttggtctctgcttcccgggataag

SEQ ID NO: 850438 - DNA, 25 bp, Mus musculus
tttggtctgtaaagattccattggc

SEQ ID NO: 850439 - DNA, 25 bp, Mus musculus
tttggtctgtaatgattccattggc

SEQ ID NO: 850440 - DNA, 25 bp, Mus musculus
tttggtgaagtgaataagggcacac

SEQ ID NO: 850441 - DNA, 25 bp, Mus musculus
tttggtgaagtgtataagggcacac

SEQ ID NO: 850442 - DNA, 25 bp, Mus musculus
tttggtgaccgacagcagcgctgcc

SEQ ID NO: 850443 - DNA, 25 bp, Mus musculus
tttggtgaccgagagcagcgctgcc

SEQ ID NO: 850444 - DNA, 25 bp, Mus musculus
tttggtgagcacactgtgaccggac

SEQ ID NO: 850445 - DNA, 25 bp, Mus musculus
tttggtgagcactctgtgaccggac

SEQ ID NO: 850446 - DNA, 25 bp, Mus musculus
tttggtgcaccgatcggaggagttc

SEQ ID NO: 850447 - DNA, 25 bp, Mus musculus
tttggtgcaccgttcggaggagttc

SEQ ID NO: 850448 - DNA, 25 bp, Mus musculus
tttggtgccaacacaggcctgccag

SEQ ID NO: 850449 - DNA, 25 bp, Mus musculus
tttggtgccaactcaggcctgccag

SEQ ID NO: 850450 - DNA, 25 bp, Mus musculus
tttggtgccagacgtttagcccgta

SEQ ID NO: 850451 - DNA, 25 bp, Mus musculus
tttggtgccagaggtttagcccgta

SEQ ID NO: 850452 - DNA, 25 bp, Mus musculus
tttggtgcgcctaagtcagttggaa

SEQ ID NO: 850453 - DNA, 25 bp, Mus musculus
tttggtgcgccttagtcagttggaa

SEQ ID NO: 850454 - DNA, 25 bp, Mus musculus
tttggtgcgtgccagcgtcgatatc

SEQ ID NO: 850455 - DNA, 25 bp, Mus musculus
tttggtgcgtgcgagcgtcgatatc

SEQ ID NO: 850456 - DNA, 25 bp, Mus musculus
tttggtgctgttccctactagggcg

SEQ ID NO: 850457 - DNA, 25 bp, Mus musculus
tttggtgctgttgcctactagggcg

SEQ ID NO: 850458 - DNA, 25 bp, Mus musculus
tttggtggaatgctagagtatggaa

SEQ ID NO: 850459 - DNA, 25 bp, Mus musculus
tttggtggaatggtagagtatggaa

SEQ ID NO: 850460 - DNA, 25 bp, Mus musculus
tttggtggcagtcaggacaccccgg

SEQ ID NO: 850461 - DNA, 25 bp, Mus musculus
tttggtggcagtcgcaccggcggct

SEQ ID NO: 850462 - DNA, 25 bp, Mus musculus
tttggtggcagtgaggacaccccgg

SEQ ID NO: 850463 - DNA, 25 bp, Mus musculus
tttggtggcagtggcaccggcggct

SEQ ID NO: 850464 - DNA, 25 bp, Mus musculus
tttggtggcggcaccccaagcgaag

SEQ ID NO: 850465 - DNA, 25 bp, Mus musculus
tttggtggcggctccccaagcgaag

SEQ ID NO: 850466 - DNA, 25 bp, Mus musculus
tttggtggctgcaccgtcacattgc

SEQ ID NO: 850467 - DNA, 25 bp, Mus musculus
tttggtggctgctccgtcacattgc

SEQ ID NO: 850468 - DNA, 25 bp, Mus musculus
tttggtggcttcaaaatgtctggga

SEQ ID NO: 850469 - DNA, 25 bp, Mus musculus
tttggtggcttctaaatgtctggga

SEQ ID NO: 850470 - DNA, 25 bp, Mus musculus
tttggtgggctcaacgcctccatcg

SEQ ID NO: 850471 - DNA, 25 bp, Mus musculus
tttggtgggctctacgcctccatcg

SEQ ID NO: 850472 - DNA, 25 bp, Mus musculus
tttggtgtccacattaaagtagtag

SEQ ID NO: 850473 - DNA, 25 bp, Mus musculus
tttggtgtccactttaaagtagtag

SEQ ID NO: 850474 - DNA, 25 bp, Mus musculus
tttggtgtctgtaggcggctacaaa

SEQ ID NO: 850475 - DNA, 25 bp, Mus musculus
tttggtgtctgttggcggctacaaa

SEQ ID NO: 850476 - DNA, 25 bp, Mus musculus
tttggttagtgccaccataccatcc

SEQ ID NO: 850477 - DNA, 25 bp, Mus musculus
tttggttagtgcgaccataccatcc

SEQ ID NO: 850478 - DNA, 25 bp, Mus musculus
tttggttatagactaccagctgaag

SEQ ID NO: 850479 - DNA, 25 bp, Mus musculus
tttggttatagagtaccagctgaag

SEQ ID NO: 850480 - DNA, 25 bp, Mus musculus
tttggttcccacagctacttggttc

SEQ ID NO: 850481 - DNA, 25 bp, Mus musculus
tttggttcccactgctacttggttc

SEQ ID NO: 850482 - DNA, 25 bp, Mus musculus
tttggttccgagaccgcgaacgcct

SEQ ID NO: 850483 - DNA, 25 bp, Mus musculus
tttggttccgagtccgcgaacgcct

SEQ ID NO: 850484 - DNA, 25 bp, Mus musculus
tttggttcgtggagtcccagcggca

SEQ ID NO: 850485 - DNA, 25 bp, Mus musculus
tttggttcgtggtgtcccagcggca

SEQ ID NO: 850486 - DNA, 25 bp, Mus musculus
tttggttcttttaaggcggcttcat

SEQ ID NO: 850487 - DNA, 25 bp, Mus musculus
tttggttctttttaggcggcttcat

SEQ ID NO: 850488 - DNA, 25 bp, Mus musculus
tttggttgagggacagcataccgtg

SEQ ID NO: 850489 - DNA, 25 bp, Mus musculus
tttggttgagggtcagcataccgtg

SEQ ID NO: 850490 - DNA, 25 bp, Mus musculus
tttggttgctgcctccttggctggc

SEQ ID NO: 850491 - DNA, 25 bp, Mus musculus
tttggttgctgcgtccttggctggc

SEQ ID NO: 850492 - DNA, 25 bp, Mus musculus
tttggttggaagaaaatatctggcg

SEQ ID NO: 850493 - DNA, 25 bp, Mus musculus
tttggttggaagtaaatatctggcg

SEQ ID NO: 850494 - DNA, 25 bp, Mus musculus
tttggtttccgtctggacaaggaag

SEQ ID NO: 850495 - DNA, 25 bp, Mus musculus
tttggtttccgtgtggacaaggaag

SEQ ID NO: 850496 - DNA, 25 bp, Mus musculus
tttggtttctatcatgccaatgaga

SEQ ID NO: 850497 - DNA, 25 bp, Mus musculus
tttggtttctatgatgccaatgaga

SEQ ID NO: 850498 - DNA, 25 bp, Mus musculus
tttggtttggcaacagtgaagtcac

SEQ ID NO: 850499 - DNA, 25 bp, Mus musculus
tttggtttggcatcagtgaagtcac

SEQ ID NO: 850500 - DNA, 25 bp, Mus musculus
tttggttttcatccagtgtgtgatc

SEQ ID NO: 850501 - DNA, 25 bp, Mus musculus
tttggttttcatgcagtgtgtgatc

SEQ ID NO: 850502 - DNA, 25 bp, Mus musculus
tttgtaaagagcacgcctctcctgg

SEQ ID NO: 850503 - DNA, 25 bp, Mus musculus
tttgtaaagagctcgcctctcctgg

SEQ ID NO: 850504 - DNA, 25 bp, Mus musculus
tttgtaacagcacaaagctatggaa

SEQ ID NO: 850505 - DNA, 25 bp, Mus musculus
tttgtaacagcagaaagctatggaa

SEQ ID NO: 850506 - DNA, 25 bp, Mus musculus
tttgtaaccctacgctgcacagcaa

SEQ ID NO: 850507 - DNA, 25 bp, Mus musculus
tttgtaaccctaggctgcacagcaa

SEQ ID NO: 850508 - DNA, 25 bp, Mus musculus
tttgtaactaaactgaatcctagcc

SEQ ID NO: 850509 - DNA, 25 bp, Mus musculus
tttgtaactaaagtgaatcctagcc

SEQ ID NO: 850510 - DNA, 25 bp, Mus musculus
tttgtaaggaggctccatggtgtcc

SEQ ID NO: 850511 - DNA, 25 bp, Mus musculus
tttgtaaggagggtccatggtgtcc

SEQ ID NO: 850512 - DNA, 25 bp, Mus musculus
tttgtaatcgctcgcgtgccccgcg

SEQ ID NO: 850513 - DNA, 25 bp, Mus musculus
tttgtaatcgctggcgtgccccgcg

SEQ ID NO: 850514 - DNA, 25 bp, Mus musculus
tttgtacagctgcatctagacttta

SEQ ID NO: 850515 - DNA, 25 bp, Mus musculus
tttgtacagctggatctagacttta

SEQ ID NO: 850516 - DNA, 25 bp, Mus musculus
tttgtacatgaacacttctcagctg

SEQ ID NO: 850517 - DNA, 25 bp, Mus musculus
tttgtacatgaagacttctcagctg

SEQ ID NO: 850518 - DNA, 25 bp, Mus musculus
tttgtacatgcaacaacttggagag

SEQ ID NO: 850519 - DNA, 25 bp, Mus musculus
tttgtacatgcatcaacttggagag

SEQ ID NO: 850520 - DNA, 25 bp, Mus musculus
tttgtacattttcaccaagatctcg

SEQ ID NO: 850521 - DNA, 25 bp, Mus musculus
tttgtacattttgaccaagatctcg

SEQ ID NO: 850522 - DNA, 25 bp, Mus musculus
tttgtaccaataacagggagtctcc

SEQ ID NO: 850523 - DNA, 25 bp, Mus musculus
tttgtaccaatatcagggagtctcc

SEQ ID NO: 850524 - DNA, 25 bp, Mus musculus
tttgtaccataaataaacgatgccc

SEQ ID NO: 850525 - DNA, 25 bp, Mus musculus
tttgtaccataattaaacgatgccc

SEQ ID NO: 850526 - DNA, 25 bp, Mus musculus
tttgtaccatagaggactgtccgta

SEQ ID NO: 850527 - DNA, 25 bp, Mus musculus
tttgtaccatagtggactgtccgta

SEQ ID NO: 850528 - DNA, 25 bp, Mus musculus
tttgtacccatgaccaagatcgctg

SEQ ID NO: 850529 - DNA, 25 bp, Mus musculus
tttgtacccatgtccaagatcgctg

SEQ ID NO: 850530 - DNA, 25 bp, Mus musculus
tttgtacccgccagcgggaacttca

SEQ ID NO: 850531 - DNA, 25 bp, Mus musculus
tttgtacccgcctgcgggaacttca

SEQ ID NO: 850532 - DNA, 25 bp, Mus musculus
tttgtacgaacaccagaagagctcc

SEQ ID NO: 850533 - DNA, 25 bp, Mus musculus
tttgtacgaacagcagaagagctcc

SEQ ID NO: 850534 - DNA, 25 bp, Mus musculus
tttgtactaagcatcgggtctcttg

SEQ ID NO: 850535 - DNA, 25 bp, Mus musculus
tttgtactaagcttcgggtctcttg

SEQ ID NO: 850536 - DNA, 25 bp, Mus musculus
tttgtactcactctaacaagcaccg

SEQ ID NO: 850537 - DNA, 25 bp, Mus musculus
tttgtactcactgtaacaagcaccg

SEQ ID NO: 850538 - DNA, 25 bp, Mus musculus
tttgtactggtgctagggacgccca

SEQ ID NO: 850539 - DNA, 25 bp, Mus musculus
tttgtactggtggtagggacgccca

SEQ ID NO: 850540 - DNA, 25 bp, Mus musculus
tttgtagaaaaacgaagagcggcac

SEQ ID NO: 850541 - DNA, 25 bp, Mus musculus
tttgtagaaaaaggaagagcggcac

SEQ ID NO: 850542 - DNA, 25 bp, Mus musculus
tttgtagacttcacggctgccaaca

SEQ ID NO: 850543 - DNA, 25 bp, Mus musculus
tttgtagacttctcggctgccaaca

SEQ ID NO: 850544 - DNA, 25 bp, Mus musculus
tttgtagagccgattgtaattctgc

SEQ ID NO: 850545 - DNA, 25 bp, Mus musculus
tttgtagagccgtttgtaattctgc

SEQ ID NO: 850546 - DNA, 25 bp, Mus musculus
tttgtagagtagaacttgcccagtg

SEQ ID NO: 850547 - DNA, 25 bp, Mus musculus
tttgtagagtagtacttgcccagtg

SEQ ID NO: 850548 - DNA, 25 bp, Mus musculus
tttgtagatgatcggactgagacgc

SEQ ID NO: 850549 - DNA, 25 bp, Mus musculus
tttgtagatgatgggactgagacgc

SEQ ID NO: 850550 - DNA, 25 bp, Mus musculus
tttgtagccagcaacagagcagatg

SEQ ID NO: 850551 - DNA, 25 bp, Mus musculus
tttgtagccagcaccatgccatcgc

SEQ ID NO: 850552 - DNA, 25 bp, Mus musculus
tttgtagccagctacagagcagatg

SEQ ID NO: 850553 - DNA, 25 bp, Mus musculus
tttgtagccagctccatgccatcgc

SEQ ID NO: 850554 - DNA, 25 bp, Mus musculus
tttgtaggccgtccacagaaaaagg

SEQ ID NO: 850555 - DNA, 25 bp, Mus musculus
tttgtaggccgtgcacagaaaaagg

SEQ ID NO: 850556 - DNA, 25 bp, Mus musculus
tttgtagtccagcatctgggaggca

SEQ ID NO: 850557 - DNA, 25 bp, Mus musculus
tttgtagtccaggatctgggaggca

SEQ ID NO: 850558 - DNA, 25 bp, Mus musculus
tttgtagtggctctcaagcaggagc

SEQ ID NO: 850559 - DNA, 25 bp, Mus musculus
tttgtagtggctgtcaagcaggagc

SEQ ID NO: 850560 - DNA, 25 bp, Mus musculus
tttgtataatgtaggccaagtcctc

SEQ ID NO: 850561 - DNA, 25 bp, Mus musculus
tttgtataatgttggccaagtcctc

SEQ ID NO: 850562 - DNA, 25 bp, Mus musculus
tttgtatctcagaggtcacttttgt

SEQ ID NO: 850563 - DNA, 25 bp, Mus musculus
tttgtatctcagtggtcacttttgt

SEQ ID NO: 850564 - DNA, 25 bp, Mus musculus
tttgtattaaggcatgagcatgcac

SEQ ID NO: 850565 - DNA, 25 bp, Mus musculus
tttgtattaagggatgagcatgcac

SEQ ID NO: 850566 - DNA, 25 bp, Mus musculus
tttgtattcggcagactgtgagccc

SEQ ID NO: 850567 - DNA, 25 bp, Mus musculus
tttgtattcggctgactgtgagccc

SEQ ID NO: 850568 - DNA, 25 bp, Mus musculus
tttgtattggtgagaaaggatatgc

SEQ ID NO: 850569 - DNA, 25 bp, Mus musculus
tttgtattggtgtgaaaggatatgc

SEQ ID NO: 850570 - DNA, 25 bp, Mus musculus
tttgtcaaacccaatgcccggaagc

SEQ ID NO: 850571 - DNA, 25 bp, Mus musculus
tttgtcaaaccctatgcccggaagc

SEQ ID NO: 850572 - DNA, 25 bp, Mus musculus
tttgtcaaatccagcaaccttccga

SEQ ID NO: 850573 - DNA, 25 bp, Mus musculus
tttgtcaaatcctgcaaccttccga

SEQ ID NO: 850574 - DNA, 25 bp, Mus musculus
tttgtcaagatcaacctgctacccg

SEQ ID NO: 850575 - DNA, 25 bp, Mus musculus
tttgtcaagatctacctgctacccg

SEQ ID NO: 850576 - DNA, 25 bp, Mus musculus
tttgtcaaggagatcggaagtggtc

SEQ ID NO: 850577 - DNA, 25 bp, Mus musculus
tttgtcaaggagttcggaagtggtc

SEQ ID NO: 850578 - DNA, 25 bp, Mus musculus
tttgtcacacaacctgcattcccag

SEQ ID NO: 850579 - DNA, 25 bp, Mus musculus
tttgtcacacaagctgcattcccag

SEQ ID NO: 850580 - DNA, 25 bp, Mus musculus
tttgtcacagcgcagtccagcttag

SEQ ID NO: 850581 - DNA, 25 bp, Mus musculus
tttgtcacagcggagtccagcttag

SEQ ID NO: 850582 - DNA, 25 bp, Mus musculus
tttgtcacgcatccccttctgggct

SEQ ID NO: 850583 - DNA, 25 bp, Mus musculus
tttgtcacgcatgcccttctgggct

SEQ ID NO: 850584 - DNA, 25 bp, Mus musculus
tttgtcagccagctgaatattcagc

SEQ ID NO: 850585 - DNA, 25 bp, Mus musculus
tttgtcagccaggtgaatattcagc

SEQ ID NO: 850586 - DNA, 25 bp, Mus musculus
tttgtcatagctcgtgctgtccgcc

SEQ ID NO: 850587 - DNA, 25 bp, Mus musculus
tttgtcatagctggtgctgtccgcc

SEQ ID NO: 850588 - DNA, 25 bp, Mus musculus
tttgtcatccatcctgtcccacaga

SEQ ID NO: 850589 - DNA, 25 bp, Mus musculus
tttgtcatccatgctgtcccacaga

SEQ ID NO: 850590 - DNA, 25 bp, Mus musculus
tttgtcatgggtaggccctgggccc

SEQ ID NO: 850591 - DNA, 25 bp, Mus musculus
tttgtcatgggttggccctgggccc

SEQ ID NO: 850592 - DNA, 25 bp, Mus musculus
tttgtcatggtcctggattcctcca

SEQ ID NO: 850593 - DNA, 25 bp, Mus musculus
tttgtcatggtcgtggattcctcca

SEQ ID NO: 850594 - DNA, 25 bp, Mus musculus
tttgtccagcagacccaggacgtca

SEQ ID NO: 850595 - DNA, 25 bp, Mus musculus
tttgtccagcagtcccaggacgtca

SEQ ID NO: 850596 - DNA, 25 bp, Mus musculus
tttgtccaggatcactttgaccaca

SEQ ID NO: 850597 - DNA, 25 bp, Mus musculus
tttgtccaggatgactttgaccaca

SEQ ID NO: 850598 - DNA, 25 bp, Mus musculus
tttgtccagtaacagtcatctcctg

SEQ ID NO: 850599 - DNA, 25 bp, Mus musculus
tttgtccagtaagagtcatctcctg

SEQ ID NO: 850600 - DNA, 25 bp, Mus musculus
tttgtcccagtgacgaaggtgaatg

SEQ ID NO: 850601 - DNA, 25 bp, Mus musculus
tttgtcccagtgtcgaaggtgaatg

SEQ ID NO: 850602 - DNA, 25 bp, Mus musculus
tttgtccccaccaactcagaagctg

SEQ ID NO: 850603 - DNA, 25 bp, Mus musculus
tttgtccccacctactcagaagctg

SEQ ID NO: 850604 - DNA, 25 bp, Mus musculus
tttgtccgatacagagctggccgca

SEQ ID NO: 850605 - DNA, 25 bp, Mus musculus
tttgtccgatactgagctggccgca

SEQ ID NO: 850606 - DNA, 25 bp, Mus musculus
tttgtccggttccagcctgaaagca

SEQ ID NO: 850607 - DNA, 25 bp, Mus musculus
tttgtccggttcgagcctgaaagca

SEQ ID NO: 850608 - DNA, 25 bp, Mus musculus
tttgtcctctaacattctacctggg

SEQ ID NO: 850609 - DNA, 25 bp, Mus musculus
tttgtcctctaagattctacctggg

SEQ ID NO: 850610 - DNA, 25 bp, Mus musculus
tttgtcctgtccagtcgcggatcgg

SEQ ID NO: 850611 - DNA, 25 bp, Mus musculus
tttgtcctgtcctgtcgcggatcgg

SEQ ID NO: 850612 - DNA, 25 bp, Mus musculus
tttgtccttggccagtggcagcccc

SEQ ID NO: 850613 - DNA, 25 bp, Mus musculus
tttgtccttggcgagtggcagcccc

SEQ ID NO: 850614 - DNA, 25 bp, Mus musculus
tttgtcgaagctagaggaccggcag

SEQ ID NO: 850615 - DNA, 25 bp, Mus musculus
tttgtcgaagcttgaggaccggcag

SEQ ID NO: 850616 - DNA, 25 bp, Mus musculus
tttgtcggacacaacctgctgctgg

SEQ ID NO: 850617 - DNA, 25 bp, Mus musculus
tttgtcggacactacctgctgctgg

SEQ ID NO: 850618 - DNA, 25 bp, Mus musculus
tttgtcgttacgctgcactgcgcgg

SEQ ID NO: 850619 - DNA, 25 bp, Mus musculus
tttgtcgttacggtgcactgcgcgg

SEQ ID NO: 850620 - DNA, 25 bp, Mus musculus
tttgtctaatgtatgatagcccggg

SEQ ID NO: 850621 - DNA, 25 bp, Mus musculus
tttgtctaatgtttgatagcccggg

SEQ ID NO: 850622 - DNA, 25 bp, Mus musculus
tttgtctagatgatgtcgcaaccac

SEQ ID NO: 850623 - DNA, 25 bp, Mus musculus
tttgtctagatgttgtcgcaaccac

SEQ ID NO: 850624 - DNA, 25 bp, Mus musculus
tttgtctatgtacctgatgtaacag

SEQ ID NO: 850625 - DNA, 25 bp, Mus musculus
tttgtctatgtagctgatgtaacag

SEQ ID NO: 850626 - DNA, 25 bp, Mus musculus
tttgtctcagagactgcggctggcc

SEQ ID NO: 850627 - DNA, 25 bp, Mus musculus
tttgtctcagagtctgcggctggcc

SEQ ID NO: 850628 - DNA, 25 bp, Mus musculus
tttgtctcagctcctggttgagcct

SEQ ID NO: 850629 - DNA, 25 bp, Mus musculus
tttgtctcagctgctggttgagcct

SEQ ID NO: 850630 - DNA, 25 bp, Mus musculus
tttgtctcgacaacaggtagcagct

SEQ ID NO: 850631 - DNA, 25 bp, Mus musculus
tttgtctcgacatcaggtagcagct

SEQ ID NO: 850632 - DNA, 25 bp, Mus musculus
tttgtctgaaaactgtgaggagccc

SEQ ID NO: 850633 - DNA, 25 bp, Mus musculus
tttgtctgaaaagtgtgaggagccc

SEQ ID NO: 850634 - DNA, 25 bp, Mus musculus
tttgtctgagaacttagagcagtcg

SEQ ID NO: 850635 - DNA, 25 bp, Mus musculus
tttgtctgagaagttagagcagtcg

SEQ ID NO: 850636 - DNA, 25 bp, Mus musculus
tttgtcttctccctcgtggacgcca

SEQ ID NO: 850637 - DNA, 25 bp, Mus musculus
tttgtcttctccgtcgtggacgcca

SEQ ID NO: 850638 - DNA, 25 bp, Mus musculus
tttgtctttgcgctatgcagccgca

SEQ ID NO: 850639 - DNA, 25 bp, Mus musculus
tttgtctttgcggtatgcagccgca

SEQ ID NO: 850640 - DNA, 25 bp, Mus musculus
tttgtgaaccagaggcaggttaacc

SEQ ID NO: 850641 - DNA, 25 bp, Mus musculus
tttgtgaaccagtggcaggttaacc

SEQ ID NO: 850642 - DNA, 25 bp, Mus musculus
tttgtgaagctaaatctcatgctga

SEQ ID NO: 850643 - DNA, 25 bp, Mus musculus
tttgtgaagctatatctcatgctga

SEQ ID NO: 850644 - DNA, 25 bp, Mus musculus
tttgtgaagtccctgcagcgctgca

SEQ ID NO: 850645 - DNA, 25 bp, Mus musculus
tttgtgaagtccgtgcagcgctgca

SEQ ID NO: 850646 - DNA, 25 bp, Mus musculus
tttgtgaagtttaaatagagcgctc

SEQ ID NO: 850647 - DNA, 25 bp, Mus musculus
tttgtgaagtttcggcttgtaacct

SEQ ID NO: 850648 - DNA, 25 bp, Mus musculus
tttgtgaagtttgggcttgtaacct

SEQ ID NO: 850649 - DNA, 25 bp, Mus musculus
tttgtgaagttttaatagagcgctc

SEQ ID NO: 850650 - DNA, 25 bp, Mus musculus
tttgtgaatcagacactggaggctg

SEQ ID NO: 850651 - DNA, 25 bp, Mus musculus
tttgtgaatcagtcactggaggctg

SEQ ID NO: 850652 - DNA, 25 bp, Mus musculus
tttgtgaatcgcattatgacaccgg

SEQ ID NO: 850653 - DNA, 25 bp, Mus musculus
tttgtgaatcgctttatgacaccgg

SEQ ID NO: 850654 - DNA, 25 bp, Mus musculus
tttgtgaatgtgcagccagtgtccc

SEQ ID NO: 850655 - DNA, 25 bp, Mus musculus
tttgtgaatgtggagccagtgtccc

SEQ ID NO: 850656 - DNA, 25 bp, Mus musculus
tttgtgaatgttaacctgatgatgc

SEQ ID NO: 850657 - DNA, 25 bp, Mus musculus
tttgtgaatgtttacctgatgatgc

SEQ ID NO: 850658 - DNA, 25 bp, Mus musculus
tttgtgacagaaagtcaaccatggt

SEQ ID NO: 850659 - DNA, 25 bp, Mus musculus
tttgtgacagaatgtcaaccatggt

SEQ ID NO: 850660 - DNA, 25 bp, Mus musculus
tttgtgaccaggcagatgatgcagc

SEQ ID NO: 850661 - DNA, 25 bp, Mus musculus
tttgtgaccagggagatgatgcagc

SEQ ID NO: 850662 - DNA, 25 bp, Mus musculus
tttgtgaccctccaggcgaacgtga

SEQ ID NO: 850663 - DNA, 25 bp, Mus musculus
tttgtgaccctcgaggcgaacgtga

SEQ ID NO: 850664 - DNA, 25 bp, Mus musculus
tttgtgaccgccaagaaaaatggcc

SEQ ID NO: 850665 - DNA, 25 bp, Mus musculus
tttgtgaccgcctagaaaaatggcc

SEQ ID NO: 850666 - DNA, 25 bp, Mus musculus
tttgtgacggtgaaggagctctaca

SEQ ID NO: 850667 - DNA, 25 bp, Mus musculus
tttgtgacggtgtaggagctctaca

SEQ ID NO: 850668 - DNA, 25 bp, Mus musculus
tttgtgacttagaaaaggcattccc

SEQ ID NO: 850669 - DNA, 25 bp, Mus musculus
tttgtgacttagtaaaggcattccc

SEQ ID NO: 850670 - DNA, 25 bp, Mus musculus
tttgtgacttttctcttgccctcag

SEQ ID NO: 850671 - DNA, 25 bp, Mus musculus
tttgtgacttttgtcttgccctcag

SEQ ID NO: 850672 - DNA, 25 bp, Mus musculus
tttgtgagaaccagcggaagctgga

SEQ ID NO: 850673 - DNA, 25 bp, Mus musculus
tttgtgagaacctgcggaagctgga

SEQ ID NO: 850674 - DNA, 25 bp, Mus musculus
tttgtgagatgaaccagaagtctgt

SEQ ID NO: 850675 - DNA, 25 bp, Mus musculus
tttgtgagatgatccagaagtctgt

SEQ ID NO: 850676 - DNA, 25 bp, Mus musculus
tttgtgaggaaacacggtacccacg

SEQ ID NO: 850677 - DNA, 25 bp, Mus musculus
tttgtgaggaaagacggtacccacg

SEQ ID NO: 850678 - DNA, 25 bp, Mus musculus
tttgtgaggttcccttgtgcacccc

SEQ ID NO: 850679 - DNA, 25 bp, Mus musculus
tttgtgaggttcgcttgtgcacccc

SEQ ID NO: 850680 - DNA, 25 bp, Mus musculus
tttgtgagtagacctgaggttgacc

SEQ ID NO: 850681 - DNA, 25 bp, Mus musculus
tttgtgagtagagctgaggttgacc

SEQ ID NO: 850682 - DNA, 25 bp, Mus musculus
tttgtgatcaggctcccagggcagt

SEQ ID NO: 850683 - DNA, 25 bp, Mus musculus
tttgtgatcagggtcccagggcagt

SEQ ID NO: 850684 - DNA, 25 bp, Mus musculus
tttgtgcaccacaggcattcagtgt

SEQ ID NO: 850685 - DNA, 25 bp, Mus musculus
tttgtgcaccactggcattcagtgt

SEQ ID NO: 850686 - DNA, 25 bp, Mus musculus
tttgtgcaccttcttagcctttgag

SEQ ID NO: 850687 - DNA, 25 bp, Mus musculus
tttgtgcaccttgttagcctttgag

SEQ ID NO: 850688 - DNA, 25 bp, Mus musculus
tttgtgcagaacagcgatctccaga

SEQ ID NO: 850689 - DNA, 25 bp, Mus musculus
tttgtgcagaactgcgatctccaga

SEQ ID NO: 850690 - DNA, 25 bp, Mus musculus
tttgtgccagtgaatctgaccgctg

SEQ ID NO: 850691 - DNA, 25 bp, Mus musculus
tttgtgccagtgtatctgaccgctg

SEQ ID NO: 850692 - DNA, 25 bp, Mus musculus
tttgtgcccaaacaagaactgcagg

SEQ ID NO: 850693 - DNA, 25 bp, Mus musculus
tttgtgcccaaagaagaactgcagg

SEQ ID NO: 850694 - DNA, 25 bp, Mus musculus
tttgtgcccattacgaattctctca

SEQ ID NO: 850695 - DNA, 25 bp, Mus musculus
tttgtgcccatttcgaattctctca

SEQ ID NO: 850696 - DNA, 25 bp, Mus musculus
tttgtgcctggcactgcagtgcagg

SEQ ID NO: 850697 - DNA, 25 bp, Mus musculus
tttgtgcctggctctgcagtgcagg

SEQ ID NO: 850698 - DNA, 25 bp, Mus musculus
tttgtgcgaattccgcctgtgccca

SEQ ID NO: 850699 - DNA, 25 bp, Mus musculus
tttgtgcgaattgcgcctgtgccca

SEQ ID NO: 850700 - DNA, 25 bp, Mus musculus
tttgtgcgagttccggcctctcaga

SEQ ID NO: 850701 - DNA, 25 bp, Mus musculus
tttgtgcgagttgcggcctctcaga

SEQ ID NO: 850702 - DNA, 25 bp, Mus musculus
tttgtgcgccctcggacttactaca

SEQ ID NO: 850703 - DNA, 25 bp, Mus musculus
tttgtgcgccctgggacttactaca

SEQ ID NO: 850704 - DNA, 25 bp, Mus musculus
tttgtgcgtcagcagatgagtcagc

SEQ ID NO: 850705 - DNA, 25 bp, Mus musculus
tttgtgcgtcaggagatgagtcagc

SEQ ID NO: 850706 - DNA, 25 bp, Mus musculus
tttgtgctccagaggagcagttcat

SEQ ID NO: 850707 - DNA, 25 bp, Mus musculus
tttgtgctccagtggagcagttcat

SEQ ID NO: 850708 - DNA, 25 bp, Mus musculus
tttgtgctctccacacagtacctca

SEQ ID NO: 850709 - DNA, 25 bp, Mus musculus
tttgtgctctcctcacagtacctca

SEQ ID NO: 850710 - DNA, 25 bp, Mus musculus
tttgtgctgaaaaccccctccgctg

SEQ ID NO: 850711 - DNA, 25 bp, Mus musculus
tttgtgctgaaatccccctccgctg

SEQ ID NO: 850712 - DNA, 25 bp, Mus musculus
tttgtgctgactctcattcaggcca

SEQ ID NO: 850713 - DNA, 25 bp, Mus musculus
tttgtgctgactgtcattcaggcca

SEQ ID NO: 850714 - DNA, 25 bp, Mus musculus
tttgtgctgctactcccggaaaggc

SEQ ID NO: 850715 - DNA, 25 bp, Mus musculus
tttgtgctgctagtcccggaaaggc

SEQ ID NO: 850716 - DNA, 25 bp, Mus musculus
tttgtggaactgcacgagttcaccg

SEQ ID NO: 850717 - DNA, 25 bp, Mus musculus
tttgtggaactggacgagttcaccg

SEQ ID NO: 850718 - DNA, 25 bp, Mus musculus
tttgtggaatataactgctgccctg

SEQ ID NO: 850719 - DNA, 25 bp, Mus musculus
tttgtggaatattactgctgccctg

SEQ ID NO: 850720 - DNA, 25 bp, Mus musculus
tttgtggacataccaattgctgacc

SEQ ID NO: 850721 - DNA, 25 bp, Mus musculus
tttgtggacatagcaattgctgacc

SEQ ID NO: 850722 - DNA, 25 bp, Mus musculus
tttgtggaccgcatctttggtggcg

SEQ ID NO: 850723 - DNA, 25 bp, Mus musculus
tttgtggaccgcttctttggtggcg

SEQ ID NO: 850724 - DNA, 25 bp, Mus musculus
tttgtggactatccgtctaactgct

SEQ ID NO: 850725 - DNA, 25 bp, Mus musculus
tttgtggactatgcgtctaactgct

SEQ ID NO: 850726 - DNA, 25 bp, Mus musculus
tttgtggagcaacctggagctctga

SEQ ID NO: 850727 - DNA, 25 bp, Mus musculus
tttgtggagcaagctggagctctga

SEQ ID NO: 850728 - DNA, 25 bp, Mus musculus
tttgtggagcagaacctcaccaact

SEQ ID NO: 850729 - DNA, 25 bp, Mus musculus
tttgtggagcagtacctcaccaact

SEQ ID NO: 850730 - DNA, 25 bp, Mus musculus
tttgtggagtcgcagaacgacccaa

SEQ ID NO: 850731 - DNA, 25 bp, Mus musculus
tttgtggagtcggagaacgacccaa

SEQ ID NO: 850732 - DNA, 25 bp, Mus musculus
tttgtggatacccaggcaagcctgc

SEQ ID NO: 850733 - DNA, 25 bp, Mus musculus
tttgtggataccgaggcaagcctgc

SEQ ID NO: 850734 - DNA, 25 bp, Mus musculus
tttgtggatagcaagcgagttgcaa

SEQ ID NO: 850735 - DNA, 25 bp, Mus musculus
tttgtggatagctagcgagttgcaa

SEQ ID NO: 850736 - DNA, 25 bp, Mus musculus
tttgtggatcttcaggcaacgaact

SEQ ID NO: 850737 - DNA, 25 bp, Mus musculus
tttgtggatcttgaggcaacgaact

SEQ ID NO: 850738 - DNA, 25 bp, Mus musculus
tttgtggcaataaactgttggtgga

SEQ ID NO: 850739 - DNA, 25 bp, Mus musculus
tttgtggcaatatactgttggtgga

SEQ ID NO: 850740 - DNA, 25 bp, Mus musculus
tttgtggcacctcctgttacaccag

SEQ ID NO: 850741 - DNA, 25 bp, Mus musculus
tttgtggcacctgctgttacaccag

SEQ ID NO: 850742 - DNA, 25 bp, Mus musculus
tttgtggcagaaagagctttggaat

SEQ ID NO: 850743 - DNA, 25 bp, Mus musculus
tttgtggcagaatgagctttggaat

SEQ ID NO: 850744 - DNA, 25 bp, Mus musculus
tttgtggcccaacttgaagccttga

SEQ ID NO: 850745 - DNA, 25 bp, Mus musculus
tttgtggcccaagttgaagccttga

SEQ ID NO: 850746 - DNA, 25 bp, Mus musculus
tttgtggccctaataggtgccctcc

SEQ ID NO: 850747 - DNA, 25 bp, Mus musculus
tttgtggccctattaggtgccctcc

SEQ ID NO: 850748 - DNA, 25 bp, Mus musculus
tttgtggcccttactatgcacggcc

SEQ ID NO: 850749 - DNA, 25 bp, Mus musculus
tttgtggcccttagaagacattcag

SEQ ID NO: 850750 - DNA, 25 bp, Mus musculus
tttgtggccctttctatgcacggcc

SEQ ID NO: 850751 - DNA, 25 bp, Mus musculus
tttgtggccctttgaagacattcag

SEQ ID NO: 850752 - DNA, 25 bp, Mus musculus
tttgtggctaataggaatatctaac

SEQ ID NO: 850753 - DNA, 25 bp, Mus musculus
tttgtggctaatcctcacagagagg

SEQ ID NO: 850754 - DNA, 25 bp, Mus musculus
tttgtggctaatgctcacagagagg

SEQ ID NO: 850755 - DNA, 25 bp, Mus musculus
tttgtggctaattggaatatctaac

SEQ ID NO: 850756 - DNA, 25 bp, Mus musculus
tttgtggctcagatgcagacatcca

SEQ ID NO: 850757 - DNA, 25 bp, Mus musculus
tttgtggctcagttgcagacatcca

SEQ ID NO: 850758 - DNA, 25 bp, Mus musculus
tttgtggctccccagcctgttgtag

SEQ ID NO: 850759 - DNA, 25 bp, Mus musculus
tttgtggctcccgagcctgttgtag

SEQ ID NO: 850760 - DNA, 25 bp, Mus musculus
tttgtggctggtctgattaaccggg

SEQ ID NO: 850761 - DNA, 25 bp, Mus musculus
tttgtggctggtgtgattaaccggg

SEQ ID NO: 850762 - DNA, 25 bp, Mus musculus
tttgtggctttgctgccccaggaag

SEQ ID NO: 850763 - DNA, 25 bp, Mus musculus
tttgtggctttggtgccccaggaag

SEQ ID NO: 850764 - DNA, 25 bp, Mus musculus
tttgtgggcaaacaaggtactcgca

SEQ ID NO: 850765 - DNA, 25 bp, Mus musculus
tttgtgggcaaagaaggtactcgca

SEQ ID NO: 850766 - DNA, 25 bp, Mus musculus
tttgtgggcgatcctgaccttgaga

SEQ ID NO: 850767 - DNA, 25 bp, Mus musculus
tttgtgggcgatgctgaccttgaga

SEQ ID NO: 850768 - DNA, 25 bp, Mus musculus
tttgtgggctcgagagaaggccacc

SEQ ID NO: 850769 - DNA, 25 bp, Mus musculus
tttgtgggctcgtgagaaggccacc

SEQ ID NO: 850770 - DNA, 25 bp, Mus musculus
tttgtgggctgcaggacacctgtgc

SEQ ID NO: 850771 - DNA, 25 bp, Mus musculus
tttgtgggctgctggacacctgtgc

SEQ ID NO: 850772 - DNA, 25 bp, Mus musculus
tttgtgggtgctctcgaccccatca

SEQ ID NO: 850773 - DNA, 25 bp, Mus musculus
tttgtgggtgctgtcgaccccatca

SEQ ID NO: 850774 - DNA, 25 bp, Mus musculus
tttgtggtcaagaggaggttctaca

SEQ ID NO: 850775 - DNA, 25 bp, Mus musculus
tttgtggtcaagtggaggttctaca

SEQ ID NO: 850776 - DNA, 25 bp, Mus musculus
tttgtggtccctacggatgagtccc

SEQ ID NO: 850777 - DNA, 25 bp, Mus musculus
tttgtggtcccttcggatgagtccc

SEQ ID NO: 850778 - DNA, 25 bp, Mus musculus
tttgtggtgccgacaagctcaagcc

SEQ ID NO: 850779 - DNA, 25 bp, Mus musculus
tttgtggtgccgtcaagctcaagcc

SEQ ID NO: 850780 - DNA, 25 bp, Mus musculus
tttgtggtgtttctgcatcagacag

SEQ ID NO: 850781 - DNA, 25 bp, Mus musculus
tttgtggtgtttgtgcatcagacag

SEQ ID NO: 850782 - DNA, 25 bp, Mus musculus
tttgtgtaacttaatggctgcctgt

SEQ ID NO: 850783 - DNA, 25 bp, Mus musculus
tttgtgtaactttatggctgcctgt

SEQ ID NO: 850784 - DNA, 25 bp, Mus musculus
tttgtgtagcaaacagctgtggcga

SEQ ID NO: 850785 - DNA, 25 bp, Mus musculus
tttgtgtagcaatcagctgtggcga

SEQ ID NO: 850786 - DNA, 25 bp, Mus musculus
tttgtgtagtgcagcaacgacccct

SEQ ID NO: 850787 - DNA, 25 bp, Mus musculus
tttgtgtagtgctgcaacgacccct

SEQ ID NO: 850788 - DNA, 25 bp, Mus musculus
tttgtgtcaaataaagcctttaagt

SEQ ID NO: 850789 - DNA, 25 bp, Mus musculus
tttgtgtcaaattaagcctttaagt

SEQ ID NO: 850790 - DNA, 25 bp, Mus musculus
tttgtgtcctgtacagacagcgcca

SEQ ID NO: 850791 - DNA, 25 bp, Mus musculus
tttgtgtcctgttcagacagcgcca

SEQ ID NO: 850792 - DNA, 25 bp, Mus musculus
tttgtgtctgtaccctagaaggagg

SEQ ID NO: 850793 - DNA, 25 bp, Mus musculus
tttgtgtctgtagcctagaaggagg

SEQ ID NO: 850794 - DNA, 25 bp, Mus musculus
tttgtgtgaaacagcaaagtattca

SEQ ID NO: 850795 - DNA, 25 bp, Mus musculus
tttgtgtgaaactgcaaagtattca

SEQ ID NO: 850796 - DNA, 25 bp, Mus musculus
tttgtgtgaagccacaacctcccag

SEQ ID NO: 850797 - DNA, 25 bp, Mus musculus
tttgtgtgaagcgacaacctcccag

SEQ ID NO: 850798 - DNA, 25 bp, Mus musculus
tttgtgtgactacaacagagacggg

SEQ ID NO: 850799 - DNA, 25 bp, Mus musculus
tttgtgtgactagaacagagacggg

SEQ ID NO: 850800 - DNA, 25 bp, Mus musculus
tttgtgtgcagcagcccaggttccc

SEQ ID NO: 850801 - DNA, 25 bp, Mus musculus
tttgtgtgcagctgcccaggttccc

SEQ ID NO: 850802 - DNA, 25 bp, Mus musculus
tttgtgtgccatatggaaaatcgag

SEQ ID NO: 850803 - DNA, 25 bp, Mus musculus
tttgtgtgccatttggaaaatcgag

SEQ ID NO: 850804 - DNA, 25 bp, Mus musculus
tttgtgtgtggcatgaaaagtgccc

SEQ ID NO: 850805 - DNA, 25 bp, Mus musculus
tttgtgtgtggcttgaaaagtgccc

SEQ ID NO: 850806 - DNA, 25 bp, Mus musculus
tttgtgttactgcatagcctgggcc

SEQ ID NO: 850807 - DNA, 25 bp, Mus musculus
tttgtgttactggatagcctgggcc

SEQ ID NO: 850808 - DNA, 25 bp, Mus musculus
tttgtgttcgatcccgtcactgacg

SEQ ID NO: 850809 - DNA, 25 bp, Mus musculus
tttgtgttcgatgccgtcactgacg

SEQ ID NO: 850810 - DNA, 25 bp, Mus musculus
tttgtgttctgtccaacggtgagga

SEQ ID NO: 850811 - DNA, 25 bp, Mus musculus
tttgtgttctgtgcaacggtgagga

SEQ ID NO: 850812 - DNA, 25 bp, Mus musculus
tttgtgttggaaagtcagaactgag

SEQ ID NO: 850813 - DNA, 25 bp, Mus musculus
tttgtgttggaatgtcagaactgag

SEQ ID NO: 850814 - DNA, 25 bp, Mus musculus
tttgtgttggtaccatccagttggc

SEQ ID NO: 850815 - DNA, 25 bp, Mus musculus
tttgtgttggtagcatccagttggc

SEQ ID NO: 850816 - DNA, 25 bp, Mus musculus
tttgtgttggtgcacccaaccacca

SEQ ID NO: 850817 - DNA, 25 bp, Mus musculus
tttgtgttggtggacccaaccacca

SEQ ID NO: 850818 - DNA, 25 bp, Mus musculus
tttgtgtttgccaataagagtctcc

SEQ ID NO: 850819 - DNA, 25 bp, Mus musculus
tttgtgtttgcctataagagtctcc

SEQ ID NO: 850820 - DNA, 25 bp, Mus musculus
tttgttacctgtcaaattgtgtgtc

SEQ ID NO: 850821 - DNA, 25 bp, Mus musculus
tttgttacctgtgaaattgtgtgtc

SEQ ID NO: 850822 - DNA, 25 bp, Mus musculus
tttgttcaattaaacaccagggcat

SEQ ID NO: 850823 - DNA, 25 bp, Mus musculus
tttgttcaattatacaccagggcat

SEQ ID NO: 850824 - DNA, 25 bp, Mus musculus
tttgttcagcctctgaccagatctt

SEQ ID NO: 850825 - DNA, 25 bp, Mus musculus
tttgttcagcctgtgaccagatctt

SEQ ID NO: 850826 - DNA, 25 bp, Mus musculus
tttgttcaggacagacatagaaaca

SEQ ID NO: 850827 - DNA, 25 bp, Mus musculus
tttgttcaggactgacatagaaaca

SEQ ID NO: 850828 - DNA, 25 bp, Mus musculus
tttgttcaggccaggtgttcacagg

SEQ ID NO: 850829 - DNA, 25 bp, Mus musculus
tttgttcaggcctggtgttcacagg

SEQ ID NO: 850830 - DNA, 25 bp, Mus musculus
tttgttcagggtaagccagagctct

SEQ ID NO: 850831 - DNA, 25 bp, Mus musculus
tttgttcagggttagccagagctct

SEQ ID NO: 850832 - DNA, 25 bp, Mus musculus
tttgttccagggaggcgccttgtct

SEQ ID NO: 850833 - DNA, 25 bp, Mus musculus
tttgttccagggtggcgccttgtct

SEQ ID NO: 850834 - DNA, 25 bp, Mus musculus
tttgttcgacaaactgatttggagg

SEQ ID NO: 850835 - DNA, 25 bp, Mus musculus
tttgttcgacaatctgatttggagg

SEQ ID NO: 850836 - DNA, 25 bp, Mus musculus
tttgttcgagtcatgcctactgatg

SEQ ID NO: 850837 - DNA, 25 bp, Mus musculus
tttgttcgagtcttgcctactgatg

SEQ ID NO: 850838 - DNA, 25 bp, Mus musculus
tttgttgaagaaagcaagtttcccc

SEQ ID NO: 850839 - DNA, 25 bp, Mus musculus
tttgttgaagaatgcaagtttcccc

SEQ ID NO: 850840 - DNA, 25 bp, Mus musculus
tttgttgaagggatccatgacgcca

SEQ ID NO: 850841 - DNA, 25 bp, Mus musculus
tttgttgaagggttccatgacgcca

SEQ ID NO: 850842 - DNA, 25 bp, Mus musculus
tttgttgaatatcccaggaccaccc

SEQ ID NO: 850843 - DNA, 25 bp, Mus musculus
tttgttgaatatgccaggaccaccc

SEQ ID NO: 850844 - DNA, 25 bp, Mus musculus
tttgttgagcacagaggtcagttaa

SEQ ID NO: 850845 - DNA, 25 bp, Mus musculus
tttgttgagcactgaggtcagttaa

SEQ ID NO: 850846 - DNA, 25 bp, Mus musculus
tttgttgctatcagaagtgccgtgg

SEQ ID NO: 850847 - DNA, 25 bp, Mus musculus
tttgttgctatctgaagtgccgtgg

SEQ ID NO: 850848 - DNA, 25 bp, Mus musculus
tttgttgctggcataattgtcctac

SEQ ID NO: 850849 - DNA, 25 bp, Mus musculus
tttgttgctggcttaattgtcctac

SEQ ID NO: 850850 - DNA, 25 bp, Mus musculus
tttgttggcgggagccttgctttca

SEQ ID NO: 850851 - DNA, 25 bp, Mus musculus
tttgttggcgggtgccttgctttca

SEQ ID NO: 850852 - DNA, 25 bp, Mus musculus
tttgttggtcctcctgcacatccgg

SEQ ID NO: 850853 - DNA, 25 bp, Mus musculus
tttgttggtcctgctgcacatccgg

SEQ ID NO: 850854 - DNA, 25 bp, Mus musculus
tttgttgtattcatgtggcggcggc

SEQ ID NO: 850855 - DNA, 25 bp, Mus musculus
tttgttgtattcttgtggcggcggc

SEQ ID NO: 850856 - DNA, 25 bp, Mus musculus
tttgttgtctcaagtgtccctagct

SEQ ID NO: 850857 - DNA, 25 bp, Mus musculus
tttgttgtctcatgtgtccctagct

SEQ ID NO: 850858 - DNA, 25 bp, Mus musculus
tttgttgtgcttaggaaatgttggc

SEQ ID NO: 850859 - DNA, 25 bp, Mus musculus
tttgttgtgctttggaaatgttggc

SEQ ID NO: 850860 - DNA, 25 bp, Mus musculus
tttgtttaagccatgagaagttgct

SEQ ID NO: 850861 - DNA, 25 bp, Mus musculus
tttgtttaagccttgagaagttgct

SEQ ID NO: 850862 - DNA, 25 bp, Mus musculus
tttgtttaatatccggccacatagg

SEQ ID NO: 850863 - DNA, 25 bp, Mus musculus
tttgtttaatatgcggccacatagg

SEQ ID NO: 850864 - DNA, 25 bp, Mus musculus
tttgtttcccttagcttcccggcat

SEQ ID NO: 850865 - DNA, 25 bp, Mus musculus
tttgtttccctttgcttcccggcat

SEQ ID NO: 850866 - DNA, 25 bp, Mus musculus
tttgtttcggaactgaggctcaagc

SEQ ID NO: 850867 - DNA, 25 bp, Mus musculus
tttgtttcggaagtgaggctcaagc

SEQ ID NO: 850868 - DNA, 25 bp, Mus musculus
tttgtttcgttgattcaagacagac

SEQ ID NO: 850869 - DNA, 25 bp, Mus musculus
tttgtttcgttgtttcaagacagac

SEQ ID NO: 850870 - DNA, 25 bp, Mus musculus
tttgtttgccaacgtagtccacgtg

SEQ ID NO: 850871 - DNA, 25 bp, Mus musculus
tttgtttgccaaggtagtccacgtg

SEQ ID NO: 850872 - DNA, 25 bp, Mus musculus
tttgtttgccgcaaaagccgtcgcg

SEQ ID NO: 850873 - DNA, 25 bp, Mus musculus
tttgtttgccgctaaagccgtcgcg

SEQ ID NO: 850874 - DNA, 25 bp, Mus musculus
tttgttttcaacagtcaataaagtg

SEQ ID NO: 850875 - DNA, 25 bp, Mus musculus
tttgttttcaactgtcaataaagtg

SEQ ID NO: 850876 - DNA, 25 bp, Mus musculus
tttgttttgagtcactacgtagccc

SEQ ID NO: 850877 - DNA, 25 bp, Mus musculus
tttgttttgagtgactacgtagccc

SEQ ID NO: 850878 - DNA, 25 bp, Mus musculus
tttgttttggaaattaccggctgag

SEQ ID NO: 850879 - DNA, 25 bp, Mus musculus
tttgttttggaatttaccggctgag

SEQ ID NO: 850880 - DNA, 25 bp, Mus musculus
ttttaaaattcccagtaatccagca

SEQ ID NO: 850881 - DNA, 25 bp, Mus musculus
ttttaaaattccgagtaatccagca

SEQ ID NO: 850882 - DNA, 25 bp, Mus musculus
ttttaaaccagcaaacatttggcag

SEQ ID NO: 850883 - DNA, 25 bp, Mus musculus
ttttaaaccagctaacatttggcag

SEQ ID NO: 850884 - DNA, 25 bp, Mus musculus
ttttaaagaccccaatccaatgcac

SEQ ID NO: 850885 - DNA, 25 bp, Mus musculus
ttttaaagacccgaatccaatgcac

SEQ ID NO: 850886 - DNA, 25 bp, Mus musculus
ttttaaagagacacgggaacattgg

SEQ ID NO: 850887 - DNA, 25 bp, Mus musculus
ttttaaagagactcgggaacattgg

SEQ ID NO: 850888 - DNA, 25 bp, Mus musculus
ttttaaagctgactggaaagcatac

SEQ ID NO: 850889 - DNA, 25 bp, Mus musculus
ttttaaagctgagtggaaagcatac

SEQ ID NO: 850890 - DNA, 25 bp, Mus musculus
ttttaaaggtcacaaagctgccatc

SEQ ID NO: 850891 - DNA, 25 bp, Mus musculus
ttttaaaggtcagaaagctgccatc

SEQ ID NO: 850892 - DNA, 25 bp, Mus musculus
ttttaaagttgactgagtgagtccc

SEQ ID NO: 850893 - DNA, 25 bp, Mus musculus
ttttaaagttgagtgagtgagtccc

SEQ ID NO: 850894 - DNA, 25 bp, Mus musculus
ttttaaataccgaaagcttcaagct

SEQ ID NO: 850895 - DNA, 25 bp, Mus musculus
ttttaaataccgtaagcttcaagct

SEQ ID NO: 850896 - DNA, 25 bp, Mus musculus
ttttaaatgtgaactgcgaacacat

SEQ ID NO: 850897 - DNA, 25 bp, Mus musculus
ttttaaatgtgatctgcgaacacat

SEQ ID NO: 850898 - DNA, 25 bp, Mus musculus
ttttaaatttcaacacctggataag

SEQ ID NO: 850899 - DNA, 25 bp, Mus musculus
ttttaaatttcatcacctggataag

SEQ ID NO: 850900 - DNA, 25 bp, Mus musculus
ttttaaccatgtcactcgagcccac

SEQ ID NO: 850901 - DNA, 25 bp, Mus musculus
ttttaaccatgtgactcgagcccac

SEQ ID NO: 850902 - DNA, 25 bp, Mus musculus
ttttaaccctgaaggagcatctcat

SEQ ID NO: 850903 - DNA, 25 bp, Mus musculus
ttttaaccctgatggagcatctcat

SEQ ID NO: 850904 - DNA, 25 bp, Mus musculus
ttttaacgcaacaacctcagcaaag

SEQ ID NO: 850905 - DNA, 25 bp, Mus musculus
ttttaacgcaactacctcagcaaag

SEQ ID NO: 850906 - DNA, 25 bp, Mus musculus
ttttaactttgcaacagctacctag

SEQ ID NO: 850907 - DNA, 25 bp, Mus musculus
ttttaactttgctacagctacctag

SEQ ID NO: 850908 - DNA, 25 bp, Mus musculus
ttttaagagtcgacacatgggtggg

SEQ ID NO: 850909 - DNA, 25 bp, Mus musculus
ttttaagagtcgtcacatgggtggg

SEQ ID NO: 850910 - DNA, 25 bp, Mus musculus
ttttaagatcgacggacgtgcggtt

SEQ ID NO: 850911 - DNA, 25 bp, Mus musculus
ttttaagatcgagggacgtgcggtt

SEQ ID NO: 850912 - DNA, 25 bp, Mus musculus
ttttaagcccgtcgcagtgcactgc

SEQ ID NO: 850913 - DNA, 25 bp, Mus musculus
ttttaagcccgtggcagtgcactgc

SEQ ID NO: 850914 - DNA, 25 bp, Mus musculus
ttttaaggagtaatttccaatctgt

SEQ ID NO: 850915 - DNA, 25 bp, Mus musculus
ttttaaggagtattttccaatctgt

SEQ ID NO: 850916 - DNA, 25 bp, Mus musculus
ttttaagtcccacattctctgtttg

SEQ ID NO: 850917 - DNA, 25 bp, Mus musculus
ttttaagtcccagattctctgtttg

SEQ ID NO: 850918 - DNA, 25 bp, Mus musculus
ttttaagtcggcaggtgtcacgcta

SEQ ID NO: 850919 - DNA, 25 bp, Mus musculus
ttttaagtcggctggtgtcacgcta

SEQ ID NO: 850920 - DNA, 25 bp, Mus musculus
ttttaatgcgttcaagacaaagagt

SEQ ID NO: 850921 - DNA, 25 bp, Mus musculus
ttttaatgcgttgaagacaaagagt

SEQ ID NO: 850922 - DNA, 25 bp, Mus musculus
ttttacaaatggaagaggacctcca

SEQ ID NO: 850923 - DNA, 25 bp, Mus musculus
ttttacaaatggtagaggacctcca

SEQ ID NO: 850924 - DNA, 25 bp, Mus musculus
ttttacaagcagctcagcacgacag

SEQ ID NO: 850925 - DNA, 25 bp, Mus musculus
ttttacaagcaggtcagcacgacag

SEQ ID NO: 850926 - DNA, 25 bp, Mus musculus
ttttacaatggcaggcaccgtgtgg

SEQ ID NO: 850927 - DNA, 25 bp, Mus musculus
ttttacaatggctggcaccgtgtgg

SEQ ID NO: 850928 - DNA, 25 bp, Mus musculus
ttttacacaacaaggcggagtggag

SEQ ID NO: 850929 - DNA, 25 bp, Mus musculus
ttttacacaacatggcggagtggag

SEQ ID NO: 850930 - DNA, 25 bp, Mus musculus
ttttacacagatcccgtggaagctg

SEQ ID NO: 850931 - DNA, 25 bp, Mus musculus
ttttacacagatgccgtggaagctg

SEQ ID NO: 850932 - DNA, 25 bp, Mus musculus
ttttacacaggccaagggcgctccc

SEQ ID NO: 850933 - DNA, 25 bp, Mus musculus
ttttacacaggcgaagggcgctccc

SEQ ID NO: 850934 - DNA, 25 bp, Mus musculus
ttttacaccccacaaaacactggag

SEQ ID NO: 850935 - DNA, 25 bp, Mus musculus
ttttacaccccagaaaacactggag

SEQ ID NO: 850936 - DNA, 25 bp, Mus musculus
ttttacagaattcccacagacccaa

SEQ ID NO: 850937 - DNA, 25 bp, Mus musculus
ttttacagaattgccacagacccaa

SEQ ID NO: 850938 - DNA, 25 bp, Mus musculus
ttttacagaggcagcgacgacgtca

SEQ ID NO: 850939 - DNA, 25 bp, Mus musculus
ttttacagaggctgcgacgacgtca

SEQ ID NO: 850940 - DNA, 25 bp, Mus musculus
ttttacagttttaggaggcagtctg

SEQ ID NO: 850941 - DNA, 25 bp, Mus musculus
ttttacagtttttggaggcagtctg

SEQ ID NO: 850942 - DNA, 25 bp, Mus musculus
ttttacatcctcaagccccagatgc

SEQ ID NO: 850943 - DNA, 25 bp, Mus musculus
ttttacatcctctagccccagatgc

SEQ ID NO: 850944 - DNA, 25 bp, Mus musculus
ttttaccaccagattctgatttgtg

SEQ ID NO: 850945 - DNA, 25 bp, Mus musculus
ttttaccaccagtttctgatttgtg

SEQ ID NO: 850946 - DNA, 25 bp, Mus musculus
ttttaccacggaacaagtgactgcc

SEQ ID NO: 850947 - DNA, 25 bp, Mus musculus
ttttaccacggatcaagtgactgcc

SEQ ID NO: 850948 - DNA, 25 bp, Mus musculus
ttttaccagcctagctactggagta

SEQ ID NO: 850949 - DNA, 25 bp, Mus musculus
ttttaccagccttgctactggagta

SEQ ID NO: 850950 - DNA, 25 bp, Mus musculus
ttttaccagctaagtgactgccacg

SEQ ID NO: 850951 - DNA, 25 bp, Mus musculus
ttttaccagctatgtgactgccacg

SEQ ID NO: 850952 - DNA, 25 bp, Mus musculus
ttttacccagtacgagtggaagact

SEQ ID NO: 850953 - DNA, 25 bp, Mus musculus
ttttacccagtaggagtggaagact

SEQ ID NO: 850954 - DNA, 25 bp, Mus musculus
ttttaccccatcactgctgaatggg

SEQ ID NO: 850955 - DNA, 25 bp, Mus musculus
ttttaccccatctctgctgaatggg

SEQ ID NO: 850956 - DNA, 25 bp, Mus musculus
ttttacccggaacgttgttgctgct

SEQ ID NO: 850957 - DNA, 25 bp, Mus musculus
ttttacccggaaggttgttgctgct

SEQ ID NO: 850958 - DNA, 25 bp, Mus musculus
ttttacctatgtcccggacagtcct

SEQ ID NO: 850959 - DNA, 25 bp, Mus musculus
ttttacctatgtgccggacagtcct

SEQ ID NO: 850960 - DNA, 25 bp, Mus musculus
ttttaccttcggcaggaggacattg

SEQ ID NO: 850961 - DNA, 25 bp, Mus musculus
ttttaccttcgggaggaggacattg

SEQ ID NO: 850962 - DNA, 25 bp, Mus musculus
ttttacgaagacaatggacagctgg

SEQ ID NO: 850963 - DNA, 25 bp, Mus musculus
ttttacgaagactatggacagctgg

SEQ ID NO: 850964 - DNA, 25 bp, Mus musculus
ttttacgcccagaatccaacacttg

SEQ ID NO: 850965 - DNA, 25 bp, Mus musculus
ttttacgcccagtatccaacacttg

SEQ ID NO: 850966 - DNA, 25 bp, Mus musculus
ttttacggcctgaacttcacttgtg

SEQ ID NO: 850967 - DNA, 25 bp, Mus musculus
ttttacggcctgtacttcacttgtg

SEQ ID NO: 850968 - DNA, 25 bp, Mus musculus
ttttacgggtgtagcggtcagagcc

SEQ ID NO: 850969 - DNA, 25 bp, Mus musculus
ttttacgggtgttgcggtcagagcc

SEQ ID NO: 850970 - DNA, 25 bp, Mus musculus
ttttacggtggtcatcgagacgcga

SEQ ID NO: 850971 - DNA, 25 bp, Mus musculus
ttttacggtggtgatcgagacgcga

SEQ ID NO: 850972 - DNA, 25 bp, Mus musculus
ttttacgtgggcaacttctccatcc

SEQ ID NO: 850973 - DNA, 25 bp, Mus musculus
ttttacgtgggctacttctccatcc

SEQ ID NO: 850974 - DNA, 25 bp, Mus musculus
ttttactaccaaagtccctctgcct

SEQ ID NO: 850975 - DNA, 25 bp, Mus musculus
ttttactaccaatgtccctctgcct

SEQ ID NO: 850976 - DNA, 25 bp, Mus musculus
ttttactgtgaactcagctaccggc

SEQ ID NO: 850977 - DNA, 25 bp, Mus musculus
ttttactgtgaagtcagctaccggc

SEQ ID NO: 850978 - DNA, 25 bp, Mus musculus
ttttactgttccaactgtcacagcg

SEQ ID NO: 850979 - DNA, 25 bp, Mus musculus
ttttactgttcctactgtcacagcg

SEQ ID NO: 850980 - DNA, 25 bp, Mus musculus
ttttagaaaagcaagacgcatttgg

SEQ ID NO: 850981 - DNA, 25 bp, Mus musculus
ttttagaaaagctagacgcatttgg

SEQ ID NO: 850982 - DNA, 25 bp, Mus musculus
ttttagaaaagtagggaggctctca

SEQ ID NO: 850983 - DNA, 25 bp, Mus musculus
ttttagaaaagttgggaggctctca

SEQ ID NO: 850984 - DNA, 25 bp, Mus musculus
ttttagaactaaacagctagaggcg

SEQ ID NO: 850985 - DNA, 25 bp, Mus musculus
ttttagaactaatcagctagaggcg

SEQ ID NO: 850986 - DNA, 25 bp, Mus musculus
ttttagaagaggaagttcagaactc

SEQ ID NO: 850987 - DNA, 25 bp, Mus musculus
ttttagaagaggtagttcagaactc

SEQ ID NO: 850988 - DNA, 25 bp, Mus musculus
ttttagaagcggcacgagccggtca

SEQ ID NO: 850989 - DNA, 25 bp, Mus musculus
ttttagaagcgggacgagccggtca

SEQ ID NO: 850990 - DNA, 25 bp, Mus musculus
ttttagatgccaagtggaagccggc

SEQ ID NO: 850991 - DNA, 25 bp, Mus musculus
ttttagatgccatgtggaagccggc

SEQ ID NO: 850992 - DNA, 25 bp, Mus musculus
ttttagccatttcgccctgctgctg

SEQ ID NO: 850993 - DNA, 25 bp, Mus musculus
ttttagccatttggccctgctgctg

SEQ ID NO: 850994 - DNA, 25 bp, Mus musculus
ttttagcctctgcactttggagacg

SEQ ID NO: 850995 - DNA, 25 bp, Mus musculus
ttttagcctctggactttggagacg

SEQ ID NO: 850996 - DNA, 25 bp, Mus musculus
ttttaggccctgacatcaaagctga

SEQ ID NO: 850997 - DNA, 25 bp, Mus musculus
ttttaggccctgtcatcaaagctga

SEQ ID NO: 850998 - DNA, 25 bp, Mus musculus
ttttagtattggacacttggcccca

SEQ ID NO: 850999 - DNA, 25 bp, Mus musculus
ttttagtattggtcacttggcccca

SEQ ID NO: 851000 - DNA, 25 bp, Mus musculus
ttttagtcagggacagacaggtgga

SEQ ID NO: 851001 - DNA, 25 bp, Mus musculus
ttttagtcagggtcagacaggtgga

SEQ ID NO: 851002 - DNA, 25 bp, Mus musculus
ttttagtcccacagtccttaatggc

SEQ ID NO: 851003 - DNA, 25 bp, Mus musculus
ttttagtcccactgtccttaatggc

SEQ ID NO: 851004 - DNA, 25 bp, Mus musculus
ttttagtcttggctcccgtgttgtc

SEQ ID NO: 851005 - DNA, 25 bp, Mus musculus
ttttagtcttgggtcccgtgttgtc

SEQ ID NO: 851006 - DNA, 25 bp, Mus musculus
ttttataaacaacagtaggcaggca

SEQ ID NO: 851007 - DNA, 25 bp, Mus musculus
ttttataaacaagagtaggcaggca

SEQ ID NO: 851008 - DNA, 25 bp, Mus musculus
ttttataaagcaatgggaaatccag

SEQ ID NO: 851009 - DNA, 25 bp, Mus musculus
ttttataaagcattgggaaatccag

SEQ ID NO: 851010 - DNA, 25 bp, Mus musculus
ttttataatgacctggatgtgcaga

SEQ ID NO: 851011 - DNA, 25 bp, Mus musculus
ttttataatgacgtggatgtgcaga

SEQ ID NO: 851012 - DNA, 25 bp, Mus musculus
ttttatacagcgcacagcgcacgga

SEQ ID NO: 851013 - DNA, 25 bp, Mus musculus
ttttatacagcggacagcgcacgga

SEQ ID NO: 851014 - DNA, 25 bp, Mus musculus
ttttataggtagaattcggtcatat

SEQ ID NO: 851015 - DNA, 25 bp, Mus musculus
ttttataggtagtattcggtcatat

SEQ ID NO: 851016 - DNA, 25 bp, Mus musculus
ttttatatgcagactgggctgaagc

SEQ ID NO: 851017 - DNA, 25 bp, Mus musculus
ttttatatgcagtctgggctgaagc

SEQ ID NO: 851018 - DNA, 25 bp, Mus musculus
ttttatatgtcccaaaacggccgag

SEQ ID NO: 851019 - DNA, 25 bp, Mus musculus
ttttatatgtccgaaaacggccgag

SEQ ID NO: 851020 - DNA, 25 bp, Mus musculus
ttttatcagactcaagagctactgt

SEQ ID NO: 851021 - DNA, 25 bp, Mus musculus
ttttatcagactgaagagctactgt

SEQ ID NO: 851022 - DNA, 25 bp, Mus musculus
ttttatcagtcacttgttcatgcag

SEQ ID NO: 851023 - DNA, 25 bp, Mus musculus
ttttatcagtcagttgttcatgcag

SEQ ID NO: 851024 - DNA, 25 bp, Mus musculus
ttttatcatgtgctgtcgggcagca

SEQ ID NO: 851025 - DNA, 25 bp, Mus musculus
ttttatcatgtggtgtcgggcagca

SEQ ID NO: 851026 - DNA, 25 bp, Mus musculus
ttttatcattcacgccgggtgacac

SEQ ID NO: 851027 - DNA, 25 bp, Mus musculus
ttttatcattcaggccgggtgacac

SEQ ID NO: 851028 - DNA, 25 bp, Mus musculus
ttttatccagaaataaccagcgctt

SEQ ID NO: 851029 - DNA, 25 bp, Mus musculus
ttttatccagaattaaccagcgctt

SEQ ID NO: 851030 - DNA, 25 bp, Mus musculus
ttttatccagatcagactacagctg

SEQ ID NO: 851031 - DNA, 25 bp, Mus musculus
ttttatccagatgagactacagctg

SEQ ID NO: 851032 - DNA, 25 bp, Mus musculus
ttttatccctagaagcagctagcta

SEQ ID NO: 851033 - DNA, 25 bp, Mus musculus
ttttatccctagtagcagctagcta

SEQ ID NO: 851034 - DNA, 25 bp, Mus musculus
ttttatccgagtcacccagcaagtg

SEQ ID NO: 851035 - DNA, 25 bp, Mus musculus
ttttatccgagtgacccagcaagtg

SEQ ID NO: 851036 - DNA, 25 bp, Mus musculus
ttttatcgtgtaaccatcgtggtca

SEQ ID NO: 851037 - DNA, 25 bp, Mus musculus
ttttatcgtgtatccatcgtggtca

SEQ ID NO: 851038 - DNA, 25 bp, Mus musculus
ttttatgacccacacaccagtgtgg

SEQ ID NO: 851039 - DNA, 25 bp, Mus musculus
ttttatgacccagacaccagtgtgg

SEQ ID NO: 851040 - DNA, 25 bp, Mus musculus
ttttatgatttcagtggccagactg

SEQ ID NO: 851041 - DNA, 25 bp, Mus musculus
ttttatgatttctgtggccagactg

SEQ ID NO: 851042 - DNA, 25 bp, Mus musculus
ttttatgctccgacaagtgctgtgg

SEQ ID NO: 851043 - DNA, 25 bp, Mus musculus
ttttatgctccgtcaagtgctgtgg

SEQ ID NO: 851044 - DNA, 25 bp, Mus musculus
ttttatggagtgattctggaacctc

SEQ ID NO: 851045 - DNA, 25 bp, Mus musculus
ttttatggagtgtttctggaacctc

SEQ ID NO: 851046 - DNA, 25 bp, Mus musculus
ttttatggccagagtcccaagtgcg

SEQ ID NO: 851047 - DNA, 25 bp, Mus musculus
ttttatggccagtgtcccaagtgcg

SEQ ID NO: 851048 - DNA, 25 bp, Mus musculus
ttttatggtgataacattgcggtga

SEQ ID NO: 851049 - DNA, 25 bp, Mus musculus
ttttatggtgattacattgcggtga

SEQ ID NO: 851050 - DNA, 25 bp, Mus musculus
ttttatgtccagcagtcctgcacag

SEQ ID NO: 851051 - DNA, 25 bp, Mus musculus
ttttatgtccaggagtcctgcacag

SEQ ID NO: 851052 - DNA, 25 bp, Mus musculus
ttttatgtgaaaccccgcgttgcag

SEQ ID NO: 851053 - DNA, 25 bp, Mus musculus
ttttatgtgaaagcccgcgttgcag

SEQ ID NO: 851054 - DNA, 25 bp, Mus musculus
ttttattcaccacccagttatgagt

SEQ ID NO: 851055 - DNA, 25 bp, Mus musculus
ttttattcaccagccagttatgagt

SEQ ID NO: 851056 - DNA, 25 bp, Mus musculus
ttttattcctcacgccgaaatcaga

SEQ ID NO: 851057 - DNA, 25 bp, Mus musculus
ttttattcctcaggccgaaatcaga

SEQ ID NO: 851058 - DNA, 25 bp, Mus musculus
ttttattctctgacctcaggcagca

SEQ ID NO: 851059 - DNA, 25 bp, Mus musculus
ttttattctctgtcctcaggcagca

SEQ ID NO: 851060 - DNA, 25 bp, Mus musculus
ttttattggagaagcaattctacag

SEQ ID NO: 851061 - DNA, 25 bp, Mus musculus
ttttattggagatgcaattctacag

SEQ ID NO: 851062 - DNA, 25 bp, Mus musculus
ttttattggcagaattgggtacaag

SEQ ID NO: 851063 - DNA, 25 bp, Mus musculus
ttttattggcagtattgggtacaag

SEQ ID NO: 851064 - DNA, 25 bp, Mus musculus
ttttatttcaatcacgaccctcgca

SEQ ID NO: 851065 - DNA, 25 bp, Mus musculus
ttttatttcaatgacgaccctcgca

SEQ ID NO: 851066 - DNA, 25 bp, Mus musculus
ttttcaacaccaccgagaactcgat

SEQ ID NO: 851067 - DNA, 25 bp, Mus musculus
ttttcaacaccagcgagaactcgat

SEQ ID NO: 851068 - DNA, 25 bp, Mus musculus
ttttcaacactaacacggaggagga

SEQ ID NO: 851069 - DNA, 25 bp, Mus musculus
ttttcaacactatcacggaggagga

SEQ ID NO: 851070 - DNA, 25 bp, Mus musculus
ttttcaacagagagcaggtttttaa

SEQ ID NO: 851071 - DNA, 25 bp, Mus musculus
ttttcaacagagtgcaggtttttaa

SEQ ID NO: 851072 - DNA, 25 bp, Mus musculus
ttttcaacatcaacacagttctata

SEQ ID NO: 851073 - DNA, 25 bp, Mus musculus
ttttcaacatcatcacagttctata

SEQ ID NO: 851074 - DNA, 25 bp, Mus musculus
ttttcaacccagagacagtcacagg

SEQ ID NO: 851075 - DNA, 25 bp, Mus musculus
ttttcaacccagtgacagtcacagg

SEQ ID NO: 851076 - DNA, 25 bp, Mus musculus
ttttcaactcctctcagctgactca

SEQ ID NO: 851077 - DNA, 25 bp, Mus musculus
ttttcaactcctgtcagctgactca

SEQ ID NO: 851078 - DNA, 25 bp, Mus musculus
ttttcaactgcgcacaaggcgtcca

SEQ ID NO: 851079 - DNA, 25 bp, Mus musculus
ttttcaactgcggacaaggcgtcca

SEQ ID NO: 851080 - DNA, 25 bp, Mus musculus
ttttcaagaaagcaggatggaccat

SEQ ID NO: 851081 - DNA, 25 bp, Mus musculus
ttttcaagaaaggaggatggaccat

SEQ ID NO: 851082 - DNA, 25 bp, Mus musculus
ttttcaagacatcgagtgtgtgccc

SEQ ID NO: 851083 - DNA, 25 bp, Mus musculus
ttttcaagacatggagtgtgtgccc

SEQ ID NO: 851084 - DNA, 25 bp, Mus musculus
ttttcaagacccagattcaagcaat

SEQ ID NO: 851085 - DNA, 25 bp, Mus musculus
ttttcaagaccctgattcaagcaat

SEQ ID NO: 851086 - DNA, 25 bp, Mus musculus
ttttcaagacgacagccctctctgg

SEQ ID NO: 851087 - DNA, 25 bp, Mus musculus
ttttcaagacgagagccctctctgg

SEQ ID NO: 851088 - DNA, 25 bp, Mus musculus
ttttcaagagaacagcctagtttga

SEQ ID NO: 851089 - DNA, 25 bp, Mus musculus
ttttcaagagaagagcctagtttga

SEQ ID NO: 851090 - DNA, 25 bp, Mus musculus
ttttcaagcactagctctggaaggg

SEQ ID NO: 851091 - DNA, 25 bp, Mus musculus
ttttcaagcacttgctctggaaggg

SEQ ID NO: 851092 - DNA, 25 bp, Mus musculus
ttttcaagctgtagaaagagggcca

SEQ ID NO: 851093 - DNA, 25 bp, Mus musculus
ttttcaagctgttgaaagagggcca

SEQ ID NO: 851094 - DNA, 25 bp, Mus musculus
ttttcaagggagagctgggatttgc

SEQ ID NO: 851095 - DNA, 25 bp, Mus musculus
ttttcaagggagtgctgggatttgc

SEQ ID NO: 851096 - DNA, 25 bp, Mus musculus
ttttcaagggtgagagagtgttgca

SEQ ID NO: 851097 - DNA, 25 bp, Mus musculus
ttttcaagggtgtgagagtgttgca

SEQ ID NO: 851098 - DNA, 25 bp, Mus musculus
ttttcaagttctccattctgacctg

SEQ ID NO: 851099 - DNA, 25 bp, Mus musculus
ttttcaagttctgcattctgacctg

SEQ ID NO: 851100 - DNA, 25 bp, Mus musculus
ttttcaatgccaacgccaatggcaa

SEQ ID NO: 851101 - DNA, 25 bp, Mus musculus
ttttcaatgccatcgccaatggcaa

SEQ ID NO: 851102 - DNA, 25 bp, Mus musculus
ttttcaattcatacccgagatagcc

SEQ ID NO: 851103 - DNA, 25 bp, Mus musculus
ttttcaattcattcccgagatagcc

SEQ ID NO: 851104 - DNA, 25 bp, Mus musculus
ttttcacaacagctggctacagtca

SEQ ID NO: 851105 - DNA, 25 bp, Mus musculus
ttttcacaacaggtggctacagtca

SEQ ID NO: 851106 - DNA, 25 bp, Mus musculus
ttttcacaccacagaaatccctaga

SEQ ID NO: 851107 - DNA, 25 bp, Mus musculus
ttttcacaccactgaaatccctaga

SEQ ID NO: 851108 - DNA, 25 bp, Mus musculus
ttttcacagaggctcttcatgatcc

SEQ ID NO: 851109 - DNA, 25 bp, Mus musculus
ttttcacagagggtcttcatgatcc

SEQ ID NO: 851110 - DNA, 25 bp, Mus musculus
ttttcacatgtaaccagcctgccag

SEQ ID NO: 851111 - DNA, 25 bp, Mus musculus
ttttcacatgtatccagcctgccag

SEQ ID NO: 851112 - DNA, 25 bp, Mus musculus
ttttcacccataccagcctttggag

SEQ ID NO: 851113 - DNA, 25 bp, Mus musculus
ttttcacccatagcagcctttggag

SEQ ID NO: 851114 - DNA, 25 bp, Mus musculus
ttttcaccgagacggatgatccgga

SEQ ID NO: 851115 - DNA, 25 bp, Mus musculus
ttttcaccgagagggatgatccgga

SEQ ID NO: 851116 - DNA, 25 bp, Mus musculus
ttttcaccgtgcagactgccaaatc

SEQ ID NO: 851117 - DNA, 25 bp, Mus musculus
ttttcaccgtgctgactgccaaatc

SEQ ID NO: 851118 - DNA, 25 bp, Mus musculus
ttttcacgtatcaggagtcactccg

SEQ ID NO: 851119 - DNA, 25 bp, Mus musculus
ttttcacgtatctggagtcactccg

SEQ ID NO: 851120 - DNA, 25 bp, Mus musculus
ttttcactggctcacccgttctaac

SEQ ID NO: 851121 - DNA, 25 bp, Mus musculus
ttttcactggctgacccgttctaac

SEQ ID NO: 851122 - DNA, 25 bp, Mus musculus
ttttcagaaggacgagggcaccgtc

SEQ ID NO: 851123 - DNA, 25 bp, Mus musculus
ttttcagaaggaggagggcaccgtc

SEQ ID NO: 851124 - DNA, 25 bp, Mus musculus
ttttcagaccagcataatgtcagcc

SEQ ID NO: 851125 - DNA, 25 bp, Mus musculus
ttttcagaccaggataatgtcagcc

SEQ ID NO: 851126 - DNA, 25 bp, Mus musculus
ttttcagacgagaatgtccgggcca

SEQ ID NO: 851127 - DNA, 25 bp, Mus musculus
ttttcagacgagtatgtccgggcca

SEQ ID NO: 851128 - DNA, 25 bp, Mus musculus
ttttcagatcagcaaggaatatgag

SEQ ID NO: 851129 - DNA, 25 bp, Mus musculus
ttttcagatcaggaaggaatatgag

SEQ ID NO: 851130 - DNA, 25 bp, Mus musculus
ttttcagatctgaaactcaacggac

SEQ ID NO: 851131 - DNA, 25 bp, Mus musculus
ttttcagatctgtaactcaacggac

SEQ ID NO: 851132 - DNA, 25 bp, Mus musculus
ttttcagccctgacttcaacgagaa

SEQ ID NO: 851133 - DNA, 25 bp, Mus musculus
ttttcagccctgtcttcaacgagaa

SEQ ID NO: 851134 - DNA, 25 bp, Mus musculus
ttttcagccgctacagtacccgaag

SEQ ID NO: 851135 - DNA, 25 bp, Mus musculus
ttttcagccgcttcagtacccgaag

SEQ ID NO: 851136 - DNA, 25 bp, Mus musculus
ttttcagcgctgctcaaatacaaag

SEQ ID NO: 851137 - DNA, 25 bp, Mus musculus
ttttcagcgctggtcaaatacaaag

SEQ ID NO: 851138 - DNA, 25 bp, Mus musculus
ttttcaggagagacgcagatgacct

SEQ ID NO: 851139 - DNA, 25 bp, Mus musculus
ttttcaggagagtcgcagatgacct

SEQ ID NO: 851140 - DNA, 25 bp, Mus musculus
ttttcagggccaccaacatggaaaa

SEQ ID NO: 851141 - DNA, 25 bp, Mus musculus
ttttcagggccagcaacatggaaaa

SEQ ID NO: 851142 - DNA, 25 bp, Mus musculus
ttttcagtgccaatcgactcacggg

SEQ ID NO: 851143 - DNA, 25 bp, Mus musculus
ttttcagtgccattcgactcacggg

SEQ ID NO: 851144 - DNA, 25 bp, Mus musculus
ttttcagtgctccttaatgagatcc

SEQ ID NO: 851145 - DNA, 25 bp, Mus musculus
ttttcagtgctcgttaatgagatcc

SEQ ID NO: 851146 - DNA, 25 bp, Mus musculus
ttttcatcgagtcggtctgtgacga

SEQ ID NO: 851147 - DNA, 25 bp, Mus musculus
ttttcatcgagtgggtctgtgacga

SEQ ID NO: 851148 - DNA, 25 bp, Mus musculus
ttttcatctcagattccaccggctc

SEQ ID NO: 851149 - DNA, 25 bp, Mus musculus
ttttcatctcagtttccaccggctc

SEQ ID NO: 851150 - DNA, 25 bp, Mus musculus
ttttcatctgagcacccctgtcttc

SEQ ID NO: 851151 - DNA, 25 bp, Mus musculus
ttttcatctgaggacccctgtcttc

SEQ ID NO: 851152 - DNA, 25 bp, Mus musculus
ttttcatcttccacagccaaccgag

SEQ ID NO: 851153 - DNA, 25 bp, Mus musculus
ttttcatcttcctcagccaaccgag

SEQ ID NO: 851154 - DNA, 25 bp, Mus musculus
ttttcatgccctattggttaaccca

SEQ ID NO: 851155 - DNA, 25 bp, Mus musculus
ttttcatgcccttttggttaaccca

SEQ ID NO: 851156 - DNA, 25 bp, Mus musculus
ttttcattcaagacaaagtccattc

SEQ ID NO: 851157 - DNA, 25 bp, Mus musculus
ttttcattcaagtcaaagtccattc

SEQ ID NO: 851158 - DNA, 25 bp, Mus musculus
ttttcattccttctctacaccggga

SEQ ID NO: 851159 - DNA, 25 bp, Mus musculus
ttttcattccttgtctacaccggga

SEQ ID NO: 851160 - DNA, 25 bp, Mus musculus
ttttcattgggcctcctcggtggaa

SEQ ID NO: 851161 - DNA, 25 bp, Mus musculus
ttttcattgggcgtcctcggtggaa

SEQ ID NO: 851162 - DNA, 25 bp, Mus musculus
ttttccaaccaaactgcaccctatg

SEQ ID NO: 851163 - DNA, 25 bp, Mus musculus
ttttccaaccaatctgcaccctatg

SEQ ID NO: 851164 - DNA, 25 bp, Mus musculus
ttttccaacggcagagagcgcctgg

SEQ ID NO: 851165 - DNA, 25 bp, Mus musculus
ttttccaacggctgagagcgcctgg

SEQ ID NO: 851166 - DNA, 25 bp, Mus musculus
ttttccaactacagcactggaatgg

SEQ ID NO: 851167 - DNA, 25 bp, Mus musculus
ttttccaactactgcactggaatgg

SEQ ID NO: 851168 - DNA, 25 bp, Mus musculus
ttttccaaggcgatcagctgaaaaa

SEQ ID NO: 851169 - DNA, 25 bp, Mus musculus
ttttccaaggcgttcagctgaaaaa

SEQ ID NO: 851170 - DNA, 25 bp, Mus musculus
ttttccacagctctttgttgctggc

SEQ ID NO: 851171 - DNA, 25 bp, Mus musculus
ttttccacagctgtttgttgctggc

SEQ ID NO: 851172 - DNA, 25 bp, Mus musculus
ttttccacccttaacttcgtgatga

SEQ ID NO: 851173 - DNA, 25 bp, Mus musculus
ttttccaccctttacttcgtgatga

SEQ ID NO: 851174 - DNA, 25 bp, Mus musculus
ttttccagaagccaagggtccaagt

SEQ ID NO: 851175 - DNA, 25 bp, Mus musculus
ttttccagaagcgaagggtccaagt

SEQ ID NO: 851176 - DNA, 25 bp, Mus musculus
ttttccagagaacggctattcgttt

SEQ ID NO: 851177 - DNA, 25 bp, Mus musculus
ttttccagagaagggctattcgttt

SEQ ID NO: 851178 - DNA, 25 bp, Mus musculus
ttttccaggacacggaagtagcaga

SEQ ID NO: 851179 - DNA, 25 bp, Mus musculus
ttttccaggacagggaagtagcaga

SEQ ID NO: 851180 - DNA, 25 bp, Mus musculus
ttttccaggcacagaggaccgcagt

SEQ ID NO: 851181 - DNA, 25 bp, Mus musculus
ttttccaggcactgaggaccgcagt

SEQ ID NO: 851182 - DNA, 25 bp, Mus musculus
ttttccagggcacaacagcagcaga

SEQ ID NO: 851183 - DNA, 25 bp, Mus musculus
ttttccagggcagaacagcagcaga

SEQ ID NO: 851184 - DNA, 25 bp, Mus musculus
ttttccagggctaccccatgtttct

SEQ ID NO: 851185 - DNA, 25 bp, Mus musculus
ttttccagggcttccccatgtttct

SEQ ID NO: 851186 - DNA, 25 bp, Mus musculus
ttttccagtccgcacacaatgtcat

SEQ ID NO: 851187 - DNA, 25 bp, Mus musculus
ttttccagtccggacacaatgtcat

SEQ ID NO: 851188 - DNA, 25 bp, Mus musculus
ttttccagtcggacccctagagtcg

SEQ ID NO: 851189 - DNA, 25 bp, Mus musculus
ttttccagtcggtcccctagagtcg

SEQ ID NO: 851190 - DNA, 25 bp, Mus musculus
ttttccatcccaacattgatgaagc

SEQ ID NO: 851191 - DNA, 25 bp, Mus musculus
ttttccatcccatcattgatgaagc

SEQ ID NO: 851192 - DNA, 25 bp, Mus musculus
ttttccatcctgatagaatctggct

SEQ ID NO: 851193 - DNA, 25 bp, Mus musculus
ttttccatcctgttagaatctggct

SEQ ID NO: 851194 - DNA, 25 bp, Mus musculus
ttttccatcgccatgaagacattag

SEQ ID NO: 851195 - DNA, 25 bp, Mus musculus
ttttccatcgccttgaagacattag

SEQ ID NO: 851196 - DNA, 25 bp, Mus musculus
ttttccatgcacattggaggctcag

SEQ ID NO: 851197 - DNA, 25 bp, Mus musculus
ttttccatgcactttggaggctcag

SEQ ID NO: 851198 - DNA, 25 bp, Mus musculus
ttttccatggtgaaatgggcaaaga

SEQ ID NO: 851199 - DNA, 25 bp, Mus musculus
ttttccatggtgtaatgggcaaaga

SEQ ID NO: 851200 - DNA, 25 bp, Mus musculus
ttttccatttgcaactactggcacg

SEQ ID NO: 851201 - DNA, 25 bp, Mus musculus
ttttccatttgctactactggcacg

SEQ ID NO: 851202 - DNA, 25 bp, Mus musculus
ttttcccaatggcaccagagcaggg

SEQ ID NO: 851203 - DNA, 25 bp, Mus musculus
ttttcccaatgggaccagagcaggg

SEQ ID NO: 851204 - DNA, 25 bp, Mus musculus
ttttcccacgcaagattgaaaaggg

SEQ ID NO: 851205 - DNA, 25 bp, Mus musculus
ttttcccacgcatgattgaaaaggg

SEQ ID NO: 851206 - DNA, 25 bp, Mus musculus
ttttcccactggatgtaattacctc

SEQ ID NO: 851207 - DNA, 25 bp, Mus musculus
ttttcccactggttgtaattacctc

SEQ ID NO: 851208 - DNA, 25 bp, Mus musculus
ttttcccagacacaaggccaggagc

SEQ ID NO: 851209 - DNA, 25 bp, Mus musculus
ttttcccagacacttttcacgtggg

SEQ ID NO: 851210 - DNA, 25 bp, Mus musculus
ttttcccagacagaaggccaggagc

SEQ ID NO: 851211 - DNA, 25 bp, Mus musculus
ttttcccagacagttttcacgtggg

SEQ ID NO: 851212 - DNA, 25 bp, Mus musculus
ttttcccagagtaccagttggaggg

SEQ ID NO: 851213 - DNA, 25 bp, Mus musculus
ttttcccagagttccagttggaggg

SEQ ID NO: 851214 - DNA, 25 bp, Mus musculus
ttttcccagcgtatcaagcttttgc

SEQ ID NO: 851215 - DNA, 25 bp, Mus musculus
ttttcccagcgtttcaagcttttgc

SEQ ID NO: 851216 - DNA, 25 bp, Mus musculus
ttttcccagctgactcagagcataa

SEQ ID NO: 851217 - DNA, 25 bp, Mus musculus
ttttcccagctgtctcagagcataa

SEQ ID NO: 851218 - DNA, 25 bp, Mus musculus
ttttcccagtcaccgactggaatcc

SEQ ID NO: 851219 - DNA, 25 bp, Mus musculus
ttttcccagtcagcgactggaatcc

SEQ ID NO: 851220 - DNA, 25 bp, Mus musculus
ttttcccagttcaaccaggatgact

SEQ ID NO: 851221 - DNA, 25 bp, Mus musculus
ttttcccagttctaccaggatgact

SEQ ID NO: 851222 - DNA, 25 bp, Mus musculus
ttttcccctcaccagtacccagtgc

SEQ ID NO: 851223 - DNA, 25 bp, Mus musculus
ttttcccctcacgagtacccagtgc

SEQ ID NO: 851224 - DNA, 25 bp, Mus musculus
ttttcccctcagagttcctccgagt

SEQ ID NO: 851225 - DNA, 25 bp, Mus musculus
ttttcccctcagtgttcctccgagt

SEQ ID NO: 851226 - DNA, 25 bp, Mus musculus
ttttcccgcgcgagcttacctctgt

SEQ ID NO: 851227 - DNA, 25 bp, Mus musculus
ttttcccgcgcgtgcttacctctgt

SEQ ID NO: 851228 - DNA, 25 bp, Mus musculus
ttttccctatctccctgaggccagg

SEQ ID NO: 851229 - DNA, 25 bp, Mus musculus
ttttccctatctgcctgaggccagg

SEQ ID NO: 851230 - DNA, 25 bp, Mus musculus
ttttccctcaatcaggccagtggag

SEQ ID NO: 851231 - DNA, 25 bp, Mus musculus
ttttccctcaatgaggccagtggag

SEQ ID NO: 851232 - DNA, 25 bp, Mus musculus
ttttccctgcagactaatgcctact

SEQ ID NO: 851233 - DNA, 25 bp, Mus musculus
ttttccctgcagtctaatgcctact

SEQ ID NO: 851234 - DNA, 25 bp, Mus musculus
ttttccctgcttaagctgctcgtcc

SEQ ID NO: 851235 - DNA, 25 bp, Mus musculus
ttttccctgctttagctgctcgtcc

SEQ ID NO: 851236 - DNA, 25 bp, Mus musculus
ttttccgaaaaacaagctatctaat

SEQ ID NO: 851237 - DNA, 25 bp, Mus musculus
ttttccgaaaaagaagctatctaat

SEQ ID NO: 851238 - DNA, 25 bp, Mus musculus
ttttccgagatcagtcttctcacac

SEQ ID NO: 851239 - DNA, 25 bp, Mus musculus
ttttccgagatctgtcttctcacac

SEQ ID NO: 851240 - DNA, 25 bp, Mus musculus
ttttccgagcgtacctgtgccactg

SEQ ID NO: 851241 - DNA, 25 bp, Mus musculus
ttttccgagcgttcctgtgccactg

SEQ ID NO: 851242 - DNA, 25 bp, Mus musculus
ttttccgagctccaggacaccagtt

SEQ ID NO: 851243 - DNA, 25 bp, Mus musculus
ttttccgagctcgaggacaccagtt

SEQ ID NO: 851244 - DNA, 25 bp, Mus musculus
ttttccgagggaccttgcaaacccg

SEQ ID NO: 851245 - DNA, 25 bp, Mus musculus
ttttccgagggagcttgcaaacccg

SEQ ID NO: 851246 - DNA, 25 bp, Mus musculus
ttttccgagtacagtaaattcctgt

SEQ ID NO: 851247 - DNA, 25 bp, Mus musculus
ttttccgagtactgtaaattcctgt

SEQ ID NO: 851248 - DNA, 25 bp, Mus musculus
ttttccgagtctcggaacagcagcc

SEQ ID NO: 851249 - DNA, 25 bp, Mus musculus
ttttccgagtctgggaacagcagcc

SEQ ID NO: 851250 - DNA, 25 bp, Mus musculus
ttttccgccagcagtgacgtcactg

SEQ ID NO: 851251 - DNA, 25 bp, Mus musculus
ttttccgccagctgtgacgtcactg

SEQ ID NO: 851252 - DNA, 25 bp, Mus musculus
ttttccggagtgaggagatgacgct

SEQ ID NO: 851253 - DNA, 25 bp, Mus musculus
ttttccggagtgtggagatgacgct

SEQ ID NO: 851254 - DNA, 25 bp, Mus musculus
ttttccggcacaacaattgggatga

SEQ ID NO: 851255 - DNA, 25 bp, Mus musculus
ttttccggcacatcaattgggatga

SEQ ID NO: 851256 - DNA, 25 bp, Mus musculus
ttttcctcctcaagaatccggaagc

SEQ ID NO: 851257 - DNA, 25 bp, Mus musculus
ttttcctcctcacaggcccttaagg

SEQ ID NO: 851258 - DNA, 25 bp, Mus musculus
ttttcctcctcagaggcccttaagg

SEQ ID NO: 851259 - DNA, 25 bp, Mus musculus
ttttcctcctcatgaatccggaagc

SEQ ID NO: 851260 - DNA, 25 bp, Mus musculus
ttttcctcctggagcgtgcgacatg

SEQ ID NO: 851261 - DNA, 25 bp, Mus musculus
ttttcctcctggtgcgtgcgacatg

SEQ ID NO: 851262 - DNA, 25 bp, Mus musculus
ttttcctccttccacgttctgagcg

SEQ ID NO: 851263 - DNA, 25 bp, Mus musculus
ttttcctccttcgacgttctgagcg

SEQ ID NO: 851264 - DNA, 25 bp, Mus musculus
ttttcctgaacaactatgagcctga

SEQ ID NO: 851265 - DNA, 25 bp, Mus musculus
ttttcctgaacatctatgagcctga

SEQ ID NO: 851266 - DNA, 25 bp, Mus musculus
ttttcctgacgacaagcttcgctgc

SEQ ID NO: 851267 - DNA, 25 bp, Mus musculus
ttttcctgacgagaagcttcgctgc

SEQ ID NO: 851268 - DNA, 25 bp, Mus musculus
ttttcctgagagatgataatgcaca

SEQ ID NO: 851269 - DNA, 25 bp, Mus musculus
ttttcctgagagttgataatgcaca

SEQ ID NO: 851270 - DNA, 25 bp, Mus musculus
ttttcctgatggatagcccgaggca

SEQ ID NO: 851271 - DNA, 25 bp, Mus musculus
ttttcctgatggttagcccgaggca

SEQ ID NO: 851272 - DNA, 25 bp, Mus musculus
ttttcctgcggcagctgcgcctacg

SEQ ID NO: 851273 - DNA, 25 bp, Mus musculus
ttttcctgcggctgctgcgcctacg

SEQ ID NO: 851274 - DNA, 25 bp, Mus musculus
ttttcctgtataccttcgggcagtt

SEQ ID NO: 851275 - DNA, 25 bp, Mus musculus
ttttcctgtatagcttcgggcagtt

SEQ ID NO: 851276 - DNA, 25 bp, Mus musculus
ttttccttaagtcgccggctgcccg

SEQ ID NO: 851277 - DNA, 25 bp, Mus musculus
ttttccttaagtggccggctgcccg

SEQ ID NO: 851278 - DNA, 25 bp, Mus musculus
ttttccttaccaagaagtccagcca

SEQ ID NO: 851279 - DNA, 25 bp, Mus musculus
ttttccttaccatgaagtccagcca

SEQ ID NO: 851280 - DNA, 25 bp, Mus musculus
ttttccttagctagaaagatgccaa

SEQ ID NO: 851281 - DNA, 25 bp, Mus musculus
ttttccttagcttgaaagatgccaa

SEQ ID NO: 851282 - DNA, 25 bp, Mus musculus
ttttccttcacgcattgggagatac

SEQ ID NO: 851283 - DNA, 25 bp, Mus musculus
ttttccttcacggattgggagatac

SEQ ID NO: 851284 - DNA, 25 bp, Mus musculus
ttttccttggaccttgctgctggca

SEQ ID NO: 851285 - DNA, 25 bp, Mus musculus
ttttccttggacgttgctgctggca

SEQ ID NO: 851286 - DNA, 25 bp, Mus musculus
ttttccttggtgagcaaatacctcc

SEQ ID NO: 851287 - DNA, 25 bp, Mus musculus
ttttccttggtgtgcaaatacctcc

SEQ ID NO: 851288 - DNA, 25 bp, Mus musculus
ttttcgaacagtctttcccatagca

SEQ ID NO: 851289 - DNA, 25 bp, Mus musculus
ttttcgaacagtgtttcccatagca

SEQ ID NO: 851290 - DNA, 25 bp, Mus musculus
ttttcgacccctatacagtttgcag

SEQ ID NO: 851291 - DNA, 25 bp, Mus musculus
ttttcgacccctttacagtttgcag

SEQ ID NO: 851292 - DNA, 25 bp, Mus musculus
ttttcgagagctcgaggtacgccag

SEQ ID NO: 851293 - DNA, 25 bp, Mus musculus
ttttcgagagctggaggtacgccag

SEQ ID NO: 851294 - DNA, 25 bp, Mus musculus
ttttcgcaggtaattgtcatatctt

SEQ ID NO: 851295 - DNA, 25 bp, Mus musculus
ttttcgcaggtatttgtcatatctt

SEQ ID NO: 851296 - DNA, 25 bp, Mus musculus
ttttcgcatccaaacacctctttgt

SEQ ID NO: 851297 - DNA, 25 bp, Mus musculus
ttttcgcatccatacacctctttgt

SEQ ID NO: 851298 - DNA, 25 bp, Mus musculus
ttttcgccgttaccagggagccatc

SEQ ID NO: 851299 - DNA, 25 bp, Mus musculus
ttttcgccgttagcagggagccatc

SEQ ID NO: 851300 - DNA, 25 bp, Mus musculus
ttttcgccttggctctctgcggcac

SEQ ID NO: 851301 - DNA, 25 bp, Mus musculus
ttttcgccttgggtctctgcggcac

SEQ ID NO: 851302 - DNA, 25 bp, Mus musculus
ttttcgcgccgccaggacatggaac

SEQ ID NO: 851303 - DNA, 25 bp, Mus musculus
ttttcgcgccgcgaggacatggaac

SEQ ID NO: 851304 - DNA, 25 bp, Mus musculus
ttttcgctgctcactggcagacttc

SEQ ID NO: 851305 - DNA, 25 bp, Mus musculus
ttttcgctgctctctggcagacttc

SEQ ID NO: 851306 - DNA, 25 bp, Mus musculus
ttttcggaccaacggctctctcatc

SEQ ID NO: 851307 - DNA, 25 bp, Mus musculus
ttttcggaccaagggctctctcatc

SEQ ID NO: 851308 - DNA, 25 bp, Mus musculus
ttttcggaccagagcagccgatcct

SEQ ID NO: 851309 - DNA, 25 bp, Mus musculus
ttttcggaccagtgcagccgatcct

SEQ ID NO: 851310 - DNA, 25 bp, Mus musculus
ttttcgggacacatcacaatccagc

SEQ ID NO: 851311 - DNA, 25 bp, Mus musculus
ttttcgggacacttcacaatccagc

SEQ ID NO: 851312 - DNA, 25 bp, Mus musculus
ttttcggtgtcaagggcgcctcgtc

SEQ ID NO: 851313 - DNA, 25 bp, Mus musculus
ttttcggtgtcatgggcgcctcgtc

SEQ ID NO: 851314 - DNA, 25 bp, Mus musculus
ttttcggttacaccaatgggaactg

SEQ ID NO: 851315 - DNA, 25 bp, Mus musculus
ttttcggttacagcaatgggaactg

SEQ ID NO: 851316 - DNA, 25 bp, Mus musculus
ttttcgtcgataacacgcacgaggc

SEQ ID NO: 851317 - DNA, 25 bp, Mus musculus
ttttcgtcgatatcacgcacgaggc

SEQ ID NO: 851318 - DNA, 25 bp, Mus musculus
ttttcgtggctgaccgcagccagcc

SEQ ID NO: 851319 - DNA, 25 bp, Mus musculus
ttttcgtggctgtccgcagccagcc

SEQ ID NO: 851320 - DNA, 25 bp, Mus musculus
ttttcgtgggcaatgtatcggctgc

SEQ ID NO: 851321 - DNA, 25 bp, Mus musculus
ttttcgtgggcattgtatcggctgc

SEQ ID NO: 851322 - DNA, 25 bp, Mus musculus
ttttcgttgcctacatctactcttg

SEQ ID NO: 851323 - DNA, 25 bp, Mus musculus
ttttcgttgccttcatctactcttg

SEQ ID NO: 851324 - DNA, 25 bp, Mus musculus
ttttctaactgcagatgacacttgg

SEQ ID NO: 851325 - DNA, 25 bp, Mus musculus
ttttctaactgctgatgacacttgg

SEQ ID NO: 851326 - DNA, 25 bp, Mus musculus
ttttctacacccaaccagaaggcgt

SEQ ID NO: 851327 - DNA, 25 bp, Mus musculus
ttttctacaccctaccagaaggcgt

SEQ ID NO: 851328 - DNA, 25 bp, Mus musculus
ttttctaccacaacagagatgacag

SEQ ID NO: 851329 - DNA, 25 bp, Mus musculus
ttttctaccacatcagagatgacag

SEQ ID NO: 851330 - DNA, 25 bp, Mus musculus
ttttctaccttcaccgcgtccagaa

SEQ ID NO: 851331 - DNA, 25 bp, Mus musculus
ttttctaccttctccgcgtccagaa

SEQ ID NO: 851332 - DNA, 25 bp, Mus musculus
ttttctactcaacccagagctgctc

SEQ ID NO: 851333 - DNA, 25 bp, Mus musculus
ttttctactcaagccagagctgctc

SEQ ID NO: 851334 - DNA, 25 bp, Mus musculus
ttttctagacacatacaagctgcca

SEQ ID NO: 851335 - DNA, 25 bp, Mus musculus
ttttctagacacttacaagctgcca

SEQ ID NO: 851336 - DNA, 25 bp, Mus musculus
ttttctagcagtcaactcaaagtgt

SEQ ID NO: 851337 - DNA, 25 bp, Mus musculus
ttttctagcagtgaactcaaagtgt

SEQ ID NO: 851338 - DNA, 25 bp, Mus musculus
ttttctaggtagactcctgccctcc

SEQ ID NO: 851339 - DNA, 25 bp, Mus musculus
ttttctaggtagtctcctgccctcc

SEQ ID NO: 851340 - DNA, 25 bp, Mus musculus
ttttctagtgttcaccgagcccggg

SEQ ID NO: 851341 - DNA, 25 bp, Mus musculus
ttttctagtgttgaccgagcccggg

SEQ ID NO: 851342 - DNA, 25 bp, Mus musculus
ttttctatgacgcagagaatcctcc

SEQ ID NO: 851343 - DNA, 25 bp, Mus musculus
ttttctatgacggagagaatcctcc

SEQ ID NO: 851344 - DNA, 25 bp, Mus musculus
ttttctcacttcaacgtcatctcag

SEQ ID NO: 851345 - DNA, 25 bp, Mus musculus
ttttctcacttctacgtcatctcag

SEQ ID NO: 851346 - DNA, 25 bp, Mus musculus
ttttctcagactcgaagcagcagca

SEQ ID NO: 851347 - DNA, 25 bp, Mus musculus
ttttctcagactggaagcagcagca

SEQ ID NO: 851348 - DNA, 25 bp, Mus musculus
ttttctcagcgtcactgtggaagaa

SEQ ID NO: 851349 - DNA, 25 bp, Mus musculus
ttttctcagcgtgactgtggaagaa

SEQ ID NO: 851350 - DNA, 25 bp, Mus musculus
ttttctcagcttaaaggctcatcag

SEQ ID NO: 851351 - DNA, 25 bp, Mus musculus
ttttctcagctttaaggctcatcag

SEQ ID NO: 851352 - DNA, 25 bp, Mus musculus
ttttctccactcatgaagagctggc

SEQ ID NO: 851353 - DNA, 25 bp, Mus musculus
ttttctccactcttgaagagctggc

SEQ ID NO: 851354 - DNA, 25 bp, Mus musculus
ttttctccagccatcaaacaatgaa

SEQ ID NO: 851355 - DNA, 25 bp, Mus musculus
ttttctccagccttcaaacaatgaa

SEQ ID NO: 851356 - DNA, 25 bp, Mus musculus
ttttctccccataatgcaaggctgg

SEQ ID NO: 851357 - DNA, 25 bp, Mus musculus
ttttctccccattatgcaaggctgg

SEQ ID NO: 851358 - DNA, 25 bp, Mus musculus
ttttctccgaaacacagaatgccat

SEQ ID NO: 851359 - DNA, 25 bp, Mus musculus
ttttctccgaaagacagaatgccat

SEQ ID NO: 851360 - DNA, 25 bp, Mus musculus
ttttctcctgaactccttatcccaa

SEQ ID NO: 851361 - DNA, 25 bp, Mus musculus
ttttctcctgaagtccttatcccaa

SEQ ID NO: 851362 - DNA, 25 bp, Mus musculus
ttttctcctgtgctataggaaaggc

SEQ ID NO: 851363 - DNA, 25 bp, Mus musculus
ttttctcctgtggtataggaaaggc

SEQ ID NO: 851364 - DNA, 25 bp, Mus musculus
ttttctcgccgtatctctcctgctg

SEQ ID NO: 851365 - DNA, 25 bp, Mus musculus
ttttctcgccgtttctctcctgctg

SEQ ID NO: 851366 - DNA, 25 bp, Mus musculus
ttttctcgcgggatacggattggac

SEQ ID NO: 851367 - DNA, 25 bp, Mus musculus
ttttctcgcgggttacggattggac

SEQ ID NO: 851368 - DNA, 25 bp, Mus musculus
ttttctcggttcagtctccgtgaag

SEQ ID NO: 851369 - DNA, 25 bp, Mus musculus
ttttctcggttctgtctccgtgaag

SEQ ID NO: 851370 - DNA, 25 bp, Mus musculus
ttttctctgggacgccacctggtca

SEQ ID NO: 851371 - DNA, 25 bp, Mus musculus
ttttctctgggaggccacctggtca

SEQ ID NO: 851372 - DNA, 25 bp, Mus musculus
ttttctctgtcaagtactgcagtca

SEQ ID NO: 851373 - DNA, 25 bp, Mus musculus
ttttctctgtcatgtactgcagtca

SEQ ID NO: 851374 - DNA, 25 bp, Mus musculus
ttttctgacctaagaaacagcatcg

SEQ ID NO: 851375 - DNA, 25 bp, Mus musculus
ttttctgacctatgaaacagcatcg

SEQ ID NO: 851376 - DNA, 25 bp, Mus musculus
ttttctgagggaacatcagctgaca

SEQ ID NO: 851377 - DNA, 25 bp, Mus musculus
ttttctgagggatcatcagctgaca

SEQ ID NO: 851378 - DNA, 25 bp, Mus musculus
ttttctgatcgcactccatccaggg

SEQ ID NO: 851379 - DNA, 25 bp, Mus musculus
ttttctgatcgctctccatccaggg

SEQ ID NO: 851380 - DNA, 25 bp, Mus musculus
ttttctgcaagtcgagagcttggca

SEQ ID NO: 851381 - DNA, 25 bp, Mus musculus
ttttctgcaagtggagagcttggca

SEQ ID NO: 851382 - DNA, 25 bp, Mus musculus
ttttctgccataccatgcactgcgg

SEQ ID NO: 851383 - DNA, 25 bp, Mus musculus
ttttctgccatagcatgcactgcgg

SEQ ID NO: 851384 - DNA, 25 bp, Mus musculus
ttttctgcgcttcggcccttcggcg

SEQ ID NO: 851385 - DNA, 25 bp, Mus musculus
ttttctgcgcttgggcccttcggcg

SEQ ID NO: 851386 - DNA, 25 bp, Mus musculus
ttttctgcggcaagagctgcccgtc

SEQ ID NO: 851387 - DNA, 25 bp, Mus musculus
ttttctgcggcatgagctgcccgtc

SEQ ID NO: 851388 - DNA, 25 bp, Mus musculus
ttttctgcgtcacttggcaggagcc

SEQ ID NO: 851389 - DNA, 25 bp, Mus musculus
ttttctgcgtcagttggcaggagcc

SEQ ID NO: 851390 - DNA, 25 bp, Mus musculus
ttttctgctgttctctttggtgcca

SEQ ID NO: 851391 - DNA, 25 bp, Mus musculus
ttttctgctgttgtctttggtgcca

SEQ ID NO: 851392 - DNA, 25 bp, Mus musculus
ttttctgcttcacgagaaacggaag

SEQ ID NO: 851393 - DNA, 25 bp, Mus musculus
ttttctgcttcaggagaaacggaag

SEQ ID NO: 851394 - DNA, 25 bp, Mus musculus
ttttctggaagacagctttacaaga

SEQ ID NO: 851395 - DNA, 25 bp, Mus musculus
ttttctggaagagagctttacaaga

SEQ ID NO: 851396 - DNA, 25 bp, Mus musculus
ttttctggccgaacgtggactggac

SEQ ID NO: 851397 - DNA, 25 bp, Mus musculus
ttttctggccgatcgtggactggac

SEQ ID NO: 851398 - DNA, 25 bp, Mus musculus
ttttctggccgccacgatcctgctg

SEQ ID NO: 851399 - DNA, 25 bp, Mus musculus
ttttctggccgcgacgatcctgctg

SEQ ID NO: 851400 - DNA, 25 bp, Mus musculus
ttttctggctgcaaagactgttgag

SEQ ID NO: 851401 - DNA, 25 bp, Mus musculus
ttttctggctgctaagactgttgag

SEQ ID NO: 851402 - DNA, 25 bp, Mus musculus
ttttctgggaaactggagctggcca

SEQ ID NO: 851403 - DNA, 25 bp, Mus musculus
ttttctgggaaagtggagctggcca

SEQ ID NO: 851404 - DNA, 25 bp, Mus musculus
ttttctgggacaacaagtttgacca

SEQ ID NO: 851405 - DNA, 25 bp, Mus musculus
ttttctgggacatcaagtttgacca

SEQ ID NO: 851406 - DNA, 25 bp, Mus musculus
ttttctgggttgaattgtcagtatc

SEQ ID NO: 851407 - DNA, 25 bp, Mus musculus
ttttctgggttgtattgtcagtatc

SEQ ID NO: 851408 - DNA, 25 bp, Mus musculus
ttttctggtccaatgaaaggaatag

SEQ ID NO: 851409 - DNA, 25 bp, Mus musculus
ttttctggtccattgaaaggaatag

SEQ ID NO: 851410 - DNA, 25 bp, Mus musculus
ttttctgtagctctcctaaaccagc

SEQ ID NO: 851411 - DNA, 25 bp, Mus musculus
ttttctgtagctgtcctaaaccagc

SEQ ID NO: 851412 - DNA, 25 bp, Mus musculus
ttttctgtgattagagctgaatcca

SEQ ID NO: 851413 - DNA, 25 bp, Mus musculus
ttttctgtgatttgagctgaatcca

SEQ ID NO: 851414 - DNA, 25 bp, Mus musculus
ttttctgtgcaaagccactgtgtca

SEQ ID NO: 851415 - DNA, 25 bp, Mus musculus
ttttctgtgcaatgccactgtgtca

SEQ ID NO: 851416 - DNA, 25 bp, Mus musculus
ttttctgtggccagtgcacgggctt

SEQ ID NO: 851417 - DNA, 25 bp, Mus musculus
ttttctgtggcctgtgcacgggctt

SEQ ID NO: 851418 - DNA, 25 bp, Mus musculus
ttttctgttctcagcaggcacttgc

SEQ ID NO: 851419 - DNA, 25 bp, Mus musculus
ttttctgttctctgcaggcacttgc

SEQ ID NO: 851420 - DNA, 25 bp, Mus musculus
ttttctgttctgagcataggcacgg

SEQ ID NO: 851421 - DNA, 25 bp, Mus musculus
ttttctgttctgtgcataggcacgg

SEQ ID NO: 851422 - DNA, 25 bp, Mus musculus
ttttctgttttgcagcatacaagca

SEQ ID NO: 851423 - DNA, 25 bp, Mus musculus
ttttctgttttggagcatacaagca

SEQ ID NO: 851424 - DNA, 25 bp, Mus musculus
ttttcttacaggagaagcaagatgc

SEQ ID NO: 851425 - DNA, 25 bp, Mus musculus
ttttcttacaggtgaagcaagatgc

SEQ ID NO: 851426 - DNA, 25 bp, Mus musculus
ttttcttagcgccaagcgggcacgg

SEQ ID NO: 851427 - DNA, 25 bp, Mus musculus
ttttcttagcgcgaagcgggcacgg

SEQ ID NO: 851428 - DNA, 25 bp, Mus musculus
ttttcttcatcacggatgccatatt

SEQ ID NO: 851429 - DNA, 25 bp, Mus musculus
ttttcttcatcagggatgccatatt

SEQ ID NO: 851430 - DNA, 25 bp, Mus musculus
ttttcttcatgcatctcctgcccaa

SEQ ID NO: 851431 - DNA, 25 bp, Mus musculus
ttttcttcatgcttctcctgcccaa

SEQ ID NO: 851432 - DNA, 25 bp, Mus musculus
ttttcttccgccagacttggactga

SEQ ID NO: 851433 - DNA, 25 bp, Mus musculus
ttttcttccgcctgacttggactga

SEQ ID NO: 851434 - DNA, 25 bp, Mus musculus
ttttcttcctaaccacagtccagct

SEQ ID NO: 851435 - DNA, 25 bp, Mus musculus
ttttcttcctaagcacagtccagct

SEQ ID NO: 851436 - DNA, 25 bp, Mus musculus
ttttcttcgggactaagtcgcacag

SEQ ID NO: 851437 - DNA, 25 bp, Mus musculus
ttttcttcgggagtaagtcgcacag

SEQ ID NO: 851438 - DNA, 25 bp, Mus musculus
ttttcttcgtgtctcctacagggcg

SEQ ID NO: 851439 - DNA, 25 bp, Mus musculus
ttttcttcgtgtgtcctacagggcg

SEQ ID NO: 851440 - DNA, 25 bp, Mus musculus
ttttcttctagtcgccatatgctca

SEQ ID NO: 851441 - DNA, 25 bp, Mus musculus
ttttcttctagtggccatatgctca

SEQ ID NO: 851442 - DNA, 25 bp, Mus musculus
ttttcttctgtgatctgagatgact

SEQ ID NO: 851443 - DNA, 25 bp, Mus musculus
ttttcttctgtgttctgagatgact

SEQ ID NO: 851444 - DNA, 25 bp, Mus musculus
ttttcttgcgcccacacttgggctg

SEQ ID NO: 851445 - DNA, 25 bp, Mus musculus
ttttcttgcgccgacacttgggctg

SEQ ID NO: 851446 - DNA, 25 bp, Mus musculus
ttttcttggcaacctacccagcact

SEQ ID NO: 851447 - DNA, 25 bp, Mus musculus
ttttcttggcaagctacccagcact

SEQ ID NO: 851448 - DNA, 25 bp, Mus musculus
ttttcttgtcccacttgtccctctg

SEQ ID NO: 851449 - DNA, 25 bp, Mus musculus
ttttcttgtccctcttgtccctctg

SEQ ID NO: 851450 - DNA, 25 bp, Mus musculus
ttttcttgtgctcggccagcaccca

SEQ ID NO: 851451 - DNA, 25 bp, Mus musculus
ttttcttgtgctgggccagcaccca

SEQ ID NO: 851452 - DNA, 25 bp, Mus musculus
ttttctttaaacatgctggccaggg

SEQ ID NO: 851453 - DNA, 25 bp, Mus musculus
ttttctttaaacttgctggccaggg

SEQ ID NO: 851454 - DNA, 25 bp, Mus musculus
ttttctttaccaccttgggactgct

SEQ ID NO: 851455 - DNA, 25 bp, Mus musculus
ttttctttaccagcttgggactgct

SEQ ID NO: 851456 - DNA, 25 bp, Mus musculus
ttttctttgcctcctgctccgcctg

SEQ ID NO: 851457 - DNA, 25 bp, Mus musculus
ttttctttgcctgctgctccgcctg

SEQ ID NO: 851458 - DNA, 25 bp, Mus musculus
ttttgaaaaaacagaggccctgagg

SEQ ID NO: 851459 - DNA, 25 bp, Mus musculus
ttttgaaaaaactgaggccctgagg

SEQ ID NO: 851460 - DNA, 25 bp, Mus musculus
ttttgaaaaagcctcggaatgccat

SEQ ID NO: 851461 - DNA, 25 bp, Mus musculus
ttttgaaaaagcgtcggaatgccat

SEQ ID NO: 851462 - DNA, 25 bp, Mus musculus
ttttgaaaaccaccacagtccgatg

SEQ ID NO: 851463 - DNA, 25 bp, Mus musculus
ttttgaaaaccagcacagtccgatg

SEQ ID NO: 851464 - DNA, 25 bp, Mus musculus
ttttgaaacctacatcaagatccac

SEQ ID NO: 851465 - DNA, 25 bp, Mus musculus
ttttgaaacctagatcaagatccac

SEQ ID NO: 851466 - DNA, 25 bp, Mus musculus
ttttgaacatgcaagaactacttga

SEQ ID NO: 851467 - DNA, 25 bp, Mus musculus
ttttgaacatgctagaactacttga

SEQ ID NO: 851468 - DNA, 25 bp, Mus musculus
ttttgaagagggagagtggctttca

SEQ ID NO: 851469 - DNA, 25 bp, Mus musculus
ttttgaagagggtgagtggctttca

SEQ ID NO: 851470 - DNA, 25 bp, Mus musculus
ttttgaagctctccacagatcaggg

SEQ ID NO: 851471 - DNA, 25 bp, Mus musculus
ttttgaagctctgcacagatcaggg

SEQ ID NO: 851472 - DNA, 25 bp, Mus musculus
ttttgaaggtgtagactgggaacac

SEQ ID NO: 851473 - DNA, 25 bp, Mus musculus
ttttgaaggtgttgactgggaacac

SEQ ID NO: 851474 - DNA, 25 bp, Mus musculus
ttttgaataaaactggccaagaaca

SEQ ID NO: 851475 - DNA, 25 bp, Mus musculus
ttttgaataaaagtggccaagaaca

SEQ ID NO: 851476 - DNA, 25 bp, Mus musculus
ttttgaataagacgtggatccaggc

SEQ ID NO: 851477 - DNA, 25 bp, Mus musculus
ttttgaataagaggtggatccaggc

SEQ ID NO: 851478 - DNA, 25 bp, Mus musculus
ttttgaatgcagatgccatctcatc

SEQ ID NO: 851479 - DNA, 25 bp, Mus musculus
ttttgaatgcagttgccatctcatc

SEQ ID NO: 851480 - DNA, 25 bp, Mus musculus
ttttgaatgcgcaagaacttcagag

SEQ ID NO: 851481 - DNA, 25 bp, Mus musculus
ttttgaatgcgctagaacttcagag

SEQ ID NO: 851482 - DNA, 25 bp, Mus musculus
ttttgaatgggaagaatgctagaga

SEQ ID NO: 851483 - DNA, 25 bp, Mus musculus
ttttgaatgggatgaatgctagaga

SEQ ID NO: 851484 - DNA, 25 bp, Mus musculus
ttttgacaccagagcttagtcctgg

SEQ ID NO: 851485 - DNA, 25 bp, Mus musculus
ttttgacaccagtgcttagtcctgg

SEQ ID NO: 851486 - DNA, 25 bp, Mus musculus
ttttgacactacatccagttccagc

SEQ ID NO: 851487 - DNA, 25 bp, Mus musculus
ttttgacactacttccagttccagc

SEQ ID NO: 851488 - DNA, 25 bp, Mus musculus
ttttgacagtgaccccgtggaaggc

SEQ ID NO: 851489 - DNA, 25 bp, Mus musculus
ttttgacagtgagcccgtggaaggc

SEQ ID NO: 851490 - DNA, 25 bp, Mus musculus
ttttgacatctgcaacagggtcgca

SEQ ID NO: 851491 - DNA, 25 bp, Mus musculus
ttttgacatctggaacagggtcgca

SEQ ID NO: 851492 - DNA, 25 bp, Mus musculus
ttttgacattggatcgtacacagtg

SEQ ID NO: 851493 - DNA, 25 bp, Mus musculus
ttttgacattggttcgtacacagtg

SEQ ID NO: 851494 - DNA, 25 bp, Mus musculus
ttttgaccctctattagtggaagag

SEQ ID NO: 851495 - DNA, 25 bp, Mus musculus
ttttgaccctcttttagtggaagag

SEQ ID NO: 851496 - DNA, 25 bp, Mus musculus
ttttgaccgagacggacaaattgtc

SEQ ID NO: 851497 - DNA, 25 bp, Mus musculus
ttttgaccgagagggacaaattgtc

SEQ ID NO: 851498 - DNA, 25 bp, Mus musculus
ttttgaccgagtctacacccaccag

SEQ ID NO: 851499 - DNA, 25 bp, Mus musculus
ttttgaccgagtgtacacccaccag

SEQ ID NO: 851500 - DNA, 25 bp, Mus musculus
ttttgaccgcttctccaagcacgac

SEQ ID NO: 851501 - DNA, 25 bp, Mus musculus
ttttgaccgcttgtccaagcacgac

SEQ ID NO: 851502 - DNA, 25 bp, Mus musculus
ttttgaccttgacgtagacgcgtgg

SEQ ID NO: 851503 - DNA, 25 bp, Mus musculus
ttttgaccttgaggtagacgcgtgg

SEQ ID NO: 851504 - DNA, 25 bp, Mus musculus
ttttgactatcacctaaatgctgca

SEQ ID NO: 851505 - DNA, 25 bp, Mus musculus
ttttgactatcagctaaatgctgca

SEQ ID NO: 851506 - DNA, 25 bp, Mus musculus
ttttgactcgggaagccctcagatg

SEQ ID NO: 851507 - DNA, 25 bp, Mus musculus
ttttgactcgggtagccctcagatg

SEQ ID NO: 851508 - DNA, 25 bp, Mus musculus
ttttgactttgcacagggcttactg

SEQ ID NO: 851509 - DNA, 25 bp, Mus musculus
ttttgactttgctcagggcttactg

SEQ ID NO: 851510 - DNA, 25 bp, Mus musculus
ttttgagaaaagaagtactcgaaca

SEQ ID NO: 851511 - DNA, 25 bp, Mus musculus
ttttgagaaaagtagtactcgaaca

SEQ ID NO: 851512 - DNA, 25 bp, Mus musculus
ttttgagaatgtcaaagatgtaccc

SEQ ID NO: 851513 - DNA, 25 bp, Mus musculus
ttttgagaatgtgaaagatgtaccc

SEQ ID NO: 851514 - DNA, 25 bp, Mus musculus
ttttgagatctacttatgctttggg

SEQ ID NO: 851515 - DNA, 25 bp, Mus musculus
ttttgagatctagttatgctttggg

SEQ ID NO: 851516 - DNA, 25 bp, Mus musculus
ttttgagcaatacatggaccatttc

SEQ ID NO: 851517 - DNA, 25 bp, Mus musculus
ttttgagcaatagatggaccatttc

SEQ ID NO: 851518 - DNA, 25 bp, Mus musculus
ttttgagcagagcacgcagctgccc

SEQ ID NO: 851519 - DNA, 25 bp, Mus musculus
ttttgagcagaggacgcagctgccc

SEQ ID NO: 851520 - DNA, 25 bp, Mus musculus
ttttgagcagttacgtaagatctac

SEQ ID NO: 851521 - DNA, 25 bp, Mus musculus
ttttgagcagtttcgtaagatctac

SEQ ID NO: 851522 - DNA, 25 bp, Mus musculus
ttttgagcattaatgtgacagctac

SEQ ID NO: 851523 - DNA, 25 bp, Mus musculus
ttttgagcattattgtgacagctac

SEQ ID NO: 851524 - DNA, 25 bp, Mus musculus
ttttgagcccggcagtctgccctag

SEQ ID NO: 851525 - DNA, 25 bp, Mus musculus
ttttgagcccgggagtctgccctag

SEQ ID NO: 851526 - DNA, 25 bp, Mus musculus
ttttgagcgcttccgccgtgttgag

SEQ ID NO: 851527 - DNA, 25 bp, Mus musculus
ttttgagcgcttgcgccgtgttgag

SEQ ID NO: 851528 - DNA, 25 bp, Mus musculus
ttttgaggacaacacttacatttgc

SEQ ID NO: 851529 - DNA, 25 bp, Mus musculus
ttttgaggacaagacttacatttgc

SEQ ID NO: 851530 - DNA, 25 bp, Mus musculus
ttttgaggatctccccggagtcccc

SEQ ID NO: 851531 - DNA, 25 bp, Mus musculus
ttttgaggatctgcccggagtcccc

SEQ ID NO: 851532 - DNA, 25 bp, Mus musculus
ttttgagggaaacctgaacacctat

SEQ ID NO: 851533 - DNA, 25 bp, Mus musculus
ttttgagggaaagctgaacacctat

SEQ ID NO: 851534 - DNA, 25 bp, Mus musculus
ttttgaggttgcaggcgggaattct

SEQ ID NO: 851535 - DNA, 25 bp, Mus musculus
ttttgaggttgctggcgggaattct

SEQ ID NO: 851536 - DNA, 25 bp, Mus musculus
ttttgatacaaacacggggcatcgt

SEQ ID NO: 851537 - DNA, 25 bp, Mus musculus
ttttgatacaaagacggggcatcgt

SEQ ID NO: 851538 - DNA, 25 bp, Mus musculus
ttttgatacgccagatgaggatccc

SEQ ID NO: 851539 - DNA, 25 bp, Mus musculus
ttttgatacgcctgatgaggatccc

SEQ ID NO: 851540 - DNA, 25 bp, Mus musculus
ttttgatattgtctctggaactcga

SEQ ID NO: 851541 - DNA, 25 bp, Mus musculus
ttttgatattgtgtctggaactcga

SEQ ID NO: 851542 - DNA, 25 bp, Mus musculus
ttttgatgagaaactaaactctttg

SEQ ID NO: 851543 - DNA, 25 bp, Mus musculus
ttttgatgagaatctaaactctttg

SEQ ID NO: 851544 - DNA, 25 bp, Mus musculus
ttttgatgccaacgaacgggcagca

SEQ ID NO: 851545 - DNA, 25 bp, Mus musculus
ttttgatgccaaggaacgggcagca

SEQ ID NO: 851546 - DNA, 25 bp, Mus musculus
ttttgatgctatagctgagatccag

SEQ ID NO: 851547 - DNA, 25 bp, Mus musculus
ttttgatgctattgctgagatccag

SEQ ID NO: 851548 - DNA, 25 bp, Mus musculus
ttttgatggcaaatggagctccttt

SEQ ID NO: 851549 - DNA, 25 bp, Mus musculus
ttttgatggcaattggagctccttt

SEQ ID NO: 851550 - DNA, 25 bp, Mus musculus
ttttgcaactgcagagcctttgggt

SEQ ID NO: 851551 - DNA, 25 bp, Mus musculus
ttttgcaactgctgagcctttgggt

SEQ ID NO: 851552 - DNA, 25 bp, Mus musculus
ttttgcaactggcaaaaacgtctgc

SEQ ID NO: 851553 - DNA, 25 bp, Mus musculus
ttttgcaactgggaaaaacgtctgc

SEQ ID NO: 851554 - DNA, 25 bp, Mus musculus
ttttgcaactgtcggcaagcagacc

SEQ ID NO: 851555 - DNA, 25 bp, Mus musculus
ttttgcaactgtgggcaagcagacc

SEQ ID NO: 851556 - DNA, 25 bp, Mus musculus
ttttgcacaagaacagtgcccctgt

SEQ ID NO: 851557 - DNA, 25 bp, Mus musculus
ttttgcacaagatcagtgcccctgt

SEQ ID NO: 851558 - DNA, 25 bp, Mus musculus
ttttgcacatgcacaagtttccatc

SEQ ID NO: 851559 - DNA, 25 bp, Mus musculus
ttttgcacatgctcaagtttccatc

SEQ ID NO: 851560 - DNA, 25 bp, Mus musculus
ttttgcaccaaaaaatccatgcccg

SEQ ID NO: 851561 - DNA, 25 bp, Mus musculus
ttttgcaccaaataatccatgcccg

SEQ ID NO: 851562 - DNA, 25 bp, Mus musculus
ttttgcactctgaaccaaagaggga

SEQ ID NO: 851563 - DNA, 25 bp, Mus musculus
ttttgcactctgtaccaaagaggga

SEQ ID NO: 851564 - DNA, 25 bp, Mus musculus
ttttgcagtaggacccctctctctg

SEQ ID NO: 851565 - DNA, 25 bp, Mus musculus
ttttgcagtaggtcccctctctctg

SEQ ID NO: 851566 - DNA, 25 bp, Mus musculus
ttttgcagtgacacttgagctgggc

SEQ ID NO: 851567 - DNA, 25 bp, Mus musculus
ttttgcagtgactcttgagctgggc

SEQ ID NO: 851568 - DNA, 25 bp, Mus musculus
ttttgcatcatgacaagctggaata

SEQ ID NO: 851569 - DNA, 25 bp, Mus musculus
ttttgcatcatgtcaagctggaata

SEQ ID NO: 851570 - DNA, 25 bp, Mus musculus
ttttgcatcctacccgcacacagtg

SEQ ID NO: 851571 - DNA, 25 bp, Mus musculus
ttttgcatcctagccgcacacagtg

SEQ ID NO: 851572 - DNA, 25 bp, Mus musculus
ttttgcatctagagaccgccatctg

SEQ ID NO: 851573 - DNA, 25 bp, Mus musculus
ttttgcatctagtgaccgccatctg

SEQ ID NO: 851574 - DNA, 25 bp, Mus musculus
ttttgcatcttgattcccgggatac

SEQ ID NO: 851575 - DNA, 25 bp, Mus musculus
ttttgcatcttgtttcccgggatac

SEQ ID NO: 851576 - DNA, 25 bp, Mus musculus
ttttgccaacggctcctgggtgcac

SEQ ID NO: 851577 - DNA, 25 bp, Mus musculus
ttttgccaacgggtcctgggtgcac

SEQ ID NO: 851578 - DNA, 25 bp, Mus musculus
ttttgccaagcaaaataagatgatg

SEQ ID NO: 851579 - DNA, 25 bp, Mus musculus
ttttgccaagcataataagatgatg

SEQ ID NO: 851580 - DNA, 25 bp, Mus musculus
ttttgccaagcgagtgaaaggccgt

SEQ ID NO: 851581 - DNA, 25 bp, Mus musculus
ttttgccaagcgtgtgaaaggccgt

SEQ ID NO: 851582 - DNA, 25 bp, Mus musculus
ttttgccacacaccagaagtgatgt

SEQ ID NO: 851583 - DNA, 25 bp, Mus musculus
ttttgccacacagcagaagtgatgt

SEQ ID NO: 851584 - DNA, 25 bp, Mus musculus
ttttgccaccagaacttaccggcag

SEQ ID NO: 851585 - DNA, 25 bp, Mus musculus
ttttgccaccagtacttaccggcag

SEQ ID NO: 851586 - DNA, 25 bp, Mus musculus
ttttgccagtggactagactgctga

SEQ ID NO: 851587 - DNA, 25 bp, Mus musculus
ttttgccagtggtctagactgctga

SEQ ID NO: 851588 - DNA, 25 bp, Mus musculus
ttttgccataaaagaaatgtgtctg

SEQ ID NO: 851589 - DNA, 25 bp, Mus musculus
ttttgccataaatgaaatgtgtctg

SEQ ID NO: 851590 - DNA, 25 bp, Mus musculus
ttttgccataataagtcacagccat

SEQ ID NO: 851591 - DNA, 25 bp, Mus musculus
ttttgccataattagtcacagccat

SEQ ID NO: 851592 - DNA, 25 bp, Mus musculus
ttttgccatcaaaatgaggcctgtg

SEQ ID NO: 851593 - DNA, 25 bp, Mus musculus
ttttgccatcaatatgaggcctgtg

SEQ ID NO: 851594 - DNA, 25 bp, Mus musculus
ttttgcccacaaagaccttgttgac

SEQ ID NO: 851595 - DNA, 25 bp, Mus musculus
ttttgcccacaatgaccttgttgac

SEQ ID NO: 851596 - DNA, 25 bp, Mus musculus
ttttgcccaggaactcctggatgat

SEQ ID NO: 851597 - DNA, 25 bp, Mus musculus
ttttgcccaggatctcctggatgat

SEQ ID NO: 851598 - DNA, 25 bp, Mus musculus
ttttgcccattcaccccaggcttgg

SEQ ID NO: 851599 - DNA, 25 bp, Mus musculus
ttttgcccattctccccaggcttgg

SEQ ID NO: 851600 - DNA, 25 bp, Mus musculus
ttttgcccgacgcatggaagccctt

SEQ ID NO: 851601 - DNA, 25 bp, Mus musculus
ttttgcccgacggatggaagccctt

SEQ ID NO: 851602 - DNA, 25 bp, Mus musculus
ttttgcctaagcagctcacccttgg

SEQ ID NO: 851603 - DNA, 25 bp, Mus musculus
ttttgcctaagctgctcacccttgg

SEQ ID NO: 851604 - DNA, 25 bp, Mus musculus
ttttgcctaaggcacccagacacca

SEQ ID NO: 851605 - DNA, 25 bp, Mus musculus
ttttgcctaagggacccagacacca

SEQ ID NO: 851606 - DNA, 25 bp, Mus musculus
ttttgcctgacaagctgaaaaatgc

SEQ ID NO: 851607 - DNA, 25 bp, Mus musculus
ttttgcctgacatgctgaaaaatgc

SEQ ID NO: 851608 - DNA, 25 bp, Mus musculus
ttttgcctgcagctagtgggcagca

SEQ ID NO: 851609 - DNA, 25 bp, Mus musculus
ttttgcctgcaggtagtgggcagca

SEQ ID NO: 851610 - DNA, 25 bp, Mus musculus
ttttgcctgctacgagagcactccg

SEQ ID NO: 851611 - DNA, 25 bp, Mus musculus
ttttgcctgctaggagagcactccg

SEQ ID NO: 851612 - DNA, 25 bp, Mus musculus
ttttgcctgggcaccttaggctgca

SEQ ID NO: 851613 - DNA, 25 bp, Mus musculus
ttttgcctgggctccttaggctgca

SEQ ID NO: 851614 - DNA, 25 bp, Mus musculus
ttttgcctgtacactggcttcctct

SEQ ID NO: 851615 - DNA, 25 bp, Mus musculus
ttttgcctgtactctggcttcctct

SEQ ID NO: 851616 - DNA, 25 bp, Mus musculus
ttttgcgaagcaaccccgaatgggc

SEQ ID NO: 851617 - DNA, 25 bp, Mus musculus
ttttgcgaagcatccccgaatgggc

SEQ ID NO: 851618 - DNA, 25 bp, Mus musculus
ttttgcggaggaattcacccggctg

SEQ ID NO: 851619 - DNA, 25 bp, Mus musculus
ttttgcggaggatttcacccggctg

SEQ ID NO: 851620 - DNA, 25 bp, Mus musculus
ttttgcggccctccggatccgagcg

SEQ ID NO: 851621 - DNA, 25 bp, Mus musculus
ttttgcggccctgcggatccgagcg

SEQ ID NO: 851622 - DNA, 25 bp, Mus musculus
ttttgcggtggtaaccggtttgcag

SEQ ID NO: 851623 - DNA, 25 bp, Mus musculus
ttttgcggtggttaccggtttgcag

SEQ ID NO: 851624 - DNA, 25 bp, Mus musculus
ttttgctagagaccaaggctttgag

SEQ ID NO: 851625 - DNA, 25 bp, Mus musculus
ttttgctagagagcaaggctttgag

SEQ ID NO: 851626 - DNA, 25 bp, Mus musculus
ttttgctgaattcaacactattgtg

SEQ ID NO: 851627 - DNA, 25 bp, Mus musculus
ttttgctgaattgaacactattgtg

SEQ ID NO: 851628 - DNA, 25 bp, Mus musculus
ttttgctgaccgctccaacctgcgt

SEQ ID NO: 851629 - DNA, 25 bp, Mus musculus
ttttgctgaccggtccaacctgcgt

SEQ ID NO: 851630 - DNA, 25 bp, Mus musculus
ttttgctgcatccactttgctggtg

SEQ ID NO: 851631 - DNA, 25 bp, Mus musculus
ttttgctgcatcgactttgctggtg

SEQ ID NO: 851632 - DNA, 25 bp, Mus musculus
ttttgctgggaacacggccaacaaa

SEQ ID NO: 851633 - DNA, 25 bp, Mus musculus
ttttgctgggaagacggccaacaaa

SEQ ID NO: 851634 - DNA, 25 bp, Mus musculus
ttttgctggtgcagggatcataccc

SEQ ID NO: 851635 - DNA, 25 bp, Mus musculus
ttttgctggtgctgggatcataccc

SEQ ID NO: 851636 - DNA, 25 bp, Mus musculus
ttttgcttagtaccgacagtgcccg

SEQ ID NO: 851637 - DNA, 25 bp, Mus musculus
ttttgcttagtagcgacagtgcccg

SEQ ID NO: 851638 - DNA, 25 bp, Mus musculus
ttttgctttctgacaatgcagcatc

SEQ ID NO: 851639 - DNA, 25 bp, Mus musculus
ttttgctttctgtcaatgcagcatc

SEQ ID NO: 851640 - DNA, 25 bp, Mus musculus
ttttggaaatgcaggaaactcccat

SEQ ID NO: 851641 - DNA, 25 bp, Mus musculus
ttttggaaatgccaagactgtgagg

SEQ ID NO: 851642 - DNA, 25 bp, Mus musculus
ttttggaaatgcgaagactgtgagg

SEQ ID NO: 851643 - DNA, 25 bp, Mus musculus
ttttggaaatgctggaaactcccat

SEQ ID NO: 851644 - DNA, 25 bp, Mus musculus
ttttggaaccacctgtccatgtgca

SEQ ID NO: 851645 - DNA, 25 bp, Mus musculus
ttttggaaccacgtgtccatgtgca

SEQ ID NO: 851646 - DNA, 25 bp, Mus musculus
ttttggaagagacaagagtccatct

SEQ ID NO: 851647 - DNA, 25 bp, Mus musculus
ttttggaagagagaagagtccatct

SEQ ID NO: 851648 - DNA, 25 bp, Mus musculus
ttttggaagatgcagtgaggaacca

SEQ ID NO: 851649 - DNA, 25 bp, Mus musculus
ttttggaagatggagtgaggaacca

SEQ ID NO: 851650 - DNA, 25 bp, Mus musculus
ttttggaatactctaaatctgagtg

SEQ ID NO: 851651 - DNA, 25 bp, Mus musculus
ttttggaatactgtaaatctgagtg

SEQ ID NO: 851652 - DNA, 25 bp, Mus musculus
ttttggaatttaccggctgagagat

SEQ ID NO: 851653 - DNA, 25 bp, Mus musculus
ttttggaatttagcggctgagagat

SEQ ID NO: 851654 - DNA, 25 bp, Mus musculus
ttttggacaaagacgtgaagtcgga

SEQ ID NO: 851655 - DNA, 25 bp, Mus musculus
ttttggacaaagtcgtgaagtcgga

SEQ ID NO: 851656 - DNA, 25 bp, Mus musculus
ttttggaccgcaaagccaatgttga

SEQ ID NO: 851657 - DNA, 25 bp, Mus musculus
ttttggaccgcatagccaatgttga

SEQ ID NO: 851658 - DNA, 25 bp, Mus musculus
ttttggacgctcagggtgttcttgg

SEQ ID NO: 851659 - DNA, 25 bp, Mus musculus
ttttggacgctctgggtgttcttgg

SEQ ID NO: 851660 - DNA, 25 bp, Mus musculus
ttttggacggtcaggtcgcaccaag

SEQ ID NO: 851661 - DNA, 25 bp, Mus musculus
ttttggacggtctggtcgcaccaag

SEQ ID NO: 851662 - DNA, 25 bp, Mus musculus
ttttggactgctcaaggcccagcag

SEQ ID NO: 851663 - DNA, 25 bp, Mus musculus
ttttggactgctgaaggcccagcag

SEQ ID NO: 851664 - DNA, 25 bp, Mus musculus
ttttggactggtacggccactggga

SEQ ID NO: 851665 - DNA, 25 bp, Mus musculus
ttttggactggttcggccactggga

SEQ ID NO: 851666 - DNA, 25 bp, Mus musculus
ttttggagcagacaaatggctgagc

SEQ ID NO: 851667 - DNA, 25 bp, Mus musculus
ttttggagcagagaaatggctgagc

SEQ ID NO: 851668 - DNA, 25 bp, Mus musculus
ttttggaggcagactgtcaggagca

SEQ ID NO: 851669 - DNA, 25 bp, Mus musculus
ttttggaggcagtctgtcaggagca

SEQ ID NO: 851670 - DNA, 25 bp, Mus musculus
ttttggagggccagagttcactccc

SEQ ID NO: 851671 - DNA, 25 bp, Mus musculus
ttttggagggcctgagttcactccc

SEQ ID NO: 851672 - DNA, 25 bp, Mus musculus
ttttggaggtgaatacttcagatac

SEQ ID NO: 851673 - DNA, 25 bp, Mus musculus
ttttggaggtgattacttcagatac

SEQ ID NO: 851674 - DNA, 25 bp, Mus musculus
ttttggagttgaaatctgtggtccc

SEQ ID NO: 851675 - DNA, 25 bp, Mus musculus
ttttggagttgatatctgtggtccc

SEQ ID NO: 851676 - DNA, 25 bp, Mus musculus
ttttggatcatacatacaagatgca

SEQ ID NO: 851677 - DNA, 25 bp, Mus musculus
ttttggatcatagatacaagatgca

SEQ ID NO: 851678 - DNA, 25 bp, Mus musculus
ttttggatccatacaagagacaaca

SEQ ID NO: 851679 - DNA, 25 bp, Mus musculus
ttttggatccattcaagagacaaca

SEQ ID NO: 851680 - DNA, 25 bp, Mus musculus
ttttggatgaccactgccccagctc

SEQ ID NO: 851681 - DNA, 25 bp, Mus musculus
ttttggatgacctctgccccagctc

SEQ ID NO: 851682 - DNA, 25 bp, Mus musculus
ttttggatgaggatcgtctggaaga

SEQ ID NO: 851683 - DNA, 25 bp, Mus musculus
ttttggatgaggttcgtctggaaga

SEQ ID NO: 851684 - DNA, 25 bp, Mus musculus
ttttggatgccgcagaccagtacca

SEQ ID NO: 851685 - DNA, 25 bp, Mus musculus
ttttggatgccggagaccagtacca

SEQ ID NO: 851686 - DNA, 25 bp, Mus musculus
ttttggatggatcgcaatagactga

SEQ ID NO: 851687 - DNA, 25 bp, Mus musculus
ttttggatggatggcaatagactga

SEQ ID NO: 851688 - DNA, 25 bp, Mus musculus
ttttggattcggagtgaccatggga

SEQ ID NO: 851689 - DNA, 25 bp, Mus musculus
ttttggattcggtgtgaccatggga

SEQ ID NO: 851690 - DNA, 25 bp, Mus musculus
ttttggcaaaaacctcaccaaggag

SEQ ID NO: 851691 - DNA, 25 bp, Mus musculus
ttttggcaaaaagctcaccaaggag

SEQ ID NO: 851692 - DNA, 25 bp, Mus musculus
ttttggcaacatcttcactcgcctg

SEQ ID NO: 851693 - DNA, 25 bp, Mus musculus
ttttggcaacatgttcactcgcctg

SEQ ID NO: 851694 - DNA, 25 bp, Mus musculus
ttttggcaccgcagcagcccgggcg

SEQ ID NO: 851695 - DNA, 25 bp, Mus musculus
ttttggcaccgctgcagcccgggcg

SEQ ID NO: 851696 - DNA, 25 bp, Mus musculus
ttttggcacgtgactgacttacatc

SEQ ID NO: 851697 - DNA, 25 bp, Mus musculus
ttttggcacgtgtctgacttacatc

SEQ ID NO: 851698 - DNA, 25 bp, Mus musculus
ttttggcagcgtccctaaggactcc

SEQ ID NO: 851699 - DNA, 25 bp, Mus musculus
ttttggcagcgtgcctaaggactcc

SEQ ID NO: 851700 - DNA, 25 bp, Mus musculus
ttttggcagtgtctggaatgcatcc

SEQ ID NO: 851701 - DNA, 25 bp, Mus musculus
ttttggcagtgtgtggaatgcatcc

SEQ ID NO: 851702 - DNA, 25 bp, Mus musculus
ttttggccacttatgactttaagac

SEQ ID NO: 851703 - DNA, 25 bp, Mus musculus
ttttggccacttttgactttaagac

SEQ ID NO: 851704 - DNA, 25 bp, Mus musculus
ttttggccagccaagagcaacagat

SEQ ID NO: 851705 - DNA, 25 bp, Mus musculus
ttttggccagcctagagcaacagat

SEQ ID NO: 851706 - DNA, 25 bp, Mus musculus
ttttggcccaaacactagacttaga

SEQ ID NO: 851707 - DNA, 25 bp, Mus musculus
ttttggcccaaagactagacttaga

SEQ ID NO: 851708 - DNA, 25 bp, Mus musculus
ttttggcccctcacttaattggaga

SEQ ID NO: 851709 - DNA, 25 bp, Mus musculus
ttttggcccctctcttaattggaga

SEQ ID NO: 851710 - DNA, 25 bp, Mus musculus
ttttggccctgccaatctaggagaa

SEQ ID NO: 851711 - DNA, 25 bp, Mus musculus
ttttggccctgcgaatctaggagaa

SEQ ID NO: 851712 - DNA, 25 bp, Mus musculus
ttttggccgcagatggcaaacattg

SEQ ID NO: 851713 - DNA, 25 bp, Mus musculus
ttttggccgcagttggcaaacattg

SEQ ID NO: 851714 - DNA, 25 bp, Mus musculus
ttttggccggtactcttcacaacgg

SEQ ID NO: 851715 - DNA, 25 bp, Mus musculus
ttttggccggtagtcttcacaacgg

SEQ ID NO: 851716 - DNA, 25 bp, Mus musculus
ttttggcctatcagaagcagtggga

SEQ ID NO: 851717 - DNA, 25 bp, Mus musculus
ttttggcctatctgaagcagtggga

SEQ ID NO: 851718 - DNA, 25 bp, Mus musculus
ttttggcggtcgcagcttggctccc

SEQ ID NO: 851719 - DNA, 25 bp, Mus musculus
ttttggcggtcggagcttggctccc

SEQ ID NO: 851720 - DNA, 25 bp, Mus musculus
ttttggcgtgaaccattatgcagga

SEQ ID NO: 851721 - DNA, 25 bp, Mus musculus
ttttggcgtgaactgcaaacactgc

SEQ ID NO: 851722 - DNA, 25 bp, Mus musculus
ttttggcgtgaagcattatgcagga

SEQ ID NO: 851723 - DNA, 25 bp, Mus musculus
ttttggcgtgaagtgcaaacactgc

SEQ ID NO: 851724 - DNA, 25 bp, Mus musculus
ttttggctccaacaagggaattggc

SEQ ID NO: 851725 - DNA, 25 bp, Mus musculus
ttttggctccaagaagggaattggc

SEQ ID NO: 851726 - DNA, 25 bp, Mus musculus
ttttggctgcacaaaggcgagagtc

SEQ ID NO: 851727 - DNA, 25 bp, Mus musculus
ttttggctgcactaaggcgagagtc

SEQ ID NO: 851728 - DNA, 25 bp, Mus musculus
ttttggctggctcacagcctcggtt

SEQ ID NO: 851729 - DNA, 25 bp, Mus musculus
ttttggctggctgacagcctcggtt

SEQ ID NO: 851730 - DNA, 25 bp, Mus musculus
ttttggcttcggagctcgaatcccc

SEQ ID NO: 851731 - DNA, 25 bp, Mus musculus
ttttggcttcggtgctcgaatcccc

SEQ ID NO: 851732 - DNA, 25 bp, Mus musculus
ttttgggaaacacatgaatccagca

SEQ ID NO: 851733 - DNA, 25 bp, Mus musculus
ttttgggaaacagatgaatccagca

SEQ ID NO: 851734 - DNA, 25 bp, Mus musculus
ttttgggaaacgactcacagactgc

SEQ ID NO: 851735 - DNA, 25 bp, Mus musculus
ttttgggaaacgtctcacagactgc

SEQ ID NO: 851736 - DNA, 25 bp, Mus musculus
ttttgggaacccaaatagtgctgtc

SEQ ID NO: 851737 - DNA, 25 bp, Mus musculus
ttttgggaaccctaatagtgctgtc

SEQ ID NO: 851738 - DNA, 25 bp, Mus musculus
ttttgggaacctcatgattcaacaa

SEQ ID NO: 851739 - DNA, 25 bp, Mus musculus
ttttgggaacctgatgattcaacaa

SEQ ID NO: 851740 - DNA, 25 bp, Mus musculus
ttttgggatgggagtagacaaagct

SEQ ID NO: 851741 - DNA, 25 bp, Mus musculus
ttttgggatgggtgtagacaaagct

SEQ ID NO: 851742 - DNA, 25 bp, Mus musculus
ttttgggccatcaaccggaaactca

SEQ ID NO: 851743 - DNA, 25 bp, Mus musculus
ttttgggccatctaccggaaactca

SEQ ID NO: 851744 - DNA, 25 bp, Mus musculus
ttttgggcttctcgtgagcactgga

SEQ ID NO: 851745 - DNA, 25 bp, Mus musculus
ttttgggcttctggtgagcactgga

SEQ ID NO: 851746 - DNA, 25 bp, Mus musculus
ttttgggtctggacttgctacgtgg

SEQ ID NO: 851747 - DNA, 25 bp, Mus musculus
ttttgggtctggtcttgctacgtgg

SEQ ID NO: 851748 - DNA, 25 bp, Mus musculus
ttttgggttcagcagctcgtcagaa

SEQ ID NO: 851749 - DNA, 25 bp, Mus musculus
ttttgggttcaggagctcgtcagaa

SEQ ID NO: 851750 - DNA, 25 bp, Mus musculus
ttttgggtttgcctgcctgggctcc

SEQ ID NO: 851751 - DNA, 25 bp, Mus musculus
ttttgggtttgcgtgcctgggctcc

SEQ ID NO: 851752 - DNA, 25 bp, Mus musculus
ttttggtaccttccatgtggcccac

SEQ ID NO: 851753 - DNA, 25 bp, Mus musculus
ttttggtaccttgcatgtggcccac

SEQ ID NO: 851754 - DNA, 25 bp, Mus musculus
ttttggtccaggagcttaactgcct

SEQ ID NO: 851755 - DNA, 25 bp, Mus musculus
ttttggtccaggtgcttaactgcct

SEQ ID NO: 851756 - DNA, 25 bp, Mus musculus
ttttggtctccaagctcggacccct

SEQ ID NO: 851757 - DNA, 25 bp, Mus musculus
ttttggtctccatgctcggacccct

SEQ ID NO: 851758 - DNA, 25 bp, Mus musculus
ttttggtctctgcatcccgggataa

SEQ ID NO: 851759 - DNA, 25 bp, Mus musculus
ttttggtctctggatcccgggataa

SEQ ID NO: 851760 - DNA, 25 bp, Mus musculus
ttttggtgcacccatcggaggagtt

SEQ ID NO: 851761 - DNA, 25 bp, Mus musculus
ttttggtgcaccgatcggaggagtt

SEQ ID NO: 851762 - DNA, 25 bp, Mus musculus
ttttggtgcatgaattgaaggagtc

SEQ ID NO: 851763 - DNA, 25 bp, Mus musculus
ttttggtgcatgtattgaaggagtc

SEQ ID NO: 851764 - DNA, 25 bp, Mus musculus
ttttggtgctccagtctttcttagc

SEQ ID NO: 851765 - DNA, 25 bp, Mus musculus
ttttggtgctcctgtctttcttagc

SEQ ID NO: 851766 - DNA, 25 bp, Mus musculus
ttttggtgctgaccaggaacttcgt

SEQ ID NO: 851767 - DNA, 25 bp, Mus musculus
ttttggtgctgagcaggaacttcgt

SEQ ID NO: 851768 - DNA, 25 bp, Mus musculus
ttttggtgggccagaactccgaggt

SEQ ID NO: 851769 - DNA, 25 bp, Mus musculus
ttttggtgggcctgaactccgaggt

SEQ ID NO: 851770 - DNA, 25 bp, Mus musculus
ttttgtaaagtacagaagtttcctg

SEQ ID NO: 851771 - DNA, 25 bp, Mus musculus
ttttgtaaagtagagaagtttcctg

SEQ ID NO: 851772 - DNA, 25 bp, Mus musculus
ttttgtaagcatccagcggcaatta

SEQ ID NO: 851773 - DNA, 25 bp, Mus musculus
ttttgtaagcatgcagcggcaatta

SEQ ID NO: 851774 - DNA, 25 bp, Mus musculus
ttttgtacagatcacagccgtcttg

SEQ ID NO: 851775 - DNA, 25 bp, Mus musculus
ttttgtacagatgacagccgtcttg

SEQ ID NO: 851776 - DNA, 25 bp, Mus musculus
ttttgtacatcaccccagagatggc

SEQ ID NO: 851777 - DNA, 25 bp, Mus musculus
ttttgtacatcagcccagagatggc

SEQ ID NO: 851778 - DNA, 25 bp, Mus musculus
ttttgtactgtcactgggccctagg

SEQ ID NO: 851779 - DNA, 25 bp, Mus musculus
ttttgtactgtctctgggccctagg

SEQ ID NO: 851780 - DNA, 25 bp, Mus musculus
ttttgtagatatcggacattctgcc

SEQ ID NO: 851781 - DNA, 25 bp, Mus musculus
ttttgtagatatgggacattctgcc

SEQ ID NO: 851782 - DNA, 25 bp, Mus musculus
ttttgtagttggaggccgagctccg

SEQ ID NO: 851783 - DNA, 25 bp, Mus musculus
ttttgtagttggtggccgagctccg

SEQ ID NO: 851784 - DNA, 25 bp, Mus musculus
ttttgtatctcacaggtcacttttg

SEQ ID NO: 851785 - DNA, 25 bp, Mus musculus
ttttgtatctcagaggtcacttttg

SEQ ID NO: 851786 - DNA, 25 bp, Mus musculus
ttttgtattattctgcctggaagct

SEQ ID NO: 851787 - DNA, 25 bp, Mus musculus
ttttgtattattgtgcctggaagct

SEQ ID NO: 851788 - DNA, 25 bp, Mus musculus
ttttgtcaacggctcccctagtggg

SEQ ID NO: 851789 - DNA, 25 bp, Mus musculus
ttttgtcaacgggtcccctagtggg

SEQ ID NO: 851790 - DNA, 25 bp, Mus musculus
ttttgtcaagagacaggaaggagag

SEQ ID NO: 851791 - DNA, 25 bp, Mus musculus
ttttgtcaagagtcaggaaggagag

SEQ ID NO: 851792 - DNA, 25 bp, Mus musculus
ttttgtccagaaatcgggtcatgca

SEQ ID NO: 851793 - DNA, 25 bp, Mus musculus
ttttgtccagaattcgggtcatgca

SEQ ID NO: 851794 - DNA, 25 bp, Mus musculus
ttttgtccctctattcactgctgcc

SEQ ID NO: 851795 - DNA, 25 bp, Mus musculus
ttttgtccctcttttcactgctgcc

SEQ ID NO: 851796 - DNA, 25 bp, Mus musculus
ttttgtcctgaacgaacagctccca

SEQ ID NO: 851797 - DNA, 25 bp, Mus musculus
ttttgtcctgaaggaacagctccca

SEQ ID NO: 851798 - DNA, 25 bp, Mus musculus
ttttgtcctgcactcaattgcaatg

SEQ ID NO: 851799 - DNA, 25 bp, Mus musculus
ttttgtcctgcagtcaattgcaatg

SEQ ID NO: 851800 - DNA, 25 bp, Mus musculus
ttttgtcgctttccggattctcgag

SEQ ID NO: 851801 - DNA, 25 bp, Mus musculus
ttttgtcgctttgcggattctcgag

SEQ ID NO: 851802 - DNA, 25 bp, Mus musculus
ttttgtctatggatgctacgtggtc

SEQ ID NO: 851803 - DNA, 25 bp, Mus musculus
ttttgtctatggttgctacgtggtc

SEQ ID NO: 851804 - DNA, 25 bp, Mus musculus
ttttgtctcccaaggcagcagtaga

SEQ ID NO: 851805 - DNA, 25 bp, Mus musculus
ttttgtctcccatggcagcagtaga

SEQ ID NO: 851806 - DNA, 25 bp, Mus musculus
ttttgtctctgtcacgtgccccgga

SEQ ID NO: 851807 - DNA, 25 bp, Mus musculus
ttttgtctctgtgacgtgccccgga

SEQ ID NO: 851808 - DNA, 25 bp, Mus musculus
ttttgtgaagctaaagctcctgatg

SEQ ID NO: 851809 - DNA, 25 bp, Mus musculus
ttttgtgaagcttaagctcctgatg

SEQ ID NO: 851810 - DNA, 25 bp, Mus musculus
ttttgtgaatttattggagtcctga

SEQ ID NO: 851811 - DNA, 25 bp, Mus musculus
ttttgtgaattttttggagtcctga

SEQ ID NO: 851812 - DNA, 25 bp, Mus musculus
ttttgtgactttactcttgccctca

SEQ ID NO: 851813 - DNA, 25 bp, Mus musculus
ttttgtgacttttctcttgccctca

SEQ ID NO: 851814 - DNA, 25 bp, Mus musculus
ttttgtgcacccctggagccgcaag

SEQ ID NO: 851815 - DNA, 25 bp, Mus musculus
ttttgtgcacccgtggagccgcaag

SEQ ID NO: 851816 - DNA, 25 bp, Mus musculus
ttttgtggaagcaggtgccatggct

SEQ ID NO: 851817 - DNA, 25 bp, Mus musculus
ttttgtggaagctggtgccatggct

SEQ ID NO: 851818 - DNA, 25 bp, Mus musculus
ttttgtggcaggcataagcaacagg

SEQ ID NO: 851819 - DNA, 25 bp, Mus musculus
ttttgtggcagggataagcaacagg

SEQ ID NO: 851820 - DNA, 25 bp, Mus musculus
ttttgtggccctaactatgcacggc

SEQ ID NO: 851821 - DNA, 25 bp, Mus musculus
ttttgtggcccttactatgcacggc

SEQ ID NO: 851822 - DNA, 25 bp, Mus musculus
ttttgtggcgccatctgaaggtcct

SEQ ID NO: 851823 - DNA, 25 bp, Mus musculus
ttttgtggcgccttctgaaggtcct

SEQ ID NO: 851824 - DNA, 25 bp, Mus musculus
ttttgtgtatccaccttaaaagatt

SEQ ID NO: 851825 - DNA, 25 bp, Mus musculus
ttttgtgtatcctccttaaaagatt

SEQ ID NO: 851826 - DNA, 25 bp, Mus musculus
ttttgtgtcacacaaccagacgtct

SEQ ID NO: 851827 - DNA, 25 bp, Mus musculus
ttttgtgtcacagaaccagacgtct

SEQ ID NO: 851828 - DNA, 25 bp, Mus musculus
ttttgtgtctctacactctggtggg

SEQ ID NO: 851829 - DNA, 25 bp, Mus musculus
ttttgtgtctcttcactctggtggg

SEQ ID NO: 851830 - DNA, 25 bp, Mus musculus
ttttgttaacatcgcctgggaaggc

SEQ ID NO: 851831 - DNA, 25 bp, Mus musculus
ttttgttaacatggcctgggaaggc

SEQ ID NO: 851832 - DNA, 25 bp, Mus musculus
ttttgttaactgcaaggagctgatc

SEQ ID NO: 851833 - DNA, 25 bp, Mus musculus
ttttgttaactggaaggagctgatc

SEQ ID NO: 851834 - DNA, 25 bp, Mus musculus
ttttgttcagccagtgaccagatct

SEQ ID NO: 851835 - DNA, 25 bp, Mus musculus
ttttgttcagcctgtgaccagatct

SEQ ID NO: 851836 - DNA, 25 bp, Mus musculus
ttttgttcatcacctgggacggagg

SEQ ID NO: 851837 - DNA, 25 bp, Mus musculus
ttttgttcatcagctgggacggagg

SEQ ID NO: 851838 - DNA, 25 bp, Mus musculus
ttttgttccaggcaggcgccttgtc

SEQ ID NO: 851839 - DNA, 25 bp, Mus musculus
ttttgttccagggaggcgccttgtc

SEQ ID NO: 851840 - DNA, 25 bp, Mus musculus
ttttgttccgcgaccacaaggcggg

SEQ ID NO: 851841 - DNA, 25 bp, Mus musculus
ttttgttccgcgtccacaaggcggg

SEQ ID NO: 851842 - DNA, 25 bp, Mus musculus
ttttgtttcagtaggacaccgtgca

SEQ ID NO: 851843 - DNA, 25 bp, Mus musculus
ttttgtttcagttggacaccgtgca

SEQ ID NO: 851844 - DNA, 25 bp, Mus musculus
tttttaaacatgcaaatgacagatg

SEQ ID NO: 851845 - DNA, 25 bp, Mus musculus
tttttaaacatggaaatgacagatg

SEQ ID NO: 851846 - DNA, 25 bp, Mus musculus
tttttaaactgacgccacccgagct

SEQ ID NO: 851847 - DNA, 25 bp, Mus musculus
tttttaaactgaggccacccgagct

SEQ ID NO: 851848 - DNA, 25 bp, Mus musculus
tttttaaagaaaccgatggagctgg

SEQ ID NO: 851849 - DNA, 25 bp, Mus musculus
tttttaaagaaagcgatggagctgg

SEQ ID NO: 851850 - DNA, 25 bp, Mus musculus
tttttaaggtatagggtcagctgac

SEQ ID NO: 851851 - DNA, 25 bp, Mus musculus
tttttaaggtattgggtcagctgac

SEQ ID NO: 851852 - DNA, 25 bp, Mus musculus
tttttaatagacctgggagcctcct

SEQ ID NO: 851853 - DNA, 25 bp, Mus musculus
tttttaatagacgtgggagcctcct

SEQ ID NO: 851854 - DNA, 25 bp, Mus musculus
tttttaatgatcagaacaacttcag

SEQ ID NO: 851855 - DNA, 25 bp, Mus musculus
tttttaatgatctgaacaacttcag

SEQ ID NO: 851856 - DNA, 25 bp, Mus musculus
tttttaatgcagctggtccaagtgg

SEQ ID NO: 851857 - DNA, 25 bp, Mus musculus
tttttaatgcaggtggtccaagtgg

SEQ ID NO: 851858 - DNA, 25 bp, Mus musculus
tttttaattccccagccctgcaact

SEQ ID NO: 851859 - DNA, 25 bp, Mus musculus
tttttaattcccgagccctgcaact

SEQ ID NO: 851860 - DNA, 25 bp, Mus musculus
tttttacaaagaagggaaacggctg

SEQ ID NO: 851861 - DNA, 25 bp, Mus musculus
tttttacaaagatgggaaacggctg

SEQ ID NO: 851862 - DNA, 25 bp, Mus musculus
tttttaccaccacggagactattgg

SEQ ID NO: 851863 - DNA, 25 bp, Mus musculus
tttttaccaccagggagactattgg

SEQ ID NO: 851864 - DNA, 25 bp, Mus musculus
tttttacctagaccagtggaccctg

SEQ ID NO: 851865 - DNA, 25 bp, Mus musculus
tttttacctagagcagtggaccctg

SEQ ID NO: 851866 - DNA, 25 bp, Mus musculus
tttttacggtggagatcgagacgcg

SEQ ID NO: 851867 - DNA, 25 bp, Mus musculus
tttttacggtggtgatcgagacgcg

SEQ ID NO: 851868 - DNA, 25 bp, Mus musculus
tttttactaagactatccaagtgag

SEQ ID NO: 851869 - DNA, 25 bp, Mus musculus
tttttactaagagtatccaagtgag

SEQ ID NO: 851870 - DNA, 25 bp, Mus musculus
tttttagccaccaattaatgacagg

SEQ ID NO: 851871 - DNA, 25 bp, Mus musculus
tttttagccacctattaatgacagg

SEQ ID NO: 851872 - DNA, 25 bp, Mus musculus
tttttatacattcccgcgcggaggc

SEQ ID NO: 851873 - DNA, 25 bp, Mus musculus
tttttatacattgccgcgcggaggc

SEQ ID NO: 851874 - DNA, 25 bp, Mus musculus
tttttatcaaaaattggacaccctg

SEQ ID NO: 851875 - DNA, 25 bp, Mus musculus
tttttatcaaaatttggacaccctg

SEQ ID NO: 851876 - DNA, 25 bp, Mus musculus
tttttatgggaactcacttctggag

SEQ ID NO: 851877 - DNA, 25 bp, Mus musculus
tttttatgggaagtcacttctggag

SEQ ID NO: 851878 - DNA, 25 bp, Mus musculus
tttttatgtccacgagtcctgcaca

SEQ ID NO: 851879 - DNA, 25 bp, Mus musculus
tttttatgtccaggagtcctgcaca

SEQ ID NO: 851880 - DNA, 25 bp, Mus musculus
tttttattggcacaattgggtacaa

SEQ ID NO: 851881 - DNA, 25 bp, Mus musculus
tttttattggcagaattgggtacaa

SEQ ID NO: 851882 - DNA, 25 bp, Mus musculus
tttttcacaaaactgtgtcagcctt

SEQ ID NO: 851883 - DNA, 25 bp, Mus musculus
tttttcacaaaagtgtgtcagcctt

SEQ ID NO: 851884 - DNA, 25 bp, Mus musculus
tttttcactgggaacaaaagcaaag

SEQ ID NO: 851885 - DNA, 25 bp, Mus musculus
tttttcactgggtacaaaagcaaag

SEQ ID NO: 851886 - DNA, 25 bp, Mus musculus
tttttcacttgtcgcccaaatgagg

SEQ ID NO: 851887 - DNA, 25 bp, Mus musculus
tttttcacttgtggcccaaatgagg

SEQ ID NO: 851888 - DNA, 25 bp, Mus musculus
tttttcagcgcccacccttgttgta

SEQ ID NO: 851889 - DNA, 25 bp, Mus musculus
tttttcagcgccgacccttgttgta

SEQ ID NO: 851890 - DNA, 25 bp, Mus musculus
tttttcatcgcaagtgatgccaaag

SEQ ID NO: 851891 - DNA, 25 bp, Mus musculus
tttttcatcgcatgtgatgccaaag

SEQ ID NO: 851892 - DNA, 25 bp, Mus musculus
tttttccaaggacatatcaggctgc

SEQ ID NO: 851893 - DNA, 25 bp, Mus musculus
tttttccaaggagatatcaggctgc

SEQ ID NO: 851894 - DNA, 25 bp, Mus musculus
tttttccaaggccatcagctgaaaa

SEQ ID NO: 851895 - DNA, 25 bp, Mus musculus
tttttccaaggcgatcagctgaaaa

SEQ ID NO: 851896 - DNA, 25 bp, Mus musculus
tttttccacccacggactctcggtg

SEQ ID NO: 851897 - DNA, 25 bp, Mus musculus
tttttccacccagggactctcggtg

SEQ ID NO: 851898 - DNA, 25 bp, Mus musculus
tttttccaccctatacttcgtgatg

SEQ ID NO: 851899 - DNA, 25 bp, Mus musculus
tttttccaccctttacttcgtgatg

SEQ ID NO: 851900 - DNA, 25 bp, Mus musculus
tttttccagcatcggtagctatcca

SEQ ID NO: 851901 - DNA, 25 bp, Mus musculus
tttttccagcatgggtagctatcca

SEQ ID NO: 851902 - DNA, 25 bp, Mus musculus
tttttccatttcagagccactcagc

SEQ ID NO: 851903 - DNA, 25 bp, Mus musculus
tttttccatttctgagccactcagc

SEQ ID NO: 851904 - DNA, 25 bp, Mus musculus
tttttccccacacgaacttctgcag

SEQ ID NO: 851905 - DNA, 25 bp, Mus musculus
tttttccccacaggaacttctgcag

SEQ ID NO: 851906 - DNA, 25 bp, Mus musculus
tttttcccgggaattagcacaggca

SEQ ID NO: 851907 - DNA, 25 bp, Mus musculus
tttttcccgggatttagcacaggca

SEQ ID NO: 851908 - DNA, 25 bp, Mus musculus
tttttccctccgcagactggccaat

SEQ ID NO: 851909 - DNA, 25 bp, Mus musculus
tttttccctccggagactggccaat

SEQ ID NO: 851910 - DNA, 25 bp, Mus musculus
tttttccgagtcacggaacagcagc

SEQ ID NO: 851911 - DNA, 25 bp, Mus musculus
tttttccgagtctcggaacagcagc

SEQ ID NO: 851912 - DNA, 25 bp, Mus musculus
tttttccgggagcagatcaccacct

SEQ ID NO: 851913 - DNA, 25 bp, Mus musculus
tttttccgggaggagatcaccacct

SEQ ID NO: 851914 - DNA, 25 bp, Mus musculus
tttttcctaggtagactacagtcag

SEQ ID NO: 851915 - DNA, 25 bp, Mus musculus
tttttcctaggttgactacagtcag

SEQ ID NO: 851916 - DNA, 25 bp, Mus musculus
tttttcctcacgatgtccagaagca

SEQ ID NO: 851917 - DNA, 25 bp, Mus musculus
tttttcctcacgttgtccagaagca

SEQ ID NO: 851918 - DNA, 25 bp, Mus musculus
tttttcctccgcagccatgtcctgg

SEQ ID NO: 851919 - DNA, 25 bp, Mus musculus
tttttcctccgctgccatgtcctgg

SEQ ID NO: 851920 - DNA, 25 bp, Mus musculus
tttttcctggaactgacactggctg

SEQ ID NO: 851921 - DNA, 25 bp, Mus musculus
tttttcctggaagtgacactggctg

SEQ ID NO: 851922 - DNA, 25 bp, Mus musculus
tttttcctggctcacaaagacgagg

SEQ ID NO: 851923 - DNA, 25 bp, Mus musculus
tttttcctggctgacaaagacgagg

SEQ ID NO: 851924 - DNA, 25 bp, Mus musculus
tttttcctgtgcaccgagtaggtgg

SEQ ID NO: 851925 - DNA, 25 bp, Mus musculus
tttttcctgtgctccgagtaggtgg

SEQ ID NO: 851926 - DNA, 25 bp, Mus musculus
tttttcgtcgacctggaaggctgta

SEQ ID NO: 851927 - DNA, 25 bp, Mus musculus
tttttcgtcgacgtggaaggctgta

SEQ ID NO: 851928 - DNA, 25 bp, Mus musculus
tttttctaccatcgcagcccaaggc

SEQ ID NO: 851929 - DNA, 25 bp, Mus musculus
tttttctaccatggcagcccaaggc

SEQ ID NO: 851930 - DNA, 25 bp, Mus musculus
tttttctcagccagccgcctatggc

SEQ ID NO: 851931 - DNA, 25 bp, Mus musculus
tttttctcagcctgccgcctatggc

SEQ ID NO: 851932 - DNA, 25 bp, Mus musculus
tttttctccagccatcaaacaatga

SEQ ID NO: 851933 - DNA, 25 bp, Mus musculus
tttttctccagcgatcaaacaatga

SEQ ID NO: 851934 - DNA, 25 bp, Mus musculus
tttttctctacacagctgggtcgac

SEQ ID NO: 851935 - DNA, 25 bp, Mus musculus
tttttctctacagagctgggtcgac

SEQ ID NO: 851936 - DNA, 25 bp, Mus musculus
tttttctgaagccacagcctccact

SEQ ID NO: 851937 - DNA, 25 bp, Mus musculus
tttttctgaagcgacagcctccact

SEQ ID NO: 851938 - DNA, 25 bp, Mus musculus
tttttctgcgctacggagtggaggc

SEQ ID NO: 851939 - DNA, 25 bp, Mus musculus
tttttctgcgcttcggagtggaggc

SEQ ID NO: 851940 - DNA, 25 bp, Mus musculus
tttttctggcaacccagcaacaatc

SEQ ID NO: 851941 - DNA, 25 bp, Mus musculus
tttttctggcaagccagcaacaatc

SEQ ID NO: 851942 - DNA, 25 bp, Mus musculus
tttttctggctgctaagactgttga

SEQ ID NO: 851943 - DNA, 25 bp, Mus musculus
tttttctggctggtaagactgttga

SEQ ID NO: 851944 - DNA, 25 bp, Mus musculus
tttttcttacaaagtttgcaacgtt

SEQ ID NO: 851945 - DNA, 25 bp, Mus musculus
tttttcttacaatgtttgcaacgtt

SEQ ID NO: 851946 - DNA, 25 bp, Mus musculus
tttttcttacagctgaagcaagatg

SEQ ID NO: 851947 - DNA, 25 bp, Mus musculus
tttttcttacaggtgaagcaagatg

SEQ ID NO: 851948 - DNA, 25 bp, Mus musculus
tttttcttatgcagcttgtttccgg

SEQ ID NO: 851949 - DNA, 25 bp, Mus musculus
tttttcttatgctgcttgtttccgg

SEQ ID NO: 851950 - DNA, 25 bp, Mus musculus
tttttcttattgcagcgcctgagtc

SEQ ID NO: 851951 - DNA, 25 bp, Mus musculus
tttttcttattggagcgcctgagtc

SEQ ID NO: 851952 - DNA, 25 bp, Mus musculus
tttttcttccctaagatgatgttgg

SEQ ID NO: 851953 - DNA, 25 bp, Mus musculus
tttttcttcccttagatgatgttgg

SEQ ID NO: 851954 - DNA, 25 bp, Mus musculus
tttttcttggagctcatcataggcc

SEQ ID NO: 851955 - DNA, 25 bp, Mus musculus
tttttcttggaggtcatcataggcc

SEQ ID NO: 851956 - DNA, 25 bp, Mus musculus
tttttcttgtctcacctctaggtgg

SEQ ID NO: 851957 - DNA, 25 bp, Mus musculus
tttttcttgtctgacctctaggtgg

SEQ ID NO: 851958 - DNA, 25 bp, Mus musculus
tttttctttcggagctgtgtacgcc

SEQ ID NO: 851959 - DNA, 25 bp, Mus musculus
tttttctttcggtgctgtgtacgcc

SEQ ID NO: 851960 - DNA, 25 bp, Mus musculus
tttttctttgtgaccctgctggtgt

SEQ ID NO: 851961 - DNA, 25 bp, Mus musculus
tttttctttgtgtccctgctggtgt

SEQ ID NO: 851962 - DNA, 25 bp, Mus musculus
tttttgaaaaatacagtgatcctgc

SEQ ID NO: 851963 - DNA, 25 bp, Mus musculus
tttttgaaaaattcagtgatcctgc

SEQ ID NO: 851964 - DNA, 25 bp, Mus musculus
tttttgaaaactccggtggaggaag

SEQ ID NO: 851965 - DNA, 25 bp, Mus musculus
tttttgaaaactgcggtggaggaag

SEQ ID NO: 851966 - DNA, 25 bp, Mus musculus
tttttgaactggagcaggacatgca

SEQ ID NO: 851967 - DNA, 25 bp, Mus musculus
tttttgaactggtgcaggacatgca

SEQ ID NO: 851968 - DNA, 25 bp, Mus musculus
tttttgaacttactggaggcttgga

SEQ ID NO: 851969 - DNA, 25 bp, Mus musculus
tttttgaacttagtggaggcttgga

SEQ ID NO: 851970 - DNA, 25 bp, Mus musculus
tttttgaagctccaagcaaaactgc

SEQ ID NO: 851971 - DNA, 25 bp, Mus musculus
tttttgaagctcgaagcaaaactgc

SEQ ID NO: 851972 - DNA, 25 bp, Mus musculus
tttttgaagtcaaccctgggtacgg

SEQ ID NO: 851973 - DNA, 25 bp, Mus musculus
tttttgaagtcatccctgggtacgg

SEQ ID NO: 851974 - DNA, 25 bp, Mus musculus
tttttgaagtggctgatacacatct

SEQ ID NO: 851975 - DNA, 25 bp, Mus musculus
tttttgaagtgggtgatacacatct

SEQ ID NO: 851976 - DNA, 25 bp, Mus musculus
tttttgaatgggaggcattgatcat

SEQ ID NO: 851977 - DNA, 25 bp, Mus musculus
tttttgaatgggtggcattgatcat

SEQ ID NO: 851978 - DNA, 25 bp, Mus musculus
tttttgacacttaaccaccaatgcg

SEQ ID NO: 851979 - DNA, 25 bp, Mus musculus
tttttgacactttaccaccaatgcg

SEQ ID NO: 851980 - DNA, 25 bp, Mus musculus
tttttgacagatatatgttgacaca

SEQ ID NO: 851981 - DNA, 25 bp, Mus musculus
tttttgacagatttatgttgacaca

SEQ ID NO: 851982 - DNA, 25 bp, Mus musculus
tttttgacatcaaccgcctgggcca

SEQ ID NO: 851983 - DNA, 25 bp, Mus musculus
tttttgacatcatccgcctgggcca

SEQ ID NO: 851984 - DNA, 25 bp, Mus musculus
tttttgaccgagactacacccacca

SEQ ID NO: 851985 - DNA, 25 bp, Mus musculus
tttttgaccgagtctacacccacca

SEQ ID NO: 851986 - DNA, 25 bp, Mus musculus
tttttgagataaagcccagttacgc

SEQ ID NO: 851987 - DNA, 25 bp, Mus musculus
tttttgagataatgcccagttacgc

SEQ ID NO: 851988 - DNA, 25 bp, Mus musculus
tttttgagctacatctgcccagtga

SEQ ID NO: 851989 - DNA, 25 bp, Mus musculus
tttttgagctacttctgcccagtga

SEQ ID NO: 851990 - DNA, 25 bp, Mus musculus
tttttgaggatcagcccggagtccc

SEQ ID NO: 851991 - DNA, 25 bp, Mus musculus
tttttgaggatctgcccggagtccc

SEQ ID NO: 851992 - DNA, 25 bp, Mus musculus
tttttgcaaagaagagcgcccgtcc

SEQ ID NO: 851993 - DNA, 25 bp, Mus musculus
tttttgcaaagatgagcgcccgtcc

SEQ ID NO: 851994 - DNA, 25 bp, Mus musculus
tttttgcaagaaacctgcgtgctcc

SEQ ID NO: 851995 - DNA, 25 bp, Mus musculus
tttttgcaagaatcctgcgtgctcc

SEQ ID NO: 851996 - DNA, 25 bp, Mus musculus
tttttgcccgagacaacacagccaa

SEQ ID NO: 851997 - DNA, 25 bp, Mus musculus
tttttgcccgagtcaacacagccaa

SEQ ID NO: 851998 - DNA, 25 bp, Mus musculus
tttttgcccgttcgccggctaggca

SEQ ID NO: 851999 - DNA, 25 bp, Mus musculus
tttttgcccgttggccggctaggca

SEQ ID NO: 852000 - DNA, 25 bp, Mus musculus
tttttgccctccaccttgtgtgtat

SEQ ID NO: 852001 - DNA, 25 bp, Mus musculus
tttttgccctcctccttgtgtgtat

SEQ ID NO: 852002 - DNA, 25 bp, Mus musculus
tttttgcgatccagagaacaaccaa

SEQ ID NO: 852003 - DNA, 25 bp, Mus musculus
tttttgcgatcctgagaacaaccaa

SEQ ID NO: 852004 - DNA, 25 bp, Mus musculus
tttttgctcattcgcgtggctgcct

SEQ ID NO: 852005 - DNA, 25 bp, Mus musculus
tttttgctcattggcgtggctgcct

SEQ ID NO: 852006 - DNA, 25 bp, Mus musculus
tttttggaacaacccgtgtcatatc

SEQ ID NO: 852007 - DNA, 25 bp, Mus musculus
tttttggaacaagccgtgtcatatc

SEQ ID NO: 852008 - DNA, 25 bp, Mus musculus
tttttggacactctacccatctttg

SEQ ID NO: 852009 - DNA, 25 bp, Mus musculus
tttttggacactgtacccatctttg

SEQ ID NO: 852010 - DNA, 25 bp, Mus musculus
tttttggaccaacacgatgacgatg

SEQ ID NO: 852011 - DNA, 25 bp, Mus musculus
tttttggaccaagacgatgacgatg

SEQ ID NO: 852012 - DNA, 25 bp, Mus musculus
tttttggaggcactctgtcaggagc

SEQ ID NO: 852013 - DNA, 25 bp, Mus musculus
tttttggaggcagtctgtcaggagc

SEQ ID NO: 852014 - DNA, 25 bp, Mus musculus
tttttggatgagcatcgtctggaag

SEQ ID NO: 852015 - DNA, 25 bp, Mus musculus
tttttggatgaggatcgtctggaag

SEQ ID NO: 852016 - DNA, 25 bp, Mus musculus
tttttggcatacataaagtacagca

SEQ ID NO: 852017 - DNA, 25 bp, Mus musculus
tttttggcatacttaaagtacagca

SEQ ID NO: 852018 - DNA, 25 bp, Mus musculus
tttttggcgtccctgtgctccgtgc

SEQ ID NO: 852019 - DNA, 25 bp, Mus musculus
tttttggcgtccgtgtgctccgtgc

SEQ ID NO: 852020 - DNA, 25 bp, Mus musculus
tttttggcttcaaactcagttatag

SEQ ID NO: 852021 - DNA, 25 bp, Mus musculus
tttttggcttcatactcagttatag

SEQ ID NO: 852022 - DNA, 25 bp, Mus musculus
tttttgggaccactgaaaggcagtg

SEQ ID NO: 852023 - DNA, 25 bp, Mus musculus
tttttgggaccagtgaaaggcagtg

SEQ ID NO: 852024 - DNA, 25 bp, Mus musculus
tttttgggccatccacagatgtttg

SEQ ID NO: 852025 - DNA, 25 bp, Mus musculus
tttttgggccatgcacagatgtttg

SEQ ID NO: 852026 - DNA, 25 bp, Mus musculus
tttttgggtgttctagtctgcgtgt

SEQ ID NO: 852027 - DNA, 25 bp, Mus musculus
tttttgggtgttgtagtctgcgtgt

SEQ ID NO: 852028 - DNA, 25 bp, Mus musculus
tttttgggttcaccagctcgtcaga

SEQ ID NO: 852029 - DNA, 25 bp, Mus musculus
tttttgggttcagcagctcgtcaga

SEQ ID NO: 852030 - DNA, 25 bp, Mus musculus
tttttggtcaatagtctgaagctgg

SEQ ID NO: 852031 - DNA, 25 bp, Mus musculus
tttttggtcaattgtctgaagctgg

SEQ ID NO: 852032 - DNA, 25 bp, Mus musculus
tttttgtacccaaataaagtctctg

SEQ ID NO: 852033 - DNA, 25 bp, Mus musculus
tttttgtacccatataaagtctctg

SEQ ID NO: 852034 - DNA, 25 bp, Mus musculus
tttttgtacggtccttcgaggagct

SEQ ID NO: 852035 - DNA, 25 bp, Mus musculus
tttttgtacggtgcttcgaggagct

SEQ ID NO: 852036 - DNA, 25 bp, Mus musculus
tttttgtagaaaacctgtatagaag

SEQ ID NO: 852037 - DNA, 25 bp, Mus musculus
tttttgtagaaaccacccacaaggg

SEQ ID NO: 852038 - DNA, 25 bp, Mus musculus
tttttgtagaaagcacccacaaggg

SEQ ID NO: 852039 - DNA, 25 bp, Mus musculus
tttttgtagaaatcctgtatagaag

SEQ ID NO: 852040 - DNA, 25 bp, Mus musculus
tttttgtcctaaacatgccgggcca

SEQ ID NO: 852041 - DNA, 25 bp, Mus musculus
tttttgtcctaatcatgccgggcca

SEQ ID NO: 852042 - DNA, 25 bp, Mus musculus
tttttgtcggacacaacctgctgct

SEQ ID NO: 852043 - DNA, 25 bp, Mus musculus
tttttgtcggactcaacctgctgct

SEQ ID NO: 852044 - DNA, 25 bp, Mus musculus
tttttgtgaagccaaccatggatat

SEQ ID NO: 852045 - DNA, 25 bp, Mus musculus
tttttgtgaagcgaaccatggatat

SEQ ID NO: 852046 - DNA, 25 bp, Mus musculus
tttttgtggctaagaggacatcatc

SEQ ID NO: 852047 - DNA, 25 bp, Mus musculus
tttttgtggctatgaggacatcatc

SEQ ID NO: 852048 - DNA, 25 bp, Mus musculus
tttttgttgctgcagcccagtgagc

SEQ ID NO: 852049 - DNA, 25 bp, Mus musculus
tttttgttgctggagcccagtgagc

SEQ ID NO: 852050 - DNA, 25 bp, Mus musculus
tttttgttggcactgatgataagaa

SEQ ID NO: 852051 - DNA, 25 bp, Mus musculus
tttttgttggcagtgatgataagaa

SEQ ID NO: 852052 - DNA, 25 bp, Mus musculus
ttttttaaattcaggtcatggatgc

SEQ ID NO: 852053 - DNA, 25 bp, Mus musculus
ttttttaaattctggtcatggatgc

SEQ ID NO: 852054 - DNA, 25 bp, Mus musculus
ttttttactgcaaggcctgtcatga

SEQ ID NO: 852055 - DNA, 25 bp, Mus musculus
ttttttactgcatggcctgtcatga

SEQ ID NO: 852056 - DNA, 25 bp, Mus musculus
ttttttattcttaccacagctgtga

SEQ ID NO: 852057 - DNA, 25 bp, Mus musculus
ttttttattctttccacagctgtga

SEQ ID NO: 852058 - DNA, 25 bp, Mus musculus
ttttttcaaggacaaatgtgttgca

SEQ ID NO: 852059 - DNA, 25 bp, Mus musculus
ttttttcaaggagaaatgtgttgca

SEQ ID NO: 852060 - DNA, 25 bp, Mus musculus
ttttttcatctgcagaccagcagac

SEQ ID NO: 852061 - DNA, 25 bp, Mus musculus
ttttttcatctggagaccagcagac

SEQ ID NO: 852062 - DNA, 25 bp, Mus musculus
ttttttccaatcagggttacctcag

SEQ ID NO: 852063 - DNA, 25 bp, Mus musculus
ttttttccaatctgggttacctcag

SEQ ID NO: 852064 - DNA, 25 bp, Mus musculus
ttttttccatttcagagccactcag

SEQ ID NO: 852065 - DNA, 25 bp, Mus musculus
ttttttccatttgagagccactcag

SEQ ID NO: 852066 - DNA, 25 bp, Mus musculus
ttttttccctagacagagcagccag

SEQ ID NO: 852067 - DNA, 25 bp, Mus musculus
ttttttccctagtcagagcagccag

SEQ ID NO: 852068 - DNA, 25 bp, Mus musculus
ttttttctatcaccggctggtggag

SEQ ID NO: 852069 - DNA, 25 bp, Mus musculus
ttttttctatcagcggctggtggag

SEQ ID NO: 852070 - DNA, 25 bp, Mus musculus
ttttttctggcccagttgcaaaggg

SEQ ID NO: 852071 - DNA, 25 bp, Mus musculus
ttttttctggccgagttgcaaaggg

SEQ ID NO: 852072 - DNA, 25 bp, Mus musculus
ttttttctgttcagtgcataggcac

SEQ ID NO: 852073 - DNA, 25 bp, Mus musculus
ttttttctgttctgtgcataggcac

SEQ ID NO: 852074 - DNA, 25 bp, Mus musculus
ttttttgacagcaccaggtcagtgg

SEQ ID NO: 852075 - DNA, 25 bp, Mus musculus
ttttttgacagctccaggtcagtgg

SEQ ID NO: 852076 - DNA, 25 bp, Mus musculus
ttttttgagacaataaagctgctgc

SEQ ID NO: 852077 - DNA, 25 bp, Mus musculus
ttttttgagacattaaagctgctgc

SEQ ID NO: 852078 - DNA, 25 bp, Mus musculus
ttttttgagatacatggagccctgg

SEQ ID NO: 852079 - DNA, 25 bp, Mus musculus
ttttttgagatagatggagccctgg

SEQ ID NO: 852080 - DNA, 25 bp, Mus musculus
ttttttgcaagccacagacactgag

SEQ ID NO: 852081 - DNA, 25 bp, Mus musculus
ttttttgcaagcgacagacactgag

SEQ ID NO: 852082 - DNA, 25 bp, Mus musculus
ttttttgcctacagctgggctgtca

SEQ ID NO: 852083 - DNA, 25 bp, Mus musculus
ttttttgcctactgctgggctgtca

SEQ ID NO: 852084 - DNA, 25 bp, Mus musculus
ttttttggaaacctggccgtcatgg

SEQ ID NO: 852085 - DNA, 25 bp, Mus musculus
ttttttggaaacgtggccgtcatgg

SEQ ID NO: 852086 - DNA, 25 bp, Mus musculus
ttttttggagttcctcctggcacct

SEQ ID NO: 852087 - DNA, 25 bp, Mus musculus
ttttttggagttgctcctggcacct

SEQ ID NO: 852088 - DNA, 25 bp, Mus musculus
ttttttggctatcaaaggtgcagat

SEQ ID NO: 852089 - DNA, 25 bp, Mus musculus
ttttttggctatgaaaggtgcagat

SEQ ID NO: 852090 - DNA, 25 bp, Mus musculus
ttttttggttacctcagcttcactg

SEQ ID NO: 852091 - DNA, 25 bp, Mus musculus
ttttttggttacgtcagcttcactg

SEQ ID NO: 852092 - DNA, 25 bp, Mus musculus
ttttttgtacccagtaaccactcag

SEQ ID NO: 852093 - DNA, 25 bp, Mus musculus
ttttttgtaccctgtaaccactcag

SEQ ID NO: 852094 - DNA, 25 bp, Mus musculus
ttttttgtctccacacatgatcggg

SEQ ID NO: 852095 - DNA, 25 bp, Mus musculus
ttttttgtctcctcacatgatcggg

SEQ ID NO: 852096 - DNA, 25 bp, Mus musculus
aaaaaaatcgatgataccatcttcc

SEQ ID NO: 852097 - DNA, 25 bp, Mus musculus
aaaaaaatcgttgataccatcttcc

SEQ ID NO: 852098 - DNA, 25 bp, Mus musculus
aaaaaacgatggcactgtgaatggg

SEQ ID NO: 852099 - DNA, 25 bp, Mus musculus
aaaaaacgatggcagtgtgaatggg

SEQ ID NO: 852100 - DNA, 25 bp, Mus musculus
aaaaaagaatagatgtgccaactgc

SEQ ID NO: 852101 - DNA, 25 bp, Mus musculus
aaaaaagaatagttgtgccaactgc

SEQ ID NO: 852102 - DNA, 25 bp, Mus musculus
aaaaaagatccgagagtgtgtgatc

SEQ ID NO: 852103 - DNA, 25 bp, Mus musculus
aaaaaagatccgagtgtgtgtgatc

SEQ ID NO: 852104 - DNA, 25 bp, Mus musculus
aaaaaagatctacaccgccctgatg

SEQ ID NO: 852105 - DNA, 25 bp, Mus musculus
aaaaaagatctacagcgccctgatg

SEQ ID NO: 852106 - DNA, 25 bp, Mus musculus
aaaaaagcagtgctttgtattgagg

SEQ ID NO: 852107 - DNA, 25 bp, Mus musculus
aaaaaagcagtggtttgtattgagg

SEQ ID NO: 852108 - DNA, 25 bp, Mus musculus
aaaaaatgagaactggctcattacc

SEQ ID NO: 852109 - DNA, 25 bp, Mus musculus
aaaaaatgagtactggctcattacc

SEQ ID NO: 852110 - DNA, 25 bp, Mus musculus
aaaaaatggtgacgccatcttctga

SEQ ID NO: 852111 - DNA, 25 bp, Mus musculus
aaaaaatggtgaggccatcttctga

SEQ ID NO: 852112 - DNA, 25 bp, Mus musculus
aaaaaattattacatggaccatcaa

SEQ ID NO: 852113 - DNA, 25 bp, Mus musculus
aaaaaattattagatggaccatcaa

SEQ ID NO: 852114 - DNA, 25 bp, Mus musculus
aaaaacaatgcgttgatcagagctc

SEQ ID NO: 852115 - DNA, 25 bp, Mus musculus
aaaaacaatgggttgatcagagctc

SEQ ID NO: 852116 - DNA, 25 bp, Mus musculus
aaaaacacagttatctatgcaattg

SEQ ID NO: 852117 - DNA, 25 bp, Mus musculus
aaaaacacagttatgtatgcaattg

SEQ ID NO: 852118 - DNA, 25 bp, Mus musculus
aaaaacagacagccactcctaggag

SEQ ID NO: 852119 - DNA, 25 bp, Mus musculus
aaaaacagacaggcactcctaggag

SEQ ID NO: 852120 - DNA, 25 bp, Mus musculus
aaaaacagcacacgatgtcaaaaaa

SEQ ID NO: 852121 - DNA, 25 bp, Mus musculus
aaaaacagcacaggatgtcaaaaaa

SEQ ID NO: 852122 - DNA, 25 bp, Mus musculus
aaaaacatcatgcttctcccaagac

SEQ ID NO: 852123 - DNA, 25 bp, Mus musculus
aaaaacatcatggttctcccaagac

SEQ ID NO: 852124 - DNA, 25 bp, Mus musculus
aaaaaccagaagaatctaatcaaat

SEQ ID NO: 852125 - DNA, 25 bp, Mus musculus
aaaaaccagaagtatctaatcaaat

SEQ ID NO: 852126 - DNA, 25 bp, Mus musculus
aaaaacccaaagccagctcctgttg

SEQ ID NO: 852127 - DNA, 25 bp, Mus musculus
aaaaacccaacgtgatgctgacagg

SEQ ID NO: 852128 - DNA, 25 bp, Mus musculus
aaaaacccaaggtgatgctgacagg

SEQ ID NO: 852129 - DNA, 25 bp, Mus musculus
aaaaacccaatgccagctcctgttg

SEQ ID NO: 852130 - DNA, 25 bp, Mus musculus
aaaaaccgcacgcccttcaacactg

SEQ ID NO: 852131 - DNA, 25 bp, Mus musculus
aaaaaccgcacggccttcaacactg

SEQ ID NO: 852132 - DNA, 25 bp, Mus musculus
aaaaactacctggaagcccagtact

SEQ ID NO: 852133 - DNA, 25 bp, Mus musculus
aaaaactacctggatgcccagtact

SEQ ID NO: 852134 - DNA, 25 bp, Mus musculus
aaaaactcaacatgtggagtacatg

SEQ ID NO: 852135 - DNA, 25 bp, Mus musculus
aaaaactcaagatgtggagtacatg

SEQ ID NO: 852136 - DNA, 25 bp, Mus musculus
aaaaactgcaagatgatgatcatgc

SEQ ID NO: 852137 - DNA, 25 bp, Mus musculus
aaaaactgcaagttgatgatcatgc

SEQ ID NO: 852138 - DNA, 25 bp, Mus musculus
aaaaactggaatcacgtggtagatg

SEQ ID NO: 852139 - DNA, 25 bp, Mus musculus
aaaaactggaatcaggtggtagatg

SEQ ID NO: 852140 - DNA, 25 bp, Mus musculus
aaaaactgtaccccgatttgcataa

SEQ ID NO: 852141 - DNA, 25 bp, Mus musculus
aaaaactgtaccgcgatttgcataa

SEQ ID NO: 852142 - DNA, 25 bp, Mus musculus
aaaaagaaagatcattactccttgc

SEQ ID NO: 852143 - DNA, 25 bp, Mus musculus
aaaaagaaagttcattactccttgc

SEQ ID NO: 852144 - DNA, 25 bp, Mus musculus
aaaaagaatgcgcctggcgcattgg

SEQ ID NO: 852145 - DNA, 25 bp, Mus musculus
aaaaagaatgcggctggcgcattgg

SEQ ID NO: 852146 - DNA, 25 bp, Mus musculus
aaaaagacgaagctttagaagatga

SEQ ID NO: 852147 - DNA, 25 bp, Mus musculus
aaaaagacgaaggtttagaagatga

SEQ ID NO: 852148 - DNA, 25 bp, Mus musculus
aaaaagactgtgtgcaagtgaaggg

SEQ ID NO: 852149 - DNA, 25 bp, Mus musculus
aaaaagactgtgtggaagtgaaggg

SEQ ID NO: 852150 - DNA, 25 bp, Mus musculus
aaaaagagggagctgctgtcagccg

SEQ ID NO: 852151 - DNA, 25 bp, Mus musculus
aaaaagagggaggtgctgtcagccg

SEQ ID NO: 852152 - DNA, 25 bp, Mus musculus
aaaaagatacttccaatcacttcca

SEQ ID NO: 852153 - DNA, 25 bp, Mus musculus
aaaaagatacttcctatcacttcca

SEQ ID NO: 852154 - DNA, 25 bp, Mus musculus
aaaaagatgtcaaatcctagaagag

SEQ ID NO: 852155 - DNA, 25 bp, Mus musculus
aaaaagatgtgaaatcctagaagag

SEQ ID NO: 852156 - DNA, 25 bp, Mus musculus
aaaaagcacaacccaagaggcactc

SEQ ID NO: 852157 - DNA, 25 bp, Mus musculus
aaaaagcacatcccaagaggcactc

SEQ ID NO: 852158 - DNA, 25 bp, Mus musculus
aaaaagcagaatcccgtgatgagag

SEQ ID NO: 852159 - DNA, 25 bp, Mus musculus
aaaaagcagaatgccgtgatgagag

SEQ ID NO: 852160 - DNA, 25 bp, Mus musculus
aaaaagccagcaccaagtgatctct

SEQ ID NO: 852161 - DNA, 25 bp, Mus musculus
aaaaagccagccctctgatcctgga

SEQ ID NO: 852162 - DNA, 25 bp, Mus musculus
aaaaagccagcgatggctgtgtgag

SEQ ID NO: 852163 - DNA, 25 bp, Mus musculus
aaaaagccaggaccaagtgatctct

SEQ ID NO: 852164 - DNA, 25 bp, Mus musculus
aaaaagccaggcctctgatcctgga

SEQ ID NO: 852165 - DNA, 25 bp, Mus musculus
aaaaagccagggatggctgtgtgag

SEQ ID NO: 852166 - DNA, 25 bp, Mus musculus
aaaaagccatagactaagatcgtct

SEQ ID NO: 852167 - DNA, 25 bp, Mus musculus
aaaaagccattgactaagatcgtct

SEQ ID NO: 852168 - DNA, 25 bp, Mus musculus
aaaaagctcgccacccccatcagtc

SEQ ID NO: 852169 - DNA, 25 bp, Mus musculus
aaaaagctcggcacccccatcagtc

SEQ ID NO: 852170 - DNA, 25 bp, Mus musculus
aaaaagcttgcacaatctttatctt

SEQ ID NO: 852171 - DNA, 25 bp, Mus musculus
aaaaagcttgcagaatctttatctt

SEQ ID NO: 852172 - DNA, 25 bp, Mus musculus
aaaaaggaagctcatcgtggagaag

SEQ ID NO: 852173 - DNA, 25 bp, Mus musculus
aaaaaggaaggtcatcgtggagaag

SEQ ID NO: 852174 - DNA, 25 bp, Mus musculus
aaaaaggagagcctctgtgctgata

SEQ ID NO: 852175 - DNA, 25 bp, Mus musculus
aaaaaggagagcctgtgtgctgata

SEQ ID NO: 852176 - DNA, 25 bp, Mus musculus
aaaaaggcagaaaacgctacagaag

SEQ ID NO: 852177 - DNA, 25 bp, Mus musculus
aaaaaggcagaaaaggctacagaag

SEQ ID NO: 852178 - DNA, 25 bp, Mus musculus
aaaaaggccacagaagctgaagctg

SEQ ID NO: 852179 - DNA, 25 bp, Mus musculus
aaaaaggccacagatgctgaagctg

SEQ ID NO: 852180 - DNA, 25 bp, Mus musculus
aaaaaggttcagctgttcttagcag

SEQ ID NO: 852181 - DNA, 25 bp, Mus musculus
aaaaaggttcaggtgttcttagcag

SEQ ID NO: 852182 - DNA, 25 bp, Mus musculus
aaaaaggttgaagacgatgaagctg

SEQ ID NO: 852183 - DNA, 25 bp, Mus musculus
aaaaaggttgaagaggatgaagctg

SEQ ID NO: 852184 - DNA, 25 bp, Mus musculus
aaaaagtggaagcacgaacagggct

SEQ ID NO: 852185 - DNA, 25 bp, Mus musculus
aaaaagtggaaggacgaacagggct

SEQ ID NO: 852186 - DNA, 25 bp, Mus musculus
aaaaagtgtgcacgtttcaactctg

SEQ ID NO: 852187 - DNA, 25 bp, Mus musculus
aaaaagtgtgcaggtttcaactctg

SEQ ID NO: 852188 - DNA, 25 bp, Mus musculus
aaaaagttagaaaacagtatgctgt

SEQ ID NO: 852189 - DNA, 25 bp, Mus musculus
aaaaagttagaaaaccatccgcaga

SEQ ID NO: 852190 - DNA, 25 bp, Mus musculus
aaaaagttagaaaacgcatctgtgg

SEQ ID NO: 852191 - DNA, 25 bp, Mus musculus
aaaaagttagaaaagagtatgctgt

SEQ ID NO: 852192 - DNA, 25 bp, Mus musculus
aaaaagttagaaaagcatccgcaga

SEQ ID NO: 852193 - DNA, 25 bp, Mus musculus
aaaaagttagaaaaggcatctgtgg

SEQ ID NO: 852194 - DNA, 25 bp, Mus musculus
aaaaagtttgccttagagcacggca

SEQ ID NO: 852195 - DNA, 25 bp, Mus musculus
aaaaagtttgcctttgagcacggca

SEQ ID NO: 852196 - DNA, 25 bp, Mus musculus
aaaaatatatctccgagaacattct

SEQ ID NO: 852197 - DNA, 25 bp, Mus musculus
aaaaatatatctgcgagaacattct

SEQ ID NO: 852198 - DNA, 25 bp, Mus musculus
aaaaatcagcccccgactctcagta

SEQ ID NO: 852199 - DNA, 25 bp, Mus musculus
aaaaatcagcgcccgactctcagta

SEQ ID NO: 852200 - DNA, 25 bp, Mus musculus
aaaaatccgtgacgtatcatcacta

SEQ ID NO: 852201 - DNA, 25 bp, Mus musculus
aaaaatccgtgaggtatcatcacta

SEQ ID NO: 852202 - DNA, 25 bp, Mus musculus
aaaaatctcaaacgtggattacagg

SEQ ID NO: 852203 - DNA, 25 bp, Mus musculus
aaaaatctcaaaggtggattacagg

SEQ ID NO: 852204 - DNA, 25 bp, Mus musculus
aaaaatgaaaatctggatagacacg

SEQ ID NO: 852205 - DNA, 25 bp, Mus musculus
aaaaatgaaaatgtggatagacacg

SEQ ID NO: 852206 - DNA, 25 bp, Mus musculus
aaaaatgagaaacagatgaaaatca

SEQ ID NO: 852207 - DNA, 25 bp, Mus musculus
aaaaatgagaaagagatgaaaatca

SEQ ID NO: 852208 - DNA, 25 bp, Mus musculus
aaaaatgcaaaaagttgaggaatgg

SEQ ID NO: 852209 - DNA, 25 bp, Mus musculus
aaaaatgcaaaatgttgaggaatgg

SEQ ID NO: 852210 - DNA, 25 bp, Mus musculus
aaaaatggcactaccgttcttgctc

SEQ ID NO: 852211 - DNA, 25 bp, Mus musculus
aaaaatggcacttccgttcttgctc

SEQ ID NO: 852212 - DNA, 25 bp, Mus musculus
aaaaatggggaagaccttcatggag

SEQ ID NO: 852213 - DNA, 25 bp, Mus musculus
aaaaatggggaagagcttcatggag

SEQ ID NO: 852214 - DNA, 25 bp, Mus musculus
aaaaatggtgagcccatcttctgat

SEQ ID NO: 852215 - DNA, 25 bp, Mus musculus
aaaaatggtgaggccatcttctgat

SEQ ID NO: 852216 - DNA, 25 bp, Mus musculus
aaaaatggtggacgtgcgttcctca

SEQ ID NO: 852217 - DNA, 25 bp, Mus musculus
aaaaatggtggaggtgcgttcctca

SEQ ID NO: 852218 - DNA, 25 bp, Mus musculus
aaaaatgttacacggatcctatgga

SEQ ID NO: 852219 - DNA, 25 bp, Mus musculus
aaaaatgttacagggatcctatgga

SEQ ID NO: 852220 - DNA, 25 bp, Mus musculus
aaaaattacactaccaaagcagtca

SEQ ID NO: 852221 - DNA, 25 bp, Mus musculus
aaaaattacagtaccaaagcagtca

SEQ ID NO: 852222 - DNA, 25 bp, Mus musculus
aaaaattattagatggaccatcaac

SEQ ID NO: 852223 - DNA, 25 bp, Mus musculus
aaaaattattagttggaccatcaac

SEQ ID NO: 852224 - DNA, 25 bp, Mus musculus
aaaaattcagcatcctcctgtgatc

SEQ ID NO: 852225 - DNA, 25 bp, Mus musculus
aaaaattcaggatcctcctgtgatc

SEQ ID NO: 852226 - DNA, 25 bp, Mus musculus
aaaaatttagaatatgacatctgca

SEQ ID NO: 852227 - DNA, 25 bp, Mus musculus
aaaaatttagtatatgacatctgca

SEQ ID NO: 852228 - DNA, 25 bp, Mus musculus
aaaaatttgaagcagacatcaagca

SEQ ID NO: 852229 - DNA, 25 bp, Mus musculus
aaaaatttgaaggagacatcaagca

SEQ ID NO: 852230 - DNA, 25 bp, Mus musculus
aaaacaacagattgttcagctaagc

SEQ ID NO: 852231 - DNA, 25 bp, Mus musculus
aaaacaacagtttgttcagctaagc

SEQ ID NO: 852232 - DNA, 25 bp, Mus musculus
aaaacacaaacacgagagtccctga

SEQ ID NO: 852233 - DNA, 25 bp, Mus musculus
aaaacacaaacacgtgagtccctga

SEQ ID NO: 852234 - DNA, 25 bp, Mus musculus
aaaacaccacaacttatgaagaagc

SEQ ID NO: 852235 - DNA, 25 bp, Mus musculus
aaaacaccacaagttatgaagaagc

SEQ ID NO: 852236 - DNA, 25 bp, Mus musculus
aaaacagagacacgttcacccagaa

SEQ ID NO: 852237 - DNA, 25 bp, Mus musculus
aaaacagagacaggttcacccagaa

SEQ ID NO: 852238 - DNA, 25 bp, Mus musculus
aaaacagatgatccagaggagtaga

SEQ ID NO: 852239 - DNA, 25 bp, Mus musculus
aaaacagatgctacaaagaagcgtt

SEQ ID NO: 852240 - DNA, 25 bp, Mus musculus
aaaacagatggtacaaagaagcgtt

SEQ ID NO: 852241 - DNA, 25 bp, Mus musculus
aaaacagatgttccagaggagtaga

SEQ ID NO: 852242 - DNA, 25 bp, Mus musculus
aaaacagcacagcatgtcaaaaaaa

SEQ ID NO: 852243 - DNA, 25 bp, Mus musculus
aaaacagcacaggatgtcaaaaaaa

SEQ ID NO: 852244 - DNA, 25 bp, Mus musculus
aaaacaggagactacagtgatggtt

SEQ ID NO: 852245 - DNA, 25 bp, Mus musculus
aaaacaggagtctacagtgatggtt

SEQ ID NO: 852246 - DNA, 25 bp, Mus musculus
aaaacaggatcacgagtttgatttc

SEQ ID NO: 852247 - DNA, 25 bp, Mus musculus
aaaacaggatcaggagtttgatttc

SEQ ID NO: 852248 - DNA, 25 bp, Mus musculus
aaaacataaaattacaagatcttat

SEQ ID NO: 852249 - DNA, 25 bp, Mus musculus
aaaacataaacaagatcttattggt

SEQ ID NO: 852250 - DNA, 25 bp, Mus musculus
aaaacataaagaagatcttattggt

SEQ ID NO: 852251 - DNA, 25 bp, Mus musculus
aaaacataaatttacaagatcttat

SEQ ID NO: 852252 - DNA, 25 bp, Mus musculus
aaaacatcctgcccattgatcatac

SEQ ID NO: 852253 - DNA, 25 bp, Mus musculus
aaaacatcctgccctttgatcatac

SEQ ID NO: 852254 - DNA, 25 bp, Mus musculus
aaaaccaaaagtcaaatggtgagcg

SEQ ID NO: 852255 - DNA, 25 bp, Mus musculus
aaaaccaaaagtcatatggtgagcg

SEQ ID NO: 852256 - DNA, 25 bp, Mus musculus
aaaaccaaagcatgcagggtgatga

SEQ ID NO: 852257 - DNA, 25 bp, Mus musculus
aaaaccaaagcatggagggtgatga

SEQ ID NO: 852258 - DNA, 25 bp, Mus musculus
aaaaccaacaggccatgaaagaagt

SEQ ID NO: 852259 - DNA, 25 bp, Mus musculus
aaaaccaacagggcatgaaagaagt

SEQ ID NO: 852260 - DNA, 25 bp, Mus musculus
aaaaccaagaggaacctgtgtggag

SEQ ID NO: 852261 - DNA, 25 bp, Mus musculus
aaaaccaagaggaagctgtgtggag

SEQ ID NO: 852262 - DNA, 25 bp, Mus musculus
aaaaccaatgcctcaccctgtgatc

SEQ ID NO: 852263 - DNA, 25 bp, Mus musculus
aaaaccaatggctcaccctgtgatc

SEQ ID NO: 852264 - DNA, 25 bp, Mus musculus
aaaaccacagagtcctgtgcatgtg

SEQ ID NO: 852265 - DNA, 25 bp, Mus musculus
aaaaccacagtgtcctgtgcatgtg

SEQ ID NO: 852266 - DNA, 25 bp, Mus musculus
aaaaccagcaaccgccgcctgccag

SEQ ID NO: 852267 - DNA, 25 bp, Mus musculus
aaaaccagcaacggccgcctgccag

SEQ ID NO: 852268 - DNA, 25 bp, Mus musculus
aaaaccataccaaaatggcagacct

SEQ ID NO: 852269 - DNA, 25 bp, Mus musculus
aaaaccataccataatggcagacct

SEQ ID NO: 852270 - DNA, 25 bp, Mus musculus
aaaaccatcacaatgactgcttcat

SEQ ID NO: 852271 - DNA, 25 bp, Mus musculus
aaaaccatcacattgactgcttcat

SEQ ID NO: 852272 - DNA, 25 bp, Mus musculus
aaaaccatcccagtcaattcagtca

SEQ ID NO: 852273 - DNA, 25 bp, Mus musculus
aaaaccatcccagtgaattcagtca

SEQ ID NO: 852274 - DNA, 25 bp, Mus musculus
aaaaccattaagctgtcatatgctc

SEQ ID NO: 852275 - DNA, 25 bp, Mus musculus
aaaaccattaaggtgtcatatgctc

SEQ ID NO: 852276 - DNA, 25 bp, Mus musculus
aaaaccctacatcaccttcctgacg

SEQ ID NO: 852277 - DNA, 25 bp, Mus musculus
aaaaccctacatcagcttcctgacg

SEQ ID NO: 852278 - DNA, 25 bp, Mus musculus
aaaaccctccggaacaatctctgtg

SEQ ID NO: 852279 - DNA, 25 bp, Mus musculus
aaaaccctccggaagaatctctgtg

SEQ ID NO: 852280 - DNA, 25 bp, Mus musculus
aaaaccgcacggccttcaacactga

SEQ ID NO: 852281 - DNA, 25 bp, Mus musculus
aaaaccgcacgggcttcaacactga

SEQ ID NO: 852282 - DNA, 25 bp, Mus musculus
aaaacctgtggacatattgatgaat

SEQ ID NO: 852283 - DNA, 25 bp, Mus musculus
aaaacctgtggagatattgatgaat

SEQ ID NO: 852284 - DNA, 25 bp, Mus musculus
aaaacgaaactgcctggaagaatgg

SEQ ID NO: 852285 - DNA, 25 bp, Mus musculus
aaaacgaaactggctggaagaatgg

SEQ ID NO: 852286 - DNA, 25 bp, Mus musculus
aaaacgatggcactgtgaatgggaa

SEQ ID NO: 852287 - DNA, 25 bp, Mus musculus
aaaacgatggcagtgtgaatgggaa

SEQ ID NO: 852288 - DNA, 25 bp, Mus musculus
aaaacggaaatctactgttctccag

SEQ ID NO: 852289 - DNA, 25 bp, Mus musculus
aaaacggaaatctagtgttctccag

SEQ ID NO: 852290 - DNA, 25 bp, Mus musculus
aaaactaagacaccttgaagaagag

SEQ ID NO: 852291 - DNA, 25 bp, Mus musculus
aaaactaagacagcttgaagaagag

SEQ ID NO: 852292 - DNA, 25 bp, Mus musculus
aaaactatagagctgccttggagca

SEQ ID NO: 852293 - DNA, 25 bp, Mus musculus
aaaactatagaggtgccttggagca

SEQ ID NO: 852294 - DNA, 25 bp, Mus musculus
aaaactatgcagctgtgcattggaa

SEQ ID NO: 852295 - DNA, 25 bp, Mus musculus
aaaactatgcaggtgtgcattggaa

SEQ ID NO: 852296 - DNA, 25 bp, Mus musculus
aaaactccaaaagactgtcctgcca

SEQ ID NO: 852297 - DNA, 25 bp, Mus musculus
aaaactccaaaagagtgtcctgcca

SEQ ID NO: 852298 - DNA, 25 bp, Mus musculus
aaaactccaccaagtatgcggttga

SEQ ID NO: 852299 - DNA, 25 bp, Mus musculus
aaaactccaccatgtatgcggttga

SEQ ID NO: 852300 - DNA, 25 bp, Mus musculus
aaaactctaccacactgactcatgt

SEQ ID NO: 852301 - DNA, 25 bp, Mus musculus
aaaactctaccacagtgactcatgt

SEQ ID NO: 852302 - DNA, 25 bp, Mus musculus
aaaactgaagcatctgaaccaatga

SEQ ID NO: 852303 - DNA, 25 bp, Mus musculus
aaaactgaagcatggcgtggttctc

SEQ ID NO: 852304 - DNA, 25 bp, Mus musculus
aaaactgaaggatctgaaccaatga

SEQ ID NO: 852305 - DNA, 25 bp, Mus musculus
aaaactgaaggatggcgtggttctc

SEQ ID NO: 852306 - DNA, 25 bp, Mus musculus
aaaactgagatgagtctacattggg

SEQ ID NO: 852307 - DNA, 25 bp, Mus musculus
aaaactgagatgtgtctacattggg

SEQ ID NO: 852308 - DNA, 25 bp, Mus musculus
aaaactgccaagctcacccctggct

SEQ ID NO: 852309 - DNA, 25 bp, Mus musculus
aaaactgccaaggtcacccctggct

SEQ ID NO: 852310 - DNA, 25 bp, Mus musculus
aaaactggagccctcagctgctcgt

SEQ ID NO: 852311 - DNA, 25 bp, Mus musculus
aaaactggaggcctcagctgctcgt

SEQ ID NO: 852312 - DNA, 25 bp, Mus musculus
aaaactgtaccgcgatttgcataac

SEQ ID NO: 852313 - DNA, 25 bp, Mus musculus
aaaactgtaccgggatttgcataac

SEQ ID NO: 852314 - DNA, 25 bp, Mus musculus
aaaactgtcccgccaggtatcatgt

SEQ ID NO: 852315 - DNA, 25 bp, Mus musculus
aaaactgtccggccaggtatcatgt

SEQ ID NO: 852316 - DNA, 25 bp, Mus musculus
aaaacttcagaccccagtgcattgt

SEQ ID NO: 852317 - DNA, 25 bp, Mus musculus
aaaacttcagtccccagtgcattgt

SEQ ID NO: 852318 - DNA, 25 bp, Mus musculus
aaaacttgagctatctgagttagca

SEQ ID NO: 852319 - DNA, 25 bp, Mus musculus
aaaacttgaggtatctgagttagca

SEQ ID NO: 852320 - DNA, 25 bp, Mus musculus
aaaactttagagctgccgcatgcct

SEQ ID NO: 852321 - DNA, 25 bp, Mus musculus
aaaactttagaggtgccgcatgcct

SEQ ID NO: 852322 - DNA, 25 bp, Mus musculus
aaaagaacagatttctcgaagctct

SEQ ID NO: 852323 - DNA, 25 bp, Mus musculus
aaaagaacagttttctcgaagctct

SEQ ID NO: 852324 - DNA, 25 bp, Mus musculus
aaaagaaccgacgagctcacctgcg

SEQ ID NO: 852325 - DNA, 25 bp, Mus musculus
aaaagaaccgaggctctccaggctg

SEQ ID NO: 852326 - DNA, 25 bp, Mus musculus
aaaagaaccgtcgagctcacctgcg

SEQ ID NO: 852327 - DNA, 25 bp, Mus musculus
aaaagaaccgtggctctccaggctg

SEQ ID NO: 852328 - DNA, 25 bp, Mus musculus
aaaagaagagatgcaaagcttacag

SEQ ID NO: 852329 - DNA, 25 bp, Mus musculus
aaaagaagagttgcaaagcttacag

SEQ ID NO: 852330 - DNA, 25 bp, Mus musculus
aaaagaatagatgtgccaactgctt

SEQ ID NO: 852331 - DNA, 25 bp, Mus musculus
aaaagaatagttgtgccaactgctt

SEQ ID NO: 852332 - DNA, 25 bp, Mus musculus
aaaagacaagccaggctacatgtct

SEQ ID NO: 852333 - DNA, 25 bp, Mus musculus
aaaagacaaggcaggctacatgtct

SEQ ID NO: 852334 - DNA, 25 bp, Mus musculus
aaaagacagctccactttttcagga

SEQ ID NO: 852335 - DNA, 25 bp, Mus musculus
aaaagacagctccagtttttcagga

SEQ ID NO: 852336 - DNA, 25 bp, Mus musculus
aaaagacattctcacactccttgga

SEQ ID NO: 852337 - DNA, 25 bp, Mus musculus
aaaagacattctcagactccttgga

SEQ ID NO: 852338 - DNA, 25 bp, Mus musculus
aaaagaccctaacacatgttgctgt

SEQ ID NO: 852339 - DNA, 25 bp, Mus musculus
aaaagaccctaacagatgttgctgt

SEQ ID NO: 852340 - DNA, 25 bp, Mus musculus
aaaagagaagctcttgcaggaagag

SEQ ID NO: 852341 - DNA, 25 bp, Mus musculus
aaaagagaagctgttgcaggaagag

SEQ ID NO: 852342 - DNA, 25 bp, Mus musculus
aaaagagaatggctgtactccatga

SEQ ID NO: 852343 - DNA, 25 bp, Mus musculus
aaaagagaatgggtgtactccatga

SEQ ID NO: 852344 - DNA, 25 bp, Mus musculus
aaaagagagaaaactcatggggaag

SEQ ID NO: 852345 - DNA, 25 bp, Mus musculus
aaaagagagaaatctcatggggaag

SEQ ID NO: 852346 - DNA, 25 bp, Mus musculus
aaaagagctgcattctaatcccttt

SEQ ID NO: 852347 - DNA, 25 bp, Mus musculus
aaaagagctggattctaatcccttt

SEQ ID NO: 852348 - DNA, 25 bp, Mus musculus
aaaagagtatagtacgtatgaccaa

SEQ ID NO: 852349 - DNA, 25 bp, Mus musculus
aaaagagtatagtaggtatgaccaa

SEQ ID NO: 852350 - DNA, 25 bp, Mus musculus
aaaagagtctgtcctgcaggctgtg

SEQ ID NO: 852351 - DNA, 25 bp, Mus musculus
aaaagagtctgtgctgcaggctgtg

SEQ ID NO: 852352 - DNA, 25 bp, Mus musculus
aaaagatcacatatagcccgtatac

SEQ ID NO: 852353 - DNA, 25 bp, Mus musculus
aaaagatcacatattgcccgtatac

SEQ ID NO: 852354 - DNA, 25 bp, Mus musculus
aaaagatccgagagtgtgtgatctg

SEQ ID NO: 852355 - DNA, 25 bp, Mus musculus
aaaagatccgagtgtgtgtgatctg

SEQ ID NO: 852356 - DNA, 25 bp, Mus musculus
aaaagatctacaccgccctgatgga

SEQ ID NO: 852357 - DNA, 25 bp, Mus musculus
aaaagatctacagcgccctgatgga

SEQ ID NO: 852358 - DNA, 25 bp, Mus musculus
aaaagatgcctgcacaaaaacaagc

SEQ ID NO: 852359 - DNA, 25 bp, Mus musculus
aaaagatgcctggacaaaaacaagc

SEQ ID NO: 852360 - DNA, 25 bp, Mus musculus
aaaagatgggcactatcttcgaccg

SEQ ID NO: 852361 - DNA, 25 bp, Mus musculus
aaaagatgggcagtatcttcgaccg

SEQ ID NO: 852362 - DNA, 25 bp, Mus musculus
aaaagattcaaacccaatgttagtg

SEQ ID NO: 852363 - DNA, 25 bp, Mus musculus
aaaagattcaaagccaatgttagtg

SEQ ID NO: 852364 - DNA, 25 bp, Mus musculus
aaaagcaaagatttgcaacattgta

SEQ ID NO: 852365 - DNA, 25 bp, Mus musculus
aaaagcaaagttttgcaacattgta

SEQ ID NO: 852366 - DNA, 25 bp, Mus musculus
aaaagcaacagacagtgcactgacc

SEQ ID NO: 852367 - DNA, 25 bp, Mus musculus
aaaagcaacagacttcttgcctctc

SEQ ID NO: 852368 - DNA, 25 bp, Mus musculus
aaaagcaacagagagtgcactgacc

SEQ ID NO: 852369 - DNA, 25 bp, Mus musculus
aaaagcaacagagttcttgcctctc

SEQ ID NO: 852370 - DNA, 25 bp, Mus musculus
aaaagcaagaagcacctagaccgcg

SEQ ID NO: 852371 - DNA, 25 bp, Mus musculus
aaaagcaagaagcgtcttgttgcag

SEQ ID NO: 852372 - DNA, 25 bp, Mus musculus
aaaagcaagaaggacctagaccgcg

SEQ ID NO: 852373 - DNA, 25 bp, Mus musculus
aaaagcaagaagggtcttgttgcag

SEQ ID NO: 852374 - DNA, 25 bp, Mus musculus
aaaagcacagaacaagcctgccatc

SEQ ID NO: 852375 - DNA, 25 bp, Mus musculus
aaaagcacagacgagctaaactcag

SEQ ID NO: 852376 - DNA, 25 bp, Mus musculus
aaaagcacagtacaagcctgccatc

SEQ ID NO: 852377 - DNA, 25 bp, Mus musculus
aaaagcacagtcgagctaaactcag

SEQ ID NO: 852378 - DNA, 25 bp, Mus musculus
aaaagcagaatgccgtgatgagagg

SEQ ID NO: 852379 - DNA, 25 bp, Mus musculus
aaaagcagaatggcgtgatgagagg

SEQ ID NO: 852380 - DNA, 25 bp, Mus musculus
aaaagcagacatgtcatatcaggct

SEQ ID NO: 852381 - DNA, 25 bp, Mus musculus
aaaagcagacatgtgatatcaggct

SEQ ID NO: 852382 - DNA, 25 bp, Mus musculus
aaaagcagcagaaccgtgacttgaa

SEQ ID NO: 852383 - DNA, 25 bp, Mus musculus
aaaagcagcagaacggtgacttgaa

SEQ ID NO: 852384 - DNA, 25 bp, Mus musculus
aaaagcaggttccacacaatcctcc

SEQ ID NO: 852385 - DNA, 25 bp, Mus musculus
aaaagcaggttccacctctcccagg

SEQ ID NO: 852386 - DNA, 25 bp, Mus musculus
aaaagcaggttccagacaatcctcc

SEQ ID NO: 852387 - DNA, 25 bp, Mus musculus
aaaagcaggttccagctctcccagg

SEQ ID NO: 852388 - DNA, 25 bp, Mus musculus
aaaagcagtgctttgtattgagggc

SEQ ID NO: 852389 - DNA, 25 bp, Mus musculus
aaaagcagtggtttgtattgagggc

SEQ ID NO: 852390 - DNA, 25 bp, Mus musculus
aaaagcatttagcgcttcagaaaga

SEQ ID NO: 852391 - DNA, 25 bp, Mus musculus
aaaagcatttagggcttcagaaaga

SEQ ID NO: 852392 - DNA, 25 bp, Mus musculus
aaaagccagtgacagagcagggctg

SEQ ID NO: 852393 - DNA, 25 bp, Mus musculus
aaaagccagtgagagagcagggctg

SEQ ID NO: 852394 - DNA, 25 bp, Mus musculus
aaaagccatactatcatccctcaag

SEQ ID NO: 852395 - DNA, 25 bp, Mus musculus
aaaagccatactatgatccctcaag

SEQ ID NO: 852396 - DNA, 25 bp, Mus musculus
aaaagcccagatctaattcagaagt

SEQ ID NO: 852397 - DNA, 25 bp, Mus musculus
aaaagcccagttctaattcagaagt

SEQ ID NO: 852398 - DNA, 25 bp, Mus musculus
aaaagcgaggaggcggctcagtggt

SEQ ID NO: 852399 - DNA, 25 bp, Mus musculus
aaaagcgaggccctcgtcacaggct

SEQ ID NO: 852400 - DNA, 25 bp, Mus musculus
aaaagcgaggccctggtcacaggct

SEQ ID NO: 852401 - DNA, 25 bp, Mus musculus
aaaagcgaggtggcggctcagtggt

SEQ ID NO: 852402 - DNA, 25 bp, Mus musculus
aaaagcgtgacactgaagcgctatg

SEQ ID NO: 852403 - DNA, 25 bp, Mus musculus
aaaagcgtgacagtgaagcgctatg

SEQ ID NO: 852404 - DNA, 25 bp, Mus musculus
aaaagctaaacaagagcatgaagga

SEQ ID NO: 852405 - DNA, 25 bp, Mus musculus
aaaagctaaacatgagcatgaagga

SEQ ID NO: 852406 - DNA, 25 bp, Mus musculus
aaaagctagtagcacaagctgggag

SEQ ID NO: 852407 - DNA, 25 bp, Mus musculus
aaaagctagtagcagaagctgggag

SEQ ID NO: 852408 - DNA, 25 bp, Mus musculus
aaaagctcaggcagcaagcctgagg

SEQ ID NO: 852409 - DNA, 25 bp, Mus musculus
aaaagctcaggcaggcaaatgagga

SEQ ID NO: 852410 - DNA, 25 bp, Mus musculus
aaaagctcaggctgcaagcctgagg

SEQ ID NO: 852411 - DNA, 25 bp, Mus musculus
aaaagctcaggctggcaaatgagga

SEQ ID NO: 852412 - DNA, 25 bp, Mus musculus
aaaagctgagagaaacgaagtgaga

SEQ ID NO: 852413 - DNA, 25 bp, Mus musculus
aaaagctgagagtaacgaagtgaga

SEQ ID NO: 852414 - DNA, 25 bp, Mus musculus
aaaagctgggtctccgaactgccta

SEQ ID NO: 852415 - DNA, 25 bp, Mus musculus
aaaagctgggtctcggaactgccta

SEQ ID NO: 852416 - DNA, 25 bp, Mus musculus
aaaagcttgcagaatctttatcttc

SEQ ID NO: 852417 - DNA, 25 bp, Mus musculus
aaaagcttgcagtatctttatcttc

SEQ ID NO: 852418 - DNA, 25 bp, Mus musculus
aaaagctttgcacattgaggcctgc

SEQ ID NO: 852419 - DNA, 25 bp, Mus musculus
aaaagctttgcagattgaggcctgc

SEQ ID NO: 852420 - DNA, 25 bp, Mus musculus
aaaaggaaaaatgccagcaagatat

SEQ ID NO: 852421 - DNA, 25 bp, Mus musculus
aaaaggaaaaatgcgagcaagatat

SEQ ID NO: 852422 - DNA, 25 bp, Mus musculus
aaaaggaagaaacgtggcaccagag

SEQ ID NO: 852423 - DNA, 25 bp, Mus musculus
aaaaggaagaaaggtggcaccagag

SEQ ID NO: 852424 - DNA, 25 bp, Mus musculus
aaaaggacagaatcatagagattgc

SEQ ID NO: 852425 - DNA, 25 bp, Mus musculus
aaaaggacagtatcatagagattgc

SEQ ID NO: 852426 - DNA, 25 bp, Mus musculus
aaaaggagacaccggcttgccaggt

SEQ ID NO: 852427 - DNA, 25 bp, Mus musculus
aaaaggagacacgggcttgccaggt

SEQ ID NO: 852428 - DNA, 25 bp, Mus musculus
aaaaggaggtgacaccttcctgcaa

SEQ ID NO: 852429 - DNA, 25 bp, Mus musculus
aaaaggaggtgacagcttcctgcaa

SEQ ID NO: 852430 - DNA, 25 bp, Mus musculus
aaaaggcagaagattgaggtaggcc

SEQ ID NO: 852431 - DNA, 25 bp, Mus musculus
aaaaggcagaagtttgaggtaggcc

SEQ ID NO: 852432 - DNA, 25 bp, Mus musculus
aaaaggctcaagcgctttgctgagc

SEQ ID NO: 852433 - DNA, 25 bp, Mus musculus
aaaaggctcaagggctttgctgagc

SEQ ID NO: 852434 - DNA, 25 bp, Mus musculus
aaaaggggcaggcgcgtgattatag

SEQ ID NO: 852435 - DNA, 25 bp, Mus musculus
aaaaggggcaggcgggtgattatag

SEQ ID NO: 852436 - DNA, 25 bp, Mus musculus
aaaagtatggagcacgtatgcggtg

SEQ ID NO: 852437 - DNA, 25 bp, Mus musculus
aaaagtatggagcaggtatgcggtg

SEQ ID NO: 852438 - DNA, 25 bp, Mus musculus
aaaagtcaagctgatgttagagaag

SEQ ID NO: 852439 - DNA, 25 bp, Mus musculus
aaaagtcaaggtgatgttagagaag

SEQ ID NO: 852440 - DNA, 25 bp, Mus musculus
aaaagtcaatcccatagcacgagaa

SEQ ID NO: 852441 - DNA, 25 bp, Mus musculus
aaaagtcaatgccatagcacgagaa

SEQ ID NO: 852442 - DNA, 25 bp, Mus musculus
aaaagtccgtgacgtcttcatgtct

SEQ ID NO: 852443 - DNA, 25 bp, Mus musculus
aaaagtccgtgaggtcttcatgtct

SEQ ID NO: 852444 - DNA, 25 bp, Mus musculus
aaaagtgatttggacattttctgga

SEQ ID NO: 852445 - DNA, 25 bp, Mus musculus
aaaagtgatttggagattttctgga

SEQ ID NO: 852446 - DNA, 25 bp, Mus musculus
aaaagtgcatcactcactggcagtg

SEQ ID NO: 852447 - DNA, 25 bp, Mus musculus
aaaagtgcatcagtcactggcagtg

SEQ ID NO: 852448 - DNA, 25 bp, Mus musculus
aaaagtgctgatctgacttcattat

SEQ ID NO: 852449 - DNA, 25 bp, Mus musculus
aaaagtgctgatgtgacttcattat

SEQ ID NO: 852450 - DNA, 25 bp, Mus musculus
aaaagtgtggatgaactcttccaga

SEQ ID NO: 852451 - DNA, 25 bp, Mus musculus
aaaagtgtggttgaactcttccaga

SEQ ID NO: 852452 - DNA, 25 bp, Mus musculus
aaaagttgatactggacaactgtgg

SEQ ID NO: 852453 - DNA, 25 bp, Mus musculus
aaaagttgattctggacaactgtgg

SEQ ID NO: 852454 - DNA, 25 bp, Mus musculus
aaaataaaggacaacgagcaagtag

SEQ ID NO: 852455 - DNA, 25 bp, Mus musculus
aaaataaaggacaaggagcaagtag

SEQ ID NO: 852456 - DNA, 25 bp, Mus musculus
aaaataaccaagaagcctcaatgtg

SEQ ID NO: 852457 - DNA, 25 bp, Mus musculus
aaaataaccaagtagcctcaatgtg

SEQ ID NO: 852458 - DNA, 25 bp, Mus musculus
aaaataatggtgatcgtcttctcca

SEQ ID NO: 852459 - DNA, 25 bp, Mus musculus
aaaataatggtgatggtcttctcca

SEQ ID NO: 852460 - DNA, 25 bp, Mus musculus
aaaatacagaactgtgtcagcattt

SEQ ID NO: 852461 - DNA, 25 bp, Mus musculus
aaaatacagaccatacgatgcgacc

SEQ ID NO: 852462 - DNA, 25 bp, Mus musculus
aaaatacagagcatacgatgcgacc

SEQ ID NO: 852463 - DNA, 25 bp, Mus musculus
aaaatacagatctgtgtcagcattt

SEQ ID NO: 852464 - DNA, 25 bp, Mus musculus
aaaatacctcaacggtgaggatcct

SEQ ID NO: 852465 - DNA, 25 bp, Mus musculus
aaaatacctcaagggtgaggatcct

SEQ ID NO: 852466 - DNA, 25 bp, Mus musculus
aaaatactcacacaaagaagaatcc

SEQ ID NO: 852467 - DNA, 25 bp, Mus musculus
aaaatactcacagaaagaagaatcc

SEQ ID NO: 852468 - DNA, 25 bp, Mus musculus
aaaatagaagccagttatgagtcag

SEQ ID NO: 852469 - DNA, 25 bp, Mus musculus
aaaatagaaggcagttatgagtcag

SEQ ID NO: 852470 - DNA, 25 bp, Mus musculus
aaaatagagaaagacgcagaaatcc

SEQ ID NO: 852471 - DNA, 25 bp, Mus musculus
aaaatagagaaagaggcagaaatcc

SEQ ID NO: 852472 - DNA, 25 bp, Mus musculus
aaaatagataatcgaatattttgga

SEQ ID NO: 852473 - DNA, 25 bp, Mus musculus
aaaatagataatggaatattttgga

SEQ ID NO: 852474 - DNA, 25 bp, Mus musculus
aaaatagtcgcattcgttctattgt

SEQ ID NO: 852475 - DNA, 25 bp, Mus musculus
aaaatagtcgcattggttctattgt

SEQ ID NO: 852476 - DNA, 25 bp, Mus musculus
aaaatatatctccgagaacattctt

SEQ ID NO: 852477 - DNA, 25 bp, Mus musculus
aaaatatatctcggagaacattctt

SEQ ID NO: 852478 - DNA, 25 bp, Mus musculus
aaaatatcagcaaggagatgaaatc

SEQ ID NO: 852479 - DNA, 25 bp, Mus musculus
aaaatatcaggaaggagatgaaatc

SEQ ID NO: 852480 - DNA, 25 bp, Mus musculus
aaaatattccataacatcatcttta

SEQ ID NO: 852481 - DNA, 25 bp, Mus musculus
aaaatattccataagatcatcttta

SEQ ID NO: 852482 - DNA, 25 bp, Mus musculus
aaaatcaaatggcacaggtcacttt

SEQ ID NO: 852483 - DNA, 25 bp, Mus musculus
aaaatcaaatggcactatatatgtt

SEQ ID NO: 852484 - DNA, 25 bp, Mus musculus
aaaatcaaatggcagaggtcacttt

SEQ ID NO: 852485 - DNA, 25 bp, Mus musculus
aaaatcaaatggcagtatatatgtt

SEQ ID NO: 852486 - DNA, 25 bp, Mus musculus
aaaatcaacaacacccacgccctcg

SEQ ID NO: 852487 - DNA, 25 bp, Mus musculus
aaaatcaacatcacccacgccctcg

SEQ ID NO: 852488 - DNA, 25 bp, Mus musculus
aaaatcaaggagcttgtagtgaaga

SEQ ID NO: 852489 - DNA, 25 bp, Mus musculus
aaaatcaaggaggttgtagtgaaga

SEQ ID NO: 852490 - DNA, 25 bp, Mus musculus
aaaatcacagagaacaccttcccac

SEQ ID NO: 852491 - DNA, 25 bp, Mus musculus
aaaatcacagtgaacaccttcccac

SEQ ID NO: 852492 - DNA, 25 bp, Mus musculus
aaaatcacggaacgtgtctcagaca

SEQ ID NO: 852493 - DNA, 25 bp, Mus musculus
aaaatcacggaaggtgtctcagaca

SEQ ID NO: 852494 - DNA, 25 bp, Mus musculus
aaaatcagcaagagcccagatggtg

SEQ ID NO: 852495 - DNA, 25 bp, Mus musculus
aaaatcagcaagtgcccagatggtg

SEQ ID NO: 852496 - DNA, 25 bp, Mus musculus
aaaatcagcgagtacattgtagaat

SEQ ID NO: 852497 - DNA, 25 bp, Mus musculus
aaaatcagcgtgtacattgtagaat

SEQ ID NO: 852498 - DNA, 25 bp, Mus musculus
aaaatcagtgggaacatgactctaa

SEQ ID NO: 852499 - DNA, 25 bp, Mus musculus
aaaatcagtgggaagatgactctaa

SEQ ID NO: 852500 - DNA, 25 bp, Mus musculus
aaaatcatagagcccatccagtccc

SEQ ID NO: 852501 - DNA, 25 bp, Mus musculus
aaaatcatagtgcccatccagtccc

SEQ ID NO: 852502 - DNA, 25 bp, Mus musculus
aaaatccaatagacttttcttacag

SEQ ID NO: 852503 - DNA, 25 bp, Mus musculus
aaaatccaatagtcttttcttacag

SEQ ID NO: 852504 - DNA, 25 bp, Mus musculus
aaaatcccatagccaccgtgggcct

SEQ ID NO: 852505 - DNA, 25 bp, Mus musculus
aaaatcccattgccaccgtgggcct

SEQ ID NO: 852506 - DNA, 25 bp, Mus musculus
aaaatccccacacatttgacctcct

SEQ ID NO: 852507 - DNA, 25 bp, Mus musculus
aaaatccccacagatttgacctcct

SEQ ID NO: 852508 - DNA, 25 bp, Mus musculus
aaaatccgtgagctatcatcactac

SEQ ID NO: 852509 - DNA, 25 bp, Mus musculus
aaaatccgtgaggtatcatcactac

SEQ ID NO: 852510 - DNA, 25 bp, Mus musculus
aaaatcctgcagcactacaaatctc

SEQ ID NO: 852511 - DNA, 25 bp, Mus musculus
aaaatcctgcaggactacaaatctc

SEQ ID NO: 852512 - DNA, 25 bp, Mus musculus
aaaatctaaagtcgattggtcttga

SEQ ID NO: 852513 - DNA, 25 bp, Mus musculus
aaaatctaaagtggattggtcttga

SEQ ID NO: 852514 - DNA, 25 bp, Mus musculus
aaaatctatgaaagccctggtttgg

SEQ ID NO: 852515 - DNA, 25 bp, Mus musculus
aaaatctatgaaatcagcaaccgct

SEQ ID NO: 852516 - DNA, 25 bp, Mus musculus
aaaatctatgaatgccctggtttgg

SEQ ID NO: 852517 - DNA, 25 bp, Mus musculus
aaaatctatgaattcagcaaccgct

SEQ ID NO: 852518 - DNA, 25 bp, Mus musculus
aaaatctcaaattgctcttaaactc

SEQ ID NO: 852519 - DNA, 25 bp, Mus musculus
aaaatctcaatttgctcttaaactc

SEQ ID NO: 852520 - DNA, 25 bp, Mus musculus
aaaatctcagaactcaagtgattga

SEQ ID NO: 852521 - DNA, 25 bp, Mus musculus
aaaatctcagcctggcctgtgagcc

SEQ ID NO: 852522 - DNA, 25 bp, Mus musculus
aaaatctcaggctggcctgtgagcc

SEQ ID NO: 852523 - DNA, 25 bp, Mus musculus
aaaatctcagtactcaagtgattga

SEQ ID NO: 852524 - DNA, 25 bp, Mus musculus
aaaatgaaagaaacagcgcattctg

SEQ ID NO: 852525 - DNA, 25 bp, Mus musculus
aaaatgaaagtaacagcgcattctg

SEQ ID NO: 852526 - DNA, 25 bp, Mus musculus
aaaatgaagaagaggaactatggac

SEQ ID NO: 852527 - DNA, 25 bp, Mus musculus
aaaatgaagaagatgggcttaggtc

SEQ ID NO: 852528 - DNA, 25 bp, Mus musculus
aaaatgaagaagtggaactatggac

SEQ ID NO: 852529 - DNA, 25 bp, Mus musculus
aaaatgaagaagttgggcttaggtc

SEQ ID NO: 852530 - DNA, 25 bp, Mus musculus
aaaatgaatcggctcatcaacttct

SEQ ID NO: 852531 - DNA, 25 bp, Mus musculus
aaaatgaatcgggtcatcaacttct

SEQ ID NO: 852532 - DNA, 25 bp, Mus musculus
aaaatgacctgcttcgccattcaaa

SEQ ID NO: 852533 - DNA, 25 bp, Mus musculus
aaaatgacctgcttggccattcaaa

SEQ ID NO: 852534 - DNA, 25 bp, Mus musculus
aaaatgagaaagagatgaaaatcaa

SEQ ID NO: 852535 - DNA, 25 bp, Mus musculus
aaaatgagaaagtgatgaaaatcaa

SEQ ID NO: 852536 - DNA, 25 bp, Mus musculus
aaaatgagagaaatgttctttgaag

SEQ ID NO: 852537 - DNA, 25 bp, Mus musculus
aaaatgagagaattgttctttgaag

SEQ ID NO: 852538 - DNA, 25 bp, Mus musculus
aaaatgaggcagcaacatcgaaatc

SEQ ID NO: 852539 - DNA, 25 bp, Mus musculus
aaaatgaggcaggaacatcgaaatc

SEQ ID NO: 852540 - DNA, 25 bp, Mus musculus
aaaatgataacagaccaacccgata

SEQ ID NO: 852541 - DNA, 25 bp, Mus musculus
aaaatgataacagaccatacaagca

SEQ ID NO: 852542 - DNA, 25 bp, Mus musculus
aaaatgataacagactcaatcccct

SEQ ID NO: 852543 - DNA, 25 bp, Mus musculus
aaaatgataacagagcaacccgata

SEQ ID NO: 852544 - DNA, 25 bp, Mus musculus
aaaatgataacagagcatacaagca

SEQ ID NO: 852545 - DNA, 25 bp, Mus musculus
aaaatgataacagagtcaatcccct

SEQ ID NO: 852546 - DNA, 25 bp, Mus musculus
aaaatgattatggaaacagcaggaa

SEQ ID NO: 852547 - DNA, 25 bp, Mus musculus
aaaatgattatggatacagcaggaa

SEQ ID NO: 852548 - DNA, 25 bp, Mus musculus
aaaatgcaaaaacttgaggaatgga

SEQ ID NO: 852549 - DNA, 25 bp, Mus musculus
aaaatgcaaaaagttgaggaatgga

SEQ ID NO: 852550 - DNA, 25 bp, Mus musculus
aaaatgcatgctattaatgggaaaa

SEQ ID NO: 852551 - DNA, 25 bp, Mus musculus
aaaatgcatggtattaatgggaaaa

SEQ ID NO: 852552 - DNA, 25 bp, Mus musculus
aaaatgccagagctaatcctccatc

SEQ ID NO: 852553 - DNA, 25 bp, Mus musculus
aaaatgccagtgctaatcctccatc

SEQ ID NO: 852554 - DNA, 25 bp, Mus musculus
aaaatgcctctgcacttgactacca

SEQ ID NO: 852555 - DNA, 25 bp, Mus musculus
aaaatgcctctggacttgactacca

SEQ ID NO: 852556 - DNA, 25 bp, Mus musculus
aaaatgcttcagcgccgcctttttg

SEQ ID NO: 852557 - DNA, 25 bp, Mus musculus
aaaatgcttcagggccgcctttttg

SEQ ID NO: 852558 - DNA, 25 bp, Mus musculus
aaaatggaagcaaatgcaagtccat

SEQ ID NO: 852559 - DNA, 25 bp, Mus musculus
aaaatggaaggaaatgcaagtccat

SEQ ID NO: 852560 - DNA, 25 bp, Mus musculus
aaaatggagacagccggcgagtttg

SEQ ID NO: 852561 - DNA, 25 bp, Mus musculus
aaaatggagacagcgggcgagtttg

SEQ ID NO: 852562 - DNA, 25 bp, Mus musculus
aaaatggagatacgcttgccagatg

SEQ ID NO: 852563 - DNA, 25 bp, Mus musculus
aaaatggagataggcttgccagatg

SEQ ID NO: 852564 - DNA, 25 bp, Mus musculus
aaaatggatcccacagatgccaagt

SEQ ID NO: 852565 - DNA, 25 bp, Mus musculus
aaaatggatcccactgatgccaagt

SEQ ID NO: 852566 - DNA, 25 bp, Mus musculus
aaaatggctgccaaatggcaccttg

SEQ ID NO: 852567 - DNA, 25 bp, Mus musculus
aaaatggctgcctaatggcaccttg

SEQ ID NO: 852568 - DNA, 25 bp, Mus musculus
aaaatgggagcctttgaaatccatg

SEQ ID NO: 852569 - DNA, 25 bp, Mus musculus
aaaatgggaggctttgaaatccatg

SEQ ID NO: 852570 - DNA, 25 bp, Mus musculus
aaaatggtggagctgcgttcctcat

SEQ ID NO: 852571 - DNA, 25 bp, Mus musculus
aaaatggtggaggtgcgttcctcat

SEQ ID NO: 852572 - DNA, 25 bp, Mus musculus
aaaatgtaacagagcgttcccatct

SEQ ID NO: 852573 - DNA, 25 bp, Mus musculus
aaaatgtaacagagcgtttgaagat

SEQ ID NO: 852574 - DNA, 25 bp, Mus musculus
aaaatgtaacagagggttcccatct

SEQ ID NO: 852575 - DNA, 25 bp, Mus musculus
aaaatgtaacagagggtttgaagat

SEQ ID NO: 852576 - DNA, 25 bp, Mus musculus
aaaatgtgcgcgtggcaatagtttc

SEQ ID NO: 852577 - DNA, 25 bp, Mus musculus
aaaatgtgcgggtggcaatagtttc

SEQ ID NO: 852578 - DNA, 25 bp, Mus musculus
aaaatgttacagatgaaatgccagc

SEQ ID NO: 852579 - DNA, 25 bp, Mus musculus
aaaatgttacagcgatcctatggaa

SEQ ID NO: 852580 - DNA, 25 bp, Mus musculus
aaaatgttacagggatcctatggaa

SEQ ID NO: 852581 - DNA, 25 bp, Mus musculus
aaaatgttacagttgaaatgccagc

SEQ ID NO: 852582 - DNA, 25 bp, Mus musculus
aaaatgttatgtaggtattttctgc

SEQ ID NO: 852583 - DNA, 25 bp, Mus musculus
aaaatgttatgttggtattttctgc

SEQ ID NO: 852584 - DNA, 25 bp, Mus musculus
aaaatgttcaaacacacgtggatgg

SEQ ID NO: 852585 - DNA, 25 bp, Mus musculus
aaaatgttcaaacagacgtggatgg

SEQ ID NO: 852586 - DNA, 25 bp, Mus musculus
aaaattaaagagtacatccagaagt

SEQ ID NO: 852587 - DNA, 25 bp, Mus musculus
aaaattaaagatgaactaatgactt

SEQ ID NO: 852588 - DNA, 25 bp, Mus musculus
aaaattaaagtgtacatccagaagt

SEQ ID NO: 852589 - DNA, 25 bp, Mus musculus
aaaattaaagttgaactaatgactt

SEQ ID NO: 852590 - DNA, 25 bp, Mus musculus
aaaattattcagcctaatggctaca

SEQ ID NO: 852591 - DNA, 25 bp, Mus musculus
aaaattattcaggctaatggctaca

SEQ ID NO: 852592 - DNA, 25 bp, Mus musculus
aaaattcaacagcctaaaccggctg

SEQ ID NO: 852593 - DNA, 25 bp, Mus musculus
aaaattcaacaggctaaaccggctg

SEQ ID NO: 852594 - DNA, 25 bp, Mus musculus
aaaattctcacactcaggagaaatc

SEQ ID NO: 852595 - DNA, 25 bp, Mus musculus
aaaattctcacagtcaggagaaatc

SEQ ID NO: 852596 - DNA, 25 bp, Mus musculus
aaaattgaatcacgtgaactggacc

SEQ ID NO: 852597 - DNA, 25 bp, Mus musculus
aaaattgaatcaggtgaactggacc

SEQ ID NO: 852598 - DNA, 25 bp, Mus musculus
aaaattgacaagcattttctacaag

SEQ ID NO: 852599 - DNA, 25 bp, Mus musculus
aaaattgacaaggattttctacaag

SEQ ID NO: 852600 - DNA, 25 bp, Mus musculus
aaaattgaccagcctgagtaccagg

SEQ ID NO: 852601 - DNA, 25 bp, Mus musculus
aaaattgacctgcctgagtaccagg

SEQ ID NO: 852602 - DNA, 25 bp, Mus musculus
aaaattgataatctagacgtgaaca

SEQ ID NO: 852603 - DNA, 25 bp, Mus musculus
aaaattgataatcttgacgtgaaca

SEQ ID NO: 852604 - DNA, 25 bp, Mus musculus
aaaattgcaccacgtgatgttattg

SEQ ID NO: 852605 - DNA, 25 bp, Mus musculus
aaaattgcaccaggtgatgttattg

SEQ ID NO: 852606 - DNA, 25 bp, Mus musculus
aaaattgcagtaaacattgtgcaag

SEQ ID NO: 852607 - DNA, 25 bp, Mus musculus
aaaattgcagtaaagattgtgcaag

SEQ ID NO: 852608 - DNA, 25 bp, Mus musculus
aaaattgctccacgaggaatgggct

SEQ ID NO: 852609 - DNA, 25 bp, Mus musculus
aaaattgctccaggaggaatgggct

SEQ ID NO: 852610 - DNA, 25 bp, Mus musculus
aaacaaaatttaagtacttatcatg

SEQ ID NO: 852611 - DNA, 25 bp, Mus musculus
aaacaaaatttatgtacttatcatg

SEQ ID NO: 852612 - DNA, 25 bp, Mus musculus
aaacaaacagcatcttcctaatgct

SEQ ID NO: 852613 - DNA, 25 bp, Mus musculus
aaacaaacagcatttgccgaatgct

SEQ ID NO: 852614 - DNA, 25 bp, Mus musculus
aaacaaacaggatcttcctaatgct

SEQ ID NO: 852615 - DNA, 25 bp, Mus musculus
aaacaaacaggatttgccgaatgct

SEQ ID NO: 852616 - DNA, 25 bp, Mus musculus
aaacaaagaccacatcgccaaggat

SEQ ID NO: 852617 - DNA, 25 bp, Mus musculus
aaacaaagaccagatcgccaaggat

SEQ ID NO: 852618 - DNA, 25 bp, Mus musculus
aaacaaagagagctggaaagtcttt

SEQ ID NO: 852619 - DNA, 25 bp, Mus musculus
aaacaaagagaggtggaaagtcttt

SEQ ID NO: 852620 - DNA, 25 bp, Mus musculus
aaacaaattgctactgcttcgtggg

SEQ ID NO: 852621 - DNA, 25 bp, Mus musculus
aaacaaattggtactgcttcgtggg

SEQ ID NO: 852622 - DNA, 25 bp, Mus musculus
aaacaacaagatctgtgatattgcc

SEQ ID NO: 852623 - DNA, 25 bp, Mus musculus
aaacaacaagttctgtgatattgcc

SEQ ID NO: 852624 - DNA, 25 bp, Mus musculus
aaacaactcttgcacgatgagaaaa

SEQ ID NO: 852625 - DNA, 25 bp, Mus musculus
aaacaactcttgcaggatgagaaaa

SEQ ID NO: 852626 - DNA, 25 bp, Mus musculus
aaacaactgcagatgctcttgctta

SEQ ID NO: 852627 - DNA, 25 bp, Mus musculus
aaacaactgcagttgctcttgctta

SEQ ID NO: 852628 - DNA, 25 bp, Mus musculus
aaacaacttgataacgctaaagagg

SEQ ID NO: 852629 - DNA, 25 bp, Mus musculus
aaacaacttgataaggctaaagagg

SEQ ID NO: 852630 - DNA, 25 bp, Mus musculus
aaacaagagaagatcctgatctacc

SEQ ID NO: 852631 - DNA, 25 bp, Mus musculus
aaacaagagaagttcctgatctacc

SEQ ID NO: 852632 - DNA, 25 bp, Mus musculus
aaacaagagcatcatttggaggaat

SEQ ID NO: 852633 - DNA, 25 bp, Mus musculus
aaacaagagcatgatttggaggaat

SEQ ID NO: 852634 - DNA, 25 bp, Mus musculus
aaacaagattaccgccgaagactgt

SEQ ID NO: 852635 - DNA, 25 bp, Mus musculus
aaacaagattaccgtacagcaaggg

SEQ ID NO: 852636 - DNA, 25 bp, Mus musculus
aaacaagattacggccgaagactgt

SEQ ID NO: 852637 - DNA, 25 bp, Mus musculus
aaacaagattacggtacagcaaggg

SEQ ID NO: 852638 - DNA, 25 bp, Mus musculus
aaacaagcccatcaagtgcccccgc

SEQ ID NO: 852639 - DNA, 25 bp, Mus musculus
aaacaagcccatgaagtgcccccgc

SEQ ID NO: 852640 - DNA, 25 bp, Mus musculus
aaacaaggagctgactcctgatgga

SEQ ID NO: 852641 - DNA, 25 bp, Mus musculus
aaacaaggagctgagtcctgatgga

SEQ ID NO: 852642 - DNA, 25 bp, Mus musculus
aaacaataagcattgctatggcaac

SEQ ID NO: 852643 - DNA, 25 bp, Mus musculus
aaacaataaggattgctatggcaac

SEQ ID NO: 852644 - DNA, 25 bp, Mus musculus
aaacaataatgaagacaactggatt

SEQ ID NO: 852645 - DNA, 25 bp, Mus musculus
aaacaataatgatgacaactggatt

SEQ ID NO: 852646 - DNA, 25 bp, Mus musculus
aaacaatcagcccaggagttaaagt

SEQ ID NO: 852647 - DNA, 25 bp, Mus musculus
aaacaatcagcctgccgaatctggg

SEQ ID NO: 852648 - DNA, 25 bp, Mus musculus
aaacaatcaggccaggagttaaagt

SEQ ID NO: 852649 - DNA, 25 bp, Mus musculus
aaacaatcaggctgccgaatctggg

SEQ ID NO: 852650 - DNA, 25 bp, Mus musculus
aaacaatgaaaaagcaaatcgctaa

SEQ ID NO: 852651 - DNA, 25 bp, Mus musculus
aaacaatgaaaatgcaaatcgctaa

SEQ ID NO: 852652 - DNA, 25 bp, Mus musculus
aaacaatgcagacttttagttggtg

SEQ ID NO: 852653 - DNA, 25 bp, Mus musculus
aaacaatgcagagttttagttggtg

SEQ ID NO: 852654 - DNA, 25 bp, Mus musculus
aaacaatggcataactagctatgga

SEQ ID NO: 852655 - DNA, 25 bp, Mus musculus
aaacaatggcattactagctatgga

SEQ ID NO: 852656 - DNA, 25 bp, Mus musculus
aaacaatgtacacatgtggagagag

SEQ ID NO: 852657 - DNA, 25 bp, Mus musculus
aaacaatgtacagatgtggagagag

SEQ ID NO: 852658 - DNA, 25 bp, Mus musculus
aaacacaatcagacgaagggggcag

SEQ ID NO: 852659 - DNA, 25 bp, Mus musculus
aaacacaatcagatgtcgtttggtc

SEQ ID NO: 852660 - DNA, 25 bp, Mus musculus
aaacacaatcagccgcataactcat

SEQ ID NO: 852661 - DNA, 25 bp, Mus musculus
aaacacaatcagccgtcattcagtc

SEQ ID NO: 852662 - DNA, 25 bp, Mus musculus
aaacacaatcaggcgcataactcat

SEQ ID NO: 852663 - DNA, 25 bp, Mus musculus
aaacacaatcaggcgtcattcagtc

SEQ ID NO: 852664 - DNA, 25 bp, Mus musculus
aaacacaatcagtcgaagggggcag

SEQ ID NO: 852665 - DNA, 25 bp, Mus musculus
aaacacaatcagttgtcgtttggtc

SEQ ID NO: 852666 - DNA, 25 bp, Mus musculus
aaacacacacggatgctgaaggagg

SEQ ID NO: 852667 - DNA, 25 bp, Mus musculus
aaacacacacggttgctgaaggagg

SEQ ID NO: 852668 - DNA, 25 bp, Mus musculus
aaacacacagccagatgtcatcaat

SEQ ID NO: 852669 - DNA, 25 bp, Mus musculus
aaacacacaggcagatgtcatcaat

SEQ ID NO: 852670 - DNA, 25 bp, Mus musculus
aaacacagaacacgccgcaagataa

SEQ ID NO: 852671 - DNA, 25 bp, Mus musculus
aaacacagaacaggccgcaagataa

SEQ ID NO: 852672 - DNA, 25 bp, Mus musculus
aaacacagttatctatgcaattggc

SEQ ID NO: 852673 - DNA, 25 bp, Mus musculus
aaacacagttatgtatgcaattggc

SEQ ID NO: 852674 - DNA, 25 bp, Mus musculus
aaacacatctgctccgtctgtgatg

SEQ ID NO: 852675 - DNA, 25 bp, Mus musculus
aaacacatctgctcggtctgtgatg

SEQ ID NO: 852676 - DNA, 25 bp, Mus musculus
aaacaccacaagatatgaagaagcc

SEQ ID NO: 852677 - DNA, 25 bp, Mus musculus
aaacaccacaagttatgaagaagcc

SEQ ID NO: 852678 - DNA, 25 bp, Mus musculus
aaacacccagatgcaaaactttcag

SEQ ID NO: 852679 - DNA, 25 bp, Mus musculus
aaacacccagctcattgatggcttt

SEQ ID NO: 852680 - DNA, 25 bp, Mus musculus
aaacacccaggtcattgatggcttt

SEQ ID NO: 852681 - DNA, 25 bp, Mus musculus
aaacacccagttgcaaaactttcag

SEQ ID NO: 852682 - DNA, 25 bp, Mus musculus
aaacacctctgcctcctcatttggc

SEQ ID NO: 852683 - DNA, 25 bp, Mus musculus
aaacacctctgcctgctcatttggc

SEQ ID NO: 852684 - DNA, 25 bp, Mus musculus
aaacacgaaaatctgattggtctgt

SEQ ID NO: 852685 - DNA, 25 bp, Mus musculus
aaacacgaaaatgtgattggtctgt

SEQ ID NO: 852686 - DNA, 25 bp, Mus musculus
aaacactacatgaactattacaatg

SEQ ID NO: 852687 - DNA, 25 bp, Mus musculus
aaacactacatgaagtattacaatg

SEQ ID NO: 852688 - DNA, 25 bp, Mus musculus
aaacactctactcgatgactggaaa

SEQ ID NO: 852689 - DNA, 25 bp, Mus musculus
aaacactctactggatgactggaaa

SEQ ID NO: 852690 - DNA, 25 bp, Mus musculus
aaacactgacagcgatcaagtttgt

SEQ ID NO: 852691 - DNA, 25 bp, Mus musculus
aaacactgacagggatcaagtttgt

SEQ ID NO: 852692 - DNA, 25 bp, Mus musculus
aaacactgtagaccttcgagtcaag

SEQ ID NO: 852693 - DNA, 25 bp, Mus musculus
aaacactgtagagcttcgagtcaag

SEQ ID NO: 852694 - DNA, 25 bp, Mus musculus
aaacactgtctaccaccatcaaaaa

SEQ ID NO: 852695 - DNA, 25 bp, Mus musculus
aaacactgtctagcaccatcaaaaa

SEQ ID NO: 852696 - DNA, 25 bp, Mus musculus
aaacactgtgggcaccaggcaacag

SEQ ID NO: 852697 - DNA, 25 bp, Mus musculus
aaacactgtgggcagcaggcaacag

SEQ ID NO: 852698 - DNA, 25 bp, Mus musculus
aaacagaacatgcacaaagaaatcc

SEQ ID NO: 852699 - DNA, 25 bp, Mus musculus
aaacagaacatgcagaaagaaatcc

SEQ ID NO: 852700 - DNA, 25 bp, Mus musculus
aaacagaattataacaattgaaatt

SEQ ID NO: 852701 - DNA, 25 bp, Mus musculus
aaacagaattttaacaattgaaatt

SEQ ID NO: 852702 - DNA, 25 bp, Mus musculus
aaacagacagccactcctaggagac

SEQ ID NO: 852703 - DNA, 25 bp, Mus musculus
aaacagacaggcactcctaggagac

SEQ ID NO: 852704 - DNA, 25 bp, Mus musculus
aaacagacccgactgggtgatcgtc

SEQ ID NO: 852705 - DNA, 25 bp, Mus musculus
aaacagacccgagtgggtgatcgtc

SEQ ID NO: 852706 - DNA, 25 bp, Mus musculus
aaacagagaaatcccatctgaagga

SEQ ID NO: 852707 - DNA, 25 bp, Mus musculus
aaacagagaaatgccatctgaagga

SEQ ID NO: 852708 - DNA, 25 bp, Mus musculus
aaacagagacagcttcacccagaac

SEQ ID NO: 852709 - DNA, 25 bp, Mus musculus
aaacagagacaggttcacccagaac

SEQ ID NO: 852710 - DNA, 25 bp, Mus musculus
aaacagcaagcgcctgtgagagaga

SEQ ID NO: 852711 - DNA, 25 bp, Mus musculus
aaacagcaagggcctgtgagagaga

SEQ ID NO: 852712 - DNA, 25 bp, Mus musculus
aaacagcacaagctttggcggaaat

SEQ ID NO: 852713 - DNA, 25 bp, Mus musculus
aaacagcacaaggtttggcggaaat

SEQ ID NO: 852714 - DNA, 25 bp, Mus musculus
aaacagcagaagctagagcttgaga

SEQ ID NO: 852715 - DNA, 25 bp, Mus musculus
aaacagcagaaggtagagcttgaga

SEQ ID NO: 852716 - DNA, 25 bp, Mus musculus
aaacagcccgatttgaccgcaacca

SEQ ID NO: 852717 - DNA, 25 bp, Mus musculus
aaacagcccgttttgaccgcaacca

SEQ ID NO: 852718 - DNA, 25 bp, Mus musculus
aaacagccttcaaacaatgtctgta

SEQ ID NO: 852719 - DNA, 25 bp, Mus musculus
aaacagccttcaaagaatgtctgta

SEQ ID NO: 852720 - DNA, 25 bp, Mus musculus
aaacagctgaagcatgctattgatg

SEQ ID NO: 852721 - DNA, 25 bp, Mus musculus
aaacagctgaagctgtgggatgtga

SEQ ID NO: 852722 - DNA, 25 bp, Mus musculus
aaacagctgaaggatgctattgatg

SEQ ID NO: 852723 - DNA, 25 bp, Mus musculus
aaacagctgaaggtgtgggatgtga

SEQ ID NO: 852724 - DNA, 25 bp, Mus musculus
aaacaggaaattcaccctcaagtac

SEQ ID NO: 852725 - DNA, 25 bp, Mus musculus
aaacaggaaattcacgcgatgctgg

SEQ ID NO: 852726 - DNA, 25 bp, Mus musculus
aaacaggaaattcagcctcaagtac

SEQ ID NO: 852727 - DNA, 25 bp, Mus musculus
aaacaggaaattcaggcgatgctgg

SEQ ID NO: 852728 - DNA, 25 bp, Mus musculus
aaacaggatcagcagtttgatttca

SEQ ID NO: 852729 - DNA, 25 bp, Mus musculus
aaacaggatcaggagtttgatttca

SEQ ID NO: 852730 - DNA, 25 bp, Mus musculus
aaacaggccacacgaaagcacagac

SEQ ID NO: 852731 - DNA, 25 bp, Mus musculus
aaacaggccacaggaaagcacagac

SEQ ID NO: 852732 - DNA, 25 bp, Mus musculus
aaacagtgtaggatacactttgaaa

SEQ ID NO: 852733 - DNA, 25 bp, Mus musculus
aaacagtgtaggttacactttgaaa

SEQ ID NO: 852734 - DNA, 25 bp, Mus musculus
aaacagtttgctttcgagcatggga

SEQ ID NO: 852735 - DNA, 25 bp, Mus musculus
aaacagtttgctttggagcatggga

SEQ ID NO: 852736 - DNA, 25 bp, Mus musculus
aaacatacagcggaaatatcagaag

SEQ ID NO: 852737 - DNA, 25 bp, Mus musculus
aaacatacaggggaaatatcagaag

SEQ ID NO: 852738 - DNA, 25 bp, Mus musculus
aaacatacatcttgccaggatgcat

SEQ ID NO: 852739 - DNA, 25 bp, Mus musculus
aaacatacatgttgccaggatgcat

SEQ ID NO: 852740 - DNA, 25 bp, Mus musculus
aaacatcatcaccaaactgaggctc

SEQ ID NO: 852741 - DNA, 25 bp, Mus musculus
aaacatcatcacgaaactgaggctc

SEQ ID NO: 852742 - DNA, 25 bp, Mus musculus
aaacatcatcatccctgagtttgag

SEQ ID NO: 852743 - DNA, 25 bp, Mus musculus
aaacatcatcatgcctgagtttgag

SEQ ID NO: 852744 - DNA, 25 bp, Mus musculus
aaacatcatgcttctcccaagacaa

SEQ ID NO: 852745 - DNA, 25 bp, Mus musculus
aaacatcatggttctcccaagacaa

SEQ ID NO: 852746 - DNA, 25 bp, Mus musculus
aaacatccagctggctctggtccag

SEQ ID NO: 852747 - DNA, 25 bp, Mus musculus
aaacatccaggtggctctggtccag

SEQ ID NO: 852748 - DNA, 25 bp, Mus musculus
aaacatcgataaccctgctattgct

SEQ ID NO: 852749 - DNA, 25 bp, Mus musculus
aaacatcgattaccctgctattgct

SEQ ID NO: 852750 - DNA, 25 bp, Mus musculus
aaacatctggaacgtatctcagacg

SEQ ID NO: 852751 - DNA, 25 bp, Mus musculus
aaacatctggaaggtatctcagacg

SEQ ID NO: 852752 - DNA, 25 bp, Mus musculus
aaacatcttgagatcttcaactttc

SEQ ID NO: 852753 - DNA, 25 bp, Mus musculus
aaacatcttgagttcttcaactttc

SEQ ID NO: 852754 - DNA, 25 bp, Mus musculus
aaacatgaactgttcgcccttgatt

SEQ ID NO: 852755 - DNA, 25 bp, Mus musculus
aaacatgaactgttggcccttgatt

SEQ ID NO: 852756 - DNA, 25 bp, Mus musculus
aaacatgcagctatgggttcataga

SEQ ID NO: 852757 - DNA, 25 bp, Mus musculus
aaacatgcaggtatgggttcataga

SEQ ID NO: 852758 - DNA, 25 bp, Mus musculus
aaacatgctgctggctgggacaacc

SEQ ID NO: 852759 - DNA, 25 bp, Mus musculus
aaacatgctgctggtgtcacaggtg

SEQ ID NO: 852760 - DNA, 25 bp, Mus musculus
aaacatgctggtggctgggacaacc

SEQ ID NO: 852761 - DNA, 25 bp, Mus musculus
aaacatgctggtggtgtcacaggtg

SEQ ID NO: 852762 - DNA, 25 bp, Mus musculus
aaacattatgagcgtgctctcgatc

SEQ ID NO: 852763 - DNA, 25 bp, Mus musculus
aaacattatgagggtgctctcgatc

SEQ ID NO: 852764 - DNA, 25 bp, Mus musculus
aaacattcataaaacagtaagtgag

SEQ ID NO: 852765 - DNA, 25 bp, Mus musculus
aaacattcataaaagagtaagtgag

SEQ ID NO: 852766 - DNA, 25 bp, Mus musculus
aaacattccatggaccatgtgtcca

SEQ ID NO: 852767 - DNA, 25 bp, Mus musculus
aaacattccatggagcatgtgtcca

SEQ ID NO: 852768 - DNA, 25 bp, Mus musculus
aaacattgtgaacatgtgaacgagt

SEQ ID NO: 852769 - DNA, 25 bp, Mus musculus
aaacattgtgaagatgtgaacgagt

SEQ ID NO: 852770 - DNA, 25 bp, Mus musculus
aaacattttattcaaccaacaacta

SEQ ID NO: 852771 - DNA, 25 bp, Mus musculus
aaacattttattcaagcttaggtgg

SEQ ID NO: 852772 - DNA, 25 bp, Mus musculus
aaacattttattcaattttctggat

SEQ ID NO: 852773 - DNA, 25 bp, Mus musculus
aaacattttattcatccaacaacta

SEQ ID NO: 852774 - DNA, 25 bp, Mus musculus
aaacattttattcatgcttaggtgg

SEQ ID NO: 852775 - DNA, 25 bp, Mus musculus
aaacattttattcatttttctggat

SEQ ID NO: 852776 - DNA, 25 bp, Mus musculus
aaacattttcaaatctggaggctaa

SEQ ID NO: 852777 - DNA, 25 bp, Mus musculus
aaacattttcaattctggaggctaa

SEQ ID NO: 852778 - DNA, 25 bp, Mus musculus
aaaccaaaagaacgcctggcactca

SEQ ID NO: 852779 - DNA, 25 bp, Mus musculus
aaaccaaaagaaggcctggcactca

SEQ ID NO: 852780 - DNA, 25 bp, Mus musculus
aaaccaaacaatttgctcctattca

SEQ ID NO: 852781 - DNA, 25 bp, Mus musculus
aaaccaaacattttgctcctattca

SEQ ID NO: 852782 - DNA, 25 bp, Mus musculus
aaaccaaagctatgcagagtcagcg

SEQ ID NO: 852783 - DNA, 25 bp, Mus musculus
aaaccaaagctatggagagtcagcg

SEQ ID NO: 852784 - DNA, 25 bp, Mus musculus
aaaccaagatctcgcctggctggac

SEQ ID NO: 852785 - DNA, 25 bp, Mus musculus
aaaccaagatgtcgcctggctggac

SEQ ID NO: 852786 - DNA, 25 bp, Mus musculus
aaaccaatgtgacagggcgattgtt

SEQ ID NO: 852787 - DNA, 25 bp, Mus musculus
aaaccaatgtgagagggcgattgtt

SEQ ID NO: 852788 - DNA, 25 bp, Mus musculus
aaaccaccaaagctgcctactcact

SEQ ID NO: 852789 - DNA, 25 bp, Mus musculus
aaaccaccaaaggtgcctactcact

SEQ ID NO: 852790 - DNA, 25 bp, Mus musculus
aaaccacctcagcagtgaagcgtgt

SEQ ID NO: 852791 - DNA, 25 bp, Mus musculus
aaaccacctcaggagtgaagcgtgt

SEQ ID NO: 852792 - DNA, 25 bp, Mus musculus
aaaccagaaagacaccagcagcacg

SEQ ID NO: 852793 - DNA, 25 bp, Mus musculus
aaaccagaaagagaccagcagcacg

SEQ ID NO: 852794 - DNA, 25 bp, Mus musculus
aaaccagaagaatctaatcaaatta

SEQ ID NO: 852795 - DNA, 25 bp, Mus musculus
aaaccagaagtatctaatcaaatta

SEQ ID NO: 852796 - DNA, 25 bp, Mus musculus
aaaccagagaagggcaagtcctggg

SEQ ID NO: 852797 - DNA, 25 bp, Mus musculus
aaaccagagatgggcaagtcctggg

SEQ ID NO: 852798 - DNA, 25 bp, Mus musculus
aaaccagagccaagcggtgctctta

SEQ ID NO: 852799 - DNA, 25 bp, Mus musculus
aaaccagagccaagtggaaccaggc

SEQ ID NO: 852800 - DNA, 25 bp, Mus musculus
aaaccagagccatgcggtgctctta

SEQ ID NO: 852801 - DNA, 25 bp, Mus musculus
aaaccagagccatgtggaaccaggc

SEQ ID NO: 852802 - DNA, 25 bp, Mus musculus
aaaccagaggcgcaggacacaggcc

SEQ ID NO: 852803 - DNA, 25 bp, Mus musculus
aaaccagaggggcaggacacaggcc

SEQ ID NO: 852804 - DNA, 25 bp, Mus musculus
aaaccaggaaaaagtttacatgagg

SEQ ID NO: 852805 - DNA, 25 bp, Mus musculus
aaaccaggaaaatgtttacatgagg

SEQ ID NO: 852806 - DNA, 25 bp, Mus musculus
aaaccaggacagcattccccctctg

SEQ ID NO: 852807 - DNA, 25 bp, Mus musculus
aaaccaggacaggattccccctctg

SEQ ID NO: 852808 - DNA, 25 bp, Mus musculus
aaaccaggctctcgccaggcagtac

SEQ ID NO: 852809 - DNA, 25 bp, Mus musculus
aaaccaggctctggccaggcagtac

SEQ ID NO: 852810 - DNA, 25 bp, Mus musculus
aaaccataccaaaatggcagacctt

SEQ ID NO: 852811 - DNA, 25 bp, Mus musculus
aaaccataccaatatggcagacctt

SEQ ID NO: 852812 - DNA, 25 bp, Mus musculus
aaaccatcacaaagactgcttcatc

SEQ ID NO: 852813 - DNA, 25 bp, Mus musculus
aaaccatcacaatgactgcttcatc

SEQ ID NO: 852814 - DNA, 25 bp, Mus musculus
aaaccatcatgccacgtacccgcaa

SEQ ID NO: 852815 - DNA, 25 bp, Mus musculus
aaaccatcatgccaggtacccgcaa

SEQ ID NO: 852816 - DNA, 25 bp, Mus musculus
aaaccatgaggacgaagtcaacacc

SEQ ID NO: 852817 - DNA, 25 bp, Mus musculus
aaaccatgaggaggaagtcaacacc

SEQ ID NO: 852818 - DNA, 25 bp, Mus musculus
aaaccatggcaacatctccaaggag

SEQ ID NO: 852819 - DNA, 25 bp, Mus musculus
aaaccatggcaagatctccaaggag

SEQ ID NO: 852820 - DNA, 25 bp, Mus musculus
aaaccatggcagaacaaaaatcaga

SEQ ID NO: 852821 - DNA, 25 bp, Mus musculus
aaaccatggcagctacagagctatc

SEQ ID NO: 852822 - DNA, 25 bp, Mus musculus
aaaccatggcaggtacagagctatc

SEQ ID NO: 852823 - DNA, 25 bp, Mus musculus
aaaccatggcagtacaaaaatcaga

SEQ ID NO: 852824 - DNA, 25 bp, Mus musculus
aaaccatgtatacacatgccgatga

SEQ ID NO: 852825 - DNA, 25 bp, Mus musculus
aaaccatgtatacagatgccgatga

SEQ ID NO: 852826 - DNA, 25 bp, Mus musculus
aaacccaagcgtctgtgcaaggagc

SEQ ID NO: 852827 - DNA, 25 bp, Mus musculus
aaacccaagcgtgtgtgcaaggagc

SEQ ID NO: 852828 - DNA, 25 bp, Mus musculus
aaacccaatcataaagtcttgtcca

SEQ ID NO: 852829 - DNA, 25 bp, Mus musculus
aaacccaatcataatgtcttgtcca

SEQ ID NO: 852830 - DNA, 25 bp, Mus musculus
aaacccagacacaaccattcccact

SEQ ID NO: 852831 - DNA, 25 bp, Mus musculus
aaacccagacacaagcattcccact

SEQ ID NO: 852832 - DNA, 25 bp, Mus musculus
aaacccagagcgccagtaagagctc

SEQ ID NO: 852833 - DNA, 25 bp, Mus musculus
aaacccagagggccagtaagagctc

SEQ ID NO: 852834 - DNA, 25 bp, Mus musculus
aaacccagctcgtctctgcggtcac

SEQ ID NO: 852835 - DNA, 25 bp, Mus musculus
aaacccagctggtctctgcggtcac

SEQ ID NO: 852836 - DNA, 25 bp, Mus musculus
aaaccccacgcaagccccacttgtg

SEQ ID NO: 852837 - DNA, 25 bp, Mus musculus
aaaccccacgcatgccccacttgtg

SEQ ID NO: 852838 - DNA, 25 bp, Mus musculus
aaacccctgtccttcccaaccagtg

SEQ ID NO: 852839 - DNA, 25 bp, Mus musculus
aaacccctgtccttgccaaccagtg

SEQ ID NO: 852840 - DNA, 25 bp, Mus musculus
aaacccgctgatgcccctcgacatg

SEQ ID NO: 852841 - DNA, 25 bp, Mus musculus
aaacccgctgttgcccctcgacatg

SEQ ID NO: 852842 - DNA, 25 bp, Mus musculus
aaaccctacgcacacagtatgatag

SEQ ID NO: 852843 - DNA, 25 bp, Mus musculus
aaaccctacgcacagagtatgatag

SEQ ID NO: 852844 - DNA, 25 bp, Mus musculus
aaaccctgaaccaaaattttcatgg

SEQ ID NO: 852845 - DNA, 25 bp, Mus musculus
aaaccctgaaccaatattttcatgg

SEQ ID NO: 852846 - DNA, 25 bp, Mus musculus
aaaccgcaagcgagaccccatcagt

SEQ ID NO: 852847 - DNA, 25 bp, Mus musculus
aaaccgcaagcgagtccccatcagt

SEQ ID NO: 852848 - DNA, 25 bp, Mus musculus
aaaccgcaggcttatgatggagcag

SEQ ID NO: 852849 - DNA, 25 bp, Mus musculus
aaaccgcagggttatgatggagcag

SEQ ID NO: 852850 - DNA, 25 bp, Mus musculus
aaaccggactaccaccttctaacat

SEQ ID NO: 852851 - DNA, 25 bp, Mus musculus
aaaccggactaccagcttctaacat

SEQ ID NO: 852852 - DNA, 25 bp, Mus musculus
aaacctagaggctacggcacctgga

SEQ ID NO: 852853 - DNA, 25 bp, Mus musculus
aaacctagaggctagggcacctgga

SEQ ID NO: 852854 - DNA, 25 bp, Mus musculus
aaacctatgtgggacgatgatgcaa

SEQ ID NO: 852855 - DNA, 25 bp, Mus musculus
aaacctatgtgggaggatgatgcaa

SEQ ID NO: 852856 - DNA, 25 bp, Mus musculus
aaacctcaattcagtggttgaattt

SEQ ID NO: 852857 - DNA, 25 bp, Mus musculus
aaacctcaattctgtggttgaattt

SEQ ID NO: 852858 - DNA, 25 bp, Mus musculus
aaacctccacagcgcacagaatcca

SEQ ID NO: 852859 - DNA, 25 bp, Mus musculus
aaacctccacagggcacagaatcca

SEQ ID NO: 852860 - DNA, 25 bp, Mus musculus
aaacctctgcggcggtatctgacct

SEQ ID NO: 852861 - DNA, 25 bp, Mus musculus
aaacctctgcgggggtatctgacct

SEQ ID NO: 852862 - DNA, 25 bp, Mus musculus
aaacctgaagcaactgagagagaga

SEQ ID NO: 852863 - DNA, 25 bp, Mus musculus
aaacctgaaggaactgagagagaga

SEQ ID NO: 852864 - DNA, 25 bp, Mus musculus
aaacctgcaaccaacatgagtcctt

SEQ ID NO: 852865 - DNA, 25 bp, Mus musculus
aaacctgcaaccaagatgagtcctt

SEQ ID NO: 852866 - DNA, 25 bp, Mus musculus
aaacctgcagggagcctgtttgtgt

SEQ ID NO: 852867 - DNA, 25 bp, Mus musculus
aaacctgcagggaggctgtttgtgt

SEQ ID NO: 852868 - DNA, 25 bp, Mus musculus
aaacctggtctcactctttctcatc

SEQ ID NO: 852869 - DNA, 25 bp, Mus musculus
aaacctggtctctctctttctcatc

SEQ ID NO: 852870 - DNA, 25 bp, Mus musculus
aaacctgtatagaactgggaagatg

SEQ ID NO: 852871 - DNA, 25 bp, Mus musculus
aaacctgtatagaagtgggaagatg

SEQ ID NO: 852872 - DNA, 25 bp, Mus musculus
aaacctgtggagatattgatgaatg

SEQ ID NO: 852873 - DNA, 25 bp, Mus musculus
aaacctgtggagttattgatgaatg

SEQ ID NO: 852874 - DNA, 25 bp, Mus musculus
aaaccttcctgagtcagctcattgc

SEQ ID NO: 852875 - DNA, 25 bp, Mus musculus
aaaccttcctgagtgagctcattgc

SEQ ID NO: 852876 - DNA, 25 bp, Mus musculus
aaacctttgccaaacgccactgtgg

SEQ ID NO: 852877 - DNA, 25 bp, Mus musculus
aaacctttgccaaaggccactgtgg

SEQ ID NO: 852878 - DNA, 25 bp, Mus musculus
aaacgaaactggctggaagaatggt

SEQ ID NO: 852879 - DNA, 25 bp, Mus musculus
aaacgaaactgggtggaagaatggt

SEQ ID NO: 852880 - DNA, 25 bp, Mus musculus
aaacgaacaacactctgacaccacc

SEQ ID NO: 852881 - DNA, 25 bp, Mus musculus
aaacgaacaaccaggttcaggagat

SEQ ID NO: 852882 - DNA, 25 bp, Mus musculus
aaacgaacaagactctgacaccacc

SEQ ID NO: 852883 - DNA, 25 bp, Mus musculus
aaacgaacaagcaggttcaggagat

SEQ ID NO: 852884 - DNA, 25 bp, Mus musculus
aaacgaagaccacacgcaaatccta

SEQ ID NO: 852885 - DNA, 25 bp, Mus musculus
aaacgaagaccacaggcaaatccta

SEQ ID NO: 852886 - DNA, 25 bp, Mus musculus
aaacgaatcaccttatgaccagaag

SEQ ID NO: 852887 - DNA, 25 bp, Mus musculus
aaacgaatcagcttatgaccagaag

SEQ ID NO: 852888 - DNA, 25 bp, Mus musculus
aaacgagaagcaacaagagctcaac

SEQ ID NO: 852889 - DNA, 25 bp, Mus musculus
aaacgagaaggaacaagagctcaac

SEQ ID NO: 852890 - DNA, 25 bp, Mus musculus
aaacgagtagaacatgaaagtctgg

SEQ ID NO: 852891 - DNA, 25 bp, Mus musculus
aaacgagtagaagatgaaagtctgg

SEQ ID NO: 852892 - DNA, 25 bp, Mus musculus
aaacgagtgtagtacgtctgttcct

SEQ ID NO: 852893 - DNA, 25 bp, Mus musculus
aaacgagtgtagtaggtctgttcct

SEQ ID NO: 852894 - DNA, 25 bp, Mus musculus
aaacgatggcagagtgaatgggaaa

SEQ ID NO: 852895 - DNA, 25 bp, Mus musculus
aaacgatggcagtgtgaatgggaaa

SEQ ID NO: 852896 - DNA, 25 bp, Mus musculus
aaacgatttctgcgaccttcgagaa

SEQ ID NO: 852897 - DNA, 25 bp, Mus musculus
aaacgatttctgggaccttcgagaa

SEQ ID NO: 852898 - DNA, 25 bp, Mus musculus
aaacgatttgaaaacaatgggatca

SEQ ID NO: 852899 - DNA, 25 bp, Mus musculus
aaacgatttgaaaagaatgggatca

SEQ ID NO: 852900 - DNA, 25 bp, Mus musculus
aaacgccacaactctgatgctcaca

SEQ ID NO: 852901 - DNA, 25 bp, Mus musculus
aaacgccacatctctgatgctcaca

SEQ ID NO: 852902 - DNA, 25 bp, Mus musculus
aaacgctgtcctgtcgaggtgtaaa

SEQ ID NO: 852903 - DNA, 25 bp, Mus musculus
aaacgctgtcctgtggaggtgtaaa

SEQ ID NO: 852904 - DNA, 25 bp, Mus musculus
aaacggaaatgcagtttcttcaggt

SEQ ID NO: 852905 - DNA, 25 bp, Mus musculus
aaacggaaatgctgtttcttcaggt

SEQ ID NO: 852906 - DNA, 25 bp, Mus musculus
aaacggacacacagttgatccgagg

SEQ ID NO: 852907 - DNA, 25 bp, Mus musculus
aaacggacacactgttgatccgagg

SEQ ID NO: 852908 - DNA, 25 bp, Mus musculus
aaacggaccgcagaccggactatac

SEQ ID NO: 852909 - DNA, 25 bp, Mus musculus
aaacggaccgcagacggactataca

SEQ ID NO: 852910 - DNA, 25 bp, Mus musculus
aaacggaccgcagagcggactatac

SEQ ID NO: 852911 - DNA, 25 bp, Mus musculus
aaacggaccgcagagggactataca

SEQ ID NO: 852912 - DNA, 25 bp, Mus musculus
aaacggatccagaacgaactgactg

SEQ ID NO: 852913 - DNA, 25 bp, Mus musculus
aaacggatccagaacgttgctttca

SEQ ID NO: 852914 - DNA, 25 bp, Mus musculus
aaacggatccagaaggaactgactg

SEQ ID NO: 852915 - DNA, 25 bp, Mus musculus
aaacggatccagaaggttgctttca

SEQ ID NO: 852916 - DNA, 25 bp, Mus musculus
aaacggcacacacagtggacttgat

SEQ ID NO: 852917 - DNA, 25 bp, Mus musculus
aaacggcacacagagtggacttgat

SEQ ID NO: 852918 - DNA, 25 bp, Mus musculus
aaacggcaggaggaggaagaggtgg

SEQ ID NO: 852919 - DNA, 25 bp, Mus musculus
aaacggcaggtggaggaagaggtgg

SEQ ID NO: 852920 - DNA, 25 bp, Mus musculus
aaacggtgcacaagtcaatgcccag

SEQ ID NO: 852921 - DNA, 25 bp, Mus musculus
aaacggtgcacatgtcaatgcccag

SEQ ID NO: 852922 - DNA, 25 bp, Mus musculus
aaacgtctgcaccacacccacaggc

SEQ ID NO: 852923 - DNA, 25 bp, Mus musculus
aaacgtctgcaccagacccacaggc

SEQ ID NO: 852924 - DNA, 25 bp, Mus musculus
aaacgtctggccgatgacaacctgt

SEQ ID NO: 852925 - DNA, 25 bp, Mus musculus
aaacgtctgggcgatgacaacctgt

SEQ ID NO: 852926 - DNA, 25 bp, Mus musculus
aaactaaaaaaaagtgacgagatgt

SEQ ID NO: 852927 - DNA, 25 bp, Mus musculus
aaactaaaaataagtgacgagatgt

SEQ ID NO: 852928 - DNA, 25 bp, Mus musculus
aaactaagacagcttgaagaagaga

SEQ ID NO: 852929 - DNA, 25 bp, Mus musculus
aaactaagacaggttgaagaagaga

SEQ ID NO: 852930 - DNA, 25 bp, Mus musculus
aaactaattgatgacatggttggta

SEQ ID NO: 852931 - DNA, 25 bp, Mus musculus
aaactaattgatgagatggttggta

SEQ ID NO: 852932 - DNA, 25 bp, Mus musculus
aaactacctggaagcccagtactat

SEQ ID NO: 852933 - DNA, 25 bp, Mus musculus
aaactacctggatgcccagtactat

SEQ ID NO: 852934 - DNA, 25 bp, Mus musculus
aaactagacaagatgtcttgggaag

SEQ ID NO: 852935 - DNA, 25 bp, Mus musculus
aaactagacaagttgtcttgggaag

SEQ ID NO: 852936 - DNA, 25 bp, Mus musculus
aaactaggttttcacgtcatcttca

SEQ ID NO: 852937 - DNA, 25 bp, Mus musculus
aaactaggttttcaggtcatcttca

SEQ ID NO: 852938 - DNA, 25 bp, Mus musculus
aaactatactacaggcccgctgctg

SEQ ID NO: 852939 - DNA, 25 bp, Mus musculus
aaactatacttcaggcccgctgctg

SEQ ID NO: 852940 - DNA, 25 bp, Mus musculus
aaactatcagctactctatctacaa

SEQ ID NO: 852941 - DNA, 25 bp, Mus musculus
aaactatcaggtactctatctacaa

SEQ ID NO: 852942 - DNA, 25 bp, Mus musculus
aaactatgagcacgtcaacatggac

SEQ ID NO: 852943 - DNA, 25 bp, Mus musculus
aaactatgagcaggtcaacatggac

SEQ ID NO: 852944 - DNA, 25 bp, Mus musculus
aaactcaaccagaaactgaagaatt

SEQ ID NO: 852945 - DNA, 25 bp, Mus musculus
aaactcaaccagtaactgaagaatt

SEQ ID NO: 852946 - DNA, 25 bp, Mus musculus
aaactcaagcagctgttctttggct

SEQ ID NO: 852947 - DNA, 25 bp, Mus musculus
aaactcaagcaggtgttctttggct

SEQ ID NO: 852948 - DNA, 25 bp, Mus musculus
aaactcaaggagccagagacccgtg

SEQ ID NO: 852949 - DNA, 25 bp, Mus musculus
aaactcaaggaggcagagacccgtg

SEQ ID NO: 852950 - DNA, 25 bp, Mus musculus
aaactcaatgaaaaagtcatggttt

SEQ ID NO: 852951 - DNA, 25 bp, Mus musculus
aaactcaatgaaaatgtcatggttt

SEQ ID NO: 852952 - DNA, 25 bp, Mus musculus
aaactcagaactcacatcaccacaa

SEQ ID NO: 852953 - DNA, 25 bp, Mus musculus
aaactcagaactcagatcaccacaa

SEQ ID NO: 852954 - DNA, 25 bp, Mus musculus
aaactcagcacaaaggatcataaga

SEQ ID NO: 852955 - DNA, 25 bp, Mus musculus
aaactcagcacataggatcataaga

SEQ ID NO: 852956 - DNA, 25 bp, Mus musculus
aaactcagccagagcccccttagca

SEQ ID NO: 852957 - DNA, 25 bp, Mus musculus
aaactcagccagtgcccccttagca

SEQ ID NO: 852958 - DNA, 25 bp, Mus musculus
aaactcatcatgcgcgagtgcattt

SEQ ID NO: 852959 - DNA, 25 bp, Mus musculus
aaactcatcatgggcgagtgcattt

SEQ ID NO: 852960 - DNA, 25 bp, Mus musculus
aaactccaccagcacctccagacaa

SEQ ID NO: 852961 - DNA, 25 bp, Mus musculus
aaactccaccagcagctccagacaa

SEQ ID NO: 852962 - DNA, 25 bp, Mus musculus
aaactccagaaaatgtggctcccga

SEQ ID NO: 852963 - DNA, 25 bp, Mus musculus
aaactccagaaattgtggctcccga

SEQ ID NO: 852964 - DNA, 25 bp, Mus musculus
aaactccatgcaagagccaaattta

SEQ ID NO: 852965 - DNA, 25 bp, Mus musculus
aaactccatgcaagtgccaaattta

SEQ ID NO: 852966 - DNA, 25 bp, Mus musculus
aaactctaatcggtcaggctccttc

SEQ ID NO: 852967 - DNA, 25 bp, Mus musculus
aaactctaatgggtcaggctccttc

SEQ ID NO: 852968 - DNA, 25 bp, Mus musculus
aaactctcaccaaaatgtgagcgtg

SEQ ID NO: 852969 - DNA, 25 bp, Mus musculus
aaactctcaccataatgtgagcgtg

SEQ ID NO: 852970 - DNA, 25 bp, Mus musculus
aaactctcagagaaccgagcccgaa

SEQ ID NO: 852971 - DNA, 25 bp, Mus musculus
aaactctcagagtaccgagcccgaa

SEQ ID NO: 852972 - DNA, 25 bp, Mus musculus
aaactctccccccatcttcatcatc

SEQ ID NO: 852973 - DNA, 25 bp, Mus musculus
aaactctcccgccatcttcatcatc

SEQ ID NO: 852974 - DNA, 25 bp, Mus musculus
aaactcttagctgtgtgtgccgttg

SEQ ID NO: 852975 - DNA, 25 bp, Mus musculus
aaactcttaggtgtgtgtgccgttg

SEQ ID NO: 852976 - DNA, 25 bp, Mus musculus
aaactcttgatagtcatctttccag

SEQ ID NO: 852977 - DNA, 25 bp, Mus musculus
aaactcttgatagtgatctttccag

SEQ ID NO: 852978 - DNA, 25 bp, Mus musculus
aaactgaagcggcactaccctgatg

SEQ ID NO: 852979 - DNA, 25 bp, Mus musculus
aaactgaagcgggactaccctgatg

SEQ ID NO: 852980 - DNA, 25 bp, Mus musculus
aaactgagacagcccttgcaaggag

SEQ ID NO: 852981 - DNA, 25 bp, Mus musculus
aaactgagacaggccttgcaaggag

SEQ ID NO: 852982 - DNA, 25 bp, Mus musculus
aaactgagcaatttgctctgtaaag

SEQ ID NO: 852983 - DNA, 25 bp, Mus musculus
aaactgagcacattaatccagtaac

SEQ ID NO: 852984 - DNA, 25 bp, Mus musculus
aaactgagcaccaaacaacatgtaa

SEQ ID NO: 852985 - DNA, 25 bp, Mus musculus
aaactgagcaccaagcttacaatga

SEQ ID NO: 852986 - DNA, 25 bp, Mus musculus
aaactgagcaccagaataaagatga

SEQ ID NO: 852987 - DNA, 25 bp, Mus musculus
aaactgagcagattaatccagtaac

SEQ ID NO: 852988 - DNA, 25 bp, Mus musculus
aaactgagcagcaaacaacatgtaa

SEQ ID NO: 852989 - DNA, 25 bp, Mus musculus
aaactgagcagcaagcttacaatga

SEQ ID NO: 852990 - DNA, 25 bp, Mus musculus
aaactgagcagcagaataaagatga

SEQ ID NO: 852991 - DNA, 25 bp, Mus musculus
aaactgagcattttgctctgtaaag

SEQ ID NO: 852992 - DNA, 25 bp, Mus musculus
aaactgcaagatgatgatcatgctg

SEQ ID NO: 852993 - DNA, 25 bp, Mus musculus
aaactgcaagatgcacccagctggt

SEQ ID NO: 852994 - DNA, 25 bp, Mus musculus
aaactgcaagcgaaagaccatgttt

SEQ ID NO: 852995 - DNA, 25 bp, Mus musculus
aaactgcaagggaaagaccatgttt

SEQ ID NO: 852996 - DNA, 25 bp, Mus musculus
aaactgcaagttgatgatcatgctg

SEQ ID NO: 852997 - DNA, 25 bp, Mus musculus
aaactgcaagttgcacccagctggt

SEQ ID NO: 852998 - DNA, 25 bp, Mus musculus
aaactgccccagctggcagaagaga

SEQ ID NO: 852999 - DNA, 25 bp, Mus musculus
aaactgccccaggtggcagaagaga

SEQ ID NO: 853000 - DNA, 25 bp, Mus musculus
aaactgcctgcaagcggcagctgga

SEQ ID NO: 853001 - DNA, 25 bp, Mus musculus
aaactgcctggaagcggcagctgga

SEQ ID NO: 853002 - DNA, 25 bp, Mus musculus
aaactgcctggccacttcagcatat

SEQ ID NO: 853003 - DNA, 25 bp, Mus musculus
aaactgcctggccagttcagcatat

SEQ ID NO: 853004 - DNA, 25 bp, Mus musculus
aaactgctacagcgttagcattcta

SEQ ID NO: 853005 - DNA, 25 bp, Mus musculus
aaactgctacagggttagcattcta

SEQ ID NO: 853006 - DNA, 25 bp, Mus musculus
aaactgcttaaacaaggtgattctg

SEQ ID NO: 853007 - DNA, 25 bp, Mus musculus
aaactgcttaaacatggtgattctg

SEQ ID NO: 853008 - DNA, 25 bp, Mus musculus
aaactgcttcagctccaagaggttt

SEQ ID NO: 853009 - DNA, 25 bp, Mus musculus
aaactgcttcaggtccaagaggttt

SEQ ID NO: 853010 - DNA, 25 bp, Mus musculus
aaactggaatcacgtggtagatgca

SEQ ID NO: 853011 - DNA, 25 bp, Mus musculus
aaactggaatcaggtggtagatgca

SEQ ID NO: 853012 - DNA, 25 bp, Mus musculus
aaactggagccaccccaaatctgcc

SEQ ID NO: 853013 - DNA, 25 bp, Mus musculus
aaactggagccagcccaaatctgcc

SEQ ID NO: 853014 - DNA, 25 bp, Mus musculus
aaactgggaccgagcctgcaggtgt

SEQ ID NO: 853015 - DNA, 25 bp, Mus musculus
aaactgggaccgtgcctgcaggtgt

SEQ ID NO: 853016 - DNA, 25 bp, Mus musculus
aaactggggccgctgattccctctg

SEQ ID NO: 853017 - DNA, 25 bp, Mus musculus
aaactggggccggtgattccctctg

SEQ ID NO: 853018 - DNA, 25 bp, Mus musculus
aaactggtacagaacaatatctccc

SEQ ID NO: 853019 - DNA, 25 bp, Mus musculus
aaactggtacagtacaatatctccc

SEQ ID NO: 853020 - DNA, 25 bp, Mus musculus
aaactggtctctacttggctctgaa

SEQ ID NO: 853021 - DNA, 25 bp, Mus musculus
aaactggtctgtacttggctctgaa

SEQ ID NO: 853022 - DNA, 25 bp, Mus musculus
aaactgtcctgacagtactatctgc

SEQ ID NO: 853023 - DNA, 25 bp, Mus musculus
aaactgtcctgagagtactatctgc

SEQ ID NO: 853024 - DNA, 25 bp, Mus musculus
aaactgtgtgactacttctccacac

SEQ ID NO: 853025 - DNA, 25 bp, Mus musculus
aaactgtgtgtctacttctccacac

SEQ ID NO: 853026 - DNA, 25 bp, Mus musculus
aaactgttctccggtggagggagac

SEQ ID NO: 853027 - DNA, 25 bp, Mus musculus
aaactgttctgcggtggagggagac

SEQ ID NO: 853028 - DNA, 25 bp, Mus musculus
aaacttaaagacaggcaagagattt

SEQ ID NO: 853029 - DNA, 25 bp, Mus musculus
aaacttaaagccagccaagccaggg

SEQ ID NO: 853030 - DNA, 25 bp, Mus musculus
aaacttaaagccagtcaggcaagag

SEQ ID NO: 853031 - DNA, 25 bp, Mus musculus
aaacttaaaggcagccaagccaggg

SEQ ID NO: 853032 - DNA, 25 bp, Mus musculus
aaacttaaaggcagtcaggcaagag

SEQ ID NO: 853033 - DNA, 25 bp, Mus musculus
aaacttaaagtcaggcaagagattt

SEQ ID NO: 853034 - DNA, 25 bp, Mus musculus
aaacttaagtaccacgtgctggacg

SEQ ID NO: 853035 - DNA, 25 bp, Mus musculus
aaacttaagtaccaggtgctggacg

SEQ ID NO: 853036 - DNA, 25 bp, Mus musculus
aaacttacatcaaaattatattatg

SEQ ID NO: 853037 - DNA, 25 bp, Mus musculus
aaacttacatctttgaggattgcgt

SEQ ID NO: 853038 - DNA, 25 bp, Mus musculus
aaacttacatgaaaattatattatg

SEQ ID NO: 853039 - DNA, 25 bp, Mus musculus
aaacttacatgtttgaggattgcgt

SEQ ID NO: 853040 - DNA, 25 bp, Mus musculus
aaacttcaagaaccatacagtttct

SEQ ID NO: 853041 - DNA, 25 bp, Mus musculus
aaacttcaagaactaccagtacata

SEQ ID NO: 853042 - DNA, 25 bp, Mus musculus
aaacttcaagaagcatacagtttct

SEQ ID NO: 853043 - DNA, 25 bp, Mus musculus
aaacttcaagaagtaccagtacata

SEQ ID NO: 853044 - DNA, 25 bp, Mus musculus
aaacttccaaaaccccctgtcatca

SEQ ID NO: 853045 - DNA, 25 bp, Mus musculus
aaacttccaaaagcccctgtcatca

SEQ ID NO: 853046 - DNA, 25 bp, Mus musculus
aaacttccagatttgaagaggaatg

SEQ ID NO: 853047 - DNA, 25 bp, Mus musculus
aaacttccagttttgaagaggaatg

SEQ ID NO: 853048 - DNA, 25 bp, Mus musculus
aaacttcgggaagaccgccaccagg

SEQ ID NO: 853049 - DNA, 25 bp, Mus musculus
aaacttcgggaagagcgccaccagg

SEQ ID NO: 853050 - DNA, 25 bp, Mus musculus
aaacttggagcaggcaccgctcctc

SEQ ID NO: 853051 - DNA, 25 bp, Mus musculus
aaacttggaggaggcaccgctcctc

SEQ ID NO: 853052 - DNA, 25 bp, Mus musculus
aaacttggtggacaatgttgctaaa

SEQ ID NO: 853053 - DNA, 25 bp, Mus musculus
aaacttggtggacattgttgctaaa

SEQ ID NO: 853054 - DNA, 25 bp, Mus musculus
aaactttcttccatgatagagtcta

SEQ ID NO: 853055 - DNA, 25 bp, Mus musculus
aaactttcttccttgatagagtcta

SEQ ID NO: 853056 - DNA, 25 bp, Mus musculus
aaactttgagctctcccatgacttt

SEQ ID NO: 853057 - DNA, 25 bp, Mus musculus
aaactttgaggtctcccatgacttt

SEQ ID NO: 853058 - DNA, 25 bp, Mus musculus
aaactttgccgaatcacaggaccag

SEQ ID NO: 853059 - DNA, 25 bp, Mus musculus
aaactttgccgattcacaggaccag

SEQ ID NO: 853060 - DNA, 25 bp, Mus musculus
aaacttttccagagtgtccattgtc

SEQ ID NO: 853061 - DNA, 25 bp, Mus musculus
aaacttttccagtgtgtccattgtc

SEQ ID NO: 853062 - DNA, 25 bp, Mus musculus
aaagaaaatatttacattgaggatg

SEQ ID NO: 853063 - DNA, 25 bp, Mus musculus
aaagaaaatatttagattgaggatg

SEQ ID NO: 853064 - DNA, 25 bp, Mus musculus
aaagaaaatgatgccgtaaccattc

SEQ ID NO: 853065 - DNA, 25 bp, Mus musculus
aaagaaaatgatgcggtaaccattc

SEQ ID NO: 853066 - DNA, 25 bp, Mus musculus
aaagaaacaaaacacagctgaactt

SEQ ID NO: 853067 - DNA, 25 bp, Mus musculus
aaagaaacaaaacagagctgaactt

SEQ ID NO: 853068 - DNA, 25 bp, Mus musculus
aaagaaacttcacgtggccacagcc

SEQ ID NO: 853069 - DNA, 25 bp, Mus musculus
aaagaaacttcaggtggccacagcc

SEQ ID NO: 853070 - DNA, 25 bp, Mus musculus
aaagaaagaacacttgtttatggca

SEQ ID NO: 853071 - DNA, 25 bp, Mus musculus
aaagaaagaacagttgtttatggca

SEQ ID NO: 853072 - DNA, 25 bp, Mus musculus
aaagaaagaatccacagaggaagac

SEQ ID NO: 853073 - DNA, 25 bp, Mus musculus
aaagaaagaatccagagaggaagac

SEQ ID NO: 853074 - DNA, 25 bp, Mus musculus
aaagaaagagagaccagagggacaa

SEQ ID NO: 853075 - DNA, 25 bp, Mus musculus
aaagaaagagagatggcagcagcag

SEQ ID NO: 853076 - DNA, 25 bp, Mus musculus
aaagaaagagagtccagagggacaa

SEQ ID NO: 853077 - DNA, 25 bp, Mus musculus
aaagaaagagagttcgatgcccaag

SEQ ID NO: 853078 - DNA, 25 bp, Mus musculus
aaagaaagagagttggcagcagcag

SEQ ID NO: 853079 - DNA, 25 bp, Mus musculus
aaagaaagagattgacctggtgtgt

SEQ ID NO: 853080 - DNA, 25 bp, Mus musculus
aaagaaagagtgttcgatgcccaag

SEQ ID NO: 853081 - DNA, 25 bp, Mus musculus
aaagaaagagtttgacctggtgtgt

SEQ ID NO: 853082 - DNA, 25 bp, Mus musculus
aaagaaagatcacgaaaagactgat

SEQ ID NO: 853083 - DNA, 25 bp, Mus musculus
aaagaaagatcacgcgagtactaac

SEQ ID NO: 853084 - DNA, 25 bp, Mus musculus
aaagaaagatcaggaaaagactgat

SEQ ID NO: 853085 - DNA, 25 bp, Mus musculus
aaagaaagatcaggcgagtactaac

SEQ ID NO: 853086 - DNA, 25 bp, Mus musculus
aaagaaagttgcaaaaatcttggca

SEQ ID NO: 853087 - DNA, 25 bp, Mus musculus
aaagaaagttgcaaatgattcattc

SEQ ID NO: 853088 - DNA, 25 bp, Mus musculus
aaagaaagttgctaaaatcttggca

SEQ ID NO: 853089 - DNA, 25 bp, Mus musculus
aaagaaagttgctaatgattcattc

SEQ ID NO: 853090 - DNA, 25 bp, Mus musculus
aaagaaattgccaaagctacaacta

SEQ ID NO: 853091 - DNA, 25 bp, Mus musculus
aaagaaattgccaatgctacaacta

SEQ ID NO: 853092 - DNA, 25 bp, Mus musculus
aaagaacaaagaccagaaccacatc

SEQ ID NO: 853093 - DNA, 25 bp, Mus musculus
aaagaacaaagagcagaaccacatc

SEQ ID NO: 853094 - DNA, 25 bp, Mus musculus
aaagaacaagaccatcattaagtct

SEQ ID NO: 853095 - DNA, 25 bp, Mus musculus
aaagaacaagcctccgactgtgagc

SEQ ID NO: 853096 - DNA, 25 bp, Mus musculus
aaagaacaaggctccgactgtgagc

SEQ ID NO: 853097 - DNA, 25 bp, Mus musculus
aaagaacaagtccatcattaagtct

SEQ ID NO: 853098 - DNA, 25 bp, Mus musculus
aaagaacatgtacacagcttggaaa

SEQ ID NO: 853099 - DNA, 25 bp, Mus musculus
aaagaacatgtacagagcttggaaa

SEQ ID NO: 853100 - DNA, 25 bp, Mus musculus
aaagaagagggatacccccgacagt

SEQ ID NO: 853101 - DNA, 25 bp, Mus musculus
aaagaagagggatagccccgacagt

SEQ ID NO: 853102 - DNA, 25 bp, Mus musculus
aaagaagcaaagcataaacaagctg

SEQ ID NO: 853103 - DNA, 25 bp, Mus musculus
aaagaagcaaaggataaacaagctg

SEQ ID NO: 853104 - DNA, 25 bp, Mus musculus
aaagaagcagcgcggaaggcaagga

SEQ ID NO: 853105 - DNA, 25 bp, Mus musculus
aaagaagcagcggggaaggcaagga

SEQ ID NO: 853106 - DNA, 25 bp, Mus musculus
aaagaaggcaatcacgacgtaaagt

SEQ ID NO: 853107 - DNA, 25 bp, Mus musculus
aaagaaggcaatcaggacgtaaagt

SEQ ID NO: 853108 - DNA, 25 bp, Mus musculus
aaagaagtgctgcaccaaaagccaa

SEQ ID NO: 853109 - DNA, 25 bp, Mus musculus
aaagaagtgctgcagcaaaagccaa

SEQ ID NO: 853110 - DNA, 25 bp, Mus musculus
aaagaatacatggacgaggccatca

SEQ ID NO: 853111 - DNA, 25 bp, Mus musculus
aaagaatacatggaggaggccatca

SEQ ID NO: 853112 - DNA, 25 bp, Mus musculus
aaagaataggaggccgtaaccatag

SEQ ID NO: 853113 - DNA, 25 bp, Mus musculus
aaagaataggaggcggtaaccatag

SEQ ID NO: 853114 - DNA, 25 bp, Mus musculus
aaagaatatgagaatgctcttttca

SEQ ID NO: 853115 - DNA, 25 bp, Mus musculus
aaagaatatgagatcgaggtccacg

SEQ ID NO: 853116 - DNA, 25 bp, Mus musculus
aaagaatatgagtatgctcttttca

SEQ ID NO: 853117 - DNA, 25 bp, Mus musculus
aaagaatatgagttcgaggtccacg

SEQ ID NO: 853118 - DNA, 25 bp, Mus musculus
aaagaatcaactagcagctgtggac

SEQ ID NO: 853119 - DNA, 25 bp, Mus musculus
aaagaatcaagtagcagctgtggac

SEQ ID NO: 853120 - DNA, 25 bp, Mus musculus
aaagaatgagattgacctggtgtgt

SEQ ID NO: 853121 - DNA, 25 bp, Mus musculus
aaagaatgagtttgacctggtgtgt

SEQ ID NO: 853122 - DNA, 25 bp, Mus musculus
aaagaatgcctgaaaagaagaaagg

SEQ ID NO: 853123 - DNA, 25 bp, Mus musculus
aaagaatgcctgtaaagaagaaagg

SEQ ID NO: 853124 - DNA, 25 bp, Mus musculus
aaagaatgcgcctggcgcattggat

SEQ ID NO: 853125 - DNA, 25 bp, Mus musculus
aaagaatgcggctggcgcattggat

SEQ ID NO: 853126 - DNA, 25 bp, Mus musculus
aaagaatgggctaaccatagagatg

SEQ ID NO: 853127 - DNA, 25 bp, Mus musculus
aaagaatggggtaaccatagagatg

SEQ ID NO: 853128 - DNA, 25 bp, Mus musculus
aaagaatgtggacccactgtatggc

SEQ ID NO: 853129 - DNA, 25 bp, Mus musculus
aaagaatgtggagccactgtatggc

SEQ ID NO: 853130 - DNA, 25 bp, Mus musculus
aaagaattcatgctagaattgggca

SEQ ID NO: 853131 - DNA, 25 bp, Mus musculus
aaagaattcatgcttgaattgggca

SEQ ID NO: 853132 - DNA, 25 bp, Mus musculus
aaagacaaaaaacccaagcagcagg

SEQ ID NO: 853133 - DNA, 25 bp, Mus musculus
aaagacaaaaaagccaagcagcagg

SEQ ID NO: 853134 - DNA, 25 bp, Mus musculus
aaagacaaaaaggacgtggcaatcg

SEQ ID NO: 853135 - DNA, 25 bp, Mus musculus
aaagacaaaaaggaggtggcaatcg

SEQ ID NO: 853136 - DNA, 25 bp, Mus musculus
aaagacacaacaaaaagcatggtag

SEQ ID NO: 853137 - DNA, 25 bp, Mus musculus
aaagacacaacaaatagcatggtag

SEQ ID NO: 853138 - DNA, 25 bp, Mus musculus
aaagacacttgtgccgaggcccact

SEQ ID NO: 853139 - DNA, 25 bp, Mus musculus
aaagacacttgtgccggtgactcag

SEQ ID NO: 853140 - DNA, 25 bp, Mus musculus
aaagacacttgtgcggaggcccact

SEQ ID NO: 853141 - DNA, 25 bp, Mus musculus
aaagacacttgtgcgggtgactcag

SEQ ID NO: 853142 - DNA, 25 bp, Mus musculus
aaagacagactgcctagatggcaag

SEQ ID NO: 853143 - DNA, 25 bp, Mus musculus
aaagacagactggctagatggcaag

SEQ ID NO: 853144 - DNA, 25 bp, Mus musculus
aaagacattgatcacgtggtgactg

SEQ ID NO: 853145 - DNA, 25 bp, Mus musculus
aaagacattgatcaggtggtgactg

SEQ ID NO: 853146 - DNA, 25 bp, Mus musculus
aaagaccaagaaatcaagcgctggc

SEQ ID NO: 853147 - DNA, 25 bp, Mus musculus
aaagaccaagaaatgaagcgctggc

SEQ ID NO: 853148 - DNA, 25 bp, Mus musculus
aaagaccacgaggatgaaggctgat

SEQ ID NO: 853149 - DNA, 25 bp, Mus musculus
aaagaccacgtggatgaaggctgat

SEQ ID NO: 853150 - DNA, 25 bp, Mus musculus
aaagaccctgcaggcgagagaatca

SEQ ID NO: 853151 - DNA, 25 bp, Mus musculus
aaagaccctgcaggggagagaatca

SEQ ID NO: 853152 - DNA, 25 bp, Mus musculus
aaagacgaaattcacgatgaagagg

SEQ ID NO: 853153 - DNA, 25 bp, Mus musculus
aaagacgaaattcaggatgaagagg

SEQ ID NO: 853154 - DNA, 25 bp, Mus musculus
aaagacgaactacgtcctgtgccat

SEQ ID NO: 853155 - DNA, 25 bp, Mus musculus
aaagacgaactaggtcctgtgccat

SEQ ID NO: 853156 - DNA, 25 bp, Mus musculus
aaagacgaagagaaacgactcagaa

SEQ ID NO: 853157 - DNA, 25 bp, Mus musculus
aaagacgaagagtaacgactcagaa

SEQ ID NO: 853158 - DNA, 25 bp, Mus musculus
aaagacgaagctcttcctgaaggag

SEQ ID NO: 853159 - DNA, 25 bp, Mus musculus
aaagacgaagctttagaagatgaag

SEQ ID NO: 853160 - DNA, 25 bp, Mus musculus
aaagacgaaggtcttcctgaaggag

SEQ ID NO: 853161 - DNA, 25 bp, Mus musculus
aaagacgaaggtttagaagatgaag

SEQ ID NO: 853162 - DNA, 25 bp, Mus musculus
aaagacgaattaccaattgaagtgg

SEQ ID NO: 853163 - DNA, 25 bp, Mus musculus
aaagacgaattacctattgaagtgg

SEQ ID NO: 853164 - DNA, 25 bp, Mus musculus
aaagacgtcgatgactgcaaagaag

SEQ ID NO: 853165 - DNA, 25 bp, Mus musculus
aaagacgtcgatgagtgcaaagaag

SEQ ID NO: 853166 - DNA, 25 bp, Mus musculus
aaagactatcatatatttccgagag

SEQ ID NO: 853167 - DNA, 25 bp, Mus musculus
aaagactatcatcttccaagatgcc

SEQ ID NO: 853168 - DNA, 25 bp, Mus musculus
aaagactatcatgttccaagatgcc

SEQ ID NO: 853169 - DNA, 25 bp, Mus musculus
aaagactatcatttatttccgagag

SEQ ID NO: 853170 - DNA, 25 bp, Mus musculus
aaagactcagaaaaaatagaagaat

SEQ ID NO: 853171 - DNA, 25 bp, Mus musculus
aaagactcagaaaatatagaagaat

SEQ ID NO: 853172 - DNA, 25 bp, Mus musculus
aaagactcagagcattacaaagcct

SEQ ID NO: 853173 - DNA, 25 bp, Mus musculus
aaagactcagaggattacaaagcct

SEQ ID NO: 853174 - DNA, 25 bp, Mus musculus
aaagactgcatcatgacttgtaacc

SEQ ID NO: 853175 - DNA, 25 bp, Mus musculus
aaagactgcatcttgacttgtaacc

SEQ ID NO: 853176 - DNA, 25 bp, Mus musculus
aaagactgtgatccccagcagatac

SEQ ID NO: 853177 - DNA, 25 bp, Mus musculus
aaagactgtgatgcccagcagatac

SEQ ID NO: 853178 - DNA, 25 bp, Mus musculus
aaagactgtgtgcaagtgaagggct

SEQ ID NO: 853179 - DNA, 25 bp, Mus musculus
aaagactgtgtggaagtgaagggct

SEQ ID NO: 853180 - DNA, 25 bp, Mus musculus
aaagagaaaacacgcatgtaatgaa

SEQ ID NO: 853181 - DNA, 25 bp, Mus musculus
aaagagaaaacacgtctcagcatca

SEQ ID NO: 853182 - DNA, 25 bp, Mus musculus
aaagagaaaacaggcatgtaatgaa

SEQ ID NO: 853183 - DNA, 25 bp, Mus musculus
aaagagaaaacaggtctcagcatca

SEQ ID NO: 853184 - DNA, 25 bp, Mus musculus
aaagagaagacaattaattttgctt

SEQ ID NO: 853185 - DNA, 25 bp, Mus musculus
aaagagaagagaattaattttgctt

SEQ ID NO: 853186 - DNA, 25 bp, Mus musculus
aaagagaagctgatgcaggaagagg

SEQ ID NO: 853187 - DNA, 25 bp, Mus musculus
aaagagaagctgttgcaggaagagg

SEQ ID NO: 853188 - DNA, 25 bp, Mus musculus
aaagagaatatgcacgtttttgaat

SEQ ID NO: 853189 - DNA, 25 bp, Mus musculus
aaagagaatatgcaggtttttgaat

SEQ ID NO: 853190 - DNA, 25 bp, Mus musculus
aaagagaatgagaaacttcataaag

SEQ ID NO: 853191 - DNA, 25 bp, Mus musculus
aaagagaatgagaatcttcataaag

SEQ ID NO: 853192 - DNA, 25 bp, Mus musculus
aaagagaattttcacagattccttc

SEQ ID NO: 853193 - DNA, 25 bp, Mus musculus
aaagagaattttcagagattccttc

SEQ ID NO: 853194 - DNA, 25 bp, Mus musculus
aaagagacagcctactggaatgtca

SEQ ID NO: 853195 - DNA, 25 bp, Mus musculus
aaagagacaggctactggaatgtca

SEQ ID NO: 853196 - DNA, 25 bp, Mus musculus
aaagagagcaaacctgtcattctgt

SEQ ID NO: 853197 - DNA, 25 bp, Mus musculus
aaagagagcaaagctgtcattctgt

SEQ ID NO: 853198 - DNA, 25 bp, Mus musculus
aaagagaggatgagacagaaaacaa

SEQ ID NO: 853199 - DNA, 25 bp, Mus musculus
aaagagaggatgtgacagaaaacaa

SEQ ID NO: 853200 - DNA, 25 bp, Mus musculus
aaagagatattgccaaacttaaagg

SEQ ID NO: 853201 - DNA, 25 bp, Mus musculus
aaagagatattgcctaacttaaagg

SEQ ID NO: 853202 - DNA, 25 bp, Mus musculus
aaagagatgctgaactttgccgtgg

SEQ ID NO: 853203 - DNA, 25 bp, Mus musculus
aaagagatgctgaagtttgccgtgg

SEQ ID NO: 853204 - DNA, 25 bp, Mus musculus
aaagagattaccccagaagacttgg

SEQ ID NO: 853205 - DNA, 25 bp, Mus musculus
aaagagattaccgcagaagacttgg

SEQ ID NO: 853206 - DNA, 25 bp, Mus musculus
aaagagcaaagaagacagcaaaagc

SEQ ID NO: 853207 - DNA, 25 bp, Mus musculus
aaagagcaaagaagtcagcaaaagc

SEQ ID NO: 853208 - DNA, 25 bp, Mus musculus
aaagagcaagagaaagcagcagctg

SEQ ID NO: 853209 - DNA, 25 bp, Mus musculus
aaagagcaagtgaaagcagcagctg

SEQ ID NO: 853210 - DNA, 25 bp, Mus musculus
aaagagccaaaccagccacaatcat

SEQ ID NO: 853211 - DNA, 25 bp, Mus musculus
aaagagccaaacgagccacaatcat

SEQ ID NO: 853212 - DNA, 25 bp, Mus musculus
aaagagccagctgcaaagaagcaga

SEQ ID NO: 853213 - DNA, 25 bp, Mus musculus
aaagagccaggtgcaaagaagcaga

SEQ ID NO: 853214 - DNA, 25 bp, Mus musculus
aaagaggaagccatcgtcatgtatg

SEQ ID NO: 853215 - DNA, 25 bp, Mus musculus
aaagaggaaggcatcgtcatgtatg

SEQ ID NO: 853216 - DNA, 25 bp, Mus musculus
aaagaggacaaacatcttgactccc

SEQ ID NO: 853217 - DNA, 25 bp, Mus musculus
aaagaggacaaagatcttgactccc

SEQ ID NO: 853218 - DNA, 25 bp, Mus musculus
aaagaggctgtgcatgaagatgtgc

SEQ ID NO: 853219 - DNA, 25 bp, Mus musculus
aaagaggctgtggatgaagatgtgc

SEQ ID NO: 853220 - DNA, 25 bp, Mus musculus
aaagagggagctgctgtcagccgcc

SEQ ID NO: 853221 - DNA, 25 bp, Mus musculus
aaagagggaggtgctgtcagccgcc

SEQ ID NO: 853222 - DNA, 25 bp, Mus musculus
aaagagggagtagacgaacattgac

SEQ ID NO: 853223 - DNA, 25 bp, Mus musculus
aaagagggagtagaggaacattgac

SEQ ID NO: 853224 - DNA, 25 bp, Mus musculus
aaagaggggaagaacgtggctgtgt

SEQ ID NO: 853225 - DNA, 25 bp, Mus musculus
aaagaggggaagaaggtggctgtgt

SEQ ID NO: 853226 - DNA, 25 bp, Mus musculus
aaagagggtgaacaaactgaaggct

SEQ ID NO: 853227 - DNA, 25 bp, Mus musculus
aaagagggtgaagaaactgaaggct

SEQ ID NO: 853228 - DNA, 25 bp, Mus musculus
aaagaggtgaagcacaatgatatgg

SEQ ID NO: 853229 - DNA, 25 bp, Mus musculus
aaagaggtgaagcagaatgatatgg

SEQ ID NO: 853230 - DNA, 25 bp, Mus musculus
aaagagtattctcaaatgcaacaac

SEQ ID NO: 853231 - DNA, 25 bp, Mus musculus
aaagagtattctgaaatgcaacaac

SEQ ID NO: 853232 - DNA, 25 bp, Mus musculus
aaagagtcagacatttacattgttg

SEQ ID NO: 853233 - DNA, 25 bp, Mus musculus
aaagagtcagtcatttacattgttg

SEQ ID NO: 853234 - DNA, 25 bp, Mus musculus
aaagagtctgtgctgcaggctgtga

SEQ ID NO: 853235 - DNA, 25 bp, Mus musculus
aaagagtctgtggtgcaggctgtga

SEQ ID NO: 853236 - DNA, 25 bp, Mus musculus
aaagataacccgccactgaatgcac

SEQ ID NO: 853237 - DNA, 25 bp, Mus musculus
aaagataacccggcactgaatgcac

SEQ ID NO: 853238 - DNA, 25 bp, Mus musculus
aaagataagaaacactgtacattta

SEQ ID NO: 853239 - DNA, 25 bp, Mus musculus
aaagataagaaagactgtacattta

SEQ ID NO: 853240 - DNA, 25 bp, Mus musculus
aaagataatcagattataccgaaaa

SEQ ID NO: 853241 - DNA, 25 bp, Mus musculus
aaagataatcagccgtggggccaat

SEQ ID NO: 853242 - DNA, 25 bp, Mus musculus
aaagataatcaggcgtggggccaat

SEQ ID NO: 853243 - DNA, 25 bp, Mus musculus
aaagataatcagtttataccgaaaa

SEQ ID NO: 853244 - DNA, 25 bp, Mus musculus
aaagatacttcactgagggggataa

SEQ ID NO: 853245 - DNA, 25 bp, Mus musculus
aaagatacttcagtgagggggataa

SEQ ID NO: 853246 - DNA, 25 bp, Mus musculus
aaagatacttccaatcacttccatg

SEQ ID NO: 853247 - DNA, 25 bp, Mus musculus
aaagatacttcctatcacttccatg

SEQ ID NO: 853248 - DNA, 25 bp, Mus musculus
aaagatacttgcaacggtgactcag

SEQ ID NO: 853249 - DNA, 25 bp, Mus musculus
aaagatacttgcaagggtgactcag

SEQ ID NO: 853250 - DNA, 25 bp, Mus musculus
aaagatcataaccttggatgagact

SEQ ID NO: 853251 - DNA, 25 bp, Mus musculus
aaagatcatatccttggatgagact

SEQ ID NO: 853252 - DNA, 25 bp, Mus musculus
aaagatccgaatgaaggagcgagag

SEQ ID NO: 853253 - DNA, 25 bp, Mus musculus
aaagatccgaatgatggagcgagag

SEQ ID NO: 853254 - DNA, 25 bp, Mus musculus
aaagatccgagactgtgtgatctgt

SEQ ID NO: 853255 - DNA, 25 bp, Mus musculus
aaagatccgagagtgtgtgatctgt

SEQ ID NO: 853256 - DNA, 25 bp, Mus musculus
aaagatctacagcgccctgatggac

SEQ ID NO: 853257 - DNA, 25 bp, Mus musculus
aaagatctacagggccctgatggac

SEQ ID NO: 853258 - DNA, 25 bp, Mus musculus
aaagatctgcaaaatcatggaccag

SEQ ID NO: 853259 - DNA, 25 bp, Mus musculus
aaagatctgcaatatcatggaccag

SEQ ID NO: 853260 - DNA, 25 bp, Mus musculus
aaagatctggcgcatatcgtcagat

SEQ ID NO: 853261 - DNA, 25 bp, Mus musculus
aaagatctggcggatatcgtcagat

SEQ ID NO: 853262 - DNA, 25 bp, Mus musculus
aaagatgaaacgctgtggtcaatgg

SEQ ID NO: 853263 - DNA, 25 bp, Mus musculus
aaagatgaaaggctgtggtcaatgg

SEQ ID NO: 853264 - DNA, 25 bp, Mus musculus
aaagatgaatatcaaaaggtggaca

SEQ ID NO: 853265 - DNA, 25 bp, Mus musculus
aaagatgaatatgaaaaggtggaca

SEQ ID NO: 853266 - DNA, 25 bp, Mus musculus
aaagatgacaaacccaccatttgta

SEQ ID NO: 853267 - DNA, 25 bp, Mus musculus
aaagatgacaaagccaccatttgta

SEQ ID NO: 853268 - DNA, 25 bp, Mus musculus
aaagatgatgtcccagcaccagatg

SEQ ID NO: 853269 - DNA, 25 bp, Mus musculus
aaagatgatgtccctgcaccagatg

SEQ ID NO: 853270 - DNA, 25 bp, Mus musculus
aaagatgccaaaaacggcttcatcc

SEQ ID NO: 853271 - DNA, 25 bp, Mus musculus
aaagatgccaaaaagggcttcatcc

SEQ ID NO: 853272 - DNA, 25 bp, Mus musculus
aaagatggaagaagccctctgggcg

SEQ ID NO: 853273 - DNA, 25 bp, Mus musculus
aaagatggaagatgccctctgggcg

SEQ ID NO: 853274 - DNA, 25 bp, Mus musculus
aaagatggacaactgctcttccaga

SEQ ID NO: 853275 - DNA, 25 bp, Mus musculus
aaagatggacaagtgctcttccaga

SEQ ID NO: 853276 - DNA, 25 bp, Mus musculus
aaagatgggcagaatcttcgaccga

SEQ ID NO: 853277 - DNA, 25 bp, Mus musculus
aaagatgggcagtatcttcgaccga

SEQ ID NO: 853278 - DNA, 25 bp, Mus musculus
aaagatgtacagcggtggcaaaata

SEQ ID NO: 853279 - DNA, 25 bp, Mus musculus
aaagatgtacagctgggtccttggc

SEQ ID NO: 853280 - DNA, 25 bp, Mus musculus
aaagatgtacaggggtggcaaaata

SEQ ID NO: 853281 - DNA, 25 bp, Mus musculus
aaagatgtacaggtgggtccttggc

SEQ ID NO: 853282 - DNA, 25 bp, Mus musculus
aaagatgtccagcttcgttatcagt

SEQ ID NO: 853283 - DNA, 25 bp, Mus musculus
aaagatgtcctgcttcgttatcagt

SEQ ID NO: 853284 - DNA, 25 bp, Mus musculus
aaagattcaaagccaatgttagtgg

SEQ ID NO: 853285 - DNA, 25 bp, Mus musculus
aaagattcaaaggcaatgttagtgg

SEQ ID NO: 853286 - DNA, 25 bp, Mus musculus
aaagattcagagcgctctggaactg

SEQ ID NO: 853287 - DNA, 25 bp, Mus musculus
aaagattcagagggctctggaactg

SEQ ID NO: 853288 - DNA, 25 bp, Mus musculus
aaagattcagatctctcggatctag

SEQ ID NO: 853289 - DNA, 25 bp, Mus musculus
aaagattcagttctctcggatctag

SEQ ID NO: 853290 - DNA, 25 bp, Mus musculus
aaagattccttgaggccgtataaag

SEQ ID NO: 853291 - DNA, 25 bp, Mus musculus
aaagattccttgtggccgtataaag

SEQ ID NO: 853292 - DNA, 25 bp, Mus musculus
aaagattggaagaatcaagatcatt

SEQ ID NO: 853293 - DNA, 25 bp, Mus musculus
aaagattggaagtatcaagatcatt

SEQ ID NO: 853294 - DNA, 25 bp, Mus musculus
aaagatttgaagctgggctctgtgg

SEQ ID NO: 853295 - DNA, 25 bp, Mus musculus
aaagatttgaaggtgggctctgtgg

SEQ ID NO: 853296 - DNA, 25 bp, Mus musculus
aaagcaacagagagtgcactgacct

SEQ ID NO: 853297 - DNA, 25 bp, Mus musculus
aaagcaacagagatcttgcctctcg

SEQ ID NO: 853298 - DNA, 25 bp, Mus musculus
aaagcaacagagtgtgcactgacct

SEQ ID NO: 853299 - DNA, 25 bp, Mus musculus
aaagcaacagagttcttgcctctcg

SEQ ID NO: 853300 - DNA, 25 bp, Mus musculus
aaagcaacagatcttgatcaactgt

SEQ ID NO: 853301 - DNA, 25 bp, Mus musculus
aaagcaacagatgttgatcaactgt

SEQ ID NO: 853302 - DNA, 25 bp, Mus musculus
aaagcaacaggaactttgcatcatg

SEQ ID NO: 853303 - DNA, 25 bp, Mus musculus
aaagcaacaggatctttgcatcatg

SEQ ID NO: 853304 - DNA, 25 bp, Mus musculus
aaagcaacagggatgaagtacaact

SEQ ID NO: 853305 - DNA, 25 bp, Mus musculus
aaagcaacagggttgaagtacaact

SEQ ID NO: 853306 - DNA, 25 bp, Mus musculus
aaagcaagaaggacctagaccgcga

SEQ ID NO: 853307 - DNA, 25 bp, Mus musculus
aaagcaagaaggctcttgttgcagc

SEQ ID NO: 853308 - DNA, 25 bp, Mus musculus
aaagcaagaagggtcttgttgcagc

SEQ ID NO: 853309 - DNA, 25 bp, Mus musculus
aaagcaagaaggtcctagaccgcga

SEQ ID NO: 853310 - DNA, 25 bp, Mus musculus
aaagcaagagattcgagtaagagta

SEQ ID NO: 853311 - DNA, 25 bp, Mus musculus
aaagcaagagtttcgagtaagagta

SEQ ID NO: 853312 - DNA, 25 bp, Mus musculus
aaagcaatccaacgatcttatttga

SEQ ID NO: 853313 - DNA, 25 bp, Mus musculus
aaagcaatccaaggatcttatttga

SEQ ID NO: 853314 - DNA, 25 bp, Mus musculus
aaagcaatctgacagatctcaatag

SEQ ID NO: 853315 - DNA, 25 bp, Mus musculus
aaagcaatctgagagatctcaatag

SEQ ID NO: 853316 - DNA, 25 bp, Mus musculus
aaagcaatgtgggtcgcctcctcag

SEQ ID NO: 853317 - DNA, 25 bp, Mus musculus
aaagcaatgtgggtggcctcctcag

SEQ ID NO: 853318 - DNA, 25 bp, Mus musculus
aaagcacacatcaacaaacttgaag

SEQ ID NO: 853319 - DNA, 25 bp, Mus musculus
aaagcacacatcaagaaacttgaag

SEQ ID NO: 853320 - DNA, 25 bp, Mus musculus
aaagcacaggaacatccatctgttt

SEQ ID NO: 853321 - DNA, 25 bp, Mus musculus
aaagcacaggaagatccatctgttt

SEQ ID NO: 853322 - DNA, 25 bp, Mus musculus
aaagcaccgcagctatcagcctagc

SEQ ID NO: 853323 - DNA, 25 bp, Mus musculus
aaagcaccgcaggtatcagcctagc

SEQ ID NO: 853324 - DNA, 25 bp, Mus musculus
aaagcaccgtggccgcagagtgtga

SEQ ID NO: 853325 - DNA, 25 bp, Mus musculus
aaagcaccgtgggcgcagagtgtga

SEQ ID NO: 853326 - DNA, 25 bp, Mus musculus
aaagcagaagaactggatccaaact

SEQ ID NO: 853327 - DNA, 25 bp, Mus musculus
aaagcagaagaagtggatccaaact

SEQ ID NO: 853328 - DNA, 25 bp, Mus musculus
aaagcagaagagtgcgacggctgtt

SEQ ID NO: 853329 - DNA, 25 bp, Mus musculus
aaagcagaagagtgggacggctgtt

SEQ ID NO: 853330 - DNA, 25 bp, Mus musculus
aaagcagagacaaattgaacaagaa

SEQ ID NO: 853331 - DNA, 25 bp, Mus musculus
aaagcagagacatattgaacaagaa

SEQ ID NO: 853332 - DNA, 25 bp, Mus musculus
aaagcagaggagactctaacacgtg

SEQ ID NO: 853333 - DNA, 25 bp, Mus musculus
aaagcagaggagtctctaacacgtg

SEQ ID NO: 853334 - DNA, 25 bp, Mus musculus
aaagcagatttaaagaacccaatat

SEQ ID NO: 853335 - DNA, 25 bp, Mus musculus
aaagcagatttatagaacccaatat

SEQ ID NO: 853336 - DNA, 25 bp, Mus musculus
aaagcagcctcgcagacaggagctt

SEQ ID NO: 853337 - DNA, 25 bp, Mus musculus
aaagcagcctcggagacaggagctt

SEQ ID NO: 853338 - DNA, 25 bp, Mus musculus
aaagcagctcataaagcaatggtct

SEQ ID NO: 853339 - DNA, 25 bp, Mus musculus
aaagcagctcttaaagcaatggtct

SEQ ID NO: 853340 - DNA, 25 bp, Mus musculus
aaagcagctggactttttggctttt

SEQ ID NO: 853341 - DNA, 25 bp, Mus musculus
aaagcagctggagtttttggctttt

SEQ ID NO: 853342 - DNA, 25 bp, Mus musculus
aaagcagtcccgcatgaggatcgtt

SEQ ID NO: 853343 - DNA, 25 bp, Mus musculus
aaagcagtccggcatgaggatcgtt

SEQ ID NO: 853344 - DNA, 25 bp, Mus musculus
aaagcataagaatgttttgagttta

SEQ ID NO: 853345 - DNA, 25 bp, Mus musculus
aaagcataagctgactcatattctc

SEQ ID NO: 853346 - DNA, 25 bp, Mus musculus
aaagcataaggtgactcatattctc

SEQ ID NO: 853347 - DNA, 25 bp, Mus musculus
aaagcataagtatgttttgagttta

SEQ ID NO: 853348 - DNA, 25 bp, Mus musculus
aaagcatacagtctcgaggaagaag

SEQ ID NO: 853349 - DNA, 25 bp, Mus musculus
aaagcatacagtctggaggaagaag

SEQ ID NO: 853350 - DNA, 25 bp, Mus musculus
aaagcatcagatgtgactgtgagct

SEQ ID NO: 853351 - DNA, 25 bp, Mus musculus
aaagcatcagccaagaggcaaagtg

SEQ ID NO: 853352 - DNA, 25 bp, Mus musculus
aaagcatcaggcaagaggcaaagtg

SEQ ID NO: 853353 - DNA, 25 bp, Mus musculus
aaagcatcagttgtgactgtgagct

SEQ ID NO: 853354 - DNA, 25 bp, Mus musculus
aaagcatccactttgtgctcgatga

SEQ ID NO: 853355 - DNA, 25 bp, Mus musculus
aaagcatccagtttgtgctcgatga

SEQ ID NO: 853356 - DNA, 25 bp, Mus musculus
aaagcatgtgatgtctaacacaggc

SEQ ID NO: 853357 - DNA, 25 bp, Mus musculus
aaagcatgtgttgtctaacacaggc

SEQ ID NO: 853358 - DNA, 25 bp, Mus musculus
aaagcatttcttgacgtaaatgagg

SEQ ID NO: 853359 - DNA, 25 bp, Mus musculus
aaagcatttcttgaggtaaatgagg

SEQ ID NO: 853360 - DNA, 25 bp, Mus musculus
aaagccaaagatgtgtgccaaaacc

SEQ ID NO: 853361 - DNA, 25 bp, Mus musculus
aaagccaaagttgtgtgccaaaacc

SEQ ID NO: 853362 - DNA, 25 bp, Mus musculus
aaagccaagcctcggactcaataga

SEQ ID NO: 853363 - DNA, 25 bp, Mus musculus
aaagccaagcctgggactcaataga

SEQ ID NO: 853364 - DNA, 25 bp, Mus musculus
aaagccacaacctaatccacaccta

SEQ ID NO: 853365 - DNA, 25 bp, Mus musculus
aaagccacaagctaatccacaccta

SEQ ID NO: 853366 - DNA, 25 bp, Mus musculus
aaagccagaccacgatcaagttact

SEQ ID NO: 853367 - DNA, 25 bp, Mus musculus
aaagccagaccacttccaagaatta

SEQ ID NO: 853368 - DNA, 25 bp, Mus musculus
aaagccagaccaggatcaagttact

SEQ ID NO: 853369 - DNA, 25 bp, Mus musculus
aaagccagaccagttccaagaatta

SEQ ID NO: 853370 - DNA, 25 bp, Mus musculus
aaagccagatttcgtgctgtgtaat

SEQ ID NO: 853371 - DNA, 25 bp, Mus musculus
aaagccagatttggtgctgtgtaat

SEQ ID NO: 853372 - DNA, 25 bp, Mus musculus
aaagccagtgagagagcagggctga

SEQ ID NO: 853373 - DNA, 25 bp, Mus musculus
aaagccagtgagtgagcagggctga

SEQ ID NO: 853374 - DNA, 25 bp, Mus musculus
aaagccagtgtgacagttgcagggc

SEQ ID NO: 853375 - DNA, 25 bp, Mus musculus
aaagccagtgtgatgcagggctggg

SEQ ID NO: 853376 - DNA, 25 bp, Mus musculus
aaagccagtgtgtcagttgcagggc

SEQ ID NO: 853377 - DNA, 25 bp, Mus musculus
aaagccagtgtgttgcagggctggg

SEQ ID NO: 853378 - DNA, 25 bp, Mus musculus
aaagccatcccgagcgagaaatgtc

SEQ ID NO: 853379 - DNA, 25 bp, Mus musculus
aaagccatcccgagggagaaatgtc

SEQ ID NO: 853380 - DNA, 25 bp, Mus musculus
aaagccatctcccacggtgtagagt

SEQ ID NO: 853381 - DNA, 25 bp, Mus musculus
aaagccatctcccagggtgtagagt

SEQ ID NO: 853382 - DNA, 25 bp, Mus musculus
aaagccatgcggcgcccagagaccg

SEQ ID NO: 853383 - DNA, 25 bp, Mus musculus
aaagccatgcggcggccagagaccg

SEQ ID NO: 853384 - DNA, 25 bp, Mus musculus
aaagccatgtactccggccgtcgtt

SEQ ID NO: 853385 - DNA, 25 bp, Mus musculus
aaagccatgtactcgggccgtcgtt

SEQ ID NO: 853386 - DNA, 25 bp, Mus musculus
aaagccattgataacaattttgatt

SEQ ID NO: 853387 - DNA, 25 bp, Mus musculus
aaagccattgataagaattttgatt

SEQ ID NO: 853388 - DNA, 25 bp, Mus musculus
aaagcccaagaggccgcacgaggga

SEQ ID NO: 853389 - DNA, 25 bp, Mus musculus
aaagcccaagtggccgcacgaggga

SEQ ID NO: 853390 - DNA, 25 bp, Mus musculus
aaagcccataaccctcttggcttca

SEQ ID NO: 853391 - DNA, 25 bp, Mus musculus
aaagcccataacgctcttggcttca

SEQ ID NO: 853392 - DNA, 25 bp, Mus musculus
aaagccccagccattcttcagcatt

SEQ ID NO: 853393 - DNA, 25 bp, Mus musculus
aaagccccaggcattcttcagcatt

SEQ ID NO: 853394 - DNA, 25 bp, Mus musculus
aaagcccctgatccctgggactata

SEQ ID NO: 853395 - DNA, 25 bp, Mus musculus
aaagcccctgatgcctgggactata

SEQ ID NO: 853396 - DNA, 25 bp, Mus musculus
aaagcctacaatctcaatgaagaaa

SEQ ID NO: 853397 - DNA, 25 bp, Mus musculus
aaagcctacaatctgaatgaagaaa

SEQ ID NO: 853398 - DNA, 25 bp, Mus musculus
aaagcctacagtctcaatgaagaaa

SEQ ID NO: 853399 - DNA, 25 bp, Mus musculus
aaagcctacagtctgaatgaagaaa

SEQ ID NO: 853400 - DNA, 25 bp, Mus musculus
aaagcctataagcagcctctaaaga

SEQ ID NO: 853401 - DNA, 25 bp, Mus musculus
aaagcctataaggagcctctaaaga

SEQ ID NO: 853402 - DNA, 25 bp, Mus musculus
aaagcctgggctgacatgaggtgcc

SEQ ID NO: 853403 - DNA, 25 bp, Mus musculus
aaagcctgggctgagatgaggtgcc

SEQ ID NO: 853404 - DNA, 25 bp, Mus musculus
aaagcctgggctgcggcgaagccct

SEQ ID NO: 853405 - DNA, 25 bp, Mus musculus
aaagcctggggtgcggcgaagccct

SEQ ID NO: 853406 - DNA, 25 bp, Mus musculus
aaagccttaagtccttgcttcccag

SEQ ID NO: 853407 - DNA, 25 bp, Mus musculus
aaagccttaagtgcttgcttcccag

SEQ ID NO: 853408 - DNA, 25 bp, Mus musculus
aaagccttcatacctggtggtgaag

SEQ ID NO: 853409 - DNA, 25 bp, Mus musculus
aaagccttcatagctggtggtgaag

SEQ ID NO: 853410 - DNA, 25 bp, Mus musculus
aaagcgagaacctagtcaagaacct

SEQ ID NO: 853411 - DNA, 25 bp, Mus musculus
aaagcgagaagctagtcaagaacct

SEQ ID NO: 853412 - DNA, 25 bp, Mus musculus
aaagcgaggatgctcatgaaagtcc

SEQ ID NO: 853413 - DNA, 25 bp, Mus musculus
aaagcgaggatggtcatgaaagtcc

SEQ ID NO: 853414 - DNA, 25 bp, Mus musculus
aaagcgcttaatagattcttctgga

SEQ ID NO: 853415 - DNA, 25 bp, Mus musculus
aaagcgcttaatagtttcttctgga

SEQ ID NO: 853416 - DNA, 25 bp, Mus musculus
aaagcggaagctctggaagctgcca

SEQ ID NO: 853417 - DNA, 25 bp, Mus musculus
aaagcggaaggtctggaagctgcca

SEQ ID NO: 853418 - DNA, 25 bp, Mus musculus
aaagcggcagtagactcagatacag

SEQ ID NO: 853419 - DNA, 25 bp, Mus musculus
aaagcggcagtagagtcagatacag

SEQ ID NO: 853420 - DNA, 25 bp, Mus musculus
aaagcgtgacagagaagcgctatgt

SEQ ID NO: 853421 - DNA, 25 bp, Mus musculus
aaagcgtgacagtgaagcgctatgt

SEQ ID NO: 853422 - DNA, 25 bp, Mus musculus
aaagcgtggttgatctggtggctct

SEQ ID NO: 853423 - DNA, 25 bp, Mus musculus
aaagcgtggttgttctggtggctct

SEQ ID NO: 853424 - DNA, 25 bp, Mus musculus
aaagctactctgctggagagctcta

SEQ ID NO: 853425 - DNA, 25 bp, Mus musculus
aaagctactctggtggagagctcta

SEQ ID NO: 853426 - DNA, 25 bp, Mus musculus
aaagctagcagactctctgtagaaa

SEQ ID NO: 853427 - DNA, 25 bp, Mus musculus
aaagctagcagagtctctgtagaaa

SEQ ID NO: 853428 - DNA, 25 bp, Mus musculus
aaagctatggagagtcagcgagctt

SEQ ID NO: 853429 - DNA, 25 bp, Mus musculus
aaagctatggtgagtcagcgagctt

SEQ ID NO: 853430 - DNA, 25 bp, Mus musculus
aaagctcacgagaacatgtgtatgt

SEQ ID NO: 853431 - DNA, 25 bp, Mus musculus
aaagctcacgagaagatgtgtatgt

SEQ ID NO: 853432 - DNA, 25 bp, Mus musculus
aaagctcagaaacctgtgtatgatc

SEQ ID NO: 853433 - DNA, 25 bp, Mus musculus
aaagctcagaaagctgtgtatgatc

SEQ ID NO: 853434 - DNA, 25 bp, Mus musculus
aaagctcaggctccaagcctgagga

SEQ ID NO: 853435 - DNA, 25 bp, Mus musculus
aaagctcaggctcgcaaatgaggag

SEQ ID NO: 853436 - DNA, 25 bp, Mus musculus
aaagctcaggctgcaagcctgagga

SEQ ID NO: 853437 - DNA, 25 bp, Mus musculus
aaagctcaggctggcaaatgaggag

SEQ ID NO: 853438 - DNA, 25 bp, Mus musculus
aaagctccacagcggatctttccag

SEQ ID NO: 853439 - DNA, 25 bp, Mus musculus
aaagctccacaggggatctttccag

SEQ ID NO: 853440 - DNA, 25 bp, Mus musculus
aaagctccagctggagtgtcatctt

SEQ ID NO: 853441 - DNA, 25 bp, Mus musculus
aaagctccaggcagcgtggagtgtc

SEQ ID NO: 853442 - DNA, 25 bp, Mus musculus
aaagctccaggcagggtggagtgtc

SEQ ID NO: 853443 - DNA, 25 bp, Mus musculus
aaagctccaggtggagtgtcatctt

SEQ ID NO: 853444 - DNA, 25 bp, Mus musculus
aaagctcctcctcacgactgtgcct

SEQ ID NO: 853445 - DNA, 25 bp, Mus musculus
aaagctcctcctcaggactgtgcct

SEQ ID NO: 853446 - DNA, 25 bp, Mus musculus
aaagctctggagcaccttggaagag

SEQ ID NO: 853447 - DNA, 25 bp, Mus musculus
aaagctctggaggaccttggaagag

SEQ ID NO: 853448 - DNA, 25 bp, Mus musculus
aaagctgaagaaaacgccttggcaa

SEQ ID NO: 853449 - DNA, 25 bp, Mus musculus
aaagctgaagaaaaggccttggcaa

SEQ ID NO: 853450 - DNA, 25 bp, Mus musculus
aaagctgaccaacggactgcacagg

SEQ ID NO: 853451 - DNA, 25 bp, Mus musculus
aaagctgaccaagggactgcacagg

SEQ ID NO: 853452 - DNA, 25 bp, Mus musculus
aaagctgatgaatgcacccttgtac

SEQ ID NO: 853453 - DNA, 25 bp, Mus musculus
aaagctgatgtatgcacccttgtac

SEQ ID NO: 853454 - DNA, 25 bp, Mus musculus
aaagctgctctgacaggagtctttt

SEQ ID NO: 853455 - DNA, 25 bp, Mus musculus
aaagctgctctgactggagtctttt

SEQ ID NO: 853456 - DNA, 25 bp, Mus musculus
aaagctgctgcgcaaagccacggct

SEQ ID NO: 853457 - DNA, 25 bp, Mus musculus
aaagctgctgcggaaagccacggct

SEQ ID NO: 853458 - DNA, 25 bp, Mus musculus
aaagctggcaagctacggactcgag

SEQ ID NO: 853459 - DNA, 25 bp, Mus musculus
aaagctggcaagcttcgaacctcag

SEQ ID NO: 853460 - DNA, 25 bp, Mus musculus
aaagctggcaaggtacggactcgag

SEQ ID NO: 853461 - DNA, 25 bp, Mus musculus
aaagctggcaaggttcgaacctcag

SEQ ID NO: 853462 - DNA, 25 bp, Mus musculus
aaagctgtcatcaacgtaaccccaa

SEQ ID NO: 853463 - DNA, 25 bp, Mus musculus
aaagctgtcatcaaggtaaccccaa

SEQ ID NO: 853464 - DNA, 25 bp, Mus musculus
aaagcttatttgctatgctaacaga

SEQ ID NO: 853465 - DNA, 25 bp, Mus musculus
aaagcttatttggtatgctaacaga

SEQ ID NO: 853466 - DNA, 25 bp, Mus musculus
aaagcttcagctctttccgggtaca

SEQ ID NO: 853467 - DNA, 25 bp, Mus musculus
aaagcttcagctttggaatgggatg

SEQ ID NO: 853468 - DNA, 25 bp, Mus musculus
aaagcttcaggtctttccgggtaca

SEQ ID NO: 853469 - DNA, 25 bp, Mus musculus
aaagcttcaggtttggaatgggatg

SEQ ID NO: 853470 - DNA, 25 bp, Mus musculus
aaagcttctggaccaagtatcctgt

SEQ ID NO: 853471 - DNA, 25 bp, Mus musculus
aaagcttctggagcaagtatcctgt

SEQ ID NO: 853472 - DNA, 25 bp, Mus musculus
aaagcttgccaaaacgtacagtgat

SEQ ID NO: 853473 - DNA, 25 bp, Mus musculus
aaagcttgccaaaaggtacagtgat

SEQ ID NO: 853474 - DNA, 25 bp, Mus musculus
aaagcttgtgtcacagttctgcaga

SEQ ID NO: 853475 - DNA, 25 bp, Mus musculus
aaagcttgtgtctcagttctgcaga

SEQ ID NO: 853476 - DNA, 25 bp, Mus musculus
aaagctttgcagattgaggcctgca

SEQ ID NO: 853477 - DNA, 25 bp, Mus musculus
aaagctttgcagtttgaggcctgca

SEQ ID NO: 853478 - DNA, 25 bp, Mus musculus
aaagctttggagcgctccactctag

SEQ ID NO: 853479 - DNA, 25 bp, Mus musculus
aaagctttggagggctccactctag

SEQ ID NO: 853480 - DNA, 25 bp, Mus musculus
aaaggaaactcctgtcgagagcagc

SEQ ID NO: 853481 - DNA, 25 bp, Mus musculus
aaaggaaactgctgtcgagagcagc

SEQ ID NO: 853482 - DNA, 25 bp, Mus musculus
aaaggaaatatgcgtgtttgctttg

SEQ ID NO: 853483 - DNA, 25 bp, Mus musculus
aaaggaaatatgggtgtttgctttg

SEQ ID NO: 853484 - DNA, 25 bp, Mus musculus
aaaggaaatgacacaggatatcgaa

SEQ ID NO: 853485 - DNA, 25 bp, Mus musculus
aaaggaaatgactcaggatatcgaa

SEQ ID NO: 853486 - DNA, 25 bp, Mus musculus
aaaggaacagagagacttaaccact

SEQ ID NO: 853487 - DNA, 25 bp, Mus musculus
aaaggaacagagtgacttaaccact

SEQ ID NO: 853488 - DNA, 25 bp, Mus musculus
aaaggaagaaagctggcaccagagt

SEQ ID NO: 853489 - DNA, 25 bp, Mus musculus
aaaggaagaaaggtggcaccagagt

SEQ ID NO: 853490 - DNA, 25 bp, Mus musculus
aaaggaagaggacaagatgcaagtg

SEQ ID NO: 853491 - DNA, 25 bp, Mus musculus
aaaggaagaggagaagatgcaagtg

SEQ ID NO: 853492 - DNA, 25 bp, Mus musculus
aaaggaaggcttcacgaggaaccat

SEQ ID NO: 853493 - DNA, 25 bp, Mus musculus
aaaggaaggcttcaggaggaaccat

SEQ ID NO: 853494 - DNA, 25 bp, Mus musculus
aaaggaataccacgaaaatagtgat

SEQ ID NO: 853495 - DNA, 25 bp, Mus musculus
aaaggaataccacgaaatgataatg

SEQ ID NO: 853496 - DNA, 25 bp, Mus musculus
aaaggaataccaggaaaatagtgat

SEQ ID NO: 853497 - DNA, 25 bp, Mus musculus
aaaggaataccaggaaatgataatg

SEQ ID NO: 853498 - DNA, 25 bp, Mus musculus
aaaggaatcgagacgggtgctgaag

SEQ ID NO: 853499 - DNA, 25 bp, Mus musculus
aaaggaatcgtgacgggtgctgaag

SEQ ID NO: 853500 - DNA, 25 bp, Mus musculus
aaaggaattcaacatggtcaaataa

SEQ ID NO: 853501 - DNA, 25 bp, Mus musculus
aaaggaattcaagatggtcaaataa

SEQ ID NO: 853502 - DNA, 25 bp, Mus musculus
aaaggaattccagatggtcaaataa

SEQ ID NO: 853503 - DNA, 25 bp, Mus musculus
aaaggaattcgagatggtcaaataa

SEQ ID NO: 853504 - DNA, 25 bp, Mus musculus
aaaggacaagcagcaagtaggctcc

SEQ ID NO: 853505 - DNA, 25 bp, Mus musculus
aaaggacaaggagcaagtaggctcc

SEQ ID NO: 853506 - DNA, 25 bp, Mus musculus
aaaggaccgaggattgaagtgagtg

SEQ ID NO: 853507 - DNA, 25 bp, Mus musculus
aaaggaccgaggtttgaagtgagtg

SEQ ID NO: 853508 - DNA, 25 bp, Mus musculus
aaaggaccttcacgaaatggctggt

SEQ ID NO: 853509 - DNA, 25 bp, Mus musculus
aaaggaccttcaggaaatggctggt

SEQ ID NO: 853510 - DNA, 25 bp, Mus musculus
aaaggacctttgatcaattctgagt

SEQ ID NO: 853511 - DNA, 25 bp, Mus musculus
aaaggacctttgttcaattctgagt

SEQ ID NO: 853512 - DNA, 25 bp, Mus musculus
aaaggactgaagcgagtggaaaatg

SEQ ID NO: 853513 - DNA, 25 bp, Mus musculus
aaaggactgaagggagtggaaaatg

SEQ ID NO: 853514 - DNA, 25 bp, Mus musculus
aaaggacttaataactctgtctggc

SEQ ID NO: 853515 - DNA, 25 bp, Mus musculus
aaaggacttaataagtctgtctggc

SEQ ID NO: 853516 - DNA, 25 bp, Mus musculus
aaaggagaaagacgattgaagaaca

SEQ ID NO: 853517 - DNA, 25 bp, Mus musculus
aaaggagaaagaggattgaagaaca

SEQ ID NO: 853518 - DNA, 25 bp, Mus musculus
aaaggagaagagcagtttggctcct

SEQ ID NO: 853519 - DNA, 25 bp, Mus musculus
aaaggagaagcaggtgaacgtgata

SEQ ID NO: 853520 - DNA, 25 bp, Mus musculus
aaaggagaaggaggtgaacgtgata

SEQ ID NO: 853521 - DNA, 25 bp, Mus musculus
aaaggagaagtgcagtttggctcct

SEQ ID NO: 853522 - DNA, 25 bp, Mus musculus
aaaggagacacgcgcttgccaggtg

SEQ ID NO: 853523 - DNA, 25 bp, Mus musculus
aaaggagacacgggcttgccaggtg

SEQ ID NO: 853524 - DNA, 25 bp, Mus musculus
aaaggagacaggcgtgtaccaggca

SEQ ID NO: 853525 - DNA, 25 bp, Mus musculus
aaaggagacaggcgtgtatttggtg

SEQ ID NO: 853526 - DNA, 25 bp, Mus musculus
aaaggagacaggggtgtaccaggca

SEQ ID NO: 853527 - DNA, 25 bp, Mus musculus
aaaggagacaggggtgtatttggtg

SEQ ID NO: 853528 - DNA, 25 bp, Mus musculus
aaaggagacatgcgggagcctggtc

SEQ ID NO: 853529 - DNA, 25 bp, Mus musculus
aaaggagacatgggggagcctggtc

SEQ ID NO: 853530 - DNA, 25 bp, Mus musculus
aaaggagagcagcgcgcacctggat

SEQ ID NO: 853531 - DNA, 25 bp, Mus musculus
aaaggagagcagggcgcacctggat

SEQ ID NO: 853532 - DNA, 25 bp, Mus musculus
aaaggagagcctctgtgctgatatt

SEQ ID NO: 853533 - DNA, 25 bp, Mus musculus
aaaggagagcctgtgtgctgatatt

SEQ ID NO: 853534 - DNA, 25 bp, Mus musculus
aaaggagatagtcaaggccatgatg

SEQ ID NO: 853535 - DNA, 25 bp, Mus musculus
aaaggagatagtcatggccatgatg

SEQ ID NO: 853536 - DNA, 25 bp, Mus musculus
aaaggagatgcacgtcttcttggtc

SEQ ID NO: 853537 - DNA, 25 bp, Mus musculus
aaaggagatgcaggtcttcttggtc

SEQ ID NO: 853538 - DNA, 25 bp, Mus musculus
aaaggagcagctgcttttggatact

SEQ ID NO: 853539 - DNA, 25 bp, Mus musculus
aaaggagcaggtgcttttggatact

SEQ ID NO: 853540 - DNA, 25 bp, Mus musculus
aaaggagggaagataattatgccac

SEQ ID NO: 853541 - DNA, 25 bp, Mus musculus
aaaggagggaagttaattatgccac

SEQ ID NO: 853542 - DNA, 25 bp, Mus musculus
aaaggagggcatccaggtggaagat

SEQ ID NO: 853543 - DNA, 25 bp, Mus musculus
aaaggagggcatcgtggaagattta

SEQ ID NO: 853544 - DNA, 25 bp, Mus musculus
aaaggagggcatgcaggtggaagat

SEQ ID NO: 853545 - DNA, 25 bp, Mus musculus
aaaggagggcatggtggaagattta

SEQ ID NO: 853546 - DNA, 25 bp, Mus musculus
aaaggagtcacctcagtctggtagc

SEQ ID NO: 853547 - DNA, 25 bp, Mus musculus
aaaggagtcacctctgtctggtagc

SEQ ID NO: 853548 - DNA, 25 bp, Mus musculus
aaaggatattttcacgtgaaccaga

SEQ ID NO: 853549 - DNA, 25 bp, Mus musculus
aaaggatattttcaggtgaaccaga

SEQ ID NO: 853550 - DNA, 25 bp, Mus musculus
aaaggatgactggacggagtttcga

SEQ ID NO: 853551 - DNA, 25 bp, Mus musculus
aaaggatgactggagggagtttcga

SEQ ID NO: 853552 - DNA, 25 bp, Mus musculus
aaaggattagggatcttggcaacca

SEQ ID NO: 853553 - DNA, 25 bp, Mus musculus
aaaggattagggttcttggcaacca

SEQ ID NO: 853554 - DNA, 25 bp, Mus musculus
aaaggcaaacaacacggcagcagaa

SEQ ID NO: 853555 - DNA, 25 bp, Mus musculus
aaaggcaaacaacacggtggcagac

SEQ ID NO: 853556 - DNA, 25 bp, Mus musculus
aaaggcaaacaacagggcagcagaa

SEQ ID NO: 853557 - DNA, 25 bp, Mus musculus
aaaggcaaacaacagggtggcagac

SEQ ID NO: 853558 - DNA, 25 bp, Mus musculus
aaaggcaatgaccacctggaccagc

SEQ ID NO: 853559 - DNA, 25 bp, Mus musculus
aaaggcaatgacgacctggaccagc

SEQ ID NO: 853560 - DNA, 25 bp, Mus musculus
aaaggcacagcaagcggaacaggaa

SEQ ID NO: 853561 - DNA, 25 bp, Mus musculus
aaaggcacaggaagcggaacaggaa

SEQ ID NO: 853562 - DNA, 25 bp, Mus musculus
aaaggcacatacttggtacatttga

SEQ ID NO: 853563 - DNA, 25 bp, Mus musculus
aaaggcacattcttggtacatttga

SEQ ID NO: 853564 - DNA, 25 bp, Mus musculus
aaaggcaccagccttgaggatttta

SEQ ID NO: 853565 - DNA, 25 bp, Mus musculus
aaaggcaccagcgttgaggatttta

SEQ ID NO: 853566 - DNA, 25 bp, Mus musculus
aaaggcactgcttactacacttgtg

SEQ ID NO: 853567 - DNA, 25 bp, Mus musculus
aaaggcactggttactacacttgtg

SEQ ID NO: 853568 - DNA, 25 bp, Mus musculus
aaaggcacttcgcacagctcctcag

SEQ ID NO: 853569 - DNA, 25 bp, Mus musculus
aaaggcacttcggacagctcctcag

SEQ ID NO: 853570 - DNA, 25 bp, Mus musculus
aaaggcagaaaacgctacagaagaa

SEQ ID NO: 853571 - DNA, 25 bp, Mus musculus
aaaggcagaaaaggctacagaagaa

SEQ ID NO: 853572 - DNA, 25 bp, Mus musculus
aaaggccaagctagccctgcttgtc

SEQ ID NO: 853573 - DNA, 25 bp, Mus musculus
aaaggccaagctcgccctgcttgtc

SEQ ID NO: 853574 - DNA, 25 bp, Mus musculus
aaaggccaagctggccctgcttgtc

SEQ ID NO: 853575 - DNA, 25 bp, Mus musculus
aaaggccaagcttgccctgcttgtc

SEQ ID NO: 853576 - DNA, 25 bp, Mus musculus
aaaggccacagaagctgaagctgac

SEQ ID NO: 853577 - DNA, 25 bp, Mus musculus
aaaggccacagatgctgaagctgac

SEQ ID NO: 853578 - DNA, 25 bp, Mus musculus
aaaggccaggttgacgtctggagaa

SEQ ID NO: 853579 - DNA, 25 bp, Mus musculus
aaaggccaggttgaggtctggagaa

SEQ ID NO: 853580 - DNA, 25 bp, Mus musculus
aaaggccctgagacagccagcaaat

SEQ ID NO: 853581 - DNA, 25 bp, Mus musculus
aaaggccctgagactgccagcaaat

SEQ ID NO: 853582 - DNA, 25 bp, Mus musculus
aaaggccctgggcaatgtatcattg

SEQ ID NO: 853583 - DNA, 25 bp, Mus musculus
aaaggccctggggaatgtatcattg

SEQ ID NO: 853584 - DNA, 25 bp, Mus musculus
aaaggcctcgctactgatgaagatg

SEQ ID NO: 853585 - DNA, 25 bp, Mus musculus
aaaggcctcggtactgatgaagatg

SEQ ID NO: 853586 - DNA, 25 bp, Mus musculus
aaaggccttcacaaactccagaact

SEQ ID NO: 853587 - DNA, 25 bp, Mus musculus
aaaggccttcacaatctccagaact

SEQ ID NO: 853588 - DNA, 25 bp, Mus musculus
aaaggcgtcgagatccccacttact

SEQ ID NO: 853589 - DNA, 25 bp, Mus musculus
aaaggcgtcgtgatccccacttact

SEQ ID NO: 853590 - DNA, 25 bp, Mus musculus
aaaggcgttctgatctcgttacaga

SEQ ID NO: 853591 - DNA, 25 bp, Mus musculus
aaaggcgttctgatgtcgttacaga

SEQ ID NO: 853592 - DNA, 25 bp, Mus musculus
aaaggctcagcacagaggcggtgga

SEQ ID NO: 853593 - DNA, 25 bp, Mus musculus
aaaggctcagcttgccaaagaaagt

SEQ ID NO: 853594 - DNA, 25 bp, Mus musculus
aaaggctcaggacagaggcggtgga

SEQ ID NO: 853595 - DNA, 25 bp, Mus musculus
aaaggctcaggttgccaaagaaagt

SEQ ID NO: 853596 - DNA, 25 bp, Mus musculus
aaaggctccaaacgttctgaagaca

SEQ ID NO: 853597 - DNA, 25 bp, Mus musculus
aaaggctccaaaggttctgaagaca

SEQ ID NO: 853598 - DNA, 25 bp, Mus musculus
aaaggctcccgagcagaaggagaag

SEQ ID NO: 853599 - DNA, 25 bp, Mus musculus
aaaggctcccgagctgaaggagaag

SEQ ID NO: 853600 - DNA, 25 bp, Mus musculus
aaaggctgtccaacaggtgcgccag

SEQ ID NO: 853601 - DNA, 25 bp, Mus musculus
aaaggctgtccatcaggtgcgccag

SEQ ID NO: 853602 - DNA, 25 bp, Mus musculus
aaaggctgttacacctaacaattca

SEQ ID NO: 853603 - DNA, 25 bp, Mus musculus
aaaggctgttacacgtaacaattca

SEQ ID NO: 853604 - DNA, 25 bp, Mus musculus
aaaggctttaagctctggtgcaagt

SEQ ID NO: 853605 - DNA, 25 bp, Mus musculus
aaaggctttaaggtctggtgcaagt

SEQ ID NO: 853606 - DNA, 25 bp, Mus musculus
aaagggaaagccaacatgccagacc

SEQ ID NO: 853607 - DNA, 25 bp, Mus musculus
aaagggaaagccaagatgccagacc

SEQ ID NO: 853608 - DNA, 25 bp, Mus musculus
aaagggagctcacaccgtgtatttt

SEQ ID NO: 853609 - DNA, 25 bp, Mus musculus
aaagggagctcacagcgtgtatttt

SEQ ID NO: 853610 - DNA, 25 bp, Mus musculus
aaagggcgtgcacagtggtaaaatg

SEQ ID NO: 853611 - DNA, 25 bp, Mus musculus
aaagggcgtggacagtggtaaaatg

SEQ ID NO: 853612 - DNA, 25 bp, Mus musculus
aaagggctctcattcatctatggct

SEQ ID NO: 853613 - DNA, 25 bp, Mus musculus
aaagggctctgattcatctatggct

SEQ ID NO: 853614 - DNA, 25 bp, Mus musculus
aaaggggaagaaaagacatgctcac

SEQ ID NO: 853615 - DNA, 25 bp, Mus musculus
aaaggggaagtaaagacatgctcac

SEQ ID NO: 853616 - DNA, 25 bp, Mus musculus
aaagggggccagcatgacgatgatg

SEQ ID NO: 853617 - DNA, 25 bp, Mus musculus
aaagggggccaggatgacgatgatg

SEQ ID NO: 853618 - DNA, 25 bp, Mus musculus
aaaggggtggcacgtgtccagaatg

SEQ ID NO: 853619 - DNA, 25 bp, Mus musculus
aaaggggtggcaggtgtccagaatg

SEQ ID NO: 853620 - DNA, 25 bp, Mus musculus
aaaggtaaaaagcttggctcatact

SEQ ID NO: 853621 - DNA, 25 bp, Mus musculus
aaaggtaaaaaggttggctcatact

SEQ ID NO: 853622 - DNA, 25 bp, Mus musculus
aaaggtatcccactacagcttcttt

SEQ ID NO: 853623 - DNA, 25 bp, Mus musculus
aaaggtatcccagtacagcttcttt

SEQ ID NO: 853624 - DNA, 25 bp, Mus musculus
aaaggtcaagacaatctgatcaaag

SEQ ID NO: 853625 - DNA, 25 bp, Mus musculus
aaaggtcaaggcaccaatgaggaaa

SEQ ID NO: 853626 - DNA, 25 bp, Mus musculus
aaaggtcaaggctccaatgaggaaa

SEQ ID NO: 853627 - DNA, 25 bp, Mus musculus
aaaggtcaagtcaatctgatcaaag

SEQ ID NO: 853628 - DNA, 25 bp, Mus musculus
aaaggtcttaagcgtgagccaggca

SEQ ID NO: 853629 - DNA, 25 bp, Mus musculus
aaaggtcttaagggtgagccaggca

SEQ ID NO: 853630 - DNA, 25 bp, Mus musculus
aaaggtgaaccctgctggttgtcta

SEQ ID NO: 853631 - DNA, 25 bp, Mus musculus
aaaggtgaacgctgctggttgtcta

SEQ ID NO: 853632 - DNA, 25 bp, Mus musculus
aaaggtgcagatcctggggcagagt

SEQ ID NO: 853633 - DNA, 25 bp, Mus musculus
aaaggtgcagcaactgctttgctct

SEQ ID NO: 853634 - DNA, 25 bp, Mus musculus
aaaggtgcaggaactgctttgctct

SEQ ID NO: 853635 - DNA, 25 bp, Mus musculus
aaaggtgcagttcctggggcagagt

SEQ ID NO: 853636 - DNA, 25 bp, Mus musculus
aaaggtgtgctgctgcgatgcatgc

SEQ ID NO: 853637 - DNA, 25 bp, Mus musculus
aaaggtgtgctggtgcgatgcatgc

SEQ ID NO: 853638 - DNA, 25 bp, Mus musculus
aaaggttacaagagtgaaacatctt

SEQ ID NO: 853639 - DNA, 25 bp, Mus musculus
aaaggttacaagtgtgaaacatctt

SEQ ID NO: 853640 - DNA, 25 bp, Mus musculus
aaaggttcagctgttcttagcagag

SEQ ID NO: 853641 - DNA, 25 bp, Mus musculus
aaaggttcaggtgttcttagcagag

SEQ ID NO: 853642 - DNA, 25 bp, Mus musculus
aaaggttgaagacgatgaagctgga

SEQ ID NO: 853643 - DNA, 25 bp, Mus musculus
aaaggttgaagaggatgaagctgga

SEQ ID NO: 853644 - DNA, 25 bp, Mus musculus
aaagtaaaggcattgcttatattga

SEQ ID NO: 853645 - DNA, 25 bp, Mus musculus
aaagtaaagggattgcttatattga

SEQ ID NO: 853646 - DNA, 25 bp, Mus musculus
aaagtaattcagcctcaaactgctt

SEQ ID NO: 853647 - DNA, 25 bp, Mus musculus
aaagtaattcaggctcaaactgctt

SEQ ID NO: 853648 - DNA, 25 bp, Mus musculus
aaagtacttcctcgtgggtgcaggg

SEQ ID NO: 853649 - DNA, 25 bp, Mus musculus
aaagtacttcctggtgggtgcaggg

SEQ ID NO: 853650 - DNA, 25 bp, Mus musculus
aaagtagaagcctcagaaccaacta

SEQ ID NO: 853651 - DNA, 25 bp, Mus musculus
aaagtagaagcttacatccaggcat

SEQ ID NO: 853652 - DNA, 25 bp, Mus musculus
aaagtagaaggctcagaaccaacta

SEQ ID NO: 853653 - DNA, 25 bp, Mus musculus
aaagtagaaggttacatccaggcat

SEQ ID NO: 853654 - DNA, 25 bp, Mus musculus
aaagtagcagcacacagcttgggct

SEQ ID NO: 853655 - DNA, 25 bp, Mus musculus
aaagtagcaggacacagcttgggct

SEQ ID NO: 853656 - DNA, 25 bp, Mus musculus
aaagtataaacactcgaacttagca

SEQ ID NO: 853657 - DNA, 25 bp, Mus musculus
aaagtataaacactctaaaggatct

SEQ ID NO: 853658 - DNA, 25 bp, Mus musculus
aaagtataaacactggaacttagca

SEQ ID NO: 853659 - DNA, 25 bp, Mus musculus
aaagtataaacactgtaaaggatct

SEQ ID NO: 853660 - DNA, 25 bp, Mus musculus
aaagtatcacattctggcacaatgg

SEQ ID NO: 853661 - DNA, 25 bp, Mus musculus
aaagtatcactttctggcacaatgg

SEQ ID NO: 853662 - DNA, 25 bp, Mus musculus
aaagtattccagcctctgtgcaagg

SEQ ID NO: 853663 - DNA, 25 bp, Mus musculus
aaagtattccaggctctgtgcaagg

SEQ ID NO: 853664 - DNA, 25 bp, Mus musculus
aaagtcaccagagacgacatgtcca

SEQ ID NO: 853665 - DNA, 25 bp, Mus musculus
aaagtcaccagagaggacatgtcca

SEQ ID NO: 853666 - DNA, 25 bp, Mus musculus
aaagtcatcttgactcgaagtgaag

SEQ ID NO: 853667 - DNA, 25 bp, Mus musculus
aaagtcatcttgtctcgaagtgaag

SEQ ID NO: 853668 - DNA, 25 bp, Mus musculus
aaagtcatgcagctcaagaattttg

SEQ ID NO: 853669 - DNA, 25 bp, Mus musculus
aaagtcatgcaggtcaagaattttg

SEQ ID NO: 853670 - DNA, 25 bp, Mus musculus
aaagtcattccgatcgaatacctcc

SEQ ID NO: 853671 - DNA, 25 bp, Mus musculus
aaagtcattccgatggaatacctcc

SEQ ID NO: 853672 - DNA, 25 bp, Mus musculus
aaagtcccagctgacactggctggt

SEQ ID NO: 853673 - DNA, 25 bp, Mus musculus
aaagtcccagctgagactggctggt

SEQ ID NO: 853674 - DNA, 25 bp, Mus musculus
aaagtccgtgagctcttcatgtctg

SEQ ID NO: 853675 - DNA, 25 bp, Mus musculus
aaagtccgtgaggtcttcatgtctg

SEQ ID NO: 853676 - DNA, 25 bp, Mus musculus
aaagtcggacagaggcttccgccac

SEQ ID NO: 853677 - DNA, 25 bp, Mus musculus
aaagtcggacagccttccgccacaa

SEQ ID NO: 853678 - DNA, 25 bp, Mus musculus
aaagtcggacaggcttccgccacaa

SEQ ID NO: 853679 - DNA, 25 bp, Mus musculus
aaagtcggacagtggcttccgccac

SEQ ID NO: 853680 - DNA, 25 bp, Mus musculus
aaagtctctgaaactcaagtcaagg

SEQ ID NO: 853681 - DNA, 25 bp, Mus musculus
aaagtctctgtaactcaagtcaagg

SEQ ID NO: 853682 - DNA, 25 bp, Mus musculus
aaagtgaaagaccattgcagcaaac

SEQ ID NO: 853683 - DNA, 25 bp, Mus musculus
aaagtgaaagtccattgcagcaaac

SEQ ID NO: 853684 - DNA, 25 bp, Mus musculus
aaagtgaagagccacgttgggcctg

SEQ ID NO: 853685 - DNA, 25 bp, Mus musculus
aaagtgaagagccaggttgggcctg

SEQ ID NO: 853686 - DNA, 25 bp, Mus musculus
aaagtgacagcagcaacgcctattg

SEQ ID NO: 853687 - DNA, 25 bp, Mus musculus
aaagtgacagctggtcgaaatggct

SEQ ID NO: 853688 - DNA, 25 bp, Mus musculus
aaagtgacaggagcaacgcctattg

SEQ ID NO: 853689 - DNA, 25 bp, Mus musculus
aaagtgacaggtggtcgaaatggct

SEQ ID NO: 853690 - DNA, 25 bp, Mus musculus
aaagtgaccaattttcagagatcac

SEQ ID NO: 853691 - DNA, 25 bp, Mus musculus
aaagtgaccatttttcagagatcac

SEQ ID NO: 853692 - DNA, 25 bp, Mus musculus
aaagtgagacctcgtatagctggca

SEQ ID NO: 853693 - DNA, 25 bp, Mus musculus
aaagtgagacctggtatagctggca

SEQ ID NO: 853694 - DNA, 25 bp, Mus musculus
aaagtgatggcgccaatccagatca

SEQ ID NO: 853695 - DNA, 25 bp, Mus musculus
aaagtgatggcggcaatccagatca

SEQ ID NO: 853696 - DNA, 25 bp, Mus musculus
aaagtgcaagcccgcgtgcaggaag

SEQ ID NO: 853697 - DNA, 25 bp, Mus musculus
aaagtgcaaggccgcgtgcaggaag

SEQ ID NO: 853698 - DNA, 25 bp, Mus musculus
aaagtgcatcagacactggcagtga

SEQ ID NO: 853699 - DNA, 25 bp, Mus musculus
aaagtgcatcagtcactggcagtga

SEQ ID NO: 853700 - DNA, 25 bp, Mus musculus
aaagtgctaaagcactgttgtgtaa

SEQ ID NO: 853701 - DNA, 25 bp, Mus musculus
aaagtgctaaaggactgttgtgtaa

SEQ ID NO: 853702 - DNA, 25 bp, Mus musculus
aaagtggaagcacgaacagggctcc

SEQ ID NO: 853703 - DNA, 25 bp, Mus musculus
aaagtggaaggacgaacagggctcc

SEQ ID NO: 853704 - DNA, 25 bp, Mus musculus
aaagtggctcagaggttgattcagg

SEQ ID NO: 853705 - DNA, 25 bp, Mus musculus
aaagtggctcagtggttgattcagg

SEQ ID NO: 853706 - DNA, 25 bp, Mus musculus
aaagtggggcatgactgtaatgttc

SEQ ID NO: 853707 - DNA, 25 bp, Mus musculus
aaagtggggcatgagtgtaatgttc

SEQ ID NO: 853708 - DNA, 25 bp, Mus musculus
aaagtgtccgtgcatgaccatgtaa

SEQ ID NO: 853709 - DNA, 25 bp, Mus musculus
aaagtgtccgtgctgaaccccacag

SEQ ID NO: 853710 - DNA, 25 bp, Mus musculus
aaagtgtccgtggatgaccatgtaa

SEQ ID NO: 853711 - DNA, 25 bp, Mus musculus
aaagtgtccgtggtgaaccccacag

SEQ ID NO: 853712 - DNA, 25 bp, Mus musculus
aaagtgtgagaccatccatgtggcc

SEQ ID NO: 853713 - DNA, 25 bp, Mus musculus
aaagtgtgagtccatccatgtggcc

SEQ ID NO: 853714 - DNA, 25 bp, Mus musculus
aaagtgtgcacgtttcaactctgag

SEQ ID NO: 853715 - DNA, 25 bp, Mus musculus
aaagtgtgcaggtttcaactctgag

SEQ ID NO: 853716 - DNA, 25 bp, Mus musculus
aaagttaatcagaacggctgttatg

SEQ ID NO: 853717 - DNA, 25 bp, Mus musculus
aaagttaatcagaagggctgttatg

SEQ ID NO: 853718 - DNA, 25 bp, Mus musculus
aaagttagaaaacagtatgctgtca

SEQ ID NO: 853719 - DNA, 25 bp, Mus musculus
aaagttagaaaaccatccgcagaca

SEQ ID NO: 853720 - DNA, 25 bp, Mus musculus
aaagttagaaaacgcatctgtggca

SEQ ID NO: 853721 - DNA, 25 bp, Mus musculus
aaagttagaaaagagtatgctgtca

SEQ ID NO: 853722 - DNA, 25 bp, Mus musculus
aaagttagaaaagcatccgcagaca

SEQ ID NO: 853723 - DNA, 25 bp, Mus musculus
aaagttagaaaaggcatctgtggca

SEQ ID NO: 853724 - DNA, 25 bp, Mus musculus
aaagttcagactggactgcccactt

SEQ ID NO: 853725 - DNA, 25 bp, Mus musculus
aaagttcagagtggactgcccactt

SEQ ID NO: 853726 - DNA, 25 bp, Mus musculus
aaagttcagtagtaccgcatccagt

SEQ ID NO: 853727 - DNA, 25 bp, Mus musculus
aaagttcagttgtaccgcatccagt

SEQ ID NO: 853728 - DNA, 25 bp, Mus musculus
aaagttcccactggcgctgaagtgg

SEQ ID NO: 853729 - DNA, 25 bp, Mus musculus
aaagttcccactggggctgaagtgg

SEQ ID NO: 853730 - DNA, 25 bp, Mus musculus
aaagttctcacaagcgataagcgtc

SEQ ID NO: 853731 - DNA, 25 bp, Mus musculus
aaagttctcacaagggataagcgtc

SEQ ID NO: 853732 - DNA, 25 bp, Mus musculus
aaagttgcacaattatcccctaaat

SEQ ID NO: 853733 - DNA, 25 bp, Mus musculus
aaagttgcactattatcccctaaat

SEQ ID NO: 853734 - DNA, 25 bp, Mus musculus
aaagttgcagcatgtgtttgagttt

SEQ ID NO: 853735 - DNA, 25 bp, Mus musculus
aaagttgcaggatgtgtttgagttt

SEQ ID NO: 853736 - DNA, 25 bp, Mus musculus
aaagttggaaatcactggtgatgag

SEQ ID NO: 853737 - DNA, 25 bp, Mus musculus
aaagttggaaatcagtggtgatgag

SEQ ID NO: 853738 - DNA, 25 bp, Mus musculus
aaagttggacaacatgcaagttctg

SEQ ID NO: 853739 - DNA, 25 bp, Mus musculus
aaagttggacaagatgcaagttctg

SEQ ID NO: 853740 - DNA, 25 bp, Mus musculus
aaagtttatgaattcccatctgcaa

SEQ ID NO: 853741 - DNA, 25 bp, Mus musculus
aaagtttatgtattcccatctgcaa

SEQ ID NO: 853742 - DNA, 25 bp, Mus musculus
aaagtttcagcggagctctttgctc

SEQ ID NO: 853743 - DNA, 25 bp, Mus musculus
aaagtttcaggggagctctttgctc

SEQ ID NO: 853744 - DNA, 25 bp, Mus musculus
aaagtttgaaaacctagctgccacg

SEQ ID NO: 853745 - DNA, 25 bp, Mus musculus
aaagtttgaaaagctagctgccacg

SEQ ID NO: 853746 - DNA, 25 bp, Mus musculus
aaagtttgagctgggatgtgtgtgg

SEQ ID NO: 853747 - DNA, 25 bp, Mus musculus
aaagtttgaggtgggatgtgtgtgg

SEQ ID NO: 853748 - DNA, 25 bp, Mus musculus
aaagtttgccttagagcacggcatc

SEQ ID NO: 853749 - DNA, 25 bp, Mus musculus
aaagtttgcctttgagcacggcatc

SEQ ID NO: 853750 - DNA, 25 bp, Mus musculus
aaagttttcacacctattgcagacc

SEQ ID NO: 853751 - DNA, 25 bp, Mus musculus
aaagttttcacagctattgcagacc

SEQ ID NO: 853752 - DNA, 25 bp, Mus musculus
aaataaaaaacaaatttgcattgca

SEQ ID NO: 853753 - DNA, 25 bp, Mus musculus
aaataaaaaagaaatttgcattgca

SEQ ID NO: 853754 - DNA, 25 bp, Mus musculus
aaataacacacacacgctttcctgc

SEQ ID NO: 853755 - DNA, 25 bp, Mus musculus
aaataacacagacacgctttcctgc

SEQ ID NO: 853756 - DNA, 25 bp, Mus musculus
aaataaccagatatcagtttttctt

SEQ ID NO: 853757 - DNA, 25 bp, Mus musculus
aaataaccagctgaagcaagatgcc

SEQ ID NO: 853758 - DNA, 25 bp, Mus musculus
aaataaccaggtgaagcaagatgcc

SEQ ID NO: 853759 - DNA, 25 bp, Mus musculus
aaataaccagttatcagtttttctt

SEQ ID NO: 853760 - DNA, 25 bp, Mus musculus
aaataatcaaagatcttgtttttag

SEQ ID NO: 853761 - DNA, 25 bp, Mus musculus
aaataatcaaagttcttgtttttag

SEQ ID NO: 853762 - DNA, 25 bp, Mus musculus
aaataatgagctccagacctgggga

SEQ ID NO: 853763 - DNA, 25 bp, Mus musculus
aaataatgaggtccagacctgggga

SEQ ID NO: 853764 - DNA, 25 bp, Mus musculus
aaatacaaagcttaccaagaagatc

SEQ ID NO: 853765 - DNA, 25 bp, Mus musculus
aaatacaaaggttaccaagaagatc

SEQ ID NO: 853766 - DNA, 25 bp, Mus musculus
aaatacagtaaatgcaagatcaaga

SEQ ID NO: 853767 - DNA, 25 bp, Mus musculus
aaatacagtaaatggaagatcaaga

SEQ ID NO: 853768 - DNA, 25 bp, Mus musculus
aaatacatgatctgcttctccacag

SEQ ID NO: 853769 - DNA, 25 bp, Mus musculus
aaatacatgatctggttctccacag

SEQ ID NO: 853770 - DNA, 25 bp, Mus musculus
aaatacattcagcaagccgaaatgt

SEQ ID NO: 853771 - DNA, 25 bp, Mus musculus
aaatacattcaggaagccgaaatgt

SEQ ID NO: 853772 - DNA, 25 bp, Mus musculus
aaataccaaatgacttcaccttgaa

SEQ ID NO: 853773 - DNA, 25 bp, Mus musculus
aaataccaaatgtcttcaccttgaa

SEQ ID NO: 853774 - DNA, 25 bp, Mus musculus
aaataccactctcccttcaacaggt

SEQ ID NO: 853775 - DNA, 25 bp, Mus musculus
aaataccactctccgttcaacaggt

SEQ ID NO: 853776 - DNA, 25 bp, Mus musculus
aaataccagaagagaaagtttcact

SEQ ID NO: 853777 - DNA, 25 bp, Mus musculus
aaataccagaagtgaaagtttcact

SEQ ID NO: 853778 - DNA, 25 bp, Mus musculus
aaataccagatcaacgacttccggg

SEQ ID NO: 853779 - DNA, 25 bp, Mus musculus
aaataccagatcaaggacttccggg

SEQ ID NO: 853780 - DNA, 25 bp, Mus musculus
aaatacctcaagcgtgaggatcctt

SEQ ID NO: 853781 - DNA, 25 bp, Mus musculus
aaatacctcaagggtgaggatcctt

SEQ ID NO: 853782 - DNA, 25 bp, Mus musculus
aaataccttcccaacctcatcagtg

SEQ ID NO: 853783 - DNA, 25 bp, Mus musculus
aaataccttcccaagctcatcagtg

SEQ ID NO: 853784 - DNA, 25 bp, Mus musculus
aaatacgcaacaggcgaaaacactg

SEQ ID NO: 853785 - DNA, 25 bp, Mus musculus
aaatacgcaacaggggaaaacactg

SEQ ID NO: 853786 - DNA, 25 bp, Mus musculus
aaatactcacagaaagaagaatcct

SEQ ID NO: 853787 - DNA, 25 bp, Mus musculus
aaatactcacagtaagaagaatcct

SEQ ID NO: 853788 - DNA, 25 bp, Mus musculus
aaatactcatctcacggctgtccaa

SEQ ID NO: 853789 - DNA, 25 bp, Mus musculus
aaatactcatctcagggctgtccaa

SEQ ID NO: 853790 - DNA, 25 bp, Mus musculus
aaatactgcttgtacgagacttatg

SEQ ID NO: 853791 - DNA, 25 bp, Mus musculus
aaatactgcttgtaggagacttatg

SEQ ID NO: 853792 - DNA, 25 bp, Mus musculus
aaatagataatgcaatattttggat

SEQ ID NO: 853793 - DNA, 25 bp, Mus musculus
aaatagataatggaatattttggat

SEQ ID NO: 853794 - DNA, 25 bp, Mus musculus
aaatagatgctattcgtggccgtcg

SEQ ID NO: 853795 - DNA, 25 bp, Mus musculus
aaatagatgctattggtggccgtcg

SEQ ID NO: 853796 - DNA, 25 bp, Mus musculus
aaatagcgatctctggaataaaagc

SEQ ID NO: 853797 - DNA, 25 bp, Mus musculus
aaatagcgatgtctggaataaaagc

SEQ ID NO: 853798 - DNA, 25 bp, Mus musculus
aaatagtctgccagtgaaaggattc

SEQ ID NO: 853799 - DNA, 25 bp, Mus musculus
aaatagtctgcctgtgaaaggattc

SEQ ID NO: 853800 - DNA, 25 bp, Mus musculus
aaatatcattagcaacgctgttcct

SEQ ID NO: 853801 - DNA, 25 bp, Mus musculus
aaatatcattagcatcgctgttcct

SEQ ID NO: 853802 - DNA, 25 bp, Mus musculus
aaatatccagagcgacgagatttat

SEQ ID NO: 853803 - DNA, 25 bp, Mus musculus
aaatatccagatttagagcgacgag

SEQ ID NO: 853804 - DNA, 25 bp, Mus musculus
aaatatccagtgcgacgagatttat

SEQ ID NO: 853805 - DNA, 25 bp, Mus musculus
aaatatccagttttagagcgacgag

SEQ ID NO: 853806 - DNA, 25 bp, Mus musculus
aaatatctaaccagcagatagtcta

SEQ ID NO: 853807 - DNA, 25 bp, Mus musculus
aaatatctaaccaggagatagtcta

SEQ ID NO: 853808 - DNA, 25 bp, Mus musculus
aaatatctggaacacttttacactt

SEQ ID NO: 853809 - DNA, 25 bp, Mus musculus
aaatatctggaagacttttacactt

SEQ ID NO: 853810 - DNA, 25 bp, Mus musculus
aaatatgaacagccatgtaatgaat

SEQ ID NO: 853811 - DNA, 25 bp, Mus musculus
aaatatgaacaggcatgtaatgaat

SEQ ID NO: 853812 - DNA, 25 bp, Mus musculus
aaatatgccaagactttatacctgc

SEQ ID NO: 853813 - DNA, 25 bp, Mus musculus
aaatatgccaagtctttatacctgc

SEQ ID NO: 853814 - DNA, 25 bp, Mus musculus
aaatatgctgcagaccttcacttgg

SEQ ID NO: 853815 - DNA, 25 bp, Mus musculus
aaatatgctgcagagcttcacttgg

SEQ ID NO: 853816 - DNA, 25 bp, Mus musculus
aaatatggttttcctgtacagagag

SEQ ID NO: 853817 - DNA, 25 bp, Mus musculus
aaatatggttttgctgtacagagag

SEQ ID NO: 853818 - DNA, 25 bp, Mus musculus
aaatattaagacatgttcgttcttc

SEQ ID NO: 853819 - DNA, 25 bp, Mus musculus
aaatattaagtcatgttcgttcttc

SEQ ID NO: 853820 - DNA, 25 bp, Mus musculus
aaatatttagattatccttatgtgg

SEQ ID NO: 853821 - DNA, 25 bp, Mus musculus
aaatatttagattgaggatgggtac

SEQ ID NO: 853822 - DNA, 25 bp, Mus musculus
aaatatttagtttatccttatgtgg

SEQ ID NO: 853823 - DNA, 25 bp, Mus musculus
aaatatttagtttgaggatgggtac

SEQ ID NO: 853824 - DNA, 25 bp, Mus musculus
aaatcaaaagctgtgatccttgcac

SEQ ID NO: 853825 - DNA, 25 bp, Mus musculus
aaatcaaaaggtgtgatccttgcac

SEQ ID NO: 853826 - DNA, 25 bp, Mus musculus
aaatcaaccaagctgctcttctcag

SEQ ID NO: 853827 - DNA, 25 bp, Mus musculus
aaatcaaccaaggtgctcttctcag

SEQ ID NO: 853828 - DNA, 25 bp, Mus musculus
aaatcaagagagctgtgtcaatgag

SEQ ID NO: 853829 - DNA, 25 bp, Mus musculus
aaatcaagagaggtgtgtcaatgag

SEQ ID NO: 853830 - DNA, 25 bp, Mus musculus
aaatcacagaataccacctcctcaa

SEQ ID NO: 853831 - DNA, 25 bp, Mus musculus
aaatcacagacaagcagaacaagcc

SEQ ID NO: 853832 - DNA, 25 bp, Mus musculus
aaatcacagagaagcagaacaagcc

SEQ ID NO: 853833 - DNA, 25 bp, Mus musculus
aaatcacagattaccacctcctcaa

SEQ ID NO: 853834 - DNA, 25 bp, Mus musculus
aaatcacatcagctgacagagttag

SEQ ID NO: 853835 - DNA, 25 bp, Mus musculus
aaatcacatcaggtgacagagttag

SEQ ID NO: 853836 - DNA, 25 bp, Mus musculus
aaatcacatgatcgagcctcaaggc

SEQ ID NO: 853837 - DNA, 25 bp, Mus musculus
aaatcacatgatggagcctcaaggc

SEQ ID NO: 853838 - DNA, 25 bp, Mus musculus
aaatcaccacagacatgaacagcag

SEQ ID NO: 853839 - DNA, 25 bp, Mus musculus
aaatcaccacagacttgaacagcag

SEQ ID NO: 853840 - DNA, 25 bp, Mus musculus
aaatcacgaggacccgccatcccca

SEQ ID NO: 853841 - DNA, 25 bp, Mus musculus
aaatcacgaggaccggccatcccca

SEQ ID NO: 853842 - DNA, 25 bp, Mus musculus
aaatcacgccagaaaagtagacttc

SEQ ID NO: 853843 - DNA, 25 bp, Mus musculus
aaatcacgccagtaaagtagacttc

SEQ ID NO: 853844 - DNA, 25 bp, Mus musculus
aaatcacggaagctgtctcagacat

SEQ ID NO: 853845 - DNA, 25 bp, Mus musculus
aaatcacggaaggtgtctcagacat

SEQ ID NO: 853846 - DNA, 25 bp, Mus musculus
aaatcagaagcctaggcaagccaga

SEQ ID NO: 853847 - DNA, 25 bp, Mus musculus
aaatcagaaggctaggcaagccaga

SEQ ID NO: 853848 - DNA, 25 bp, Mus musculus
aaatcagacttccacgtgaatctaa

SEQ ID NO: 853849 - DNA, 25 bp, Mus musculus
aaatcagacttccaggtgaatctaa

SEQ ID NO: 853850 - DNA, 25 bp, Mus musculus
aaatcagagtagggaatacacctga

SEQ ID NO: 853851 - DNA, 25 bp, Mus musculus
aaatcagagttgggaatacacctga

SEQ ID NO: 853852 - DNA, 25 bp, Mus musculus
aaatcagttaagctcattgttgtgg

SEQ ID NO: 853853 - DNA, 25 bp, Mus musculus
aaatcagttaaggtcattgttgtgg

SEQ ID NO: 853854 - DNA, 25 bp, Mus musculus
aaatcatcaccacaataagcctgca

SEQ ID NO: 853855 - DNA, 25 bp, Mus musculus
aaatcatcaccagaataagcctgca

SEQ ID NO: 853856 - DNA, 25 bp, Mus musculus
aaatcattagataacaactattcca

SEQ ID NO: 853857 - DNA, 25 bp, Mus musculus
aaatcattagttaacaactattcca

SEQ ID NO: 853858 - DNA, 25 bp, Mus musculus
aaatcattggaggaggctgagaaac

SEQ ID NO: 853859 - DNA, 25 bp, Mus musculus
aaatcattggtggaggctgagaaac

SEQ ID NO: 853860 - DNA, 25 bp, Mus musculus
aaatccaacaatatatttctccatg

SEQ ID NO: 853861 - DNA, 25 bp, Mus musculus
aaatccaacattatatttctccatg

SEQ ID NO: 853862 - DNA, 25 bp, Mus musculus
aaatccaactaccacctgtggcacg

SEQ ID NO: 853863 - DNA, 25 bp, Mus musculus
aaatccaactaccagctgtggcacg

SEQ ID NO: 853864 - DNA, 25 bp, Mus musculus
aaatccacagagtttatcagaccca

SEQ ID NO: 853865 - DNA, 25 bp, Mus musculus
aaatccacagtgtttatcagaccca

SEQ ID NO: 853866 - DNA, 25 bp, Mus musculus
aaatccagagcatctctctcaacac

SEQ ID NO: 853867 - DNA, 25 bp, Mus musculus
aaatccagagctgaaaatccagggc

SEQ ID NO: 853868 - DNA, 25 bp, Mus musculus
aaatccagaggatctctctcaacac

SEQ ID NO: 853869 - DNA, 25 bp, Mus musculus
aaatccagaggtgaaaatccagggc

SEQ ID NO: 853870 - DNA, 25 bp, Mus musculus
aaatccatgaagcgcttaggcactg

SEQ ID NO: 853871 - DNA, 25 bp, Mus musculus
aaatccatgaagggcttaggcactg

SEQ ID NO: 853872 - DNA, 25 bp, Mus musculus
aaatccccacagatttgacctcctg

SEQ ID NO: 853873 - DNA, 25 bp, Mus musculus
aaatccccacagttttgacctcctg

SEQ ID NO: 853874 - DNA, 25 bp, Mus musculus
aaatcctacacaccatggaccgcga

SEQ ID NO: 853875 - DNA, 25 bp, Mus musculus
aaatcctacacagcatggaccgcga

SEQ ID NO: 853876 - DNA, 25 bp, Mus musculus
aaatcctcaaagctgtaccgccgac

SEQ ID NO: 853877 - DNA, 25 bp, Mus musculus
aaatcctcaaaggtgtaccgccgac

SEQ ID NO: 853878 - DNA, 25 bp, Mus musculus
aaatcctgtgctgggagcatgccgg

SEQ ID NO: 853879 - DNA, 25 bp, Mus musculus
aaatcctgtggtgggagcatgccgg

SEQ ID NO: 853880 - DNA, 25 bp, Mus musculus
aaatccttagcacgaaggaggctgc

SEQ ID NO: 853881 - DNA, 25 bp, Mus musculus
aaatccttagcaggaaggaggctgc

SEQ ID NO: 853882 - DNA, 25 bp, Mus musculus
aaatccttcagacatttatccaata

SEQ ID NO: 853883 - DNA, 25 bp, Mus musculus
aaatccttcagagatttatccaata

SEQ ID NO: 853884 - DNA, 25 bp, Mus musculus
aaatccttgctgctctgtgcgtgat

SEQ ID NO: 853885 - DNA, 25 bp, Mus musculus
aaatccttgctggtctgtgcgtgat

SEQ ID NO: 853886 - DNA, 25 bp, Mus musculus
aaatccttggctggaagctcaggcc

SEQ ID NO: 853887 - DNA, 25 bp, Mus musculus
aaatccttggctggactcaggccct

SEQ ID NO: 853888 - DNA, 25 bp, Mus musculus
aaatccttggctggtagctcaggcc

SEQ ID NO: 853889 - DNA, 25 bp, Mus musculus
aaatccttggctggtctcaggccct

SEQ ID NO: 853890 - DNA, 25 bp, Mus musculus
aaatcgaagcagaaaatgaacaggt

SEQ ID NO: 853891 - DNA, 25 bp, Mus musculus
aaatcgaagcagtaaatgaacaggt

SEQ ID NO: 853892 - DNA, 25 bp, Mus musculus
aaatcgattcaacgatcgcattgta

SEQ ID NO: 853893 - DNA, 25 bp, Mus musculus
aaatcgattcaaggatcgcattgta

SEQ ID NO: 853894 - DNA, 25 bp, Mus musculus
aaatcggtggaacttctgttgagtt

SEQ ID NO: 853895 - DNA, 25 bp, Mus musculus
aaatcggtggaagttctgttgagtt

SEQ ID NO: 853896 - DNA, 25 bp, Mus musculus
aaatctaaagtgcattggtcttgat

SEQ ID NO: 853897 - DNA, 25 bp, Mus musculus
aaatctaaagtggattggtcttgat

SEQ ID NO: 853898 - DNA, 25 bp, Mus musculus
aaatctaacactcgtgaatatgtaa

SEQ ID NO: 853899 - DNA, 25 bp, Mus musculus
aaatctaacactggtgaatatgtaa

SEQ ID NO: 853900 - DNA, 25 bp, Mus musculus
aaatctagaagacgaacaagagagt

SEQ ID NO: 853901 - DNA, 25 bp, Mus musculus
aaatctagaagaggaacaagagagt

SEQ ID NO: 853902 - DNA, 25 bp, Mus musculus
aaatctatgaatggtaccacaagaa

SEQ ID NO: 853903 - DNA, 25 bp, Mus musculus
aaatctatgattggtaccacaagaa

SEQ ID NO: 853904 - DNA, 25 bp, Mus musculus
aaatctcaaacgtggattacaggaa

SEQ ID NO: 853905 - DNA, 25 bp, Mus musculus
aaatctcaaaggtggattacaggaa

SEQ ID NO: 853906 - DNA, 25 bp, Mus musculus
aaatctcagaaaatcgctcctcggt

SEQ ID NO: 853907 - DNA, 25 bp, Mus musculus
aaatctcagaaaatggctcctcggt

SEQ ID NO: 853908 - DNA, 25 bp, Mus musculus
aaatctccagcatggaggcctgcat

SEQ ID NO: 853909 - DNA, 25 bp, Mus musculus
aaatctccaggatggaggcctgcat

SEQ ID NO: 853910 - DNA, 25 bp, Mus musculus
aaatctccgttgtcacagctaccaa

SEQ ID NO: 853911 - DNA, 25 bp, Mus musculus
aaatctccgttgtcactaccaaggg

SEQ ID NO: 853912 - DNA, 25 bp, Mus musculus
aaatctccgttgtctcagctaccaa

SEQ ID NO: 853913 - DNA, 25 bp, Mus musculus
aaatctccgttgtctctaccaaggg

SEQ ID NO: 853914 - DNA, 25 bp, Mus musculus
aaatctcggcagaactgcaggctcc

SEQ ID NO: 853915 - DNA, 25 bp, Mus musculus
aaatctcggcagaagtgcaggctcc

SEQ ID NO: 853916 - DNA, 25 bp, Mus musculus
aaatctctataaaattcaacttact

SEQ ID NO: 853917 - DNA, 25 bp, Mus musculus
aaatctctataatattcaacttact

SEQ ID NO: 853918 - DNA, 25 bp, Mus musculus
aaatctgaactgcagaaggaacctc

SEQ ID NO: 853919 - DNA, 25 bp, Mus musculus
aaatctgaactggagaaggaacctc

SEQ ID NO: 853920 - DNA, 25 bp, Mus musculus
aaatctgaagatcgcgccagcctcc

SEQ ID NO: 853921 - DNA, 25 bp, Mus musculus
aaatctgaagatggcgccagcctcc

SEQ ID NO: 853922 - DNA, 25 bp, Mus musculus
aaatctgagagacgtgaaccaccaa

SEQ ID NO: 853923 - DNA, 25 bp, Mus musculus
aaatctgagagaggtgaaccaccaa

SEQ ID NO: 853924 - DNA, 25 bp, Mus musculus
aaatctgattctcgttttgctattc

SEQ ID NO: 853925 - DNA, 25 bp, Mus musculus
aaatctgattctggttttgctattc

SEQ ID NO: 853926 - DNA, 25 bp, Mus musculus
aaatctgcagagctggacgctagtg

SEQ ID NO: 853927 - DNA, 25 bp, Mus musculus
aaatctgcagaggtggacgctagtg

SEQ ID NO: 853928 - DNA, 25 bp, Mus musculus
aaatctgcagatctcataggatggt

SEQ ID NO: 853929 - DNA, 25 bp, Mus musculus
aaatctgcagatgtgaatcctaaat

SEQ ID NO: 853930 - DNA, 25 bp, Mus musculus
aaatctgcagttctcataggatggt

SEQ ID NO: 853931 - DNA, 25 bp, Mus musculus
aaatctgcagttgtgaatcctaaat

SEQ ID NO: 853932 - DNA, 25 bp, Mus musculus
aaatctgtcgctagtggtggttggc

SEQ ID NO: 853933 - DNA, 25 bp, Mus musculus
aaatctgtcggtagtggtggttggc

SEQ ID NO: 853934 - DNA, 25 bp, Mus musculus
aaatctgtgaagcgttccgagcctc

SEQ ID NO: 853935 - DNA, 25 bp, Mus musculus
aaatctgtgaagggttccgagcctc

SEQ ID NO: 853936 - DNA, 25 bp, Mus musculus
aaatctttgaactcattggattgcc

SEQ ID NO: 853937 - DNA, 25 bp, Mus musculus
aaatctttgatctcattggattgcc

SEQ ID NO: 853938 - DNA, 25 bp, Mus musculus
aaatgaaaactgagggagatgagac

SEQ ID NO: 853939 - DNA, 25 bp, Mus musculus
aaatgaaaactgtgggagatgagac

SEQ ID NO: 853940 - DNA, 25 bp, Mus musculus
aaatgaaaatctggatagacacgta

SEQ ID NO: 853941 - DNA, 25 bp, Mus musculus
aaatgaaaatgtggatagacacgta

SEQ ID NO: 853942 - DNA, 25 bp, Mus musculus
aaatgaatttcaaggggctgaggcg

SEQ ID NO: 853943 - DNA, 25 bp, Mus musculus
aaatgaatttcatggggctgaggcg

SEQ ID NO: 853944 - DNA, 25 bp, Mus musculus
aaatgactacattacgttatttggg

SEQ ID NO: 853945 - DNA, 25 bp, Mus musculus
aaatgactacattaggttatttggg

SEQ ID NO: 853946 - DNA, 25 bp, Mus musculus
aaatgacttcaacgcatttttcatc

SEQ ID NO: 853947 - DNA, 25 bp, Mus musculus
aaatgacttcaaggcatttttcatc

SEQ ID NO: 853948 - DNA, 25 bp, Mus musculus
aaatgagacgagctggagatcaaag

SEQ ID NO: 853949 - DNA, 25 bp, Mus musculus
aaatgagacgcaagctgccactttt

SEQ ID NO: 853950 - DNA, 25 bp, Mus musculus
aaatgagacggaagctgccactttt

SEQ ID NO: 853951 - DNA, 25 bp, Mus musculus
aaatgagacgtgctggagatcaaag

SEQ ID NO: 853952 - DNA, 25 bp, Mus musculus
aaatgagagtaacccttcctccacg

SEQ ID NO: 853953 - DNA, 25 bp, Mus musculus
aaatgagagtaagccttcctccacg

SEQ ID NO: 853954 - DNA, 25 bp, Mus musculus
aaatgaggtgcttgtagaccctgat

SEQ ID NO: 853955 - DNA, 25 bp, Mus musculus
aaatgaggtggttgtagaccctgat

SEQ ID NO: 853956 - DNA, 25 bp, Mus musculus
aaatgagtttcacgatagtgatgca

SEQ ID NO: 853957 - DNA, 25 bp, Mus musculus
aaatgagtttcaggatagtgatgca

SEQ ID NO: 853958 - DNA, 25 bp, Mus musculus
aaatgataagaatggcacacgaaac

SEQ ID NO: 853959 - DNA, 25 bp, Mus musculus
aaatgataagcaacatgacattgaa

SEQ ID NO: 853960 - DNA, 25 bp, Mus musculus
aaatgataagctcaatgatatggaa

SEQ ID NO: 853961 - DNA, 25 bp, Mus musculus
aaatgataagctcggtaaaactcca

SEQ ID NO: 853962 - DNA, 25 bp, Mus musculus
aaatgataagctgaatgatatggaa

SEQ ID NO: 853963 - DNA, 25 bp, Mus musculus
aaatgataagctgggtaaaactcca

SEQ ID NO: 853964 - DNA, 25 bp, Mus musculus
aaatgataaggaacatgacattgaa

SEQ ID NO: 853965 - DNA, 25 bp, Mus musculus
aaatgataagtatggcacacgaaac

SEQ ID NO: 853966 - DNA, 25 bp, Mus musculus
aaatgatcgtaaagagtttgttgga

SEQ ID NO: 853967 - DNA, 25 bp, Mus musculus
aaatgatcgtaaagtgtttgttgga

SEQ ID NO: 853968 - DNA, 25 bp, Mus musculus
aaatgatgcgctaaccattcaagtc

SEQ ID NO: 853969 - DNA, 25 bp, Mus musculus
aaatgatgcggtaaccattcaagtc

SEQ ID NO: 853970 - DNA, 25 bp, Mus musculus
aaatgcacagcaaactttgctggtt

SEQ ID NO: 853971 - DNA, 25 bp, Mus musculus
aaatgcacaggaaactttgctggtt

SEQ ID NO: 853972 - DNA, 25 bp, Mus musculus
aaatgcaccaaaagatgagattgat

SEQ ID NO: 853973 - DNA, 25 bp, Mus musculus
aaatgcaccaaatgatgagattgat

SEQ ID NO: 853974 - DNA, 25 bp, Mus musculus
aaatgcaggcaatgcaacgctgcca

SEQ ID NO: 853975 - DNA, 25 bp, Mus musculus
aaatgcaggctatgcaacgctgcca

SEQ ID NO: 853976 - DNA, 25 bp, Mus musculus
aaatgcattgggatcgaactgtcca

SEQ ID NO: 853977 - DNA, 25 bp, Mus musculus
aaatgcattgggatggaactgtcca

SEQ ID NO: 853978 - DNA, 25 bp, Mus musculus
aaatgccaaacacgttggccgcctt

SEQ ID NO: 853979 - DNA, 25 bp, Mus musculus
aaatgccaaacaggttggccgcctt

SEQ ID NO: 853980 - DNA, 25 bp, Mus musculus
aaatgccaacagatggctgaggaca

SEQ ID NO: 853981 - DNA, 25 bp, Mus musculus
aaatgccaacagcagatggctgagg

SEQ ID NO: 853982 - DNA, 25 bp, Mus musculus
aaatgccaacaggagatggctgagg

SEQ ID NO: 853983 - DNA, 25 bp, Mus musculus
aaatgccaacagttggctgaggaca

SEQ ID NO: 853984 - DNA, 25 bp, Mus musculus
aaatgcctatcacatgcgagctgtt

SEQ ID NO: 853985 - DNA, 25 bp, Mus musculus
aaatgcctatcagatgcgagctgtt

SEQ ID NO: 853986 - DNA, 25 bp, Mus musculus
aaatgctgaatgctattttgacaga

SEQ ID NO: 853987 - DNA, 25 bp, Mus musculus
aaatgctgaatggtattttgacaga

SEQ ID NO: 853988 - DNA, 25 bp, Mus musculus
aaatgcttggctcaccagtggattc

SEQ ID NO: 853989 - DNA, 25 bp, Mus musculus
aaatgcttgggtcaccagtggattc

SEQ ID NO: 853990 - DNA, 25 bp, Mus musculus
aaatggagagactggatgtggatag

SEQ ID NO: 853991 - DNA, 25 bp, Mus musculus
aaatggagagaggtaagaagtatgg

SEQ ID NO: 853992 - DNA, 25 bp, Mus musculus
aaatggagagtctggatgtggatag

SEQ ID NO: 853993 - DNA, 25 bp, Mus musculus
aaatggagagtggtaagaagtatgg

SEQ ID NO: 853994 - DNA, 25 bp, Mus musculus
aaatggagatagccttgccagatga

SEQ ID NO: 853995 - DNA, 25 bp, Mus musculus
aaatggagataggcttgccagatga

SEQ ID NO: 853996 - DNA, 25 bp, Mus musculus
aaatggagatataatcatgtgtgca

SEQ ID NO: 853997 - DNA, 25 bp, Mus musculus
aaatggagatttaatcatgtgtgca

SEQ ID NO: 853998 - DNA, 25 bp, Mus musculus
aaatggagcaggagccctgcctagc

SEQ ID NO: 853999 - DNA, 25 bp, Mus musculus
aaatggagcaggtgccctgcctagc

SEQ ID NO: 854000 - DNA, 25 bp, Mus musculus
aaatggagtcaaactgggtgtcgct

SEQ ID NO: 854001 - DNA, 25 bp, Mus musculus
aaatggagtcaatctgggtgtcgct

SEQ ID NO: 854002 - DNA, 25 bp, Mus musculus
aaatggattcttctcctgttgttgg

SEQ ID NO: 854003 - DNA, 25 bp, Mus musculus
aaatggattcttgtcctgttgttgg

SEQ ID NO: 854004 - DNA, 25 bp, Mus musculus
aaatggcaaaaacgtatgtggacag

SEQ ID NO: 854005 - DNA, 25 bp, Mus musculus
aaatggcaaaaaggtatgtggacag

SEQ ID NO: 854006 - DNA, 25 bp, Mus musculus
aaatggcactaccgttcttgctcct

SEQ ID NO: 854007 - DNA, 25 bp, Mus musculus
aaatggcacttccgttcttgctcct

SEQ ID NO: 854008 - DNA, 25 bp, Mus musculus
aaatggcagccacactcagtcctct

SEQ ID NO: 854009 - DNA, 25 bp, Mus musculus
aaatggcagccagactcagtcctct

SEQ ID NO: 854010 - DNA, 25 bp, Mus musculus
aaatggccatctcagggatgagagg

SEQ ID NO: 854011 - DNA, 25 bp, Mus musculus
aaatggccatgtcagggatgagagg

SEQ ID NO: 854012 - DNA, 25 bp, Mus musculus
aaatggctcacggggagcaccgtct

SEQ ID NO: 854013 - DNA, 25 bp, Mus musculus
aaatggctcagggggagcaccgtct

SEQ ID NO: 854014 - DNA, 25 bp, Mus musculus
aaatggctgccaaatggcaccttga

SEQ ID NO: 854015 - DNA, 25 bp, Mus musculus
aaatggctgccatatggcaccttga

SEQ ID NO: 854016 - DNA, 25 bp, Mus musculus
aaatgggacgcgaaaatgctcaaca

SEQ ID NO: 854017 - DNA, 25 bp, Mus musculus
aaatgggacgggaaaatgctcaaca

SEQ ID NO: 854018 - DNA, 25 bp, Mus musculus
aaatggggaagaccttcatggaggt

SEQ ID NO: 854019 - DNA, 25 bp, Mus musculus
aaatggggaagagcttcatggaggt

SEQ ID NO: 854020 - DNA, 25 bp, Mus musculus
aaatggtatcttaacgaactccagg

SEQ ID NO: 854021 - DNA, 25 bp, Mus musculus
aaatggtatcttaaggaactccagg

SEQ ID NO: 854022 - DNA, 25 bp, Mus musculus
aaatggtcatcacagctgtactggc

SEQ ID NO: 854023 - DNA, 25 bp, Mus musculus
aaatggtcatcactgtcctcctatc

SEQ ID NO: 854024 - DNA, 25 bp, Mus musculus
aaatggtcatcagagctgtactggc

SEQ ID NO: 854025 - DNA, 25 bp, Mus musculus
aaatggtcatcagtgtcctcctatc

SEQ ID NO: 854026 - DNA, 25 bp, Mus musculus
aaatggtgagcccatcttctgatac

SEQ ID NO: 854027 - DNA, 25 bp, Mus musculus
aaatggtgaggccatcttctgatac

SEQ ID NO: 854028 - DNA, 25 bp, Mus musculus
aaatggtggaggaacgacacttcgc

SEQ ID NO: 854029 - DNA, 25 bp, Mus musculus
aaatggtggaggaaggacacttcgc

SEQ ID NO: 854030 - DNA, 25 bp, Mus musculus
aaatggttcacccacgctatggtgt

SEQ ID NO: 854031 - DNA, 25 bp, Mus musculus
aaatggttcacccaggctatggtgt

SEQ ID NO: 854032 - DNA, 25 bp, Mus musculus
aaatgtaaaaagacttgtagggatg

SEQ ID NO: 854033 - DNA, 25 bp, Mus musculus
aaatgtaaaatgacttgtagggatg

SEQ ID NO: 854034 - DNA, 25 bp, Mus musculus
aaatgtacagactaaatccagtgaa

SEQ ID NO: 854035 - DNA, 25 bp, Mus musculus
aaatgtacagtctaaatccagtgaa

SEQ ID NO: 854036 - DNA, 25 bp, Mus musculus
aaatgtagagcttgtggtgtgaact

SEQ ID NO: 854037 - DNA, 25 bp, Mus musculus
aaatgtagaggttgtggtgtgaact

SEQ ID NO: 854038 - DNA, 25 bp, Mus musculus
aaatgtcaccttcacctacccctgc

SEQ ID NO: 854039 - DNA, 25 bp, Mus musculus
aaatgtcaccttcagctacccctgc

SEQ ID NO: 854040 - DNA, 25 bp, Mus musculus
aaatgtcatgcaaacttgacatcac

SEQ ID NO: 854041 - DNA, 25 bp, Mus musculus
aaatgtcatggaaacttgacatcac

SEQ ID NO: 854042 - DNA, 25 bp, Mus musculus
aaatgtccagcttgctacaagatta

SEQ ID NO: 854043 - DNA, 25 bp, Mus musculus
aaatgtccaggttgctacaagatta

SEQ ID NO: 854044 - DNA, 25 bp, Mus musculus
aaatgtgaaaaactattcaaacata

SEQ ID NO: 854045 - DNA, 25 bp, Mus musculus
aaatgtgaaaaagtattcaaacata

SEQ ID NO: 854046 - DNA, 25 bp, Mus musculus
aaatgtgaagcccgaggtggtaaga

SEQ ID NO: 854047 - DNA, 25 bp, Mus musculus
aaatgtgaagcctgtggattaaatt

SEQ ID NO: 854048 - DNA, 25 bp, Mus musculus
aaatgtgaaggccgaggtggtaaga

SEQ ID NO: 854049 - DNA, 25 bp, Mus musculus
aaatgtgaaggctgtggattaaatt

SEQ ID NO: 854050 - DNA, 25 bp, Mus musculus
aaatgtggccatcacggctgtggca

SEQ ID NO: 854051 - DNA, 25 bp, Mus musculus
aaatgtggccatcacgggctgtggc

SEQ ID NO: 854052 - DNA, 25 bp, Mus musculus
aaatgtggccatcagggctgtggca

SEQ ID NO: 854053 - DNA, 25 bp, Mus musculus
aaatgtggccatcaggggctgtggc

SEQ ID NO: 854054 - DNA, 25 bp, Mus musculus
aaatgttatgttcgtattttctgct

SEQ ID NO: 854055 - DNA, 25 bp, Mus musculus
aaatgttatgttggtattttctgct

SEQ ID NO: 854056 - DNA, 25 bp, Mus musculus
aaatgttgcctaaaaccatgaatag

SEQ ID NO: 854057 - DNA, 25 bp, Mus musculus
aaatgttgcctataaccatgaatag

SEQ ID NO: 854058 - DNA, 25 bp, Mus musculus
aaatgttgtgacctctgttgtgcat

SEQ ID NO: 854059 - DNA, 25 bp, Mus musculus
aaatgttgtgccagaataccagagt

SEQ ID NO: 854060 - DNA, 25 bp, Mus musculus
aaatgttgtggcagaataccagagt

SEQ ID NO: 854061 - DNA, 25 bp, Mus musculus
aaatgttgtgtcctctgttgtgcat

SEQ ID NO: 854062 - DNA, 25 bp, Mus musculus
aaatgttttctggactgacactagc

SEQ ID NO: 854063 - DNA, 25 bp, Mus musculus
aaatgttttctggagtgacactagc

SEQ ID NO: 854064 - DNA, 25 bp, Mus musculus
aaattaacagagcatattttgcccg

SEQ ID NO: 854065 - DNA, 25 bp, Mus musculus
aaattaacagaggatattttgcccg

SEQ ID NO: 854066 - DNA, 25 bp, Mus musculus
aaattaacagagtgtccaagcacga

SEQ ID NO: 854067 - DNA, 25 bp, Mus musculus
aaattaacagtgtgtccaagcacga

SEQ ID NO: 854068 - DNA, 25 bp, Mus musculus
aaattaccctaacttatacattgat

SEQ ID NO: 854069 - DNA, 25 bp, Mus musculus
aaattaccctaagttatacattgat

SEQ ID NO: 854070 - DNA, 25 bp, Mus musculus
aaattacgtgaagacagggcacatc

SEQ ID NO: 854071 - DNA, 25 bp, Mus musculus
aaattacgtgaagagagggcacatc

SEQ ID NO: 854072 - DNA, 25 bp, Mus musculus
aaattagacagacagaatcggatat

SEQ ID NO: 854073 - DNA, 25 bp, Mus musculus
aaattagacagagagaatcggatat

SEQ ID NO: 854074 - DNA, 25 bp, Mus musculus
aaattattagatggaccatcaactg

SEQ ID NO: 854075 - DNA, 25 bp, Mus musculus
aaattattagttggaccatcaactg

SEQ ID NO: 854076 - DNA, 25 bp, Mus musculus
aaattattggaaaaaatggtgatta

SEQ ID NO: 854077 - DNA, 25 bp, Mus musculus
aaattattggaataaatggtgatta

SEQ ID NO: 854078 - DNA, 25 bp, Mus musculus
aaattcaaccagcaggtacagaagg

SEQ ID NO: 854079 - DNA, 25 bp, Mus musculus
aaattcaaccaggaggtacagaagg

SEQ ID NO: 854080 - DNA, 25 bp, Mus musculus
aaattcaactcagtccatttaaaaa

SEQ ID NO: 854081 - DNA, 25 bp, Mus musculus
aaattcaactcagtgcatttaaaaa

SEQ ID NO: 854082 - DNA, 25 bp, Mus musculus
aaattcacaaaacggaaggatctgt

SEQ ID NO: 854083 - DNA, 25 bp, Mus musculus
aaattcacaaaagggaaggatctgt

SEQ ID NO: 854084 - DNA, 25 bp, Mus musculus
aaattcactgttcaccccacagtga

SEQ ID NO: 854085 - DNA, 25 bp, Mus musculus
aaattcactgttcacgcatccgaag

SEQ ID NO: 854086 - DNA, 25 bp, Mus musculus
aaattcactgttcagcccacagtga

SEQ ID NO: 854087 - DNA, 25 bp, Mus musculus
aaattcactgttcaggcatccgaag

SEQ ID NO: 854088 - DNA, 25 bp, Mus musculus
aaattccaccagcagtatgagcccc

SEQ ID NO: 854089 - DNA, 25 bp, Mus musculus
aaattccaccaggagtatgagcccc

SEQ ID NO: 854090 - DNA, 25 bp, Mus musculus
aaattccacttgacagggacgtgga

SEQ ID NO: 854091 - DNA, 25 bp, Mus musculus
aaattccacttgactgggacgtgga

SEQ ID NO: 854092 - DNA, 25 bp, Mus musculus
aaattcgaactgctgttgatcagtg

SEQ ID NO: 854093 - DNA, 25 bp, Mus musculus
aaattcgaactggtgttgatcagtg

SEQ ID NO: 854094 - DNA, 25 bp, Mus musculus
aaattctcacaacatagtactggag

SEQ ID NO: 854095 - DNA, 25 bp, Mus musculus
aaattctcacaagatagtactggag

SEQ ID NO: 854096 - DNA, 25 bp, Mus musculus
aaattctcacagacaggagaaatct

SEQ ID NO: 854097 - DNA, 25 bp, Mus musculus
aaattctcacagtcaggagaaatct

SEQ ID NO: 854098 - DNA, 25 bp, Mus musculus
aaattctcagcacagcagccctcct

SEQ ID NO: 854099 - DNA, 25 bp, Mus musculus
aaattctcaggacagcagccctcct

SEQ ID NO: 854100 - DNA, 25 bp, Mus musculus
aaattctcattaagctgtttgacac

SEQ ID NO: 854101 - DNA, 25 bp, Mus musculus
aaattctcattatgctgtttgacac

SEQ ID NO: 854102 - DNA, 25 bp, Mus musculus
aaattctgatgtattaaaaatcact

SEQ ID NO: 854103 - DNA, 25 bp, Mus musculus
aaattctgatgttttaaaaatcact

SEQ ID NO: 854104 - DNA, 25 bp, Mus musculus
aaattgaaaggcaacggacccacat

SEQ ID NO: 854105 - DNA, 25 bp, Mus musculus
aaattgaaaggcaagggacccacat

SEQ ID NO: 854106 - DNA, 25 bp, Mus musculus
aaattgaagcagcaggcaatttgta

SEQ ID NO: 854107 - DNA, 25 bp, Mus musculus
aaattgaagcaggaggcaatttgta

SEQ ID NO: 854108 - DNA, 25 bp, Mus musculus
aaattgaatcagctgaactggaccc

SEQ ID NO: 854109 - DNA, 25 bp, Mus musculus
aaattgaatcaggtgaactggaccc

SEQ ID NO: 854110 - DNA, 25 bp, Mus musculus
aaattgacagctagctacatcaagc

SEQ ID NO: 854111 - DNA, 25 bp, Mus musculus
aaattgacaggtagctacatcaagc

SEQ ID NO: 854112 - DNA, 25 bp, Mus musculus
aaattgagagagctgatagaaattg

SEQ ID NO: 854113 - DNA, 25 bp, Mus musculus
aaattgagagaggtgatagaaattg

SEQ ID NO: 854114 - DNA, 25 bp, Mus musculus
aaattgagtattggcaatattacag

SEQ ID NO: 854115 - DNA, 25 bp, Mus musculus
aaattgagtattgggaatattacag

SEQ ID NO: 854116 - DNA, 25 bp, Mus musculus
aaattgcaccagctgatgttattgt

SEQ ID NO: 854117 - DNA, 25 bp, Mus musculus
aaattgcaccaggtgatgttattgt

SEQ ID NO: 854118 - DNA, 25 bp, Mus musculus
aaattgccagcttctacaaactgca

SEQ ID NO: 854119 - DNA, 25 bp, Mus musculus
aaattgccaggttctacaaactgca

SEQ ID NO: 854120 - DNA, 25 bp, Mus musculus
aaattgctcaagagacattttaagt

SEQ ID NO: 854121 - DNA, 25 bp, Mus musculus
aaattgctcaagagtcctaaacctg

SEQ ID NO: 854122 - DNA, 25 bp, Mus musculus
aaattgctcaagtgacattttaagt

SEQ ID NO: 854123 - DNA, 25 bp, Mus musculus
aaattgctcaagtgtcctaaacctg

SEQ ID NO: 854124 - DNA, 25 bp, Mus musculus
aaattgctccagcaggaatgggctc

SEQ ID NO: 854125 - DNA, 25 bp, Mus musculus
aaattgctccaggaggaatgggctc

SEQ ID NO: 854126 - DNA, 25 bp, Mus musculus
aaattggaccagctctctcagtttg

SEQ ID NO: 854127 - DNA, 25 bp, Mus musculus
aaattggaccaggtctctcagtttg

SEQ ID NO: 854128 - DNA, 25 bp, Mus musculus
aaattggcatcacgttgtttgggcc

SEQ ID NO: 854129 - DNA, 25 bp, Mus musculus
aaattggcatcaggttgtttgggcc

SEQ ID NO: 854130 - DNA, 25 bp, Mus musculus
aaattgtgaaagaggtcctgtaata

SEQ ID NO: 854131 - DNA, 25 bp, Mus musculus
aaattgtgaaagtggtcctgtaata

SEQ ID NO: 854132 - DNA, 25 bp, Mus musculus
aaatttagacagattgtttccgcag

SEQ ID NO: 854133 - DNA, 25 bp, Mus musculus
aaatttagacagtttgtttccgcag

SEQ ID NO: 854134 - DNA, 25 bp, Mus musculus
aaatttccagtgaaccaattgactt

SEQ ID NO: 854135 - DNA, 25 bp, Mus musculus
aaatttccagtgaagcaattgactt

SEQ ID NO: 854136 - DNA, 25 bp, Mus musculus
aaatttcgccagatagtgtctgctg

SEQ ID NO: 854137 - DNA, 25 bp, Mus musculus
aaatttcgccagttagtgtctgctg

SEQ ID NO: 854138 - DNA, 25 bp, Mus musculus
aaatttgaagagatcaccagtgtaa

SEQ ID NO: 854139 - DNA, 25 bp, Mus musculus
aaatttgaagagttcaccagtgtaa

SEQ ID NO: 854140 - DNA, 25 bp, Mus musculus
aaatttgaagcagacatcaagcagg

SEQ ID NO: 854141 - DNA, 25 bp, Mus musculus
aaatttgaaggagacatcaagcagg

SEQ ID NO: 854142 - DNA, 25 bp, Mus musculus
aaatttgaggagcaagtgcagagtg

SEQ ID NO: 854143 - DNA, 25 bp, Mus musculus
aaatttgaggagcatgtgcagagtg

SEQ ID NO: 854144 - DNA, 25 bp, Mus musculus
aaatttgatgatcccaaatttgaag

SEQ ID NO: 854145 - DNA, 25 bp, Mus musculus
aaatttgatgttcccaaatttgaag

SEQ ID NO: 854146 - DNA, 25 bp, Mus musculus
aaatttgcatgcaacgcttgttccc

SEQ ID NO: 854147 - DNA, 25 bp, Mus musculus
aaatttgcatgcaacgtacagaaga

SEQ ID NO: 854148 - DNA, 25 bp, Mus musculus
aaatttgcatgcaaggcttgttccc

SEQ ID NO: 854149 - DNA, 25 bp, Mus musculus
aaatttgcatgcaaggtacagaaga

SEQ ID NO: 854150 - DNA, 25 bp, Mus musculus
aaatttggcatcatccaaatgacaa

SEQ ID NO: 854151 - DNA, 25 bp, Mus musculus
aaatttggcatcatgcaaatgacaa

SEQ ID NO: 854152 - DNA, 25 bp, Mus musculus
aaatttgttcccagccaaattccat

SEQ ID NO: 854153 - DNA, 25 bp, Mus musculus
aaatttgttcccaggcaaattccat

SEQ ID NO: 854154 - DNA, 25 bp, Mus musculus
aacaaaaaatgacaactggctcatt

SEQ ID NO: 854155 - DNA, 25 bp, Mus musculus
aacaaaaaatgagaactggctcatt

SEQ ID NO: 854156 - DNA, 25 bp, Mus musculus
aacaaaaatgcctcaaactcagaaa

SEQ ID NO: 854157 - DNA, 25 bp, Mus musculus
aacaaaaatggctcaaactcagaaa

SEQ ID NO: 854158 - DNA, 25 bp, Mus musculus
aacaaaacaacaatgtcattgcgcc

SEQ ID NO: 854159 - DNA, 25 bp, Mus musculus
aacaaaacaagaatgtcattgcgcc

SEQ ID NO: 854160 - DNA, 25 bp, Mus musculus
aacaaaacagagctgaacttggtca

SEQ ID NO: 854161 - DNA, 25 bp, Mus musculus
aacaaaacagtgctgaacttggtca

SEQ ID NO: 854162 - DNA, 25 bp, Mus musculus
aacaaaagcaaacatttgcaacatt

SEQ ID NO: 854163 - DNA, 25 bp, Mus musculus
aacaaaagcaaagatttgcaacatt

SEQ ID NO: 854164 - DNA, 25 bp, Mus musculus
aacaaaataaccaactagcctcaat

SEQ ID NO: 854165 - DNA, 25 bp, Mus musculus
aacaaaataaccaagtagcctcaat

SEQ ID NO: 854166 - DNA, 25 bp, Mus musculus
aacaaaatttatctacttatcatgt

SEQ ID NO: 854167 - DNA, 25 bp, Mus musculus
aacaaaatttatgtacttatcatgt

SEQ ID NO: 854168 - DNA, 25 bp, Mus musculus
aacaaacctgcttggcatggacaga

SEQ ID NO: 854169 - DNA, 25 bp, Mus musculus
aacaaacctggttggcatggacaga

SEQ ID NO: 854170 - DNA, 25 bp, Mus musculus
aacaaacgaacaagactctgacacc

SEQ ID NO: 854171 - DNA, 25 bp, Mus musculus
aacaaacgaacaagcaggttcagga

SEQ ID NO: 854172 - DNA, 25 bp, Mus musculus
aacaaacgaacatgactctgacacc

SEQ ID NO: 854173 - DNA, 25 bp, Mus musculus
aacaaacgaacatgcaggttcagga

SEQ ID NO: 854174 - DNA, 25 bp, Mus musculus
aacaaactcaagatgggaagtcatt

SEQ ID NO: 854175 - DNA, 25 bp, Mus musculus
aacaaactcaagttgggaagtcatt

SEQ ID NO: 854176 - DNA, 25 bp, Mus musculus
aacaaacttaaacccagtcaggcaa

SEQ ID NO: 854177 - DNA, 25 bp, Mus musculus
aacaaacttaaactcaggcaagaga

SEQ ID NO: 854178 - DNA, 25 bp, Mus musculus
aacaaacttaaagccagtcaggcaa

SEQ ID NO: 854179 - DNA, 25 bp, Mus musculus
aacaaacttaaagtcaggcaagaga

SEQ ID NO: 854180 - DNA, 25 bp, Mus musculus
aacaaactttgccgaatcacaggac

SEQ ID NO: 854181 - DNA, 25 bp, Mus musculus
aacaaactttgccgtatcacaggac

SEQ ID NO: 854182 - DNA, 25 bp, Mus musculus
aacaaagaccagatcgccaaggatg

SEQ ID NO: 854183 - DNA, 25 bp, Mus musculus
aacaaagaccagttcgccaaggatg

SEQ ID NO: 854184 - DNA, 25 bp, Mus musculus
aacaaaggcgacctgcaccgctggg

SEQ ID NO: 854185 - DNA, 25 bp, Mus musculus
aacaaaggcgtcctgcaccgctggg

SEQ ID NO: 854186 - DNA, 25 bp, Mus musculus
aacaaataccagatattgaaagatg

SEQ ID NO: 854187 - DNA, 25 bp, Mus musculus
aacaaataccagttattgaaagatg

SEQ ID NO: 854188 - DNA, 25 bp, Mus musculus
aacaaatgtgctccgtgcttctgct

SEQ ID NO: 854189 - DNA, 25 bp, Mus musculus
aacaaatgtggtccgtgcttctgct

SEQ ID NO: 854190 - DNA, 25 bp, Mus musculus
aacaacaaaaatcgctcaaactcag

SEQ ID NO: 854191 - DNA, 25 bp, Mus musculus
aacaacaaaaatggctcaaactcag

SEQ ID NO: 854192 - DNA, 25 bp, Mus musculus
aacaacaagaagctatatgtggctc

SEQ ID NO: 854193 - DNA, 25 bp, Mus musculus
aacaacaagaaggtatatgtggctc

SEQ ID NO: 854194 - DNA, 25 bp, Mus musculus
aacaacaagcagccttttgatggct

SEQ ID NO: 854195 - DNA, 25 bp, Mus musculus
aacaacaagcaggcttttgatggct

SEQ ID NO: 854196 - DNA, 25 bp, Mus musculus
aacaacaatgagagtgctgcaaaga

SEQ ID NO: 854197 - DNA, 25 bp, Mus musculus
aacaacaatgagtgtgctgcaaaga

SEQ ID NO: 854198 - DNA, 25 bp, Mus musculus
aacaacacacaccgctcttggaagg

SEQ ID NO: 854199 - DNA, 25 bp, Mus musculus
aacaacacacaccggtcttggaagg

SEQ ID NO: 854200 - DNA, 25 bp, Mus musculus
aacaacatcaaagaaaaattcaacg

SEQ ID NO: 854201 - DNA, 25 bp, Mus musculus
aacaacatcatagaaaaattcaacg

SEQ ID NO: 854202 - DNA, 25 bp, Mus musculus
aacaacatgaacagaagagagaggg

SEQ ID NO: 854203 - DNA, 25 bp, Mus musculus
aacaacatgaacagaagagcacttc

SEQ ID NO: 854204 - DNA, 25 bp, Mus musculus
aacaacatgaacagacagagagcac

SEQ ID NO: 854205 - DNA, 25 bp, Mus musculus
aacaacatgaacagtagagagaggg

SEQ ID NO: 854206 - DNA, 25 bp, Mus musculus
aacaacatgaacagtagagcacttc

SEQ ID NO: 854207 - DNA, 25 bp, Mus musculus
aacaacatgaacagtcagagagcac

SEQ ID NO: 854208 - DNA, 25 bp, Mus musculus
aacaacattgagcacagtctgcgag

SEQ ID NO: 854209 - DNA, 25 bp, Mus musculus
aacaacattgagcagagtctgcgag

SEQ ID NO: 854210 - DNA, 25 bp, Mus musculus
aacaaccagctgaacgaactgagag

SEQ ID NO: 854211 - DNA, 25 bp, Mus musculus
aacaaccagctgaaggaactgagag

SEQ ID NO: 854212 - DNA, 25 bp, Mus musculus
aacaaccgagaccacatcatcttca

SEQ ID NO: 854213 - DNA, 25 bp, Mus musculus
aacaaccgagaccagatcatcttca

SEQ ID NO: 854214 - DNA, 25 bp, Mus musculus
aacaacctagagcttcaggatctca

SEQ ID NO: 854215 - DNA, 25 bp, Mus musculus
aacaacctagtgcttcaggatctca

SEQ ID NO: 854216 - DNA, 25 bp, Mus musculus
aacaacctcgccacagccgtgacca

SEQ ID NO: 854217 - DNA, 25 bp, Mus musculus
aacaacctcggcacagccgtgacca

SEQ ID NO: 854218 - DNA, 25 bp, Mus musculus
aacaacctttaccacacagcactgc

SEQ ID NO: 854219 - DNA, 25 bp, Mus musculus
aacaacctttaccagacagcactgc

SEQ ID NO: 854220 - DNA, 25 bp, Mus musculus
aacaactatatacacgctacagaca

SEQ ID NO: 854221 - DNA, 25 bp, Mus musculus
aacaactatatacaggctacagaca

SEQ ID NO: 854222 - DNA, 25 bp, Mus musculus
aacaactcatagcaccgaccatcat

SEQ ID NO: 854223 - DNA, 25 bp, Mus musculus
aacaactcataggaccgaccatcat

SEQ ID NO: 854224 - DNA, 25 bp, Mus musculus
aacaacttgacacgcttagaatcag

SEQ ID NO: 854225 - DNA, 25 bp, Mus musculus
aacaacttgacaggcttagaatcag

SEQ ID NO: 854226 - DNA, 25 bp, Mus musculus
aacaagaaaatactcaattttctca

SEQ ID NO: 854227 - DNA, 25 bp, Mus musculus
aacaagaaaatactgaattttctca

SEQ ID NO: 854228 - DNA, 25 bp, Mus musculus
aacaagaaagaaatcgcaaaagatg

SEQ ID NO: 854229 - DNA, 25 bp, Mus musculus
aacaagaaagaaatggcaaaagatg

SEQ ID NO: 854230 - DNA, 25 bp, Mus musculus
aacaagaaagcgacgagccgcaaag

SEQ ID NO: 854231 - DNA, 25 bp, Mus musculus
aacaagaaagggacgagccgcaaag

SEQ ID NO: 854232 - DNA, 25 bp, Mus musculus
aacaagacagaaggtgaagatgatg

SEQ ID NO: 854233 - DNA, 25 bp, Mus musculus
aacaagacagcttgtcctccaaaag

SEQ ID NO: 854234 - DNA, 25 bp, Mus musculus
aacaagacaggttgtcctccaaaag

SEQ ID NO: 854235 - DNA, 25 bp, Mus musculus
aacaagacagtaggtgaagatgatg

SEQ ID NO: 854236 - DNA, 25 bp, Mus musculus
aacaagactcagaataagcctgcac

SEQ ID NO: 854237 - DNA, 25 bp, Mus musculus
aacaagactcagtataagcctgcac

SEQ ID NO: 854238 - DNA, 25 bp, Mus musculus
aacaagaggcagatgggcatatcaa

SEQ ID NO: 854239 - DNA, 25 bp, Mus musculus
aacaagaggcagctgtactaccaag

SEQ ID NO: 854240 - DNA, 25 bp, Mus musculus
aacaagaggcaggtgtactaccaag

SEQ ID NO: 854241 - DNA, 25 bp, Mus musculus
aacaagaggcagttgggcatatcaa

SEQ ID NO: 854242 - DNA, 25 bp, Mus musculus
aacaagatcgatggaatgccaagat

SEQ ID NO: 854243 - DNA, 25 bp, Mus musculus
aacaagatcgcttctctttgtagct

SEQ ID NO: 854244 - DNA, 25 bp, Mus musculus
aacaagatcggttctctttgtagct

SEQ ID NO: 854245 - DNA, 25 bp, Mus musculus
aacaagatcgttggaatgccaagat

SEQ ID NO: 854246 - DNA, 25 bp, Mus musculus
aacaagatgggacgcacctccaagt

SEQ ID NO: 854247 - DNA, 25 bp, Mus musculus
aacaagatgggaggcacctccaagt

SEQ ID NO: 854248 - DNA, 25 bp, Mus musculus
aacaagattacgcccgaagactgta

SEQ ID NO: 854249 - DNA, 25 bp, Mus musculus
aacaagattacgctacagcaaggga

SEQ ID NO: 854250 - DNA, 25 bp, Mus musculus
aacaagattacggccgaagactgta

SEQ ID NO: 854251 - DNA, 25 bp, Mus musculus
aacaagattacggtacagcaaggga

SEQ ID NO: 854252 - DNA, 25 bp, Mus musculus
aacaagatttatgacactaccgtta

SEQ ID NO: 854253 - DNA, 25 bp, Mus musculus
aacaagatttatgagactaccgtta

SEQ ID NO: 854254 - DNA, 25 bp, Mus musculus
aacaagcacaatgggtgtgttttac

SEQ ID NO: 854255 - DNA, 25 bp, Mus musculus
aacaagcacattgggtgtgttttac

SEQ ID NO: 854256 - DNA, 25 bp, Mus musculus
aacaagcactctcacgctaccggct

SEQ ID NO: 854257 - DNA, 25 bp, Mus musculus
aacaagcactctcaggctaccggct

SEQ ID NO: 854258 - DNA, 25 bp, Mus musculus
aacaagcatgcgatctcgggaacag

SEQ ID NO: 854259 - DNA, 25 bp, Mus musculus
aacaagcatgggatctcgggaacag

SEQ ID NO: 854260 - DNA, 25 bp, Mus musculus
aacaagcccatgaagtgcccccgcc

SEQ ID NO: 854261 - DNA, 25 bp, Mus musculus
aacaagcccatgtagtgcccccgcc

SEQ ID NO: 854262 - DNA, 25 bp, Mus musculus
aacaagcctgccaacaccctaccac

SEQ ID NO: 854263 - DNA, 25 bp, Mus musculus
aacaagcctgccaagaccctaccac

SEQ ID NO: 854264 - DNA, 25 bp, Mus musculus
aacaagctaaagcccatgagagcac

SEQ ID NO: 854265 - DNA, 25 bp, Mus musculus
aacaagctaaaggccatgagagcac

SEQ ID NO: 854266 - DNA, 25 bp, Mus musculus
aacaagctagaaatcgtctggggaa

SEQ ID NO: 854267 - DNA, 25 bp, Mus musculus
aacaagctagaaatggtctggggaa

SEQ ID NO: 854268 - DNA, 25 bp, Mus musculus
aacaagctagcacgctacctgcaca

SEQ ID NO: 854269 - DNA, 25 bp, Mus musculus
aacaagctagcaggctacctgcaca

SEQ ID NO: 854270 - DNA, 25 bp, Mus musculus
aacaagctgactgacgacaaggcag

SEQ ID NO: 854271 - DNA, 25 bp, Mus musculus
aacaagctgactgaggacaaggcag

SEQ ID NO: 854272 - DNA, 25 bp, Mus musculus
aacaagctggcgcaccagaagaagc

SEQ ID NO: 854273 - DNA, 25 bp, Mus musculus
aacaagctggggcaccagaagaagc

SEQ ID NO: 854274 - DNA, 25 bp, Mus musculus
aacaaggaagagcgagctagcacct

SEQ ID NO: 854275 - DNA, 25 bp, Mus musculus
aacaaggaagagcttttgctgcctc

SEQ ID NO: 854276 - DNA, 25 bp, Mus musculus
aacaaggaagagggagctagcacct

SEQ ID NO: 854277 - DNA, 25 bp, Mus musculus
aacaaggaagaggttttgctgcctc

SEQ ID NO: 854278 - DNA, 25 bp, Mus musculus
aacaaggacttacacgaagacaagg

SEQ ID NO: 854279 - DNA, 25 bp, Mus musculus
aacaaggacttacaggaagacaagg

SEQ ID NO: 854280 - DNA, 25 bp, Mus musculus
aacaaggagcagatacagaagatca

SEQ ID NO: 854281 - DNA, 25 bp, Mus musculus
aacaaggagcagttacagaagatca

SEQ ID NO: 854282 - DNA, 25 bp, Mus musculus
aacaaggctcggctgccagggccat

SEQ ID NO: 854283 - DNA, 25 bp, Mus musculus
aacaaggctcgggtgccagggccat

SEQ ID NO: 854284 - DNA, 25 bp, Mus musculus
aacaaggtatcactcagagaggcag

SEQ ID NO: 854285 - DNA, 25 bp, Mus musculus
aacaaggtatcactgagagaggcag

SEQ ID NO: 854286 - DNA, 25 bp, Mus musculus
aacaaggtgttccacgagcgcatca

SEQ ID NO: 854287 - DNA, 25 bp, Mus musculus
aacaaggtgttccacgtaggtgcat

SEQ ID NO: 854288 - DNA, 25 bp, Mus musculus
aacaaggtgttccaggagcgcatca

SEQ ID NO: 854289 - DNA, 25 bp, Mus musculus
aacaaggtgttccaggtaggtgcat

SEQ ID NO: 854290 - DNA, 25 bp, Mus musculus
aacaagtcagctctggagatgcgga

SEQ ID NO: 854291 - DNA, 25 bp, Mus musculus
aacaagtcagctgtggagatgcgga

SEQ ID NO: 854292 - DNA, 25 bp, Mus musculus
aacaagtccaacgacgaccagtcca

SEQ ID NO: 854293 - DNA, 25 bp, Mus musculus
aacaagtccaacgaggaccagtcca

SEQ ID NO: 854294 - DNA, 25 bp, Mus musculus
aacaagtgcaaacgttatggttttg

SEQ ID NO: 854295 - DNA, 25 bp, Mus musculus
aacaagtgcaaaggttatggttttg

SEQ ID NO: 854296 - DNA, 25 bp, Mus musculus
aacaagtgcaagatgatttaccttg

SEQ ID NO: 854297 - DNA, 25 bp, Mus musculus
aacaagtgcaagttgatttaccttg

SEQ ID NO: 854298 - DNA, 25 bp, Mus musculus
aacaagtgttcacagccggaaacaa

SEQ ID NO: 854299 - DNA, 25 bp, Mus musculus
aacaagtgttcacgcctccttcttt

SEQ ID NO: 854300 - DNA, 25 bp, Mus musculus
aacaagtgttcagagccggaaacaa

SEQ ID NO: 854301 - DNA, 25 bp, Mus musculus
aacaagtgttcaggcctccttcttt

SEQ ID NO: 854302 - DNA, 25 bp, Mus musculus
aacaagtttgcccactgtctctgcc

SEQ ID NO: 854303 - DNA, 25 bp, Mus musculus
aacaagtttgcccagtgtctctgcc

SEQ ID NO: 854304 - DNA, 25 bp, Mus musculus
aacaataatgaacacaactggattg

SEQ ID NO: 854305 - DNA, 25 bp, Mus musculus
aacaataatgaagacaactggattg

SEQ ID NO: 854306 - DNA, 25 bp, Mus musculus
aacaataatgcacatgctgaggaca

SEQ ID NO: 854307 - DNA, 25 bp, Mus musculus
aacaataatgcagatgctgaggaca

SEQ ID NO: 854308 - DNA, 25 bp, Mus musculus
aacaatacagacaggatggctaaag

SEQ ID NO: 854309 - DNA, 25 bp, Mus musculus
aacaatacagctggccaagaaggaa

SEQ ID NO: 854310 - DNA, 25 bp, Mus musculus
aacaatacaggtggccaagaaggaa

SEQ ID NO: 854311 - DNA, 25 bp, Mus musculus
aacaatacagtcaggatggctaaag

SEQ ID NO: 854312 - DNA, 25 bp, Mus musculus
aacaatagaaagaggccattcctcc

SEQ ID NO: 854313 - DNA, 25 bp, Mus musculus
aacaatagaaagtggccattcctcc

SEQ ID NO: 854314 - DNA, 25 bp, Mus musculus
aacaatagcacacgaatgattggca

SEQ ID NO: 854315 - DNA, 25 bp, Mus musculus
aacaatagcacaggaatgattggca

SEQ ID NO: 854316 - DNA, 25 bp, Mus musculus
aacaatcacacgagcgagcactttt

SEQ ID NO: 854317 - DNA, 25 bp, Mus musculus
aacaatcacacgtgcgagcactttt

SEQ ID NO: 854318 - DNA, 25 bp, Mus musculus
aacaatccctccagaactggtgaag

SEQ ID NO: 854319 - DNA, 25 bp, Mus musculus
aacaatccctcctgaactggtgaag

SEQ ID NO: 854320 - DNA, 25 bp, Mus musculus
aacaatgaaaaaccaaatcgctaac

SEQ ID NO: 854321 - DNA, 25 bp, Mus musculus
aacaatgaaaaagcaaatcgctaac

SEQ ID NO: 854322 - DNA, 25 bp, Mus musculus
aacaatgaaaatcttcagaagcagc

SEQ ID NO: 854323 - DNA, 25 bp, Mus musculus
aacaatgaaaatgttcagaagcagc

SEQ ID NO: 854324 - DNA, 25 bp, Mus musculus
aacaatgaggccctggagctgctaa

SEQ ID NO: 854325 - DNA, 25 bp, Mus musculus
aacaatgagggcctggagctgctaa

SEQ ID NO: 854326 - DNA, 25 bp, Mus musculus
aacaatgccttccacgatgtggagt

SEQ ID NO: 854327 - DNA, 25 bp, Mus musculus
aacaatgccttccaggatgtggagt

SEQ ID NO: 854328 - DNA, 25 bp, Mus musculus
aacaatggaaaaatacctgaatcaa

SEQ ID NO: 854329 - DNA, 25 bp, Mus musculus
aacaatggaaaattacctgaatcaa

SEQ ID NO: 854330 - DNA, 25 bp, Mus musculus
aacaatgtacagatgtggagagagc

SEQ ID NO: 854331 - DNA, 25 bp, Mus musculus
aacaatgtacagttgtggagagagc

SEQ ID NO: 854332 - DNA, 25 bp, Mus musculus
aacaatgtagatggtgtgcagaagg

SEQ ID NO: 854333 - DNA, 25 bp, Mus musculus
aacaatgtagttggtgtgcagaagg

SEQ ID NO: 854334 - DNA, 25 bp, Mus musculus
aacaatgtggtgcacgtgatcgaat

SEQ ID NO: 854335 - DNA, 25 bp, Mus musculus
aacaatgtggtgcaggtgatcgaat

SEQ ID NO: 854336 - DNA, 25 bp, Mus musculus
aacaatgtttgcctcggaaatgctc

SEQ ID NO: 854337 - DNA, 25 bp, Mus musculus
aacaatgtttgcctgggaaatgctc

SEQ ID NO: 854338 - DNA, 25 bp, Mus musculus
aacaattccactatactctggataa

SEQ ID NO: 854339 - DNA, 25 bp, Mus musculus
aacaattccagtatactctggataa

SEQ ID NO: 854340 - DNA, 25 bp, Mus musculus
aacaattgatggctgctgttgtgat

SEQ ID NO: 854341 - DNA, 25 bp, Mus musculus
aacaattgatgggtgctgttgtgat

SEQ ID NO: 854342 - DNA, 25 bp, Mus musculus
aacaatttcatacatgctatgctga

SEQ ID NO: 854343 - DNA, 25 bp, Mus musculus
aacaatttcatagatgctatgctga

SEQ ID NO: 854344 - DNA, 25 bp, Mus musculus
aacaatttccagctcatgagcatgg

SEQ ID NO: 854345 - DNA, 25 bp, Mus musculus
aacaatttccaggtcatgagcatgg

SEQ ID NO: 854346 - DNA, 25 bp, Mus musculus
aacacaaacacgagagtccctgacc

SEQ ID NO: 854347 - DNA, 25 bp, Mus musculus
aacacaaacacgtgagtccctgacc

SEQ ID NO: 854348 - DNA, 25 bp, Mus musculus
aacacaaaggaaagaaagcacgctt

SEQ ID NO: 854349 - DNA, 25 bp, Mus musculus
aacacaaaggtaagaaagcacgctt

SEQ ID NO: 854350 - DNA, 25 bp, Mus musculus
aacacaagtaagaagcttcttacta

SEQ ID NO: 854351 - DNA, 25 bp, Mus musculus
aacacaagtaagtagcttcttacta

SEQ ID NO: 854352 - DNA, 25 bp, Mus musculus
aacacaagttctcaaatgccctgaa

SEQ ID NO: 854353 - DNA, 25 bp, Mus musculus
aacacaagttctgaaatgccctgaa

SEQ ID NO: 854354 - DNA, 25 bp, Mus musculus
aacacaatcaagccacttcggagga

SEQ ID NO: 854355 - DNA, 25 bp, Mus musculus
aacacaatcaagcccccactgtgtt

SEQ ID NO: 854356 - DNA, 25 bp, Mus musculus
aacacaatcaagctccacaggatga

SEQ ID NO: 854357 - DNA, 25 bp, Mus musculus
aacacaatcaaggcacttcggagga

SEQ ID NO: 854358 - DNA, 25 bp, Mus musculus
aacacaatcaaggccccactgtgtt

SEQ ID NO: 854359 - DNA, 25 bp, Mus musculus
aacacaatcaaggtccacaggatga

SEQ ID NO: 854360 - DNA, 25 bp, Mus musculus
aacacacaccggacttggaaggaga

SEQ ID NO: 854361 - DNA, 25 bp, Mus musculus
aacacacaccggtcttggaaggaga

SEQ ID NO: 854362 - DNA, 25 bp, Mus musculus
aacacacaggtaagcgcagatgtca

SEQ ID NO: 854363 - DNA, 25 bp, Mus musculus
aacacacaggtaagggcagatgtca

SEQ ID NO: 854364 - DNA, 25 bp, Mus musculus
aacacactggaacgatttgccagtc

SEQ ID NO: 854365 - DNA, 25 bp, Mus musculus
aacacactggaactatttttgaaca

SEQ ID NO: 854366 - DNA, 25 bp, Mus musculus
aacacactggaaggatttgccagtc

SEQ ID NO: 854367 - DNA, 25 bp, Mus musculus
aacacactggaagtatttttgaaca

SEQ ID NO: 854368 - DNA, 25 bp, Mus musculus
aacacagaaaagaacgctggtgagg

SEQ ID NO: 854369 - DNA, 25 bp, Mus musculus
aacacagaaaagaaggctggtgagg

SEQ ID NO: 854370 - DNA, 25 bp, Mus musculus
aacacagaacagcccgcaagataat

SEQ ID NO: 854371 - DNA, 25 bp, Mus musculus
aacacagaacaggccgcaagataat

SEQ ID NO: 854372 - DNA, 25 bp, Mus musculus
aacacagagcaccgcgcaagagtcc

SEQ ID NO: 854373 - DNA, 25 bp, Mus musculus
aacacagagcaccgcggactcctga

SEQ ID NO: 854374 - DNA, 25 bp, Mus musculus
aacacagagcaccgggcaagagtcc

SEQ ID NO: 854375 - DNA, 25 bp, Mus musculus
aacacagagcaccggggactcctga

SEQ ID NO: 854376 - DNA, 25 bp, Mus musculus
aacacagatgcaggaagagcagaag

SEQ ID NO: 854377 - DNA, 25 bp, Mus musculus
aacacagatggaggaagagcagaag

SEQ ID NO: 854378 - DNA, 25 bp, Mus musculus
aacacagcaacacctgataaagtac

SEQ ID NO: 854379 - DNA, 25 bp, Mus musculus
aacacagcaacagctgataaagtac

SEQ ID NO: 854380 - DNA, 25 bp, Mus musculus
aacacagccgagttgaccactggct

SEQ ID NO: 854381 - DNA, 25 bp, Mus musculus
aacacagccgtgttgaccactggct

SEQ ID NO: 854382 - DNA, 25 bp, Mus musculus
aacacagctaagctcttcgactcca

SEQ ID NO: 854383 - DNA, 25 bp, Mus musculus
aacacagctaaggtcttcgactcca

SEQ ID NO: 854384 - DNA, 25 bp, Mus musculus
aacacagtcagatgcaatccagcaa

SEQ ID NO: 854385 - DNA, 25 bp, Mus musculus
aacacagtcagatggaatccagcaa

SEQ ID NO: 854386 - DNA, 25 bp, Mus musculus
aacacagtccaacgtcacacggtta

SEQ ID NO: 854387 - DNA, 25 bp, Mus musculus
aacacagtccaaggtcacacggtta

SEQ ID NO: 854388 - DNA, 25 bp, Mus musculus
aacacagtctcgcagtggggtacct

SEQ ID NO: 854389 - DNA, 25 bp, Mus musculus
aacacagtctcggagtggggtacct

SEQ ID NO: 854390 - DNA, 25 bp, Mus musculus
aacacagtgccacgcaggtcggata

SEQ ID NO: 854391 - DNA, 25 bp, Mus musculus
aacacagtgccacggagcccagagg

SEQ ID NO: 854392 - DNA, 25 bp, Mus musculus
aacacagtgccaggcaggtcggata

SEQ ID NO: 854393 - DNA, 25 bp, Mus musculus
aacacagtgccagggagcccagagg

SEQ ID NO: 854394 - DNA, 25 bp, Mus musculus
aacacagttatgaatgcaattggca

SEQ ID NO: 854395 - DNA, 25 bp, Mus musculus
aacacagttatgtatgcaattggca

SEQ ID NO: 854396 - DNA, 25 bp, Mus musculus
aacacataccaacacgtccaacaga

SEQ ID NO: 854397 - DNA, 25 bp, Mus musculus
aacacataccaacaggtccaacaga

SEQ ID NO: 854398 - DNA, 25 bp, Mus musculus
aacacatagcagataaacttctgca

SEQ ID NO: 854399 - DNA, 25 bp, Mus musculus
aacacatagcagttaaacttctgca

SEQ ID NO: 854400 - DNA, 25 bp, Mus musculus
aacacatcacttctcttccccaggg

SEQ ID NO: 854401 - DNA, 25 bp, Mus musculus
aacacatcacttgtcttccccaggg

SEQ ID NO: 854402 - DNA, 25 bp, Mus musculus
aacacatcagcgagagaccagctgc

SEQ ID NO: 854403 - DNA, 25 bp, Mus musculus
aacacatcagggagagaccagctgc

SEQ ID NO: 854404 - DNA, 25 bp, Mus musculus
aacaccatcaagatctgggataaaa

SEQ ID NO: 854405 - DNA, 25 bp, Mus musculus
aacaccatcaagttctgggataaaa

SEQ ID NO: 854406 - DNA, 25 bp, Mus musculus
aacaccatctatttagaggactatt

SEQ ID NO: 854407 - DNA, 25 bp, Mus musculus
aacaccatctattttgaggactatt

SEQ ID NO: 854408 - DNA, 25 bp, Mus musculus
aacaccatcttcaacgcctgggcta

SEQ ID NO: 854409 - DNA, 25 bp, Mus musculus
aacaccatcttcaaggcctgggcta

SEQ ID NO: 854410 - DNA, 25 bp, Mus musculus
aacaccatctttccacccaggattc

SEQ ID NO: 854411 - DNA, 25 bp, Mus musculus
aacaccatctttccatgaaagcccc

SEQ ID NO: 854412 - DNA, 25 bp, Mus musculus
aacaccatctttcgattcaattttt

SEQ ID NO: 854413 - DNA, 25 bp, Mus musculus
aacaccatctttgcacccaggattc

SEQ ID NO: 854414 - DNA, 25 bp, Mus musculus
aacaccatctttgcatgaaagcccc

SEQ ID NO: 854415 - DNA, 25 bp, Mus musculus
aacaccatctttggattcaattttt

SEQ ID NO: 854416 - DNA, 25 bp, Mus musculus
aacaccattgaaatcccagcctgca

SEQ ID NO: 854417 - DNA, 25 bp, Mus musculus
aacaccattgaacgtcctcaacttt

SEQ ID NO: 854418 - DNA, 25 bp, Mus musculus
aacaccattgaaggtcctcaacttt

SEQ ID NO: 854419 - DNA, 25 bp, Mus musculus
aacaccattgaattcccagcctgca

SEQ ID NO: 854420 - DNA, 25 bp, Mus musculus
aacaccatttttaacgcttgggctg

SEQ ID NO: 854421 - DNA, 25 bp, Mus musculus
aacaccatttttaaggcttgggctg

SEQ ID NO: 854422 - DNA, 25 bp, Mus musculus
aacacccaagccttgatatttgtgg

SEQ ID NO: 854423 - DNA, 25 bp, Mus musculus
aacacccaagccttgatcttcgtag

SEQ ID NO: 854424 - DNA, 25 bp, Mus musculus
aacacccaaggcttgatatttgtgg

SEQ ID NO: 854425 - DNA, 25 bp, Mus musculus
aacacccaaggcttgatcttcgtag

SEQ ID NO: 854426 - DNA, 25 bp, Mus musculus
aacacccaggctacatatggaagtg

SEQ ID NO: 854427 - DNA, 25 bp, Mus musculus
aacacccagggtacatatggaagtg

SEQ ID NO: 854428 - DNA, 25 bp, Mus musculus
aacaccccagctgatcatggaactc

SEQ ID NO: 854429 - DNA, 25 bp, Mus musculus
aacaccccaggtgatcatggaactc

SEQ ID NO: 854430 - DNA, 25 bp, Mus musculus
aacacccctggccacgtgcgcaccc

SEQ ID NO: 854431 - DNA, 25 bp, Mus musculus
aacacccctggccaggtgcgcaccc

SEQ ID NO: 854432 - DNA, 25 bp, Mus musculus
aacaccccttcactgcctgtgctga

SEQ ID NO: 854433 - DNA, 25 bp, Mus musculus
aacaccccttcagtgcctgtgctga

SEQ ID NO: 854434 - DNA, 25 bp, Mus musculus
aacaccctagagaggatttccaggg

SEQ ID NO: 854435 - DNA, 25 bp, Mus musculus
aacaccctagagtggatttccaggg

SEQ ID NO: 854436 - DNA, 25 bp, Mus musculus
aacaccctagatgacgcagctgcgg

SEQ ID NO: 854437 - DNA, 25 bp, Mus musculus
aacaccctagatgaggcagctgcgg

SEQ ID NO: 854438 - DNA, 25 bp, Mus musculus
aacacctatcagccaacaattggca

SEQ ID NO: 854439 - DNA, 25 bp, Mus musculus
aacacctatcaggcaacaattggca

SEQ ID NO: 854440 - DNA, 25 bp, Mus musculus
aacacctatttactggaactctgta

SEQ ID NO: 854441 - DNA, 25 bp, Mus musculus
aacacctatttagtggaactctgta

SEQ ID NO: 854442 - DNA, 25 bp, Mus musculus
aacacctgcaaacacaatgggccct

SEQ ID NO: 854443 - DNA, 25 bp, Mus musculus
aacacctgcaaagacaatgggccct

SEQ ID NO: 854444 - DNA, 25 bp, Mus musculus
aacacctgcatgaacgtggtctaca

SEQ ID NO: 854445 - DNA, 25 bp, Mus musculus
aacacctgcatgaaggtggtctaca

SEQ ID NO: 854446 - DNA, 25 bp, Mus musculus
aacacctggccaaacggtcattatc

SEQ ID NO: 854447 - DNA, 25 bp, Mus musculus
aacacctggccaaacgtcagcctcc

SEQ ID NO: 854448 - DNA, 25 bp, Mus musculus
aacacctggccaaacgtcggacatc

SEQ ID NO: 854449 - DNA, 25 bp, Mus musculus
aacacctggccaaagggtcattatc

SEQ ID NO: 854450 - DNA, 25 bp, Mus musculus
aacacctggccaaaggtcagcctcc

SEQ ID NO: 854451 - DNA, 25 bp, Mus musculus
aacacctggccaaaggtcggacatc

SEQ ID NO: 854452 - DNA, 25 bp, Mus musculus
aacacctgttcacctgtgcctcctg

SEQ ID NO: 854453 - DNA, 25 bp, Mus musculus
aacacctgttcagctgtgcctcctg

SEQ ID NO: 854454 - DNA, 25 bp, Mus musculus
aacacgcgcaagccctgaggtgcgc

SEQ ID NO: 854455 - DNA, 25 bp, Mus musculus
aacacgcgcaaggcctgaggtgcgc

SEQ ID NO: 854456 - DNA, 25 bp, Mus musculus
aacactatcacagacacgtgcgacc

SEQ ID NO: 854457 - DNA, 25 bp, Mus musculus
aacactatcacagacgatctagaag

SEQ ID NO: 854458 - DNA, 25 bp, Mus musculus
aacactatcacagagacgtgcgacc

SEQ ID NO: 854459 - DNA, 25 bp, Mus musculus
aacactatcacagaggatctagaag

SEQ ID NO: 854460 - DNA, 25 bp, Mus musculus
aacactcaagaacaagaatgtccct

SEQ ID NO: 854461 - DNA, 25 bp, Mus musculus
aacactcaagaacaatgtcccttct

SEQ ID NO: 854462 - DNA, 25 bp, Mus musculus
aacactcaagaagaagaatgtccct

SEQ ID NO: 854463 - DNA, 25 bp, Mus musculus
aacactcaagaagaatgtcccttct

SEQ ID NO: 854464 - DNA, 25 bp, Mus musculus
aacactcaagctctgattttcgtgg

SEQ ID NO: 854465 - DNA, 25 bp, Mus musculus
aacactcaaggtctgattttcgtgg

SEQ ID NO: 854466 - DNA, 25 bp, Mus musculus
aacactcaagtgaacgtaattgcag

SEQ ID NO: 854467 - DNA, 25 bp, Mus musculus
aacactcaagtgaaggtaattgcag

SEQ ID NO: 854468 - DNA, 25 bp, Mus musculus
aacactctggccaaccgctttcctg

SEQ ID NO: 854469 - DNA, 25 bp, Mus musculus
aacactctggcctaccgctttcctg

SEQ ID NO: 854470 - DNA, 25 bp, Mus musculus
aacactgagcaacagtccaacttta

SEQ ID NO: 854471 - DNA, 25 bp, Mus musculus
aacactgagcaagagtccaacttta

SEQ ID NO: 854472 - DNA, 25 bp, Mus musculus
aacactgatgcaaacttccaggtgt

SEQ ID NO: 854473 - DNA, 25 bp, Mus musculus
aacactgatgcaaagttccaggtgt

SEQ ID NO: 854474 - DNA, 25 bp, Mus musculus
aacactgcagcttaaaatgccataa

SEQ ID NO: 854475 - DNA, 25 bp, Mus musculus
aacactgcaggttaaaatgccataa

SEQ ID NO: 854476 - DNA, 25 bp, Mus musculus
aacactgccaagctggagcctggtt

SEQ ID NO: 854477 - DNA, 25 bp, Mus musculus
aacactgccaaggtggagcctggtt

SEQ ID NO: 854478 - DNA, 25 bp, Mus musculus
aacactggccgacggatggaattcg

SEQ ID NO: 854479 - DNA, 25 bp, Mus musculus
aacactggccgagggatggaattcg

SEQ ID NO: 854480 - DNA, 25 bp, Mus musculus
aacactgtagagcttcgagtcaaga

SEQ ID NO: 854481 - DNA, 25 bp, Mus musculus
aacactgtagaggttcgagtcaaga

SEQ ID NO: 854482 - DNA, 25 bp, Mus musculus
aacactgtctagcaccatcaaaaag

SEQ ID NO: 854483 - DNA, 25 bp, Mus musculus
aacactgtctaggaccatcaaaaag

SEQ ID NO: 854484 - DNA, 25 bp, Mus musculus
aacactgttgctcaggagcttctgc

SEQ ID NO: 854485 - DNA, 25 bp, Mus musculus
aacactgttggtcaggagcttctgc

SEQ ID NO: 854486 - DNA, 25 bp, Mus musculus
aacactttgcaaaggcaaaatcatg

SEQ ID NO: 854487 - DNA, 25 bp, Mus musculus
aacactttgcaatggcaaaatcatg

SEQ ID NO: 854488 - DNA, 25 bp, Mus musculus
aacagaaaagcagtgtgtgagggag

SEQ ID NO: 854489 - DNA, 25 bp, Mus musculus
aacagaaaaggagtgtgtgagggag

SEQ ID NO: 854490 - DNA, 25 bp, Mus musculus
aacagaaaatgacgagttacttaag

SEQ ID NO: 854491 - DNA, 25 bp, Mus musculus
aacagaaaatgaggagttacttaag

SEQ ID NO: 854492 - DNA, 25 bp, Mus musculus
aacagaaacacacacgcagatgtca

SEQ ID NO: 854493 - DNA, 25 bp, Mus musculus
aacagaaacacacaggcagatgtca

SEQ ID NO: 854494 - DNA, 25 bp, Mus musculus
aacagaaagtagaacgctcagaacc

SEQ ID NO: 854495 - DNA, 25 bp, Mus musculus
aacagaaagtagaaggctcagaacc

SEQ ID NO: 854496 - DNA, 25 bp, Mus musculus
aacagaacagagctcttggctccag

SEQ ID NO: 854497 - DNA, 25 bp, Mus musculus
aacagaacagcaaacaatggtcaga

SEQ ID NO: 854498 - DNA, 25 bp, Mus musculus
aacagaacagcatttgtgcaggaat

SEQ ID NO: 854499 - DNA, 25 bp, Mus musculus
aacagaacagccttagaaacagcag

SEQ ID NO: 854500 - DNA, 25 bp, Mus musculus
aacagaacaggaaacaatggtcaga

SEQ ID NO: 854501 - DNA, 25 bp, Mus musculus
aacagaacaggatttgtgcaggaat

SEQ ID NO: 854502 - DNA, 25 bp, Mus musculus
aacagaacaggcttagaaacagcag

SEQ ID NO: 854503 - DNA, 25 bp, Mus musculus
aacagaacagtgctcttggctccag

SEQ ID NO: 854504 - DNA, 25 bp, Mus musculus
aacagaagctcacatcatgttcatg

SEQ ID NO: 854505 - DNA, 25 bp, Mus musculus
aacagaagctccatgtctgctggta

SEQ ID NO: 854506 - DNA, 25 bp, Mus musculus
aacagaagctgacatcatgttcatg

SEQ ID NO: 854507 - DNA, 25 bp, Mus musculus
aacagaagctgcatgtctgctggta

SEQ ID NO: 854508 - DNA, 25 bp, Mus musculus
aacagaagtcagaaagaaaaatgac

SEQ ID NO: 854509 - DNA, 25 bp, Mus musculus
aacagaagtcagaaagcacaatgtc

SEQ ID NO: 854510 - DNA, 25 bp, Mus musculus
aacagaagtcagtaagaaaaatgac

SEQ ID NO: 854511 - DNA, 25 bp, Mus musculus
aacagaagtcagtaagcacaatgtc

SEQ ID NO: 854512 - DNA, 25 bp, Mus musculus
aacagaatatcacatacacaaaatt

SEQ ID NO: 854513 - DNA, 25 bp, Mus musculus
aacagaatatcagatacacaaaatt

SEQ ID NO: 854514 - DNA, 25 bp, Mus musculus
aacagacaacctcacagatcgttac

SEQ ID NO: 854515 - DNA, 25 bp, Mus musculus
aacagacaacctgacagatcgttac

SEQ ID NO: 854516 - DNA, 25 bp, Mus musculus
aacagacaagcatgacttcgcaaat

SEQ ID NO: 854517 - DNA, 25 bp, Mus musculus
aacagacaagcctttgaggacctct

SEQ ID NO: 854518 - DNA, 25 bp, Mus musculus
aacagacaagcgtgtgtctgcagca

SEQ ID NO: 854519 - DNA, 25 bp, Mus musculus
aacagacaaggatgacttcgcaaat

SEQ ID NO: 854520 - DNA, 25 bp, Mus musculus
aacagacaaggctttgaggacctct

SEQ ID NO: 854521 - DNA, 25 bp, Mus musculus
aacagacaagggtgtgtctgcagca

SEQ ID NO: 854522 - DNA, 25 bp, Mus musculus
aacagacatatcaacgccagcacca

SEQ ID NO: 854523 - DNA, 25 bp, Mus musculus
aacagacatatcaaggccagcacca

SEQ ID NO: 854524 - DNA, 25 bp, Mus musculus
aacagacccgagagggtgatcgtcg

SEQ ID NO: 854525 - DNA, 25 bp, Mus musculus
aacagacccgagtgggtgatcgtcg

SEQ ID NO: 854526 - DNA, 25 bp, Mus musculus
aacagacgccagctagccttctcta

SEQ ID NO: 854527 - DNA, 25 bp, Mus musculus
aacagacgccagcttgccttctcta

SEQ ID NO: 854528 - DNA, 25 bp, Mus musculus
aacagacgtcgacgtgttaatggag

SEQ ID NO: 854529 - DNA, 25 bp, Mus musculus
aacagacgtcgaggtgttaatggag

SEQ ID NO: 854530 - DNA, 25 bp, Mus musculus
aacagactgtgtcgtaatgagagat

SEQ ID NO: 854531 - DNA, 25 bp, Mus musculus
aacagactgtgtggtaatgagagat

SEQ ID NO: 854532 - DNA, 25 bp, Mus musculus
aacagagacaaacgggaccgtgctg

SEQ ID NO: 854533 - DNA, 25 bp, Mus musculus
aacagagacaaaggggaccgtgctg

SEQ ID NO: 854534 - DNA, 25 bp, Mus musculus
aacagagagaggcgaccatggcagc

SEQ ID NO: 854535 - DNA, 25 bp, Mus musculus
aacagagagaggggaccatggcagc

SEQ ID NO: 854536 - DNA, 25 bp, Mus musculus
aacagagcaaactctggcaaacatt

SEQ ID NO: 854537 - DNA, 25 bp, Mus musculus
aacagagcaactgacaaatgacctc

SEQ ID NO: 854538 - DNA, 25 bp, Mus musculus
aacagagcaagtgacaaatgacctc

SEQ ID NO: 854539 - DNA, 25 bp, Mus musculus
aacagagcaatctctggcaaacatt

SEQ ID NO: 854540 - DNA, 25 bp, Mus musculus
aacagagcagctacgaagaaatggg

SEQ ID NO: 854541 - DNA, 25 bp, Mus musculus
aacagagcaggtacgaagaaatggg

SEQ ID NO: 854542 - DNA, 25 bp, Mus musculus
aacagaggggacgaccctgtgcgta

SEQ ID NO: 854543 - DNA, 25 bp, Mus musculus
aacagaggggtcgaccctgtgcgta

SEQ ID NO: 854544 - DNA, 25 bp, Mus musculus
aacagatgaacatcattcaccagga

SEQ ID NO: 854545 - DNA, 25 bp, Mus musculus
aacagatgaacattatccaccagga

SEQ ID NO: 854546 - DNA, 25 bp, Mus musculus
aacagatgaagatcattcaccagga

SEQ ID NO: 854547 - DNA, 25 bp, Mus musculus
aacagatgaagattatccaccagga

SEQ ID NO: 854548 - DNA, 25 bp, Mus musculus
aacagatgcgaacatgtggatgagt

SEQ ID NO: 854549 - DNA, 25 bp, Mus musculus
aacagatgcgaagatgtggatgagt

SEQ ID NO: 854550 - DNA, 25 bp, Mus musculus
aacagatggaatctctctctctcct

SEQ ID NO: 854551 - DNA, 25 bp, Mus musculus
aacagatggaatctgtctctctcct

SEQ ID NO: 854552 - DNA, 25 bp, Mus musculus
aacagatggcaaatcagggtgttaa

SEQ ID NO: 854553 - DNA, 25 bp, Mus musculus
aacagatggcaaatgagggtgttaa

SEQ ID NO: 854554 - DNA, 25 bp, Mus musculus
aacagattgcagagttcaaggaagc

SEQ ID NO: 854555 - DNA, 25 bp, Mus musculus
aacagattgcagtgttcaaggaagc

SEQ ID NO: 854556 - DNA, 25 bp, Mus musculus
aacagcaaacagacaagctcatctg

SEQ ID NO: 854557 - DNA, 25 bp, Mus musculus
aacagcaaacagtcaagctcatctg

SEQ ID NO: 854558 - DNA, 25 bp, Mus musculus
aacagcaaagcaatttgcagattcc

SEQ ID NO: 854559 - DNA, 25 bp, Mus musculus
aacagcaaagctcaatatccaacac

SEQ ID NO: 854560 - DNA, 25 bp, Mus musculus
aacagcaaaggaatttgcagattcc

SEQ ID NO: 854561 - DNA, 25 bp, Mus musculus
aacagcaaaggtcaatatccaacac

SEQ ID NO: 854562 - DNA, 25 bp, Mus musculus
aacagcaagccacgcactgaaacac

SEQ ID NO: 854563 - DNA, 25 bp, Mus musculus
aacagcaagccaggcactgaaacac

SEQ ID NO: 854564 - DNA, 25 bp, Mus musculus
aacagcaatatacacgtcctttctg

SEQ ID NO: 854565 - DNA, 25 bp, Mus musculus
aacagcaatatacaggtcctttctg

SEQ ID NO: 854566 - DNA, 25 bp, Mus musculus
aacagcaatcatcactgtgggtaag

SEQ ID NO: 854567 - DNA, 25 bp, Mus musculus
aacagcaatcatgactgtgggtaag

SEQ ID NO: 854568 - DNA, 25 bp, Mus musculus
aacagcacagcatgtcaaaaaaaga

SEQ ID NO: 854569 - DNA, 25 bp, Mus musculus
aacagcacaggatgtcaaaaaaaga

SEQ ID NO: 854570 - DNA, 25 bp, Mus musculus
aacagcaccacacgaaaagttgagg

SEQ ID NO: 854571 - DNA, 25 bp, Mus musculus
aacagcaccacaggaaaagttgagg

SEQ ID NO: 854572 - DNA, 25 bp, Mus musculus
aacagcagagaactggggaacccga

SEQ ID NO: 854573 - DNA, 25 bp, Mus musculus
aacagcagagtactggggaacccga

SEQ ID NO: 854574 - DNA, 25 bp, Mus musculus
aacagcaggaagacctttgggaagt

SEQ ID NO: 854575 - DNA, 25 bp, Mus musculus
aacagcaggaagtcctttgggaagt

SEQ ID NO: 854576 - DNA, 25 bp, Mus musculus
aacagcataaaccatatgtgtcaca

SEQ ID NO: 854577 - DNA, 25 bp, Mus musculus
aacagcataaacgatatgtgtcaca

SEQ ID NO: 854578 - DNA, 25 bp, Mus musculus
aacagcatggcagacgctcctcttc

SEQ ID NO: 854579 - DNA, 25 bp, Mus musculus
aacagcatggcagaggctcctcttc

SEQ ID NO: 854580 - DNA, 25 bp, Mus musculus
aacagcattgctgacgttgaaaatg

SEQ ID NO: 854581 - DNA, 25 bp, Mus musculus
aacagcattgctgaggttgaaaatg

SEQ ID NO: 854582 - DNA, 25 bp, Mus musculus
aacagccaagcctctgagagccgcc

SEQ ID NO: 854583 - DNA, 25 bp, Mus musculus
aacagccaaggctctgagagccgcc

SEQ ID NO: 854584 - DNA, 25 bp, Mus musculus
aacagccagaggcacagtgaagaaa

SEQ ID NO: 854585 - DNA, 25 bp, Mus musculus
aacagccagaggcagagtgaagaaa

SEQ ID NO: 854586 - DNA, 25 bp, Mus musculus
aacagcccagctggtgtggtaactg

SEQ ID NO: 854587 - DNA, 25 bp, Mus musculus
aacagcccaggtggtgtggtaactg

SEQ ID NO: 854588 - DNA, 25 bp, Mus musculus
aacagccccagcgacacagaggctt

SEQ ID NO: 854589 - DNA, 25 bp, Mus musculus
aacagccccagcgacagctagctga

SEQ ID NO: 854590 - DNA, 25 bp, Mus musculus
aacagccccagcgactccttcgggg

SEQ ID NO: 854591 - DNA, 25 bp, Mus musculus
aacagccccagcgagacagaggctt

SEQ ID NO: 854592 - DNA, 25 bp, Mus musculus
aacagccccagcgagagctagctga

SEQ ID NO: 854593 - DNA, 25 bp, Mus musculus
aacagccccagcgagtccttcgggg

SEQ ID NO: 854594 - DNA, 25 bp, Mus musculus
aacagcctcaagatctggttcaaca

SEQ ID NO: 854595 - DNA, 25 bp, Mus musculus
aacagcctcaagttctggttcaaca

SEQ ID NO: 854596 - DNA, 25 bp, Mus musculus
aacagccttacctacatcaaaatag

SEQ ID NO: 854597 - DNA, 25 bp, Mus musculus
aacagccttagctacatcaaaatag

SEQ ID NO: 854598 - DNA, 25 bp, Mus musculus
aacagcgcagagttagactatccct

SEQ ID NO: 854599 - DNA, 25 bp, Mus musculus
aacagcgcagagtttgactatccct

SEQ ID NO: 854600 - DNA, 25 bp, Mus musculus
aacagctccagctgcgtagccccag

SEQ ID NO: 854601 - DNA, 25 bp, Mus musculus
aacagctccagctgggtagccccag

SEQ ID NO: 854602 - DNA, 25 bp, Mus musculus
aacagctctggaaactgattcaagg

SEQ ID NO: 854603 - DNA, 25 bp, Mus musculus
aacagctctggaaagtgattcaagg

SEQ ID NO: 854604 - DNA, 25 bp, Mus musculus
aacagctgagtttacaatccaagag

SEQ ID NO: 854605 - DNA, 25 bp, Mus musculus
aacagctgagtttacaattttctaa

SEQ ID NO: 854606 - DNA, 25 bp, Mus musculus
aacagctgagtttagaatccaagag

SEQ ID NO: 854607 - DNA, 25 bp, Mus musculus
aacagctgagtttagaattttctaa

SEQ ID NO: 854608 - DNA, 25 bp, Mus musculus
aacagctgcaggaatagtgattgac

SEQ ID NO: 854609 - DNA, 25 bp, Mus musculus
aacagctgcaggtatagtgattgac

SEQ ID NO: 854610 - DNA, 25 bp, Mus musculus
aacagcttcaactacggaaaagcct

SEQ ID NO: 854611 - DNA, 25 bp, Mus musculus
aacagcttcaactagggaaaagcct

SEQ ID NO: 854612 - DNA, 25 bp, Mus musculus
aacagcttcagagacatggtgtctt

SEQ ID NO: 854613 - DNA, 25 bp, Mus musculus
aacagcttcagagacctgccaggcc

SEQ ID NO: 854614 - DNA, 25 bp, Mus musculus
aacagcttcagagactgtttaattc

SEQ ID NO: 854615 - DNA, 25 bp, Mus musculus
aacagcttcagagagatggtgtctt

SEQ ID NO: 854616 - DNA, 25 bp, Mus musculus
aacagcttcagagagctgccaggcc

SEQ ID NO: 854617 - DNA, 25 bp, Mus musculus
aacagcttcagagagtgtttaattc

SEQ ID NO: 854618 - DNA, 25 bp, Mus musculus
aacaggaagcttcacattataccga

SEQ ID NO: 854619 - DNA, 25 bp, Mus musculus
aacaggaagcttcacgctatgtctt

SEQ ID NO: 854620 - DNA, 25 bp, Mus musculus
aacaggaagcttcagattataccga

SEQ ID NO: 854621 - DNA, 25 bp, Mus musculus
aacaggaagcttcaggctatgtctt

SEQ ID NO: 854622 - DNA, 25 bp, Mus musculus
aacaggagcaggaacgggagaagga

SEQ ID NO: 854623 - DNA, 25 bp, Mus musculus
aacaggagcaggaaggggagaagga

SEQ ID NO: 854624 - DNA, 25 bp, Mus musculus
aacaggatgtacactataaatggat

SEQ ID NO: 854625 - DNA, 25 bp, Mus musculus
aacaggatgtactctataaatggat

SEQ ID NO: 854626 - DNA, 25 bp, Mus musculus
aacaggccacagcaaagcacagaca

SEQ ID NO: 854627 - DNA, 25 bp, Mus musculus
aacaggccacaggaaagcacagaca

SEQ ID NO: 854628 - DNA, 25 bp, Mus musculus
aacaggccatcgatgcccgggtagt

SEQ ID NO: 854629 - DNA, 25 bp, Mus musculus
aacaggccatggatgcccgggtagt

SEQ ID NO: 854630 - DNA, 25 bp, Mus musculus
aacaggccctcccagggccttatgg

SEQ ID NO: 854631 - DNA, 25 bp, Mus musculus
aacaggccctccgagggccttatgg

SEQ ID NO: 854632 - DNA, 25 bp, Mus musculus
aacaggccgtcatgctagatgattt

SEQ ID NO: 854633 - DNA, 25 bp, Mus musculus
aacaggccgtgatgctagatgattt

SEQ ID NO: 854634 - DNA, 25 bp, Mus musculus
aacaggcgtcagaaagaaaaatgac

SEQ ID NO: 854635 - DNA, 25 bp, Mus musculus
aacaggcgtcagtaagaaaaatgac

SEQ ID NO: 854636 - DNA, 25 bp, Mus musculus
aacaggcttaatatcagaaaggaac

SEQ ID NO: 854637 - DNA, 25 bp, Mus musculus
aacaggcttaatatgagaaaggaac

SEQ ID NO: 854638 - DNA, 25 bp, Mus musculus
aacagggaatggcgaagaaggcatg

SEQ ID NO: 854639 - DNA, 25 bp, Mus musculus
aacagggaatggggaagaaggcatg

SEQ ID NO: 854640 - DNA, 25 bp, Mus musculus
aacagggagaagcatgtgctgctgg

SEQ ID NO: 854641 - DNA, 25 bp, Mus musculus
aacagggagaaggatgtgctgctgg

SEQ ID NO: 854642 - DNA, 25 bp, Mus musculus
aacagggtccagaacatggctcttt

SEQ ID NO: 854643 - DNA, 25 bp, Mus musculus
aacagggtccagtacatggctcttt

SEQ ID NO: 854644 - DNA, 25 bp, Mus musculus
aacaggtcaaaaagtcctgcaggtc

SEQ ID NO: 854645 - DNA, 25 bp, Mus musculus
aacaggtcaaaatgtcctgcaggtc

SEQ ID NO: 854646 - DNA, 25 bp, Mus musculus
aacaggtggagcagcgctcaaactc

SEQ ID NO: 854647 - DNA, 25 bp, Mus musculus
aacaggtggagcagggctcaaactc

SEQ ID NO: 854648 - DNA, 25 bp, Mus musculus
aacagtacagagtgagataatccga

SEQ ID NO: 854649 - DNA, 25 bp, Mus musculus
aacagtacagtgtgagataatccga

SEQ ID NO: 854650 - DNA, 25 bp, Mus musculus
aacagtacctttcaaagctttggat

SEQ ID NO: 854651 - DNA, 25 bp, Mus musculus
aacagtacctttgaaagctttggat

SEQ ID NO: 854652 - DNA, 25 bp, Mus musculus
aacagtaggctacccgtgatggtgt

SEQ ID NO: 854653 - DNA, 25 bp, Mus musculus
aacagtaggctaccggtgatggtgt

SEQ ID NO: 854654 - DNA, 25 bp, Mus musculus
aacagtctcacccctgcctgctctg

SEQ ID NO: 854655 - DNA, 25 bp, Mus musculus
aacagtctcagccctgcctgctctg

SEQ ID NO: 854656 - DNA, 25 bp, Mus musculus
aacagtctgggcaccttcatgccgg

SEQ ID NO: 854657 - DNA, 25 bp, Mus musculus
aacagtctgggcacgttcatgccgg

SEQ ID NO: 854658 - DNA, 25 bp, Mus musculus
aacagtgacattcaagttcattctg

SEQ ID NO: 854659 - DNA, 25 bp, Mus musculus
aacagtgacattcatgttcattctg

SEQ ID NO: 854660 - DNA, 25 bp, Mus musculus
aacagttcatgaaatcttttgagca

SEQ ID NO: 854661 - DNA, 25 bp, Mus musculus
aacagttcatgacgttacgtcccca

SEQ ID NO: 854662 - DNA, 25 bp, Mus musculus
aacagttcatgaggttacgtcccca

SEQ ID NO: 854663 - DNA, 25 bp, Mus musculus
aacagttcatgatatcttttgagca

SEQ ID NO: 854664 - DNA, 25 bp, Mus musculus
aacagtttgcatagagactcgcttc

SEQ ID NO: 854665 - DNA, 25 bp, Mus musculus
aacagtttgcattgagactcgcttc

SEQ ID NO: 854666 - DNA, 25 bp, Mus musculus
aacagtttggagcacgtaccatgcg

SEQ ID NO: 854667 - DNA, 25 bp, Mus musculus
aacagtttggagcctcacccgggtg

SEQ ID NO: 854668 - DNA, 25 bp, Mus musculus
aacagtttggaggacgtaccatgcg

SEQ ID NO: 854669 - DNA, 25 bp, Mus musculus
aacagtttggaggctcacccgggtg

SEQ ID NO: 854670 - DNA, 25 bp, Mus musculus
aacataaaaattcgactctatagtc

SEQ ID NO: 854671 - DNA, 25 bp, Mus musculus
aacataaaaattggactctatagtc

SEQ ID NO: 854672 - DNA, 25 bp, Mus musculus
aacataaccaagcacgctgccttag

SEQ ID NO: 854673 - DNA, 25 bp, Mus musculus
aacataaccaagcaggctgccttag

SEQ ID NO: 854674 - DNA, 25 bp, Mus musculus
aacataacgaagaggagcgccgccg

SEQ ID NO: 854675 - DNA, 25 bp, Mus musculus
aacataacgaagtggagcgccgccg

SEQ ID NO: 854676 - DNA, 25 bp, Mus musculus
aacatacccagtcccttgccatctc

SEQ ID NO: 854677 - DNA, 25 bp, Mus musculus
aacatacccagtctgtcatcaataa

SEQ ID NO: 854678 - DNA, 25 bp, Mus musculus
aacatacccagtgccttgccatctc

SEQ ID NO: 854679 - DNA, 25 bp, Mus musculus
aacatacccagtgtgtcatcaataa

SEQ ID NO: 854680 - DNA, 25 bp, Mus musculus
aacatacgaagacaaagattcatct

SEQ ID NO: 854681 - DNA, 25 bp, Mus musculus
aacatacgaagacatagattcatct

SEQ ID NO: 854682 - DNA, 25 bp, Mus musculus
aacatactacgttgatcacctcaac

SEQ ID NO: 854683 - DNA, 25 bp, Mus musculus
aacatactacgttgttcacctcaac

SEQ ID NO: 854684 - DNA, 25 bp, Mus musculus
aacatagagacgaactacaagaatc

SEQ ID NO: 854685 - DNA, 25 bp, Mus musculus
aacatagagaggaactacaagaatc

SEQ ID NO: 854686 - DNA, 25 bp, Mus musculus
aacatagatgcccgcatgtacatgg

SEQ ID NO: 854687 - DNA, 25 bp, Mus musculus
aacatagatgccggcatgtacatgg

SEQ ID NO: 854688 - DNA, 25 bp, Mus musculus
aacatagcaattaacgaactagagg

SEQ ID NO: 854689 - DNA, 25 bp, Mus musculus
aacatagcaattaacggagtggcca

SEQ ID NO: 854690 - DNA, 25 bp, Mus musculus
aacatagcaattaaggaactagagg

SEQ ID NO: 854691 - DNA, 25 bp, Mus musculus
aacatagcaattaagggagtggcca

SEQ ID NO: 854692 - DNA, 25 bp, Mus musculus
aacatagcagagttgagctgaaatg

SEQ ID NO: 854693 - DNA, 25 bp, Mus musculus
aacatagcagtgttgagctgaaatg

SEQ ID NO: 854694 - DNA, 25 bp, Mus musculus
aacataggtcagcgctgtgtctcgt

SEQ ID NO: 854695 - DNA, 25 bp, Mus musculus
aacataggtcagggctgtgtctcgt

SEQ ID NO: 854696 - DNA, 25 bp, Mus musculus
aacatatcactactcgggaaacagg

SEQ ID NO: 854697 - DNA, 25 bp, Mus musculus
aacatatcactactctggtcgtgca

SEQ ID NO: 854698 - DNA, 25 bp, Mus musculus
aacatatcactactggggaaacagg

SEQ ID NO: 854699 - DNA, 25 bp, Mus musculus
aacatatcactactgtggtcgtgca

SEQ ID NO: 854700 - DNA, 25 bp, Mus musculus
aacatatctccacaatcctaaggac

SEQ ID NO: 854701 - DNA, 25 bp, Mus musculus
aacatatctccagaatcctaaggac

SEQ ID NO: 854702 - DNA, 25 bp, Mus musculus
aacatcaaagactccacgggcaagt

SEQ ID NO: 854703 - DNA, 25 bp, Mus musculus
aacatcaaagtctccacgggcaagt

SEQ ID NO: 854704 - DNA, 25 bp, Mus musculus
aacatcaacgcttctcccatggcgc

SEQ ID NO: 854705 - DNA, 25 bp, Mus musculus
aacatcaacggttctcccatggcgc

SEQ ID NO: 854706 - DNA, 25 bp, Mus musculus
aacatcacagattgctgaaagacag

SEQ ID NO: 854707 - DNA, 25 bp, Mus musculus
aacatcacagtttgctgaaagacag

SEQ ID NO: 854708 - DNA, 25 bp, Mus musculus
aacatcacattgccgtcttctggga

SEQ ID NO: 854709 - DNA, 25 bp, Mus musculus
aacatcacattggcgtcttctggga

SEQ ID NO: 854710 - DNA, 25 bp, Mus musculus
aacatcataaagcctggcccagtac

SEQ ID NO: 854711 - DNA, 25 bp, Mus musculus
aacatcataaaggctggcccagtac

SEQ ID NO: 854712 - DNA, 25 bp, Mus musculus
aacatcatcacgaaactgaggctcc

SEQ ID NO: 854713 - DNA, 25 bp, Mus musculus
aacatcatcacgtaactgaggctcc

SEQ ID NO: 854714 - DNA, 25 bp, Mus musculus
aacatcatcatgcctgagtttgaga

SEQ ID NO: 854715 - DNA, 25 bp, Mus musculus
aacatcatcatggctgagtttgaga

SEQ ID NO: 854716 - DNA, 25 bp, Mus musculus
aacatcatgcaccccaagtggaagc

SEQ ID NO: 854717 - DNA, 25 bp, Mus musculus
aacatcatgcaccccaagtggcagc

SEQ ID NO: 854718 - DNA, 25 bp, Mus musculus
aacatcatgcacgccaagtggaagc

SEQ ID NO: 854719 - DNA, 25 bp, Mus musculus
aacatcatgcacgccaagtggcagc

SEQ ID NO: 854720 - DNA, 25 bp, Mus musculus
aacatcatgtttcgtccggacatct

SEQ ID NO: 854721 - DNA, 25 bp, Mus musculus
aacatcatgtttggtccggacatct

SEQ ID NO: 854722 - DNA, 25 bp, Mus musculus
aacatccactggattcgaatgagaa

SEQ ID NO: 854723 - DNA, 25 bp, Mus musculus
aacatccactggtttcgaatgagaa

SEQ ID NO: 854724 - DNA, 25 bp, Mus musculus
aacatccacttatcacttcattgta

SEQ ID NO: 854725 - DNA, 25 bp, Mus musculus
aacatccacttatctcttcattgta

SEQ ID NO: 854726 - DNA, 25 bp, Mus musculus
aacatccccaacaacgatgacctga

SEQ ID NO: 854727 - DNA, 25 bp, Mus musculus
aacatccccaactacgatgacctga

SEQ ID NO: 854728 - DNA, 25 bp, Mus musculus
aacatccccactgacatgatccccc

SEQ ID NO: 854729 - DNA, 25 bp, Mus musculus
aacatccccactgagatgatccccc

SEQ ID NO: 854730 - DNA, 25 bp, Mus musculus
aacatcctaacccacactgtttcaa

SEQ ID NO: 854731 - DNA, 25 bp, Mus musculus
aacatcctaacccagactgtttcaa

SEQ ID NO: 854732 - DNA, 25 bp, Mus musculus
aacatcctagagcccatgatttccg

SEQ ID NO: 854733 - DNA, 25 bp, Mus musculus
aacatcctagaggccatgatttccg

SEQ ID NO: 854734 - DNA, 25 bp, Mus musculus
aacatcctcaaaccgacccctgaac

SEQ ID NO: 854735 - DNA, 25 bp, Mus musculus
aacatcctcaaacgatacaacttct

SEQ ID NO: 854736 - DNA, 25 bp, Mus musculus
aacatcctcaaagcgacccctgaac

SEQ ID NO: 854737 - DNA, 25 bp, Mus musculus
aacatcctcaaaggatacaacttct

SEQ ID NO: 854738 - DNA, 25 bp, Mus musculus
aacatcctgcccattgatcatacca

SEQ ID NO: 854739 - DNA, 25 bp, Mus musculus
aacatcctgccctttgatcatacca

SEQ ID NO: 854740 - DNA, 25 bp, Mus musculus
aacatccttcaacaaaccctgaagc

SEQ ID NO: 854741 - DNA, 25 bp, Mus musculus
aacatccttcaagaaaccctgaagc

SEQ ID NO: 854742 - DNA, 25 bp, Mus musculus
aacatcgaccaagacatgctaaaat

SEQ ID NO: 854743 - DNA, 25 bp, Mus musculus
aacatcgaccaagagatgctaaaat

SEQ ID NO: 854744 - DNA, 25 bp, Mus musculus
aacatcgccgcagtcgtgtttgcct

SEQ ID NO: 854745 - DNA, 25 bp, Mus musculus
aacatcgccgcagtggtgtttgcct

SEQ ID NO: 854746 - DNA, 25 bp, Mus musculus
aacatcggtacacgacagctttgca

SEQ ID NO: 854747 - DNA, 25 bp, Mus musculus
aacatcggtacactggcaggacagc

SEQ ID NO: 854748 - DNA, 25 bp, Mus musculus
aacatcggtacaggacagctttgca

SEQ ID NO: 854749 - DNA, 25 bp, Mus musculus
aacatcggtacagtggcaggacagc

SEQ ID NO: 854750 - DNA, 25 bp, Mus musculus
aacatctaagctgccaagtgctggt

SEQ ID NO: 854751 - DNA, 25 bp, Mus musculus
aacatctaaggtgccaagtgctggt

SEQ ID NO: 854752 - DNA, 25 bp, Mus musculus
aacatctactataacagtgacctga

SEQ ID NO: 854753 - DNA, 25 bp, Mus musculus
aacatctactataagagtgacctga

SEQ ID NO: 854754 - DNA, 25 bp, Mus musculus
aacatctagacacttcgaacctcag

SEQ ID NO: 854755 - DNA, 25 bp, Mus musculus
aacatctagacagttcgaacctcag

SEQ ID NO: 854756 - DNA, 25 bp, Mus musculus
aacatctatgactgcaatggaggaa

SEQ ID NO: 854757 - DNA, 25 bp, Mus musculus
aacatctatgactggaatggaggaa

SEQ ID NO: 854758 - DNA, 25 bp, Mus musculus
aacatctattaacgcgttgctagga

SEQ ID NO: 854759 - DNA, 25 bp, Mus musculus
aacatctattaacgggttgctagga

SEQ ID NO: 854760 - DNA, 25 bp, Mus musculus
aacatctggaagctatctcagacga

SEQ ID NO: 854761 - DNA, 25 bp, Mus musculus
aacatctggaaggtatctcagacga

SEQ ID NO: 854762 - DNA, 25 bp, Mus musculus
aacatctggagccgcagccagagga

SEQ ID NO: 854763 - DNA, 25 bp, Mus musculus
aacatctggagccggagccagagga

SEQ ID NO: 854764 - DNA, 25 bp, Mus musculus
aacatctgtcctgacgagtgtgcag

SEQ ID NO: 854765 - DNA, 25 bp, Mus musculus
aacatctgtcctgaggagtgtgcag

SEQ ID NO: 854766 - DNA, 25 bp, Mus musculus
aacatgaacagaagagagaggggga

SEQ ID NO: 854767 - DNA, 25 bp, Mus musculus
aacatgaacagaagagcacttctga

SEQ ID NO: 854768 - DNA, 25 bp, Mus musculus
aacatgaacagacagagagcacttc

SEQ ID NO: 854769 - DNA, 25 bp, Mus musculus
aacatgaacagagagagagcacttc

SEQ ID NO: 854770 - DNA, 25 bp, Mus musculus
aacatgaacagatgagagaggggga

SEQ ID NO: 854771 - DNA, 25 bp, Mus musculus
aacatgaacagatgagcacttctga

SEQ ID NO: 854772 - DNA, 25 bp, Mus musculus
aacatgaaccagggtggccacgtgg

SEQ ID NO: 854773 - DNA, 25 bp, Mus musculus
aacatgaacctgggtggccacgtgg

SEQ ID NO: 854774 - DNA, 25 bp, Mus musculus
aacatgaactgtcacatgtccaaca

SEQ ID NO: 854775 - DNA, 25 bp, Mus musculus
aacatgaactgtcagatgtccaaca

SEQ ID NO: 854776 - DNA, 25 bp, Mus musculus
aacatgaagttgctgagcccgagtt

SEQ ID NO: 854777 - DNA, 25 bp, Mus musculus
aacatgaagttggtgagcccgagtt

SEQ ID NO: 854778 - DNA, 25 bp, Mus musculus
aacatgaatgtgaccgagataatca

SEQ ID NO: 854779 - DNA, 25 bp, Mus musculus
aacatgaatgtgtccgagataatca

SEQ ID NO: 854780 - DNA, 25 bp, Mus musculus
aacatgacagtgaacggccagaatg

SEQ ID NO: 854781 - DNA, 25 bp, Mus musculus
aacatgacagtgaagggccagaatg

SEQ ID NO: 854782 - DNA, 25 bp, Mus musculus
aacatgatgatgaacttgttcctag

SEQ ID NO: 854783 - DNA, 25 bp, Mus musculus
aacatgatgatgtacttgttcctag

SEQ ID NO: 854784 - DNA, 25 bp, Mus musculus
aacatgatggagcatgtggagaaca

SEQ ID NO: 854785 - DNA, 25 bp, Mus musculus
aacatgatggaggatgtggagaaca

SEQ ID NO: 854786 - DNA, 25 bp, Mus musculus
aacatgcagatgctgtcagtggatt

SEQ ID NO: 854787 - DNA, 25 bp, Mus musculus
aacatgcagatggtgtcagtggatt

SEQ ID NO: 854788 - DNA, 25 bp, Mus musculus
aacatgctcttttcaggtacaaaca

SEQ ID NO: 854789 - DNA, 25 bp, Mus musculus
aacatgctcttttctggtacaaaca

SEQ ID NO: 854790 - DNA, 25 bp, Mus musculus
aacatggaaactaacgcattactca

SEQ ID NO: 854791 - DNA, 25 bp, Mus musculus
aacatggaaactaacgctggccttg

SEQ ID NO: 854792 - DNA, 25 bp, Mus musculus
aacatggaaactaaggcattactca

SEQ ID NO: 854793 - DNA, 25 bp, Mus musculus
aacatggaaactaaggctggccttg

SEQ ID NO: 854794 - DNA, 25 bp, Mus musculus
aacatggacaatgcaatttctgcca

SEQ ID NO: 854795 - DNA, 25 bp, Mus musculus
aacatggacaatgctatttctgcca

SEQ ID NO: 854796 - DNA, 25 bp, Mus musculus
aacatggacggcaacgtcggctcct

SEQ ID NO: 854797 - DNA, 25 bp, Mus musculus
aacatggacggcaaggtcggctcct

SEQ ID NO: 854798 - DNA, 25 bp, Mus musculus
aacatggaggcccctggtgaccatt

SEQ ID NO: 854799 - DNA, 25 bp, Mus musculus
aacatggaggccgacgctgagaatc

SEQ ID NO: 854800 - DNA, 25 bp, Mus musculus
aacatggaggccgaggctgagaatc

SEQ ID NO: 854801 - DNA, 25 bp, Mus musculus
aacatggagggccctggtgaccatt

SEQ ID NO: 854802 - DNA, 25 bp, Mus musculus
aacatggcaaaagaagccagtctaa

SEQ ID NO: 854803 - DNA, 25 bp, Mus musculus
aacatggcaaaagatgccagtctaa

SEQ ID NO: 854804 - DNA, 25 bp, Mus musculus
aacatggcagcagagtcactcggca

SEQ ID NO: 854805 - DNA, 25 bp, Mus musculus
aacatggcagcctctacacagagag

SEQ ID NO: 854806 - DNA, 25 bp, Mus musculus
aacatggcaggagagtcactcggca

SEQ ID NO: 854807 - DNA, 25 bp, Mus musculus
aacatggcaggctctacacagagag

SEQ ID NO: 854808 - DNA, 25 bp, Mus musculus
aacatggcatcagacagcgggaagc

SEQ ID NO: 854809 - DNA, 25 bp, Mus musculus
aacatggcatcagagagcgggaagc

SEQ ID NO: 854810 - DNA, 25 bp, Mus musculus
aacatggctgagagctacggagccc

SEQ ID NO: 854811 - DNA, 25 bp, Mus musculus
aacatggctgagcctttcagtgcta

SEQ ID NO: 854812 - DNA, 25 bp, Mus musculus
aacatggctgaggctttcagtgcta

SEQ ID NO: 854813 - DNA, 25 bp, Mus musculus
aacatggctgagtgctacggagccc

SEQ ID NO: 854814 - DNA, 25 bp, Mus musculus
aacatggtggagccctgtctgctgg

SEQ ID NO: 854815 - DNA, 25 bp, Mus musculus
aacatggtggaggcctgtctgctgg

SEQ ID NO: 854816 - DNA, 25 bp, Mus musculus
aacatgtagaagctccactgccatc

SEQ ID NO: 854817 - DNA, 25 bp, Mus musculus
aacatgtagaaggtccactgccatc

SEQ ID NO: 854818 - DNA, 25 bp, Mus musculus
aacatgtcaacacgtactggaaaaa

SEQ ID NO: 854819 - DNA, 25 bp, Mus musculus
aacatgtcaacaggtactggaaaaa

SEQ ID NO: 854820 - DNA, 25 bp, Mus musculus
aacattaatagccacatcaacatgt

SEQ ID NO: 854821 - DNA, 25 bp, Mus musculus
aacattaatagccagatcaacatgt

SEQ ID NO: 854822 - DNA, 25 bp, Mus musculus
aacattacagccacgtccactgtgg

SEQ ID NO: 854823 - DNA, 25 bp, Mus musculus
aacattacaggcacgtccactgtgg

SEQ ID NO: 854824 - DNA, 25 bp, Mus musculus
aacattacccagcttccccgctcgt

SEQ ID NO: 854825 - DNA, 25 bp, Mus musculus
aacattacccaggttccccgctcgt

SEQ ID NO: 854826 - DNA, 25 bp, Mus musculus
aacattattgcttcacctctgctct

SEQ ID NO: 854827 - DNA, 25 bp, Mus musculus
aacattattggttcacctctgctct

SEQ ID NO: 854828 - DNA, 25 bp, Mus musculus
aacattcagaagcctgctgaaatag

SEQ ID NO: 854829 - DNA, 25 bp, Mus musculus
aacattcagaaggctgctgaaatag

SEQ ID NO: 854830 - DNA, 25 bp, Mus musculus
aacattgagcagagtctgcgagaaa

SEQ ID NO: 854831 - DNA, 25 bp, Mus musculus
aacattgagcagtgtctgcgagaaa

SEQ ID NO: 854832 - DNA, 25 bp, Mus musculus
aacattgatgtcaccaagccagcga

SEQ ID NO: 854833 - DNA, 25 bp, Mus musculus
aacattgatgtcaccgtctattaca

SEQ ID NO: 854834 - DNA, 25 bp, Mus musculus
aacattgatgtcacgaagccagcga

SEQ ID NO: 854835 - DNA, 25 bp, Mus musculus
aacattgatgtcacggtctattaca

SEQ ID NO: 854836 - DNA, 25 bp, Mus musculus
aacattgcagcgccgtgcaggcctg

SEQ ID NO: 854837 - DNA, 25 bp, Mus musculus
aacattgcagctaaagatgagcctt

SEQ ID NO: 854838 - DNA, 25 bp, Mus musculus
aacattgcagggccgtgcaggcctg

SEQ ID NO: 854839 - DNA, 25 bp, Mus musculus
aacattgcaggtaaagatgagcctt

SEQ ID NO: 854840 - DNA, 25 bp, Mus musculus
aacattgccagaaacagaaatgctt

SEQ ID NO: 854841 - DNA, 25 bp, Mus musculus
aacattgccagaaagagaaatgctt

SEQ ID NO: 854842 - DNA, 25 bp, Mus musculus
aacattgctctggacaccagtgaca

SEQ ID NO: 854843 - DNA, 25 bp, Mus musculus
aacattgctctggactgacaagcac

SEQ ID NO: 854844 - DNA, 25 bp, Mus musculus
aacattgctctggagaccagtgaca

SEQ ID NO: 854845 - DNA, 25 bp, Mus musculus
aacattgctctggagtgacaagcac

SEQ ID NO: 854846 - DNA, 25 bp, Mus musculus
aacattgctgctggcatcagaaatg

SEQ ID NO: 854847 - DNA, 25 bp, Mus musculus
aacattgctggtggcatcagaaatg

SEQ ID NO: 854848 - DNA, 25 bp, Mus musculus
aacattggactacacaacggtgtac

SEQ ID NO: 854849 - DNA, 25 bp, Mus musculus
aacattggactacagaacggtgtac

SEQ ID NO: 854850 - DNA, 25 bp, Mus musculus
aacattgtgaagatgtgaacgagtg

SEQ ID NO: 854851 - DNA, 25 bp, Mus musculus
aacattgtgaagttgtgaacgagtg

SEQ ID NO: 854852 - DNA, 25 bp, Mus musculus
aacatttaagagtgaatgccatcca

SEQ ID NO: 854853 - DNA, 25 bp, Mus musculus
aacatttaagccaattctgccttga

SEQ ID NO: 854854 - DNA, 25 bp, Mus musculus
aacatttaaggcaattctgccttga

SEQ ID NO: 854855 - DNA, 25 bp, Mus musculus
aacatttaagtgtgaatgccatcca

SEQ ID NO: 854856 - DNA, 25 bp, Mus musculus
aacatttacagcgacgaactgcgtg

SEQ ID NO: 854857 - DNA, 25 bp, Mus musculus
aacatttacagcgaggaactgcgtg

SEQ ID NO: 854858 - DNA, 25 bp, Mus musculus
aacatttatgagaatggagatgtat

SEQ ID NO: 854859 - DNA, 25 bp, Mus musculus
aacatttatgagtatggagatgtat

SEQ ID NO: 854860 - DNA, 25 bp, Mus musculus
aacatttgtgtgctgaggctcccac

SEQ ID NO: 854861 - DNA, 25 bp, Mus musculus
aacatttgtgtggtgaggctcccac

SEQ ID NO: 854862 - DNA, 25 bp, Mus musculus
aaccaaaagtcaaatggtgagcgga

SEQ ID NO: 854863 - DNA, 25 bp, Mus musculus
aaccaaaagtcatatggtgagcgga

SEQ ID NO: 854864 - DNA, 25 bp, Mus musculus
aaccaaagcacacataaaatctgtg

SEQ ID NO: 854865 - DNA, 25 bp, Mus musculus
aaccaaagcacagataaaatctgtg

SEQ ID NO: 854866 - DNA, 25 bp, Mus musculus
aaccaaagcatgcagggtgatgagg

SEQ ID NO: 854867 - DNA, 25 bp, Mus musculus
aaccaaagcatggagggtgatgagg

SEQ ID NO: 854868 - DNA, 25 bp, Mus musculus
aaccaaatacaaaatcccatatata

SEQ ID NO: 854869 - DNA, 25 bp, Mus musculus
aaccaaatacaatatcccatatata

SEQ ID NO: 854870 - DNA, 25 bp, Mus musculus
aaccaaatctatacctacatcggct

SEQ ID NO: 854871 - DNA, 25 bp, Mus musculus
aaccaaatctattcctacatcggct

SEQ ID NO: 854872 - DNA, 25 bp, Mus musculus
aaccaaattagacatgctcgtaaag

SEQ ID NO: 854873 - DNA, 25 bp, Mus musculus
aaccaaattagagatgctcgtaaag

SEQ ID NO: 854874 - DNA, 25 bp, Mus musculus
aaccaacaggccatgaaagaagtga

SEQ ID NO: 854875 - DNA, 25 bp, Mus musculus
aaccaacagggcatgaaagaagtga

SEQ ID NO: 854876 - DNA, 25 bp, Mus musculus
aaccaagaggaacctgtgtggagat

SEQ ID NO: 854877 - DNA, 25 bp, Mus musculus
aaccaagaggaagctgtgtggagat

SEQ ID NO: 854878 - DNA, 25 bp, Mus musculus
aaccaagatgctcacatagatgtct

SEQ ID NO: 854879 - DNA, 25 bp, Mus musculus
aaccaagatggtcacatagatgtct

SEQ ID NO: 854880 - DNA, 25 bp, Mus musculus
aaccaagcagcctgccttaggagtt

SEQ ID NO: 854881 - DNA, 25 bp, Mus musculus
aaccaagcaggctgccttaggagtt

SEQ ID NO: 854882 - DNA, 25 bp, Mus musculus
aaccaagccttcctcggctttacat

SEQ ID NO: 854883 - DNA, 25 bp, Mus musculus
aaccaagccttcctgggctttacat

SEQ ID NO: 854884 - DNA, 25 bp, Mus musculus
aaccaagtgacccacagatcttccc

SEQ ID NO: 854885 - DNA, 25 bp, Mus musculus
aaccaagtgacccagagatcttccc

SEQ ID NO: 854886 - DNA, 25 bp, Mus musculus
aaccaatgagcaatacttggacctc

SEQ ID NO: 854887 - DNA, 25 bp, Mus musculus
aaccaatgagcaatacttggatctc

SEQ ID NO: 854888 - DNA, 25 bp, Mus musculus
aaccaatgaggaatacttggacctc

SEQ ID NO: 854889 - DNA, 25 bp, Mus musculus
aaccaatgaggaatacttggatctc

SEQ ID NO: 854890 - DNA, 25 bp, Mus musculus
aaccaatgtgagagggcgattgttt

SEQ ID NO: 854891 - DNA, 25 bp, Mus musculus
aaccaatgtgagtgggcgattgttt

SEQ ID NO: 854892 - DNA, 25 bp, Mus musculus
aaccaatgtgtggtcagatattaag

SEQ ID NO: 854893 - DNA, 25 bp, Mus musculus
aaccaatgtgtggtgagatattaag

SEQ ID NO: 854894 - DNA, 25 bp, Mus musculus
aaccacaaagcccatgcctacagac

SEQ ID NO: 854895 - DNA, 25 bp, Mus musculus
aaccacaaaggccatgcctacagac

SEQ ID NO: 854896 - DNA, 25 bp, Mus musculus
aaccacagccaacgacccctgcgct

SEQ ID NO: 854897 - DNA, 25 bp, Mus musculus
aaccacagccaaggacccctgcgct

SEQ ID NO: 854898 - DNA, 25 bp, Mus musculus
aaccacagtaagctcacgaagttgg

SEQ ID NO: 854899 - DNA, 25 bp, Mus musculus
aaccacagtaaggtcacgaagttgg

SEQ ID NO: 854900 - DNA, 25 bp, Mus musculus
aaccaccaggaacacagagaacatt

SEQ ID NO: 854901 - DNA, 25 bp, Mus musculus
aaccaccaggaacagagagaacatt

SEQ ID NO: 854902 - DNA, 25 bp, Mus musculus
aaccaccatgcagaacagtctcaag

SEQ ID NO: 854903 - DNA, 25 bp, Mus musculus
aaccaccatggagaacagtctcaag

SEQ ID NO: 854904 - DNA, 25 bp, Mus musculus
aaccacccagatctcttgcttaaga

SEQ ID NO: 854905 - DNA, 25 bp, Mus musculus
aaccacccagttctcttgcttaaga

SEQ ID NO: 854906 - DNA, 25 bp, Mus musculus
aaccacctgcaacgcccacgatgtg

SEQ ID NO: 854907 - DNA, 25 bp, Mus musculus
aaccacctgcaaggcccacgatgtg

SEQ ID NO: 854908 - DNA, 25 bp, Mus musculus
aaccacgcccaacacgtaccgctat

SEQ ID NO: 854909 - DNA, 25 bp, Mus musculus
aaccacgcccaacaggtaccgctat

SEQ ID NO: 854910 - DNA, 25 bp, Mus musculus
aaccacgctggccacacagctgcag

SEQ ID NO: 854911 - DNA, 25 bp, Mus musculus
aaccacgctggccacgtattgttag

SEQ ID NO: 854912 - DNA, 25 bp, Mus musculus
aaccacgctggccagacagctgcag

SEQ ID NO: 854913 - DNA, 25 bp, Mus musculus
aaccacgctggccaggtattgttag

SEQ ID NO: 854914 - DNA, 25 bp, Mus musculus
aaccacggaaccaacgtggctatgg

SEQ ID NO: 854915 - DNA, 25 bp, Mus musculus
aaccacggaaccaaggtggctatgg

SEQ ID NO: 854916 - DNA, 25 bp, Mus musculus
aaccacggcctgcacgagacctggt

SEQ ID NO: 854917 - DNA, 25 bp, Mus musculus
aaccacggcctgcaggagacctggt

SEQ ID NO: 854918 - DNA, 25 bp, Mus musculus
aaccactatatcaacactctctctt

SEQ ID NO: 854919 - DNA, 25 bp, Mus musculus
aaccactatatcaagactctctctt

SEQ ID NO: 854920 - DNA, 25 bp, Mus musculus
aaccactcaaacaacgttcagagtc

SEQ ID NO: 854921 - DNA, 25 bp, Mus musculus
aaccactcaaacaaggttcagagtc

SEQ ID NO: 854922 - DNA, 25 bp, Mus musculus
aaccactcagcgcttcacacctacc

SEQ ID NO: 854923 - DNA, 25 bp, Mus musculus
aaccactcagggcttcacacctacc

SEQ ID NO: 854924 - DNA, 25 bp, Mus musculus
aaccactctccgaaagtaaatcacc

SEQ ID NO: 854925 - DNA, 25 bp, Mus musculus
aaccactctccgaatgtaaatcacc

SEQ ID NO: 854926 - DNA, 25 bp, Mus musculus
aaccactgcaggatttctggcacca

SEQ ID NO: 854927 - DNA, 25 bp, Mus musculus
aaccactgcaggttttctggcacca

SEQ ID NO: 854928 - DNA, 25 bp, Mus musculus
aaccactgtggaacatttggctatc

SEQ ID NO: 854929 - DNA, 25 bp, Mus musculus
aaccactgtggatcatttggctatc

SEQ ID NO: 854930 - DNA, 25 bp, Mus musculus
aaccagaaagagaccagcagcacgc

SEQ ID NO: 854931 - DNA, 25 bp, Mus musculus
aaccagaaagagtccaaagctgccc

SEQ ID NO: 854932 - DNA, 25 bp, Mus musculus
aaccagaaagagtccagcagcacgc

SEQ ID NO: 854933 - DNA, 25 bp, Mus musculus
aaccagaaagcacagtctggacttc

SEQ ID NO: 854934 - DNA, 25 bp, Mus musculus
aaccagaaagctgatctgtaaatcg

SEQ ID NO: 854935 - DNA, 25 bp, Mus musculus
aaccagaaaggacagtctggacttc

SEQ ID NO: 854936 - DNA, 25 bp, Mus musculus
aaccagaaaggtgatctgtaaatcg

SEQ ID NO: 854937 - DNA, 25 bp, Mus musculus
aaccagaaagtgtccaaagctgccc

SEQ ID NO: 854938 - DNA, 25 bp, Mus musculus
aaccagaagcaattgagaagccgaa

SEQ ID NO: 854939 - DNA, 25 bp, Mus musculus
aaccagaagctattgagaagccgaa

SEQ ID NO: 854940 - DNA, 25 bp, Mus musculus
aaccagaagtgcctcacagaggagg

SEQ ID NO: 854941 - DNA, 25 bp, Mus musculus
aaccagaagtgcctcctcttgctcc

SEQ ID NO: 854942 - DNA, 25 bp, Mus musculus
aaccagaagtgcctgacagaggagg

SEQ ID NO: 854943 - DNA, 25 bp, Mus musculus
aaccagaagtgcctgctcttgctcc

SEQ ID NO: 854944 - DNA, 25 bp, Mus musculus
aaccagaagttccgccctctggccg

SEQ ID NO: 854945 - DNA, 25 bp, Mus musculus
aaccagaagttccggcctctggccg

SEQ ID NO: 854946 - DNA, 25 bp, Mus musculus
aaccagacagaggatatttggtccg

SEQ ID NO: 854947 - DNA, 25 bp, Mus musculus
aaccagacagatggagaaagacgaa

SEQ ID NO: 854948 - DNA, 25 bp, Mus musculus
aaccagacagtggatatttggtccg

SEQ ID NO: 854949 - DNA, 25 bp, Mus musculus
aaccagacagttggagaaagacgaa

SEQ ID NO: 854950 - DNA, 25 bp, Mus musculus
aaccagagaagaccaaggaaagcaa

SEQ ID NO: 854951 - DNA, 25 bp, Mus musculus
aaccagagaagagcaaggaaagcaa

SEQ ID NO: 854952 - DNA, 25 bp, Mus musculus
aaccagagagcacaattgactttgg

SEQ ID NO: 854953 - DNA, 25 bp, Mus musculus
aaccagagagcagaattgactttgg

SEQ ID NO: 854954 - DNA, 25 bp, Mus musculus
aaccagagcaaacaacctgctgagt

SEQ ID NO: 854955 - DNA, 25 bp, Mus musculus
aaccagagcaaagaacctgctgagt

SEQ ID NO: 854956 - DNA, 25 bp, Mus musculus
aaccagagccatccggtgctcttag

SEQ ID NO: 854957 - DNA, 25 bp, Mus musculus
aaccagagccatctggaaccaggcc

SEQ ID NO: 854958 - DNA, 25 bp, Mus musculus
aaccagagccatcttccctttgccc

SEQ ID NO: 854959 - DNA, 25 bp, Mus musculus
aaccagagccatgcggtgctcttag

SEQ ID NO: 854960 - DNA, 25 bp, Mus musculus
aaccagagccatgtagaaccaggcc

SEQ ID NO: 854961 - DNA, 25 bp, Mus musculus
aaccagagccatgtggaaccaggcc

SEQ ID NO: 854962 - DNA, 25 bp, Mus musculus
aaccagagccatgttccctttgccc

SEQ ID NO: 854963 - DNA, 25 bp, Mus musculus
aaccagagccatgttgaaccaggcc

SEQ ID NO: 854964 - DNA, 25 bp, Mus musculus
aaccagaggaaacagagaaagtcca

SEQ ID NO: 854965 - DNA, 25 bp, Mus musculus
aaccagaggaaagagagaaagtcca

SEQ ID NO: 854966 - DNA, 25 bp, Mus musculus
aaccagagttcactaagtactgccc

SEQ ID NO: 854967 - DNA, 25 bp, Mus musculus
aaccagagttcagtaagtactgccc

SEQ ID NO: 854968 - DNA, 25 bp, Mus musculus
aaccagcaaccgccgcctgccagtc

SEQ ID NO: 854969 - DNA, 25 bp, Mus musculus
aaccagcaacggccgcctgccagtc

SEQ ID NO: 854970 - DNA, 25 bp, Mus musculus
aaccagcaagagcgactgtatctgg

SEQ ID NO: 854971 - DNA, 25 bp, Mus musculus
aaccagcaagtgcgactgtatctgg

SEQ ID NO: 854972 - DNA, 25 bp, Mus musculus
aaccagcacaaacggtgctgaatcc

SEQ ID NO: 854973 - DNA, 25 bp, Mus musculus
aaccagcacaaagggtgctgaatcc

SEQ ID NO: 854974 - DNA, 25 bp, Mus musculus
aaccagcagttcaccattctcgagc

SEQ ID NO: 854975 - DNA, 25 bp, Mus musculus
aaccagcagttcacgattctcgagc

SEQ ID NO: 854976 - DNA, 25 bp, Mus musculus
aaccagcgctcttcagttatgttct

SEQ ID NO: 854977 - DNA, 25 bp, Mus musculus
aaccagcgctcttctgttatgttct

SEQ ID NO: 854978 - DNA, 25 bp, Mus musculus
aaccagctacggctccagcggctcc

SEQ ID NO: 854979 - DNA, 25 bp, Mus musculus
aaccagctacgggtccagcggctcc

SEQ ID NO: 854980 - DNA, 25 bp, Mus musculus
aaccagctcgacttgagcagcggca

SEQ ID NO: 854981 - DNA, 25 bp, Mus musculus
aaccagctcgtcttgagcagcggca

SEQ ID NO: 854982 - DNA, 25 bp, Mus musculus
aaccagctgaagcaactgagagaga

SEQ ID NO: 854983 - DNA, 25 bp, Mus musculus
aaccagctgaaggaactgagagaga

SEQ ID NO: 854984 - DNA, 25 bp, Mus musculus
aaccaggaaaatctttacatgagga

SEQ ID NO: 854985 - DNA, 25 bp, Mus musculus
aaccaggaaaatgtttacatgagga

SEQ ID NO: 854986 - DNA, 25 bp, Mus musculus
aaccaggaactcgacgctcctggag

SEQ ID NO: 854987 - DNA, 25 bp, Mus musculus
aaccaggaactcgaggctcctggag

SEQ ID NO: 854988 - DNA, 25 bp, Mus musculus
aaccaggcagctatatcttccggcc

SEQ ID NO: 854989 - DNA, 25 bp, Mus musculus
aaccaggcaggtatatcttccggcc

SEQ ID NO: 854990 - DNA, 25 bp, Mus musculus
aaccaggctacacacgaagcatgtg

SEQ ID NO: 854991 - DNA, 25 bp, Mus musculus
aaccaggctacacaggaagcatgtg

SEQ ID NO: 854992 - DNA, 25 bp, Mus musculus
aaccaggctctgcccaggcagtaca

SEQ ID NO: 854993 - DNA, 25 bp, Mus musculus
aaccaggctctggccaggcagtaca

SEQ ID NO: 854994 - DNA, 25 bp, Mus musculus
aaccagggacttatcgagctcctgt

SEQ ID NO: 854995 - DNA, 25 bp, Mus musculus
aaccagggacttttcgagctcctgt

SEQ ID NO: 854996 - DNA, 25 bp, Mus musculus
aaccagggagtaaacggacatctct

SEQ ID NO: 854997 - DNA, 25 bp, Mus musculus
aaccagggagtaaagggacatctct

SEQ ID NO: 854998 - DNA, 25 bp, Mus musculus
aaccagggtgatcgcgggctaggag

SEQ ID NO: 854999 - DNA, 25 bp, Mus musculus
aaccagggtgatggcgggctaggag

SEQ ID NO: 855000 - DNA, 25 bp, Mus musculus
aaccagggttcacggggcagacagc

SEQ ID NO: 855001 - DNA, 25 bp, Mus musculus
aaccagggttcagggggcagacagc

SEQ ID NO: 855002 - DNA, 25 bp, Mus musculus
aaccagtgcaccctcgaacagcttc

SEQ ID NO: 855003 - DNA, 25 bp, Mus musculus
aaccagtgcaccctggaacagcttc

SEQ ID NO: 855004 - DNA, 25 bp, Mus musculus
aaccagtgtgtgcatgtggacgagt

SEQ ID NO: 855005 - DNA, 25 bp, Mus musculus
aaccagtgtgtggatgtggacgagt

SEQ ID NO: 855006 - DNA, 25 bp, Mus musculus
aaccataaaaacattattagcttat

SEQ ID NO: 855007 - DNA, 25 bp, Mus musculus
aaccataaaaactttattagcttat

SEQ ID NO: 855008 - DNA, 25 bp, Mus musculus
aaccataaagctgtggaacacaagt

SEQ ID NO: 855009 - DNA, 25 bp, Mus musculus
aaccataaaggtgtggaacacaagt

SEQ ID NO: 855010 - DNA, 25 bp, Mus musculus
aaccataatcgaagcttggctgctg

SEQ ID NO: 855011 - DNA, 25 bp, Mus musculus
aaccataatcgaaggttggctgctg

SEQ ID NO: 855012 - DNA, 25 bp, Mus musculus
aaccatacgtgacacaaatggctca

SEQ ID NO: 855013 - DNA, 25 bp, Mus musculus
aaccatacgtgacagaaatggctca

SEQ ID NO: 855014 - DNA, 25 bp, Mus musculus
aaccatcaagctcattattgtcatc

SEQ ID NO: 855015 - DNA, 25 bp, Mus musculus
aaccatcaaggtcattattgtcatc

SEQ ID NO: 855016 - DNA, 25 bp, Mus musculus
aaccatcaggctgctgattttccga

SEQ ID NO: 855017 - DNA, 25 bp, Mus musculus
aaccatcagggtgctgattttccga

SEQ ID NO: 855018 - DNA, 25 bp, Mus musculus
aaccatcatgagatatctgccaaga

SEQ ID NO: 855019 - DNA, 25 bp, Mus musculus
aaccatcatgagttatctgccaaga

SEQ ID NO: 855020 - DNA, 25 bp, Mus musculus
aaccatcccagtcaattcagtcagc

SEQ ID NO: 855021 - DNA, 25 bp, Mus musculus
aaccatcccagtgaattcagtcagc

SEQ ID NO: 855022 - DNA, 25 bp, Mus musculus
aaccatcctgagccctgactaccag

SEQ ID NO: 855023 - DNA, 25 bp, Mus musculus
aaccatcctgaggcctgactaccag

SEQ ID NO: 855024 - DNA, 25 bp, Mus musculus
aaccatctgaaacctgggttgcagg

SEQ ID NO: 855025 - DNA, 25 bp, Mus musculus
aaccatctgaaagctgggttgcagg

SEQ ID NO: 855026 - DNA, 25 bp, Mus musculus
aaccatgaagagcaagtcaacaccc

SEQ ID NO: 855027 - DNA, 25 bp, Mus musculus
aaccatgaagaggaagtcaacaccc

SEQ ID NO: 855028 - DNA, 25 bp, Mus musculus
aaccatgaatccccacctgccgttt

SEQ ID NO: 855029 - DNA, 25 bp, Mus musculus
aaccatgaatgcccacctgccgttt

SEQ ID NO: 855030 - DNA, 25 bp, Mus musculus
aaccatgaccttctcttgatccggc

SEQ ID NO: 855031 - DNA, 25 bp, Mus musculus
aaccatgaccttgtcttgatccggc

SEQ ID NO: 855032 - DNA, 25 bp, Mus musculus
aaccatgaggagcaagtcaacaccc

SEQ ID NO: 855033 - DNA, 25 bp, Mus musculus
aaccatgaggagcagatgaaggaat

SEQ ID NO: 855034 - DNA, 25 bp, Mus musculus
aaccatgaggaggaagtcaacaccc

SEQ ID NO: 855035 - DNA, 25 bp, Mus musculus
aaccatgaggaggagatgaaggaat

SEQ ID NO: 855036 - DNA, 25 bp, Mus musculus
aaccatgctgtgctgtgtcaaggat

SEQ ID NO: 855037 - DNA, 25 bp, Mus musculus
aaccatgctgtggtgtgtcaaggat

SEQ ID NO: 855038 - DNA, 25 bp, Mus musculus
aaccatggaatgcacacaacggttt

SEQ ID NO: 855039 - DNA, 25 bp, Mus musculus
aaccatggaatggacacaacggttt

SEQ ID NO: 855040 - DNA, 25 bp, Mus musculus
aaccatgggaagatcccaacgctgg

SEQ ID NO: 855041 - DNA, 25 bp, Mus musculus
aaccatgggaagttcccaacgctgg

SEQ ID NO: 855042 - DNA, 25 bp, Mus musculus
aaccattaagctgtcatatgctcgc

SEQ ID NO: 855043 - DNA, 25 bp, Mus musculus
aaccattaaggtgtcatatgctcgc

SEQ ID NO: 855044 - DNA, 25 bp, Mus musculus
aaccattacaaacacttattcagaa

SEQ ID NO: 855045 - DNA, 25 bp, Mus musculus
aaccattacaaacagttattcagaa

SEQ ID NO: 855046 - DNA, 25 bp, Mus musculus
aaccattcagattgcaggagacata

SEQ ID NO: 855047 - DNA, 25 bp, Mus musculus
aaccattcagtttgcaggagacata

SEQ ID NO: 855048 - DNA, 25 bp, Mus musculus
aaccattttgacaacaagcagacag

SEQ ID NO: 855049 - DNA, 25 bp, Mus musculus
aaccattttgacaacgaccatggcg

SEQ ID NO: 855050 - DNA, 25 bp, Mus musculus
aaccattttgacaagaagcagacag

SEQ ID NO: 855051 - DNA, 25 bp, Mus musculus
aaccattttgacaaggaccatggcg

SEQ ID NO: 855052 - DNA, 25 bp, Mus musculus
aacccaaacgtgcaaggacctgctg

SEQ ID NO: 855053 - DNA, 25 bp, Mus musculus
aacccaaacgtggaaggacctgctg

SEQ ID NO: 855054 - DNA, 25 bp, Mus musculus
aacccaacagcatcttgggtcaggt

SEQ ID NO: 855055 - DNA, 25 bp, Mus musculus
aacccaacaggatcttgggtcaggt

SEQ ID NO: 855056 - DNA, 25 bp, Mus musculus
aacccaactgatagtttatattgct

SEQ ID NO: 855057 - DNA, 25 bp, Mus musculus
aacccaactgatccccagctcaagg

SEQ ID NO: 855058 - DNA, 25 bp, Mus musculus
aacccaactgattgtttatattgct

SEQ ID NO: 855059 - DNA, 25 bp, Mus musculus
aacccaactgttccccagctcaagg

SEQ ID NO: 855060 - DNA, 25 bp, Mus musculus
aacccaagagacttctctacccagg

SEQ ID NO: 855061 - DNA, 25 bp, Mus musculus
aacccaagagtcttctctacccagg

SEQ ID NO: 855062 - DNA, 25 bp, Mus musculus
aacccaagcccacgacaccgtgcat

SEQ ID NO: 855063 - DNA, 25 bp, Mus musculus
aacccaagcccaggacaccgtgcat

SEQ ID NO: 855064 - DNA, 25 bp, Mus musculus
aacccaagcgtgagtgcaaggagcc

SEQ ID NO: 855065 - DNA, 25 bp, Mus musculus
aacccaagcgtgtgtgcaaggagcc

SEQ ID NO: 855066 - DNA, 25 bp, Mus musculus
aacccacgcaagatggctgccagca

SEQ ID NO: 855067 - DNA, 25 bp, Mus musculus
aacccacgcaagttggctgccagca

SEQ ID NO: 855068 - DNA, 25 bp, Mus musculus
aacccacggtcatccatgaagttcg

SEQ ID NO: 855069 - DNA, 25 bp, Mus musculus
aacccacggtcatcgatgaagttcg

SEQ ID NO: 855070 - DNA, 25 bp, Mus musculus
aacccagaaagccggtggccctgct

SEQ ID NO: 855071 - DNA, 25 bp, Mus musculus
aacccagaaagcgggtggccctgct

SEQ ID NO: 855072 - DNA, 25 bp, Mus musculus
aacccagaccagagggatgtggacc

SEQ ID NO: 855073 - DNA, 25 bp, Mus musculus
aacccagaccagtgggatgtggacc

SEQ ID NO: 855074 - DNA, 25 bp, Mus musculus
aacccagaggagcgagtgagctact

SEQ ID NO: 855075 - DNA, 25 bp, Mus musculus
aacccagaggagggagtgagctact

SEQ ID NO: 855076 - DNA, 25 bp, Mus musculus
aacccagatggtcactgaggcaaat

SEQ ID NO: 855077 - DNA, 25 bp, Mus musculus
aacccagatggtgactgaggcaaat

SEQ ID NO: 855078 - DNA, 25 bp, Mus musculus
aacccagattcaaactgccgtggtg

SEQ ID NO: 855079 - DNA, 25 bp, Mus musculus
aacccagattcaaagtgccgtggtg

SEQ ID NO: 855080 - DNA, 25 bp, Mus musculus
aacccagcagcttccatcacatctc

SEQ ID NO: 855081 - DNA, 25 bp, Mus musculus
aacccagcagcttctgtccctcagc

SEQ ID NO: 855082 - DNA, 25 bp, Mus musculus
aacccagcaggttccatcacatctc

SEQ ID NO: 855083 - DNA, 25 bp, Mus musculus
aacccagcaggttctgtccctcagc

SEQ ID NO: 855084 - DNA, 25 bp, Mus musculus
aacccaggccaacgaggagtcagaa

SEQ ID NO: 855085 - DNA, 25 bp, Mus musculus
aacccaggccaaggaggagtcagaa

SEQ ID NO: 855086 - DNA, 25 bp, Mus musculus
aacccatgagacagcttttttagga

SEQ ID NO: 855087 - DNA, 25 bp, Mus musculus
aacccatgagactgcttttttagga

SEQ ID NO: 855088 - DNA, 25 bp, Mus musculus
aacccatttcggatcttcctgcctt

SEQ ID NO: 855089 - DNA, 25 bp, Mus musculus
aacccatttcggatgttcctgcctt

SEQ ID NO: 855090 - DNA, 25 bp, Mus musculus
aaccccacccagattctgtgttgtg

SEQ ID NO: 855091 - DNA, 25 bp, Mus musculus
aaccccacccagctggaggatgcgg

SEQ ID NO: 855092 - DNA, 25 bp, Mus musculus
aaccccacccaggtggaggatgcgg

SEQ ID NO: 855093 - DNA, 25 bp, Mus musculus
aaccccacccagtttctgtgttgtg

SEQ ID NO: 855094 - DNA, 25 bp, Mus musculus
aaccccagagcacgtggcagaggag

SEQ ID NO: 855095 - DNA, 25 bp, Mus musculus
aaccccagagcaggtggcagaggag

SEQ ID NO: 855096 - DNA, 25 bp, Mus musculus
aaccccagagcgagagttcgtgtcg

SEQ ID NO: 855097 - DNA, 25 bp, Mus musculus
aaccccagagggagagttcgtgtcg

SEQ ID NO: 855098 - DNA, 25 bp, Mus musculus
aaccccagctcaccaaatgaccctg

SEQ ID NO: 855099 - DNA, 25 bp, Mus musculus
aaccccagctcagcaaatgaccctg

SEQ ID NO: 855100 - DNA, 25 bp, Mus musculus
aaccccataccacatgtgagatcca

SEQ ID NO: 855101 - DNA, 25 bp, Mus musculus
aaccccataccagatgtgagatcca

SEQ ID NO: 855102 - DNA, 25 bp, Mus musculus
aaccccattagtcgtctgggtggca

SEQ ID NO: 855103 - DNA, 25 bp, Mus musculus
aaccccattagtggtctgggtggca

SEQ ID NO: 855104 - DNA, 25 bp, Mus musculus
aacccccagatacgtcacctctggg

SEQ ID NO: 855105 - DNA, 25 bp, Mus musculus
aacccccagataggtcacctctggg

SEQ ID NO: 855106 - DNA, 25 bp, Mus musculus
aacccccctaagcgcagcagcaatg

SEQ ID NO: 855107 - DNA, 25 bp, Mus musculus
aacccccctaagggcagcagcaatg

SEQ ID NO: 855108 - DNA, 25 bp, Mus musculus
aacccctatggcaggccacagattg

SEQ ID NO: 855109 - DNA, 25 bp, Mus musculus
aacccctatggctggccacagattg

SEQ ID NO: 855110 - DNA, 25 bp, Mus musculus
aacccctgccccaatgacccatgcc

SEQ ID NO: 855111 - DNA, 25 bp, Mus musculus
aacccctgcccctatgacccatgcc

SEQ ID NO: 855112 - DNA, 25 bp, Mus musculus
aacccctgcttgcatggtgccatac

SEQ ID NO: 855113 - DNA, 25 bp, Mus musculus
aacccctgcttggatggtgccatac

SEQ ID NO: 855114 - DNA, 25 bp, Mus musculus
aacccggaccaactctggatgacag

SEQ ID NO: 855115 - DNA, 25 bp, Mus musculus
aacccggaccaagtctggatgacag

SEQ ID NO: 855116 - DNA, 25 bp, Mus musculus
aacccggagaagagcgagcaaatca

SEQ ID NO: 855117 - DNA, 25 bp, Mus musculus
aacccggagaagagggagcaaatca

SEQ ID NO: 855118 - DNA, 25 bp, Mus musculus
aacccggcagaactacacatactca

SEQ ID NO: 855119 - DNA, 25 bp, Mus musculus
aacccggcagtactacacatactca

SEQ ID NO: 855120 - DNA, 25 bp, Mus musculus
aacccgtgagctcaatatccaacac

SEQ ID NO: 855121 - DNA, 25 bp, Mus musculus
aacccgtgaggtcaatatccaacac

SEQ ID NO: 855122 - DNA, 25 bp, Mus musculus
aaccctacatcaccttcctgacgca

SEQ ID NO: 855123 - DNA, 25 bp, Mus musculus
aaccctacatcagcttcctgacgca

SEQ ID NO: 855124 - DNA, 25 bp, Mus musculus
aaccctcatgcattaagtcttgtga

SEQ ID NO: 855125 - DNA, 25 bp, Mus musculus
aaccctcatgcatttagtcttgtga

SEQ ID NO: 855126 - DNA, 25 bp, Mus musculus
aaccctccagaaagccatcgatctg

SEQ ID NO: 855127 - DNA, 25 bp, Mus musculus
aaccctccagtaagccatcgatctg

SEQ ID NO: 855128 - DNA, 25 bp, Mus musculus
aaccctccggaacaatctctgtggc

SEQ ID NO: 855129 - DNA, 25 bp, Mus musculus
aaccctccggaagaatctctgtggc

SEQ ID NO: 855130 - DNA, 25 bp, Mus musculus
aaccctcgagttaacgccacagctt

SEQ ID NO: 855131 - DNA, 25 bp, Mus musculus
aaccctcgagttaaggccacagctt

SEQ ID NO: 855132 - DNA, 25 bp, Mus musculus
aaccctgaagatattgtgaacaagg

SEQ ID NO: 855133 - DNA, 25 bp, Mus musculus
aaccctgaagcatcctcgctctgca

SEQ ID NO: 855134 - DNA, 25 bp, Mus musculus
aaccctgaagcgagcctctgatcta

SEQ ID NO: 855135 - DNA, 25 bp, Mus musculus
aaccctgaaggatcctcgctctgca

SEQ ID NO: 855136 - DNA, 25 bp, Mus musculus
aaccctgaagggagcctctgatcta

SEQ ID NO: 855137 - DNA, 25 bp, Mus musculus
aaccctgaagttattgtgaacaagg

SEQ ID NO: 855138 - DNA, 25 bp, Mus musculus
aaccctgattttaacgtgttcagat

SEQ ID NO: 855139 - DNA, 25 bp, Mus musculus
aaccctgattttaaggtgttcagat

SEQ ID NO: 855140 - DNA, 25 bp, Mus musculus
aaccctgcccagctgaggcaaaagg

SEQ ID NO: 855141 - DNA, 25 bp, Mus musculus
aaccctgcccaggtgaggcaaaagg

SEQ ID NO: 855142 - DNA, 25 bp, Mus musculus
aaccctggacgacccgcgtgtgcag

SEQ ID NO: 855143 - DNA, 25 bp, Mus musculus
aaccctggacgaccctatctggact

SEQ ID NO: 855144 - DNA, 25 bp, Mus musculus
aaccctggacgaccggcgtgtgcag

SEQ ID NO: 855145 - DNA, 25 bp, Mus musculus
aaccctggacgaccgtatctggact

SEQ ID NO: 855146 - DNA, 25 bp, Mus musculus
aaccctggcctgaacatggatcacc

SEQ ID NO: 855147 - DNA, 25 bp, Mus musculus
aaccctggcctgaagatggatcacc

SEQ ID NO: 855148 - DNA, 25 bp, Mus musculus
aaccctgggcaggacatgcagtggg

SEQ ID NO: 855149 - DNA, 25 bp, Mus musculus
aaccctgggcaggagatgcagtggg

SEQ ID NO: 855150 - DNA, 25 bp, Mus musculus
aaccctgtcaagctgggctgtcaac

SEQ ID NO: 855151 - DNA, 25 bp, Mus musculus
aaccctgtcaaggtgggctgtcaac

SEQ ID NO: 855152 - DNA, 25 bp, Mus musculus
aaccctgtgcaacaccaaaatcaaa

SEQ ID NO: 855153 - DNA, 25 bp, Mus musculus
aaccctgtgcaacagcaaaatcaaa

SEQ ID NO: 855154 - DNA, 25 bp, Mus musculus
aacccttctacacaatttatcagtt

SEQ ID NO: 855155 - DNA, 25 bp, Mus musculus
aacccttctacagaatttatcagtt

SEQ ID NO: 855156 - DNA, 25 bp, Mus musculus
aaccgaaaccgcagccttatgatgg

SEQ ID NO: 855157 - DNA, 25 bp, Mus musculus
aaccgaaaccgcaggcttatgatgg

SEQ ID NO: 855158 - DNA, 25 bp, Mus musculus
aaccgaactcagcgattgctttctg

SEQ ID NO: 855159 - DNA, 25 bp, Mus musculus
aaccgaactcagggattgctttctg

SEQ ID NO: 855160 - DNA, 25 bp, Mus musculus
aaccgacacctgagagatgaaggcc

SEQ ID NO: 855161 - DNA, 25 bp, Mus musculus
aaccgacacctgagtgatgaaggcc

SEQ ID NO: 855162 - DNA, 25 bp, Mus musculus
aaccgagaccagatcatcttcatgg

SEQ ID NO: 855163 - DNA, 25 bp, Mus musculus
aaccgagaccagttcatcttcatgg

SEQ ID NO: 855164 - DNA, 25 bp, Mus musculus
aaccgatccaccacagtgcgcctgc

SEQ ID NO: 855165 - DNA, 25 bp, Mus musculus
aaccgatccaccactgtgcgcctgc

SEQ ID NO: 855166 - DNA, 25 bp, Mus musculus
aaccgcacggccttcaacactgacc

SEQ ID NO: 855167 - DNA, 25 bp, Mus musculus
aaccgcacgggcttcaacactgacc

SEQ ID NO: 855168 - DNA, 25 bp, Mus musculus
aaccgcagagagcaactggcccaaa

SEQ ID NO: 855169 - DNA, 25 bp, Mus musculus
aaccgcagagaggaactggcccaaa

SEQ ID NO: 855170 - DNA, 25 bp, Mus musculus
aaccgcattccacagtctgggggag

SEQ ID NO: 855171 - DNA, 25 bp, Mus musculus
aaccgcattccagagtctgggggag

SEQ ID NO: 855172 - DNA, 25 bp, Mus musculus
aaccgccagtacaaggcggataaga

SEQ ID NO: 855173 - DNA, 25 bp, Mus musculus
aaccgccagttcaaggcggataaga

SEQ ID NO: 855174 - DNA, 25 bp, Mus musculus
aaccgcgatgagcctgcccggacca

SEQ ID NO: 855175 - DNA, 25 bp, Mus musculus
aaccgcgatgaggctgcccggacca

SEQ ID NO: 855176 - DNA, 25 bp, Mus musculus
aaccgctcagaacaccatcccctac

SEQ ID NO: 855177 - DNA, 25 bp, Mus musculus
aaccgctcagaacacgtcttcacat

SEQ ID NO: 855178 - DNA, 25 bp, Mus musculus
aaccgctcagaacagcatcccctac

SEQ ID NO: 855179 - DNA, 25 bp, Mus musculus
aaccgctcagaacaggtcttcacat

SEQ ID NO: 855180 - DNA, 25 bp, Mus musculus
aaccggattgagcacttggatgagg

SEQ ID NO: 855181 - DNA, 25 bp, Mus musculus
aaccggattgagcagttggatgagg

SEQ ID NO: 855182 - DNA, 25 bp, Mus musculus
aaccggcagtggcgccgtccagagg

SEQ ID NO: 855183 - DNA, 25 bp, Mus musculus
aaccggcagtggcggcgtccagagg

SEQ ID NO: 855184 - DNA, 25 bp, Mus musculus
aaccggcctgctcatgtgtattcct

SEQ ID NO: 855185 - DNA, 25 bp, Mus musculus
aaccggcctgctgatgtgtattcct

SEQ ID NO: 855186 - DNA, 25 bp, Mus musculus
aaccggcggcagcatgtgtgaccgg

SEQ ID NO: 855187 - DNA, 25 bp, Mus musculus
aaccggcggcaggatgtgtgaccgg

SEQ ID NO: 855188 - DNA, 25 bp, Mus musculus
aaccggcttaatcgtgattttgctc

SEQ ID NO: 855189 - DNA, 25 bp, Mus musculus
aaccggcttaatggtgattttgctc

SEQ ID NO: 855190 - DNA, 25 bp, Mus musculus
aaccgtaacaagcacgctttgacaa

SEQ ID NO: 855191 - DNA, 25 bp, Mus musculus
aaccgtaacaagcaggctttgacaa

SEQ ID NO: 855192 - DNA, 25 bp, Mus musculus
aaccgtagtcagaatgagtctgcat

SEQ ID NO: 855193 - DNA, 25 bp, Mus musculus
aaccgtagtcagtatgagtctgcat

SEQ ID NO: 855194 - DNA, 25 bp, Mus musculus
aaccgtccttggaagatccgccagg

SEQ ID NO: 855195 - DNA, 25 bp, Mus musculus
aaccgtccttggtagatccgccagg

SEQ ID NO: 855196 - DNA, 25 bp, Mus musculus
aaccgtgagccactttacaagattc

SEQ ID NO: 855197 - DNA, 25 bp, Mus musculus
aaccgtgagccagtttacaagattc

SEQ ID NO: 855198 - DNA, 25 bp, Mus musculus
aaccgtgcagcttgagaatgagtac

SEQ ID NO: 855199 - DNA, 25 bp, Mus musculus
aaccgtgcaggttgagaatgagtac

SEQ ID NO: 855200 - DNA, 25 bp, Mus musculus
aaccgtttctccaacgaggatgaag

SEQ ID NO: 855201 - DNA, 25 bp, Mus musculus
aaccgtttctccaaggaggatgaag

SEQ ID NO: 855202 - DNA, 25 bp, Mus musculus
aacctaaacacacggctgtgagtca

SEQ ID NO: 855203 - DNA, 25 bp, Mus musculus
aacctaaacacagggctgtgagtca

SEQ ID NO: 855204 - DNA, 25 bp, Mus musculus
aacctaaaggctatgcatttataga

SEQ ID NO: 855205 - DNA, 25 bp, Mus musculus
aacctaaagggtatgcatttataga

SEQ ID NO: 855206 - DNA, 25 bp, Mus musculus
aacctaaatcagcaattcgtcaaca

SEQ ID NO: 855207 - DNA, 25 bp, Mus musculus
aacctaaatcaggaattcgtcaaca

SEQ ID NO: 855208 - DNA, 25 bp, Mus musculus
aacctaagccagcacgcctcagggc

SEQ ID NO: 855209 - DNA, 25 bp, Mus musculus
aacctaagccagcacggcctgggct

SEQ ID NO: 855210 - DNA, 25 bp, Mus musculus
aacctaagccagcaggcctcagggc

SEQ ID NO: 855211 - DNA, 25 bp, Mus musculus
aacctaagccagcagggcctgggct

SEQ ID NO: 855212 - DNA, 25 bp, Mus musculus
aacctaattgaaaatcattgcatgg

SEQ ID NO: 855213 - DNA, 25 bp, Mus musculus
aacctaattgaatatcattgcatgg

SEQ ID NO: 855214 - DNA, 25 bp, Mus musculus
aacctacaacaacacacagatccag

SEQ ID NO: 855215 - DNA, 25 bp, Mus musculus
aacctacaacaagacacagatccag

SEQ ID NO: 855216 - DNA, 25 bp, Mus musculus
aacctacagatacgtatgtaggatt

SEQ ID NO: 855217 - DNA, 25 bp, Mus musculus
aacctacagataggtatgtaggatt

SEQ ID NO: 855218 - DNA, 25 bp, Mus musculus
aacctagagaagaagcgagatgagc

SEQ ID NO: 855219 - DNA, 25 bp, Mus musculus
aacctagagaagcgagatgagcgca

SEQ ID NO: 855220 - DNA, 25 bp, Mus musculus
aacctagagaagggagatgagcgca

SEQ ID NO: 855221 - DNA, 25 bp, Mus musculus
aacctagagaagtagcgagatgagc

SEQ ID NO: 855222 - DNA, 25 bp, Mus musculus
aacctagagcggctgactgagatac

SEQ ID NO: 855223 - DNA, 25 bp, Mus musculus
aacctagagcgggtgactgagatac

SEQ ID NO: 855224 - DNA, 25 bp, Mus musculus
aacctagctacacaactgtgccgga

SEQ ID NO: 855225 - DNA, 25 bp, Mus musculus
aacctagctacagaactgtgccgga

SEQ ID NO: 855226 - DNA, 25 bp, Mus musculus
aacctatttgactgcttcatggact

SEQ ID NO: 855227 - DNA, 25 bp, Mus musculus
aacctatttgtctgcttcatggact

SEQ ID NO: 855228 - DNA, 25 bp, Mus musculus
aacctcaaataaagaagatacatta

SEQ ID NO: 855229 - DNA, 25 bp, Mus musculus
aacctcaaataatgaagatacatta

SEQ ID NO: 855230 - DNA, 25 bp, Mus musculus
aacctcaactgtctgtgcaacagaa

SEQ ID NO: 855231 - DNA, 25 bp, Mus musculus
aacctcaactgtgtgtgcaacagaa

SEQ ID NO: 855232 - DNA, 25 bp, Mus musculus
aacctcaatgaacgaagtgcttgct

SEQ ID NO: 855233 - DNA, 25 bp, Mus musculus
aacctcaatgaaggaagtgcttgct

SEQ ID NO: 855234 - DNA, 25 bp, Mus musculus
aacctcaattctctggttgaatttt

SEQ ID NO: 855235 - DNA, 25 bp, Mus musculus
aacctcaattctgtggttgaatttt

SEQ ID NO: 855236 - DNA, 25 bp, Mus musculus
aacctcacagatgaaacaggagtat

SEQ ID NO: 855237 - DNA, 25 bp, Mus musculus
aacctcacagttgaaacaggagtat

SEQ ID NO: 855238 - DNA, 25 bp, Mus musculus
aacctcacatacatacctgggagct

SEQ ID NO: 855239 - DNA, 25 bp, Mus musculus
aacctcacatacttacctgggagct

SEQ ID NO: 855240 - DNA, 25 bp, Mus musculus
aacctcactttccaagttataaaca

SEQ ID NO: 855241 - DNA, 25 bp, Mus musculus
aacctcactttccatgttataaaca

SEQ ID NO: 855242 - DNA, 25 bp, Mus musculus
aacctcatccagacctgggctgacg

SEQ ID NO: 855243 - DNA, 25 bp, Mus musculus
aacctcatccagtcctgggctgacg

SEQ ID NO: 855244 - DNA, 25 bp, Mus musculus
aacctcatcttctgcggggcagctg

SEQ ID NO: 855245 - DNA, 25 bp, Mus musculus
aacctcatcttctggggggcagctg

SEQ ID NO: 855246 - DNA, 25 bp, Mus musculus
aacctccaagcctgaagggcacgag

SEQ ID NO: 855247 - DNA, 25 bp, Mus musculus
aacctccaaggctgaagggcacgag

SEQ ID NO: 855248 - DNA, 25 bp, Mus musculus
aacctccgaaccagattcacagatg

SEQ ID NO: 855249 - DNA, 25 bp, Mus musculus
aacctccgaacctgattcacagatg

SEQ ID NO: 855250 - DNA, 25 bp, Mus musculus
aacctcggaacacgatggttcgagg

SEQ ID NO: 855251 - DNA, 25 bp, Mus musculus
aacctcggaacaggatggttcgagg

SEQ ID NO: 855252 - DNA, 25 bp, Mus musculus
aacctcggggaactccctcagtgtg

SEQ ID NO: 855253 - DNA, 25 bp, Mus musculus
aacctcggggaagtccctcagtgtg

SEQ ID NO: 855254 - DNA, 25 bp, Mus musculus
aacctctcaagaaacatgcgccagg

SEQ ID NO: 855255 - DNA, 25 bp, Mus musculus
aacctctcaagaaacgacagatcgt

SEQ ID NO: 855256 - DNA, 25 bp, Mus musculus
aacctctcaagaaagatgcgccagg

SEQ ID NO: 855257 - DNA, 25 bp, Mus musculus
aacctctcaagaaaggacagatcgt

SEQ ID NO: 855258 - DNA, 25 bp, Mus musculus
aacctctcaatttcactcaagagtt

SEQ ID NO: 855259 - DNA, 25 bp, Mus musculus
aacctctcaatttctctcaagagtt

SEQ ID NO: 855260 - DNA, 25 bp, Mus musculus
aacctctctcagcttgtacggcgca

SEQ ID NO: 855261 - DNA, 25 bp, Mus musculus
aacctctctcaggttgtacggcgca

SEQ ID NO: 855262 - DNA, 25 bp, Mus musculus
aacctctgaaacaccctgaagaatg

SEQ ID NO: 855263 - DNA, 25 bp, Mus musculus
aacctctgaaactccctgaagaatg

SEQ ID NO: 855264 - DNA, 25 bp, Mus musculus
aacctcttgccacacgattttgcag

SEQ ID NO: 855265 - DNA, 25 bp, Mus musculus
aacctcttgccacaggattttgcag

SEQ ID NO: 855266 - DNA, 25 bp, Mus musculus
aacctgaaagccaaaggacatggtt

SEQ ID NO: 855267 - DNA, 25 bp, Mus musculus
aacctgaaaggcaaaggacatggtt

SEQ ID NO: 855268 - DNA, 25 bp, Mus musculus
aacctgatgaatgtcccttccgaca

SEQ ID NO: 855269 - DNA, 25 bp, Mus musculus
aacctgatgaatgtgccttccgaca

SEQ ID NO: 855270 - DNA, 25 bp, Mus musculus
aacctgatggtgcacaacaaaagaa

SEQ ID NO: 855271 - DNA, 25 bp, Mus musculus
aacctgatggtgcagaacaaaagaa

SEQ ID NO: 855272 - DNA, 25 bp, Mus musculus
aacctgcaccaacgttccgctgctt

SEQ ID NO: 855273 - DNA, 25 bp, Mus musculus
aacctgcaccaaggttccgctgctt

SEQ ID NO: 855274 - DNA, 25 bp, Mus musculus
aacctgcccaagcacaagctgggac

SEQ ID NO: 855275 - DNA, 25 bp, Mus musculus
aacctgcccaaggacaagctgggac

SEQ ID NO: 855276 - DNA, 25 bp, Mus musculus
aacctgcctatgcaacccccagtcc

SEQ ID NO: 855277 - DNA, 25 bp, Mus musculus
aacctgcctatgcatcccccagtcc

SEQ ID NO: 855278 - DNA, 25 bp, Mus musculus
aacctgctgtataccctggtcagcc

SEQ ID NO: 855279 - DNA, 25 bp, Mus musculus
aacctgctgtataccggtcagctgc

SEQ ID NO: 855280 - DNA, 25 bp, Mus musculus
aacctgctgtatacgctggtcagcc

SEQ ID NO: 855281 - DNA, 25 bp, Mus musculus
aacctgctgtatacgggtcagctgc

SEQ ID NO: 855282 - DNA, 25 bp, Mus musculus
aacctggaggagatcttcctaaagg

SEQ ID NO: 855283 - DNA, 25 bp, Mus musculus
aacctggaggagttcttcctaaagg

SEQ ID NO: 855284 - DNA, 25 bp, Mus musculus
aacctggctgtgcgtggtgagaagc

SEQ ID NO: 855285 - DNA, 25 bp, Mus musculus
aacctggctgtgggtggtgagaagc

SEQ ID NO: 855286 - DNA, 25 bp, Mus musculus
aacctgggctactgcagacatggaa

SEQ ID NO: 855287 - DNA, 25 bp, Mus musculus
aacctgggctactggagacatggaa

SEQ ID NO: 855288 - DNA, 25 bp, Mus musculus
aacctgggctctgtcggggcagctg

SEQ ID NO: 855289 - DNA, 25 bp, Mus musculus
aacctgggctctgtgggggcagctg

SEQ ID NO: 855290 - DNA, 25 bp, Mus musculus
aacctggtctctctctttctcatca

SEQ ID NO: 855291 - DNA, 25 bp, Mus musculus
aacctggtctctgtctttctcatca

SEQ ID NO: 855292 - DNA, 25 bp, Mus musculus
aacctgtatcagaatatgtctgtac

SEQ ID NO: 855293 - DNA, 25 bp, Mus musculus
aacctgtatcagtatatgtctgtac

SEQ ID NO: 855294 - DNA, 25 bp, Mus musculus
aacctgtcagccctgctgtccactc

SEQ ID NO: 855295 - DNA, 25 bp, Mus musculus
aacctgtcaggcctgctgtccactc

SEQ ID NO: 855296 - DNA, 25 bp, Mus musculus
aacctgtccactgctcataaggtcc

SEQ ID NO: 855297 - DNA, 25 bp, Mus musculus
aacctgtccagtgctcataaggtcc

SEQ ID NO: 855298 - DNA, 25 bp, Mus musculus
aacctgtcttaacaccttcacagcc

SEQ ID NO: 855299 - DNA, 25 bp, Mus musculus
aacctgtcttaagaccttcacagcc

SEQ ID NO: 855300 - DNA, 25 bp, Mus musculus
aacctgtgggaactatctcatggtc

SEQ ID NO: 855301 - DNA, 25 bp, Mus musculus
aacctgtgggaagtatctcatggtc

SEQ ID NO: 855302 - DNA, 25 bp, Mus musculus
aacctgttacgcttctacttcatcc

SEQ ID NO: 855303 - DNA, 25 bp, Mus musculus
aacctgttacgcttgtacttcatcc

SEQ ID NO: 855304 - DNA, 25 bp, Mus musculus
aaccttacagccagctgcacaggag

SEQ ID NO: 855305 - DNA, 25 bp, Mus musculus
aaccttacagctcaccaacaagaag

SEQ ID NO: 855306 - DNA, 25 bp, Mus musculus
aaccttacagctcacgaaatggaga

SEQ ID NO: 855307 - DNA, 25 bp, Mus musculus
aaccttacagctcactgcagggagc

SEQ ID NO: 855308 - DNA, 25 bp, Mus musculus
aaccttacagctcagcaacaagaag

SEQ ID NO: 855309 - DNA, 25 bp, Mus musculus
aaccttacagctcaggaaatggaga

SEQ ID NO: 855310 - DNA, 25 bp, Mus musculus
aaccttacaggcagctgcacaggag

SEQ ID NO: 855311 - DNA, 25 bp, Mus musculus
aaccttacaggtcactgcagggagc

SEQ ID NO: 855312 - DNA, 25 bp, Mus musculus
aaccttagcaaacggatattatggt

SEQ ID NO: 855313 - DNA, 25 bp, Mus musculus
aaccttagcaaagggatattatggt

SEQ ID NO: 855314 - DNA, 25 bp, Mus musculus
aaccttattttacactgaaaatgtg

SEQ ID NO: 855315 - DNA, 25 bp, Mus musculus
aaccttattttacagtgaaaatgtg

SEQ ID NO: 855316 - DNA, 25 bp, Mus musculus
aaccttcgaggcctggtgcaagatt

SEQ ID NO: 855317 - DNA, 25 bp, Mus musculus
aaccttcgaggcgtggtgcaagatt

SEQ ID NO: 855318 - DNA, 25 bp, Mus musculus
aaccttctctcactcatgattcctt

SEQ ID NO: 855319 - DNA, 25 bp, Mus musculus
aaccttctctcactgatgattcctt

SEQ ID NO: 855320 - DNA, 25 bp, Mus musculus
aaccttgaaccacaatgtctgtaag

SEQ ID NO: 855321 - DNA, 25 bp, Mus musculus
aaccttgaaccagaatgtctgtaag

SEQ ID NO: 855322 - DNA, 25 bp, Mus musculus
aaccttgttgctctctcgatcctga

SEQ ID NO: 855323 - DNA, 25 bp, Mus musculus
aaccttgttgctctgtcgatcctga

SEQ ID NO: 855324 - DNA, 25 bp, Mus musculus
aacctttaccagacagcactgcatc

SEQ ID NO: 855325 - DNA, 25 bp, Mus musculus
aacctttaccagtcagcactgcatc

SEQ ID NO: 855326 - DNA, 25 bp, Mus musculus
aacgaaacataacgaggaagctcct

SEQ ID NO: 855327 - DNA, 25 bp, Mus musculus
aacgaaacataaggaggaagctcct

SEQ ID NO: 855328 - DNA, 25 bp, Mus musculus
aacgaaagcattaacgcacaaacaa

SEQ ID NO: 855329 - DNA, 25 bp, Mus musculus
aacgaaagcattaaggcacaaacaa

SEQ ID NO: 855330 - DNA, 25 bp, Mus musculus
aacgaacacatacacgcgagaaacc

SEQ ID NO: 855331 - DNA, 25 bp, Mus musculus
aacgaacacatacaggcgagaaacc

SEQ ID NO: 855332 - DNA, 25 bp, Mus musculus
aacgaatcacagcattagtcgtatc

SEQ ID NO: 855333 - DNA, 25 bp, Mus musculus
aacgaatcacaggattagtcgtatc

SEQ ID NO: 855334 - DNA, 25 bp, Mus musculus
aacgacaaaactcctaacccagtag

SEQ ID NO: 855335 - DNA, 25 bp, Mus musculus
aacgacaaaactgctaacccagtag

SEQ ID NO: 855336 - DNA, 25 bp, Mus musculus
aacgacaaggccgattcgacagatc

SEQ ID NO: 855337 - DNA, 25 bp, Mus musculus
aacgacaagggcgattcgacagatc

SEQ ID NO: 855338 - DNA, 25 bp, Mus musculus
aacgaccaagacccaaatggaactt

SEQ ID NO: 855339 - DNA, 25 bp, Mus musculus
aacgaccaagacgcaaatggaactt

SEQ ID NO: 855340 - DNA, 25 bp, Mus musculus
aacgactcactacggaagctatgcg

SEQ ID NO: 855341 - DNA, 25 bp, Mus musculus
aacgactcactagggaagctatgcg

SEQ ID NO: 855342 - DNA, 25 bp, Mus musculus
aacgactggagcccacgagacatcc

SEQ ID NO: 855343 - DNA, 25 bp, Mus musculus
aacgactggagcgcacgagacatcc

SEQ ID NO: 855344 - DNA, 25 bp, Mus musculus
aacgagaaagctgagatctcaatgg

SEQ ID NO: 855345 - DNA, 25 bp, Mus musculus
aacgagaaaggtgagatctcaatgg

SEQ ID NO: 855346 - DNA, 25 bp, Mus musculus
aacgagaaatgacacaaaagaagtt

SEQ ID NO: 855347 - DNA, 25 bp, Mus musculus
aacgagaaatgagacaaaagaagtt

SEQ ID NO: 855348 - DNA, 25 bp, Mus musculus
aacgagaagaaacggctgaaggact

SEQ ID NO: 855349 - DNA, 25 bp, Mus musculus
aacgagaagaaagggctgaaggact

SEQ ID NO: 855350 - DNA, 25 bp, Mus musculus
aacgagaagggggacattgagcagg

SEQ ID NO: 855351 - DNA, 25 bp, Mus musculus
aacgagaagggggagattgagcagg

SEQ ID NO: 855352 - DNA, 25 bp, Mus musculus
aacgagagggctgccatactggttg

SEQ ID NO: 855353 - DNA, 25 bp, Mus musculus
aacgagagggctgcgatactggttg

SEQ ID NO: 855354 - DNA, 25 bp, Mus musculus
aacgagataagagactgggaggcga

SEQ ID NO: 855355 - DNA, 25 bp, Mus musculus
aacgagataagagagtgggaggcga

SEQ ID NO: 855356 - DNA, 25 bp, Mus musculus
aacgagatccgcagaatgttccgga

SEQ ID NO: 855357 - DNA, 25 bp, Mus musculus
aacgagatccgcagaggtttctctg

SEQ ID NO: 855358 - DNA, 25 bp, Mus musculus
aacgagatccgcagtatgttccgga

SEQ ID NO: 855359 - DNA, 25 bp, Mus musculus
aacgagatccgcagtggtttctctg

SEQ ID NO: 855360 - DNA, 25 bp, Mus musculus
aacgagatcgatgcaggtgtgtgtg

SEQ ID NO: 855361 - DNA, 25 bp, Mus musculus
aacgagatcgatgctggtgtgtgtg

SEQ ID NO: 855362 - DNA, 25 bp, Mus musculus
aacgagcaggagctactaaatgcaa

SEQ ID NO: 855363 - DNA, 25 bp, Mus musculus
aacgagcaggaggtactaaatgcaa

SEQ ID NO: 855364 - DNA, 25 bp, Mus musculus
aacgagctagatgatcccgatgatc

SEQ ID NO: 855365 - DNA, 25 bp, Mus musculus
aacgagctagttgatcccgatgatc

SEQ ID NO: 855366 - DNA, 25 bp, Mus musculus
aacgagtagaagatgaaagtctgga

SEQ ID NO: 855367 - DNA, 25 bp, Mus musculus
aacgagtagaagttgaaagtctgga

SEQ ID NO: 855368 - DNA, 25 bp, Mus musculus
aacgagtcggatggcatgtcaggcc

SEQ ID NO: 855369 - DNA, 25 bp, Mus musculus
aacgagtcggcagatggcatgtcag

SEQ ID NO: 855370 - DNA, 25 bp, Mus musculus
aacgagtcgggagatggcatgtcag

SEQ ID NO: 855371 - DNA, 25 bp, Mus musculus
aacgagtcggttggcatgtcaggcc

SEQ ID NO: 855372 - DNA, 25 bp, Mus musculus
aacgatatcaaaccagcatttggca

SEQ ID NO: 855373 - DNA, 25 bp, Mus musculus
aacgatatcaaacctgcatttggca

SEQ ID NO: 855374 - DNA, 25 bp, Mus musculus
aacgatgaaatcaacgaacaagcaa

SEQ ID NO: 855375 - DNA, 25 bp, Mus musculus
aacgatgaaatcaacgtaactatgg

SEQ ID NO: 855376 - DNA, 25 bp, Mus musculus
aacgatgaaatcaaggaacaagcaa

SEQ ID NO: 855377 - DNA, 25 bp, Mus musculus
aacgatgaaatcaaggtaactatgg

SEQ ID NO: 855378 - DNA, 25 bp, Mus musculus
aacgatgaggaccacgtggtagtta

SEQ ID NO: 855379 - DNA, 25 bp, Mus musculus
aacgatgaggaccaggtggtagtta

SEQ ID NO: 855380 - DNA, 25 bp, Mus musculus
aacgatgcagcgagccgaaactcta

SEQ ID NO: 855381 - DNA, 25 bp, Mus musculus
aacgatgcagggagccgaaactcta

SEQ ID NO: 855382 - DNA, 25 bp, Mus musculus
aacgatgtactgactcttttggaaa

SEQ ID NO: 855383 - DNA, 25 bp, Mus musculus
aacgatgtactgtctcttttggaaa

SEQ ID NO: 855384 - DNA, 25 bp, Mus musculus
aacgatgtgctgcagctgttggaca

SEQ ID NO: 855385 - DNA, 25 bp, Mus musculus
aacgatgtgctgctgttggacaaat

SEQ ID NO: 855386 - DNA, 25 bp, Mus musculus
aacgatgtgctggagctgttggaca

SEQ ID NO: 855387 - DNA, 25 bp, Mus musculus
aacgatgtgctggtgttggacaaat

SEQ ID NO: 855388 - DNA, 25 bp, Mus musculus
aacgcatcgtattgacgacagtgtg

SEQ ID NO: 855389 - DNA, 25 bp, Mus musculus
aacgcatcgttttgacgacagtgtg

SEQ ID NO: 855390 - DNA, 25 bp, Mus musculus
aacgcattggccgcctggtggaccg

SEQ ID NO: 855391 - DNA, 25 bp, Mus musculus
aacgcattgggcgcctggtggaccg

SEQ ID NO: 855392 - DNA, 25 bp, Mus musculus
aacgccaacgcaattgccgtgcaga

SEQ ID NO: 855393 - DNA, 25 bp, Mus musculus
aacgccaacgcatttgccgtgcaga

SEQ ID NO: 855394 - DNA, 25 bp, Mus musculus
aacgccatggctcacaagatcctga

SEQ ID NO: 855395 - DNA, 25 bp, Mus musculus
aacgccatggctgacaagatcctga

SEQ ID NO: 855396 - DNA, 25 bp, Mus musculus
aacgcccacccacgttatgaacagg

SEQ ID NO: 855397 - DNA, 25 bp, Mus musculus
aacgcccacccaggttatgaacagg

SEQ ID NO: 855398 - DNA, 25 bp, Mus musculus
aacgccccagctctcttgtgctgta

SEQ ID NO: 855399 - DNA, 25 bp, Mus musculus
aacgccccaggtctcttgtgctgta

SEQ ID NO: 855400 - DNA, 25 bp, Mus musculus
aacgccggcaagcacaagggcgggt

SEQ ID NO: 855401 - DNA, 25 bp, Mus musculus
aacgccggcaagcagaagggcgggt

SEQ ID NO: 855402 - DNA, 25 bp, Mus musculus
aacgcctcagagactccatctccgg

SEQ ID NO: 855403 - DNA, 25 bp, Mus musculus
aacgcctcagtgactccatctccgg

SEQ ID NO: 855404 - DNA, 25 bp, Mus musculus
aacgcctgaggagccggaagaatgg

SEQ ID NO: 855405 - DNA, 25 bp, Mus musculus
aacgcctgaggagcgggaagaatgg

SEQ ID NO: 855406 - DNA, 25 bp, Mus musculus
aacgcctgcaactccgtcataaagc

SEQ ID NO: 855407 - DNA, 25 bp, Mus musculus
aacgcctgcaactcggtcataaagc

SEQ ID NO: 855408 - DNA, 25 bp, Mus musculus
aacgcgaagtctgtcattcgtaaga

SEQ ID NO: 855409 - DNA, 25 bp, Mus musculus
aacgcgaagtctgtgattcgtaaga

SEQ ID NO: 855410 - DNA, 25 bp, Mus musculus
aacgctcagcagactccgttgggta

SEQ ID NO: 855411 - DNA, 25 bp, Mus musculus
aacgctcagcagtctccgttgggta

SEQ ID NO: 855412 - DNA, 25 bp, Mus musculus
aacgctgacaagctgaagaaggaga

SEQ ID NO: 855413 - DNA, 25 bp, Mus musculus
aacgctgacaaggtgaagaaggaga

SEQ ID NO: 855414 - DNA, 25 bp, Mus musculus
aacgctgactttcagaagctgaagc

SEQ ID NO: 855415 - DNA, 25 bp, Mus musculus
aacgctgactttgagaagctgaagc

SEQ ID NO: 855416 - DNA, 25 bp, Mus musculus
aacgctgcaatggacagttgtgatc

SEQ ID NO: 855417 - DNA, 25 bp, Mus musculus
aacgctgcaatggagagttgtgatc

SEQ ID NO: 855418 - DNA, 25 bp, Mus musculus
aacgctgccgccaagttgaagttca

SEQ ID NO: 855419 - DNA, 25 bp, Mus musculus
aacgctgccggcaagttgaagttca

SEQ ID NO: 855420 - DNA, 25 bp, Mus musculus
aacgctggagagatcgccaccggga

SEQ ID NO: 855421 - DNA, 25 bp, Mus musculus
aacgctggagagatggccaccggga

SEQ ID NO: 855422 - DNA, 25 bp, Mus musculus
aacgctggcatcaacgtttggatgc

SEQ ID NO: 855423 - DNA, 25 bp, Mus musculus
aacgctggcatcaaggtttggatgc

SEQ ID NO: 855424 - DNA, 25 bp, Mus musculus
aacgctgtcagtatcttcccgagtg

SEQ ID NO: 855425 - DNA, 25 bp, Mus musculus
aacgctgtcagtttcttcccgagtg

SEQ ID NO: 855426 - DNA, 25 bp, Mus musculus
aacgctgtgacacatctgagcactg

SEQ ID NO: 855427 - DNA, 25 bp, Mus musculus
aacgctgtgacaccacctccgtccg

SEQ ID NO: 855428 - DNA, 25 bp, Mus musculus
aacgctgtgacagatctgagcactg

SEQ ID NO: 855429 - DNA, 25 bp, Mus musculus
aacgctgtgacagcacctccgtccg

SEQ ID NO: 855430 - DNA, 25 bp, Mus musculus
aacggaaatctactgttctccagtt

SEQ ID NO: 855431 - DNA, 25 bp, Mus musculus
aacggaaatctagtgttctccagtt

SEQ ID NO: 855432 - DNA, 25 bp, Mus musculus
aacggaaatgctctttcttcaggtt

SEQ ID NO: 855433 - DNA, 25 bp, Mus musculus
aacggaaatgctgtttcttcaggtt

SEQ ID NO: 855434 - DNA, 25 bp, Mus musculus
aacggacacacactatcgatcgatc

SEQ ID NO: 855435 - DNA, 25 bp, Mus musculus
aacggacacacacttgatccgagga

SEQ ID NO: 855436 - DNA, 25 bp, Mus musculus
aacggacacacagtatcgatcgatc

SEQ ID NO: 855437 - DNA, 25 bp, Mus musculus
aacggacacacagttgatccgagga

SEQ ID NO: 855438 - DNA, 25 bp, Mus musculus
aacggacttgatcctgagcccctgc

SEQ ID NO: 855439 - DNA, 25 bp, Mus musculus
aacggacttgatgctgagcccctgc

SEQ ID NO: 855440 - DNA, 25 bp, Mus musculus
aacggagacatgcgcggtatggcct

SEQ ID NO: 855441 - DNA, 25 bp, Mus musculus
aacggagacatgggcggtatggcct

SEQ ID NO: 855442 - DNA, 25 bp, Mus musculus
aacggagagatacatctagctagtg

SEQ ID NO: 855443 - DNA, 25 bp, Mus musculus
aacggagagatagatctagctagtg

SEQ ID NO: 855444 - DNA, 25 bp, Mus musculus
aacggaggcagaacacagttcgatc

SEQ ID NO: 855445 - DNA, 25 bp, Mus musculus
aacggaggcagatcacagttcgatc

SEQ ID NO: 855446 - DNA, 25 bp, Mus musculus
aacggatatgagaactcaaactaca

SEQ ID NO: 855447 - DNA, 25 bp, Mus musculus
aacggatatgagaagtcaaactaca

SEQ ID NO: 855448 - DNA, 25 bp, Mus musculus
aacggatccctgcgctcgggcgata

SEQ ID NO: 855449 - DNA, 25 bp, Mus musculus
aacggatccctgggctcgggcgata

SEQ ID NO: 855450 - DNA, 25 bp, Mus musculus
aacggattttcgcaagtcaagcatt

SEQ ID NO: 855451 - DNA, 25 bp, Mus musculus
aacggattttggcaagtcaagcatt

SEQ ID NO: 855452 - DNA, 25 bp, Mus musculus
aacggcacacagagtggacttgatt

SEQ ID NO: 855453 - DNA, 25 bp, Mus musculus
aacggcacacagtgtggacttgatt

SEQ ID NO: 855454 - DNA, 25 bp, Mus musculus
aacggcatggccaactatacctccg

SEQ ID NO: 855455 - DNA, 25 bp, Mus musculus
aacggcatggccaagtatacctccg

SEQ ID NO: 855456 - DNA, 25 bp, Mus musculus
aacggccacatccacattgtgaaga

SEQ ID NO: 855457 - DNA, 25 bp, Mus musculus
aacggccacatccagattgtgaaga

SEQ ID NO: 855458 - DNA, 25 bp, Mus musculus
aacggcctgagacgctggtttccag

SEQ ID NO: 855459 - DNA, 25 bp, Mus musculus
aacggcctgagaggctggtttccag

SEQ ID NO: 855460 - DNA, 25 bp, Mus musculus
aacggcgatgctttccgtcagaata

SEQ ID NO: 855461 - DNA, 25 bp, Mus musculus
aacggcgatggtttccgtcagaata

SEQ ID NO: 855462 - DNA, 25 bp, Mus musculus
aacggcgcctcgcctggacattgtg

SEQ ID NO: 855463 - DNA, 25 bp, Mus musculus
aacggcgcctcggctggacattgtg

SEQ ID NO: 855464 - DNA, 25 bp, Mus musculus
aacggcgctccgcccattcctttgt

SEQ ID NO: 855465 - DNA, 25 bp, Mus musculus
aacggcgctccgcccgtgagcacga

SEQ ID NO: 855466 - DNA, 25 bp, Mus musculus
aacggcgctccgccgattcctttgt

SEQ ID NO: 855467 - DNA, 25 bp, Mus musculus
aacggcgctccgccggtgagcacga

SEQ ID NO: 855468 - DNA, 25 bp, Mus musculus
aacgggactgtgaaatgggcctgct

SEQ ID NO: 855469 - DNA, 25 bp, Mus musculus
aacgggactgtgtaatgggcctgct

SEQ ID NO: 855470 - DNA, 25 bp, Mus musculus
aacgggcataaacgttacatatatg

SEQ ID NO: 855471 - DNA, 25 bp, Mus musculus
aacgggcataaaggttacatatatg

SEQ ID NO: 855472 - DNA, 25 bp, Mus musculus
aacggggactgagccgtcttgacga

SEQ ID NO: 855473 - DNA, 25 bp, Mus musculus
aacggggactgagcggtcttgacga

SEQ ID NO: 855474 - DNA, 25 bp, Mus musculus
aacgggggagagctcttcttccatc

SEQ ID NO: 855475 - DNA, 25 bp, Mus musculus
aacgggggagaggtcttcttccatc

SEQ ID NO: 855476 - DNA, 25 bp, Mus musculus
aacggtgcacatctcaatgcccaga

SEQ ID NO: 855477 - DNA, 25 bp, Mus musculus
aacggtgcacatgtcaatgcccaga

SEQ ID NO: 855478 - DNA, 25 bp, Mus musculus
aacggtgcagatgtcgacgatttca

SEQ ID NO: 855479 - DNA, 25 bp, Mus musculus
aacggtgcagttgtcgacgatttca

SEQ ID NO: 855480 - DNA, 25 bp, Mus musculus
aacggtgcggcagcgtgcttccggc

SEQ ID NO: 855481 - DNA, 25 bp, Mus musculus
aacggtgcgggagcgtgcttccggc

SEQ ID NO: 855482 - DNA, 25 bp, Mus musculus
aacggtttgaagctccctgcataga

SEQ ID NO: 855483 - DNA, 25 bp, Mus musculus
aacggtttgaaggtccctgcataga

SEQ ID NO: 855484 - DNA, 25 bp, Mus musculus
aacgtacacatacacgagagaagaa

SEQ ID NO: 855485 - DNA, 25 bp, Mus musculus
aacgtacacatacaggagagaagaa

SEQ ID NO: 855486 - DNA, 25 bp, Mus musculus
aacgtactaaaactgtgcagggcta

SEQ ID NO: 855487 - DNA, 25 bp, Mus musculus
aacgtactaaaagtgtgcagggcta

SEQ ID NO: 855488 - DNA, 25 bp, Mus musculus
aacgtcaaactggacgaaagcacag

SEQ ID NO: 855489 - DNA, 25 bp, Mus musculus
aacgtcaaactggaggaaagcacag

SEQ ID NO: 855490 - DNA, 25 bp, Mus musculus
aacgtcacagccatatatcgagcag

SEQ ID NO: 855491 - DNA, 25 bp, Mus musculus
aacgtcacaggcatatatcgagcag

SEQ ID NO: 855492 - DNA, 25 bp, Mus musculus
aacgtcatcactgcagttctgatct

SEQ ID NO: 855493 - DNA, 25 bp, Mus musculus
aacgtcatcactgctgttctgatct

SEQ ID NO: 855494 - DNA, 25 bp, Mus musculus
aacgtcattgagctggagcatcagt

SEQ ID NO: 855495 - DNA, 25 bp, Mus musculus
aacgtcattgaggtggagcatcagt

SEQ ID NO: 855496 - DNA, 25 bp, Mus musculus
aacgtccaggcatgtgagacaacgg

SEQ ID NO: 855497 - DNA, 25 bp, Mus musculus
aacgtccagggatgtgagacaacgg

SEQ ID NO: 855498 - DNA, 25 bp, Mus musculus
aacgtccgagattgttgccagtgcc

SEQ ID NO: 855499 - DNA, 25 bp, Mus musculus
aacgtccgagtttgttgccagtgcc

SEQ ID NO: 855500 - DNA, 25 bp, Mus musculus
aacgtcctgacaatgcagaccttgc

SEQ ID NO: 855501 - DNA, 25 bp, Mus musculus
aacgtcctgacattgcagaccttgc

SEQ ID NO: 855502 - DNA, 25 bp, Mus musculus
aacgtctgcattcaatgtaactgta

SEQ ID NO: 855503 - DNA, 25 bp, Mus musculus
aacgtctgcattgaatgtaactgta

SEQ ID NO: 855504 - DNA, 25 bp, Mus musculus
aacgtctgcgccagcatccgcctct

SEQ ID NO: 855505 - DNA, 25 bp, Mus musculus
aacgtctgcgccaggatccgcctct

SEQ ID NO: 855506 - DNA, 25 bp, Mus musculus
aacgtgaaggtcatcagatcagccc

SEQ ID NO: 855507 - DNA, 25 bp, Mus musculus
aacgtgaaggtcatgagatcagccc

SEQ ID NO: 855508 - DNA, 25 bp, Mus musculus
aacgtgagagatctcaagcagataa

SEQ ID NO: 855509 - DNA, 25 bp, Mus musculus
aacgtgagagatctgaagcagataa

SEQ ID NO: 855510 - DNA, 25 bp, Mus musculus
aacgtgcaagcaagccagcattttt

SEQ ID NO: 855511 - DNA, 25 bp, Mus musculus
aacgtgcaaggaagccagcattttt

SEQ ID NO: 855512 - DNA, 25 bp, Mus musculus
aacgtgcgcctgcacgtctctgcaa

SEQ ID NO: 855513 - DNA, 25 bp, Mus musculus
aacgtgcgcctgcacgtggtggtgg

SEQ ID NO: 855514 - DNA, 25 bp, Mus musculus
aacgtgcgcctgcacgttcacattg

SEQ ID NO: 855515 - DNA, 25 bp, Mus musculus
aacgtgcgcctgcaggtctctgcaa

SEQ ID NO: 855516 - DNA, 25 bp, Mus musculus
aacgtgcgcctgcaggtggtggtgg

SEQ ID NO: 855517 - DNA, 25 bp, Mus musculus
aacgtgcgcctgcaggttcacattg

SEQ ID NO: 855518 - DNA, 25 bp, Mus musculus
aacgtggaagcagcctgtgattctc

SEQ ID NO: 855519 - DNA, 25 bp, Mus musculus
aacgtggaagccctctgctcatcac

SEQ ID NO: 855520 - DNA, 25 bp, Mus musculus
aacgtggaaggagcctgtgattctc

SEQ ID NO: 855521 - DNA, 25 bp, Mus musculus
aacgtggaaggcctctgctcatcac

SEQ ID NO: 855522 - DNA, 25 bp, Mus musculus
aacgtggactcacacatataaagaa

SEQ ID NO: 855523 - DNA, 25 bp, Mus musculus
aacgtggactcagacatataaagaa

SEQ ID NO: 855524 - DNA, 25 bp, Mus musculus
aacgtggcccatcttttcttggaag

SEQ ID NO: 855525 - DNA, 25 bp, Mus musculus
aacgtggcccatgttttcttggaag

SEQ ID NO: 855526 - DNA, 25 bp, Mus musculus
aacgtggtgaagaacgttcattatg

SEQ ID NO: 855527 - DNA, 25 bp, Mus musculus
aacgtggtgaagaaggttcattatg

SEQ ID NO: 855528 - DNA, 25 bp, Mus musculus
aacgtggtttatatccattcacatc

SEQ ID NO: 855529 - DNA, 25 bp, Mus musculus
aacgtggtttatatccttgtgggct

SEQ ID NO: 855530 - DNA, 25 bp, Mus musculus
aacgtggtttatatgcattcacatc

SEQ ID NO: 855531 - DNA, 25 bp, Mus musculus
aacgtggtttatatgcttgtgggct

SEQ ID NO: 855532 - DNA, 25 bp, Mus musculus
aacgtgtccaagacttggctactga

SEQ ID NO: 855533 - DNA, 25 bp, Mus musculus
aacgtgtccaagtcttggctactga

SEQ ID NO: 855534 - DNA, 25 bp, Mus musculus
aacgttacaacagattgttctaaca

SEQ ID NO: 855535 - DNA, 25 bp, Mus musculus
aacgttacaagagattgttctaaca

SEQ ID NO: 855536 - DNA, 25 bp, Mus musculus
aacgttcaagctctcactcatggac

SEQ ID NO: 855537 - DNA, 25 bp, Mus musculus
aacgttcaaggtctcactcatggac

SEQ ID NO: 855538 - DNA, 25 bp, Mus musculus
aacgttttcgagcagagtttgaaag

SEQ ID NO: 855539 - DNA, 25 bp, Mus musculus
aacgttttcgtgcagagtttgaaag

SEQ ID NO: 855540 - DNA, 25 bp, Mus musculus
aactaaactaaacattgcgcagctg

SEQ ID NO: 855541 - DNA, 25 bp, Mus musculus
aactaaactaaagattgcgcagctg

SEQ ID NO: 855542 - DNA, 25 bp, Mus musculus
aactaaagccaggaccagcaggtgg

SEQ ID NO: 855543 - DNA, 25 bp, Mus musculus
aactaaagccaggaccaggtggatg

SEQ ID NO: 855544 - DNA, 25 bp, Mus musculus
aactaaagccaggagcagcaggtgg

SEQ ID NO: 855545 - DNA, 25 bp, Mus musculus
aactaaagccaggagcaggtggatg

SEQ ID NO: 855546 - DNA, 25 bp, Mus musculus
aactaaccagattgaatgtcaccca

SEQ ID NO: 855547 - DNA, 25 bp, Mus musculus
aactaaccagtttgaatgtcaccca

SEQ ID NO: 855548 - DNA, 25 bp, Mus musculus
aactaagactaaatcggtgaccgag

SEQ ID NO: 855549 - DNA, 25 bp, Mus musculus
aactaagactaaatgggtgaccgag

SEQ ID NO: 855550 - DNA, 25 bp, Mus musculus
aactaagcagaacaagccatccagt

SEQ ID NO: 855551 - DNA, 25 bp, Mus musculus
aactaagcagcaagcagaacaagcc

SEQ ID NO: 855552 - DNA, 25 bp, Mus musculus
aactaagcaggaagcagaacaagcc

SEQ ID NO: 855553 - DNA, 25 bp, Mus musculus
aactaagcagtacaagccatccagt

SEQ ID NO: 855554 - DNA, 25 bp, Mus musculus
aactacaagatccactcactgggcc

SEQ ID NO: 855555 - DNA, 25 bp, Mus musculus
aactacaagatccagtcactgggcc

SEQ ID NO: 855556 - DNA, 25 bp, Mus musculus
aactacaagtctacatctctcccag

SEQ ID NO: 855557 - DNA, 25 bp, Mus musculus
aactacaagtctacttctctcccag

SEQ ID NO: 855558 - DNA, 25 bp, Mus musculus
aactacaatgagaacatctatgagc

SEQ ID NO: 855559 - DNA, 25 bp, Mus musculus
aactacaatgagaagatctatgagc

SEQ ID NO: 855560 - DNA, 25 bp, Mus musculus
aactacacaatggaccatatccgtg

SEQ ID NO: 855561 - DNA, 25 bp, Mus musculus
aactacacaatggagcatatccgtg

SEQ ID NO: 855562 - DNA, 25 bp, Mus musculus
aactacaccatccacaaactcatcg

SEQ ID NO: 855563 - DNA, 25 bp, Mus musculus
aactacaccatccagaaactcatcg

SEQ ID NO: 855564 - DNA, 25 bp, Mus musculus
aactacatgtgtaacgaggtgatcc

SEQ ID NO: 855565 - DNA, 25 bp, Mus musculus
aactacatgtgtaaggaggtgatcc

SEQ ID NO: 855566 - DNA, 25 bp, Mus musculus
aactacattcttcacgtcgttatca

SEQ ID NO: 855567 - DNA, 25 bp, Mus musculus
aactacattcttcaggtcgttatca

SEQ ID NO: 855568 - DNA, 25 bp, Mus musculus
aactacattgatttcatcttccaca

SEQ ID NO: 855569 - DNA, 25 bp, Mus musculus
aactacattgccaaccgaggtccct

SEQ ID NO: 855570 - DNA, 25 bp, Mus musculus
aactacattggcaaccgaggtccct

SEQ ID NO: 855571 - DNA, 25 bp, Mus musculus
aactacattgttttcatcttccaca

SEQ ID NO: 855572 - DNA, 25 bp, Mus musculus
aactaccaagcatctatatttgcgg

SEQ ID NO: 855573 - DNA, 25 bp, Mus musculus
aactaccaaggatctatatttgcgg

SEQ ID NO: 855574 - DNA, 25 bp, Mus musculus
aactaccaccagaacatagtgaaat

SEQ ID NO: 855575 - DNA, 25 bp, Mus musculus
aactaccaccagtacatagtgaaat

SEQ ID NO: 855576 - DNA, 25 bp, Mus musculus
aactaccatgcacgttactccatgt

SEQ ID NO: 855577 - DNA, 25 bp, Mus musculus
aactaccatgcaggttactccatgt

SEQ ID NO: 855578 - DNA, 25 bp, Mus musculus
aactacctcagtcgtaatcattgca

SEQ ID NO: 855579 - DNA, 25 bp, Mus musculus
aactacctcagtggtaatcattgca

SEQ ID NO: 855580 - DNA, 25 bp, Mus musculus
aactacctccgactctgtgtgatac

SEQ ID NO: 855581 - DNA, 25 bp, Mus musculus
aactacctccgagtctgtgtgatac

SEQ ID NO: 855582 - DNA, 25 bp, Mus musculus
aactacctggatccccagtactatg

SEQ ID NO: 855583 - DNA, 25 bp, Mus musculus
aactacctggatgcccagtactatg

SEQ ID NO: 855584 - DNA, 25 bp, Mus musculus
aactacggaaagaatgatgaagtgg

SEQ ID NO: 855585 - DNA, 25 bp, Mus musculus
aactacggaaagatcagaaacatcg

SEQ ID NO: 855586 - DNA, 25 bp, Mus musculus
aactacggaaagctgactcagaact

SEQ ID NO: 855587 - DNA, 25 bp, Mus musculus
aactacggaaaggtgactcagaact

SEQ ID NO: 855588 - DNA, 25 bp, Mus musculus
aactacggaaagtatgatgaagtgg

SEQ ID NO: 855589 - DNA, 25 bp, Mus musculus
aactacggaaagttcagaaacatcg

SEQ ID NO: 855590 - DNA, 25 bp, Mus musculus
aactacgtgaagcaatggagacatt

SEQ ID NO: 855591 - DNA, 25 bp, Mus musculus
aactacgtgaaggaatggagacatt

SEQ ID NO: 855592 - DNA, 25 bp, Mus musculus
aactactgcgaggaggcggtgggag

SEQ ID NO: 855593 - DNA, 25 bp, Mus musculus
aactactgcgtggaggcggtgggag

SEQ ID NO: 855594 - DNA, 25 bp, Mus musculus
aactactggcaccatcctcaccacg

SEQ ID NO: 855595 - DNA, 25 bp, Mus musculus
aactactggcacgatcctcaccacg

SEQ ID NO: 855596 - DNA, 25 bp, Mus musculus
aactagaaacccagaactggagcaa

SEQ ID NO: 855597 - DNA, 25 bp, Mus musculus
aactagaaaccctgaactggagcaa

SEQ ID NO: 855598 - DNA, 25 bp, Mus musculus
aactagcaagcttgcagggcttgaa

SEQ ID NO: 855599 - DNA, 25 bp, Mus musculus
aactagcaaggttgcagggcttgaa

SEQ ID NO: 855600 - DNA, 25 bp, Mus musculus
aactataaagatgtggtgacagtcc

SEQ ID NO: 855601 - DNA, 25 bp, Mus musculus
aactataaagttgtggtgacagtcc

SEQ ID NO: 855602 - DNA, 25 bp, Mus musculus
aactatagagctgccttggagcact

SEQ ID NO: 855603 - DNA, 25 bp, Mus musculus
aactatagaggtgccttggagcact

SEQ ID NO: 855604 - DNA, 25 bp, Mus musculus
aactatatacagcctacagacaaga

SEQ ID NO: 855605 - DNA, 25 bp, Mus musculus
aactatatacaggctacagacaaga

SEQ ID NO: 855606 - DNA, 25 bp, Mus musculus
aactatatggaccaacctcggaggc

SEQ ID NO: 855607 - DNA, 25 bp, Mus musculus
aactatatggacgaacctcggaggc

SEQ ID NO: 855608 - DNA, 25 bp, Mus musculus
aactatccaactcacgttctcggta

SEQ ID NO: 855609 - DNA, 25 bp, Mus musculus
aactatccaactcaggttctcggta

SEQ ID NO: 855610 - DNA, 25 bp, Mus musculus
aactatcccgaggtctccattgagg

SEQ ID NO: 855611 - DNA, 25 bp, Mus musculus
aactatcccgtggtctccattgagg

SEQ ID NO: 855612 - DNA, 25 bp, Mus musculus
aactatgaagaattcgtacagatga

SEQ ID NO: 855613 - DNA, 25 bp, Mus musculus
aactatgaagtattcgtacagatga

SEQ ID NO: 855614 - DNA, 25 bp, Mus musculus
aactatgaatagaggcaaatttttg

SEQ ID NO: 855615 - DNA, 25 bp, Mus musculus
aactatgaatagtggcaaatttttg

SEQ ID NO: 855616 - DNA, 25 bp, Mus musculus
aactatgaccatctggtgctgggag

SEQ ID NO: 855617 - DNA, 25 bp, Mus musculus
aactatgaccatgtggtgctgggag

SEQ ID NO: 855618 - DNA, 25 bp, Mus musculus
aactatgagcagctcaacatggacg

SEQ ID NO: 855619 - DNA, 25 bp, Mus musculus
aactatgagcaggtcaacatggacg

SEQ ID NO: 855620 - DNA, 25 bp, Mus musculus
aactatgatgccctgactcccctac

SEQ ID NO: 855621 - DNA, 25 bp, Mus musculus
aactatgatggcctgactcccctac

SEQ ID NO: 855622 - DNA, 25 bp, Mus musculus
aactatgcagctgtgcattggaatt

SEQ ID NO: 855623 - DNA, 25 bp, Mus musculus
aactatgcaggtgtgcattggaatt

SEQ ID NO: 855624 - DNA, 25 bp, Mus musculus
aactatggtcagattgaccatgggg

SEQ ID NO: 855625 - DNA, 25 bp, Mus musculus
aactatggtcagtttgaccatgggg

SEQ ID NO: 855626 - DNA, 25 bp, Mus musculus
aactcaaaaggacagagaaaattca

SEQ ID NO: 855627 - DNA, 25 bp, Mus musculus
aactcaaaaggagagagaaaattca

SEQ ID NO: 855628 - DNA, 25 bp, Mus musculus
aactcaacatgtatggttttcggaa

SEQ ID NO: 855629 - DNA, 25 bp, Mus musculus
aactcaacatgtttggttttcggaa

SEQ ID NO: 855630 - DNA, 25 bp, Mus musculus
aactcaactaagcggtcactgaatc

SEQ ID NO: 855631 - DNA, 25 bp, Mus musculus
aactcaactaaggggtcactgaatc

SEQ ID NO: 855632 - DNA, 25 bp, Mus musculus
aactcaagaaagatagatttgaatc

SEQ ID NO: 855633 - DNA, 25 bp, Mus musculus
aactcaagaatgatagatttgaatc

SEQ ID NO: 855634 - DNA, 25 bp, Mus musculus
aactcaagagcagcttcctgaagct

SEQ ID NO: 855635 - DNA, 25 bp, Mus musculus
aactcaagaggagcttcctgaagct

SEQ ID NO: 855636 - DNA, 25 bp, Mus musculus
aactcaatcgcgacaaacctgacac

SEQ ID NO: 855637 - DNA, 25 bp, Mus musculus
aactcaatcgggacaaacctgacac

SEQ ID NO: 855638 - DNA, 25 bp, Mus musculus
aactcacaacggacgcctccttggc

SEQ ID NO: 855639 - DNA, 25 bp, Mus musculus
aactcacaacggcattgtcttgggg

SEQ ID NO: 855640 - DNA, 25 bp, Mus musculus
aactcacaacgggattgtcttgggg

SEQ ID NO: 855641 - DNA, 25 bp, Mus musculus
aactcacaacggtcgcctccttggc

SEQ ID NO: 855642 - DNA, 25 bp, Mus musculus
aactcacaacttagctcggaaaacg

SEQ ID NO: 855643 - DNA, 25 bp, Mus musculus
aactcacaactttgctcggaaaacg

SEQ ID NO: 855644 - DNA, 25 bp, Mus musculus
aactcacaagaacaaacatgtcatt

SEQ ID NO: 855645 - DNA, 25 bp, Mus musculus
aactcacaagaacacttccaactga

SEQ ID NO: 855646 - DNA, 25 bp, Mus musculus
aactcacaagaactcgcaatgtgtc

SEQ ID NO: 855647 - DNA, 25 bp, Mus musculus
aactcacaagaagaaacatgtcatt

SEQ ID NO: 855648 - DNA, 25 bp, Mus musculus
aactcacaagaagacttccaactga

SEQ ID NO: 855649 - DNA, 25 bp, Mus musculus
aactcacaagaagtcgcaatgtgtc

SEQ ID NO: 855650 - DNA, 25 bp, Mus musculus
aactcaccctcacggaagtgatttc

SEQ ID NO: 855651 - DNA, 25 bp, Mus musculus
aactcaccctcagggaagtgatttc

SEQ ID NO: 855652 - DNA, 25 bp, Mus musculus
aactcacgccagaatctggaccaga

SEQ ID NO: 855653 - DNA, 25 bp, Mus musculus
aactcacgccagtatctggaccaga

SEQ ID NO: 855654 - DNA, 25 bp, Mus musculus
aactcacttctcaactccaccttgt

SEQ ID NO: 855655 - DNA, 25 bp, Mus musculus
aactcacttctcaagtccaccttgt

SEQ ID NO: 855656 - DNA, 25 bp, Mus musculus
aactcagcacaaaggatcataagag

SEQ ID NO: 855657 - DNA, 25 bp, Mus musculus
aactcagcacaatggatcataagag

SEQ ID NO: 855658 - DNA, 25 bp, Mus musculus
aactcaggaaaacgttggatgtcga

SEQ ID NO: 855659 - DNA, 25 bp, Mus musculus
aactcaggaaaaggttggatgtcga

SEQ ID NO: 855660 - DNA, 25 bp, Mus musculus
aactcaggagagcagccatttattg

SEQ ID NO: 855661 - DNA, 25 bp, Mus musculus
aactcaggagagctacttggaaggc

SEQ ID NO: 855662 - DNA, 25 bp, Mus musculus
aactcaggagaggagccatttattg

SEQ ID NO: 855663 - DNA, 25 bp, Mus musculus
aactcaggagaggtacttggaaggc

SEQ ID NO: 855664 - DNA, 25 bp, Mus musculus
aactcaggcaccagaacgagatctt

SEQ ID NO: 855665 - DNA, 25 bp, Mus musculus
aactcaggcagcagaacgagatctt

SEQ ID NO: 855666 - DNA, 25 bp, Mus musculus
aactcatctagattcggcaaataca

SEQ ID NO: 855667 - DNA, 25 bp, Mus musculus
aactcatctagattgggcaaataca

SEQ ID NO: 855668 - DNA, 25 bp, Mus musculus
aactccaaaagactgtcctgccata

SEQ ID NO: 855669 - DNA, 25 bp, Mus musculus
aactccaaaagagtgtcctgccata

SEQ ID NO: 855670 - DNA, 25 bp, Mus musculus
aactccacactcaacatcaattctc

SEQ ID NO: 855671 - DNA, 25 bp, Mus musculus
aactccacactcaagatcaattctc

SEQ ID NO: 855672 - DNA, 25 bp, Mus musculus
aactccaccaagtatgcggttgaaa

SEQ ID NO: 855673 - DNA, 25 bp, Mus musculus
aactccaccatgtatgcggttgaaa

SEQ ID NO: 855674 - DNA, 25 bp, Mus musculus
aactccacctctccacagaagaatg

SEQ ID NO: 855675 - DNA, 25 bp, Mus musculus
aactccacctctgcacagaagaatg

SEQ ID NO: 855676 - DNA, 25 bp, Mus musculus
aactccacgtgcagcgtctgttgca

SEQ ID NO: 855677 - DNA, 25 bp, Mus musculus
aactccacgtgcagggtctgttgca

SEQ ID NO: 855678 - DNA, 25 bp, Mus musculus
aactccactggagaagaagtggcca

SEQ ID NO: 855679 - DNA, 25 bp, Mus musculus
aactccactggagatgaagtggcca

SEQ ID NO: 855680 - DNA, 25 bp, Mus musculus
aactccagaaatagtggctcccgag

SEQ ID NO: 855681 - DNA, 25 bp, Mus musculus
aactccagaaattgtggctcccgag

SEQ ID NO: 855682 - DNA, 25 bp, Mus musculus
aactccagaagacgcccaacccagc

SEQ ID NO: 855683 - DNA, 25 bp, Mus musculus
aactccagaagaggcccaacccagc

SEQ ID NO: 855684 - DNA, 25 bp, Mus musculus
aactccagtgaacgtcattcagctg

SEQ ID NO: 855685 - DNA, 25 bp, Mus musculus
aactccagtgaaggtcattcagctg

SEQ ID NO: 855686 - DNA, 25 bp, Mus musculus
aactccatcatccgacagcagctcc

SEQ ID NO: 855687 - DNA, 25 bp, Mus musculus
aactccatcatccgacagctccagg

SEQ ID NO: 855688 - DNA, 25 bp, Mus musculus
aactccatcatccgtcagcagctcc

SEQ ID NO: 855689 - DNA, 25 bp, Mus musculus
aactccatcatccgtcagctccagg

SEQ ID NO: 855690 - DNA, 25 bp, Mus musculus
aactccatctttcgtctggctccca

SEQ ID NO: 855691 - DNA, 25 bp, Mus musculus
aactccatctttggtctggctccca

SEQ ID NO: 855692 - DNA, 25 bp, Mus musculus
aactccattcaaagtacgatgagat

SEQ ID NO: 855693 - DNA, 25 bp, Mus musculus
aactccattcaatgtacgatgagat

SEQ ID NO: 855694 - DNA, 25 bp, Mus musculus
aactcccaactacacaaaagcagtc

SEQ ID NO: 855695 - DNA, 25 bp, Mus musculus
aactcccaactacagaaaagcagtc

SEQ ID NO: 855696 - DNA, 25 bp, Mus musculus
aactcccacaagtatgcacataagc

SEQ ID NO: 855697 - DNA, 25 bp, Mus musculus
aactcccacatgtatgcacataagc

SEQ ID NO: 855698 - DNA, 25 bp, Mus musculus
aactccgaagaggactatcccaatg

SEQ ID NO: 855699 - DNA, 25 bp, Mus musculus
aactccgaagtggactatcccaatg

SEQ ID NO: 855700 - DNA, 25 bp, Mus musculus
aactccgacatccatcctgcagtag

SEQ ID NO: 855701 - DNA, 25 bp, Mus musculus
aactccgacatccgcagacagacac

SEQ ID NO: 855702 - DNA, 25 bp, Mus musculus
aactccgacatcctgatccgggcca

SEQ ID NO: 855703 - DNA, 25 bp, Mus musculus
aactccgacatcgatcctgcagtag

SEQ ID NO: 855704 - DNA, 25 bp, Mus musculus
aactccgacatcggcagacagacac

SEQ ID NO: 855705 - DNA, 25 bp, Mus musculus
aactccgacatcgtgatccgggcca

SEQ ID NO: 855706 - DNA, 25 bp, Mus musculus
aactccgtgttgcgagatggcaaat

SEQ ID NO: 855707 - DNA, 25 bp, Mus musculus
aactccgtgttgggagatggcaaat

SEQ ID NO: 855708 - DNA, 25 bp, Mus musculus
aactcctggattctcgcattaatgt

SEQ ID NO: 855709 - DNA, 25 bp, Mus musculus
aactcctggattctggcattaatgt

SEQ ID NO: 855710 - DNA, 25 bp, Mus musculus
aactcctgtccacagccgagtggtc

SEQ ID NO: 855711 - DNA, 25 bp, Mus musculus
aactcctgtccagagccgagtggtc

SEQ ID NO: 855712 - DNA, 25 bp, Mus musculus
aactccttgaagctgctaaggaaat

SEQ ID NO: 855713 - DNA, 25 bp, Mus musculus
aactccttgaaggtgctaaggaaat

SEQ ID NO: 855714 - DNA, 25 bp, Mus musculus
aactcgcacctcaccgcctccccga

SEQ ID NO: 855715 - DNA, 25 bp, Mus musculus
aactcgcacctcacggcctccccga

SEQ ID NO: 855716 - DNA, 25 bp, Mus musculus
aactcgcactatcgtccacgcttca

SEQ ID NO: 855717 - DNA, 25 bp, Mus musculus
aactcgcactatggtccacgcttca

SEQ ID NO: 855718 - DNA, 25 bp, Mus musculus
aactcgcggcggaagactgctagct

SEQ ID NO: 855719 - DNA, 25 bp, Mus musculus
aactcgcggcggtagactgctagct

SEQ ID NO: 855720 - DNA, 25 bp, Mus musculus
aactcggacctgcatgctaaaagga

SEQ ID NO: 855721 - DNA, 25 bp, Mus musculus
aactcggacctgctcataagggcta

SEQ ID NO: 855722 - DNA, 25 bp, Mus musculus
aactcggacctggatgctaaaagga

SEQ ID NO: 855723 - DNA, 25 bp, Mus musculus
aactcggacctggtcataagggcta

SEQ ID NO: 855724 - DNA, 25 bp, Mus musculus
aactcggagcagctggagctgatca

SEQ ID NO: 855725 - DNA, 25 bp, Mus musculus
aactcggagcaggtggagctgatca

SEQ ID NO: 855726 - DNA, 25 bp, Mus musculus
aactcggcaaacagttattatcaac

SEQ ID NO: 855727 - DNA, 25 bp, Mus musculus
aactcggcaaactgttattatcaac

SEQ ID NO: 855728 - DNA, 25 bp, Mus musculus
aactcggggtttgcctgaagagaag

SEQ ID NO: 855729 - DNA, 25 bp, Mus musculus
aactcggggtttgcgtgaagagaag

SEQ ID NO: 855730 - DNA, 25 bp, Mus musculus
aactcggttgtgaacggagtgagaa

SEQ ID NO: 855731 - DNA, 25 bp, Mus musculus
aactcggttgtgaagggagtgagaa

SEQ ID NO: 855732 - DNA, 25 bp, Mus musculus
aactcgtcaaagctctcattcagga

SEQ ID NO: 855733 - DNA, 25 bp, Mus musculus
aactcgtcaaaggtctcattcagga

SEQ ID NO: 855734 - DNA, 25 bp, Mus musculus
aactcgtgcaagagctggaatcact

SEQ ID NO: 855735 - DNA, 25 bp, Mus musculus
aactcgtgcaagtgctggaatcact

SEQ ID NO: 855736 - DNA, 25 bp, Mus musculus
aactctaccacactgactcatgttc

SEQ ID NO: 855737 - DNA, 25 bp, Mus musculus
aactctaccacagtgactcatgttc

SEQ ID NO: 855738 - DNA, 25 bp, Mus musculus
aactctatagccttcgaggtggaac

SEQ ID NO: 855739 - DNA, 25 bp, Mus musculus
aactctataggcttcgaggtggaac

SEQ ID NO: 855740 - DNA, 25 bp, Mus musculus
aactctatatgactgttttggcagt

SEQ ID NO: 855741 - DNA, 25 bp, Mus musculus
aactctatatgagtgttttggcagt

SEQ ID NO: 855742 - DNA, 25 bp, Mus musculus
aactctcatgcacttcccagtcaag

SEQ ID NO: 855743 - DNA, 25 bp, Mus musculus
aactctcatgcagttcccagtcaag

SEQ ID NO: 855744 - DNA, 25 bp, Mus musculus
aactctcctgatgacatggctgctc

SEQ ID NO: 855745 - DNA, 25 bp, Mus musculus
aactctcctgatgagatggctgctc

SEQ ID NO: 855746 - DNA, 25 bp, Mus musculus
aactctgaaattgtacaactgtatg

SEQ ID NO: 855747 - DNA, 25 bp, Mus musculus
aactctgaaattgttcaactgtatg

SEQ ID NO: 855748 - DNA, 25 bp, Mus musculus
aactctgaacctctatgaagtctta

SEQ ID NO: 855749 - DNA, 25 bp, Mus musculus
aactctgaacctgtatgaagtctta

SEQ ID NO: 855750 - DNA, 25 bp, Mus musculus
aactctgaagactctgcaggtgcgg

SEQ ID NO: 855751 - DNA, 25 bp, Mus musculus
aactctgaagtctctgcaggtgcgg

SEQ ID NO: 855752 - DNA, 25 bp, Mus musculus
aactctgactttcacctcctgactg

SEQ ID NO: 855753 - DNA, 25 bp, Mus musculus
aactctgactttgacctcctgactg

SEQ ID NO: 855754 - DNA, 25 bp, Mus musculus
aactctgagaagctctattacaatg

SEQ ID NO: 855755 - DNA, 25 bp, Mus musculus
aactctgagaaggtctattacaatg

SEQ ID NO: 855756 - DNA, 25 bp, Mus musculus
aactctgctcagatgtataacttta

SEQ ID NO: 855757 - DNA, 25 bp, Mus musculus
aactctgctcagttgtataacttta

SEQ ID NO: 855758 - DNA, 25 bp, Mus musculus
aactctggcatgcgagctgtgatgg

SEQ ID NO: 855759 - DNA, 25 bp, Mus musculus
aactctggcatgggagctgtgatgg

SEQ ID NO: 855760 - DNA, 25 bp, Mus musculus
aactcttggcattgaccttggccca

SEQ ID NO: 855761 - DNA, 25 bp, Mus musculus
aactcttggctttgaccttggccca

SEQ ID NO: 855762 - DNA, 25 bp, Mus musculus
aactctttgaaaaacgagagcaact

SEQ ID NO: 855763 - DNA, 25 bp, Mus musculus
aactctttgaaaaaggagagcaact

SEQ ID NO: 855764 - DNA, 25 bp, Mus musculus
aactgaaatgctgtttgcgagtaaa

SEQ ID NO: 855765 - DNA, 25 bp, Mus musculus
aactgaaatggtgtttgcgagtaaa

SEQ ID NO: 855766 - DNA, 25 bp, Mus musculus
aactgaagatgaaaaaggtcattta

SEQ ID NO: 855767 - DNA, 25 bp, Mus musculus
aactgaagatgataaaggtcattta

SEQ ID NO: 855768 - DNA, 25 bp, Mus musculus
aactgacattatttcttaatggcca

SEQ ID NO: 855769 - DNA, 25 bp, Mus musculus
aactgacattatttgttaatggcca

SEQ ID NO: 855770 - DNA, 25 bp, Mus musculus
aactgacccagttactccctggcag

SEQ ID NO: 855771 - DNA, 25 bp, Mus musculus
aactgacccagttagtccctggcag

SEQ ID NO: 855772 - DNA, 25 bp, Mus musculus
aactgacctagacactttgaaggat

SEQ ID NO: 855773 - DNA, 25 bp, Mus musculus
aactgacctagacagtttgaaggat

SEQ ID NO: 855774 - DNA, 25 bp, Mus musculus
aactgagatgagtctacattgggcc

SEQ ID NO: 855775 - DNA, 25 bp, Mus musculus
aactgagatgtgtctacattgggcc

SEQ ID NO: 855776 - DNA, 25 bp, Mus musculus
aactgagccaccatgagttcttcat

SEQ ID NO: 855777 - DNA, 25 bp, Mus musculus
aactgagccaccttgagttcttcat

SEQ ID NO: 855778 - DNA, 25 bp, Mus musculus
aactgaggagaactgtgagaaactt

SEQ ID NO: 855779 - DNA, 25 bp, Mus musculus
aactgaggagaagtgtgagaaactt

SEQ ID NO: 855780 - DNA, 25 bp, Mus musculus
aactgatcagcacagcagaacagct

SEQ ID NO: 855781 - DNA, 25 bp, Mus musculus
aactgatcaggacagcagaacagct

SEQ ID NO: 855782 - DNA, 25 bp, Mus musculus
aactgattatccaactctctccaaa

SEQ ID NO: 855783 - DNA, 25 bp, Mus musculus
aactgattatccaagtctctccaaa

SEQ ID NO: 855784 - DNA, 25 bp, Mus musculus
aactgcaaaaacctcaatcagtgcc

SEQ ID NO: 855785 - DNA, 25 bp, Mus musculus
aactgcaaaaacgtcaatcagtgcc

SEQ ID NO: 855786 - DNA, 25 bp, Mus musculus
aactgcaaactgccacgtcctcccc

SEQ ID NO: 855787 - DNA, 25 bp, Mus musculus
aactgcaaactggcacgtcctcccc

SEQ ID NO: 855788 - DNA, 25 bp, Mus musculus
aactgcacatgcttcaacgggacca

SEQ ID NO: 855789 - DNA, 25 bp, Mus musculus
aactgcacatgcttgaacgggacca

SEQ ID NO: 855790 - DNA, 25 bp, Mus musculus
aactgcaccacaccctttttccagg

SEQ ID NO: 855791 - DNA, 25 bp, Mus musculus
aactgcaccacagcctttttccagg

SEQ ID NO: 855792 - DNA, 25 bp, Mus musculus
aactgcattcagcacaggggtccga

SEQ ID NO: 855793 - DNA, 25 bp, Mus musculus
aactgcattcaggacaggggtccga

SEQ ID NO: 855794 - DNA, 25 bp, Mus musculus
aactgcattgagatgggcgggaatc

SEQ ID NO: 855795 - DNA, 25 bp, Mus musculus
aactgcattgtgatgggcgggaatc

SEQ ID NO: 855796 - DNA, 25 bp, Mus musculus
aactgccaagaacgttcaacgggca

SEQ ID NO: 855797 - DNA, 25 bp, Mus musculus
aactgccaagaaggttcaacgggca

SEQ ID NO: 855798 - DNA, 25 bp, Mus musculus
aactgccaagctcacccctggctcc

SEQ ID NO: 855799 - DNA, 25 bp, Mus musculus
aactgccaaggtcacccctggctcc

SEQ ID NO: 855800 - DNA, 25 bp, Mus musculus
aactgccacatccgtgatgccttca

SEQ ID NO: 855801 - DNA, 25 bp, Mus musculus
aactgccacatcggtgatgccttca

SEQ ID NO: 855802 - DNA, 25 bp, Mus musculus
aactgcctaacgagcctcaaggcat

SEQ ID NO: 855803 - DNA, 25 bp, Mus musculus
aactgcctaaggagcctcaaggcat

SEQ ID NO: 855804 - DNA, 25 bp, Mus musculus
aactgcctggatgtagatgagtgtc

SEQ ID NO: 855805 - DNA, 25 bp, Mus musculus
aactgcctggttgtagatgagtgtc

SEQ ID NO: 855806 - DNA, 25 bp, Mus musculus
aactgcgcagcttacatccaggcat

SEQ ID NO: 855807 - DNA, 25 bp, Mus musculus
aactgcgcaggttacatccaggcat

SEQ ID NO: 855808 - DNA, 25 bp, Mus musculus
aactgcgtgccaaacaaggactcca

SEQ ID NO: 855809 - DNA, 25 bp, Mus musculus
aactgcgtgccaaacgactccatga

SEQ ID NO: 855810 - DNA, 25 bp, Mus musculus
aactgcgtgccaaagaaggactcca

SEQ ID NO: 855811 - DNA, 25 bp, Mus musculus
aactgcgtgccaaaggactccatga

SEQ ID NO: 855812 - DNA, 25 bp, Mus musculus
aactgctacaggcttagcattctat

SEQ ID NO: 855813 - DNA, 25 bp, Mus musculus
aactgctacagggttagcattctat

SEQ ID NO: 855814 - DNA, 25 bp, Mus musculus
aactgctagaagctggctcgctggg

SEQ ID NO: 855815 - DNA, 25 bp, Mus musculus
aactgctagaaggtggctcgctggg

SEQ ID NO: 855816 - DNA, 25 bp, Mus musculus
aactgctcacagagtcagtccgacc

SEQ ID NO: 855817 - DNA, 25 bp, Mus musculus
aactgctcacagtgtcagtccgacc

SEQ ID NO: 855818 - DNA, 25 bp, Mus musculus
aactgctcagcaataaagctggctg

SEQ ID NO: 855819 - DNA, 25 bp, Mus musculus
aactgctcaggaataaagctggctg

SEQ ID NO: 855820 - DNA, 25 bp, Mus musculus
aactgctccactactatcagcaatc

SEQ ID NO: 855821 - DNA, 25 bp, Mus musculus
aactgctccacttctatcagcaatc

SEQ ID NO: 855822 - DNA, 25 bp, Mus musculus
aactgctcgtaccacgcacagaaga

SEQ ID NO: 855823 - DNA, 25 bp, Mus musculus
aactgctcgtaccaggcacagaaga

SEQ ID NO: 855824 - DNA, 25 bp, Mus musculus
aactgctgaaagcgctgagagtccg

SEQ ID NO: 855825 - DNA, 25 bp, Mus musculus
aactgctgaatgcgctgagagtccg

SEQ ID NO: 855826 - DNA, 25 bp, Mus musculus
aactgctgcatgcacaacccttacc

SEQ ID NO: 855827 - DNA, 25 bp, Mus musculus
aactgctgcatgcacctggtgcaga

SEQ ID NO: 855828 - DNA, 25 bp, Mus musculus
aactgctgcatgcagaacccttacc

SEQ ID NO: 855829 - DNA, 25 bp, Mus musculus
aactgctgcatgcagctggtgcaga

SEQ ID NO: 855830 - DNA, 25 bp, Mus musculus
aactgctgcttctgcatttatttat

SEQ ID NO: 855831 - DNA, 25 bp, Mus musculus
aactgctgcttctgcctggccggcc

SEQ ID NO: 855832 - DNA, 25 bp, Mus musculus
aactgctgcttctgcgtgccggtga

SEQ ID NO: 855833 - DNA, 25 bp, Mus musculus
aactgctgcttctggatttatttat

SEQ ID NO: 855834 - DNA, 25 bp, Mus musculus
aactgctgcttctggctggccggcc

SEQ ID NO: 855835 - DNA, 25 bp, Mus musculus
aactgctgcttctgggtgccggtga

SEQ ID NO: 855836 - DNA, 25 bp, Mus musculus
aactgctgtcagcggatgggccgag

SEQ ID NO: 855837 - DNA, 25 bp, Mus musculus
aactgctgtcaggggatgggccgag

SEQ ID NO: 855838 - DNA, 25 bp, Mus musculus
aactgcttggcttctccatataacc

SEQ ID NO: 855839 - DNA, 25 bp, Mus musculus
aactgcttgggttctccatataacc

SEQ ID NO: 855840 - DNA, 25 bp, Mus musculus
aactggaaagaatgtcttgattgtt

SEQ ID NO: 855841 - DNA, 25 bp, Mus musculus
aactggaaagcatataattgacact

SEQ ID NO: 855842 - DNA, 25 bp, Mus musculus
aactggaaaggatataattgacact

SEQ ID NO: 855843 - DNA, 25 bp, Mus musculus
aactggaaagtatgtcttgattgtt

SEQ ID NO: 855844 - DNA, 25 bp, Mus musculus
aactggaagaagcggaaagctatgt

SEQ ID NO: 855845 - DNA, 25 bp, Mus musculus
aactggaagaaggggaaagctatgt

SEQ ID NO: 855846 - DNA, 25 bp, Mus musculus
aactggaagcagcacaacaatcctc

SEQ ID NO: 855847 - DNA, 25 bp, Mus musculus
aactggaagcaggacaacaatcctc

SEQ ID NO: 855848 - DNA, 25 bp, Mus musculus
aactggaatcacctggtagatgcaa

SEQ ID NO: 855849 - DNA, 25 bp, Mus musculus
aactggaatcacgtggtagatgcaa

SEQ ID NO: 855850 - DNA, 25 bp, Mus musculus
aactggacagagcagtgtgacaatc

SEQ ID NO: 855851 - DNA, 25 bp, Mus musculus
aactggacagaggagtgtgacaatc

SEQ ID NO: 855852 - DNA, 25 bp, Mus musculus
aactggagacagcacgcacaccaag

SEQ ID NO: 855853 - DNA, 25 bp, Mus musculus
aactggagacagcaggcacaccaag

SEQ ID NO: 855854 - DNA, 25 bp, Mus musculus
aactggagatagaactgtttctcaa

SEQ ID NO: 855855 - DNA, 25 bp, Mus musculus
aactggagatagtactgtttctcaa

SEQ ID NO: 855856 - DNA, 25 bp, Mus musculus
aactggagccaccccaaatctgcca

SEQ ID NO: 855857 - DNA, 25 bp, Mus musculus
aactggagccacgccaaatctgcca

SEQ ID NO: 855858 - DNA, 25 bp, Mus musculus
aactggagcgctgctgggaacgctt

SEQ ID NO: 855859 - DNA, 25 bp, Mus musculus
aactggagcggtgctgggaacgctt

SEQ ID NO: 855860 - DNA, 25 bp, Mus musculus
aactggataacactgcctccggagc

SEQ ID NO: 855861 - DNA, 25 bp, Mus musculus
aactggataacagtgcctccggagc

SEQ ID NO: 855862 - DNA, 25 bp, Mus musculus
aactggatactaaactgtcttgtcc

SEQ ID NO: 855863 - DNA, 25 bp, Mus musculus
aactggatactaaagtgtcttgtcc

SEQ ID NO: 855864 - DNA, 25 bp, Mus musculus
aactggatgataccaggaaaaatgg

SEQ ID NO: 855865 - DNA, 25 bp, Mus musculus
aactggatgatacctggaaaaatgg

SEQ ID NO: 855866 - DNA, 25 bp, Mus musculus
aactggcaagctctggcctgtctcc

SEQ ID NO: 855867 - DNA, 25 bp, Mus musculus
aactggcaaggtctggcctgtctcc

SEQ ID NO: 855868 - DNA, 25 bp, Mus musculus
aactggcaccagctagaaaatctct

SEQ ID NO: 855869 - DNA, 25 bp, Mus musculus
aactggcaccaggtagaaaatctct

SEQ ID NO: 855870 - DNA, 25 bp, Mus musculus
aactggcaggaatgaaccttggctc

SEQ ID NO: 855871 - DNA, 25 bp, Mus musculus
aactggcaggaatgtaccttggctc

SEQ ID NO: 855872 - DNA, 25 bp, Mus musculus
aactggccagacaccttgttgccaa

SEQ ID NO: 855873 - DNA, 25 bp, Mus musculus
aactggccagatccgtctaccttga

SEQ ID NO: 855874 - DNA, 25 bp, Mus musculus
aactggccagccccctgcctttcta

SEQ ID NO: 855875 - DNA, 25 bp, Mus musculus
aactggccaggcccctgcctttcta

SEQ ID NO: 855876 - DNA, 25 bp, Mus musculus
aactggccagtcaccttgttgccaa

SEQ ID NO: 855877 - DNA, 25 bp, Mus musculus
aactggccagttccgtctaccttga

SEQ ID NO: 855878 - DNA, 25 bp, Mus musculus
aactggcccacacgattgcaaatgg

SEQ ID NO: 855879 - DNA, 25 bp, Mus musculus
aactggcccacaggattgcaaatgg

SEQ ID NO: 855880 - DNA, 25 bp, Mus musculus
aactggcgacagccccacatgcagg

SEQ ID NO: 855881 - DNA, 25 bp, Mus musculus
aactggcgacagcctctgatgggcg

SEQ ID NO: 855882 - DNA, 25 bp, Mus musculus
aactggcgacaggcccacatgcagg

SEQ ID NO: 855883 - DNA, 25 bp, Mus musculus
aactggcgacaggctctgatgggcg

SEQ ID NO: 855884 - DNA, 25 bp, Mus musculus
aactggctgaaacacaaacccgtgg

SEQ ID NO: 855885 - DNA, 25 bp, Mus musculus
aactggctgaaagacaaacccgtgg

SEQ ID NO: 855886 - DNA, 25 bp, Mus musculus
aactgggaggagcacatattcagtg

SEQ ID NO: 855887 - DNA, 25 bp, Mus musculus
aactgggaggagcagatattcagtg

SEQ ID NO: 855888 - DNA, 25 bp, Mus musculus
aactgggatgttaacgtgcatggcg

SEQ ID NO: 855889 - DNA, 25 bp, Mus musculus
aactgggatgttaaggtgcatggcg

SEQ ID NO: 855890 - DNA, 25 bp, Mus musculus
aactgggccatggacggaggcacag

SEQ ID NO: 855891 - DNA, 25 bp, Mus musculus
aactgggccatggagggaggcacag

SEQ ID NO: 855892 - DNA, 25 bp, Mus musculus
aactggggtgaacccatacactggg

SEQ ID NO: 855893 - DNA, 25 bp, Mus musculus
aactggggtgaaccgatacactggg

SEQ ID NO: 855894 - DNA, 25 bp, Mus musculus
aactggtcctcgcggcataacgagt

SEQ ID NO: 855895 - DNA, 25 bp, Mus musculus
aactggtcctcggggcataacgagt

SEQ ID NO: 855896 - DNA, 25 bp, Mus musculus
aactggtgccagagcgatgctacca

SEQ ID NO: 855897 - DNA, 25 bp, Mus musculus
aactggtgccagagggatgctacca

SEQ ID NO: 855898 - DNA, 25 bp, Mus musculus
aactgtaccatccctgagatctgga

SEQ ID NO: 855899 - DNA, 25 bp, Mus musculus
aactgtaccatcgctgagatctgga

SEQ ID NO: 855900 - DNA, 25 bp, Mus musculus
aactgtaccgcgatttgcataacca

SEQ ID NO: 855901 - DNA, 25 bp, Mus musculus
aactgtaccgggatttgcataacca

SEQ ID NO: 855902 - DNA, 25 bp, Mus musculus
aactgtagtgtgcagctgaccccag

SEQ ID NO: 855903 - DNA, 25 bp, Mus musculus
aactgtagtgtggagctgaccccag

SEQ ID NO: 855904 - DNA, 25 bp, Mus musculus
aactgtcagacacgtttggccgcaa

SEQ ID NO: 855905 - DNA, 25 bp, Mus musculus
aactgtcagacaggtttggccgcaa

SEQ ID NO: 855906 - DNA, 25 bp, Mus musculus
aactgtcagcctcgtactttctgca

SEQ ID NO: 855907 - DNA, 25 bp, Mus musculus
aactgtcagcctggtactttctgca

SEQ ID NO: 855908 - DNA, 25 bp, Mus musculus
aactgtcagtgatccccaacttcag

SEQ ID NO: 855909 - DNA, 25 bp, Mus musculus
aactgtcagtgatcgccaacttcag

SEQ ID NO: 855910 - DNA, 25 bp, Mus musculus
aactgtccatcccagcagcagcatg

SEQ ID NO: 855911 - DNA, 25 bp, Mus musculus
aactgtccatccgagcagcagcatg

SEQ ID NO: 855912 - DNA, 25 bp, Mus musculus
aactgtcctgagagtactatctgct

SEQ ID NO: 855913 - DNA, 25 bp, Mus musculus
aactgtcctgagtgtactatctgct

SEQ ID NO: 855914 - DNA, 25 bp, Mus musculus
aactgtctaaattgatcagggacca

SEQ ID NO: 855915 - DNA, 25 bp, Mus musculus
aactgtctaatttgatcagggacca

SEQ ID NO: 855916 - DNA, 25 bp, Mus musculus
aactgtctttatccgtctaccttga

SEQ ID NO: 855917 - DNA, 25 bp, Mus musculus
aactgtctttttccgtctaccttga

SEQ ID NO: 855918 - DNA, 25 bp, Mus musculus
aactgtgaaaaagacgcattttata

SEQ ID NO: 855919 - DNA, 25 bp, Mus musculus
aactgtgaaaaagaggcattttata

SEQ ID NO: 855920 - DNA, 25 bp, Mus musculus
aactgtggagaatcacggtgatcgt

SEQ ID NO: 855921 - DNA, 25 bp, Mus musculus
aactgtggagtatcacggtgatcgt

SEQ ID NO: 855922 - DNA, 25 bp, Mus musculus
aactgtgtggacatcaacgaatgca

SEQ ID NO: 855923 - DNA, 25 bp, Mus musculus
aactgtgtggtcatcaacgaatgca

SEQ ID NO: 855924 - DNA, 25 bp, Mus musculus
aactgtgtgtatatccccaaagtca

SEQ ID NO: 855925 - DNA, 25 bp, Mus musculus
aactgtgtgtttatccccaaagtca

SEQ ID NO: 855926 - DNA, 25 bp, Mus musculus
aactgttaggaatgcgatgcagatc

SEQ ID NO: 855927 - DNA, 25 bp, Mus musculus
aactgttaggtatgcgatgcagatc

SEQ ID NO: 855928 - DNA, 25 bp, Mus musculus
aactgttcagacgcctccttggcat

SEQ ID NO: 855929 - DNA, 25 bp, Mus musculus
aactgttcagtcgcctccttggcat

SEQ ID NO: 855930 - DNA, 25 bp, Mus musculus
aactgttctgcacgtacatttgtca

SEQ ID NO: 855931 - DNA, 25 bp, Mus musculus
aactgttctgcaggtacatttgtca

SEQ ID NO: 855932 - DNA, 25 bp, Mus musculus
aacttaatgtcacccataacaaact

SEQ ID NO: 855933 - DNA, 25 bp, Mus musculus
aacttaatgtcagccataacaaact

SEQ ID NO: 855934 - DNA, 25 bp, Mus musculus
aacttacaggagcttgtgccagcca

SEQ ID NO: 855935 - DNA, 25 bp, Mus musculus
aacttacaggaggttgtgccagcca

SEQ ID NO: 855936 - DNA, 25 bp, Mus musculus
aacttatgagacggtacatagccat

SEQ ID NO: 855937 - DNA, 25 bp, Mus musculus
aacttatgagtcggtacatagccat

SEQ ID NO: 855938 - DNA, 25 bp, Mus musculus
aacttatgatatgggacaccagatc

SEQ ID NO: 855939 - DNA, 25 bp, Mus musculus
aacttatgatttgggacaccagatc

SEQ ID NO: 855940 - DNA, 25 bp, Mus musculus
aacttcaaagccattcctgttgatg

SEQ ID NO: 855941 - DNA, 25 bp, Mus musculus
aacttcaaaggcattcctgttgatg

SEQ ID NO: 855942 - DNA, 25 bp, Mus musculus
aacttcacttgtcgtggatccaaca

SEQ ID NO: 855943 - DNA, 25 bp, Mus musculus
aacttcacttgtggtggatccaaca

SEQ ID NO: 855944 - DNA, 25 bp, Mus musculus
aacttcagacaccacgaagcccctg

SEQ ID NO: 855945 - DNA, 25 bp, Mus musculus
aacttcagacaccaggaagcccctg

SEQ ID NO: 855946 - DNA, 25 bp, Mus musculus
aacttcaggagaatcagctatgcta

SEQ ID NO: 855947 - DNA, 25 bp, Mus musculus
aacttcaggagaatgagctatgcta

SEQ ID NO: 855948 - DNA, 25 bp, Mus musculus
aacttcatttatcctagcattaaag

SEQ ID NO: 855949 - DNA, 25 bp, Mus musculus
aacttcatttatgctagcattaaag

SEQ ID NO: 855950 - DNA, 25 bp, Mus musculus
aacttccaaaagcccctgtcatcac

SEQ ID NO: 855951 - DNA, 25 bp, Mus musculus
aacttccaaaaggccctgtcatcac

SEQ ID NO: 855952 - DNA, 25 bp, Mus musculus
aacttccactatcgagctggacacc

SEQ ID NO: 855953 - DNA, 25 bp, Mus musculus
aacttccactatggagctggacacc

SEQ ID NO: 855954 - DNA, 25 bp, Mus musculus
aacttcccacagcgacgactgctgc

SEQ ID NO: 855955 - DNA, 25 bp, Mus musculus
aacttcccacagggacgactgctgc

SEQ ID NO: 855956 - DNA, 25 bp, Mus musculus
aacttccctatagtcaatacttcga

SEQ ID NO: 855957 - DNA, 25 bp, Mus musculus
aacttccctatagtgaatacttcga

SEQ ID NO: 855958 - DNA, 25 bp, Mus musculus
aacttcctagtcttcctgctgggcc

SEQ ID NO: 855959 - DNA, 25 bp, Mus musculus
aacttcctagtcttgctgctgggcc

SEQ ID NO: 855960 - DNA, 25 bp, Mus musculus
aacttcctcgacccatctctccaac

SEQ ID NO: 855961 - DNA, 25 bp, Mus musculus
aacttcctcgtcccatctctccaac

SEQ ID NO: 855962 - DNA, 25 bp, Mus musculus
aacttcctgaagcgtgcccacgtga

SEQ ID NO: 855963 - DNA, 25 bp, Mus musculus
aacttcctgaagggtgcccacgtga

SEQ ID NO: 855964 - DNA, 25 bp, Mus musculus
aacttctatattcacacataccgga

SEQ ID NO: 855965 - DNA, 25 bp, Mus musculus
aacttctatattcagacataccgga

SEQ ID NO: 855966 - DNA, 25 bp, Mus musculus
aacttctcaagactgtgaatgacat

SEQ ID NO: 855967 - DNA, 25 bp, Mus musculus
aacttctcaagagtgtgaatgacat

SEQ ID NO: 855968 - DNA, 25 bp, Mus musculus
aacttctcagacaattgacatatat

SEQ ID NO: 855969 - DNA, 25 bp, Mus musculus
aacttctcagtcaattgacatatat

SEQ ID NO: 855970 - DNA, 25 bp, Mus musculus
aacttctcccagaatacccaggcgt

SEQ ID NO: 855971 - DNA, 25 bp, Mus musculus
aacttctcccagtatacccaggcgt

SEQ ID NO: 855972 - DNA, 25 bp, Mus musculus
aacttctcctcactgtttacaaaat

SEQ ID NO: 855973 - DNA, 25 bp, Mus musculus
aacttctcctcagtgtttacaaaat

SEQ ID NO: 855974 - DNA, 25 bp, Mus musculus
aacttctctgcaaccaagcaacagg

SEQ ID NO: 855975 - DNA, 25 bp, Mus musculus
aacttctctggaaccaagcaacagg

SEQ ID NO: 855976 - DNA, 25 bp, Mus musculus
aacttctgcctaccatcaacgatat

SEQ ID NO: 855977 - DNA, 25 bp, Mus musculus
aacttctgcctacgtatgtctatat

SEQ ID NO: 855978 - DNA, 25 bp, Mus musculus
aacttctgcctacgtcctcaacttt

SEQ ID NO: 855979 - DNA, 25 bp, Mus musculus
aacttctgcctagcatcaacgatat

SEQ ID NO: 855980 - DNA, 25 bp, Mus musculus
aacttctgcctaggtatgtctatat

SEQ ID NO: 855981 - DNA, 25 bp, Mus musculus
aacttctgcctaggtcctcaacttt

SEQ ID NO: 855982 - DNA, 25 bp, Mus musculus
aacttctttaatgcattttacagtg

SEQ ID NO: 855983 - DNA, 25 bp, Mus musculus
aacttctttaatgctttttacagtg

SEQ ID NO: 855984 - DNA, 25 bp, Mus musculus
aacttcttttcacaatgctcatgat

SEQ ID NO: 855985 - DNA, 25 bp, Mus musculus
aacttcttttcacattgctcatgat

SEQ ID NO: 855986 - DNA, 25 bp, Mus musculus
aacttgaatctgaacaggtagaaga

SEQ ID NO: 855987 - DNA, 25 bp, Mus musculus
aacttgaatctgaagaggtagaaga

SEQ ID NO: 855988 - DNA, 25 bp, Mus musculus
aacttgacagccttagaatcagact

SEQ ID NO: 855989 - DNA, 25 bp, Mus musculus
aacttgacaggcttagaatcagact

SEQ ID NO: 855990 - DNA, 25 bp, Mus musculus
aacttgagagctatggatatacaac

SEQ ID NO: 855991 - DNA, 25 bp, Mus musculus
aacttgagagctttggatatacaac

SEQ ID NO: 855992 - DNA, 25 bp, Mus musculus
aacttgatcaaggacgcaggctttc

SEQ ID NO: 855993 - DNA, 25 bp, Mus musculus
aacttgatcaaggaggcaggctttc

SEQ ID NO: 855994 - DNA, 25 bp, Mus musculus
aacttgattatgatgttccagaaga

SEQ ID NO: 855995 - DNA, 25 bp, Mus musculus
aacttgattatgttgttccagaaga

SEQ ID NO: 855996 - DNA, 25 bp, Mus musculus
aacttgcattcacactacttgggat

SEQ ID NO: 855997 - DNA, 25 bp, Mus musculus
aacttgcattcacagtacttgggat

SEQ ID NO: 855998 - DNA, 25 bp, Mus musculus
aacttgctgttcttaatcctgggtg

SEQ ID NO: 855999 - DNA, 25 bp, Mus musculus
aacttgctgttctttatcctgggtg

SEQ ID NO: 856000 - DNA, 25 bp, Mus musculus
aacttggtggatcgatgagtttcat

SEQ ID NO: 856001 - DNA, 25 bp, Mus musculus
aacttggtggatggatgagtttcat

SEQ ID NO: 856002 - DNA, 25 bp, Mus musculus
aacttggtgtggagctgagccctac

SEQ ID NO: 856003 - DNA, 25 bp, Mus musculus
aacttggtgtggtgctgagccctac

SEQ ID NO: 856004 - DNA, 25 bp, Mus musculus
aacttgtcagatgtttctgtggtcg

SEQ ID NO: 856005 - DNA, 25 bp, Mus musculus
aacttgtcagttgtttctgtggtcg

SEQ ID NO: 856006 - DNA, 25 bp, Mus musculus
aacttgttgcgtcgcagtaacggag

SEQ ID NO: 856007 - DNA, 25 bp, Mus musculus
aacttgttgcgtggcagtaacggag

SEQ ID NO: 856008 - DNA, 25 bp, Mus musculus
aactttagagctgccgcatgccttt

SEQ ID NO: 856009 - DNA, 25 bp, Mus musculus
aactttagaggtgccgcatgccttt

SEQ ID NO: 856010 - DNA, 25 bp, Mus musculus
aactttccagctgtctcctgggact

SEQ ID NO: 856011 - DNA, 25 bp, Mus musculus
aactttccaggtgtctcctgggact

SEQ ID NO: 856012 - DNA, 25 bp, Mus musculus
aactttgcacaaatacacactctcc

SEQ ID NO: 856013 - DNA, 25 bp, Mus musculus
aactttgcacaaattcacactctcc

SEQ ID NO: 856014 - DNA, 25 bp, Mus musculus
aactttgcccagctcctgggctgtt

SEQ ID NO: 856015 - DNA, 25 bp, Mus musculus
aactttgcccagctgtggtgtggga

SEQ ID NO: 856016 - DNA, 25 bp, Mus musculus
aactttgcccaggtcctgggctgtt

SEQ ID NO: 856017 - DNA, 25 bp, Mus musculus
aactttgcccaggtgtggtgtggga

SEQ ID NO: 856018 - DNA, 25 bp, Mus musculus
aactttgctaaacatggcagactgt

SEQ ID NO: 856019 - DNA, 25 bp, Mus musculus
aactttgctaaagatggcagactgt

SEQ ID NO: 856020 - DNA, 25 bp, Mus musculus
aactttgtagacacagtccgtgaca

SEQ ID NO: 856021 - DNA, 25 bp, Mus musculus
aactttgtagtcacagtccgtgaca

SEQ ID NO: 856022 - DNA, 25 bp, Mus musculus
aagaaaaaaaatgacatcctgctga

SEQ ID NO: 856023 - DNA, 25 bp, Mus musculus
aagaaaaaaattgacatcctgctga

SEQ ID NO: 856024 - DNA, 25 bp, Mus musculus
aagaaaaaagatcctgtgacatggt

SEQ ID NO: 856025 - DNA, 25 bp, Mus musculus
aagaaaaaagttcctgtgacatggt

SEQ ID NO: 856026 - DNA, 25 bp, Mus musculus
aagaaaaagaccattcacatcattt

SEQ ID NO: 856027 - DNA, 25 bp, Mus musculus
aagaaaaagagcattcacatcattt

SEQ ID NO: 856028 - DNA, 25 bp, Mus musculus
aagaaaacagagacaacataagatc

SEQ ID NO: 856029 - DNA, 25 bp, Mus musculus
aagaaaacagatcatccagaggagt

SEQ ID NO: 856030 - DNA, 25 bp, Mus musculus
aagaaaacagatcgtacaaagaagc

SEQ ID NO: 856031 - DNA, 25 bp, Mus musculus
aagaaaacagatgatccagaggagt

SEQ ID NO: 856032 - DNA, 25 bp, Mus musculus
aagaaaacagatggtacaaagaagc

SEQ ID NO: 856033 - DNA, 25 bp, Mus musculus
aagaaaacagcaatctgcaagcaga

SEQ ID NO: 856034 - DNA, 25 bp, Mus musculus
aagaaaacagcgctattccagatga

SEQ ID NO: 856035 - DNA, 25 bp, Mus musculus
aagaaaacaggaatctgcaagcaga

SEQ ID NO: 856036 - DNA, 25 bp, Mus musculus
aagaaaacagggctattccagatga

SEQ ID NO: 856037 - DNA, 25 bp, Mus musculus
aagaaaacagtgacaacataagatc

SEQ ID NO: 856038 - DNA, 25 bp, Mus musculus
aagaaaaccaacagcgcatgaaaga

SEQ ID NO: 856039 - DNA, 25 bp, Mus musculus
aagaaaaccaacagggcatgaaaga

SEQ ID NO: 856040 - DNA, 25 bp, Mus musculus
aagaaaaccagcaacggccgcctgc

SEQ ID NO: 856041 - DNA, 25 bp, Mus musculus
aagaaaaccagcaagggccgcctgc

SEQ ID NO: 856042 - DNA, 25 bp, Mus musculus
aagaaaactatgcacgtgtgcattg

SEQ ID NO: 856043 - DNA, 25 bp, Mus musculus
aagaaaactatgcaggtgtgcattg

SEQ ID NO: 856044 - DNA, 25 bp, Mus musculus
aagaaaactgtgccaacataacatg

SEQ ID NO: 856045 - DNA, 25 bp, Mus musculus
aagaaaactgtggcaacataacatg

SEQ ID NO: 856046 - DNA, 25 bp, Mus musculus
aagaaaagctgagacaaacgaagtg

SEQ ID NO: 856047 - DNA, 25 bp, Mus musculus
aagaaaagctgagagaaacgaagtg

SEQ ID NO: 856048 - DNA, 25 bp, Mus musculus
aagaaaatactgaattttctcagcg

SEQ ID NO: 856049 - DNA, 25 bp, Mus musculus
aagaaaatactgtattttctcagcg

SEQ ID NO: 856050 - DNA, 25 bp, Mus musculus
aagaaaatgccactgctaatcctcc

SEQ ID NO: 856051 - DNA, 25 bp, Mus musculus
aagaaaatgccagtgctaatcctcc

SEQ ID NO: 856052 - DNA, 25 bp, Mus musculus
aagaaaattaaacatgaactaatga

SEQ ID NO: 856053 - DNA, 25 bp, Mus musculus
aagaaaattaaagatgaactaatga

SEQ ID NO: 856054 - DNA, 25 bp, Mus musculus
aagaaaattgagcccagagtgccca

SEQ ID NO: 856055 - DNA, 25 bp, Mus musculus
aagaaaattgagcccagggattgtg

SEQ ID NO: 856056 - DNA, 25 bp, Mus musculus
aagaaaattgtgcccagagtgccca

SEQ ID NO: 856057 - DNA, 25 bp, Mus musculus
aagaaaattgtgcccagggattgtg

SEQ ID NO: 856058 - DNA, 25 bp, Mus musculus
aagaaacaataaccattgctatggc

SEQ ID NO: 856059 - DNA, 25 bp, Mus musculus
aagaaacaataagcattgctatggc

SEQ ID NO: 856060 - DNA, 25 bp, Mus musculus
aagaaacatcgaaaaccctgctatt

SEQ ID NO: 856061 - DNA, 25 bp, Mus musculus
aagaaacatcgataaccctgctatt

SEQ ID NO: 856062 - DNA, 25 bp, Mus musculus
aagaaacatgcactgataaagcagt

SEQ ID NO: 856063 - DNA, 25 bp, Mus musculus
aagaaacatgcgattactgctgggc

SEQ ID NO: 856064 - DNA, 25 bp, Mus musculus
aagaaacatggactgataaagcagt

SEQ ID NO: 856065 - DNA, 25 bp, Mus musculus
aagaaacatgggattactgctgggc

SEQ ID NO: 856066 - DNA, 25 bp, Mus musculus
aagaaacccagcaggtctctgcggt

SEQ ID NO: 856067 - DNA, 25 bp, Mus musculus
aagaaacccagctggtctctgcggt

SEQ ID NO: 856068 - DNA, 25 bp, Mus musculus
aagaaacgagaacgaacaagagctc

SEQ ID NO: 856069 - DNA, 25 bp, Mus musculus
aagaaacgagaaggaacaagagctc

SEQ ID NO: 856070 - DNA, 25 bp, Mus musculus
aagaaacggaagccatgaaagaagt

SEQ ID NO: 856071 - DNA, 25 bp, Mus musculus
aagaaacggaaggcatgaaagaagt

SEQ ID NO: 856072 - DNA, 25 bp, Mus musculus
aagaaactagcactaactgaagaag

SEQ ID NO: 856073 - DNA, 25 bp, Mus musculus
aagaaactaggactaactgaagaag

SEQ ID NO: 856074 - DNA, 25 bp, Mus musculus
aagaaactcaaccacaaactgaaga

SEQ ID NO: 856075 - DNA, 25 bp, Mus musculus
aagaaactcaaccagaaactgaaga

SEQ ID NO: 856076 - DNA, 25 bp, Mus musculus
aagaaactccagcctgcgctggctg

SEQ ID NO: 856077 - DNA, 25 bp, Mus musculus
aagaaactccaggctgcgctggctg

SEQ ID NO: 856078 - DNA, 25 bp, Mus musculus
aagaaactgcaacggaaagaccatg

SEQ ID NO: 856079 - DNA, 25 bp, Mus musculus
aagaaactgcaagggaaagaccatg

SEQ ID NO: 856080 - DNA, 25 bp, Mus musculus
aagaaactgcctccaagcggcagct

SEQ ID NO: 856081 - DNA, 25 bp, Mus musculus
aagaaactgcctgcaagcggcagct

SEQ ID NO: 856082 - DNA, 25 bp, Mus musculus
aagaaactgggaccctgcctgcagg

SEQ ID NO: 856083 - DNA, 25 bp, Mus musculus
aagaaactgggaccgtgcctgcagg

SEQ ID NO: 856084 - DNA, 25 bp, Mus musculus
aagaaacttcagctggccacagccg

SEQ ID NO: 856085 - DNA, 25 bp, Mus musculus
aagaaacttcaggtggccacagccg

SEQ ID NO: 856086 - DNA, 25 bp, Mus musculus
aagaaagaaatgccaaaagatgtga

SEQ ID NO: 856087 - DNA, 25 bp, Mus musculus
aagaaagaaatggcaaaagatgtga

SEQ ID NO: 856088 - DNA, 25 bp, Mus musculus
aagaaagaacagatgtttatggcat

SEQ ID NO: 856089 - DNA, 25 bp, Mus musculus
aagaaagaacagttgtttatggcat

SEQ ID NO: 856090 - DNA, 25 bp, Mus musculus
aagaaagaactcctcactgtgtttc

SEQ ID NO: 856091 - DNA, 25 bp, Mus musculus
aagaaagaactcgtcactgtgtttc

SEQ ID NO: 856092 - DNA, 25 bp, Mus musculus
aagaaagaagactcctgccagctca

SEQ ID NO: 856093 - DNA, 25 bp, Mus musculus
aagaaagaagtctcctgccagctca

SEQ ID NO: 856094 - DNA, 25 bp, Mus musculus
aagaaagactatcaagttccaagat

SEQ ID NO: 856095 - DNA, 25 bp, Mus musculus
aagaaagactatcaattatttccga

SEQ ID NO: 856096 - DNA, 25 bp, Mus musculus
aagaaagactatcatgttccaagat

SEQ ID NO: 856097 - DNA, 25 bp, Mus musculus
aagaaagactatcatttatttccga

SEQ ID NO: 856098 - DNA, 25 bp, Mus musculus
aagaaagagccacgtgcaaagaagc

SEQ ID NO: 856099 - DNA, 25 bp, Mus musculus
aagaaagagccaggtgcaaagaagc

SEQ ID NO: 856100 - DNA, 25 bp, Mus musculus
aagaaagataatcacattataccga

SEQ ID NO: 856101 - DNA, 25 bp, Mus musculus
aagaaagataatcacccgtggggcc

SEQ ID NO: 856102 - DNA, 25 bp, Mus musculus
aagaaagataatcagattataccga

SEQ ID NO: 856103 - DNA, 25 bp, Mus musculus
aagaaagataatcagccgtggggcc

SEQ ID NO: 856104 - DNA, 25 bp, Mus musculus
aagaaagatcagcaaaagactgata

SEQ ID NO: 856105 - DNA, 25 bp, Mus musculus
aagaaagatcagccgagtactaaca

SEQ ID NO: 856106 - DNA, 25 bp, Mus musculus
aagaaagatcaggaaaagactgata

SEQ ID NO: 856107 - DNA, 25 bp, Mus musculus
aagaaagatcaggcgagtactaaca

SEQ ID NO: 856108 - DNA, 25 bp, Mus musculus
aagaaagccaagcgcgctgatggca

SEQ ID NO: 856109 - DNA, 25 bp, Mus musculus
aagaaagccaagggcgctgatggca

SEQ ID NO: 856110 - DNA, 25 bp, Mus musculus
aagaaagccagtgtctcagttgcag

SEQ ID NO: 856111 - DNA, 25 bp, Mus musculus
aagaaagccagtgtcttgcagggct

SEQ ID NO: 856112 - DNA, 25 bp, Mus musculus
aagaaagccagtgtgtcagttgcag

SEQ ID NO: 856113 - DNA, 25 bp, Mus musculus
aagaaagccagtgtgttgcagggct

SEQ ID NO: 856114 - DNA, 25 bp, Mus musculus
aagaaagcctatatgcttcagtgga

SEQ ID NO: 856115 - DNA, 25 bp, Mus musculus
aagaaagcctatttgcttcagtgga

SEQ ID NO: 856116 - DNA, 25 bp, Mus musculus
aagaaagcggaacctctggaagctg

SEQ ID NO: 856117 - DNA, 25 bp, Mus musculus
aagaaagcggaagctctggaagctg

SEQ ID NO: 856118 - DNA, 25 bp, Mus musculus
aagaaagcttcacgtttggaatggg

SEQ ID NO: 856119 - DNA, 25 bp, Mus musculus
aagaaagcttcaggtttggaatggg

SEQ ID NO: 856120 - DNA, 25 bp, Mus musculus
aagaaaggagacatcggggagcctg

SEQ ID NO: 856121 - DNA, 25 bp, Mus musculus
aagaaaggagacatgggggagcctg

SEQ ID NO: 856122 - DNA, 25 bp, Mus musculus
aagaaaggagatccacatgaaatga

SEQ ID NO: 856123 - DNA, 25 bp, Mus musculus
aagaaaggagatgcacatgaaatga

SEQ ID NO: 856124 - DNA, 25 bp, Mus musculus
aagaaaggttacaacagtgaaacat

SEQ ID NO: 856125 - DNA, 25 bp, Mus musculus
aagaaaggttacaagagtgaaacat

SEQ ID NO: 856126 - DNA, 25 bp, Mus musculus
aagaaagtatcacattctggcacaa

SEQ ID NO: 856127 - DNA, 25 bp, Mus musculus
aagaaagtatcagattctggcacaa

SEQ ID NO: 856128 - DNA, 25 bp, Mus musculus
aagaaagtgaaacaccattgcagca

SEQ ID NO: 856129 - DNA, 25 bp, Mus musculus
aagaaagtgaaagaccattgcagca

SEQ ID NO: 856130 - DNA, 25 bp, Mus musculus
aagaaagtgacacgtggtcgaaatg

SEQ ID NO: 856131 - DNA, 25 bp, Mus musculus
aagaaagtgacaggtggtcgaaatg

SEQ ID NO: 856132 - DNA, 25 bp, Mus musculus
aagaaagttgcaaaaatcttggcaa

SEQ ID NO: 856133 - DNA, 25 bp, Mus musculus
aagaaagttgcaaatgattcattcc

SEQ ID NO: 856134 - DNA, 25 bp, Mus musculus
aagaaagttgcataaatcttggcaa

SEQ ID NO: 856135 - DNA, 25 bp, Mus musculus
aagaaagttgcatatgattcattcc

SEQ ID NO: 856136 - DNA, 25 bp, Mus musculus
aagaaataaccacatatcagttttt

SEQ ID NO: 856137 - DNA, 25 bp, Mus musculus
aagaaataaccacgtgaagcaagat

SEQ ID NO: 856138 - DNA, 25 bp, Mus musculus
aagaaataaccagatatcagttttt

SEQ ID NO: 856139 - DNA, 25 bp, Mus musculus
aagaaataaccaggtgaagcaagat

SEQ ID NO: 856140 - DNA, 25 bp, Mus musculus
aagaaatcagttaacgtcattgttg

SEQ ID NO: 856141 - DNA, 25 bp, Mus musculus
aagaaatcagttaaggtcattgttg

SEQ ID NO: 856142 - DNA, 25 bp, Mus musculus
aagaaatctctataaaattcaactt

SEQ ID NO: 856143 - DNA, 25 bp, Mus musculus
aagaaatctctatataattcaactt

SEQ ID NO: 856144 - DNA, 25 bp, Mus musculus
aagaaatgccaacacatggctgagg

SEQ ID NO: 856145 - DNA, 25 bp, Mus musculus
aagaaatgccaacaccagatggctg

SEQ ID NO: 856146 - DNA, 25 bp, Mus musculus
aagaaatgccaacagatggctgagg

SEQ ID NO: 856147 - DNA, 25 bp, Mus musculus
aagaaatgccaacagcagatggctg

SEQ ID NO: 856148 - DNA, 25 bp, Mus musculus
aagaaatgtcatccaaacttgacat

SEQ ID NO: 856149 - DNA, 25 bp, Mus musculus
aagaaatgtcatgcaaacttgacat

SEQ ID NO: 856150 - DNA, 25 bp, Mus musculus
aagaaattcaagatggttatattaa

SEQ ID NO: 856151 - DNA, 25 bp, Mus musculus
aagaaattcaagttggttatattaa

SEQ ID NO: 856152 - DNA, 25 bp, Mus musculus
aagaaattcgaactcgtgttgatca

SEQ ID NO: 856153 - DNA, 25 bp, Mus musculus
aagaaattcgaactggtgttgatca

SEQ ID NO: 856154 - DNA, 25 bp, Mus musculus
aagaaatttgagccctctggcttct

SEQ ID NO: 856155 - DNA, 25 bp, Mus musculus
aagaaatttgaggcctctggcttct

SEQ ID NO: 856156 - DNA, 25 bp, Mus musculus
aagaacaaaaatccaagctgggcgt

SEQ ID NO: 856157 - DNA, 25 bp, Mus musculus
aagaacaaaaatgcaagctgggcgt

SEQ ID NO: 856158 - DNA, 25 bp, Mus musculus
aagaacaaagagcagaaccacatca

SEQ ID NO: 856159 - DNA, 25 bp, Mus musculus
aagaacaaagaggagaaccacatca

SEQ ID NO: 856160 - DNA, 25 bp, Mus musculus
aagaacaaaggccacctgcaccgct

SEQ ID NO: 856161 - DNA, 25 bp, Mus musculus
aagaacaaaggcgacctgcaccgct

SEQ ID NO: 856162 - DNA, 25 bp, Mus musculus
aagaacaacaagaacctatatgtgg

SEQ ID NO: 856163 - DNA, 25 bp, Mus musculus
aagaacaacaagaagctatatgtgg

SEQ ID NO: 856164 - DNA, 25 bp, Mus musculus
aagaacaagaaaccgacgagccgca

SEQ ID NO: 856165 - DNA, 25 bp, Mus musculus
aagaacaagaaagcgacgagccgca

SEQ ID NO: 856166 - DNA, 25 bp, Mus musculus
aagaacaatgctaccatcacctggg

SEQ ID NO: 856167 - DNA, 25 bp, Mus musculus
aagaacaatggtaccatcacctggg

SEQ ID NO: 856168 - DNA, 25 bp, Mus musculus
aagaacaattgatgcgtgctgttgt

SEQ ID NO: 856169 - DNA, 25 bp, Mus musculus
aagaacaattgatgggtgctgttgt

SEQ ID NO: 856170 - DNA, 25 bp, Mus musculus
aagaacacctacagtgagatgattc

SEQ ID NO: 856171 - DNA, 25 bp, Mus musculus
aagaacaccttcagtgagatgattc

SEQ ID NO: 856172 - DNA, 25 bp, Mus musculus
aagaacagcaaacacacaagctcat

SEQ ID NO: 856173 - DNA, 25 bp, Mus musculus
aagaacagcaaacagacaagctcat

SEQ ID NO: 856174 - DNA, 25 bp, Mus musculus
aagaacagggtccacaacatggctc

SEQ ID NO: 856175 - DNA, 25 bp, Mus musculus
aagaacagggtccagaacatggctc

SEQ ID NO: 856176 - DNA, 25 bp, Mus musculus
aagaacagtttggacgacgtaccat

SEQ ID NO: 856177 - DNA, 25 bp, Mus musculus
aagaacagtttggacgctcacccgg

SEQ ID NO: 856178 - DNA, 25 bp, Mus musculus
aagaacagtttggaggacgtaccat

SEQ ID NO: 856179 - DNA, 25 bp, Mus musculus
aagaacagtttggaggctcacccgg

SEQ ID NO: 856180 - DNA, 25 bp, Mus musculus
aagaacatccagaacaactggcggg

SEQ ID NO: 856181 - DNA, 25 bp, Mus musculus
aagaacatccagctcctgcctggca

SEQ ID NO: 856182 - DNA, 25 bp, Mus musculus
aagaacatccaggtcctgcctggca

SEQ ID NO: 856183 - DNA, 25 bp, Mus musculus
aagaacatccagtacaactggcggg

SEQ ID NO: 856184 - DNA, 25 bp, Mus musculus
aagaacatgatggacgatgtggaga

SEQ ID NO: 856185 - DNA, 25 bp, Mus musculus
aagaacatgatggaggatgtggaga

SEQ ID NO: 856186 - DNA, 25 bp, Mus musculus
aagaacatggagccccctggtgacc

SEQ ID NO: 856187 - DNA, 25 bp, Mus musculus
aagaacatggaggcccctggtgacc

SEQ ID NO: 856188 - DNA, 25 bp, Mus musculus
aagaaccaaattagagatgctcgta

SEQ ID NO: 856189 - DNA, 25 bp, Mus musculus
aagaaccaaattagtgatgctcgta

SEQ ID NO: 856190 - DNA, 25 bp, Mus musculus
aagaaccatgaggacgagatgaagg

SEQ ID NO: 856191 - DNA, 25 bp, Mus musculus
aagaaccatgaggaggagatgaagg

SEQ ID NO: 856192 - DNA, 25 bp, Mus musculus
aagaaccatgctgtcgtgtgtcaag

SEQ ID NO: 856193 - DNA, 25 bp, Mus musculus
aagaaccatgctgtggtgtgtcaag

SEQ ID NO: 856194 - DNA, 25 bp, Mus musculus
aagaacccaactcatccccagctca

SEQ ID NO: 856195 - DNA, 25 bp, Mus musculus
aagaacccaactgatccccagctca

SEQ ID NO: 856196 - DNA, 25 bp, Mus musculus
aagaacccagcacgttccatcacat

SEQ ID NO: 856197 - DNA, 25 bp, Mus musculus
aagaacccagcaggttccatcacat

SEQ ID NO: 856198 - DNA, 25 bp, Mus musculus
aagaaccccaagaggttcaatgttg

SEQ ID NO: 856199 - DNA, 25 bp, Mus musculus
aagaaccccaagtggttcaatgttg

SEQ ID NO: 856200 - DNA, 25 bp, Mus musculus
aagaacctgagacagttctggaaac

SEQ ID NO: 856201 - DNA, 25 bp, Mus musculus
aagaacctgagagagttctggaaac

SEQ ID NO: 856202 - DNA, 25 bp, Mus musculus
aagaacgccgagatggcccgaatgc

SEQ ID NO: 856203 - DNA, 25 bp, Mus musculus
aagaacgccgagttggcccgaatgc

SEQ ID NO: 856204 - DNA, 25 bp, Mus musculus
aagaacggcgatcctttccgtcaga

SEQ ID NO: 856205 - DNA, 25 bp, Mus musculus
aagaacggcgatgctttccgtcaga

SEQ ID NO: 856206 - DNA, 25 bp, Mus musculus
aagaactcaagaatgatagatttga

SEQ ID NO: 856207 - DNA, 25 bp, Mus musculus
aagaactcaagattgatagatttga

SEQ ID NO: 856208 - DNA, 25 bp, Mus musculus
aagaactccttgaacctgctaagga

SEQ ID NO: 856209 - DNA, 25 bp, Mus musculus
aagaactccttgaagctgctaagga

SEQ ID NO: 856210 - DNA, 25 bp, Mus musculus
aagaactgaccgcactgatggagga

SEQ ID NO: 856211 - DNA, 25 bp, Mus musculus
aagaactgacggcactgatggagga

SEQ ID NO: 856212 - DNA, 25 bp, Mus musculus
aagaactgcagaattgagctccttg

SEQ ID NO: 856213 - DNA, 25 bp, Mus musculus
aagaactgcagatttgagctccttg

SEQ ID NO: 856214 - DNA, 25 bp, Mus musculus
aagaactggaactagtggactgcca

SEQ ID NO: 856215 - DNA, 25 bp, Mus musculus
aagaactggagccctgctgggaacg

SEQ ID NO: 856216 - DNA, 25 bp, Mus musculus
aagaactggagcgctgctgggaacg

SEQ ID NO: 856217 - DNA, 25 bp, Mus musculus
aagaactggatctagtggactgcca

SEQ ID NO: 856218 - DNA, 25 bp, Mus musculus
aagaactggcaacgtctggcctgtc

SEQ ID NO: 856219 - DNA, 25 bp, Mus musculus
aagaactggcaaggtctggcctgtc

SEQ ID NO: 856220 - DNA, 25 bp, Mus musculus
aagaactgtagtgtcgagctgaccc

SEQ ID NO: 856221 - DNA, 25 bp, Mus musculus
aagaactgtagtgtggagctgaccc

SEQ ID NO: 856222 - DNA, 25 bp, Mus musculus
aagaactgtgaaaagaagacgtgtg

SEQ ID NO: 856223 - DNA, 25 bp, Mus musculus
aagaactgtgtaaagaagacgtgtg

SEQ ID NO: 856224 - DNA, 25 bp, Mus musculus
aagaactttgcccacgtcctgggct

SEQ ID NO: 856225 - DNA, 25 bp, Mus musculus
aagaactttgcccaggtcctgggct

SEQ ID NO: 856226 - DNA, 25 bp, Mus musculus
aagaactttgtacacacagtccgtg

SEQ ID NO: 856227 - DNA, 25 bp, Mus musculus
aagaactttgtagacacagtccgtg

SEQ ID NO: 856228 - DNA, 25 bp, Mus musculus
aagaagaaaatgaagaccatcaaat

SEQ ID NO: 856229 - DNA, 25 bp, Mus musculus
aagaagaaaatgaccatcaaatgag

SEQ ID NO: 856230 - DNA, 25 bp, Mus musculus
aagaagaaaatgtagaccatcaaat

SEQ ID NO: 856231 - DNA, 25 bp, Mus musculus
aagaagaaaatgtccatcaaatgag

SEQ ID NO: 856232 - DNA, 25 bp, Mus musculus
aagaagaaagaactcgtcactgtgt

SEQ ID NO: 856233 - DNA, 25 bp, Mus musculus
aagaagaaagaactggtcactgtgt

SEQ ID NO: 856234 - DNA, 25 bp, Mus musculus
aagaagaaagcactgacagacgaag

SEQ ID NO: 856235 - DNA, 25 bp, Mus musculus
aagaagaaagcagcacacacaggcc

SEQ ID NO: 856236 - DNA, 25 bp, Mus musculus
aagaagaaaggactgacagacgaag

SEQ ID NO: 856237 - DNA, 25 bp, Mus musculus
aagaagaaaggagcacacacaggcc

SEQ ID NO: 856238 - DNA, 25 bp, Mus musculus
aagaagaaattcaacatggttatat

SEQ ID NO: 856239 - DNA, 25 bp, Mus musculus
aagaagaaattcaagatggttatat

SEQ ID NO: 856240 - DNA, 25 bp, Mus musculus
aagaagaagaggcagcgagatcttg

SEQ ID NO: 856241 - DNA, 25 bp, Mus musculus
aagaagaagagggagcgagatcttg

SEQ ID NO: 856242 - DNA, 25 bp, Mus musculus
aagaagaagcagatcaaatttgaga

SEQ ID NO: 856243 - DNA, 25 bp, Mus musculus
aagaagaagcagttcaaatttgaga

SEQ ID NO: 856244 - DNA, 25 bp, Mus musculus
aagaagaatgcacgtgggagaggaa

SEQ ID NO: 856245 - DNA, 25 bp, Mus musculus
aagaagaatgcaggtgggagaggaa

SEQ ID NO: 856246 - DNA, 25 bp, Mus musculus
aagaagacagccaaacatttcattg

SEQ ID NO: 856247 - DNA, 25 bp, Mus musculus
aagaagacaggcaaacatttcattg

SEQ ID NO: 856248 - DNA, 25 bp, Mus musculus
aagaagaccacaaaaggccggctac

SEQ ID NO: 856249 - DNA, 25 bp, Mus musculus
aagaagaccacaaatggccggctac

SEQ ID NO: 856250 - DNA, 25 bp, Mus musculus
aagaagacccagtaatcctgttact

SEQ ID NO: 856251 - DNA, 25 bp, Mus musculus
aagaagacccagtattcctgttact

SEQ ID NO: 856252 - DNA, 25 bp, Mus musculus
aagaagactcagctctcatccgcca

SEQ ID NO: 856253 - DNA, 25 bp, Mus musculus
aagaagactcaggtctcatccgcca

SEQ ID NO: 856254 - DNA, 25 bp, Mus musculus
aagaagactctggacagtgactgca

SEQ ID NO: 856255 - DNA, 25 bp, Mus musculus
aagaagactctggagagtgactgca

SEQ ID NO: 856256 - DNA, 25 bp, Mus musculus
aagaagaggaagattgtagctgatg

SEQ ID NO: 856257 - DNA, 25 bp, Mus musculus
aagaagaggaagtttgtagctgatg

SEQ ID NO: 856258 - DNA, 25 bp, Mus musculus
aagaagaggacagcattgatttcat

SEQ ID NO: 856259 - DNA, 25 bp, Mus musculus
aagaagaggacagctttgatttcat

SEQ ID NO: 856260 - DNA, 25 bp, Mus musculus
aagaagagtgcaatccttgtttggg

SEQ ID NO: 856261 - DNA, 25 bp, Mus musculus
aagaagagtggaatccttgtttggg

SEQ ID NO: 856262 - DNA, 25 bp, Mus musculus
aagaagagtgtcaacactgtgaacc

SEQ ID NO: 856263 - DNA, 25 bp, Mus musculus
aagaagagtgtcaagactgtgaacc

SEQ ID NO: 856264 - DNA, 25 bp, Mus musculus
aagaagataacacgtatcgtaacca

SEQ ID NO: 856265 - DNA, 25 bp, Mus musculus
aagaagataacaggtatcgtaacca

SEQ ID NO: 856266 - DNA, 25 bp, Mus musculus
aagaagatagctgacgaggaggcta

SEQ ID NO: 856267 - DNA, 25 bp, Mus musculus
aagaagatagctgaggaggaggcta

SEQ ID NO: 856268 - DNA, 25 bp, Mus musculus
aagaagatccagctcggtcaccagg

SEQ ID NO: 856269 - DNA, 25 bp, Mus musculus
aagaagatccaggtcggtcaccagg

SEQ ID NO: 856270 - DNA, 25 bp, Mus musculus
aagaagatgatccccagtgtttcca

SEQ ID NO: 856271 - DNA, 25 bp, Mus musculus
aagaagatgatcctcttcaagcctt

SEQ ID NO: 856272 - DNA, 25 bp, Mus musculus
aagaagatgatcgccagtgtttcca

SEQ ID NO: 856273 - DNA, 25 bp, Mus musculus
aagaagatgatcgtcttcaagcctt

SEQ ID NO: 856274 - DNA, 25 bp, Mus musculus
aagaagatggcaaacattactactt

SEQ ID NO: 856275 - DNA, 25 bp, Mus musculus
aagaagatggcaaagattactactt

SEQ ID NO: 856276 - DNA, 25 bp, Mus musculus
aagaagcaagataaaagagcagagg

SEQ ID NO: 856277 - DNA, 25 bp, Mus musculus
aagaagcaagataatagagcagagg

SEQ ID NO: 856278 - DNA, 25 bp, Mus musculus
aagaagcaagcaccccactcctgac

SEQ ID NO: 856279 - DNA, 25 bp, Mus musculus
aagaagcaagcacctagaggatgaa

SEQ ID NO: 856280 - DNA, 25 bp, Mus musculus
aagaagcaagcagcccactcctgac

SEQ ID NO: 856281 - DNA, 25 bp, Mus musculus
aagaagcaagcagctagaggatgaa

SEQ ID NO: 856282 - DNA, 25 bp, Mus musculus
aagaagcagaccaacgtggaattcc

SEQ ID NO: 856283 - DNA, 25 bp, Mus musculus
aagaagcagaccaaggtggaattcc

SEQ ID NO: 856284 - DNA, 25 bp, Mus musculus
aagaagcagcgatgcgccagggctt

SEQ ID NO: 856285 - DNA, 25 bp, Mus musculus
aagaagcagcgatgggccagggctt

SEQ ID NO: 856286 - DNA, 25 bp, Mus musculus
aagaagcagcggcgaaggcaaggaa

SEQ ID NO: 856287 - DNA, 25 bp, Mus musculus
aagaagcagcggggaaggcaaggaa

SEQ ID NO: 856288 - DNA, 25 bp, Mus musculus
aagaagcatgagaacacaagcaatc

SEQ ID NO: 856289 - DNA, 25 bp, Mus musculus
aagaagcatgagaagacaagcaatc

SEQ ID NO: 856290 - DNA, 25 bp, Mus musculus
aagaagcatttgcgaactctcaact

SEQ ID NO: 856291 - DNA, 25 bp, Mus musculus
aagaagcatttgggaactctcaact

SEQ ID NO: 856292 - DNA, 25 bp, Mus musculus
aagaagccacagcaatcctgacctc

SEQ ID NO: 856293 - DNA, 25 bp, Mus musculus
aagaagccacaggaatcctgacctc

SEQ ID NO: 856294 - DNA, 25 bp, Mus musculus
aagaagccagatgtgaactggggct

SEQ ID NO: 856295 - DNA, 25 bp, Mus musculus
aagaagccagcccctctttgctggg

SEQ ID NO: 856296 - DNA, 25 bp, Mus musculus
aagaagccaggccctctttgctggg

SEQ ID NO: 856297 - DNA, 25 bp, Mus musculus
aagaagccagttgtgaactggggct

SEQ ID NO: 856298 - DNA, 25 bp, Mus musculus
aagaagccccaactcaggaatggat

SEQ ID NO: 856299 - DNA, 25 bp, Mus musculus
aagaagccccaactgaggaatggat

SEQ ID NO: 856300 - DNA, 25 bp, Mus musculus
aagaagcccgtgcccgtcagcttct

SEQ ID NO: 856301 - DNA, 25 bp, Mus musculus
aagaagcccgtgccggtcagcttct

SEQ ID NO: 856302 - DNA, 25 bp, Mus musculus
aagaagcgagaaacatcaatggatt

SEQ ID NO: 856303 - DNA, 25 bp, Mus musculus
aagaagcgaggcaactttgtgaagg

SEQ ID NO: 856304 - DNA, 25 bp, Mus musculus
aagaagcgaggcaagtttgtgaagg

SEQ ID NO: 856305 - DNA, 25 bp, Mus musculus
aagaagcgagtaacatcaatggatt

SEQ ID NO: 856306 - DNA, 25 bp, Mus musculus
aagaagcggcctccatgacccgccg

SEQ ID NO: 856307 - DNA, 25 bp, Mus musculus
aagaagcggcctgcatgacccgccg

SEQ ID NO: 856308 - DNA, 25 bp, Mus musculus
aagaagctatggcacaaagccctgc

SEQ ID NO: 856309 - DNA, 25 bp, Mus musculus
aagaagctatggcacagtgctggga

SEQ ID NO: 856310 - DNA, 25 bp, Mus musculus
aagaagctatggcacctacttaaaa

SEQ ID NO: 856311 - DNA, 25 bp, Mus musculus
aagaagctatggcacgtgattggag

SEQ ID NO: 856312 - DNA, 25 bp, Mus musculus
aagaagctatggcactggttttatg

SEQ ID NO: 856313 - DNA, 25 bp, Mus musculus
aagaagctatggcagaaagccctgc

SEQ ID NO: 856314 - DNA, 25 bp, Mus musculus
aagaagctatggcagagtgctggga

SEQ ID NO: 856315 - DNA, 25 bp, Mus musculus
aagaagctatggcagctacttaaaa

SEQ ID NO: 856316 - DNA, 25 bp, Mus musculus
aagaagctatggcaggtgattggag

SEQ ID NO: 856317 - DNA, 25 bp, Mus musculus
aagaagctatggcagtggttttatg

SEQ ID NO: 856318 - DNA, 25 bp, Mus musculus
aagaagctcccccacctgcactctt

SEQ ID NO: 856319 - DNA, 25 bp, Mus musculus
aagaagctccccgacctgcactctt

SEQ ID NO: 856320 - DNA, 25 bp, Mus musculus
aagaagctctagaaccgtacaggcg

SEQ ID NO: 856321 - DNA, 25 bp, Mus musculus
aagaagctctagaagcgtacaggcg

SEQ ID NO: 856322 - DNA, 25 bp, Mus musculus
aagaagctgcttcgccccatcagcc

SEQ ID NO: 856323 - DNA, 25 bp, Mus musculus
aagaagctgcttggccccatcagcc

SEQ ID NO: 856324 - DNA, 25 bp, Mus musculus
aagaagctggaggacgtcattcaga

SEQ ID NO: 856325 - DNA, 25 bp, Mus musculus
aagaagctggaggaggtcattcaga

SEQ ID NO: 856326 - DNA, 25 bp, Mus musculus
aagaagctggctaagaagtacgatg

SEQ ID NO: 856327 - DNA, 25 bp, Mus musculus
aagaagctgggtaagaagtacgatg

SEQ ID NO: 856328 - DNA, 25 bp, Mus musculus
aagaagctggtcaacggtctagaga

SEQ ID NO: 856329 - DNA, 25 bp, Mus musculus
aagaagctggtcaagggtctagaga

SEQ ID NO: 856330 - DNA, 25 bp, Mus musculus
aagaagcttgctcacgatggctgca

SEQ ID NO: 856331 - DNA, 25 bp, Mus musculus
aagaagcttgctcacgctcctcgga

SEQ ID NO: 856332 - DNA, 25 bp, Mus musculus
aagaagcttgctcaggatggctgca

SEQ ID NO: 856333 - DNA, 25 bp, Mus musculus
aagaagcttgctcaggctcctcgga

SEQ ID NO: 856334 - DNA, 25 bp, Mus musculus
aagaaggagaagacaggctgggaca

SEQ ID NO: 856335 - DNA, 25 bp, Mus musculus
aagaaggagaagcaacaagccaagc

SEQ ID NO: 856336 - DNA, 25 bp, Mus musculus
aagaaggagaaggaacaagccaagc

SEQ ID NO: 856337 - DNA, 25 bp, Mus musculus
aagaaggagaagtcaggctgggaca

SEQ ID NO: 856338 - DNA, 25 bp, Mus musculus
aagaaggcaaatcctatgctggatg

SEQ ID NO: 856339 - DNA, 25 bp, Mus musculus
aagaaggcaaatgctatgctggatg

SEQ ID NO: 856340 - DNA, 25 bp, Mus musculus
aagaaggcacctcactttgtgttct

SEQ ID NO: 856341 - DNA, 25 bp, Mus musculus
aagaaggcacctgactttgtgttct

SEQ ID NO: 856342 - DNA, 25 bp, Mus musculus
aagaaggcagccgacgctgaagctg

SEQ ID NO: 856343 - DNA, 25 bp, Mus musculus
aagaaggcagccgaggctgaagctg

SEQ ID NO: 856344 - DNA, 25 bp, Mus musculus
aagaaggccattcggcacaatcatg

SEQ ID NO: 856345 - DNA, 25 bp, Mus musculus
aagaaggccattgggcacaatcatg

SEQ ID NO: 856346 - DNA, 25 bp, Mus musculus
aagaaggcgcaagtcccctggactt

SEQ ID NO: 856347 - DNA, 25 bp, Mus musculus
aagaaggcgctagtcccctggactt

SEQ ID NO: 856348 - DNA, 25 bp, Mus musculus
aagaaggctcagcggaacctgcctc

SEQ ID NO: 856349 - DNA, 25 bp, Mus musculus
aagaaggctctgcggaacctgcctc

SEQ ID NO: 856350 - DNA, 25 bp, Mus musculus
aagaagggcaaacatgagtggttct

SEQ ID NO: 856351 - DNA, 25 bp, Mus musculus
aagaagggcaaagatgagtggttct

SEQ ID NO: 856352 - DNA, 25 bp, Mus musculus
aagaagggttatagcacgttgaaga

SEQ ID NO: 856353 - DNA, 25 bp, Mus musculus
aagaagggttattgcacgttgaaga

SEQ ID NO: 856354 - DNA, 25 bp, Mus musculus
aagaaggtgacgctgaggaggagga

SEQ ID NO: 856355 - DNA, 25 bp, Mus musculus
aagaaggtgacggtgaggaggagga

SEQ ID NO: 856356 - DNA, 25 bp, Mus musculus
aagaaggtgcagatctttgagatga

SEQ ID NO: 856357 - DNA, 25 bp, Mus musculus
aagaaggtgcagttctttgagatga

SEQ ID NO: 856358 - DNA, 25 bp, Mus musculus
aagaagtaaagcaacagcaccagaa

SEQ ID NO: 856359 - DNA, 25 bp, Mus musculus
aagaagtaaagcaacgctgtggctc

SEQ ID NO: 856360 - DNA, 25 bp, Mus musculus
aagaagtaaagcaagagcaccagaa

SEQ ID NO: 856361 - DNA, 25 bp, Mus musculus
aagaagtaaagcaaggctgtggctc

SEQ ID NO: 856362 - DNA, 25 bp, Mus musculus
aagaagtcttaacggtgtagtggag

SEQ ID NO: 856363 - DNA, 25 bp, Mus musculus
aagaagtcttaagggtgtagtggag

SEQ ID NO: 856364 - DNA, 25 bp, Mus musculus
aagaagtgccactgaatggaactct

SEQ ID NO: 856365 - DNA, 25 bp, Mus musculus
aagaagtgccactgtatggaactct

SEQ ID NO: 856366 - DNA, 25 bp, Mus musculus
aagaagtgggctgccgccatgctgc

SEQ ID NO: 856367 - DNA, 25 bp, Mus musculus
aagaagtggggtgccgccatgctgc

SEQ ID NO: 856368 - DNA, 25 bp, Mus musculus
aagaagttcacacgagaaaacatct

SEQ ID NO: 856369 - DNA, 25 bp, Mus musculus
aagaagttcacaggagaaaacatct

SEQ ID NO: 856370 - DNA, 25 bp, Mus musculus
aagaagtttgatcaattcttcaaag

SEQ ID NO: 856371 - DNA, 25 bp, Mus musculus
aagaagtttgatgaattcttcaaag

SEQ ID NO: 856372 - DNA, 25 bp, Mus musculus
aagaataacctgccttcctgctacc

SEQ ID NO: 856373 - DNA, 25 bp, Mus musculus
aagaataacctggcttcctgctacc

SEQ ID NO: 856374 - DNA, 25 bp, Mus musculus
aagaatacagcgaaaatggagaact

SEQ ID NO: 856375 - DNA, 25 bp, Mus musculus
aagaatacagctatggttttctaat

SEQ ID NO: 856376 - DNA, 25 bp, Mus musculus
aagaatacagggaaaatggagaact

SEQ ID NO: 856377 - DNA, 25 bp, Mus musculus
aagaatacaggtatggttttctaat

SEQ ID NO: 856378 - DNA, 25 bp, Mus musculus
aagaataggcatgacattgctgtta

SEQ ID NO: 856379 - DNA, 25 bp, Mus musculus
aagaataggcatgagattgctgtta

SEQ ID NO: 856380 - DNA, 25 bp, Mus musculus
aagaatcaaatgctcttcccagctg

SEQ ID NO: 856381 - DNA, 25 bp, Mus musculus
aagaatcaaatggtcttcccagctg

SEQ ID NO: 856382 - DNA, 25 bp, Mus musculus
aagaatccaccacacataactctct

SEQ ID NO: 856383 - DNA, 25 bp, Mus musculus
aagaatccaccacagataactctct

SEQ ID NO: 856384 - DNA, 25 bp, Mus musculus
aagaatccagaaaatgtaaagcaat

SEQ ID NO: 856385 - DNA, 25 bp, Mus musculus
aagaatccagaatatgtaaagcaat

SEQ ID NO: 856386 - DNA, 25 bp, Mus musculus
aagaatccagagaggaagacgactg

SEQ ID NO: 856387 - DNA, 25 bp, Mus musculus
aagaatccagtgaggaagacgactg

SEQ ID NO: 856388 - DNA, 25 bp, Mus musculus
aagaatctaagccacgttgccatga

SEQ ID NO: 856389 - DNA, 25 bp, Mus musculus
aagaatctaagccaggttgccatga

SEQ ID NO: 856390 - DNA, 25 bp, Mus musculus
aagaatgaagacagaaaaaaggact

SEQ ID NO: 856391 - DNA, 25 bp, Mus musculus
aagaatgaagagtatcccctactct

SEQ ID NO: 856392 - DNA, 25 bp, Mus musculus
aagaatgaagcaataacagccttgt

SEQ ID NO: 856393 - DNA, 25 bp, Mus musculus
aagaatgaaggaataacagccttgt

SEQ ID NO: 856394 - DNA, 25 bp, Mus musculus
aagaatgaagtcagaaaaaaggact

SEQ ID NO: 856395 - DNA, 25 bp, Mus musculus
aagaatgaagtgtatcccctactct

SEQ ID NO: 856396 - DNA, 25 bp, Mus musculus
aagaatgacattattgccattggct

SEQ ID NO: 856397 - DNA, 25 bp, Mus musculus
aagaatgacattcgctcgtgagctg

SEQ ID NO: 856398 - DNA, 25 bp, Mus musculus
aagaatgacattggctcgtgagctg

SEQ ID NO: 856399 - DNA, 25 bp, Mus musculus
aagaatgacatttttgccattggct

SEQ ID NO: 856400 - DNA, 25 bp, Mus musculus
aagaatgattttagcttacagccaa

SEQ ID NO: 856401 - DNA, 25 bp, Mus musculus
aagaatgattttaggttacagccaa

SEQ ID NO: 856402 - DNA, 25 bp, Mus musculus
aagaatgcagctgggagaggaaggc

SEQ ID NO: 856403 - DNA, 25 bp, Mus musculus
aagaatgcaggtgggagaggaaggc

SEQ ID NO: 856404 - DNA, 25 bp, Mus musculus
aagaatgcctgaaaagaagaaaggc

SEQ ID NO: 856405 - DNA, 25 bp, Mus musculus
aagaatgcctgataagaagaaaggc

SEQ ID NO: 856406 - DNA, 25 bp, Mus musculus
aagaatgctgacatgtgcattgctt

SEQ ID NO: 856407 - DNA, 25 bp, Mus musculus
aagaatgctgacttgtgcattgctt

SEQ ID NO: 856408 - DNA, 25 bp, Mus musculus
aagaatggaaagaacttatctacaa

SEQ ID NO: 856409 - DNA, 25 bp, Mus musculus
aagaatggaaagtacttatctacaa

SEQ ID NO: 856410 - DNA, 25 bp, Mus musculus
aagaatggcatgattgaggactggg

SEQ ID NO: 856411 - DNA, 25 bp, Mus musculus
aagaatggcatgcttgaagactggg

SEQ ID NO: 856412 - DNA, 25 bp, Mus musculus
aagaatggcatggttgaagactggg

SEQ ID NO: 856413 - DNA, 25 bp, Mus musculus
aagaatggcatgtttgaggactggg

SEQ ID NO: 856414 - DNA, 25 bp, Mus musculus
aagaatgtggagccactgtatggct

SEQ ID NO: 856415 - DNA, 25 bp, Mus musculus
aagaatgtggaggcactgtatggct

SEQ ID NO: 856416 - DNA, 25 bp, Mus musculus
aagaatgtgttagaccttcgaagcc

SEQ ID NO: 856417 - DNA, 25 bp, Mus musculus
aagaatgtgttagagcttcgaagcc

SEQ ID NO: 856418 - DNA, 25 bp, Mus musculus
aagaattccaaaaagcatagcttgt

SEQ ID NO: 856419 - DNA, 25 bp, Mus musculus
aagaattccaaaagcttacttttct

SEQ ID NO: 856420 - DNA, 25 bp, Mus musculus
aagaattccaaatagcatagcttgt

SEQ ID NO: 856421 - DNA, 25 bp, Mus musculus
aagaattccaaatgcttacttttct

SEQ ID NO: 856422 - DNA, 25 bp, Mus musculus
aagaattccacgcacctagactcag

SEQ ID NO: 856423 - DNA, 25 bp, Mus musculus
aagaattccacggacctagactcag

SEQ ID NO: 856424 - DNA, 25 bp, Mus musculus
aagaattgtttgcccttggatctct

SEQ ID NO: 856425 - DNA, 25 bp, Mus musculus
aagaattgtttggccttggatctct

SEQ ID NO: 856426 - DNA, 25 bp, Mus musculus
aagaatttaaatatctctagagtgg

SEQ ID NO: 856427 - DNA, 25 bp, Mus musculus
aagaatttaaatatgtctagagtgg

SEQ ID NO: 856428 - DNA, 25 bp, Mus musculus
aagaatttcaagactgcgagtgcta

SEQ ID NO: 856429 - DNA, 25 bp, Mus musculus
aagaatttcaagtctgcgagtgcta

SEQ ID NO: 856430 - DNA, 25 bp, Mus musculus
aagaatttgctgaagacattttaag

SEQ ID NO: 856431 - DNA, 25 bp, Mus musculus
aagaatttgctgtagacattttaag

SEQ ID NO: 856432 - DNA, 25 bp, Mus musculus
aagacaaaaaagccaagcagcagga

SEQ ID NO: 856433 - DNA, 25 bp, Mus musculus
aagacaaaaaaggcaagcagcagga

SEQ ID NO: 856434 - DNA, 25 bp, Mus musculus
aagacaaagtttcacgggagctctt

SEQ ID NO: 856435 - DNA, 25 bp, Mus musculus
aagacaaagtttcaggggagctctt

SEQ ID NO: 856436 - DNA, 25 bp, Mus musculus
aagacaaatcaacgtgattcccaaa

SEQ ID NO: 856437 - DNA, 25 bp, Mus musculus
aagacaaatcaaggtgattcccaaa

SEQ ID NO: 856438 - DNA, 25 bp, Mus musculus
aagacaagacctggacacgcatccc

SEQ ID NO: 856439 - DNA, 25 bp, Mus musculus
aagacaagacgtggacacgcatccc

SEQ ID NO: 856440 - DNA, 25 bp, Mus musculus
aagacaagtacagaaaccttttcaa

SEQ ID NO: 856441 - DNA, 25 bp, Mus musculus
aagacaagtacagataccttttcaa

SEQ ID NO: 856442 - DNA, 25 bp, Mus musculus
aagacaagtgcttgctatgggactc

SEQ ID NO: 856443 - DNA, 25 bp, Mus musculus
aagacaagtggttgctatgggactc

SEQ ID NO: 856444 - DNA, 25 bp, Mus musculus
aagacacaacagagcaggttaggaa

SEQ ID NO: 856445 - DNA, 25 bp, Mus musculus
aagacacaacagtgcaggttaggaa

SEQ ID NO: 856446 - DNA, 25 bp, Mus musculus
aagacacaagtccaccagtcctgac

SEQ ID NO: 856447 - DNA, 25 bp, Mus musculus
aagacacaagtcgaccagtcctgac

SEQ ID NO: 856448 - DNA, 25 bp, Mus musculus
aagacacagcctccttctacctggc

SEQ ID NO: 856449 - DNA, 25 bp, Mus musculus
aagacacagcctgcttctacctggc

SEQ ID NO: 856450 - DNA, 25 bp, Mus musculus
aagacacaggatgctgggacacaaa

SEQ ID NO: 856451 - DNA, 25 bp, Mus musculus
aagacacaggttgctgggacacaaa

SEQ ID NO: 856452 - DNA, 25 bp, Mus musculus
aagacaccatcacgctgaccagcct

SEQ ID NO: 856453 - DNA, 25 bp, Mus musculus
aagacaccatcaggctgaccagcct

SEQ ID NO: 856454 - DNA, 25 bp, Mus musculus
aagacacctacagactagcacacct

SEQ ID NO: 856455 - DNA, 25 bp, Mus musculus
aagacacctagagactagcacacct

SEQ ID NO: 856456 - DNA, 25 bp, Mus musculus
aagacagagcaacgtcctgtttatt

SEQ ID NO: 856457 - DNA, 25 bp, Mus musculus
aagacagagcaaggtcctgtttatt

SEQ ID NO: 856458 - DNA, 25 bp, Mus musculus
aagacagatcagaaccacaattata

SEQ ID NO: 856459 - DNA, 25 bp, Mus musculus
aagacagatcagaacgcttatggta

SEQ ID NO: 856460 - DNA, 25 bp, Mus musculus
aagacagatcagaagcacaattata

SEQ ID NO: 856461 - DNA, 25 bp, Mus musculus
aagacagatcagaaggcttatggta

SEQ ID NO: 856462 - DNA, 25 bp, Mus musculus
aagacagattttcatgaatataaaa

SEQ ID NO: 856463 - DNA, 25 bp, Mus musculus
aagacagattttgatgaatataaaa

SEQ ID NO: 856464 - DNA, 25 bp, Mus musculus
aagacagcagaaaactttcgagctc

SEQ ID NO: 856465 - DNA, 25 bp, Mus musculus
aagacagcagtaaactttcgagctc

SEQ ID NO: 856466 - DNA, 25 bp, Mus musculus
aagacagcatctggcttttctggga

SEQ ID NO: 856467 - DNA, 25 bp, Mus musculus
aagacagcatctgggttttctggga

SEQ ID NO: 856468 - DNA, 25 bp, Mus musculus
aagacagccaattgcgtctctgaat

SEQ ID NO: 856469 - DNA, 25 bp, Mus musculus
aagacagccaattgggtctctgaat

SEQ ID NO: 856470 - DNA, 25 bp, Mus musculus
aagacagctccactttttcaggaat

SEQ ID NO: 856471 - DNA, 25 bp, Mus musculus
aagacagctccagtttttcaggaat

SEQ ID NO: 856472 - DNA, 25 bp, Mus musculus
aagacaggagtagcaaactggctga

SEQ ID NO: 856473 - DNA, 25 bp, Mus musculus
aagacaggagtagctaactggctga

SEQ ID NO: 856474 - DNA, 25 bp, Mus musculus
aagacatcaactgctgtaacagttg

SEQ ID NO: 856475 - DNA, 25 bp, Mus musculus
aagacatcaagtgctgtaacagttg

SEQ ID NO: 856476 - DNA, 25 bp, Mus musculus
aagacatcacaacgtactacctgtg

SEQ ID NO: 856477 - DNA, 25 bp, Mus musculus
aagacatcacaaggtactacctgtg

SEQ ID NO: 856478 - DNA, 25 bp, Mus musculus
aagacatctactaaaccgcccagaa

SEQ ID NO: 856479 - DNA, 25 bp, Mus musculus
aagacatctacttaaccgcccagaa

SEQ ID NO: 856480 - DNA, 25 bp, Mus musculus
aagacatgcaaacacatcaacgagt

SEQ ID NO: 856481 - DNA, 25 bp, Mus musculus
aagacatgcaaagacatcaacgagt

SEQ ID NO: 856482 - DNA, 25 bp, Mus musculus
aagacatggaagcgctgggactgct

SEQ ID NO: 856483 - DNA, 25 bp, Mus musculus
aagacatggaagggctgggactgct

SEQ ID NO: 856484 - DNA, 25 bp, Mus musculus
aagacatggatgaactggatgtgcg

SEQ ID NO: 856485 - DNA, 25 bp, Mus musculus
aagacatggatgaagtggatgtgcg

SEQ ID NO: 856486 - DNA, 25 bp, Mus musculus
aagacatgtaaacatatcgatgagt

SEQ ID NO: 856487 - DNA, 25 bp, Mus musculus
aagacatgtaaagatatcgatgagt

SEQ ID NO: 856488 - DNA, 25 bp, Mus musculus
aagacatgtcagcttctctgtccac

SEQ ID NO: 856489 - DNA, 25 bp, Mus musculus
aagacatgtcaggttctctgtccac

SEQ ID NO: 856490 - DNA, 25 bp, Mus musculus
aagacattctcacactccttggatg

SEQ ID NO: 856491 - DNA, 25 bp, Mus musculus
aagacattctcagactccttggatg

SEQ ID NO: 856492 - DNA, 25 bp, Mus musculus
aagacattgctaccatttgaagaca

SEQ ID NO: 856493 - DNA, 25 bp, Mus musculus
aagacattgctagcatttgaagaca

SEQ ID NO: 856494 - DNA, 25 bp, Mus musculus
aagacattttccaacaacagttagc

SEQ ID NO: 856495 - DNA, 25 bp, Mus musculus
aagacattttccaagaacagttagc

SEQ ID NO: 856496 - DNA, 25 bp, Mus musculus
aagaccaaagacagcggggatgcac

SEQ ID NO: 856497 - DNA, 25 bp, Mus musculus
aagaccaaagtcagcggggatgcac

SEQ ID NO: 856498 - DNA, 25 bp, Mus musculus
aagaccacaaatcgccggctacctg

SEQ ID NO: 856499 - DNA, 25 bp, Mus musculus
aagaccacaaatggccggctacctg

SEQ ID NO: 856500 - DNA, 25 bp, Mus musculus
aagaccacagccaaatcctaagaga

SEQ ID NO: 856501 - DNA, 25 bp, Mus musculus
aagaccacaggaatcggtgccatct

SEQ ID NO: 856502 - DNA, 25 bp, Mus musculus
aagaccacaggaatgggtgccatct

SEQ ID NO: 856503 - DNA, 25 bp, Mus musculus
aagaccacaggcaaatcctaagaga

SEQ ID NO: 856504 - DNA, 25 bp, Mus musculus
aagaccatagcaggcgcaattcaga

SEQ ID NO: 856505 - DNA, 25 bp, Mus musculus
aagaccatagccgcaattcagattc

SEQ ID NO: 856506 - DNA, 25 bp, Mus musculus
aagaccataggaggcgcaattcaga

SEQ ID NO: 856507 - DNA, 25 bp, Mus musculus
aagaccataggcgcaattcagattc

SEQ ID NO: 856508 - DNA, 25 bp, Mus musculus
aagaccatcagtcttcccgatgttg

SEQ ID NO: 856509 - DNA, 25 bp, Mus musculus
aagaccatcagtgttcccgatgttg

SEQ ID NO: 856510 - DNA, 25 bp, Mus musculus
aagaccatggacgacgacattgtga

SEQ ID NO: 856511 - DNA, 25 bp, Mus musculus
aagaccatggacgaggacattgtga

SEQ ID NO: 856512 - DNA, 25 bp, Mus musculus
aagacccacgcaaactacagctgaa

SEQ ID NO: 856513 - DNA, 25 bp, Mus musculus
aagacccacgcatactacagctgaa

SEQ ID NO: 856514 - DNA, 25 bp, Mus musculus
aagacccagtatacctgttactgct

SEQ ID NO: 856515 - DNA, 25 bp, Mus musculus
aagacccagtattcctgttactgct

SEQ ID NO: 856516 - DNA, 25 bp, Mus musculus
aagaccccaacaggaggatgaccat

SEQ ID NO: 856517 - DNA, 25 bp, Mus musculus
aagaccccaagaggaggatgaccat

SEQ ID NO: 856518 - DNA, 25 bp, Mus musculus
aagaccccaccgagcatgcgtctta

SEQ ID NO: 856519 - DNA, 25 bp, Mus musculus
aagaccccaccgtgcatgcgtctta

SEQ ID NO: 856520 - DNA, 25 bp, Mus musculus
aagaccccggctcttgttgcagcat

SEQ ID NO: 856521 - DNA, 25 bp, Mus musculus
aagaccccgggtcttgttgcagcat

SEQ ID NO: 856522 - DNA, 25 bp, Mus musculus
aagacccggcagcgcgtggaggatg

SEQ ID NO: 856523 - DNA, 25 bp, Mus musculus
aagacccggcagggcgtggaggatg

SEQ ID NO: 856524 - DNA, 25 bp, Mus musculus
aagaccctaacacatgttgctgtgg

SEQ ID NO: 856525 - DNA, 25 bp, Mus musculus
aagaccctaacagatgttgctgtgg

SEQ ID NO: 856526 - DNA, 25 bp, Mus musculus
aagaccctcacacatgtcttccagg

SEQ ID NO: 856527 - DNA, 25 bp, Mus musculus
aagaccctcacagatgtcttccagg

SEQ ID NO: 856528 - DNA, 25 bp, Mus musculus
aagaccctgcagcgagagagaatca

SEQ ID NO: 856529 - DNA, 25 bp, Mus musculus
aagaccctgcagggagagagaatca

SEQ ID NO: 856530 - DNA, 25 bp, Mus musculus
aagaccgagaagcgcttgaaaagga

SEQ ID NO: 856531 - DNA, 25 bp, Mus musculus
aagaccgagaagggcttgaaaagga

SEQ ID NO: 856532 - DNA, 25 bp, Mus musculus
aagaccgccaagattgaggatgaga

SEQ ID NO: 856533 - DNA, 25 bp, Mus musculus
aagaccgccaagtttgaggatgaga

SEQ ID NO: 856534 - DNA, 25 bp, Mus musculus
aagacctacaagctcggacatcaaa

SEQ ID NO: 856535 - DNA, 25 bp, Mus musculus
aagacctacaaggtcggacatcaaa

SEQ ID NO: 856536 - DNA, 25 bp, Mus musculus
aagacctactcccactgaccttcag

SEQ ID NO: 856537 - DNA, 25 bp, Mus musculus
aagacctactcccagtgaccttcag

SEQ ID NO: 856538 - DNA, 25 bp, Mus musculus
aagacctccagactggtggattgtc

SEQ ID NO: 856539 - DNA, 25 bp, Mus musculus
aagacctccagagtggtggattgtc

SEQ ID NO: 856540 - DNA, 25 bp, Mus musculus
aagacctgcaagagctaggattggg

SEQ ID NO: 856541 - DNA, 25 bp, Mus musculus
aagacctgcaagcaatctccggttc

SEQ ID NO: 856542 - DNA, 25 bp, Mus musculus
aagacctgcaagcacccagagcaga

SEQ ID NO: 856543 - DNA, 25 bp, Mus musculus
aagacctgcaagcagagctaggatt

SEQ ID NO: 856544 - DNA, 25 bp, Mus musculus
aagacctgcaagccctacctgacct

SEQ ID NO: 856545 - DNA, 25 bp, Mus musculus
aagacctgcaaggaatctccggttc

SEQ ID NO: 856546 - DNA, 25 bp, Mus musculus
aagacctgcaaggacccagagcaga

SEQ ID NO: 856547 - DNA, 25 bp, Mus musculus
aagacctgcaaggagagctaggatt

SEQ ID NO: 856548 - DNA, 25 bp, Mus musculus
aagacctgcaaggcctacctgacct

SEQ ID NO: 856549 - DNA, 25 bp, Mus musculus
aagacctgcaagtgctaggattggg

SEQ ID NO: 856550 - DNA, 25 bp, Mus musculus
aagacctggcatctgccccagcaag

SEQ ID NO: 856551 - DNA, 25 bp, Mus musculus
aagacctggcatgtgccccagcaag

SEQ ID NO: 856552 - DNA, 25 bp, Mus musculus
aagacctggccactatattattctc

SEQ ID NO: 856553 - DNA, 25 bp, Mus musculus
aagacctggccagtatattattctc

SEQ ID NO: 856554 - DNA, 25 bp, Mus musculus
aagaccttcaaaaccggcagcatcc

SEQ ID NO: 856555 - DNA, 25 bp, Mus musculus
aagaccttcaaaacgggcagcatcc

SEQ ID NO: 856556 - DNA, 25 bp, Mus musculus
aagaccttcaaacctgtggaacagt

SEQ ID NO: 856557 - DNA, 25 bp, Mus musculus
aagaccttcaaagctgtggaacagt

SEQ ID NO: 856558 - DNA, 25 bp, Mus musculus
aagaccttcttgcaccgggaatacc

SEQ ID NO: 856559 - DNA, 25 bp, Mus musculus
aagaccttcttgcagcgggaatacc

SEQ ID NO: 856560 - DNA, 25 bp, Mus musculus
aagacctttaccaacagctgggtcg

SEQ ID NO: 856561 - DNA, 25 bp, Mus musculus
aagacctttaccaagagctgggtcg

SEQ ID NO: 856562 - DNA, 25 bp, Mus musculus
aagacgaactagctcctgtgccatt

SEQ ID NO: 856563 - DNA, 25 bp, Mus musculus
aagacgaactaggtcctgtgccatt

SEQ ID NO: 856564 - DNA, 25 bp, Mus musculus
aagacgaaggaagacgtgggagagt

SEQ ID NO: 856565 - DNA, 25 bp, Mus musculus
aagacgaaggaagaggtgggagagt

SEQ ID NO: 856566 - DNA, 25 bp, Mus musculus
aagacgaggagtcgttccgatctaa

SEQ ID NO: 856567 - DNA, 25 bp, Mus musculus
aagacgaggagtggttccgatctaa

SEQ ID NO: 856568 - DNA, 25 bp, Mus musculus
aagacgccagcacgtcctgctggtg

SEQ ID NO: 856569 - DNA, 25 bp, Mus musculus
aagacgccagcaggtcctgctggtg

SEQ ID NO: 856570 - DNA, 25 bp, Mus musculus
aagacgcctgcccaattaatggagg

SEQ ID NO: 856571 - DNA, 25 bp, Mus musculus
aagacgcctgcccatttaatggagg

SEQ ID NO: 856572 - DNA, 25 bp, Mus musculus
aagacgctcagacacgagttcagga

SEQ ID NO: 856573 - DNA, 25 bp, Mus musculus
aagacgctcagagacgagttcagga

SEQ ID NO: 856574 - DNA, 25 bp, Mus musculus
aagacggaagcactggaaatggcag

SEQ ID NO: 856575 - DNA, 25 bp, Mus musculus
aagacggaaggactggaaatggcag

SEQ ID NO: 856576 - DNA, 25 bp, Mus musculus
aagacggctacaatcatgtcgccat

SEQ ID NO: 856577 - DNA, 25 bp, Mus musculus
aagacggctacaatgatgtcgccat

SEQ ID NO: 856578 - DNA, 25 bp, Mus musculus
aagacgtcagccaacttgtccagag

SEQ ID NO: 856579 - DNA, 25 bp, Mus musculus
aagacgtcagccaagttgtccagag

SEQ ID NO: 856580 - DNA, 25 bp, Mus musculus
aagacgtcgcggccccatggcggac

SEQ ID NO: 856581 - DNA, 25 bp, Mus musculus
aagacgtcgcggccgcatggcggac

SEQ ID NO: 856582 - DNA, 25 bp, Mus musculus
aagacgtcgtgtcgcatgtgggcac

SEQ ID NO: 856583 - DNA, 25 bp, Mus musculus
aagacgtcgtgtggcatgtgggcac

SEQ ID NO: 856584 - DNA, 25 bp, Mus musculus
aagactcagagcattacaaagccta

SEQ ID NO: 856585 - DNA, 25 bp, Mus musculus
aagactcagagctttacaaagccta

SEQ ID NO: 856586 - DNA, 25 bp, Mus musculus
aagactccgtgtctcacattagctt

SEQ ID NO: 856587 - DNA, 25 bp, Mus musculus
aagactccgtgtgtcacattagctt

SEQ ID NO: 856588 - DNA, 25 bp, Mus musculus
aagactcctgcattagtcttcctta

SEQ ID NO: 856589 - DNA, 25 bp, Mus musculus
aagactcctgcatttgtcttcctta

SEQ ID NO: 856590 - DNA, 25 bp, Mus musculus
aagactctagacctaccttctagcc

SEQ ID NO: 856591 - DNA, 25 bp, Mus musculus
aagactctagacgtaccttctagcc

SEQ ID NO: 856592 - DNA, 25 bp, Mus musculus
aagactctggaccacgtcttagaag

SEQ ID NO: 856593 - DNA, 25 bp, Mus musculus
aagactctggaccaggtcttagaag

SEQ ID NO: 856594 - DNA, 25 bp, Mus musculus
aagactctggagagtgactgcacca

SEQ ID NO: 856595 - DNA, 25 bp, Mus musculus
aagactctggagtgtgactgcacca

SEQ ID NO: 856596 - DNA, 25 bp, Mus musculus
aagactgcagagaacttcagagccc

SEQ ID NO: 856597 - DNA, 25 bp, Mus musculus
aagactgcagtgaacttcagagccc

SEQ ID NO: 856598 - DNA, 25 bp, Mus musculus
aagactgcatctagacttgtaacca

SEQ ID NO: 856599 - DNA, 25 bp, Mus musculus
aagactgcatcttgacttgtaacca

SEQ ID NO: 856600 - DNA, 25 bp, Mus musculus
aagactggaaagccctccattcctt

SEQ ID NO: 856601 - DNA, 25 bp, Mus musculus
aagactggaaaggcctccattcctt

SEQ ID NO: 856602 - DNA, 25 bp, Mus musculus
aagactggagagaagctgaagaagg

SEQ ID NO: 856603 - DNA, 25 bp, Mus musculus
aagactggagtgaagctgaagaagg

SEQ ID NO: 856604 - DNA, 25 bp, Mus musculus
aagactgtaccacgcccagtctgtg

SEQ ID NO: 856605 - DNA, 25 bp, Mus musculus
aagactgtaccacggccacacccta

SEQ ID NO: 856606 - DNA, 25 bp, Mus musculus
aagactgtaccactgacttcaatgc

SEQ ID NO: 856607 - DNA, 25 bp, Mus musculus
aagactgtaccaggcccagtctgtg

SEQ ID NO: 856608 - DNA, 25 bp, Mus musculus
aagactgtaccagggccacacccta

SEQ ID NO: 856609 - DNA, 25 bp, Mus musculus
aagactgtaccagtgacttcaatgc

SEQ ID NO: 856610 - DNA, 25 bp, Mus musculus
aagactgtgatgcccagcagatacg

SEQ ID NO: 856611 - DNA, 25 bp, Mus musculus
aagactgtgatggccagcagatacg

SEQ ID NO: 856612 - DNA, 25 bp, Mus musculus
aagactgtgcatctgctccaagtga

SEQ ID NO: 856613 - DNA, 25 bp, Mus musculus
aagactgtgcatgtgctccaagtga

SEQ ID NO: 856614 - DNA, 25 bp, Mus musculus
aagactgtgtggaagtgaagggctt

SEQ ID NO: 856615 - DNA, 25 bp, Mus musculus
aagactgtgtggtagtgaagggctt

SEQ ID NO: 856616 - DNA, 25 bp, Mus musculus
aagacttcagagcataccaagaaga

SEQ ID NO: 856617 - DNA, 25 bp, Mus musculus
aagacttcagaggataccaagaaga

SEQ ID NO: 856618 - DNA, 25 bp, Mus musculus
aagacttctccacgctagaaaatgc

SEQ ID NO: 856619 - DNA, 25 bp, Mus musculus
aagacttctccaggctagaaaatgc

SEQ ID NO: 856620 - DNA, 25 bp, Mus musculus
aagacttgactacacacgctgagag

SEQ ID NO: 856621 - DNA, 25 bp, Mus musculus
aagacttgactagacacgctgagag

SEQ ID NO: 856622 - DNA, 25 bp, Mus musculus
aagactttcattcgcacagtacgag

SEQ ID NO: 856623 - DNA, 25 bp, Mus musculus
aagactttcattggcacagtacgag

SEQ ID NO: 856624 - DNA, 25 bp, Mus musculus
aagactttttacaaagtgattggag

SEQ ID NO: 856625 - DNA, 25 bp, Mus musculus
aagactttttacaatgtgattggag

SEQ ID NO: 856626 - DNA, 25 bp, Mus musculus
aagagaaaacaacatgatgaaggtt

SEQ ID NO: 856627 - DNA, 25 bp, Mus musculus
aagagaaaacaagatgatgaaggtt

SEQ ID NO: 856628 - DNA, 25 bp, Mus musculus
aagagaaaacagccatgtaatgaat

SEQ ID NO: 856629 - DNA, 25 bp, Mus musculus
aagagaaaacagctctcagcatcag

SEQ ID NO: 856630 - DNA, 25 bp, Mus musculus
aagagaaaacaggcatgtaatgaat

SEQ ID NO: 856631 - DNA, 25 bp, Mus musculus
aagagaaaacaggtctcagcatcag

SEQ ID NO: 856632 - DNA, 25 bp, Mus musculus
aagagaaaatatcgctttattgaaa

SEQ ID NO: 856633 - DNA, 25 bp, Mus musculus
aagagaaaatatggctttattgaaa

SEQ ID NO: 856634 - DNA, 25 bp, Mus musculus
aagagaaagcctggcctgcggcgaa

SEQ ID NO: 856635 - DNA, 25 bp, Mus musculus
aagagaaagcctgggctgcggcgaa

SEQ ID NO: 856636 - DNA, 25 bp, Mus musculus
aagagaaccgccatggagagtagaa

SEQ ID NO: 856637 - DNA, 25 bp, Mus musculus
aagagaaccggcatggagagtagaa

SEQ ID NO: 856638 - DNA, 25 bp, Mus musculus
aagagaaccttacacgtcactgcag

SEQ ID NO: 856639 - DNA, 25 bp, Mus musculus
aagagaaccttacaggtcactgcag

SEQ ID NO: 856640 - DNA, 25 bp, Mus musculus
aagagaactccacagactcactggc

SEQ ID NO: 856641 - DNA, 25 bp, Mus musculus
aagagaactccagagactcactggc

SEQ ID NO: 856642 - DNA, 25 bp, Mus musculus
aagagaagaaagaagttccagcagc

SEQ ID NO: 856643 - DNA, 25 bp, Mus musculus
aagagaagaaagatccagcagcaat

SEQ ID NO: 856644 - DNA, 25 bp, Mus musculus
aagagaagaaagtagttccagcagc

SEQ ID NO: 856645 - DNA, 25 bp, Mus musculus
aagagaagaaagttccagcagcaat

SEQ ID NO: 856646 - DNA, 25 bp, Mus musculus
aagagaagaagaattaactctgctg

SEQ ID NO: 856647 - DNA, 25 bp, Mus musculus
aagagaagaagaatttgggcttcct

SEQ ID NO: 856648 - DNA, 25 bp, Mus musculus
aagagaagaagatttaactctgctg

SEQ ID NO: 856649 - DNA, 25 bp, Mus musculus
aagagaagaagattttgggcttcct

SEQ ID NO: 856650 - DNA, 25 bp, Mus musculus
aagagaagcggccggagtacctgac

SEQ ID NO: 856651 - DNA, 25 bp, Mus musculus
aagagaagcggcgggagtacctgac

SEQ ID NO: 856652 - DNA, 25 bp, Mus musculus
aagagaagtattcaggaagccattc

SEQ ID NO: 856653 - DNA, 25 bp, Mus musculus
aagagaagtattgaggaagccattc

SEQ ID NO: 856654 - DNA, 25 bp, Mus musculus
aagagaatagatattatggtgggaa

SEQ ID NO: 856655 - DNA, 25 bp, Mus musculus
aagagaatagttattatggtgggaa

SEQ ID NO: 856656 - DNA, 25 bp, Mus musculus
aagagaatccagatatttttgcagt

SEQ ID NO: 856657 - DNA, 25 bp, Mus musculus
aagagaatccagttatttttgcagt

SEQ ID NO: 856658 - DNA, 25 bp, Mus musculus
aagagaatggctgtactccatgagc

SEQ ID NO: 856659 - DNA, 25 bp, Mus musculus
aagagaatgggtgtactccatgagc

SEQ ID NO: 856660 - DNA, 25 bp, Mus musculus
aagagaattgagcgtttatcactcc

SEQ ID NO: 856661 - DNA, 25 bp, Mus musculus
aagagaattgagggtttatcactcc

SEQ ID NO: 856662 - DNA, 25 bp, Mus musculus
aagagacataaacaagacccggatg

SEQ ID NO: 856663 - DNA, 25 bp, Mus musculus
aagagacataaacacccggatggca

SEQ ID NO: 856664 - DNA, 25 bp, Mus musculus
aagagacataaagaagacccggatg

SEQ ID NO: 856665 - DNA, 25 bp, Mus musculus
aagagacataaagacccggatggca

SEQ ID NO: 856666 - DNA, 25 bp, Mus musculus
aagagacgagctctgtgccctgatc

SEQ ID NO: 856667 - DNA, 25 bp, Mus musculus
aagagacgagctgtgtgccctgatc

SEQ ID NO: 856668 - DNA, 25 bp, Mus musculus
aagagactcctgaattgcatgaaag

SEQ ID NO: 856669 - DNA, 25 bp, Mus musculus
aagagactcctgtattgcatgaaag

SEQ ID NO: 856670 - DNA, 25 bp, Mus musculus
aagagagaaaactcatggggaagtg

SEQ ID NO: 856671 - DNA, 25 bp, Mus musculus
aagagagaaatctcatggggaagtg

SEQ ID NO: 856672 - DNA, 25 bp, Mus musculus
aagagagatgataacgagagacccc

SEQ ID NO: 856673 - DNA, 25 bp, Mus musculus
aagagagatgataacgtccagagtt

SEQ ID NO: 856674 - DNA, 25 bp, Mus musculus
aagagagatgataaggagagacccc

SEQ ID NO: 856675 - DNA, 25 bp, Mus musculus
aagagagatgataaggtccagagtt

SEQ ID NO: 856676 - DNA, 25 bp, Mus musculus
aagagagcaaagctgtcattctgtg

SEQ ID NO: 856677 - DNA, 25 bp, Mus musculus
aagagagcaaaggtgtcattctgtg

SEQ ID NO: 856678 - DNA, 25 bp, Mus musculus
aagagagcagacccgtctgaaacga

SEQ ID NO: 856679 - DNA, 25 bp, Mus musculus
aagagagcagtcccgtctgaaacga

SEQ ID NO: 856680 - DNA, 25 bp, Mus musculus
aagagagctagaagtgcagcatcct

SEQ ID NO: 856681 - DNA, 25 bp, Mus musculus
aagagagctagatgtgcagcatcct

SEQ ID NO: 856682 - DNA, 25 bp, Mus musculus
aagagagtcagaagagttcgctata

SEQ ID NO: 856683 - DNA, 25 bp, Mus musculus
aagagagtcagaagtgttcgctata

SEQ ID NO: 856684 - DNA, 25 bp, Mus musculus
aagagataagatctccatcatgtgt

SEQ ID NO: 856685 - DNA, 25 bp, Mus musculus
aagagataagatgtccatcatgtgt

SEQ ID NO: 856686 - DNA, 25 bp, Mus musculus
aagagatataccattggccggaccc

SEQ ID NO: 856687 - DNA, 25 bp, Mus musculus
aagagatatagcattggccggaccc

SEQ ID NO: 856688 - DNA, 25 bp, Mus musculus
aagagatcacagagcatttccgcta

SEQ ID NO: 856689 - DNA, 25 bp, Mus musculus
aagagatcacagtgcatttccgcta

SEQ ID NO: 856690 - DNA, 25 bp, Mus musculus
aagagatcagatccctgaatcccca

SEQ ID NO: 856691 - DNA, 25 bp, Mus musculus
aagagatcagttccctgaatcccca

SEQ ID NO: 856692 - DNA, 25 bp, Mus musculus
aagagatggactcatgcacttctga

SEQ ID NO: 856693 - DNA, 25 bp, Mus musculus
aagagatggagtcatgcacttctga

SEQ ID NO: 856694 - DNA, 25 bp, Mus musculus
aagagatggccaaatacgcctacta

SEQ ID NO: 856695 - DNA, 25 bp, Mus musculus
aagagatggccatatacgcctacta

SEQ ID NO: 856696 - DNA, 25 bp, Mus musculus
aagagatgtacaaacgaggaaaagc

SEQ ID NO: 856697 - DNA, 25 bp, Mus musculus
aagagatgtacaaaggaggaaaagc

SEQ ID NO: 856698 - DNA, 25 bp, Mus musculus
aagagattacagctgaagcagaacc

SEQ ID NO: 856699 - DNA, 25 bp, Mus musculus
aagagattacaggtgaagcagaacc

SEQ ID NO: 856700 - DNA, 25 bp, Mus musculus
aagagattatatcacgttgtacggg

SEQ ID NO: 856701 - DNA, 25 bp, Mus musculus
aagagattatatcaggttgtacggg

SEQ ID NO: 856702 - DNA, 25 bp, Mus musculus
aagagattcaaaccagaataccaga

SEQ ID NO: 856703 - DNA, 25 bp, Mus musculus
aagagattcaaagcagaataccaga

SEQ ID NO: 856704 - DNA, 25 bp, Mus musculus
aagagattggcacgggtgccttctc

SEQ ID NO: 856705 - DNA, 25 bp, Mus musculus
aagagattggcaggggtgccttctc

SEQ ID NO: 856706 - DNA, 25 bp, Mus musculus
aagagcaaaaagtttcaaatgtatt

SEQ ID NO: 856707 - DNA, 25 bp, Mus musculus
aagagcaaaatgtttcaaatgtatt

SEQ ID NO: 856708 - DNA, 25 bp, Mus musculus
aagagcaaagagagtgccatcgcca

SEQ ID NO: 856709 - DNA, 25 bp, Mus musculus
aagagcaaagagtgtgccatcgcca

SEQ ID NO: 856710 - DNA, 25 bp, Mus musculus
aagagcaagcacccccccagaggta

SEQ ID NO: 856711 - DNA, 25 bp, Mus musculus
aagagcaagcacgcccccagaggta

SEQ ID NO: 856712 - DNA, 25 bp, Mus musculus
aagagcaagtagctcatattgacgg

SEQ ID NO: 856713 - DNA, 25 bp, Mus musculus
aagagcaagtagctgatattgacgg

SEQ ID NO: 856714 - DNA, 25 bp, Mus musculus
aagagcacttttcagcacaagtgca

SEQ ID NO: 856715 - DNA, 25 bp, Mus musculus
aagagcacttttcgactacattgca

SEQ ID NO: 856716 - DNA, 25 bp, Mus musculus
aagagcacttttgagcacaagtgca

SEQ ID NO: 856717 - DNA, 25 bp, Mus musculus
aagagcacttttggactacattgca

SEQ ID NO: 856718 - DNA, 25 bp, Mus musculus
aagagcagagagccttctgctgggg

SEQ ID NO: 856719 - DNA, 25 bp, Mus musculus
aagagcagagtgccttctgctgggg

SEQ ID NO: 856720 - DNA, 25 bp, Mus musculus
aagagcagattgctcaattcaagga

SEQ ID NO: 856721 - DNA, 25 bp, Mus musculus
aagagcagattgctgaattcaagga

SEQ ID NO: 856722 - DNA, 25 bp, Mus musculus
aagagcagcaagcgcatgcagctgg

SEQ ID NO: 856723 - DNA, 25 bp, Mus musculus
aagagcagcaagggcatgcagctgg

SEQ ID NO: 856724 - DNA, 25 bp, Mus musculus
aagagcatggaccactctcacacac

SEQ ID NO: 856725 - DNA, 25 bp, Mus musculus
aagagcatggacgactctcacacac

SEQ ID NO: 856726 - DNA, 25 bp, Mus musculus
aagagccaaacgagccacaatcatg

SEQ ID NO: 856727 - DNA, 25 bp, Mus musculus
aagagccaaacgtgccacaatcatg

SEQ ID NO: 856728 - DNA, 25 bp, Mus musculus
aagagccagaagaaacctcagacag

SEQ ID NO: 856729 - DNA, 25 bp, Mus musculus
aagagccagaagtaacctcagacag

SEQ ID NO: 856730 - DNA, 25 bp, Mus musculus
aagagccataacctcaatgtagagt

SEQ ID NO: 856731 - DNA, 25 bp, Mus musculus
aagagccataacctgaatgtagagt

SEQ ID NO: 856732 - DNA, 25 bp, Mus musculus
aagagcccagagccatgtcggaccc

SEQ ID NO: 856733 - DNA, 25 bp, Mus musculus
aagagcccagcttgtctgttctttc

SEQ ID NO: 856734 - DNA, 25 bp, Mus musculus
aagagcccaggttgtctgttctttc

SEQ ID NO: 856735 - DNA, 25 bp, Mus musculus
aagagcccagtgccatgtcggaccc

SEQ ID NO: 856736 - DNA, 25 bp, Mus musculus
aagagccccactcacgcggtgttta

SEQ ID NO: 856737 - DNA, 25 bp, Mus musculus
aagagccccagactggtaaacagct

SEQ ID NO: 856738 - DNA, 25 bp, Mus musculus
aagagccccagagtggtaaacagct

SEQ ID NO: 856739 - DNA, 25 bp, Mus musculus
aagagccccagtcacgcggtgttta

SEQ ID NO: 856740 - DNA, 25 bp, Mus musculus
aagagccggagtccctctacagaga

SEQ ID NO: 856741 - DNA, 25 bp, Mus musculus
aagagccggagtccgtctacagaga

SEQ ID NO: 856742 - DNA, 25 bp, Mus musculus
aagagcgaggagacgagcaaaaatc

SEQ ID NO: 856743 - DNA, 25 bp, Mus musculus
aagagcgaggagctggaagatatca

SEQ ID NO: 856744 - DNA, 25 bp, Mus musculus
aagagcgaggaggtggaagatatca

SEQ ID NO: 856745 - DNA, 25 bp, Mus musculus
aagagcgaggagtcgagcaaaaatc

SEQ ID NO: 856746 - DNA, 25 bp, Mus musculus
aagagctacagacaatttttgacac

SEQ ID NO: 856747 - DNA, 25 bp, Mus musculus
aagagctacagacattttttgacac

SEQ ID NO: 856748 - DNA, 25 bp, Mus musculus
aagagctactgtaatgatcagtcaa

SEQ ID NO: 856749 - DNA, 25 bp, Mus musculus
aagagctactgttatgatcagtcaa

SEQ ID NO: 856750 - DNA, 25 bp, Mus musculus
aagagctatgagtatggccccatcc

SEQ ID NO: 856751 - DNA, 25 bp, Mus musculus
aagagctatgtgtatggccccatcc

SEQ ID NO: 856752 - DNA, 25 bp, Mus musculus
aagagctcaactgccccacccctgg

SEQ ID NO: 856753 - DNA, 25 bp, Mus musculus
aagagctcaagtgccccacccctgg

SEQ ID NO: 856754 - DNA, 25 bp, Mus musculus
aagagctcagctttgggattccctc

SEQ ID NO: 856755 - DNA, 25 bp, Mus musculus
aagagctcaggtttgggattccctc

SEQ ID NO: 856756 - DNA, 25 bp, Mus musculus
aagagctccgagacgctatccggca

SEQ ID NO: 856757 - DNA, 25 bp, Mus musculus
aagagctccgagtcgctatccggca

SEQ ID NO: 856758 - DNA, 25 bp, Mus musculus
aagagctccgggactgaagtgtcct

SEQ ID NO: 856759 - DNA, 25 bp, Mus musculus
aagagctccgggtctgaagtgtcct

SEQ ID NO: 856760 - DNA, 25 bp, Mus musculus
aagagctcgaagccatacacagtct

SEQ ID NO: 856761 - DNA, 25 bp, Mus musculus
aagagctcgaaggcatacacagtct

SEQ ID NO: 856762 - DNA, 25 bp, Mus musculus
aagagctctgagctggaaggtgata

SEQ ID NO: 856763 - DNA, 25 bp, Mus musculus
aagagctctgaggtggaaggtgata

SEQ ID NO: 856764 - DNA, 25 bp, Mus musculus
aagagctgagcatcatctgtcccta

SEQ ID NO: 856765 - DNA, 25 bp, Mus musculus
aagagctgaggatcatctgtcccta

SEQ ID NO: 856766 - DNA, 25 bp, Mus musculus
aagagctgtgaccggtgccgggagg

SEQ ID NO: 856767 - DNA, 25 bp, Mus musculus
aagagctgtgacgggtgccgggagg

SEQ ID NO: 856768 - DNA, 25 bp, Mus musculus
aagagctgttcacctgtcccactcc

SEQ ID NO: 856769 - DNA, 25 bp, Mus musculus
aagagctgttcagctgtcccactcc

SEQ ID NO: 856770 - DNA, 25 bp, Mus musculus
aagagcttccacgacgaggaaagaa

SEQ ID NO: 856771 - DNA, 25 bp, Mus musculus
aagagcttccacgaggaggaaagaa

SEQ ID NO: 856772 - DNA, 25 bp, Mus musculus
aagagcttcgagaacgccaaagaat

SEQ ID NO: 856773 - DNA, 25 bp, Mus musculus
aagagcttcgagaaggccaaagaat

SEQ ID NO: 856774 - DNA, 25 bp, Mus musculus
aagagcttcgccagaaacctcagct

SEQ ID NO: 856775 - DNA, 25 bp, Mus musculus
aagagcttcgcctgaaacctcagct

SEQ ID NO: 856776 - DNA, 25 bp, Mus musculus
aagagcttctttcgtccgcagaaca

SEQ ID NO: 856777 - DNA, 25 bp, Mus musculus
aagagcttctttggtccgcagaaca

SEQ ID NO: 856778 - DNA, 25 bp, Mus musculus
aagaggaaagacaaagtcagcatac

SEQ ID NO: 856779 - DNA, 25 bp, Mus musculus
aagaggaaagacagctacaaccaag

SEQ ID NO: 856780 - DNA, 25 bp, Mus musculus
aagaggaaagagaaagagagcgagc

SEQ ID NO: 856781 - DNA, 25 bp, Mus musculus
aagaggaaagagatgagccgccaga

SEQ ID NO: 856782 - DNA, 25 bp, Mus musculus
aagaggaaagctaccagcagtgctg

SEQ ID NO: 856783 - DNA, 25 bp, Mus musculus
aagaggaaaggtaccagcagtgctg

SEQ ID NO: 856784 - DNA, 25 bp, Mus musculus
aagaggaaagtcaaagtcagcatac

SEQ ID NO: 856785 - DNA, 25 bp, Mus musculus
aagaggaaagtcagctacaaccaag

SEQ ID NO: 856786 - DNA, 25 bp, Mus musculus
aagaggaaagtgaaagagagcgagc

SEQ ID NO: 856787 - DNA, 25 bp, Mus musculus
aagaggaaagtgatgagccgccaga

SEQ ID NO: 856788 - DNA, 25 bp, Mus musculus
aagaggaaccgaaactctaagcatc

SEQ ID NO: 856789 - DNA, 25 bp, Mus musculus
aagaggaaccgaaagtctaagcatc

SEQ ID NO: 856790 - DNA, 25 bp, Mus musculus
aagaggaaggcgaacatttgcagtc

SEQ ID NO: 856791 - DNA, 25 bp, Mus musculus
aagaggaaggcgaagatttgcagtc

SEQ ID NO: 856792 - DNA, 25 bp, Mus musculus
aagaggaatgtgcgttcctatttct

SEQ ID NO: 856793 - DNA, 25 bp, Mus musculus
aagaggaatgtgggttcctatttct

SEQ ID NO: 856794 - DNA, 25 bp, Mus musculus
aagaggacaaagatcttgactccca

SEQ ID NO: 856795 - DNA, 25 bp, Mus musculus
aagaggacaaagttcttgactccca

SEQ ID NO: 856796 - DNA, 25 bp, Mus musculus
aagaggacaatgaccgggatggcgt

SEQ ID NO: 856797 - DNA, 25 bp, Mus musculus
aagaggacaatgacggggatggcgt

SEQ ID NO: 856798 - DNA, 25 bp, Mus musculus
aagaggacagctatgatttcattgg

SEQ ID NO: 856799 - DNA, 25 bp, Mus musculus
aagaggacagctttgatttcattgg

SEQ ID NO: 856800 - DNA, 25 bp, Mus musculus
aagaggacgatgatcgcttgtggag

SEQ ID NO: 856801 - DNA, 25 bp, Mus musculus
aagaggacgatgatggcttgtggag

SEQ ID NO: 856802 - DNA, 25 bp, Mus musculus
aagaggactcttcgaactattctca

SEQ ID NO: 856803 - DNA, 25 bp, Mus musculus
aagaggactcttggaactattctca

SEQ ID NO: 856804 - DNA, 25 bp, Mus musculus
aagaggagagaaaacggagctgtga

SEQ ID NO: 856805 - DNA, 25 bp, Mus musculus
aagaggagagaaaagggagctgtga

SEQ ID NO: 856806 - DNA, 25 bp, Mus musculus
aagaggagccatcaatgtatcattg

SEQ ID NO: 856807 - DNA, 25 bp, Mus musculus
aagaggagccatgaatgtatcattg

SEQ ID NO: 856808 - DNA, 25 bp, Mus musculus
aagaggaggaagagcagccttccaa

SEQ ID NO: 856809 - DNA, 25 bp, Mus musculus
aagaggaggaagatcactctgagga

SEQ ID NO: 856810 - DNA, 25 bp, Mus musculus
aagaggaggaagatgactctgagga

SEQ ID NO: 856811 - DNA, 25 bp, Mus musculus
aagaggaggaagtgcagccttccaa

SEQ ID NO: 856812 - DNA, 25 bp, Mus musculus
aagaggaggacagcattgacttcat

SEQ ID NO: 856813 - DNA, 25 bp, Mus musculus
aagaggaggacagctttgacttcat

SEQ ID NO: 856814 - DNA, 25 bp, Mus musculus
aagaggaggagaaccgagttcatat

SEQ ID NO: 856815 - DNA, 25 bp, Mus musculus
aagaggaggagaacggagttcatat

SEQ ID NO: 856816 - DNA, 25 bp, Mus musculus
aagaggatgctgcatccatccatta

SEQ ID NO: 856817 - DNA, 25 bp, Mus musculus
aagaggatgctggatccatccatta

SEQ ID NO: 856818 - DNA, 25 bp, Mus musculus
aagaggcaagacctggggatctggg

SEQ ID NO: 856819 - DNA, 25 bp, Mus musculus
aagaggcaagtcctggggatctggg

SEQ ID NO: 856820 - DNA, 25 bp, Mus musculus
aagaggcacgcaacacagtgggtcc

SEQ ID NO: 856821 - DNA, 25 bp, Mus musculus
aagaggcacggaacacagtgggtcc

SEQ ID NO: 856822 - DNA, 25 bp, Mus musculus
aagaggcattgctgagttacatagt

SEQ ID NO: 856823 - DNA, 25 bp, Mus musculus
aagaggcattgctgtgttacatagt

SEQ ID NO: 856824 - DNA, 25 bp, Mus musculus
aagaggccccagagaaggggcagag

SEQ ID NO: 856825 - DNA, 25 bp, Mus musculus
aagaggccccagtgaaggggcagag

SEQ ID NO: 856826 - DNA, 25 bp, Mus musculus
aagaggcgtgagctgctttcagctg

SEQ ID NO: 856827 - DNA, 25 bp, Mus musculus
aagaggcgtgaggtgctttcagctg

SEQ ID NO: 856828 - DNA, 25 bp, Mus musculus
aagaggctggcttcctcatgggtgc

SEQ ID NO: 856829 - DNA, 25 bp, Mus musculus
aagaggctgggttcctcatgggtgc

SEQ ID NO: 856830 - DNA, 25 bp, Mus musculus
aagaggctgtgaaacgcgtgttgga

SEQ ID NO: 856831 - DNA, 25 bp, Mus musculus
aagaggctgtgaaaggcgtgttgga

SEQ ID NO: 856832 - DNA, 25 bp, Mus musculus
aagaggcttcctctctttggcaccg

SEQ ID NO: 856833 - DNA, 25 bp, Mus musculus
aagaggcttcctgtctttggcaccg

SEQ ID NO: 856834 - DNA, 25 bp, Mus musculus
aagagggcaaatatggttatgtcct

SEQ ID NO: 856835 - DNA, 25 bp, Mus musculus
aagagggcaaatttggttatgtcct

SEQ ID NO: 856836 - DNA, 25 bp, Mus musculus
aagagggcgaatagtggagccccgg

SEQ ID NO: 856837 - DNA, 25 bp, Mus musculus
aagagggcgaatattcgcctcccac

SEQ ID NO: 856838 - DNA, 25 bp, Mus musculus
aagagggcgaattgtggagccccgg

SEQ ID NO: 856839 - DNA, 25 bp, Mus musculus
aagagggcgaattttcgcctcccac

SEQ ID NO: 856840 - DNA, 25 bp, Mus musculus
aagaggggaagaatatcggcaccac

SEQ ID NO: 856841 - DNA, 25 bp, Mus musculus
aagaggggaagattatcggcaccac

SEQ ID NO: 856842 - DNA, 25 bp, Mus musculus
aagaggggttaactgactgtgaagt

SEQ ID NO: 856843 - DNA, 25 bp, Mus musculus
aagaggggttaagtgactgtgaagt

SEQ ID NO: 856844 - DNA, 25 bp, Mus musculus
aagagggtgaagaaactgaaggctc

SEQ ID NO: 856845 - DNA, 25 bp, Mus musculus
aagagggtgaagtaactgaaggctc

SEQ ID NO: 856846 - DNA, 25 bp, Mus musculus
aagaggtacacaaacaagtattcct

SEQ ID NO: 856847 - DNA, 25 bp, Mus musculus
aagaggtacacatacaagtattcct

SEQ ID NO: 856848 - DNA, 25 bp, Mus musculus
aagaggtcaaagaggcgccagctga

SEQ ID NO: 856849 - DNA, 25 bp, Mus musculus
aagaggtcaaagtggcgccagctga

SEQ ID NO: 856850 - DNA, 25 bp, Mus musculus
aagaggttccagcagacctttgagg

SEQ ID NO: 856851 - DNA, 25 bp, Mus musculus
aagaggttccaggagacctttgagg

SEQ ID NO: 856852 - DNA, 25 bp, Mus musculus
aagagtatagtacgtatgaccaagg

SEQ ID NO: 856853 - DNA, 25 bp, Mus musculus
aagagtatagtaggtatgaccaagg

SEQ ID NO: 856854 - DNA, 25 bp, Mus musculus
aagagtccaacacctcagccaacaa

SEQ ID NO: 856855 - DNA, 25 bp, Mus musculus
aagagtccaacagctcagccaacaa

SEQ ID NO: 856856 - DNA, 25 bp, Mus musculus
aagagtccatcacgagtttggaaca

SEQ ID NO: 856857 - DNA, 25 bp, Mus musculus
aagagtccatcaggagtttggaaca

SEQ ID NO: 856858 - DNA, 25 bp, Mus musculus
aagagtctgcagcaaaacagcagac

SEQ ID NO: 856859 - DNA, 25 bp, Mus musculus
aagagtctgcaggaaaacagcagac

SEQ ID NO: 856860 - DNA, 25 bp, Mus musculus
aagagtctgctcagcgcggcttcat

SEQ ID NO: 856861 - DNA, 25 bp, Mus musculus
aagagtctgctcagggcggcttcat

SEQ ID NO: 856862 - DNA, 25 bp, Mus musculus
aagagtgaccagccgtgggaatggt

SEQ ID NO: 856863 - DNA, 25 bp, Mus musculus
aagagtgaccaggcgtgggaatggt

SEQ ID NO: 856864 - DNA, 25 bp, Mus musculus
aagagtgaggtgcgccagacatcag

SEQ ID NO: 856865 - DNA, 25 bp, Mus musculus
aagagtgaggtgggccagacatcag

SEQ ID NO: 856866 - DNA, 25 bp, Mus musculus
aagagtgcaatgcacgacagtggtg

SEQ ID NO: 856867 - DNA, 25 bp, Mus musculus
aagagtgcaatgcactccgtggtgg

SEQ ID NO: 856868 - DNA, 25 bp, Mus musculus
aagagtgcaatgcaggacagtggtg

SEQ ID NO: 856869 - DNA, 25 bp, Mus musculus
aagagtgcaatgcagtccgtggtgg

SEQ ID NO: 856870 - DNA, 25 bp, Mus musculus
aagagtgcagaggagatgccatacc

SEQ ID NO: 856871 - DNA, 25 bp, Mus musculus
aagagtgcagtggagatgccatacc

SEQ ID NO: 856872 - DNA, 25 bp, Mus musculus
aagagtgccaggctgaacctgtggc

SEQ ID NO: 856873 - DNA, 25 bp, Mus musculus
aagagtgccagggtgaacctgtggc

SEQ ID NO: 856874 - DNA, 25 bp, Mus musculus
aagagtgctggacacgccggggccc

SEQ ID NO: 856875 - DNA, 25 bp, Mus musculus
aagagtgctggacaggccggggccc

SEQ ID NO: 856876 - DNA, 25 bp, Mus musculus
aagagtggatcacatcatcatggca

SEQ ID NO: 856877 - DNA, 25 bp, Mus musculus
aagagtggatcagatcatcatggca

SEQ ID NO: 856878 - DNA, 25 bp, Mus musculus
aagagtgtcaagactgtgaaccaac

SEQ ID NO: 856879 - DNA, 25 bp, Mus musculus
aagagtgtcaagtctgtgaaccaac

SEQ ID NO: 856880 - DNA, 25 bp, Mus musculus
aagagttagcaacaaacatccatgg

SEQ ID NO: 856881 - DNA, 25 bp, Mus musculus
aagagttagcaacaagaaacatcca

SEQ ID NO: 856882 - DNA, 25 bp, Mus musculus
aagagttagcaagaaacatccatgg

SEQ ID NO: 856883 - DNA, 25 bp, Mus musculus
aagagttagcaagaagaaacatcca

SEQ ID NO: 856884 - DNA, 25 bp, Mus musculus
aagagttcaaattgatctctacacg

SEQ ID NO: 856885 - DNA, 25 bp, Mus musculus
aagagttcaacaagtttgatctcta

SEQ ID NO: 856886 - DNA, 25 bp, Mus musculus
aagagttcaagaagtttgatctcta

SEQ ID NO: 856887 - DNA, 25 bp, Mus musculus
aagagttcaatttgatctctacacg

SEQ ID NO: 856888 - DNA, 25 bp, Mus musculus
aagagttcagaccacaaatgctcca

SEQ ID NO: 856889 - DNA, 25 bp, Mus musculus
aagagttcagaccagaaatgctcca

SEQ ID NO: 856890 - DNA, 25 bp, Mus musculus
aagagttcagcacaaatttcacagg

SEQ ID NO: 856891 - DNA, 25 bp, Mus musculus
aagagttcagcacatatttcacagg

SEQ ID NO: 856892 - DNA, 25 bp, Mus musculus
aagagtttaaagcttgacatgacaa

SEQ ID NO: 856893 - DNA, 25 bp, Mus musculus
aagagtttaaaggttgacatgacaa

SEQ ID NO: 856894 - DNA, 25 bp, Mus musculus
aagagtttcatggacaatcaaaagc

SEQ ID NO: 856895 - DNA, 25 bp, Mus musculus
aagagtttcatggagaatcaaaagc

SEQ ID NO: 856896 - DNA, 25 bp, Mus musculus
aagagtttggcacagtatacgaagc

SEQ ID NO: 856897 - DNA, 25 bp, Mus musculus
aagagtttggcactgtcaaaggtcc

SEQ ID NO: 856898 - DNA, 25 bp, Mus musculus
aagagtttggcagagtatacgaagc

SEQ ID NO: 856899 - DNA, 25 bp, Mus musculus
aagagtttggcagtgtcaaaggtcc

SEQ ID NO: 856900 - DNA, 25 bp, Mus musculus
aagagtttgtctcgggcctcaacaa

SEQ ID NO: 856901 - DNA, 25 bp, Mus musculus
aagagtttgtctggggcctcaacaa

SEQ ID NO: 856902 - DNA, 25 bp, Mus musculus
aagataaaagcaaaaagaagctctg

SEQ ID NO: 856903 - DNA, 25 bp, Mus musculus
aagataaaaggaaaaagaagctctg

SEQ ID NO: 856904 - DNA, 25 bp, Mus musculus
aagataaagcgacgctgaaaggaaa

SEQ ID NO: 856905 - DNA, 25 bp, Mus musculus
aagataaagcgactttcactttcag

SEQ ID NO: 856906 - DNA, 25 bp, Mus musculus
aagataaagcgaggctgaaaggaaa

SEQ ID NO: 856907 - DNA, 25 bp, Mus musculus
aagataaagcgagtttcactttcag

SEQ ID NO: 856908 - DNA, 25 bp, Mus musculus
aagataaagtagagcagaggaagat

SEQ ID NO: 856909 - DNA, 25 bp, Mus musculus
aagataaagtagcagaggaagatgc

SEQ ID NO: 856910 - DNA, 25 bp, Mus musculus
aagataaagttgagcagaggaagat

SEQ ID NO: 856911 - DNA, 25 bp, Mus musculus
aagataaagttgcagaggaagatgc

SEQ ID NO: 856912 - DNA, 25 bp, Mus musculus
aagataacagctatcgtaaccactg

SEQ ID NO: 856913 - DNA, 25 bp, Mus musculus
aagataacaggtatcgtaaccactg

SEQ ID NO: 856914 - DNA, 25 bp, Mus musculus
aagataacccggcactgaatgcaca

SEQ ID NO: 856915 - DNA, 25 bp, Mus musculus
aagataacccgggactgaatgcaca

SEQ ID NO: 856916 - DNA, 25 bp, Mus musculus
aagataacctaactaccagcagtgc

SEQ ID NO: 856917 - DNA, 25 bp, Mus musculus
aagataacctaagtaccagcagtgc

SEQ ID NO: 856918 - DNA, 25 bp, Mus musculus
aagataagagatatgccagaatttc

SEQ ID NO: 856919 - DNA, 25 bp, Mus musculus
aagataagagatttgccagaatttc

SEQ ID NO: 856920 - DNA, 25 bp, Mus musculus
aagataataactttcacaagaagta

SEQ ID NO: 856921 - DNA, 25 bp, Mus musculus
aagataataagtttcacaagaagta

SEQ ID NO: 856922 - DNA, 25 bp, Mus musculus
aagataatgggtaacgaagtgaaag

SEQ ID NO: 856923 - DNA, 25 bp, Mus musculus
aagataatgggtaaggaagtgaaag

SEQ ID NO: 856924 - DNA, 25 bp, Mus musculus
aagataattgataacgagccaagca

SEQ ID NO: 856925 - DNA, 25 bp, Mus musculus
aagataattgataaggagccaagca

SEQ ID NO: 856926 - DNA, 25 bp, Mus musculus
aagatacttcagagagggggataag

SEQ ID NO: 856927 - DNA, 25 bp, Mus musculus
aagatacttcagtgagggggataag

SEQ ID NO: 856928 - DNA, 25 bp, Mus musculus
aagatacttccaatcacttccatgt

SEQ ID NO: 856929 - DNA, 25 bp, Mus musculus
aagatacttccattcacttccatgt

SEQ ID NO: 856930 - DNA, 25 bp, Mus musculus
aagatagagcggcgaaaaatggagt

SEQ ID NO: 856931 - DNA, 25 bp, Mus musculus
aagatagagcggggaaaaatggagt

SEQ ID NO: 856932 - DNA, 25 bp, Mus musculus
aagatagctgagcaggaggctaagg

SEQ ID NO: 856933 - DNA, 25 bp, Mus musculus
aagatagctgaggaggaggctaagg

SEQ ID NO: 856934 - DNA, 25 bp, Mus musculus
aagataggaggcaccctgctatgtg

SEQ ID NO: 856935 - DNA, 25 bp, Mus musculus
aagataggaggctccctgctatgtg

SEQ ID NO: 856936 - DNA, 25 bp, Mus musculus
aagatagtagaaacacagataaatt

SEQ ID NO: 856937 - DNA, 25 bp, Mus musculus
aagatagtagaatcacagataaatt

SEQ ID NO: 856938 - DNA, 25 bp, Mus musculus
aagatattgactcatataaaagcgg

SEQ ID NO: 856939 - DNA, 25 bp, Mus musculus
aagatattgagtcatataaaagcgg

SEQ ID NO: 856940 - DNA, 25 bp, Mus musculus
aagatcaaagatgatagaaccaatc

SEQ ID NO: 856941 - DNA, 25 bp, Mus musculus
aagatcaaagcctcagcgttctcac

SEQ ID NO: 856942 - DNA, 25 bp, Mus musculus
aagatcaaaggctcagcgttctcac

SEQ ID NO: 856943 - DNA, 25 bp, Mus musculus
aagatcaaagttgatagaaccaatc

SEQ ID NO: 856944 - DNA, 25 bp, Mus musculus
aagatcaacacaaggctgggccagg

SEQ ID NO: 856945 - DNA, 25 bp, Mus musculus
aagatcaacacatggctgggccagg

SEQ ID NO: 856946 - DNA, 25 bp, Mus musculus
aagatcaagaaacaggaagactcgg

SEQ ID NO: 856947 - DNA, 25 bp, Mus musculus
aagatcaagaaagaggaagactcgg

SEQ ID NO: 856948 - DNA, 25 bp, Mus musculus
aagatcaatcaacatgactgtgatg

SEQ ID NO: 856949 - DNA, 25 bp, Mus musculus
aagatcaatcaagatgactgtgatg

SEQ ID NO: 856950 - DNA, 25 bp, Mus musculus
aagatcaatgcgcagcagcaatgac

SEQ ID NO: 856951 - DNA, 25 bp, Mus musculus
aagatcaatgggcagcagcaatgac

SEQ ID NO: 856952 - DNA, 25 bp, Mus musculus
aagatcacatatagcccgtatacag

SEQ ID NO: 856953 - DNA, 25 bp, Mus musculus
aagatcacatattgcccgtatacag

SEQ ID NO: 856954 - DNA, 25 bp, Mus musculus
aagatcacttcaagtgggtaaagca

SEQ ID NO: 856955 - DNA, 25 bp, Mus musculus
aagatcacttcatgtgggtaaagca

SEQ ID NO: 856956 - DNA, 25 bp, Mus musculus
aagatcagagcaaacatccacatct

SEQ ID NO: 856957 - DNA, 25 bp, Mus musculus
aagatcagaggaaacatccacatct

SEQ ID NO: 856958 - DNA, 25 bp, Mus musculus
aagatcagcaagcagcttcaggatc

SEQ ID NO: 856959 - DNA, 25 bp, Mus musculus
aagatcagcaagctgattaccagga

SEQ ID NO: 856960 - DNA, 25 bp, Mus musculus
aagatcagcaaggagcttcaggatc

SEQ ID NO: 856961 - DNA, 25 bp, Mus musculus
aagatcagcaaggtgattaccagga

SEQ ID NO: 856962 - DNA, 25 bp, Mus musculus
aagatcatcccccaattgcagtgga

SEQ ID NO: 856963 - DNA, 25 bp, Mus musculus
aagatcatcccccatttgcagtgga

SEQ ID NO: 856964 - DNA, 25 bp, Mus musculus
aagatcatcgaaatcaagattggat

SEQ ID NO: 856965 - DNA, 25 bp, Mus musculus
aagatcatcgaaatcatgccagaat

SEQ ID NO: 856966 - DNA, 25 bp, Mus musculus
aagatcatcgaaatcgaaatcagag

SEQ ID NO: 856967 - DNA, 25 bp, Mus musculus
aagatcatcgaaatgaagattggat

SEQ ID NO: 856968 - DNA, 25 bp, Mus musculus
aagatcatcgaaatgatgccagaat

SEQ ID NO: 856969 - DNA, 25 bp, Mus musculus
aagatcatcgaaatggaaatcagag

SEQ ID NO: 856970 - DNA, 25 bp, Mus musculus
aagatccaagatgctcaccggctgc

SEQ ID NO: 856971 - DNA, 25 bp, Mus musculus
aagatccaagttgctcaccggctgc

SEQ ID NO: 856972 - DNA, 25 bp, Mus musculus
aagatccactcgtgggagaacgtgt

SEQ ID NO: 856973 - DNA, 25 bp, Mus musculus
aagatccactggtgggagaacgtgt

SEQ ID NO: 856974 - DNA, 25 bp, Mus musculus
aagatccagtatcacaacgtgaagc

SEQ ID NO: 856975 - DNA, 25 bp, Mus musculus
aagatccagtttcacaacgtgaagc

SEQ ID NO: 856976 - DNA, 25 bp, Mus musculus
aagatcccaaggatctggtggaaga

SEQ ID NO: 856977 - DNA, 25 bp, Mus musculus
aagatcccaaggttctggtggaaga

SEQ ID NO: 856978 - DNA, 25 bp, Mus musculus
aagatcccaccacgctgcaacctga

SEQ ID NO: 856979 - DNA, 25 bp, Mus musculus
aagatcccaccaggctgcaacctga

SEQ ID NO: 856980 - DNA, 25 bp, Mus musculus
aagatcctctcgctaaatggccaag

SEQ ID NO: 856981 - DNA, 25 bp, Mus musculus
aagatcctctcggtaaatggccaag

SEQ ID NO: 856982 - DNA, 25 bp, Mus musculus
aagatcctgaggaactggtttgagc

SEQ ID NO: 856983 - DNA, 25 bp, Mus musculus
aagatcctgaggaagtggtttgagc

SEQ ID NO: 856984 - DNA, 25 bp, Mus musculus
aagatcctgcaaagcgcatccctgg

SEQ ID NO: 856985 - DNA, 25 bp, Mus musculus
aagatcctgcaaagggcatccctgg

SEQ ID NO: 856986 - DNA, 25 bp, Mus musculus
aagatcctggagcacttggaatctc

SEQ ID NO: 856987 - DNA, 25 bp, Mus musculus
aagatcctggaggacttggaatctc

SEQ ID NO: 856988 - DNA, 25 bp, Mus musculus
aagatccttgcttctcgctggaagt

SEQ ID NO: 856989 - DNA, 25 bp, Mus musculus
aagatccttggttctcgctggaagt

SEQ ID NO: 856990 - DNA, 25 bp, Mus musculus
aagatctacctcagcaatgaatcag

SEQ ID NO: 856991 - DNA, 25 bp, Mus musculus
aagatctacctcaggaatgaatcag

SEQ ID NO: 856992 - DNA, 25 bp, Mus musculus
aagatctctacacaggaaggcatta

SEQ ID NO: 856993 - DNA, 25 bp, Mus musculus
aagatctctacagaggaaggcatta

SEQ ID NO: 856994 - DNA, 25 bp, Mus musculus
aagatctctgccaatccatagtacc

SEQ ID NO: 856995 - DNA, 25 bp, Mus musculus
aagatctctggcaatccatagtacc

SEQ ID NO: 856996 - DNA, 25 bp, Mus musculus
aagatctgacccaacagattgctat

SEQ ID NO: 856997 - DNA, 25 bp, Mus musculus
aagatctgacccaaccttatgatgg

SEQ ID NO: 856998 - DNA, 25 bp, Mus musculus
aagatctgacccaagagattgctat

SEQ ID NO: 856999 - DNA, 25 bp, Mus musculus
aagatctgacccaagcttatgatgg

SEQ ID NO: 857000 - DNA, 25 bp, Mus musculus
aagatctgcaaaatcatggaccagg

SEQ ID NO: 857001 - DNA, 25 bp, Mus musculus
aagatctgcaaattcatggaccagg

SEQ ID NO: 857002 - DNA, 25 bp, Mus musculus
aagatctggcggatatcgtcagatt

SEQ ID NO: 857003 - DNA, 25 bp, Mus musculus
aagatctggcggttatcgtcagatt

SEQ ID NO: 857004 - DNA, 25 bp, Mus musculus
aagatcttagacctcgaagagaaac

SEQ ID NO: 857005 - DNA, 25 bp, Mus musculus
aagatcttagacctggaagagaaac

SEQ ID NO: 857006 - DNA, 25 bp, Mus musculus
aagatcttagcttcagttactaccc

SEQ ID NO: 857007 - DNA, 25 bp, Mus musculus
aagatcttaggttcagttactaccc

SEQ ID NO: 857008 - DNA, 25 bp, Mus musculus
aagatcttttcgcacaagccacaga

SEQ ID NO: 857009 - DNA, 25 bp, Mus musculus
aagatcttttcgcagaagccacaga

SEQ ID NO: 857010 - DNA, 25 bp, Mus musculus
aagatgaaacagcagccggttcgat

SEQ ID NO: 857011 - DNA, 25 bp, Mus musculus
aagatgaaacaggagccggttcgat

SEQ ID NO: 857012 - DNA, 25 bp, Mus musculus
aagatgaacactaaaacccagcacc

SEQ ID NO: 857013 - DNA, 25 bp, Mus musculus
aagatgaacacttaaacccagcacc

SEQ ID NO: 857014 - DNA, 25 bp, Mus musculus
aagatgaatatccacagactaagtc

SEQ ID NO: 857015 - DNA, 25 bp, Mus musculus
aagatgaatatccagagactaagtc

SEQ ID NO: 857016 - DNA, 25 bp, Mus musculus
aagatgaatatgaaaaggtggacaa

SEQ ID NO: 857017 - DNA, 25 bp, Mus musculus
aagatgaatatgaacatgttgtaga

SEQ ID NO: 857018 - DNA, 25 bp, Mus musculus
aagatgaatatgaagatgttgtaga

SEQ ID NO: 857019 - DNA, 25 bp, Mus musculus
aagatgaatatgtaaaggtggacaa

SEQ ID NO: 857020 - DNA, 25 bp, Mus musculus
aagatgacaaagccaccatttgtaa

SEQ ID NO: 857021 - DNA, 25 bp, Mus musculus
aagatgacaaaggcaccatttgtaa

SEQ ID NO: 857022 - DNA, 25 bp, Mus musculus
aagatgacaacttgaccccaaagat

SEQ ID NO: 857023 - DNA, 25 bp, Mus musculus
aagatgacaagttgaccccaaagat

SEQ ID NO: 857024 - DNA, 25 bp, Mus musculus
aagatgaccgtgcccaacgtgctgg

SEQ ID NO: 857025 - DNA, 25 bp, Mus musculus
aagatgaccgtgccgaacgtgctgg

SEQ ID NO: 857026 - DNA, 25 bp, Mus musculus
aagatgactaagatgctaaaaggat

SEQ ID NO: 857027 - DNA, 25 bp, Mus musculus
aagatgactaagttgctaaaaggat

SEQ ID NO: 857028 - DNA, 25 bp, Mus musculus
aagatgactgtggccattgtgaaag

SEQ ID NO: 857029 - DNA, 25 bp, Mus musculus
aagatgactgtggcgattgtgaaag

SEQ ID NO: 857030 - DNA, 25 bp, Mus musculus
aagatgacttaccacggtttgacct

SEQ ID NO: 857031 - DNA, 25 bp, Mus musculus
aagatgacttaccagggtttgacct

SEQ ID NO: 857032 - DNA, 25 bp, Mus musculus
aagatgagaaagctcatttactaca

SEQ ID NO: 857033 - DNA, 25 bp, Mus musculus
aagatgagaaaggtcatttactaca

SEQ ID NO: 857034 - DNA, 25 bp, Mus musculus
aagatgagacagcagacaatcaggc

SEQ ID NO: 857035 - DNA, 25 bp, Mus musculus
aagatgagacaggagacaatcaggc

SEQ ID NO: 857036 - DNA, 25 bp, Mus musculus
aagatgagatacaacggtcaatata

SEQ ID NO: 857037 - DNA, 25 bp, Mus musculus
aagatgagatacaacgtgtagtggc

SEQ ID NO: 857038 - DNA, 25 bp, Mus musculus
aagatgagatacaagggtcaatata

SEQ ID NO: 857039 - DNA, 25 bp, Mus musculus
aagatgagatacaaggtgtagtggc

SEQ ID NO: 857040 - DNA, 25 bp, Mus musculus
aagatgataacacctgctctcatcg

SEQ ID NO: 857041 - DNA, 25 bp, Mus musculus
aagatgataacagctgctctcatcg

SEQ ID NO: 857042 - DNA, 25 bp, Mus musculus
aagatgatgaaacccctctctatag

SEQ ID NO: 857043 - DNA, 25 bp, Mus musculus
aagatgatgaaagccctctctatag

SEQ ID NO: 857044 - DNA, 25 bp, Mus musculus
aagatgatgcagactttccagaggg

SEQ ID NO: 857045 - DNA, 25 bp, Mus musculus
aagatgatgcagtctttccagaggg

SEQ ID NO: 857046 - DNA, 25 bp, Mus musculus
aagatgattttgcaagttgctttaa

SEQ ID NO: 857047 - DNA, 25 bp, Mus musculus
aagatgattttggaagttgctttaa

SEQ ID NO: 857048 - DNA, 25 bp, Mus musculus
aagatgcaatcaaacttgtcctggg

SEQ ID NO: 857049 - DNA, 25 bp, Mus musculus
aagatgcaatcaaagttgtcctggg

SEQ ID NO: 857050 - DNA, 25 bp, Mus musculus
aagatgcacatcaacaaactggagg

SEQ ID NO: 857051 - DNA, 25 bp, Mus musculus
aagatgcacatcaagaaactggagg

SEQ ID NO: 857052 - DNA, 25 bp, Mus musculus
aagatgcactccatgaatgggttca

SEQ ID NO: 857053 - DNA, 25 bp, Mus musculus
aagatgcactgcatgaatgggttca

SEQ ID NO: 857054 - DNA, 25 bp, Mus musculus
aagatgcagaggaacctccgggcag

SEQ ID NO: 857055 - DNA, 25 bp, Mus musculus
aagatgcagaggaagctccgggcag

SEQ ID NO: 857056 - DNA, 25 bp, Mus musculus
aagatgccagcacacgcacacaaac

SEQ ID NO: 857057 - DNA, 25 bp, Mus musculus
aagatgccagcacaggcacacaaac

SEQ ID NO: 857058 - DNA, 25 bp, Mus musculus
aagatgccagccaatggttcagcgt

SEQ ID NO: 857059 - DNA, 25 bp, Mus musculus
aagatgccagcggatctgagtgtac

SEQ ID NO: 857060 - DNA, 25 bp, Mus musculus
aagatgccaggcaatggttcagcgt

SEQ ID NO: 857061 - DNA, 25 bp, Mus musculus
aagatgccaggggatctgagtgtac

SEQ ID NO: 857062 - DNA, 25 bp, Mus musculus
aagatgcccaagccaatcaacgtcc

SEQ ID NO: 857063 - DNA, 25 bp, Mus musculus
aagatgcccaagcctatcaacgtcc

SEQ ID NO: 857064 - DNA, 25 bp, Mus musculus
aagatgcccagacagcactggacat

SEQ ID NO: 857065 - DNA, 25 bp, Mus musculus
aagatgcccagagagcactggacat

SEQ ID NO: 857066 - DNA, 25 bp, Mus musculus
aagatgcctgcacaaaaacaagctg

SEQ ID NO: 857067 - DNA, 25 bp, Mus musculus
aagatgcctggacaaaaacaagctg

SEQ ID NO: 857068 - DNA, 25 bp, Mus musculus
aagatgcgtggccgatccatcctaa

SEQ ID NO: 857069 - DNA, 25 bp, Mus musculus
aagatgcgtggcggatccatcctaa

SEQ ID NO: 857070 - DNA, 25 bp, Mus musculus
aagatgctgaaaacgacagccagaa

SEQ ID NO: 857071 - DNA, 25 bp, Mus musculus
aagatgctgaaacacaatgcctccg

SEQ ID NO: 857072 - DNA, 25 bp, Mus musculus
aagatgctgaaacatgatgcgactg

SEQ ID NO: 857073 - DNA, 25 bp, Mus musculus
aagatgctgaaagacaatgcctccg

SEQ ID NO: 857074 - DNA, 25 bp, Mus musculus
aagatgctgaaagatgatgcgactg

SEQ ID NO: 857075 - DNA, 25 bp, Mus musculus
aagatgctgaaatcgacagccagaa

SEQ ID NO: 857076 - DNA, 25 bp, Mus musculus
aagatgctgcagccaccagaaagca

SEQ ID NO: 857077 - DNA, 25 bp, Mus musculus
aagatgctgcagctctgggaaggcc

SEQ ID NO: 857078 - DNA, 25 bp, Mus musculus
aagatgctgcaggcaccagaaagca

SEQ ID NO: 857079 - DNA, 25 bp, Mus musculus
aagatgctgcaggtctgggaaggcc

SEQ ID NO: 857080 - DNA, 25 bp, Mus musculus
aagatggaaagtcttaagaaagatt

SEQ ID NO: 857081 - DNA, 25 bp, Mus musculus
aagatggaaagtgttaagaaagatt

SEQ ID NO: 857082 - DNA, 25 bp, Mus musculus
aagatggaagaacccctctgggcgt

SEQ ID NO: 857083 - DNA, 25 bp, Mus musculus
aagatggaagaagccctctgggcgt

SEQ ID NO: 857084 - DNA, 25 bp, Mus musculus
aagatggacaagagctcttccagaa

SEQ ID NO: 857085 - DNA, 25 bp, Mus musculus
aagatggacaagtgctcttccagaa

SEQ ID NO: 857086 - DNA, 25 bp, Mus musculus
aagatggagagcatcacaaatgcgg

SEQ ID NO: 857087 - DNA, 25 bp, Mus musculus
aagatggagagcatgacaaatgcgg

SEQ ID NO: 857088 - DNA, 25 bp, Mus musculus
aagatggagcacctggcacagctgc

SEQ ID NO: 857089 - DNA, 25 bp, Mus musculus
aagatggagctcctggcacagctgc

SEQ ID NO: 857090 - DNA, 25 bp, Mus musculus
aagatggattttaacgtgagactgt

SEQ ID NO: 857091 - DNA, 25 bp, Mus musculus
aagatggattttaaggtgagactgt

SEQ ID NO: 857092 - DNA, 25 bp, Mus musculus
aagatggcaaagattactactttgt

SEQ ID NO: 857093 - DNA, 25 bp, Mus musculus
aagatggcaaagtttactactttgt

SEQ ID NO: 857094 - DNA, 25 bp, Mus musculus
aagatggcagaatagtgattgacgg

SEQ ID NO: 857095 - DNA, 25 bp, Mus musculus
aagatggcagtatagtgattgacgg

SEQ ID NO: 857096 - DNA, 25 bp, Mus musculus
aagatggcgggccgcactatgcaag

SEQ ID NO: 857097 - DNA, 25 bp, Mus musculus
aagatggcgggccgcgtttctgttg

SEQ ID NO: 857098 - DNA, 25 bp, Mus musculus
aagatggcgggccggactatgcaag

SEQ ID NO: 857099 - DNA, 25 bp, Mus musculus
aagatggcgggccgggtttctgttg

SEQ ID NO: 857100 - DNA, 25 bp, Mus musculus
aagatgggagccacctccaagtgga

SEQ ID NO: 857101 - DNA, 25 bp, Mus musculus
aagatgggaggcacctccaagtgga

SEQ ID NO: 857102 - DNA, 25 bp, Mus musculus
aagatggggtcaaacctgaccgcca

SEQ ID NO: 857103 - DNA, 25 bp, Mus musculus
aagatggggtcaaagctgaccgcca

SEQ ID NO: 857104 - DNA, 25 bp, Mus musculus
aagatggtggagactgtgttccgga

SEQ ID NO: 857105 - DNA, 25 bp, Mus musculus
aagatggtggagtctgtgttccgga

SEQ ID NO: 857106 - DNA, 25 bp, Mus musculus
aagatgtcacctcgcacaggcgaca

SEQ ID NO: 857107 - DNA, 25 bp, Mus musculus
aagatgtcacctggcacaggcgaca

SEQ ID NO: 857108 - DNA, 25 bp, Mus musculus
aagatgtcatctatcagctgatcca

SEQ ID NO: 857109 - DNA, 25 bp, Mus musculus
aagatgtcatctatgagctgatcca

SEQ ID NO: 857110 - DNA, 25 bp, Mus musculus
aagatgtggagactcgcacccagct

SEQ ID NO: 857111 - DNA, 25 bp, Mus musculus
aagatgtggagactggcacccagct

SEQ ID NO: 857112 - DNA, 25 bp, Mus musculus
aagatgtgtaggcgagctgtcccga

SEQ ID NO: 857113 - DNA, 25 bp, Mus musculus
aagatgtgtaggggagctgtcccga

SEQ ID NO: 857114 - DNA, 25 bp, Mus musculus
aagatgttgaaacatgatgccacag

SEQ ID NO: 857115 - DNA, 25 bp, Mus musculus
aagatgttgaaagatgatgccacag

SEQ ID NO: 857116 - DNA, 25 bp, Mus musculus
aagatgttgaagaccgacgcaacgg

SEQ ID NO: 857117 - DNA, 25 bp, Mus musculus
aagatgttgaagtccgacgcaacgg

SEQ ID NO: 857118 - DNA, 25 bp, Mus musculus
aagatgttgtcaatgtttatgaacc

SEQ ID NO: 857119 - DNA, 25 bp, Mus musculus
aagatgttgtcattgtttatgaacc

SEQ ID NO: 857120 - DNA, 25 bp, Mus musculus
aagatgtttgtgaacggggctccag

SEQ ID NO: 857121 - DNA, 25 bp, Mus musculus
aagatgtttgtgaagggggctccag

SEQ ID NO: 857122 - DNA, 25 bp, Mus musculus
aagatgttttatcacatttccctgg

SEQ ID NO: 857123 - DNA, 25 bp, Mus musculus
aagatgttttatcagatttccctgg

SEQ ID NO: 857124 - DNA, 25 bp, Mus musculus
aagattaaagatgtacaagcattcc

SEQ ID NO: 857125 - DNA, 25 bp, Mus musculus
aagattaaagttgtacaagcattcc

SEQ ID NO: 857126 - DNA, 25 bp, Mus musculus
aagattacagccagagtggcatgat

SEQ ID NO: 857127 - DNA, 25 bp, Mus musculus
aagattacagctcacgaagcagtgg

SEQ ID NO: 857128 - DNA, 25 bp, Mus musculus
aagattacagctcaggaagcagtgg

SEQ ID NO: 857129 - DNA, 25 bp, Mus musculus
aagattacaggcagagtggcatgat

SEQ ID NO: 857130 - DNA, 25 bp, Mus musculus
aagattaggaagcaagaatatgaac

SEQ ID NO: 857131 - DNA, 25 bp, Mus musculus
aagattaggaaggaagaatatgaac

SEQ ID NO: 857132 - DNA, 25 bp, Mus musculus
aagattcaagagcaaagtgaccaag

SEQ ID NO: 857133 - DNA, 25 bp, Mus musculus
aagattcaagagcatagtgaccaag

SEQ ID NO: 857134 - DNA, 25 bp, Mus musculus
aagattcggcagatgtgggggagca

SEQ ID NO: 857135 - DNA, 25 bp, Mus musculus
aagattcggcagttgtgggggagca

SEQ ID NO: 857136 - DNA, 25 bp, Mus musculus
aagattgaagcgctggacatccact

SEQ ID NO: 857137 - DNA, 25 bp, Mus musculus
aagattgaagggctggacatccact

SEQ ID NO: 857138 - DNA, 25 bp, Mus musculus
aagattgcacttccgcgctggcctt

SEQ ID NO: 857139 - DNA, 25 bp, Mus musculus
aagattgcacttgcgcgctggcctt

SEQ ID NO: 857140 - DNA, 25 bp, Mus musculus
aagattgccctcaccatcaacaagg

SEQ ID NO: 857141 - DNA, 25 bp, Mus musculus
aagattgccctcacccataaaaata

SEQ ID NO: 857142 - DNA, 25 bp, Mus musculus
aagattgccctcacgatcaacaagg

SEQ ID NO: 857143 - DNA, 25 bp, Mus musculus
aagattgccctcacgcataaaaata

SEQ ID NO: 857144 - DNA, 25 bp, Mus musculus
aagattgtcaagagcaactgcaatg

SEQ ID NO: 857145 - DNA, 25 bp, Mus musculus
aagattgtcaagtgcaactgcaatg

SEQ ID NO: 857146 - DNA, 25 bp, Mus musculus
aagattgtctggagatggctgcagc

SEQ ID NO: 857147 - DNA, 25 bp, Mus musculus
aagattgtctggtgatggctgcagc

SEQ ID NO: 857148 - DNA, 25 bp, Mus musculus
aagattgttaatcagaaataccata

SEQ ID NO: 857149 - DNA, 25 bp, Mus musculus
aagattgttattcagaaataccata

SEQ ID NO: 857150 - DNA, 25 bp, Mus musculus
aagatttatgagactaccgttaata

SEQ ID NO: 857151 - DNA, 25 bp, Mus musculus
aagatttatgagtctaccgttaata

SEQ ID NO: 857152 - DNA, 25 bp, Mus musculus
aagatttgagaaagaacgagtgaaa

SEQ ID NO: 857153 - DNA, 25 bp, Mus musculus
aagatttgagtaagaacgagtgaaa

SEQ ID NO: 857154 - DNA, 25 bp, Mus musculus
aagattttaaacgcactcctggaag

SEQ ID NO: 857155 - DNA, 25 bp, Mus musculus
aagattttaatcgcactcctggaag

SEQ ID NO: 857156 - DNA, 25 bp, Mus musculus
aagcaaaaccagaccccgcaggatc

SEQ ID NO: 857157 - DNA, 25 bp, Mus musculus
aagcaaaaccagtccccgcaggatc

SEQ ID NO: 857158 - DNA, 25 bp, Mus musculus
aagcaaagaacttctacctctgtct

SEQ ID NO: 857159 - DNA, 25 bp, Mus musculus
aagcaaagaagttctacctctgtct

SEQ ID NO: 857160 - DNA, 25 bp, Mus musculus
aagcaaagagaactccattgcgggg

SEQ ID NO: 857161 - DNA, 25 bp, Mus musculus
aagcaaagagtactccattgcgggg

SEQ ID NO: 857162 - DNA, 25 bp, Mus musculus
aagcaaaggactgtcgtcaatgtgc

SEQ ID NO: 857163 - DNA, 25 bp, Mus musculus
aagcaaaggactgtggtcaatgtgc

SEQ ID NO: 857164 - DNA, 25 bp, Mus musculus
aagcaaatgttgcgtgaacggctgt

SEQ ID NO: 857165 - DNA, 25 bp, Mus musculus
aagcaaatgttgggtgaacggctgt

SEQ ID NO: 857166 - DNA, 25 bp, Mus musculus
aagcaacaagcaggatctcagccaa

SEQ ID NO: 857167 - DNA, 25 bp, Mus musculus
aagcaacaagctgctccgccagcat

SEQ ID NO: 857168 - DNA, 25 bp, Mus musculus
aagcaacaaggaggatctcagccaa

SEQ ID NO: 857169 - DNA, 25 bp, Mus musculus
aagcaacaaggtgctccgccagcat

SEQ ID NO: 857170 - DNA, 25 bp, Mus musculus
aagcaacagatgatgatcaactgtg

SEQ ID NO: 857171 - DNA, 25 bp, Mus musculus
aagcaacagatgttgatcaactgtg

SEQ ID NO: 857172 - DNA, 25 bp, Mus musculus
aagcaacaggaactttgcatcatgc

SEQ ID NO: 857173 - DNA, 25 bp, Mus musculus
aagcaacaggaagtttgcatcatgc

SEQ ID NO: 857174 - DNA, 25 bp, Mus musculus
aagcaactggatgtgggagaagaag

SEQ ID NO: 857175 - DNA, 25 bp, Mus musculus
aagcaactggttgtgggagaagaag

SEQ ID NO: 857176 - DNA, 25 bp, Mus musculus
aagcaagaagccacttgctatcagc

SEQ ID NO: 857177 - DNA, 25 bp, Mus musculus
aagcaagaaggcacttgctatcagc

SEQ ID NO: 857178 - DNA, 25 bp, Mus musculus
aagcaagagcaaccccatgatgatg

SEQ ID NO: 857179 - DNA, 25 bp, Mus musculus
aagcaagagcaagcccatgatgatg

SEQ ID NO: 857180 - DNA, 25 bp, Mus musculus
aagcaagataaaagagcagaggaag

SEQ ID NO: 857181 - DNA, 25 bp, Mus musculus
aagcaagataaatgagcagaggaag

SEQ ID NO: 857182 - DNA, 25 bp, Mus musculus
aagcaagcagcccactcctgaccgg

SEQ ID NO: 857183 - DNA, 25 bp, Mus musculus
aagcaagcagctagaggatgaacta

SEQ ID NO: 857184 - DNA, 25 bp, Mus musculus
aagcaagcaggccactcctgaccgg

SEQ ID NO: 857185 - DNA, 25 bp, Mus musculus
aagcaagcaggtagaggatgaacta

SEQ ID NO: 857186 - DNA, 25 bp, Mus musculus
aagcaaggaagcggcaacagcacag

SEQ ID NO: 857187 - DNA, 25 bp, Mus musculus
aagcaaggaagcgggaacagcacag

SEQ ID NO: 857188 - DNA, 25 bp, Mus musculus
aagcaaggagcggtcatgaaaaact

SEQ ID NO: 857189 - DNA, 25 bp, Mus musculus
aagcaaggagcggtgatgaaaaact

SEQ ID NO: 857190 - DNA, 25 bp, Mus musculus
aagcaagtcgaggaagccgtcaaga

SEQ ID NO: 857191 - DNA, 25 bp, Mus musculus
aagcaagtcgaggatgccgtcaaga

SEQ ID NO: 857192 - DNA, 25 bp, Mus musculus
aagcaagtgcaaccaatagctgtct

SEQ ID NO: 857193 - DNA, 25 bp, Mus musculus
aagcaagtgcaacgcaaaggcagag

SEQ ID NO: 857194 - DNA, 25 bp, Mus musculus
aagcaagtgcaacgtttctgaaaga

SEQ ID NO: 857195 - DNA, 25 bp, Mus musculus
aagcaagtgcaagcaatagctgtct

SEQ ID NO: 857196 - DNA, 25 bp, Mus musculus
aagcaagtgcaaggcaaaggcagag

SEQ ID NO: 857197 - DNA, 25 bp, Mus musculus
aagcaagtgcaaggtttctgaaaga

SEQ ID NO: 857198 - DNA, 25 bp, Mus musculus
aagcaatctgagagatctcaataga

SEQ ID NO: 857199 - DNA, 25 bp, Mus musculus
aagcaatctgagtgatctcaataga

SEQ ID NO: 857200 - DNA, 25 bp, Mus musculus
aagcaatgagcattctgatcatgcc

SEQ ID NO: 857201 - DNA, 25 bp, Mus musculus
aagcaatgaggattctgatcatgcc

SEQ ID NO: 857202 - DNA, 25 bp, Mus musculus
aagcacaacctgagtggagagacag

SEQ ID NO: 857203 - DNA, 25 bp, Mus musculus
aagcacaacctgagtggggagacag

SEQ ID NO: 857204 - DNA, 25 bp, Mus musculus
aagcacaacctgtgtggagagacag

SEQ ID NO: 857205 - DNA, 25 bp, Mus musculus
aagcacaacctgtgtggggagacag

SEQ ID NO: 857206 - DNA, 25 bp, Mus musculus
aagcacaacgcaccagagaactggc

SEQ ID NO: 857207 - DNA, 25 bp, Mus musculus
aagcacaacggaccagagaactggc

SEQ ID NO: 857208 - DNA, 25 bp, Mus musculus
aagcacagcccccacctcgtagtgc

SEQ ID NO: 857209 - DNA, 25 bp, Mus musculus
aagcacagcccccagctcgtagtgc

SEQ ID NO: 857210 - DNA, 25 bp, Mus musculus
aagcacaggaagatccatctgtttg

SEQ ID NO: 857211 - DNA, 25 bp, Mus musculus
aagcacaggaagttccatctgtttg

SEQ ID NO: 857212 - DNA, 25 bp, Mus musculus
aagcacaggattgacgtccagaagg

SEQ ID NO: 857213 - DNA, 25 bp, Mus musculus
aagcacaggattgaggtccagaagg

SEQ ID NO: 857214 - DNA, 25 bp, Mus musculus
aagcacaggccttgcgctggagcac

SEQ ID NO: 857215 - DNA, 25 bp, Mus musculus
aagcacaggccttgggctggagcac

SEQ ID NO: 857216 - DNA, 25 bp, Mus musculus
aagcacatcccacgcttccccagtc

SEQ ID NO: 857217 - DNA, 25 bp, Mus musculus
aagcacatcccaggcttccccagtc

SEQ ID NO: 857218 - DNA, 25 bp, Mus musculus
aagcaccaggaccccggcgctactt

SEQ ID NO: 857219 - DNA, 25 bp, Mus musculus
aagcaccaggtccccggcgctactt

SEQ ID NO: 857220 - DNA, 25 bp, Mus musculus
aagcacccagaacgctcagaagcag

SEQ ID NO: 857221 - DNA, 25 bp, Mus musculus
aagcacccagaaggctcagaagcag

SEQ ID NO: 857222 - DNA, 25 bp, Mus musculus
aagcaccctcacaacataatcgtta

SEQ ID NO: 857223 - DNA, 25 bp, Mus musculus
aagcaccctcacaagataatcgtta

SEQ ID NO: 857224 - DNA, 25 bp, Mus musculus
aagcaccgtgtgaccatgaacgagt

SEQ ID NO: 857225 - DNA, 25 bp, Mus musculus
aagcaccgtgtgtccatgaacgagt

SEQ ID NO: 857226 - DNA, 25 bp, Mus musculus
aagcacctcaagcagcagcaggaga

SEQ ID NO: 857227 - DNA, 25 bp, Mus musculus
aagcacctcaaggagcagcaggaga

SEQ ID NO: 857228 - DNA, 25 bp, Mus musculus
aagcaccttgctgaccagaatggag

SEQ ID NO: 857229 - DNA, 25 bp, Mus musculus
aagcaccttggtgaccagaatggag

SEQ ID NO: 857230 - DNA, 25 bp, Mus musculus
aagcacgagaatgacatgtttagca

SEQ ID NO: 857231 - DNA, 25 bp, Mus musculus
aagcacgagaatgagatgtttagca

SEQ ID NO: 857232 - DNA, 25 bp, Mus musculus
aagcacggggtactgatccattgta

SEQ ID NO: 857233 - DNA, 25 bp, Mus musculus
aagcacggggtagtgatccattgta

SEQ ID NO: 857234 - DNA, 25 bp, Mus musculus
aagcactctcagcctaccggctctc

SEQ ID NO: 857235 - DNA, 25 bp, Mus musculus
aagcactctcaggctaccggctctc

SEQ ID NO: 857236 - DNA, 25 bp, Mus musculus
aagcagaaaagaaacgagatcacta

SEQ ID NO: 857237 - DNA, 25 bp, Mus musculus
aagcagaaaagaaaggagatcacta

SEQ ID NO: 857238 - DNA, 25 bp, Mus musculus
aagcagaaaggagaatatttacctt

SEQ ID NO: 857239 - DNA, 25 bp, Mus musculus
aagcagaaaggagattatttacctt

SEQ ID NO: 857240 - DNA, 25 bp, Mus musculus
aagcagaagaagaggatccaaactt

SEQ ID NO: 857241 - DNA, 25 bp, Mus musculus
aagcagaagaagtggatccaaactt

SEQ ID NO: 857242 - DNA, 25 bp, Mus musculus
aagcagaagcagcacggcacacata

SEQ ID NO: 857243 - DNA, 25 bp, Mus musculus
aagcagaagcagcagggcacacata

SEQ ID NO: 857244 - DNA, 25 bp, Mus musculus
aagcagaagctgcgagtgaagaaga

SEQ ID NO: 857245 - DNA, 25 bp, Mus musculus
aagcagaagctgcgtgtgaagaaga

SEQ ID NO: 857246 - DNA, 25 bp, Mus musculus
aagcagaagggttacgatgatgctg

SEQ ID NO: 857247 - DNA, 25 bp, Mus musculus
aagcagaagggttaggatgatgctg

SEQ ID NO: 857248 - DNA, 25 bp, Mus musculus
aagcagaatgccgtgatgagaggaa

SEQ ID NO: 857249 - DNA, 25 bp, Mus musculus
aagcagaatggcgtgatgagaggaa

SEQ ID NO: 857250 - DNA, 25 bp, Mus musculus
aagcagacagcatgacggacggtgc

SEQ ID NO: 857251 - DNA, 25 bp, Mus musculus
aagcagacaggatgacggacggtgc

SEQ ID NO: 857252 - DNA, 25 bp, Mus musculus
aagcagacatgtcatatcaggctcc

SEQ ID NO: 857253 - DNA, 25 bp, Mus musculus
aagcagacatgtgatatcaggctcc

SEQ ID NO: 857254 - DNA, 25 bp, Mus musculus
aagcagaccaagctggaattcccag

SEQ ID NO: 857255 - DNA, 25 bp, Mus musculus
aagcagaccaaggtggaattcccag

SEQ ID NO: 857256 - DNA, 25 bp, Mus musculus
aagcagagaacgcccagctgatcat

SEQ ID NO: 857257 - DNA, 25 bp, Mus musculus
aagcagagaaggcccagctgatcat

SEQ ID NO: 857258 - DNA, 25 bp, Mus musculus
aagcagagacaaattgaacaagaaa

SEQ ID NO: 857259 - DNA, 25 bp, Mus musculus
aagcagagacaatttgaacaagaaa

SEQ ID NO: 857260 - DNA, 25 bp, Mus musculus
aagcagagagcagaaaaggaggacg

SEQ ID NO: 857261 - DNA, 25 bp, Mus musculus
aagcagagaggagaaaaggaggacg

SEQ ID NO: 857262 - DNA, 25 bp, Mus musculus
aagcagagcacacgttattaaaagc

SEQ ID NO: 857263 - DNA, 25 bp, Mus musculus
aagcagagcacaggttattaaaagc

SEQ ID NO: 857264 - DNA, 25 bp, Mus musculus
aagcagaggcttgacctgaaggagc

SEQ ID NO: 857265 - DNA, 25 bp, Mus musculus
aagcagaggcttgagctgaaggagc

SEQ ID NO: 857266 - DNA, 25 bp, Mus musculus
aagcagataccgcgcccaacgaagg

SEQ ID NO: 857267 - DNA, 25 bp, Mus musculus
aagcagataccgcgtggggacgacg

SEQ ID NO: 857268 - DNA, 25 bp, Mus musculus
aagcagataccgggcccaacgaagg

SEQ ID NO: 857269 - DNA, 25 bp, Mus musculus
aagcagataccgggtggggacgacg

SEQ ID NO: 857270 - DNA, 25 bp, Mus musculus
aagcagatcacgctacggttctcca

SEQ ID NO: 857271 - DNA, 25 bp, Mus musculus
aagcagatcacggtacggttctcca

SEQ ID NO: 857272 - DNA, 25 bp, Mus musculus
aagcagatccaggacctggtggaag

SEQ ID NO: 857273 - DNA, 25 bp, Mus musculus
aagcagatccaggacgacttcttcc

SEQ ID NO: 857274 - DNA, 25 bp, Mus musculus
aagcagatccaggagctggtggaag

SEQ ID NO: 857275 - DNA, 25 bp, Mus musculus
aagcagatccaggaggacttcttcc

SEQ ID NO: 857276 - DNA, 25 bp, Mus musculus
aagcagatcccgatggctatgagtt

SEQ ID NO: 857277 - DNA, 25 bp, Mus musculus
aagcagatcccgttggctatgagtt

SEQ ID NO: 857278 - DNA, 25 bp, Mus musculus
aagcagatccggagtagcccctgga

SEQ ID NO: 857279 - DNA, 25 bp, Mus musculus
aagcagatccggtgtagcccctgga

SEQ ID NO: 857280 - DNA, 25 bp, Mus musculus
aagcagatgaagatgtaccgaggct

SEQ ID NO: 857281 - DNA, 25 bp, Mus musculus
aagcagatgaagttgtaccgaggct

SEQ ID NO: 857282 - DNA, 25 bp, Mus musculus
aagcagatgctgcgggagcgtctgt

SEQ ID NO: 857283 - DNA, 25 bp, Mus musculus
aagcagatgctgggggagcgtctgt

SEQ ID NO: 857284 - DNA, 25 bp, Mus musculus
aagcagattgcacaggaggatttct

SEQ ID NO: 857285 - DNA, 25 bp, Mus musculus
aagcagattgcacgaggatttctat

SEQ ID NO: 857286 - DNA, 25 bp, Mus musculus
aagcagattgcagaggaggatttct

SEQ ID NO: 857287 - DNA, 25 bp, Mus musculus
aagcagattgcaggaggatttctat

SEQ ID NO: 857288 - DNA, 25 bp, Mus musculus
aagcagatttaaagaacccaatatg

SEQ ID NO: 857289 - DNA, 25 bp, Mus musculus
aagcagatttaatgaacccaatatg

SEQ ID NO: 857290 - DNA, 25 bp, Mus musculus
aagcagcagaaccgtgacttgaaag

SEQ ID NO: 857291 - DNA, 25 bp, Mus musculus
aagcagcagaacggtgacttgaaag

SEQ ID NO: 857292 - DNA, 25 bp, Mus musculus
aagcagcagaaggaaggcttgctgt

SEQ ID NO: 857293 - DNA, 25 bp, Mus musculus
aagcagcagatggaaggcttgctgt

SEQ ID NO: 857294 - DNA, 25 bp, Mus musculus
aagcagcagcgcaacaccttcacag

SEQ ID NO: 857295 - DNA, 25 bp, Mus musculus
aagcagcagcgcaagaccttcacag

SEQ ID NO: 857296 - DNA, 25 bp, Mus musculus
aagcagccagccaatttgtaaaaat

SEQ ID NO: 857297 - DNA, 25 bp, Mus musculus
aagcagccaggcaatttgtaaaaat

SEQ ID NO: 857298 - DNA, 25 bp, Mus musculus
aagcagccatggaactggaagcccc

SEQ ID NO: 857299 - DNA, 25 bp, Mus musculus
aagcagccatggaagtggaagcccc

SEQ ID NO: 857300 - DNA, 25 bp, Mus musculus
aagcagcgagaccacacctgcacac

SEQ ID NO: 857301 - DNA, 25 bp, Mus musculus
aagcagcgagaccagacctgcacac

SEQ ID NO: 857302 - DNA, 25 bp, Mus musculus
aagcagcgatggcccagggctttga

SEQ ID NO: 857303 - DNA, 25 bp, Mus musculus
aagcagcgatgggccagggctttga

SEQ ID NO: 857304 - DNA, 25 bp, Mus musculus
aagcagctgaggcacgtctccaagg

SEQ ID NO: 857305 - DNA, 25 bp, Mus musculus
aagcagctgaggcaggtctccaagg

SEQ ID NO: 857306 - DNA, 25 bp, Mus musculus
aagcagctgatggacgtttttaaat

SEQ ID NO: 857307 - DNA, 25 bp, Mus musculus
aagcagctgatggaggtttttaaat

SEQ ID NO: 857308 - DNA, 25 bp, Mus musculus
aagcagctgccacactctgatagac

SEQ ID NO: 857309 - DNA, 25 bp, Mus musculus
aagcagctgccagactctgatagac

SEQ ID NO: 857310 - DNA, 25 bp, Mus musculus
aagcagctgctccacactggatgag

SEQ ID NO: 857311 - DNA, 25 bp, Mus musculus
aagcagctgctccagactggatgag

SEQ ID NO: 857312 - DNA, 25 bp, Mus musculus
aagcagctggagatgaactttctag

SEQ ID NO: 857313 - DNA, 25 bp, Mus musculus
aagcagctggagctggtcaagctgc

SEQ ID NO: 857314 - DNA, 25 bp, Mus musculus
aagcagctggaggtggtcaagctgc

SEQ ID NO: 857315 - DNA, 25 bp, Mus musculus
aagcagctggagttgaactttctag

SEQ ID NO: 857316 - DNA, 25 bp, Mus musculus
aagcaggacgcccacgaactgtatg

SEQ ID NO: 857317 - DNA, 25 bp, Mus musculus
aagcaggacgcccacgtctttcaac

SEQ ID NO: 857318 - DNA, 25 bp, Mus musculus
aagcaggacgcccaggaactgtatg

SEQ ID NO: 857319 - DNA, 25 bp, Mus musculus
aagcaggacgcccaggtctttcaac

SEQ ID NO: 857320 - DNA, 25 bp, Mus musculus
aagcaggagcgtgcagtccaggaac

SEQ ID NO: 857321 - DNA, 25 bp, Mus musculus
aagcaggagcgtgctgtccaggaac

SEQ ID NO: 857322 - DNA, 25 bp, Mus musculus
aagcagggaccaaggttggggtgct

SEQ ID NO: 857323 - DNA, 25 bp, Mus musculus
aagcagggaccacgccctctgccaa

SEQ ID NO: 857324 - DNA, 25 bp, Mus musculus
aagcagggaccaggccctctgccaa

SEQ ID NO: 857325 - DNA, 25 bp, Mus musculus
aagcagggaccatggttggggtgct

SEQ ID NO: 857326 - DNA, 25 bp, Mus musculus
aagcagggccctcacgaacaatggc

SEQ ID NO: 857327 - DNA, 25 bp, Mus musculus
aagcagggccctcaggaacaatggc

SEQ ID NO: 857328 - DNA, 25 bp, Mus musculus
aagcaggtgcagacaaaatgatcag

SEQ ID NO: 857329 - DNA, 25 bp, Mus musculus
aagcaggtgcagactaaatgatcag

SEQ ID NO: 857330 - DNA, 25 bp, Mus musculus
aagcaggttcagcctaaccaggaat

SEQ ID NO: 857331 - DNA, 25 bp, Mus musculus
aagcaggttcaggctaaccaggaat

SEQ ID NO: 857332 - DNA, 25 bp, Mus musculus
aagcaggttccacacaatcctcctg

SEQ ID NO: 857333 - DNA, 25 bp, Mus musculus
aagcaggttccacctctcccaggaa

SEQ ID NO: 857334 - DNA, 25 bp, Mus musculus
aagcaggttccagacaatcctcctg

SEQ ID NO: 857335 - DNA, 25 bp, Mus musculus
aagcaggttccagctctcccaggaa

SEQ ID NO: 857336 - DNA, 25 bp, Mus musculus
aagcaggtttagaacacagcgtgga

SEQ ID NO: 857337 - DNA, 25 bp, Mus musculus
aagcaggtttagaagacagcgtgga

SEQ ID NO: 857338 - DNA, 25 bp, Mus musculus
aagcagtacaaacctctttctcatc

SEQ ID NO: 857339 - DNA, 25 bp, Mus musculus
aagcagtacaaagctctttctcatc

SEQ ID NO: 857340 - DNA, 25 bp, Mus musculus
aagcagtgaagcgacgtcacagaga

SEQ ID NO: 857341 - DNA, 25 bp, Mus musculus
aagcagtgaagcgaggtcacagaga

SEQ ID NO: 857342 - DNA, 25 bp, Mus musculus
aagcagtgctagatgggtgcaaagc

SEQ ID NO: 857343 - DNA, 25 bp, Mus musculus
aagcagtgctagttgggtgcaaagc

SEQ ID NO: 857344 - DNA, 25 bp, Mus musculus
aagcataaagcaaatggtaactcaa

SEQ ID NO: 857345 - DNA, 25 bp, Mus musculus
aagcataaagcgaggtgcagaacat

SEQ ID NO: 857346 - DNA, 25 bp, Mus musculus
aagcataaaggaaatggtaactcaa

SEQ ID NO: 857347 - DNA, 25 bp, Mus musculus
aagcataaagggaggtgcagaacat

SEQ ID NO: 857348 - DNA, 25 bp, Mus musculus
aagcatcaaccacctggtgtacatg

SEQ ID NO: 857349 - DNA, 25 bp, Mus musculus
aagcatcaaccagctggtgtacatg

SEQ ID NO: 857350 - DNA, 25 bp, Mus musculus
aagcatcaccctaatgactcgggga

SEQ ID NO: 857351 - DNA, 25 bp, Mus musculus
aagcatcacccttatgactcgggga

SEQ ID NO: 857352 - DNA, 25 bp, Mus musculus
aagcatcatacacaccagagggatt

SEQ ID NO: 857353 - DNA, 25 bp, Mus musculus
aagcatcatacagaccagagggatt

SEQ ID NO: 857354 - DNA, 25 bp, Mus musculus
aagcatctaagaaaccttgtgatca

SEQ ID NO: 857355 - DNA, 25 bp, Mus musculus
aagcatctaagaaagcttgtgatca

SEQ ID NO: 857356 - DNA, 25 bp, Mus musculus
aagcatgactctcgtgatcaagata

SEQ ID NO: 857357 - DNA, 25 bp, Mus musculus
aagcatgactctggtgatcaagata

SEQ ID NO: 857358 - DNA, 25 bp, Mus musculus
aagcatgagaagacaagcaatcatc

SEQ ID NO: 857359 - DNA, 25 bp, Mus musculus
aagcatgagaagtcaagcaatcatc

SEQ ID NO: 857360 - DNA, 25 bp, Mus musculus
aagcatgcggatccccggatccaaa

SEQ ID NO: 857361 - DNA, 25 bp, Mus musculus
aagcatgcggattctgatgtctggt

SEQ ID NO: 857362 - DNA, 25 bp, Mus musculus
aagcatgcggttccccggatccaaa

SEQ ID NO: 857363 - DNA, 25 bp, Mus musculus
aagcatgcggtttctgatgtctggt

SEQ ID NO: 857364 - DNA, 25 bp, Mus musculus
aagcatggaataagctcagctatgt

SEQ ID NO: 857365 - DNA, 25 bp, Mus musculus
aagcatggaatatgctcagctatgt

SEQ ID NO: 857366 - DNA, 25 bp, Mus musculus
aagcatggacaaagaagaccgtctt

SEQ ID NO: 857367 - DNA, 25 bp, Mus musculus
aagcatggacaatgaagaccgtctt

SEQ ID NO: 857368 - DNA, 25 bp, Mus musculus
aagcatggagatcagtatcaaggtc

SEQ ID NO: 857369 - DNA, 25 bp, Mus musculus
aagcatggagttcagtatcaaggtc

SEQ ID NO: 857370 - DNA, 25 bp, Mus musculus
aagcatgtcgtggacatgagacaga

SEQ ID NO: 857371 - DNA, 25 bp, Mus musculus
aagcatgtcgtggagatgagacaga

SEQ ID NO: 857372 - DNA, 25 bp, Mus musculus
aagcattaagccacaaacaaaagtg

SEQ ID NO: 857373 - DNA, 25 bp, Mus musculus
aagcattaaggcacaaacaaaagtg

SEQ ID NO: 857374 - DNA, 25 bp, Mus musculus
aagcattatccaatcgtacatggac

SEQ ID NO: 857375 - DNA, 25 bp, Mus musculus
aagcattatccaatggtacatggac

SEQ ID NO: 857376 - DNA, 25 bp, Mus musculus
aagcattctacactcctggacatcg

SEQ ID NO: 857377 - DNA, 25 bp, Mus musculus
aagcattctacagtcctggacatcg

SEQ ID NO: 857378 - DNA, 25 bp, Mus musculus
aagcattctcaacgagatttctcct

SEQ ID NO: 857379 - DNA, 25 bp, Mus musculus
aagcattctcaaggagatttctcct

SEQ ID NO: 857380 - DNA, 25 bp, Mus musculus
aagcattctgggcgtcaaccggatg

SEQ ID NO: 857381 - DNA, 25 bp, Mus musculus
aagcattctgggggtcaaccggatg

SEQ ID NO: 857382 - DNA, 25 bp, Mus musculus
aagcatttaatgcctcctgcctgtc

SEQ ID NO: 857383 - DNA, 25 bp, Mus musculus
aagcatttaatggctcctgcctgtc

SEQ ID NO: 857384 - DNA, 25 bp, Mus musculus
aagcatttagaaagcacaaaacaac

SEQ ID NO: 857385 - DNA, 25 bp, Mus musculus
aagcatttagaatgcacaaaacaac

SEQ ID NO: 857386 - DNA, 25 bp, Mus musculus
aagcatttagcgcttcagaaagact

SEQ ID NO: 857387 - DNA, 25 bp, Mus musculus
aagcatttagggcttcagaaagact

SEQ ID NO: 857388 - DNA, 25 bp, Mus musculus
aagcatttcgccatgctccaccgct

SEQ ID NO: 857389 - DNA, 25 bp, Mus musculus
aagcatttcggcatgctccaccgct

SEQ ID NO: 857390 - DNA, 25 bp, Mus musculus
aagccaaatccacgttctagcaccg

SEQ ID NO: 857391 - DNA, 25 bp, Mus musculus
aagccaaatccaggttctagcaccg

SEQ ID NO: 857392 - DNA, 25 bp, Mus musculus
aagccaacatcaagaaactagggga

SEQ ID NO: 857393 - DNA, 25 bp, Mus musculus
aagccaacatcatgaaactagggga

SEQ ID NO: 857394 - DNA, 25 bp, Mus musculus
aagccaagcccaagtaaaacagact

SEQ ID NO: 857395 - DNA, 25 bp, Mus musculus
aagccaagcccatgtaaaacagact

SEQ ID NO: 857396 - DNA, 25 bp, Mus musculus
aagccaagcctgcgactcaatagat

SEQ ID NO: 857397 - DNA, 25 bp, Mus musculus
aagccaagcctgggactcaatagat

SEQ ID NO: 857398 - DNA, 25 bp, Mus musculus
aagccaagcgcaggcgggtggtcgt

SEQ ID NO: 857399 - DNA, 25 bp, Mus musculus
aagccaagcgcaggggggtggtcgt

SEQ ID NO: 857400 - DNA, 25 bp, Mus musculus
aagccaaggccaccatcaaccctgt

SEQ ID NO: 857401 - DNA, 25 bp, Mus musculus
aagccaaggccagcatcaaccctgt

SEQ ID NO: 857402 - DNA, 25 bp, Mus musculus
aagccaagtgaaacacccatagagc

SEQ ID NO: 857403 - DNA, 25 bp, Mus musculus
aagccaagtgtaacacccatagagc

SEQ ID NO: 857404 - DNA, 25 bp, Mus musculus
aagccaatcccacttatgctcctgg

SEQ ID NO: 857405 - DNA, 25 bp, Mus musculus
aagccaatcccagttatgctcctgg

SEQ ID NO: 857406 - DNA, 25 bp, Mus musculus
aagccaatgagagacgacacaatgt

SEQ ID NO: 857407 - DNA, 25 bp, Mus musculus
aagccaatgagagaggacacaatgt

SEQ ID NO: 857408 - DNA, 25 bp, Mus musculus
aagccaatggcgattacatccctgc

SEQ ID NO: 857409 - DNA, 25 bp, Mus musculus
aagccaatggcgtttacatccctgc

SEQ ID NO: 857410 - DNA, 25 bp, Mus musculus
aagccacctgggcacgtcagccggc

SEQ ID NO: 857411 - DNA, 25 bp, Mus musculus
aagccacctgggcaggtcagccggc

SEQ ID NO: 857412 - DNA, 25 bp, Mus musculus
aagccacgagagctgagggagttta

SEQ ID NO: 857413 - DNA, 25 bp, Mus musculus
aagccacgagaggtgagggagttta

SEQ ID NO: 857414 - DNA, 25 bp, Mus musculus
aagccagaaatgcggctggtgtcat

SEQ ID NO: 857415 - DNA, 25 bp, Mus musculus
aagccagaaatggggctggtgtcat

SEQ ID NO: 857416 - DNA, 25 bp, Mus musculus
aagccagacacaattgttcagcata

SEQ ID NO: 857417 - DNA, 25 bp, Mus musculus
aagccagacacatttgttcagcata

SEQ ID NO: 857418 - DNA, 25 bp, Mus musculus
aagccagaccagatccaagaattac

SEQ ID NO: 857419 - DNA, 25 bp, Mus musculus
aagccagaccagcatcaagttactg

SEQ ID NO: 857420 - DNA, 25 bp, Mus musculus
aagccagaccaggatcaagttactg

SEQ ID NO: 857421 - DNA, 25 bp, Mus musculus
aagccagaccagttccaagaattac

SEQ ID NO: 857422 - DNA, 25 bp, Mus musculus
aagccagagagaaacattcagttta

SEQ ID NO: 857423 - DNA, 25 bp, Mus musculus
aagccagagagaaagattcagttta

SEQ ID NO: 857424 - DNA, 25 bp, Mus musculus
aagccagagtacggccgtcctagtg

SEQ ID NO: 857425 - DNA, 25 bp, Mus musculus
aagccagagtacgggcgtcctagtg

SEQ ID NO: 857426 - DNA, 25 bp, Mus musculus
aagccagatgggacagtggaggaac

SEQ ID NO: 857427 - DNA, 25 bp, Mus musculus
aagccagatgggtcagtggaggaac

SEQ ID NO: 857428 - DNA, 25 bp, Mus musculus
aagccagatttgctgctgtgtaatg

SEQ ID NO: 857429 - DNA, 25 bp, Mus musculus
aagccagatttggtgctgtgtaatg

SEQ ID NO: 857430 - DNA, 25 bp, Mus musculus
aagccagcagatgtgttctgagctg

SEQ ID NO: 857431 - DNA, 25 bp, Mus musculus
aagccagcagccctcagggctggct

SEQ ID NO: 857432 - DNA, 25 bp, Mus musculus
aagccagcagcgcctgggctggtgc

SEQ ID NO: 857433 - DNA, 25 bp, Mus musculus
aagccagcaggcctcagggctggct

SEQ ID NO: 857434 - DNA, 25 bp, Mus musculus
aagccagcagggcctgggctggtgc

SEQ ID NO: 857435 - DNA, 25 bp, Mus musculus
aagccagcagttgtgttctgagctg

SEQ ID NO: 857436 - DNA, 25 bp, Mus musculus
aagccagccacacgcccaggccttg

SEQ ID NO: 857437 - DNA, 25 bp, Mus musculus
aagccagccacaggcccaggccttg

SEQ ID NO: 857438 - DNA, 25 bp, Mus musculus
aagccagcccagaggaaccccaact

SEQ ID NO: 857439 - DNA, 25 bp, Mus musculus
aagccagcccagtggaaccccaact

SEQ ID NO: 857440 - DNA, 25 bp, Mus musculus
aagccagctaaacgtatgctaacag

SEQ ID NO: 857441 - DNA, 25 bp, Mus musculus
aagccagctaaaggtatgctaacag

SEQ ID NO: 857442 - DNA, 25 bp, Mus musculus
aagccaggagagggcctgaggcagg

SEQ ID NO: 857443 - DNA, 25 bp, Mus musculus
aagccaggagattagagtgggcctg

SEQ ID NO: 857444 - DNA, 25 bp, Mus musculus
aagccaggagcagcaggtggatgga

SEQ ID NO: 857445 - DNA, 25 bp, Mus musculus
aagccaggagcaggtggatggatgc

SEQ ID NO: 857446 - DNA, 25 bp, Mus musculus
aagccaggaggagcaggtggatgga

SEQ ID NO: 857447 - DNA, 25 bp, Mus musculus
aagccaggaggaggtggatggatgc

SEQ ID NO: 857448 - DNA, 25 bp, Mus musculus
aagccaggagtgggcctgaggcagg

SEQ ID NO: 857449 - DNA, 25 bp, Mus musculus
aagccaggagtttagagtgggcctg

SEQ ID NO: 857450 - DNA, 25 bp, Mus musculus
aagccaggctggaacaactctattc

SEQ ID NO: 857451 - DNA, 25 bp, Mus musculus
aagccaggctggaagaactctattc

SEQ ID NO: 857452 - DNA, 25 bp, Mus musculus
aagccaggtgcaccagcgagcctgt

SEQ ID NO: 857453 - DNA, 25 bp, Mus musculus
aagccaggtgcacctgcgagcctgt

SEQ ID NO: 857454 - DNA, 25 bp, Mus musculus
aagccagtcaatcctatcattgagc

SEQ ID NO: 857455 - DNA, 25 bp, Mus musculus
aagccagtcaatgctatcattgagc

SEQ ID NO: 857456 - DNA, 25 bp, Mus musculus
aagccagtggcagtgtgcagccaca

SEQ ID NO: 857457 - DNA, 25 bp, Mus musculus
aagccagtgggagtgtgcagccaca

SEQ ID NO: 857458 - DNA, 25 bp, Mus musculus
aagccagtgtgttaagccaaattta

SEQ ID NO: 857459 - DNA, 25 bp, Mus musculus
aagccagtgtgttaagtattttgga

SEQ ID NO: 857460 - DNA, 25 bp, Mus musculus
aagccagtgtgttatgccaaattta

SEQ ID NO: 857461 - DNA, 25 bp, Mus musculus
aagccagtgtgttatgtattttgga

SEQ ID NO: 857462 - DNA, 25 bp, Mus musculus
aagccatactatcatccctcaagaa

SEQ ID NO: 857463 - DNA, 25 bp, Mus musculus
aagccatactatgatccctcaagaa

SEQ ID NO: 857464 - DNA, 25 bp, Mus musculus
aagccatcaacgacctagacagaga

SEQ ID NO: 857465 - DNA, 25 bp, Mus musculus
aagccatcaacttgcctgcaggagg

SEQ ID NO: 857466 - DNA, 25 bp, Mus musculus
aagccatcaaggacctagacagaga

SEQ ID NO: 857467 - DNA, 25 bp, Mus musculus
aagccatcaagttgcctgcaggagg

SEQ ID NO: 857468 - DNA, 25 bp, Mus musculus
aagccatcagacatattggctggat

SEQ ID NO: 857469 - DNA, 25 bp, Mus musculus
aagccatcagacttattggctggat

SEQ ID NO: 857470 - DNA, 25 bp, Mus musculus
aagccatgagccaagaaactacatt

SEQ ID NO: 857471 - DNA, 25 bp, Mus musculus
aagccatgaggcaagaaactacatt

SEQ ID NO: 857472 - DNA, 25 bp, Mus musculus
aagccatgcgccagagaccgctgct

SEQ ID NO: 857473 - DNA, 25 bp, Mus musculus
aagccatgcggcagagaccgctgct

SEQ ID NO: 857474 - DNA, 25 bp, Mus musculus
aagccatggtcactctggaccctga

SEQ ID NO: 857475 - DNA, 25 bp, Mus musculus
aagccatggtcactgtggaccctga

SEQ ID NO: 857476 - DNA, 25 bp, Mus musculus
aagccattggaacttgccatgtacc

SEQ ID NO: 857477 - DNA, 25 bp, Mus musculus
aagccattggaagttgccatgtacc

SEQ ID NO: 857478 - DNA, 25 bp, Mus musculus
aagccattgtctgcatgtgtctgcc

SEQ ID NO: 857479 - DNA, 25 bp, Mus musculus
aagccattgtctgcttgtgtctgcc

SEQ ID NO: 857480 - DNA, 25 bp, Mus musculus
aagccatttcagacgctaatgtttt

SEQ ID NO: 857481 - DNA, 25 bp, Mus musculus
aagccatttcagtcgctaatgtttt

SEQ ID NO: 857482 - DNA, 25 bp, Mus musculus
aagccatttgaacacgtcaaaggca

SEQ ID NO: 857483 - DNA, 25 bp, Mus musculus
aagccatttgaacaggtcaaaggca

SEQ ID NO: 857484 - DNA, 25 bp, Mus musculus
aagccatttgcacatgaaaagaaca

SEQ ID NO: 857485 - DNA, 25 bp, Mus musculus
aagccatttgcagatgaaaagaaca

SEQ ID NO: 857486 - DNA, 25 bp, Mus musculus
aagcccacagagaccacaagtagtc

SEQ ID NO: 857487 - DNA, 25 bp, Mus musculus
aagcccacagtgaccacaagtagtc

SEQ ID NO: 857488 - DNA, 25 bp, Mus musculus
aagcccactgccgctgacctgttgg

SEQ ID NO: 857489 - DNA, 25 bp, Mus musculus
aagcccactggcgctgacctgttgg

SEQ ID NO: 857490 - DNA, 25 bp, Mus musculus
aagccccaactgaggaatggataca

SEQ ID NO: 857491 - DNA, 25 bp, Mus musculus
aagccccaactgtggaatggataca

SEQ ID NO: 857492 - DNA, 25 bp, Mus musculus
aagccccaagaggatgattattgga

SEQ ID NO: 857493 - DNA, 25 bp, Mus musculus
aagccccaagtggatgattattgga

SEQ ID NO: 857494 - DNA, 25 bp, Mus musculus
aagccccagggcaacgattctgtac

SEQ ID NO: 857495 - DNA, 25 bp, Mus musculus
aagccccagggcaacgtggctgcct

SEQ ID NO: 857496 - DNA, 25 bp, Mus musculus
aagccccagggcaaggattctgtac

SEQ ID NO: 857497 - DNA, 25 bp, Mus musculus
aagccccagggcaaggtggctgcct

SEQ ID NO: 857498 - DNA, 25 bp, Mus musculus
aagccccccttttcagaatgaagat

SEQ ID NO: 857499 - DNA, 25 bp, Mus musculus
aagccccccttttctgaatgaagat

SEQ ID NO: 857500 - DNA, 25 bp, Mus musculus
aagccccctgagctgacaaaccgat

SEQ ID NO: 857501 - DNA, 25 bp, Mus musculus
aagccccctgaggtgacaaaccgat

SEQ ID NO: 857502 - DNA, 25 bp, Mus musculus
aagcccctgatgcctgggactatag

SEQ ID NO: 857503 - DNA, 25 bp, Mus musculus
aagcccctgatggctgggactatag

SEQ ID NO: 857504 - DNA, 25 bp, Mus musculus
aagcccgacctgacatgccttccag

SEQ ID NO: 857505 - DNA, 25 bp, Mus musculus
aagcccgacctgtcatgccttccag

SEQ ID NO: 857506 - DNA, 25 bp, Mus musculus
aagcccgcaaaacctccctccaaca

SEQ ID NO: 857507 - DNA, 25 bp, Mus musculus
aagcccgcaaaagctccctccaaca

SEQ ID NO: 857508 - DNA, 25 bp, Mus musculus
aagcccgcacagctcccaggaaggt

SEQ ID NO: 857509 - DNA, 25 bp, Mus musculus
aagcccgcacaggtcccaggaaggt

SEQ ID NO: 857510 - DNA, 25 bp, Mus musculus
aagcccgtgcccctcagcttctagg

SEQ ID NO: 857511 - DNA, 25 bp, Mus musculus
aagcccgtgcccgtcagcttctagg

SEQ ID NO: 857512 - DNA, 25 bp, Mus musculus
aagccctcgaagcttgcagctccac

SEQ ID NO: 857513 - DNA, 25 bp, Mus musculus
aagccctcgaaggttgcagctccac

SEQ ID NO: 857514 - DNA, 25 bp, Mus musculus
aagccctcgacccctcatctttggt

SEQ ID NO: 857515 - DNA, 25 bp, Mus musculus
aagccctcgaccgctcatctttggt

SEQ ID NO: 857516 - DNA, 25 bp, Mus musculus
aagccctctacactttcaggcctgg

SEQ ID NO: 857517 - DNA, 25 bp, Mus musculus
aagccctctacagtttcaggcctgg

SEQ ID NO: 857518 - DNA, 25 bp, Mus musculus
aagccctgagctcacttggtcgctc

SEQ ID NO: 857519 - DNA, 25 bp, Mus musculus
aagccctgagctgtggttcccagga

SEQ ID NO: 857520 - DNA, 25 bp, Mus musculus
aagccctgaggtcacttggtcgctc

SEQ ID NO: 857521 - DNA, 25 bp, Mus musculus
aagccctgaggtgtggttcccagga

SEQ ID NO: 857522 - DNA, 25 bp, Mus musculus
aagccctggcacaccccccaaggaa

SEQ ID NO: 857523 - DNA, 25 bp, Mus musculus
aagccctggcacacgccccaaggaa

SEQ ID NO: 857524 - DNA, 25 bp, Mus musculus
aagccctggctgcgggatgggctct

SEQ ID NO: 857525 - DNA, 25 bp, Mus musculus
aagccctggctgggggatgggctct

SEQ ID NO: 857526 - DNA, 25 bp, Mus musculus
aagccctgtcagagtttgtagacac

SEQ ID NO: 857527 - DNA, 25 bp, Mus musculus
aagccctgtcagtgtttgtagacac

SEQ ID NO: 857528 - DNA, 25 bp, Mus musculus
aagccctgtgaccaatggcacacga

SEQ ID NO: 857529 - DNA, 25 bp, Mus musculus
aagccctgtgacgaatggcacacga

SEQ ID NO: 857530 - DNA, 25 bp, Mus musculus
aagcccttagagatgcaacaaggag

SEQ ID NO: 857531 - DNA, 25 bp, Mus musculus
aagcccttagagttgcaacaaggag

SEQ ID NO: 857532 - DNA, 25 bp, Mus musculus
aagccgaggtcacacatgaaattat

SEQ ID NO: 857533 - DNA, 25 bp, Mus musculus
aagccgaggtcacagatgaaattat

SEQ ID NO: 857534 - DNA, 25 bp, Mus musculus
aagccgccttcgaccatgcagtttg

SEQ ID NO: 857535 - DNA, 25 bp, Mus musculus
aagccgccttcgtccatgcagtttg

SEQ ID NO: 857536 - DNA, 25 bp, Mus musculus
aagccggcactccggctcctcccac

SEQ ID NO: 857537 - DNA, 25 bp, Mus musculus
aagccggcactcgggctcctcccac

SEQ ID NO: 857538 - DNA, 25 bp, Mus musculus
aagccggtgccgcgctttcaggtag

SEQ ID NO: 857539 - DNA, 25 bp, Mus musculus
aagccggtgccgggctttcaggtag

SEQ ID NO: 857540 - DNA, 25 bp, Mus musculus
aagccgtgcagaccaagccatacag

SEQ ID NO: 857541 - DNA, 25 bp, Mus musculus
aagccgtgcagaccatctactgccg

SEQ ID NO: 857542 - DNA, 25 bp, Mus musculus
aagccgtgcagagcaagccatacag

SEQ ID NO: 857543 - DNA, 25 bp, Mus musculus
aagccgtgcagagcatctactgccg

SEQ ID NO: 857544 - DNA, 25 bp, Mus musculus
aagccgtggctacgggatggcctct

SEQ ID NO: 857545 - DNA, 25 bp, Mus musculus
aagccgtggctaggggatggcctct

SEQ ID NO: 857546 - DNA, 25 bp, Mus musculus
aagcctaagcctcacgtgcagccag

SEQ ID NO: 857547 - DNA, 25 bp, Mus musculus
aagcctaagcctccagacgtgcagc

SEQ ID NO: 857548 - DNA, 25 bp, Mus musculus
aagcctaagcctgacgtgcagccag

SEQ ID NO: 857549 - DNA, 25 bp, Mus musculus
aagcctaagcctgcagacgtgcagc

SEQ ID NO: 857550 - DNA, 25 bp, Mus musculus
aagcctcaagacgaaagtaggtggg

SEQ ID NO: 857551 - DNA, 25 bp, Mus musculus
aagcctcaagcgcgccctgagccag

SEQ ID NO: 857552 - DNA, 25 bp, Mus musculus
aagcctcaagggcgccctgagccag

SEQ ID NO: 857553 - DNA, 25 bp, Mus musculus
aagcctcaaggggacgctcgtgtgc

SEQ ID NO: 857554 - DNA, 25 bp, Mus musculus
aagcctcaaggggaggctcgtgtgc

SEQ ID NO: 857555 - DNA, 25 bp, Mus musculus
aagcctcaagtcgaaagtaggtggg

SEQ ID NO: 857556 - DNA, 25 bp, Mus musculus
aagcctcactgaaacctgggaagtc

SEQ ID NO: 857557 - DNA, 25 bp, Mus musculus
aagcctcactgaaagctgggaagtc

SEQ ID NO: 857558 - DNA, 25 bp, Mus musculus
aagcctcagaagcatgcgggctcct

SEQ ID NO: 857559 - DNA, 25 bp, Mus musculus
aagcctcagaaggatgcgggctcct

SEQ ID NO: 857560 - DNA, 25 bp, Mus musculus
aagcctgaagctctccaccagctcc

SEQ ID NO: 857561 - DNA, 25 bp, Mus musculus
aagcctgaaggtctccaccagctcc

SEQ ID NO: 857562 - DNA, 25 bp, Mus musculus
aagcctgagtgacgatcatggctgc

SEQ ID NO: 857563 - DNA, 25 bp, Mus musculus
aagcctgagtgaggatcatggctgc

SEQ ID NO: 857564 - DNA, 25 bp, Mus musculus
aagcctgccaagaccctaccactga

SEQ ID NO: 857565 - DNA, 25 bp, Mus musculus
aagcctgccaagtccctaccactga

SEQ ID NO: 857566 - DNA, 25 bp, Mus musculus
aagcctgcggcgacttgactgcgtt

SEQ ID NO: 857567 - DNA, 25 bp, Mus musculus
aagcctgcggggacttgactgcgtt

SEQ ID NO: 857568 - DNA, 25 bp, Mus musculus
aagcctgctgctcctacagtggagc

SEQ ID NO: 857569 - DNA, 25 bp, Mus musculus
aagcctgctggtcctacagtggagc

SEQ ID NO: 857570 - DNA, 25 bp, Mus musculus
aagcctggatagaggagaagttgtt

SEQ ID NO: 857571 - DNA, 25 bp, Mus musculus
aagcctggatagtggagaagttgtt

SEQ ID NO: 857572 - DNA, 25 bp, Mus musculus
aagcctggcaagcgctactgacagt

SEQ ID NO: 857573 - DNA, 25 bp, Mus musculus
aagcctggcaagggctactgacagt

SEQ ID NO: 857574 - DNA, 25 bp, Mus musculus
aagcctggggatcgtgtgaccccac

SEQ ID NO: 857575 - DNA, 25 bp, Mus musculus
aagcctggggatggtgtgaccccac

SEQ ID NO: 857576 - DNA, 25 bp, Mus musculus
aagcctgtgtcagcggagcctttgt

SEQ ID NO: 857577 - DNA, 25 bp, Mus musculus
aagcctgtgtctgcagcggagcctt

SEQ ID NO: 857578 - DNA, 25 bp, Mus musculus
aagcctgtgtgagcggagcctttgt

SEQ ID NO: 857579 - DNA, 25 bp, Mus musculus
aagcctgtgtgtgcagcggagcctt

SEQ ID NO: 857580 - DNA, 25 bp, Mus musculus
aagccttaagtgcttgcttcccaga

SEQ ID NO: 857581 - DNA, 25 bp, Mus musculus
aagccttaagtggttgcttcccaga

SEQ ID NO: 857582 - DNA, 25 bp, Mus musculus
aagccttcaaggagaagtacatgga

SEQ ID NO: 857583 - DNA, 25 bp, Mus musculus
aagccttcaaggcgccccccacagg

SEQ ID NO: 857584 - DNA, 25 bp, Mus musculus
aagccttcaaggggccccccacagg

SEQ ID NO: 857585 - DNA, 25 bp, Mus musculus
aagccttcaaggtgaagtacatgga

SEQ ID NO: 857586 - DNA, 25 bp, Mus musculus
aagccttcatagctggtggtgaagt

SEQ ID NO: 857587 - DNA, 25 bp, Mus musculus
aagccttcataggtggtggtgaagt

SEQ ID NO: 857588 - DNA, 25 bp, Mus musculus
aagccttcctgtcactgctctggat

SEQ ID NO: 857589 - DNA, 25 bp, Mus musculus
aagccttcctgtcagtgctctggat

SEQ ID NO: 857590 - DNA, 25 bp, Mus musculus
aagccttcgatacccacatccatgc

SEQ ID NO: 857591 - DNA, 25 bp, Mus musculus
aagccttcgataccgacatccatgc

SEQ ID NO: 857592 - DNA, 25 bp, Mus musculus
aagccttctaagctacctgaaccag

SEQ ID NO: 857593 - DNA, 25 bp, Mus musculus
aagccttctaaggtacctgaaccag

SEQ ID NO: 857594 - DNA, 25 bp, Mus musculus
aagccttgacttctcctaagcggta

SEQ ID NO: 857595 - DNA, 25 bp, Mus musculus
aagccttgacttctgctaagcggta

SEQ ID NO: 857596 - DNA, 25 bp, Mus musculus
aagcctttctgcaacactacagagc

SEQ ID NO: 857597 - DNA, 25 bp, Mus musculus
aagcctttctgcaagactacagagc

SEQ ID NO: 857598 - DNA, 25 bp, Mus musculus
aagcgaagagcccgtctctggggaa

SEQ ID NO: 857599 - DNA, 25 bp, Mus musculus
aagcgaagagccggtctctggggaa

SEQ ID NO: 857600 - DNA, 25 bp, Mus musculus
aagcgaaggctgacggcagcaagga

SEQ ID NO: 857601 - DNA, 25 bp, Mus musculus
aagcgaaggctgtcggcagcaagga

SEQ ID NO: 857602 - DNA, 25 bp, Mus musculus
aagcgaagttcacatcttgaagggc

SEQ ID NO: 857603 - DNA, 25 bp, Mus musculus
aagcgaagttcagatcttgaagggc

SEQ ID NO: 857604 - DNA, 25 bp, Mus musculus
aagcgaatcaaagacatggatctgt

SEQ ID NO: 857605 - DNA, 25 bp, Mus musculus
aagcgaatcaaagagatggatctgt

SEQ ID NO: 857606 - DNA, 25 bp, Mus musculus
aagcgacagaaacatgtccgacccc

SEQ ID NO: 857607 - DNA, 25 bp, Mus musculus
aagcgacagaaagatgtccgacccc

SEQ ID NO: 857608 - DNA, 25 bp, Mus musculus
aagcgacccaagttccatttaaata

SEQ ID NO: 857609 - DNA, 25 bp, Mus musculus
aagcgacccaagttcctggacaaat

SEQ ID NO: 857610 - DNA, 25 bp, Mus musculus
aagcgacccaagttgcatttaaata

SEQ ID NO: 857611 - DNA, 25 bp, Mus musculus
aagcgacccaagttgctggacaaat

SEQ ID NO: 857612 - DNA, 25 bp, Mus musculus
aagcgagatgtggactttctagtgc

SEQ ID NO: 857613 - DNA, 25 bp, Mus musculus
aagcgagatgtggagtttctagtgc

SEQ ID NO: 857614 - DNA, 25 bp, Mus musculus
aagcgagccaagaacctggcctggc

SEQ ID NO: 857615 - DNA, 25 bp, Mus musculus
aagcgagccaagaagctggcctggc

SEQ ID NO: 857616 - DNA, 25 bp, Mus musculus
aagcgaggatggacatgaaagtcca

SEQ ID NO: 857617 - DNA, 25 bp, Mus musculus
aagcgaggatggtcatgaaagtcca

SEQ ID NO: 857618 - DNA, 25 bp, Mus musculus
aagcgaggcaagattgtgaaggtgc

SEQ ID NO: 857619 - DNA, 25 bp, Mus musculus
aagcgaggcaagtttgtgaaggtgc

SEQ ID NO: 857620 - DNA, 25 bp, Mus musculus
aagcgaggccctcgtcacaggctct

SEQ ID NO: 857621 - DNA, 25 bp, Mus musculus
aagcgaggccctggtcacaggctct

SEQ ID NO: 857622 - DNA, 25 bp, Mus musculus
aagcgagggcggcacacgccagtgc

SEQ ID NO: 857623 - DNA, 25 bp, Mus musculus
aagcgagggcggcagacgccagtgc

SEQ ID NO: 857624 - DNA, 25 bp, Mus musculus
aagcgagttgcactggagaactcgg

SEQ ID NO: 857625 - DNA, 25 bp, Mus musculus
aagcgagttgcagtggagaactcgg

SEQ ID NO: 857626 - DNA, 25 bp, Mus musculus
aagcgatgctcgatgctttcttctg

SEQ ID NO: 857627 - DNA, 25 bp, Mus musculus
aagcgatgctcgttgctttcttctg

SEQ ID NO: 857628 - DNA, 25 bp, Mus musculus
aagcgattccagcacgctggtttta

SEQ ID NO: 857629 - DNA, 25 bp, Mus musculus
aagcgattccagcaggctggtttta

SEQ ID NO: 857630 - DNA, 25 bp, Mus musculus
aagcgcagggcggtggtcgtctttg

SEQ ID NO: 857631 - DNA, 25 bp, Mus musculus
aagcgcaggggggtggtcgtctttg

SEQ ID NO: 857632 - DNA, 25 bp, Mus musculus
aagcgccacacccccagaggaaatg

SEQ ID NO: 857633 - DNA, 25 bp, Mus musculus
aagcgccacagccccagaggaaatg

SEQ ID NO: 857634 - DNA, 25 bp, Mus musculus
aagcgcgccctgcccaacagcctcg

SEQ ID NO: 857635 - DNA, 25 bp, Mus musculus
aagcgcgccctggccaacagcctcg

SEQ ID NO: 857636 - DNA, 25 bp, Mus musculus
aagcgctcagatatgctgaaggatg

SEQ ID NO: 857637 - DNA, 25 bp, Mus musculus
aagcgctcagttatgctgaaggatg

SEQ ID NO: 857638 - DNA, 25 bp, Mus musculus
aagcgctgagagaaaatgtgctatt

SEQ ID NO: 857639 - DNA, 25 bp, Mus musculus
aagcgctgagtgaaaatgtgctatt

SEQ ID NO: 857640 - DNA, 25 bp, Mus musculus
aagcgctggacgcgtggagtgtcat

SEQ ID NO: 857641 - DNA, 25 bp, Mus musculus
aagcgctggacgggtggagtgtcat

SEQ ID NO: 857642 - DNA, 25 bp, Mus musculus
aagcggcctgcatgacccgccggga

SEQ ID NO: 857643 - DNA, 25 bp, Mus musculus
aagcggcctggatgacccgccggga

SEQ ID NO: 857644 - DNA, 25 bp, Mus musculus
aagcggcctggccccgacttagcat

SEQ ID NO: 857645 - DNA, 25 bp, Mus musculus
aagcggcctggcccggacttagcat

SEQ ID NO: 857646 - DNA, 25 bp, Mus musculus
aagcggcgcaggcaccaaagcgccc

SEQ ID NO: 857647 - DNA, 25 bp, Mus musculus
aagcggcgcaggcagcaaagcgccc

SEQ ID NO: 857648 - DNA, 25 bp, Mus musculus
aagcgggaagaggacgccaagtcag

SEQ ID NO: 857649 - DNA, 25 bp, Mus musculus
aagcgggaagaggaggccaagtcag

SEQ ID NO: 857650 - DNA, 25 bp, Mus musculus
aagcgggaagctgtgcaggaggagc

SEQ ID NO: 857651 - DNA, 25 bp, Mus musculus
aagcgggaaggtgtgcaggaggagc

SEQ ID NO: 857652 - DNA, 25 bp, Mus musculus
aagcgggaattgctctcggtgtgat

SEQ ID NO: 857653 - DNA, 25 bp, Mus musculus
aagcgggaattgctctgggcgtcat

SEQ ID NO: 857654 - DNA, 25 bp, Mus musculus
aagcgggaattgctcttggagttct

SEQ ID NO: 857655 - DNA, 25 bp, Mus musculus
aagcgggaattggtctcggtgtgat

SEQ ID NO: 857656 - DNA, 25 bp, Mus musculus
aagcgggaattggtctgggcgtcat

SEQ ID NO: 857657 - DNA, 25 bp, Mus musculus
aagcgggaattggtcttggagttct

SEQ ID NO: 857658 - DNA, 25 bp, Mus musculus
aagcggtctctgacttatgggacac

SEQ ID NO: 857659 - DNA, 25 bp, Mus musculus
aagcggtctctgtcttatgggacac

SEQ ID NO: 857660 - DNA, 25 bp, Mus musculus
aagcgtagcaagcccgtcctggaca

SEQ ID NO: 857661 - DNA, 25 bp, Mus musculus
aagcgtagcaagccggtcctggaca

SEQ ID NO: 857662 - DNA, 25 bp, Mus musculus
aagcgtcgtgcaagatttcctgcca

SEQ ID NO: 857663 - DNA, 25 bp, Mus musculus
aagcgtcgtgcatgatttcctgcca

SEQ ID NO: 857664 - DNA, 25 bp, Mus musculus
aagcgtgatgttggcaaagtattaa

SEQ ID NO: 857665 - DNA, 25 bp, Mus musculus
aagcgtgatgttgggaaagtattaa

SEQ ID NO: 857666 - DNA, 25 bp, Mus musculus
aagcgtgcacagcgaagaatagcca

SEQ ID NO: 857667 - DNA, 25 bp, Mus musculus
aagcgtgcacagggaagaatagcca

SEQ ID NO: 857668 - DNA, 25 bp, Mus musculus
aagcgtggcttgagcaacaaaagaa

SEQ ID NO: 857669 - DNA, 25 bp, Mus musculus
aagcgtggcttgaggaacaaaagaa

SEQ ID NO: 857670 - DNA, 25 bp, Mus musculus
aagctaaaagacaacgcaggctaca

SEQ ID NO: 857671 - DNA, 25 bp, Mus musculus
aagctaaaagacaaggcaggctaca

SEQ ID NO: 857672 - DNA, 25 bp, Mus musculus
aagctaaacaagagcatgaaggaag

SEQ ID NO: 857673 - DNA, 25 bp, Mus musculus
aagctaaacacccacatgcaaaact

SEQ ID NO: 857674 - DNA, 25 bp, Mus musculus
aagctaaacacccagatgcaaaact

SEQ ID NO: 857675 - DNA, 25 bp, Mus musculus
aagctaaacatgagcatgaaggaag

SEQ ID NO: 857676 - DNA, 25 bp, Mus musculus
aagctaatgtcccgtttgttgctca

SEQ ID NO: 857677 - DNA, 25 bp, Mus musculus
aagctaatgtccggtttgttgctca

SEQ ID NO: 857678 - DNA, 25 bp, Mus musculus
aagctacaccatccccccgcaggct

SEQ ID NO: 857679 - DNA, 25 bp, Mus musculus
aagctacaccatccgcccgcaggct

SEQ ID NO: 857680 - DNA, 25 bp, Mus musculus
aagctacactcatagcctcctctgt

SEQ ID NO: 857681 - DNA, 25 bp, Mus musculus
aagctacactgatagcctcctctgt

SEQ ID NO: 857682 - DNA, 25 bp, Mus musculus
aagctacagagaacctgcagcgctt

SEQ ID NO: 857683 - DNA, 25 bp, Mus musculus
aagctacagagatcctgcagcgctt

SEQ ID NO: 857684 - DNA, 25 bp, Mus musculus
aagctacagataagggacacagcag

SEQ ID NO: 857685 - DNA, 25 bp, Mus musculus
aagctacagatatgggacacagcag

SEQ ID NO: 857686 - DNA, 25 bp, Mus musculus
aagctagaaatgctctggggaagga

SEQ ID NO: 857687 - DNA, 25 bp, Mus musculus
aagctagaaatggtctggggaagga

SEQ ID NO: 857688 - DNA, 25 bp, Mus musculus
aagctagaacaacaccgacagctat

SEQ ID NO: 857689 - DNA, 25 bp, Mus musculus
aagctagaacaacacgtgttgggag

SEQ ID NO: 857690 - DNA, 25 bp, Mus musculus
aagctagaacaacagcgacagctat

SEQ ID NO: 857691 - DNA, 25 bp, Mus musculus
aagctagaacaacaggtgttgggag

SEQ ID NO: 857692 - DNA, 25 bp, Mus musculus
aagctagaggacaaccttctggtcc

SEQ ID NO: 857693 - DNA, 25 bp, Mus musculus
aagctagaggtcaaccttctggtcc

SEQ ID NO: 857694 - DNA, 25 bp, Mus musculus
aagctagatgaaagtaaaactactt

SEQ ID NO: 857695 - DNA, 25 bp, Mus musculus
aagctagatgaatgtaaaactactt

SEQ ID NO: 857696 - DNA, 25 bp, Mus musculus
aagctagcagagactctgtagaaat

SEQ ID NO: 857697 - DNA, 25 bp, Mus musculus
aagctagcagagtctctgtagaaat

SEQ ID NO: 857698 - DNA, 25 bp, Mus musculus
aagctagcagcctacctgcacacac

SEQ ID NO: 857699 - DNA, 25 bp, Mus musculus
aagctagcaggctacctgcacacac

SEQ ID NO: 857700 - DNA, 25 bp, Mus musculus
aagctagtagcacaagctgggaggg

SEQ ID NO: 857701 - DNA, 25 bp, Mus musculus
aagctagtagcagaagctgggaggg

SEQ ID NO: 857702 - DNA, 25 bp, Mus musculus
aagctatggcagaaagccctgcagg

SEQ ID NO: 857703 - DNA, 25 bp, Mus musculus
aagctatggcagaggttttatgaag

SEQ ID NO: 857704 - DNA, 25 bp, Mus musculus
aagctatggcagagtgctgggatta

SEQ ID NO: 857705 - DNA, 25 bp, Mus musculus
aagctatggcagctacttaaaattc

SEQ ID NO: 857706 - DNA, 25 bp, Mus musculus
aagctatggcagctgattggagttg

SEQ ID NO: 857707 - DNA, 25 bp, Mus musculus
aagctatggcaggtacttaaaattc

SEQ ID NO: 857708 - DNA, 25 bp, Mus musculus
aagctatggcaggtgattggagttg

SEQ ID NO: 857709 - DNA, 25 bp, Mus musculus
aagctatggcagtaagccctgcagg

SEQ ID NO: 857710 - DNA, 25 bp, Mus musculus
aagctatggcagtggttttatgaag

SEQ ID NO: 857711 - DNA, 25 bp, Mus musculus
aagctatggcagtgtgctgggatta

SEQ ID NO: 857712 - DNA, 25 bp, Mus musculus
aagctcacaacatccacaatgtctg

SEQ ID NO: 857713 - DNA, 25 bp, Mus musculus
aagctcacaacatcgacaatgtctg

SEQ ID NO: 857714 - DNA, 25 bp, Mus musculus
aagctcacagtgaacgcccgtgagc

SEQ ID NO: 857715 - DNA, 25 bp, Mus musculus
aagctcacagtgaaggcccgtgagc

SEQ ID NO: 857716 - DNA, 25 bp, Mus musculus
aagctcactgtggacgagctgaagt

SEQ ID NO: 857717 - DNA, 25 bp, Mus musculus
aagctcactgtggaggagctgaagt

SEQ ID NO: 857718 - DNA, 25 bp, Mus musculus
aagctcagaaagctgtgtatgatcg

SEQ ID NO: 857719 - DNA, 25 bp, Mus musculus
aagctcagaaaggtgtgtatgatcg

SEQ ID NO: 857720 - DNA, 25 bp, Mus musculus
aagctcagagctgccgagagcagtt

SEQ ID NO: 857721 - DNA, 25 bp, Mus musculus
aagctcagagggatcagaaacatcg

SEQ ID NO: 857722 - DNA, 25 bp, Mus musculus
aagctcagagggttcagaaacatcg

SEQ ID NO: 857723 - DNA, 25 bp, Mus musculus
aagctcagaggtgccgagagcagtt

SEQ ID NO: 857724 - DNA, 25 bp, Mus musculus
aagctcagatcacgtaagggagcac

SEQ ID NO: 857725 - DNA, 25 bp, Mus musculus
aagctcagatcaggtaagggagcac

SEQ ID NO: 857726 - DNA, 25 bp, Mus musculus
aagctcagatgaaaagaagaaacca

SEQ ID NO: 857727 - DNA, 25 bp, Mus musculus
aagctcagatgataagaagaaacca

SEQ ID NO: 857728 - DNA, 25 bp, Mus musculus
aagctcatgcagcatgatctacaca

SEQ ID NO: 857729 - DNA, 25 bp, Mus musculus
aagctcatgcaggatgatctacaca

SEQ ID NO: 857730 - DNA, 25 bp, Mus musculus
aagctcatggccggactggacatgc

SEQ ID NO: 857731 - DNA, 25 bp, Mus musculus
aagctcatggctcacgtgaaccaga

SEQ ID NO: 857732 - DNA, 25 bp, Mus musculus
aagctcatggctcaggtgaaccaga

SEQ ID NO: 857733 - DNA, 25 bp, Mus musculus
aagctcatgggcggactggacatgc

SEQ ID NO: 857734 - DNA, 25 bp, Mus musculus
aagctcattgatcagtttggaagca

SEQ ID NO: 857735 - DNA, 25 bp, Mus musculus
aagctcattgttcagtttggaagca

SEQ ID NO: 857736 - DNA, 25 bp, Mus musculus
aagctccatgggcttcccaggcctc

SEQ ID NO: 857737 - DNA, 25 bp, Mus musculus
aagctccatggggttcccaggcctc

SEQ ID NO: 857738 - DNA, 25 bp, Mus musculus
aagctcccacagcgaagccctgccc

SEQ ID NO: 857739 - DNA, 25 bp, Mus musculus
aagctcccacagggaagccctgccc

SEQ ID NO: 857740 - DNA, 25 bp, Mus musculus
aagctccccgacctgcactcttgag

SEQ ID NO: 857741 - DNA, 25 bp, Mus musculus
aagctccccgtcctgcactcttgag

SEQ ID NO: 857742 - DNA, 25 bp, Mus musculus
aagctcccgccaaacgccatgagaa

SEQ ID NO: 857743 - DNA, 25 bp, Mus musculus
aagctcccgccaaaggccatgagaa

SEQ ID NO: 857744 - DNA, 25 bp, Mus musculus
aagctcctccagcttgtctatctgc

SEQ ID NO: 857745 - DNA, 25 bp, Mus musculus
aagctcctccaggttgtctatctgc

SEQ ID NO: 857746 - DNA, 25 bp, Mus musculus
aagctcgcaaagcctggcaaaaccc

SEQ ID NO: 857747 - DNA, 25 bp, Mus musculus
aagctcgcaaaggctggcaaaaccc

SEQ ID NO: 857748 - DNA, 25 bp, Mus musculus
aagctcgcctcagactgtgttcagt

SEQ ID NO: 857749 - DNA, 25 bp, Mus musculus
aagctcgcctcagacttccctggca

SEQ ID NO: 857750 - DNA, 25 bp, Mus musculus
aagctcgcctcagagtgtgttcagt

SEQ ID NO: 857751 - DNA, 25 bp, Mus musculus
aagctcgcctcagagttccctggca

SEQ ID NO: 857752 - DNA, 25 bp, Mus musculus
aagctctacaagctctccaacggtg

SEQ ID NO: 857753 - DNA, 25 bp, Mus musculus
aagctctacaaggtctccaacggtg

SEQ ID NO: 857754 - DNA, 25 bp, Mus musculus
aagctctagaagcgtacaggcggga

SEQ ID NO: 857755 - DNA, 25 bp, Mus musculus
aagctctagaagggtacaggcggga

SEQ ID NO: 857756 - DNA, 25 bp, Mus musculus
aagctctatgactttgtgaagacag

SEQ ID NO: 857757 - DNA, 25 bp, Mus musculus
aagctctatgctcgggagccacagc

SEQ ID NO: 857758 - DNA, 25 bp, Mus musculus
aagctctatggtcgggagccacagc

SEQ ID NO: 857759 - DNA, 25 bp, Mus musculus
aagctctatgtctttgtgaagacag

SEQ ID NO: 857760 - DNA, 25 bp, Mus musculus
aagctctcagctcaccggaacctgc

SEQ ID NO: 857761 - DNA, 25 bp, Mus musculus
aagctctcagctcaccggtcacaca

SEQ ID NO: 857762 - DNA, 25 bp, Mus musculus
aagctctcagctcagcggaacctgc

SEQ ID NO: 857763 - DNA, 25 bp, Mus musculus
aagctctcagctcagcggtcacaca

SEQ ID NO: 857764 - DNA, 25 bp, Mus musculus
aagctctcgccaaacgtgatgagaa

SEQ ID NO: 857765 - DNA, 25 bp, Mus musculus
aagctctcgccaaaggtgatgagaa

SEQ ID NO: 857766 - DNA, 25 bp, Mus musculus
aagctctgccaaccctgccctgagg

SEQ ID NO: 857767 - DNA, 25 bp, Mus musculus
aagctctgccaagcctgccctgagg

SEQ ID NO: 857768 - DNA, 25 bp, Mus musculus
aagctcttaattatcggagatacag

SEQ ID NO: 857769 - DNA, 25 bp, Mus musculus
aagctcttaattatgggagatacag

SEQ ID NO: 857770 - DNA, 25 bp, Mus musculus
aagctcttatctgagacgtggaatc

SEQ ID NO: 857771 - DNA, 25 bp, Mus musculus
aagctcttatgtgagacgtggaatc

SEQ ID NO: 857772 - DNA, 25 bp, Mus musculus
aagctcttgaaacaatttgaattca

SEQ ID NO: 857773 - DNA, 25 bp, Mus musculus
aagctcttgaaagaatttgaattca

SEQ ID NO: 857774 - DNA, 25 bp, Mus musculus
aagctctttgtacacgatgagaaag

SEQ ID NO: 857775 - DNA, 25 bp, Mus musculus
aagctctttgtacaggatgagaaag

SEQ ID NO: 857776 - DNA, 25 bp, Mus musculus
aagctgaaaaagcctgtagattttg

SEQ ID NO: 857777 - DNA, 25 bp, Mus musculus
aagctgaaaaaggctgtagattttg

SEQ ID NO: 857778 - DNA, 25 bp, Mus musculus
aagctgaaagatattcggcagagtc

SEQ ID NO: 857779 - DNA, 25 bp, Mus musculus
aagctgaaagttattcggcagagtc

SEQ ID NO: 857780 - DNA, 25 bp, Mus musculus
aagctgaaggagcctgaaactcggg

SEQ ID NO: 857781 - DNA, 25 bp, Mus musculus
aagctgaaggaggctgaaactcggg

SEQ ID NO: 857782 - DNA, 25 bp, Mus musculus
aagctgaaggcacgtgacactgtca

SEQ ID NO: 857783 - DNA, 25 bp, Mus musculus
aagctgaaggcaggtgacactgtca

SEQ ID NO: 857784 - DNA, 25 bp, Mus musculus
aagctgaatatgaacgacaatcagt

SEQ ID NO: 857785 - DNA, 25 bp, Mus musculus
aagctgaatatgaaggacaatcagt

SEQ ID NO: 857786 - DNA, 25 bp, Mus musculus
aagctgaatgccatcaaactacaac

SEQ ID NO: 857787 - DNA, 25 bp, Mus musculus
aagctgaatgccttcaaactacaac

SEQ ID NO: 857788 - DNA, 25 bp, Mus musculus
aagctgacaacaaacgtatgtcacc

SEQ ID NO: 857789 - DNA, 25 bp, Mus musculus
aagctgacaacaaaggtatgtcacc

SEQ ID NO: 857790 - DNA, 25 bp, Mus musculus
aagctgacagagcacgtgtcttagc

SEQ ID NO: 857791 - DNA, 25 bp, Mus musculus
aagctgacagagcaggtgtcttagc

SEQ ID NO: 857792 - DNA, 25 bp, Mus musculus
aagctgaccaagcgactgcacagga

SEQ ID NO: 857793 - DNA, 25 bp, Mus musculus
aagctgaccaagggactgcacagga

SEQ ID NO: 857794 - DNA, 25 bp, Mus musculus
aagctgacccccaacaggccattaa

SEQ ID NO: 857795 - DNA, 25 bp, Mus musculus
aagctgacccccaacgccatcgccc

SEQ ID NO: 857796 - DNA, 25 bp, Mus musculus
aagctgacccccaagaggccattaa

SEQ ID NO: 857797 - DNA, 25 bp, Mus musculus
aagctgacccccaaggccatcgccc

SEQ ID NO: 857798 - DNA, 25 bp, Mus musculus
aagctgactgagcacaaggcagatg

SEQ ID NO: 857799 - DNA, 25 bp, Mus musculus
aagctgactgaggacaaggcagatg

SEQ ID NO: 857800 - DNA, 25 bp, Mus musculus
aagctgacttcacggatgttctatg

SEQ ID NO: 857801 - DNA, 25 bp, Mus musculus
aagctgacttcagggatgttctatg

SEQ ID NO: 857802 - DNA, 25 bp, Mus musculus
aagctgagagaaacgaagtgagaag

SEQ ID NO: 857803 - DNA, 25 bp, Mus musculus
aagctgagagtaacgaagtgagaag

SEQ ID NO: 857804 - DNA, 25 bp, Mus musculus
aagctgaggcggcgcatcgtgaagc

SEQ ID NO: 857805 - DNA, 25 bp, Mus musculus
aagctgaggcggggcatcgtgaagc

SEQ ID NO: 857806 - DNA, 25 bp, Mus musculus
aagctgagtatagacgtgctccaga

SEQ ID NO: 857807 - DNA, 25 bp, Mus musculus
aagctgagtatagaggtgctccaga

SEQ ID NO: 857808 - DNA, 25 bp, Mus musculus
aagctgataaccaccgctctgaagc

SEQ ID NO: 857809 - DNA, 25 bp, Mus musculus
aagctgataaccacctctctgggtc

SEQ ID NO: 857810 - DNA, 25 bp, Mus musculus
aagctgataaccacggctctgaagc

SEQ ID NO: 857811 - DNA, 25 bp, Mus musculus
aagctgataaccacgtctctgggtc

SEQ ID NO: 857812 - DNA, 25 bp, Mus musculus
aagctgatcaagctcttggataaac

SEQ ID NO: 857813 - DNA, 25 bp, Mus musculus
aagctgatcaaggtcttggataaac

SEQ ID NO: 857814 - DNA, 25 bp, Mus musculus
aagctgatgaaaaagctgctggaag

SEQ ID NO: 857815 - DNA, 25 bp, Mus musculus
aagctgatgaaatagctgctggaag

SEQ ID NO: 857816 - DNA, 25 bp, Mus musculus
aagctgcacatcaacacctgtgttc

SEQ ID NO: 857817 - DNA, 25 bp, Mus musculus
aagctgcacatcaacgtccctttgt

SEQ ID NO: 857818 - DNA, 25 bp, Mus musculus
aagctgcacatcaagacctgtgttc

SEQ ID NO: 857819 - DNA, 25 bp, Mus musculus
aagctgcacatcaaggtccctttgt

SEQ ID NO: 857820 - DNA, 25 bp, Mus musculus
aagctgcagatttgcgacacagcag

SEQ ID NO: 857821 - DNA, 25 bp, Mus musculus
aagctgcagatttgggacacagcag

SEQ ID NO: 857822 - DNA, 25 bp, Mus musculus
aagctgcagcaagacttccactgtt

SEQ ID NO: 857823 - DNA, 25 bp, Mus musculus
aagctgcagcaagagttccactgtt

SEQ ID NO: 857824 - DNA, 25 bp, Mus musculus
aagctgcatgaccactgtagtccat

SEQ ID NO: 857825 - DNA, 25 bp, Mus musculus
aagctgcatgaccagtgtagtccat

SEQ ID NO: 857826 - DNA, 25 bp, Mus musculus
aagctgcggaagcatgatccagtca

SEQ ID NO: 857827 - DNA, 25 bp, Mus musculus
aagctgcggaaggatgatccagtca

SEQ ID NO: 857828 - DNA, 25 bp, Mus musculus
aagctgcgggaaaccgctgaagctg

SEQ ID NO: 857829 - DNA, 25 bp, Mus musculus
aagctgcgggaaacggctgaagctg

SEQ ID NO: 857830 - DNA, 25 bp, Mus musculus
aagctgctacaactgtccctccaat

SEQ ID NO: 857831 - DNA, 25 bp, Mus musculus
aagctgctacaagtgtccctccaat

SEQ ID NO: 857832 - DNA, 25 bp, Mus musculus
aagctgctcgactggctggtggaca

SEQ ID NO: 857833 - DNA, 25 bp, Mus musculus
aagctgctcgtctggctggtggaca

SEQ ID NO: 857834 - DNA, 25 bp, Mus musculus
aagctgctgcggaaagccacggctt

SEQ ID NO: 857835 - DNA, 25 bp, Mus musculus
aagctgctgcggtaagccacggctt

SEQ ID NO: 857836 - DNA, 25 bp, Mus musculus
aagctgcttgcccccatcagccaga

SEQ ID NO: 857837 - DNA, 25 bp, Mus musculus
aagctgcttggccccatcagccaga

SEQ ID NO: 857838 - DNA, 25 bp, Mus musculus
aagctggaaatgcaaccagtgacct

SEQ ID NO: 857839 - DNA, 25 bp, Mus musculus
aagctggaaatggaaccagtgacct

SEQ ID NO: 857840 - DNA, 25 bp, Mus musculus
aagctggaagaagagacttttcatg

SEQ ID NO: 857841 - DNA, 25 bp, Mus musculus
aagctggaagaagctgggagggcag

SEQ ID NO: 857842 - DNA, 25 bp, Mus musculus
aagctggaagcggctgcagtgctag

SEQ ID NO: 857843 - DNA, 25 bp, Mus musculus
aagctggaagctgaaattaaaaagc

SEQ ID NO: 857844 - DNA, 25 bp, Mus musculus
aagctggaaggggctgcagtgctag

SEQ ID NO: 857845 - DNA, 25 bp, Mus musculus
aagctggaaggtgaaattaaaaagc

SEQ ID NO: 857846 - DNA, 25 bp, Mus musculus
aagctggaagtagagacttttcatg

SEQ ID NO: 857847 - DNA, 25 bp, Mus musculus
aagctggaagtagctgggagggcag

SEQ ID NO: 857848 - DNA, 25 bp, Mus musculus
aagctggacaatcacagggcactgc

SEQ ID NO: 857849 - DNA, 25 bp, Mus musculus
aagctggacaatcagagggcactgc

SEQ ID NO: 857850 - DNA, 25 bp, Mus musculus
aagctggagcagcaaagatctatac

SEQ ID NO: 857851 - DNA, 25 bp, Mus musculus
aagctggagcagcaggagtaccagg

SEQ ID NO: 857852 - DNA, 25 bp, Mus musculus
aagctggagcagcttgaacttgaga

SEQ ID NO: 857853 - DNA, 25 bp, Mus musculus
aagctggagcaggaaagatctatac

SEQ ID NO: 857854 - DNA, 25 bp, Mus musculus
aagctggagcaggaggagtaccagg

SEQ ID NO: 857855 - DNA, 25 bp, Mus musculus
aagctggagcaggttgaacttgaga

SEQ ID NO: 857856 - DNA, 25 bp, Mus musculus
aagctggaggagcccaagcacattg

SEQ ID NO: 857857 - DNA, 25 bp, Mus musculus
aagctggaggagctcattcagattc

SEQ ID NO: 857858 - DNA, 25 bp, Mus musculus
aagctggaggaggccaagcacattg

SEQ ID NO: 857859 - DNA, 25 bp, Mus musculus
aagctggaggaggtcattcagattc

SEQ ID NO: 857860 - DNA, 25 bp, Mus musculus
aagctggataacaacgatctgttca

SEQ ID NO: 857861 - DNA, 25 bp, Mus musculus
aagctggataacaaggatctgttca

SEQ ID NO: 857862 - DNA, 25 bp, Mus musculus
aagctggatagtaacgtgaacatca

SEQ ID NO: 857863 - DNA, 25 bp, Mus musculus
aagctggatagtaaggtgaacatca

SEQ ID NO: 857864 - DNA, 25 bp, Mus musculus
aagctggatcagcatgcgggctcct

SEQ ID NO: 857865 - DNA, 25 bp, Mus musculus
aagctggatcaggatgcgggctcct

SEQ ID NO: 857866 - DNA, 25 bp, Mus musculus
aagctggatgagcacctttgtgctg

SEQ ID NO: 857867 - DNA, 25 bp, Mus musculus
aagctggatgaggacctttgtgctg

SEQ ID NO: 857868 - DNA, 25 bp, Mus musculus
aagctggcctactaagcctatcaga

SEQ ID NO: 857869 - DNA, 25 bp, Mus musculus
aagctggcctactatgcctatcaga

SEQ ID NO: 857870 - DNA, 25 bp, Mus musculus
aagctggcgaaagccattggagcgc

SEQ ID NO: 857871 - DNA, 25 bp, Mus musculus
aagctggcgaaagcgattggagcgc

SEQ ID NO: 857872 - DNA, 25 bp, Mus musculus
aagctgggaaagaacatgaaagcag

SEQ ID NO: 857873 - DNA, 25 bp, Mus musculus
aagctgggaaagaagatgaaagcag

SEQ ID NO: 857874 - DNA, 25 bp, Mus musculus
aagctgggaattcaaatgactgtga

SEQ ID NO: 857875 - DNA, 25 bp, Mus musculus
aagctgggaattcaagtctgcccgg

SEQ ID NO: 857876 - DNA, 25 bp, Mus musculus
aagctgggaattcatatgactgtga

SEQ ID NO: 857877 - DNA, 25 bp, Mus musculus
aagctgggaattcatgtctgcccgg

SEQ ID NO: 857878 - DNA, 25 bp, Mus musculus
aagctgggagttcgccaagaaggaa

SEQ ID NO: 857879 - DNA, 25 bp, Mus musculus
aagctgggagttggccaagaaggaa

SEQ ID NO: 857880 - DNA, 25 bp, Mus musculus
aagctgggtctccgaactgcctaca

SEQ ID NO: 857881 - DNA, 25 bp, Mus musculus
aagctgggtctcggaactgcctaca

SEQ ID NO: 857882 - DNA, 25 bp, Mus musculus
aagctgggtttgcccgattatcaca

SEQ ID NO: 857883 - DNA, 25 bp, Mus musculus
aagctgggtttgccggattatcaca

SEQ ID NO: 857884 - DNA, 25 bp, Mus musculus
aagctggtaacagtgcacaggtctc

SEQ ID NO: 857885 - DNA, 25 bp, Mus musculus
aagctggtaagagtgcacaggtctc

SEQ ID NO: 857886 - DNA, 25 bp, Mus musculus
aagctggtcaagcgtctagagacat

SEQ ID NO: 857887 - DNA, 25 bp, Mus musculus
aagctggtcaagctgtggaatctgg

SEQ ID NO: 857888 - DNA, 25 bp, Mus musculus
aagctggtcaagggtctagagacat

SEQ ID NO: 857889 - DNA, 25 bp, Mus musculus
aagctggtcaaggtgtggaatctgg

SEQ ID NO: 857890 - DNA, 25 bp, Mus musculus
aagctggtggagaccccttgtccgg

SEQ ID NO: 857891 - DNA, 25 bp, Mus musculus
aagctggtggagacgccttgtccgg

SEQ ID NO: 857892 - DNA, 25 bp, Mus musculus
aagctggtttcagacgaggcctttc

SEQ ID NO: 857893 - DNA, 25 bp, Mus musculus
aagctggtttcagaggaggcctttc

SEQ ID NO: 857894 - DNA, 25 bp, Mus musculus
aagctgtaagctgctcgtcctcagg

SEQ ID NO: 857895 - DNA, 25 bp, Mus musculus
aagctgtaaggtgctcgtcctcagg

SEQ ID NO: 857896 - DNA, 25 bp, Mus musculus
aagctgtcagatctgagaagtcaga

SEQ ID NO: 857897 - DNA, 25 bp, Mus musculus
aagctgtcagcattctgcctacatg

SEQ ID NO: 857898 - DNA, 25 bp, Mus musculus
aagctgtcaggattctgcctacatg

SEQ ID NO: 857899 - DNA, 25 bp, Mus musculus
aagctgtcagttctgagaagtcaga

SEQ ID NO: 857900 - DNA, 25 bp, Mus musculus
aagctgtccttcctcgtgactctga

SEQ ID NO: 857901 - DNA, 25 bp, Mus musculus
aagctgtccttcctggtgactctga

SEQ ID NO: 857902 - DNA, 25 bp, Mus musculus
aagctgtctttacactatgtaggcc

SEQ ID NO: 857903 - DNA, 25 bp, Mus musculus
aagctgtctttacagtatgtaggcc

SEQ ID NO: 857904 - DNA, 25 bp, Mus musculus
aagctgtgatcttcaggaccatact

SEQ ID NO: 857905 - DNA, 25 bp, Mus musculus
aagctgtgatgttcaggaccatact

SEQ ID NO: 857906 - DNA, 25 bp, Mus musculus
aagctgtgcgcatgccgggagacag

SEQ ID NO: 857907 - DNA, 25 bp, Mus musculus
aagctgtgcggatgccgggagacag

SEQ ID NO: 857908 - DNA, 25 bp, Mus musculus
aagctgtgggaacagcagcaagctg

SEQ ID NO: 857909 - DNA, 25 bp, Mus musculus
aagctgtgggaagagcagcaagctg

SEQ ID NO: 857910 - DNA, 25 bp, Mus musculus
aagctgttgtctatcttggagatgg

SEQ ID NO: 857911 - DNA, 25 bp, Mus musculus
aagctgttgtgtatcttggagatgg

SEQ ID NO: 857912 - DNA, 25 bp, Mus musculus
aagcttacagcagtgccaggaggta

SEQ ID NO: 857913 - DNA, 25 bp, Mus musculus
aagcttacaggagtgccaggaggta

SEQ ID NO: 857914 - DNA, 25 bp, Mus musculus
aagcttcaacaggccacctgggccc

SEQ ID NO: 857915 - DNA, 25 bp, Mus musculus
aagcttcaacaggcgacctgggccc

SEQ ID NO: 857916 - DNA, 25 bp, Mus musculus
aagcttcagatttgcgacacagcag

SEQ ID NO: 857917 - DNA, 25 bp, Mus musculus
aagcttcagatttgggacacagcag

SEQ ID NO: 857918 - DNA, 25 bp, Mus musculus
aagcttcataatattaacagacccc

SEQ ID NO: 857919 - DNA, 25 bp, Mus musculus
aagcttcataattttaacagacccc

SEQ ID NO: 857920 - DNA, 25 bp, Mus musculus
aagcttcctgctgcaaatagtctac

SEQ ID NO: 857921 - DNA, 25 bp, Mus musculus
aagcttcctggtgcaaatagtctac

SEQ ID NO: 857922 - DNA, 25 bp, Mus musculus
aagcttctggagcaagtatcctgtc

SEQ ID NO: 857923 - DNA, 25 bp, Mus musculus
aagcttctggaggaagtatcctgtc

SEQ ID NO: 857924 - DNA, 25 bp, Mus musculus
aagcttctgtcagtcaccccatgaa

SEQ ID NO: 857925 - DNA, 25 bp, Mus musculus
aagcttctgtcagtgaccccatgaa

SEQ ID NO: 857926 - DNA, 25 bp, Mus musculus
aagcttgagaaaaaccatggtgaat

SEQ ID NO: 857927 - DNA, 25 bp, Mus musculus
aagcttgagaaataccatggtgaat

SEQ ID NO: 857928 - DNA, 25 bp, Mus musculus
aagcttgcagaatctttatcttctg

SEQ ID NO: 857929 - DNA, 25 bp, Mus musculus
aagcttgcagccctttctcatagca

SEQ ID NO: 857930 - DNA, 25 bp, Mus musculus
aagcttgcaggcctttctcatagca

SEQ ID NO: 857931 - DNA, 25 bp, Mus musculus
aagcttgcagtatctttatcttctg

SEQ ID NO: 857932 - DNA, 25 bp, Mus musculus
aagcttgccacactcgaagacttct

SEQ ID NO: 857933 - DNA, 25 bp, Mus musculus
aagcttgccagactcgaagacttct

SEQ ID NO: 857934 - DNA, 25 bp, Mus musculus
aagcttgcccagaatgtgggatcct

SEQ ID NO: 857935 - DNA, 25 bp, Mus musculus
aagcttgcccagtatgtgggatcct

SEQ ID NO: 857936 - DNA, 25 bp, Mus musculus
aagcttgctcagcatggctgcagca

SEQ ID NO: 857937 - DNA, 25 bp, Mus musculus
aagcttgctcagcctcctcggatta

SEQ ID NO: 857938 - DNA, 25 bp, Mus musculus
aagcttgctcaggatggctgcagca

SEQ ID NO: 857939 - DNA, 25 bp, Mus musculus
aagcttgctcaggctcctcggatta

SEQ ID NO: 857940 - DNA, 25 bp, Mus musculus
aagcttgctgagactctccgctggt

SEQ ID NO: 857941 - DNA, 25 bp, Mus musculus
aagcttgctgagcgtttcccagtgt

SEQ ID NO: 857942 - DNA, 25 bp, Mus musculus
aagcttgctgagggtttcccagtgt

SEQ ID NO: 857943 - DNA, 25 bp, Mus musculus
aagcttgctgagtctctccgctggt

SEQ ID NO: 857944 - DNA, 25 bp, Mus musculus
aagcttgtgtctcagttctgcagag

SEQ ID NO: 857945 - DNA, 25 bp, Mus musculus
aagcttgtgtctgagttctgcagag

SEQ ID NO: 857946 - DNA, 25 bp, Mus musculus
aagctttaaacaagaggctcaagat

SEQ ID NO: 857947 - DNA, 25 bp, Mus musculus
aagctttaaacaaggggcgcagaga

SEQ ID NO: 857948 - DNA, 25 bp, Mus musculus
aagctttaaacatgaggctcaagat

SEQ ID NO: 857949 - DNA, 25 bp, Mus musculus
aagctttaaacatggggcgcagaga

SEQ ID NO: 857950 - DNA, 25 bp, Mus musculus
aagctttaacctttgattctcataa

SEQ ID NO: 857951 - DNA, 25 bp, Mus musculus
aagctttaacgtttgattctcataa

SEQ ID NO: 857952 - DNA, 25 bp, Mus musculus
aagctttacaataacattacatctc

SEQ ID NO: 857953 - DNA, 25 bp, Mus musculus
aagctttacaataagattacatctc

SEQ ID NO: 857954 - DNA, 25 bp, Mus musculus
aagctttcaaagccattggcacagc

SEQ ID NO: 857955 - DNA, 25 bp, Mus musculus
aagctttcaaaggcattggcacagc

SEQ ID NO: 857956 - DNA, 25 bp, Mus musculus
aagcttttaaatctctagtttggtg

SEQ ID NO: 857957 - DNA, 25 bp, Mus musculus
aagcttttaaatgtctagtttggtg

SEQ ID NO: 857958 - DNA, 25 bp, Mus musculus
aaggaaaaatgccagcaagatatgt

SEQ ID NO: 857959 - DNA, 25 bp, Mus musculus
aaggaaaaatgcgagcaagatatgt

SEQ ID NO: 857960 - DNA, 25 bp, Mus musculus
aaggaaacatagagaggaactacaa

SEQ ID NO: 857961 - DNA, 25 bp, Mus musculus
aaggaaacatagagtggaactacaa

SEQ ID NO: 857962 - DNA, 25 bp, Mus musculus
aaggaaatccacaaccatcgatact

SEQ ID NO: 857963 - DNA, 25 bp, Mus musculus
aaggaaatccacaagcatcgatact

SEQ ID NO: 857964 - DNA, 25 bp, Mus musculus
aaggaaatgcgccacttgatgaagg

SEQ ID NO: 857965 - DNA, 25 bp, Mus musculus
aaggaaatgcgccagttgatgaagg

SEQ ID NO: 857966 - DNA, 25 bp, Mus musculus
aaggaacatgattccagagtgtgga

SEQ ID NO: 857967 - DNA, 25 bp, Mus musculus
aaggaacatgtttccagagtgtgga

SEQ ID NO: 857968 - DNA, 25 bp, Mus musculus
aaggaaccatgaaaagaagagatga

SEQ ID NO: 857969 - DNA, 25 bp, Mus musculus
aaggaaccatgaaatgaagagatga

SEQ ID NO: 857970 - DNA, 25 bp, Mus musculus
aaggaactcaaacgcaaatcagagg

SEQ ID NO: 857971 - DNA, 25 bp, Mus musculus
aaggaactcaaaggcaaatcagagg

SEQ ID NO: 857972 - DNA, 25 bp, Mus musculus
aaggaactctggaacatgggtgtgt

SEQ ID NO: 857973 - DNA, 25 bp, Mus musculus
aaggaactctggaagatgggtgtgt

SEQ ID NO: 857974 - DNA, 25 bp, Mus musculus
aaggaagacacacgtacaagctctg

SEQ ID NO: 857975 - DNA, 25 bp, Mus musculus
aaggaagacacaggtacaagctctg

SEQ ID NO: 857976 - DNA, 25 bp, Mus musculus
aaggaagacttcaacaggacgctgg

SEQ ID NO: 857977 - DNA, 25 bp, Mus musculus
aaggaagacttcaagaggacgctgg

SEQ ID NO: 857978 - DNA, 25 bp, Mus musculus
aaggaagactttctggacataaaga

SEQ ID NO: 857979 - DNA, 25 bp, Mus musculus
aaggaagactttgtggacataaaga

SEQ ID NO: 857980 - DNA, 25 bp, Mus musculus
aaggaagaggagaagatgcaagtgg

SEQ ID NO: 857981 - DNA, 25 bp, Mus musculus
aaggaagaggagtagatgcaagtgg

SEQ ID NO: 857982 - DNA, 25 bp, Mus musculus
aaggaagaggcgatatgtggtacat

SEQ ID NO: 857983 - DNA, 25 bp, Mus musculus
aaggaagaggggatatgtggtacat

SEQ ID NO: 857984 - DNA, 25 bp, Mus musculus
aaggaagattgaagtcggcagctct

SEQ ID NO: 857985 - DNA, 25 bp, Mus musculus
aaggaagattgatgtcggcagctct

SEQ ID NO: 857986 - DNA, 25 bp, Mus musculus
aaggaagcagagatgcccggaaccg

SEQ ID NO: 857987 - DNA, 25 bp, Mus musculus
aaggaagcagagttgcccggaaccg

SEQ ID NO: 857988 - DNA, 25 bp, Mus musculus
aaggaagccaaaaacaagaagcact

SEQ ID NO: 857989 - DNA, 25 bp, Mus musculus
aaggaagccaaaaacagcaagaagc

SEQ ID NO: 857990 - DNA, 25 bp, Mus musculus
aaggaagccaaaaagaagaagcact

SEQ ID NO: 857991 - DNA, 25 bp, Mus musculus
aaggaagccaaaaagagcaagaagc

SEQ ID NO: 857992 - DNA, 25 bp, Mus musculus
aaggaaggcgagcgtgctgaccatc

SEQ ID NO: 857993 - DNA, 25 bp, Mus musculus
aaggaaggcgagggtgctgaccatc

SEQ ID NO: 857994 - DNA, 25 bp, Mus musculus
aaggaaggctcacaccagccaactc

SEQ ID NO: 857995 - DNA, 25 bp, Mus musculus
aaggaaggctcagaccagccaactc

SEQ ID NO: 857996 - DNA, 25 bp, Mus musculus
aaggaagggagaagtttggagctgt

SEQ ID NO: 857997 - DNA, 25 bp, Mus musculus
aaggaagggagatgtttggagctgt

SEQ ID NO: 857998 - DNA, 25 bp, Mus musculus
aaggaagtataaatccatcgaatca

SEQ ID NO: 857999 - DNA, 25 bp, Mus musculus
aaggaagtattaatccatcgaatca

SEQ ID NO: 858000 - DNA, 25 bp, Mus musculus
aaggaagtcggccagatcctgtctg

SEQ ID NO: 858001 - DNA, 25 bp, Mus musculus
aaggaagtcggcgagatcctgtctg

SEQ ID NO: 858002 - DNA, 25 bp, Mus musculus
aaggaagtgttcaacgctgctgctg

SEQ ID NO: 858003 - DNA, 25 bp, Mus musculus
aaggaagtgttcaaggctgctgctg

SEQ ID NO: 858004 - DNA, 25 bp, Mus musculus
aaggaataccagcaaaatagtgatg

SEQ ID NO: 858005 - DNA, 25 bp, Mus musculus
aaggaataccagcaaatgataatgc

SEQ ID NO: 858006 - DNA, 25 bp, Mus musculus
aaggaataccaggaaaatagtgatg

SEQ ID NO: 858007 - DNA, 25 bp, Mus musculus
aaggaataccaggaaatgataatgc

SEQ ID NO: 858008 - DNA, 25 bp, Mus musculus
aaggaatagaactgcccgtgcggcc

SEQ ID NO: 858009 - DNA, 25 bp, Mus musculus
aaggaatagaactggccgtgcggcc

SEQ ID NO: 858010 - DNA, 25 bp, Mus musculus
aaggaatagtgtcataattggcctt

SEQ ID NO: 858011 - DNA, 25 bp, Mus musculus
aaggaatagtgtctgcagcttatga

SEQ ID NO: 858012 - DNA, 25 bp, Mus musculus
aaggaatagtgtgataattggcctt

SEQ ID NO: 858013 - DNA, 25 bp, Mus musculus
aaggaatagtgtgtgcagcttatga

SEQ ID NO: 858014 - DNA, 25 bp, Mus musculus
aaggaatatccacaaggtgactcca

SEQ ID NO: 858015 - DNA, 25 bp, Mus musculus
aaggaatatccagaaggtgactcca

SEQ ID NO: 858016 - DNA, 25 bp, Mus musculus
aaggaatatgagaaagagagccaga

SEQ ID NO: 858017 - DNA, 25 bp, Mus musculus
aaggaatatgagtaagagagccaga

SEQ ID NO: 858018 - DNA, 25 bp, Mus musculus
aaggaatcgtggcacgccccatgaa

SEQ ID NO: 858019 - DNA, 25 bp, Mus musculus
aaggaatcgtggcaggccccatgaa

SEQ ID NO: 858020 - DNA, 25 bp, Mus musculus
aaggaatcttgaaacgctcaccctt

SEQ ID NO: 858021 - DNA, 25 bp, Mus musculus
aaggaatcttgaaaggctcaccctt

SEQ ID NO: 858022 - DNA, 25 bp, Mus musculus
aaggaatgccatatcaacgaatgcc

SEQ ID NO: 858023 - DNA, 25 bp, Mus musculus
aaggaatgccttatcaacgaatgcc

SEQ ID NO: 858024 - DNA, 25 bp, Mus musculus
aaggaattacagccgaagaagcagg

SEQ ID NO: 858025 - DNA, 25 bp, Mus musculus
aaggaattacaggcgaagaagcagg

SEQ ID NO: 858026 - DNA, 25 bp, Mus musculus
aaggaattcaagatggtcaaataaa

SEQ ID NO: 858027 - DNA, 25 bp, Mus musculus
aaggaattcaagttggtcaaataaa

SEQ ID NO: 858028 - DNA, 25 bp, Mus musculus
aaggacaaggatgttgacctcctgt

SEQ ID NO: 858029 - DNA, 25 bp, Mus musculus
aaggacaaggttgttgacctcctgt

SEQ ID NO: 858030 - DNA, 25 bp, Mus musculus
aaggacaatgagcatggcagtacct

SEQ ID NO: 858031 - DNA, 25 bp, Mus musculus
aaggacaatgaggatggcagtacct

SEQ ID NO: 858032 - DNA, 25 bp, Mus musculus
aaggacacactacgcctcggaaaga

SEQ ID NO: 858033 - DNA, 25 bp, Mus musculus
aaggacacactaggcctcggaaaga

SEQ ID NO: 858034 - DNA, 25 bp, Mus musculus
aaggacacgcaccactggtatgtgt

SEQ ID NO: 858035 - DNA, 25 bp, Mus musculus
aaggacacgcaccagtggtatgtgt

SEQ ID NO: 858036 - DNA, 25 bp, Mus musculus
aaggacactgtcaacggcagggtca

SEQ ID NO: 858037 - DNA, 25 bp, Mus musculus
aaggacactgtcaagggcagggtca

SEQ ID NO: 858038 - DNA, 25 bp, Mus musculus
aaggacagcaatcgcatgcgccccc

SEQ ID NO: 858039 - DNA, 25 bp, Mus musculus
aaggacagcaatggcatgcgccccc

SEQ ID NO: 858040 - DNA, 25 bp, Mus musculus
aaggacagtgtggacgggcagtctc

SEQ ID NO: 858041 - DNA, 25 bp, Mus musculus
aaggacagtgtggaggggcagtctc

SEQ ID NO: 858042 - DNA, 25 bp, Mus musculus
aaggacattgagacagaaagacatg

SEQ ID NO: 858043 - DNA, 25 bp, Mus musculus
aaggacattgagtcagaaagacatg

SEQ ID NO: 858044 - DNA, 25 bp, Mus musculus
aaggacattggtaccgagtgcatga

SEQ ID NO: 858045 - DNA, 25 bp, Mus musculus
aaggacattggttccgagtgcatga

SEQ ID NO: 858046 - DNA, 25 bp, Mus musculus
aaggaccacaaagatctggctacca

SEQ ID NO: 858047 - DNA, 25 bp, Mus musculus
aaggaccacatagatctggctacca

SEQ ID NO: 858048 - DNA, 25 bp, Mus musculus
aaggacccacgattccgacccactg

SEQ ID NO: 858049 - DNA, 25 bp, Mus musculus
aaggacccacgattgcgacccactg

SEQ ID NO: 858050 - DNA, 25 bp, Mus musculus
aaggaccgagagcgttacacatcat

SEQ ID NO: 858051 - DNA, 25 bp, Mus musculus
aaggaccgagagctgagacgtggaa

SEQ ID NO: 858052 - DNA, 25 bp, Mus musculus
aaggaccgagagctgatctgtaaat

SEQ ID NO: 858053 - DNA, 25 bp, Mus musculus
aaggaccgagagggttacacatcat

SEQ ID NO: 858054 - DNA, 25 bp, Mus musculus
aaggaccgagaggtgagacgtggaa

SEQ ID NO: 858055 - DNA, 25 bp, Mus musculus
aaggaccgagaggtgatctgtaaat

SEQ ID NO: 858056 - DNA, 25 bp, Mus musculus
aaggaccgtacacagatcgccatct

SEQ ID NO: 858057 - DNA, 25 bp, Mus musculus
aaggaccgtacagagatcgccatct

SEQ ID NO: 858058 - DNA, 25 bp, Mus musculus
aaggaccttcagcaaatggctggtg

SEQ ID NO: 858059 - DNA, 25 bp, Mus musculus
aaggaccttcaggaaatggctggtg

SEQ ID NO: 858060 - DNA, 25 bp, Mus musculus
aaggaccttctcagcgacagtgcgg

SEQ ID NO: 858061 - DNA, 25 bp, Mus musculus
aaggaccttctcagctgcgggcttc

SEQ ID NO: 858062 - DNA, 25 bp, Mus musculus
aaggaccttctcagggacagtgcgg

SEQ ID NO: 858063 - DNA, 25 bp, Mus musculus
aaggaccttctcaggtgcgggcttc

SEQ ID NO: 858064 - DNA, 25 bp, Mus musculus
aaggacgacccacgtattctcatac

SEQ ID NO: 858065 - DNA, 25 bp, Mus musculus
aaggacgacccaggtattctcatac

SEQ ID NO: 858066 - DNA, 25 bp, Mus musculus
aaggacgagatgaccacaaaggtag

SEQ ID NO: 858067 - DNA, 25 bp, Mus musculus
aaggacgagatgtccacaaaggtag

SEQ ID NO: 858068 - DNA, 25 bp, Mus musculus
aaggacgatttgcggctcatcacaa

SEQ ID NO: 858069 - DNA, 25 bp, Mus musculus
aaggacgatttgcgtgtcctgctcc

SEQ ID NO: 858070 - DNA, 25 bp, Mus musculus
aaggacgatttggggctcatcacaa

SEQ ID NO: 858071 - DNA, 25 bp, Mus musculus
aaggacgatttgggtgtcctgctcc

SEQ ID NO: 858072 - DNA, 25 bp, Mus musculus
aaggacgcagccatgtttgctccca

SEQ ID NO: 858073 - DNA, 25 bp, Mus musculus
aaggacgcaggcatgtttgctccca

SEQ ID NO: 858074 - DNA, 25 bp, Mus musculus
aaggacgcatagaggaagtagtgga

SEQ ID NO: 858075 - DNA, 25 bp, Mus musculus
aaggacgcatagtggaagtagtgga

SEQ ID NO: 858076 - DNA, 25 bp, Mus musculus
aaggactacatcagtccaaacattt

SEQ ID NO: 858077 - DNA, 25 bp, Mus musculus
aaggactacatctgtccaaacattt

SEQ ID NO: 858078 - DNA, 25 bp, Mus musculus
aaggactatgcggtgcaggtggcag

SEQ ID NO: 858079 - DNA, 25 bp, Mus musculus
aaggactatggggtgcaggtggcag

SEQ ID NO: 858080 - DNA, 25 bp, Mus musculus
aaggactctgatcgtgatggccgag

SEQ ID NO: 858081 - DNA, 25 bp, Mus musculus
aaggactctgatggtgatggccgag

SEQ ID NO: 858082 - DNA, 25 bp, Mus musculus
aaggactgcacactaacctgtaact

SEQ ID NO: 858083 - DNA, 25 bp, Mus musculus
aaggactgcacagtaacctgtaact

SEQ ID NO: 858084 - DNA, 25 bp, Mus musculus
aaggactgcgcctctaaggtgggag

SEQ ID NO: 858085 - DNA, 25 bp, Mus musculus
aaggactgcggctctaaggtgggag

SEQ ID NO: 858086 - DNA, 25 bp, Mus musculus
aaggactggccagacgctcagattc

SEQ ID NO: 858087 - DNA, 25 bp, Mus musculus
aaggactggccagaggctcagattc

SEQ ID NO: 858088 - DNA, 25 bp, Mus musculus
aaggactgtgctcaatgtgcggaat

SEQ ID NO: 858089 - DNA, 25 bp, Mus musculus
aaggactgtggtcaatgtgcggaat

SEQ ID NO: 858090 - DNA, 25 bp, Mus musculus
aaggactgtgtgcagatgaacgggt

SEQ ID NO: 858091 - DNA, 25 bp, Mus musculus
aaggactgtgtggagatgaacgggt

SEQ ID NO: 858092 - DNA, 25 bp, Mus musculus
aaggacttacagcaagacaaggagg

SEQ ID NO: 858093 - DNA, 25 bp, Mus musculus
aaggacttacaggaagacaaggagg

SEQ ID NO: 858094 - DNA, 25 bp, Mus musculus
aaggacttcactcgaccttcaggca

SEQ ID NO: 858095 - DNA, 25 bp, Mus musculus
aaggacttcactggaccttcaggca

SEQ ID NO: 858096 - DNA, 25 bp, Mus musculus
aaggacttgcataccttgatccttg

SEQ ID NO: 858097 - DNA, 25 bp, Mus musculus
aaggacttgcattccttgatccttg

SEQ ID NO: 858098 - DNA, 25 bp, Mus musculus
aaggagaaagagcattgaagaacaa

SEQ ID NO: 858099 - DNA, 25 bp, Mus musculus
aaggagaaagaggattgaagaacaa

SEQ ID NO: 858100 - DNA, 25 bp, Mus musculus
aaggagaacgaggacatatggtctg

SEQ ID NO: 858101 - DNA, 25 bp, Mus musculus
aaggagaacgaggacttatggtctg

SEQ ID NO: 858102 - DNA, 25 bp, Mus musculus
aaggagaacgatgacatttggtcag

SEQ ID NO: 858103 - DNA, 25 bp, Mus musculus
aaggagaacgtggacatatggtctg

SEQ ID NO: 858104 - DNA, 25 bp, Mus musculus
aaggagaacgtggacttatggtctg

SEQ ID NO: 858105 - DNA, 25 bp, Mus musculus
aaggagaacgttgacatttggtcag

SEQ ID NO: 858106 - DNA, 25 bp, Mus musculus
aaggagaagaagcaatgtctgaccg

SEQ ID NO: 858107 - DNA, 25 bp, Mus musculus
aaggagaagaaggaatgtctgaccg

SEQ ID NO: 858108 - DNA, 25 bp, Mus musculus
aaggagaaggagctggtgaataagg

SEQ ID NO: 858109 - DNA, 25 bp, Mus musculus
aaggagaaggaggtggtgaataagg

SEQ ID NO: 858110 - DNA, 25 bp, Mus musculus
aaggagacagaggccattctcaagg

SEQ ID NO: 858111 - DNA, 25 bp, Mus musculus
aaggagacagtggccattctcaagg

SEQ ID NO: 858112 - DNA, 25 bp, Mus musculus
aaggagactattgaaattaatccca

SEQ ID NO: 858113 - DNA, 25 bp, Mus musculus
aaggagactattgatattaatccca

SEQ ID NO: 858114 - DNA, 25 bp, Mus musculus
aaggagagagtgagtgcatctgatg

SEQ ID NO: 858115 - DNA, 25 bp, Mus musculus
aaggagagagtgtgtgcatctgatg

SEQ ID NO: 858116 - DNA, 25 bp, Mus musculus
aaggagagcctgagtgctgatattt

SEQ ID NO: 858117 - DNA, 25 bp, Mus musculus
aaggagagcctgtgtgctgatattt

SEQ ID NO: 858118 - DNA, 25 bp, Mus musculus
aaggagagcgaggctggactggtat

SEQ ID NO: 858119 - DNA, 25 bp, Mus musculus
aaggagagcgtggctggactggtat

SEQ ID NO: 858120 - DNA, 25 bp, Mus musculus
aaggagaggaagacggactccaaga

SEQ ID NO: 858121 - DNA, 25 bp, Mus musculus
aaggagaggaagtcggactccaaga

SEQ ID NO: 858122 - DNA, 25 bp, Mus musculus
aaggagatccgagacactacaggag

SEQ ID NO: 858123 - DNA, 25 bp, Mus musculus
aaggagatccgagagactacaggag

SEQ ID NO: 858124 - DNA, 25 bp, Mus musculus
aaggagatgaagaacatattgcctc

SEQ ID NO: 858125 - DNA, 25 bp, Mus musculus
aaggagatgaagaagatattgcctc

SEQ ID NO: 858126 - DNA, 25 bp, Mus musculus
aaggagatgcagctcttcttggtcc

SEQ ID NO: 858127 - DNA, 25 bp, Mus musculus
aaggagatgcaggtcttcttggtcc

SEQ ID NO: 858128 - DNA, 25 bp, Mus musculus
aaggagattgcccacgatgccctga

SEQ ID NO: 858129 - DNA, 25 bp, Mus musculus
aaggagattgcccaggatgccctga

SEQ ID NO: 858130 - DNA, 25 bp, Mus musculus
aaggagcaaagaccagagctgtcgg

SEQ ID NO: 858131 - DNA, 25 bp, Mus musculus
aaggagcaaagagcagagctgtcgg

SEQ ID NO: 858132 - DNA, 25 bp, Mus musculus
aaggagcagcttcgctatattgtct

SEQ ID NO: 858133 - DNA, 25 bp, Mus musculus
aaggagcagcttggctatattgtct

SEQ ID NO: 858134 - DNA, 25 bp, Mus musculus
aaggagcagtctcatggagccagat

SEQ ID NO: 858135 - DNA, 25 bp, Mus musculus
aaggagcagtctgatggagccagat

SEQ ID NO: 858136 - DNA, 25 bp, Mus musculus
aaggagcattttgacaaagcaattg

SEQ ID NO: 858137 - DNA, 25 bp, Mus musculus
aaggagcattttgacgttttctctg

SEQ ID NO: 858138 - DNA, 25 bp, Mus musculus
aaggagcattttgagaaagcaattg

SEQ ID NO: 858139 - DNA, 25 bp, Mus musculus
aaggagcattttgaggttttctctg

SEQ ID NO: 858140 - DNA, 25 bp, Mus musculus
aaggagccaaagatggcaagcttcc

SEQ ID NO: 858141 - DNA, 25 bp, Mus musculus
aaggagccaaagttggcaagcttcc

SEQ ID NO: 858142 - DNA, 25 bp, Mus musculus
aaggagccagagccagtccttccgc

SEQ ID NO: 858143 - DNA, 25 bp, Mus musculus
aaggagccagtgccagtccttccgc

SEQ ID NO: 858144 - DNA, 25 bp, Mus musculus
aaggagccgagtccagttcctccat

SEQ ID NO: 858145 - DNA, 25 bp, Mus musculus
aaggagccgagtgcagttcctccat

SEQ ID NO: 858146 - DNA, 25 bp, Mus musculus
aaggagcggcaaaacagctttatgg

SEQ ID NO: 858147 - DNA, 25 bp, Mus musculus
aaggagcggcaaaacagtgatagaa

SEQ ID NO: 858148 - DNA, 25 bp, Mus musculus
aaggagcggcaaaagagctttatgg

SEQ ID NO: 858149 - DNA, 25 bp, Mus musculus
aaggagcggcaaaagagtgatagaa

SEQ ID NO: 858150 - DNA, 25 bp, Mus musculus
aaggagctatttaacctggccacca

SEQ ID NO: 858151 - DNA, 25 bp, Mus musculus
aaggagctatttaagctggccacca

SEQ ID NO: 858152 - DNA, 25 bp, Mus musculus
aaggagctgaagccggagcaggaaa

SEQ ID NO: 858153 - DNA, 25 bp, Mus musculus
aaggagctgaaggcggagcaggaaa

SEQ ID NO: 858154 - DNA, 25 bp, Mus musculus
aaggagctgctgaacaggcaagtgg

SEQ ID NO: 858155 - DNA, 25 bp, Mus musculus
aaggagctgctgaagaggcaagtgg

SEQ ID NO: 858156 - DNA, 25 bp, Mus musculus
aaggagctgtataacgtacatttga

SEQ ID NO: 858157 - DNA, 25 bp, Mus musculus
aaggagctgtataaggtacatttga

SEQ ID NO: 858158 - DNA, 25 bp, Mus musculus
aaggagctgttcagagtaggtggcg

SEQ ID NO: 858159 - DNA, 25 bp, Mus musculus
aaggagctgttcagtgtaggtggcg

SEQ ID NO: 858160 - DNA, 25 bp, Mus musculus
aaggaggaagagtgagctgggtgcc

SEQ ID NO: 858161 - DNA, 25 bp, Mus musculus
aaggaggaagtgtgagctgggtgcc

SEQ ID NO: 858162 - DNA, 25 bp, Mus musculus
aaggaggacgctgtgccgatgctct

SEQ ID NO: 858163 - DNA, 25 bp, Mus musculus
aaggaggacggtgtgccgatgctct

SEQ ID NO: 858164 - DNA, 25 bp, Mus musculus
aaggaggagaaacccttgtagccgc

SEQ ID NO: 858165 - DNA, 25 bp, Mus musculus
aaggaggagaaagccttgtagccgc

SEQ ID NO: 858166 - DNA, 25 bp, Mus musculus
aaggaggaggcccaagaagcactta

SEQ ID NO: 858167 - DNA, 25 bp, Mus musculus
aaggaggaggccgaagaagcactta

SEQ ID NO: 858168 - DNA, 25 bp, Mus musculus
aaggaggcagctgcgattggagcat

SEQ ID NO: 858169 - DNA, 25 bp, Mus musculus
aaggaggcaggtgcgattggagcat

SEQ ID NO: 858170 - DNA, 25 bp, Mus musculus
aaggaggccgaacatcccttcaatc

SEQ ID NO: 858171 - DNA, 25 bp, Mus musculus
aaggaggccgagcacaaggagggag

SEQ ID NO: 858172 - DNA, 25 bp, Mus musculus
aaggaggccgagcagaaggagggag

SEQ ID NO: 858173 - DNA, 25 bp, Mus musculus
aaggaggccggtcacgtgtccttgc

SEQ ID NO: 858174 - DNA, 25 bp, Mus musculus
aaggaggccggtcaggtgtccttgc

SEQ ID NO: 858175 - DNA, 25 bp, Mus musculus
aaggaggccgtacatcccttcaatc

SEQ ID NO: 858176 - DNA, 25 bp, Mus musculus
aaggagggaagaaaattatgccacc

SEQ ID NO: 858177 - DNA, 25 bp, Mus musculus
aaggagggaagataattatgccacc

SEQ ID NO: 858178 - DNA, 25 bp, Mus musculus
aaggagggcatgcaggtggaagatt

SEQ ID NO: 858179 - DNA, 25 bp, Mus musculus
aaggagggcatgctggaagatttaa

SEQ ID NO: 858180 - DNA, 25 bp, Mus musculus
aaggagggcatggaggtggaagatt

SEQ ID NO: 858181 - DNA, 25 bp, Mus musculus
aaggagggcatggtggaagatttaa

SEQ ID NO: 858182 - DNA, 25 bp, Mus musculus
aaggagggtgatctcacagctccca

SEQ ID NO: 858183 - DNA, 25 bp, Mus musculus
aaggagggtgatgtcacagctccca

SEQ ID NO: 858184 - DNA, 25 bp, Mus musculus
aaggaggtccagctgctcggcactg

SEQ ID NO: 858185 - DNA, 25 bp, Mus musculus
aaggaggtccagctgttcatgactg

SEQ ID NO: 858186 - DNA, 25 bp, Mus musculus
aaggaggtccaggtgctcggcactg

SEQ ID NO: 858187 - DNA, 25 bp, Mus musculus
aaggaggtccaggtgttcatgactg

SEQ ID NO: 858188 - DNA, 25 bp, Mus musculus
aaggaggtgacaccttcctgcaatc

SEQ ID NO: 858189 - DNA, 25 bp, Mus musculus
aaggaggtgacagcttcctgcaatc

SEQ ID NO: 858190 - DNA, 25 bp, Mus musculus
aaggaggtggcaggcttaaggcagc

SEQ ID NO: 858191 - DNA, 25 bp, Mus musculus
aaggaggtggcagggttaaggcagc

SEQ ID NO: 858192 - DNA, 25 bp, Mus musculus
aaggagtatgagcgagccgtctacc

SEQ ID NO: 858193 - DNA, 25 bp, Mus musculus
aaggagtatgagggagccgtctacc

SEQ ID NO: 858194 - DNA, 25 bp, Mus musculus
aaggagtcgttagccagagcacaaa

SEQ ID NO: 858195 - DNA, 25 bp, Mus musculus
aaggagtcgttagcgagagcacaaa

SEQ ID NO: 858196 - DNA, 25 bp, Mus musculus
aaggagtgaggactcaccactactt

SEQ ID NO: 858197 - DNA, 25 bp, Mus musculus
aaggagtgaggagtcaccactactt

SEQ ID NO: 858198 - DNA, 25 bp, Mus musculus
aaggagtgcaaaacaacctgccagt

SEQ ID NO: 858199 - DNA, 25 bp, Mus musculus
aaggagtgcaaatcaacctgccagt

SEQ ID NO: 858200 - DNA, 25 bp, Mus musculus
aaggagtgcaagaccaacgagtgtt

SEQ ID NO: 858201 - DNA, 25 bp, Mus musculus
aaggagtgcatgaccaacgagtgtt

SEQ ID NO: 858202 - DNA, 25 bp, Mus musculus
aaggagttagaaacaggtgagaact

SEQ ID NO: 858203 - DNA, 25 bp, Mus musculus
aaggagttagaatcaggtgagaact

SEQ ID NO: 858204 - DNA, 25 bp, Mus musculus
aaggagttcgtcaaaagactggcaa

SEQ ID NO: 858205 - DNA, 25 bp, Mus musculus
aaggagttcgtcaatagactggcaa

SEQ ID NO: 858206 - DNA, 25 bp, Mus musculus
aaggagttttccaatacagcaaata

SEQ ID NO: 858207 - DNA, 25 bp, Mus musculus
aaggagttttcctatacagcaaata

SEQ ID NO: 858208 - DNA, 25 bp, Mus musculus
aaggataaagcgctgcagacaagcc

SEQ ID NO: 858209 - DNA, 25 bp, Mus musculus
aaggataaagggctgcagacaagcc

SEQ ID NO: 858210 - DNA, 25 bp, Mus musculus
aaggataagacgaacgttcttcagt

SEQ ID NO: 858211 - DNA, 25 bp, Mus musculus
aaggataagacgaaggttcttcagt

SEQ ID NO: 858212 - DNA, 25 bp, Mus musculus
aaggatacgagcaatcatttccatg

SEQ ID NO: 858213 - DNA, 25 bp, Mus musculus
aaggatacgagcagtagtaccgttg

SEQ ID NO: 858214 - DNA, 25 bp, Mus musculus
aaggatacgagctatcatttccatg

SEQ ID NO: 858215 - DNA, 25 bp, Mus musculus
aaggatacgagctgtagtaccgttg

SEQ ID NO: 858216 - DNA, 25 bp, Mus musculus
aaggatatccttaacgatcggggct

SEQ ID NO: 858217 - DNA, 25 bp, Mus musculus
aaggatatccttaaggatcggggct

SEQ ID NO: 858218 - DNA, 25 bp, Mus musculus
aaggatatcgacctgatcatgggtg

SEQ ID NO: 858219 - DNA, 25 bp, Mus musculus
aaggatatcgacgtgatcatgggtg

SEQ ID NO: 858220 - DNA, 25 bp, Mus musculus
aaggatatcgatcgccgccctgtca

SEQ ID NO: 858221 - DNA, 25 bp, Mus musculus
aaggatatcgatggccgccctgtca

SEQ ID NO: 858222 - DNA, 25 bp, Mus musculus
aaggatatgacgatcccaagcggta

SEQ ID NO: 858223 - DNA, 25 bp, Mus musculus
aaggatatgacgatgccaagcggta

SEQ ID NO: 858224 - DNA, 25 bp, Mus musculus
aaggatatgatgcttgagatggata

SEQ ID NO: 858225 - DNA, 25 bp, Mus musculus
aaggatatgatggttgagatggata

SEQ ID NO: 858226 - DNA, 25 bp, Mus musculus
aaggatcaagccagagatgctttat

SEQ ID NO: 858227 - DNA, 25 bp, Mus musculus
aaggatcaagcttctttacctgaga

SEQ ID NO: 858228 - DNA, 25 bp, Mus musculus
aaggatcaaggcagagatgctttat

SEQ ID NO: 858229 - DNA, 25 bp, Mus musculus
aaggatcaaggttctttacctgaga

SEQ ID NO: 858230 - DNA, 25 bp, Mus musculus
aaggatctagatgagaatgaagttg

SEQ ID NO: 858231 - DNA, 25 bp, Mus musculus
aaggatctagtcccagatttgagta

SEQ ID NO: 858232 - DNA, 25 bp, Mus musculus
aaggatctagtccctgatttgagta

SEQ ID NO: 858233 - DNA, 25 bp, Mus musculus
aaggatctagttgagaatgaagttg

SEQ ID NO: 858234 - DNA, 25 bp, Mus musculus
aaggatctgcagaaattagtcttga

SEQ ID NO: 858235 - DNA, 25 bp, Mus musculus
aaggatctgcagtaattagtcttga

SEQ ID NO: 858236 - DNA, 25 bp, Mus musculus
aaggatcttaggaactgtctctctt

SEQ ID NO: 858237 - DNA, 25 bp, Mus musculus
aaggatcttaggaagtgtctctctt

SEQ ID NO: 858238 - DNA, 25 bp, Mus musculus
aaggatgaagatggagatcttataa

SEQ ID NO: 858239 - DNA, 25 bp, Mus musculus
aaggatgaagattcctatcacatat

SEQ ID NO: 858240 - DNA, 25 bp, Mus musculus
aaggatgaagttggagatcttataa

SEQ ID NO: 858241 - DNA, 25 bp, Mus musculus
aaggatgaagtttcctatcacatat

SEQ ID NO: 858242 - DNA, 25 bp, Mus musculus
aaggatgcagagtgtggctgcattt

SEQ ID NO: 858243 - DNA, 25 bp, Mus musculus
aaggatgcagcaccatcagcacgtg

SEQ ID NO: 858244 - DNA, 25 bp, Mus musculus
aaggatgcaggaccatcagcacgtg

SEQ ID NO: 858245 - DNA, 25 bp, Mus musculus
aaggatgcagtgtgtggctgcattt

SEQ ID NO: 858246 - DNA, 25 bp, Mus musculus
aaggatgccatgaatccaagcaaaa

SEQ ID NO: 858247 - DNA, 25 bp, Mus musculus
aaggatgccatgtatccaagcaaaa

SEQ ID NO: 858248 - DNA, 25 bp, Mus musculus
aaggatgctatcccaatgtgtgcga

SEQ ID NO: 858249 - DNA, 25 bp, Mus musculus
aaggatgctatcgcaatgtgtgcga

SEQ ID NO: 858250 - DNA, 25 bp, Mus musculus
aaggatgctgcgaagtccgtgggca

SEQ ID NO: 858251 - DNA, 25 bp, Mus musculus
aaggatgctgggaagtccgtgggca

SEQ ID NO: 858252 - DNA, 25 bp, Mus musculus
aaggatgctgtgcatccttagcaaa

SEQ ID NO: 858253 - DNA, 25 bp, Mus musculus
aaggatgctgtggatccttagcaaa

SEQ ID NO: 858254 - DNA, 25 bp, Mus musculus
aaggatggagatcccccaggtccaa

SEQ ID NO: 858255 - DNA, 25 bp, Mus musculus
aaggatggagccaaacatttctcgg

SEQ ID NO: 858256 - DNA, 25 bp, Mus musculus
aaggatggagccaaagaatgaataa

SEQ ID NO: 858257 - DNA, 25 bp, Mus musculus
aaggatggagccaatcatttctcgg

SEQ ID NO: 858258 - DNA, 25 bp, Mus musculus
aaggatggagccaatgaatgaataa

SEQ ID NO: 858259 - DNA, 25 bp, Mus musculus
aaggatggagttcccccaggtccaa

SEQ ID NO: 858260 - DNA, 25 bp, Mus musculus
aaggatggcaatcgagagtgtggta

SEQ ID NO: 858261 - DNA, 25 bp, Mus musculus
aaggatggcaatggagagtgtggta

SEQ ID NO: 858262 - DNA, 25 bp, Mus musculus
aaggatgtcaaacggacccaagaga

SEQ ID NO: 858263 - DNA, 25 bp, Mus musculus
aaggatgtcaaagggacccaagaga

SEQ ID NO: 858264 - DNA, 25 bp, Mus musculus
aaggatgtggaacgtcaagatgtag

SEQ ID NO: 858265 - DNA, 25 bp, Mus musculus
aaggatgtggaaggtcaagatgtag

SEQ ID NO: 858266 - DNA, 25 bp, Mus musculus
aaggattcagcctaaaaccgactct

SEQ ID NO: 858267 - DNA, 25 bp, Mus musculus
aaggattcaggctaaaaccgactct

SEQ ID NO: 858268 - DNA, 25 bp, Mus musculus
aaggcaaaagcacgtacctgtttgc

SEQ ID NO: 858269 - DNA, 25 bp, Mus musculus
aaggcaaaagcaggtacctgtttgc

SEQ ID NO: 858270 - DNA, 25 bp, Mus musculus
aaggcaaagaagcaagcatgattga

SEQ ID NO: 858271 - DNA, 25 bp, Mus musculus
aaggcaaagaaggaagcatgattga

SEQ ID NO: 858272 - DNA, 25 bp, Mus musculus
aaggcaaatgctatgctggatgaag

SEQ ID NO: 858273 - DNA, 25 bp, Mus musculus
aaggcaaatggtatgctggatgaag

SEQ ID NO: 858274 - DNA, 25 bp, Mus musculus
aaggcaacagaatgaagggacctga

SEQ ID NO: 858275 - DNA, 25 bp, Mus musculus
aaggcaacagtatgaagggacctga

SEQ ID NO: 858276 - DNA, 25 bp, Mus musculus
aaggcaacatcgcatggcacttcca

SEQ ID NO: 858277 - DNA, 25 bp, Mus musculus
aaggcaacatcgctgtgggcaaatc

SEQ ID NO: 858278 - DNA, 25 bp, Mus musculus
aaggcaacatcggatggcacttcca

SEQ ID NO: 858279 - DNA, 25 bp, Mus musculus
aaggcaacatcggtgtgggcaaatc

SEQ ID NO: 858280 - DNA, 25 bp, Mus musculus
aaggcaagacagattacaaaagaag

SEQ ID NO: 858281 - DNA, 25 bp, Mus musculus
aaggcaagacagtttacaaaagaag

SEQ ID NO: 858282 - DNA, 25 bp, Mus musculus
aaggcaagatcaaaccctcagcgtt

SEQ ID NO: 858283 - DNA, 25 bp, Mus musculus
aaggcaagatcaaagcctcagcgtt

SEQ ID NO: 858284 - DNA, 25 bp, Mus musculus
aaggcaagatctctcccaatccata

SEQ ID NO: 858285 - DNA, 25 bp, Mus musculus
aaggcaagatctctgccaatccata

SEQ ID NO: 858286 - DNA, 25 bp, Mus musculus
aaggcaaggataccatccatgtctt

SEQ ID NO: 858287 - DNA, 25 bp, Mus musculus
aaggcaaggatacggagcgcctcat

SEQ ID NO: 858288 - DNA, 25 bp, Mus musculus
aaggcaaggatagcatccatgtctt

SEQ ID NO: 858289 - DNA, 25 bp, Mus musculus
aaggcaaggatagggagcgcctcat

SEQ ID NO: 858290 - DNA, 25 bp, Mus musculus
aaggcaagggaagtgacagtgacag

SEQ ID NO: 858291 - DNA, 25 bp, Mus musculus
aaggcaagggtagtgacagtgacag

SEQ ID NO: 858292 - DNA, 25 bp, Mus musculus
aaggcaatgaccacctggaccagct

SEQ ID NO: 858293 - DNA, 25 bp, Mus musculus
aaggcaatgacctcctggaccagct

SEQ ID NO: 858294 - DNA, 25 bp, Mus musculus
aaggcaattgtgagcatgagcccat

SEQ ID NO: 858295 - DNA, 25 bp, Mus musculus
aaggcaattgtgaggatgagcccat

SEQ ID NO: 858296 - DNA, 25 bp, Mus musculus
aaggcacagacgcatcaacagtaaa

SEQ ID NO: 858297 - DNA, 25 bp, Mus musculus
aaggcacagacggatcaacagtaaa

SEQ ID NO: 858298 - DNA, 25 bp, Mus musculus
aaggcaccagcgatgaggattttag

SEQ ID NO: 858299 - DNA, 25 bp, Mus musculus
aaggcaccagcgttgaggattttag

SEQ ID NO: 858300 - DNA, 25 bp, Mus musculus
aaggcacctctgctaccaacgcaga

SEQ ID NO: 858301 - DNA, 25 bp, Mus musculus
aaggcacctctggtaccaacgcaga

SEQ ID NO: 858302 - DNA, 25 bp, Mus musculus
aaggcactcaagcactataagtcaa

SEQ ID NO: 858303 - DNA, 25 bp, Mus musculus
aaggcactcaaggactataagtcaa

SEQ ID NO: 858304 - DNA, 25 bp, Mus musculus
aaggcagaaaagcctacagaagaag

SEQ ID NO: 858305 - DNA, 25 bp, Mus musculus
aaggcagaaaaggctacagaagaag

SEQ ID NO: 858306 - DNA, 25 bp, Mus musculus
aaggcagaagattgaggtaggcctg

SEQ ID NO: 858307 - DNA, 25 bp, Mus musculus
aaggcagaagtttgaggtaggcctg

SEQ ID NO: 858308 - DNA, 25 bp, Mus musculus
aaggcagagaactgtgccaagtggt

SEQ ID NO: 858309 - DNA, 25 bp, Mus musculus
aaggcagagatctgtgccaagtggt

SEQ ID NO: 858310 - DNA, 25 bp, Mus musculus
aaggcagaggcacacattcggtcat

SEQ ID NO: 858311 - DNA, 25 bp, Mus musculus
aaggcagaggcacagattcggtcat

SEQ ID NO: 858312 - DNA, 25 bp, Mus musculus
aaggcagaggcacgcgtgcccacac

SEQ ID NO: 858313 - DNA, 25 bp, Mus musculus
aaggcagaggcaggcgtgcccacac

SEQ ID NO: 858314 - DNA, 25 bp, Mus musculus
aaggcagcagagaacaaagcccgct

SEQ ID NO: 858315 - DNA, 25 bp, Mus musculus
aaggcagcagagaacggcggtgctg

SEQ ID NO: 858316 - DNA, 25 bp, Mus musculus
aaggcagcagagaagaaagcccgct

SEQ ID NO: 858317 - DNA, 25 bp, Mus musculus
aaggcagcagagaagggcggtgctg

SEQ ID NO: 858318 - DNA, 25 bp, Mus musculus
aaggcagcagctataagtagccctg

SEQ ID NO: 858319 - DNA, 25 bp, Mus musculus
aaggcagcaggtataagtagccctg

SEQ ID NO: 858320 - DNA, 25 bp, Mus musculus
aaggcagccgaccctgaagctgagg

SEQ ID NO: 858321 - DNA, 25 bp, Mus musculus
aaggcagccgacgctgaagctgagg

SEQ ID NO: 858322 - DNA, 25 bp, Mus musculus
aaggcagcgagcgactggtgatcat

SEQ ID NO: 858323 - DNA, 25 bp, Mus musculus
aaggcagcgagcgagtggtgatcat

SEQ ID NO: 858324 - DNA, 25 bp, Mus musculus
aaggcaggcaccagactctggggtg

SEQ ID NO: 858325 - DNA, 25 bp, Mus musculus
aaggcaggcaccagtctctggggtg

SEQ ID NO: 858326 - DNA, 25 bp, Mus musculus
aaggcagggtgcccagatgatggta

SEQ ID NO: 858327 - DNA, 25 bp, Mus musculus
aaggcagggtgcgcagatgatggta

SEQ ID NO: 858328 - DNA, 25 bp, Mus musculus
aaggcagggtgtgacgtaaccatcc

SEQ ID NO: 858329 - DNA, 25 bp, Mus musculus
aaggcagggtgtgaggtaaccatcc

SEQ ID NO: 858330 - DNA, 25 bp, Mus musculus
aaggcagtagccaaagagccgagtc

SEQ ID NO: 858331 - DNA, 25 bp, Mus musculus
aaggcagtaggcaaagagccgagtc

SEQ ID NO: 858332 - DNA, 25 bp, Mus musculus
aaggcagtgagccacatgccttctg

SEQ ID NO: 858333 - DNA, 25 bp, Mus musculus
aaggcagtgagccagatgccttctg

SEQ ID NO: 858334 - DNA, 25 bp, Mus musculus
aaggcagttgaattgtttgaggaga

SEQ ID NO: 858335 - DNA, 25 bp, Mus musculus
aaggcagttgtattgtttgaggaga

SEQ ID NO: 858336 - DNA, 25 bp, Mus musculus
aaggcatcaacacaataaccagagc

SEQ ID NO: 858337 - DNA, 25 bp, Mus musculus
aaggcatcaacagaataaccagagc

SEQ ID NO: 858338 - DNA, 25 bp, Mus musculus
aaggcatgggctacatggcctcttc

SEQ ID NO: 858339 - DNA, 25 bp, Mus musculus
aaggcatgggctacttggcctcttc

SEQ ID NO: 858340 - DNA, 25 bp, Mus musculus
aaggccaagacatacctcattctgg

SEQ ID NO: 858341 - DNA, 25 bp, Mus musculus
aaggccaagacatactcttgccatg

SEQ ID NO: 858342 - DNA, 25 bp, Mus musculus
aaggccaagacatagctcattctgg

SEQ ID NO: 858343 - DNA, 25 bp, Mus musculus
aaggccaagacatagtcttgccatg

SEQ ID NO: 858344 - DNA, 25 bp, Mus musculus
aaggccaagacccgcgatgagtatc

SEQ ID NO: 858345 - DNA, 25 bp, Mus musculus
aaggccaagacccgggatgagtatc

SEQ ID NO: 858346 - DNA, 25 bp, Mus musculus
aaggccaagctgcccctgcttgtca

SEQ ID NO: 858347 - DNA, 25 bp, Mus musculus
aaggccaagctggccctgcttgtca

SEQ ID NO: 858348 - DNA, 25 bp, Mus musculus
aaggccacaaatctgacgttccaga

SEQ ID NO: 858349 - DNA, 25 bp, Mus musculus
aaggccacaaatgtgacgttccaga

SEQ ID NO: 858350 - DNA, 25 bp, Mus musculus
aaggccacagatcctgaagctgacg

SEQ ID NO: 858351 - DNA, 25 bp, Mus musculus
aaggccacagatgctgaagctgacg

SEQ ID NO: 858352 - DNA, 25 bp, Mus musculus
aaggccaccgccgccgcatggatgg

SEQ ID NO: 858353 - DNA, 25 bp, Mus musculus
aaggccaccgccgcggcatggatgg

SEQ ID NO: 858354 - DNA, 25 bp, Mus musculus
aaggccagacagaccggtccacctc

SEQ ID NO: 858355 - DNA, 25 bp, Mus musculus
aaggccagacagacgggtccacctc

SEQ ID NO: 858356 - DNA, 25 bp, Mus musculus
aaggccagagcacatgaagtgagag

SEQ ID NO: 858357 - DNA, 25 bp, Mus musculus
aaggccagagcacgctccttaggct

SEQ ID NO: 858358 - DNA, 25 bp, Mus musculus
aaggccagagcagatgaagtgagag

SEQ ID NO: 858359 - DNA, 25 bp, Mus musculus
aaggccagagcaggctccttaggct

SEQ ID NO: 858360 - DNA, 25 bp, Mus musculus
aaggccagcaatgacgatgtgacta

SEQ ID NO: 858361 - DNA, 25 bp, Mus musculus
aaggccagcaatgaggatgtgacta

SEQ ID NO: 858362 - DNA, 25 bp, Mus musculus
aaggccagggctgacgcttgttccc

SEQ ID NO: 858363 - DNA, 25 bp, Mus musculus
aaggccagggctgaggcttgttccc

SEQ ID NO: 858364 - DNA, 25 bp, Mus musculus
aaggccagtgagcctgtcatctggg

SEQ ID NO: 858365 - DNA, 25 bp, Mus musculus
aaggccagtgaggctgtcatctggg

SEQ ID NO: 858366 - DNA, 25 bp, Mus musculus
aaggccagtgcatgcgcctatgtac

SEQ ID NO: 858367 - DNA, 25 bp, Mus musculus
aaggccagtggatgcgcctatgtac

SEQ ID NO: 858368 - DNA, 25 bp, Mus musculus
aaggccattgagctgctgtctgatg

SEQ ID NO: 858369 - DNA, 25 bp, Mus musculus
aaggccattgaggtgctgtctgatg

SEQ ID NO: 858370 - DNA, 25 bp, Mus musculus
aaggccattgcgcacaatcatgaag

SEQ ID NO: 858371 - DNA, 25 bp, Mus musculus
aaggccattgggcacaatcatgaag

SEQ ID NO: 858372 - DNA, 25 bp, Mus musculus
aaggccccatgaacgtgttggtgtt

SEQ ID NO: 858373 - DNA, 25 bp, Mus musculus
aaggccccatgatcgtgttggtgtt

SEQ ID NO: 858374 - DNA, 25 bp, Mus musculus
aaggccctttgcatggatctcttga

SEQ ID NO: 858375 - DNA, 25 bp, Mus musculus
aaggccctttgcttggatctcttga

SEQ ID NO: 858376 - DNA, 25 bp, Mus musculus
aaggccgcgggaaacagtccagcct

SEQ ID NO: 858377 - DNA, 25 bp, Mus musculus
aaggccgcgggaaacgataaagcat

SEQ ID NO: 858378 - DNA, 25 bp, Mus musculus
aaggccgcgggaaagagtccagcct

SEQ ID NO: 858379 - DNA, 25 bp, Mus musculus
aaggccgcgggaaaggataaagcat

SEQ ID NO: 858380 - DNA, 25 bp, Mus musculus
aaggccgggaagagactcgtgttcg

SEQ ID NO: 858381 - DNA, 25 bp, Mus musculus
aaggccgggaagtgactcgtgttcg

SEQ ID NO: 858382 - DNA, 25 bp, Mus musculus
aaggccgtgccacggatgatgacat

SEQ ID NO: 858383 - DNA, 25 bp, Mus musculus
aaggccgtgccagggatgatgacat

SEQ ID NO: 858384 - DNA, 25 bp, Mus musculus
aaggcctatgaaggaggttccgagt

SEQ ID NO: 858385 - DNA, 25 bp, Mus musculus
aaggcctatgaaggtggttccgagt

SEQ ID NO: 858386 - DNA, 25 bp, Mus musculus
aaggcctcagcaagaagatggtcct

SEQ ID NO: 858387 - DNA, 25 bp, Mus musculus
aaggcctcaggaagaagatggtcct

SEQ ID NO: 858388 - DNA, 25 bp, Mus musculus
aaggcctgacactgactctcatggt

SEQ ID NO: 858389 - DNA, 25 bp, Mus musculus
aaggcctgacactgtctctcatggt

SEQ ID NO: 858390 - DNA, 25 bp, Mus musculus
aaggcctgctctcgagtgggcagta

SEQ ID NO: 858391 - DNA, 25 bp, Mus musculus
aaggcctgctctcgtgtgggcagta

SEQ ID NO: 858392 - DNA, 25 bp, Mus musculus
aaggcctggacgaaaaccacgagct

SEQ ID NO: 858393 - DNA, 25 bp, Mus musculus
aaggcctggacgacgctgagcaggg

SEQ ID NO: 858394 - DNA, 25 bp, Mus musculus
aaggcctggacgtaaaccacgagct

SEQ ID NO: 858395 - DNA, 25 bp, Mus musculus
aaggcctggacgtcgctgagcaggg

SEQ ID NO: 858396 - DNA, 25 bp, Mus musculus
aaggccttgaaaccttttagcctag

SEQ ID NO: 858397 - DNA, 25 bp, Mus musculus
aaggccttgaaagcttttagcctag

SEQ ID NO: 858398 - DNA, 25 bp, Mus musculus
aaggcgagaaatcagagaaacgcac

SEQ ID NO: 858399 - DNA, 25 bp, Mus musculus
aaggcgagaaatcgaaacagctgct

SEQ ID NO: 858400 - DNA, 25 bp, Mus musculus
aaggcgagaaatgagagaaacgcac

SEQ ID NO: 858401 - DNA, 25 bp, Mus musculus
aaggcgagaaatggaaacagctgct

SEQ ID NO: 858402 - DNA, 25 bp, Mus musculus
aaggcgagggattttaggtgatggg

SEQ ID NO: 858403 - DNA, 25 bp, Mus musculus
aaggcgagggtttttaggtgatggg

SEQ ID NO: 858404 - DNA, 25 bp, Mus musculus
aaggcgcagaagcatcgccacgact

SEQ ID NO: 858405 - DNA, 25 bp, Mus musculus
aaggcgcagaaggatcgccacgact

SEQ ID NO: 858406 - DNA, 25 bp, Mus musculus
aaggcgcctcctcacggccgcaagc

SEQ ID NO: 858407 - DNA, 25 bp, Mus musculus
aaggcgcctcctcagggccgcaagc

SEQ ID NO: 858408 - DNA, 25 bp, Mus musculus
aaggcggcagactttctgcactggc

SEQ ID NO: 858409 - DNA, 25 bp, Mus musculus
aaggcggcagtctttctgcactggc

SEQ ID NO: 858410 - DNA, 25 bp, Mus musculus
aaggcggccgaccacatgtgaggtg

SEQ ID NO: 858411 - DNA, 25 bp, Mus musculus
aaggcggccgaccagatgtgaggtg

SEQ ID NO: 858412 - DNA, 25 bp, Mus musculus
aaggcggcgcgggacgtgctggaga

SEQ ID NO: 858413 - DNA, 25 bp, Mus musculus
aaggcggcgcgggaggtgctggaga

SEQ ID NO: 858414 - DNA, 25 bp, Mus musculus
aaggcgggacccgacatccacgtgt

SEQ ID NO: 858415 - DNA, 25 bp, Mus musculus
aaggcgggacccgacatcccactga

SEQ ID NO: 858416 - DNA, 25 bp, Mus musculus
aaggcgggacccgaccagatcccac

SEQ ID NO: 858417 - DNA, 25 bp, Mus musculus
aaggcgggacccgacctgtgtctct

SEQ ID NO: 858418 - DNA, 25 bp, Mus musculus
aaggcgggacccgagatccacgtgt

SEQ ID NO: 858419 - DNA, 25 bp, Mus musculus
aaggcgggacccgagatcccactga

SEQ ID NO: 858420 - DNA, 25 bp, Mus musculus
aaggcgggacccgagcagatcccac

SEQ ID NO: 858421 - DNA, 25 bp, Mus musculus
aaggcgggacccgagctgtgtctct

SEQ ID NO: 858422 - DNA, 25 bp, Mus musculus
aaggctacggagcctatggggcatg

SEQ ID NO: 858423 - DNA, 25 bp, Mus musculus
aaggctacggaggctatggggcatg

SEQ ID NO: 858424 - DNA, 25 bp, Mus musculus
aaggctagactgcctgcgaagctgg

SEQ ID NO: 858425 - DNA, 25 bp, Mus musculus
aaggctagactggctgcgaagctgg

SEQ ID NO: 858426 - DNA, 25 bp, Mus musculus
aaggctagagccctgacaggtttga

SEQ ID NO: 858427 - DNA, 25 bp, Mus musculus
aaggctagaggcctgacaggtttga

SEQ ID NO: 858428 - DNA, 25 bp, Mus musculus
aaggctatgaaccactgggtgtctg

SEQ ID NO: 858429 - DNA, 25 bp, Mus musculus
aaggctatgaaccagtgggtgtctg

SEQ ID NO: 858430 - DNA, 25 bp, Mus musculus
aaggctcaagcgctttgctgagcgc

SEQ ID NO: 858431 - DNA, 25 bp, Mus musculus
aaggctcaagggctttgctgagcgc

SEQ ID NO: 858432 - DNA, 25 bp, Mus musculus
aaggctcaggcccgctccaggttta

SEQ ID NO: 858433 - DNA, 25 bp, Mus musculus
aaggctcaggccggctccaggttta

SEQ ID NO: 858434 - DNA, 25 bp, Mus musculus
aaggctcatcagctgaaaaatcaca

SEQ ID NO: 858435 - DNA, 25 bp, Mus musculus
aaggctcatcaggtgaaaaatcaca

SEQ ID NO: 858436 - DNA, 25 bp, Mus musculus
aaggctccaaagcttctgaagacag

SEQ ID NO: 858437 - DNA, 25 bp, Mus musculus
aaggctccaaaggttctgaagacag

SEQ ID NO: 858438 - DNA, 25 bp, Mus musculus
aaggctccggaaccacgataagaaa

SEQ ID NO: 858439 - DNA, 25 bp, Mus musculus
aaggctccggaagcacgataagaaa

SEQ ID NO: 858440 - DNA, 25 bp, Mus musculus
aaggctcgcaacagcctagcagaga

SEQ ID NO: 858441 - DNA, 25 bp, Mus musculus
aaggctcgcaacaggctagcagaga

SEQ ID NO: 858442 - DNA, 25 bp, Mus musculus
aaggctctgcagctggtcctggcac

SEQ ID NO: 858443 - DNA, 25 bp, Mus musculus
aaggctctgcaggtggtcctggcac

SEQ ID NO: 858444 - DNA, 25 bp, Mus musculus
aaggctctggagatggcaggttcag

SEQ ID NO: 858445 - DNA, 25 bp, Mus musculus
aaggctctggagttggcaggttcag

SEQ ID NO: 858446 - DNA, 25 bp, Mus musculus
aaggctgaagcaaacagagaagatc

SEQ ID NO: 858447 - DNA, 25 bp, Mus musculus
aaggctgaaggaaacagagaagatc

SEQ ID NO: 858448 - DNA, 25 bp, Mus musculus
aaggctgagaacggctcgtcctctg

SEQ ID NO: 858449 - DNA, 25 bp, Mus musculus
aaggctgagaacgggtcgtcctctg

SEQ ID NO: 858450 - DNA, 25 bp, Mus musculus
aaggctgagttctgcctggatctgc

SEQ ID NO: 858451 - DNA, 25 bp, Mus musculus
aaggctgagttctggctggatctgc

SEQ ID NO: 858452 - DNA, 25 bp, Mus musculus
aaggctgcaccatacgtttcatagc

SEQ ID NO: 858453 - DNA, 25 bp, Mus musculus
aaggctgcaccataggtttcatagc

SEQ ID NO: 858454 - DNA, 25 bp, Mus musculus
aaggctgctccagcacagctaccaa

SEQ ID NO: 858455 - DNA, 25 bp, Mus musculus
aaggctgctccagcactaccaacgt

SEQ ID NO: 858456 - DNA, 25 bp, Mus musculus
aaggctgctccagctcagctaccaa

SEQ ID NO: 858457 - DNA, 25 bp, Mus musculus
aaggctgctccagctctaccaacgt

SEQ ID NO: 858458 - DNA, 25 bp, Mus musculus
aaggctggaatgcacataacaattg

SEQ ID NO: 858459 - DNA, 25 bp, Mus musculus
aaggctggaatgcaccttgaaggtc

SEQ ID NO: 858460 - DNA, 25 bp, Mus musculus
aaggctggaatgcagataacaattg

SEQ ID NO: 858461 - DNA, 25 bp, Mus musculus
aaggctggaatgcagcttgaaggtc

SEQ ID NO: 858462 - DNA, 25 bp, Mus musculus
aaggctggagcacgttctgccactc

SEQ ID NO: 858463 - DNA, 25 bp, Mus musculus
aaggctggagcaggttctgccactc

SEQ ID NO: 858464 - DNA, 25 bp, Mus musculus
aaggctggcgtacatcgactgtgcc

SEQ ID NO: 858465 - DNA, 25 bp, Mus musculus
aaggctggcgtagatcgactgtgcc

SEQ ID NO: 858466 - DNA, 25 bp, Mus musculus
aaggctgtccaacaggtgcgccagg

SEQ ID NO: 858467 - DNA, 25 bp, Mus musculus
aaggctgtccaagaggtgcgccagg

SEQ ID NO: 858468 - DNA, 25 bp, Mus musculus
aaggctgtggcctccataggctatc

SEQ ID NO: 858469 - DNA, 25 bp, Mus musculus
aaggctgtgggctccataggctatc

SEQ ID NO: 858470 - DNA, 25 bp, Mus musculus
aaggctgtttatcgatgaccaggaa

SEQ ID NO: 858471 - DNA, 25 bp, Mus musculus
aaggctgtttatggatgaccaggaa

SEQ ID NO: 858472 - DNA, 25 bp, Mus musculus
aaggcttcagcaggaaccatgggtg

SEQ ID NO: 858473 - DNA, 25 bp, Mus musculus
aaggcttcaggaggaaccatgggtg

SEQ ID NO: 858474 - DNA, 25 bp, Mus musculus
aaggcttcagtgcccctaattgcca

SEQ ID NO: 858475 - DNA, 25 bp, Mus musculus
aaggcttcagtggccctaattgcca

SEQ ID NO: 858476 - DNA, 25 bp, Mus musculus
aaggcttcctacaacatggacgtgg

SEQ ID NO: 858477 - DNA, 25 bp, Mus musculus
aaggcttcctacaagatggacgtgg

SEQ ID NO: 858478 - DNA, 25 bp, Mus musculus
aaggcttctgagcacccagttctgg

SEQ ID NO: 858479 - DNA, 25 bp, Mus musculus
aaggcttctgagcacgttctgaagg

SEQ ID NO: 858480 - DNA, 25 bp, Mus musculus
aaggcttctgagcacgttgccccgt

SEQ ID NO: 858481 - DNA, 25 bp, Mus musculus
aaggcttctgagcacttctggagcc

SEQ ID NO: 858482 - DNA, 25 bp, Mus musculus
aaggcttctgagcagccagttctgg

SEQ ID NO: 858483 - DNA, 25 bp, Mus musculus
aaggcttctgagcaggttctgaagg

SEQ ID NO: 858484 - DNA, 25 bp, Mus musculus
aaggcttctgagcaggttgccccgt

SEQ ID NO: 858485 - DNA, 25 bp, Mus musculus
aaggcttctgagcagttctggagcc

SEQ ID NO: 858486 - DNA, 25 bp, Mus musculus
aaggctttccagccatggccatgca

SEQ ID NO: 858487 - DNA, 25 bp, Mus musculus
aaggctttccagctccagcacctgc

SEQ ID NO: 858488 - DNA, 25 bp, Mus musculus
aaggctttccaggcatggccatgca

SEQ ID NO: 858489 - DNA, 25 bp, Mus musculus
aaggctttccaggtccagcacctgc

SEQ ID NO: 858490 - DNA, 25 bp, Mus musculus
aaggctttctgccactgatttgagc

SEQ ID NO: 858491 - DNA, 25 bp, Mus musculus
aaggctttctgccagtgatttgagc

SEQ ID NO: 858492 - DNA, 25 bp, Mus musculus
aaggctttggcactaacggccaggt

SEQ ID NO: 858493 - DNA, 25 bp, Mus musculus
aaggctttggcagtaacggccaggt

SEQ ID NO: 858494 - DNA, 25 bp, Mus musculus
aaggcttttgcacgttttagaagat

SEQ ID NO: 858495 - DNA, 25 bp, Mus musculus
aaggcttttgcaggttttagaagat

SEQ ID NO: 858496 - DNA, 25 bp, Mus musculus
aaggcttttgcggcaggggctgact

SEQ ID NO: 858497 - DNA, 25 bp, Mus musculus
aaggcttttgcggctgactttgtga

SEQ ID NO: 858498 - DNA, 25 bp, Mus musculus
aaggcttttggggcaggggctgact

SEQ ID NO: 858499 - DNA, 25 bp, Mus musculus
aaggcttttggggctgactttgtga

SEQ ID NO: 858500 - DNA, 25 bp, Mus musculus
aagggaaaagagctcgattctaatc

SEQ ID NO: 858501 - DNA, 25 bp, Mus musculus
aagggaaaagagctggattctaatc

SEQ ID NO: 858502 - DNA, 25 bp, Mus musculus
aagggaaccacacggcccaactgtg

SEQ ID NO: 858503 - DNA, 25 bp, Mus musculus
aagggaaccacagggcccaactgtg

SEQ ID NO: 858504 - DNA, 25 bp, Mus musculus
aagggaactggacggaggagacgct

SEQ ID NO: 858505 - DNA, 25 bp, Mus musculus
aagggaactggagggaggagacgct

SEQ ID NO: 858506 - DNA, 25 bp, Mus musculus
aagggaagagcgcatagatacatca

SEQ ID NO: 858507 - DNA, 25 bp, Mus musculus
aagggaagagggcatagatacatca

SEQ ID NO: 858508 - DNA, 25 bp, Mus musculus
aagggaaggaccacaaagatctggc

SEQ ID NO: 858509 - DNA, 25 bp, Mus musculus
aagggaaggaccactaagatctggc

SEQ ID NO: 858510 - DNA, 25 bp, Mus musculus
aagggacaactgcttcggcccacaa

SEQ ID NO: 858511 - DNA, 25 bp, Mus musculus
aagggacaactggttcggcccacaa

SEQ ID NO: 858512 - DNA, 25 bp, Mus musculus
aagggacaagcctgtcccttccaat

SEQ ID NO: 858513 - DNA, 25 bp, Mus musculus
aagggacaaggctgtcccttccaat

SEQ ID NO: 858514 - DNA, 25 bp, Mus musculus
aagggaccttcattcagaatggcca

SEQ ID NO: 858515 - DNA, 25 bp, Mus musculus
aagggaccttcattgagaatggcca

SEQ ID NO: 858516 - DNA, 25 bp, Mus musculus
aagggagaaaagcgtgactgtgagg

SEQ ID NO: 858517 - DNA, 25 bp, Mus musculus
aagggagaaaagggtgactgtgagg

SEQ ID NO: 858518 - DNA, 25 bp, Mus musculus
aagggagaatacagcgattacagca

SEQ ID NO: 858519 - DNA, 25 bp, Mus musculus
aagggagaatacagcgtctgttcac

SEQ ID NO: 858520 - DNA, 25 bp, Mus musculus
aagggagaatacagggattacagca

SEQ ID NO: 858521 - DNA, 25 bp, Mus musculus
aagggagaatacagggtctgttcac

SEQ ID NO: 858522 - DNA, 25 bp, Mus musculus
aagggagctctgcatgctgaatgct

SEQ ID NO: 858523 - DNA, 25 bp, Mus musculus
aagggagctctggatgctgaatgct

SEQ ID NO: 858524 - DNA, 25 bp, Mus musculus
aagggaggagctcacacatgccctg

SEQ ID NO: 858525 - DNA, 25 bp, Mus musculus
aagggaggagctcagacatgccctg

SEQ ID NO: 858526 - DNA, 25 bp, Mus musculus
aagggaggtgagcaggaagaagtgc

SEQ ID NO: 858527 - DNA, 25 bp, Mus musculus
aagggaggtgaggaggaagaagtgc

SEQ ID NO: 858528 - DNA, 25 bp, Mus musculus
aagggatctgcagacctcagtcaga

SEQ ID NO: 858529 - DNA, 25 bp, Mus musculus
aagggatctgcagagctcagtcaga

SEQ ID NO: 858530 - DNA, 25 bp, Mus musculus
aagggatctgccagtgtgcccctgg

SEQ ID NO: 858531 - DNA, 25 bp, Mus musculus
aagggatctgcctgtgtgcccctgg

SEQ ID NO: 858532 - DNA, 25 bp, Mus musculus
aagggattgactttctacaccacta

SEQ ID NO: 858533 - DNA, 25 bp, Mus musculus
aagggattgactttgtacaccacta

SEQ ID NO: 858534 - DNA, 25 bp, Mus musculus
aagggcaaaaagcgctcatcaaagg

SEQ ID NO: 858535 - DNA, 25 bp, Mus musculus
aagggcaaaaagggctcatcaaagg

SEQ ID NO: 858536 - DNA, 25 bp, Mus musculus
aagggcaaaagacatatatccagtg

SEQ ID NO: 858537 - DNA, 25 bp, Mus musculus
aagggcaaaagagatatatccagtg

SEQ ID NO: 858538 - DNA, 25 bp, Mus musculus
aagggcaaagatgagtggttctcca

SEQ ID NO: 858539 - DNA, 25 bp, Mus musculus
aagggcaaagttgagtggttctcca

SEQ ID NO: 858540 - DNA, 25 bp, Mus musculus
aagggcacggcaccagtattcatga

SEQ ID NO: 858541 - DNA, 25 bp, Mus musculus
aagggcacggcactattcatgatca

SEQ ID NO: 858542 - DNA, 25 bp, Mus musculus
aagggcacggcagcagtattcatga

SEQ ID NO: 858543 - DNA, 25 bp, Mus musculus
aagggcacggcagtattcatgatca

SEQ ID NO: 858544 - DNA, 25 bp, Mus musculus
aagggcagtgcctacatattgatga

SEQ ID NO: 858545 - DNA, 25 bp, Mus musculus
aagggcagtgcctagatattgatga

SEQ ID NO: 858546 - DNA, 25 bp, Mus musculus
aagggcatggatcatcggctgtttt

SEQ ID NO: 858547 - DNA, 25 bp, Mus musculus
aagggcatggatgatcggctgtttt

SEQ ID NO: 858548 - DNA, 25 bp, Mus musculus
aagggcattgggcatgaagctctcc

SEQ ID NO: 858549 - DNA, 25 bp, Mus musculus
aagggcattggggatgaagctctcc

SEQ ID NO: 858550 - DNA, 25 bp, Mus musculus
aagggccagggatcactctctccac

SEQ ID NO: 858551 - DNA, 25 bp, Mus musculus
aagggccagggatcagatgcgggct

SEQ ID NO: 858552 - DNA, 25 bp, Mus musculus
aagggccagggatctctctctccac

SEQ ID NO: 858553 - DNA, 25 bp, Mus musculus
aagggccagggatctgatgcgggct

SEQ ID NO: 858554 - DNA, 25 bp, Mus musculus
aagggcccatcatctccatctttcc

SEQ ID NO: 858555 - DNA, 25 bp, Mus musculus
aagggcccatgatctccatctttcc

SEQ ID NO: 858556 - DNA, 25 bp, Mus musculus
aagggcctgcagcgccggctcccag

SEQ ID NO: 858557 - DNA, 25 bp, Mus musculus
aagggcctgcagggccggctcccag

SEQ ID NO: 858558 - DNA, 25 bp, Mus musculus
aagggcgagggtgacgtgtgtgtga

SEQ ID NO: 858559 - DNA, 25 bp, Mus musculus
aagggcgagggtgaggtgtgtgtga

SEQ ID NO: 858560 - DNA, 25 bp, Mus musculus
aagggcgtcttacatgacgtggtct

SEQ ID NO: 858561 - DNA, 25 bp, Mus musculus
aagggcgtcttagatgacgtggtct

SEQ ID NO: 858562 - DNA, 25 bp, Mus musculus
aagggctcagccagagtaacagttg

SEQ ID NO: 858563 - DNA, 25 bp, Mus musculus
aagggctcaggcagagtaacagttg

SEQ ID NO: 858564 - DNA, 25 bp, Mus musculus
aagggctgccgacatgtggacgagt

SEQ ID NO: 858565 - DNA, 25 bp, Mus musculus
aagggctgccgagatgtggacgagt

SEQ ID NO: 858566 - DNA, 25 bp, Mus musculus
aaggggagagctcctgctttctgac

SEQ ID NO: 858567 - DNA, 25 bp, Mus musculus
aaggggagaggtcctgctttctgac

SEQ ID NO: 858568 - DNA, 25 bp, Mus musculus
aaggggagcaggcagcggagggagc

SEQ ID NO: 858569 - DNA, 25 bp, Mus musculus
aaggggagcagggagcggagggagc

SEQ ID NO: 858570 - DNA, 25 bp, Mus musculus
aaggggattatcatcggtgcccctt

SEQ ID NO: 858571 - DNA, 25 bp, Mus musculus
aaggggattatcatgggtgcccctt

SEQ ID NO: 858572 - DNA, 25 bp, Mus musculus
aaggggcaggcgcgtgattatagag

SEQ ID NO: 858573 - DNA, 25 bp, Mus musculus
aaggggcaggcgggtgattatagag

SEQ ID NO: 858574 - DNA, 25 bp, Mus musculus
aaggggccccccctctctgtgacat

SEQ ID NO: 858575 - DNA, 25 bp, Mus musculus
aaggggccccccgtctctgtgacat

SEQ ID NO: 858576 - DNA, 25 bp, Mus musculus
aaggggctgaagaatatccatgcgg

SEQ ID NO: 858577 - DNA, 25 bp, Mus musculus
aaggggctgaagtatatccatgcgg

SEQ ID NO: 858578 - DNA, 25 bp, Mus musculus
aaggggtgacctaggagatatggga

SEQ ID NO: 858579 - DNA, 25 bp, Mus musculus
aaggggtgaccttggagatatggga

SEQ ID NO: 858580 - DNA, 25 bp, Mus musculus
aaggggtggcagctgtccagaatgt

SEQ ID NO: 858581 - DNA, 25 bp, Mus musculus
aaggggtggcaggtgtccagaatgt

SEQ ID NO: 858582 - DNA, 25 bp, Mus musculus
aaggggtttgactcccacatccttg

SEQ ID NO: 858583 - DNA, 25 bp, Mus musculus
aaggggtttgactcgcacatccttg

SEQ ID NO: 858584 - DNA, 25 bp, Mus musculus
aagggtgaacagcgtgcctctggtg

SEQ ID NO: 858585 - DNA, 25 bp, Mus musculus
aagggtgaacagggtgcctctggtg

SEQ ID NO: 858586 - DNA, 25 bp, Mus musculus
aagggtgacaagcgtgactcagctg

SEQ ID NO: 858587 - DNA, 25 bp, Mus musculus
aagggtgacaagggtgactcagctg

SEQ ID NO: 858588 - DNA, 25 bp, Mus musculus
aagggtgatggtgacgtctagtgac

SEQ ID NO: 858589 - DNA, 25 bp, Mus musculus
aagggtgatggtgaggtctagtgac

SEQ ID NO: 858590 - DNA, 25 bp, Mus musculus
aagggtgcaaaacgtaccagcaagg

SEQ ID NO: 858591 - DNA, 25 bp, Mus musculus
aagggtgcaaaaggtaccagcaagg

SEQ ID NO: 858592 - DNA, 25 bp, Mus musculus
aagggtgccaagcgggagccaggca

SEQ ID NO: 858593 - DNA, 25 bp, Mus musculus
aagggtgccaagggggagccaggca

SEQ ID NO: 858594 - DNA, 25 bp, Mus musculus
aagggttgtgatcggaggctcctat

SEQ ID NO: 858595 - DNA, 25 bp, Mus musculus
aagggttgtgatcggcggctcctat

SEQ ID NO: 858596 - DNA, 25 bp, Mus musculus
aagggttgtgatgggaggctcctat

SEQ ID NO: 858597 - DNA, 25 bp, Mus musculus
aagggttgtgatgggcggctcctat

SEQ ID NO: 858598 - DNA, 25 bp, Mus musculus
aaggtaactgcacagaaattaatag

SEQ ID NO: 858599 - DNA, 25 bp, Mus musculus
aaggtaactgcagagaaattaatag

SEQ ID NO: 858600 - DNA, 25 bp, Mus musculus
aaggtaccaggaagaatggacctgg

SEQ ID NO: 858601 - DNA, 25 bp, Mus musculus
aaggtaccaggaagtatggacctgg

SEQ ID NO: 858602 - DNA, 25 bp, Mus musculus
aaggtagaagcacatgtcttccctg

SEQ ID NO: 858603 - DNA, 25 bp, Mus musculus
aaggtagaaggacatgtcttccctg

SEQ ID NO: 858604 - DNA, 25 bp, Mus musculus
aaggtagcaaagcgtgtggaatatt

SEQ ID NO: 858605 - DNA, 25 bp, Mus musculus
aaggtagcaaagggtgtggaatatt

SEQ ID NO: 858606 - DNA, 25 bp, Mus musculus
aaggtagcagaggccagctgcctct

SEQ ID NO: 858607 - DNA, 25 bp, Mus musculus
aaggtagcagtggccagctgcctct

SEQ ID NO: 858608 - DNA, 25 bp, Mus musculus
aaggtatcactgagagaggcagctg

SEQ ID NO: 858609 - DNA, 25 bp, Mus musculus
aaggtatcactgtgagaggcagctg

SEQ ID NO: 858610 - DNA, 25 bp, Mus musculus
aaggtattcatgcacgtccacgcct

SEQ ID NO: 858611 - DNA, 25 bp, Mus musculus
aaggtattcatgcaggtccacgcct

SEQ ID NO: 858612 - DNA, 25 bp, Mus musculus
aaggtcaaagagttctgtgaaaatc

SEQ ID NO: 858613 - DNA, 25 bp, Mus musculus
aaggtcaaagtgttctgtgaaaatc

SEQ ID NO: 858614 - DNA, 25 bp, Mus musculus
aaggtcaagcagaaccaacagaaag

SEQ ID NO: 858615 - DNA, 25 bp, Mus musculus
aaggtcaagcagaagcaacagaaag

SEQ ID NO: 858616 - DNA, 25 bp, Mus musculus
aaggtcaaggaaatcgtggctgcgt

SEQ ID NO: 858617 - DNA, 25 bp, Mus musculus
aaggtcaaggaaatggtggctgcgt

SEQ ID NO: 858618 - DNA, 25 bp, Mus musculus
aaggtcaaggcaccaatgaggaaac

SEQ ID NO: 858619 - DNA, 25 bp, Mus musculus
aaggtcaaggcagcaatgaggaaac

SEQ ID NO: 858620 - DNA, 25 bp, Mus musculus
aaggtcctgaagcactcggggataa

SEQ ID NO: 858621 - DNA, 25 bp, Mus musculus
aaggtcctgaaggactcggggataa

SEQ ID NO: 858622 - DNA, 25 bp, Mus musculus
aaggtcgatgtgcgcccagaccctt

SEQ ID NO: 858623 - DNA, 25 bp, Mus musculus
aaggtcgatgtgggcccagaccctt

SEQ ID NO: 858624 - DNA, 25 bp, Mus musculus
aaggtcggacaacctctactccagg

SEQ ID NO: 858625 - DNA, 25 bp, Mus musculus
aaggtcggacaacgaaacacagaga

SEQ ID NO: 858626 - DNA, 25 bp, Mus musculus
aaggtcggacaagctctactccagg

SEQ ID NO: 858627 - DNA, 25 bp, Mus musculus
aaggtcggacaaggaaacacagaga

SEQ ID NO: 858628 - DNA, 25 bp, Mus musculus
aaggtcttaaggaacgccaagattg

SEQ ID NO: 858629 - DNA, 25 bp, Mus musculus
aaggtcttaaggaaggccaagattg

SEQ ID NO: 858630 - DNA, 25 bp, Mus musculus
aaggtgaccaagcgacgtgcaatct

SEQ ID NO: 858631 - DNA, 25 bp, Mus musculus
aaggtgaccaagggacgtgcaatct

SEQ ID NO: 858632 - DNA, 25 bp, Mus musculus
aaggtgacggtgagaggaggatgga

SEQ ID NO: 858633 - DNA, 25 bp, Mus musculus
aaggtgacggtgtgaggaggatgga

SEQ ID NO: 858634 - DNA, 25 bp, Mus musculus
aaggtgatgaaaacaacatggaatt

SEQ ID NO: 858635 - DNA, 25 bp, Mus musculus
aaggtgatgaaaactacatggaatt

SEQ ID NO: 858636 - DNA, 25 bp, Mus musculus
aaggtgatggagagcaaggaggaga

SEQ ID NO: 858637 - DNA, 25 bp, Mus musculus
aaggtgatggagaggaaggaggaga

SEQ ID NO: 858638 - DNA, 25 bp, Mus musculus
aaggtgcaagacaacgctttggatg

SEQ ID NO: 858639 - DNA, 25 bp, Mus musculus
aaggtgcaagacaaggctttggatg

SEQ ID NO: 858640 - DNA, 25 bp, Mus musculus
aaggtgccggatttggcacgtgact

SEQ ID NO: 858641 - DNA, 25 bp, Mus musculus
aaggtgccggttttggcacgtgact

SEQ ID NO: 858642 - DNA, 25 bp, Mus musculus
aaggtgcctggacacaaatatcttg

SEQ ID NO: 858643 - DNA, 25 bp, Mus musculus
aaggtgcctggacagaaatatcttg

SEQ ID NO: 858644 - DNA, 25 bp, Mus musculus
aaggtggacggggacgtgctgagga

SEQ ID NO: 858645 - DNA, 25 bp, Mus musculus
aaggtggacggggaggtgctgagga

SEQ ID NO: 858646 - DNA, 25 bp, Mus musculus
aaggtggatcaccatgaacgcttgg

SEQ ID NO: 858647 - DNA, 25 bp, Mus musculus
aaggtggatcacgatgaacgcttgg

SEQ ID NO: 858648 - DNA, 25 bp, Mus musculus
aaggtggatgacccggcgggaatgc

SEQ ID NO: 858649 - DNA, 25 bp, Mus musculus
aaggtggatgtcccggcgggaatgc

SEQ ID NO: 858650 - DNA, 25 bp, Mus musculus
aaggtggttctgaaacgaagtgaga

SEQ ID NO: 858651 - DNA, 25 bp, Mus musculus
aaggtggttctgtaacgaagtgaga

SEQ ID NO: 858652 - DNA, 25 bp, Mus musculus
aaggtgtatacacgaaagcagtcgt

SEQ ID NO: 858653 - DNA, 25 bp, Mus musculus
aaggtgtatacaggaaagcagtcgt

SEQ ID NO: 858654 - DNA, 25 bp, Mus musculus
aaggtgtgcaagcaggggtggctgt

SEQ ID NO: 858655 - DNA, 25 bp, Mus musculus
aaggtgtgcaaggaggggtggctgt

SEQ ID NO: 858656 - DNA, 25 bp, Mus musculus
aaggtgtgcgcatactgcctcgact

SEQ ID NO: 858657 - DNA, 25 bp, Mus musculus
aaggtgtgcgcatagtgcctcgact

SEQ ID NO: 858658 - DNA, 25 bp, Mus musculus
aaggtgtggtctcgccggcccttcg

SEQ ID NO: 858659 - DNA, 25 bp, Mus musculus
aaggtgtggtctcggcggcccttcg

SEQ ID NO: 858660 - DNA, 25 bp, Mus musculus
aaggtgttcaatctcaccagggaca

SEQ ID NO: 858661 - DNA, 25 bp, Mus musculus
aaggtgttcaatgtcaccagggaca

SEQ ID NO: 858662 - DNA, 25 bp, Mus musculus
aaggtgttccagcagcgcatcaact

SEQ ID NO: 858663 - DNA, 25 bp, Mus musculus
aaggtgttccagctaggtgcatgag

SEQ ID NO: 858664 - DNA, 25 bp, Mus musculus
aaggtgttccaggagcgcatcaact

SEQ ID NO: 858665 - DNA, 25 bp, Mus musculus
aaggtgttccaggtaggtgcatgag

SEQ ID NO: 858666 - DNA, 25 bp, Mus musculus
aaggttattgggattgagtgttcca

SEQ ID NO: 858667 - DNA, 25 bp, Mus musculus
aaggttattgggtttgagtgttcca

SEQ ID NO: 858668 - DNA, 25 bp, Mus musculus
aaggttcatcactcccttctcagca

SEQ ID NO: 858669 - DNA, 25 bp, Mus musculus
aaggttcatctctcccttctcagca

SEQ ID NO: 858670 - DNA, 25 bp, Mus musculus
aaggttcctgcacgacagtgttgaa

SEQ ID NO: 858671 - DNA, 25 bp, Mus musculus
aaggttcctgcaggacagtgttgaa

SEQ ID NO: 858672 - DNA, 25 bp, Mus musculus
aaggttcctgccgctaacgtcctga

SEQ ID NO: 858673 - DNA, 25 bp, Mus musculus
aaggttcctggcgctaacgtcctga

SEQ ID NO: 858674 - DNA, 25 bp, Mus musculus
aaggttctcaagcacagtgacctgc

SEQ ID NO: 858675 - DNA, 25 bp, Mus musculus
aaggttctcaaggacagtgacctgc

SEQ ID NO: 858676 - DNA, 25 bp, Mus musculus
aaggttgaagagcatgaagctggag

SEQ ID NO: 858677 - DNA, 25 bp, Mus musculus
aaggttgaagaggatgaagctggag

SEQ ID NO: 858678 - DNA, 25 bp, Mus musculus
aaggttgctcaaacatgtgaggaac

SEQ ID NO: 858679 - DNA, 25 bp, Mus musculus
aaggttgctcaatcatgtgaggaac

SEQ ID NO: 858680 - DNA, 25 bp, Mus musculus
aaggttgtagagctagagctgagtg

SEQ ID NO: 858681 - DNA, 25 bp, Mus musculus
aaggttgtagaggtagagctgagtg

SEQ ID NO: 858682 - DNA, 25 bp, Mus musculus
aaggtttataagaacgagctgcacc

SEQ ID NO: 858683 - DNA, 25 bp, Mus musculus
aaggtttataagaaggagctgcacc

SEQ ID NO: 858684 - DNA, 25 bp, Mus musculus
aaggtttcagataaatggaggatag

SEQ ID NO: 858685 - DNA, 25 bp, Mus musculus
aaggtttcagataaatgggccattg

SEQ ID NO: 858686 - DNA, 25 bp, Mus musculus
aaggtttcagataattggaggatag

SEQ ID NO: 858687 - DNA, 25 bp, Mus musculus
aaggtttcagataattgggccattg

SEQ ID NO: 858688 - DNA, 25 bp, Mus musculus
aagtaaagcaagagcaccagaagtg

SEQ ID NO: 858689 - DNA, 25 bp, Mus musculus
aagtaaagcaagcctgtggctctgg

SEQ ID NO: 858690 - DNA, 25 bp, Mus musculus
aagtaaagcaaggctgtggctctgg

SEQ ID NO: 858691 - DNA, 25 bp, Mus musculus
aagtaaagcaagtgcaccagaagtg

SEQ ID NO: 858692 - DNA, 25 bp, Mus musculus
aagtaaatgcttagtcattgagaaa

SEQ ID NO: 858693 - DNA, 25 bp, Mus musculus
aagtaaatgctttgtcattgagaaa

SEQ ID NO: 858694 - DNA, 25 bp, Mus musculus
aagtaaatggaacgcatacgatgcg

SEQ ID NO: 858695 - DNA, 25 bp, Mus musculus
aagtaaatggaaggcatacgatgcg

SEQ ID NO: 858696 - DNA, 25 bp, Mus musculus
aagtaactgtgacatgtaccgaagg

SEQ ID NO: 858697 - DNA, 25 bp, Mus musculus
aagtaactgtgagatgtaccgaagg

SEQ ID NO: 858698 - DNA, 25 bp, Mus musculus
aagtaagccacaatggctacaagtt

SEQ ID NO: 858699 - DNA, 25 bp, Mus musculus
aagtaagccagaatggctacaagtt

SEQ ID NO: 858700 - DNA, 25 bp, Mus musculus
aagtacaaagagcttgtagccaaga

SEQ ID NO: 858701 - DNA, 25 bp, Mus musculus
aagtacaaagtgcttgtagccaaga

SEQ ID NO: 858702 - DNA, 25 bp, Mus musculus
aagtacaattgcaccgtagtgcagt

SEQ ID NO: 858703 - DNA, 25 bp, Mus musculus
aagtacaattgcacggtagtgcagt

SEQ ID NO: 858704 - DNA, 25 bp, Mus musculus
aagtacacagagtgtgattcagtga

SEQ ID NO: 858705 - DNA, 25 bp, Mus musculus
aagtacacagtgtgtgattcagtga

SEQ ID NO: 858706 - DNA, 25 bp, Mus musculus
aagtacaccctcaacattgtagaag

SEQ ID NO: 858707 - DNA, 25 bp, Mus musculus
aagtacaccctcaagattgtagaag

SEQ ID NO: 858708 - DNA, 25 bp, Mus musculus
aagtacaccttccacgacttcacgg

SEQ ID NO: 858709 - DNA, 25 bp, Mus musculus
aagtacaccttccaggacttcacgg

SEQ ID NO: 858710 - DNA, 25 bp, Mus musculus
aagtacacggtccacgatgagagtc

SEQ ID NO: 858711 - DNA, 25 bp, Mus musculus
aagtacacggtccaggatgagagtc

SEQ ID NO: 858712 - DNA, 25 bp, Mus musculus
aagtacagagaacgtcggacactga

SEQ ID NO: 858713 - DNA, 25 bp, Mus musculus
aagtacagagaaggtcggacactga

SEQ ID NO: 858714 - DNA, 25 bp, Mus musculus
aagtacagataccttttcaagcaag

SEQ ID NO: 858715 - DNA, 25 bp, Mus musculus
aagtacagattccttttcaagcaag

SEQ ID NO: 858716 - DNA, 25 bp, Mus musculus
aagtacagcaaacacatgcgtgtac

SEQ ID NO: 858717 - DNA, 25 bp, Mus musculus
aagtacagcaaacacccatttcgta

SEQ ID NO: 858718 - DNA, 25 bp, Mus musculus
aagtacagcaaacagatgcgtgtac

SEQ ID NO: 858719 - DNA, 25 bp, Mus musculus
aagtacagcaaacagccatttcgta

SEQ ID NO: 858720 - DNA, 25 bp, Mus musculus
aagtacaggtatgaactcaagcggc

SEQ ID NO: 858721 - DNA, 25 bp, Mus musculus
aagtacaggtttgaactcaagcggc

SEQ ID NO: 858722 - DNA, 25 bp, Mus musculus
aagtacattgagacctgtgcagtgg

SEQ ID NO: 858723 - DNA, 25 bp, Mus musculus
aagtacattgtgacctgtgcagtgg

SEQ ID NO: 858724 - DNA, 25 bp, Mus musculus
aagtaccaacaacaccaggtggtga

SEQ ID NO: 858725 - DNA, 25 bp, Mus musculus
aagtaccaacaagaccaggtggtga

SEQ ID NO: 858726 - DNA, 25 bp, Mus musculus
aagtaccaagagccatgcgagaatg

SEQ ID NO: 858727 - DNA, 25 bp, Mus musculus
aagtaccaagaggcatgcgagaatg

SEQ ID NO: 858728 - DNA, 25 bp, Mus musculus
aagtaccgagagctgcttttgatac

SEQ ID NO: 858729 - DNA, 25 bp, Mus musculus
aagtaccgagtgctgcttttgatac

SEQ ID NO: 858730 - DNA, 25 bp, Mus musculus
aagtaccgctctgacgtcccgccca

SEQ ID NO: 858731 - DNA, 25 bp, Mus musculus
aagtaccgctctgaggtcccgccca

SEQ ID NO: 858732 - DNA, 25 bp, Mus musculus
aagtacctggagattatctcagaaa

SEQ ID NO: 858733 - DNA, 25 bp, Mus musculus
aagtacctggagtttatctcagaaa

SEQ ID NO: 858734 - DNA, 25 bp, Mus musculus
aagtactatctgacaagcacaaacg

SEQ ID NO: 858735 - DNA, 25 bp, Mus musculus
aagtactatctgacagaagtggtcc

SEQ ID NO: 858736 - DNA, 25 bp, Mus musculus
aagtactatctgactagcacaaacg

SEQ ID NO: 858737 - DNA, 25 bp, Mus musculus
aagtactatctgactgaagtggtcc

SEQ ID NO: 858738 - DNA, 25 bp, Mus musculus
aagtactgaaaccagagctctagaa

SEQ ID NO: 858739 - DNA, 25 bp, Mus musculus
aagtactgaaacgagagctctagaa

SEQ ID NO: 858740 - DNA, 25 bp, Mus musculus
aagtactgggagctcatctatgagg

SEQ ID NO: 858741 - DNA, 25 bp, Mus musculus
aagtactgggaggtcatctatgagg

SEQ ID NO: 858742 - DNA, 25 bp, Mus musculus
aagtacttcctgctgggtgcagggg

SEQ ID NO: 858743 - DNA, 25 bp, Mus musculus
aagtacttcctggtgggtgcagggg

SEQ ID NO: 858744 - DNA, 25 bp, Mus musculus
aagtacttggagcacagcaagatct

SEQ ID NO: 858745 - DNA, 25 bp, Mus musculus
aagtacttggaggacagcaagatct

SEQ ID NO: 858746 - DNA, 25 bp, Mus musculus
aagtagaaaaaacacacagtgatgt

SEQ ID NO: 858747 - DNA, 25 bp, Mus musculus
aagtagaaaaaacagacagtgatgt

SEQ ID NO: 858748 - DNA, 25 bp, Mus musculus
aagtagagccagcaagtccacatgc

SEQ ID NO: 858749 - DNA, 25 bp, Mus musculus
aagtagagccagccttgccatctcc

SEQ ID NO: 858750 - DNA, 25 bp, Mus musculus
aagtagagccaggaagtccacatgc

SEQ ID NO: 858751 - DNA, 25 bp, Mus musculus
aagtagagccaggcttgccatctcc

SEQ ID NO: 858752 - DNA, 25 bp, Mus musculus
aagtagaggactgtaatgaaagaga

SEQ ID NO: 858753 - DNA, 25 bp, Mus musculus
aagtagaggactgttatgaaagaga

SEQ ID NO: 858754 - DNA, 25 bp, Mus musculus
aagtagcaacaacctacctaaaaag

SEQ ID NO: 858755 - DNA, 25 bp, Mus musculus
aagtagcaacaagctacctaaaaag

SEQ ID NO: 858756 - DNA, 25 bp, Mus musculus
aagtatatactcaacgtatcgcagg

SEQ ID NO: 858757 - DNA, 25 bp, Mus musculus
aagtatatactcaaggtatcgcagg

SEQ ID NO: 858758 - DNA, 25 bp, Mus musculus
aagtatatccagctcgtctaccttc

SEQ ID NO: 858759 - DNA, 25 bp, Mus musculus
aagtatatccaggtcgtctaccttc

SEQ ID NO: 858760 - DNA, 25 bp, Mus musculus
aagtatcagctaccatcgggacaga

SEQ ID NO: 858761 - DNA, 25 bp, Mus musculus
aagtatcagctagcatcgggacaga

SEQ ID NO: 858762 - DNA, 25 bp, Mus musculus
aagtatcggaagcttgtgtcggcag

SEQ ID NO: 858763 - DNA, 25 bp, Mus musculus
aagtatcggaaggttgtgtcggcag

SEQ ID NO: 858764 - DNA, 25 bp, Mus musculus
aagtatcttaagctttcaggcacag

SEQ ID NO: 858765 - DNA, 25 bp, Mus musculus
aagtatcttaaggtttcaggcacag

SEQ ID NO: 858766 - DNA, 25 bp, Mus musculus
aagtatgaagagctggcccgtaagc

SEQ ID NO: 858767 - DNA, 25 bp, Mus musculus
aagtatgaagagctggctcgtaagt

SEQ ID NO: 858768 - DNA, 25 bp, Mus musculus
aagtatgaagaggtggcccgtaagc

SEQ ID NO: 858769 - DNA, 25 bp, Mus musculus
aagtatgaagaggtggctcgtaagt

SEQ ID NO: 858770 - DNA, 25 bp, Mus musculus
aagtatgacctcaacggctctctag

SEQ ID NO: 858771 - DNA, 25 bp, Mus musculus
aagtatgacctcaagggctctctag

SEQ ID NO: 858772 - DNA, 25 bp, Mus musculus
aagtatgagaagcatattgctgcct

SEQ ID NO: 858773 - DNA, 25 bp, Mus musculus
aagtatgagaagcatgttgctgact

SEQ ID NO: 858774 - DNA, 25 bp, Mus musculus
aagtatgagaaggatattgctgcct

SEQ ID NO: 858775 - DNA, 25 bp, Mus musculus
aagtatgagaaggatgttgctgact

SEQ ID NO: 858776 - DNA, 25 bp, Mus musculus
aagtatgatgcccacgacttagaag

SEQ ID NO: 858777 - DNA, 25 bp, Mus musculus
aagtatgatgcccactcttaccatg

SEQ ID NO: 858778 - DNA, 25 bp, Mus musculus
aagtatgatgcccaggacttagaag

SEQ ID NO: 858779 - DNA, 25 bp, Mus musculus
aagtatgatgcccagtcttaccatg

SEQ ID NO: 858780 - DNA, 25 bp, Mus musculus
aagtatgatgctgacagaatggtca

SEQ ID NO: 858781 - DNA, 25 bp, Mus musculus
aagtatgatgctgagagaatggtca

SEQ ID NO: 858782 - DNA, 25 bp, Mus musculus
aagtatgcagagctcgatgaagcca

SEQ ID NO: 858783 - DNA, 25 bp, Mus musculus
aagtatgcagtgctcgatgaagcca

SEQ ID NO: 858784 - DNA, 25 bp, Mus musculus
aagtatggaaagcacccaacagtag

SEQ ID NO: 858785 - DNA, 25 bp, Mus musculus
aagtatggaaaggacccaacagtag

SEQ ID NO: 858786 - DNA, 25 bp, Mus musculus
aagtatggagcacgtatgcggtggt

SEQ ID NO: 858787 - DNA, 25 bp, Mus musculus
aagtatggagcaggtatgcggtggt

SEQ ID NO: 858788 - DNA, 25 bp, Mus musculus
aagtatggatggctacctggaatgg

SEQ ID NO: 858789 - DNA, 25 bp, Mus musculus
aagtatggatgggtacctggaatgg

SEQ ID NO: 858790 - DNA, 25 bp, Mus musculus
aagtatttcccacacgcctatatga

SEQ ID NO: 858791 - DNA, 25 bp, Mus musculus
aagtatttcccacaggcctatatga

SEQ ID NO: 858792 - DNA, 25 bp, Mus musculus
aagtcaacagatttgctcttgcctc

SEQ ID NO: 858793 - DNA, 25 bp, Mus musculus
aagtcaacagccatcaactaaacaa

SEQ ID NO: 858794 - DNA, 25 bp, Mus musculus
aagtcaacaggcatcaactaaacaa

SEQ ID NO: 858795 - DNA, 25 bp, Mus musculus
aagtcaacagttttgctcttgcctc

SEQ ID NO: 858796 - DNA, 25 bp, Mus musculus
aagtcaactatgaacaattcgtaca

SEQ ID NO: 858797 - DNA, 25 bp, Mus musculus
aagtcaactatgaagaattcgtaca

SEQ ID NO: 858798 - DNA, 25 bp, Mus musculus
aagtcaagaaaccttgttatcgctg

SEQ ID NO: 858799 - DNA, 25 bp, Mus musculus
aagtcaagaaacgttgttatcgctg

SEQ ID NO: 858800 - DNA, 25 bp, Mus musculus
aagtcaagatccaacatgctcaccg

SEQ ID NO: 858801 - DNA, 25 bp, Mus musculus
aagtcaagatccaagatgctcaccg

SEQ ID NO: 858802 - DNA, 25 bp, Mus musculus
aagtcaagatcttaccttcagttac

SEQ ID NO: 858803 - DNA, 25 bp, Mus musculus
aagtcaagatcttagcttcagttac

SEQ ID NO: 858804 - DNA, 25 bp, Mus musculus
aagtcaatagataaaggtatatttg

SEQ ID NO: 858805 - DNA, 25 bp, Mus musculus
aagtcaatagataatggtatatttg

SEQ ID NO: 858806 - DNA, 25 bp, Mus musculus
aagtcagaacaaatcgtgaaagaga

SEQ ID NO: 858807 - DNA, 25 bp, Mus musculus
aagtcagaacaaatggtgaaagaga

SEQ ID NO: 858808 - DNA, 25 bp, Mus musculus
aagtcagaagcctgttatcagaagg

SEQ ID NO: 858809 - DNA, 25 bp, Mus musculus
aagtcagaaggctgttatcagaagg

SEQ ID NO: 858810 - DNA, 25 bp, Mus musculus
aagtcagacgcaaagagtggtcacc

SEQ ID NO: 858811 - DNA, 25 bp, Mus musculus
aagtcagacggaaagagtggtcacc

SEQ ID NO: 858812 - DNA, 25 bp, Mus musculus
aagtcatcagaactgtacaactgga

SEQ ID NO: 858813 - DNA, 25 bp, Mus musculus
aagtcatcagaagtgtacaactgga

SEQ ID NO: 858814 - DNA, 25 bp, Mus musculus
aagtcatcagccagctcttgaaagc

SEQ ID NO: 858815 - DNA, 25 bp, Mus musculus
aagtcatcagcgatgccagagaggc

SEQ ID NO: 858816 - DNA, 25 bp, Mus musculus
aagtcatcaggcagctcttgaaagc

SEQ ID NO: 858817 - DNA, 25 bp, Mus musculus
aagtcatcagggatgccagagaggc

SEQ ID NO: 858818 - DNA, 25 bp, Mus musculus
aagtcatcataacacgtcactgcca

SEQ ID NO: 858819 - DNA, 25 bp, Mus musculus
aagtcatcataacaggtcactgcca

SEQ ID NO: 858820 - DNA, 25 bp, Mus musculus
aagtcatgacaacacaccctgttga

SEQ ID NO: 858821 - DNA, 25 bp, Mus musculus
aagtcatgacaagacaccctgttga

SEQ ID NO: 858822 - DNA, 25 bp, Mus musculus
aagtcattcaattctggaacaagaa

SEQ ID NO: 858823 - DNA, 25 bp, Mus musculus
aagtcattcatttctggaacaagaa

SEQ ID NO: 858824 - DNA, 25 bp, Mus musculus
aagtcattcccacacccccggctga

SEQ ID NO: 858825 - DNA, 25 bp, Mus musculus
aagtcattccgacacccccggctga

SEQ ID NO: 858826 - DNA, 25 bp, Mus musculus
aagtcattggcacgtgtaagtgcaa

SEQ ID NO: 858827 - DNA, 25 bp, Mus musculus
aagtcattggcaggtgtaagtgcaa

SEQ ID NO: 858828 - DNA, 25 bp, Mus musculus
aagtcattggggcacgttcctttgg

SEQ ID NO: 858829 - DNA, 25 bp, Mus musculus
aagtcattggggcaggttcctttgg

SEQ ID NO: 858830 - DNA, 25 bp, Mus musculus
aagtcattgtgtcaacttgtataaa

SEQ ID NO: 858831 - DNA, 25 bp, Mus musculus
aagtcattgtgtgaacttgtataaa

SEQ ID NO: 858832 - DNA, 25 bp, Mus musculus
aagtcattttgaaacatgtccttca

SEQ ID NO: 858833 - DNA, 25 bp, Mus musculus
aagtcattttgaaagatgtccttca

SEQ ID NO: 858834 - DNA, 25 bp, Mus musculus
aagtccaacaaacaagtttgcacgg

SEQ ID NO: 858835 - DNA, 25 bp, Mus musculus
aagtccaacaaacatgtttgcacgg

SEQ ID NO: 858836 - DNA, 25 bp, Mus musculus
aagtccaacgagcaccagtccatgg

SEQ ID NO: 858837 - DNA, 25 bp, Mus musculus
aagtccaacgaggaccagtccatgg

SEQ ID NO: 858838 - DNA, 25 bp, Mus musculus
aagtccacaacacgaaacacactgg

SEQ ID NO: 858839 - DNA, 25 bp, Mus musculus
aagtccacaacaggaaacacactgg

SEQ ID NO: 858840 - DNA, 25 bp, Mus musculus
aagtccacatttgacaacggccggt

SEQ ID NO: 858841 - DNA, 25 bp, Mus musculus
aagtccacatttgactgtgaagtga

SEQ ID NO: 858842 - DNA, 25 bp, Mus musculus
aagtccacatttgagaacggccggt

SEQ ID NO: 858843 - DNA, 25 bp, Mus musculus
aagtccacatttgagtgtgaagtga

SEQ ID NO: 858844 - DNA, 25 bp, Mus musculus
aagtccaccaacatctcatttacaa

SEQ ID NO: 858845 - DNA, 25 bp, Mus musculus
aagtccaccaacttctcatttacaa

SEQ ID NO: 858846 - DNA, 25 bp, Mus musculus
aagtccagcacgaattgtctgggac

SEQ ID NO: 858847 - DNA, 25 bp, Mus musculus
aagtccagcaggaattgtctgggac

SEQ ID NO: 858848 - DNA, 25 bp, Mus musculus
aagtccatggagaatggaggatcct

SEQ ID NO: 858849 - DNA, 25 bp, Mus musculus
aagtccatggtgaatggaggatcct

SEQ ID NO: 858850 - DNA, 25 bp, Mus musculus
aagtcccatgcgtcaggaaatgtgt

SEQ ID NO: 858851 - DNA, 25 bp, Mus musculus
aagtcccatgcgtctggaaatgtgt

SEQ ID NO: 858852 - DNA, 25 bp, Mus musculus
aagtccctaggggacctcatcaata

SEQ ID NO: 858853 - DNA, 25 bp, Mus musculus
aagtccctaggggagctcatcaata

SEQ ID NO: 858854 - DNA, 25 bp, Mus musculus
aagtccctcacacacctgcacgttc

SEQ ID NO: 858855 - DNA, 25 bp, Mus musculus
aagtccctcacagacctgcacgttc

SEQ ID NO: 858856 - DNA, 25 bp, Mus musculus
aagtccgagaagaacaaggaggaga

SEQ ID NO: 858857 - DNA, 25 bp, Mus musculus
aagtccgagaagaacgaggagaggt

SEQ ID NO: 858858 - DNA, 25 bp, Mus musculus
aagtccgagaagaagaaggaggaga

SEQ ID NO: 858859 - DNA, 25 bp, Mus musculus
aagtccgagaagaaggaggagaggt

SEQ ID NO: 858860 - DNA, 25 bp, Mus musculus
aagtcctatgaaattttattgcatg

SEQ ID NO: 858861 - DNA, 25 bp, Mus musculus
aagtcctatgaatttttattgcatg

SEQ ID NO: 858862 - DNA, 25 bp, Mus musculus
aagtcctcatcgctctgtttaagac

SEQ ID NO: 858863 - DNA, 25 bp, Mus musculus
aagtcctcatcggtctgtttaagac

SEQ ID NO: 858864 - DNA, 25 bp, Mus musculus
aagtcctctatgaacactggaccac

SEQ ID NO: 858865 - DNA, 25 bp, Mus musculus
aagtcctctatgaagactggaccac

SEQ ID NO: 858866 - DNA, 25 bp, Mus musculus
aagtcgcttcagcctttaccctccg

SEQ ID NO: 858867 - DNA, 25 bp, Mus musculus
aagtcgcttcaggctttaccctccg

SEQ ID NO: 858868 - DNA, 25 bp, Mus musculus
aagtcgggccagctacatccaatgt

SEQ ID NO: 858869 - DNA, 25 bp, Mus musculus
aagtcgggccaggtacatccaatgt

SEQ ID NO: 858870 - DNA, 25 bp, Mus musculus
aagtctaaggcagacctgctgctgt

SEQ ID NO: 858871 - DNA, 25 bp, Mus musculus
aagtctaaggcagagctgctgctgt

SEQ ID NO: 858872 - DNA, 25 bp, Mus musculus
aagtctacaaaacctcttcagagaa

SEQ ID NO: 858873 - DNA, 25 bp, Mus musculus
aagtctacaaaacgtgaagtatttg

SEQ ID NO: 858874 - DNA, 25 bp, Mus musculus
aagtctacaaaagctcttcagagaa

SEQ ID NO: 858875 - DNA, 25 bp, Mus musculus
aagtctacaaaaggtgaagtatttg

SEQ ID NO: 858876 - DNA, 25 bp, Mus musculus
aagtctacagctggtgtctaccatg

SEQ ID NO: 858877 - DNA, 25 bp, Mus musculus
aagtctacaggtggtgtctaccatg

SEQ ID NO: 858878 - DNA, 25 bp, Mus musculus
aagtctactatcaccattgtggctg

SEQ ID NO: 858879 - DNA, 25 bp, Mus musculus
aagtctactatcacgattgtggctg

SEQ ID NO: 858880 - DNA, 25 bp, Mus musculus
aagtctactccatcatttgtaggga

SEQ ID NO: 858881 - DNA, 25 bp, Mus musculus
aagtctactccatcttttgtaggga

SEQ ID NO: 858882 - DNA, 25 bp, Mus musculus
aagtctatctatcaacagagaaaac

SEQ ID NO: 858883 - DNA, 25 bp, Mus musculus
aagtctatctatgaacagagaaaac

SEQ ID NO: 858884 - DNA, 25 bp, Mus musculus
aagtctatgcttcacgcaacagctg

SEQ ID NO: 858885 - DNA, 25 bp, Mus musculus
aagtctatgcttcaggcaacagctg

SEQ ID NO: 858886 - DNA, 25 bp, Mus musculus
aagtctcctagtgaccttgtccagg

SEQ ID NO: 858887 - DNA, 25 bp, Mus musculus
aagtctcctagtgagcttgtccagg

SEQ ID NO: 858888 - DNA, 25 bp, Mus musculus
aagtctcctgctcacattttgatcc

SEQ ID NO: 858889 - DNA, 25 bp, Mus musculus
aagtctcctgctcagattttgatcc

SEQ ID NO: 858890 - DNA, 25 bp, Mus musculus
aagtctcgaagtgacgtagagctca

SEQ ID NO: 858891 - DNA, 25 bp, Mus musculus
aagtctcgaagtgaggtagagctca

SEQ ID NO: 858892 - DNA, 25 bp, Mus musculus
aagtctctctcacagaaacgggaga

SEQ ID NO: 858893 - DNA, 25 bp, Mus musculus
aagtctctctcagagaaacgggaga

SEQ ID NO: 858894 - DNA, 25 bp, Mus musculus
aagtcttaagcgtgtagtggagatg

SEQ ID NO: 858895 - DNA, 25 bp, Mus musculus
aagtcttaagggtgtagtggagatg

SEQ ID NO: 858896 - DNA, 25 bp, Mus musculus
aagtcttcagatgaatggcggcggg

SEQ ID NO: 858897 - DNA, 25 bp, Mus musculus
aagtcttcagttgaatggcggcggg

SEQ ID NO: 858898 - DNA, 25 bp, Mus musculus
aagtcttgccaacatgtggatgaat

SEQ ID NO: 858899 - DNA, 25 bp, Mus musculus
aagtcttgccaagatgtggatgaat

SEQ ID NO: 858900 - DNA, 25 bp, Mus musculus
aagtgaaagacgtcaaccggatgca

SEQ ID NO: 858901 - DNA, 25 bp, Mus musculus
aagtgaaagaggtcaaccggatgca

SEQ ID NO: 858902 - DNA, 25 bp, Mus musculus
aagtgaacagcccatggcgcaggct

SEQ ID NO: 858903 - DNA, 25 bp, Mus musculus
aagtgaacagctgccttcttcacaa

SEQ ID NO: 858904 - DNA, 25 bp, Mus musculus
aagtgaacaggccatggcgcaggct

SEQ ID NO: 858905 - DNA, 25 bp, Mus musculus
aagtgaacaggtgccttcttcacaa

SEQ ID NO: 858906 - DNA, 25 bp, Mus musculus
aagtgaagagcgcattcaaggactg

SEQ ID NO: 858907 - DNA, 25 bp, Mus musculus
aagtgaagagggcattcaaggactg

SEQ ID NO: 858908 - DNA, 25 bp, Mus musculus
aagtgaagcctgctcgtcctacagt

SEQ ID NO: 858909 - DNA, 25 bp, Mus musculus
aagtgaagcctgctggtcctacagt

SEQ ID NO: 858910 - DNA, 25 bp, Mus musculus
aagtgacaagctgcttacagacaca

SEQ ID NO: 858911 - DNA, 25 bp, Mus musculus
aagtgacaaggtctgcttacagaca

SEQ ID NO: 858912 - DNA, 25 bp, Mus musculus
aagtgacaaggtgcttacagacaca

SEQ ID NO: 858913 - DNA, 25 bp, Mus musculus
aagtgacaaggtgtgcttacagaca

SEQ ID NO: 858914 - DNA, 25 bp, Mus musculus
aagtgaccatggaagcgtatttgat

SEQ ID NO: 858915 - DNA, 25 bp, Mus musculus
aagtgaccatggtagcgtatttgat

SEQ ID NO: 858916 - DNA, 25 bp, Mus musculus
aagtgactgagactggaatgcagtg

SEQ ID NO: 858917 - DNA, 25 bp, Mus musculus
aagtgactgagagtggaatgcagtg

SEQ ID NO: 858918 - DNA, 25 bp, Mus musculus
aagtgagaacagaaaccttgaggaa

SEQ ID NO: 858919 - DNA, 25 bp, Mus musculus
aagtgagaacagtaaccttgaggaa

SEQ ID NO: 858920 - DNA, 25 bp, Mus musculus
aagtgaggacagccttttgattgca

SEQ ID NO: 858921 - DNA, 25 bp, Mus musculus
aagtgaggacaggcttttgattgca

SEQ ID NO: 858922 - DNA, 25 bp, Mus musculus
aagtgataatagcttaaagaatttg

SEQ ID NO: 858923 - DNA, 25 bp, Mus musculus
aagtgataataggttaaagaatttg

SEQ ID NO: 858924 - DNA, 25 bp, Mus musculus
aagtgatgagatcctaagggaagac

SEQ ID NO: 858925 - DNA, 25 bp, Mus musculus
aagtgatgagttcctaagggaagac

SEQ ID NO: 858926 - DNA, 25 bp, Mus musculus
aagtgattactgcaaccctgtggaa

SEQ ID NO: 858927 - DNA, 25 bp, Mus musculus
aagtgattactggaaccctgtggaa

SEQ ID NO: 858928 - DNA, 25 bp, Mus musculus
aagtgatttggacattttctggaac

SEQ ID NO: 858929 - DNA, 25 bp, Mus musculus
aagtgatttggagattttctggaac

SEQ ID NO: 858930 - DNA, 25 bp, Mus musculus
aagtgcaaagcttatggttttgttg

SEQ ID NO: 858931 - DNA, 25 bp, Mus musculus
aagtgcaaaggttatggttttgttg

SEQ ID NO: 858932 - DNA, 25 bp, Mus musculus
aagtgcagagtcaacgagaagccaa

SEQ ID NO: 858933 - DNA, 25 bp, Mus musculus
aagtgcagagtcaaggagaagccaa

SEQ ID NO: 858934 - DNA, 25 bp, Mus musculus
aagtgcagcgaccgatcgaagcctg

SEQ ID NO: 858935 - DNA, 25 bp, Mus musculus
aagtgcagcgacggatcgaagcctg

SEQ ID NO: 858936 - DNA, 25 bp, Mus musculus
aagtgcatagcaggagcttcctggc

SEQ ID NO: 858937 - DNA, 25 bp, Mus musculus
aagtgcatagcagtggctgctactc

SEQ ID NO: 858938 - DNA, 25 bp, Mus musculus
aagtgcataggaggagcttcctggc

SEQ ID NO: 858939 - DNA, 25 bp, Mus musculus
aagtgcataggagtggctgctactc

SEQ ID NO: 858940 - DNA, 25 bp, Mus musculus
aagtgcattgagaaagaagtcaaca

SEQ ID NO: 858941 - DNA, 25 bp, Mus musculus
aagtgcattgagagctgtctgtcta

SEQ ID NO: 858942 - DNA, 25 bp, Mus musculus
aagtgcattgagtaagaagtcaaca

SEQ ID NO: 858943 - DNA, 25 bp, Mus musculus
aagtgcattgagtgctgtctgtcta

SEQ ID NO: 858944 - DNA, 25 bp, Mus musculus
aagtgccaagatatagatgagtgca

SEQ ID NO: 858945 - DNA, 25 bp, Mus musculus
aagtgccaagttatagatgagtgca

SEQ ID NO: 858946 - DNA, 25 bp, Mus musculus
aagtgccacaaacgaacctacttgg

SEQ ID NO: 858947 - DNA, 25 bp, Mus musculus
aagtgccacaaaggaacctacttgg

SEQ ID NO: 858948 - DNA, 25 bp, Mus musculus
aagtgccactgaatggaactctgac

SEQ ID NO: 858949 - DNA, 25 bp, Mus musculus
aagtgccactgattggaactctgac

SEQ ID NO: 858950 - DNA, 25 bp, Mus musculus
aagtgccaggatcacaacgaatgcc

SEQ ID NO: 858951 - DNA, 25 bp, Mus musculus
aagtgccaggttcacaacgaatgcc

SEQ ID NO: 858952 - DNA, 25 bp, Mus musculus
aagtgccggttaggcactgcatgag

SEQ ID NO: 858953 - DNA, 25 bp, Mus musculus
aagtgccggttagggactgcatgag

SEQ ID NO: 858954 - DNA, 25 bp, Mus musculus
aagtgcctcccacgtcagaaccgtt

SEQ ID NO: 858955 - DNA, 25 bp, Mus musculus
aagtgcctcccaggtcagaaccgtt

SEQ ID NO: 858956 - DNA, 25 bp, Mus musculus
aagtgcctgcagcgtccagtgcctc

SEQ ID NO: 858957 - DNA, 25 bp, Mus musculus
aagtgcctgcagggtccagtgcctc

SEQ ID NO: 858958 - DNA, 25 bp, Mus musculus
aagtgcctggagcacgaacagctcc

SEQ ID NO: 858959 - DNA, 25 bp, Mus musculus
aagtgcctggagcaggaacagctcc

SEQ ID NO: 858960 - DNA, 25 bp, Mus musculus
aagtgcgatgcgctgttcctgggcg

SEQ ID NO: 858961 - DNA, 25 bp, Mus musculus
aagtgcgatgcgtcgtcccccagac

SEQ ID NO: 858962 - DNA, 25 bp, Mus musculus
aagtgcgatgggctgttcctgggcg

SEQ ID NO: 858963 - DNA, 25 bp, Mus musculus
aagtgcgatgggtcgtcccccagac

SEQ ID NO: 858964 - DNA, 25 bp, Mus musculus
aagtgcgcaccgcacccctgaatga

SEQ ID NO: 858965 - DNA, 25 bp, Mus musculus
aagtgcgcacggcacccctgaatga

SEQ ID NO: 858966 - DNA, 25 bp, Mus musculus
aagtgcgcgacacgctgtttggtct

SEQ ID NO: 858967 - DNA, 25 bp, Mus musculus
aagtgcgcgacacgttctggatggt

SEQ ID NO: 858968 - DNA, 25 bp, Mus musculus
aagtgcgcgacaggctgtttggtct

SEQ ID NO: 858969 - DNA, 25 bp, Mus musculus
aagtgcgcgacaggttctggatggt

SEQ ID NO: 858970 - DNA, 25 bp, Mus musculus
aagtgcggaaatcggagaagaaatg

SEQ ID NO: 858971 - DNA, 25 bp, Mus musculus
aagtgcggaaatgggagaagaaatg

SEQ ID NO: 858972 - DNA, 25 bp, Mus musculus
aagtgctcagcaagactcttcaatc

SEQ ID NO: 858973 - DNA, 25 bp, Mus musculus
aagtgctcagcacaacatcaaaaat

SEQ ID NO: 858974 - DNA, 25 bp, Mus musculus
aagtgctcagcaggccatgacaccg

SEQ ID NO: 858975 - DNA, 25 bp, Mus musculus
aagtgctcaggaagactcttcaatc

SEQ ID NO: 858976 - DNA, 25 bp, Mus musculus
aagtgctcaggacaacatcaaaaat

SEQ ID NO: 858977 - DNA, 25 bp, Mus musculus
aagtgctcaggaggccatgacaccg

SEQ ID NO: 858978 - DNA, 25 bp, Mus musculus
aagtgctctcgacacgaagtcatct

SEQ ID NO: 858979 - DNA, 25 bp, Mus musculus
aagtgctctcgacaggaagtcatct

SEQ ID NO: 858980 - DNA, 25 bp, Mus musculus
aagtgctctgctcctcctcctcctt

SEQ ID NO: 858981 - DNA, 25 bp, Mus musculus
aagtgctctggtcctcctcctcctt

SEQ ID NO: 858982 - DNA, 25 bp, Mus musculus
aagtgctgatctgacttcattatct

SEQ ID NO: 858983 - DNA, 25 bp, Mus musculus
aagtgctgatgtgacttcattatct

SEQ ID NO: 858984 - DNA, 25 bp, Mus musculus
aagtgctggacatctttggctttga

SEQ ID NO: 858985 - DNA, 25 bp, Mus musculus
aagtgctggagatctttggctttga

SEQ ID NO: 858986 - DNA, 25 bp, Mus musculus
aagtgctgggagctgtcattgccgg

SEQ ID NO: 858987 - DNA, 25 bp, Mus musculus
aagtgctgggaggtgtcattgccgg

SEQ ID NO: 858988 - DNA, 25 bp, Mus musculus
aagtggaaatagcaaaaccagcaag

SEQ ID NO: 858989 - DNA, 25 bp, Mus musculus
aagtggaaataggaaaaccagcaag

SEQ ID NO: 858990 - DNA, 25 bp, Mus musculus
aagtggaacactgaagacatgctgt

SEQ ID NO: 858991 - DNA, 25 bp, Mus musculus
aagtggaacactgatgacatgctgt

SEQ ID NO: 858992 - DNA, 25 bp, Mus musculus
aagtggaacgcccaatgcagcagtg

SEQ ID NO: 858993 - DNA, 25 bp, Mus musculus
aagtggaacggccaatgcagcagtg

SEQ ID NO: 858994 - DNA, 25 bp, Mus musculus
aagtggacaatcatcgctgtcatgg

SEQ ID NO: 858995 - DNA, 25 bp, Mus musculus
aagtggacaatcatggctgtcatgg

SEQ ID NO: 858996 - DNA, 25 bp, Mus musculus
aagtggaccccaaacgccatgaaga

SEQ ID NO: 858997 - DNA, 25 bp, Mus musculus
aagtggaccccaaaggccatgaaga

SEQ ID NO: 858998 - DNA, 25 bp, Mus musculus
aagtggagagagcataccggatgtc

SEQ ID NO: 858999 - DNA, 25 bp, Mus musculus
aagtggagagaggataccggatgtc

SEQ ID NO: 859000 - DNA, 25 bp, Mus musculus
aagtggagctggagcgctaaaaccg

SEQ ID NO: 859001 - DNA, 25 bp, Mus musculus
aagtggagctggagggctaaaaccg

SEQ ID NO: 859002 - DNA, 25 bp, Mus musculus
aagtggaggatgaacagatcgagtg

SEQ ID NO: 859003 - DNA, 25 bp, Mus musculus
aagtggaggatgaagagatcgagtg

SEQ ID NO: 859004 - DNA, 25 bp, Mus musculus
aagtggatgctgatcgcaatggcac

SEQ ID NO: 859005 - DNA, 25 bp, Mus musculus
aagtggatgctgatggcaatggcac

SEQ ID NO: 859006 - DNA, 25 bp, Mus musculus
aagtggcaagacagtacaggctacc

SEQ ID NO: 859007 - DNA, 25 bp, Mus musculus
aagtggcaagatcttagggttggag

SEQ ID NO: 859008 - DNA, 25 bp, Mus musculus
aagtggcaagtcagtacaggctacc

SEQ ID NO: 859009 - DNA, 25 bp, Mus musculus
aagtggcaagttcttagggttggag

SEQ ID NO: 859010 - DNA, 25 bp, Mus musculus
aagtggcatgcagatgttgcagtaa

SEQ ID NO: 859011 - DNA, 25 bp, Mus musculus
aagtggcatggagatgttgcagtaa

SEQ ID NO: 859012 - DNA, 25 bp, Mus musculus
aagtggctttatctgtaacatcatg

SEQ ID NO: 859013 - DNA, 25 bp, Mus musculus
aagtggctttttctgtaacatcatg

SEQ ID NO: 859014 - DNA, 25 bp, Mus musculus
aagtgggacttactcggtttgaatg

SEQ ID NO: 859015 - DNA, 25 bp, Mus musculus
aagtgggacttactgggtttgaatg

SEQ ID NO: 859016 - DNA, 25 bp, Mus musculus
aagtgggagaagctgcagcagctgg

SEQ ID NO: 859017 - DNA, 25 bp, Mus musculus
aagtgggagaaggtgcagcagctgg

SEQ ID NO: 859018 - DNA, 25 bp, Mus musculus
aagtgggctgcgctatcagcctagc

SEQ ID NO: 859019 - DNA, 25 bp, Mus musculus
aagtgggctgcggtatcagcctagc

SEQ ID NO: 859020 - DNA, 25 bp, Mus musculus
aagtggggcctggacgacatcatgt

SEQ ID NO: 859021 - DNA, 25 bp, Mus musculus
aagtggggcctggaggacatcatgt

SEQ ID NO: 859022 - DNA, 25 bp, Mus musculus
aagtgggggccgcccagtcctgtct

SEQ ID NO: 859023 - DNA, 25 bp, Mus musculus
aagtgggggccgccctcctgtctca

SEQ ID NO: 859024 - DNA, 25 bp, Mus musculus
aagtgggggccgccgagtcctgtct

SEQ ID NO: 859025 - DNA, 25 bp, Mus musculus
aagtgggggccgccgtcctgtctca

SEQ ID NO: 859026 - DNA, 25 bp, Mus musculus
aagtggtcattccacaggatgaaga

SEQ ID NO: 859027 - DNA, 25 bp, Mus musculus
aagtggtcattccagaggatgaaga

SEQ ID NO: 859028 - DNA, 25 bp, Mus musculus
aagtggtctgaatcttcctgacggc

SEQ ID NO: 859029 - DNA, 25 bp, Mus musculus
aagtggtctgtatcttcctgacggc

SEQ ID NO: 859030 - DNA, 25 bp, Mus musculus
aagtggttctagcagctcagactga

SEQ ID NO: 859031 - DNA, 25 bp, Mus musculus
aagtggttctagctttaaggaccat

SEQ ID NO: 859032 - DNA, 25 bp, Mus musculus
aagtggttctaggagctcagactga

SEQ ID NO: 859033 - DNA, 25 bp, Mus musculus
aagtggttctaggtttaaggaccat

SEQ ID NO: 859034 - DNA, 25 bp, Mus musculus
aagtggttgattgacaaggagggag

SEQ ID NO: 859035 - DNA, 25 bp, Mus musculus
aagtggttgattgagaaggagggag

SEQ ID NO: 859036 - DNA, 25 bp, Mus musculus
aagtgtatcaaagcaaagtcctgtg

SEQ ID NO: 859037 - DNA, 25 bp, Mus musculus
aagtgtatcacaaagtcctgtgaag

SEQ ID NO: 859038 - DNA, 25 bp, Mus musculus
aagtgtatcagaaagtcctgtgaag

SEQ ID NO: 859039 - DNA, 25 bp, Mus musculus
aagtgtatcatagcaaagtcctgtg

SEQ ID NO: 859040 - DNA, 25 bp, Mus musculus
aagtgtcctcctcgccaatatgtga

SEQ ID NO: 859041 - DNA, 25 bp, Mus musculus
aagtgtcctcctggccaatatgtga

SEQ ID NO: 859042 - DNA, 25 bp, Mus musculus
aagtgtcgccatccttatcaccagg

SEQ ID NO: 859043 - DNA, 25 bp, Mus musculus
aagtgtcgccatgcttatcaccagg

SEQ ID NO: 859044 - DNA, 25 bp, Mus musculus
aagtgtgaagattgtggcatgaatg

SEQ ID NO: 859045 - DNA, 25 bp, Mus musculus
aagtgtgaagtttgtggcatgaatg

SEQ ID NO: 859046 - DNA, 25 bp, Mus musculus
aagtgtgagaataaccatattgcca

SEQ ID NO: 859047 - DNA, 25 bp, Mus musculus
aagtgtgagaataagcatattgcca

SEQ ID NO: 859048 - DNA, 25 bp, Mus musculus
aagtgtgaggacaacagtgtggaaa

SEQ ID NO: 859049 - DNA, 25 bp, Mus musculus
aagtgtgaggacaagagtgtggaaa

SEQ ID NO: 859050 - DNA, 25 bp, Mus musculus
aagtgtgccagccacgtgggcatga

SEQ ID NO: 859051 - DNA, 25 bp, Mus musculus
aagtgtgccagccaggtgggcatga

SEQ ID NO: 859052 - DNA, 25 bp, Mus musculus
aagtgtgcggagccaggagctaaca

SEQ ID NO: 859053 - DNA, 25 bp, Mus musculus
aagtgtgcggaggcaggagctaaca

SEQ ID NO: 859054 - DNA, 25 bp, Mus musculus
aagtgtggcttgctacctggaatgg

SEQ ID NO: 859055 - DNA, 25 bp, Mus musculus
aagtgtggcttggtacctggaatgg

SEQ ID NO: 859056 - DNA, 25 bp, Mus musculus
aagtgtgtggacatcaatgagtgtg

SEQ ID NO: 859057 - DNA, 25 bp, Mus musculus
aagtgtgtggtcatcaatgagtgtg

SEQ ID NO: 859058 - DNA, 25 bp, Mus musculus
aagtgttaagctccaaaaatatgct

SEQ ID NO: 859059 - DNA, 25 bp, Mus musculus
aagtgttaaggtccaaaaatatgct

SEQ ID NO: 859060 - DNA, 25 bp, Mus musculus
aagtgttacaagagacttgcagcac

SEQ ID NO: 859061 - DNA, 25 bp, Mus musculus
aagtgttacaagcagagacttgcag

SEQ ID NO: 859062 - DNA, 25 bp, Mus musculus
aagtgttacaaggagagacttgcag

SEQ ID NO: 859063 - DNA, 25 bp, Mus musculus
aagtgttacaagtgacttgcagcac

SEQ ID NO: 859064 - DNA, 25 bp, Mus musculus
aagtgttcagagccggaaacaactg

SEQ ID NO: 859065 - DNA, 25 bp, Mus musculus
aagtgttcagccctccttctttttg

SEQ ID NO: 859066 - DNA, 25 bp, Mus musculus
aagtgttcaggcctccttctttttg

SEQ ID NO: 859067 - DNA, 25 bp, Mus musculus
aagtgttcagtgccggaaacaactg

SEQ ID NO: 859068 - DNA, 25 bp, Mus musculus
aagtgttggacacattgtaggtgaa

SEQ ID NO: 859069 - DNA, 25 bp, Mus musculus
aagtgttggacagattgtaggtgaa

SEQ ID NO: 859070 - DNA, 25 bp, Mus musculus
aagtgttttcaacactgacgaagag

SEQ ID NO: 859071 - DNA, 25 bp, Mus musculus
aagtgttttcaacagtgacgaagag

SEQ ID NO: 859072 - DNA, 25 bp, Mus musculus
aagttaaaagcaacttctgcaggtg

SEQ ID NO: 859073 - DNA, 25 bp, Mus musculus
aagttaaaaggaacttctgcaggtg

SEQ ID NO: 859074 - DNA, 25 bp, Mus musculus
aagttactgtgagaaaaattgtcag

SEQ ID NO: 859075 - DNA, 25 bp, Mus musculus
aagttactgtgagataaattgtcag

SEQ ID NO: 859076 - DNA, 25 bp, Mus musculus
aagttagaaaagagtatgctgtcaa

SEQ ID NO: 859077 - DNA, 25 bp, Mus musculus
aagttagaaaagcatccgcagacat

SEQ ID NO: 859078 - DNA, 25 bp, Mus musculus
aagttagaaaagccatctgtggcaa

SEQ ID NO: 859079 - DNA, 25 bp, Mus musculus
aagttagaaaaggatccgcagacat

SEQ ID NO: 859080 - DNA, 25 bp, Mus musculus
aagttagaaaaggcatctgtggcaa

SEQ ID NO: 859081 - DNA, 25 bp, Mus musculus
aagttagaaaagtgtatgctgtcaa

SEQ ID NO: 859082 - DNA, 25 bp, Mus musculus
aagttagaccatcgcacccgatggc

SEQ ID NO: 859083 - DNA, 25 bp, Mus musculus
aagttagaccatctggtgaccatca

SEQ ID NO: 859084 - DNA, 25 bp, Mus musculus
aagttagaccatggcacccgatggc

SEQ ID NO: 859085 - DNA, 25 bp, Mus musculus
aagttagaccatgtggtgaccatca

SEQ ID NO: 859086 - DNA, 25 bp, Mus musculus
aagttagcagcactccagggcagta

SEQ ID NO: 859087 - DNA, 25 bp, Mus musculus
aagttagcaggactccagggcagta

SEQ ID NO: 859088 - DNA, 25 bp, Mus musculus
aagttcaaagcgcaacaggtcctgg

SEQ ID NO: 859089 - DNA, 25 bp, Mus musculus
aagttcaaagctctaggactccatc

SEQ ID NO: 859090 - DNA, 25 bp, Mus musculus
aagttcaaagggcaacaggtcctgg

SEQ ID NO: 859091 - DNA, 25 bp, Mus musculus
aagttcaaaggtctaggactccatc

SEQ ID NO: 859092 - DNA, 25 bp, Mus musculus
aagttcaatggccacaagcaccaag

SEQ ID NO: 859093 - DNA, 25 bp, Mus musculus
aagttcaatggccacgtcaggagtt

SEQ ID NO: 859094 - DNA, 25 bp, Mus musculus
aagttcaatggccagaagcaccaag

SEQ ID NO: 859095 - DNA, 25 bp, Mus musculus
aagttcaatggccaggtcaggagtt

SEQ ID NO: 859096 - DNA, 25 bp, Mus musculus
aagttcacaattggagaccacagcc

SEQ ID NO: 859097 - DNA, 25 bp, Mus musculus
aagttcacaattggtgaccacagcc

SEQ ID NO: 859098 - DNA, 25 bp, Mus musculus
aagttcacagagctccagaaagcag

SEQ ID NO: 859099 - DNA, 25 bp, Mus musculus
aagttcacagaggtccagaaagcag

SEQ ID NO: 859100 - DNA, 25 bp, Mus musculus
aagttcacagatgtgaccttgagcc

SEQ ID NO: 859101 - DNA, 25 bp, Mus musculus
aagttcacagcagaaaacatctgaa

SEQ ID NO: 859102 - DNA, 25 bp, Mus musculus
aagttcacaggagaaaacatctgaa

SEQ ID NO: 859103 - DNA, 25 bp, Mus musculus
aagttcacagttgtgaccttgagcc

SEQ ID NO: 859104 - DNA, 25 bp, Mus musculus
aagttcaccaagatatttatcaaca

SEQ ID NO: 859105 - DNA, 25 bp, Mus musculus
aagttcaccaagttatttatcaaca

SEQ ID NO: 859106 - DNA, 25 bp, Mus musculus
aagttcacgcggcacgctcacctgc

SEQ ID NO: 859107 - DNA, 25 bp, Mus musculus
aagttcacgcggcaggctcacctgc

SEQ ID NO: 859108 - DNA, 25 bp, Mus musculus
aagttcactctacagtcttttattc

SEQ ID NO: 859109 - DNA, 25 bp, Mus musculus
aagttcactctagagtcttttattc

SEQ ID NO: 859110 - DNA, 25 bp, Mus musculus
aagttcagtgcgcacgctgatgcag

SEQ ID NO: 859111 - DNA, 25 bp, Mus musculus
aagttcagtgcgcaggctgatgcag

SEQ ID NO: 859112 - DNA, 25 bp, Mus musculus
aagttcatcaaagcagcaattggtt

SEQ ID NO: 859113 - DNA, 25 bp, Mus musculus
aagttcatcaaagctgcaattggtt

SEQ ID NO: 859114 - DNA, 25 bp, Mus musculus
aagttcatgcaagaacctatggaga

SEQ ID NO: 859115 - DNA, 25 bp, Mus musculus
aagttcatgcaagatcctatggaga

SEQ ID NO: 859116 - DNA, 25 bp, Mus musculus
aagttccagaccaacgtgcacagga

SEQ ID NO: 859117 - DNA, 25 bp, Mus musculus
aagttccagaccaaggtgcacagga

SEQ ID NO: 859118 - DNA, 25 bp, Mus musculus
aagttccattacaacaccgaccagg

SEQ ID NO: 859119 - DNA, 25 bp, Mus musculus
aagttccattacaagaccgaccagg

SEQ ID NO: 859120 - DNA, 25 bp, Mus musculus
aagttccgacatcgatatagtgacc

SEQ ID NO: 859121 - DNA, 25 bp, Mus musculus
aagttccgacatggatatagtgacc

SEQ ID NO: 859122 - DNA, 25 bp, Mus musculus
aagttcctggctttgatgaagataa

SEQ ID NO: 859123 - DNA, 25 bp, Mus musculus
aagttcctgggtttgatgaagataa

SEQ ID NO: 859124 - DNA, 25 bp, Mus musculus
aagttcgtggaacgcaagaagaaat

SEQ ID NO: 859125 - DNA, 25 bp, Mus musculus
aagttcgtggaacgggaagacagcg

SEQ ID NO: 859126 - DNA, 25 bp, Mus musculus
aagttcgtggaaggcaagaagaaat

SEQ ID NO: 859127 - DNA, 25 bp, Mus musculus
aagttcgtggaaggggaagacagcg

SEQ ID NO: 859128 - DNA, 25 bp, Mus musculus
aagttctaagagtctcctgtttcgc

SEQ ID NO: 859129 - DNA, 25 bp, Mus musculus
aagttctaagtgtctcctgtttcgc

SEQ ID NO: 859130 - DNA, 25 bp, Mus musculus
aagttctacctgaacgatctgaaaa

SEQ ID NO: 859131 - DNA, 25 bp, Mus musculus
aagttctacctgaaggatctgaaaa

SEQ ID NO: 859132 - DNA, 25 bp, Mus musculus
aagttctcacagcacatgaaggcac

SEQ ID NO: 859133 - DNA, 25 bp, Mus musculus
aagttctcacaggacatgaaggcac

SEQ ID NO: 859134 - DNA, 25 bp, Mus musculus
aagttctctgacaggaatgaatttc

SEQ ID NO: 859135 - DNA, 25 bp, Mus musculus
aagttctctgactggaatgaatttc

SEQ ID NO: 859136 - DNA, 25 bp, Mus musculus
aagttgaaggcaaactatcctgtag

SEQ ID NO: 859137 - DNA, 25 bp, Mus musculus
aagttgaaggcaaagtatcctgtag

SEQ ID NO: 859138 - DNA, 25 bp, Mus musculus
aagttgccaaaaagatgaaaacata

SEQ ID NO: 859139 - DNA, 25 bp, Mus musculus
aagttgccaaaatgatgaaaacata

SEQ ID NO: 859140 - DNA, 25 bp, Mus musculus
aagttgccatcattcgaaagatcta

SEQ ID NO: 859141 - DNA, 25 bp, Mus musculus
aagttgccatcattggaaagatcta

SEQ ID NO: 859142 - DNA, 25 bp, Mus musculus
aagttggacaagatgcaagttctgc

SEQ ID NO: 859143 - DNA, 25 bp, Mus musculus
aagttggacaagttgcaagttctgc

SEQ ID NO: 859144 - DNA, 25 bp, Mus musculus
aagttgtattaacacgtgctaaagt

SEQ ID NO: 859145 - DNA, 25 bp, Mus musculus
aagttgtattaacaggtgctaaagt

SEQ ID NO: 859146 - DNA, 25 bp, Mus musculus
aagttgtcctgtcacctttggccac

SEQ ID NO: 859147 - DNA, 25 bp, Mus musculus
aagttgtcctgtcagctttggccac

SEQ ID NO: 859148 - DNA, 25 bp, Mus musculus
aagttgtgatcttgcaggctggtcc

SEQ ID NO: 859149 - DNA, 25 bp, Mus musculus
aagttgtgatcttggaggctggtcc

SEQ ID NO: 859150 - DNA, 25 bp, Mus musculus
aagtttacagcgattaatacagcaa

SEQ ID NO: 859151 - DNA, 25 bp, Mus musculus
aagtttacagggattaatacagcaa

SEQ ID NO: 859152 - DNA, 25 bp, Mus musculus
aagtttattcagattgatatctgtg

SEQ ID NO: 859153 - DNA, 25 bp, Mus musculus
aagtttattcagtttgatatctgtg

SEQ ID NO: 859154 - DNA, 25 bp, Mus musculus
aagtttccacagagcgtgtaccaga

SEQ ID NO: 859155 - DNA, 25 bp, Mus musculus
aagtttccacagtgcgtgtaccaga

SEQ ID NO: 859156 - DNA, 25 bp, Mus musculus
aagtttcctgagattttgtgtatcc

SEQ ID NO: 859157 - DNA, 25 bp, Mus musculus
aagtttcctgagtttttgtgtatcc

SEQ ID NO: 859158 - DNA, 25 bp, Mus musculus
aagtttcttgcaaacatcactggag

SEQ ID NO: 859159 - DNA, 25 bp, Mus musculus
aagtttcttgcaaagatcactggag

SEQ ID NO: 859160 - DNA, 25 bp, Mus musculus
aagtttgactctcaggagagaatgt

SEQ ID NO: 859161 - DNA, 25 bp, Mus musculus
aagtttgactctgaggagagaatgt

SEQ ID NO: 859162 - DNA, 25 bp, Mus musculus
aagtttgagaagatgtgcaagagtg

SEQ ID NO: 859163 - DNA, 25 bp, Mus musculus
aagtttgagaagttgtgcaagagtg

SEQ ID NO: 859164 - DNA, 25 bp, Mus musculus
aagtttgatgaattcttcaaagaac

SEQ ID NO: 859165 - DNA, 25 bp, Mus musculus
aagtttgatggcaacggtcatgtgg

SEQ ID NO: 859166 - DNA, 25 bp, Mus musculus
aagtttgatggcaacgtgctgtctg

SEQ ID NO: 859167 - DNA, 25 bp, Mus musculus
aagtttgatggcaagggtcatgtgg

SEQ ID NO: 859168 - DNA, 25 bp, Mus musculus
aagtttgatggcaaggtgctgtctg

SEQ ID NO: 859169 - DNA, 25 bp, Mus musculus
aagtttgatgtattcttcaaagaac

SEQ ID NO: 859170 - DNA, 25 bp, Mus musculus
aagtttgcacagcttgtactccagg

SEQ ID NO: 859171 - DNA, 25 bp, Mus musculus
aagtttgcacaggttgtactccagg

SEQ ID NO: 859172 - DNA, 25 bp, Mus musculus
aagtttgcccagagtctctgcctct

SEQ ID NO: 859173 - DNA, 25 bp, Mus musculus
aagtttgcccagtgtctctgcctct

SEQ ID NO: 859174 - DNA, 25 bp, Mus musculus
aagtttgccttacagcacggcatcc

SEQ ID NO: 859175 - DNA, 25 bp, Mus musculus
aagtttgccttagagcacggcatcc

SEQ ID NO: 859176 - DNA, 25 bp, Mus musculus
aagtttggcaagcaagcagaacaag

SEQ ID NO: 859177 - DNA, 25 bp, Mus musculus
aagtttggcaaggaagcagaacaag

SEQ ID NO: 859178 - DNA, 25 bp, Mus musculus
aagtttgggagcaatgcttatccta

SEQ ID NO: 859179 - DNA, 25 bp, Mus musculus
aagtttgggagctatgcttatccta

SEQ ID NO: 859180 - DNA, 25 bp, Mus musculus
aagtttgtaaccatcaaaatcagaa

SEQ ID NO: 859181 - DNA, 25 bp, Mus musculus
aagtttgtaaccatgaaaatcagaa

SEQ ID NO: 859182 - DNA, 25 bp, Mus musculus
aagtttgtcgcttccaaccagagga

SEQ ID NO: 859183 - DNA, 25 bp, Mus musculus
aagtttgtcggttccaaccagagga

SEQ ID NO: 859184 - DNA, 25 bp, Mus musculus
aagttttcacagtacgctattgcag

SEQ ID NO: 859185 - DNA, 25 bp, Mus musculus
aagttttcacagtaggctattgcag

SEQ ID NO: 859186 - DNA, 25 bp, Mus musculus
aagttttcctacagagagaacctgg

SEQ ID NO: 859187 - DNA, 25 bp, Mus musculus
aagttttcctacagtgagaacctgg

SEQ ID NO: 859188 - DNA, 25 bp, Mus musculus
aagttttttgaaattggcagtcatg

SEQ ID NO: 859189 - DNA, 25 bp, Mus musculus
aagttttttgaatttggcagtcatg

SEQ ID NO: 859190 - DNA, 25 bp, Mus musculus
aataaaaagatgacaaatcctagaa

SEQ ID NO: 859191 - DNA, 25 bp, Mus musculus
aataaaaagatgtcaaatcctagaa

SEQ ID NO: 859192 - DNA, 25 bp, Mus musculus
aataaaaaggatgatgcgaaggatg

SEQ ID NO: 859193 - DNA, 25 bp, Mus musculus
aataaaaaggttgatgcgaaggatg

SEQ ID NO: 859194 - DNA, 25 bp, Mus musculus
aataaaaattcaccatcctcctgtg

SEQ ID NO: 859195 - DNA, 25 bp, Mus musculus
aataaaaattcagcatcctcctgtg

SEQ ID NO: 859196 - DNA, 25 bp, Mus musculus
aataaaacaacacattgttcagcta

SEQ ID NO: 859197 - DNA, 25 bp, Mus musculus
aataaaacaacagattgttcagcta

SEQ ID NO: 859198 - DNA, 25 bp, Mus musculus
aataaaagtgctgaagtgacttcat

SEQ ID NO: 859199 - DNA, 25 bp, Mus musculus
aataaaagtgctgatgtgacttcat

SEQ ID NO: 859200 - DNA, 25 bp, Mus musculus
aataaaatgcatcctattaatggga

SEQ ID NO: 859201 - DNA, 25 bp, Mus musculus
aataaaatgcatgctattaatggga

SEQ ID NO: 859202 - DNA, 25 bp, Mus musculus
aataaacatcttgacatcttcaact

SEQ ID NO: 859203 - DNA, 25 bp, Mus musculus
aataaacatcttgagatcttcaact

SEQ ID NO: 859204 - DNA, 25 bp, Mus musculus
aataaacttaaacccagccaagcca

SEQ ID NO: 859205 - DNA, 25 bp, Mus musculus
aataaacttaaagccagccaagcca

SEQ ID NO: 859206 - DNA, 25 bp, Mus musculus
aataaactttcttccatgatagagt

SEQ ID NO: 859207 - DNA, 25 bp, Mus musculus
aataaactttcttcgatgatagagt

SEQ ID NO: 859208 - DNA, 25 bp, Mus musculus
aataaagacaccacagtgctacaag

SEQ ID NO: 859209 - DNA, 25 bp, Mus musculus
aataaagacacctcagtgctacaag

SEQ ID NO: 859210 - DNA, 25 bp, Mus musculus
aataaagagcagctgtcacaactgc

SEQ ID NO: 859211 - DNA, 25 bp, Mus musculus
aataaagagcaggtgtcacaactgc

SEQ ID NO: 859212 - DNA, 25 bp, Mus musculus
aataaagatatgagtgaagacaatg

SEQ ID NO: 859213 - DNA, 25 bp, Mus musculus
aataaagatatgtgtgaagacaatg

SEQ ID NO: 859214 - DNA, 25 bp, Mus musculus
aataaagccatgaacatccgagtct

SEQ ID NO: 859215 - DNA, 25 bp, Mus musculus
aataaagccatgtacatccgagtct

SEQ ID NO: 859216 - DNA, 25 bp, Mus musculus
aataaaggacaacgagcaagtaggc

SEQ ID NO: 859217 - DNA, 25 bp, Mus musculus
aataaaggacaaggagcaagtaggc

SEQ ID NO: 859218 - DNA, 25 bp, Mus musculus
aataaaggaccgagcattgaagtga

SEQ ID NO: 859219 - DNA, 25 bp, Mus musculus
aataaaggaccgaggattgaagtga

SEQ ID NO: 859220 - DNA, 25 bp, Mus musculus
aataaaggcacttccgacagctcct

SEQ ID NO: 859221 - DNA, 25 bp, Mus musculus
aataaaggcacttcggacagctcct

SEQ ID NO: 859222 - DNA, 25 bp, Mus musculus
aataacaaatagaacacaggataca

SEQ ID NO: 859223 - DNA, 25 bp, Mus musculus
aataacaaatagtacacaggataca

SEQ ID NO: 859224 - DNA, 25 bp, Mus musculus
aataacaaggaagacggagctagca

SEQ ID NO: 859225 - DNA, 25 bp, Mus musculus
aataacaaggaagagggagctagca

SEQ ID NO: 859226 - DNA, 25 bp, Mus musculus
aataaccaagaagcctcaatgtgta

SEQ ID NO: 859227 - DNA, 25 bp, Mus musculus
aataaccaagtagcctcaatgtgta

SEQ ID NO: 859228 - DNA, 25 bp, Mus musculus
aataacccagaggtaatgctagaaa

SEQ ID NO: 859229 - DNA, 25 bp, Mus musculus
aataacccagtggtaatgctagaaa

SEQ ID NO: 859230 - DNA, 25 bp, Mus musculus
aataacttggacctacagccagtca

SEQ ID NO: 859231 - DNA, 25 bp, Mus musculus
aataacttggtcctacagccagtca

SEQ ID NO: 859232 - DNA, 25 bp, Mus musculus
aataagatgcacaccatgaatgggt

SEQ ID NO: 859233 - DNA, 25 bp, Mus musculus
aataagatgcactccatgaatgggt

SEQ ID NO: 859234 - DNA, 25 bp, Mus musculus
aataagattgagaccactgttcctc

SEQ ID NO: 859235 - DNA, 25 bp, Mus musculus
aataagattgagtccactgttcctc

SEQ ID NO: 859236 - DNA, 25 bp, Mus musculus
aataagcacgctaagcagatccagg

SEQ ID NO: 859237 - DNA, 25 bp, Mus musculus
aataagcacggtaagcagatccagg

SEQ ID NO: 859238 - DNA, 25 bp, Mus musculus
aataagctacttcaacacagcttca

SEQ ID NO: 859239 - DNA, 25 bp, Mus musculus
aataagctacttgaacacagcttca

SEQ ID NO: 859240 - DNA, 25 bp, Mus musculus
aataagcttgctgacactctccgct

SEQ ID NO: 859241 - DNA, 25 bp, Mus musculus
aataagcttgctgacggtttcccag

SEQ ID NO: 859242 - DNA, 25 bp, Mus musculus
aataagcttgctgagactctccgct

SEQ ID NO: 859243 - DNA, 25 bp, Mus musculus
aataagcttgctgagggtttcccag

SEQ ID NO: 859244 - DNA, 25 bp, Mus musculus
aataaggagaagctatacatcatag

SEQ ID NO: 859245 - DNA, 25 bp, Mus musculus
aataaggagaaggtatacatcatag

SEQ ID NO: 859246 - DNA, 25 bp, Mus musculus
aataataaaaagagctctatgccca

SEQ ID NO: 859247 - DNA, 25 bp, Mus musculus
aataataaaaagcatgatgcgaagg

SEQ ID NO: 859248 - DNA, 25 bp, Mus musculus
aataataaaaaggatgatgcgaagg

SEQ ID NO: 859249 - DNA, 25 bp, Mus musculus
aataataaaaagtgctctatgccca

SEQ ID NO: 859250 - DNA, 25 bp, Mus musculus
aataatcaaagaacttgtttttagc

SEQ ID NO: 859251 - DNA, 25 bp, Mus musculus
aataatcaaagatcttgtttttagc

SEQ ID NO: 859252 - DNA, 25 bp, Mus musculus
aataatgcagatgctgaggacaagt

SEQ ID NO: 859253 - DNA, 25 bp, Mus musculus
aataatgcagttgctgaggacaagt

SEQ ID NO: 859254 - DNA, 25 bp, Mus musculus
aataatggtgatcgtcttctccatc

SEQ ID NO: 859255 - DNA, 25 bp, Mus musculus
aataatggtgatggtcttctccatc

SEQ ID NO: 859256 - DNA, 25 bp, Mus musculus
aataattatttgcctgatgaagaat

SEQ ID NO: 859257 - DNA, 25 bp, Mus musculus
aataattatttggctgatgaagaat

SEQ ID NO: 859258 - DNA, 25 bp, Mus musculus
aataatttagcggctgctgtgttga

SEQ ID NO: 859259 - DNA, 25 bp, Mus musculus
aataatttaggggctgctgtgttga

SEQ ID NO: 859260 - DNA, 25 bp, Mus musculus
aatacaaataaagagagacaaattg

SEQ ID NO: 859261 - DNA, 25 bp, Mus musculus
aatacaaatatagagagacaaattg

SEQ ID NO: 859262 - DNA, 25 bp, Mus musculus
aatacacgtctgcccgtgtgctgat

SEQ ID NO: 859263 - DNA, 25 bp, Mus musculus
aatacacgtctgccggtgtgctgat

SEQ ID NO: 859264 - DNA, 25 bp, Mus musculus
aatacagaagctgacgtttaagagt

SEQ ID NO: 859265 - DNA, 25 bp, Mus musculus
aatacagaagctgaggtttaagagt

SEQ ID NO: 859266 - DNA, 25 bp, Mus musculus
aatacagcaaataacgagacagtga

SEQ ID NO: 859267 - DNA, 25 bp, Mus musculus
aatacagcaaataaggagacagtga

SEQ ID NO: 859268 - DNA, 25 bp, Mus musculus
aatacagcagcccacgacttggagt

SEQ ID NO: 859269 - DNA, 25 bp, Mus musculus
aatacagcagcccaggacttggagt

SEQ ID NO: 859270 - DNA, 25 bp, Mus musculus
aatacagtggaacgttacagtgctc

SEQ ID NO: 859271 - DNA, 25 bp, Mus musculus
aatacagtggaaggttacagtgctc

SEQ ID NO: 859272 - DNA, 25 bp, Mus musculus
aatacatgtcaacatgtgaatgagt

SEQ ID NO: 859273 - DNA, 25 bp, Mus musculus
aatacatgtcaacatgtggatgagt

SEQ ID NO: 859274 - DNA, 25 bp, Mus musculus
aatacatgtcaaccatcagtgaaca

SEQ ID NO: 859275 - DNA, 25 bp, Mus musculus
aatacatgtcaagatgtgaatgagt

SEQ ID NO: 859276 - DNA, 25 bp, Mus musculus
aatacatgtcaagatgtggatgagt

SEQ ID NO: 859277 - DNA, 25 bp, Mus musculus
aatacatgtcaagcatcagtgaaca

SEQ ID NO: 859278 - DNA, 25 bp, Mus musculus
aatacattttcacggacaagccctc

SEQ ID NO: 859279 - DNA, 25 bp, Mus musculus
aatacattttcagggacaagccctc

SEQ ID NO: 859280 - DNA, 25 bp, Mus musculus
aataccacaacacaacaatcttggg

SEQ ID NO: 859281 - DNA, 25 bp, Mus musculus
aataccacaacacatcaatcttggg

SEQ ID NO: 859282 - DNA, 25 bp, Mus musculus
aataccagataaaaaatgacaccta

SEQ ID NO: 859283 - DNA, 25 bp, Mus musculus
aataccagataataaatgacaccta

SEQ ID NO: 859284 - DNA, 25 bp, Mus musculus
aataccgagaccagtattttgaagg

SEQ ID NO: 859285 - DNA, 25 bp, Mus musculus
aataccgagacctgtattttgaagg

SEQ ID NO: 859286 - DNA, 25 bp, Mus musculus
aataccgtagatgggtacagtagct

SEQ ID NO: 859287 - DNA, 25 bp, Mus musculus
aataccgtagttgggtacagtagct

SEQ ID NO: 859288 - DNA, 25 bp, Mus musculus
aatacctgaaacccttcgcatcctc

SEQ ID NO: 859289 - DNA, 25 bp, Mus musculus
aatacctgaaacgcttcgcatcctc

SEQ ID NO: 859290 - DNA, 25 bp, Mus musculus
aatacctggcatccagtctgaaatg

SEQ ID NO: 859291 - DNA, 25 bp, Mus musculus
aatacctggcatcctgtctgaaatg

SEQ ID NO: 859292 - DNA, 25 bp, Mus musculus
aatacctgtgtctgcacggaaggag

SEQ ID NO: 859293 - DNA, 25 bp, Mus musculus
aatacctgtgtctggacggaaggag

SEQ ID NO: 859294 - DNA, 25 bp, Mus musculus
aataccttgaatcactgaaaccatt

SEQ ID NO: 859295 - DNA, 25 bp, Mus musculus
aataccttgaatcagtgaaaccatt

SEQ ID NO: 859296 - DNA, 25 bp, Mus musculus
aatacgagtgtcgacattcctaatc

SEQ ID NO: 859297 - DNA, 25 bp, Mus musculus
aatacgagtgtcgagattcctaatc

SEQ ID NO: 859298 - DNA, 25 bp, Mus musculus
aatacgtacatctccgtacgaataa

SEQ ID NO: 859299 - DNA, 25 bp, Mus musculus
aatacgtacatctcggtacgaataa

SEQ ID NO: 859300 - DNA, 25 bp, Mus musculus
aatacgttcgcaactcacggatgat

SEQ ID NO: 859301 - DNA, 25 bp, Mus musculus
aatacgttcgcatctcacggatgat

SEQ ID NO: 859302 - DNA, 25 bp, Mus musculus
aatactaagaggatcttatttcact

SEQ ID NO: 859303 - DNA, 25 bp, Mus musculus
aatactaagaggttcttatttcact

SEQ ID NO: 859304 - DNA, 25 bp, Mus musculus
aatactccagagcatgcaaaagtca

SEQ ID NO: 859305 - DNA, 25 bp, Mus musculus
aatactccagaggatgcaaaagtca

SEQ ID NO: 859306 - DNA, 25 bp, Mus musculus
aatactgaagcataagaaactgatc

SEQ ID NO: 859307 - DNA, 25 bp, Mus musculus
aatactgaaggataagaaactgatc

SEQ ID NO: 859308 - DNA, 25 bp, Mus musculus
aatactgatacacgcgctgcagctg

SEQ ID NO: 859309 - DNA, 25 bp, Mus musculus
aatactgatacaggcgctgcagctg

SEQ ID NO: 859310 - DNA, 25 bp, Mus musculus
aatacttcttcctgatcggaccgcc

SEQ ID NO: 859311 - DNA, 25 bp, Mus musculus
aatacttcttcctgttcggaccgcc

SEQ ID NO: 859312 - DNA, 25 bp, Mus musculus
aatagaaaataacacaaatggaatc

SEQ ID NO: 859313 - DNA, 25 bp, Mus musculus
aatagaaaattacacaaatggaatc

SEQ ID NO: 859314 - DNA, 25 bp, Mus musculus
aatagaaggaagctgagcagtgagg

SEQ ID NO: 859315 - DNA, 25 bp, Mus musculus
aatagaaggaaggtgagcagtgagg

SEQ ID NO: 859316 - DNA, 25 bp, Mus musculus
aatagagaaagacgcagaaatcctg

SEQ ID NO: 859317 - DNA, 25 bp, Mus musculus
aatagagaaagaggcagaaatcctg

SEQ ID NO: 859318 - DNA, 25 bp, Mus musculus
aatagataatcgtatatttgttcaa

SEQ ID NO: 859319 - DNA, 25 bp, Mus musculus
aatagataatggtatatttgttcaa

SEQ ID NO: 859320 - DNA, 25 bp, Mus musculus
aatagatgcaaacgcagaagaagag

SEQ ID NO: 859321 - DNA, 25 bp, Mus musculus
aatagatgcaaaggcagaagaagag

SEQ ID NO: 859322 - DNA, 25 bp, Mus musculus
aatagcacagaacttcccagcaaac

SEQ ID NO: 859323 - DNA, 25 bp, Mus musculus
aatagcacagcaatgattggcagca

SEQ ID NO: 859324 - DNA, 25 bp, Mus musculus
aatagcacaggaatgattggcagca

SEQ ID NO: 859325 - DNA, 25 bp, Mus musculus
aatagcacagtacttcccagcaaac

SEQ ID NO: 859326 - DNA, 25 bp, Mus musculus
aatagccttggataagtggttagat

SEQ ID NO: 859327 - DNA, 25 bp, Mus musculus
aatagccttggatatgtggttagat

SEQ ID NO: 859328 - DNA, 25 bp, Mus musculus
aataggatccctcgagtccctggct

SEQ ID NO: 859329 - DNA, 25 bp, Mus musculus
aataggatccctggagtccctggct

SEQ ID NO: 859330 - DNA, 25 bp, Mus musculus
aataggattccacgagtccctggct

SEQ ID NO: 859331 - DNA, 25 bp, Mus musculus
aataggattccaggagtccctggct

SEQ ID NO: 859332 - DNA, 25 bp, Mus musculus
aataggcatgagattgctgttatgt

SEQ ID NO: 859333 - DNA, 25 bp, Mus musculus
aataggcatgagtttgctgttatgt

SEQ ID NO: 859334 - DNA, 25 bp, Mus musculus
aatagtacagccagtgggaactcac

SEQ ID NO: 859335 - DNA, 25 bp, Mus musculus
aatagtacaggcagtgggaactcac

SEQ ID NO: 859336 - DNA, 25 bp, Mus musculus
aatagtcgcattcgttctattgtgg

SEQ ID NO: 859337 - DNA, 25 bp, Mus musculus
aatagtcgcattggttctattgtgg

SEQ ID NO: 859338 - DNA, 25 bp, Mus musculus
aatagtctgccactgaaaggattcc

SEQ ID NO: 859339 - DNA, 25 bp, Mus musculus
aatagtctgccagtgaaaggattcc

SEQ ID NO: 859340 - DNA, 25 bp, Mus musculus
aatagtgaagcagagccatgaagaa

SEQ ID NO: 859341 - DNA, 25 bp, Mus musculus
aatagtgaaggagagccatgaagaa

SEQ ID NO: 859342 - DNA, 25 bp, Mus musculus
aatagttaagcgtcgtgcatctctc

SEQ ID NO: 859343 - DNA, 25 bp, Mus musculus
aatagttaagggtcgtgcatctctc

SEQ ID NO: 859344 - DNA, 25 bp, Mus musculus
aatagttcagacatcctacaggctt

SEQ ID NO: 859345 - DNA, 25 bp, Mus musculus
aatagttcagtcatcctacaggctt

SEQ ID NO: 859346 - DNA, 25 bp, Mus musculus
aatagttttgccttggatgccatag

SEQ ID NO: 859347 - DNA, 25 bp, Mus musculus
aatagttttggcttggatgccatag

SEQ ID NO: 859348 - DNA, 25 bp, Mus musculus
aatataaaagctgacaggagacatg

SEQ ID NO: 859349 - DNA, 25 bp, Mus musculus
aatataaaaggtgacaggagacatg

SEQ ID NO: 859350 - DNA, 25 bp, Mus musculus
aatatacaagcctcaaactcagaaa

SEQ ID NO: 859351 - DNA, 25 bp, Mus musculus
aatatacaaggctcaaactcagaaa

SEQ ID NO: 859352 - DNA, 25 bp, Mus musculus
aatatagtcaaagactgtgttgatg

SEQ ID NO: 859353 - DNA, 25 bp, Mus musculus
aatatagtcaaagagtgtgttgatg

SEQ ID NO: 859354 - DNA, 25 bp, Mus musculus
aatatataaagacgcttgcacagca

SEQ ID NO: 859355 - DNA, 25 bp, Mus musculus
aatatataaagaggcttgcacagca

SEQ ID NO: 859356 - DNA, 25 bp, Mus musculus
aatatatcagaccacgacggagcgg

SEQ ID NO: 859357 - DNA, 25 bp, Mus musculus
aatatatcagtccacgacggagcgg

SEQ ID NO: 859358 - DNA, 25 bp, Mus musculus
aatatatctccgagaacattcttgt

SEQ ID NO: 859359 - DNA, 25 bp, Mus musculus
aatatatctcggagaacattcttgt

SEQ ID NO: 859360 - DNA, 25 bp, Mus musculus
aatatcaaggcgctgagaaagaatg

SEQ ID NO: 859361 - DNA, 25 bp, Mus musculus
aatatcaaggggctgagaaagaatg

SEQ ID NO: 859362 - DNA, 25 bp, Mus musculus
aatatcactgagaaaaacattgcaa

SEQ ID NO: 859363 - DNA, 25 bp, Mus musculus
aatatcactgagcagaaaaacattg

SEQ ID NO: 859364 - DNA, 25 bp, Mus musculus
aatatcactgaggagaaaaacattg

SEQ ID NO: 859365 - DNA, 25 bp, Mus musculus
aatatcactgagtaaaacattgcaa

SEQ ID NO: 859366 - DNA, 25 bp, Mus musculus
aatatcagtgaacggtgacaaaggt

SEQ ID NO: 859367 - DNA, 25 bp, Mus musculus
aatatcagtgaagggtgacaaaggt

SEQ ID NO: 859368 - DNA, 25 bp, Mus musculus
aatatcagtgccatcacatcgacga

SEQ ID NO: 859369 - DNA, 25 bp, Mus musculus
aatatcagtgccatgacatcgacga

SEQ ID NO: 859370 - DNA, 25 bp, Mus musculus
aatatcatatctcgccatcagacac

SEQ ID NO: 859371 - DNA, 25 bp, Mus musculus
aatatcatatctggccatcagacac

SEQ ID NO: 859372 - DNA, 25 bp, Mus musculus
aatatcatcattgcaggtcccccag

SEQ ID NO: 859373 - DNA, 25 bp, Mus musculus
aatatcatcattgctggtcccccag

SEQ ID NO: 859374 - DNA, 25 bp, Mus musculus
aatatcatccagctcggtggcacca

SEQ ID NO: 859375 - DNA, 25 bp, Mus musculus
aatatcatccagctgggtggcacca

SEQ ID NO: 859376 - DNA, 25 bp, Mus musculus
aatatcatggtgcactaccatgcac

SEQ ID NO: 859377 - DNA, 25 bp, Mus musculus
aatatcatggtgcagtaccatgcac

SEQ ID NO: 859378 - DNA, 25 bp, Mus musculus
aatatctgacctctgctgagcctac

SEQ ID NO: 859379 - DNA, 25 bp, Mus musculus
aatatctgacctgtgctgagcctac

SEQ ID NO: 859380 - DNA, 25 bp, Mus musculus
aatatctggaagacttttacacttt

SEQ ID NO: 859381 - DNA, 25 bp, Mus musculus
aatatctggaagtcttttacacttt

SEQ ID NO: 859382 - DNA, 25 bp, Mus musculus
aatatcttctcccacattacctccc

SEQ ID NO: 859383 - DNA, 25 bp, Mus musculus
aatatcttctcccagattacctccc

SEQ ID NO: 859384 - DNA, 25 bp, Mus musculus
aatatcttgaagcacgtggactccc

SEQ ID NO: 859385 - DNA, 25 bp, Mus musculus
aatatcttgaagcaggtggactccc

SEQ ID NO: 859386 - DNA, 25 bp, Mus musculus
aatatctttcttggagagaaagcag

SEQ ID NO: 859387 - DNA, 25 bp, Mus musculus
aatatctttcttggtgagaaagcag

SEQ ID NO: 859388 - DNA, 25 bp, Mus musculus
aatatgaaaaagctggagaactgta

SEQ ID NO: 859389 - DNA, 25 bp, Mus musculus
aatatgaaaaaggtggagaactgta

SEQ ID NO: 859390 - DNA, 25 bp, Mus musculus
aatatgaatgaaagtgacgctcatg

SEQ ID NO: 859391 - DNA, 25 bp, Mus musculus
aatatgaatgaatgtgacgctcatg

SEQ ID NO: 859392 - DNA, 25 bp, Mus musculus
aatatgacaactcttggctggctct

SEQ ID NO: 859393 - DNA, 25 bp, Mus musculus
aatatgacaactgttggctggctct

SEQ ID NO: 859394 - DNA, 25 bp, Mus musculus
aatatgacagagctgtccatgctgc

SEQ ID NO: 859395 - DNA, 25 bp, Mus musculus
aatatgacagtgctgtccatgctgc

SEQ ID NO: 859396 - DNA, 25 bp, Mus musculus
aatatgactgaaacggcatggaccg

SEQ ID NO: 859397 - DNA, 25 bp, Mus musculus
aatatgactgcccgaagcctttccc

SEQ ID NO: 859398 - DNA, 25 bp, Mus musculus
aatatgactggccgaagcctttccc

SEQ ID NO: 859399 - DNA, 25 bp, Mus musculus
aatatgactgtaacggcatggaccg

SEQ ID NO: 859400 - DNA, 25 bp, Mus musculus
aatatgcaagtggacgtgaagtatt

SEQ ID NO: 859401 - DNA, 25 bp, Mus musculus
aatatgcaagtggaggtgaagtatt

SEQ ID NO: 859402 - DNA, 25 bp, Mus musculus
aatatgccaagactttatacctgct

SEQ ID NO: 859403 - DNA, 25 bp, Mus musculus
aatatgccaagagtttatacctgct

SEQ ID NO: 859404 - DNA, 25 bp, Mus musculus
aatatgcttgcaaggaccttcgtga

SEQ ID NO: 859405 - DNA, 25 bp, Mus musculus
aatatgcttgcatggaccttcgtga

SEQ ID NO: 859406 - DNA, 25 bp, Mus musculus
aatatggttttgctgtacagagagg

SEQ ID NO: 859407 - DNA, 25 bp, Mus musculus
aatatggttttggtgtacagagagg

SEQ ID NO: 859408 - DNA, 25 bp, Mus musculus
aatatgtcaacacaattccagaggt

SEQ ID NO: 859409 - DNA, 25 bp, Mus musculus
aatatgtcaacaccccagaaggctc

SEQ ID NO: 859410 - DNA, 25 bp, Mus musculus
aatatgtcaacacgacccacagtta

SEQ ID NO: 859411 - DNA, 25 bp, Mus musculus
aatatgtcaacagaattccagaggt

SEQ ID NO: 859412 - DNA, 25 bp, Mus musculus
aatatgtcaacagcccagaaggctc

SEQ ID NO: 859413 - DNA, 25 bp, Mus musculus
aatatgtcaacaggacccacagtta

SEQ ID NO: 859414 - DNA, 25 bp, Mus musculus
aatattcaagcaatggtgattgttc

SEQ ID NO: 859415 - DNA, 25 bp, Mus musculus
aatattcaaggaatggtgattgttc

SEQ ID NO: 859416 - DNA, 25 bp, Mus musculus
aatattccagaaaccccacctcctg

SEQ ID NO: 859417 - DNA, 25 bp, Mus musculus
aatattccagtaaccccacctcctg

SEQ ID NO: 859418 - DNA, 25 bp, Mus musculus
aatattccataacatcatctttaga

SEQ ID NO: 859419 - DNA, 25 bp, Mus musculus
aatattccataagatcatctttaga

SEQ ID NO: 859420 - DNA, 25 bp, Mus musculus
aatattccccgaagccgagtgctgg

SEQ ID NO: 859421 - DNA, 25 bp, Mus musculus
aatattccccgatgccgagtgctgg

SEQ ID NO: 859422 - DNA, 25 bp, Mus musculus
aatattctcccacagatcttcaaaa

SEQ ID NO: 859423 - DNA, 25 bp, Mus musculus
aatattctcccagagatcttcaaaa

SEQ ID NO: 859424 - DNA, 25 bp, Mus musculus
aatattgaacagctcggaaggagac

SEQ ID NO: 859425 - DNA, 25 bp, Mus musculus
aatattgaacagctgggaaggagac

SEQ ID NO: 859426 - DNA, 25 bp, Mus musculus
aatattgagcagattctcgactatc

SEQ ID NO: 859427 - DNA, 25 bp, Mus musculus
aatattgagcagtttctcgactatc

SEQ ID NO: 859428 - DNA, 25 bp, Mus musculus
aatatttcttggctggaatataaat

SEQ ID NO: 859429 - DNA, 25 bp, Mus musculus
aatatttcttgggtggaatataaat

SEQ ID NO: 859430 - DNA, 25 bp, Mus musculus
aatatttgagaatcaagaccggaag

SEQ ID NO: 859431 - DNA, 25 bp, Mus musculus
aatatttgagcagaatcaagaccgg

SEQ ID NO: 859432 - DNA, 25 bp, Mus musculus
aatatttgagcataacagcttcgag

SEQ ID NO: 859433 - DNA, 25 bp, Mus musculus
aatatttgaggagaatcaagaccgg

SEQ ID NO: 859434 - DNA, 25 bp, Mus musculus
aatatttgaggataacagcttcgag

SEQ ID NO: 859435 - DNA, 25 bp, Mus musculus
aatatttgagtatcaagaccggaag

SEQ ID NO: 859436 - DNA, 25 bp, Mus musculus
aatcaaaaatcacataacaactatt

SEQ ID NO: 859437 - DNA, 25 bp, Mus musculus
aatcaaaaatcacataagaaacctg

SEQ ID NO: 859438 - DNA, 25 bp, Mus musculus
aatcaaaaatcagataacaactatt

SEQ ID NO: 859439 - DNA, 25 bp, Mus musculus
aatcaaaaatcagataagaaacctg

SEQ ID NO: 859440 - DNA, 25 bp, Mus musculus
aatcaaaacttccgatgtgacctcc

SEQ ID NO: 859441 - DNA, 25 bp, Mus musculus
aatcaaaacttcggatgtgacctcc

SEQ ID NO: 859442 - DNA, 25 bp, Mus musculus
aatcaaagagatggatctgtccgtg

SEQ ID NO: 859443 - DNA, 25 bp, Mus musculus
aatcaaagagcaaagcaagcctgaa

SEQ ID NO: 859444 - DNA, 25 bp, Mus musculus
aatcaaagaggaaagcaagcctgaa

SEQ ID NO: 859445 - DNA, 25 bp, Mus musculus
aatcaaagagttggatctgtccgtg

SEQ ID NO: 859446 - DNA, 25 bp, Mus musculus
aatcaaagcgacaggcatctggagg

SEQ ID NO: 859447 - DNA, 25 bp, Mus musculus
aatcaaagcgactggcatctggagg

SEQ ID NO: 859448 - DNA, 25 bp, Mus musculus
aatcaaatggacttcccagctggca

SEQ ID NO: 859449 - DNA, 25 bp, Mus musculus
aatcaaatggcacaggtcacttttg

SEQ ID NO: 859450 - DNA, 25 bp, Mus musculus
aatcaaatggcactatatatgtttt

SEQ ID NO: 859451 - DNA, 25 bp, Mus musculus
aatcaaatggcagaggtcacttttg

SEQ ID NO: 859452 - DNA, 25 bp, Mus musculus
aatcaaatggcagtatatatgtttt

SEQ ID NO: 859453 - DNA, 25 bp, Mus musculus
aatcaaatggtcttcccagctggca

SEQ ID NO: 859454 - DNA, 25 bp, Mus musculus
aatcaagagagcaacctcatcattc

SEQ ID NO: 859455 - DNA, 25 bp, Mus musculus
aatcaagagagcaagctcatcattc

SEQ ID NO: 859456 - DNA, 25 bp, Mus musculus
aatcaagagaggagtgtcaatgagt

SEQ ID NO: 859457 - DNA, 25 bp, Mus musculus
aatcaagagaggtgtgtcaatgagt

SEQ ID NO: 859458 - DNA, 25 bp, Mus musculus
aatcaagcagcaacctgggcagtct

SEQ ID NO: 859459 - DNA, 25 bp, Mus musculus
aatcaagcaggaacctgggcagtct

SEQ ID NO: 859460 - DNA, 25 bp, Mus musculus
aatcaagcgagacgatgaggaggaa

SEQ ID NO: 859461 - DNA, 25 bp, Mus musculus
aatcaagcgagaggatgaggaggaa

SEQ ID NO: 859462 - DNA, 25 bp, Mus musculus
aatcaaggagcttgtagtgaagaat

SEQ ID NO: 859463 - DNA, 25 bp, Mus musculus
aatcaaggaggttgtagtgaagaat

SEQ ID NO: 859464 - DNA, 25 bp, Mus musculus
aatcaaggtctgcatattgaagtaa

SEQ ID NO: 859465 - DNA, 25 bp, Mus musculus
aatcaaggtctgctgagaagctgga

SEQ ID NO: 859466 - DNA, 25 bp, Mus musculus
aatcaaggtctggatattgaagtaa

SEQ ID NO: 859467 - DNA, 25 bp, Mus musculus
aatcaaggtctggtgagaagctgga

SEQ ID NO: 859468 - DNA, 25 bp, Mus musculus
aatcacaaaaatataattggccttt

SEQ ID NO: 859469 - DNA, 25 bp, Mus musculus
aatcacaaaaatttaattggccttt

SEQ ID NO: 859470 - DNA, 25 bp, Mus musculus
aatcacaacttgattgaacgaagaa

SEQ ID NO: 859471 - DNA, 25 bp, Mus musculus
aatcacaacttgtttgaacgaagaa

SEQ ID NO: 859472 - DNA, 25 bp, Mus musculus
aatcacactattcggatggaagact

SEQ ID NO: 859473 - DNA, 25 bp, Mus musculus
aatcacactattcgtcctgagttca

SEQ ID NO: 859474 - DNA, 25 bp, Mus musculus
aatcacactattgggatggaagact

SEQ ID NO: 859475 - DNA, 25 bp, Mus musculus
aatcacactattggtcctgagttca

SEQ ID NO: 859476 - DNA, 25 bp, Mus musculus
aatcacagatcgaacaatgttgcaa

SEQ ID NO: 859477 - DNA, 25 bp, Mus musculus
aatcacagatggaacaatgttgcaa

SEQ ID NO: 859478 - DNA, 25 bp, Mus musculus
aatcacagattagcagttattttaa

SEQ ID NO: 859479 - DNA, 25 bp, Mus musculus
aatcacagattagctgttattttaa

SEQ ID NO: 859480 - DNA, 25 bp, Mus musculus
aatcacatctcacacactgtggata

SEQ ID NO: 859481 - DNA, 25 bp, Mus musculus
aatcacatctcacagactgtggata

SEQ ID NO: 859482 - DNA, 25 bp, Mus musculus
aatcaccgctcacatgaagaacgca

SEQ ID NO: 859483 - DNA, 25 bp, Mus musculus
aatcaccgctgacatgaagaacgca

SEQ ID NO: 859484 - DNA, 25 bp, Mus musculus
aatcaccggcgacgagtctgcaggt

SEQ ID NO: 859485 - DNA, 25 bp, Mus musculus
aatcaccggcgaggagtctgcaggt

SEQ ID NO: 859486 - DNA, 25 bp, Mus musculus
aatcacgaagatagcctgtattccc

SEQ ID NO: 859487 - DNA, 25 bp, Mus musculus
aatcacgaagttagcctgtattccc

SEQ ID NO: 859488 - DNA, 25 bp, Mus musculus
aatcacgccaagagcatcgtgcagt

SEQ ID NO: 859489 - DNA, 25 bp, Mus musculus
aatcacgccaagtgcatcgtgcagt

SEQ ID NO: 859490 - DNA, 25 bp, Mus musculus
aatcacgccagtaaagtagacttcg

SEQ ID NO: 859491 - DNA, 25 bp, Mus musculus
aatcacgccagtgcaaaagtagact

SEQ ID NO: 859492 - DNA, 25 bp, Mus musculus
aatcacgccagtgctaaagtagact

SEQ ID NO: 859493 - DNA, 25 bp, Mus musculus
aatcacgccagttaagtagacttcg

SEQ ID NO: 859494 - DNA, 25 bp, Mus musculus
aatcactccccacccgtgggaatgg

SEQ ID NO: 859495 - DNA, 25 bp, Mus musculus
aatcactccccagccgtgggaatgg

SEQ ID NO: 859496 - DNA, 25 bp, Mus musculus
aatcactgcccacgaagggaagatt

SEQ ID NO: 859497 - DNA, 25 bp, Mus musculus
aatcactgcccaggaagggaagatt

SEQ ID NO: 859498 - DNA, 25 bp, Mus musculus
aatcacttcaagctggacctggtgt

SEQ ID NO: 859499 - DNA, 25 bp, Mus musculus
aatcacttcaaggtggacctggtgt

SEQ ID NO: 859500 - DNA, 25 bp, Mus musculus
aatcagaaaagactctcattactaa

SEQ ID NO: 859501 - DNA, 25 bp, Mus musculus
aatcagaaaagactgtcattactaa

SEQ ID NO: 859502 - DNA, 25 bp, Mus musculus
aatcagaatcacaaccagccagacc

SEQ ID NO: 859503 - DNA, 25 bp, Mus musculus
aatcagaatcactaccagccagacc

SEQ ID NO: 859504 - DNA, 25 bp, Mus musculus
aatcagacagcaatctgcttgaata

SEQ ID NO: 859505 - DNA, 25 bp, Mus musculus
aatcagacagctgatttgaactgtg

SEQ ID NO: 859506 - DNA, 25 bp, Mus musculus
aatcagacaggaatctgcttgaata

SEQ ID NO: 859507 - DNA, 25 bp, Mus musculus
aatcagacaggtgatttgaactgtg

SEQ ID NO: 859508 - DNA, 25 bp, Mus musculus
aatcagagagagtcacgatgtctga

SEQ ID NO: 859509 - DNA, 25 bp, Mus musculus
aatcagagagcctgcagcggtgtct

SEQ ID NO: 859510 - DNA, 25 bp, Mus musculus
aatcagagagcctgccatatcctgg

SEQ ID NO: 859511 - DNA, 25 bp, Mus musculus
aatcagagagcggacgtctccggcc

SEQ ID NO: 859512 - DNA, 25 bp, Mus musculus
aatcagagagcggaggtctccggcc

SEQ ID NO: 859513 - DNA, 25 bp, Mus musculus
aatcagagaggctgcagcggtgtct

SEQ ID NO: 859514 - DNA, 25 bp, Mus musculus
aatcagagaggctgccatatcctgg

SEQ ID NO: 859515 - DNA, 25 bp, Mus musculus
aatcagagagtgtcacgatgtctga

SEQ ID NO: 859516 - DNA, 25 bp, Mus musculus
aatcagagcagtgaccagtgggaga

SEQ ID NO: 859517 - DNA, 25 bp, Mus musculus
aatcagagcagtgacgataccgcta

SEQ ID NO: 859518 - DNA, 25 bp, Mus musculus
aatcagagcagtgagcagtgggaga

SEQ ID NO: 859519 - DNA, 25 bp, Mus musculus
aatcagagcagtgaggataccgcta

SEQ ID NO: 859520 - DNA, 25 bp, Mus musculus
aatcagatagacttccccgctggca

SEQ ID NO: 859521 - DNA, 25 bp, Mus musculus
aatcagatagtcttccccgctggca

SEQ ID NO: 859522 - DNA, 25 bp, Mus musculus
aatcagatccagcatgctcggaagg

SEQ ID NO: 859523 - DNA, 25 bp, Mus musculus
aatcagatccaggatgctcggaagg

SEQ ID NO: 859524 - DNA, 25 bp, Mus musculus
aatcagcaagacagacaccaaaccc

SEQ ID NO: 859525 - DNA, 25 bp, Mus musculus
aatcagcaagactacagatgctgga

SEQ ID NO: 859526 - DNA, 25 bp, Mus musculus
aatcagcaagagcccagatggtgct

SEQ ID NO: 859527 - DNA, 25 bp, Mus musculus
aatcagcaagatggaagccctcgga

SEQ ID NO: 859528 - DNA, 25 bp, Mus musculus
aatcagcaagtcagacaccaaaccc

SEQ ID NO: 859529 - DNA, 25 bp, Mus musculus
aatcagcaagtctacagatgctgga

SEQ ID NO: 859530 - DNA, 25 bp, Mus musculus
aatcagcaagtgcccagatggtgct

SEQ ID NO: 859531 - DNA, 25 bp, Mus musculus
aatcagcaagttggaagccctcgga

SEQ ID NO: 859532 - DNA, 25 bp, Mus musculus
aatcagcacaacctcatattcagtg

SEQ ID NO: 859533 - DNA, 25 bp, Mus musculus
aatcagcacatcctcatattcagtg

SEQ ID NO: 859534 - DNA, 25 bp, Mus musculus
aatcagcagctggacgaccttatta

SEQ ID NO: 859535 - DNA, 25 bp, Mus musculus
aatcagcagctggaggaccttatta

SEQ ID NO: 859536 - DNA, 25 bp, Mus musculus
aatcagccagaacagcgatggaacg

SEQ ID NO: 859537 - DNA, 25 bp, Mus musculus
aatcagccagcagaacagcgatgga

SEQ ID NO: 859538 - DNA, 25 bp, Mus musculus
aatcagccagccttcgaccatgggc

SEQ ID NO: 859539 - DNA, 25 bp, Mus musculus
aatcagccaggagaacagcgatgga

SEQ ID NO: 859540 - DNA, 25 bp, Mus musculus
aatcagccaggcttcgaccatgggc

SEQ ID NO: 859541 - DNA, 25 bp, Mus musculus
aatcagccagtacagcgatggaacg

SEQ ID NO: 859542 - DNA, 25 bp, Mus musculus
aatcagtgggaacatgactctaaag

SEQ ID NO: 859543 - DNA, 25 bp, Mus musculus
aatcagtgggaagatgactctaaag

SEQ ID NO: 859544 - DNA, 25 bp, Mus musculus
aatcataaaccacaagactggggac

SEQ ID NO: 859545 - DNA, 25 bp, Mus musculus
aatcataaaccacatgactggggac

SEQ ID NO: 859546 - DNA, 25 bp, Mus musculus
aatcatcaaaaacacattcaggtat

SEQ ID NO: 859547 - DNA, 25 bp, Mus musculus
aatcatcaaaaagacattcaggtat

SEQ ID NO: 859548 - DNA, 25 bp, Mus musculus
aatcatcaccagaataagcctgcac

SEQ ID NO: 859549 - DNA, 25 bp, Mus musculus
aatcatcaccagtataagcctgcac

SEQ ID NO: 859550 - DNA, 25 bp, Mus musculus
aatcatgcacaacattcgacctcat

SEQ ID NO: 859551 - DNA, 25 bp, Mus musculus
aatcatgcacaagattcgacctcat

SEQ ID NO: 859552 - DNA, 25 bp, Mus musculus
aatcattattttagacacagaatgt

SEQ ID NO: 859553 - DNA, 25 bp, Mus musculus
aatcattatttttgacacagaatgt

SEQ ID NO: 859554 - DNA, 25 bp, Mus musculus
aatcattcccagctttctgtccagc

SEQ ID NO: 859555 - DNA, 25 bp, Mus musculus
aatcattcccaggtttctgtccagc

SEQ ID NO: 859556 - DNA, 25 bp, Mus musculus
aatcattggattcacgtacagaagc

SEQ ID NO: 859557 - DNA, 25 bp, Mus musculus
aatcattggattcaggtacagaagc

SEQ ID NO: 859558 - DNA, 25 bp, Mus musculus
aatccaatagacttttcttacagag

SEQ ID NO: 859559 - DNA, 25 bp, Mus musculus
aatccaatagtcttttcttacagag

SEQ ID NO: 859560 - DNA, 25 bp, Mus musculus
aatccaatttcacgccactccatgt

SEQ ID NO: 859561 - DNA, 25 bp, Mus musculus
aatccaatttcaggccactccatgt

SEQ ID NO: 859562 - DNA, 25 bp, Mus musculus
aatccacaagcatcgatactggccc

SEQ ID NO: 859563 - DNA, 25 bp, Mus musculus
aatccacaaggatcgatactggccc

SEQ ID NO: 859564 - DNA, 25 bp, Mus musculus
aatccaccacagataactctcttca

SEQ ID NO: 859565 - DNA, 25 bp, Mus musculus
aatccaccacagttaactctcttca

SEQ ID NO: 859566 - DNA, 25 bp, Mus musculus
aatccacccccacctcccaaagagc

SEQ ID NO: 859567 - DNA, 25 bp, Mus musculus
aatccacccccagctcccaaagagc

SEQ ID NO: 859568 - DNA, 25 bp, Mus musculus
aatccagaaaatgtaaagcaattgt

SEQ ID NO: 859569 - DNA, 25 bp, Mus musculus
aatccagaaattgtaaagcaattgt

SEQ ID NO: 859570 - DNA, 25 bp, Mus musculus
aatccagaagacattgatcagctca

SEQ ID NO: 859571 - DNA, 25 bp, Mus musculus
aatccagaagtcattgatcagctca

SEQ ID NO: 859572 - DNA, 25 bp, Mus musculus
aatccagaccagctggactctgact

SEQ ID NO: 859573 - DNA, 25 bp, Mus musculus
aatccagaccaggtggactctgact

SEQ ID NO: 859574 - DNA, 25 bp, Mus musculus
aatccagcagaactggtgaaacagc

SEQ ID NO: 859575 - DNA, 25 bp, Mus musculus
aatccagcagaagtggtgaaacagc

SEQ ID NO: 859576 - DNA, 25 bp, Mus musculus
aatccataatgacgtggagtttgag

SEQ ID NO: 859577 - DNA, 25 bp, Mus musculus
aatccataatgaggtggagtttgag

SEQ ID NO: 859578 - DNA, 25 bp, Mus musculus
aatccatcaccacgctcgagaaaga

SEQ ID NO: 859579 - DNA, 25 bp, Mus musculus
aatccatcaccaggctcgagaaaga

SEQ ID NO: 859580 - DNA, 25 bp, Mus musculus
aatccatcggctatcgaggtagaag

SEQ ID NO: 859581 - DNA, 25 bp, Mus musculus
aatccatcggctatggaggtagaag

SEQ ID NO: 859582 - DNA, 25 bp, Mus musculus
aatccatgagatcagggcactgaca

SEQ ID NO: 859583 - DNA, 25 bp, Mus musculus
aatccatgagttcagggcactgaca

SEQ ID NO: 859584 - DNA, 25 bp, Mus musculus
aatccatgtatacaaccaaggcacc

SEQ ID NO: 859585 - DNA, 25 bp, Mus musculus
aatccatgtatagaaccaaggcacc

SEQ ID NO: 859586 - DNA, 25 bp, Mus musculus
aatccattatgaaattgaagaccaa

SEQ ID NO: 859587 - DNA, 25 bp, Mus musculus
aatccattatgaagaaacagggaag

SEQ ID NO: 859588 - DNA, 25 bp, Mus musculus
aatccattatgatattgaagaccaa

SEQ ID NO: 859589 - DNA, 25 bp, Mus musculus
aatccattatgatgaaacagggaag

SEQ ID NO: 859590 - DNA, 25 bp, Mus musculus
aatccatttctgcctctgttccctc

SEQ ID NO: 859591 - DNA, 25 bp, Mus musculus
aatccatttctggctctgttccctc

SEQ ID NO: 859592 - DNA, 25 bp, Mus musculus
aatcccactgattttaggtgatggg

SEQ ID NO: 859593 - DNA, 25 bp, Mus musculus
aatcccactgtttttaggtgatggg

SEQ ID NO: 859594 - DNA, 25 bp, Mus musculus
aatccccaagcttcattctgtggtg

SEQ ID NO: 859595 - DNA, 25 bp, Mus musculus
aatccccaaggttcattctgtggtg

SEQ ID NO: 859596 - DNA, 25 bp, Mus musculus
aatcccctggctgtcgacctactgg

SEQ ID NO: 859597 - DNA, 25 bp, Mus musculus
aatcccctgggtgtcgacctactgg

SEQ ID NO: 859598 - DNA, 25 bp, Mus musculus
aatccctccacaactggtgaagcag

SEQ ID NO: 859599 - DNA, 25 bp, Mus musculus
aatccctccagaactggtgaagcag

SEQ ID NO: 859600 - DNA, 25 bp, Mus musculus
aatccctgcatagacgtagttccta

SEQ ID NO: 859601 - DNA, 25 bp, Mus musculus
aatccctgcatagacgtgtgaaatt

SEQ ID NO: 859602 - DNA, 25 bp, Mus musculus
aatccctgcatagaggtagttccta

SEQ ID NO: 859603 - DNA, 25 bp, Mus musculus
aatccctgcatagaggtgtgaaatt

SEQ ID NO: 859604 - DNA, 25 bp, Mus musculus
aatccgacagcgcttcttcacagat

SEQ ID NO: 859605 - DNA, 25 bp, Mus musculus
aatccgacagggcttcttcacagat

SEQ ID NO: 859606 - DNA, 25 bp, Mus musculus
aatccgggaacacagcagtgcccgg

SEQ ID NO: 859607 - DNA, 25 bp, Mus musculus
aatccgggaacagagcagtgcccgg

SEQ ID NO: 859608 - DNA, 25 bp, Mus musculus
aatccgtgagctatcatcactacag

SEQ ID NO: 859609 - DNA, 25 bp, Mus musculus
aatccgtgaggtatcatcactacag

SEQ ID NO: 859610 - DNA, 25 bp, Mus musculus
aatcctaaatctccacagttgacgg

SEQ ID NO: 859611 - DNA, 25 bp, Mus musculus
aatcctaaatgtccacagttgacgg

SEQ ID NO: 859612 - DNA, 25 bp, Mus musculus
aatcctaactgctaagcaagctctg

SEQ ID NO: 859613 - DNA, 25 bp, Mus musculus
aatcctaactgctatgcaagctctg

SEQ ID NO: 859614 - DNA, 25 bp, Mus musculus
aatcctacacagcatggaccgcgat

SEQ ID NO: 859615 - DNA, 25 bp, Mus musculus
aatcctacacaggatggaccgcgat

SEQ ID NO: 859616 - DNA, 25 bp, Mus musculus
aatcctcaggcgattggcacatctc

SEQ ID NO: 859617 - DNA, 25 bp, Mus musculus
aatcctcaggggattggcacatctc

SEQ ID NO: 859618 - DNA, 25 bp, Mus musculus
aatcctcctcgaatcataatctgga

SEQ ID NO: 859619 - DNA, 25 bp, Mus musculus
aatcctcctcgaatgataatctgga

SEQ ID NO: 859620 - DNA, 25 bp, Mus musculus
aatcctcttgcttcagacaatgaat

SEQ ID NO: 859621 - DNA, 25 bp, Mus musculus
aatcctcttggttcagacaatgaat

SEQ ID NO: 859622 - DNA, 25 bp, Mus musculus
aatcctgaaacacgtactacttgtc

SEQ ID NO: 859623 - DNA, 25 bp, Mus musculus
aatcctgaaacaggtactacttgtc

SEQ ID NO: 859624 - DNA, 25 bp, Mus musculus
aatcctgaatacaacggcgagtgga

SEQ ID NO: 859625 - DNA, 25 bp, Mus musculus
aatcctgaatacaagggcgagtgga

SEQ ID NO: 859626 - DNA, 25 bp, Mus musculus
aatcctgcagcactacaaatctctc

SEQ ID NO: 859627 - DNA, 25 bp, Mus musculus
aatcctgcaggactacaaatctctc

SEQ ID NO: 859628 - DNA, 25 bp, Mus musculus
aatcctggagatagcagcccaagtc

SEQ ID NO: 859629 - DNA, 25 bp, Mus musculus
aatcctggagctcctagaagaccct

SEQ ID NO: 859630 - DNA, 25 bp, Mus musculus
aatcctggaggtcctagaagaccct

SEQ ID NO: 859631 - DNA, 25 bp, Mus musculus
aatcctggagttagcagcccaagtc

SEQ ID NO: 859632 - DNA, 25 bp, Mus musculus
aatcctggatagctgagaaagaagc

SEQ ID NO: 859633 - DNA, 25 bp, Mus musculus
aatcctggataggtgagaaagaagc

SEQ ID NO: 859634 - DNA, 25 bp, Mus musculus
aatcctggtgacaacggttccaaag

SEQ ID NO: 859635 - DNA, 25 bp, Mus musculus
aatcctggtgacaagggttccaaag

SEQ ID NO: 859636 - DNA, 25 bp, Mus musculus
aatcctgtgaagatattgacgaatg

SEQ ID NO: 859637 - DNA, 25 bp, Mus musculus
aatcctgtgaagttattgacgaatg

SEQ ID NO: 859638 - DNA, 25 bp, Mus musculus
aatccttagcaccaaggaggctgca

SEQ ID NO: 859639 - DNA, 25 bp, Mus musculus
aatccttagcacgaaggaggctgca

SEQ ID NO: 859640 - DNA, 25 bp, Mus musculus
aatccttcagacctccagagtgaag

SEQ ID NO: 859641 - DNA, 25 bp, Mus musculus
aatccttcagagatttatccaataa

SEQ ID NO: 859642 - DNA, 25 bp, Mus musculus
aatccttcagagttttatccaataa

SEQ ID NO: 859643 - DNA, 25 bp, Mus musculus
aatccttcagtcctccagagtgaag

SEQ ID NO: 859644 - DNA, 25 bp, Mus musculus
aatccttcctcaaacttcatggctc

SEQ ID NO: 859645 - DNA, 25 bp, Mus musculus
aatccttcctcgaaggccggatggt

SEQ ID NO: 859646 - DNA, 25 bp, Mus musculus
aatccttcctgaaacttcatggctc

SEQ ID NO: 859647 - DNA, 25 bp, Mus musculus
aatccttcctggaaggccggatggt

SEQ ID NO: 859648 - DNA, 25 bp, Mus musculus
aatccttgctcacacgggactacat

SEQ ID NO: 859649 - DNA, 25 bp, Mus musculus
aatccttgctcacaggggactacat

SEQ ID NO: 859650 - DNA, 25 bp, Mus musculus
aatcctttagcagctactccatccg

SEQ ID NO: 859651 - DNA, 25 bp, Mus musculus
aatcctttaggagctactccatccg

SEQ ID NO: 859652 - DNA, 25 bp, Mus musculus
aatcgaagagaccgagctggtggct

SEQ ID NO: 859653 - DNA, 25 bp, Mus musculus
aatcgaagagacggagctggtggct

SEQ ID NO: 859654 - DNA, 25 bp, Mus musculus
aatcgactactgcaaagcctacaag

SEQ ID NO: 859655 - DNA, 25 bp, Mus musculus
aatcgactactggaaagcctacaag

SEQ ID NO: 859656 - DNA, 25 bp, Mus musculus
aatcgattcaagcatcgcattgtat

SEQ ID NO: 859657 - DNA, 25 bp, Mus musculus
aatcgattcaaggatcgcattgtat

SEQ ID NO: 859658 - DNA, 25 bp, Mus musculus
aatcgccactaacaggggaggcgca

SEQ ID NO: 859659 - DNA, 25 bp, Mus musculus
aatcgccactaagaggggaggcgca

SEQ ID NO: 859660 - DNA, 25 bp, Mus musculus
aatcggctgtcagacactatgaaat

SEQ ID NO: 859661 - DNA, 25 bp, Mus musculus
aatcggctgtcagagactatgaaat

SEQ ID NO: 859662 - DNA, 25 bp, Mus musculus
aatcggtggaagatctgttgagttt

SEQ ID NO: 859663 - DNA, 25 bp, Mus musculus
aatcggtggaagttctgttgagttt

SEQ ID NO: 859664 - DNA, 25 bp, Mus musculus
aatcgtagatcactgcatggataag

SEQ ID NO: 859665 - DNA, 25 bp, Mus musculus
aatcgtagatcagtgcatggataag

SEQ ID NO: 859666 - DNA, 25 bp, Mus musculus
aatcgtccccggaccgagctgaaga

SEQ ID NO: 859667 - DNA, 25 bp, Mus musculus
aatcgtccccggacggagctgaaga

SEQ ID NO: 859668 - DNA, 25 bp, Mus musculus
aatcgtggcaaaaagtcagtccgac

SEQ ID NO: 859669 - DNA, 25 bp, Mus musculus
aatcgtggcaaatagtcagtccgac

SEQ ID NO: 859670 - DNA, 25 bp, Mus musculus
aatctaacactgctgaatatgtaat

SEQ ID NO: 859671 - DNA, 25 bp, Mus musculus
aatctaacactggtgaatatgtaat

SEQ ID NO: 859672 - DNA, 25 bp, Mus musculus
aatctaagccagcttgccatgaagt

SEQ ID NO: 859673 - DNA, 25 bp, Mus musculus
aatctaagccaggttgccatgaagt

SEQ ID NO: 859674 - DNA, 25 bp, Mus musculus
aatctagaagagcaacaagagagtg

SEQ ID NO: 859675 - DNA, 25 bp, Mus musculus
aatctagaagaggaacaagagagtg

SEQ ID NO: 859676 - DNA, 25 bp, Mus musculus
aatctaggagcccaccttgggacac

SEQ ID NO: 859677 - DNA, 25 bp, Mus musculus
aatctaggaggccaccttgggacac

SEQ ID NO: 859678 - DNA, 25 bp, Mus musculus
aatctaggccctcacatcaatgatg

SEQ ID NO: 859679 - DNA, 25 bp, Mus musculus
aatctaggccctcagatcaatgatg

SEQ ID NO: 859680 - DNA, 25 bp, Mus musculus
aatctatgaaagccctggtttggtc

SEQ ID NO: 859681 - DNA, 25 bp, Mus musculus
aatctatgaaatcagcaaccgctgg

SEQ ID NO: 859682 - DNA, 25 bp, Mus musculus
aatctatgaatgccctggtttggtc

SEQ ID NO: 859683 - DNA, 25 bp, Mus musculus
aatctatgaattcagcaaccgctgg

SEQ ID NO: 859684 - DNA, 25 bp, Mus musculus
aatctatggagacagtgctgaggct

SEQ ID NO: 859685 - DNA, 25 bp, Mus musculus
aatctatggagagagtgctgaggct

SEQ ID NO: 859686 - DNA, 25 bp, Mus musculus
aatctattagccatcagaccatgat

SEQ ID NO: 859687 - DNA, 25 bp, Mus musculus
aatctattagcgaaagagataccac

SEQ ID NO: 859688 - DNA, 25 bp, Mus musculus
aatctattaggcatcagaccatgat

SEQ ID NO: 859689 - DNA, 25 bp, Mus musculus
aatctattagggaaagagataccac

SEQ ID NO: 859690 - DNA, 25 bp, Mus musculus
aatctcaaccagctgaaagacaaag

SEQ ID NO: 859691 - DNA, 25 bp, Mus musculus
aatctcaacctgctgaaagacaaag

SEQ ID NO: 859692 - DNA, 25 bp, Mus musculus
aatctcaagaaacgatggatgatcc

SEQ ID NO: 859693 - DNA, 25 bp, Mus musculus
aatctcaagaaaggatggatgatcc

SEQ ID NO: 859694 - DNA, 25 bp, Mus musculus
aatctcacagctctcgagatggtga

SEQ ID NO: 859695 - DNA, 25 bp, Mus musculus
aatctcacagctctggagatggtga

SEQ ID NO: 859696 - DNA, 25 bp, Mus musculus
aatctcctgcagctcccagagagaa

SEQ ID NO: 859697 - DNA, 25 bp, Mus musculus
aatctcctgcaggtcccagagagaa

SEQ ID NO: 859698 - DNA, 25 bp, Mus musculus
aatctctaaaacagaagcaccttca

SEQ ID NO: 859699 - DNA, 25 bp, Mus musculus
aatctctaaaacatctatcatcctg

SEQ ID NO: 859700 - DNA, 25 bp, Mus musculus
aatctctaaaactgaagcaccttca

SEQ ID NO: 859701 - DNA, 25 bp, Mus musculus
aatctctaaaacttctatcatcctg

SEQ ID NO: 859702 - DNA, 25 bp, Mus musculus
aatctctagctgaactgagcaaacc

SEQ ID NO: 859703 - DNA, 25 bp, Mus musculus
aatctctagctgaagtgagcaaacc

SEQ ID NO: 859704 - DNA, 25 bp, Mus musculus
aatctctgaaccagttccagctacg

SEQ ID NO: 859705 - DNA, 25 bp, Mus musculus
aatctctgaacctgttccagctacg

SEQ ID NO: 859706 - DNA, 25 bp, Mus musculus
aatctctgacaactacaggacatat

SEQ ID NO: 859707 - DNA, 25 bp, Mus musculus
aatctctgacaagtacaggacatat

SEQ ID NO: 859708 - DNA, 25 bp, Mus musculus
aatctctgagcttcgttgccttccc

SEQ ID NO: 859709 - DNA, 25 bp, Mus musculus
aatctctgaggttcgttgccttccc

SEQ ID NO: 859710 - DNA, 25 bp, Mus musculus
aatctgaaggcctgcttctgcataa

SEQ ID NO: 859711 - DNA, 25 bp, Mus musculus
aatctgaaggcctggttctgcataa

SEQ ID NO: 859712 - DNA, 25 bp, Mus musculus
aatctgaatataaaaagaaagaaat

SEQ ID NO: 859713 - DNA, 25 bp, Mus musculus
aatctgaatatataaagaaagaaat

SEQ ID NO: 859714 - DNA, 25 bp, Mus musculus
aatctgagagagctgaaccaccaaa

SEQ ID NO: 859715 - DNA, 25 bp, Mus musculus
aatctgagagaggtgaaccaccaaa

SEQ ID NO: 859716 - DNA, 25 bp, Mus musculus
aatctgattcctcacggcatcgtga

SEQ ID NO: 859717 - DNA, 25 bp, Mus musculus
aatctgattcctcagggcatcgtga

SEQ ID NO: 859718 - DNA, 25 bp, Mus musculus
aatctgattctgcttttgctattca

SEQ ID NO: 859719 - DNA, 25 bp, Mus musculus
aatctgattctggttttgctattca

SEQ ID NO: 859720 - DNA, 25 bp, Mus musculus
aatctgcagcgaccctatagtttgg

SEQ ID NO: 859721 - DNA, 25 bp, Mus musculus
aatctgcagcgactgcccttcgcat

SEQ ID NO: 859722 - DNA, 25 bp, Mus musculus
aatctgcagcgactttggccaagga

SEQ ID NO: 859723 - DNA, 25 bp, Mus musculus
aatctgcagcgagcctatagtttgg

SEQ ID NO: 859724 - DNA, 25 bp, Mus musculus
aatctgcagcgagtgcccttcgcat

SEQ ID NO: 859725 - DNA, 25 bp, Mus musculus
aatctgcagcgagtttggccaagga

SEQ ID NO: 859726 - DNA, 25 bp, Mus musculus
aatctgcccttgcacgtaaaatttg

SEQ ID NO: 859727 - DNA, 25 bp, Mus musculus
aatctgcccttgcaggtaaaatttg

SEQ ID NO: 859728 - DNA, 25 bp, Mus musculus
aatctggctcgaacagcagaagatg

SEQ ID NO: 859729 - DNA, 25 bp, Mus musculus
aatctggctcgaactgcagaagatg

SEQ ID NO: 859730 - DNA, 25 bp, Mus musculus
aatctgtcggcggtggagggcttca

SEQ ID NO: 859731 - DNA, 25 bp, Mus musculus
aatctgtcgggggtggagggcttca

SEQ ID NO: 859732 - DNA, 25 bp, Mus musculus
aatctgtgaaggcttccgagcctcc

SEQ ID NO: 859733 - DNA, 25 bp, Mus musculus
aatctgtgaagggttccgagcctcc

SEQ ID NO: 859734 - DNA, 25 bp, Mus musculus
aatctgttcttgcccgtaatatttg

SEQ ID NO: 859735 - DNA, 25 bp, Mus musculus
aatctgttcttgccggtaatatttg

SEQ ID NO: 859736 - DNA, 25 bp, Mus musculus
aatcttaaagatcaggtcctgtaat

SEQ ID NO: 859737 - DNA, 25 bp, Mus musculus
aatcttaaagatcgaggcgccgagg

SEQ ID NO: 859738 - DNA, 25 bp, Mus musculus
aatcttaaagatcgcttgtccatgc

SEQ ID NO: 859739 - DNA, 25 bp, Mus musculus
aatcttaaagatcggggctgaggcg

SEQ ID NO: 859740 - DNA, 25 bp, Mus musculus
aatcttaaagatgaggtcctgtaat

SEQ ID NO: 859741 - DNA, 25 bp, Mus musculus
aatcttaaagatggaggcgccgagg

SEQ ID NO: 859742 - DNA, 25 bp, Mus musculus
aatcttaaagatggcttgtccatgc

SEQ ID NO: 859743 - DNA, 25 bp, Mus musculus
aatcttaaagatgggggctgaggcg

SEQ ID NO: 859744 - DNA, 25 bp, Mus musculus
aatcttaacaagcgataactctctg

SEQ ID NO: 859745 - DNA, 25 bp, Mus musculus
aatcttaacaagggataactctctg

SEQ ID NO: 859746 - DNA, 25 bp, Mus musculus
aatcttacaaaactcattcggaaga

SEQ ID NO: 859747 - DNA, 25 bp, Mus musculus
aatcttacaaaactgattcggaaga

SEQ ID NO: 859748 - DNA, 25 bp, Mus musculus
aatcttatcgccaaagctaaaacca

SEQ ID NO: 859749 - DNA, 25 bp, Mus musculus
aatcttatcggcaaagctaaaacca

SEQ ID NO: 859750 - DNA, 25 bp, Mus musculus
aatcttctaccccacataatatttc

SEQ ID NO: 859751 - DNA, 25 bp, Mus musculus
aatcttctaccccagataatatttc

SEQ ID NO: 859752 - DNA, 25 bp, Mus musculus
aatctttctgctatacattgtcccc

SEQ ID NO: 859753 - DNA, 25 bp, Mus musculus
aatctttctggtatacattgtcccc

SEQ ID NO: 859754 - DNA, 25 bp, Mus musculus
aatctttgagagtgagaaactttac

SEQ ID NO: 859755 - DNA, 25 bp, Mus musculus
aatctttgagtgtgagaaactttac

SEQ ID NO: 859756 - DNA, 25 bp, Mus musculus
aatgaaaaacttgacgtatctgagt

SEQ ID NO: 859757 - DNA, 25 bp, Mus musculus
aatgaaaaacttgaggtatctgagt

SEQ ID NO: 859758 - DNA, 25 bp, Mus musculus
aatgaaacaacattttggtatcaaa

SEQ ID NO: 859759 - DNA, 25 bp, Mus musculus
aatgaaacaagattttggtatcaaa

SEQ ID NO: 859760 - DNA, 25 bp, Mus musculus
aatgaaagacagaaacaaactgttc

SEQ ID NO: 859761 - DNA, 25 bp, Mus musculus
aatgaaagacagcgacatgaaacct

SEQ ID NO: 859762 - DNA, 25 bp, Mus musculus
aatgaaagacagggacatgaaacct

SEQ ID NO: 859763 - DNA, 25 bp, Mus musculus
aatgaaagacagtaacaaactgttc

SEQ ID NO: 859764 - DNA, 25 bp, Mus musculus
aatgaaatgatccacgtactgcagg

SEQ ID NO: 859765 - DNA, 25 bp, Mus musculus
aatgaaatgatccaggtactgcagg

SEQ ID NO: 859766 - DNA, 25 bp, Mus musculus
aatgaaattaatcaagcagacacaa

SEQ ID NO: 859767 - DNA, 25 bp, Mus musculus
aatgaaattaatcatgcagacacaa

SEQ ID NO: 859768 - DNA, 25 bp, Mus musculus
aatgaaattggacacgtccttcatt

SEQ ID NO: 859769 - DNA, 25 bp, Mus musculus
aatgaaattggacaggtccttcatt

SEQ ID NO: 859770 - DNA, 25 bp, Mus musculus
aatgaacttgcgggactgcaggcca

SEQ ID NO: 859771 - DNA, 25 bp, Mus musculus
aatgaacttgggggactgcaggcca

SEQ ID NO: 859772 - DNA, 25 bp, Mus musculus
aatgaagaacttctcgaaaatctca

SEQ ID NO: 859773 - DNA, 25 bp, Mus musculus
aatgaagaacttctggaaaatctca

SEQ ID NO: 859774 - DNA, 25 bp, Mus musculus
aatgaagaagaggaactatggacac

SEQ ID NO: 859775 - DNA, 25 bp, Mus musculus
aatgaagaagatgggcttaggtcat

SEQ ID NO: 859776 - DNA, 25 bp, Mus musculus
aatgaagaagtggaactatggacac

SEQ ID NO: 859777 - DNA, 25 bp, Mus musculus
aatgaagaagttgggcttaggtcat

SEQ ID NO: 859778 - DNA, 25 bp, Mus musculus
aatgaaggccagtctgtgtcagatg

SEQ ID NO: 859779 - DNA, 25 bp, Mus musculus
aatgaaggcctgtctgtgtcagatg

SEQ ID NO: 859780 - DNA, 25 bp, Mus musculus
aatgaaggcgtgccaacatacgcag

SEQ ID NO: 859781 - DNA, 25 bp, Mus musculus
aatgaaggcgtggcaacatacgcag

SEQ ID NO: 859782 - DNA, 25 bp, Mus musculus
aatgaagggggtgacgtgggcctgc

SEQ ID NO: 859783 - DNA, 25 bp, Mus musculus
aatgaagggggtgaggtgggcctgc

SEQ ID NO: 859784 - DNA, 25 bp, Mus musculus
aatgaatacccctcaataaaactgg

SEQ ID NO: 859785 - DNA, 25 bp, Mus musculus
aatgaatacccctcactggtggtgg

SEQ ID NO: 859786 - DNA, 25 bp, Mus musculus
aatgaatacccctctataaaactgg

SEQ ID NO: 859787 - DNA, 25 bp, Mus musculus
aatgaatacccctctctggtggtgg

SEQ ID NO: 859788 - DNA, 25 bp, Mus musculus
aatgaatcggatgcatggtttgaag

SEQ ID NO: 859789 - DNA, 25 bp, Mus musculus
aatgaatcggatgcttggtttgaag

SEQ ID NO: 859790 - DNA, 25 bp, Mus musculus
aatgaatcggctcatcaacttctat

SEQ ID NO: 859791 - DNA, 25 bp, Mus musculus
aatgaatcgggtcatcaacttctat

SEQ ID NO: 859792 - DNA, 25 bp, Mus musculus
aatgaatttcaacgggctgaggcga

SEQ ID NO: 859793 - DNA, 25 bp, Mus musculus
aatgaatttcaaggggctgaggcga

SEQ ID NO: 859794 - DNA, 25 bp, Mus musculus
aatgacaattttcacggggtgctgc

SEQ ID NO: 859795 - DNA, 25 bp, Mus musculus
aatgacaattttcagggggtgctgc

SEQ ID NO: 859796 - DNA, 25 bp, Mus musculus
aatgacacagagcggctggctgtgg

SEQ ID NO: 859797 - DNA, 25 bp, Mus musculus
aatgacacagagctggcggagaaca

SEQ ID NO: 859798 - DNA, 25 bp, Mus musculus
aatgacacagaggggctggctgtgg

SEQ ID NO: 859799 - DNA, 25 bp, Mus musculus
aatgacacagaggtggcggagaaca

SEQ ID NO: 859800 - DNA, 25 bp, Mus musculus
aatgacacggagctcctccagcgcc

SEQ ID NO: 859801 - DNA, 25 bp, Mus musculus
aatgacacggaggtcctccagcgcc

SEQ ID NO: 859802 - DNA, 25 bp, Mus musculus
aatgacactgagaatgagatggcta

SEQ ID NO: 859803 - DNA, 25 bp, Mus musculus
aatgacactgagtatgagatggcta

SEQ ID NO: 859804 - DNA, 25 bp, Mus musculus
aatgacagagatacttggtcgtcaa

SEQ ID NO: 859805 - DNA, 25 bp, Mus musculus
aatgacagagttacttggtcgtcaa

SEQ ID NO: 859806 - DNA, 25 bp, Mus musculus
aatgacagcagacgaaatggctagt

SEQ ID NO: 859807 - DNA, 25 bp, Mus musculus
aatgacagcagaggaaatggctagt

SEQ ID NO: 859808 - DNA, 25 bp, Mus musculus
aatgacatcatcaccatcatttccc

SEQ ID NO: 859809 - DNA, 25 bp, Mus musculus
aatgacatcatcacgatcatttccc

SEQ ID NO: 859810 - DNA, 25 bp, Mus musculus
aatgacatggcagtccccacacccc

SEQ ID NO: 859811 - DNA, 25 bp, Mus musculus
aatgacatggcagtgcccacacccc

SEQ ID NO: 859812 - DNA, 25 bp, Mus musculus
aatgaccaaccactacagtattctc

SEQ ID NO: 859813 - DNA, 25 bp, Mus musculus
aatgaccaaccactattctcttcaa

SEQ ID NO: 859814 - DNA, 25 bp, Mus musculus
aatgaccaaccagtacagtattctc

SEQ ID NO: 859815 - DNA, 25 bp, Mus musculus
aatgaccaaccagtattctcttcaa

SEQ ID NO: 859816 - DNA, 25 bp, Mus musculus
aatgacccagacatcttagtgatcg

SEQ ID NO: 859817 - DNA, 25 bp, Mus musculus
aatgacccagacatgttagtgatcg

SEQ ID NO: 859818 - DNA, 25 bp, Mus musculus
aatgaccctgaaaataaaaatgatc

SEQ ID NO: 859819 - DNA, 25 bp, Mus musculus
aatgaccctgaatataaaaatgatc

SEQ ID NO: 859820 - DNA, 25 bp, Mus musculus
aatgaccggcagcgtgatgctgagt

SEQ ID NO: 859821 - DNA, 25 bp, Mus musculus
aatgaccggcagggtgatgctgagt

SEQ ID NO: 859822 - DNA, 25 bp, Mus musculus
aatgacctgcttcgccattcaaata

SEQ ID NO: 859823 - DNA, 25 bp, Mus musculus
aatgacctgcttggccattcaaata

SEQ ID NO: 859824 - DNA, 25 bp, Mus musculus
aatgactgcacgcacaaagatgaca

SEQ ID NO: 859825 - DNA, 25 bp, Mus musculus
aatgactgcacgcagaaagatgaca

SEQ ID NO: 859826 - DNA, 25 bp, Mus musculus
aatgacttagagcagtgtgaccagg

SEQ ID NO: 859827 - DNA, 25 bp, Mus musculus
aatgacttagaggagtgtgaccagg

SEQ ID NO: 859828 - DNA, 25 bp, Mus musculus
aatgacttcaagccatttttcatcg

SEQ ID NO: 859829 - DNA, 25 bp, Mus musculus
aatgacttcaagcgtttgatttcca

SEQ ID NO: 859830 - DNA, 25 bp, Mus musculus
aatgacttcaaggcatttttcatcg

SEQ ID NO: 859831 - DNA, 25 bp, Mus musculus
aatgacttcaagggtttgatttcca

SEQ ID NO: 859832 - DNA, 25 bp, Mus musculus
aatgactttaagcacgtgctgctgg

SEQ ID NO: 859833 - DNA, 25 bp, Mus musculus
aatgactttaagcaggtgctgctgg

SEQ ID NO: 859834 - DNA, 25 bp, Mus musculus
aatgagaaagagatgaaaatcaagc

SEQ ID NO: 859835 - DNA, 25 bp, Mus musculus
aatgagaaagtgatgaaaatcaagc

SEQ ID NO: 859836 - DNA, 25 bp, Mus musculus
aatgagaaggagggcgagctcaact

SEQ ID NO: 859837 - DNA, 25 bp, Mus musculus
aatgagaaggagggcttccccatca

SEQ ID NO: 859838 - DNA, 25 bp, Mus musculus
aatgagaaggagggggagctcaact

SEQ ID NO: 859839 - DNA, 25 bp, Mus musculus
aatgagaaggaggggttccccatca

SEQ ID NO: 859840 - DNA, 25 bp, Mus musculus
aatgagacaaacactggaacttgcg

SEQ ID NO: 859841 - DNA, 25 bp, Mus musculus
aatgagacaatcactggaacttgcg

SEQ ID NO: 859842 - DNA, 25 bp, Mus musculus
aatgagagaaatgttctttgaagat

SEQ ID NO: 859843 - DNA, 25 bp, Mus musculus
aatgagagaattgttctttgaagat

SEQ ID NO: 859844 - DNA, 25 bp, Mus musculus
aatgagagagcacacaatgtaggaa

SEQ ID NO: 859845 - DNA, 25 bp, Mus musculus
aatgagagaggacacaatgtaggaa

SEQ ID NO: 859846 - DNA, 25 bp, Mus musculus
aatgagagtaagccttcctccacgt

SEQ ID NO: 859847 - DNA, 25 bp, Mus musculus
aatgagagtaaggcttcctccacgt

SEQ ID NO: 859848 - DNA, 25 bp, Mus musculus
aatgagatatatacatacattggga

SEQ ID NO: 859849 - DNA, 25 bp, Mus musculus
aatgagatatattcatacattggga

SEQ ID NO: 859850 - DNA, 25 bp, Mus musculus
aatgagatccacacattagcttttt

SEQ ID NO: 859851 - DNA, 25 bp, Mus musculus
aatgagatcctcacattagcttttt

SEQ ID NO: 859852 - DNA, 25 bp, Mus musculus
aatgagcaagcgccccttgattgtg

SEQ ID NO: 859853 - DNA, 25 bp, Mus musculus
aatgagcaagcgccttgttatgctg

SEQ ID NO: 859854 - DNA, 25 bp, Mus musculus
aatgagcaagcggcccttgattgtg

SEQ ID NO: 859855 - DNA, 25 bp, Mus musculus
aatgagcaagcggcttgttatgctg

SEQ ID NO: 859856 - DNA, 25 bp, Mus musculus
aatgaggacgttcaccttcgtctca

SEQ ID NO: 859857 - DNA, 25 bp, Mus musculus
aatgaggacgttcagcttcgtctca

SEQ ID NO: 859858 - DNA, 25 bp, Mus musculus
aatgaggaggattacgtgaacatgt

SEQ ID NO: 859859 - DNA, 25 bp, Mus musculus
aatgaggaggattaggtgaacatgt

SEQ ID NO: 859860 - DNA, 25 bp, Mus musculus
aatgaggcagcaacatcgaaatcgt

SEQ ID NO: 859861 - DNA, 25 bp, Mus musculus
aatgaggcaggaacatcgaaatcgt

SEQ ID NO: 859862 - DNA, 25 bp, Mus musculus
aatgagtatcttgacttgaactaca

SEQ ID NO: 859863 - DNA, 25 bp, Mus musculus
aatgagtatcttgagttgaactaca

SEQ ID NO: 859864 - DNA, 25 bp, Mus musculus
aatgagtgtgcccacgagaaacatc

SEQ ID NO: 859865 - DNA, 25 bp, Mus musculus
aatgagtgtgcccaggagaaacatc

SEQ ID NO: 859866 - DNA, 25 bp, Mus musculus
aatgagtgtgggctcgtaccctctg

SEQ ID NO: 859867 - DNA, 25 bp, Mus musculus
aatgagtgtgggctggtaccctctg

SEQ ID NO: 859868 - DNA, 25 bp, Mus musculus
aatgagtttcagcatagtgatgcac

SEQ ID NO: 859869 - DNA, 25 bp, Mus musculus
aatgagtttcaggatagtgatgcac

SEQ ID NO: 859870 - DNA, 25 bp, Mus musculus
aatgataaaagcacaaaaaggtata

SEQ ID NO: 859871 - DNA, 25 bp, Mus musculus
aatgataaaagcactaaaaggtata

SEQ ID NO: 859872 - DNA, 25 bp, Mus musculus
aatgataaagatgacgcaggttggt

SEQ ID NO: 859873 - DNA, 25 bp, Mus musculus
aatgataaagatgaggcaggttggt

SEQ ID NO: 859874 - DNA, 25 bp, Mus musculus
aatgataacagaccaacccgatagc

SEQ ID NO: 859875 - DNA, 25 bp, Mus musculus
aatgataacagaccatacaagcaat

SEQ ID NO: 859876 - DNA, 25 bp, Mus musculus
aatgataacagactcaatccccttc

SEQ ID NO: 859877 - DNA, 25 bp, Mus musculus
aatgataacagagcaacccgatagc

SEQ ID NO: 859878 - DNA, 25 bp, Mus musculus
aatgataacagagcatacaagcaat

SEQ ID NO: 859879 - DNA, 25 bp, Mus musculus
aatgataacagagtcaatccccttc

SEQ ID NO: 859880 - DNA, 25 bp, Mus musculus
aatgataagctgaatgatatggaac

SEQ ID NO: 859881 - DNA, 25 bp, Mus musculus
aatgataagctgcgtaaaactccac

SEQ ID NO: 859882 - DNA, 25 bp, Mus musculus
aatgataagctgggtaaaactccac

SEQ ID NO: 859883 - DNA, 25 bp, Mus musculus
aatgataagctgtatgatatggaac

SEQ ID NO: 859884 - DNA, 25 bp, Mus musculus
aatgataccacactgctgctgcctc

SEQ ID NO: 859885 - DNA, 25 bp, Mus musculus
aatgataccacagtgctgctgcctc

SEQ ID NO: 859886 - DNA, 25 bp, Mus musculus
aatgatactgacggccagtgaagca

SEQ ID NO: 859887 - DNA, 25 bp, Mus musculus
aatgatactgtcggccagtgaagca

SEQ ID NO: 859888 - DNA, 25 bp, Mus musculus
aatgatatacatagcgccttcaaga

SEQ ID NO: 859889 - DNA, 25 bp, Mus musculus
aatgatatacatagggccttcaaga

SEQ ID NO: 859890 - DNA, 25 bp, Mus musculus
aatgatccagctactgcagggtgct

SEQ ID NO: 859891 - DNA, 25 bp, Mus musculus
aatgatccaggtactgcagggtgct

SEQ ID NO: 859892 - DNA, 25 bp, Mus musculus
aatgatccttaacgtggtgatggcc

SEQ ID NO: 859893 - DNA, 25 bp, Mus musculus
aatgatccttaaggtggtgatggcc

SEQ ID NO: 859894 - DNA, 25 bp, Mus musculus
aatgatgaagatctggagcaagaaa

SEQ ID NO: 859895 - DNA, 25 bp, Mus musculus
aatgatgaagatgtggagcaagaaa

SEQ ID NO: 859896 - DNA, 25 bp, Mus musculus
aatgatgcagagaacctctcatctg

SEQ ID NO: 859897 - DNA, 25 bp, Mus musculus
aatgatgcagtgaacctctcatctg

SEQ ID NO: 859898 - DNA, 25 bp, Mus musculus
aatgatgcagtgcacgcaatacaga

SEQ ID NO: 859899 - DNA, 25 bp, Mus musculus
aatgatgcagtgcaggcaatacaga

SEQ ID NO: 859900 - DNA, 25 bp, Mus musculus
aatgatgcccagaaggtgaccgagg

SEQ ID NO: 859901 - DNA, 25 bp, Mus musculus
aatgatgcccagtaggtgaccgagg

SEQ ID NO: 859902 - DNA, 25 bp, Mus musculus
aatgatggagagtgtgtccctggac

SEQ ID NO: 859903 - DNA, 25 bp, Mus musculus
aatgatggagtgtgtgtccctggac

SEQ ID NO: 859904 - DNA, 25 bp, Mus musculus
aatgatgtgaagcccctgcttgaca

SEQ ID NO: 859905 - DNA, 25 bp, Mus musculus
aatgatgtgaaggccctgcttgaca

SEQ ID NO: 859906 - DNA, 25 bp, Mus musculus
aatgattacaataacgggtggtaca

SEQ ID NO: 859907 - DNA, 25 bp, Mus musculus
aatgattacaataaggggtggtaca

SEQ ID NO: 859908 - DNA, 25 bp, Mus musculus
aatgattacaatcaagggctcagtg

SEQ ID NO: 859909 - DNA, 25 bp, Mus musculus
aatgattacaatcatgggctcagtg

SEQ ID NO: 859910 - DNA, 25 bp, Mus musculus
aatgattacatccgaggctgccagc

SEQ ID NO: 859911 - DNA, 25 bp, Mus musculus
aatgattacatcggaggctgccagc

SEQ ID NO: 859912 - DNA, 25 bp, Mus musculus
aatgattatggaaacagcaggaaat

SEQ ID NO: 859913 - DNA, 25 bp, Mus musculus
aatgattatggatacagcaggaaat

SEQ ID NO: 859914 - DNA, 25 bp, Mus musculus
aatgattcagatatcctgttagatt

SEQ ID NO: 859915 - DNA, 25 bp, Mus musculus
aatgattcagttatcctgttagatt

SEQ ID NO: 859916 - DNA, 25 bp, Mus musculus
aatgattccgatggagggacggctt

SEQ ID NO: 859917 - DNA, 25 bp, Mus musculus
aatgattccgttggagggacggctt

SEQ ID NO: 859918 - DNA, 25 bp, Mus musculus
aatgattggcaagcagtggtgacgt

SEQ ID NO: 859919 - DNA, 25 bp, Mus musculus
aatgattggcaagctgtggtgacgt

SEQ ID NO: 859920 - DNA, 25 bp, Mus musculus
aatgattttaggatacagccaagct

SEQ ID NO: 859921 - DNA, 25 bp, Mus musculus
aatgattttaggttacagccaagct

SEQ ID NO: 859922 - DNA, 25 bp, Mus musculus
aatgcaaaaacttgaggaatggagt

SEQ ID NO: 859923 - DNA, 25 bp, Mus musculus
aatgcaaaaagttgaggaatggagt

SEQ ID NO: 859924 - DNA, 25 bp, Mus musculus
aatgcaaaagcaccctgatagaact

SEQ ID NO: 859925 - DNA, 25 bp, Mus musculus
aatgcaaaaggaccctgatagaact

SEQ ID NO: 859926 - DNA, 25 bp, Mus musculus
aatgcaaacaacagatgtaattgtt

SEQ ID NO: 859927 - DNA, 25 bp, Mus musculus
aatgcaaacatcagatgtaattgtt

SEQ ID NO: 859928 - DNA, 25 bp, Mus musculus
aatgcaaatgggaacaactgtataa

SEQ ID NO: 859929 - DNA, 25 bp, Mus musculus
aatgcaaatgggtacaactgtataa

SEQ ID NO: 859930 - DNA, 25 bp, Mus musculus
aatgcaagagagatgctgaggatgc

SEQ ID NO: 859931 - DNA, 25 bp, Mus musculus
aatgcaagagtgatgctgaggatgc

SEQ ID NO: 859932 - DNA, 25 bp, Mus musculus
aatgcaccaaaacatgagattgatt

SEQ ID NO: 859933 - DNA, 25 bp, Mus musculus
aatgcaccaaaagatgagattgatt

SEQ ID NO: 859934 - DNA, 25 bp, Mus musculus
aatgcacctgagacaatcctaaagg

SEQ ID NO: 859935 - DNA, 25 bp, Mus musculus
aatgcacctgagactatcctaaagg

SEQ ID NO: 859936 - DNA, 25 bp, Mus musculus
aatgcagcaaccaacctgtgattgg

SEQ ID NO: 859937 - DNA, 25 bp, Mus musculus
aatgcagcaaccaacgagacagtga

SEQ ID NO: 859938 - DNA, 25 bp, Mus musculus
aatgcagcaaccaagctgtgattgg

SEQ ID NO: 859939 - DNA, 25 bp, Mus musculus
aatgcagcaaccaaggagacagtga

SEQ ID NO: 859940 - DNA, 25 bp, Mus musculus
aatgcagcagatttctgccagctgt

SEQ ID NO: 859941 - DNA, 25 bp, Mus musculus
aatgcagcagttttctgccagctgt

SEQ ID NO: 859942 - DNA, 25 bp, Mus musculus
aatgcagctgctctcatatctcgtc

SEQ ID NO: 859943 - DNA, 25 bp, Mus musculus
aatgcagctggtctcatatctcgtc

SEQ ID NO: 859944 - DNA, 25 bp, Mus musculus
aatgcagcttaacgtcttacattcc

SEQ ID NO: 859945 - DNA, 25 bp, Mus musculus
aatgcagcttaaggtcttacattcc

SEQ ID NO: 859946 - DNA, 25 bp, Mus musculus
aatgcagttatgcacaacttgtcac

SEQ ID NO: 859947 - DNA, 25 bp, Mus musculus
aatgcagttatgcagaacttgtcac

SEQ ID NO: 859948 - DNA, 25 bp, Mus musculus
aatgcatcaacacgcaaggtagaga

SEQ ID NO: 859949 - DNA, 25 bp, Mus musculus
aatgcatcaacaggcaaggtagaga

SEQ ID NO: 859950 - DNA, 25 bp, Mus musculus
aatgcatcaacgctgccatcagcag

SEQ ID NO: 859951 - DNA, 25 bp, Mus musculus
aatgcatcaaggctgccatcagcag

SEQ ID NO: 859952 - DNA, 25 bp, Mus musculus
aatgcatccgtatcaactcaacaag

SEQ ID NO: 859953 - DNA, 25 bp, Mus musculus
aatgcatccgtatcaagacatgttc

SEQ ID NO: 859954 - DNA, 25 bp, Mus musculus
aatgcatccgtatctactcaacaag

SEQ ID NO: 859955 - DNA, 25 bp, Mus musculus
aatgcatccgtatctagacatgttc

SEQ ID NO: 859956 - DNA, 25 bp, Mus musculus
aatgccaaaaacaaacgtgacttgg

SEQ ID NO: 859957 - DNA, 25 bp, Mus musculus
aatgccaaaaacaatcgtgacttgg

SEQ ID NO: 859958 - DNA, 25 bp, Mus musculus
aatgccaaacagcttggccgccttg

SEQ ID NO: 859959 - DNA, 25 bp, Mus musculus
aatgccaaacaggttggccgccttg

SEQ ID NO: 859960 - DNA, 25 bp, Mus musculus
aatgccactgcatggcggaagaact

SEQ ID NO: 859961 - DNA, 25 bp, Mus musculus
aatgccactggatggcggaagaact

SEQ ID NO: 859962 - DNA, 25 bp, Mus musculus
aatgccactttcatcgcgttcaacc

SEQ ID NO: 859963 - DNA, 25 bp, Mus musculus
aatgccactttcatggcgttcaacc

SEQ ID NO: 859964 - DNA, 25 bp, Mus musculus
aatgccatatgtatctttcccaatg

SEQ ID NO: 859965 - DNA, 25 bp, Mus musculus
aatgccatatgtttctttcccaatg

SEQ ID NO: 859966 - DNA, 25 bp, Mus musculus
aatgccatggatgtcatcctgcaac

SEQ ID NO: 859967 - DNA, 25 bp, Mus musculus
aatgccatggttgtcatcctgcaac

SEQ ID NO: 859968 - DNA, 25 bp, Mus musculus
aatgccccacagaacgtgattgaac

SEQ ID NO: 859969 - DNA, 25 bp, Mus musculus
aatgccccacagaaggtgattgaac

SEQ ID NO: 859970 - DNA, 25 bp, Mus musculus
aatgccgagaagaaggaactttgct

SEQ ID NO: 859971 - DNA, 25 bp, Mus musculus
aatgccgagaagtaggaactttgct

SEQ ID NO: 859972 - DNA, 25 bp, Mus musculus
aatgcctagaagagtggttcttcga

SEQ ID NO: 859973 - DNA, 25 bp, Mus musculus
aatgcctagaagcggcaatgtcatc

SEQ ID NO: 859974 - DNA, 25 bp, Mus musculus
aatgcctagaaggggcaatgtcatc

SEQ ID NO: 859975 - DNA, 25 bp, Mus musculus
aatgcctagaagtgtggttcttcga

SEQ ID NO: 859976 - DNA, 25 bp, Mus musculus
aatgcctatcagatgcgagctgttt

SEQ ID NO: 859977 - DNA, 25 bp, Mus musculus
aatgcctatcagttgcgagctgttt

SEQ ID NO: 859978 - DNA, 25 bp, Mus musculus
aatgcctctgcacttgactaccagt

SEQ ID NO: 859979 - DNA, 25 bp, Mus musculus
aatgcctctggacttgactaccagt

SEQ ID NO: 859980 - DNA, 25 bp, Mus musculus
aatgcctctgttcatgacagccgtc

SEQ ID NO: 859981 - DNA, 25 bp, Mus musculus
aatgcctctgttgatgacagccgtc

SEQ ID NO: 859982 - DNA, 25 bp, Mus musculus
aatgccttccagcatgtggagtcag

SEQ ID NO: 859983 - DNA, 25 bp, Mus musculus
aatgccttccaggatgtggagtcag

SEQ ID NO: 859984 - DNA, 25 bp, Mus musculus
aatgccttctcacgtgtcatgatgc

SEQ ID NO: 859985 - DNA, 25 bp, Mus musculus
aatgccttctcaggtgtcatgatgc

SEQ ID NO: 859986 - DNA, 25 bp, Mus musculus
aatgcctttattcacgctgacgtgt

SEQ ID NO: 859987 - DNA, 25 bp, Mus musculus
aatgcctttattcaggctgacgtgt

SEQ ID NO: 859988 - DNA, 25 bp, Mus musculus
aatgcctttttgagataggttgggc

SEQ ID NO: 859989 - DNA, 25 bp, Mus musculus
aatgcctttttgtgataggttgggc

SEQ ID NO: 859990 - DNA, 25 bp, Mus musculus
aatgcgaacgacttcttcgccaagc

SEQ ID NO: 859991 - DNA, 25 bp, Mus musculus
aatgcgaacgtcttcttcgccaagc

SEQ ID NO: 859992 - DNA, 25 bp, Mus musculus
aatgcgccagatgatgaaggttgtc

SEQ ID NO: 859993 - DNA, 25 bp, Mus musculus
aatgcgccagttgatgaaggttgtc

SEQ ID NO: 859994 - DNA, 25 bp, Mus musculus
aatgctaaccggccatttcagaaga

SEQ ID NO: 859995 - DNA, 25 bp, Mus musculus
aatgctaaccgggcatttcagaaga

SEQ ID NO: 859996 - DNA, 25 bp, Mus musculus
aatgctacaaacagacagacaagac

SEQ ID NO: 859997 - DNA, 25 bp, Mus musculus
aatgctacaaactgacagacaagac

SEQ ID NO: 859998 - DNA, 25 bp, Mus musculus
aatgctagcaaacgccgagaagcaa

SEQ ID NO: 859999 - DNA, 25 bp, Mus musculus
aatgctagcaaaggccgagaagcaa

SEQ ID NO: 860000 - DNA, 25 bp, Mus musculus
aatgctatgtcacaaggcttatcag

SEQ ID NO: 860001 - DNA, 25 bp, Mus musculus
aatgctatgtcacgaaaccatccaa

SEQ ID NO: 860002 - DNA, 25 bp, Mus musculus
aatgctatgtcagaaggcttatcag

SEQ ID NO: 860003 - DNA, 25 bp, Mus musculus
aatgctatgtcaggaaaccatccaa

SEQ ID NO: 860004 - DNA, 25 bp, Mus musculus
aatgctccagcactcaattactgga

SEQ ID NO: 860005 - DNA, 25 bp, Mus musculus
aatgctccaggactcaattactgga

SEQ ID NO: 860006 - DNA, 25 bp, Mus musculus
aatgctccccagcacctccctggaa

SEQ ID NO: 860007 - DNA, 25 bp, Mus musculus
aatgctccccagcagctccctggaa

SEQ ID NO: 860008 - DNA, 25 bp, Mus musculus
aatgctcccgctaagtcgtcagcgc

SEQ ID NO: 860009 - DNA, 25 bp, Mus musculus
aatgctcccgctagtgttgcagagg

SEQ ID NO: 860010 - DNA, 25 bp, Mus musculus
aatgctcccgcttagtcgtcagcgc

SEQ ID NO: 860011 - DNA, 25 bp, Mus musculus
aatgctcccgcttgtgttgcagagg

SEQ ID NO: 860012 - DNA, 25 bp, Mus musculus
aatgctctcaagcatttgaggtctc

SEQ ID NO: 860013 - DNA, 25 bp, Mus musculus
aatgctctcaaggatttgaggtctc

SEQ ID NO: 860014 - DNA, 25 bp, Mus musculus
aatgctctcaggcaaaattccagaa

SEQ ID NO: 860015 - DNA, 25 bp, Mus musculus
aatgctctcagggaaaattccagaa

SEQ ID NO: 860016 - DNA, 25 bp, Mus musculus
aatgctgaagctgtgattagctact

SEQ ID NO: 860017 - DNA, 25 bp, Mus musculus
aatgctgaaggtgtgattagctact

SEQ ID NO: 860018 - DNA, 25 bp, Mus musculus
aatgctgactagtgcattgcttcag

SEQ ID NO: 860019 - DNA, 25 bp, Mus musculus
aatgctgacttgtgcattgcttcag

SEQ ID NO: 860020 - DNA, 25 bp, Mus musculus
aatgctgccaagcgctcctccaatt

SEQ ID NO: 860021 - DNA, 25 bp, Mus musculus
aatgctgccaagggctcctccaatt

SEQ ID NO: 860022 - DNA, 25 bp, Mus musculus
aatgctgtcattcgggcggatgtgg

SEQ ID NO: 860023 - DNA, 25 bp, Mus musculus
aatgctgtcattggggcggatgtgg

SEQ ID NO: 860024 - DNA, 25 bp, Mus musculus
aatgcttcagcgccgcctttttgcc

SEQ ID NO: 860025 - DNA, 25 bp, Mus musculus
aatgcttcagggccgcctttttgcc

SEQ ID NO: 860026 - DNA, 25 bp, Mus musculus
aatgctttatcaaacatttcacaaa

SEQ ID NO: 860027 - DNA, 25 bp, Mus musculus
aatgctttatcaaagatttcacaaa

SEQ ID NO: 860028 - DNA, 25 bp, Mus musculus
aatgctttccgcaacgccctttatg

SEQ ID NO: 860029 - DNA, 25 bp, Mus musculus
aatgctttccgcaaggccctttatg

SEQ ID NO: 860030 - DNA, 25 bp, Mus musculus
aatggaaactgagcacattaatcca

SEQ ID NO: 860031 - DNA, 25 bp, Mus musculus
aatggaaactgagcaccaaacaaca

SEQ ID NO: 860032 - DNA, 25 bp, Mus musculus
aatggaaactgagcaccaagcttac

SEQ ID NO: 860033 - DNA, 25 bp, Mus musculus
aatggaaactgagcagcagaataaa

SEQ ID NO: 860034 - DNA, 25 bp, Mus musculus
aatggaaactgagcattttgctctg

SEQ ID NO: 860035 - DNA, 25 bp, Mus musculus
aatggaaactgagctcattaatcca

SEQ ID NO: 860036 - DNA, 25 bp, Mus musculus
aatggaaactgagctccaaacaaca

SEQ ID NO: 860037 - DNA, 25 bp, Mus musculus
aatggaaactgagctccaagcttac

SEQ ID NO: 860038 - DNA, 25 bp, Mus musculus
aatggaaactgagctgcagaataaa

SEQ ID NO: 860039 - DNA, 25 bp, Mus musculus
aatggaaactgagctttttgctctg

SEQ ID NO: 860040 - DNA, 25 bp, Mus musculus
aatggaacaaaactggctgtgctgc

SEQ ID NO: 860041 - DNA, 25 bp, Mus musculus
aatggaacaaaagtggctgtgctgc

SEQ ID NO: 860042 - DNA, 25 bp, Mus musculus
aatggaaccatcagcctgctgattt

SEQ ID NO: 860043 - DNA, 25 bp, Mus musculus
aatggaaccatcaggctgctgattt

SEQ ID NO: 860044 - DNA, 25 bp, Mus musculus
aatggaaccatgaaagcccacctgc

SEQ ID NO: 860045 - DNA, 25 bp, Mus musculus
aatggaaccatgaatgcccacctgc

SEQ ID NO: 860046 - DNA, 25 bp, Mus musculus
aatggaagagcacatagatacatca

SEQ ID NO: 860047 - DNA, 25 bp, Mus musculus
aatggaagaggacatagatacatca

SEQ ID NO: 860048 - DNA, 25 bp, Mus musculus
aatggaaggaagctcaatggagggc

SEQ ID NO: 860049 - DNA, 25 bp, Mus musculus
aatggaaggaaggtcaatggagggc

SEQ ID NO: 860050 - DNA, 25 bp, Mus musculus
aatggaatggccattatatttagta

SEQ ID NO: 860051 - DNA, 25 bp, Mus musculus
aatggaatggcccttgcatttagta

SEQ ID NO: 860052 - DNA, 25 bp, Mus musculus
aatggaatgggcattatatttagta

SEQ ID NO: 860053 - DNA, 25 bp, Mus musculus
aatggaatgggccttgcatttagta

SEQ ID NO: 860054 - DNA, 25 bp, Mus musculus
aatggacagatgaccactcccgaga

SEQ ID NO: 860055 - DNA, 25 bp, Mus musculus
aatggacagatgtccactcccgaga

SEQ ID NO: 860056 - DNA, 25 bp, Mus musculus
aatggacagtgccacctgaggatgg

SEQ ID NO: 860057 - DNA, 25 bp, Mus musculus
aatggacagtgccagctgaggatgg

SEQ ID NO: 860058 - DNA, 25 bp, Mus musculus
aatggacccagacatttcctgcaaa

SEQ ID NO: 860059 - DNA, 25 bp, Mus musculus
aatggacccagagatttcctgcaaa

SEQ ID NO: 860060 - DNA, 25 bp, Mus musculus
aatggactcaattggtcaaagaaag

SEQ ID NO: 860061 - DNA, 25 bp, Mus musculus
aatggactcatttggtcaaagaaag

SEQ ID NO: 860062 - DNA, 25 bp, Mus musculus
aatggagacagccggcgagtttgta

SEQ ID NO: 860063 - DNA, 25 bp, Mus musculus
aatggagacagcgggcgagtttgta

SEQ ID NO: 860064 - DNA, 25 bp, Mus musculus
aatggagatatccatattatgtcct

SEQ ID NO: 860065 - DNA, 25 bp, Mus musculus
aatggagatatcgatattatgtcct

SEQ ID NO: 860066 - DNA, 25 bp, Mus musculus
aatggagcgaggaacgcacctgatg

SEQ ID NO: 860067 - DNA, 25 bp, Mus musculus
aatggagcgaggaacggatcgctta

SEQ ID NO: 860068 - DNA, 25 bp, Mus musculus
aatggagcgaggaaggcacctgatg

SEQ ID NO: 860069 - DNA, 25 bp, Mus musculus
aatggagcgaggaagggatcgctta

SEQ ID NO: 860070 - DNA, 25 bp, Mus musculus
aatggaggccagcaaaacggcaact

SEQ ID NO: 860071 - DNA, 25 bp, Mus musculus
aatggaggccaggaaaacggcaact

SEQ ID NO: 860072 - DNA, 25 bp, Mus musculus
aatggagtcaaactgggtgtcgctg

SEQ ID NO: 860073 - DNA, 25 bp, Mus musculus
aatggagtcaaagtgggtgtcgctg

SEQ ID NO: 860074 - DNA, 25 bp, Mus musculus
aatggataccctcatctaatcgttg

SEQ ID NO: 860075 - DNA, 25 bp, Mus musculus
aatggataccctgatctaatcgttg

SEQ ID NO: 860076 - DNA, 25 bp, Mus musculus
aatggatatgttcatgtagccgttg

SEQ ID NO: 860077 - DNA, 25 bp, Mus musculus
aatggatatgttgatgtagccgttg

SEQ ID NO: 860078 - DNA, 25 bp, Mus musculus
aatggatcccacagatgccaagtat

SEQ ID NO: 860079 - DNA, 25 bp, Mus musculus
aatggatcccactgatgccaagtat

SEQ ID NO: 860080 - DNA, 25 bp, Mus musculus
aatggatcgacaagtgcaatgaaga

SEQ ID NO: 860081 - DNA, 25 bp, Mus musculus
aatggatcgacatgtgcaatgaaga

SEQ ID NO: 860082 - DNA, 25 bp, Mus musculus
aatggattatgacgaggcagacaat

SEQ ID NO: 860083 - DNA, 25 bp, Mus musculus
aatggattatgaggaggcagacaat

SEQ ID NO: 860084 - DNA, 25 bp, Mus musculus
aatggcaaaaagctatgtggacagc

SEQ ID NO: 860085 - DNA, 25 bp, Mus musculus
aatggcaaaaaggtatgtggacagc

SEQ ID NO: 860086 - DNA, 25 bp, Mus musculus
aatggcaaaatcactcataatcccc

SEQ ID NO: 860087 - DNA, 25 bp, Mus musculus
aatggcaaaatctctcataatcccc

SEQ ID NO: 860088 - DNA, 25 bp, Mus musculus
aatggcaaataccttacccgtctct

SEQ ID NO: 860089 - DNA, 25 bp, Mus musculus
aatggcaaatacgttacccgtctct

SEQ ID NO: 860090 - DNA, 25 bp, Mus musculus
aatggcagccagactcagtcctctg

SEQ ID NO: 860091 - DNA, 25 bp, Mus musculus
aatggcagccagtctcagtcctctg

SEQ ID NO: 860092 - DNA, 25 bp, Mus musculus
aatggcatcatgctgctcccccggc

SEQ ID NO: 860093 - DNA, 25 bp, Mus musculus
aatggcatcatggtgctcccccggc

SEQ ID NO: 860094 - DNA, 25 bp, Mus musculus
aatggcatgaatgaggactgggagt

SEQ ID NO: 860095 - DNA, 25 bp, Mus musculus
aatggcatgattgaggactgggagt

SEQ ID NO: 860096 - DNA, 25 bp, Mus musculus
aatggcatggatgaagactgggata

SEQ ID NO: 860097 - DNA, 25 bp, Mus musculus
aatggcatggttgaagactgggata

SEQ ID NO: 860098 - DNA, 25 bp, Mus musculus
aatggccatgaacccgggagaaaat

SEQ ID NO: 860099 - DNA, 25 bp, Mus musculus
aatggccatgaagccgggagaaaat

SEQ ID NO: 860100 - DNA, 25 bp, Mus musculus
aatggccatgataacagctatcttg

SEQ ID NO: 860101 - DNA, 25 bp, Mus musculus
aatggccatgttaacagctatcttg

SEQ ID NO: 860102 - DNA, 25 bp, Mus musculus
aatggcccatagaaaagagtcatca

SEQ ID NO: 860103 - DNA, 25 bp, Mus musculus
aatggcccatcattttgttctttag

SEQ ID NO: 860104 - DNA, 25 bp, Mus musculus
aatggcccatctgctctgtaacaga

SEQ ID NO: 860105 - DNA, 25 bp, Mus musculus
aatggcccatgattttgttctttag

SEQ ID NO: 860106 - DNA, 25 bp, Mus musculus
aatggcccatgtgctctgtaacaga

SEQ ID NO: 860107 - DNA, 25 bp, Mus musculus
aatggcccattgaaaagagtcatca

SEQ ID NO: 860108 - DNA, 25 bp, Mus musculus
aatggcccgcaaaacaagtctgtgg

SEQ ID NO: 860109 - DNA, 25 bp, Mus musculus
aatggcccgcaaaagaagtctgtgg

SEQ ID NO: 860110 - DNA, 25 bp, Mus musculus
aatggcgacaatctttcagaagaca

SEQ ID NO: 860111 - DNA, 25 bp, Mus musculus
aatggcgacattctttcagaagaca

SEQ ID NO: 860112 - DNA, 25 bp, Mus musculus
aatggctcagctttcaacatttcca

SEQ ID NO: 860113 - DNA, 25 bp, Mus musculus
aatggctcaggtttcaacatttcca

SEQ ID NO: 860114 - DNA, 25 bp, Mus musculus
aatggctctatcgtcacttgtgggc

SEQ ID NO: 860115 - DNA, 25 bp, Mus musculus
aatggctctatcgtgacttgtgggc

SEQ ID NO: 860116 - DNA, 25 bp, Mus musculus
aatggctgaagtgacgggggtccag

SEQ ID NO: 860117 - DNA, 25 bp, Mus musculus
aatggctgaagtgactgggcccagc

SEQ ID NO: 860118 - DNA, 25 bp, Mus musculus
aatggctgaagtgaggggggtccag

SEQ ID NO: 860119 - DNA, 25 bp, Mus musculus
aatggctgaagtgagtgggcccagc

SEQ ID NO: 860120 - DNA, 25 bp, Mus musculus
aatgggaacgctcaaaatgaggaaa

SEQ ID NO: 860121 - DNA, 25 bp, Mus musculus
aatgggaacgctgaaaatgaggaaa

SEQ ID NO: 860122 - DNA, 25 bp, Mus musculus
aatgggaagactccaattcattgct

SEQ ID NO: 860123 - DNA, 25 bp, Mus musculus
aatgggaagactcctattcattgct

SEQ ID NO: 860124 - DNA, 25 bp, Mus musculus
aatgggagagatgcagaaagagagt

SEQ ID NO: 860125 - DNA, 25 bp, Mus musculus
aatgggagagcttttgcctaccaaa

SEQ ID NO: 860126 - DNA, 25 bp, Mus musculus
aatgggagaggttttgcctaccaaa

SEQ ID NO: 860127 - DNA, 25 bp, Mus musculus
aatgggagagttgcagaaagagagt

SEQ ID NO: 860128 - DNA, 25 bp, Mus musculus
aatgggatgaacaaatcatttttcc

SEQ ID NO: 860129 - DNA, 25 bp, Mus musculus
aatgggatgaactaatcatttttcc

SEQ ID NO: 860130 - DNA, 25 bp, Mus musculus
aatgggatgaagcttggccttgcca

SEQ ID NO: 860131 - DNA, 25 bp, Mus musculus
aatgggatgaaggttggccttgcca

SEQ ID NO: 860132 - DNA, 25 bp, Mus musculus
aatgggcacaagccgacccaagctc

SEQ ID NO: 860133 - DNA, 25 bp, Mus musculus
aatgggcacaagcgtgtggactgcg

SEQ ID NO: 860134 - DNA, 25 bp, Mus musculus
aatgggcacaaggcgacccaagctc

SEQ ID NO: 860135 - DNA, 25 bp, Mus musculus
aatgggcacaagggtgtggactgcg

SEQ ID NO: 860136 - DNA, 25 bp, Mus musculus
aatgggcccaccaacctgcagctga

SEQ ID NO: 860137 - DNA, 25 bp, Mus musculus
aatgggcccaccaagctgcagctga

SEQ ID NO: 860138 - DNA, 25 bp, Mus musculus
aatgggcgcaccaacgccatggtgg

SEQ ID NO: 860139 - DNA, 25 bp, Mus musculus
aatgggcgcaccaaggccatggtgg

SEQ ID NO: 860140 - DNA, 25 bp, Mus musculus
aatgggctagacacagttgcagatt

SEQ ID NO: 860141 - DNA, 25 bp, Mus musculus
aatgggctagccaaaagatgtgatt

SEQ ID NO: 860142 - DNA, 25 bp, Mus musculus
aatgggctaggcaaaagatgtgatt

SEQ ID NO: 860143 - DNA, 25 bp, Mus musculus
aatgggctagtcacagttgcagatt

SEQ ID NO: 860144 - DNA, 25 bp, Mus musculus
aatggggaagagcttcatggaggta

SEQ ID NO: 860145 - DNA, 25 bp, Mus musculus
aatggggaagaggttcatggaggta

SEQ ID NO: 860146 - DNA, 25 bp, Mus musculus
aatggggagctgcccccacagggct

SEQ ID NO: 860147 - DNA, 25 bp, Mus musculus
aatggggagctgcctaagctggtgc

SEQ ID NO: 860148 - DNA, 25 bp, Mus musculus
aatggggagctggccccacagggct

SEQ ID NO: 860149 - DNA, 25 bp, Mus musculus
aatggggagctggctaagctggtgc

SEQ ID NO: 860150 - DNA, 25 bp, Mus musculus
aatggggcagctaaaattgtactga

SEQ ID NO: 860151 - DNA, 25 bp, Mus musculus
aatggggcagctgctgatactgtta

SEQ ID NO: 860152 - DNA, 25 bp, Mus musculus
aatggggcaggtaaaattgtactga

SEQ ID NO: 860153 - DNA, 25 bp, Mus musculus
aatggggcaggtgctgatactgtta

SEQ ID NO: 860154 - DNA, 25 bp, Mus musculus
aatgggggccagctgatgtacaggg

SEQ ID NO: 860155 - DNA, 25 bp, Mus musculus
aatgggggccaggtgatgtacaggg

SEQ ID NO: 860156 - DNA, 25 bp, Mus musculus
aatgggtaagcaagtgaaagtgaat

SEQ ID NO: 860157 - DNA, 25 bp, Mus musculus
aatgggtaaggaagtgaaagtgaat

SEQ ID NO: 860158 - DNA, 25 bp, Mus musculus
aatggtcatcagagctgtactggcg

SEQ ID NO: 860159 - DNA, 25 bp, Mus musculus
aatggtcatcagagtcctcctatcg

SEQ ID NO: 860160 - DNA, 25 bp, Mus musculus
aatggtcatcagtgctgtactggcg

SEQ ID NO: 860161 - DNA, 25 bp, Mus musculus
aatggtcatcagtgtcctcctatcg

SEQ ID NO: 860162 - DNA, 25 bp, Mus musculus
aatggtgatgctcttctccatcgtg

SEQ ID NO: 860163 - DNA, 25 bp, Mus musculus
aatggtgatggtcttctccatcgtg

SEQ ID NO: 860164 - DNA, 25 bp, Mus musculus
aatggtggagctgcgttcctcatac

SEQ ID NO: 860165 - DNA, 25 bp, Mus musculus
aatggtggaggtgcgttcctcatac

SEQ ID NO: 860166 - DNA, 25 bp, Mus musculus
aatggtgtgtttgacgagatttcta

SEQ ID NO: 860167 - DNA, 25 bp, Mus musculus
aatggtgtgtttgaggagatttcta

SEQ ID NO: 860168 - DNA, 25 bp, Mus musculus
aatggttatactaatggaattgcta

SEQ ID NO: 860169 - DNA, 25 bp, Mus musculus
aatggttatactcccttaacatggg

SEQ ID NO: 860170 - DNA, 25 bp, Mus musculus
aatggttatactgccttaacatggg

SEQ ID NO: 860171 - DNA, 25 bp, Mus musculus
aatggttatacttatggaattgcta

SEQ ID NO: 860172 - DNA, 25 bp, Mus musculus
aatggttgagaggtgtggcgaagtc

SEQ ID NO: 860173 - DNA, 25 bp, Mus musculus
aatggttgagtggtgtggcgaagtc

SEQ ID NO: 860174 - DNA, 25 bp, Mus musculus
aatgtaaagcagcttttccggcgtg

SEQ ID NO: 860175 - DNA, 25 bp, Mus musculus
aatgtaaagcaggttttccggcgtg

SEQ ID NO: 860176 - DNA, 25 bp, Mus musculus
aatgtaacagagcgttcccatctcc

SEQ ID NO: 860177 - DNA, 25 bp, Mus musculus
aatgtaacagagcgtttgaagatca

SEQ ID NO: 860178 - DNA, 25 bp, Mus musculus
aatgtaacagagggttcccatctcc

SEQ ID NO: 860179 - DNA, 25 bp, Mus musculus
aatgtaacagagggtttgaagatca

SEQ ID NO: 860180 - DNA, 25 bp, Mus musculus
aatgtaacagattgccacactgtga

SEQ ID NO: 860181 - DNA, 25 bp, Mus musculus
aatgtaacagtttgccacactgtga

SEQ ID NO: 860182 - DNA, 25 bp, Mus musculus
aatgtactgaagcatttctggtagg

SEQ ID NO: 860183 - DNA, 25 bp, Mus musculus
aatgtactgaaggatttctggtagg

SEQ ID NO: 860184 - DNA, 25 bp, Mus musculus
aatgtagatgaaactgaaggctcag

SEQ ID NO: 860185 - DNA, 25 bp, Mus musculus
aatgtagatgaggaagcaagggaag

SEQ ID NO: 860186 - DNA, 25 bp, Mus musculus
aatgtagatgtaactgaaggctcag

SEQ ID NO: 860187 - DNA, 25 bp, Mus musculus
aatgtagatgtggaagcaagggaag

SEQ ID NO: 860188 - DNA, 25 bp, Mus musculus
aatgtatgtatacacgtttgttaac

SEQ ID NO: 860189 - DNA, 25 bp, Mus musculus
aatgtatgtatacaggtttgttaac

SEQ ID NO: 860190 - DNA, 25 bp, Mus musculus
aatgtattcaagatgctggagactt

SEQ ID NO: 860191 - DNA, 25 bp, Mus musculus
aatgtattcaagctctgcgacgagc

SEQ ID NO: 860192 - DNA, 25 bp, Mus musculus
aatgtattcaaggtctgcgacgagc

SEQ ID NO: 860193 - DNA, 25 bp, Mus musculus
aatgtattcaagttgctggagactt

SEQ ID NO: 860194 - DNA, 25 bp, Mus musculus
aatgtattctgcaaaaccttatgca

SEQ ID NO: 860195 - DNA, 25 bp, Mus musculus
aatgtattctgcaaacttcaagcac

SEQ ID NO: 860196 - DNA, 25 bp, Mus musculus
aatgtattctgcaataccttatgca

SEQ ID NO: 860197 - DNA, 25 bp, Mus musculus
aatgtattctgcaatcttcaagcac

SEQ ID NO: 860198 - DNA, 25 bp, Mus musculus
aatgtcaacgaccccagtccagtgc

SEQ ID NO: 860199 - DNA, 25 bp, Mus musculus
aatgtcaacgtccccagtccagtgc

SEQ ID NO: 860200 - DNA, 25 bp, Mus musculus
aatgtcaagacgcacccgtttacaa

SEQ ID NO: 860201 - DNA, 25 bp, Mus musculus
aatgtcaagacgcactagccgttta

SEQ ID NO: 860202 - DNA, 25 bp, Mus musculus
aatgtcaagacgcagccgtttacaa

SEQ ID NO: 860203 - DNA, 25 bp, Mus musculus
aatgtcaagacgcagtagccgttta

SEQ ID NO: 860204 - DNA, 25 bp, Mus musculus
aatgtcaatggttccgcaactgaat

SEQ ID NO: 860205 - DNA, 25 bp, Mus musculus
aatgtcaatggttcggcaactgaat

SEQ ID NO: 860206 - DNA, 25 bp, Mus musculus
aatgtcacagatgccatctcatctg

SEQ ID NO: 860207 - DNA, 25 bp, Mus musculus
aatgtcacagttgccatctcatctg

SEQ ID NO: 860208 - DNA, 25 bp, Mus musculus
aatgtcactcagctgcggacattct

SEQ ID NO: 860209 - DNA, 25 bp, Mus musculus
aatgtcactcaggtgcggacattct

SEQ ID NO: 860210 - DNA, 25 bp, Mus musculus
aatgtcagaaagagtctactgtata

SEQ ID NO: 860211 - DNA, 25 bp, Mus musculus
aatgtcagaaagtgtctactgtata

SEQ ID NO: 860212 - DNA, 25 bp, Mus musculus
aatgtcagcccacgtgctgtgagtg

SEQ ID NO: 860213 - DNA, 25 bp, Mus musculus
aatgtcagcccaggtgctgtgagtg

SEQ ID NO: 860214 - DNA, 25 bp, Mus musculus
aatgtcatcgagatgctggacgttg

SEQ ID NO: 860215 - DNA, 25 bp, Mus musculus
aatgtcatcgagttgctggacgttg

SEQ ID NO: 860216 - DNA, 25 bp, Mus musculus
aatgtcatgtttaacgttggtgaag

SEQ ID NO: 860217 - DNA, 25 bp, Mus musculus
aatgtcatgtttaaggttggtgaag

SEQ ID NO: 860218 - DNA, 25 bp, Mus musculus
aatgtcccagatccagatcaaacca

SEQ ID NO: 860219 - DNA, 25 bp, Mus musculus
aatgtcccagttccagatcaaacca

SEQ ID NO: 860220 - DNA, 25 bp, Mus musculus
aatgtccgacagcacgaggtgttca

SEQ ID NO: 860221 - DNA, 25 bp, Mus musculus
aatgtccgacagcaggaggtgttca

SEQ ID NO: 860222 - DNA, 25 bp, Mus musculus
aatgtcctgaattcagagtgggtgg

SEQ ID NO: 860223 - DNA, 25 bp, Mus musculus
aatgtcctgatttcagagtgggtgg

SEQ ID NO: 860224 - DNA, 25 bp, Mus musculus
aatgtctcagatgcactcccatcct

SEQ ID NO: 860225 - DNA, 25 bp, Mus musculus
aatgtctcagttgcactcccatcct

SEQ ID NO: 860226 - DNA, 25 bp, Mus musculus
aatgtctccgctattacgctggctg

SEQ ID NO: 860227 - DNA, 25 bp, Mus musculus
aatgtctccggtattacgctggctg

SEQ ID NO: 860228 - DNA, 25 bp, Mus musculus
aatgtgaaaaagaattcaaacatag

SEQ ID NO: 860229 - DNA, 25 bp, Mus musculus
aatgtgaaaaagtattcaaacatag

SEQ ID NO: 860230 - DNA, 25 bp, Mus musculus
aatgtgaaagaaaactgggtgcctg

SEQ ID NO: 860231 - DNA, 25 bp, Mus musculus
aatgtgaaagaaaagtgggtgcctg

SEQ ID NO: 860232 - DNA, 25 bp, Mus musculus
aatgtgaaagcctaccttggaccgg

SEQ ID NO: 860233 - DNA, 25 bp, Mus musculus
aatgtgaaagcctggcacagaagtc

SEQ ID NO: 860234 - DNA, 25 bp, Mus musculus
aatgtgaaaggctaccttggaccgg

SEQ ID NO: 860235 - DNA, 25 bp, Mus musculus
aatgtgaaaggctggcacagaagtc

SEQ ID NO: 860236 - DNA, 25 bp, Mus musculus
aatgtgaaattaaacggtacacttg

SEQ ID NO: 860237 - DNA, 25 bp, Mus musculus
aatgtgaaattaaagggtacacttg

SEQ ID NO: 860238 - DNA, 25 bp, Mus musculus
aatgtgaacaaactgaattccaagg

SEQ ID NO: 860239 - DNA, 25 bp, Mus musculus
aatgtgaacaaagtgaattccaagg

SEQ ID NO: 860240 - DNA, 25 bp, Mus musculus
aatgtgacagcgacttgtcactcat

SEQ ID NO: 860241 - DNA, 25 bp, Mus musculus
aatgtgacagggacttgtcactcat

SEQ ID NO: 860242 - DNA, 25 bp, Mus musculus
aatgtgatcctccaacttcagtatc

SEQ ID NO: 860243 - DNA, 25 bp, Mus musculus
aatgtgatcctccatcttcagtatc

SEQ ID NO: 860244 - DNA, 25 bp, Mus musculus
aatgtgatgcttgccgaatgcagcc

SEQ ID NO: 860245 - DNA, 25 bp, Mus musculus
aatgtgatgcttgcctgcaatgctc

SEQ ID NO: 860246 - DNA, 25 bp, Mus musculus
aatgtgatgcttgcggaatgcagcc

SEQ ID NO: 860247 - DNA, 25 bp, Mus musculus
aatgtgatgcttgcgtgcaatgctc

SEQ ID NO: 860248 - DNA, 25 bp, Mus musculus
aatgtgattgtcgacacgtgcgacc

SEQ ID NO: 860249 - DNA, 25 bp, Mus musculus
aatgtgattgtcgagacgtgcgacc

SEQ ID NO: 860250 - DNA, 25 bp, Mus musculus
aatgtgcagtcacacgtggataccc

SEQ ID NO: 860251 - DNA, 25 bp, Mus musculus
aatgtgcagtcacaggtggataccc

SEQ ID NO: 860252 - DNA, 25 bp, Mus musculus
aatgtgctgaaacggttcaacttct

SEQ ID NO: 860253 - DNA, 25 bp, Mus musculus
aatgtgctgaaagggttcaacttct

SEQ ID NO: 860254 - DNA, 25 bp, Mus musculus
aatgtgctgcagattctggaggcgg

SEQ ID NO: 860255 - DNA, 25 bp, Mus musculus
aatgtgctgcagcacattgtcaatc

SEQ ID NO: 860256 - DNA, 25 bp, Mus musculus
aatgtgctgcagcagattgtcaatc

SEQ ID NO: 860257 - DNA, 25 bp, Mus musculus
aatgtgctgcagtttctggaggcgg

SEQ ID NO: 860258 - DNA, 25 bp, Mus musculus
aatgtggacaagctattctttgatc

SEQ ID NO: 860259 - DNA, 25 bp, Mus musculus
aatgtggacaagctcattgtgctca

SEQ ID NO: 860260 - DNA, 25 bp, Mus musculus
aatgtggacaaggtattctttgatc

SEQ ID NO: 860261 - DNA, 25 bp, Mus musculus
aatgtggacaaggtcattgtgctca

SEQ ID NO: 860262 - DNA, 25 bp, Mus musculus
aatgtggcctcacggtgcttggaca

SEQ ID NO: 860263 - DNA, 25 bp, Mus musculus
aatgtggcctcagggtgcttggaca

SEQ ID NO: 860264 - DNA, 25 bp, Mus musculus
aatgtggctcagccttattatgccc

SEQ ID NO: 860265 - DNA, 25 bp, Mus musculus
aatgtggctcaggcttattatgccc

SEQ ID NO: 860266 - DNA, 25 bp, Mus musculus
aatgtgggtgccctcctcagccccc

SEQ ID NO: 860267 - DNA, 25 bp, Mus musculus
aatgtgggtggcctcctcagccccc

SEQ ID NO: 860268 - DNA, 25 bp, Mus musculus
aatgtggtgcagctgatcgaatggg

SEQ ID NO: 860269 - DNA, 25 bp, Mus musculus
aatgtggtgcaggtgatcgaatggg

SEQ ID NO: 860270 - DNA, 25 bp, Mus musculus
aatgtgtccgacttcccggagagga

SEQ ID NO: 860271 - DNA, 25 bp, Mus musculus
aatgtgtccgtcttcccggagagga

SEQ ID NO: 860272 - DNA, 25 bp, Mus musculus
aatgtgttaaaacacatcactcaag

SEQ ID NO: 860273 - DNA, 25 bp, Mus musculus
aatgtgttaaaagacatcactcaag

SEQ ID NO: 860274 - DNA, 25 bp, Mus musculus
aatgtgttagagcttcgaagccgag

SEQ ID NO: 860275 - DNA, 25 bp, Mus musculus
aatgtgttagaggttcgaagccgag

SEQ ID NO: 860276 - DNA, 25 bp, Mus musculus
aatgttacagaccccgacagcatat

SEQ ID NO: 860277 - DNA, 25 bp, Mus musculus
aatgttacagacgccgacagcatat

SEQ ID NO: 860278 - DNA, 25 bp, Mus musculus
aatgttacagatgaaatgccagcaa

SEQ ID NO: 860279 - DNA, 25 bp, Mus musculus
aatgttacagcacatggagaaggaa

SEQ ID NO: 860280 - DNA, 25 bp, Mus musculus
aatgttacagccatacagtcatctc

SEQ ID NO: 860281 - DNA, 25 bp, Mus musculus
aatgttacagcgatcctatggaacc

SEQ ID NO: 860282 - DNA, 25 bp, Mus musculus
aatgttacaggacatggagaaggaa

SEQ ID NO: 860283 - DNA, 25 bp, Mus musculus
aatgttacaggcatacagtcatctc

SEQ ID NO: 860284 - DNA, 25 bp, Mus musculus
aatgttacagggatcctatggaacc

SEQ ID NO: 860285 - DNA, 25 bp, Mus musculus
aatgttacagttgaaatgccagcaa

SEQ ID NO: 860286 - DNA, 25 bp, Mus musculus
aatgttagagagctggcagaaagcg

SEQ ID NO: 860287 - DNA, 25 bp, Mus musculus
aatgttagagaggtggcagaaagcg

SEQ ID NO: 860288 - DNA, 25 bp, Mus musculus
aatgttcaaacacacgtggatggat

SEQ ID NO: 860289 - DNA, 25 bp, Mus musculus
aatgttcaaacagacgtggatggat

SEQ ID NO: 860290 - DNA, 25 bp, Mus musculus
aatgttcaggagcttgcagaaggag

SEQ ID NO: 860291 - DNA, 25 bp, Mus musculus
aatgttcaggaggttgcagaaggag

SEQ ID NO: 860292 - DNA, 25 bp, Mus musculus
aatgttccagaatgttaaaggatct

SEQ ID NO: 860293 - DNA, 25 bp, Mus musculus
aatgttccagcctagagaagttaag

SEQ ID NO: 860294 - DNA, 25 bp, Mus musculus
aatgttccaggctagagaagttaag

SEQ ID NO: 860295 - DNA, 25 bp, Mus musculus
aatgttccagtatgttaaaggatct

SEQ ID NO: 860296 - DNA, 25 bp, Mus musculus
aatgttgcctaaaaccatgaataga

SEQ ID NO: 860297 - DNA, 25 bp, Mus musculus
aatgttgcctaataccatgaataga

SEQ ID NO: 860298 - DNA, 25 bp, Mus musculus
aatgttggcctatacgaagtttggt

SEQ ID NO: 860299 - DNA, 25 bp, Mus musculus
aatgttggcctataggaagtttggt

SEQ ID NO: 860300 - DNA, 25 bp, Mus musculus
aatgttgggccaagatctgcaagta

SEQ ID NO: 860301 - DNA, 25 bp, Mus musculus
aatgttgggccattgtgtttaagca

SEQ ID NO: 860302 - DNA, 25 bp, Mus musculus
aatgttgggcctaggattgtgttta

SEQ ID NO: 860303 - DNA, 25 bp, Mus musculus
aatgttgggcctgtgcatgtagccg

SEQ ID NO: 860304 - DNA, 25 bp, Mus musculus
aatgttgggcgaagatctgcaagta

SEQ ID NO: 860305 - DNA, 25 bp, Mus musculus
aatgttgggcgattgtgtttaagca

SEQ ID NO: 860306 - DNA, 25 bp, Mus musculus
aatgttgggcgtaggattgtgttta

SEQ ID NO: 860307 - DNA, 25 bp, Mus musculus
aatgttgggcgtgtgcatgtagccg

SEQ ID NO: 860308 - DNA, 25 bp, Mus musculus
aatgtttatgagaacactgataagg

SEQ ID NO: 860309 - DNA, 25 bp, Mus musculus
aatgtttatgtgaacactgataagg

SEQ ID NO: 860310 - DNA, 25 bp, Mus musculus
aatgtttgcctgcgaaatgctcata

SEQ ID NO: 860311 - DNA, 25 bp, Mus musculus
aatgtttgcctgggaaatgctcata

SEQ ID NO: 860312 - DNA, 25 bp, Mus musculus
aattaaacagccatgatgcacagct

SEQ ID NO: 860313 - DNA, 25 bp, Mus musculus
aattaaacaggcatgatgcacagct

SEQ ID NO: 860314 - DNA, 25 bp, Mus musculus
aattaaagagcctcattgggaaggt

SEQ ID NO: 860315 - DNA, 25 bp, Mus musculus
aattaaagaggctcattgggaaggt

SEQ ID NO: 860316 - DNA, 25 bp, Mus musculus
aattaaagtgaacacgctgactggg

SEQ ID NO: 860317 - DNA, 25 bp, Mus musculus
aattaaagtgaactccaccacagaa

SEQ ID NO: 860318 - DNA, 25 bp, Mus musculus
aattaaagtgaagacgctgactggg

SEQ ID NO: 860319 - DNA, 25 bp, Mus musculus
aattaaagtgaagtccaccacagaa

SEQ ID NO: 860320 - DNA, 25 bp, Mus musculus
aattaatcaaccagacacaactcat

SEQ ID NO: 860321 - DNA, 25 bp, Mus musculus
aattaatcaagcagacacaactcat

SEQ ID NO: 860322 - DNA, 25 bp, Mus musculus
aattacagataacgaactgctgaag

SEQ ID NO: 860323 - DNA, 25 bp, Mus musculus
aattacagataacgtgttctcattg

SEQ ID NO: 860324 - DNA, 25 bp, Mus musculus
aattacagataaggaactgctgaag

SEQ ID NO: 860325 - DNA, 25 bp, Mus musculus
aattacagataaggtgttctcattg

SEQ ID NO: 860326 - DNA, 25 bp, Mus musculus
aattacataaaagacgaactcatta

SEQ ID NO: 860327 - DNA, 25 bp, Mus musculus
aattacataaaagaggaactcatta

SEQ ID NO: 860328 - DNA, 25 bp, Mus musculus
aattacatgtgcaacgcgtcatcca

SEQ ID NO: 860329 - DNA, 25 bp, Mus musculus
aattacatgtgcaactgcgtcatcc

SEQ ID NO: 860330 - DNA, 25 bp, Mus musculus
aattacatgtgcaaggcgtcatcca

SEQ ID NO: 860331 - DNA, 25 bp, Mus musculus
aattacatgtgcaagtgcgtcatcc

SEQ ID NO: 860332 - DNA, 25 bp, Mus musculus
aattaccgatggatctggtggccct

SEQ ID NO: 860333 - DNA, 25 bp, Mus musculus
aattaccgatggttctggtggccct

SEQ ID NO: 860334 - DNA, 25 bp, Mus musculus
aattacctggctttcctaataggat

SEQ ID NO: 860335 - DNA, 25 bp, Mus musculus
aattacctgggtttcctaataggat

SEQ ID NO: 860336 - DNA, 25 bp, Mus musculus
aattacgacagacataacatagaag

SEQ ID NO: 860337 - DNA, 25 bp, Mus musculus
aattacgacagagataacatagaag

SEQ ID NO: 860338 - DNA, 25 bp, Mus musculus
aattactcctgctgcgggctggaga

SEQ ID NO: 860339 - DNA, 25 bp, Mus musculus
aattactcctgctgggggctggaga

SEQ ID NO: 860340 - DNA, 25 bp, Mus musculus
aattactgagcaaattgctgttact

SEQ ID NO: 860341 - DNA, 25 bp, Mus musculus
aattactgaggaaattgctgttact

SEQ ID NO: 860342 - DNA, 25 bp, Mus musculus
aattactgggaacatctcaggaaac

SEQ ID NO: 860343 - DNA, 25 bp, Mus musculus
aattactgggaagatctcaggaaac

SEQ ID NO: 860344 - DNA, 25 bp, Mus musculus
aattacttgcagatggaaaagattt

SEQ ID NO: 860345 - DNA, 25 bp, Mus musculus
aattacttgcagttggaaaagattt

SEQ ID NO: 860346 - DNA, 25 bp, Mus musculus
aattagacagagagaatcggatatc

SEQ ID NO: 860347 - DNA, 25 bp, Mus musculus
aattagacagagtgaatcggatatc

SEQ ID NO: 860348 - DNA, 25 bp, Mus musculus
aattagttcgagatgaccttgggtt

SEQ ID NO: 860349 - DNA, 25 bp, Mus musculus
aattagttcgtgatgaccttgggtt

SEQ ID NO: 860350 - DNA, 25 bp, Mus musculus
aattagttgttcaacagaaaccatt

SEQ ID NO: 860351 - DNA, 25 bp, Mus musculus
aattagttgttcaacatgggagaat

SEQ ID NO: 860352 - DNA, 25 bp, Mus musculus
aattagttgttcaagagaaaccatt

SEQ ID NO: 860353 - DNA, 25 bp, Mus musculus
aattagttgttcaagatgggagaat

SEQ ID NO: 860354 - DNA, 25 bp, Mus musculus
aattataaaaagccacagaagaatg

SEQ ID NO: 860355 - DNA, 25 bp, Mus musculus
aattataaaaaggcacagaagaatg

SEQ ID NO: 860356 - DNA, 25 bp, Mus musculus
aattatagctaaaggaactcaagaa

SEQ ID NO: 860357 - DNA, 25 bp, Mus musculus
aattatagcttaaggaactcaagaa

SEQ ID NO: 860358 - DNA, 25 bp, Mus musculus
aattatatcccgctggacttgctgg

SEQ ID NO: 860359 - DNA, 25 bp, Mus musculus
aattatatcccggtggacttgctgg

SEQ ID NO: 860360 - DNA, 25 bp, Mus musculus
aattatgaagagtttgtacagatga

SEQ ID NO: 860361 - DNA, 25 bp, Mus musculus
aattatgaagtgtttgtacagatga

SEQ ID NO: 860362 - DNA, 25 bp, Mus musculus
aattatgagcagcatcagtatgaga

SEQ ID NO: 860363 - DNA, 25 bp, Mus musculus
aattatgagcaggatcagtatgaga

SEQ ID NO: 860364 - DNA, 25 bp, Mus musculus
aattatgttgctatcgacaccgagt

SEQ ID NO: 860365 - DNA, 25 bp, Mus musculus
aattatgttgctatggacaccgagt

SEQ ID NO: 860366 - DNA, 25 bp, Mus musculus
aattattcagcctaatggctacagt

SEQ ID NO: 860367 - DNA, 25 bp, Mus musculus
aattattcaggctaatggctacagt

SEQ ID NO: 860368 - DNA, 25 bp, Mus musculus
aattattcatcgcgacttaaagcct

SEQ ID NO: 860369 - DNA, 25 bp, Mus musculus
aattattcatcgggacttaaagcct

SEQ ID NO: 860370 - DNA, 25 bp, Mus musculus
aattattgccacagcgacgagagat

SEQ ID NO: 860371 - DNA, 25 bp, Mus musculus
aattattgccacagggacgagagat

SEQ ID NO: 860372 - DNA, 25 bp, Mus musculus
aattattggaataaatggtgattac

SEQ ID NO: 860373 - DNA, 25 bp, Mus musculus
aattattggaattaatggtgattac

SEQ ID NO: 860374 - DNA, 25 bp, Mus musculus
aattcaaatgttgtcgcagaatacc

SEQ ID NO: 860375 - DNA, 25 bp, Mus musculus
aattcaaatgttgtctcctctgttg

SEQ ID NO: 860376 - DNA, 25 bp, Mus musculus
aattcaaatgttgtggcagaatacc

SEQ ID NO: 860377 - DNA, 25 bp, Mus musculus
aattcaaatgttgtgtcctctgttg

SEQ ID NO: 860378 - DNA, 25 bp, Mus musculus
aattcaacagcctaaaccggctgac

SEQ ID NO: 860379 - DNA, 25 bp, Mus musculus
aattcaacaggctaaaccggctgac

SEQ ID NO: 860380 - DNA, 25 bp, Mus musculus
aattcaatgacgagtacctggtgac

SEQ ID NO: 860381 - DNA, 25 bp, Mus musculus
aattcaatgacgtgtacctggtgac

SEQ ID NO: 860382 - DNA, 25 bp, Mus musculus
aattcacaaaagcgaaggatctgtc

SEQ ID NO: 860383 - DNA, 25 bp, Mus musculus
aattcacaaaagggaaggatctgtc

SEQ ID NO: 860384 - DNA, 25 bp, Mus musculus
aattcacaggcacctaaagcccagc

SEQ ID NO: 860385 - DNA, 25 bp, Mus musculus
aattcacagggacctaaagcccagc

SEQ ID NO: 860386 - DNA, 25 bp, Mus musculus
aattcacattcacgcacaccaagat

SEQ ID NO: 860387 - DNA, 25 bp, Mus musculus
aattcacattcaggcacaccaagat

SEQ ID NO: 860388 - DNA, 25 bp, Mus musculus
aattcacgcccccacatgaagactg

SEQ ID NO: 860389 - DNA, 25 bp, Mus musculus
aattcacgcccccagatgaagactg

SEQ ID NO: 860390 - DNA, 25 bp, Mus musculus
aattcacttagacacacttacaaca

SEQ ID NO: 860391 - DNA, 25 bp, Mus musculus
aattcacttagacagacttacaaca

SEQ ID NO: 860392 - DNA, 25 bp, Mus musculus
aattcagatctgactatgtggtact

SEQ ID NO: 860393 - DNA, 25 bp, Mus musculus
aattcagatctgtctatgtggtact

SEQ ID NO: 860394 - DNA, 25 bp, Mus musculus
aattcaggaaagatctccagaaaga

SEQ ID NO: 860395 - DNA, 25 bp, Mus musculus
aattcaggaaagatgtccagaaaga

SEQ ID NO: 860396 - DNA, 25 bp, Mus musculus
aattcaggacggctggtcccaggat

SEQ ID NO: 860397 - DNA, 25 bp, Mus musculus
aattcaggacgggtggtcccaggat

SEQ ID NO: 860398 - DNA, 25 bp, Mus musculus
aattcagttacacacttgccctaaa

SEQ ID NO: 860399 - DNA, 25 bp, Mus musculus
aattcagttacacagttgccctaaa

SEQ ID NO: 860400 - DNA, 25 bp, Mus musculus
aattccaatgatgttgcaaaatcta

SEQ ID NO: 860401 - DNA, 25 bp, Mus musculus
aattccaatgcaaacaagaatgccg

SEQ ID NO: 860402 - DNA, 25 bp, Mus musculus
aattccaatggaaacaagaatgccg

SEQ ID NO: 860403 - DNA, 25 bp, Mus musculus
aattccaatgttgttgcaaaatcta

SEQ ID NO: 860404 - DNA, 25 bp, Mus musculus
aattccacaacctgatcaacgtcac

SEQ ID NO: 860405 - DNA, 25 bp, Mus musculus
aattccacaagctgatcaacgtcac

SEQ ID NO: 860406 - DNA, 25 bp, Mus musculus
aattccacggacctagactcagcac

SEQ ID NO: 860407 - DNA, 25 bp, Mus musculus
aattccacggtcctagactcagcac

SEQ ID NO: 860408 - DNA, 25 bp, Mus musculus
aattccagagattaaaactattttg

SEQ ID NO: 860409 - DNA, 25 bp, Mus musculus
aattccagagtttaaaactattttg

SEQ ID NO: 860410 - DNA, 25 bp, Mus musculus
aattcccaaatgcatgacaagtggg

SEQ ID NO: 860411 - DNA, 25 bp, Mus musculus
aattcccaaatggatgacaagtggg

SEQ ID NO: 860412 - DNA, 25 bp, Mus musculus
aattcccaacagcacctctttcaga

SEQ ID NO: 860413 - DNA, 25 bp, Mus musculus
aattcccaacagcagctctttcaga

SEQ ID NO: 860414 - DNA, 25 bp, Mus musculus
aattcccaagcattcacacctcctg

SEQ ID NO: 860415 - DNA, 25 bp, Mus musculus
aattcccaaggattcacacctcctg

SEQ ID NO: 860416 - DNA, 25 bp, Mus musculus
aattccctggacaacctgtggccag

SEQ ID NO: 860417 - DNA, 25 bp, Mus musculus
aattccctggacaagctgtggccag

SEQ ID NO: 860418 - DNA, 25 bp, Mus musculus
aattccggagctcgactgaactttt

SEQ ID NO: 860419 - DNA, 25 bp, Mus musculus
aattccggagctggactgaactttt

SEQ ID NO: 860420 - DNA, 25 bp, Mus musculus
aattcctggtataacgtcatattaa

SEQ ID NO: 860421 - DNA, 25 bp, Mus musculus
aattcctggtataaggtcatattaa

SEQ ID NO: 860422 - DNA, 25 bp, Mus musculus
aattccttggagcttcattctgtgg

SEQ ID NO: 860423 - DNA, 25 bp, Mus musculus
aattccttggaggttcattctgtgg

SEQ ID NO: 860424 - DNA, 25 bp, Mus musculus
aattcgagaagtcaaccatccaaaa

SEQ ID NO: 860425 - DNA, 25 bp, Mus musculus
aattcgagaagtgaaccatccaaaa

SEQ ID NO: 860426 - DNA, 25 bp, Mus musculus
aattcgagagaacatgacaatactt

SEQ ID NO: 860427 - DNA, 25 bp, Mus musculus
aattcgagagaagatgacaatactt

SEQ ID NO: 860428 - DNA, 25 bp, Mus musculus
aattcgcctaggcacgaaatatgtt

SEQ ID NO: 860429 - DNA, 25 bp, Mus musculus
aattcgcctaggcaggaaatatgtt

SEQ ID NO: 860430 - DNA, 25 bp, Mus musculus
aattcgtgcaccctaacgtacctga

SEQ ID NO: 860431 - DNA, 25 bp, Mus musculus
aattcgtgcaccgtaacgtacctga

SEQ ID NO: 860432 - DNA, 25 bp, Mus musculus
aattctacagacaacgtgaccttga

SEQ ID NO: 860433 - DNA, 25 bp, Mus musculus
aattctacagacaaggtgaccttga

SEQ ID NO: 860434 - DNA, 25 bp, Mus musculus
aattctacagataaatggaattaat

SEQ ID NO: 860435 - DNA, 25 bp, Mus musculus
aattctacagttaaatggaattaat

SEQ ID NO: 860436 - DNA, 25 bp, Mus musculus
aattctaccgcaacctggtctccat

SEQ ID NO: 860437 - DNA, 25 bp, Mus musculus
aattctaccgcaacgtggtctccat

SEQ ID NO: 860438 - DNA, 25 bp, Mus musculus
aattctactactcggactcgtactg

SEQ ID NO: 860439 - DNA, 25 bp, Mus musculus
aattctactactgggactcgtactg

SEQ ID NO: 860440 - DNA, 25 bp, Mus musculus
aattctcaacaacacctattccaaa

SEQ ID NO: 860441 - DNA, 25 bp, Mus musculus
aattctcaacaacagctattccaaa

SEQ ID NO: 860442 - DNA, 25 bp, Mus musculus
aattctcaagccccggctagagtat

SEQ ID NO: 860443 - DNA, 25 bp, Mus musculus
aattctcaaggcccggctagagtat

SEQ ID NO: 860444 - DNA, 25 bp, Mus musculus
aattctcacaagatagtactggagt

SEQ ID NO: 860445 - DNA, 25 bp, Mus musculus
aattctcacaagttagtactggagt

SEQ ID NO: 860446 - DNA, 25 bp, Mus musculus
aattctcattaacctgtttgacacc

SEQ ID NO: 860447 - DNA, 25 bp, Mus musculus
aattctcattaagctgtttgacacc

SEQ ID NO: 860448 - DNA, 25 bp, Mus musculus
aattctcattagacgtctgtgaagc

SEQ ID NO: 860449 - DNA, 25 bp, Mus musculus
aattctcatttgacgtctgtgaagc

SEQ ID NO: 860450 - DNA, 25 bp, Mus musculus
aattctgcagacccatgcagatgca

SEQ ID NO: 860451 - DNA, 25 bp, Mus musculus
aattctgcagctatccaacggttgt

SEQ ID NO: 860452 - DNA, 25 bp, Mus musculus
aattctgcaggtatccaacggttgt

SEQ ID NO: 860453 - DNA, 25 bp, Mus musculus
aattctgcagtcccatgcagatgca

SEQ ID NO: 860454 - DNA, 25 bp, Mus musculus
aattctgcgaaatacacgttcgggc

SEQ ID NO: 860455 - DNA, 25 bp, Mus musculus
aattctgcgaaatagacgttcgggc

SEQ ID NO: 860456 - DNA, 25 bp, Mus musculus
aattcttcacctactacagacaagt

SEQ ID NO: 860457 - DNA, 25 bp, Mus musculus
aattcttcaccttctacagacaagt

SEQ ID NO: 860458 - DNA, 25 bp, Mus musculus
aattgaagagcgcaaactggttgga

SEQ ID NO: 860459 - DNA, 25 bp, Mus musculus
aattgaagagggcaaactggttgga

SEQ ID NO: 860460 - DNA, 25 bp, Mus musculus
aattgaagcagcaggcaatttgtaa

SEQ ID NO: 860461 - DNA, 25 bp, Mus musculus
aattgaagcagccacgcaatttgta

SEQ ID NO: 860462 - DNA, 25 bp, Mus musculus
aattgaagcagccaggcaatttgta

SEQ ID NO: 860463 - DNA, 25 bp, Mus musculus
aattgaagcagctggcaatttgtaa

SEQ ID NO: 860464 - DNA, 25 bp, Mus musculus
aattgaatgtgacgtaataaatctg

SEQ ID NO: 860465 - DNA, 25 bp, Mus musculus
aattgaatgtgaggtaataaatctg

SEQ ID NO: 860466 - DNA, 25 bp, Mus musculus
aattgacaagcattttctacaagga

SEQ ID NO: 860467 - DNA, 25 bp, Mus musculus
aattgacaaggattttctacaagga

SEQ ID NO: 860468 - DNA, 25 bp, Mus musculus
aattgataaccagccaagcattgac

SEQ ID NO: 860469 - DNA, 25 bp, Mus musculus
aattgataacgagccaagcattgac

SEQ ID NO: 860470 - DNA, 25 bp, Mus musculus
aattgataatctagacgtgaacaga

SEQ ID NO: 860471 - DNA, 25 bp, Mus musculus
aattgataatcttgacgtgaacaga

SEQ ID NO: 860472 - DNA, 25 bp, Mus musculus
aattgatcataaagctgaccttgca

SEQ ID NO: 860473 - DNA, 25 bp, Mus musculus
aattgatcattaagctgaccttgca

SEQ ID NO: 860474 - DNA, 25 bp, Mus musculus
aattgatgagatggttggtaaaggc

SEQ ID NO: 860475 - DNA, 25 bp, Mus musculus
aattgatgagttggttggtaaaggc

SEQ ID NO: 860476 - DNA, 25 bp, Mus musculus
aattgatgttagcatggatgaaacc

SEQ ID NO: 860477 - DNA, 25 bp, Mus musculus
aattgatgttaggatggatgaaacc

SEQ ID NO: 860478 - DNA, 25 bp, Mus musculus
aattgattgaggactctcaaagaag

SEQ ID NO: 860479 - DNA, 25 bp, Mus musculus
aattgattgaggtctctcaaagaag

SEQ ID NO: 860480 - DNA, 25 bp, Mus musculus
aattgcaaagagtactgggactaaa

SEQ ID NO: 860481 - DNA, 25 bp, Mus musculus
aattgcaaagatgtgtccaggtgtg

SEQ ID NO: 860482 - DNA, 25 bp, Mus musculus
aattgcaaagcttcagtggttctct

SEQ ID NO: 860483 - DNA, 25 bp, Mus musculus
aattgcaaagcttctgtggttctct

SEQ ID NO: 860484 - DNA, 25 bp, Mus musculus
aattgcaaagtgtactgggactaaa

SEQ ID NO: 860485 - DNA, 25 bp, Mus musculus
aattgcaaagttgtgtccaggtgtg

SEQ ID NO: 860486 - DNA, 25 bp, Mus musculus
aattgcagaaataggcagatttgta

SEQ ID NO: 860487 - DNA, 25 bp, Mus musculus
aattgcagaaattggcagatttgta

SEQ ID NO: 860488 - DNA, 25 bp, Mus musculus
aattgcagtaaacattgtgcaagat

SEQ ID NO: 860489 - DNA, 25 bp, Mus musculus
aattgcagtaaagattgtgcaagat

SEQ ID NO: 860490 - DNA, 25 bp, Mus musculus
aattgccaatcctacaactaaacca

SEQ ID NO: 860491 - DNA, 25 bp, Mus musculus
aattgccaatgctacaactaaacca

SEQ ID NO: 860492 - DNA, 25 bp, Mus musculus
aattgcccagaatttaacagacctg

SEQ ID NO: 860493 - DNA, 25 bp, Mus musculus
aattgcccagcactcgttaatgttg

SEQ ID NO: 860494 - DNA, 25 bp, Mus musculus
aattgcccaggactcgttaatgttg

SEQ ID NO: 860495 - DNA, 25 bp, Mus musculus
aattgcccagtatttaacagacctg

SEQ ID NO: 860496 - DNA, 25 bp, Mus musculus
aattgcgcaacgcatcaacgtcaat

SEQ ID NO: 860497 - DNA, 25 bp, Mus musculus
aattgcgcaaggcatcaacgtcaat

SEQ ID NO: 860498 - DNA, 25 bp, Mus musculus
aattgctcagcaaactcacaggccc

SEQ ID NO: 860499 - DNA, 25 bp, Mus musculus
aattgctcagccgagagcaggcttt

SEQ ID NO: 860500 - DNA, 25 bp, Mus musculus
aattgctcaggaaactcacaggccc

SEQ ID NO: 860501 - DNA, 25 bp, Mus musculus
aattgctcaggcgagagcaggcttt

SEQ ID NO: 860502 - DNA, 25 bp, Mus musculus
aattgctctgataagctggcccaaa

SEQ ID NO: 860503 - DNA, 25 bp, Mus musculus
aattgctctgttaagctggcccaaa

SEQ ID NO: 860504 - DNA, 25 bp, Mus musculus
aattgctgataacatctcccttgat

SEQ ID NO: 860505 - DNA, 25 bp, Mus musculus
aattgctgataacatgtctggtgag

SEQ ID NO: 860506 - DNA, 25 bp, Mus musculus
aattgctgataagatctcccttgat

SEQ ID NO: 860507 - DNA, 25 bp, Mus musculus
aattgctgataagatgtctggtgag

SEQ ID NO: 860508 - DNA, 25 bp, Mus musculus
aattgcttcagcaaaaccaaatgca

SEQ ID NO: 860509 - DNA, 25 bp, Mus musculus
aattgcttcagctaaaccaaatgca

SEQ ID NO: 860510 - DNA, 25 bp, Mus musculus
aattggaaagacagtgatgtgactc

SEQ ID NO: 860511 - DNA, 25 bp, Mus musculus
aattggaaagctatctggccaggaa

SEQ ID NO: 860512 - DNA, 25 bp, Mus musculus
aattggaaaggtatctggccaggaa

SEQ ID NO: 860513 - DNA, 25 bp, Mus musculus
aattggaaagtcagtgatgtgactc

SEQ ID NO: 860514 - DNA, 25 bp, Mus musculus
aattggacagctccttcattttgag

SEQ ID NO: 860515 - DNA, 25 bp, Mus musculus
aattggacaggtccttcattttgag

SEQ ID NO: 860516 - DNA, 25 bp, Mus musculus
aattggagaagtccaaaaggatgat

SEQ ID NO: 860517 - DNA, 25 bp, Mus musculus
aattggagaagtgcaaaaggatgat

SEQ ID NO: 860518 - DNA, 25 bp, Mus musculus
aattggaggagagacaatgactctg

SEQ ID NO: 860519 - DNA, 25 bp, Mus musculus
aattggaggagagacgtacaatttc

SEQ ID NO: 860520 - DNA, 25 bp, Mus musculus
aattggaggagagagaatgactctg

SEQ ID NO: 860521 - DNA, 25 bp, Mus musculus
aattggaggagagaggtacaatttc

SEQ ID NO: 860522 - DNA, 25 bp, Mus musculus
aattggcatcaccttgtttgggccc

SEQ ID NO: 860523 - DNA, 25 bp, Mus musculus
aattggcatcacgttgtttgggccc

SEQ ID NO: 860524 - DNA, 25 bp, Mus musculus
aattggctagctttgagatttctaa

SEQ ID NO: 860525 - DNA, 25 bp, Mus musculus
aattggctaggtttgagatttctaa

SEQ ID NO: 860526 - DNA, 25 bp, Mus musculus
aattggggataaagagtactggaat

SEQ ID NO: 860527 - DNA, 25 bp, Mus musculus
aattggggataaagtgtactggaat

SEQ ID NO: 860528 - DNA, 25 bp, Mus musculus
aattgggggaagctggattcagcta

SEQ ID NO: 860529 - DNA, 25 bp, Mus musculus
aattgggggaaggtggattcagcta

SEQ ID NO: 860530 - DNA, 25 bp, Mus musculus
aattgggtacaactggttctataga

SEQ ID NO: 860531 - DNA, 25 bp, Mus musculus
aattgggtacaagtggttctataga

SEQ ID NO: 860532 - DNA, 25 bp, Mus musculus
aattgggtgtacaacatacttgggg

SEQ ID NO: 860533 - DNA, 25 bp, Mus musculus
aattgggtgtacaagatacttgggg

SEQ ID NO: 860534 - DNA, 25 bp, Mus musculus
aattggtgaaaacagcaatccagaa

SEQ ID NO: 860535 - DNA, 25 bp, Mus musculus
aattggtgaaaagagcaatccagaa

SEQ ID NO: 860536 - DNA, 25 bp, Mus musculus
aattggttaaagatcggaccaaatg

SEQ ID NO: 860537 - DNA, 25 bp, Mus musculus
aattggttaaagttcggaccaaatg

SEQ ID NO: 860538 - DNA, 25 bp, Mus musculus
aattgtcaggcacatgaaggatcag

SEQ ID NO: 860539 - DNA, 25 bp, Mus musculus
aattgtcagggacatgaaggatcag

SEQ ID NO: 860540 - DNA, 25 bp, Mus musculus
aattgtcttgatatggacgaatgct

SEQ ID NO: 860541 - DNA, 25 bp, Mus musculus
aattgtcttgttatggacgaatgct

SEQ ID NO: 860542 - DNA, 25 bp, Mus musculus
aattgtgaggatgagcccatggatt

SEQ ID NO: 860543 - DNA, 25 bp, Mus musculus
aattgtgaggttgagcccatggatt

SEQ ID NO: 860544 - DNA, 25 bp, Mus musculus
aattgtgctacacgttgattttcct

SEQ ID NO: 860545 - DNA, 25 bp, Mus musculus
aattgtgctacaggttgattttcct

SEQ ID NO: 860546 - DNA, 25 bp, Mus musculus
aattgtgtggccaaagccaaacttg

SEQ ID NO: 860547 - DNA, 25 bp, Mus musculus
aattgtgtggccaaagggacagtac

SEQ ID NO: 860548 - DNA, 25 bp, Mus musculus
aattgtgtggccaatgccaaacttg

SEQ ID NO: 860549 - DNA, 25 bp, Mus musculus
aattgtgtggccaatgggacagtac

SEQ ID NO: 860550 - DNA, 25 bp, Mus musculus
aattgttgaaaacatccaagcaaag

SEQ ID NO: 860551 - DNA, 25 bp, Mus musculus
aattgttgaaaagatccaagcaaag

SEQ ID NO: 860552 - DNA, 25 bp, Mus musculus
aattgtttggccttggatctctgcg

SEQ ID NO: 860553 - DNA, 25 bp, Mus musculus
aattgtttgggcttggatctctgcg

SEQ ID NO: 860554 - DNA, 25 bp, Mus musculus
aatttaaacgccacaactctgatgc

SEQ ID NO: 860555 - DNA, 25 bp, Mus musculus
aatttaaacgccactactctgatgc

SEQ ID NO: 860556 - DNA, 25 bp, Mus musculus
aatttaaatatgactagagtggatg

SEQ ID NO: 860557 - DNA, 25 bp, Mus musculus
aatttaaatatgtctagagtggatg

SEQ ID NO: 860558 - DNA, 25 bp, Mus musculus
aatttacacgaccactgcagcccct

SEQ ID NO: 860559 - DNA, 25 bp, Mus musculus
aatttacacgaccagtgcagcccct

SEQ ID NO: 860560 - DNA, 25 bp, Mus musculus
aatttactaaaacacgcatcaggaa

SEQ ID NO: 860561 - DNA, 25 bp, Mus musculus
aatttactaaaacaggcatcaggaa

SEQ ID NO: 860562 - DNA, 25 bp, Mus musculus
aatttagccactgtcttgagctgct

SEQ ID NO: 860563 - DNA, 25 bp, Mus musculus
aatttagccagtgtcttgagctgct

SEQ ID NO: 860564 - DNA, 25 bp, Mus musculus
aatttatgccattagttggagtcct

SEQ ID NO: 860565 - DNA, 25 bp, Mus musculus
aatttatgcctttagttggagtcct

SEQ ID NO: 860566 - DNA, 25 bp, Mus musculus
aatttcaagatgattacatagtcat

SEQ ID NO: 860567 - DNA, 25 bp, Mus musculus
aatttcaagatgtttacatagtcat

SEQ ID NO: 860568 - DNA, 25 bp, Mus musculus
aatttcagagcgccttcagcggctc

SEQ ID NO: 860569 - DNA, 25 bp, Mus musculus
aatttcagagggccttcagcggctc

SEQ ID NO: 860570 - DNA, 25 bp, Mus musculus
aatttcatagatgctatgctgatgg

SEQ ID NO: 860571 - DNA, 25 bp, Mus musculus
aatttcatagttgctatgctgatgg

SEQ ID NO: 860572 - DNA, 25 bp, Mus musculus
aatttccagaagcacgtgtccccag

SEQ ID NO: 860573 - DNA, 25 bp, Mus musculus
aatttccagaagcaggtgtccccag

SEQ ID NO: 860574 - DNA, 25 bp, Mus musculus
aatttccaggcacgctcatggcaga

SEQ ID NO: 860575 - DNA, 25 bp, Mus musculus
aatttccaggcaggctcatggcaga

SEQ ID NO: 860576 - DNA, 25 bp, Mus musculus
aatttcctggccgtgaagagcatcc

SEQ ID NO: 860577 - DNA, 25 bp, Mus musculus
aatttcctgggcgtgaagagcatcc

SEQ ID NO: 860578 - DNA, 25 bp, Mus musculus
aatttcgtcttctgcctggctggag

SEQ ID NO: 860579 - DNA, 25 bp, Mus musculus
aatttcgtcttctggctggctggag

SEQ ID NO: 860580 - DNA, 25 bp, Mus musculus
aatttctattgtagtcaactttgcc

SEQ ID NO: 860581 - DNA, 25 bp, Mus musculus
aatttctattgttgtcaactttgcc

SEQ ID NO: 860582 - DNA, 25 bp, Mus musculus
aatttgacagcaaacgctcccggat

SEQ ID NO: 860583 - DNA, 25 bp, Mus musculus
aatttgacagcaaaggctcccggat

SEQ ID NO: 860584 - DNA, 25 bp, Mus musculus
aatttgcaaaatcgttcattcccaa

SEQ ID NO: 860585 - DNA, 25 bp, Mus musculus
aatttgcaaaccagctactgaagaa

SEQ ID NO: 860586 - DNA, 25 bp, Mus musculus
aatttgcaaagcagctactgaagaa

SEQ ID NO: 860587 - DNA, 25 bp, Mus musculus
aatttgcaaattcgttcattcccaa

SEQ ID NO: 860588 - DNA, 25 bp, Mus musculus
aatttgccagcaatgtagtagaaaa

SEQ ID NO: 860589 - DNA, 25 bp, Mus musculus
aatttgccaggaatgtagtagaaaa

SEQ ID NO: 860590 - DNA, 25 bp, Mus musculus
aatttgctgtagacattttaagtct

SEQ ID NO: 860591 - DNA, 25 bp, Mus musculus
aatttgctgttgacattttaagtct

SEQ ID NO: 860592 - DNA, 25 bp, Mus musculus
aatttggaaatcattacttgtatca

SEQ ID NO: 860593 - DNA, 25 bp, Mus musculus
aatttggaaatctttacttgtatca

SEQ ID NO: 860594 - DNA, 25 bp, Mus musculus
aatttggagaagctacattattttg

SEQ ID NO: 860595 - DNA, 25 bp, Mus musculus
aatttggagaaggtacattattttg

SEQ ID NO: 860596 - DNA, 25 bp, Mus musculus
aatttggggctgctcatatggaggg

SEQ ID NO: 860597 - DNA, 25 bp, Mus musculus
aatttggggctggtcatatggaggg

SEQ ID NO: 860598 - DNA, 25 bp, Mus musculus
aatttgtgagcacaacatgttacta

SEQ ID NO: 860599 - DNA, 25 bp, Mus musculus
aatttgtgagcacgtgtccacaaag

SEQ ID NO: 860600 - DNA, 25 bp, Mus musculus
aatttgtgagcagaacatgttacta

SEQ ID NO: 860601 - DNA, 25 bp, Mus musculus
aatttgtgagcaggtgtccacaaag

SEQ ID NO: 860602 - DNA, 25 bp, Mus musculus
aatttgttggcagactgaacctgat

SEQ ID NO: 860603 - DNA, 25 bp, Mus musculus
aatttgttggcagagtgaacctgat

SEQ ID NO: 860604 - DNA, 25 bp, Mus musculus
aattttatcacacacgaactgaaga

SEQ ID NO: 860605 - DNA, 25 bp, Mus musculus
aattttatcacacaggaactgaaga

SEQ ID NO: 860606 - DNA, 25 bp, Mus musculus
aattttcaaaccaaagatagcagag

SEQ ID NO: 860607 - DNA, 25 bp, Mus musculus
aattttcaaaccaatgatagcagag

SEQ ID NO: 860608 - DNA, 25 bp, Mus musculus
aattttccagatccagtgcagactc

SEQ ID NO: 860609 - DNA, 25 bp, Mus musculus
aattttccagctccactggtctcca

SEQ ID NO: 860610 - DNA, 25 bp, Mus musculus
aattttccaggtccactggtctcca

SEQ ID NO: 860611 - DNA, 25 bp, Mus musculus
aattttccagttccagtgcagactc

SEQ ID NO: 860612 - DNA, 25 bp, Mus musculus
aatttttattcgcctcaacagagca

SEQ ID NO: 860613 - DNA, 25 bp, Mus musculus
aatttttattcggctcaacagagca

SEQ ID NO: 860614 - DNA, 25 bp, Mus musculus
aatttttcagcccgtttgcttatgt

SEQ ID NO: 860615 - DNA, 25 bp, Mus musculus
aatttttcaggccgtttgcttatgt

SEQ ID NO: 860616 - DNA, 25 bp, Mus musculus
aatttttgacaacgcacggcaagct

SEQ ID NO: 860617 - DNA, 25 bp, Mus musculus
aatttttgacaaggcacggcaagct

SEQ ID NO: 860618 - DNA, 25 bp, Mus musculus
aatttttgagatgcgatgatgacca

SEQ ID NO: 860619 - DNA, 25 bp, Mus musculus
aatttttgagttgcgatgatgacca

SEQ ID NO: 860620 - DNA, 25 bp, Mus musculus
acaaaaaatgagaactggctcatta

SEQ ID NO: 860621 - DNA, 25 bp, Mus musculus
acaaaaaatgagtactggctcatta

SEQ ID NO: 860622 - DNA, 25 bp, Mus musculus
acaaaaacagcttatagagcacaaa

SEQ ID NO: 860623 - DNA, 25 bp, Mus musculus
acaaaaacaggttatagagcacaaa

SEQ ID NO: 860624 - DNA, 25 bp, Mus musculus
acaaaaacccaaagccagctcctgt

SEQ ID NO: 860625 - DNA, 25 bp, Mus musculus
acaaaaacccaatgccagctcctgt

SEQ ID NO: 860626 - DNA, 25 bp, Mus musculus
acaaaaagccagcaccaagtgatct

SEQ ID NO: 860627 - DNA, 25 bp, Mus musculus
acaaaaagccagcgatggctgtgtg

SEQ ID NO: 860628 - DNA, 25 bp, Mus musculus
acaaaaagccaggaccaagtgatct

SEQ ID NO: 860629 - DNA, 25 bp, Mus musculus
acaaaaagccagggatggctgtgtg

SEQ ID NO: 860630 - DNA, 25 bp, Mus musculus
acaaaaatggtggacgtgcgttcct

SEQ ID NO: 860631 - DNA, 25 bp, Mus musculus
acaaaaatggtggaggtgcgttcct

SEQ ID NO: 860632 - DNA, 25 bp, Mus musculus
acaaaagcaaagatttgcaacattg

SEQ ID NO: 860633 - DNA, 25 bp, Mus musculus
acaaaagcaaagttttgcaacattg

SEQ ID NO: 860634 - DNA, 25 bp, Mus musculus
acaaaagtttatcaattcccatctg

SEQ ID NO: 860635 - DNA, 25 bp, Mus musculus
acaaaagtttatgaattcccatctg

SEQ ID NO: 860636 - DNA, 25 bp, Mus musculus
acaaaatcatagagcccatccagtc

SEQ ID NO: 860637 - DNA, 25 bp, Mus musculus
acaaaatcatagtgcccatccagtc

SEQ ID NO: 860638 - DNA, 25 bp, Mus musculus
acaaaatcattacataacaactatt

SEQ ID NO: 860639 - DNA, 25 bp, Mus musculus
acaaaatcattagataacaactatt

SEQ ID NO: 860640 - DNA, 25 bp, Mus musculus
acaaaattgaatcacgtgaactgga

SEQ ID NO: 860641 - DNA, 25 bp, Mus musculus
acaaaattgaatcaggtgaactgga

SEQ ID NO: 860642 - DNA, 25 bp, Mus musculus
acaaacaacgagctaagttcagatg

SEQ ID NO: 860643 - DNA, 25 bp, Mus musculus
acaaacaacgtgctaagttcagatg

SEQ ID NO: 860644 - DNA, 25 bp, Mus musculus
acaaacaagattaccgccgaagact

SEQ ID NO: 860645 - DNA, 25 bp, Mus musculus
acaaacaagattaccgtacagcaag

SEQ ID NO: 860646 - DNA, 25 bp, Mus musculus
acaaacaagattacggccgaagact

SEQ ID NO: 860647 - DNA, 25 bp, Mus musculus
acaaacaagattacggtacagcaag

SEQ ID NO: 860648 - DNA, 25 bp, Mus musculus
acaaacaataatgaagacaactgga

SEQ ID NO: 860649 - DNA, 25 bp, Mus musculus
acaaacaataatgatgacaactgga

SEQ ID NO: 860650 - DNA, 25 bp, Mus musculus
acaaacacccagctcattgatggct

SEQ ID NO: 860651 - DNA, 25 bp, Mus musculus
acaaacacccaggtcattgatggct

SEQ ID NO: 860652 - DNA, 25 bp, Mus musculus
acaaacacgacagtccctgacctca

SEQ ID NO: 860653 - DNA, 25 bp, Mus musculus
acaaacacgagagtccctgacctca

SEQ ID NO: 860654 - DNA, 25 bp, Mus musculus
acaaacagaaagcaacaaggatgac

SEQ ID NO: 860655 - DNA, 25 bp, Mus musculus
acaaacagaacagaaaagaaatggt

SEQ ID NO: 860656 - DNA, 25 bp, Mus musculus
acaaacagaagagaaaagaaatggt

SEQ ID NO: 860657 - DNA, 25 bp, Mus musculus
acaaacagaatgcaacaaggatgac

SEQ ID NO: 860658 - DNA, 25 bp, Mus musculus
acaaacagagcgcagagaatactca

SEQ ID NO: 860659 - DNA, 25 bp, Mus musculus
acaaacagagggcagagaatactca

SEQ ID NO: 860660 - DNA, 25 bp, Mus musculus
acaaacagcccgatttgaccgcaac

SEQ ID NO: 860661 - DNA, 25 bp, Mus musculus
acaaacagcccgttttgaccgcaac

SEQ ID NO: 860662 - DNA, 25 bp, Mus musculus
acaaacatacagcggaaatatcaga

SEQ ID NO: 860663 - DNA, 25 bp, Mus musculus
acaaacatacaggggaaatatcaga

SEQ ID NO: 860664 - DNA, 25 bp, Mus musculus
acaaaccaggcacctatatcttccg

SEQ ID NO: 860665 - DNA, 25 bp, Mus musculus
acaaaccaggcagctatatcttccg

SEQ ID NO: 860666 - DNA, 25 bp, Mus musculus
acaaacgaacaacactctgacacca

SEQ ID NO: 860667 - DNA, 25 bp, Mus musculus
acaaacgaacaaccaggttcaggag

SEQ ID NO: 860668 - DNA, 25 bp, Mus musculus
acaaacgaacaagactctgacacca

SEQ ID NO: 860669 - DNA, 25 bp, Mus musculus
acaaacgaacaagcaggttcaggag

SEQ ID NO: 860670 - DNA, 25 bp, Mus musculus
acaaacttaaagacaggcaagagat

SEQ ID NO: 860671 - DNA, 25 bp, Mus musculus
acaaacttaaagccagtcaggcaag

SEQ ID NO: 860672 - DNA, 25 bp, Mus musculus
acaaacttaaaggcagtcaggcaag

SEQ ID NO: 860673 - DNA, 25 bp, Mus musculus
acaaacttaaagtcaggcaagagat

SEQ ID NO: 860674 - DNA, 25 bp, Mus musculus
acaaagaacaagcctccgactgtga

SEQ ID NO: 860675 - DNA, 25 bp, Mus musculus
acaaagaacaaggctccgactgtga

SEQ ID NO: 860676 - DNA, 25 bp, Mus musculus
acaaagagagctggaaagtctttga

SEQ ID NO: 860677 - DNA, 25 bp, Mus musculus
acaaagagaggtggaaagtctttga

SEQ ID NO: 860678 - DNA, 25 bp, Mus musculus
acaaagatgactggataagtggagc

SEQ ID NO: 860679 - DNA, 25 bp, Mus musculus
acaaagatgagtggataagtggagc

SEQ ID NO: 860680 - DNA, 25 bp, Mus musculus
acaaagatgccacgggatctgagtg

SEQ ID NO: 860681 - DNA, 25 bp, Mus musculus
acaaagatgccaggggatctgagtg

SEQ ID NO: 860682 - DNA, 25 bp, Mus musculus
acaaagatggacaactgctcttcca

SEQ ID NO: 860683 - DNA, 25 bp, Mus musculus
acaaagatggacaagtgctcttcca

SEQ ID NO: 860684 - DNA, 25 bp, Mus musculus
acaaagcaacagatcttgatcaact

SEQ ID NO: 860685 - DNA, 25 bp, Mus musculus
acaaagcaacagatgttgatcaact

SEQ ID NO: 860686 - DNA, 25 bp, Mus musculus
acaaagcagaagaactggatccaaa

SEQ ID NO: 860687 - DNA, 25 bp, Mus musculus
acaaagcagaagaagtggatccaaa

SEQ ID NO: 860688 - DNA, 25 bp, Mus musculus
acaaagcagatttaaagaacccaat

SEQ ID NO: 860689 - DNA, 25 bp, Mus musculus
acaaagcagatttatagaacccaat

SEQ ID NO: 860690 - DNA, 25 bp, Mus musculus
acaaagccagctaccgagtctattg

SEQ ID NO: 860691 - DNA, 25 bp, Mus musculus
acaaagccaggtaccgagtctattg

SEQ ID NO: 860692 - DNA, 25 bp, Mus musculus
acaaagccccagccattcttcagca

SEQ ID NO: 860693 - DNA, 25 bp, Mus musculus
acaaagccccaggcattcttcagca

SEQ ID NO: 860694 - DNA, 25 bp, Mus musculus
acaaagcccctgatccctgggacta

SEQ ID NO: 860695 - DNA, 25 bp, Mus musculus
acaaagcccctgatgcctgggacta

SEQ ID NO: 860696 - DNA, 25 bp, Mus musculus
acaaagctagcagactctctgtaga

SEQ ID NO: 860697 - DNA, 25 bp, Mus musculus
acaaagctagcagagtctctgtaga

SEQ ID NO: 860698 - DNA, 25 bp, Mus musculus
acaaagctccagctggagtgtcatc

SEQ ID NO: 860699 - DNA, 25 bp, Mus musculus
acaaagctccaggtggagtgtcatc

SEQ ID NO: 860700 - DNA, 25 bp, Mus musculus
acaaagtaagccagaatggctacaa

SEQ ID NO: 860701 - DNA, 25 bp, Mus musculus
acaaagtaagcctgaatggctacaa

SEQ ID NO: 860702 - DNA, 25 bp, Mus musculus
acaaagtgcgatccgctgttcctgg

SEQ ID NO: 860703 - DNA, 25 bp, Mus musculus
acaaagtgcgatccgtcgtccccca

SEQ ID NO: 860704 - DNA, 25 bp, Mus musculus
acaaagtgcgatgcgctgttcctgg

SEQ ID NO: 860705 - DNA, 25 bp, Mus musculus
acaaagtgcgatgcgtcgtccccca

SEQ ID NO: 860706 - DNA, 25 bp, Mus musculus
acaaagtttcagcggagctctttgc

SEQ ID NO: 860707 - DNA, 25 bp, Mus musculus
acaaagtttcaggggagctctttgc

SEQ ID NO: 860708 - DNA, 25 bp, Mus musculus
acaaataatactgcttacagacaca

SEQ ID NO: 860709 - DNA, 25 bp, Mus musculus
acaaataatagtgcttacagacaca

SEQ ID NO: 860710 - DNA, 25 bp, Mus musculus
acaaatagagcctacgagaactatg

SEQ ID NO: 860711 - DNA, 25 bp, Mus musculus
acaaatagaggctacgagaactatg

SEQ ID NO: 860712 - DNA, 25 bp, Mus musculus
acaaatcaaaagctgtgatccttgc

SEQ ID NO: 860713 - DNA, 25 bp, Mus musculus
acaaatcaaaaggtgtgatccttgc

SEQ ID NO: 860714 - DNA, 25 bp, Mus musculus
acaaatcaagctgattcccaaacga

SEQ ID NO: 860715 - DNA, 25 bp, Mus musculus
acaaatcaaggtgattcccaaacga

SEQ ID NO: 860716 - DNA, 25 bp, Mus musculus
acaaatcattggaggaggctgagaa

SEQ ID NO: 860717 - DNA, 25 bp, Mus musculus
acaaatcattggtggaggctgagaa

SEQ ID NO: 860718 - DNA, 25 bp, Mus musculus
acaaatcctcctggctcctcccacc

SEQ ID NO: 860719 - DNA, 25 bp, Mus musculus
acaaatcctcgtggctcctcccacc

SEQ ID NO: 860720 - DNA, 25 bp, Mus musculus
acaaatcgattcaacgatcgcattg

SEQ ID NO: 860721 - DNA, 25 bp, Mus musculus
acaaatcgattcaaggatcgcattg

SEQ ID NO: 860722 - DNA, 25 bp, Mus musculus
acaaatctgtcgctagtggtggttg

SEQ ID NO: 860723 - DNA, 25 bp, Mus musculus
acaaatctgtcggtagtggtggttg

SEQ ID NO: 860724 - DNA, 25 bp, Mus musculus
acaaatgacacccagtcttctggga

SEQ ID NO: 860725 - DNA, 25 bp, Mus musculus
acaaatgacagccagtcttctggga

SEQ ID NO: 860726 - DNA, 25 bp, Mus musculus
acaaatgatggactgtgtgtccctg

SEQ ID NO: 860727 - DNA, 25 bp, Mus musculus
acaaatgatggagtgtgtgtccctg

SEQ ID NO: 860728 - DNA, 25 bp, Mus musculus
acaaatgcaggcaatgcaacgctgc

SEQ ID NO: 860729 - DNA, 25 bp, Mus musculus
acaaatgcaggctatgcaacgctgc

SEQ ID NO: 860730 - DNA, 25 bp, Mus musculus
acaaatgctgcctaaaacgctgcgg

SEQ ID NO: 860731 - DNA, 25 bp, Mus musculus
acaaatgctggctaaaacgctgcgg

SEQ ID NO: 860732 - DNA, 25 bp, Mus musculus
acaaatgtgaagcccgaggtggtaa

SEQ ID NO: 860733 - DNA, 25 bp, Mus musculus
acaaatgtgaaggccgaggtggtaa

SEQ ID NO: 860734 - DNA, 25 bp, Mus musculus
acaaatttgccaccaatgtagtaga

SEQ ID NO: 860735 - DNA, 25 bp, Mus musculus
acaaatttgccagcaatgtagtaga

SEQ ID NO: 860736 - DNA, 25 bp, Mus musculus
acaacaaaaatgcctcaaactcaga

SEQ ID NO: 860737 - DNA, 25 bp, Mus musculus
acaacaaaaatggctcaaactcaga

SEQ ID NO: 860738 - DNA, 25 bp, Mus musculus
acaacaacaaaaatcgctcaaactc

SEQ ID NO: 860739 - DNA, 25 bp, Mus musculus
acaacaacaaaaatggctcaaactc

SEQ ID NO: 860740 - DNA, 25 bp, Mus musculus
acaacaacataacgtgcttcaagaa

SEQ ID NO: 860741 - DNA, 25 bp, Mus musculus
acaacaacataaggtgcttcaagaa

SEQ ID NO: 860742 - DNA, 25 bp, Mus musculus
acaacaagaacctctgtgtccagat

SEQ ID NO: 860743 - DNA, 25 bp, Mus musculus
acaacaagaagctctgtgtccagat

SEQ ID NO: 860744 - DNA, 25 bp, Mus musculus
acaacaagcacaagttctgcctatc

SEQ ID NO: 860745 - DNA, 25 bp, Mus musculus
acaacaagcacatgttctgcctatc

SEQ ID NO: 860746 - DNA, 25 bp, Mus musculus
acaacaagctagcacgctacctgca

SEQ ID NO: 860747 - DNA, 25 bp, Mus musculus
acaacaagctagcaggctacctgca

SEQ ID NO: 860748 - DNA, 25 bp, Mus musculus
acaacaattccaaagattttggcca

SEQ ID NO: 860749 - DNA, 25 bp, Mus musculus
acaacaattccatagattttggcca

SEQ ID NO: 860750 - DNA, 25 bp, Mus musculus
acaacacaaaaaccttcctagagga

SEQ ID NO: 860751 - DNA, 25 bp, Mus musculus
acaacacaaaaagcttcctagagga

SEQ ID NO: 860752 - DNA, 25 bp, Mus musculus
acaacacagtgccacgcaggtcgga

SEQ ID NO: 860753 - DNA, 25 bp, Mus musculus
acaacacagtgccacggagcccaga

SEQ ID NO: 860754 - DNA, 25 bp, Mus musculus
acaacacagtgccaggcaggtcgga

SEQ ID NO: 860755 - DNA, 25 bp, Mus musculus
acaacacagtgccagggagcccaga

SEQ ID NO: 860756 - DNA, 25 bp, Mus musculus
acaacaccaagacaggtattgtggc

SEQ ID NO: 860757 - DNA, 25 bp, Mus musculus
acaacaccaagaccttactggcggt

SEQ ID NO: 860758 - DNA, 25 bp, Mus musculus
acaacaccaagagaggtattgtggc

SEQ ID NO: 860759 - DNA, 25 bp, Mus musculus
acaacaccaagagcttactggcggt

SEQ ID NO: 860760 - DNA, 25 bp, Mus musculus
acaacaccatcacgctgtgggacat

SEQ ID NO: 860761 - DNA, 25 bp, Mus musculus
acaacaccatcaggctgtgggacat

SEQ ID NO: 860762 - DNA, 25 bp, Mus musculus
acaacacccacccagtggtcaactc

SEQ ID NO: 860763 - DNA, 25 bp, Mus musculus
acaacacccaccctggtcaactcac

SEQ ID NO: 860764 - DNA, 25 bp, Mus musculus
acaacacccaccgagtggtcaactc

SEQ ID NO: 860765 - DNA, 25 bp, Mus musculus
acaacacccaccgtggtcaactcac

SEQ ID NO: 860766 - DNA, 25 bp, Mus musculus
acaacacctatttactggaactctg

SEQ ID NO: 860767 - DNA, 25 bp, Mus musculus
acaacacctatttagtggaactctg

SEQ ID NO: 860768 - DNA, 25 bp, Mus musculus
acaacacctgttcacctgtgcctcc

SEQ ID NO: 860769 - DNA, 25 bp, Mus musculus
acaacacctgttcagctgtgcctcc

SEQ ID NO: 860770 - DNA, 25 bp, Mus musculus
acaacagacgtcgacgtgttaatgg

SEQ ID NO: 860771 - DNA, 25 bp, Mus musculus
acaacagacgtcgaggtgttaatgg

SEQ ID NO: 860772 - DNA, 25 bp, Mus musculus
acaacagcaaagcaatttgcagatt

SEQ ID NO: 860773 - DNA, 25 bp, Mus musculus
acaacagcaaaggaatttgcagatt

SEQ ID NO: 860774 - DNA, 25 bp, Mus musculus
acaacagcaccacacgaaaagttga

SEQ ID NO: 860775 - DNA, 25 bp, Mus musculus
acaacagcaccacaggaaaagttga

SEQ ID NO: 860776 - DNA, 25 bp, Mus musculus
acaacagcagatcccagcatggtca

SEQ ID NO: 860777 - DNA, 25 bp, Mus musculus
acaacagcagttcccagcatggtca

SEQ ID NO: 860778 - DNA, 25 bp, Mus musculus
acaacagcataaaccatatgtgtca

SEQ ID NO: 860779 - DNA, 25 bp, Mus musculus
acaacagcataaacgatatgtgtca

SEQ ID NO: 860780 - DNA, 25 bp, Mus musculus
acaacagtctcacccctgcctgctc

SEQ ID NO: 860781 - DNA, 25 bp, Mus musculus
acaacagtctcagccctgcctgctc

SEQ ID NO: 860782 - DNA, 25 bp, Mus musculus
acaacagtctgacggaggctgtact

SEQ ID NO: 860783 - DNA, 25 bp, Mus musculus
acaacagtctgagggaggctgtact

SEQ ID NO: 860784 - DNA, 25 bp, Mus musculus
acaacagtggctcgttggatccttg

SEQ ID NO: 860785 - DNA, 25 bp, Mus musculus
acaacagtggctggttggatccttg

SEQ ID NO: 860786 - DNA, 25 bp, Mus musculus
acaacataaaaattcgactctatag

SEQ ID NO: 860787 - DNA, 25 bp, Mus musculus
acaacataaaaattggactctatag

SEQ ID NO: 860788 - DNA, 25 bp, Mus musculus
acaacataagctgcttcaagaagat

SEQ ID NO: 860789 - DNA, 25 bp, Mus musculus
acaacataaggtgcttcaagaagat

SEQ ID NO: 860790 - DNA, 25 bp, Mus musculus
acaacatagatgcccgcatgtacat

SEQ ID NO: 860791 - DNA, 25 bp, Mus musculus
acaacatagatgccggcatgtacat

SEQ ID NO: 860792 - DNA, 25 bp, Mus musculus
acaacataggtcagcgctgtgtctc

SEQ ID NO: 860793 - DNA, 25 bp, Mus musculus
acaacataggtcagggctgtgtctc

SEQ ID NO: 860794 - DNA, 25 bp, Mus musculus
acaacatcaaagactccacgggcaa

SEQ ID NO: 860795 - DNA, 25 bp, Mus musculus
acaacatcaaagtctccacgggcaa

SEQ ID NO: 860796 - DNA, 25 bp, Mus musculus
acaacatcagagactggtgcatctc

SEQ ID NO: 860797 - DNA, 25 bp, Mus musculus
acaacatcagtgactggtgcatctc

SEQ ID NO: 860798 - DNA, 25 bp, Mus musculus
acaacatctgatcgaacctgtacca

SEQ ID NO: 860799 - DNA, 25 bp, Mus musculus
acaacatctgatcgtctatctccac

SEQ ID NO: 860800 - DNA, 25 bp, Mus musculus
acaacatctgatggaacctgtacca

SEQ ID NO: 860801 - DNA, 25 bp, Mus musculus
acaacatctgatggtctatctccac

SEQ ID NO: 860802 - DNA, 25 bp, Mus musculus
acaacatggaaactcccgttactct

SEQ ID NO: 860803 - DNA, 25 bp, Mus musculus
acaacatggaaagtcccgttactct

SEQ ID NO: 860804 - DNA, 25 bp, Mus musculus
acaacattacagccacgtccactgt

SEQ ID NO: 860805 - DNA, 25 bp, Mus musculus
acaacattacaggcacgtccactgt

SEQ ID NO: 860806 - DNA, 25 bp, Mus musculus
acaacattccgacgtacctgaatga

SEQ ID NO: 860807 - DNA, 25 bp, Mus musculus
acaacattccgaggtacctgaatga

SEQ ID NO: 860808 - DNA, 25 bp, Mus musculus
acaaccaaagctctgcgcagttcga

SEQ ID NO: 860809 - DNA, 25 bp, Mus musculus
acaaccaaaggtctgcgcagttcga

SEQ ID NO: 860810 - DNA, 25 bp, Mus musculus
acaaccaatgagcaatacttggacc

SEQ ID NO: 860811 - DNA, 25 bp, Mus musculus
acaaccaatgagcaatacttggatc

SEQ ID NO: 860812 - DNA, 25 bp, Mus musculus
acaaccaatgaggaatacttggacc

SEQ ID NO: 860813 - DNA, 25 bp, Mus musculus
acaaccaatgaggaatacttggatc

SEQ ID NO: 860814 - DNA, 25 bp, Mus musculus
acaaccacctgcaacgcccacgatg

SEQ ID NO: 860815 - DNA, 25 bp, Mus musculus
acaaccacctgcaaggcccacgatg

SEQ ID NO: 860816 - DNA, 25 bp, Mus musculus
acaaccactcagcgcttcacaccta

SEQ ID NO: 860817 - DNA, 25 bp, Mus musculus
acaaccactcagggcttcacaccta

SEQ ID NO: 860818 - DNA, 25 bp, Mus musculus
acaaccagagccatcttccctttgc

SEQ ID NO: 860819 - DNA, 25 bp, Mus musculus
acaaccagagccatgttccctttgc

SEQ ID NO: 860820 - DNA, 25 bp, Mus musculus
acaaccatcaagctcattattgtca

SEQ ID NO: 860821 - DNA, 25 bp, Mus musculus
acaaccatcaaggtcattattgtca

SEQ ID NO: 860822 - DNA, 25 bp, Mus musculus
acaaccatgaccttctcttgatccg

SEQ ID NO: 860823 - DNA, 25 bp, Mus musculus
acaaccatgaccttgtcttgatccg

SEQ ID NO: 860824 - DNA, 25 bp, Mus musculus
acaacccacccacgaacaattgtga

SEQ ID NO: 860825 - DNA, 25 bp, Mus musculus
acaacccacccaggaacaattgtga

SEQ ID NO: 860826 - DNA, 25 bp, Mus musculus
acaaccgcattccacagtctggggg

SEQ ID NO: 860827 - DNA, 25 bp, Mus musculus
acaaccgcattccagagtctggggg

SEQ ID NO: 860828 - DNA, 25 bp, Mus musculus
acaacctagcaacattatccagctg

SEQ ID NO: 860829 - DNA, 25 bp, Mus musculus
acaacctagcaagattatccagctg

SEQ ID NO: 860830 - DNA, 25 bp, Mus musculus
acaacctagctacacaactgtgccg

SEQ ID NO: 860831 - DNA, 25 bp, Mus musculus
acaacctagctacagaactgtgccg

SEQ ID NO: 860832 - DNA, 25 bp, Mus musculus
acaacctcaaataaagaagatacat

SEQ ID NO: 860833 - DNA, 25 bp, Mus musculus
acaacctcaaataatgaagatacat

SEQ ID NO: 860834 - DNA, 25 bp, Mus musculus
acaacctggaaccggcacacggtga

SEQ ID NO: 860835 - DNA, 25 bp, Mus musculus
acaacctggaacgggcacacggtga

SEQ ID NO: 860836 - DNA, 25 bp, Mus musculus
acaacgaaacataacgaggaagctc

SEQ ID NO: 860837 - DNA, 25 bp, Mus musculus
acaacgaaacataaggaggaagctc

SEQ ID NO: 860838 - DNA, 25 bp, Mus musculus
acaacggacacacactatcgatcga

SEQ ID NO: 860839 - DNA, 25 bp, Mus musculus
acaacggacacacagtatcgatcga

SEQ ID NO: 860840 - DNA, 25 bp, Mus musculus
acaacggatgaaagattggcaggag

SEQ ID NO: 860841 - DNA, 25 bp, Mus musculus
acaacggatgaatgattggcaggag

SEQ ID NO: 860842 - DNA, 25 bp, Mus musculus
acaactacccagcggctggatgggc

SEQ ID NO: 860843 - DNA, 25 bp, Mus musculus
acaactacccaggggctggatgggc

SEQ ID NO: 860844 - DNA, 25 bp, Mus musculus
acaactaccgccatgggcagcccat

SEQ ID NO: 860845 - DNA, 25 bp, Mus musculus
acaactaccgccttgggcagcccat

SEQ ID NO: 860846 - DNA, 25 bp, Mus musculus
acaactataaagatgtggtgacagt

SEQ ID NO: 860847 - DNA, 25 bp, Mus musculus
acaactataaagttgtggtgacagt

SEQ ID NO: 860848 - DNA, 25 bp, Mus musculus
acaactataccacgagaaacatctt

SEQ ID NO: 860849 - DNA, 25 bp, Mus musculus
acaactataccaggagaaacatctt

SEQ ID NO: 860850 - DNA, 25 bp, Mus musculus
acaactcacaacttagctcggaaaa

SEQ ID NO: 860851 - DNA, 25 bp, Mus musculus
acaactcacaactttgctcggaaaa

SEQ ID NO: 860852 - DNA, 25 bp, Mus musculus
acaactccgtgttgcgagatggcaa

SEQ ID NO: 860853 - DNA, 25 bp, Mus musculus
acaactccgtgttgggagatggcaa

SEQ ID NO: 860854 - DNA, 25 bp, Mus musculus
acaactctgactttcacctcctgac

SEQ ID NO: 860855 - DNA, 25 bp, Mus musculus
acaactctgactttgacctcctgac

SEQ ID NO: 860856 - DNA, 25 bp, Mus musculus
acaactcttgcacgatgagaaaact

SEQ ID NO: 860857 - DNA, 25 bp, Mus musculus
acaactcttgcaggatgagaaaact

SEQ ID NO: 860858 - DNA, 25 bp, Mus musculus
acaactgataaacatcccaaggaag

SEQ ID NO: 860859 - DNA, 25 bp, Mus musculus
acaactgataaagatcccaaggaag

SEQ ID NO: 860860 - DNA, 25 bp, Mus musculus
acaactgcagatgctcttgcttatg

SEQ ID NO: 860861 - DNA, 25 bp, Mus musculus
acaactgcagcctgtttggtctcga

SEQ ID NO: 860862 - DNA, 25 bp, Mus musculus
acaactgcaggctgtttggtctcga

SEQ ID NO: 860863 - DNA, 25 bp, Mus musculus
acaactgcagttgctcttgcttatg

SEQ ID NO: 860864 - DNA, 25 bp, Mus musculus
acaactgccacatccgtgatgcctt

SEQ ID NO: 860865 - DNA, 25 bp, Mus musculus
acaactgccacatcggtgatgcctt

SEQ ID NO: 860866 - DNA, 25 bp, Mus musculus
acaactgcctggatgtagatgagtg

SEQ ID NO: 860867 - DNA, 25 bp, Mus musculus
acaactgcctggttgtagatgagtg

SEQ ID NO: 860868 - DNA, 25 bp, Mus musculus
acaactgctgtcagcggatgggccg

SEQ ID NO: 860869 - DNA, 25 bp, Mus musculus
acaactgctgtcaggggatgggccg

SEQ ID NO: 860870 - DNA, 25 bp, Mus musculus
acaacttaagctactgggagatcga

SEQ ID NO: 860871 - DNA, 25 bp, Mus musculus
acaacttaaggtactgggagatcga

SEQ ID NO: 860872 - DNA, 25 bp, Mus musculus
acaacttcaatgaattcctgttccg

SEQ ID NO: 860873 - DNA, 25 bp, Mus musculus
acaacttcaatgtattcctgttccg

SEQ ID NO: 860874 - DNA, 25 bp, Mus musculus
acaacttcagatatgccaagtacta

SEQ ID NO: 860875 - DNA, 25 bp, Mus musculus
acaacttcagttatgccaagtacta

SEQ ID NO: 860876 - DNA, 25 bp, Mus musculus
acaacttgacagccttagaatcaga

SEQ ID NO: 860877 - DNA, 25 bp, Mus musculus
acaacttgacaggcttagaatcaga

SEQ ID NO: 860878 - DNA, 25 bp, Mus musculus
acaacttgataacgctaaagaggcc

SEQ ID NO: 860879 - DNA, 25 bp, Mus musculus
acaacttgataaggctaaagaggcc

SEQ ID NO: 860880 - DNA, 25 bp, Mus musculus
acaacttggagacattaatattaca

SEQ ID NO: 860881 - DNA, 25 bp, Mus musculus
acaacttggagagattaatattaca

SEQ ID NO: 860882 - DNA, 25 bp, Mus musculus
acaactttgctaaacatggcagact

SEQ ID NO: 860883 - DNA, 25 bp, Mus musculus
acaactttgctaaagatggcagact

SEQ ID NO: 860884 - DNA, 25 bp, Mus musculus
acaagaaaactgatcattcgtatct

SEQ ID NO: 860885 - DNA, 25 bp, Mus musculus
acaagaaaactgttcattcgtatct

SEQ ID NO: 860886 - DNA, 25 bp, Mus musculus
acaagaaaattgagcccagagtgcc

SEQ ID NO: 860887 - DNA, 25 bp, Mus musculus
acaagaaaattgagcccagggattg

SEQ ID NO: 860888 - DNA, 25 bp, Mus musculus
acaagaaaattgtgcccagagtgcc

SEQ ID NO: 860889 - DNA, 25 bp, Mus musculus
acaagaaaattgtgcccagggattg

SEQ ID NO: 860890 - DNA, 25 bp, Mus musculus
acaagaacccaactcatccccagct

SEQ ID NO: 860891 - DNA, 25 bp, Mus musculus
acaagaacccaactgatccccagct

SEQ ID NO: 860892 - DNA, 25 bp, Mus musculus
acaagaactgaccgcactgatggag

SEQ ID NO: 860893 - DNA, 25 bp, Mus musculus
acaagaactgacggcactgatggag

SEQ ID NO: 860894 - DNA, 25 bp, Mus musculus
acaagaacttagtgatgtggagaga

SEQ ID NO: 860895 - DNA, 25 bp, Mus musculus
acaagaactttgtgatgtggagaga

SEQ ID NO: 860896 - DNA, 25 bp, Mus musculus
acaagaagatggccctctctttcag

SEQ ID NO: 860897 - DNA, 25 bp, Mus musculus
acaagaagatggccgtggcaaccct

SEQ ID NO: 860898 - DNA, 25 bp, Mus musculus
acaagaagatgggcctctctttcag

SEQ ID NO: 860899 - DNA, 25 bp, Mus musculus
acaagaagatgggcgtggcaaccct

SEQ ID NO: 860900 - DNA, 25 bp, Mus musculus
acaagaagcaagcaccccactcctg

SEQ ID NO: 860901 - DNA, 25 bp, Mus musculus
acaagaagcaagcagcccactcctg

SEQ ID NO: 860902 - DNA, 25 bp, Mus musculus
acaagaagtcttaacggtgtagtgg

SEQ ID NO: 860903 - DNA, 25 bp, Mus musculus
acaagaagtcttaagggtgtagtgg

SEQ ID NO: 860904 - DNA, 25 bp, Mus musculus
acaagaagtttgatcaattcttcaa

SEQ ID NO: 860905 - DNA, 25 bp, Mus musculus
acaagaagtttgatgaattcttcaa

SEQ ID NO: 860906 - DNA, 25 bp, Mus musculus
acaagaatacagcgaaaatggagaa

SEQ ID NO: 860907 - DNA, 25 bp, Mus musculus
acaagaatacagggaaaatggagaa

SEQ ID NO: 860908 - DNA, 25 bp, Mus musculus
acaagaatcaaatgctcttcccagc

SEQ ID NO: 860909 - DNA, 25 bp, Mus musculus
acaagaatcaaatggtcttcccagc

SEQ ID NO: 860910 - DNA, 25 bp, Mus musculus
acaagaatcaatcatacagcagctc

SEQ ID NO: 860911 - DNA, 25 bp, Mus musculus
acaagaatcaatgatacagcagctc

SEQ ID NO: 860912 - DNA, 25 bp, Mus musculus
acaagaatgaagacagaaaaaagga

SEQ ID NO: 860913 - DNA, 25 bp, Mus musculus
acaagaatgaagtcagaaaaaagga

SEQ ID NO: 860914 - DNA, 25 bp, Mus musculus
acaagaattgtttgcccttggatct

SEQ ID NO: 860915 - DNA, 25 bp, Mus musculus
acaagaattgtttggccttggatct

SEQ ID NO: 860916 - DNA, 25 bp, Mus musculus
acaagacaaaaaagatgacctccct

SEQ ID NO: 860917 - DNA, 25 bp, Mus musculus
acaagacaaataagatgacctccct

SEQ ID NO: 860918 - DNA, 25 bp, Mus musculus
acaagacacccacaatgggctacac

SEQ ID NO: 860919 - DNA, 25 bp, Mus musculus
acaagacacccagaatgggctacac

SEQ ID NO: 860920 - DNA, 25 bp, Mus musculus
acaagacattgacacaatagagtcc

SEQ ID NO: 860921 - DNA, 25 bp, Mus musculus
acaagacattgagacaatagagtcc

SEQ ID NO: 860922 - DNA, 25 bp, Mus musculus
acaagactaccaagctccacttcga

SEQ ID NO: 860923 - DNA, 25 bp, Mus musculus
acaagactaccaagtgaacaccttt

SEQ ID NO: 860924 - DNA, 25 bp, Mus musculus
acaagactaccatgctccacttcga

SEQ ID NO: 860925 - DNA, 25 bp, Mus musculus
acaagactaccatgtgaacaccttt

SEQ ID NO: 860926 - DNA, 25 bp, Mus musculus
acaagagaagatcctgatctaccac

SEQ ID NO: 860927 - DNA, 25 bp, Mus musculus
acaagagaagttcctgatctaccac

SEQ ID NO: 860928 - DNA, 25 bp, Mus musculus
acaagagatggaatacgaccataag

SEQ ID NO: 860929 - DNA, 25 bp, Mus musculus
acaagagatggattacgaccataag

SEQ ID NO: 860930 - DNA, 25 bp, Mus musculus
acaagagcagagcctcacatatctg

SEQ ID NO: 860931 - DNA, 25 bp, Mus musculus
acaagagcagaggctcacatatctg

SEQ ID NO: 860932 - DNA, 25 bp, Mus musculus
acaagagcagcccaggatctgttgt

SEQ ID NO: 860933 - DNA, 25 bp, Mus musculus
acaagagcaggccaggatctgttgt

SEQ ID NO: 860934 - DNA, 25 bp, Mus musculus
acaagagcatcatttggaggaatta

SEQ ID NO: 860935 - DNA, 25 bp, Mus musculus
acaagagcatgatttggaggaatta

SEQ ID NO: 860936 - DNA, 25 bp, Mus musculus
acaagagcatggaccactctcacac

SEQ ID NO: 860937 - DNA, 25 bp, Mus musculus
acaagagcatggacgactctcacac

SEQ ID NO: 860938 - DNA, 25 bp, Mus musculus
acaagagctgttcacctgtcccact

SEQ ID NO: 860939 - DNA, 25 bp, Mus musculus
acaagagctgttcagctgtcccact

SEQ ID NO: 860940 - DNA, 25 bp, Mus musculus
acaagagggagaaccacttaaatgg

SEQ ID NO: 860941 - DNA, 25 bp, Mus musculus
acaagagggagacaatatgctggct

SEQ ID NO: 860942 - DNA, 25 bp, Mus musculus
acaagagggagagaatatgctggct

SEQ ID NO: 860943 - DNA, 25 bp, Mus musculus
acaagagggagatccacttaaatgg

SEQ ID NO: 860944 - DNA, 25 bp, Mus musculus
acaagaggggaagaatatcggcacc

SEQ ID NO: 860945 - DNA, 25 bp, Mus musculus
acaagaggggaagattatcggcacc

SEQ ID NO: 860946 - DNA, 25 bp, Mus musculus
acaagaggtacacaaacaagtattc

SEQ ID NO: 860947 - DNA, 25 bp, Mus musculus
acaagaggtacacatacaagtattc

SEQ ID NO: 860948 - DNA, 25 bp, Mus musculus
acaagagtctgcagcaaaacagcag

SEQ ID NO: 860949 - DNA, 25 bp, Mus musculus
acaagagtctgcaggaaaacagcag

SEQ ID NO: 860950 - DNA, 25 bp, Mus musculus
acaagagtgcagaggagatgccata

SEQ ID NO: 860951 - DNA, 25 bp, Mus musculus
acaagagtgcagtggagatgccata

SEQ ID NO: 860952 - DNA, 25 bp, Mus musculus
acaagataaaagcaaaaagaagctc

SEQ ID NO: 860953 - DNA, 25 bp, Mus musculus
acaagataaaaggaaaaagaagctc

SEQ ID NO: 860954 - DNA, 25 bp, Mus musculus
acaagatccactcgtgggagaacgt

SEQ ID NO: 860955 - DNA, 25 bp, Mus musculus
acaagatccactggtgggagaacgt

SEQ ID NO: 860956 - DNA, 25 bp, Mus musculus
acaagatccagtatcacaacgtgaa

SEQ ID NO: 860957 - DNA, 25 bp, Mus musculus
acaagatccagtttcacaacgtgaa

SEQ ID NO: 860958 - DNA, 25 bp, Mus musculus
acaagatgggagccacctccaagtg

SEQ ID NO: 860959 - DNA, 25 bp, Mus musculus
acaagatgggaggcacctccaagtg

SEQ ID NO: 860960 - DNA, 25 bp, Mus musculus
acaagattgccacctggaatgtgct

SEQ ID NO: 860961 - DNA, 25 bp, Mus musculus
acaagattgccagctggaatgtgct

SEQ ID NO: 860962 - DNA, 25 bp, Mus musculus
acaagcaaggcacatgctctccaaa

SEQ ID NO: 860963 - DNA, 25 bp, Mus musculus
acaagcaagggacatgctctccaaa

SEQ ID NO: 860964 - DNA, 25 bp, Mus musculus
acaagcacaactcctaatagtacag

SEQ ID NO: 860965 - DNA, 25 bp, Mus musculus
acaagcacaacttctgcctatcttg

SEQ ID NO: 860966 - DNA, 25 bp, Mus musculus
acaagcacaagtcctaatagtacag

SEQ ID NO: 860967 - DNA, 25 bp, Mus musculus
acaagcacaagttctgcctatcttg

SEQ ID NO: 860968 - DNA, 25 bp, Mus musculus
acaagcacagcacggccctgccctg

SEQ ID NO: 860969 - DNA, 25 bp, Mus musculus
acaagcacaggacggccctgccctg

SEQ ID NO: 860970 - DNA, 25 bp, Mus musculus
acaagcagatggcacagcaaagagc

SEQ ID NO: 860971 - DNA, 25 bp, Mus musculus
acaagcagatgggacagcaaagagc

SEQ ID NO: 860972 - DNA, 25 bp, Mus musculus
acaagcagcgatcacactaatccca

SEQ ID NO: 860973 - DNA, 25 bp, Mus musculus
acaagcagcgttcacactaatccca

SEQ ID NO: 860974 - DNA, 25 bp, Mus musculus
acaagcatggaataagctcagctat

SEQ ID NO: 860975 - DNA, 25 bp, Mus musculus
acaagcatggaatatgctcagctat

SEQ ID NO: 860976 - DNA, 25 bp, Mus musculus
acaagcatggagatcagtatcaagg

SEQ ID NO: 860977 - DNA, 25 bp, Mus musculus
acaagcatggagttcagtatcaagg

SEQ ID NO: 860978 - DNA, 25 bp, Mus musculus
acaagccacaatttacacccacctc

SEQ ID NO: 860979 - DNA, 25 bp, Mus musculus
acaagccacattttacacccacctc

SEQ ID NO: 860980 - DNA, 25 bp, Mus musculus
acaagcccagcagacaatcaggctc

SEQ ID NO: 860981 - DNA, 25 bp, Mus musculus
acaagcccaggagacaatcaggctc

SEQ ID NO: 860982 - DNA, 25 bp, Mus musculus
acaagcctaagcctcacgtgcagcc

SEQ ID NO: 860983 - DNA, 25 bp, Mus musculus
acaagcctaagcctccagacgtgca

SEQ ID NO: 860984 - DNA, 25 bp, Mus musculus
acaagcctaagcctgacgtgcagcc

SEQ ID NO: 860985 - DNA, 25 bp, Mus musculus
acaagcctaagcctgcagacgtgca

SEQ ID NO: 860986 - DNA, 25 bp, Mus musculus
acaagcctgaaatcaactccaccac

SEQ ID NO: 860987 - DNA, 25 bp, Mus musculus
acaagcctgacccaggagggccgta

SEQ ID NO: 860988 - DNA, 25 bp, Mus musculus
acaagcctgagccaggagggccgta

SEQ ID NO: 860989 - DNA, 25 bp, Mus musculus
acaagcctgatatcaactccaccac

SEQ ID NO: 860990 - DNA, 25 bp, Mus musculus
acaagcgatgctcatctttttgact

SEQ ID NO: 860991 - DNA, 25 bp, Mus musculus
acaagcgatgctgatctttttgact

SEQ ID NO: 860992 - DNA, 25 bp, Mus musculus
acaagcgctgagagaaaatgtgcta

SEQ ID NO: 860993 - DNA, 25 bp, Mus musculus
acaagcgctgagtgaaaatgtgcta

SEQ ID NO: 860994 - DNA, 25 bp, Mus musculus
acaagctagcagcctacctgcacac

SEQ ID NO: 860995 - DNA, 25 bp, Mus musculus
acaagctagcaggctacctgcacac

SEQ ID NO: 860996 - DNA, 25 bp, Mus musculus
acaagctcattgatcagtttggaag

SEQ ID NO: 860997 - DNA, 25 bp, Mus musculus
acaagctcattgttcagtttggaag

SEQ ID NO: 860998 - DNA, 25 bp, Mus musculus
acaagctctccacgcacagagtcat

SEQ ID NO: 860999 - DNA, 25 bp, Mus musculus
acaagctctccaggcacagagtcat

SEQ ID NO: 861000 - DNA, 25 bp, Mus musculus
acaagctctgccaaccctgccctga

SEQ ID NO: 861001 - DNA, 25 bp, Mus musculus
acaagctctgccaagcctgccctga

SEQ ID NO: 861002 - DNA, 25 bp, Mus musculus
acaagctgaatgccatcaaactaca

SEQ ID NO: 861003 - DNA, 25 bp, Mus musculus
acaagctgaatgccttcaaactaca

SEQ ID NO: 861004 - DNA, 25 bp, Mus musculus
acaagctgaccaaagcggagaagct

SEQ ID NO: 861005 - DNA, 25 bp, Mus musculus
acaagctgaccaagttacagtccat

SEQ ID NO: 861006 - DNA, 25 bp, Mus musculus
acaagctgaccatagcggagaagct

SEQ ID NO: 861007 - DNA, 25 bp, Mus musculus
acaagctgaccatgttacagtccat

SEQ ID NO: 861008 - DNA, 25 bp, Mus musculus
acaagcttttaaatctctagtttgg

SEQ ID NO: 861009 - DNA, 25 bp, Mus musculus
acaagcttttaaatgtctagtttgg

SEQ ID NO: 861010 - DNA, 25 bp, Mus musculus
acaaggaaagagaggatggagagct

SEQ ID NO: 861011 - DNA, 25 bp, Mus musculus
acaaggaaagtgaggatggagagct

SEQ ID NO: 861012 - DNA, 25 bp, Mus musculus
acaaggaacacctgcaggcaggatg

SEQ ID NO: 861013 - DNA, 25 bp, Mus musculus
acaaggaacagctgcaggcaggatg

SEQ ID NO: 861014 - DNA, 25 bp, Mus musculus
acaaggaactcaaacgcaaatcaga

SEQ ID NO: 861015 - DNA, 25 bp, Mus musculus
acaaggaactcaaaggcaaatcaga

SEQ ID NO: 861016 - DNA, 25 bp, Mus musculus
acaaggaactctttgatgaacttgt

SEQ ID NO: 861017 - DNA, 25 bp, Mus musculus
acaaggaactgtttgatgaacttgt

SEQ ID NO: 861018 - DNA, 25 bp, Mus musculus
acaaggaatatccacaaggtgactc

SEQ ID NO: 861019 - DNA, 25 bp, Mus musculus
acaaggaatatccagaaggtgactc

SEQ ID NO: 861020 - DNA, 25 bp, Mus musculus
acaaggacacaacggtgaagagggt

SEQ ID NO: 861021 - DNA, 25 bp, Mus musculus
acaaggacacaagggtgaagagggt

SEQ ID NO: 861022 - DNA, 25 bp, Mus musculus
acaaggaccatcagtaccagttttt

SEQ ID NO: 861023 - DNA, 25 bp, Mus musculus
acaaggaccatctgtaccagttttt

SEQ ID NO: 861024 - DNA, 25 bp, Mus musculus
acaaggaccgattcatttcagggag

SEQ ID NO: 861025 - DNA, 25 bp, Mus musculus
acaaggaccgtacacagatcgccat

SEQ ID NO: 861026 - DNA, 25 bp, Mus musculus
acaaggaccgtacagagatcgccat

SEQ ID NO: 861027 - DNA, 25 bp, Mus musculus
acaaggaccgtttcatttcagggag

SEQ ID NO: 861028 - DNA, 25 bp, Mus musculus
acaaggacgagatgaccacaaaggt

SEQ ID NO: 861029 - DNA, 25 bp, Mus musculus
acaaggacgagatgtccacaaaggt

SEQ ID NO: 861030 - DNA, 25 bp, Mus musculus
acaaggacgatttgcggctcatcac

SEQ ID NO: 861031 - DNA, 25 bp, Mus musculus
acaaggacgatttgcgtgtcctgct

SEQ ID NO: 861032 - DNA, 25 bp, Mus musculus
acaaggacgatttggggctcatcac

SEQ ID NO: 861033 - DNA, 25 bp, Mus musculus
acaaggacgatttgggtgtcctgct

SEQ ID NO: 861034 - DNA, 25 bp, Mus musculus
acaaggagaacgaggacatatggtc

SEQ ID NO: 861035 - DNA, 25 bp, Mus musculus
acaaggagaacgaggacttatggtc

SEQ ID NO: 861036 - DNA, 25 bp, Mus musculus
acaaggagaacgatgacatttggtc

SEQ ID NO: 861037 - DNA, 25 bp, Mus musculus
acaaggagaacgtggacatatggtc

SEQ ID NO: 861038 - DNA, 25 bp, Mus musculus
acaaggagaacgtggacttatggtc

SEQ ID NO: 861039 - DNA, 25 bp, Mus musculus
acaaggagaacgttgacatttggtc

SEQ ID NO: 861040 - DNA, 25 bp, Mus musculus
acaaggagctgactcctgatggaac

SEQ ID NO: 861041 - DNA, 25 bp, Mus musculus
acaaggagctgagtcctgatggaac

SEQ ID NO: 861042 - DNA, 25 bp, Mus musculus
acaaggaggacacctacaagcccat

SEQ ID NO: 861043 - DNA, 25 bp, Mus musculus
acaaggaggacagctacaagcccat

SEQ ID NO: 861044 - DNA, 25 bp, Mus musculus
acaaggaggacgctgtgccgatgct

SEQ ID NO: 861045 - DNA, 25 bp, Mus musculus
acaaggaggacggtgtgccgatgct

SEQ ID NO: 861046 - DNA, 25 bp, Mus musculus
acaaggaggagaaacccttgtagcc

SEQ ID NO: 861047 - DNA, 25 bp, Mus musculus
acaaggaggagaaagccttgtagcc

SEQ ID NO: 861048 - DNA, 25 bp, Mus musculus
acaaggatgtggaacgtcaagatgt

SEQ ID NO: 861049 - DNA, 25 bp, Mus musculus
acaaggatgtggaaggtcaagatgt

SEQ ID NO: 861050 - DNA, 25 bp, Mus musculus
acaaggccagcactgtggcggccac

SEQ ID NO: 861051 - DNA, 25 bp, Mus musculus
acaaggccaggactgtggcggccac

SEQ ID NO: 861052 - DNA, 25 bp, Mus musculus
acaaggccagtgagcctgtcatctg

SEQ ID NO: 861053 - DNA, 25 bp, Mus musculus
acaaggccagtgaggctgtcatctg

SEQ ID NO: 861054 - DNA, 25 bp, Mus musculus
acaaggcccctacccccatctcttc

SEQ ID NO: 861055 - DNA, 25 bp, Mus musculus
acaaggcccctagccccatctcttc

SEQ ID NO: 861056 - DNA, 25 bp, Mus musculus
acaaggccttcaagacagacagttc

SEQ ID NO: 861057 - DNA, 25 bp, Mus musculus
acaaggccttcatgacagacagttc

SEQ ID NO: 861058 - DNA, 25 bp, Mus musculus
acaaggccttcccagccgacagctc

SEQ ID NO: 861059 - DNA, 25 bp, Mus musculus
acaaggccttccgagccgacagctc

SEQ ID NO: 861060 - DNA, 25 bp, Mus musculus
acaaggcggcagactttctgcactg

SEQ ID NO: 861061 - DNA, 25 bp, Mus musculus
acaaggcggcagtctttctgcactg

SEQ ID NO: 861062 - DNA, 25 bp, Mus musculus
acaagggatctgccagtgtgcccct

SEQ ID NO: 861063 - DNA, 25 bp, Mus musculus
acaagggatctgcctgtgtgcccct

SEQ ID NO: 861064 - DNA, 25 bp, Mus musculus
acaaggtcaaagagttctgtgaaaa

SEQ ID NO: 861065 - DNA, 25 bp, Mus musculus
acaaggtcaaagtgttctgtgaaaa

SEQ ID NO: 861066 - DNA, 25 bp, Mus musculus
acaaggttcctgcacgacagtgttg

SEQ ID NO: 861067 - DNA, 25 bp, Mus musculus
acaaggttcctgcaggacagtgttg

SEQ ID NO: 861068 - DNA, 25 bp, Mus musculus
acaagtacagataccttttcaagca

SEQ ID NO: 861069 - DNA, 25 bp, Mus musculus
acaagtacagattccttttcaagca

SEQ ID NO: 861070 - DNA, 25 bp, Mus musculus
acaagtacattgagacctgtgcagt

SEQ ID NO: 861071 - DNA, 25 bp, Mus musculus
acaagtacattgtgacctgtgcagt

SEQ ID NO: 861072 - DNA, 25 bp, Mus musculus
acaagtatcagctaccatcgggaca

SEQ ID NO: 861073 - DNA, 25 bp, Mus musculus
acaagtatcagctagcatcgggaca

SEQ ID NO: 861074 - DNA, 25 bp, Mus musculus
acaagtcaagatactggcagaagag

SEQ ID NO: 861075 - DNA, 25 bp, Mus musculus
acaagtcaagttactggcagaagag

SEQ ID NO: 861076 - DNA, 25 bp, Mus musculus
acaagtccctggaaaagctacttca

SEQ ID NO: 861077 - DNA, 25 bp, Mus musculus
acaagtccctggtaaagctacttca

SEQ ID NO: 861078 - DNA, 25 bp, Mus musculus
acaagtcctgaacacaacagacatc

SEQ ID NO: 861079 - DNA, 25 bp, Mus musculus
acaagtcctgaagacaacagacatc

SEQ ID NO: 861080 - DNA, 25 bp, Mus musculus
acaagtctacaaaacctcttcagag

SEQ ID NO: 861081 - DNA, 25 bp, Mus musculus
acaagtctacaaaacgtgaagtatt

SEQ ID NO: 861082 - DNA, 25 bp, Mus musculus
acaagtctacaaaagctcttcagag

SEQ ID NO: 861083 - DNA, 25 bp, Mus musculus
acaagtctacaaaaggtgaagtatt

SEQ ID NO: 861084 - DNA, 25 bp, Mus musculus
acaagtctataacggtcgacatgtt

SEQ ID NO: 861085 - DNA, 25 bp, Mus musculus
acaagtctataagggtcgacatgtt

SEQ ID NO: 861086 - DNA, 25 bp, Mus musculus
acaagtgcaaagcttatggttttgt

SEQ ID NO: 861087 - DNA, 25 bp, Mus musculus
acaagtgcaaaggttatggttttgt

SEQ ID NO: 861088 - DNA, 25 bp, Mus musculus
acaagtgcagcgaccgatcgaagcc

SEQ ID NO: 861089 - DNA, 25 bp, Mus musculus
acaagtgcagcgacggatcgaagcc

SEQ ID NO: 861090 - DNA, 25 bp, Mus musculus
acaagtgcttaccacccggcactac

SEQ ID NO: 861091 - DNA, 25 bp, Mus musculus
acaagtgcttacgacccggcactac

SEQ ID NO: 861092 - DNA, 25 bp, Mus musculus
acaagtggaggacgtggtggacatc

SEQ ID NO: 861093 - DNA, 25 bp, Mus musculus
acaagtggaggaggtggtggacatc

SEQ ID NO: 861094 - DNA, 25 bp, Mus musculus
acaagtgttcagagccggaaacaac

SEQ ID NO: 861095 - DNA, 25 bp, Mus musculus
acaagtgttcagccctccttctttt

SEQ ID NO: 861096 - DNA, 25 bp, Mus musculus
acaagtgttcaggcctccttctttt

SEQ ID NO: 861097 - DNA, 25 bp, Mus musculus
acaagtgttcagtgccggaaacaac

SEQ ID NO: 861098 - DNA, 25 bp, Mus musculus
acaagttagaccatcgcacccgatg

SEQ ID NO: 861099 - DNA, 25 bp, Mus musculus
acaagttagaccatctggtgaccat

SEQ ID NO: 861100 - DNA, 25 bp, Mus musculus
acaagttagaccatggcacccgatg

SEQ ID NO: 861101 - DNA, 25 bp, Mus musculus
acaagttagaccatgtggtgaccat

SEQ ID NO: 861102 - DNA, 25 bp, Mus musculus
acaagttatcacggcaatggaagtc

SEQ ID NO: 861103 - DNA, 25 bp, Mus musculus
acaagttatctcggcaatggaagtc

SEQ ID NO: 861104 - DNA, 25 bp, Mus musculus
acaagttcgacgccttaaaagatga

SEQ ID NO: 861105 - DNA, 25 bp, Mus musculus
acaagttcgacggcttaaaagatga

SEQ ID NO: 861106 - DNA, 25 bp, Mus musculus
acaagttctacacgcctgagaatac

SEQ ID NO: 861107 - DNA, 25 bp, Mus musculus
acaagttctacacgctgccacaggt

SEQ ID NO: 861108 - DNA, 25 bp, Mus musculus
acaagttctacaggcctgagaatac

SEQ ID NO: 861109 - DNA, 25 bp, Mus musculus
acaagttctacaggctgccacaggt

SEQ ID NO: 861110 - DNA, 25 bp, Mus musculus
acaagttctgaaatgccctgaagcc

SEQ ID NO: 861111 - DNA, 25 bp, Mus musculus
acaagttctgactcttcagcacttc

SEQ ID NO: 861112 - DNA, 25 bp, Mus musculus
acaagttctgtaatgccctgaagcc

SEQ ID NO: 861113 - DNA, 25 bp, Mus musculus
acaagttctgtctcttcagcacttc

SEQ ID NO: 861114 - DNA, 25 bp, Mus musculus
acaagttgagatgaagcccgaggca

SEQ ID NO: 861115 - DNA, 25 bp, Mus musculus
acaagttgagttgaagcccgaggca

SEQ ID NO: 861116 - DNA, 25 bp, Mus musculus
acaagtttgcaaccaatgttgtgga

SEQ ID NO: 861117 - DNA, 25 bp, Mus musculus
acaagtttgcaagcaatgttgtgga

SEQ ID NO: 861118 - DNA, 25 bp, Mus musculus
acaataaacttaaacccagccaagc

SEQ ID NO: 861119 - DNA, 25 bp, Mus musculus
acaataaacttaaagccagccaagc

SEQ ID NO: 861120 - DNA, 25 bp, Mus musculus
acaataacttggacctacagccagt

SEQ ID NO: 861121 - DNA, 25 bp, Mus musculus
acaataacttggtcctacagccagt

SEQ ID NO: 861122 - DNA, 25 bp, Mus musculus
acaataatgcagatgctgaggacaa

SEQ ID NO: 861123 - DNA, 25 bp, Mus musculus
acaataatgcagttgctgaggacaa

SEQ ID NO: 861124 - DNA, 25 bp, Mus musculus
acaataatggagtgatagaaggaag

SEQ ID NO: 861125 - DNA, 25 bp, Mus musculus
acaataatggtgtgatagaaggaag

SEQ ID NO: 861126 - DNA, 25 bp, Mus musculus
acaatacaaataaagagagacaaat

SEQ ID NO: 861127 - DNA, 25 bp, Mus musculus
acaatacaaatatagagagacaaat

SEQ ID NO: 861128 - DNA, 25 bp, Mus musculus
acaatacgagcccgctgagcagctc

SEQ ID NO: 861129 - DNA, 25 bp, Mus musculus
acaatacgagccggctgagcagctc

SEQ ID NO: 861130 - DNA, 25 bp, Mus musculus
acaatagcacagcaatgattggcag

SEQ ID NO: 861131 - DNA, 25 bp, Mus musculus
acaatagcacaggaatgattggcag

SEQ ID NO: 861132 - DNA, 25 bp, Mus musculus
acaatatcagcctggtttacaacag

SEQ ID NO: 861133 - DNA, 25 bp, Mus musculus
acaatatcaggctggtttacaacag

SEQ ID NO: 861134 - DNA, 25 bp, Mus musculus
acaatatctgccaaaaaggataagt

SEQ ID NO: 861135 - DNA, 25 bp, Mus musculus
acaatatctggcaaaaaggataagt

SEQ ID NO: 861136 - DNA, 25 bp, Mus musculus
acaatattcaagcaatggtgattgt

SEQ ID NO: 861137 - DNA, 25 bp, Mus musculus
acaatattcaaggaatggtgattgt

SEQ ID NO: 861138 - DNA, 25 bp, Mus musculus
acaatcaaagagcaaagcaagcctg

SEQ ID NO: 861139 - DNA, 25 bp, Mus musculus
acaatcaaagaggaaagcaagcctg

SEQ ID NO: 861140 - DNA, 25 bp, Mus musculus
acaatcacaacttgattgaacgaag

SEQ ID NO: 861141 - DNA, 25 bp, Mus musculus
acaatcacaacttgtttgaacgaag

SEQ ID NO: 861142 - DNA, 25 bp, Mus musculus
acaatcacagacagcttacctctag

SEQ ID NO: 861143 - DNA, 25 bp, Mus musculus
acaatcacagaggccagaagagaga

SEQ ID NO: 861144 - DNA, 25 bp, Mus musculus
acaatcacagctgtagatgtcagca

SEQ ID NO: 861145 - DNA, 25 bp, Mus musculus
acaatcacaggtgtagatgtcagca

SEQ ID NO: 861146 - DNA, 25 bp, Mus musculus
acaatcacagtcagcttacctctag

SEQ ID NO: 861147 - DNA, 25 bp, Mus musculus
acaatcacagtggccagaagagaga

SEQ ID NO: 861148 - DNA, 25 bp, Mus musculus
acaatccatgtatacaaccaaggca

SEQ ID NO: 861149 - DNA, 25 bp, Mus musculus
acaatccatgtatagaaccaaggca

SEQ ID NO: 861150 - DNA, 25 bp, Mus musculus
acaatcccctctaaggagactcaga

SEQ ID NO: 861151 - DNA, 25 bp, Mus musculus
acaatcccctgtaaggagactcaga

SEQ ID NO: 861152 - DNA, 25 bp, Mus musculus
acaatccctccacaactggtgaagc

SEQ ID NO: 861153 - DNA, 25 bp, Mus musculus
acaatccctccagaactggtgaagc

SEQ ID NO: 861154 - DNA, 25 bp, Mus musculus
acaatcctgaaacacgtactacttg

SEQ ID NO: 861155 - DNA, 25 bp, Mus musculus
acaatcctgaaacaggtactacttg

SEQ ID NO: 861156 - DNA, 25 bp, Mus musculus
acaatcctttagcagctactccatc

SEQ ID NO: 861157 - DNA, 25 bp, Mus musculus
acaatcctttaggagctactccatc

SEQ ID NO: 861158 - DNA, 25 bp, Mus musculus
acaatgaaggccagtctgtgtcaga

SEQ ID NO: 861159 - DNA, 25 bp, Mus musculus
acaatgaaggcctgtctgtgtcaga

SEQ ID NO: 861160 - DNA, 25 bp, Mus musculus
acaatgacctcccgttggcccagca

SEQ ID NO: 861161 - DNA, 25 bp, Mus musculus
acaatgacctccggttggcccagca

SEQ ID NO: 861162 - DNA, 25 bp, Mus musculus
acaatgagagagtggtgcaggtcct

SEQ ID NO: 861163 - DNA, 25 bp, Mus musculus
acaatgagagtgtggtgcaggtcct

SEQ ID NO: 861164 - DNA, 25 bp, Mus musculus
acaatgaggagacgtacacacccct

SEQ ID NO: 861165 - DNA, 25 bp, Mus musculus
acaatgaggagaggtacacacccct

SEQ ID NO: 861166 - DNA, 25 bp, Mus musculus
acaatgcaaactatgccatctctat

SEQ ID NO: 861167 - DNA, 25 bp, Mus musculus
acaatgcaaagtatgccatctctat

SEQ ID NO: 861168 - DNA, 25 bp, Mus musculus
acaatgcagacttttagttggtgat

SEQ ID NO: 861169 - DNA, 25 bp, Mus musculus
acaatgcagagttttagttggtgat

SEQ ID NO: 861170 - DNA, 25 bp, Mus musculus
acaatgcagcagatttctgccagct

SEQ ID NO: 861171 - DNA, 25 bp, Mus musculus
acaatgcagcagttttctgccagct

SEQ ID NO: 861172 - DNA, 25 bp, Mus musculus
acaatgcagctgctctcatatctcg

SEQ ID NO: 861173 - DNA, 25 bp, Mus musculus
acaatgcagctggtctcatatctcg

SEQ ID NO: 861174 - DNA, 25 bp, Mus musculus
acaatgcaggcgttgacaacttcgg

SEQ ID NO: 861175 - DNA, 25 bp, Mus musculus
acaatgcaggggttgacaacttcgg

SEQ ID NO: 861176 - DNA, 25 bp, Mus musculus
acaatgcatcaacacgcaaggtaga

SEQ ID NO: 861177 - DNA, 25 bp, Mus musculus
acaatgcatcaacaggcaaggtaga

SEQ ID NO: 861178 - DNA, 25 bp, Mus musculus
acaatggaagagcacatagatacat

SEQ ID NO: 861179 - DNA, 25 bp, Mus musculus
acaatggaagaggacatagatacat

SEQ ID NO: 861180 - DNA, 25 bp, Mus musculus
acaatggacccagacatttcctgca

SEQ ID NO: 861181 - DNA, 25 bp, Mus musculus
acaatggacccagagatttcctgca

SEQ ID NO: 861182 - DNA, 25 bp, Mus musculus
acaatggatatgttcatgtagccgt

SEQ ID NO: 861183 - DNA, 25 bp, Mus musculus
acaatggatatgttgatgtagccgt

SEQ ID NO: 861184 - DNA, 25 bp, Mus musculus
acaatggcataactagctatggata

SEQ ID NO: 861185 - DNA, 25 bp, Mus musculus
acaatggcattactagctatggata

SEQ ID NO: 861186 - DNA, 25 bp, Mus musculus
acaatggggcagctaaaattgtact

SEQ ID NO: 861187 - DNA, 25 bp, Mus musculus
acaatggggcagctgctgatactgt

SEQ ID NO: 861188 - DNA, 25 bp, Mus musculus
acaatggggcaggtaaaattgtact

SEQ ID NO: 861189 - DNA, 25 bp, Mus musculus
acaatggggcaggtgctgatactgt

SEQ ID NO: 861190 - DNA, 25 bp, Mus musculus
acaatgtatgccaatcgcatcctga

SEQ ID NO: 861191 - DNA, 25 bp, Mus musculus
acaatgtatggcaatcgcatcctga

SEQ ID NO: 861192 - DNA, 25 bp, Mus musculus
acaatgtcccagatccagatcaaac

SEQ ID NO: 861193 - DNA, 25 bp, Mus musculus
acaatgtcccagttccagatcaaac

SEQ ID NO: 861194 - DNA, 25 bp, Mus musculus
acaatgtctgcacgtgccatgttgg

SEQ ID NO: 861195 - DNA, 25 bp, Mus musculus
acaatgtctgcaggtgccatgttgg

SEQ ID NO: 861196 - DNA, 25 bp, Mus musculus
acaatgtgatgacaaagttccatgg

SEQ ID NO: 861197 - DNA, 25 bp, Mus musculus
acaatgtgatgagaaagttccatgg

SEQ ID NO: 861198 - DNA, 25 bp, Mus musculus
acaattaaagctttttgatgacaag

SEQ ID NO: 861199 - DNA, 25 bp, Mus musculus
acaattaaaggtttttgatgacaag

SEQ ID NO: 861200 - DNA, 25 bp, Mus musculus
acaattacagataacgaactgctga

SEQ ID NO: 861201 - DNA, 25 bp, Mus musculus
acaattacagataacgtgttctcat

SEQ ID NO: 861202 - DNA, 25 bp, Mus musculus
acaattacagataaggaactgctga

SEQ ID NO: 861203 - DNA, 25 bp, Mus musculus
acaattacagataaggtgttctcat

SEQ ID NO: 861204 - DNA, 25 bp, Mus musculus
acaattacagcggatttgacattgg

SEQ ID NO: 861205 - DNA, 25 bp, Mus musculus
acaattacaggggatttgacattgg

SEQ ID NO: 861206 - DNA, 25 bp, Mus musculus
acaattacgacagacataacataga

SEQ ID NO: 861207 - DNA, 25 bp, Mus musculus
acaattacgacagagataacataga

SEQ ID NO: 861208 - DNA, 25 bp, Mus musculus
acaattccaaagattttggccagct

SEQ ID NO: 861209 - DNA, 25 bp, Mus musculus
acaattccaatgattttggccagct

SEQ ID NO: 861210 - DNA, 25 bp, Mus musculus
acaattctaacacagatataccgca

SEQ ID NO: 861211 - DNA, 25 bp, Mus musculus
acaattctaacagagatataccgca

SEQ ID NO: 861212 - DNA, 25 bp, Mus musculus
acaatttcatagatgctatgctgat

SEQ ID NO: 861213 - DNA, 25 bp, Mus musculus
acaatttcatagttgctatgctgat

SEQ ID NO: 861214 - DNA, 25 bp, Mus musculus
acaatttgtcgaaaatctgtatcga

SEQ ID NO: 861215 - DNA, 25 bp, Mus musculus
acaatttgtcgataatctgtatcga

SEQ ID NO: 861216 - DNA, 25 bp, Mus musculus
acaatttgtgagcacaacatgttac

SEQ ID NO: 861217 - DNA, 25 bp, Mus musculus
acaatttgtgagcacgtgtccacaa

SEQ ID NO: 861218 - DNA, 25 bp, Mus musculus
acaatttgtgagcagaacatgttac

SEQ ID NO: 861219 - DNA, 25 bp, Mus musculus
acaatttgtgagcaggtgtccacaa

SEQ ID NO: 861220 - DNA, 25 bp, Mus musculus
acacaaaaagcttcctagaggaagt

SEQ ID NO: 861221 - DNA, 25 bp, Mus musculus
acacaaaaaggttcctagaggaagt

SEQ ID NO: 861222 - DNA, 25 bp, Mus musculus
acacaaaaggcttttgtgcatccct

SEQ ID NO: 861223 - DNA, 25 bp, Mus musculus
acacaaaagggttttgtgcatccct

SEQ ID NO: 861224 - DNA, 25 bp, Mus musculus
acacaaaatcattacataacaacta

SEQ ID NO: 861225 - DNA, 25 bp, Mus musculus
acacaaaatcattagataacaacta

SEQ ID NO: 861226 - DNA, 25 bp, Mus musculus
acacaaacaccaccgtgttcccatg

SEQ ID NO: 861227 - DNA, 25 bp, Mus musculus
acacaaacaccagcgtgttcccatg

SEQ ID NO: 861228 - DNA, 25 bp, Mus musculus
acacaaacacgacagtccctgacct

SEQ ID NO: 861229 - DNA, 25 bp, Mus musculus
acacaaacacgagagtccctgacct

SEQ ID NO: 861230 - DNA, 25 bp, Mus musculus
acacaaatttgccaccaatgtagta

SEQ ID NO: 861231 - DNA, 25 bp, Mus musculus
acacaaatttgccagcaatgtagta

SEQ ID NO: 861232 - DNA, 25 bp, Mus musculus
acacaacacaaaaaccttcctagag

SEQ ID NO: 861233 - DNA, 25 bp, Mus musculus
acacaacacaaaaagcttcctagag

SEQ ID NO: 861234 - DNA, 25 bp, Mus musculus
acacaacacccacccagtggtcaac

SEQ ID NO: 861235 - DNA, 25 bp, Mus musculus
acacaacacccaccctggtcaactc

SEQ ID NO: 861236 - DNA, 25 bp, Mus musculus
acacaacacccaccgagtggtcaac

SEQ ID NO: 861237 - DNA, 25 bp, Mus musculus
acacaacacccaccgtggtcaactc

SEQ ID NO: 861238 - DNA, 25 bp, Mus musculus
acacaacagaccaggttaggaaatc

SEQ ID NO: 861239 - DNA, 25 bp, Mus musculus
acacaacagagcaggttaggaaatc

SEQ ID NO: 861240 - DNA, 25 bp, Mus musculus
acacaagagcagagcctcacatatc

SEQ ID NO: 861241 - DNA, 25 bp, Mus musculus
acacaagagcagaggctcacatatc

SEQ ID NO: 861242 - DNA, 25 bp, Mus musculus
acacaagcacagcacggccctgccc

SEQ ID NO: 861243 - DNA, 25 bp, Mus musculus
acacaagcacaggacggccctgccc

SEQ ID NO: 861244 - DNA, 25 bp, Mus musculus
acacaagcagctcagatgtaccagc

SEQ ID NO: 861245 - DNA, 25 bp, Mus musculus
acacaagcaggacttcctggacaag

SEQ ID NO: 861246 - DNA, 25 bp, Mus musculus
acacaagcaggagttcctggacaag

SEQ ID NO: 861247 - DNA, 25 bp, Mus musculus
acacaagcaggtcagatgtaccagc

SEQ ID NO: 861248 - DNA, 25 bp, Mus musculus
acacaagtataacgtgatgttccct

SEQ ID NO: 861249 - DNA, 25 bp, Mus musculus
acacaagtataaggtgatgttccct

SEQ ID NO: 861250 - DNA, 25 bp, Mus musculus
acacaagtcaatcgaaaatttccag

SEQ ID NO: 861251 - DNA, 25 bp, Mus musculus
acacaagtcaatcgccagctaatgt

SEQ ID NO: 861252 - DNA, 25 bp, Mus musculus
acacaagtcaatggaaaatttccag

SEQ ID NO: 861253 - DNA, 25 bp, Mus musculus
acacaagtcaatggccagctaatgt

SEQ ID NO: 861254 - DNA, 25 bp, Mus musculus
acacaagtcgaccagtcctgacagt

SEQ ID NO: 861255 - DNA, 25 bp, Mus musculus
acacaagtcgtccagtcctgacagt

SEQ ID NO: 861256 - DNA, 25 bp, Mus musculus
acacaagttctgaaatgccctgaag

SEQ ID NO: 861257 - DNA, 25 bp, Mus musculus
acacaagttctgtaatgccctgaag

SEQ ID NO: 861258 - DNA, 25 bp, Mus musculus
acacaataatggagtgatagaagga

SEQ ID NO: 861259 - DNA, 25 bp, Mus musculus
acacaataatggtgtgatagaagga

SEQ ID NO: 861260 - DNA, 25 bp, Mus musculus
acacaatcagacgaagggggcagag

SEQ ID NO: 861261 - DNA, 25 bp, Mus musculus
acacaatcagatgtcgtttggtcac

SEQ ID NO: 861262 - DNA, 25 bp, Mus musculus
acacaatcagccgcataactcatca

SEQ ID NO: 861263 - DNA, 25 bp, Mus musculus
acacaatcagccgtcattcagtctg

SEQ ID NO: 861264 - DNA, 25 bp, Mus musculus
acacaatcaggcgcataactcatca

SEQ ID NO: 861265 - DNA, 25 bp, Mus musculus
acacaatcaggcgtcattcagtctg

SEQ ID NO: 861266 - DNA, 25 bp, Mus musculus
acacaatcagtcgaagggggcagag

SEQ ID NO: 861267 - DNA, 25 bp, Mus musculus
acacaatcagttgtcgtttggtcac

SEQ ID NO: 861268 - DNA, 25 bp, Mus musculus
acacaatttgcgagtgagctacttt

SEQ ID NO: 861269 - DNA, 25 bp, Mus musculus
acacaatttgggagtgagctacttt

SEQ ID NO: 861270 - DNA, 25 bp, Mus musculus
acacacaaaacacgctggccttgtg

SEQ ID NO: 861271 - DNA, 25 bp, Mus musculus
acacacaaaacaggctggccttgtg

SEQ ID NO: 861272 - DNA, 25 bp, Mus musculus
acacacacagcattggagagcttca

SEQ ID NO: 861273 - DNA, 25 bp, Mus musculus
acacacacagcgattgagtcctgga

SEQ ID NO: 861274 - DNA, 25 bp, Mus musculus
acacacacaggattggagagcttca

SEQ ID NO: 861275 - DNA, 25 bp, Mus musculus
acacacacagggattgagtcctgga

SEQ ID NO: 861276 - DNA, 25 bp, Mus musculus
acacacaccattcacctttctccca

SEQ ID NO: 861277 - DNA, 25 bp, Mus musculus
acacacaccattcagctttctccca

SEQ ID NO: 861278 - DNA, 25 bp, Mus musculus
acacacacggatgctgaaggaggtg

SEQ ID NO: 861279 - DNA, 25 bp, Mus musculus
acacacacggttgctgaaggaggtg

SEQ ID NO: 861280 - DNA, 25 bp, Mus musculus
acacaccagttacactatctggtcg

SEQ ID NO: 861281 - DNA, 25 bp, Mus musculus
acacaccagttacagtatctggtcg

SEQ ID NO: 861282 - DNA, 25 bp, Mus musculus
acacaccatcatcgcaggaaatgtg

SEQ ID NO: 861283 - DNA, 25 bp, Mus musculus
acacaccatcatggcaggaaatgtg

SEQ ID NO: 861284 - DNA, 25 bp, Mus musculus
acacaccattcacctttctcccaga

SEQ ID NO: 861285 - DNA, 25 bp, Mus musculus
acacaccattcagctttctcccaga

SEQ ID NO: 861286 - DNA, 25 bp, Mus musculus
acacaccgtatgaacgtggaagata

SEQ ID NO: 861287 - DNA, 25 bp, Mus musculus
acacaccgtatgaaggtggaagata

SEQ ID NO: 861288 - DNA, 25 bp, Mus musculus
acacacctcgcggccctcatggctg

SEQ ID NO: 861289 - DNA, 25 bp, Mus musculus
acacacctcggggccctcatggctg

SEQ ID NO: 861290 - DNA, 25 bp, Mus musculus
acacacctctctctgtgctgagcta

SEQ ID NO: 861291 - DNA, 25 bp, Mus musculus
acacacctctctgtgtgctgagcta

SEQ ID NO: 861292 - DNA, 25 bp, Mus musculus
acacacctcttccacacgctgaatc

SEQ ID NO: 861293 - DNA, 25 bp, Mus musculus
acacacctcttccagacgctgaatc

SEQ ID NO: 861294 - DNA, 25 bp, Mus musculus
acacacctgaacctgatatctgtca

SEQ ID NO: 861295 - DNA, 25 bp, Mus musculus
acacacctgaacgtgatatctgtca

SEQ ID NO: 861296 - DNA, 25 bp, Mus musculus
acacacgaccttcgacgtaccatgc

SEQ ID NO: 861297 - DNA, 25 bp, Mus musculus
acacacgaccttggacgtaccatgc

SEQ ID NO: 861298 - DNA, 25 bp, Mus musculus
acacactcttcactgggcccgggat

SEQ ID NO: 861299 - DNA, 25 bp, Mus musculus
acacactcttcagtgggcccgggat

SEQ ID NO: 861300 - DNA, 25 bp, Mus musculus
acacactgcaagaaccagcactgcg

SEQ ID NO: 861301 - DNA, 25 bp, Mus musculus
acacactgcaagtaccagcactgcg

SEQ ID NO: 861302 - DNA, 25 bp, Mus musculus
acacactgcgctaccctgtgaagcc

SEQ ID NO: 861303 - DNA, 25 bp, Mus musculus
acacactgcgcttccctgtgaagcc

SEQ ID NO: 861304 - DNA, 25 bp, Mus musculus
acacactggaagaatttttgaacaa

SEQ ID NO: 861305 - DNA, 25 bp, Mus musculus
acacactggaagcatttgccagtcc

SEQ ID NO: 861306 - DNA, 25 bp, Mus musculus
acacactggaaggatttgccagtcc

SEQ ID NO: 861307 - DNA, 25 bp, Mus musculus
acacactggaagtatttttgaacaa

SEQ ID NO: 861308 - DNA, 25 bp, Mus musculus
acacacttcaagaacgtgtgtggcc

SEQ ID NO: 861309 - DNA, 25 bp, Mus musculus
acacacttcaagaaggtgtgtggcc

SEQ ID NO: 861310 - DNA, 25 bp, Mus musculus
acacacttcccgctcgacgtgcaat

SEQ ID NO: 861311 - DNA, 25 bp, Mus musculus
acacacttcccgctggacgtgcaat

SEQ ID NO: 861312 - DNA, 25 bp, Mus musculus
acacagaagccaagcgtccaccagg

SEQ ID NO: 861313 - DNA, 25 bp, Mus musculus
acacagaagccatgcgtccaccagg

SEQ ID NO: 861314 - DNA, 25 bp, Mus musculus
acacagagaacaaaggctccttctt

SEQ ID NO: 861315 - DNA, 25 bp, Mus musculus
acacagagaactatagaagaagaaa

SEQ ID NO: 861316 - DNA, 25 bp, Mus musculus
acacagagaagaaaggctccttctt

SEQ ID NO: 861317 - DNA, 25 bp, Mus musculus
acacagagaagtatagaagaagaaa

SEQ ID NO: 861318 - DNA, 25 bp, Mus musculus
acacagagagaggtgctgcagctgc

SEQ ID NO: 861319 - DNA, 25 bp, Mus musculus
acacagagagtggtgctgcagctgc

SEQ ID NO: 861320 - DNA, 25 bp, Mus musculus
acacagagtttcaacgcaaacgaat

SEQ ID NO: 861321 - DNA, 25 bp, Mus musculus
acacagagtttcaacgtgggatgtg

SEQ ID NO: 861322 - DNA, 25 bp, Mus musculus
acacagagtttcaaggcaaacgaat

SEQ ID NO: 861323 - DNA, 25 bp, Mus musculus
acacagagtttcaaggtgggatgtg

SEQ ID NO: 861324 - DNA, 25 bp, Mus musculus
acacagataaagaggggctccagga

SEQ ID NO: 861325 - DNA, 25 bp, Mus musculus
acacagataaagtggggctccagga

SEQ ID NO: 861326 - DNA, 25 bp, Mus musculus
acacagatctcgctcaagaagtcct

SEQ ID NO: 861327 - DNA, 25 bp, Mus musculus
acacagatctcgctgaagaagtcct

SEQ ID NO: 861328 - DNA, 25 bp, Mus musculus
acacagatggctctcgccgaagctt

SEQ ID NO: 861329 - DNA, 25 bp, Mus musculus
acacagatggctctggccgaagctt

SEQ ID NO: 861330 - DNA, 25 bp, Mus musculus
acacagcaacagctgataaagtact

SEQ ID NO: 861331 - DNA, 25 bp, Mus musculus
acacagcaacaggtgataaagtact

SEQ ID NO: 861332 - DNA, 25 bp, Mus musculus
acacagcaagacaacgtgcgaagtt

SEQ ID NO: 861333 - DNA, 25 bp, Mus musculus
acacagcaagacaaggtgcgaagtt

SEQ ID NO: 861334 - DNA, 25 bp, Mus musculus
acacagcaagagatttagttccttg

SEQ ID NO: 861335 - DNA, 25 bp, Mus musculus
acacagcaagtgatttagttccttg

SEQ ID NO: 861336 - DNA, 25 bp, Mus musculus
acacagcaagtgctgattggcacgc

SEQ ID NO: 861337 - DNA, 25 bp, Mus musculus
acacagcaagtggtgattggcacgc

SEQ ID NO: 861338 - DNA, 25 bp, Mus musculus
acacagcagctgcaactcattatac

SEQ ID NO: 861339 - DNA, 25 bp, Mus musculus
acacagcagctggaactcattatac

SEQ ID NO: 861340 - DNA, 25 bp, Mus musculus
acacagcattaacgctcggctatta

SEQ ID NO: 861341 - DNA, 25 bp, Mus musculus
acacagcattaaggctcggctatta

SEQ ID NO: 861342 - DNA, 25 bp, Mus musculus
acacagccaaggctcgattccgagc

SEQ ID NO: 861343 - DNA, 25 bp, Mus musculus
acacagccaagggtcgattccgagc

SEQ ID NO: 861344 - DNA, 25 bp, Mus musculus
acacagccagctccggtctgatggc

SEQ ID NO: 861345 - DNA, 25 bp, Mus musculus
acacagccaggtccggtctgatggc

SEQ ID NO: 861346 - DNA, 25 bp, Mus musculus
acacagcctagacgggtgaactggt

SEQ ID NO: 861347 - DNA, 25 bp, Mus musculus
acacagcctagaggggtgaactggt

SEQ ID NO: 861348 - DNA, 25 bp, Mus musculus
acacagcctgcttctacctggcaga

SEQ ID NO: 861349 - DNA, 25 bp, Mus musculus
acacagcctggttctacctggcaga

SEQ ID NO: 861350 - DNA, 25 bp, Mus musculus
acacagcgagaattggacaaattat

SEQ ID NO: 861351 - DNA, 25 bp, Mus musculus
acacagcgagtattggacaaattat

SEQ ID NO: 861352 - DNA, 25 bp, Mus musculus
acacagcgtgttcctaacacatcaa

SEQ ID NO: 861353 - DNA, 25 bp, Mus musculus
acacagcgtgttgctaacacatcaa

SEQ ID NO: 861354 - DNA, 25 bp, Mus musculus
acacagctagagctttggatgatgt

SEQ ID NO: 861355 - DNA, 25 bp, Mus musculus
acacagctagaggtttggatgatgt

SEQ ID NO: 861356 - DNA, 25 bp, Mus musculus
acacagctccagagcacgtacgacc

SEQ ID NO: 861357 - DNA, 25 bp, Mus musculus
acacagctccagtgcacgtacgacc

SEQ ID NO: 861358 - DNA, 25 bp, Mus musculus
acacagctctgtagtacgacaacat

SEQ ID NO: 861359 - DNA, 25 bp, Mus musculus
acacagctctgttgtacgacaacat

SEQ ID NO: 861360 - DNA, 25 bp, Mus musculus
acacagctgaagcagagactagaaa

SEQ ID NO: 861361 - DNA, 25 bp, Mus musculus
acacagctgaaggagagactagaaa

SEQ ID NO: 861362 - DNA, 25 bp, Mus musculus
acacaggaagccattggctgacccg

SEQ ID NO: 861363 - DNA, 25 bp, Mus musculus
acacaggaaggcattggctgacccg

SEQ ID NO: 861364 - DNA, 25 bp, Mus musculus
acacaggacagcgacggcaatctgc

SEQ ID NO: 861365 - DNA, 25 bp, Mus musculus
acacaggacagcgagggcaatctgc

SEQ ID NO: 861366 - DNA, 25 bp, Mus musculus
acacaggactccctgaagctgtttg

SEQ ID NO: 861367 - DNA, 25 bp, Mus musculus
acacaggactgaccaagcaatgaag

SEQ ID NO: 861368 - DNA, 25 bp, Mus musculus
acacaggactgagcaagcaatgaag

SEQ ID NO: 861369 - DNA, 25 bp, Mus musculus
acacaggactgcctgaagctgtttg

SEQ ID NO: 861370 - DNA, 25 bp, Mus musculus
acacaggatgctcctctttatgtca

SEQ ID NO: 861371 - DNA, 25 bp, Mus musculus
acacaggatggtcctctttatgtca

SEQ ID NO: 861372 - DNA, 25 bp, Mus musculus
acacaggctcagctcgtgcagttcg

SEQ ID NO: 861373 - DNA, 25 bp, Mus musculus
acacaggctcagctggtgcagttcg

SEQ ID NO: 861374 - DNA, 25 bp, Mus musculus
acacagggcaaacactggtcttaca

SEQ ID NO: 861375 - DNA, 25 bp, Mus musculus
acacagggcaaagactggtcttaca

SEQ ID NO: 861376 - DNA, 25 bp, Mus musculus
acacaggggaaacacaggagcgagt

SEQ ID NO: 861377 - DNA, 25 bp, Mus musculus
acacaggggaaacagaggagcgagt

SEQ ID NO: 861378 - DNA, 25 bp, Mus musculus
acacagggtgcgcccctgtatgtgc

SEQ ID NO: 861379 - DNA, 25 bp, Mus musculus
acacagggtgggcccctgtatgtgc

SEQ ID NO: 861380 - DNA, 25 bp, Mus musculus
acacaggtaaggccagatgtcatca

SEQ ID NO: 861381 - DNA, 25 bp, Mus musculus
acacaggtaagggcagatgtcatca

SEQ ID NO: 861382 - DNA, 25 bp, Mus musculus
acacagtccaagctcacacggttat

SEQ ID NO: 861383 - DNA, 25 bp, Mus musculus
acacagtccaaggtcacacggttat

SEQ ID NO: 861384 - DNA, 25 bp, Mus musculus
acacagtctcggagtggggtaccta

SEQ ID NO: 861385 - DNA, 25 bp, Mus musculus
acacagtctcggtgtggggtaccta

SEQ ID NO: 861386 - DNA, 25 bp, Mus musculus
acacagtgagagttcgatgcccaag

SEQ ID NO: 861387 - DNA, 25 bp, Mus musculus
acacagtgagtgttcgatgcccaag

SEQ ID NO: 861388 - DNA, 25 bp, Mus musculus
acacagtgcattcccgacaaaccag

SEQ ID NO: 861389 - DNA, 25 bp, Mus musculus
acacagtgcattgccgacaaaccag

SEQ ID NO: 861390 - DNA, 25 bp, Mus musculus
acacagtgccagccaggtcggataa

SEQ ID NO: 861391 - DNA, 25 bp, Mus musculus
acacagtgccagcgagcccagagga

SEQ ID NO: 861392 - DNA, 25 bp, Mus musculus
acacagtgccaggcaggtcggataa

SEQ ID NO: 861393 - DNA, 25 bp, Mus musculus
acacagtgccagggagcccagagga

SEQ ID NO: 861394 - DNA, 25 bp, Mus musculus
acacagtggctggaagtctaaacga

SEQ ID NO: 861395 - DNA, 25 bp, Mus musculus
acacagtggctggatgtctaaacga

SEQ ID NO: 861396 - DNA, 25 bp, Mus musculus
acacagtggtcccagatacttcacg

SEQ ID NO: 861397 - DNA, 25 bp, Mus musculus
acacagtggtgccagatacttcacg

SEQ ID NO: 861398 - DNA, 25 bp, Mus musculus
acacagtgtaaaaacagaaagtgtg

SEQ ID NO: 861399 - DNA, 25 bp, Mus musculus
acacagtgtaaatacagaaagtgtg

SEQ ID NO: 861400 - DNA, 25 bp, Mus musculus
acacagttccaacccctggagatgg

SEQ ID NO: 861401 - DNA, 25 bp, Mus musculus
acacagttccaagccctggagatgg

SEQ ID NO: 861402 - DNA, 25 bp, Mus musculus
acacagtttgtattcgcttctcaag

SEQ ID NO: 861403 - DNA, 25 bp, Mus musculus
acacagtttgtattggcttctcaag

SEQ ID NO: 861404 - DNA, 25 bp, Mus musculus
acacataaagcacaatgctcagtgt

SEQ ID NO: 861405 - DNA, 25 bp, Mus musculus
acacataaagcagaatgctcagtgt

SEQ ID NO: 861406 - DNA, 25 bp, Mus musculus
acacatacagcagagaagaaatttg

SEQ ID NO: 861407 - DNA, 25 bp, Mus musculus
acacatacagccgagaaacctttca

SEQ ID NO: 861408 - DNA, 25 bp, Mus musculus
acacatacaggagagaagaaatttg

SEQ ID NO: 861409 - DNA, 25 bp, Mus musculus
acacatacaggcgagaaacctttca

SEQ ID NO: 861410 - DNA, 25 bp, Mus musculus
acacatcaagaaacttgaagaagcg

SEQ ID NO: 861411 - DNA, 25 bp, Mus musculus
acacatcaagtaacttgaagaagcg

SEQ ID NO: 861412 - DNA, 25 bp, Mus musculus
acacatcccaagctcgagacatcaa

SEQ ID NO: 861413 - DNA, 25 bp, Mus musculus
acacatcccaaggtcgagacatcaa

SEQ ID NO: 861414 - DNA, 25 bp, Mus musculus
acacatctgctccgtctgtgatgct

SEQ ID NO: 861415 - DNA, 25 bp, Mus musculus
acacatctgctcggtctgtgatgct

SEQ ID NO: 861416 - DNA, 25 bp, Mus musculus
acacatgcagaaaagtaaagaacaa

SEQ ID NO: 861417 - DNA, 25 bp, Mus musculus
acacatgcagccgcatacctcttgg

SEQ ID NO: 861418 - DNA, 25 bp, Mus musculus
acacatgcagctggtgaatgagcaa

SEQ ID NO: 861419 - DNA, 25 bp, Mus musculus
acacatgcaggcgcatacctcttgg

SEQ ID NO: 861420 - DNA, 25 bp, Mus musculus
acacatgcaggtggtgaatgagcaa

SEQ ID NO: 861421 - DNA, 25 bp, Mus musculus
acacatgcagtaaagtaaagaacaa

SEQ ID NO: 861422 - DNA, 25 bp, Mus musculus
acacatgcttcacacagagcagaat

SEQ ID NO: 861423 - DNA, 25 bp, Mus musculus
acacatgcttcacagagagcagaat

SEQ ID NO: 861424 - DNA, 25 bp, Mus musculus
acacattatgccaggatctgcactc

SEQ ID NO: 861425 - DNA, 25 bp, Mus musculus
acacattatgcctggatctgcactc

SEQ ID NO: 861426 - DNA, 25 bp, Mus musculus
acacattattaaaccgatggctccc

SEQ ID NO: 861427 - DNA, 25 bp, Mus musculus
acacattattaaacggatggctccc

SEQ ID NO: 861428 - DNA, 25 bp, Mus musculus
acacattattagctccaggacgccc

SEQ ID NO: 861429 - DNA, 25 bp, Mus musculus
acacattattaggtccaggacgccc

SEQ ID NO: 861430 - DNA, 25 bp, Mus musculus
acacattcaacgggcgattcatcag

SEQ ID NO: 861431 - DNA, 25 bp, Mus musculus
acacattcaacgggggattcatcag

SEQ ID NO: 861432 - DNA, 25 bp, Mus musculus
acacattcagcactgtcatctccag

SEQ ID NO: 861433 - DNA, 25 bp, Mus musculus
acacattcagcagtgtcatctccag

SEQ ID NO: 861434 - DNA, 25 bp, Mus musculus
acacatttcagggacactgctgggc

SEQ ID NO: 861435 - DNA, 25 bp, Mus musculus
acacatttcagggagactgctgggc

SEQ ID NO: 861436 - DNA, 25 bp, Mus musculus
acaccaaaaagcacaacccaagagg

SEQ ID NO: 861437 - DNA, 25 bp, Mus musculus
acaccaaaaagcactacccaagagg

SEQ ID NO: 861438 - DNA, 25 bp, Mus musculus
acaccaaaagcgctcaggatgctac

SEQ ID NO: 861439 - DNA, 25 bp, Mus musculus
acaccaaaagggctcaggatgctac

SEQ ID NO: 861440 - DNA, 25 bp, Mus musculus
acaccaagaaaaaaattgacatcct

SEQ ID NO: 861441 - DNA, 25 bp, Mus musculus
acaccaagaaaaaatttgacatcct

SEQ ID NO: 861442 - DNA, 25 bp, Mus musculus
acaccaagagaggtattgtggccag

SEQ ID NO: 861443 - DNA, 25 bp, Mus musculus
acaccaagagcttactggcggtttt

SEQ ID NO: 861444 - DNA, 25 bp, Mus musculus
acaccaagaggttactggcggtttt

SEQ ID NO: 861445 - DNA, 25 bp, Mus musculus
acaccaagagtggtattgtggccag

SEQ ID NO: 861446 - DNA, 25 bp, Mus musculus
acaccaatgtgaagaactctagcca

SEQ ID NO: 861447 - DNA, 25 bp, Mus musculus
acaccaatgtgatgaactctagcca

SEQ ID NO: 861448 - DNA, 25 bp, Mus musculus
acaccacaagatatgaagaagccaa

SEQ ID NO: 861449 - DNA, 25 bp, Mus musculus
acaccacaagttatgaagaagccaa

SEQ ID NO: 861450 - DNA, 25 bp, Mus musculus
acaccacatgagccctgtgggacat

SEQ ID NO: 861451 - DNA, 25 bp, Mus musculus
acaccacatgtgccctgtgggacat

SEQ ID NO: 861452 - DNA, 25 bp, Mus musculus
acaccaccactagtctgtcacatca

SEQ ID NO: 861453 - DNA, 25 bp, Mus musculus
acaccaccactagtgtgtcacatca

SEQ ID NO: 861454 - DNA, 25 bp, Mus musculus
acaccaccctggttcgtggatataa

SEQ ID NO: 861455 - DNA, 25 bp, Mus musculus
acaccaccctggttggtggatataa

SEQ ID NO: 861456 - DNA, 25 bp, Mus musculus
acaccacgtgcacctctgttacctg

SEQ ID NO: 861457 - DNA, 25 bp, Mus musculus
acaccacgtggacctctgttacctg

SEQ ID NO: 861458 - DNA, 25 bp, Mus musculus
acaccactgtgtcacgtgtggccca

SEQ ID NO: 861459 - DNA, 25 bp, Mus musculus
acaccactgtgtcaggtgtggccca

SEQ ID NO: 861460 - DNA, 25 bp, Mus musculus
acaccagaaggactacctgaacaac

SEQ ID NO: 861461 - DNA, 25 bp, Mus musculus
acaccagaaggagtacctgaacaac

SEQ ID NO: 861462 - DNA, 25 bp, Mus musculus
acaccagagagcaatcattgaggcg

SEQ ID NO: 861463 - DNA, 25 bp, Mus musculus
acaccagagagctatcattgaggcg

SEQ ID NO: 861464 - DNA, 25 bp, Mus musculus
acaccagagagctgacattgaggcg

SEQ ID NO: 861465 - DNA, 25 bp, Mus musculus
acaccagagagctgtcattgaggcg

SEQ ID NO: 861466 - DNA, 25 bp, Mus musculus
acaccagagcagcgtcatctccgaa

SEQ ID NO: 861467 - DNA, 25 bp, Mus musculus
acaccagagcagggtcatctccgaa

SEQ ID NO: 861468 - DNA, 25 bp, Mus musculus
acaccagagcgatgagtggtctttt

SEQ ID NO: 861469 - DNA, 25 bp, Mus musculus
acaccagagcgatgtgtggtctttt

SEQ ID NO: 861470 - DNA, 25 bp, Mus musculus
acaccagagtgacgagtggtctttc

SEQ ID NO: 861471 - DNA, 25 bp, Mus musculus
acaccagagtgacgtgtggtctttc

SEQ ID NO: 861472 - DNA, 25 bp, Mus musculus
acaccagcagacatagactgccagt

SEQ ID NO: 861473 - DNA, 25 bp, Mus musculus
acaccagcagtcatagactgccagt

SEQ ID NO: 861474 - DNA, 25 bp, Mus musculus
acaccaggagctgaaggattaacag

SEQ ID NO: 861475 - DNA, 25 bp, Mus musculus
acaccaggagctgatggattaacag

SEQ ID NO: 861476 - DNA, 25 bp, Mus musculus
acaccaggctgcagccctgtgggcc

SEQ ID NO: 861477 - DNA, 25 bp, Mus musculus
acaccaggctgcaggcctgtgggcc

SEQ ID NO: 861478 - DNA, 25 bp, Mus musculus
acaccagttacactatctggtcgat

SEQ ID NO: 861479 - DNA, 25 bp, Mus musculus
acaccagttacagtatctggtcgat

SEQ ID NO: 861480 - DNA, 25 bp, Mus musculus
acaccagtttgacacgacacagagc

SEQ ID NO: 861481 - DNA, 25 bp, Mus musculus
acaccagtttgacaggacacagagc

SEQ ID NO: 861482 - DNA, 25 bp, Mus musculus
acaccatatgccaacagccaccgtt

SEQ ID NO: 861483 - DNA, 25 bp, Mus musculus
acaccatatgccaagagccaccgtt

SEQ ID NO: 861484 - DNA, 25 bp, Mus musculus
acaccatcagcctgaccagcctccg

SEQ ID NO: 861485 - DNA, 25 bp, Mus musculus
acaccatcagcctgtgggacataga

SEQ ID NO: 861486 - DNA, 25 bp, Mus musculus
acaccatcaggctgaccagcctccg

SEQ ID NO: 861487 - DNA, 25 bp, Mus musculus
acaccatcaggctgtgggacataga

SEQ ID NO: 861488 - DNA, 25 bp, Mus musculus
acaccatccccccgcaggctggcca

SEQ ID NO: 861489 - DNA, 25 bp, Mus musculus
acaccatcccgccgcaggctggcca

SEQ ID NO: 861490 - DNA, 25 bp, Mus musculus
acaccatctttgcacccaggattca

SEQ ID NO: 861491 - DNA, 25 bp, Mus musculus
acaccatctttgcatgaaagcccct

SEQ ID NO: 861492 - DNA, 25 bp, Mus musculus
acaccatctttgcattcaatttttt

SEQ ID NO: 861493 - DNA, 25 bp, Mus musculus
acaccatctttggacccaggattca

SEQ ID NO: 861494 - DNA, 25 bp, Mus musculus
acaccatctttggatgaaagcccct

SEQ ID NO: 861495 - DNA, 25 bp, Mus musculus
acaccatctttggattcaatttttt

SEQ ID NO: 861496 - DNA, 25 bp, Mus musculus
acaccatgaaagctctatcatgaca

SEQ ID NO: 861497 - DNA, 25 bp, Mus musculus
acaccatgaaaggtctatcatgaca

SEQ ID NO: 861498 - DNA, 25 bp, Mus musculus
acaccatgagcctactcatcttcct

SEQ ID NO: 861499 - DNA, 25 bp, Mus musculus
acaccatgagctacattctaatcga

SEQ ID NO: 861500 - DNA, 25 bp, Mus musculus
acaccatgaggctactcatcttcct

SEQ ID NO: 861501 - DNA, 25 bp, Mus musculus
acaccatgaggtacattctaatcga

SEQ ID NO: 861502 - DNA, 25 bp, Mus musculus
acaccatgcatacgaagcaccttca

SEQ ID NO: 861503 - DNA, 25 bp, Mus musculus
acaccatgcataggaagcaccttca

SEQ ID NO: 861504 - DNA, 25 bp, Mus musculus
acaccatgggtgatcctcctgacta

SEQ ID NO: 861505 - DNA, 25 bp, Mus musculus
acaccatgggtgatgctcctgacta

SEQ ID NO: 861506 - DNA, 25 bp, Mus musculus
acaccattgaaaacccagcctgcag

SEQ ID NO: 861507 - DNA, 25 bp, Mus musculus
acaccattgaaatcccagcctgcag

SEQ ID NO: 861508 - DNA, 25 bp, Mus musculus
acaccattgaagctcctcaactttg

SEQ ID NO: 861509 - DNA, 25 bp, Mus musculus
acaccattgaaggtcctcaactttg

SEQ ID NO: 861510 - DNA, 25 bp, Mus musculus
acacccaagaagcacgcagagacag

SEQ ID NO: 861511 - DNA, 25 bp, Mus musculus
acacccaagaagcaggcagagacag

SEQ ID NO: 861512 - DNA, 25 bp, Mus musculus
acacccaaggatgtgaatgagtgca

SEQ ID NO: 861513 - DNA, 25 bp, Mus musculus
acacccaaggttgtgaatgagtgca

SEQ ID NO: 861514 - DNA, 25 bp, Mus musculus
acacccaccacacaccttgtctgag

SEQ ID NO: 861515 - DNA, 25 bp, Mus musculus
acacccaccacacagcttgtctgag

SEQ ID NO: 861516 - DNA, 25 bp, Mus musculus
acacccaccgaggtcaactcacagg

SEQ ID NO: 861517 - DNA, 25 bp, Mus musculus
acacccaccgagtggtcaactcaca

SEQ ID NO: 861518 - DNA, 25 bp, Mus musculus
acacccaccgtggtcaactcacagg

SEQ ID NO: 861519 - DNA, 25 bp, Mus musculus
acacccaccgtgtggtcaactcaca

SEQ ID NO: 861520 - DNA, 25 bp, Mus musculus
acacccacgaaaaggcaaatcccaa

SEQ ID NO: 861521 - DNA, 25 bp, Mus musculus
acacccacgaaatggcaaatcccaa

SEQ ID NO: 861522 - DNA, 25 bp, Mus musculus
acacccagggaacttctccagcctg

SEQ ID NO: 861523 - DNA, 25 bp, Mus musculus
acacccagggtacttctccagcctg

SEQ ID NO: 861524 - DNA, 25 bp, Mus musculus
acacccatacagaaattagacggct

SEQ ID NO: 861525 - DNA, 25 bp, Mus musculus
acacccatacagtaattagacggct

SEQ ID NO: 861526 - DNA, 25 bp, Mus musculus
acaccccagagaactgtattcaact

SEQ ID NO: 861527 - DNA, 25 bp, Mus musculus
acaccccagagatctgtattcaact

SEQ ID NO: 861528 - DNA, 25 bp, Mus musculus
acacccgcaaagattacagcggcga

SEQ ID NO: 861529 - DNA, 25 bp, Mus musculus
acacccgcaatgattacagcggcga

SEQ ID NO: 861530 - DNA, 25 bp, Mus musculus
acacccgtcaaaaatgaatacccag

SEQ ID NO: 861531 - DNA, 25 bp, Mus musculus
acacccgtcaaatatgaatacccag

SEQ ID NO: 861532 - DNA, 25 bp, Mus musculus
acaccctcctacacagaccgagtcc

SEQ ID NO: 861533 - DNA, 25 bp, Mus musculus
acaccctcctacactgaccgagtcc

SEQ ID NO: 861534 - DNA, 25 bp, Mus musculus
acaccctgagagaatgttggctcaa

SEQ ID NO: 861535 - DNA, 25 bp, Mus musculus
acaccctgagagtatgttggctcaa

SEQ ID NO: 861536 - DNA, 25 bp, Mus musculus
acaccgccagctctgctgtggctgg

SEQ ID NO: 861537 - DNA, 25 bp, Mus musculus
acaccgccagctgtgctgtggctgg

SEQ ID NO: 861538 - DNA, 25 bp, Mus musculus
acaccgctcgagtcttatctagcat

SEQ ID NO: 861539 - DNA, 25 bp, Mus musculus
acaccgctcgtgtcttatctagcat

SEQ ID NO: 861540 - DNA, 25 bp, Mus musculus
acaccgctgccacgcacaatggaag

SEQ ID NO: 861541 - DNA, 25 bp, Mus musculus
acaccgctgccaggcacaatggaag

SEQ ID NO: 861542 - DNA, 25 bp, Mus musculus
acaccggatgcccacactcaacgca

SEQ ID NO: 861543 - DNA, 25 bp, Mus musculus
acaccggatgcccagactcaacgca

SEQ ID NO: 861544 - DNA, 25 bp, Mus musculus
acaccggcagctgggtaatgctgtg

SEQ ID NO: 861545 - DNA, 25 bp, Mus musculus
acaccggcaggtgggtaatgctgtg

SEQ ID NO: 861546 - DNA, 25 bp, Mus musculus
acaccgtacgagccagctgtggccc

SEQ ID NO: 861547 - DNA, 25 bp, Mus musculus
acaccgtacgaggcagctgtggccc

SEQ ID NO: 861548 - DNA, 25 bp, Mus musculus
acaccgtatgaacgtggaagatatc

SEQ ID NO: 861549 - DNA, 25 bp, Mus musculus
acaccgtatgaaggtggaagatatc

SEQ ID NO: 861550 - DNA, 25 bp, Mus musculus
acacctagccagcaccaccaccaac

SEQ ID NO: 861551 - DNA, 25 bp, Mus musculus
acacctagccaggaccaccaccaac

SEQ ID NO: 861552 - DNA, 25 bp, Mus musculus
acacctaggcctcatccagagctca

SEQ ID NO: 861553 - DNA, 25 bp, Mus musculus
acacctaggcctgatccagagctca

SEQ ID NO: 861554 - DNA, 25 bp, Mus musculus
acacctatttagaggaactctgtag

SEQ ID NO: 861555 - DNA, 25 bp, Mus musculus
acacctatttagtggaactctgtag

SEQ ID NO: 861556 - DNA, 25 bp, Mus musculus
acacctcaactgatcggaccctgcc

SEQ ID NO: 861557 - DNA, 25 bp, Mus musculus
acacctcaactgatgggaccctgcc

SEQ ID NO: 861558 - DNA, 25 bp, Mus musculus
acacctcatgcccagcaactgtggg

SEQ ID NO: 861559 - DNA, 25 bp, Mus musculus
acacctcatgccgagcaactgtggg

SEQ ID NO: 861560 - DNA, 25 bp, Mus musculus
acacctctgcctcctcatttggctg

SEQ ID NO: 861561 - DNA, 25 bp, Mus musculus
acacctctgcctgctcatttggctg

SEQ ID NO: 861562 - DNA, 25 bp, Mus musculus
acacctcttccacacgctgaatcgc

SEQ ID NO: 861563 - DNA, 25 bp, Mus musculus
acacctcttccagacgctgaatcgc

SEQ ID NO: 861564 - DNA, 25 bp, Mus musculus
acacctgagacatgaaggcctaagg

SEQ ID NO: 861565 - DNA, 25 bp, Mus musculus
acacctgagagatgaaggcctaagg

SEQ ID NO: 861566 - DNA, 25 bp, Mus musculus
acacctgatggccgcgaaattgtct

SEQ ID NO: 861567 - DNA, 25 bp, Mus musculus
acacctgatggccgggaaattgtct

SEQ ID NO: 861568 - DNA, 25 bp, Mus musculus
acacctgcaaagacaatgggccctg

SEQ ID NO: 861569 - DNA, 25 bp, Mus musculus
acacctgcaaagtcaatgggccctg

SEQ ID NO: 861570 - DNA, 25 bp, Mus musculus
acacctgcacaacctgggtatcatc

SEQ ID NO: 861571 - DNA, 25 bp, Mus musculus
acacctgcacaagctgggtatcatc

SEQ ID NO: 861572 - DNA, 25 bp, Mus musculus
acacctgcagagagaagggtcgcaa

SEQ ID NO: 861573 - DNA, 25 bp, Mus musculus
acacctgcagtgagaagggtcgcaa

SEQ ID NO: 861574 - DNA, 25 bp, Mus musculus
acacctgccgctcagggatccccca

SEQ ID NO: 861575 - DNA, 25 bp, Mus musculus
acacctgccgctccaaccgtgactg

SEQ ID NO: 861576 - DNA, 25 bp, Mus musculus
acacctgccggtcagggatccccca

SEQ ID NO: 861577 - DNA, 25 bp, Mus musculus
acacctgccggtccaaccgtgactg

SEQ ID NO: 861578 - DNA, 25 bp, Mus musculus
acacctgcctcttcccgtttgtcta

SEQ ID NO: 861579 - DNA, 25 bp, Mus musculus
acacctgcctcttcgcgtttgtcta

SEQ ID NO: 861580 - DNA, 25 bp, Mus musculus
acacctgtcgcccatattttaatat

SEQ ID NO: 861581 - DNA, 25 bp, Mus musculus
acacctgtcgcccctgagtgcaata

SEQ ID NO: 861582 - DNA, 25 bp, Mus musculus
acacctgtcgccgatattttaatat

SEQ ID NO: 861583 - DNA, 25 bp, Mus musculus
acacctgtcgccgctgagtgcaata

SEQ ID NO: 861584 - DNA, 25 bp, Mus musculus
acacctgtggacctcatggggtgac

SEQ ID NO: 861585 - DNA, 25 bp, Mus musculus
acacctgtggacctgatggggtgac

SEQ ID NO: 861586 - DNA, 25 bp, Mus musculus
acacctgttcagctgtgcctcctga

SEQ ID NO: 861587 - DNA, 25 bp, Mus musculus
acacctgttcaggtgtgcctcctga

SEQ ID NO: 861588 - DNA, 25 bp, Mus musculus
acaccttctacgtgcgcatctacat

SEQ ID NO: 861589 - DNA, 25 bp, Mus musculus
acaccttctacgtgggcatctacat

SEQ ID NO: 861590 - DNA, 25 bp, Mus musculus
acaccttcttttccttctgcagtga

SEQ ID NO: 861591 - DNA, 25 bp, Mus musculus
acaccttcttttcgcgtgcccacac

SEQ ID NO: 861592 - DNA, 25 bp, Mus musculus
acaccttcttttgcttctgcagtga

SEQ ID NO: 861593 - DNA, 25 bp, Mus musculus
acaccttcttttggcgtgcccacac

SEQ ID NO: 861594 - DNA, 25 bp, Mus musculus
acacctttcggtcgtagcctggatg

SEQ ID NO: 861595 - DNA, 25 bp, Mus musculus
acacctttcggtggtagcctggatg

SEQ ID NO: 861596 - DNA, 25 bp, Mus musculus
acacgaaaatctgattggtctgttg

SEQ ID NO: 861597 - DNA, 25 bp, Mus musculus
acacgaaaatgtgattggtctgttg

SEQ ID NO: 861598 - DNA, 25 bp, Mus musculus
acacgaccagagcagcccctggaag

SEQ ID NO: 861599 - DNA, 25 bp, Mus musculus
acacgaccagtgcagcccctggaag

SEQ ID NO: 861600 - DNA, 25 bp, Mus musculus
acacgacttgagctttgtgggacat

SEQ ID NO: 861601 - DNA, 25 bp, Mus musculus
acacgacttgtgctttgtgggacat

SEQ ID NO: 861602 - DNA, 25 bp, Mus musculus
acacgagctggactgagcaaaccaa

SEQ ID NO: 861603 - DNA, 25 bp, Mus musculus
acacgagctggagtgagcaaaccaa

SEQ ID NO: 861604 - DNA, 25 bp, Mus musculus
acacgattcacgaggtcctgtaata

SEQ ID NO: 861605 - DNA, 25 bp, Mus musculus
acacgattcacgtggtcctgtaata

SEQ ID NO: 861606 - DNA, 25 bp, Mus musculus
acacgcacagcgaggtatgtggtat

SEQ ID NO: 861607 - DNA, 25 bp, Mus musculus
acacgcacagggaggtatgtggtat

SEQ ID NO: 861608 - DNA, 25 bp, Mus musculus
acacgcagacagaggacatttggtc

SEQ ID NO: 861609 - DNA, 25 bp, Mus musculus
acacgcagacagtggacatttggtc

SEQ ID NO: 861610 - DNA, 25 bp, Mus musculus
acacgcagaggccacgtgctcctct

SEQ ID NO: 861611 - DNA, 25 bp, Mus musculus
acacgcagaggccaggtgctcctct

SEQ ID NO: 861612 - DNA, 25 bp, Mus musculus
acacgcccaagaaacgtggcaggag

SEQ ID NO: 861613 - DNA, 25 bp, Mus musculus
acacgcccaagaaaggtggcaggag

SEQ ID NO: 861614 - DNA, 25 bp, Mus musculus
acacgcccatggaacagaccgtgcg

SEQ ID NO: 861615 - DNA, 25 bp, Mus musculus
acacgcccatggaagagaccgtgcg

SEQ ID NO: 861616 - DNA, 25 bp, Mus musculus
acacgccctgcgccgacaactggct

SEQ ID NO: 861617 - DNA, 25 bp, Mus musculus
acacgccctgggccgacaactggct

SEQ ID NO: 861618 - DNA, 25 bp, Mus musculus
acacgcggcatacgccttcagaagt

SEQ ID NO: 861619 - DNA, 25 bp, Mus musculus
acacgcggcataggccttcagaagt

SEQ ID NO: 861620 - DNA, 25 bp, Mus musculus
acacgctacttacccccaaccatac

SEQ ID NO: 861621 - DNA, 25 bp, Mus musculus
acacgctacttacgtgatgcaagaa

SEQ ID NO: 861622 - DNA, 25 bp, Mus musculus
acacgctacttagccccaaccatac

SEQ ID NO: 861623 - DNA, 25 bp, Mus musculus
acacgctacttaggtgatgcaagaa

SEQ ID NO: 861624 - DNA, 25 bp, Mus musculus
acacgctggtcaaacgcatcatcga

SEQ ID NO: 861625 - DNA, 25 bp, Mus musculus
acacgctggtcaaaggcatcatcga

SEQ ID NO: 861626 - DNA, 25 bp, Mus musculus
acacgctgtgctcaatgagcaacat

SEQ ID NO: 861627 - DNA, 25 bp, Mus musculus
acacgctgtgctgaatgagcaacat

SEQ ID NO: 861628 - DNA, 25 bp, Mus musculus
acacgcttcaaatgcatagtcacat

SEQ ID NO: 861629 - DNA, 25 bp, Mus musculus
acacgcttcaaatggatagtcacat

SEQ ID NO: 861630 - DNA, 25 bp, Mus musculus
acacggaagaagaacatcagaaagc

SEQ ID NO: 861631 - DNA, 25 bp, Mus musculus
acacggaagaagtacatcagaaagc

SEQ ID NO: 861632 - DNA, 25 bp, Mus musculus
acacggacagactggtccctgagtg

SEQ ID NO: 861633 - DNA, 25 bp, Mus musculus
acacggacagtctggtccctgagtg

SEQ ID NO: 861634 - DNA, 25 bp, Mus musculus
acacggacctcccacgagctgcaga

SEQ ID NO: 861635 - DNA, 25 bp, Mus musculus
acacggacctcccaggagctgcaga

SEQ ID NO: 861636 - DNA, 25 bp, Mus musculus
acacggatcgcacgtgcctgtccca

SEQ ID NO: 861637 - DNA, 25 bp, Mus musculus
acacggatcgcaggtgcctgtccca

SEQ ID NO: 861638 - DNA, 25 bp, Mus musculus
acacgggtgatgctcgacaagtggg

SEQ ID NO: 861639 - DNA, 25 bp, Mus musculus
acacgggtgatgctggacaagtggg

SEQ ID NO: 861640 - DNA, 25 bp, Mus musculus
acacgtaccagtccaaagaccctaa

SEQ ID NO: 861641 - DNA, 25 bp, Mus musculus
acacgtaccagtgcaaagaccctaa

SEQ ID NO: 861642 - DNA, 25 bp, Mus musculus
acacgtacctcacgccaagtgcttt

SEQ ID NO: 861643 - DNA, 25 bp, Mus musculus
acacgtacctcaggccaagtgcttt

SEQ ID NO: 861644 - DNA, 25 bp, Mus musculus
acacgtctgcccctgtgctgatgtc

SEQ ID NO: 861645 - DNA, 25 bp, Mus musculus
acacgtctgcccgtgtgctgatgtc

SEQ ID NO: 861646 - DNA, 25 bp, Mus musculus
acacgtgaccagaatggcaagaaga

SEQ ID NO: 861647 - DNA, 25 bp, Mus musculus
acacgtgaccagtatggcaagaaga

SEQ ID NO: 861648 - DNA, 25 bp, Mus musculus
acacgtgctcagagcagagcctcta

SEQ ID NO: 861649 - DNA, 25 bp, Mus musculus
acacgtgctcagccctttgttcagg

SEQ ID NO: 861650 - DNA, 25 bp, Mus musculus
acacgtgctcaggcctttgttcagg

SEQ ID NO: 861651 - DNA, 25 bp, Mus musculus
acacgtgctcagtgcagagcctcta

SEQ ID NO: 861652 - DNA, 25 bp, Mus musculus
acacgttcttcccgctggtgtcacc

SEQ ID NO: 861653 - DNA, 25 bp, Mus musculus
acacgttcttccggctggtgtcacc

SEQ ID NO: 861654 - DNA, 25 bp, Mus musculus
acactaaagtagagactcagggtga

SEQ ID NO: 861655 - DNA, 25 bp, Mus musculus
acactaaagtagtgactcagggtga

SEQ ID NO: 861656 - DNA, 25 bp, Mus musculus
acactaagagagcacacccgtctga

SEQ ID NO: 861657 - DNA, 25 bp, Mus musculus
acactaagagagcagacccgtctga

SEQ ID NO: 861658 - DNA, 25 bp, Mus musculus
acactacatgaactattacaatgac

SEQ ID NO: 861659 - DNA, 25 bp, Mus musculus
acactacatgaagtattacaatgac

SEQ ID NO: 861660 - DNA, 25 bp, Mus musculus
acactaccagctcgcctataggttg

SEQ ID NO: 861661 - DNA, 25 bp, Mus musculus
acactaccagctcggtaacgacatt

SEQ ID NO: 861662 - DNA, 25 bp, Mus musculus
acactaccagctggcctataggttg

SEQ ID NO: 861663 - DNA, 25 bp, Mus musculus
acactaccagctgggtaacgacatt

SEQ ID NO: 861664 - DNA, 25 bp, Mus musculus
acactataagctttgctatgcgcgt

SEQ ID NO: 861665 - DNA, 25 bp, Mus musculus
acactataaggtttgctatgcgcgt

SEQ ID NO: 861666 - DNA, 25 bp, Mus musculus
acactcaagaagaagaatgtccctt

SEQ ID NO: 861667 - DNA, 25 bp, Mus musculus
acactcaagaagaatgtcccttcta

SEQ ID NO: 861668 - DNA, 25 bp, Mus musculus
acactcaagaagtagaatgtccctt

SEQ ID NO: 861669 - DNA, 25 bp, Mus musculus
acactcaagaagtatgtcccttcta

SEQ ID NO: 861670 - DNA, 25 bp, Mus musculus
acactcaccctcaggctctgagtca

SEQ ID NO: 861671 - DNA, 25 bp, Mus musculus
acactcaccctctggctctgagtca

SEQ ID NO: 861672 - DNA, 25 bp, Mus musculus
acactcagagactgtctctggaggt

SEQ ID NO: 861673 - DNA, 25 bp, Mus musculus
acactcagagcatttccctagagat

SEQ ID NO: 861674 - DNA, 25 bp, Mus musculus
acactcagaggatttccctagagat

SEQ ID NO: 861675 - DNA, 25 bp, Mus musculus
acactcagagtctgtctctggaggt

SEQ ID NO: 861676 - DNA, 25 bp, Mus musculus
acactcagcagaaacatgttaaaca

SEQ ID NO: 861677 - DNA, 25 bp, Mus musculus
acactcagcagaaagatgttaaaca

SEQ ID NO: 861678 - DNA, 25 bp, Mus musculus
acactccaagccatgtagaagtcca

SEQ ID NO: 861679 - DNA, 25 bp, Mus musculus
acactccaaggcatgtagaagtcca

SEQ ID NO: 861680 - DNA, 25 bp, Mus musculus
acactccagggcaacccccaggact

SEQ ID NO: 861681 - DNA, 25 bp, Mus musculus
acactccagggcaagccccaggact

SEQ ID NO: 861682 - DNA, 25 bp, Mus musculus
acactccatcagatctcatcgcaga

SEQ ID NO: 861683 - DNA, 25 bp, Mus musculus
acactccatcagttctcatcgcaga

SEQ ID NO: 861684 - DNA, 25 bp, Mus musculus
acactccgacagctttccaccacca

SEQ ID NO: 861685 - DNA, 25 bp, Mus musculus
acactccgacaggtttccaccacca

SEQ ID NO: 861686 - DNA, 25 bp, Mus musculus
acactcctctacacttagcctgtga

SEQ ID NO: 861687 - DNA, 25 bp, Mus musculus
acactcctctatcacgtttggcatc

SEQ ID NO: 861688 - DNA, 25 bp, Mus musculus
acactcctctatcaggtttggcatc

SEQ ID NO: 861689 - DNA, 25 bp, Mus musculus
acactcctcttcacttagcctgtga

SEQ ID NO: 861690 - DNA, 25 bp, Mus musculus
acactcgcagcagacaaagcattat

SEQ ID NO: 861691 - DNA, 25 bp, Mus musculus
acactcgcaggagacaaagcattat

SEQ ID NO: 861692 - DNA, 25 bp, Mus musculus
acactcgccttgaacgctcagaagt

SEQ ID NO: 861693 - DNA, 25 bp, Mus musculus
acactcgccttgaaggctcagaagt

SEQ ID NO: 861694 - DNA, 25 bp, Mus musculus
acactctactcgatgactggaaacc

SEQ ID NO: 861695 - DNA, 25 bp, Mus musculus
acactctactggatgactggaaacc

SEQ ID NO: 861696 - DNA, 25 bp, Mus musculus
acactctccagacgttggggcgatc

SEQ ID NO: 861697 - DNA, 25 bp, Mus musculus
acactctccagaggttggggcgatc

SEQ ID NO: 861698 - DNA, 25 bp, Mus musculus
acactctggccaaccgctttcctgc

SEQ ID NO: 861699 - DNA, 25 bp, Mus musculus
acactctggccatccgctttcctgc

SEQ ID NO: 861700 - DNA, 25 bp, Mus musculus
acactcttcaagctaaagtggatct

SEQ ID NO: 861701 - DNA, 25 bp, Mus musculus
acactcttcaaggtaaagtggatct

SEQ ID NO: 861702 - DNA, 25 bp, Mus musculus
acactgacagcagtctggtgtgtga

SEQ ID NO: 861703 - DNA, 25 bp, Mus musculus
acactgacagcgatcaagtttgtgg

SEQ ID NO: 861704 - DNA, 25 bp, Mus musculus
acactgacaggagtctggtgtgtga

SEQ ID NO: 861705 - DNA, 25 bp, Mus musculus
acactgacagggatcaagtttgtgg

SEQ ID NO: 861706 - DNA, 25 bp, Mus musculus
acactgacctggagttgctgcacct

SEQ ID NO: 861707 - DNA, 25 bp, Mus musculus
acactgacctggagtttacagtgtt

SEQ ID NO: 861708 - DNA, 25 bp, Mus musculus
acactgacctggtgttgctgcacct

SEQ ID NO: 861709 - DNA, 25 bp, Mus musculus
acactgacctggtgtttacagtgtt

SEQ ID NO: 861710 - DNA, 25 bp, Mus musculus
acactgagagcagacttctttctat

SEQ ID NO: 861711 - DNA, 25 bp, Mus musculus
acactgagaggagacttctttctat

SEQ ID NO: 861712 - DNA, 25 bp, Mus musculus
acactgagcaagagtccaactttat

SEQ ID NO: 861713 - DNA, 25 bp, Mus musculus
acactgagcaagtgtccaactttat

SEQ ID NO: 861714 - DNA, 25 bp, Mus musculus
acactgagtctctgcgcacggaggt

SEQ ID NO: 861715 - DNA, 25 bp, Mus musculus
acactgagtctctgggcacggaggt

SEQ ID NO: 861716 - DNA, 25 bp, Mus musculus
acactgcgctcagtgcaccaatgtc

SEQ ID NO: 861717 - DNA, 25 bp, Mus musculus
acactgcgctgagtgcaccaatgtc

SEQ ID NO: 861718 - DNA, 25 bp, Mus musculus
acactgctgaccgccatcacgtcct

SEQ ID NO: 861719 - DNA, 25 bp, Mus musculus
acactgctgagcgccatcacgtcct

SEQ ID NO: 861720 - DNA, 25 bp, Mus musculus
acactggaagaatttttgaacaatg

SEQ ID NO: 861721 - DNA, 25 bp, Mus musculus
acactggaagcatttgccagtccac

SEQ ID NO: 861722 - DNA, 25 bp, Mus musculus
acactggaaggatttgccagtccac

SEQ ID NO: 861723 - DNA, 25 bp, Mus musculus
acactggaagtatttttgaacaatg

SEQ ID NO: 861724 - DNA, 25 bp, Mus musculus
acactggacgatctccccagcgcag

SEQ ID NO: 861725 - DNA, 25 bp, Mus musculus
acactggacgatgtccccagcgcag

SEQ ID NO: 861726 - DNA, 25 bp, Mus musculus
acactggcaattgccgttatcaatg

SEQ ID NO: 861727 - DNA, 25 bp, Mus musculus
acactggcaattgcggttatcaatg

SEQ ID NO: 861728 - DNA, 25 bp, Mus musculus
acactggccaaaatatatgagaaga

SEQ ID NO: 861729 - DNA, 25 bp, Mus musculus
acactggccaaaatatcctctgtga

SEQ ID NO: 861730 - DNA, 25 bp, Mus musculus
acactggccaaaatttatgagaaga

SEQ ID NO: 861731 - DNA, 25 bp, Mus musculus
acactggccaaaatttcctctgtga

SEQ ID NO: 861732 - DNA, 25 bp, Mus musculus
acactggccaggcaatatggtgttc

SEQ ID NO: 861733 - DNA, 25 bp, Mus musculus
acactggccagggaatatggtgttc

SEQ ID NO: 861734 - DNA, 25 bp, Mus musculus
acactggccgagcgatggaattcga

SEQ ID NO: 861735 - DNA, 25 bp, Mus musculus
acactggccgagggatggaattcga

SEQ ID NO: 861736 - DNA, 25 bp, Mus musculus
acactggccgcagaagctggaggga

SEQ ID NO: 861737 - DNA, 25 bp, Mus musculus
acactggccgccacaatatgacgac

SEQ ID NO: 861738 - DNA, 25 bp, Mus musculus
acactggccgccactgggaagcctg

SEQ ID NO: 861739 - DNA, 25 bp, Mus musculus
acactggccggagaagctggaggga

SEQ ID NO: 861740 - DNA, 25 bp, Mus musculus
acactggccggcacaatatgacgac

SEQ ID NO: 861741 - DNA, 25 bp, Mus musculus
acactggccggcactgggaagcctg

SEQ ID NO: 861742 - DNA, 25 bp, Mus musculus
acactgtagtggaacaagaatgact

SEQ ID NO: 861743 - DNA, 25 bp, Mus musculus
acactgtagtggaacagaaatcact

SEQ ID NO: 861744 - DNA, 25 bp, Mus musculus
acactgtagtggaagaagaatgact

SEQ ID NO: 861745 - DNA, 25 bp, Mus musculus
acactgtagtggaagagaaatcact

SEQ ID NO: 861746 - DNA, 25 bp, Mus musculus
acactgtgggaacacgaacagaatg

SEQ ID NO: 861747 - DNA, 25 bp, Mus musculus
acactgtgggaacacgtattgaagc

SEQ ID NO: 861748 - DNA, 25 bp, Mus musculus
acactgtgggaacaggaacagaatg

SEQ ID NO: 861749 - DNA, 25 bp, Mus musculus
acactgtgggaacaggtattgaagc

SEQ ID NO: 861750 - DNA, 25 bp, Mus musculus
acactgtgggcaccaggcaacagat

SEQ ID NO: 861751 - DNA, 25 bp, Mus musculus
acactgtgggcagcaggcaacagat

SEQ ID NO: 861752 - DNA, 25 bp, Mus musculus
acacttcaaagaatagtgcaaaaat

SEQ ID NO: 861753 - DNA, 25 bp, Mus musculus
acacttcaaagaattgtgcaaaaat

SEQ ID NO: 861754 - DNA, 25 bp, Mus musculus
acacttcaagaacgtgtgtggccct

SEQ ID NO: 861755 - DNA, 25 bp, Mus musculus
acacttcaagaaggtgtgtggccct

SEQ ID NO: 861756 - DNA, 25 bp, Mus musculus
acacttcccagggacgtcagcacct

SEQ ID NO: 861757 - DNA, 25 bp, Mus musculus
acacttcccagggaggtcagcacct

SEQ ID NO: 861758 - DNA, 25 bp, Mus musculus
acacttcccgctcgacgtgcaatgg

SEQ ID NO: 861759 - DNA, 25 bp, Mus musculus
acacttcccgctggacgtgcaatgg

SEQ ID NO: 861760 - DNA, 25 bp, Mus musculus
acacttcgaaaccacgacaccttct

SEQ ID NO: 861761 - DNA, 25 bp, Mus musculus
acacttcgaaaccaggacaccttct

SEQ ID NO: 861762 - DNA, 25 bp, Mus musculus
acacttcgggagcacgtgatatatc

SEQ ID NO: 861763 - DNA, 25 bp, Mus musculus
acacttcgggagcaggtgatatatc

SEQ ID NO: 861764 - DNA, 25 bp, Mus musculus
acacttctcctggacgaatgtggcc

SEQ ID NO: 861765 - DNA, 25 bp, Mus musculus
acacttctcctggaggaatgtggcc

SEQ ID NO: 861766 - DNA, 25 bp, Mus musculus
acacttctgacgatcttgaccggcc

SEQ ID NO: 861767 - DNA, 25 bp, Mus musculus
acacttctgacgttcttgaccggcc

SEQ ID NO: 861768 - DNA, 25 bp, Mus musculus
acacttctggagaccacatgtgtcg

SEQ ID NO: 861769 - DNA, 25 bp, Mus musculus
acacttctggagcaaaatatgtcgt

SEQ ID NO: 861770 - DNA, 25 bp, Mus musculus
acacttctggaggaaaatatgtcgt

SEQ ID NO: 861771 - DNA, 25 bp, Mus musculus
acacttctggagtccacatgtgtcg

SEQ ID NO: 861772 - DNA, 25 bp, Mus musculus
acacttcttcctcccttaaccatgg

SEQ ID NO: 861773 - DNA, 25 bp, Mus musculus
acacttcttcctgccttaaccatgg

SEQ ID NO: 861774 - DNA, 25 bp, Mus musculus
acactttgagcattttggctttaga

SEQ ID NO: 861775 - DNA, 25 bp, Mus musculus
acactttgaggattttggctttaga

SEQ ID NO: 861776 - DNA, 25 bp, Mus musculus
acactttgcaaacgcaaaatcatgg

SEQ ID NO: 861777 - DNA, 25 bp, Mus musculus
acactttgcaaaggcaaaatcatgg

SEQ ID NO: 861778 - DNA, 25 bp, Mus musculus
acactttgtaacagcactgagggtg

SEQ ID NO: 861779 - DNA, 25 bp, Mus musculus
acactttgtaactgcactgagggtg

SEQ ID NO: 861780 - DNA, 25 bp, Mus musculus
acactttgtcatgtagatgccggac

SEQ ID NO: 861781 - DNA, 25 bp, Mus musculus
acactttgtcgcaatgtagatgccg

SEQ ID NO: 861782 - DNA, 25 bp, Mus musculus
acactttgtcgcagaagatgtagat

SEQ ID NO: 861783 - DNA, 25 bp, Mus musculus
acactttgtcgctatgtagatgccg

SEQ ID NO: 861784 - DNA, 25 bp, Mus musculus
acactttgtcgctgaagatgtagat

SEQ ID NO: 861785 - DNA, 25 bp, Mus musculus
acactttgtcttgtagatgccggac

SEQ ID NO: 861786 - DNA, 25 bp, Mus musculus
acactttgtttacacgtgatgttgc

SEQ ID NO: 861787 - DNA, 25 bp, Mus musculus
acactttgtttacaggtgatgttgc

SEQ ID NO: 861788 - DNA, 25 bp, Mus musculus
acacttttctccagccttcagataa

SEQ ID NO: 861789 - DNA, 25 bp, Mus musculus
acacttttctccaggcttcagataa

SEQ ID NO: 861790 - DNA, 25 bp, Mus musculus
acagaaaaataaagttgatttagtg

SEQ ID NO: 861791 - DNA, 25 bp, Mus musculus
acagaaaaataatgttgatttagtg

SEQ ID NO: 861792 - DNA, 25 bp, Mus musculus
acagaaaagaagcctggtgaggact

SEQ ID NO: 861793 - DNA, 25 bp, Mus musculus
acagaaaagaaggctggtgaggact

SEQ ID NO: 861794 - DNA, 25 bp, Mus musculus
acagaaaatgagcagttacttaagg

SEQ ID NO: 861795 - DNA, 25 bp, Mus musculus
acagaaaatgaggagttacttaagg

SEQ ID NO: 861796 - DNA, 25 bp, Mus musculus
acagaaacagcctttgctctgctgg

SEQ ID NO: 861797 - DNA, 25 bp, Mus musculus
acagaaacaggctttgctctgctgg

SEQ ID NO: 861798 - DNA, 25 bp, Mus musculus
acagaaaccaagcagttggccaaag

SEQ ID NO: 861799 - DNA, 25 bp, Mus musculus
acagaaaccaaggagttggccaaag

SEQ ID NO: 861800 - DNA, 25 bp, Mus musculus
acagaaaccatacgggattctggct

SEQ ID NO: 861801 - DNA, 25 bp, Mus musculus
acagaaaccataggggattctggct

SEQ ID NO: 861802 - DNA, 25 bp, Mus musculus
acagaaacccagacaccgcccagga

SEQ ID NO: 861803 - DNA, 25 bp, Mus musculus
acagaaacccagtcaccgcccagga

SEQ ID NO: 861804 - DNA, 25 bp, Mus musculus
acagaaactaaaataagtgacgaga

SEQ ID NO: 861805 - DNA, 25 bp, Mus musculus
acagaaactaaattaagtgacgaga

SEQ ID NO: 861806 - DNA, 25 bp, Mus musculus
acagaaatcgagctgaggaaacgtg

SEQ ID NO: 861807 - DNA, 25 bp, Mus musculus
acagaaatcgaggtgaggaaacgtg

SEQ ID NO: 861808 - DNA, 25 bp, Mus musculus
acagaaatctctcggcgcttgtcag

SEQ ID NO: 861809 - DNA, 25 bp, Mus musculus
acagaaatctctgggcgcttgtcag

SEQ ID NO: 861810 - DNA, 25 bp, Mus musculus
acagaaatggcacgaaaggagaaca

SEQ ID NO: 861811 - DNA, 25 bp, Mus musculus
acagaaatggcaggaaaggagaaca

SEQ ID NO: 861812 - DNA, 25 bp, Mus musculus
acagaaatgttccaccctagagaag

SEQ ID NO: 861813 - DNA, 25 bp, Mus musculus
acagaaatgttccagcctagagaag

SEQ ID NO: 861814 - DNA, 25 bp, Mus musculus
acagaacatgcacaaagaaatcctg

SEQ ID NO: 861815 - DNA, 25 bp, Mus musculus
acagaacatgcagaaagaaatcctg

SEQ ID NO: 861816 - DNA, 25 bp, Mus musculus
acagaacctcaacgagctgcgggaa

SEQ ID NO: 861817 - DNA, 25 bp, Mus musculus
acagaacctcaaggagctgcgggaa

SEQ ID NO: 861818 - DNA, 25 bp, Mus musculus
acagaactagctaacgctcaaactc

SEQ ID NO: 861819 - DNA, 25 bp, Mus musculus
acagaactagctaaggctcaaactc

SEQ ID NO: 861820 - DNA, 25 bp, Mus musculus
acagaactcacaagccttattcctg

SEQ ID NO: 861821 - DNA, 25 bp, Mus musculus
acagaactcacatgccttattcctg

SEQ ID NO: 861822 - DNA, 25 bp, Mus musculus
acagaagaaaaaatcatcgttaaag

SEQ ID NO: 861823 - DNA, 25 bp, Mus musculus
acagaagaaaaattcatcgttaaag

SEQ ID NO: 861824 - DNA, 25 bp, Mus musculus
acagaagaagacatcaacaagcaga

SEQ ID NO: 861825 - DNA, 25 bp, Mus musculus
acagaagaagacttcaacaagcaga

SEQ ID NO: 861826 - DNA, 25 bp, Mus musculus
acagaagaagcacgagtacctggag

SEQ ID NO: 861827 - DNA, 25 bp, Mus musculus
acagaagaagcaggagtacctggag

SEQ ID NO: 861828 - DNA, 25 bp, Mus musculus
acagaagaggagatctcagcaatgt

SEQ ID NO: 861829 - DNA, 25 bp, Mus musculus
acagaagaggagttctcagcaatgt

SEQ ID NO: 861830 - DNA, 25 bp, Mus musculus
acagaagatgaacatgtctggtgag

SEQ ID NO: 861831 - DNA, 25 bp, Mus musculus
acagaagatgaagatgtctggtgag

SEQ ID NO: 861832 - DNA, 25 bp, Mus musculus
acagaagcagattaagcacatgatg

SEQ ID NO: 861833 - DNA, 25 bp, Mus musculus
acagaagcagcaggggagaaccccc

SEQ ID NO: 861834 - DNA, 25 bp, Mus musculus
acagaagcagcggagaaccccctgg

SEQ ID NO: 861835 - DNA, 25 bp, Mus musculus
acagaagcaggaggggagaaccccc

SEQ ID NO: 861836 - DNA, 25 bp, Mus musculus
acagaagcaggggagaaccccctgg

SEQ ID NO: 861837 - DNA, 25 bp, Mus musculus
acagaagcagtgagtacaacacatg

SEQ ID NO: 861838 - DNA, 25 bp, Mus musculus
acagaagcagtgctatttatgagcc

SEQ ID NO: 861839 - DNA, 25 bp, Mus musculus
acagaagcagtggtatttatgagcc

SEQ ID NO: 861840 - DNA, 25 bp, Mus musculus
acagaagcagtgtgtacaacacatg

SEQ ID NO: 861841 - DNA, 25 bp, Mus musculus
acagaagcagtttaagcacatgatg

SEQ ID NO: 861842 - DNA, 25 bp, Mus musculus
acagaagccaagcgtccaccaggct

SEQ ID NO: 861843 - DNA, 25 bp, Mus musculus
acagaagccatgcgtccaccaggct

SEQ ID NO: 861844 - DNA, 25 bp, Mus musculus
acagaagctgacctttaagagtgca

SEQ ID NO: 861845 - DNA, 25 bp, Mus musculus
acagaagctgacgtttaagagtgca

SEQ ID NO: 861846 - DNA, 25 bp, Mus musculus
acagaagggactcgacccatacaat

SEQ ID NO: 861847 - DNA, 25 bp, Mus musculus
acagaagggactctcaactcttgtc

SEQ ID NO: 861848 - DNA, 25 bp, Mus musculus
acagaagggactggacccatacaat

SEQ ID NO: 861849 - DNA, 25 bp, Mus musculus
acagaagggactgtcaactcttgtc

SEQ ID NO: 861850 - DNA, 25 bp, Mus musculus
acagaagtgaagaccgttactgtca

SEQ ID NO: 861851 - DNA, 25 bp, Mus musculus
acagaagtgaagacggttactgtca

SEQ ID NO: 861852 - DNA, 25 bp, Mus musculus
acagaagttcacaacctggttcatg

SEQ ID NO: 861853 - DNA, 25 bp, Mus musculus
acagaagttcacaagctggttcatg

SEQ ID NO: 861854 - DNA, 25 bp, Mus musculus
acagaagttggcttcgcttgagatt

SEQ ID NO: 861855 - DNA, 25 bp, Mus musculus
acagaagttggcttggcttgagatt

SEQ ID NO: 861856 - DNA, 25 bp, Mus musculus
acagaataaacacactgtgacagag

SEQ ID NO: 861857 - DNA, 25 bp, Mus musculus
acagaataaacagactgtgacagag

SEQ ID NO: 861858 - DNA, 25 bp, Mus musculus
acagaatatcagatacacaaaattg

SEQ ID NO: 861859 - DNA, 25 bp, Mus musculus
acagaatatcagttacacaaaattg

SEQ ID NO: 861860 - DNA, 25 bp, Mus musculus
acagaatattcacattgaagaaatt

SEQ ID NO: 861861 - DNA, 25 bp, Mus musculus
acagaatattcagattgaagaaatt

SEQ ID NO: 861862 - DNA, 25 bp, Mus musculus
acagaatcccagactcctcactact

SEQ ID NO: 861863 - DNA, 25 bp, Mus musculus
acagaatcccagaggggaaacggca

SEQ ID NO: 861864 - DNA, 25 bp, Mus musculus
acagaatcccagtctcctcactact

SEQ ID NO: 861865 - DNA, 25 bp, Mus musculus
acagaatcccagtggggaaacggca

SEQ ID NO: 861866 - DNA, 25 bp, Mus musculus
acagaatgcacacgaacgactaagg

SEQ ID NO: 861867 - DNA, 25 bp, Mus musculus
acagaatgcacaggaacgactaagg

SEQ ID NO: 861868 - DNA, 25 bp, Mus musculus
acagaatgccaaacaccgtgtcgac

SEQ ID NO: 861869 - DNA, 25 bp, Mus musculus
acagaatgccaaactccgtgtcgac

SEQ ID NO: 861870 - DNA, 25 bp, Mus musculus
acagacaaatctaacgagttgccgt

SEQ ID NO: 861871 - DNA, 25 bp, Mus musculus
acagacaaatctaaggagttgccgt

SEQ ID NO: 861872 - DNA, 25 bp, Mus musculus
acagacaagacacgaaccctgaccc

SEQ ID NO: 861873 - DNA, 25 bp, Mus musculus
acagacaagacaggaaccctgaccc

SEQ ID NO: 861874 - DNA, 25 bp, Mus musculus
acagacaatcctatggtctttgcca

SEQ ID NO: 861875 - DNA, 25 bp, Mus musculus
acagacaatcctttggtctttgcca

SEQ ID NO: 861876 - DNA, 25 bp, Mus musculus
acagacacagacctggtacctggga

SEQ ID NO: 861877 - DNA, 25 bp, Mus musculus
acagacacagtcctggtacctggga

SEQ ID NO: 861878 - DNA, 25 bp, Mus musculus
acagacacatcttatccaagtgcct

SEQ ID NO: 861879 - DNA, 25 bp, Mus musculus
acagacacatgttatccaagtgcct

SEQ ID NO: 861880 - DNA, 25 bp, Mus musculus
acagacagctagcacccagaggcca

SEQ ID NO: 861881 - DNA, 25 bp, Mus musculus
acagacagctaggacccagaggcca

SEQ ID NO: 861882 - DNA, 25 bp, Mus musculus
acagacagctgcagtgcttacagac

SEQ ID NO: 861883 - DNA, 25 bp, Mus musculus
acagacagctgctgtgcttacagac

SEQ ID NO: 861884 - DNA, 25 bp, Mus musculus
acagacatgtttcacgtgggcaggt

SEQ ID NO: 861885 - DNA, 25 bp, Mus musculus
acagacatgtttcaggtgggcaggt

SEQ ID NO: 861886 - DNA, 25 bp, Mus musculus
acagacccaacatgtctctcctatg

SEQ ID NO: 861887 - DNA, 25 bp, Mus musculus
acagacccaagatgtctctcctatg

SEQ ID NO: 861888 - DNA, 25 bp, Mus musculus
acagacgtcgagctgttaatggagc

SEQ ID NO: 861889 - DNA, 25 bp, Mus musculus
acagacgtcgaggtgttaatggagc

SEQ ID NO: 861890 - DNA, 25 bp, Mus musculus
acagactatgggcacgtgttcacct

SEQ ID NO: 861891 - DNA, 25 bp, Mus musculus
acagactatgggcaggtgttcacct

SEQ ID NO: 861892 - DNA, 25 bp, Mus musculus
acagactcattaaacgaaaaggata

SEQ ID NO: 861893 - DNA, 25 bp, Mus musculus
acagactcattaaaggaaaaggata

SEQ ID NO: 861894 - DNA, 25 bp, Mus musculus
acagactccccactttctcaaggga

SEQ ID NO: 861895 - DNA, 25 bp, Mus musculus
acagactccccagtttctcaaggga

SEQ ID NO: 861896 - DNA, 25 bp, Mus musculus
acagactgtgtgctaatgagagatc

SEQ ID NO: 861897 - DNA, 25 bp, Mus musculus
acagactgtgtggtaatgagagatc

SEQ ID NO: 861898 - DNA, 25 bp, Mus musculus
acagacttctcgctgaaggaggact

SEQ ID NO: 861899 - DNA, 25 bp, Mus musculus
acagacttctcggtgaaggaggact

SEQ ID NO: 861900 - DNA, 25 bp, Mus musculus
acagacttctgcaaattcatcaatt

SEQ ID NO: 861901 - DNA, 25 bp, Mus musculus
acagacttctgctaattcatcaatt

SEQ ID NO: 861902 - DNA, 25 bp, Mus musculus
acagagaaagaaagttgaaactctc

SEQ ID NO: 861903 - DNA, 25 bp, Mus musculus
acagagaaagtaagttgaaactctc

SEQ ID NO: 861904 - DNA, 25 bp, Mus musculus
acagagaaatcccatctgaaggagg

SEQ ID NO: 861905 - DNA, 25 bp, Mus musculus
acagagaaatgccatctgaaggagg

SEQ ID NO: 861906 - DNA, 25 bp, Mus musculus
acagagaacgagaaaacagcggagt

SEQ ID NO: 861907 - DNA, 25 bp, Mus musculus
acagagaacgtgaaaacagcggagt

SEQ ID NO: 861908 - DNA, 25 bp, Mus musculus
acagagaagccacgttacaaactac

SEQ ID NO: 861909 - DNA, 25 bp, Mus musculus
acagagaagccaggttacaaactac

SEQ ID NO: 861910 - DNA, 25 bp, Mus musculus
acagagaatgagcgtaagatgatca

SEQ ID NO: 861911 - DNA, 25 bp, Mus musculus
acagagaatgagggtaagatgatca

SEQ ID NO: 861912 - DNA, 25 bp, Mus musculus
acagagacaaagcggaccgtgctga

SEQ ID NO: 861913 - DNA, 25 bp, Mus musculus
acagagacaaaggggaccgtgctga

SEQ ID NO: 861914 - DNA, 25 bp, Mus musculus
acagagacagcttcacccagaacct

SEQ ID NO: 861915 - DNA, 25 bp, Mus musculus
acagagacaggttcacccagaacct

SEQ ID NO: 861916 - DNA, 25 bp, Mus musculus
acagagagacagcccatccatttaa

SEQ ID NO: 861917 - DNA, 25 bp, Mus musculus
acagagagacaggccatccatttaa

SEQ ID NO: 861918 - DNA, 25 bp, Mus musculus
acagagagagcccaagccgaaagcg

SEQ ID NO: 861919 - DNA, 25 bp, Mus musculus
acagagagagcccaatattaattaa

SEQ ID NO: 861920 - DNA, 25 bp, Mus musculus
acagagagagccgaagccgaaagcg

SEQ ID NO: 861921 - DNA, 25 bp, Mus musculus
acagagagagccgaatattaattaa

SEQ ID NO: 861922 - DNA, 25 bp, Mus musculus
acagagagagggcaccatggcagcc

SEQ ID NO: 861923 - DNA, 25 bp, Mus musculus
acagagagaggggaccatggcagcc

SEQ ID NO: 861924 - DNA, 25 bp, Mus musculus
acagagatatatttctgcaacagga

SEQ ID NO: 861925 - DNA, 25 bp, Mus musculus
acagagatatatttgtgcaacagga

SEQ ID NO: 861926 - DNA, 25 bp, Mus musculus
acagagattcagcttctcccctatg

SEQ ID NO: 861927 - DNA, 25 bp, Mus musculus
acagagattcaggttctcccctatg

SEQ ID NO: 861928 - DNA, 25 bp, Mus musculus
acagagcaagaacgagagcgtggca

SEQ ID NO: 861929 - DNA, 25 bp, Mus musculus
acagagcaagaaggagagcgtggca

SEQ ID NO: 861930 - DNA, 25 bp, Mus musculus
acagagcaagctcctgtttattgct

SEQ ID NO: 861931 - DNA, 25 bp, Mus musculus
acagagcaaggtcctgtttattgct

SEQ ID NO: 861932 - DNA, 25 bp, Mus musculus
acagagcacacctgtcccagaagct

SEQ ID NO: 861933 - DNA, 25 bp, Mus musculus
acagagcacagctgtcccagaagct

SEQ ID NO: 861934 - DNA, 25 bp, Mus musculus
acagagcaccggccaagagtccatc

SEQ ID NO: 861935 - DNA, 25 bp, Mus musculus
acagagcaccggcgactcctgagac

SEQ ID NO: 861936 - DNA, 25 bp, Mus musculus
acagagcaccgggcaagagtccatc

SEQ ID NO: 861937 - DNA, 25 bp, Mus musculus
acagagcaccggggactcctgagac

SEQ ID NO: 861938 - DNA, 25 bp, Mus musculus
acagagcctgagctgtttaaataca

SEQ ID NO: 861939 - DNA, 25 bp, Mus musculus
acagagcctgaggtgtttaaataca

SEQ ID NO: 861940 - DNA, 25 bp, Mus musculus
acagagctgatgcaacctgtaggtg

SEQ ID NO: 861941 - DNA, 25 bp, Mus musculus
acagagctgatgcatcctgtaggtg

SEQ ID NO: 861942 - DNA, 25 bp, Mus musculus
acagaggaaaacaacatctcaaaga

SEQ ID NO: 861943 - DNA, 25 bp, Mus musculus
acagaggaaaacaagatctcaaaga

SEQ ID NO: 861944 - DNA, 25 bp, Mus musculus
acagaggaacagctgtcttggctct

SEQ ID NO: 861945 - DNA, 25 bp, Mus musculus
acagaggaacaggtgtcttggctct

SEQ ID NO: 861946 - DNA, 25 bp, Mus musculus
acagaggaccagctggtctccacgg

SEQ ID NO: 861947 - DNA, 25 bp, Mus musculus
acagaggaccaggtggtctccacgg

SEQ ID NO: 861948 - DNA, 25 bp, Mus musculus
acagaggatcccctattaagtcgcg

SEQ ID NO: 861949 - DNA, 25 bp, Mus musculus
acagaggatcgcctattaagtcgcg

SEQ ID NO: 861950 - DNA, 25 bp, Mus musculus
acagagggtcagagagatggcacat

SEQ ID NO: 861951 - DNA, 25 bp, Mus musculus
acagagggtcagatccaggaagaca

SEQ ID NO: 861952 - DNA, 25 bp, Mus musculus
acagagggtcagtgagatggcacat

SEQ ID NO: 861953 - DNA, 25 bp, Mus musculus
acagagggtcagttccaggaagaca

SEQ ID NO: 861954 - DNA, 25 bp, Mus musculus
acagaggtgagtgcagcagtaagcc

SEQ ID NO: 861955 - DNA, 25 bp, Mus musculus
acagaggtgagtgctgcagtaagcc

SEQ ID NO: 861956 - DNA, 25 bp, Mus musculus
acagagtccatgagtttacaggaac

SEQ ID NO: 861957 - DNA, 25 bp, Mus musculus
acagagtccatgtgtttacaggaac

SEQ ID NO: 861958 - DNA, 25 bp, Mus musculus
acagagtgcagacgccaagaactac

SEQ ID NO: 861959 - DNA, 25 bp, Mus musculus
acagagtgcagaggccaagaactac

SEQ ID NO: 861960 - DNA, 25 bp, Mus musculus
acagagtggttggacggctacctca

SEQ ID NO: 861961 - DNA, 25 bp, Mus musculus
acagagtggttggagggctacctca

SEQ ID NO: 861962 - DNA, 25 bp, Mus musculus
acagagtgtgcaaaagaacacaagg

SEQ ID NO: 861963 - DNA, 25 bp, Mus musculus
acagagtgtgcgaaaagaacacaag

SEQ ID NO: 861964 - DNA, 25 bp, Mus musculus
acagagtgtggaaaagaacacaagg

SEQ ID NO: 861965 - DNA, 25 bp, Mus musculus
acagagtgtgggaaaagaacacaag

SEQ ID NO: 861966 - DNA, 25 bp, Mus musculus
acagagttaaatagcttaaagcaat

SEQ ID NO: 861967 - DNA, 25 bp, Mus musculus
acagagttaaattgcttaaagcaat

SEQ ID NO: 861968 - DNA, 25 bp, Mus musculus
acagagttaggaaacgaaagcactg

SEQ ID NO: 861969 - DNA, 25 bp, Mus musculus
acagagttaggaaaggaaagcactg

SEQ ID NO: 861970 - DNA, 25 bp, Mus musculus
acagagtttcaacgcaaacgaatgc

SEQ ID NO: 861971 - DNA, 25 bp, Mus musculus
acagagtttcaacgtgggatgtgtg

SEQ ID NO: 861972 - DNA, 25 bp, Mus musculus
acagagtttcaaggcaaacgaatgc

SEQ ID NO: 861973 - DNA, 25 bp, Mus musculus
acagagtttcaaggtgggatgtgtg

SEQ ID NO: 861974 - DNA, 25 bp, Mus musculus
acagataaagaggggctccaggaag

SEQ ID NO: 861975 - DNA, 25 bp, Mus musculus
acagataaagtggggctccaggaag

SEQ ID NO: 861976 - DNA, 25 bp, Mus musculus
acagataactggcctcacgttgacc

SEQ ID NO: 861977 - DNA, 25 bp, Mus musculus
acagataactgggctcacgttgacc

SEQ ID NO: 861978 - DNA, 25 bp, Mus musculus
acagataagaaacatggcttgccag

SEQ ID NO: 861979 - DNA, 25 bp, Mus musculus
acagataagaaagatggcttgccag

SEQ ID NO: 861980 - DNA, 25 bp, Mus musculus
acagatacgtatgctgggctttgcc

SEQ ID NO: 861981 - DNA, 25 bp, Mus musculus
acagatacgtttgctgggctttgcc

SEQ ID NO: 861982 - DNA, 25 bp, Mus musculus
acagatacttctctgagtgcaaaga

SEQ ID NO: 861983 - DNA, 25 bp, Mus musculus
acagatacttctgtgagtgcaaaga

SEQ ID NO: 861984 - DNA, 25 bp, Mus musculus
acagatagcaaggacaaagaaaagt

SEQ ID NO: 861985 - DNA, 25 bp, Mus musculus
acagatagcaaggacggattttgaa

SEQ ID NO: 861986 - DNA, 25 bp, Mus musculus
acagatagcaaggagaaagaaaagt

SEQ ID NO: 861987 - DNA, 25 bp, Mus musculus
acagatagcaaggagggattttgaa

SEQ ID NO: 861988 - DNA, 25 bp, Mus musculus
acagataggaaaagcatatatattt

SEQ ID NO: 861989 - DNA, 25 bp, Mus musculus
acagataggaaatgcatatatattt

SEQ ID NO: 861990 - DNA, 25 bp, Mus musculus
acagatcagaagcacaattatatga

SEQ ID NO: 861991 - DNA, 25 bp, Mus musculus
acagatcagaagccttatggtagca

SEQ ID NO: 861992 - DNA, 25 bp, Mus musculus
acagatcagaaggacaattatatga

SEQ ID NO: 861993 - DNA, 25 bp, Mus musculus
acagatcagaaggcttatggtagca

SEQ ID NO: 861994 - DNA, 25 bp, Mus musculus
acagatcattccctggaacttcccg

SEQ ID NO: 861995 - DNA, 25 bp, Mus musculus
acagatcattccgtggaacttcccg

SEQ ID NO: 861996 - DNA, 25 bp, Mus musculus
acagatccagcgagcatggcactct

SEQ ID NO: 861997 - DNA, 25 bp, Mus musculus
acagatccagggagcatggcactct

SEQ ID NO: 861998 - DNA, 25 bp, Mus musculus
acagatctcgctcaagaagtcctga

SEQ ID NO: 861999 - DNA, 25 bp, Mus musculus
acagatctcgctgaagaagtcctga

SEQ ID NO: 862000 - DNA, 25 bp, Mus musculus
acagatcttcaacgcctgggctgtg

SEQ ID NO: 862001 - DNA, 25 bp, Mus musculus
acagatcttcaaggcctgggctgtg

SEQ ID NO: 862002 - DNA, 25 bp, Mus musculus
acagatgaagataacactgtgtacc

SEQ ID NO: 862003 - DNA, 25 bp, Mus musculus
acagatgaagatatcgtaaccgaga

SEQ ID NO: 862004 - DNA, 25 bp, Mus musculus
acagatgaagatatggtaaccgaga

SEQ ID NO: 862005 - DNA, 25 bp, Mus musculus
acagatgaagttaacactgtgtacc

SEQ ID NO: 862006 - DNA, 25 bp, Mus musculus
acagatgacatgataccacatgact

SEQ ID NO: 862007 - DNA, 25 bp, Mus musculus
acagatgacatgttaccacatgact

SEQ ID NO: 862008 - DNA, 25 bp, Mus musculus
acagatgatatgctggacaaatttg

SEQ ID NO: 862009 - DNA, 25 bp, Mus musculus
acagatgatatggtggacaaatttg

SEQ ID NO: 862010 - DNA, 25 bp, Mus musculus
acagatgatcaactatttcaagaag

SEQ ID NO: 862011 - DNA, 25 bp, Mus musculus
acagatgatcaagtatttcaagaag

SEQ ID NO: 862012 - DNA, 25 bp, Mus musculus
acagatgcagcaatgggcttggctc

SEQ ID NO: 862013 - DNA, 25 bp, Mus musculus
acagatgcaggaatgggcttggctc

SEQ ID NO: 862014 - DNA, 25 bp, Mus musculus
acagatgcgaagatgtggatgagtg

SEQ ID NO: 862015 - DNA, 25 bp, Mus musculus
acagatgcgaagttgtggatgagtg

SEQ ID NO: 862016 - DNA, 25 bp, Mus musculus
acagatggaaccctcaaaaagctgg

SEQ ID NO: 862017 - DNA, 25 bp, Mus musculus
acagatggaaccctgaaaaagctgg

SEQ ID NO: 862018 - DNA, 25 bp, Mus musculus
acagatggcacacggcttactctca

SEQ ID NO: 862019 - DNA, 25 bp, Mus musculus
acagatggcacagggcttactctca

SEQ ID NO: 862020 - DNA, 25 bp, Mus musculus
acagatggctctcgccgaagctttg

SEQ ID NO: 862021 - DNA, 25 bp, Mus musculus
acagatggctctggccgaagctttg

SEQ ID NO: 862022 - DNA, 25 bp, Mus musculus
acagatgggattcacaagataattg

SEQ ID NO: 862023 - DNA, 25 bp, Mus musculus
acagatgggattcagaagataattg

SEQ ID NO: 862024 - DNA, 25 bp, Mus musculus
acagatgtagcagactgtgatcttg

SEQ ID NO: 862025 - DNA, 25 bp, Mus musculus
acagatgtagcagagtgtgatcttg

SEQ ID NO: 862026 - DNA, 25 bp, Mus musculus
acagatgttcatcataggagacaaa

SEQ ID NO: 862027 - DNA, 25 bp, Mus musculus
acagatgttcatcggactttcagtt

SEQ ID NO: 862028 - DNA, 25 bp, Mus musculus
acagatgttcatgataggagacaaa

SEQ ID NO: 862029 - DNA, 25 bp, Mus musculus
acagatgttcatgggactttcagtt

SEQ ID NO: 862030 - DNA, 25 bp, Mus musculus
acagatgttctcaactcctggaatc

SEQ ID NO: 862031 - DNA, 25 bp, Mus musculus
acagatgttctctactcctggaatc

SEQ ID NO: 862032 - DNA, 25 bp, Mus musculus
acagattaagcacattttctacgtt

SEQ ID NO: 862033 - DNA, 25 bp, Mus musculus
acagattaaggacattttctacgtt

SEQ ID NO: 862034 - DNA, 25 bp, Mus musculus
acagattcaagccaaagacaccata

SEQ ID NO: 862035 - DNA, 25 bp, Mus musculus
acagattcaagccatagacaccata

SEQ ID NO: 862036 - DNA, 25 bp, Mus musculus
acagattcagagcctctctcccagc

SEQ ID NO: 862037 - DNA, 25 bp, Mus musculus
acagattcagcagcagcaacagcag

SEQ ID NO: 862038 - DNA, 25 bp, Mus musculus
acagattcaggagcagcaacagcag

SEQ ID NO: 862039 - DNA, 25 bp, Mus musculus
acagattcagtgcctctctcccagc

SEQ ID NO: 862040 - DNA, 25 bp, Mus musculus
acagattgcacacgatcttcaacaa

SEQ ID NO: 862041 - DNA, 25 bp, Mus musculus
acagattgcacaggatcttcaacaa

SEQ ID NO: 862042 - DNA, 25 bp, Mus musculus
acagattgcactttttgatgccacc

SEQ ID NO: 862043 - DNA, 25 bp, Mus musculus
acagattgcagtttttgatgccacc

SEQ ID NO: 862044 - DNA, 25 bp, Mus musculus
acagattgctaaaagtactattaat

SEQ ID NO: 862045 - DNA, 25 bp, Mus musculus
acagattgctaaagaccagagtaat

SEQ ID NO: 862046 - DNA, 25 bp, Mus musculus
acagattgctaatagtactattaat

SEQ ID NO: 862047 - DNA, 25 bp, Mus musculus
acagattgctaatgaccagagtaat

SEQ ID NO: 862048 - DNA, 25 bp, Mus musculus
acagattgctctcccatcacctgtt

SEQ ID NO: 862049 - DNA, 25 bp, Mus musculus
acagattgctctgccatcacctgtt

SEQ ID NO: 862050 - DNA, 25 bp, Mus musculus
acagattggcagcaagatcaaactg

SEQ ID NO: 862051 - DNA, 25 bp, Mus musculus
acagattggcaggaagatcaaactg

SEQ ID NO: 862052 - DNA, 25 bp, Mus musculus
acagattttgatgaatataaaaaca

SEQ ID NO: 862053 - DNA, 25 bp, Mus musculus
acagattttgcgaacatcaacagct

SEQ ID NO: 862054 - DNA, 25 bp, Mus musculus
acagattttgggaacatcaacagct

SEQ ID NO: 862055 - DNA, 25 bp, Mus musculus
acagattttgttgaatataaaaaca

SEQ ID NO: 862056 - DNA, 25 bp, Mus musculus
acagcaaaagcccagatattctcaa

SEQ ID NO: 862057 - DNA, 25 bp, Mus musculus
acagcaaaaggccagatattctcaa

SEQ ID NO: 862058 - DNA, 25 bp, Mus musculus
acagcaaaatcagccagtacattgt

SEQ ID NO: 862059 - DNA, 25 bp, Mus musculus
acagcaaaatcagcgagtacattgt

SEQ ID NO: 862060 - DNA, 25 bp, Mus musculus
acagcaaagaagcagagaaaaacac

SEQ ID NO: 862061 - DNA, 25 bp, Mus musculus
acagcaaagaaggagagaaaaacac

SEQ ID NO: 862062 - DNA, 25 bp, Mus musculus
acagcaaataagcagacagtgatgg

SEQ ID NO: 862063 - DNA, 25 bp, Mus musculus
acagcaaataaggagacagtgatgg

SEQ ID NO: 862064 - DNA, 25 bp, Mus musculus
acagcaacagagcgctctgtcacct

SEQ ID NO: 862065 - DNA, 25 bp, Mus musculus
acagcaacagctgataaagtactgg

SEQ ID NO: 862066 - DNA, 25 bp, Mus musculus
acagcaacaggtgataaagtactgg

SEQ ID NO: 862067 - DNA, 25 bp, Mus musculus
acagcaacagtgcgctctgtcacct

SEQ ID NO: 862068 - DNA, 25 bp, Mus musculus
acagcaaccaaaagccagtcttcag

SEQ ID NO: 862069 - DNA, 25 bp, Mus musculus
acagcaaccaaatgccagtcttcag

SEQ ID NO: 862070 - DNA, 25 bp, Mus musculus
acagcaagacaacgtgcgaagtttc

SEQ ID NO: 862071 - DNA, 25 bp, Mus musculus
acagcaagacaaggtgcgaagtttc

SEQ ID NO: 862072 - DNA, 25 bp, Mus musculus
acagcaagcacaaccgaccagagaa

SEQ ID NO: 862073 - DNA, 25 bp, Mus musculus
acagcaagcacaacggaccagagaa

SEQ ID NO: 862074 - DNA, 25 bp, Mus musculus
acagcaagccagccactgaaacacc

SEQ ID NO: 862075 - DNA, 25 bp, Mus musculus
acagcaagccaggcactgaaacacc

SEQ ID NO: 862076 - DNA, 25 bp, Mus musculus
acagcaaggagagccaggctggact

SEQ ID NO: 862077 - DNA, 25 bp, Mus musculus
acagcaaggagagcgaggctggact

SEQ ID NO: 862078 - DNA, 25 bp, Mus musculus
acagcaagtgctgattggcacgcct

SEQ ID NO: 862079 - DNA, 25 bp, Mus musculus
acagcaagtggtgattggcacgcct

SEQ ID NO: 862080 - DNA, 25 bp, Mus musculus
acagcaatcatgactgtgggtaaga

SEQ ID NO: 862081 - DNA, 25 bp, Mus musculus
acagcaatcatgtctgtgggtaaga

SEQ ID NO: 862082 - DNA, 25 bp, Mus musculus
acagcaatgccatgcatgtcatcct

SEQ ID NO: 862083 - DNA, 25 bp, Mus musculus
acagcaatgccatggatgtcatcct

SEQ ID NO: 862084 - DNA, 25 bp, Mus musculus
acagcaattaaacgatgttctggag

SEQ ID NO: 862085 - DNA, 25 bp, Mus musculus
acagcaattaaaggatgttctggag

SEQ ID NO: 862086 - DNA, 25 bp, Mus musculus
acagcacaaaaacggactcagctgt

SEQ ID NO: 862087 - DNA, 25 bp, Mus musculus
acagcacaaaaagggactcagctgt

SEQ ID NO: 862088 - DNA, 25 bp, Mus musculus
acagcacaaaagtctgcagaatcca

SEQ ID NO: 862089 - DNA, 25 bp, Mus musculus
acagcacaaataatagtgcttacag

SEQ ID NO: 862090 - DNA, 25 bp, Mus musculus
acagcacaaataattgtgcttacag

SEQ ID NO: 862091 - DNA, 25 bp, Mus musculus
acagcacaaatgtctgcagaatcca

SEQ ID NO: 862092 - DNA, 25 bp, Mus musculus
acagcacaagctttggcggaaatgc

SEQ ID NO: 862093 - DNA, 25 bp, Mus musculus
acagcacaaggtttggcggaaatgc

SEQ ID NO: 862094 - DNA, 25 bp, Mus musculus
acagcacaataaaacccaagcaact

SEQ ID NO: 862095 - DNA, 25 bp, Mus musculus
acagcacaattaaacccaagcaact

SEQ ID NO: 862096 - DNA, 25 bp, Mus musculus
acagcacacacacgtactttgagac

SEQ ID NO: 862097 - DNA, 25 bp, Mus musculus
acagcacacacaggtactttgagac

SEQ ID NO: 862098 - DNA, 25 bp, Mus musculus
acagcacaggataccagtgcagaat

SEQ ID NO: 862099 - DNA, 25 bp, Mus musculus
acagcacaggatgctggttgttgga

SEQ ID NO: 862100 - DNA, 25 bp, Mus musculus
acagcacaggctaaataaaacggaa

SEQ ID NO: 862101 - DNA, 25 bp, Mus musculus
acagcacagggtaaataaaacggaa

SEQ ID NO: 862102 - DNA, 25 bp, Mus musculus
acagcacaggttaccagtgcagaat

SEQ ID NO: 862103 - DNA, 25 bp, Mus musculus
acagcacaggttgctggttgttgga

SEQ ID NO: 862104 - DNA, 25 bp, Mus musculus
acagcacataaaatcttgcattgag

SEQ ID NO: 862105 - DNA, 25 bp, Mus musculus
acagcacataaattcttgcattgag

SEQ ID NO: 862106 - DNA, 25 bp, Mus musculus
acagcaccaattccacactgttcaa

SEQ ID NO: 862107 - DNA, 25 bp, Mus musculus
acagcaccaattcctcactgttcaa

SEQ ID NO: 862108 - DNA, 25 bp, Mus musculus
acagcaccacagcaaaagttgaggt

SEQ ID NO: 862109 - DNA, 25 bp, Mus musculus
acagcaccacaggaaaagttgaggt

SEQ ID NO: 862110 - DNA, 25 bp, Mus musculus
acagcacctatgcggctgaatgcga

SEQ ID NO: 862111 - DNA, 25 bp, Mus musculus
acagcacctatggggctgaatgcga

SEQ ID NO: 862112 - DNA, 25 bp, Mus musculus
acagcacctccacacagaaaaagct

SEQ ID NO: 862113 - DNA, 25 bp, Mus musculus
acagcacctccacagagaaaaagct

SEQ ID NO: 862114 - DNA, 25 bp, Mus musculus
acagcactgtggttcgctgggaccc

SEQ ID NO: 862115 - DNA, 25 bp, Mus musculus
acagcactgtggttcgtgagcgggg

SEQ ID NO: 862116 - DNA, 25 bp, Mus musculus
acagcactgtggttggctgggaccc

SEQ ID NO: 862117 - DNA, 25 bp, Mus musculus
acagcactgtggttggtgagcgggg

SEQ ID NO: 862118 - DNA, 25 bp, Mus musculus
acagcacttgtgaaatttctgattt

SEQ ID NO: 862119 - DNA, 25 bp, Mus musculus
acagcacttgtgaattttctgattt

SEQ ID NO: 862120 - DNA, 25 bp, Mus musculus
acagcagaagactagagagactgtg

SEQ ID NO: 862121 - DNA, 25 bp, Mus musculus
acagcagaagctagagcttgagatg

SEQ ID NO: 862122 - DNA, 25 bp, Mus musculus
acagcagaaggtagagcttgagatg

SEQ ID NO: 862123 - DNA, 25 bp, Mus musculus
acagcagaagtctagagagactgtg

SEQ ID NO: 862124 - DNA, 25 bp, Mus musculus
acagcagaccagcaaacataagcaa

SEQ ID NO: 862125 - DNA, 25 bp, Mus musculus
acagcagaccaggaaacataagcaa

SEQ ID NO: 862126 - DNA, 25 bp, Mus musculus
acagcagagcagctgaagagaagga

SEQ ID NO: 862127 - DNA, 25 bp, Mus musculus
acagcagagcaggtgaagagaagga

SEQ ID NO: 862128 - DNA, 25 bp, Mus musculus
acagcagatcaacatttccatggag

SEQ ID NO: 862129 - DNA, 25 bp, Mus musculus
acagcagatcaagatttccatggag

SEQ ID NO: 862130 - DNA, 25 bp, Mus musculus
acagcagcagatgattgtggaacag

SEQ ID NO: 862131 - DNA, 25 bp, Mus musculus
acagcagcagcttcttcgtcctgga

SEQ ID NO: 862132 - DNA, 25 bp, Mus musculus
acagcagcagcttcttcgtggagga

SEQ ID NO: 862133 - DNA, 25 bp, Mus musculus
acagcagcaggttcttcgtcctgga

SEQ ID NO: 862134 - DNA, 25 bp, Mus musculus
acagcagcaggttcttcgtggagga

SEQ ID NO: 862135 - DNA, 25 bp, Mus musculus
acagcagcagttgattgtggaacag

SEQ ID NO: 862136 - DNA, 25 bp, Mus musculus
acagcagcccagcacttggagtgaa

SEQ ID NO: 862137 - DNA, 25 bp, Mus musculus
acagcagcccaggacttggagtgaa

SEQ ID NO: 862138 - DNA, 25 bp, Mus musculus
acagcagctgcaactcattatacaa

SEQ ID NO: 862139 - DNA, 25 bp, Mus musculus
acagcagctggaactcattatacaa

SEQ ID NO: 862140 - DNA, 25 bp, Mus musculus
acagcaggacagccagagtttacag

SEQ ID NO: 862141 - DNA, 25 bp, Mus musculus
acagcaggacaggcagagtttacag

SEQ ID NO: 862142 - DNA, 25 bp, Mus musculus
acagcagtacagccagtctgagagt

SEQ ID NO: 862143 - DNA, 25 bp, Mus musculus
acagcagtacaggcagtctgagagt

SEQ ID NO: 862144 - DNA, 25 bp, Mus musculus
acagcagtctcacctgcccccaaag

SEQ ID NO: 862145 - DNA, 25 bp, Mus musculus
acagcagtctcagctgcccccaaag

SEQ ID NO: 862146 - DNA, 25 bp, Mus musculus
acagcagtgcagctgccaacaggaa

SEQ ID NO: 862147 - DNA, 25 bp, Mus musculus
acagcagtgcaggtgccaacaggaa

SEQ ID NO: 862148 - DNA, 25 bp, Mus musculus
acagcataaacgatatgtgtcacaa

SEQ ID NO: 862149 - DNA, 25 bp, Mus musculus
acagcataaacgttatgtgtcacaa

SEQ ID NO: 862150 - DNA, 25 bp, Mus musculus
acagcataacagcgtcttggcagct

SEQ ID NO: 862151 - DNA, 25 bp, Mus musculus
acagcataacagggtcttggcagct

SEQ ID NO: 862152 - DNA, 25 bp, Mus musculus
acagcatcaaaatgccaggcaggct

SEQ ID NO: 862153 - DNA, 25 bp, Mus musculus
acagcatcaaacaatttgtcgtcct

SEQ ID NO: 862154 - DNA, 25 bp, Mus musculus
acagcatcaaacatggaggaatcgt

SEQ ID NO: 862155 - DNA, 25 bp, Mus musculus
acagcatcaaactatttgtcgtcct

SEQ ID NO: 862156 - DNA, 25 bp, Mus musculus
acagcatcaaacttggaggaatcgt

SEQ ID NO: 862157 - DNA, 25 bp, Mus musculus
acagcatcaacgacaattcaagctt

SEQ ID NO: 862158 - DNA, 25 bp, Mus musculus
acagcatcaacgcctgggaggagtt

SEQ ID NO: 862159 - DNA, 25 bp, Mus musculus
acagcatcaaggacaattcaagctt

SEQ ID NO: 862160 - DNA, 25 bp, Mus musculus
acagcatcaaggcctgggaggagtt

SEQ ID NO: 862161 - DNA, 25 bp, Mus musculus
acagcatcaatatgccaggcaggct

SEQ ID NO: 862162 - DNA, 25 bp, Mus musculus
acagcatcacacaagtgtctattta

SEQ ID NO: 862163 - DNA, 25 bp, Mus musculus
acagcatcactcaacgagaagctgt

SEQ ID NO: 862164 - DNA, 25 bp, Mus musculus
acagcatcactcaaggagaagctgt

SEQ ID NO: 862165 - DNA, 25 bp, Mus musculus
acagcatcactcaagtgtctattta

SEQ ID NO: 862166 - DNA, 25 bp, Mus musculus
acagcatcagcaaacgatcgaccat

SEQ ID NO: 862167 - DNA, 25 bp, Mus musculus
acagcatcagcaaaggatcgaccat

SEQ ID NO: 862168 - DNA, 25 bp, Mus musculus
acagcatcatgaacccagactataa

SEQ ID NO: 862169 - DNA, 25 bp, Mus musculus
acagcatcatgatcccagactataa

SEQ ID NO: 862170 - DNA, 25 bp, Mus musculus
acagcatcctcacgtatttggagag

SEQ ID NO: 862171 - DNA, 25 bp, Mus musculus
acagcatcctcaggtatttggagag

SEQ ID NO: 862172 - DNA, 25 bp, Mus musculus
acagcatctgggatttctgggaacg

SEQ ID NO: 862173 - DNA, 25 bp, Mus musculus
acagcatctgggttttctgggaacg

SEQ ID NO: 862174 - DNA, 25 bp, Mus musculus
acagcatgactgagtgtccattgtc

SEQ ID NO: 862175 - DNA, 25 bp, Mus musculus
acagcatgactgtgtgtccattgtc

SEQ ID NO: 862176 - DNA, 25 bp, Mus musculus
acagcatggacgcacgttctccaaa

SEQ ID NO: 862177 - DNA, 25 bp, Mus musculus
acagcatggacgcaggttctccaaa

SEQ ID NO: 862178 - DNA, 25 bp, Mus musculus
acagcatttgcacactccaaaaaac

SEQ ID NO: 862179 - DNA, 25 bp, Mus musculus
acagcatttgcagactccaaaaaac

SEQ ID NO: 862180 - DNA, 25 bp, Mus musculus
acagccaaagatgaactgacctgca

SEQ ID NO: 862181 - DNA, 25 bp, Mus musculus
acagccaaagatgaagaaatacttg

SEQ ID NO: 862182 - DNA, 25 bp, Mus musculus
acagccaaagttgaactgacctgca

SEQ ID NO: 862183 - DNA, 25 bp, Mus musculus
acagccaaagttgaagaaatacttg

SEQ ID NO: 862184 - DNA, 25 bp, Mus musculus
acagccaagcagctattcctcagta

SEQ ID NO: 862185 - DNA, 25 bp, Mus musculus
acagccaagcaggtattcctcagta

SEQ ID NO: 862186 - DNA, 25 bp, Mus musculus
acagccaaggctcgattccgagcag

SEQ ID NO: 862187 - DNA, 25 bp, Mus musculus
acagccaagggtcgattccgagcag

SEQ ID NO: 862188 - DNA, 25 bp, Mus musculus
acagccaattggctctctgaatact

SEQ ID NO: 862189 - DNA, 25 bp, Mus musculus
acagccaattgggtctctgaatact

SEQ ID NO: 862190 - DNA, 25 bp, Mus musculus
acagccacaaaaaaatcctgcagct

SEQ ID NO: 862191 - DNA, 25 bp, Mus musculus
acagccacaaaaaattcctgcagct

SEQ ID NO: 862192 - DNA, 25 bp, Mus musculus
acagccacccaattcgctgttaaca

SEQ ID NO: 862193 - DNA, 25 bp, Mus musculus
acagccacccaattggctgttaaca

SEQ ID NO: 862194 - DNA, 25 bp, Mus musculus
acagccagaaaacacgtgctgccta

SEQ ID NO: 862195 - DNA, 25 bp, Mus musculus
acagccagaaaacaggtgctgccta

SEQ ID NO: 862196 - DNA, 25 bp, Mus musculus
acagccagaagacatcctcagctct

SEQ ID NO: 862197 - DNA, 25 bp, Mus musculus
acagccagaagacccatggcgagtg

SEQ ID NO: 862198 - DNA, 25 bp, Mus musculus
acagccagaagagatcctcagctct

SEQ ID NO: 862199 - DNA, 25 bp, Mus musculus
acagccagaagagccatggcgagtg

SEQ ID NO: 862200 - DNA, 25 bp, Mus musculus
acagccagcatgagttcctggcgcc

SEQ ID NO: 862201 - DNA, 25 bp, Mus musculus
acagccagcatgtgttcctggcgcc

SEQ ID NO: 862202 - DNA, 25 bp, Mus musculus
acagccagccaactaagactcctgc

SEQ ID NO: 862203 - DNA, 25 bp, Mus musculus
acagccagccaacttagactcctgc

SEQ ID NO: 862204 - DNA, 25 bp, Mus musculus
acagccagctgttacatgacggcca

SEQ ID NO: 862205 - DNA, 25 bp, Mus musculus
acagccagctgttagatgacggcca

SEQ ID NO: 862206 - DNA, 25 bp, Mus musculus
acagccagttcacgaagacagaagt

SEQ ID NO: 862207 - DNA, 25 bp, Mus musculus
acagccagttcaggaagacagaagt

SEQ ID NO: 862208 - DNA, 25 bp, Mus musculus
acagccatggcgcccaggaggacac

SEQ ID NO: 862209 - DNA, 25 bp, Mus musculus
acagccatggcggccaggaggacac

SEQ ID NO: 862210 - DNA, 25 bp, Mus musculus
acagcccaagcagccacctagatca

SEQ ID NO: 862211 - DNA, 25 bp, Mus musculus
acagcccaaggagccacctagatca

SEQ ID NO: 862212 - DNA, 25 bp, Mus musculus
acagcccaataacgtattcaattga

SEQ ID NO: 862213 - DNA, 25 bp, Mus musculus
acagcccaataaggtattcaattga

SEQ ID NO: 862214 - DNA, 25 bp, Mus musculus
acagcccacagtcacactctcttga

SEQ ID NO: 862215 - DNA, 25 bp, Mus musculus
acagcccacagtcagactctcttga

SEQ ID NO: 862216 - DNA, 25 bp, Mus musculus
acagcccaggccaatgtggctggag

SEQ ID NO: 862217 - DNA, 25 bp, Mus musculus
acagcccagggcaatgtggctggag

SEQ ID NO: 862218 - DNA, 25 bp, Mus musculus
acagcccattcccatgatggaccgg

SEQ ID NO: 862219 - DNA, 25 bp, Mus musculus
acagcccattgccatgatggaccgg

SEQ ID NO: 862220 - DNA, 25 bp, Mus musculus
acagccccacgccacgattacatct

SEQ ID NO: 862221 - DNA, 25 bp, Mus musculus
acagccccacgccaggattacatct

SEQ ID NO: 862222 - DNA, 25 bp, Mus musculus
acagccccagagctctctctgtgtt

SEQ ID NO: 862223 - DNA, 25 bp, Mus musculus
acagccccagatcacagccatgaac

SEQ ID NO: 862224 - DNA, 25 bp, Mus musculus
acagccccagcccagcagaggagcc

SEQ ID NO: 862225 - DNA, 25 bp, Mus musculus
acagccccaggccagcagaggagcc

SEQ ID NO: 862226 - DNA, 25 bp, Mus musculus
acagccccagtgctctctctgtgtt

SEQ ID NO: 862227 - DNA, 25 bp, Mus musculus
acagccccagttcacagccatgaac

SEQ ID NO: 862228 - DNA, 25 bp, Mus musculus
acagccccccagaagtgtcaaccac

SEQ ID NO: 862229 - DNA, 25 bp, Mus musculus
acagccccccagtagtgtcaaccac

SEQ ID NO: 862230 - DNA, 25 bp, Mus musculus
acagcccccgatcagtatggtggct

SEQ ID NO: 862231 - DNA, 25 bp, Mus musculus
acagcccccgttcagtatggtggct

SEQ ID NO: 862232 - DNA, 25 bp, Mus musculus
acagccctcgagcggacattgggat

SEQ ID NO: 862233 - DNA, 25 bp, Mus musculus
acagccctcgaggggacattgggat

SEQ ID NO: 862234 - DNA, 25 bp, Mus musculus
acagccctgatacacccaactcatt

SEQ ID NO: 862235 - DNA, 25 bp, Mus musculus
acagccctgatagacccaactcatt

SEQ ID NO: 862236 - DNA, 25 bp, Mus musculus
acagccgaggagcgatccaagaacc

SEQ ID NO: 862237 - DNA, 25 bp, Mus musculus
acagccgaggagcgtatttcctggt

SEQ ID NO: 862238 - DNA, 25 bp, Mus musculus
acagccgaggagggatccaagaacc

SEQ ID NO: 862239 - DNA, 25 bp, Mus musculus
acagccgaggagggtatttcctggt

SEQ ID NO: 862240 - DNA, 25 bp, Mus musculus
acagccgaggggacccgaaggctgc

SEQ ID NO: 862241 - DNA, 25 bp, Mus musculus
acagccgaggggtcccgaaggctgc

SEQ ID NO: 862242 - DNA, 25 bp, Mus musculus
acagccgcagcgcacaccgcagagg

SEQ ID NO: 862243 - DNA, 25 bp, Mus musculus
acagccgcagcgcagaccgcagagg

SEQ ID NO: 862244 - DNA, 25 bp, Mus musculus
acagccgcttcgccattctggaatt

SEQ ID NO: 862245 - DNA, 25 bp, Mus musculus
acagccgcttcggcattctggaatt

SEQ ID NO: 862246 - DNA, 25 bp, Mus musculus
acagccggggagctggtggagaagc

SEQ ID NO: 862247 - DNA, 25 bp, Mus musculus
acagccggggaggtggtggagaagc

SEQ ID NO: 862248 - DNA, 25 bp, Mus musculus
acagccgtgctaaatcttgctgctg

SEQ ID NO: 862249 - DNA, 25 bp, Mus musculus
acagccgtgctatatcttgctgctg

SEQ ID NO: 862250 - DNA, 25 bp, Mus musculus
acagcctaagcacgttctatttcca

SEQ ID NO: 862251 - DNA, 25 bp, Mus musculus
acagcctaagcaggttctatttcca

SEQ ID NO: 862252 - DNA, 25 bp, Mus musculus
acagcctagaacaggcagcagaaga

SEQ ID NO: 862253 - DNA, 25 bp, Mus musculus
acagcctagaactggcagcagaaga

SEQ ID NO: 862254 - DNA, 25 bp, Mus musculus
acagcctatgctcgggaggagttta

SEQ ID NO: 862255 - DNA, 25 bp, Mus musculus
acagcctatggtcgggaggagttta

SEQ ID NO: 862256 - DNA, 25 bp, Mus musculus
acagcctcagctgtgattgggctgt

SEQ ID NO: 862257 - DNA, 25 bp, Mus musculus
acagcctcaggtgtgattgggctgt

SEQ ID NO: 862258 - DNA, 25 bp, Mus musculus
acagcctccactttcgtgaaagtca

SEQ ID NO: 862259 - DNA, 25 bp, Mus musculus
acagcctccactttggtgaaagtca

SEQ ID NO: 862260 - DNA, 25 bp, Mus musculus
acagcctccagcctcattaaagtga

SEQ ID NO: 862261 - DNA, 25 bp, Mus musculus
acagcctccagcctgattaaagtga

SEQ ID NO: 862262 - DNA, 25 bp, Mus musculus
acagcctccaggagtcatccatcaa

SEQ ID NO: 862263 - DNA, 25 bp, Mus musculus
acagcctccaggtgtcatccatcaa

SEQ ID NO: 862264 - DNA, 25 bp, Mus musculus
acagcctgaggacacgcagaggcag

SEQ ID NO: 862265 - DNA, 25 bp, Mus musculus
acagcctgaggagacgcagaggcag

SEQ ID NO: 862266 - DNA, 25 bp, Mus musculus
acagcctgcccacgctgcctatccc

SEQ ID NO: 862267 - DNA, 25 bp, Mus musculus
acagcctgcccaggctgcctatccc

SEQ ID NO: 862268 - DNA, 25 bp, Mus musculus
acagcctggatcctcatgatgagga

SEQ ID NO: 862269 - DNA, 25 bp, Mus musculus
acagcctggatcctcggctttttgt

SEQ ID NO: 862270 - DNA, 25 bp, Mus musculus
acagcctggatcctctttagatgat

SEQ ID NO: 862271 - DNA, 25 bp, Mus musculus
acagcctggatcctgatgatgagga

SEQ ID NO: 862272 - DNA, 25 bp, Mus musculus
acagcctggatcctgggctttttgt

SEQ ID NO: 862273 - DNA, 25 bp, Mus musculus
acagcctggatcctgtttagatgat

SEQ ID NO: 862274 - DNA, 25 bp, Mus musculus
acagcctgtgaatccctggccagag

SEQ ID NO: 862275 - DNA, 25 bp, Mus musculus
acagcctgtgtatccctggccagag

SEQ ID NO: 862276 - DNA, 25 bp, Mus musculus
acagccttcaaacaatgtctgtaag

SEQ ID NO: 862277 - DNA, 25 bp, Mus musculus
acagccttcaaagaatgtctgtaag

SEQ ID NO: 862278 - DNA, 25 bp, Mus musculus
acagccttccagcatgcctgaaggc

SEQ ID NO: 862279 - DNA, 25 bp, Mus musculus
acagccttccaggatgcctgaaggc

SEQ ID NO: 862280 - DNA, 25 bp, Mus musculus
acagcctttcagatccagagacacc

SEQ ID NO: 862281 - DNA, 25 bp, Mus musculus
acagcctttcagttccagagacacc

SEQ ID NO: 862282 - DNA, 25 bp, Mus musculus
acagcgcactgacggcccaggagac

SEQ ID NO: 862283 - DNA, 25 bp, Mus musculus
acagcgcactgagggcccaggagac

SEQ ID NO: 862284 - DNA, 25 bp, Mus musculus
acagcggcatgccactacctgtaat

SEQ ID NO: 862285 - DNA, 25 bp, Mus musculus
acagcggcatgccagtacctgtaat

SEQ ID NO: 862286 - DNA, 25 bp, Mus musculus
acagcgtcagcaaccgtgtcgggcc

SEQ ID NO: 862287 - DNA, 25 bp, Mus musculus
acagcgtcaggaaccgtgtcgggcc

SEQ ID NO: 862288 - DNA, 25 bp, Mus musculus
acagcgtcctcccggtagctgggag

SEQ ID NO: 862289 - DNA, 25 bp, Mus musculus
acagcgtcctccgggtagctgggag

SEQ ID NO: 862290 - DNA, 25 bp, Mus musculus
acagcgtttgcttcatgactttata

SEQ ID NO: 862291 - DNA, 25 bp, Mus musculus
acagcgtttgcttcttgactttata

SEQ ID NO: 862292 - DNA, 25 bp, Mus musculus
acagctaaagagaatggactcgcta

SEQ ID NO: 862293 - DNA, 25 bp, Mus musculus
acagctaaagagtatggactcgcta

SEQ ID NO: 862294 - DNA, 25 bp, Mus musculus
acagctaacccacaaatgacatcag

SEQ ID NO: 862295 - DNA, 25 bp, Mus musculus
acagctaacccagaaatgacatcag

SEQ ID NO: 862296 - DNA, 25 bp, Mus musculus
acagctaccgagagcctggctccat

SEQ ID NO: 862297 - DNA, 25 bp, Mus musculus
acagctaccgagtgcctggctccat

SEQ ID NO: 862298 - DNA, 25 bp, Mus musculus
acagctacctagcatgtccaaaatt

SEQ ID NO: 862299 - DNA, 25 bp, Mus musculus
acagctacctaggatgtccaaaatt

SEQ ID NO: 862300 - DNA, 25 bp, Mus musculus
acagctacttggcatactctgtggc

SEQ ID NO: 862301 - DNA, 25 bp, Mus musculus
acagctacttgggatactctgtggc

SEQ ID NO: 862302 - DNA, 25 bp, Mus musculus
acagctagagccaacggccgggcgt

SEQ ID NO: 862303 - DNA, 25 bp, Mus musculus
acagctagagccaagggccgggcgt

SEQ ID NO: 862304 - DNA, 25 bp, Mus musculus
acagctagagctttggatgatgtga

SEQ ID NO: 862305 - DNA, 25 bp, Mus musculus
acagctagaggtttggatgatgtga

SEQ ID NO: 862306 - DNA, 25 bp, Mus musculus
acagctagctatcacctatgaggag

SEQ ID NO: 862307 - DNA, 25 bp, Mus musculus
acagctagctatgacctatgaggag

SEQ ID NO: 862308 - DNA, 25 bp, Mus musculus
acagctagttcatcactatttcatg

SEQ ID NO: 862309 - DNA, 25 bp, Mus musculus
acagctagttgatcactatttcatg

SEQ ID NO: 862310 - DNA, 25 bp, Mus musculus
acagctatccagcacagccatggaa

SEQ ID NO: 862311 - DNA, 25 bp, Mus musculus
acagctatccagcagagccatggaa

SEQ ID NO: 862312 - DNA, 25 bp, Mus musculus
acagctatcccacgaccgggacttc

SEQ ID NO: 862313 - DNA, 25 bp, Mus musculus
acagctatcccacgcccctctgccc

SEQ ID NO: 862314 - DNA, 25 bp, Mus musculus
acagctatcccaggaccgggacttc

SEQ ID NO: 862315 - DNA, 25 bp, Mus musculus
acagctatcccaggcccctctgccc

SEQ ID NO: 862316 - DNA, 25 bp, Mus musculus
acagctccagagcacgtacgaccgc

SEQ ID NO: 862317 - DNA, 25 bp, Mus musculus
acagctccagattttcaggaatctg

SEQ ID NO: 862318 - DNA, 25 bp, Mus musculus
acagctccagcgtagccccagtgga

SEQ ID NO: 862319 - DNA, 25 bp, Mus musculus
acagctccagggtagccccagtgga

SEQ ID NO: 862320 - DNA, 25 bp, Mus musculus
acagctccagtgcacgtacgaccgc

SEQ ID NO: 862321 - DNA, 25 bp, Mus musculus
acagctccagtttttcaggaatctg

SEQ ID NO: 862322 - DNA, 25 bp, Mus musculus
acagctccatggatggttcctggca

SEQ ID NO: 862323 - DNA, 25 bp, Mus musculus
acagctccatggttggttcctggca

SEQ ID NO: 862324 - DNA, 25 bp, Mus musculus
acagctcggaccactgccaaggaag

SEQ ID NO: 862325 - DNA, 25 bp, Mus musculus
acagctcggacctctgccaaggaag

SEQ ID NO: 862326 - DNA, 25 bp, Mus musculus
acagctctctatcatcttaccaata

SEQ ID NO: 862327 - DNA, 25 bp, Mus musculus
acagctctctatgatcttaccaata

SEQ ID NO: 862328 - DNA, 25 bp, Mus musculus
acagctctggtcgacgaagatgggc

SEQ ID NO: 862329 - DNA, 25 bp, Mus musculus
acagctctggtcgaggaagatgggc

SEQ ID NO: 862330 - DNA, 25 bp, Mus musculus
acagctctgtagtacgacaacatga

SEQ ID NO: 862331 - DNA, 25 bp, Mus musculus
acagctctgttgtacgacaacatga

SEQ ID NO: 862332 - DNA, 25 bp, Mus musculus
acagctcttgatgtctcgcctggcc

SEQ ID NO: 862333 - DNA, 25 bp, Mus musculus
acagctcttgttgtctcgcctggcc

SEQ ID NO: 862334 - DNA, 25 bp, Mus musculus
acagctgaagcagagactagaaaaa

SEQ ID NO: 862335 - DNA, 25 bp, Mus musculus
acagctgaagcatgctattgatgag

SEQ ID NO: 862336 - DNA, 25 bp, Mus musculus
acagctgaagctgtgggatgtgatt

SEQ ID NO: 862337 - DNA, 25 bp, Mus musculus
acagctgaaggagagactagaaaaa

SEQ ID NO: 862338 - DNA, 25 bp, Mus musculus
acagctgaaggatgctattgatgag

SEQ ID NO: 862339 - DNA, 25 bp, Mus musculus
acagctgaaggtgtgggatgtgatt

SEQ ID NO: 862340 - DNA, 25 bp, Mus musculus
acagctgacgatgacgctgactttg

SEQ ID NO: 862341 - DNA, 25 bp, Mus musculus
acagctgacgatgaggctgactttg

SEQ ID NO: 862342 - DNA, 25 bp, Mus musculus
acagctgactcaccccggcaagctg

SEQ ID NO: 862343 - DNA, 25 bp, Mus musculus
acagctgactcagcccggcaagctg

SEQ ID NO: 862344 - DNA, 25 bp, Mus musculus
acagctgatgcttccagcatcttgg

SEQ ID NO: 862345 - DNA, 25 bp, Mus musculus
acagctgatggttccagcatcttgg

SEQ ID NO: 862346 - DNA, 25 bp, Mus musculus
acagctgcagcctcagtccggatag

SEQ ID NO: 862347 - DNA, 25 bp, Mus musculus
acagctgcagcctctgtccggatag

SEQ ID NO: 862348 - DNA, 25 bp, Mus musculus
acagctgcttaaccttcaggccttc

SEQ ID NO: 862349 - DNA, 25 bp, Mus musculus
acagctgcttaagcttcaggccttc

SEQ ID NO: 862350 - DNA, 25 bp, Mus musculus
acagctggaacactggccgcacgag

SEQ ID NO: 862351 - DNA, 25 bp, Mus musculus
acagctggaacagtggccgcacgag

SEQ ID NO: 862352 - DNA, 25 bp, Mus musculus
acagctggatgaagctcgtgtcatc

SEQ ID NO: 862353 - DNA, 25 bp, Mus musculus
acagctggatgatgctcgtgtcatc

SEQ ID NO: 862354 - DNA, 25 bp, Mus musculus
acagctgtcaccaacattaccacag

SEQ ID NO: 862355 - DNA, 25 bp, Mus musculus
acagctgtcacctacattaccacag

SEQ ID NO: 862356 - DNA, 25 bp, Mus musculus
acagctgtctagaccccatggacac

SEQ ID NO: 862357 - DNA, 25 bp, Mus musculus
acagctgtctagtccccatggacac

SEQ ID NO: 862358 - DNA, 25 bp, Mus musculus
acagcttcccagcagatgtacgact

SEQ ID NO: 862359 - DNA, 25 bp, Mus musculus
acagcttcccaggagatgtacgact

SEQ ID NO: 862360 - DNA, 25 bp, Mus musculus
acagcttcgctgcgtggatgtggcc

SEQ ID NO: 862361 - DNA, 25 bp, Mus musculus
acagcttcgctgggtggatgtggcc

SEQ ID NO: 862362 - DNA, 25 bp, Mus musculus
acagctttacttttcgtatatcatg

SEQ ID NO: 862363 - DNA, 25 bp, Mus musculus
acagctttacttttggtatatcatg

SEQ ID NO: 862364 - DNA, 25 bp, Mus musculus
acagctttccagaattcctcagaga

SEQ ID NO: 862365 - DNA, 25 bp, Mus musculus
acagctttccagacttacaacagct

SEQ ID NO: 862366 - DNA, 25 bp, Mus musculus
acagctttccagtattcctcagaga

SEQ ID NO: 862367 - DNA, 25 bp, Mus musculus
acagctttccagtcttacaacagct

SEQ ID NO: 862368 - DNA, 25 bp, Mus musculus
acagctttctgaaacggtgaaggct

SEQ ID NO: 862369 - DNA, 25 bp, Mus musculus
acagctttctgaaagggtgaaggct

SEQ ID NO: 862370 - DNA, 25 bp, Mus musculus
acaggaaaaccacgttgctggtgac

SEQ ID NO: 862371 - DNA, 25 bp, Mus musculus
acaggaaaaccaggttgctggtgac

SEQ ID NO: 862372 - DNA, 25 bp, Mus musculus
acaggaaattcaccctcaagtacct

SEQ ID NO: 862373 - DNA, 25 bp, Mus musculus
acaggaaattcacgcgatgctgggc

SEQ ID NO: 862374 - DNA, 25 bp, Mus musculus
acaggaaattcagcctcaagtacct

SEQ ID NO: 862375 - DNA, 25 bp, Mus musculus
acaggaaattcaggcgatgctgggc

SEQ ID NO: 862376 - DNA, 25 bp, Mus musculus
acaggaacatcgagactttatatgg

SEQ ID NO: 862377 - DNA, 25 bp, Mus musculus
acaggaacatcgtgactttatatgg

SEQ ID NO: 862378 - DNA, 25 bp, Mus musculus
acaggaacgcattgcgcgcctggtg

SEQ ID NO: 862379 - DNA, 25 bp, Mus musculus
acaggaacgcattgggcgcctggtg

SEQ ID NO: 862380 - DNA, 25 bp, Mus musculus
acaggaactgagcctccggagggtg

SEQ ID NO: 862381 - DNA, 25 bp, Mus musculus
acaggaactgaggctccggagggtg

SEQ ID NO: 862382 - DNA, 25 bp, Mus musculus
acaggaagccaaaattctgaagcaa

SEQ ID NO: 862383 - DNA, 25 bp, Mus musculus
acaggaagccaatattctgaagcaa

SEQ ID NO: 862384 - DNA, 25 bp, Mus musculus
acaggaagtcagctagcagccacat

SEQ ID NO: 862385 - DNA, 25 bp, Mus musculus
acaggaagtcaggtagcagccacat

SEQ ID NO: 862386 - DNA, 25 bp, Mus musculus
acaggaagtgcatacgaggagcttc

SEQ ID NO: 862387 - DNA, 25 bp, Mus musculus
acaggaagtgcatacgagtggctgc

SEQ ID NO: 862388 - DNA, 25 bp, Mus musculus
acaggaagtgcataggaggagcttc

SEQ ID NO: 862389 - DNA, 25 bp, Mus musculus
acaggaagtgcataggagtggctgc

SEQ ID NO: 862390 - DNA, 25 bp, Mus musculus
acaggaagtgctgcgctacaacaca

SEQ ID NO: 862391 - DNA, 25 bp, Mus musculus
acaggaagtggtgcgctacaacaca

SEQ ID NO: 862392 - DNA, 25 bp, Mus musculus
acaggaatacgacaaagccctgcag

SEQ ID NO: 862393 - DNA, 25 bp, Mus musculus
acaggaatacgagaaagccctgcag

SEQ ID NO: 862394 - DNA, 25 bp, Mus musculus
acaggacaaactttccatcctcatc

SEQ ID NO: 862395 - DNA, 25 bp, Mus musculus
acaggacaaagtttccatcctcatc

SEQ ID NO: 862396 - DNA, 25 bp, Mus musculus
acaggacaagaatgccctggacttg

SEQ ID NO: 862397 - DNA, 25 bp, Mus musculus
acaggacaagctaagcattgaggat

SEQ ID NO: 862398 - DNA, 25 bp, Mus musculus
acaggacaaggtaagcattgaggat

SEQ ID NO: 862399 - DNA, 25 bp, Mus musculus
acaggacaagtatgccctggacttg

SEQ ID NO: 862400 - DNA, 25 bp, Mus musculus
acaggacagcgacggcaatctgcag

SEQ ID NO: 862401 - DNA, 25 bp, Mus musculus
acaggacagcgagggcaatctgcag

SEQ ID NO: 862402 - DNA, 25 bp, Mus musculus
acaggacatttgaacgtatcgccgg

SEQ ID NO: 862403 - DNA, 25 bp, Mus musculus
acaggacatttgaaggtatcgccgg

SEQ ID NO: 862404 - DNA, 25 bp, Mus musculus
acaggacccaagcgagagccaggtg

SEQ ID NO: 862405 - DNA, 25 bp, Mus musculus
acaggacccaagggagagccaggtg

SEQ ID NO: 862406 - DNA, 25 bp, Mus musculus
acaggacccagaccaagtccacatg

SEQ ID NO: 862407 - DNA, 25 bp, Mus musculus
acaggacccagagaaaactgtcctg

SEQ ID NO: 862408 - DNA, 25 bp, Mus musculus
acaggacccagagataactgtcctg

SEQ ID NO: 862409 - DNA, 25 bp, Mus musculus
acaggacccagagcaagtccacatg

SEQ ID NO: 862410 - DNA, 25 bp, Mus musculus
acaggacggaaaccgaatggacccg

SEQ ID NO: 862411 - DNA, 25 bp, Mus musculus
acaggacggaaagcgaatggacccg

SEQ ID NO: 862412 - DNA, 25 bp, Mus musculus
acaggactcaggaagatgagaggcc

SEQ ID NO: 862413 - DNA, 25 bp, Mus musculus
acaggactcaggaaggttgatggaa

SEQ ID NO: 862414 - DNA, 25 bp, Mus musculus
acaggactcaggtagatgagaggcc

SEQ ID NO: 862415 - DNA, 25 bp, Mus musculus
acaggactcaggtaggttgatggaa

SEQ ID NO: 862416 - DNA, 25 bp, Mus musculus
acaggagaaaggctcgagctggaac

SEQ ID NO: 862417 - DNA, 25 bp, Mus musculus
acaggagaaaggctcggtgaagacc

SEQ ID NO: 862418 - DNA, 25 bp, Mus musculus
acaggagaaaggctggagctggaac

SEQ ID NO: 862419 - DNA, 25 bp, Mus musculus
acaggagaaaggctgggtgaagacc

SEQ ID NO: 862420 - DNA, 25 bp, Mus musculus
acaggagaagtgctgcatggatgtt

SEQ ID NO: 862421 - DNA, 25 bp, Mus musculus
acaggagaagtgctggcctgcttga

SEQ ID NO: 862422 - DNA, 25 bp, Mus musculus
acaggagaagtggtgcatggatgtt

SEQ ID NO: 862423 - DNA, 25 bp, Mus musculus
acaggagaagtggtggcctgcttga

SEQ ID NO: 862424 - DNA, 25 bp, Mus musculus
acaggagatatgagcaacaaaagcg

SEQ ID NO: 862425 - DNA, 25 bp, Mus musculus
acaggagatatgtgcaacaaaagcg

SEQ ID NO: 862426 - DNA, 25 bp, Mus musculus
acaggagatcaacaatctctctggc

SEQ ID NO: 862427 - DNA, 25 bp, Mus musculus
acaggagatcaagaatctctctggc

SEQ ID NO: 862428 - DNA, 25 bp, Mus musculus
acaggagcaaccagagagcaccgta

SEQ ID NO: 862429 - DNA, 25 bp, Mus musculus
acaggagcaaccagtgagcaccgta

SEQ ID NO: 862430 - DNA, 25 bp, Mus musculus
acaggagctgccaaacccaagctga

SEQ ID NO: 862431 - DNA, 25 bp, Mus musculus
acaggagctgccaatcccaagctga

SEQ ID NO: 862432 - DNA, 25 bp, Mus musculus
acaggaggagcacgattttggcagt

SEQ ID NO: 862433 - DNA, 25 bp, Mus musculus
acaggaggagcaggattttggcagt

SEQ ID NO: 862434 - DNA, 25 bp, Mus musculus
acaggaggcaaacagaactctggtt

SEQ ID NO: 862435 - DNA, 25 bp, Mus musculus
acaggaggcaaagagaactctggtt

SEQ ID NO: 862436 - DNA, 25 bp, Mus musculus
acaggaggccagcaagtccttcttc

SEQ ID NO: 862437 - DNA, 25 bp, Mus musculus
acaggaggccaggaagtccttcttc

SEQ ID NO: 862438 - DNA, 25 bp, Mus musculus
acaggagtagcaaactggctgacag

SEQ ID NO: 862439 - DNA, 25 bp, Mus musculus
acaggagtagcatactggctgacag

SEQ ID NO: 862440 - DNA, 25 bp, Mus musculus
acaggagtggacccgtaggcctcac

SEQ ID NO: 862441 - DNA, 25 bp, Mus musculus
acaggagtggcagtctgctgggcag

SEQ ID NO: 862442 - DNA, 25 bp, Mus musculus
acaggagtgggagtctgctgggcag

SEQ ID NO: 862443 - DNA, 25 bp, Mus musculus
acaggagtggtcccgtaggcctcac

SEQ ID NO: 862444 - DNA, 25 bp, Mus musculus
acaggataagatagtgaaagaaaag

SEQ ID NO: 862445 - DNA, 25 bp, Mus musculus
acaggataagttagtgaaagaaaag

SEQ ID NO: 862446 - DNA, 25 bp, Mus musculus
acaggatcagcagtttgatttcagt

SEQ ID NO: 862447 - DNA, 25 bp, Mus musculus
acaggatcaggagtttgatttcagt

SEQ ID NO: 862448 - DNA, 25 bp, Mus musculus
acaggatgggacccagcctgcagtt

SEQ ID NO: 862449 - DNA, 25 bp, Mus musculus
acaggatgggtcccagcctgcagtt

SEQ ID NO: 862450 - DNA, 25 bp, Mus musculus
acaggatgtactctataaatggata

SEQ ID NO: 862451 - DNA, 25 bp, Mus musculus
acaggatgtactgtataaatggata

SEQ ID NO: 862452 - DNA, 25 bp, Mus musculus
acaggattcaaaccaggactgttca

SEQ ID NO: 862453 - DNA, 25 bp, Mus musculus
acaggattcaaacctggactgttca

SEQ ID NO: 862454 - DNA, 25 bp, Mus musculus
acaggattcgcaagctgaccagtgc

SEQ ID NO: 862455 - DNA, 25 bp, Mus musculus
acaggattcgcatgctgaccagtgc

SEQ ID NO: 862456 - DNA, 25 bp, Mus musculus
acaggcaatgaccaaataacccctt

SEQ ID NO: 862457 - DNA, 25 bp, Mus musculus
acaggcaatgacgaaataacccctt

SEQ ID NO: 862458 - DNA, 25 bp, Mus musculus
acaggcacagatgctgatatgtgtt

SEQ ID NO: 862459 - DNA, 25 bp, Mus musculus
acaggcacagttgctgatatgtgtt

SEQ ID NO: 862460 - DNA, 25 bp, Mus musculus
acaggcaccgagtctgacctggctc

SEQ ID NO: 862461 - DNA, 25 bp, Mus musculus
acaggcaccgtgtctgacctggctc

SEQ ID NO: 862462 - DNA, 25 bp, Mus musculus
acaggcactagatacagcagaagca

SEQ ID NO: 862463 - DNA, 25 bp, Mus musculus
acaggcactagatagagcagaagca

SEQ ID NO: 862464 - DNA, 25 bp, Mus musculus
acaggcagagtgcagctcttccgaa

SEQ ID NO: 862465 - DNA, 25 bp, Mus musculus
acaggcagagtgctcttccgaaggc

SEQ ID NO: 862466 - DNA, 25 bp, Mus musculus
acaggcagagtggagctcttccgaa

SEQ ID NO: 862467 - DNA, 25 bp, Mus musculus
acaggcagagtggtcttccgaaggc

SEQ ID NO: 862468 - DNA, 25 bp, Mus musculus
acaggcagctcacgaaaataaaaac

SEQ ID NO: 862469 - DNA, 25 bp, Mus musculus
acaggcagctcaggaaaataaaaac

SEQ ID NO: 862470 - DNA, 25 bp, Mus musculus
acaggcaggcagattgaccttggcc

SEQ ID NO: 862471 - DNA, 25 bp, Mus musculus
acaggcaggcagtttgaccttggcc

SEQ ID NO: 862472 - DNA, 25 bp, Mus musculus
acaggcagtgctccagagtccagcc

SEQ ID NO: 862473 - DNA, 25 bp, Mus musculus
acaggcagtggtccagagtccagcc

SEQ ID NO: 862474 - DNA, 25 bp, Mus musculus
acaggccagactatgttggatttga

SEQ ID NO: 862475 - DNA, 25 bp, Mus musculus
acaggccagactttgttggatttga

SEQ ID NO: 862476 - DNA, 25 bp, Mus musculus
acaggcccagctccccatcatcccc

SEQ ID NO: 862477 - DNA, 25 bp, Mus musculus
acaggcccaggtccccatcatcccc

SEQ ID NO: 862478 - DNA, 25 bp, Mus musculus
acaggccctccgagggccttatgga

SEQ ID NO: 862479 - DNA, 25 bp, Mus musculus
acaggccctccgtgggccttatgga

SEQ ID NO: 862480 - DNA, 25 bp, Mus musculus
acaggccgagagcttgcaataaaaa

SEQ ID NO: 862481 - DNA, 25 bp, Mus musculus
acaggccgagaggttgcaataaaaa

SEQ ID NO: 862482 - DNA, 25 bp, Mus musculus
acaggcctcactgtgaccgccagtt

SEQ ID NO: 862483 - DNA, 25 bp, Mus musculus
acaggcctcagtgtgaccgccagtt

SEQ ID NO: 862484 - DNA, 25 bp, Mus musculus
acaggcctggagaacattgaacagc

SEQ ID NO: 862485 - DNA, 25 bp, Mus musculus
acaggcctggagaagattgaacagc

SEQ ID NO: 862486 - DNA, 25 bp, Mus musculus
acaggcgggcggagtatcctcagag

SEQ ID NO: 862487 - DNA, 25 bp, Mus musculus
acaggcgggcggtgtatcctcagag

SEQ ID NO: 862488 - DNA, 25 bp, Mus musculus
acaggcgtccaacctcccagcagca

SEQ ID NO: 862489 - DNA, 25 bp, Mus musculus
acaggcgtccaacgccatcagctcc

SEQ ID NO: 862490 - DNA, 25 bp, Mus musculus
acaggcgtccaagctcccagcagca

SEQ ID NO: 862491 - DNA, 25 bp, Mus musculus
acaggcgtccaaggccatcagctcc

SEQ ID NO: 862492 - DNA, 25 bp, Mus musculus
acaggctaagcaactcaccagggat

SEQ ID NO: 862493 - DNA, 25 bp, Mus musculus
acaggctaaggaactcaccagggat

SEQ ID NO: 862494 - DNA, 25 bp, Mus musculus
acaggctcagcaggcctttcccagg

SEQ ID NO: 862495 - DNA, 25 bp, Mus musculus
acaggctcagccgtggaagctccat

SEQ ID NO: 862496 - DNA, 25 bp, Mus musculus
acaggctcagctcgtgcagttcgta

SEQ ID NO: 862497 - DNA, 25 bp, Mus musculus
acaggctcagctggtgcagttcgta

SEQ ID NO: 862498 - DNA, 25 bp, Mus musculus
acaggctcaggaggcctttcccagg

SEQ ID NO: 862499 - DNA, 25 bp, Mus musculus
acaggctcaggcgtggaagctccat

SEQ ID NO: 862500 - DNA, 25 bp, Mus musculus
acaggctccacggacgttggtcacc

SEQ ID NO: 862501 - DNA, 25 bp, Mus musculus
acaggctccacggaggttggtcacc

SEQ ID NO: 862502 - DNA, 25 bp, Mus musculus
acaggctgcaaactcctcttctcca

SEQ ID NO: 862503 - DNA, 25 bp, Mus musculus
acaggctgcaaagtcctcttctcca

SEQ ID NO: 862504 - DNA, 25 bp, Mus musculus
acaggctgcgctgacgctccagcct

SEQ ID NO: 862505 - DNA, 25 bp, Mus musculus
acaggctgcgctgaggctccagcct

SEQ ID NO: 862506 - DNA, 25 bp, Mus musculus
acaggctgctcacgtcggcctgctg

SEQ ID NO: 862507 - DNA, 25 bp, Mus musculus
acaggctgctcaggtcggcctgctg

SEQ ID NO: 862508 - DNA, 25 bp, Mus musculus
acaggctggcaacgtcaaacctgcg

SEQ ID NO: 862509 - DNA, 25 bp, Mus musculus
acaggctggcaaggtcaaacctgcg

SEQ ID NO: 862510 - DNA, 25 bp, Mus musculus
acagggaatgggcaagaaggcatgc

SEQ ID NO: 862511 - DNA, 25 bp, Mus musculus
acagggaatggggaagaaggcatgc

SEQ ID NO: 862512 - DNA, 25 bp, Mus musculus
acagggaccagtcattgacaggcgc

SEQ ID NO: 862513 - DNA, 25 bp, Mus musculus
acagggaccagtgattgacaggcgc

SEQ ID NO: 862514 - DNA, 25 bp, Mus musculus
acagggacccagaacatgatttttg

SEQ ID NO: 862515 - DNA, 25 bp, Mus musculus
acagggacccagaagatgatttttg

SEQ ID NO: 862516 - DNA, 25 bp, Mus musculus
acagggactagccgcgttattcgca

SEQ ID NO: 862517 - DNA, 25 bp, Mus musculus
acagggactagccgggttattcgca

SEQ ID NO: 862518 - DNA, 25 bp, Mus musculus
acagggatcgtacccagatcgccct

SEQ ID NO: 862519 - DNA, 25 bp, Mus musculus
acagggatcgtaccgagatcgccct

SEQ ID NO: 862520 - DNA, 25 bp, Mus musculus
acagggcctggacttggatccagag

SEQ ID NO: 862521 - DNA, 25 bp, Mus musculus
acagggcctggagttggatccagag

SEQ ID NO: 862522 - DNA, 25 bp, Mus musculus
acagggctcccagccgcaaggacag

SEQ ID NO: 862523 - DNA, 25 bp, Mus musculus
acagggctccgagccgcaaggacag

SEQ ID NO: 862524 - DNA, 25 bp, Mus musculus
acaggggaaacacaggagcgagttg

SEQ ID NO: 862525 - DNA, 25 bp, Mus musculus
acaggggaaacagaggagcgagttg

SEQ ID NO: 862526 - DNA, 25 bp, Mus musculus
acaggggttgcacacgatttcccta

SEQ ID NO: 862527 - DNA, 25 bp, Mus musculus
acaggggttgcacaggatttcccta

SEQ ID NO: 862528 - DNA, 25 bp, Mus musculus
acagggtcagcgaagtcctctttgg

SEQ ID NO: 862529 - DNA, 25 bp, Mus musculus
acagggtcagggaagtcctctttgg

SEQ ID NO: 862530 - DNA, 25 bp, Mus musculus
acaggtaaaaatcgattagtcgtat

SEQ ID NO: 862531 - DNA, 25 bp, Mus musculus
acaggtaaaaatggattagtcgtat

SEQ ID NO: 862532 - DNA, 25 bp, Mus musculus
acaggtaacactgtcagctgactcc

SEQ ID NO: 862533 - DNA, 25 bp, Mus musculus
acaggtaacagtgtcagctgactcc

SEQ ID NO: 862534 - DNA, 25 bp, Mus musculus
acaggtaacgatgaggtcatcggac

SEQ ID NO: 862535 - DNA, 25 bp, Mus musculus
acaggtaacgttgaggtcatcggac

SEQ ID NO: 862536 - DNA, 25 bp, Mus musculus
acaggtaaggccagatgtcatcaat

SEQ ID NO: 862537 - DNA, 25 bp, Mus musculus
acaggtaagggcagatgtcatcaat

SEQ ID NO: 862538 - DNA, 25 bp, Mus musculus
acaggtcacctgcacatactttatg

SEQ ID NO: 862539 - DNA, 25 bp, Mus musculus
acaggtcacctgcagatactttatg

SEQ ID NO: 862540 - DNA, 25 bp, Mus musculus
acaggtcagtcctgcgctgggccgt

SEQ ID NO: 862541 - DNA, 25 bp, Mus musculus
acaggtcagtcctgggctgggccgt

SEQ ID NO: 862542 - DNA, 25 bp, Mus musculus
acaggtcccagctgcggtcggagct

SEQ ID NO: 862543 - DNA, 25 bp, Mus musculus
acaggtcccagctggggtcggagct

SEQ ID NO: 862544 - DNA, 25 bp, Mus musculus
acaggtgcaagtaatcccacagggc

SEQ ID NO: 862545 - DNA, 25 bp, Mus musculus
acaggtgcaagttatcccacagggc

SEQ ID NO: 862546 - DNA, 25 bp, Mus musculus
acaggtggcaaacaaccagcatttt

SEQ ID NO: 862547 - DNA, 25 bp, Mus musculus
acaggtggcaaagaaccagcatttt

SEQ ID NO: 862548 - DNA, 25 bp, Mus musculus
acaggtgtgaagatattgacgagtg

SEQ ID NO: 862549 - DNA, 25 bp, Mus musculus
acaggtgtgaagttattgacgagtg

SEQ ID NO: 862550 - DNA, 25 bp, Mus musculus
acaggttatgggcgcaccagctgca

SEQ ID NO: 862551 - DNA, 25 bp, Mus musculus
acaggttatgggggcaccagctgca

SEQ ID NO: 862552 - DNA, 25 bp, Mus musculus
acaggttctttgcctctgtatgaga

SEQ ID NO: 862553 - DNA, 25 bp, Mus musculus
acaggttctttggctctgtatgaga

SEQ ID NO: 862554 - DNA, 25 bp, Mus musculus
acaggtttctggatatggttcagga

SEQ ID NO: 862555 - DNA, 25 bp, Mus musculus
acaggtttctggttatggttcagga

SEQ ID NO: 862556 - DNA, 25 bp, Mus musculus
acagtaagtacacttgatacactaa

SEQ ID NO: 862557 - DNA, 25 bp, Mus musculus
acagtaagtacagttgatacactaa

SEQ ID NO: 862558 - DNA, 25 bp, Mus musculus
acagtacaaggaaactgaggatgga

SEQ ID NO: 862559 - DNA, 25 bp, Mus musculus
acagtacaaggaaagtgaggatgga

SEQ ID NO: 862560 - DNA, 25 bp, Mus musculus
acagtacacagtgacagttcgatgc

SEQ ID NO: 862561 - DNA, 25 bp, Mus musculus
acagtacacagtgagagttcgatgc

SEQ ID NO: 862562 - DNA, 25 bp, Mus musculus
acagtacacgcctcgacgaccagcc

SEQ ID NO: 862563 - DNA, 25 bp, Mus musculus
acagtacacggctcgacgaccagcc

SEQ ID NO: 862564 - DNA, 25 bp, Mus musculus
acagtacattccctccttgttcagt

SEQ ID NO: 862565 - DNA, 25 bp, Mus musculus
acagtacattccctgcttgttcagt

SEQ ID NO: 862566 - DNA, 25 bp, Mus musculus
acagtacatttcaacagttttccag

SEQ ID NO: 862567 - DNA, 25 bp, Mus musculus
acagtacatttcaagagttttccag

SEQ ID NO: 862568 - DNA, 25 bp, Mus musculus
acagtactatggcgatgtctgtgtt

SEQ ID NO: 862569 - DNA, 25 bp, Mus musculus
acagtactatggggatgtctgtgtt

SEQ ID NO: 862570 - DNA, 25 bp, Mus musculus
acagtagaagagcctccacgctgga

SEQ ID NO: 862571 - DNA, 25 bp, Mus musculus
acagtagaagcgctccaaaatctta

SEQ ID NO: 862572 - DNA, 25 bp, Mus musculus
acagtagaagcgctgcaaaatctta

SEQ ID NO: 862573 - DNA, 25 bp, Mus musculus
acagtagaagtgcctccacgctgga

SEQ ID NO: 862574 - DNA, 25 bp, Mus musculus
acagtaggaagaaacatgcttctga

SEQ ID NO: 862575 - DNA, 25 bp, Mus musculus
acagtaggaagaaagatgcttctga

SEQ ID NO: 862576 - DNA, 25 bp, Mus musculus
acagtaggggagatcactattgcta

SEQ ID NO: 862577 - DNA, 25 bp, Mus musculus
acagtaggggagttcactattgcta

SEQ ID NO: 862578 - DNA, 25 bp, Mus musculus
acagtatcacagctatccaactggt

SEQ ID NO: 862579 - DNA, 25 bp, Mus musculus
acagtatcacaggtatccaactggt

SEQ ID NO: 862580 - DNA, 25 bp, Mus musculus
acagtattcaagagaacctgcagct

SEQ ID NO: 862581 - DNA, 25 bp, Mus musculus
acagtattcacaggaaatataagaa

SEQ ID NO: 862582 - DNA, 25 bp, Mus musculus
acagtattcacttacggtctttggt

SEQ ID NO: 862583 - DNA, 25 bp, Mus musculus
acagtattcagaggaaatataagaa

SEQ ID NO: 862584 - DNA, 25 bp, Mus musculus
acagtattcagttacggtctttggt

SEQ ID NO: 862585 - DNA, 25 bp, Mus musculus
acagtattcatgagaacctgcagct

SEQ ID NO: 862586 - DNA, 25 bp, Mus musculus
acagtcaacgatgacatttttgtgc

SEQ ID NO: 862587 - DNA, 25 bp, Mus musculus
acagtcaacgatgagatttttgtgc

SEQ ID NO: 862588 - DNA, 25 bp, Mus musculus
acagtcaattcgccccctcagttcc

SEQ ID NO: 862589 - DNA, 25 bp, Mus musculus
acagtcaattggccccctcagttcc

SEQ ID NO: 862590 - DNA, 25 bp, Mus musculus
acagtcactcagctagtacccgcag

SEQ ID NO: 862591 - DNA, 25 bp, Mus musculus
acagtcactcaggtagtacccgcag

SEQ ID NO: 862592 - DNA, 25 bp, Mus musculus
acagtcactgaaccttctgggtgag

SEQ ID NO: 862593 - DNA, 25 bp, Mus musculus
acagtcactgaagcttctgggtgag

SEQ ID NO: 862594 - DNA, 25 bp, Mus musculus
acagtcagatggaatccagcaagct

SEQ ID NO: 862595 - DNA, 25 bp, Mus musculus
acagtcagatggtatccagcaagct

SEQ ID NO: 862596 - DNA, 25 bp, Mus musculus
acagtcatacagaccagacaagaca

SEQ ID NO: 862597 - DNA, 25 bp, Mus musculus
acagtcatacagtccagacaagaca

SEQ ID NO: 862598 - DNA, 25 bp, Mus musculus
acagtcatctaactcatctacagcc

SEQ ID NO: 862599 - DNA, 25 bp, Mus musculus
acagtcatctaagtcatctacagcc

SEQ ID NO: 862600 - DNA, 25 bp, Mus musculus
acagtccaagctcacacggttatcc

SEQ ID NO: 862601 - DNA, 25 bp, Mus musculus
acagtccaaggtcacacggttatcc

SEQ ID NO: 862602 - DNA, 25 bp, Mus musculus
acagtccatggagacattgatcctg

SEQ ID NO: 862603 - DNA, 25 bp, Mus musculus
acagtccatggagagattgatcctg

SEQ ID NO: 862604 - DNA, 25 bp, Mus musculus
acagtcccagcacagtgatggttgc

SEQ ID NO: 862605 - DNA, 25 bp, Mus musculus
acagtcccagcacgacatggatttg

SEQ ID NO: 862606 - DNA, 25 bp, Mus musculus
acagtcccagcagagtgatggttgc

SEQ ID NO: 862607 - DNA, 25 bp, Mus musculus
acagtcccagcaggacatggatttg

SEQ ID NO: 862608 - DNA, 25 bp, Mus musculus
acagtcctcgagacttcacccgaat

SEQ ID NO: 862609 - DNA, 25 bp, Mus musculus
acagtcctcgagtcttcacccgaat

SEQ ID NO: 862610 - DNA, 25 bp, Mus musculus
acagtcctcggacgagtatatatcc

SEQ ID NO: 862611 - DNA, 25 bp, Mus musculus
acagtcctcggaggagtatatatcc

SEQ ID NO: 862612 - DNA, 25 bp, Mus musculus
acagtcctggatcctccacgtaact

SEQ ID NO: 862613 - DNA, 25 bp, Mus musculus
acagtcctggttcctccacgtaact

SEQ ID NO: 862614 - DNA, 25 bp, Mus musculus
acagtcgcagataatgagaaggaga

SEQ ID NO: 862615 - DNA, 25 bp, Mus musculus
acagtcgcagttaatgagaaggaga

SEQ ID NO: 862616 - DNA, 25 bp, Mus musculus
acagtctcagaaaccattgaatcct

SEQ ID NO: 862617 - DNA, 25 bp, Mus musculus
acagtctcagcacccatcgaaacct

SEQ ID NO: 862618 - DNA, 25 bp, Mus musculus
acagtctcagccacagagaaccagg

SEQ ID NO: 862619 - DNA, 25 bp, Mus musculus
acagtctcaggacccatcgaaacct

SEQ ID NO: 862620 - DNA, 25 bp, Mus musculus
acagtctcaggcacagagaaccagg

SEQ ID NO: 862621 - DNA, 25 bp, Mus musculus
acagtctcagtaaccattgaatcct

SEQ ID NO: 862622 - DNA, 25 bp, Mus musculus
acagtctcctcacagagtcagtcct

SEQ ID NO: 862623 - DNA, 25 bp, Mus musculus
acagtctcctcacagtctgcgagaa

SEQ ID NO: 862624 - DNA, 25 bp, Mus musculus
acagtctcctcacccaaaacaacag

SEQ ID NO: 862625 - DNA, 25 bp, Mus musculus
acagtctcctcacccaaaacgacac

SEQ ID NO: 862626 - DNA, 25 bp, Mus musculus
acagtctcctcagagagtcagtcct

SEQ ID NO: 862627 - DNA, 25 bp, Mus musculus
acagtctcctcagagtctgcgagaa

SEQ ID NO: 862628 - DNA, 25 bp, Mus musculus
acagtctcctcagccaaaacaacag

SEQ ID NO: 862629 - DNA, 25 bp, Mus musculus
acagtctcctcagccaaaacgacac

SEQ ID NO: 862630 - DNA, 25 bp, Mus musculus
acagtctcggagtggggtacctagc

SEQ ID NO: 862631 - DNA, 25 bp, Mus musculus
acagtctcggtgtggggtacctagc

SEQ ID NO: 862632 - DNA, 25 bp, Mus musculus
acagtctgacacagcaattaccaag

SEQ ID NO: 862633 - DNA, 25 bp, Mus musculus
acagtctgacactgcaattaccaag

SEQ ID NO: 862634 - DNA, 25 bp, Mus musculus
acagtctgaccgaggctgtactgcc

SEQ ID NO: 862635 - DNA, 25 bp, Mus musculus
acagtctgacggaggctgtactgcc

SEQ ID NO: 862636 - DNA, 25 bp, Mus musculus
acagtgaaggagaagagtcttgatg

SEQ ID NO: 862637 - DNA, 25 bp, Mus musculus
acagtgaaggagacttgatgaagtc

SEQ ID NO: 862638 - DNA, 25 bp, Mus musculus
acagtgaaggagagtcttgatgaag

SEQ ID NO: 862639 - DNA, 25 bp, Mus musculus
acagtgaaggagtagagtcttgatg

SEQ ID NO: 862640 - DNA, 25 bp, Mus musculus
acagtgaaggagtcttgatgaagtc

SEQ ID NO: 862641 - DNA, 25 bp, Mus musculus
acagtgaaggagtgtcttgatgaag

SEQ ID NO: 862642 - DNA, 25 bp, Mus musculus
acagtgaatatcctaaaaagcacca

SEQ ID NO: 862643 - DNA, 25 bp, Mus musculus
acagtgaatatcgtaaaaagcacca

SEQ ID NO: 862644 - DNA, 25 bp, Mus musculus
acagtgaatcagcctcaccttcagc

SEQ ID NO: 862645 - DNA, 25 bp, Mus musculus
acagtgaatcaggctcaccttcagc

SEQ ID NO: 862646 - DNA, 25 bp, Mus musculus
acagtgacaagggacaattcggtgg

SEQ ID NO: 862647 - DNA, 25 bp, Mus musculus
acagtgacaagggacggaaaattga

SEQ ID NO: 862648 - DNA, 25 bp, Mus musculus
acagtgacaagggagaattcggtgg

SEQ ID NO: 862649 - DNA, 25 bp, Mus musculus
acagtgacaagggagggaaaattga

SEQ ID NO: 862650 - DNA, 25 bp, Mus musculus
acagtgacacccttacagttgaaac

SEQ ID NO: 862651 - DNA, 25 bp, Mus musculus
acagtgacaccctttcagttgaaac

SEQ ID NO: 862652 - DNA, 25 bp, Mus musculus
acagtgacagcgcccaatgtaaagg

SEQ ID NO: 862653 - DNA, 25 bp, Mus musculus
acagtgacagctatatctttgcaaa

SEQ ID NO: 862654 - DNA, 25 bp, Mus musculus
acagtgacagggcccaatgtaaagg

SEQ ID NO: 862655 - DNA, 25 bp, Mus musculus
acagtgacaggtatatctttgcaaa

SEQ ID NO: 862656 - DNA, 25 bp, Mus musculus
acagtgaccacgctggaccagctat

SEQ ID NO: 862657 - DNA, 25 bp, Mus musculus
acagtgaccacggtggaccagctat

SEQ ID NO: 862658 - DNA, 25 bp, Mus musculus
acagtgaccccctgccaggacacta

SEQ ID NO: 862659 - DNA, 25 bp, Mus musculus
acagtgaccccctggcaggacacta

SEQ ID NO: 862660 - DNA, 25 bp, Mus musculus
acagtgactgagataacagcctcat

SEQ ID NO: 862661 - DNA, 25 bp, Mus musculus
acagtgactgagttaacagcctcat

SEQ ID NO: 862662 - DNA, 25 bp, Mus musculus
acagtgactgcatccatcagttttc

SEQ ID NO: 862663 - DNA, 25 bp, Mus musculus
acagtgactgcatccggaagatcag

SEQ ID NO: 862664 - DNA, 25 bp, Mus musculus
acagtgactgcatcgatcagttttc

SEQ ID NO: 862665 - DNA, 25 bp, Mus musculus
acagtgactgcatcgggaagatcag

SEQ ID NO: 862666 - DNA, 25 bp, Mus musculus
acagtgagaccacgtgacaaagtca

SEQ ID NO: 862667 - DNA, 25 bp, Mus musculus
acagtgagaccaggtgacaaagtca

SEQ ID NO: 862668 - DNA, 25 bp, Mus musculus
acagtgagggaacagcctcaggaga

SEQ ID NO: 862669 - DNA, 25 bp, Mus musculus
acagtgagggaagagcctcaggaga

SEQ ID NO: 862670 - DNA, 25 bp, Mus musculus
acagtgccagccaggtcggataact

SEQ ID NO: 862671 - DNA, 25 bp, Mus musculus
acagtgccagcgagcccagaggaaa

SEQ ID NO: 862672 - DNA, 25 bp, Mus musculus
acagtgccagctgaggatggttccc

SEQ ID NO: 862673 - DNA, 25 bp, Mus musculus
acagtgccaggcaggtcggataact

SEQ ID NO: 862674 - DNA, 25 bp, Mus musculus
acagtgccagggagcccagaggaaa

SEQ ID NO: 862675 - DNA, 25 bp, Mus musculus
acagtgccaggtgaggatggttccc

SEQ ID NO: 862676 - DNA, 25 bp, Mus musculus
acagtgcccgcccacgttgtcttga

SEQ ID NO: 862677 - DNA, 25 bp, Mus musculus
acagtgcccgcccaggttgtcttga

SEQ ID NO: 862678 - DNA, 25 bp, Mus musculus
acagtgccggtgctgtaagaggaaa

SEQ ID NO: 862679 - DNA, 25 bp, Mus musculus
acagtgccggtggtgtaagaggaaa

SEQ ID NO: 862680 - DNA, 25 bp, Mus musculus
acagtgcctagaaactcggacctgt

SEQ ID NO: 862681 - DNA, 25 bp, Mus musculus
acagtgcctagaaagtcggacctgt

SEQ ID NO: 862682 - DNA, 25 bp, Mus musculus
acagtgcctcagagaccatgatggg

SEQ ID NO: 862683 - DNA, 25 bp, Mus musculus
acagtgcctcagtgaccatgatggg

SEQ ID NO: 862684 - DNA, 25 bp, Mus musculus
acagtgccttcacagtgatccacct

SEQ ID NO: 862685 - DNA, 25 bp, Mus musculus
acagtgccttcacgtgccttggagc

SEQ ID NO: 862686 - DNA, 25 bp, Mus musculus
acagtgccttcagagtgatccacct

SEQ ID NO: 862687 - DNA, 25 bp, Mus musculus
acagtgccttcaggtgccttggagc

SEQ ID NO: 862688 - DNA, 25 bp, Mus musculus
acagtgctctcagaacagtacggac

SEQ ID NO: 862689 - DNA, 25 bp, Mus musculus
acagtgctctgagaacagtacggac

SEQ ID NO: 862690 - DNA, 25 bp, Mus musculus
acagtggaagcttacagtgctccca

SEQ ID NO: 862691 - DNA, 25 bp, Mus musculus
acagtggaaggttacagtgctccca

SEQ ID NO: 862692 - DNA, 25 bp, Mus musculus
acagtggaggtgaacgccaatacat

SEQ ID NO: 862693 - DNA, 25 bp, Mus musculus
acagtggaggtgaaggccaatacat

SEQ ID NO: 862694 - DNA, 25 bp, Mus musculus
acagtggataaaaagatgcccgtgt

SEQ ID NO: 862695 - DNA, 25 bp, Mus musculus
acagtggataaatagatgcccgtgt

SEQ ID NO: 862696 - DNA, 25 bp, Mus musculus
acagtggctgcttggatccttggaa

SEQ ID NO: 862697 - DNA, 25 bp, Mus musculus
acagtggctggaagtctaaacgatt

SEQ ID NO: 862698 - DNA, 25 bp, Mus musculus
acagtggctggatgtctaaacgatt

SEQ ID NO: 862699 - DNA, 25 bp, Mus musculus
acagtggctggttggatccttggaa

SEQ ID NO: 862700 - DNA, 25 bp, Mus musculus
acagtgtaggatacactttgaaaaa

SEQ ID NO: 862701 - DNA, 25 bp, Mus musculus
acagtgtaggttacactttgaaaaa

SEQ ID NO: 862702 - DNA, 25 bp, Mus musculus
acagtgtatttccaaatgcagacca

SEQ ID NO: 862703 - DNA, 25 bp, Mus musculus
acagtgtatttccatatgcagacca

SEQ ID NO: 862704 - DNA, 25 bp, Mus musculus
acagtgtcagatcctgtcagatggc

SEQ ID NO: 862705 - DNA, 25 bp, Mus musculus
acagtgtcagccaaatctcggtgct

SEQ ID NO: 862706 - DNA, 25 bp, Mus musculus
acagtgtcaggcaaatctcggtgct

SEQ ID NO: 862707 - DNA, 25 bp, Mus musculus
acagtgtcagttcctgtcagatggc

SEQ ID NO: 862708 - DNA, 25 bp, Mus musculus
acagtgtcctagcacattgtccttc

SEQ ID NO: 862709 - DNA, 25 bp, Mus musculus
acagtgtcctagcagattgtccttc

SEQ ID NO: 862710 - DNA, 25 bp, Mus musculus
acagtgtgcgaacatgtggatgagt

SEQ ID NO: 862711 - DNA, 25 bp, Mus musculus
acagtgtgcgaagatgtggatgagt

SEQ ID NO: 862712 - DNA, 25 bp, Mus musculus
acagtgttcaagcgtctcttgtggt

SEQ ID NO: 862713 - DNA, 25 bp, Mus musculus
acagtgttcaagggtctcttgtggt

SEQ ID NO: 862714 - DNA, 25 bp, Mus musculus
acagtgtttttgcacaatgtgtgct

SEQ ID NO: 862715 - DNA, 25 bp, Mus musculus
acagtgtttttgcagaatgtgtgct

SEQ ID NO: 862716 - DNA, 25 bp, Mus musculus
acagttaactggcaaggattttcac

SEQ ID NO: 862717 - DNA, 25 bp, Mus musculus
acagttaactggcatggattttcac

SEQ ID NO: 862718 - DNA, 25 bp, Mus musculus
acagttaagtagacttttcacagag

SEQ ID NO: 862719 - DNA, 25 bp, Mus musculus
acagttaagtagtcttttcacagag

SEQ ID NO: 862720 - DNA, 25 bp, Mus musculus
acagttagagaactcgtacctgttg

SEQ ID NO: 862721 - DNA, 25 bp, Mus musculus
acagttagagtactcgtacctgttg

SEQ ID NO: 862722 - DNA, 25 bp, Mus musculus
acagttcatcagaggagaaatgggt

SEQ ID NO: 862723 - DNA, 25 bp, Mus musculus
acagttcatcagtggagaaatgggt

SEQ ID NO: 862724 - DNA, 25 bp, Mus musculus
acagttcatccgcaaaatgacccgc

SEQ ID NO: 862725 - DNA, 25 bp, Mus musculus
acagttcatccggaaaatgacccgc

SEQ ID NO: 862726 - DNA, 25 bp, Mus musculus
acagttccagaagtcatccagactc

SEQ ID NO: 862727 - DNA, 25 bp, Mus musculus
acagttccagaagtgatccagactc

SEQ ID NO: 862728 - DNA, 25 bp, Mus musculus
acagttccagacatctcttaacaag

SEQ ID NO: 862729 - DNA, 25 bp, Mus musculus
acagttccagtcatctcttaacaag

SEQ ID NO: 862730 - DNA, 25 bp, Mus musculus
acagttcggccagacgattactcac

SEQ ID NO: 862731 - DNA, 25 bp, Mus musculus
acagttcggccagaggattactcac

SEQ ID NO: 862732 - DNA, 25 bp, Mus musculus
acagttcgtacacgctttgaaatat

SEQ ID NO: 862733 - DNA, 25 bp, Mus musculus
acagttcgtacaggctttgaaatat

SEQ ID NO: 862734 - DNA, 25 bp, Mus musculus
acagttctgccaccgcctgtgagag

SEQ ID NO: 862735 - DNA, 25 bp, Mus musculus
acagttctgccagcgcctgtgagag

SEQ ID NO: 862736 - DNA, 25 bp, Mus musculus
acagttcttcctaccgagatggctc

SEQ ID NO: 862737 - DNA, 25 bp, Mus musculus
acagttcttcctacggagatggctc

SEQ ID NO: 862738 - DNA, 25 bp, Mus musculus
acagttgcagccatcccacaaagag

SEQ ID NO: 862739 - DNA, 25 bp, Mus musculus
acagttgcaggcatcccacaaagag

SEQ ID NO: 862740 - DNA, 25 bp, Mus musculus
acagttgctgacaacatcctgtggg

SEQ ID NO: 862741 - DNA, 25 bp, Mus musculus
acagttgctgacaagatcctgtggg

SEQ ID NO: 862742 - DNA, 25 bp, Mus musculus
acagttggtacacgatcagtatggc

SEQ ID NO: 862743 - DNA, 25 bp, Mus musculus
acagttggtacaggatcagtatggc

SEQ ID NO: 862744 - DNA, 25 bp, Mus musculus
acagttgttcatctcctgaagggga

SEQ ID NO: 862745 - DNA, 25 bp, Mus musculus
acagttgttcatgtcctgaagggga

SEQ ID NO: 862746 - DNA, 25 bp, Mus musculus
acagttgttgcactctgatactaaa

SEQ ID NO: 862747 - DNA, 25 bp, Mus musculus
acagttgttggactctgatactaaa

SEQ ID NO: 862748 - DNA, 25 bp, Mus musculus
acagtttcagagattctaagctgac

SEQ ID NO: 862749 - DNA, 25 bp, Mus musculus
acagtttcagagtttctaagctgac

SEQ ID NO: 862750 - DNA, 25 bp, Mus musculus
acagtttctcaacggttgagctcca

SEQ ID NO: 862751 - DNA, 25 bp, Mus musculus
acagtttctcaagggttgagctcca

SEQ ID NO: 862752 - DNA, 25 bp, Mus musculus
acagtttgcatacagactcgcttct

SEQ ID NO: 862753 - DNA, 25 bp, Mus musculus
acagtttgcatagagactcgcttct

SEQ ID NO: 862754 - DNA, 25 bp, Mus musculus
acagtttgctgctgcaggtgcctta

SEQ ID NO: 862755 - DNA, 25 bp, Mus musculus
acagtttgctgctggaggtgcctta

SEQ ID NO: 862756 - DNA, 25 bp, Mus musculus
acagtttgctttcgagcatgggatt

SEQ ID NO: 862757 - DNA, 25 bp, Mus musculus
acagtttgctttggagcatgggatt

SEQ ID NO: 862758 - DNA, 25 bp, Mus musculus
acagtttgtattcgcttctcaagga

SEQ ID NO: 862759 - DNA, 25 bp, Mus musculus
acagtttgtattggcttctcaagga

SEQ ID NO: 862760 - DNA, 25 bp, Mus musculus
acagttttaagagacgatttaacag

SEQ ID NO: 862761 - DNA, 25 bp, Mus musculus
acagttttaagagacgtggctttgc

SEQ ID NO: 862762 - DNA, 25 bp, Mus musculus
acagttttaagagaggatttaacag

SEQ ID NO: 862763 - DNA, 25 bp, Mus musculus
acagttttaagagaggtggctttgc

SEQ ID NO: 862764 - DNA, 25 bp, Mus musculus
acataaaaattgcactctatagtct

SEQ ID NO: 862765 - DNA, 25 bp, Mus musculus
acataaaaattggactctatagtct

SEQ ID NO: 862766 - DNA, 25 bp, Mus musculus
acataaagaaaaagcagcgttcctg

SEQ ID NO: 862767 - DNA, 25 bp, Mus musculus
acataaagaaaatgcagcgttcctg

SEQ ID NO: 862768 - DNA, 25 bp, Mus musculus
acataaagaagccaccccctctttg

SEQ ID NO: 862769 - DNA, 25 bp, Mus musculus
acataaagaagccagcccctctttg

SEQ ID NO: 862770 - DNA, 25 bp, Mus musculus
acataaatctcaacctgctgaaaga

SEQ ID NO: 862771 - DNA, 25 bp, Mus musculus
acataaatctcaacgtgctgaaaga

SEQ ID NO: 862772 - DNA, 25 bp, Mus musculus
acataacgagcctgagctcggggcc

SEQ ID NO: 862773 - DNA, 25 bp, Mus musculus
acataacgaggctgagctcggggcc

SEQ ID NO: 862774 - DNA, 25 bp, Mus musculus
acataactccagcactgtcaccgtg

SEQ ID NO: 862775 - DNA, 25 bp, Mus musculus
acataactccaggactgtcaccgtg

SEQ ID NO: 862776 - DNA, 25 bp, Mus musculus
acataacttaaacgctaatggaggc

SEQ ID NO: 862777 - DNA, 25 bp, Mus musculus
acataacttaaaggctaatggaggc

SEQ ID NO: 862778 - DNA, 25 bp, Mus musculus
acataaggacattacattgatcagg

SEQ ID NO: 862779 - DNA, 25 bp, Mus musculus
acataaggacattagattgatcagg

SEQ ID NO: 862780 - DNA, 25 bp, Mus musculus
acataattgaagcactgaaagcgtc

SEQ ID NO: 862781 - DNA, 25 bp, Mus musculus
acataattgaaggactgaaagcgtc

SEQ ID NO: 862782 - DNA, 25 bp, Mus musculus
acatacaagactcgtaccagcaaac

SEQ ID NO: 862783 - DNA, 25 bp, Mus musculus
acatacaagactggtaccagcaaac

SEQ ID NO: 862784 - DNA, 25 bp, Mus musculus
acatacaagagacgtgactacgggg

SEQ ID NO: 862785 - DNA, 25 bp, Mus musculus
acatacaagagaggtgactacgggg

SEQ ID NO: 862786 - DNA, 25 bp, Mus musculus
acatacagccagagaagtgacaggg

SEQ ID NO: 862787 - DNA, 25 bp, Mus musculus
acatacagccagcaaacaaagctta

SEQ ID NO: 862788 - DNA, 25 bp, Mus musculus
acatacagccagcaaggaatctgct

SEQ ID NO: 862789 - DNA, 25 bp, Mus musculus
acatacagccaggaaacaaagctta

SEQ ID NO: 862790 - DNA, 25 bp, Mus musculus
acatacagccaggaaggaatctgct

SEQ ID NO: 862791 - DNA, 25 bp, Mus musculus
acatacagccagtgaagtgacaggg

SEQ ID NO: 862792 - DNA, 25 bp, Mus musculus
acatacagtcctaactgtgacttgg

SEQ ID NO: 862793 - DNA, 25 bp, Mus musculus
acatacagtcctaagtgtgacttgg

SEQ ID NO: 862794 - DNA, 25 bp, Mus musculus
acataccaacagctccaacagactc

SEQ ID NO: 862795 - DNA, 25 bp, Mus musculus
acataccaacaggtccaacagactc

SEQ ID NO: 862796 - DNA, 25 bp, Mus musculus
acataccagcagcaatatggaagga

SEQ ID NO: 862797 - DNA, 25 bp, Mus musculus
acataccagcaggaatatggaagga

SEQ ID NO: 862798 - DNA, 25 bp, Mus musculus
acatacccagcaatatcagttgtaa

SEQ ID NO: 862799 - DNA, 25 bp, Mus musculus
acatacccagcatcaaaaccctatc

SEQ ID NO: 862800 - DNA, 25 bp, Mus musculus
acatacccagcattatcagttgtaa

SEQ ID NO: 862801 - DNA, 25 bp, Mus musculus
acatacccagcttgctgccttgatc

SEQ ID NO: 862802 - DNA, 25 bp, Mus musculus
acatacccaggatcaaaaccctatc

SEQ ID NO: 862803 - DNA, 25 bp, Mus musculus
acatacccaggttgctgccttgatc

SEQ ID NO: 862804 - DNA, 25 bp, Mus musculus
acataccctaagaaggagtggaaga

SEQ ID NO: 862805 - DNA, 25 bp, Mus musculus
acataccctaagcagggagtggaga

SEQ ID NO: 862806 - DNA, 25 bp, Mus musculus
acataccctaagcagtggaagactc

SEQ ID NO: 862807 - DNA, 25 bp, Mus musculus
acataccctaagcgagtggagagag

SEQ ID NO: 862808 - DNA, 25 bp, Mus musculus
acataccctaaggagggagtggaga

SEQ ID NO: 862809 - DNA, 25 bp, Mus musculus
acataccctaaggagtggaagactc

SEQ ID NO: 862810 - DNA, 25 bp, Mus musculus
acataccctaagggagtggagagag

SEQ ID NO: 862811 - DNA, 25 bp, Mus musculus
acataccctaagtaggagtggaaga

SEQ ID NO: 862812 - DNA, 25 bp, Mus musculus
acatacctcgccggaggacatcaac

SEQ ID NO: 862813 - DNA, 25 bp, Mus musculus
acatacctcggcggaggacatcaac

SEQ ID NO: 862814 - DNA, 25 bp, Mus musculus
acatacgatgaggactaccaggagc

SEQ ID NO: 862815 - DNA, 25 bp, Mus musculus
acatacgatgtggactaccaggagc

SEQ ID NO: 862816 - DNA, 25 bp, Mus musculus
acatactccgccaacctggataatg

SEQ ID NO: 862817 - DNA, 25 bp, Mus musculus
acatactccgccaagctggataatg

SEQ ID NO: 862818 - DNA, 25 bp, Mus musculus
acatactgggctgagcatgccaact

SEQ ID NO: 862819 - DNA, 25 bp, Mus musculus
acatactggggtgagcatgccaact

SEQ ID NO: 862820 - DNA, 25 bp, Mus musculus
acatagaccagccctcctccagaca

SEQ ID NO: 862821 - DNA, 25 bp, Mus musculus
acatagaccagcgctcctccagaca

SEQ ID NO: 862822 - DNA, 25 bp, Mus musculus
acatagatgcccccatgtacatgga

SEQ ID NO: 862823 - DNA, 25 bp, Mus musculus
acatagatgcccgcatgtacatgga

SEQ ID NO: 862824 - DNA, 25 bp, Mus musculus
acatagatggcgaccgaatacgaaa

SEQ ID NO: 862825 - DNA, 25 bp, Mus musculus
acatagatggcgacggaatacgaaa

SEQ ID NO: 862826 - DNA, 25 bp, Mus musculus
acatagcctgctcggtccaccataa

SEQ ID NO: 862827 - DNA, 25 bp, Mus musculus
acatagcctgctgggtccaccataa

SEQ ID NO: 862828 - DNA, 25 bp, Mus musculus
acatagctccacatcaactcacaga

SEQ ID NO: 862829 - DNA, 25 bp, Mus musculus
acatagctccacatcacattctctg

SEQ ID NO: 862830 - DNA, 25 bp, Mus musculus
acatagctccacatcccatttacca

SEQ ID NO: 862831 - DNA, 25 bp, Mus musculus
acatagctccacatgaactcacaga

SEQ ID NO: 862832 - DNA, 25 bp, Mus musculus
acatagctccacatgacattctctg

SEQ ID NO: 862833 - DNA, 25 bp, Mus musculus
acatagctccacatgccatttacca

SEQ ID NO: 862834 - DNA, 25 bp, Mus musculus
acataggaagatcaccagcaaaagt

SEQ ID NO: 862835 - DNA, 25 bp, Mus musculus
acataggaagttcaccagcaaaagt

SEQ ID NO: 862836 - DNA, 25 bp, Mus musculus
acataggtcaggcctgtgtctcgtg

SEQ ID NO: 862837 - DNA, 25 bp, Mus musculus
acataggtcagggctgtgtctcgtg

SEQ ID NO: 862838 - DNA, 25 bp, Mus musculus
acatagtgaacaaacctgaactctc

SEQ ID NO: 862839 - DNA, 25 bp, Mus musculus
acatagtgaacaaagctgaactctc

SEQ ID NO: 862840 - DNA, 25 bp, Mus musculus
acatataaactcaacccaggaacca

SEQ ID NO: 862841 - DNA, 25 bp, Mus musculus
acatataaactcaacggctcgggcc

SEQ ID NO: 862842 - DNA, 25 bp, Mus musculus
acatataaactcaagccaggaacca

SEQ ID NO: 862843 - DNA, 25 bp, Mus musculus
acatataaactcaagggctcgggcc

SEQ ID NO: 862844 - DNA, 25 bp, Mus musculus
acatatagagcactaccaaatatgc

SEQ ID NO: 862845 - DNA, 25 bp, Mus musculus
acatatagagcagtaccaaatatgc

SEQ ID NO: 862846 - DNA, 25 bp, Mus musculus
acatatagctcacgtacagctgaca

SEQ ID NO: 862847 - DNA, 25 bp, Mus musculus
acatatagctcaggtacagctgaca

SEQ ID NO: 862848 - DNA, 25 bp, Mus musculus
acatatcaagcccagcaccaaagta

SEQ ID NO: 862849 - DNA, 25 bp, Mus musculus
acatatcaaggccagcaccaaagta

SEQ ID NO: 862850 - DNA, 25 bp, Mus musculus
acatatccaaagcgctacaaacctc

SEQ ID NO: 862851 - DNA, 25 bp, Mus musculus
acatatccaaagggctacaaacctc

SEQ ID NO: 862852 - DNA, 25 bp, Mus musculus
acatatctccagaatcctaaggact

SEQ ID NO: 862853 - DNA, 25 bp, Mus musculus
acatatctccagtatcctaaggact

SEQ ID NO: 862854 - DNA, 25 bp, Mus musculus
acatatgaggagatgctgaaccgag

SEQ ID NO: 862855 - DNA, 25 bp, Mus musculus
acatatgaggagttgctgaaccgag

SEQ ID NO: 862856 - DNA, 25 bp, Mus musculus
acatatgagtcgaacaccaaacagc

SEQ ID NO: 862857 - DNA, 25 bp, Mus musculus
acatatgagtggaacaccaaacagc

SEQ ID NO: 862858 - DNA, 25 bp, Mus musculus
acatatgcagacatcaagccctaca

SEQ ID NO: 862859 - DNA, 25 bp, Mus musculus
acatatgcagcaatctccacacaaa

SEQ ID NO: 862860 - DNA, 25 bp, Mus musculus
acatatgcaggaatctccacacaaa

SEQ ID NO: 862861 - DNA, 25 bp, Mus musculus
acatatgcagtcatcaagccctaca

SEQ ID NO: 862862 - DNA, 25 bp, Mus musculus
acatatggagcctgtgaagacacag

SEQ ID NO: 862863 - DNA, 25 bp, Mus musculus
acatatggaggctgtgaagacacag

SEQ ID NO: 862864 - DNA, 25 bp, Mus musculus
acatatggtaacagccttacagaat

SEQ ID NO: 862865 - DNA, 25 bp, Mus musculus
acatatggtaactgccttacagaat

SEQ ID NO: 862866 - DNA, 25 bp, Mus musculus
acatattcaagcaaccatttaagaa

SEQ ID NO: 862867 - DNA, 25 bp, Mus musculus
acatattcaagcaagcatttaagaa

SEQ ID NO: 862868 - DNA, 25 bp, Mus musculus
acatatttagcccgtatacagcgtt

SEQ ID NO: 862869 - DNA, 25 bp, Mus musculus
acatatttaggccgtatacagcgtt

SEQ ID NO: 862870 - DNA, 25 bp, Mus musculus
acatatttctttcacggcttcacat

SEQ ID NO: 862871 - DNA, 25 bp, Mus musculus
acatatttctttcagggcttcacat

SEQ ID NO: 862872 - DNA, 25 bp, Mus musculus
acatcaaaagaggaattcctaatta

SEQ ID NO: 862873 - DNA, 25 bp, Mus musculus
acatcaaaagtggaattcctaatta

SEQ ID NO: 862874 - DNA, 25 bp, Mus musculus
acatcaaactatcacgtactctatc

SEQ ID NO: 862875 - DNA, 25 bp, Mus musculus
acatcaaactatcaggtactctatc

SEQ ID NO: 862876 - DNA, 25 bp, Mus musculus
acatcaaccgaccagtacttggacc

SEQ ID NO: 862877 - DNA, 25 bp, Mus musculus
acatcaaccgacgagtacttggacc

SEQ ID NO: 862878 - DNA, 25 bp, Mus musculus
acatcaagaaggcgtaccgaaagaa

SEQ ID NO: 862879 - DNA, 25 bp, Mus musculus
acatcaagaaggggtaccgaaagaa

SEQ ID NO: 862880 - DNA, 25 bp, Mus musculus
acatcaaggacgcacgcatgtttgc

SEQ ID NO: 862881 - DNA, 25 bp, Mus musculus
acatcaaggacgcaggcatgtttgc

SEQ ID NO: 862882 - DNA, 25 bp, Mus musculus
acatcaagtttcagccctaccactg

SEQ ID NO: 862883 - DNA, 25 bp, Mus musculus
acatcaagtttctgccctaccactg

SEQ ID NO: 862884 - DNA, 25 bp, Mus musculus
acatcaattgccagagcccggcggg

SEQ ID NO: 862885 - DNA, 25 bp, Mus musculus
acatcaattgcctgagcccggcggg

SEQ ID NO: 862886 - DNA, 25 bp, Mus musculus
acatcacaagctactacctgtgcct

SEQ ID NO: 862887 - DNA, 25 bp, Mus musculus
acatcacaaggtactacctgtgcct

SEQ ID NO: 862888 - DNA, 25 bp, Mus musculus
acatcacagcagctgcaggcttagg

SEQ ID NO: 862889 - DNA, 25 bp, Mus musculus
acatcacagcaggtgcaggcttagg

SEQ ID NO: 862890 - DNA, 25 bp, Mus musculus
acatcacatactcgatccaaaacta

SEQ ID NO: 862891 - DNA, 25 bp, Mus musculus
acatcacatactggatccaaaacta

SEQ ID NO: 862892 - DNA, 25 bp, Mus musculus
acatcacattggcgtcttctgggac

SEQ ID NO: 862893 - DNA, 25 bp, Mus musculus
acatcacattggggtcttctgggac

SEQ ID NO: 862894 - DNA, 25 bp, Mus musculus
acatcaccagccgagaaacctgcaa

SEQ ID NO: 862895 - DNA, 25 bp, Mus musculus
acatcaccaggcgagaaacctgcaa

SEQ ID NO: 862896 - DNA, 25 bp, Mus musculus
acatcacccttgcgcatccactaaa

SEQ ID NO: 862897 - DNA, 25 bp, Mus musculus
acatcacccttgggcatccactaaa

SEQ ID NO: 862898 - DNA, 25 bp, Mus musculus
acatcacggaaaatctcattgcaaa

SEQ ID NO: 862899 - DNA, 25 bp, Mus musculus
acatcacggaaattctcattgcaaa

SEQ ID NO: 862900 - DNA, 25 bp, Mus musculus
acatcagaagcacgagctatctgga

SEQ ID NO: 862901 - DNA, 25 bp, Mus musculus
acatcagaagcaggagctatctgga

SEQ ID NO: 862902 - DNA, 25 bp, Mus musculus
acatcagcagagcctgcagaagcca

SEQ ID NO: 862903 - DNA, 25 bp, Mus musculus
acatcagcagcaacgtcatccatgc

SEQ ID NO: 862904 - DNA, 25 bp, Mus musculus
acatcagcaggaacgtcatccatgc

SEQ ID NO: 862905 - DNA, 25 bp, Mus musculus
acatcagcagtgcctgcagaagcca

SEQ ID NO: 862906 - DNA, 25 bp, Mus musculus
acatcagctcctacgtgcggctctg

SEQ ID NO: 862907 - DNA, 25 bp, Mus musculus
acatcagctcgtacgtgcggctctg

SEQ ID NO: 862908 - DNA, 25 bp, Mus musculus
acatcatatggagacacgtgtcctg

SEQ ID NO: 862909 - DNA, 25 bp, Mus musculus
acatcatatggagactatgctatta

SEQ ID NO: 862910 - DNA, 25 bp, Mus musculus
acatcatatggagagacgtgtcctg

SEQ ID NO: 862911 - DNA, 25 bp, Mus musculus
acatcatatggagagtatgctatta

SEQ ID NO: 862912 - DNA, 25 bp, Mus musculus
acatcatctacacagacctgaagcc

SEQ ID NO: 862913 - DNA, 25 bp, Mus musculus
acatcatctacagagacctgaagcc

SEQ ID NO: 862914 - DNA, 25 bp, Mus musculus
acatcatctttgaggacagtgcggc

SEQ ID NO: 862915 - DNA, 25 bp, Mus musculus
acatcatctttgtggacagtgcggc

SEQ ID NO: 862916 - DNA, 25 bp, Mus musculus
acatcatgagagtgatctccatcaa

SEQ ID NO: 862917 - DNA, 25 bp, Mus musculus
acatcatgagtgtgatctccatcaa

SEQ ID NO: 862918 - DNA, 25 bp, Mus musculus
acatcatgtttgctccggacatctg

SEQ ID NO: 862919 - DNA, 25 bp, Mus musculus
acatcatgtttggtccggacatctg

SEQ ID NO: 862920 - DNA, 25 bp, Mus musculus
acatcattctgacggatggcctgga

SEQ ID NO: 862921 - DNA, 25 bp, Mus musculus
acatcattctgagggatggcctgga

SEQ ID NO: 862922 - DNA, 25 bp, Mus musculus
acatccaaaggcaaagttggttcta

SEQ ID NO: 862923 - DNA, 25 bp, Mus musculus
acatccaaaggcaatgttggttcta

SEQ ID NO: 862924 - DNA, 25 bp, Mus musculus
acatccagcgattcatagaaacccc

SEQ ID NO: 862925 - DNA, 25 bp, Mus musculus
acatccagcgtttcatagaaacccc

SEQ ID NO: 862926 - DNA, 25 bp, Mus musculus
acatccagctagattacaaaaacaa

SEQ ID NO: 862927 - DNA, 25 bp, Mus musculus
acatccagctagtttacaaaaacaa

SEQ ID NO: 862928 - DNA, 25 bp, Mus musculus
acatccaggaccaacacgtcttgtt

SEQ ID NO: 862929 - DNA, 25 bp, Mus musculus
acatccaggaccaagacgtcttgtt

SEQ ID NO: 862930 - DNA, 25 bp, Mus musculus
acatccaggaggctcgtggcattat

SEQ ID NO: 862931 - DNA, 25 bp, Mus musculus
acatccaggaggctggtggcattat

SEQ ID NO: 862932 - DNA, 25 bp, Mus musculus
acatccagttattgcagtccatgtc

SEQ ID NO: 862933 - DNA, 25 bp, Mus musculus
acatccagttattggagtccatgtc

SEQ ID NO: 862934 - DNA, 25 bp, Mus musculus
acatccatccgccaggaaatctcag

SEQ ID NO: 862935 - DNA, 25 bp, Mus musculus
acatccatccgcgaggaaatctcag

SEQ ID NO: 862936 - DNA, 25 bp, Mus musculus
acatccatctctaggacgacgacga

SEQ ID NO: 862937 - DNA, 25 bp, Mus musculus
acatccatctcttggacgacgacga

SEQ ID NO: 862938 - DNA, 25 bp, Mus musculus
acatccattcaacgcctacttggat

SEQ ID NO: 862939 - DNA, 25 bp, Mus musculus
acatccattcaaggcctacttggat

SEQ ID NO: 862940 - DNA, 25 bp, Mus musculus
acatcccaagctcgagacatcaacc

SEQ ID NO: 862941 - DNA, 25 bp, Mus musculus
acatcccaaggtcgagacatcaacc

SEQ ID NO: 862942 - DNA, 25 bp, Mus musculus
acatccccaactacgatgacctgag

SEQ ID NO: 862943 - DNA, 25 bp, Mus musculus
acatccccaacttcgatgacctgag

SEQ ID NO: 862944 - DNA, 25 bp, Mus musculus
acatccccagaggtataataggaga

SEQ ID NO: 862945 - DNA, 25 bp, Mus musculus
acatccccagtggtataataggaga

SEQ ID NO: 862946 - DNA, 25 bp, Mus musculus
acatccctctggagaattccaaggc

SEQ ID NO: 862947 - DNA, 25 bp, Mus musculus
acatccctctggatcggttaagcat

SEQ ID NO: 862948 - DNA, 25 bp, Mus musculus
acatccctctggtgaattccaaggc

SEQ ID NO: 862949 - DNA, 25 bp, Mus musculus
acatccctctggttcggttaagcat

SEQ ID NO: 862950 - DNA, 25 bp, Mus musculus
acatccggacagccagcgatgggga

SEQ ID NO: 862951 - DNA, 25 bp, Mus musculus
acatccggacagcctgacgatgctc

SEQ ID NO: 862952 - DNA, 25 bp, Mus musculus
acatccggacaggcagcgatgggga

SEQ ID NO: 862953 - DNA, 25 bp, Mus musculus
acatccggacaggctgacgatgctc

SEQ ID NO: 862954 - DNA, 25 bp, Mus musculus
acatccgtggctccattgtctacct

SEQ ID NO: 862955 - DNA, 25 bp, Mus musculus
acatccgtgggtccattgtctacct

SEQ ID NO: 862956 - DNA, 25 bp, Mus musculus
acatcctataacccagtttatggag

SEQ ID NO: 862957 - DNA, 25 bp, Mus musculus
acatcctatatcccagtttatggag

SEQ ID NO: 862958 - DNA, 25 bp, Mus musculus
acatcctcaaagcatacaacttctc

SEQ ID NO: 862959 - DNA, 25 bp, Mus musculus
acatcctcaaagcgacccctgaaca

SEQ ID NO: 862960 - DNA, 25 bp, Mus musculus
acatcctcaaaggatacaacttctc

SEQ ID NO: 862961 - DNA, 25 bp, Mus musculus
acatcctcaaagggacccctgaaca

SEQ ID NO: 862962 - DNA, 25 bp, Mus musculus
acatcctcgttatccgaatgaccaa

SEQ ID NO: 862963 - DNA, 25 bp, Mus musculus
acatcctcgttatcggaatgaccaa

SEQ ID NO: 862964 - DNA, 25 bp, Mus musculus
acatcctgatcacacgacagctccc

SEQ ID NO: 862965 - DNA, 25 bp, Mus musculus
acatcctgatcacaggacagctccc

SEQ ID NO: 862966 - DNA, 25 bp, Mus musculus
acatcctgccctatgatcataccag

SEQ ID NO: 862967 - DNA, 25 bp, Mus musculus
acatcctgccctttgatcataccag

SEQ ID NO: 862968 - DNA, 25 bp, Mus musculus
acatcctgtgcgtgcgggagacagg

SEQ ID NO: 862969 - DNA, 25 bp, Mus musculus
acatcctgtgcgtgggggagacagg

SEQ ID NO: 862970 - DNA, 25 bp, Mus musculus
acatccttcaagaaaccctgaagct

SEQ ID NO: 862971 - DNA, 25 bp, Mus musculus
acatccttcaagtaaccctgaagct

SEQ ID NO: 862972 - DNA, 25 bp, Mus musculus
acatcctttgtgaatttaagcaatg

SEQ ID NO: 862973 - DNA, 25 bp, Mus musculus
acatcctttgtgtatttaagcaatg

SEQ ID NO: 862974 - DNA, 25 bp, Mus musculus
acatcgactacgagagagatcctgc

SEQ ID NO: 862975 - DNA, 25 bp, Mus musculus
acatcgactacgtgagagatcctgc

SEQ ID NO: 862976 - DNA, 25 bp, Mus musculus
acatcgagaagccacgagaaactac

SEQ ID NO: 862977 - DNA, 25 bp, Mus musculus
acatcgagaagccacgtggtgacca

SEQ ID NO: 862978 - DNA, 25 bp, Mus musculus
acatcgagaagccaggagaaactac

SEQ ID NO: 862979 - DNA, 25 bp, Mus musculus
acatcgagaagccaggtggtgacca

SEQ ID NO: 862980 - DNA, 25 bp, Mus musculus
acatcgagagtgaccctacctacaa

SEQ ID NO: 862981 - DNA, 25 bp, Mus musculus
acatcgagagtgtccctacctacaa

SEQ ID NO: 862982 - DNA, 25 bp, Mus musculus
acatcgatggagatcgaatcctcaa

SEQ ID NO: 862983 - DNA, 25 bp, Mus musculus
acatcgatggagatggaatcctcaa

SEQ ID NO: 862984 - DNA, 25 bp, Mus musculus
acatcgctgatgcttgcatctatga

SEQ ID NO: 862985 - DNA, 25 bp, Mus musculus
acatcgctgatggttgcatctatga

SEQ ID NO: 862986 - DNA, 25 bp, Mus musculus
acatcgctttcaacagtatggtctt

SEQ ID NO: 862987 - DNA, 25 bp, Mus musculus
acatcgctttcaactgtatggtctt

SEQ ID NO: 862988 - DNA, 25 bp, Mus musculus
acatcggtacagaggcaggacagct

SEQ ID NO: 862989 - DNA, 25 bp, Mus musculus
acatcggtacagcacagctttgcaa

SEQ ID NO: 862990 - DNA, 25 bp, Mus musculus
acatcggtacaggacagctttgcaa

SEQ ID NO: 862991 - DNA, 25 bp, Mus musculus
acatcggtacagtggcaggacagct

SEQ ID NO: 862992 - DNA, 25 bp, Mus musculus
acatcggtgtctcgcccttctgggc

SEQ ID NO: 862993 - DNA, 25 bp, Mus musculus
acatcggtgtctcggccttctgggc

SEQ ID NO: 862994 - DNA, 25 bp, Mus musculus
acatcggttctggccctccggcact

SEQ ID NO: 862995 - DNA, 25 bp, Mus musculus
acatcggttctggccggattcctct

SEQ ID NO: 862996 - DNA, 25 bp, Mus musculus
acatcggttctggcgctccggcact

SEQ ID NO: 862997 - DNA, 25 bp, Mus musculus
acatcggttctggcgggattcctct

SEQ ID NO: 862998 - DNA, 25 bp, Mus musculus
acatcgtgtccgcccctccaaccca

SEQ ID NO: 862999 - DNA, 25 bp, Mus musculus
acatcgtgtccggccctccaaccca

SEQ ID NO: 863000 - DNA, 25 bp, Mus musculus
acatctacagatatttacagagtat

SEQ ID NO: 863001 - DNA, 25 bp, Mus musculus
acatctacagttatttacagagtat

SEQ ID NO: 863002 - DNA, 25 bp, Mus musculus
acatctagaatattaattcatagaa

SEQ ID NO: 863003 - DNA, 25 bp, Mus musculus
acatctagaatatttattcatagaa

SEQ ID NO: 863004 - DNA, 25 bp, Mus musculus
acatctcaaagcagcgtcagatctg

SEQ ID NO: 863005 - DNA, 25 bp, Mus musculus
acatctcaaagctgcgtcagatctg

SEQ ID NO: 863006 - DNA, 25 bp, Mus musculus
acatctccacttcccgcctggaggt

SEQ ID NO: 863007 - DNA, 25 bp, Mus musculus
acatctccacttccggcctggaggt

SEQ ID NO: 863008 - DNA, 25 bp, Mus musculus
acatctccagatgaagtcctgcaga

SEQ ID NO: 863009 - DNA, 25 bp, Mus musculus
acatctccagcgaagaggtgaatga

SEQ ID NO: 863010 - DNA, 25 bp, Mus musculus
acatctccagggaagaggtgaatga

SEQ ID NO: 863011 - DNA, 25 bp, Mus musculus
acatctccagttgaagtcctgcaga

SEQ ID NO: 863012 - DNA, 25 bp, Mus musculus
acatctccgtggccaatgtgcttca

SEQ ID NO: 863013 - DNA, 25 bp, Mus musculus
acatctccgtgggcaatgtgcttca

SEQ ID NO: 863014 - DNA, 25 bp, Mus musculus
acatctctagccctgaggctgtcca

SEQ ID NO: 863015 - DNA, 25 bp, Mus musculus
acatctctaggcctgaggctgtcca

SEQ ID NO: 863016 - DNA, 25 bp, Mus musculus
acatctctgaagtggaaggggagta

SEQ ID NO: 863017 - DNA, 25 bp, Mus musculus
acatctctgatgtggaaggggagta

SEQ ID NO: 863018 - DNA, 25 bp, Mus musculus
acatctctgtgatccagaatggcta

SEQ ID NO: 863019 - DNA, 25 bp, Mus musculus
acatctctgtgatcgagaatggcta

SEQ ID NO: 863020 - DNA, 25 bp, Mus musculus
acatctctgtggaacagacctctgc

SEQ ID NO: 863021 - DNA, 25 bp, Mus musculus
acatctctgtggaagagacctctgc

SEQ ID NO: 863022 - DNA, 25 bp, Mus musculus
acatctgatgcaacctgtaccatca

SEQ ID NO: 863023 - DNA, 25 bp, Mus musculus
acatctgatgctctatctccacgag

SEQ ID NO: 863024 - DNA, 25 bp, Mus musculus
acatctgatggaacctgtaccatca

SEQ ID NO: 863025 - DNA, 25 bp, Mus musculus
acatctgatggggacgtgtttgcct

SEQ ID NO: 863026 - DNA, 25 bp, Mus musculus
acatctgatggggaggtgtttgcct

SEQ ID NO: 863027 - DNA, 25 bp, Mus musculus
acatctgatggtctatctccacgag

SEQ ID NO: 863028 - DNA, 25 bp, Mus musculus
acatctggcacacaagctgattggc

SEQ ID NO: 863029 - DNA, 25 bp, Mus musculus
acatctggcacagaagctgattggc

SEQ ID NO: 863030 - DNA, 25 bp, Mus musculus
acatctgggattcactcattaggat

SEQ ID NO: 863031 - DNA, 25 bp, Mus musculus
acatctgggattcagtcattaggat

SEQ ID NO: 863032 - DNA, 25 bp, Mus musculus
acatctgtagcatagcccagaggca

SEQ ID NO: 863033 - DNA, 25 bp, Mus musculus
acatctgtagcatatatccggtcga

SEQ ID NO: 863034 - DNA, 25 bp, Mus musculus
acatctgtaggatagcccagaggca

SEQ ID NO: 863035 - DNA, 25 bp, Mus musculus
acatctgtaggatatatccggtcga

SEQ ID NO: 863036 - DNA, 25 bp, Mus musculus
acatctgttgcactcgccatcatca

SEQ ID NO: 863037 - DNA, 25 bp, Mus musculus
acatctgttgcactggccatcatca

SEQ ID NO: 863038 - DNA, 25 bp, Mus musculus
acatcttaaaaacacgtgtcctgga

SEQ ID NO: 863039 - DNA, 25 bp, Mus musculus
acatcttaaaaacaggtgtcctgga

SEQ ID NO: 863040 - DNA, 25 bp, Mus musculus
acatcttaagactgccctgctgcaa

SEQ ID NO: 863041 - DNA, 25 bp, Mus musculus
acatcttaagactggcctgctgcaa

SEQ ID NO: 863042 - DNA, 25 bp, Mus musculus
acatcttattccatagtagtgggca

SEQ ID NO: 863043 - DNA, 25 bp, Mus musculus
acatcttattccattgtagtgggca

SEQ ID NO: 863044 - DNA, 25 bp, Mus musculus
acatcttcaacccgatctccctgac

SEQ ID NO: 863045 - DNA, 25 bp, Mus musculus
acatcttcaaccggatctccctgac

SEQ ID NO: 863046 - DNA, 25 bp, Mus musculus
acatcttcaccacgtccagctagct

SEQ ID NO: 863047 - DNA, 25 bp, Mus musculus
acatcttcaccactctaaatccagt

SEQ ID NO: 863048 - DNA, 25 bp, Mus musculus
acatcttcaccaggtccagctagct

SEQ ID NO: 863049 - DNA, 25 bp, Mus musculus
acatcttcaccagtctaaatccagt

SEQ ID NO: 863050 - DNA, 25 bp, Mus musculus
acatcttcagagacaataaaatcgc

SEQ ID NO: 863051 - DNA, 25 bp, Mus musculus
acatcttcagagtcaataaaatcgc

SEQ ID NO: 863052 - DNA, 25 bp, Mus musculus
acatcttgagatcttcaactttctt

SEQ ID NO: 863053 - DNA, 25 bp, Mus musculus
acatcttgagttcttcaactttctt

SEQ ID NO: 863054 - DNA, 25 bp, Mus musculus
acatctttcattaatctttcctgca

SEQ ID NO: 863055 - DNA, 25 bp, Mus musculus
acatctttcatttatctttcctgca

SEQ ID NO: 863056 - DNA, 25 bp, Mus musculus
acatgaaaagcttgtggcagagaga

SEQ ID NO: 863057 - DNA, 25 bp, Mus musculus
acatgaaaaggttgtggcagagaga

SEQ ID NO: 863058 - DNA, 25 bp, Mus musculus
acatgaaatccaacaatatatttct

SEQ ID NO: 863059 - DNA, 25 bp, Mus musculus
acatgaaatccaactatatatttct

SEQ ID NO: 863060 - DNA, 25 bp, Mus musculus
acatgaaccctgaacggagcctctg

SEQ ID NO: 863061 - DNA, 25 bp, Mus musculus
acatgaaccctgaagggagcctctg

SEQ ID NO: 863062 - DNA, 25 bp, Mus musculus
acatgaactgcattcagatgggcgg

SEQ ID NO: 863063 - DNA, 25 bp, Mus musculus
acatgaactgcattgagatgggcgg

SEQ ID NO: 863064 - DNA, 25 bp, Mus musculus
acatgaactgttcgcccttgattgt

SEQ ID NO: 863065 - DNA, 25 bp, Mus musculus
acatgaactgttggcccttgattgt

SEQ ID NO: 863066 - DNA, 25 bp, Mus musculus
acatgaagagcctgtgaggaaacaa

SEQ ID NO: 863067 - DNA, 25 bp, Mus musculus
acatgaagaggctgtgaggaaacaa

SEQ ID NO: 863068 - DNA, 25 bp, Mus musculus
acatgaatacacaattgccaacact

SEQ ID NO: 863069 - DNA, 25 bp, Mus musculus
acatgaatacactattgccaacact

SEQ ID NO: 863070 - DNA, 25 bp, Mus musculus
acatgaccagtgacgttaggagagg

SEQ ID NO: 863071 - DNA, 25 bp, Mus musculus
acatgaccagtgatcggcgccagtg

SEQ ID NO: 863072 - DNA, 25 bp, Mus musculus
acatgaccagtgtcgttaggagagg

SEQ ID NO: 863073 - DNA, 25 bp, Mus musculus
acatgaccagtgttcggcgccagtg

SEQ ID NO: 863074 - DNA, 25 bp, Mus musculus
acatgacctctaaataaactgaagt

SEQ ID NO: 863075 - DNA, 25 bp, Mus musculus
acatgacctctatataaactgaagt

SEQ ID NO: 863076 - DNA, 25 bp, Mus musculus
acatgactgccaagattcatgaata

SEQ ID NO: 863077 - DNA, 25 bp, Mus musculus
acatgactgccatgattcatgaata

SEQ ID NO: 863078 - DNA, 25 bp, Mus musculus
acatgagcaaagcaagtttgcttga

SEQ ID NO: 863079 - DNA, 25 bp, Mus musculus
acatgagcaaaggaagtttgcttga

SEQ ID NO: 863080 - DNA, 25 bp, Mus musculus
acatgaggaggtcgttcaggttctt

SEQ ID NO: 863081 - DNA, 25 bp, Mus musculus
acatgaggaggtggttcaggttctt

SEQ ID NO: 863082 - DNA, 25 bp, Mus musculus
acatgatgtatacaccttcgccatt

SEQ ID NO: 863083 - DNA, 25 bp, Mus musculus
acatgatgtatacagcttcgccatt

SEQ ID NO: 863084 - DNA, 25 bp, Mus musculus
acatgatgtcagcaaaccacacgcc

SEQ ID NO: 863085 - DNA, 25 bp, Mus musculus
acatgatgtcagcgtcaatactatc

SEQ ID NO: 863086 - DNA, 25 bp, Mus musculus
acatgatgtcaggaaaccacacgcc

SEQ ID NO: 863087 - DNA, 25 bp, Mus musculus
acatgatgtcagggtcaatactatc

SEQ ID NO: 863088 - DNA, 25 bp, Mus musculus
acatgatttttcaataccgttattg

SEQ ID NO: 863089 - DNA, 25 bp, Mus musculus
acatgatttttctataccgttattg

SEQ ID NO: 863090 - DNA, 25 bp, Mus musculus
acatgcaaagacatcaacgagtgct

SEQ ID NO: 863091 - DNA, 25 bp, Mus musculus
acatgcaaagtcatcaacgagtgct

SEQ ID NO: 863092 - DNA, 25 bp, Mus musculus
acatgcaatacttagctgccactgc

SEQ ID NO: 863093 - DNA, 25 bp, Mus musculus
acatgcaatagttagctgccactgc

SEQ ID NO: 863094 - DNA, 25 bp, Mus musculus
acatgcaatgattccagcggttttt

SEQ ID NO: 863095 - DNA, 25 bp, Mus musculus
acatgcaatgtttccagcggttttt

SEQ ID NO: 863096 - DNA, 25 bp, Mus musculus
acatgcacagcctatttaagagtgg

SEQ ID NO: 863097 - DNA, 25 bp, Mus musculus
acatgcacaggctatttaagagtgg

SEQ ID NO: 863098 - DNA, 25 bp, Mus musculus
acatgccaagacattgacgagtgtt

SEQ ID NO: 863099 - DNA, 25 bp, Mus musculus
acatgccaagtcattgacgagtgtt

SEQ ID NO: 863100 - DNA, 25 bp, Mus musculus
acatgccatcaacacgggaattttc

SEQ ID NO: 863101 - DNA, 25 bp, Mus musculus
acatgccatcaacaggggaattttc

SEQ ID NO: 863102 - DNA, 25 bp, Mus musculus
acatgcctgtctcgaaacaacctga

SEQ ID NO: 863103 - DNA, 25 bp, Mus musculus
acatgcctgtctggaaacaacctga

SEQ ID NO: 863104 - DNA, 25 bp, Mus musculus
acatgccttgtgccaacttgagcat

SEQ ID NO: 863105 - DNA, 25 bp, Mus musculus
acatgccttgtgcctacttgagcat

SEQ ID NO: 863106 - DNA, 25 bp, Mus musculus
acatgctgctttctcgtcccaccag

SEQ ID NO: 863107 - DNA, 25 bp, Mus musculus
acatgctgctttctggtcccaccag

SEQ ID NO: 863108 - DNA, 25 bp, Mus musculus
acatgctggaaactccagattttag

SEQ ID NO: 863109 - DNA, 25 bp, Mus musculus
acatgctggaaagtccagattttag

SEQ ID NO: 863110 - DNA, 25 bp, Mus musculus
acatgctgggaggacgtggcccaga

SEQ ID NO: 863111 - DNA, 25 bp, Mus musculus
acatgctgggaggaggtggcccaga

SEQ ID NO: 863112 - DNA, 25 bp, Mus musculus
acatgcttcacacagagcagaatgt

SEQ ID NO: 863113 - DNA, 25 bp, Mus musculus
acatgcttcacagagagcagaatgt

SEQ ID NO: 863114 - DNA, 25 bp, Mus musculus
acatgcttctgaccctcagtttgta

SEQ ID NO: 863115 - DNA, 25 bp, Mus musculus
acatgcttctgagcctcagtttgta

SEQ ID NO: 863116 - DNA, 25 bp, Mus musculus
acatgctttgatctcccgcatggtt

SEQ ID NO: 863117 - DNA, 25 bp, Mus musculus
acatgctttgatgtcccgcatggtt

SEQ ID NO: 863118 - DNA, 25 bp, Mus musculus
acatggaaacacccgttactctgat

SEQ ID NO: 863119 - DNA, 25 bp, Mus musculus
acatggaaactcccgttactctgat

SEQ ID NO: 863120 - DNA, 25 bp, Mus musculus
acatggaaggcctgggactgctctg

SEQ ID NO: 863121 - DNA, 25 bp, Mus musculus
acatggaagggctgggactgctctg

SEQ ID NO: 863122 - DNA, 25 bp, Mus musculus
acatggaagtcaaggatgcgaacgc

SEQ ID NO: 863123 - DNA, 25 bp, Mus musculus
acatggaagtgaaggatgcgaacgc

SEQ ID NO: 863124 - DNA, 25 bp, Mus musculus
acatggaatgaccacgtttgtgggc

SEQ ID NO: 863125 - DNA, 25 bp, Mus musculus
acatggaatgaccaggtttgtgggc

SEQ ID NO: 863126 - DNA, 25 bp, Mus musculus
acatggaccacttggaggtgggcaa

SEQ ID NO: 863127 - DNA, 25 bp, Mus musculus
acatggaccagttggaggtgggcaa

SEQ ID NO: 863128 - DNA, 25 bp, Mus musculus
acatggagaattgacaaaatggagc

SEQ ID NO: 863129 - DNA, 25 bp, Mus musculus
acatggagaattgagaaaatggagc

SEQ ID NO: 863130 - DNA, 25 bp, Mus musculus
acatggagacagaacctcatcagaa

SEQ ID NO: 863131 - DNA, 25 bp, Mus musculus
acatggagacagaacgtggtggaga

SEQ ID NO: 863132 - DNA, 25 bp, Mus musculus
acatggagacagaagctcatcagaa

SEQ ID NO: 863133 - DNA, 25 bp, Mus musculus
acatggagacagaaggtggtggaga

SEQ ID NO: 863134 - DNA, 25 bp, Mus musculus
acatggagagcaccaaggagcctgg

SEQ ID NO: 863135 - DNA, 25 bp, Mus musculus
acatggagagcagcaaggagcctgg

SEQ ID NO: 863136 - DNA, 25 bp, Mus musculus
acatggagcggaccctctctgcctt

SEQ ID NO: 863137 - DNA, 25 bp, Mus musculus
acatggagcggacgtctcattggga

SEQ ID NO: 863138 - DNA, 25 bp, Mus musculus
acatggagcggagcctctctgcctt

SEQ ID NO: 863139 - DNA, 25 bp, Mus musculus
acatggagcggaggtctcattggga

SEQ ID NO: 863140 - DNA, 25 bp, Mus musculus
acatggagtacacgatcaataagcc

SEQ ID NO: 863141 - DNA, 25 bp, Mus musculus
acatggagtacaggatcaataagcc

SEQ ID NO: 863142 - DNA, 25 bp, Mus musculus
acatggatgaaaatgtgagcagcta

SEQ ID NO: 863143 - DNA, 25 bp, Mus musculus
acatggatgaaattgtgagcagcta

SEQ ID NO: 863144 - DNA, 25 bp, Mus musculus
acatggatgaagaggatgtgcggct

SEQ ID NO: 863145 - DNA, 25 bp, Mus musculus
acatggatgaagtggatgtgcggct

SEQ ID NO: 863146 - DNA, 25 bp, Mus musculus
acatggatgggaaggtctcgctggc

SEQ ID NO: 863147 - DNA, 25 bp, Mus musculus
acatggatgggatggtctcgctggc

SEQ ID NO: 863148 - DNA, 25 bp, Mus musculus
acatggcaagcctgtggactggtgg

SEQ ID NO: 863149 - DNA, 25 bp, Mus musculus
acatggcaaggctgtggactggtgg

SEQ ID NO: 863150 - DNA, 25 bp, Mus musculus
acatggcctgcacgctgttgtggtc

SEQ ID NO: 863151 - DNA, 25 bp, Mus musculus
acatggcctgcaggctgttgtggtc

SEQ ID NO: 863152 - DNA, 25 bp, Mus musculus
acatggcctgccccccttcttcaac

SEQ ID NO: 863153 - DNA, 25 bp, Mus musculus
acatggcctggcccccttcttcaac

SEQ ID NO: 863154 - DNA, 25 bp, Mus musculus
acatggcctgtgtgcatgtgaacga

SEQ ID NO: 863155 - DNA, 25 bp, Mus musculus
acatggcctgtgtggatgtgaacga

SEQ ID NO: 863156 - DNA, 25 bp, Mus musculus
acatggctattgacccagattccct

SEQ ID NO: 863157 - DNA, 25 bp, Mus musculus
acatggctattgtcccagattccct

SEQ ID NO: 863158 - DNA, 25 bp, Mus musculus
acatgggactagcatgatgtctaca

SEQ ID NO: 863159 - DNA, 25 bp, Mus musculus
acatgggactaggatgatgtctaca

SEQ ID NO: 863160 - DNA, 25 bp, Mus musculus
acatgggatacaaagtcctctcagc

SEQ ID NO: 863161 - DNA, 25 bp, Mus musculus
acatgggatacaagaacaattttta

SEQ ID NO: 863162 - DNA, 25 bp, Mus musculus
acatgggatacatagtcctctcagc

SEQ ID NO: 863163 - DNA, 25 bp, Mus musculus
acatgggatacatgaacaattttta

SEQ ID NO: 863164 - DNA, 25 bp, Mus musculus
acatgggccgaatgaagctgttgca

SEQ ID NO: 863165 - DNA, 25 bp, Mus musculus
acatgggccgtatgaagctgttgca

SEQ ID NO: 863166 - DNA, 25 bp, Mus musculus
acatgggcgcagacctgtgccgtca

SEQ ID NO: 863167 - DNA, 25 bp, Mus musculus
acatgggcgctgacctgtgccgtca

SEQ ID NO: 863168 - DNA, 25 bp, Mus musculus
acatggggagagagggcaatgcgag

SEQ ID NO: 863169 - DNA, 25 bp, Mus musculus
acatggggagagtgggcaatgcgag

SEQ ID NO: 863170 - DNA, 25 bp, Mus musculus
acatgggtgttgcactcaaatgggt

SEQ ID NO: 863171 - DNA, 25 bp, Mus musculus
acatgggtgttgcagtcaaatgggt

SEQ ID NO: 863172 - DNA, 25 bp, Mus musculus
acatggtagagacatctgagtgcat

SEQ ID NO: 863173 - DNA, 25 bp, Mus musculus
acatggtagagagatctgagtgcat

SEQ ID NO: 863174 - DNA, 25 bp, Mus musculus
acatggtagagtcgtataccaaatc

SEQ ID NO: 863175 - DNA, 25 bp, Mus musculus
acatggtagagtggtataccaaatc

SEQ ID NO: 863176 - DNA, 25 bp, Mus musculus
acatgtaaagatatcgatgagtgcc

SEQ ID NO: 863177 - DNA, 25 bp, Mus musculus
acatgtaaagttatcgatgagtgcc

SEQ ID NO: 863178 - DNA, 25 bp, Mus musculus
acatgtacaacacaatgaccagtgc

SEQ ID NO: 863179 - DNA, 25 bp, Mus musculus
acatgtacaacagaatgaccagtgc

SEQ ID NO: 863180 - DNA, 25 bp, Mus musculus
acatgtacagagcttggaaacccaa

SEQ ID NO: 863181 - DNA, 25 bp, Mus musculus
acatgtacagtgcttggaaacccaa

SEQ ID NO: 863182 - DNA, 25 bp, Mus musculus
acatgtatatcacacactgtcctgt

SEQ ID NO: 863183 - DNA, 25 bp, Mus musculus
acatgtatatcagacactgtcctgt

SEQ ID NO: 863184 - DNA, 25 bp, Mus musculus
acatgtcaacagctactggaaaaac

SEQ ID NO: 863185 - DNA, 25 bp, Mus musculus
acatgtcaacaggtactggaaaaac

SEQ ID NO: 863186 - DNA, 25 bp, Mus musculus
acatgtcaagatgtgaatgagtgca

SEQ ID NO: 863187 - DNA, 25 bp, Mus musculus
acatgtcaagatgtggatgagtgca

SEQ ID NO: 863188 - DNA, 25 bp, Mus musculus
acatgtcaagcatcagtgaacactg

SEQ ID NO: 863189 - DNA, 25 bp, Mus musculus
acatgtcaaggatcagtgaacactg

SEQ ID NO: 863190 - DNA, 25 bp, Mus musculus
acatgtcaagttgtgaatgagtgca

SEQ ID NO: 863191 - DNA, 25 bp, Mus musculus
acatgtcaagttgtggatgagtgca

SEQ ID NO: 863192 - DNA, 25 bp, Mus musculus
acatgtcccatgaacgaaggaaatc

SEQ ID NO: 863193 - DNA, 25 bp, Mus musculus
acatgtcccatgaaggaaggaaatc

SEQ ID NO: 863194 - DNA, 25 bp, Mus musculus
acatgtcggaaacaaatgtcccagg

SEQ ID NO: 863195 - DNA, 25 bp, Mus musculus
acatgtcggaaagaaatgtcccagg

SEQ ID NO: 863196 - DNA, 25 bp, Mus musculus
acatgtgatgagagttctactgtag

SEQ ID NO: 863197 - DNA, 25 bp, Mus musculus
acatgtgatgtgagttctactgtag

SEQ ID NO: 863198 - DNA, 25 bp, Mus musculus
acatgtgcaacttcttggtgaattt

SEQ ID NO: 863199 - DNA, 25 bp, Mus musculus
acatgtgcaagttcttggtgaattt

SEQ ID NO: 863200 - DNA, 25 bp, Mus musculus
acatgtgctgccagtccctccacag

SEQ ID NO: 863201 - DNA, 25 bp, Mus musculus
acatgtgctgcctgtccctccacag

SEQ ID NO: 863202 - DNA, 25 bp, Mus musculus
acatgtgtactccctcaaacccaag

SEQ ID NO: 863203 - DNA, 25 bp, Mus musculus
acatgtgtactcgctcaaacccaag

SEQ ID NO: 863204 - DNA, 25 bp, Mus musculus
acatgtgtcctcgacagacccagcc

SEQ ID NO: 863205 - DNA, 25 bp, Mus musculus
acatgtgtcctcgacttttactaca

SEQ ID NO: 863206 - DNA, 25 bp, Mus musculus
acatgtgtcctcgagagacccagcc

SEQ ID NO: 863207 - DNA, 25 bp, Mus musculus
acatgtgtcctcgagttttactaca

SEQ ID NO: 863208 - DNA, 25 bp, Mus musculus
acatgtgtgtgacgaggttccccct

SEQ ID NO: 863209 - DNA, 25 bp, Mus musculus
acatgtgtgtgaggaggttccccct

SEQ ID NO: 863210 - DNA, 25 bp, Mus musculus
acatgttctgtgctcgcttcaaggt

SEQ ID NO: 863211 - DNA, 25 bp, Mus musculus
acatgttctgtgctggcttcaaggt

SEQ ID NO: 863212 - DNA, 25 bp, Mus musculus
acatgttgccttagacggacctaga

SEQ ID NO: 863213 - DNA, 25 bp, Mus musculus
acatgttgcctttgacggacctaga

SEQ ID NO: 863214 - DNA, 25 bp, Mus musculus
acattaaacgaacaatccagttcat

SEQ ID NO: 863215 - DNA, 25 bp, Mus musculus
acattaaacgaagaatccagttcat

SEQ ID NO: 863216 - DNA, 25 bp, Mus musculus
acattaaatgctcttgcttctccat

SEQ ID NO: 863217 - DNA, 25 bp, Mus musculus
acattaaatggtcttgcttctccat

SEQ ID NO: 863218 - DNA, 25 bp, Mus musculus
acattaatgttacacgcatacagtc

SEQ ID NO: 863219 - DNA, 25 bp, Mus musculus
acattaatgttacaggcatacagtc

SEQ ID NO: 863220 - DNA, 25 bp, Mus musculus
acattagcagctccagcagtggttc

SEQ ID NO: 863221 - DNA, 25 bp, Mus musculus
acattagcaggtccagcagtggttc

SEQ ID NO: 863222 - DNA, 25 bp, Mus musculus
acattagtgggaagcagctatactg

SEQ ID NO: 863223 - DNA, 25 bp, Mus musculus
acattagtgggatgcagctatactg

SEQ ID NO: 863224 - DNA, 25 bp, Mus musculus
acattagttgataatgcttacagtt

SEQ ID NO: 863225 - DNA, 25 bp, Mus musculus
acattagttgttaatgcttacagtt

SEQ ID NO: 863226 - DNA, 25 bp, Mus musculus
acattatcagaggctgcctcttttc

SEQ ID NO: 863227 - DNA, 25 bp, Mus musculus
acattatcagtggctgcctcttttc

SEQ ID NO: 863228 - DNA, 25 bp, Mus musculus
acattatgagcgtgctctcgatcaa

SEQ ID NO: 863229 - DNA, 25 bp, Mus musculus
acattatgagggtgctctcgatcaa

SEQ ID NO: 863230 - DNA, 25 bp, Mus musculus
acattatgatagatttttcagtgaa

SEQ ID NO: 863231 - DNA, 25 bp, Mus musculus
acattatgatagttttttcagtgaa

SEQ ID NO: 863232 - DNA, 25 bp, Mus musculus
acattatgctagcacgctagcagaa

SEQ ID NO: 863233 - DNA, 25 bp, Mus musculus
acattatgctagcaggctagcagaa

SEQ ID NO: 863234 - DNA, 25 bp, Mus musculus
acattatggatcttagtatcgaatg

SEQ ID NO: 863235 - DNA, 25 bp, Mus musculus
acattatggatctttgtatcgaatg

SEQ ID NO: 863236 - DNA, 25 bp, Mus musculus
acattattaaaccgatggctcccag

SEQ ID NO: 863237 - DNA, 25 bp, Mus musculus
acattattaaacggatggctcccag

SEQ ID NO: 863238 - DNA, 25 bp, Mus musculus
acattattagctccaggacgcccct

SEQ ID NO: 863239 - DNA, 25 bp, Mus musculus
acattattaggtccaggacgcccct

SEQ ID NO: 863240 - DNA, 25 bp, Mus musculus
acattatttgataatggccagccaa

SEQ ID NO: 863241 - DNA, 25 bp, Mus musculus
acattatttgttaatggccagccaa

SEQ ID NO: 863242 - DNA, 25 bp, Mus musculus
acattcaacgggcgattcatcagtt

SEQ ID NO: 863243 - DNA, 25 bp, Mus musculus
acattcaacgggggattcatcagtt

SEQ ID NO: 863244 - DNA, 25 bp, Mus musculus
acattcaatgaaatccttgtatata

SEQ ID NO: 863245 - DNA, 25 bp, Mus musculus
acattcaatgaaatgcttgtatata

SEQ ID NO: 863246 - DNA, 25 bp, Mus musculus
acattcactttcaacgtgccatacc

SEQ ID NO: 863247 - DNA, 25 bp, Mus musculus
acattcactttcaaggtgccatacc

SEQ ID NO: 863248 - DNA, 25 bp, Mus musculus
acattcagactccgtcagatccagc

SEQ ID NO: 863249 - DNA, 25 bp, Mus musculus
acattcagactcggtcagatccagc

SEQ ID NO: 863250 - DNA, 25 bp, Mus musculus
acattcagagccacaggcaccatgt

SEQ ID NO: 863251 - DNA, 25 bp, Mus musculus
acattcagaggcacaggcaccatgt

SEQ ID NO: 863252 - DNA, 25 bp, Mus musculus
acattcataaaacagtaagtgagca

SEQ ID NO: 863253 - DNA, 25 bp, Mus musculus
acattcataaaagagtaagtgagca

SEQ ID NO: 863254 - DNA, 25 bp, Mus musculus
acattcatggtgaacgacacatctt

SEQ ID NO: 863255 - DNA, 25 bp, Mus musculus
acattcatggtgaaggacacatctt

SEQ ID NO: 863256 - DNA, 25 bp, Mus musculus
acattccaaggacgtcaggaaggtc

SEQ ID NO: 863257 - DNA, 25 bp, Mus musculus
acattccaaggaggtcaggaaggtc

SEQ ID NO: 863258 - DNA, 25 bp, Mus musculus
acattccacaagattgtgaaatgga

SEQ ID NO: 863259 - DNA, 25 bp, Mus musculus
acattccacaagtttgtgaaatgga

SEQ ID NO: 863260 - DNA, 25 bp, Mus musculus
acattccatggaccatgtgtccatg

SEQ ID NO: 863261 - DNA, 25 bp, Mus musculus
acattccatggagcatgtgtccatg

SEQ ID NO: 863262 - DNA, 25 bp, Mus musculus
acattccctgcttgttcagtgggtg

SEQ ID NO: 863263 - DNA, 25 bp, Mus musculus
acattccctggttgttcagtgggtg

SEQ ID NO: 863264 - DNA, 25 bp, Mus musculus
acattccgagctacctgaatgactt

SEQ ID NO: 863265 - DNA, 25 bp, Mus musculus
acattccgaggtacctgaatgactt

SEQ ID NO: 863266 - DNA, 25 bp, Mus musculus
acattcggattctgcgattgaagag

SEQ ID NO: 863267 - DNA, 25 bp, Mus musculus
acattcggattctgggattgaagag

SEQ ID NO: 863268 - DNA, 25 bp, Mus musculus
acattctcagactccttggatgtgc

SEQ ID NO: 863269 - DNA, 25 bp, Mus musculus
acattctcagtctccttggatgtgc

SEQ ID NO: 863270 - DNA, 25 bp, Mus musculus
acattctccatgcagcagcctggtg

SEQ ID NO: 863271 - DNA, 25 bp, Mus musculus
acattctccatggagcagcctggtg

SEQ ID NO: 863272 - DNA, 25 bp, Mus musculus
acattcttcatactgaagatcttgg

SEQ ID NO: 863273 - DNA, 25 bp, Mus musculus
acattcttcatagtgaagatcttgg

SEQ ID NO: 863274 - DNA, 25 bp, Mus musculus
acattgataatccggaccagcgaat

SEQ ID NO: 863275 - DNA, 25 bp, Mus musculus
acattgataatcgggaccagcgaat

SEQ ID NO: 863276 - DNA, 25 bp, Mus musculus
acattgatgaagcgtcaggaactgt

SEQ ID NO: 863277 - DNA, 25 bp, Mus musculus
acattgatgaagggtcaggaactgt

SEQ ID NO: 863278 - DNA, 25 bp, Mus musculus
acattgcaagaaatttgaaaaagag

SEQ ID NO: 863279 - DNA, 25 bp, Mus musculus
acattgcaagaattttgaaaaagag

SEQ ID NO: 863280 - DNA, 25 bp, Mus musculus
acattgcacctatacatggcattcg

SEQ ID NO: 863281 - DNA, 25 bp, Mus musculus
acattgcacctatactgtctataat

SEQ ID NO: 863282 - DNA, 25 bp, Mus musculus
acattgcacctatagatggcattcg

SEQ ID NO: 863283 - DNA, 25 bp, Mus musculus
acattgcacctatagtgtctataat

SEQ ID NO: 863284 - DNA, 25 bp, Mus musculus
acattgccaagcaacgaagcctgct

SEQ ID NO: 863285 - DNA, 25 bp, Mus musculus
acattgccaagcaaggaagcctgct

SEQ ID NO: 863286 - DNA, 25 bp, Mus musculus
acattgcctcaacgtgagctgtcct

SEQ ID NO: 863287 - DNA, 25 bp, Mus musculus
acattgcctcaaggtgagctgtcct

SEQ ID NO: 863288 - DNA, 25 bp, Mus musculus
acattgctacagctgcacagagcat

SEQ ID NO: 863289 - DNA, 25 bp, Mus musculus
acattgctacaggtgcacagagcat

SEQ ID NO: 863290 - DNA, 25 bp, Mus musculus
acattgctaccacggtccgcctggc

SEQ ID NO: 863291 - DNA, 25 bp, Mus musculus
acattgctaccagggtccgcctggc

SEQ ID NO: 863292 - DNA, 25 bp, Mus musculus
acattgctagcatttgaagacatgc

SEQ ID NO: 863293 - DNA, 25 bp, Mus musculus
acattgctaggatttgaagacatgc

SEQ ID NO: 863294 - DNA, 25 bp, Mus musculus
acattgctgacacgatgcctagccg

SEQ ID NO: 863295 - DNA, 25 bp, Mus musculus
acattgctgacaggatgcctagccg

SEQ ID NO: 863296 - DNA, 25 bp, Mus musculus
acattgctggacatttcaatgatga

SEQ ID NO: 863297 - DNA, 25 bp, Mus musculus
acattgctggatcctctcccagtcc

SEQ ID NO: 863298 - DNA, 25 bp, Mus musculus
acattgctggtcatttcaatgatga

SEQ ID NO: 863299 - DNA, 25 bp, Mus musculus
acattgctggttcctctcccagtcc

SEQ ID NO: 863300 - DNA, 25 bp, Mus musculus
acattgcttctggacacatctctgg

SEQ ID NO: 863301 - DNA, 25 bp, Mus musculus
acattgcttctggagacatctctgg

SEQ ID NO: 863302 - DNA, 25 bp, Mus musculus
acattgggctcaaccataagtcctg

SEQ ID NO: 863303 - DNA, 25 bp, Mus musculus
acattgggctcaacgataagtcctg

SEQ ID NO: 863304 - DNA, 25 bp, Mus musculus
acattggtcttaaggcactgaagcc

SEQ ID NO: 863305 - DNA, 25 bp, Mus musculus
acattggtcttatggcactgaagcc

SEQ ID NO: 863306 - DNA, 25 bp, Mus musculus
acattgtcacagcttcttctgacaa

SEQ ID NO: 863307 - DNA, 25 bp, Mus musculus
acattgtcacaggttcttctgacaa

SEQ ID NO: 863308 - DNA, 25 bp, Mus musculus
acattgtctccacggtcctgattcg

SEQ ID NO: 863309 - DNA, 25 bp, Mus musculus
acattgtctccagggtcctgattcg

SEQ ID NO: 863310 - DNA, 25 bp, Mus musculus
acattgtgagatcactgaagaagtc

SEQ ID NO: 863311 - DNA, 25 bp, Mus musculus
acattgtgagttcactgaagaagtc

SEQ ID NO: 863312 - DNA, 25 bp, Mus musculus
acattgtgatcacactgaactcagc

SEQ ID NO: 863313 - DNA, 25 bp, Mus musculus
acattgtgatcagactgaactcagc

SEQ ID NO: 863314 - DNA, 25 bp, Mus musculus
acatttaaaacacttgccatccaca

SEQ ID NO: 863315 - DNA, 25 bp, Mus musculus
acatttaaaacagttgccatccaca

SEQ ID NO: 863316 - DNA, 25 bp, Mus musculus
acatttcaagagttttccagaaaag

SEQ ID NO: 863317 - DNA, 25 bp, Mus musculus
acatttcaagtgttttccagaaaag

SEQ ID NO: 863318 - DNA, 25 bp, Mus musculus
acatttcagggacactgctgggctg

SEQ ID NO: 863319 - DNA, 25 bp, Mus musculus
acatttcagggagactgctgggctg

SEQ ID NO: 863320 - DNA, 25 bp, Mus musculus
acatttcctcctacaacacggtaga

SEQ ID NO: 863321 - DNA, 25 bp, Mus musculus
acatttcctcctacattgagcagac

SEQ ID NO: 863322 - DNA, 25 bp, Mus musculus
acatttcctcctactacacggtaga

SEQ ID NO: 863323 - DNA, 25 bp, Mus musculus
acatttcctcctactttgagcagac

SEQ ID NO: 863324 - DNA, 25 bp, Mus musculus
acatttcttcctggcgtgttgttca

SEQ ID NO: 863325 - DNA, 25 bp, Mus musculus
acatttcttcctggggtgttgttca

SEQ ID NO: 863326 - DNA, 25 bp, Mus musculus
acatttgaagctatcgccgggcagg

SEQ ID NO: 863327 - DNA, 25 bp, Mus musculus
acatttgaaggtatcgccgggcagg

SEQ ID NO: 863328 - DNA, 25 bp, Mus musculus
acatttgagaagcgccacatccggg

SEQ ID NO: 863329 - DNA, 25 bp, Mus musculus
acatttgagaagggccacatccggg

SEQ ID NO: 863330 - DNA, 25 bp, Mus musculus
acatttgagattaacaaatgtgacc

SEQ ID NO: 863331 - DNA, 25 bp, Mus musculus
acatttgagattaacgaagcctgct

SEQ ID NO: 863332 - DNA, 25 bp, Mus musculus
acatttgagattaagaaatgtgacc

SEQ ID NO: 863333 - DNA, 25 bp, Mus musculus
acatttgagattaaggaagcctgct

SEQ ID NO: 863334 - DNA, 25 bp, Mus musculus
acatttgatacgccttactgcaaag

SEQ ID NO: 863335 - DNA, 25 bp, Mus musculus
acatttgatacggcttactgcaaag

SEQ ID NO: 863336 - DNA, 25 bp, Mus musculus
acattttattcaaccaacaactatt

SEQ ID NO: 863337 - DNA, 25 bp, Mus musculus
acattttattcaagcttaggtggag

SEQ ID NO: 863338 - DNA, 25 bp, Mus musculus
acattttattcaattttctggatat

SEQ ID NO: 863339 - DNA, 25 bp, Mus musculus
acattttattcatccaacaactatt

SEQ ID NO: 863340 - DNA, 25 bp, Mus musculus
acattttattcatgcttaggtggag

SEQ ID NO: 863341 - DNA, 25 bp, Mus musculus
acattttattcatttttctggatat

SEQ ID NO: 863342 - DNA, 25 bp, Mus musculus
acattttcaaatctggaggctaatc

SEQ ID NO: 863343 - DNA, 25 bp, Mus musculus
acattttcaattctggaggctaatc

SEQ ID NO: 863344 - DNA, 25 bp, Mus musculus
acattttcaccgacaagccctcagt

SEQ ID NO: 863345 - DNA, 25 bp, Mus musculus
acattttcacggacaagccctcagt

SEQ ID NO: 863346 - DNA, 25 bp, Mus musculus
acattttccaagaacagttagctgc

SEQ ID NO: 863347 - DNA, 25 bp, Mus musculus
acattttccaagtacagttagctgc

SEQ ID NO: 863348 - DNA, 25 bp, Mus musculus
acattttcttggcgagcaagagtgc

SEQ ID NO: 863349 - DNA, 25 bp, Mus musculus
acattttcttggggagcaagagtgc

SEQ ID NO: 863350 - DNA, 25 bp, Mus musculus
acattttgacttacccagcgcagac

SEQ ID NO: 863351 - DNA, 25 bp, Mus musculus
acattttgactttcccagcgcagac

SEQ ID NO: 863352 - DNA, 25 bp, Mus musculus
acatttttaacacattagttcataa

SEQ ID NO: 863353 - DNA, 25 bp, Mus musculus
acatttttaacagattagttcataa

SEQ ID NO: 863354 - DNA, 25 bp, Mus musculus
accaaaaagcacaacccaagaggca

SEQ ID NO: 863355 - DNA, 25 bp, Mus musculus
accaaaaagcactacccaagaggca

SEQ ID NO: 863356 - DNA, 25 bp, Mus musculus
accaaaaagcagatggagacacgga

SEQ ID NO: 863357 - DNA, 25 bp, Mus musculus
accaaaaagcagattgtccatccca

SEQ ID NO: 863358 - DNA, 25 bp, Mus musculus
accaaaaagcagttggagacacgga

SEQ ID NO: 863359 - DNA, 25 bp, Mus musculus
accaaaaagcagtttgtccatccca

SEQ ID NO: 863360 - DNA, 25 bp, Mus musculus
accaaaacaaagcacgcgaggcaga

SEQ ID NO: 863361 - DNA, 25 bp, Mus musculus
accaaaacaaaggacgcgaggcaga

SEQ ID NO: 863362 - DNA, 25 bp, Mus musculus
accaaaagaacgcctggcactcatc

SEQ ID NO: 863363 - DNA, 25 bp, Mus musculus
accaaaagaaggcctggcactcatc

SEQ ID NO: 863364 - DNA, 25 bp, Mus musculus
accaaaagtcatatggtgagcggat

SEQ ID NO: 863365 - DNA, 25 bp, Mus musculus
accaaaagtcatttggtgagcggat

SEQ ID NO: 863366 - DNA, 25 bp, Mus musculus
accaaaatcacgaggatgaaagcag

SEQ ID NO: 863367 - DNA, 25 bp, Mus musculus
accaaaatcacgtggatgaaagcag

SEQ ID NO: 863368 - DNA, 25 bp, Mus musculus
accaaaatcgctaaggagagctgct

SEQ ID NO: 863369 - DNA, 25 bp, Mus musculus
accaaaatcggtaaggagagctgct

SEQ ID NO: 863370 - DNA, 25 bp, Mus musculus
accaaaatctcacaactcaagtgat

SEQ ID NO: 863371 - DNA, 25 bp, Mus musculus
accaaaatctcacgctggcctgtga

SEQ ID NO: 863372 - DNA, 25 bp, Mus musculus
accaaaatctcagaactcaagtgat

SEQ ID NO: 863373 - DNA, 25 bp, Mus musculus
accaaaatctcaggctggcctgtga

SEQ ID NO: 863374 - DNA, 25 bp, Mus musculus
accaaaatgaagaacatgggcttag

SEQ ID NO: 863375 - DNA, 25 bp, Mus musculus
accaaaatgaagaactggaactatg

SEQ ID NO: 863376 - DNA, 25 bp, Mus musculus
accaaaatgaagaagatgggcttag

SEQ ID NO: 863377 - DNA, 25 bp, Mus musculus
accaaaatgaagaagtggaactatg

SEQ ID NO: 863378 - DNA, 25 bp, Mus musculus
accaaaatgaagcaagctctgagtt

SEQ ID NO: 863379 - DNA, 25 bp, Mus musculus
accaaaatgaaggaagctctgagtt

SEQ ID NO: 863380 - DNA, 25 bp, Mus musculus
accaaacgaatcagcttatgaccag

SEQ ID NO: 863381 - DNA, 25 bp, Mus musculus
accaaacgaatctgcttatgaccag

SEQ ID NO: 863382 - DNA, 25 bp, Mus musculus
accaaagaccacctggatgaaggct

SEQ ID NO: 863383 - DNA, 25 bp, Mus musculus
accaaagaccacgtggatgaaggct

SEQ ID NO: 863384 - DNA, 25 bp, Mus musculus
accaaagcacagataaaatctgtgg

SEQ ID NO: 863385 - DNA, 25 bp, Mus musculus
accaaagcacagttaaaatctgtgg

SEQ ID NO: 863386 - DNA, 25 bp, Mus musculus
accaaagcatggagggtgatgagga

SEQ ID NO: 863387 - DNA, 25 bp, Mus musculus
accaaagcatggtgggtgatgagga

SEQ ID NO: 863388 - DNA, 25 bp, Mus musculus
accaaagcctataacgagcctctaa

SEQ ID NO: 863389 - DNA, 25 bp, Mus musculus
accaaagcctataaggagcctctaa

SEQ ID NO: 863390 - DNA, 25 bp, Mus musculus
accaaagctatgcagagtcagcgag

SEQ ID NO: 863391 - DNA, 25 bp, Mus musculus
accaaagctatggagagtcagcgag

SEQ ID NO: 863392 - DNA, 25 bp, Mus musculus
accaaaggagcgcccatctacatca

SEQ ID NO: 863393 - DNA, 25 bp, Mus musculus
accaaaggagggcccatctacatca

SEQ ID NO: 863394 - DNA, 25 bp, Mus musculus
accaaatacaatatcccatatatag

SEQ ID NO: 863395 - DNA, 25 bp, Mus musculus
accaaatacaatttcccatatatag

SEQ ID NO: 863396 - DNA, 25 bp, Mus musculus
accaaatcacatgaaggagcctcaa

SEQ ID NO: 863397 - DNA, 25 bp, Mus musculus
accaaatcacatgatggagcctcaa

SEQ ID NO: 863398 - DNA, 25 bp, Mus musculus
accaaatgacagctatggccctgtc

SEQ ID NO: 863399 - DNA, 25 bp, Mus musculus
accaaatgacaggtatggccctgtc

SEQ ID NO: 863400 - DNA, 25 bp, Mus musculus
accaaatggagaaataatcatgtgt

SEQ ID NO: 863401 - DNA, 25 bp, Mus musculus
accaaatggagatataatcatgtgt

SEQ ID NO: 863402 - DNA, 25 bp, Mus musculus
accaacaatagaaactggccattcc

SEQ ID NO: 863403 - DNA, 25 bp, Mus musculus
accaacaatagaaagtggccattcc

SEQ ID NO: 863404 - DNA, 25 bp, Mus musculus
accaacacatattcagtgtagcatc

SEQ ID NO: 863405 - DNA, 25 bp, Mus musculus
accaacacattttcagtgtagcatc

SEQ ID NO: 863406 - DNA, 25 bp, Mus musculus
accaacaccccttcagtgcctgtgc

SEQ ID NO: 863407 - DNA, 25 bp, Mus musculus
accaacaccccttctgtgcctgtgc

SEQ ID NO: 863408 - DNA, 25 bp, Mus musculus
accaacagcagacaactggggaacc

SEQ ID NO: 863409 - DNA, 25 bp, Mus musculus
accaacagcagagaactggggaacc

SEQ ID NO: 863410 - DNA, 25 bp, Mus musculus
accaacatcatgcacgccaagtggc

SEQ ID NO: 863411 - DNA, 25 bp, Mus musculus
accaacatcatgcaggccaagtggc

SEQ ID NO: 863412 - DNA, 25 bp, Mus musculus
accaacctgcagatggcagcagtga

SEQ ID NO: 863413 - DNA, 25 bp, Mus musculus
accaacctgcagatggcagctcaac

SEQ ID NO: 863414 - DNA, 25 bp, Mus musculus
accaacctgcagttggcagcagtga

SEQ ID NO: 863415 - DNA, 25 bp, Mus musculus
accaacctgcagttggcagctcaac

SEQ ID NO: 863416 - DNA, 25 bp, Mus musculus
accaacctggaggacatcttcctaa

SEQ ID NO: 863417 - DNA, 25 bp, Mus musculus
accaacctggaggagatcttcctaa

SEQ ID NO: 863418 - DNA, 25 bp, Mus musculus
accaactactatctctggcctgctg

SEQ ID NO: 863419 - DNA, 25 bp, Mus musculus
accaactactatgtctggcctgctg

SEQ ID NO: 863420 - DNA, 25 bp, Mus musculus
accaactcaagacgagcttcctgaa

SEQ ID NO: 863421 - DNA, 25 bp, Mus musculus
accaactcaagaggagcttcctgaa

SEQ ID NO: 863422 - DNA, 25 bp, Mus musculus
accaactcagctctctgctctctgc

SEQ ID NO: 863423 - DNA, 25 bp, Mus musculus
accaactcaggtctctgctctctgc

SEQ ID NO: 863424 - DNA, 25 bp, Mus musculus
accaactccacctcagcacagaaga

SEQ ID NO: 863425 - DNA, 25 bp, Mus musculus
accaactccacctctgcacagaaga

SEQ ID NO: 863426 - DNA, 25 bp, Mus musculus
accaactgaaagaggttggcatggc

SEQ ID NO: 863427 - DNA, 25 bp, Mus musculus
accaactgaaagtggttggcatggc

SEQ ID NO: 863428 - DNA, 25 bp, Mus musculus
accaagaaaaaaattgacatcctgc

SEQ ID NO: 863429 - DNA, 25 bp, Mus musculus
accaagaaaaaatttgacatcctgc

SEQ ID NO: 863430 - DNA, 25 bp, Mus musculus
accaagaaagagattcaagccacag

SEQ ID NO: 863431 - DNA, 25 bp, Mus musculus
accaagaaagagtttcaagccacag

SEQ ID NO: 863432 - DNA, 25 bp, Mus musculus
accaagaaccagccgctcaactcca

SEQ ID NO: 863433 - DNA, 25 bp, Mus musculus
accaagaaccaggcgctcaactcca

SEQ ID NO: 863434 - DNA, 25 bp, Mus musculus
accaagaataacctcgcttcctgct

SEQ ID NO: 863435 - DNA, 25 bp, Mus musculus
accaagaataacctggcttcctgct

SEQ ID NO: 863436 - DNA, 25 bp, Mus musculus
accaagaccacgatggggatggtca

SEQ ID NO: 863437 - DNA, 25 bp, Mus musculus
accaagaccaggatggggatggtca

SEQ ID NO: 863438 - DNA, 25 bp, Mus musculus
accaagacccacatctggcaagttc

SEQ ID NO: 863439 - DNA, 25 bp, Mus musculus
accaagacccacttctggcaagttc

SEQ ID NO: 863440 - DNA, 25 bp, Mus musculus
accaagacctgcaacagctaggatt

SEQ ID NO: 863441 - DNA, 25 bp, Mus musculus
accaagacctgcaaccagagctagg

SEQ ID NO: 863442 - DNA, 25 bp, Mus musculus
accaagacctgcaacccctacctga

SEQ ID NO: 863443 - DNA, 25 bp, Mus musculus
accaagacctgcaacgaatctccgg

SEQ ID NO: 863444 - DNA, 25 bp, Mus musculus
accaagacctgcaagagctaggatt

SEQ ID NO: 863445 - DNA, 25 bp, Mus musculus
accaagacctgcaagcagagctagg

SEQ ID NO: 863446 - DNA, 25 bp, Mus musculus
accaagacctgcaagccctacctga

SEQ ID NO: 863447 - DNA, 25 bp, Mus musculus
accaagacctgcaaggaatctccgg

SEQ ID NO: 863448 - DNA, 25 bp, Mus musculus
accaagagaacccgcatggagagta

SEQ ID NO: 863449 - DNA, 25 bp, Mus musculus
accaagagaaccggcatggagagta

SEQ ID NO: 863450 - DNA, 25 bp, Mus musculus
accaagaggaagctgtgtggagatg

SEQ ID NO: 863451 - DNA, 25 bp, Mus musculus
accaagaggaaggtgtgtggagatg

SEQ ID NO: 863452 - DNA, 25 bp, Mus musculus
accaagaggacgctgtgccgatgct

SEQ ID NO: 863453 - DNA, 25 bp, Mus musculus
accaagaggacggtgtgccgatgct

SEQ ID NO: 863454 - DNA, 25 bp, Mus musculus
accaagatcaagaccgctgaccacc

SEQ ID NO: 863455 - DNA, 25 bp, Mus musculus
accaagatcaagtccgctgaccacc

SEQ ID NO: 863456 - DNA, 25 bp, Mus musculus
accaagatcacgcgcgaccccaaca

SEQ ID NO: 863457 - DNA, 25 bp, Mus musculus
accaagatcacgggcgaccccaaca

SEQ ID NO: 863458 - DNA, 25 bp, Mus musculus
accaagatcccactgattatagagc

SEQ ID NO: 863459 - DNA, 25 bp, Mus musculus
accaagatcccagtgattatagagc

SEQ ID NO: 863460 - DNA, 25 bp, Mus musculus
accaagatctcgctggatatgttct

SEQ ID NO: 863461 - DNA, 25 bp, Mus musculus
accaagatctcggtggatatgttct

SEQ ID NO: 863462 - DNA, 25 bp, Mus musculus
accaagatggagcacctggcacagc

SEQ ID NO: 863463 - DNA, 25 bp, Mus musculus
accaagatggagcagatcgggcgca

SEQ ID NO: 863464 - DNA, 25 bp, Mus musculus
accaagatggaggacctggcacagc

SEQ ID NO: 863465 - DNA, 25 bp, Mus musculus
accaagatggaggagatcgggcgca

SEQ ID NO: 863466 - DNA, 25 bp, Mus musculus
accaagattgaacggctggacatcc

SEQ ID NO: 863467 - DNA, 25 bp, Mus musculus
accaagattgaagggctggacatcc

SEQ ID NO: 863468 - DNA, 25 bp, Mus musculus
accaagccacagcaatgtggggctg

SEQ ID NO: 863469 - DNA, 25 bp, Mus musculus
accaagccacagcatggtgacatta

SEQ ID NO: 863470 - DNA, 25 bp, Mus musculus
accaagccacaggaatgtggggctg

SEQ ID NO: 863471 - DNA, 25 bp, Mus musculus
accaagccacaggatggtgacatta

SEQ ID NO: 863472 - DNA, 25 bp, Mus musculus
accaagccatggaacactgtgggag

SEQ ID NO: 863473 - DNA, 25 bp, Mus musculus
accaagccatggtacactgtgggag

SEQ ID NO: 863474 - DNA, 25 bp, Mus musculus
accaagcctgcaatctggtgacagc

SEQ ID NO: 863475 - DNA, 25 bp, Mus musculus
accaagcctggaatctggtgacagc

SEQ ID NO: 863476 - DNA, 25 bp, Mus musculus
accaagcggtctctcacttatggga

SEQ ID NO: 863477 - DNA, 25 bp, Mus musculus
accaagcggtctctgacttatggga

SEQ ID NO: 863478 - DNA, 25 bp, Mus musculus
accaagctacagagatcctgcagcg

SEQ ID NO: 863479 - DNA, 25 bp, Mus musculus
accaagctacagagttcctgcagcg

SEQ ID NO: 863480 - DNA, 25 bp, Mus musculus
accaagctcaagatacccctgattc

SEQ ID NO: 863481 - DNA, 25 bp, Mus musculus
accaagctcaagttacccctgattc

SEQ ID NO: 863482 - DNA, 25 bp, Mus musculus
accaaggaacagatcctgaagctgc

SEQ ID NO: 863483 - DNA, 25 bp, Mus musculus
accaaggaacagttcctgaagctgc

SEQ ID NO: 863484 - DNA, 25 bp, Mus musculus
accaaggacgcatactggaagtagt

SEQ ID NO: 863485 - DNA, 25 bp, Mus musculus
accaaggacgcatagtggaagtagt

SEQ ID NO: 863486 - DNA, 25 bp, Mus musculus
accaaggagaagcagttctttgatg

SEQ ID NO: 863487 - DNA, 25 bp, Mus musculus
accaaggagaaggagttctttgatg

SEQ ID NO: 863488 - DNA, 25 bp, Mus musculus
accaaggagcagctgactaacgaga

SEQ ID NO: 863489 - DNA, 25 bp, Mus musculus
accaaggagcaggtgactaacgaga

SEQ ID NO: 863490 - DNA, 25 bp, Mus musculus
accaaggaggcccaacatcccttca

SEQ ID NO: 863491 - DNA, 25 bp, Mus musculus
accaaggaggccgaacatcccttca

SEQ ID NO: 863492 - DNA, 25 bp, Mus musculus
accaaggcgcagcatttctataatt

SEQ ID NO: 863493 - DNA, 25 bp, Mus musculus
accaaggcgcaggatttctataatt

SEQ ID NO: 863494 - DNA, 25 bp, Mus musculus
accaagtagacaccattttcaaaat

SEQ ID NO: 863495 - DNA, 25 bp, Mus musculus
accaagtagacagcattttcaaaat

SEQ ID NO: 863496 - DNA, 25 bp, Mus musculus
accaagtccagcaggaattgtctgg

SEQ ID NO: 863497 - DNA, 25 bp, Mus musculus
accaagtccagctggaattgtctgg

SEQ ID NO: 863498 - DNA, 25 bp, Mus musculus
accaagtctgtgctttgtcccatct

SEQ ID NO: 863499 - DNA, 25 bp, Mus musculus
accaagtctgtggtttgtcccatct

SEQ ID NO: 863500 - DNA, 25 bp, Mus musculus
accaagtgacaacgtgcttacagac

SEQ ID NO: 863501 - DNA, 25 bp, Mus musculus
accaagtgacaaggagtgcttacag

SEQ ID NO: 863502 - DNA, 25 bp, Mus musculus
accaagtgacaaggtgcttacagac

SEQ ID NO: 863503 - DNA, 25 bp, Mus musculus
accaagtgacaaggtgtgcttacag

SEQ ID NO: 863504 - DNA, 25 bp, Mus musculus
accaagttacagcaggcagtgacat

SEQ ID NO: 863505 - DNA, 25 bp, Mus musculus
accaagttacagcaggcagtgacgt

SEQ ID NO: 863506 - DNA, 25 bp, Mus musculus
accaagttacagctctcctgtttct

SEQ ID NO: 863507 - DNA, 25 bp, Mus musculus
accaagttacaggaggcagtgacat

SEQ ID NO: 863508 - DNA, 25 bp, Mus musculus
accaagttacaggaggcagtgacgt

SEQ ID NO: 863509 - DNA, 25 bp, Mus musculus
accaagttacaggtctcctgtttct

SEQ ID NO: 863510 - DNA, 25 bp, Mus musculus
accaatagttcacacatcctacagg

SEQ ID NO: 863511 - DNA, 25 bp, Mus musculus
accaatagttcagacatcctacagg

SEQ ID NO: 863512 - DNA, 25 bp, Mus musculus
accaatcagccacaacagcgatgga

SEQ ID NO: 863513 - DNA, 25 bp, Mus musculus
accaatcagccaccagaacagcgat

SEQ ID NO: 863514 - DNA, 25 bp, Mus musculus
accaatcagccacccttcgaccatg

SEQ ID NO: 863515 - DNA, 25 bp, Mus musculus
accaatcagccagaacagcgatgga

SEQ ID NO: 863516 - DNA, 25 bp, Mus musculus
accaatcagccagcagaacagcgat

SEQ ID NO: 863517 - DNA, 25 bp, Mus musculus
accaatcagccagccttcgaccatg

SEQ ID NO: 863518 - DNA, 25 bp, Mus musculus
accaatccagcatctggatctctta

SEQ ID NO: 863519 - DNA, 25 bp, Mus musculus
accaatccaggatctggatctctta

SEQ ID NO: 863520 - DNA, 25 bp, Mus musculus
accaatctattacgcatcagaccat

SEQ ID NO: 863521 - DNA, 25 bp, Mus musculus
accaatctattacggaaagagatac

SEQ ID NO: 863522 - DNA, 25 bp, Mus musculus
accaatctattaggcatcagaccat

SEQ ID NO: 863523 - DNA, 25 bp, Mus musculus
accaatctattagggaaagagatac

SEQ ID NO: 863524 - DNA, 25 bp, Mus musculus
accaatgacacagacgggctggctg

SEQ ID NO: 863525 - DNA, 25 bp, Mus musculus
accaatgacacagacgtggcggaga

SEQ ID NO: 863526 - DNA, 25 bp, Mus musculus
accaatgacacagaggggctggctg

SEQ ID NO: 863527 - DNA, 25 bp, Mus musculus
accaatgacacagaggtggcggaga

SEQ ID NO: 863528 - DNA, 25 bp, Mus musculus
accaatgatgtgaacgccctgcttg

SEQ ID NO: 863529 - DNA, 25 bp, Mus musculus
accaatgatgtgaaggccctgcttg

SEQ ID NO: 863530 - DNA, 25 bp, Mus musculus
accaatggcgacattctttcagaag

SEQ ID NO: 863531 - DNA, 25 bp, Mus musculus
accaatggcgactttctttcagaag

SEQ ID NO: 863532 - DNA, 25 bp, Mus musculus
accaatgtcctgatttcagagtggg

SEQ ID NO: 863533 - DNA, 25 bp, Mus musculus
accaatgtcctgttttcagagtggg

SEQ ID NO: 863534 - DNA, 25 bp, Mus musculus
accaattccacactgttcaacctca

SEQ ID NO: 863535 - DNA, 25 bp, Mus musculus
accaattccagactgttcaacctca

SEQ ID NO: 863536 - DNA, 25 bp, Mus musculus
accaattccttggacgttcattctg

SEQ ID NO: 863537 - DNA, 25 bp, Mus musculus
accaattccttggaggttcattctg

SEQ ID NO: 863538 - DNA, 25 bp, Mus musculus
accaattggagaagagcaaaaggat

SEQ ID NO: 863539 - DNA, 25 bp, Mus musculus
accaattggagaagtgcaaaaggat

SEQ ID NO: 863540 - DNA, 25 bp, Mus musculus
accacaaacaagcttcatgccatcc

SEQ ID NO: 863541 - DNA, 25 bp, Mus musculus
accacaaacaaggttcatgccatcc

SEQ ID NO: 863542 - DNA, 25 bp, Mus musculus
accacaaatccaaatggaacataac

SEQ ID NO: 863543 - DNA, 25 bp, Mus musculus
accacaaatccatatggaacataac

SEQ ID NO: 863544 - DNA, 25 bp, Mus musculus
accacaacacaacaatcttgggata

SEQ ID NO: 863545 - DNA, 25 bp, Mus musculus
accacaacacaagaatcttgggata

SEQ ID NO: 863546 - DNA, 25 bp, Mus musculus
accacaaccacctgctgaaccgaat

SEQ ID NO: 863547 - DNA, 25 bp, Mus musculus
accacaaccagctgctgaaccgaat

SEQ ID NO: 863548 - DNA, 25 bp, Mus musculus
accacaaccatcaacgtcattattg

SEQ ID NO: 863549 - DNA, 25 bp, Mus musculus
accacaaccatcaaggtcattattg

SEQ ID NO: 863550 - DNA, 25 bp, Mus musculus
accacaagttctctctcttcagcac

SEQ ID NO: 863551 - DNA, 25 bp, Mus musculus
accacaagttctgtctcttcagcac

SEQ ID NO: 863552 - DNA, 25 bp, Mus musculus
accacacaagccttcctgaattact

SEQ ID NO: 863553 - DNA, 25 bp, Mus musculus
accacacaaggcttcctgaattact

SEQ ID NO: 863554 - DNA, 25 bp, Mus musculus
accacacagaagaatctctcctttg

SEQ ID NO: 863555 - DNA, 25 bp, Mus musculus
accacacagaagtatctctcctttg

SEQ ID NO: 863556 - DNA, 25 bp, Mus musculus
accacacaggacaccctgaagctgt

SEQ ID NO: 863557 - DNA, 25 bp, Mus musculus
accacacaggactccctgaagctgt

SEQ ID NO: 863558 - DNA, 25 bp, Mus musculus
accacaccacagccggtgtctattg

SEQ ID NO: 863559 - DNA, 25 bp, Mus musculus
accacaccacaggcggtgtctattg

SEQ ID NO: 863560 - DNA, 25 bp, Mus musculus
accacaccagatcctctaattcttt

SEQ ID NO: 863561 - DNA, 25 bp, Mus musculus
accacaccagcattcggaggggttt

SEQ ID NO: 863562 - DNA, 25 bp, Mus musculus
accacaccaggattcggaggggttt

SEQ ID NO: 863563 - DNA, 25 bp, Mus musculus
accacaccagttcctctaattcttt

SEQ ID NO: 863564 - DNA, 25 bp, Mus musculus
accacacctgactcctccttcacat

SEQ ID NO: 863565 - DNA, 25 bp, Mus musculus
accacacctgtctcctccttcacat

SEQ ID NO: 863566 - DNA, 25 bp, Mus musculus
accacacttccccgtctgtatgctg

SEQ ID NO: 863567 - DNA, 25 bp, Mus musculus
accacacttcccggtctgtatgctg

SEQ ID NO: 863568 - DNA, 25 bp, Mus musculus
accacagactagaacagcagcaaac

SEQ ID NO: 863569 - DNA, 25 bp, Mus musculus
accacagacttgaacagcagcaaac

SEQ ID NO: 863570 - DNA, 25 bp, Mus musculus
accacagagaaactgagcaaaatca

SEQ ID NO: 863571 - DNA, 25 bp, Mus musculus
accacagagaaagtgagcaaaatca

SEQ ID NO: 863572 - DNA, 25 bp, Mus musculus
accacagaggcaaacatcttcagtg

SEQ ID NO: 863573 - DNA, 25 bp, Mus musculus
accacagagggaaacatcttcagtg

SEQ ID NO: 863574 - DNA, 25 bp, Mus musculus
accacagatgccatcactctggcca

SEQ ID NO: 863575 - DNA, 25 bp, Mus musculus
accacagatggcatcactctggcca

SEQ ID NO: 863576 - DNA, 25 bp, Mus musculus
accacagcagaactgtctggccttt

SEQ ID NO: 863577 - DNA, 25 bp, Mus musculus
accacagcagccactacagactcga

SEQ ID NO: 863578 - DNA, 25 bp, Mus musculus
accacagcagcgcaacccagagaga

SEQ ID NO: 863579 - DNA, 25 bp, Mus musculus
accacagcaggcactacagactcga

SEQ ID NO: 863580 - DNA, 25 bp, Mus musculus
accacagcagggcaacccagagaga

SEQ ID NO: 863581 - DNA, 25 bp, Mus musculus
accacagcagtactgtctggccttt

SEQ ID NO: 863582 - DNA, 25 bp, Mus musculus
accacagccaagcacccctgcgctc

SEQ ID NO: 863583 - DNA, 25 bp, Mus musculus
accacagccaaggacccctgcgctc

SEQ ID NO: 863584 - DNA, 25 bp, Mus musculus
accacagccgcttccgcattctgga

SEQ ID NO: 863585 - DNA, 25 bp, Mus musculus
accacagccgcttcggcattctgga

SEQ ID NO: 863586 - DNA, 25 bp, Mus musculus
accacagccggggacgtggtggaga

SEQ ID NO: 863587 - DNA, 25 bp, Mus musculus
accacagccggggaggtggtggaga

SEQ ID NO: 863588 - DNA, 25 bp, Mus musculus
accacagctgcagaaatatctagaa

SEQ ID NO: 863589 - DNA, 25 bp, Mus musculus
accacagctggagaaatatctagaa

SEQ ID NO: 863590 - DNA, 25 bp, Mus musculus
accacaggaatgcgtgccatctatg

SEQ ID NO: 863591 - DNA, 25 bp, Mus musculus
accacaggaatgggtgccatctatg

SEQ ID NO: 863592 - DNA, 25 bp, Mus musculus
accacaggagcaggtgttacagcca

SEQ ID NO: 863593 - DNA, 25 bp, Mus musculus
accacaggagctgttacagccattg

SEQ ID NO: 863594 - DNA, 25 bp, Mus musculus
accacaggaggaggtgttacagcca

SEQ ID NO: 863595 - DNA, 25 bp, Mus musculus
accacaggaggtgttacagccattg

SEQ ID NO: 863596 - DNA, 25 bp, Mus musculus
accacagtaaggacacgaagttggg

SEQ ID NO: 863597 - DNA, 25 bp, Mus musculus
accacagtaaggtcacgaagttggg

SEQ ID NO: 863598 - DNA, 25 bp, Mus musculus
accacagtatggcagttatggaaca

SEQ ID NO: 863599 - DNA, 25 bp, Mus musculus
accacagtatgggagttatggaaca

SEQ ID NO: 863600 - DNA, 25 bp, Mus musculus
accaccaaagctgcctactcacttt

SEQ ID NO: 863601 - DNA, 25 bp, Mus musculus
accaccaaaggtgcctactcacttt

SEQ ID NO: 863602 - DNA, 25 bp, Mus musculus
accaccaaatgacacctatggccct

SEQ ID NO: 863603 - DNA, 25 bp, Mus musculus
accaccaaatgacagctatggccct

SEQ ID NO: 863604 - DNA, 25 bp, Mus musculus
accaccacagacttcccacaaccca

SEQ ID NO: 863605 - DNA, 25 bp, Mus musculus
accaccacagagctccgatgtctgg

SEQ ID NO: 863606 - DNA, 25 bp, Mus musculus
accaccacagcacgcactacagact

SEQ ID NO: 863607 - DNA, 25 bp, Mus musculus
accaccacagcaggcactacagact

SEQ ID NO: 863608 - DNA, 25 bp, Mus musculus
accaccacagctcgagaaatatcta

SEQ ID NO: 863609 - DNA, 25 bp, Mus musculus
accaccacagctggagaaatatcta

SEQ ID NO: 863610 - DNA, 25 bp, Mus musculus
accaccacagtcttcccacaaccca

SEQ ID NO: 863611 - DNA, 25 bp, Mus musculus
accaccacagtgctccgatgtctgg

SEQ ID NO: 863612 - DNA, 25 bp, Mus musculus
accaccactagtctgtcacatcaag

SEQ ID NO: 863613 - DNA, 25 bp, Mus musculus
accaccactagtgtgtcacatcaag

SEQ ID NO: 863614 - DNA, 25 bp, Mus musculus
accaccactgctacagcagcaaggg

SEQ ID NO: 863615 - DNA, 25 bp, Mus musculus
accaccactggtacagcagcaaggg

SEQ ID NO: 863616 - DNA, 25 bp, Mus musculus
accaccagcccccagtgtgaggaac

SEQ ID NO: 863617 - DNA, 25 bp, Mus musculus
accaccagccccgagtgtgaggaac

SEQ ID NO: 863618 - DNA, 25 bp, Mus musculus
accaccaggaagcgtgttaggagtg

SEQ ID NO: 863619 - DNA, 25 bp, Mus musculus
accaccaggaagggtgttaggagtg

SEQ ID NO: 863620 - DNA, 25 bp, Mus musculus
accaccatgacaacaagtacttgct

SEQ ID NO: 863621 - DNA, 25 bp, Mus musculus
accaccatgagaacaagtacttgct

SEQ ID NO: 863622 - DNA, 25 bp, Mus musculus
accaccatgagagacttccagacag

SEQ ID NO: 863623 - DNA, 25 bp, Mus musculus
accaccatgagagagttccagacag

SEQ ID NO: 863624 - DNA, 25 bp, Mus musculus
accaccatgataatggaccatgtgt

SEQ ID NO: 863625 - DNA, 25 bp, Mus musculus
accaccatgatattggaccatgtgt

SEQ ID NO: 863626 - DNA, 25 bp, Mus musculus
accaccattttgcaagaaccatatg

SEQ ID NO: 863627 - DNA, 25 bp, Mus musculus
accaccattttggaagaaccatatg

SEQ ID NO: 863628 - DNA, 25 bp, Mus musculus
accacccagcagctagaagaaaaac

SEQ ID NO: 863629 - DNA, 25 bp, Mus musculus
accacccagcaggtagaagaaaaac

SEQ ID NO: 863630 - DNA, 25 bp, Mus musculus
accacccatcacaccctgcctgcag

SEQ ID NO: 863631 - DNA, 25 bp, Mus musculus
accacccatcacacgctgcctgcag

SEQ ID NO: 863632 - DNA, 25 bp, Mus musculus
accacccctgcacacgcaggtcctg

SEQ ID NO: 863633 - DNA, 25 bp, Mus musculus
accacccctgcacaggcaggtcctg

SEQ ID NO: 863634 - DNA, 25 bp, Mus musculus
accaccctggttcgtggatataaag

SEQ ID NO: 863635 - DNA, 25 bp, Mus musculus
accaccctggttggtggatataaag

SEQ ID NO: 863636 - DNA, 25 bp, Mus musculus
accaccctgtgagacatctactgcc

SEQ ID NO: 863637 - DNA, 25 bp, Mus musculus
accaccctgtgagacccagatctac

SEQ ID NO: 863638 - DNA, 25 bp, Mus musculus
accaccctgtgagagatctactgcc

SEQ ID NO: 863639 - DNA, 25 bp, Mus musculus
accaccctgtgagagccagatctac

SEQ ID NO: 863640 - DNA, 25 bp, Mus musculus
accacccttcatgccccctccaggg

SEQ ID NO: 863641 - DNA, 25 bp, Mus musculus
accacccttcttgccccctccaggg

SEQ ID NO: 863642 - DNA, 25 bp, Mus musculus
accaccgatttctgcctagtgagga

SEQ ID NO: 863643 - DNA, 25 bp, Mus musculus
accaccgatttctggctagtgagga

SEQ ID NO: 863644 - DNA, 25 bp, Mus musculus
accaccgcggccgtccagttggaat

SEQ ID NO: 863645 - DNA, 25 bp, Mus musculus
accaccgcggccgtgcagttggaat

SEQ ID NO: 863646 - DNA, 25 bp, Mus musculus
accaccgctgacgatgcagatcttt

SEQ ID NO: 863647 - DNA, 25 bp, Mus musculus
accaccgctgtcgatgcagatcttt

SEQ ID NO: 863648 - DNA, 25 bp, Mus musculus
accaccgtcgagggggagcccatca

SEQ ID NO: 863649 - DNA, 25 bp, Mus musculus
accaccgtcgtgggggagcccatca

SEQ ID NO: 863650 - DNA, 25 bp, Mus musculus
accacctatgagcaagtccctccac

SEQ ID NO: 863651 - DNA, 25 bp, Mus musculus
accacctatgcaagtccctccacgg

SEQ ID NO: 863652 - DNA, 25 bp, Mus musculus
accacctatggaagtccctccacgg

SEQ ID NO: 863653 - DNA, 25 bp, Mus musculus
accacctatgtgcaagtccctccac

SEQ ID NO: 863654 - DNA, 25 bp, Mus musculus
accacctcagacattcttacactgg

SEQ ID NO: 863655 - DNA, 25 bp, Mus musculus
accacctcagcagtgaagcgtgtcc

SEQ ID NO: 863656 - DNA, 25 bp, Mus musculus
accacctcaggagtgaagcgtgtcc

SEQ ID NO: 863657 - DNA, 25 bp, Mus musculus
accacctcagtcattcttacactgg

SEQ ID NO: 863658 - DNA, 25 bp, Mus musculus
accacctcccaacattccactttga

SEQ ID NO: 863659 - DNA, 25 bp, Mus musculus
accacctcccaagattccactttga

SEQ ID NO: 863660 - DNA, 25 bp, Mus musculus
accacctgcaagccccacgatgtgt

SEQ ID NO: 863661 - DNA, 25 bp, Mus musculus
accacctgcaaggcccacgatgtgt

SEQ ID NO: 863662 - DNA, 25 bp, Mus musculus
accacctgtgctggactggtgatag

SEQ ID NO: 863663 - DNA, 25 bp, Mus musculus
accacctgtggtggactggtgatag

SEQ ID NO: 863664 - DNA, 25 bp, Mus musculus
accacctgttccagaagttggcatc

SEQ ID NO: 863665 - DNA, 25 bp, Mus musculus
accacctgttcctgaagttggcatc

SEQ ID NO: 863666 - DNA, 25 bp, Mus musculus
accaccttactgcgtaatgcatgtc

SEQ ID NO: 863667 - DNA, 25 bp, Mus musculus
accaccttactgggtaatgcatgtc

SEQ ID NO: 863668 - DNA, 25 bp, Mus musculus
accaccttcgaaactctgatcgtct

SEQ ID NO: 863669 - DNA, 25 bp, Mus musculus
accaccttcgaatctctgatcgtct

SEQ ID NO: 863670 - DNA, 25 bp, Mus musculus
accaccttggagaacataaaaatat

SEQ ID NO: 863671 - DNA, 25 bp, Mus musculus
accaccttggagaagataaaaatat

SEQ ID NO: 863672 - DNA, 25 bp, Mus musculus
accacctttgatgacatatgtgtca

SEQ ID NO: 863673 - DNA, 25 bp, Mus musculus
accacctttgatgagatatgtgtca

SEQ ID NO: 863674 - DNA, 25 bp, Mus musculus
accacgaaatgacgaagatgcaaca

SEQ ID NO: 863675 - DNA, 25 bp, Mus musculus
accacgaaatgaggaagatgcaaca

SEQ ID NO: 863676 - DNA, 25 bp, Mus musculus
accacgagatggccattgagccgct

SEQ ID NO: 863677 - DNA, 25 bp, Mus musculus
accacgagatgggcattgagccgct

SEQ ID NO: 863678 - DNA, 25 bp, Mus musculus
accacgcccttccacgtgactggtt

SEQ ID NO: 863679 - DNA, 25 bp, Mus musculus
accacgcccttccaggtgactggtt

SEQ ID NO: 863680 - DNA, 25 bp, Mus musculus
accacggagattagcggagccaggt

SEQ ID NO: 863681 - DNA, 25 bp, Mus musculus
accacggagattaggggagccaggt

SEQ ID NO: 863682 - DNA, 25 bp, Mus musculus
accacggctgcaaactccagtcagg

SEQ ID NO: 863683 - DNA, 25 bp, Mus musculus
accacggctggaaactccagtcagg

SEQ ID NO: 863684 - DNA, 25 bp, Mus musculus
accacgggattgaatattgcctgga

SEQ ID NO: 863685 - DNA, 25 bp, Mus musculus
accacgggattgtatattgcctgga

SEQ ID NO: 863686 - DNA, 25 bp, Mus musculus
accacgtcagaatgattcctgccaa

SEQ ID NO: 863687 - DNA, 25 bp, Mus musculus
accacgtcagtatgattcctgccaa

SEQ ID NO: 863688 - DNA, 25 bp, Mus musculus
accacgtgcaaacctttctgcaaag

SEQ ID NO: 863689 - DNA, 25 bp, Mus musculus
accacgtgcaaagctttctgcaaag

SEQ ID NO: 863690 - DNA, 25 bp, Mus musculus
accactacgcagataccgtgacggt

SEQ ID NO: 863691 - DNA, 25 bp, Mus musculus
accactacgcagcaggattacaacc

SEQ ID NO: 863692 - DNA, 25 bp, Mus musculus
accactacgcaggaggattacaacc

SEQ ID NO: 863693 - DNA, 25 bp, Mus musculus
accactacgcagttaccgtgacggt

SEQ ID NO: 863694 - DNA, 25 bp, Mus musculus
accactactacgaacgtggcatagg

SEQ ID NO: 863695 - DNA, 25 bp, Mus musculus
accactactacgaaggtggcatagg

SEQ ID NO: 863696 - DNA, 25 bp, Mus musculus
accactactcacctcgttcaaccag

SEQ ID NO: 863697 - DNA, 25 bp, Mus musculus
accactactcacctggttcaaccag

SEQ ID NO: 863698 - DNA, 25 bp, Mus musculus
accactagtgagtcacatcaagttg

SEQ ID NO: 863699 - DNA, 25 bp, Mus musculus
accactagtgtgtcacatcaagttg

SEQ ID NO: 863700 - DNA, 25 bp, Mus musculus
accactatcaagaacggtgtgactg

SEQ ID NO: 863701 - DNA, 25 bp, Mus musculus
accactatcaagaagggtgtgactg

SEQ ID NO: 863702 - DNA, 25 bp, Mus musculus
accactcaaaaggacgtctgtgggg

SEQ ID NO: 863703 - DNA, 25 bp, Mus musculus
accactcaaaaggaggtctgtgggg

SEQ ID NO: 863704 - DNA, 25 bp, Mus musculus
accactcccgatgcaactccagggc

SEQ ID NO: 863705 - DNA, 25 bp, Mus musculus
accactcccgcaagatgcaactcca

SEQ ID NO: 863706 - DNA, 25 bp, Mus musculus
accactcccggaagatgcaactcca

SEQ ID NO: 863707 - DNA, 25 bp, Mus musculus
accactcccgttgcaactccagggc

SEQ ID NO: 863708 - DNA, 25 bp, Mus musculus
accactcctctgcatcccagagtgc

SEQ ID NO: 863709 - DNA, 25 bp, Mus musculus
accactcctctggatcccagagtgc

SEQ ID NO: 863710 - DNA, 25 bp, Mus musculus
accactctgcagcgaacatcatggg

SEQ ID NO: 863711 - DNA, 25 bp, Mus musculus
accactctgcagggaacatcatggg

SEQ ID NO: 863712 - DNA, 25 bp, Mus musculus
accactctggaggacgtgttcctat

SEQ ID NO: 863713 - DNA, 25 bp, Mus musculus
accactctggaggaggtgttcctat

SEQ ID NO: 863714 - DNA, 25 bp, Mus musculus
accactgatgagagaggtcctccgg

SEQ ID NO: 863715 - DNA, 25 bp, Mus musculus
accactgatgagtgaggtcctccgg

SEQ ID NO: 863716 - DNA, 25 bp, Mus musculus
accactgattaacgattcaggaggg

SEQ ID NO: 863717 - DNA, 25 bp, Mus musculus
accactgattaaggattcaggaggg

SEQ ID NO: 863718 - DNA, 25 bp, Mus musculus
accactgctgagctcatatctcagc

SEQ ID NO: 863719 - DNA, 25 bp, Mus musculus
accactgctgaggtcatatctcagc

SEQ ID NO: 863720 - DNA, 25 bp, Mus musculus
accactggttgacatcctctttagg

SEQ ID NO: 863721 - DNA, 25 bp, Mus musculus
accactggttgacggcaatggcatc

SEQ ID NO: 863722 - DNA, 25 bp, Mus musculus
accactggttgagatcctctttagg

SEQ ID NO: 863723 - DNA, 25 bp, Mus musculus
accactggttgagggcaatggcatc

SEQ ID NO: 863724 - DNA, 25 bp, Mus musculus
accactgtatcaaacgctacctggg

SEQ ID NO: 863725 - DNA, 25 bp, Mus musculus
accactgtatcaaaggctacctggg

SEQ ID NO: 863726 - DNA, 25 bp, Mus musculus
accactgtggaacatttggctatcc

SEQ ID NO: 863727 - DNA, 25 bp, Mus musculus
accactgtggaagatttggctatcc

SEQ ID NO: 863728 - DNA, 25 bp, Mus musculus
accactgtgtcacgtgtggcccata

SEQ ID NO: 863729 - DNA, 25 bp, Mus musculus
accactgtgtcaggtgtggcccata

SEQ ID NO: 863730 - DNA, 25 bp, Mus musculus
accactgtgtgtctccctcgtgcct

SEQ ID NO: 863731 - DNA, 25 bp, Mus musculus
accactgtgtgtctgcctcgtgcct

SEQ ID NO: 863732 - DNA, 25 bp, Mus musculus
accacttacacacataccaggaatg

SEQ ID NO: 863733 - DNA, 25 bp, Mus musculus
accacttacacagataccaggaatg

SEQ ID NO: 863734 - DNA, 25 bp, Mus musculus
accacttatgggcctacaaagattt

SEQ ID NO: 863735 - DNA, 25 bp, Mus musculus
accacttatggggctacaaagattt

SEQ ID NO: 863736 - DNA, 25 bp, Mus musculus
accacttcaacacgactcatttcac

SEQ ID NO: 863737 - DNA, 25 bp, Mus musculus
accacttcaacaggactcatttcac

SEQ ID NO: 863738 - DNA, 25 bp, Mus musculus
accagaaaatgtgccggtggcaata

SEQ ID NO: 863739 - DNA, 25 bp, Mus musculus
accagaaaatgtgcgggtggcaata

SEQ ID NO: 863740 - DNA, 25 bp, Mus musculus
accagaacaatccattggaagaatt

SEQ ID NO: 863741 - DNA, 25 bp, Mus musculus
accagaacaatccggaacagactgc

SEQ ID NO: 863742 - DNA, 25 bp, Mus musculus
accagaacaatcgattggaagaatt

SEQ ID NO: 863743 - DNA, 25 bp, Mus musculus
accagaacaatcgggaacagactgc

SEQ ID NO: 863744 - DNA, 25 bp, Mus musculus
accagaaccacgatggctgcatcag

SEQ ID NO: 863745 - DNA, 25 bp, Mus musculus
accagaaccaggatggctgcatcag

SEQ ID NO: 863746 - DNA, 25 bp, Mus musculus
accagaacttctcacacaattgaca

SEQ ID NO: 863747 - DNA, 25 bp, Mus musculus
accagaacttctcagacaattgaca

SEQ ID NO: 863748 - DNA, 25 bp, Mus musculus
accagaagagaatacatattatggt

SEQ ID NO: 863749 - DNA, 25 bp, Mus musculus
accagaagagaatagatattatggt

SEQ ID NO: 863750 - DNA, 25 bp, Mus musculus
accagacaggagtgcgagtctgctg

SEQ ID NO: 863751 - DNA, 25 bp, Mus musculus
accagacaggagtgggagtctgctg

SEQ ID NO: 863752 - DNA, 25 bp, Mus musculus
accagacattgacgcaccacctacc

SEQ ID NO: 863753 - DNA, 25 bp, Mus musculus
accagacattgaggcaccacctacc

SEQ ID NO: 863754 - DNA, 25 bp, Mus musculus
accagacctgccccaggatccggtt

SEQ ID NO: 863755 - DNA, 25 bp, Mus musculus
accagacctggcccaggatccggtt

SEQ ID NO: 863756 - DNA, 25 bp, Mus musculus
accagactttgccacctcctttaag

SEQ ID NO: 863757 - DNA, 25 bp, Mus musculus
accagactttgccagctcctttaag

SEQ ID NO: 863758 - DNA, 25 bp, Mus musculus
accagagaagaagccacaggaagcc

SEQ ID NO: 863759 - DNA, 25 bp, Mus musculus
accagagaagagcaaggaaagcaat

SEQ ID NO: 863760 - DNA, 25 bp, Mus musculus
accagagaagaggaaggaaagcaat

SEQ ID NO: 863761 - DNA, 25 bp, Mus musculus
accagagaagcagaagccacaggaa

SEQ ID NO: 863762 - DNA, 25 bp, Mus musculus
accagagaaggagaagccacaggaa

SEQ ID NO: 863763 - DNA, 25 bp, Mus musculus
accagagaagtagccacaggaagcc

SEQ ID NO: 863764 - DNA, 25 bp, Mus musculus
accagagacaagctccactgggcag

SEQ ID NO: 863765 - DNA, 25 bp, Mus musculus
accagagacaaggtccactgggcag

SEQ ID NO: 863766 - DNA, 25 bp, Mus musculus
accagagagcagaattgactttggg

SEQ ID NO: 863767 - DNA, 25 bp, Mus musculus
accagagagcagtattgactttggg

SEQ ID NO: 863768 - DNA, 25 bp, Mus musculus
accagagagctgacattgaggcgga

SEQ ID NO: 863769 - DNA, 25 bp, Mus musculus
accagagagctgtcattgaggcgga

SEQ ID NO: 863770 - DNA, 25 bp, Mus musculus
accagagaggttcacatctctgctc

SEQ ID NO: 863771 - DNA, 25 bp, Mus musculus
accagagaggttcagatctctgctc

SEQ ID NO: 863772 - DNA, 25 bp, Mus musculus
accagagattcacatgtggagttgc

SEQ ID NO: 863773 - DNA, 25 bp, Mus musculus
accagagattcagatgtggagttgc

SEQ ID NO: 863774 - DNA, 25 bp, Mus musculus
accagagcaaagaacctgctgagtc

SEQ ID NO: 863775 - DNA, 25 bp, Mus musculus
accagagcaaagtacctgctgagtc

SEQ ID NO: 863776 - DNA, 25 bp, Mus musculus
accagagcaaccctttctatggcgt

SEQ ID NO: 863777 - DNA, 25 bp, Mus musculus
accagagcaaccgtttctatggcgt

SEQ ID NO: 863778 - DNA, 25 bp, Mus musculus
accagagcaaggactataatgatga

SEQ ID NO: 863779 - DNA, 25 bp, Mus musculus
accagagcaaggtctataatgatga

SEQ ID NO: 863780 - DNA, 25 bp, Mus musculus
accagagccatgatccctttgcccc

SEQ ID NO: 863781 - DNA, 25 bp, Mus musculus
accagagccatgttccctttgcccc

SEQ ID NO: 863782 - DNA, 25 bp, Mus musculus
accagagcgatgagtggtcttttgg

SEQ ID NO: 863783 - DNA, 25 bp, Mus musculus
accagagcgatgtgtggtcttttgg

SEQ ID NO: 863784 - DNA, 25 bp, Mus musculus
accagaggaaagagagaaagtccaa

SEQ ID NO: 863785 - DNA, 25 bp, Mus musculus
accagaggaaagtgagaaagtccaa

SEQ ID NO: 863786 - DNA, 25 bp, Mus musculus
accagagtgacgagtggtctttcgg

SEQ ID NO: 863787 - DNA, 25 bp, Mus musculus
accagagtgacgtgtggtctttcgg

SEQ ID NO: 863788 - DNA, 25 bp, Mus musculus
accagagtgatgattggtcttttgg

SEQ ID NO: 863789 - DNA, 25 bp, Mus musculus
accagagtgatgtttggtcttttgg

SEQ ID NO: 863790 - DNA, 25 bp, Mus musculus
accagagttcagaaagtactgccca

SEQ ID NO: 863791 - DNA, 25 bp, Mus musculus
accagagttcagtaagtactgccca

SEQ ID NO: 863792 - DNA, 25 bp, Mus musculus
accagatatcagcgtgtgaaccttt

SEQ ID NO: 863793 - DNA, 25 bp, Mus musculus
accagatatcagggtgtgaaccttt

SEQ ID NO: 863794 - DNA, 25 bp, Mus musculus
accagatgaaatcgcagaatcctct

SEQ ID NO: 863795 - DNA, 25 bp, Mus musculus
accagatgaattcgcagaatcctct

SEQ ID NO: 863796 - DNA, 25 bp, Mus musculus
accagatgagcacgctaacatccac

SEQ ID NO: 863797 - DNA, 25 bp, Mus musculus
accagatgagcaggctaacatccac

SEQ ID NO: 863798 - DNA, 25 bp, Mus musculus
accagatgccagcatgttgatgaat

SEQ ID NO: 863799 - DNA, 25 bp, Mus musculus
accagatgccaggatgttgatgaat

SEQ ID NO: 863800 - DNA, 25 bp, Mus musculus
accagcaacaaccccccttttgtca

SEQ ID NO: 863801 - DNA, 25 bp, Mus musculus
accagcaacaacccgccttttgtca

SEQ ID NO: 863802 - DNA, 25 bp, Mus musculus
accagcaacccacattgcttcatgg

SEQ ID NO: 863803 - DNA, 25 bp, Mus musculus
accagcaacccagattgcttcatgg

SEQ ID NO: 863804 - DNA, 25 bp, Mus musculus
accagcaactcccatgacaaatcga

SEQ ID NO: 863805 - DNA, 25 bp, Mus musculus
accagcaactgaaaagtgaacttca

SEQ ID NO: 863806 - DNA, 25 bp, Mus musculus
accagcaactgataagtgaacttca

SEQ ID NO: 863807 - DNA, 25 bp, Mus musculus
accagcaactgccatgacaaatcga

SEQ ID NO: 863808 - DNA, 25 bp, Mus musculus
accagcacaaagcgtgctgaatcca

SEQ ID NO: 863809 - DNA, 25 bp, Mus musculus
accagcacaaagggtgctgaatcca

SEQ ID NO: 863810 - DNA, 25 bp, Mus musculus
accagcacaaggccagttggtagca

SEQ ID NO: 863811 - DNA, 25 bp, Mus musculus
accagcacaaggcttggtagcaaga

SEQ ID NO: 863812 - DNA, 25 bp, Mus musculus
accagcacaagggcagttggtagca

SEQ ID NO: 863813 - DNA, 25 bp, Mus musculus
accagcacaagggttggtagcaaga

SEQ ID NO: 863814 - DNA, 25 bp, Mus musculus
accagcacctaccactacctagaac

SEQ ID NO: 863815 - DNA, 25 bp, Mus musculus
accagcacctaccagtacctagaac

SEQ ID NO: 863816 - DNA, 25 bp, Mus musculus
accagcacgacttgcctctgctgcg

SEQ ID NO: 863817 - DNA, 25 bp, Mus musculus
accagcacgacttggctctgctgcg

SEQ ID NO: 863818 - DNA, 25 bp, Mus musculus
accagcagaaaacccgttgctgtgg

SEQ ID NO: 863819 - DNA, 25 bp, Mus musculus
accagcagaaaaccggttgctgtgg

SEQ ID NO: 863820 - DNA, 25 bp, Mus musculus
accagcagcacgcaggacttccctg

SEQ ID NO: 863821 - DNA, 25 bp, Mus musculus
accagcagcacggaggacttccctg

SEQ ID NO: 863822 - DNA, 25 bp, Mus musculus
accagcagcataacatgagattgac

SEQ ID NO: 863823 - DNA, 25 bp, Mus musculus
accagcagcatatcatgagattgac

SEQ ID NO: 863824 - DNA, 25 bp, Mus musculus
accagcagctgcagaacatggacaa

SEQ ID NO: 863825 - DNA, 25 bp, Mus musculus
accagcagctgcagtacatggacaa

SEQ ID NO: 863826 - DNA, 25 bp, Mus musculus
accagcagtgccatcttctgctgtg

SEQ ID NO: 863827 - DNA, 25 bp, Mus musculus
accagcagtggcatcttctgctgtg

SEQ ID NO: 863828 - DNA, 25 bp, Mus musculus
accagccaaacacgcgctctcaggt

SEQ ID NO: 863829 - DNA, 25 bp, Mus musculus
accagccaaacacgggctctcaggt

SEQ ID NO: 863830 - DNA, 25 bp, Mus musculus
accagccacgaactcccttctgcag

SEQ ID NO: 863831 - DNA, 25 bp, Mus musculus
accagccacgaagtcccttctgcag

SEQ ID NO: 863832 - DNA, 25 bp, Mus musculus
accagccagaaaatcgacatttggg

SEQ ID NO: 863833 - DNA, 25 bp, Mus musculus
accagccagaaaatggacatttggg

SEQ ID NO: 863834 - DNA, 25 bp, Mus musculus
accagccccgagtgtgaggaacaca

SEQ ID NO: 863835 - DNA, 25 bp, Mus musculus
accagccccgtgtgtgaggaacaca

SEQ ID NO: 863836 - DNA, 25 bp, Mus musculus
accagccctcctggctgcaatatca

SEQ ID NO: 863837 - DNA, 25 bp, Mus musculus
accagccctcgtggctgcaatatca

SEQ ID NO: 863838 - DNA, 25 bp, Mus musculus
accagccctgccccagcaccaccta

SEQ ID NO: 863839 - DNA, 25 bp, Mus musculus
accagccctgcccctgcaccaccta

SEQ ID NO: 863840 - DNA, 25 bp, Mus musculus
accagcctacagcactgggaatttg

SEQ ID NO: 863841 - DNA, 25 bp, Mus musculus
accagcctacaggactgggaatttg

SEQ ID NO: 863842 - DNA, 25 bp, Mus musculus
accagcctcacatcccaggtttagc

SEQ ID NO: 863843 - DNA, 25 bp, Mus musculus
accagcctcacatcgcaggtttagc

SEQ ID NO: 863844 - DNA, 25 bp, Mus musculus
accagcctgacacatttctatcact

SEQ ID NO: 863845 - DNA, 25 bp, Mus musculus
accagcctgacagatttctatcact

SEQ ID NO: 863846 - DNA, 25 bp, Mus musculus
accagcctttacaggacgcctttga

SEQ ID NO: 863847 - DNA, 25 bp, Mus musculus
accagcctttactggacgcctttga

SEQ ID NO: 863848 - DNA, 25 bp, Mus musculus
accagcgcgaagctgatgctagaag

SEQ ID NO: 863849 - DNA, 25 bp, Mus musculus
accagcgcgaaggtgatgctagaag

SEQ ID NO: 863850 - DNA, 25 bp, Mus musculus
accagcggcaagcctgagactggtg

SEQ ID NO: 863851 - DNA, 25 bp, Mus musculus
accagcggcaaggctgagactggtg

SEQ ID NO: 863852 - DNA, 25 bp, Mus musculus
accagctaagctttgcagccagcct

SEQ ID NO: 863853 - DNA, 25 bp, Mus musculus
accagctaaggtttgcagccagcct

SEQ ID NO: 863854 - DNA, 25 bp, Mus musculus
accagctagaaacgagatgtccctg

SEQ ID NO: 863855 - DNA, 25 bp, Mus musculus
accagctagaaacttctcctctgtt

SEQ ID NO: 863856 - DNA, 25 bp, Mus musculus
accagctagaaaggagatgtccctg

SEQ ID NO: 863857 - DNA, 25 bp, Mus musculus
accagctagaaagttctcctctgtt

SEQ ID NO: 863858 - DNA, 25 bp, Mus musculus
accagctcagcaaagagtacacact

SEQ ID NO: 863859 - DNA, 25 bp, Mus musculus
accagctcagcatagagtacacact

SEQ ID NO: 863860 - DNA, 25 bp, Mus musculus
accagctctgtgcacgtatataatt

SEQ ID NO: 863861 - DNA, 25 bp, Mus musculus
accagctctgtgcaggtatataatt

SEQ ID NO: 863862 - DNA, 25 bp, Mus musculus
accagctgatccagataccgctatt

SEQ ID NO: 863863 - DNA, 25 bp, Mus musculus
accagctgatcctgataccgctatt

SEQ ID NO: 863864 - DNA, 25 bp, Mus musculus
accagctgcgcgcctgtcaagctga

SEQ ID NO: 863865 - DNA, 25 bp, Mus musculus
accagctgcgggcctgtcaagctga

SEQ ID NO: 863866 - DNA, 25 bp, Mus musculus
accagctggcaacgttatgaaaact

SEQ ID NO: 863867 - DNA, 25 bp, Mus musculus
accagctggcaaggttatgaaaact

SEQ ID NO: 863868 - DNA, 25 bp, Mus musculus
accagctgggccaaagaaaaccaac

SEQ ID NO: 863869 - DNA, 25 bp, Mus musculus
accagctgggccaatgaaaaccaac

SEQ ID NO: 863870 - DNA, 25 bp, Mus musculus
accagcttatgacgattgaggaggc

SEQ ID NO: 863871 - DNA, 25 bp, Mus musculus
accagcttatgaggattgaggaggc

SEQ ID NO: 863872 - DNA, 25 bp, Mus musculus
accagcttctatagaggaagggtcc

SEQ ID NO: 863873 - DNA, 25 bp, Mus musculus
accagcttctattgaggaagggtcc

SEQ ID NO: 863874 - DNA, 25 bp, Mus musculus
accagcttctccctcgatttgagct

SEQ ID NO: 863875 - DNA, 25 bp, Mus musculus
accagcttctccctggatttgagct

SEQ ID NO: 863876 - DNA, 25 bp, Mus musculus
accagcttgttctgcgacgcactct

SEQ ID NO: 863877 - DNA, 25 bp, Mus musculus
accagcttgttctgggacgcactct

SEQ ID NO: 863878 - DNA, 25 bp, Mus musculus
accagctttagtcctcaaaggccag

SEQ ID NO: 863879 - DNA, 25 bp, Mus musculus
accagctttagtgctcaaaggccag

SEQ ID NO: 863880 - DNA, 25 bp, Mus musculus
accaggaaggctgttaggagtggat

SEQ ID NO: 863881 - DNA, 25 bp, Mus musculus
accaggaagggtgttaggagtggat

SEQ ID NO: 863882 - DNA, 25 bp, Mus musculus
accaggaagtatggacctgggcatc

SEQ ID NO: 863883 - DNA, 25 bp, Mus musculus
accaggaagtttggacctgggcatc

SEQ ID NO: 863884 - DNA, 25 bp, Mus musculus
accaggacagcattccccctctgtg

SEQ ID NO: 863885 - DNA, 25 bp, Mus musculus
accaggacaggattccccctctgtg

SEQ ID NO: 863886 - DNA, 25 bp, Mus musculus
accaggagcccagacaactgcctcc

SEQ ID NO: 863887 - DNA, 25 bp, Mus musculus
accaggagcccagagaactgcctcc

SEQ ID NO: 863888 - DNA, 25 bp, Mus musculus
accaggagctgaaggattaacagga

SEQ ID NO: 863889 - DNA, 25 bp, Mus musculus
accaggagctgatggattaacagga

SEQ ID NO: 863890 - DNA, 25 bp, Mus musculus
accaggatactggaccttgcctctc

SEQ ID NO: 863891 - DNA, 25 bp, Mus musculus
accaggatactggagcttgcctctc

SEQ ID NO: 863892 - DNA, 25 bp, Mus musculus
accaggatccccacctgtgcccctg

SEQ ID NO: 863893 - DNA, 25 bp, Mus musculus
accaggatccccaggcctcgctgga

SEQ ID NO: 863894 - DNA, 25 bp, Mus musculus
accaggatcccctcctgtgcccctg

SEQ ID NO: 863895 - DNA, 25 bp, Mus musculus
accaggatcccctggcctcgctgga

SEQ ID NO: 863896 - DNA, 25 bp, Mus musculus
accaggatggctcatatagacagaa

SEQ ID NO: 863897 - DNA, 25 bp, Mus musculus
accaggatggctgatatagacagaa

SEQ ID NO: 863898 - DNA, 25 bp, Mus musculus
accaggcaccagctcctgtttattg

SEQ ID NO: 863899 - DNA, 25 bp, Mus musculus
accaggcaccaggtcctgtttattg

SEQ ID NO: 863900 - DNA, 25 bp, Mus musculus
accaggcacccacagttttgctctg

SEQ ID NO: 863901 - DNA, 25 bp, Mus musculus
accaggcacccagagttttgctctg

SEQ ID NO: 863902 - DNA, 25 bp, Mus musculus
accaggcagaagccgacagacttat

SEQ ID NO: 863903 - DNA, 25 bp, Mus musculus
accaggcagaagctgggaagtcatc

SEQ ID NO: 863904 - DNA, 25 bp, Mus musculus
accaggcagaaggcgacagacttat

SEQ ID NO: 863905 - DNA, 25 bp, Mus musculus
accaggcagaaggtgggaagtcatc

SEQ ID NO: 863906 - DNA, 25 bp, Mus musculus
accaggcagctaaactgtgttatat

SEQ ID NO: 863907 - DNA, 25 bp, Mus musculus
accaggcagctaaagtgtgttatat

SEQ ID NO: 863908 - DNA, 25 bp, Mus musculus
accaggcatgagcggccataaaggg

SEQ ID NO: 863909 - DNA, 25 bp, Mus musculus
accaggcatgaggggccataaaggg

SEQ ID NO: 863910 - DNA, 25 bp, Mus musculus
accaggccaaggtgagagaacgatt

SEQ ID NO: 863911 - DNA, 25 bp, Mus musculus
accaggccaaggtgtgagaacgatt

SEQ ID NO: 863912 - DNA, 25 bp, Mus musculus
accaggcccgacagtttcttggaag

SEQ ID NO: 863913 - DNA, 25 bp, Mus musculus
accaggcccgactgtttcttggaag

SEQ ID NO: 863914 - DNA, 25 bp, Mus musculus
accaggcctagctcaagtcttttat

SEQ ID NO: 863915 - DNA, 25 bp, Mus musculus
accaggcctagctctagtcttttat

SEQ ID NO: 863916 - DNA, 25 bp, Mus musculus
accaggctctttcacccgtggccca

SEQ ID NO: 863917 - DNA, 25 bp, Mus musculus
accaggctctttcagccgtggccca

SEQ ID NO: 863918 - DNA, 25 bp, Mus musculus
accaggctgcagccctgtgggccga

SEQ ID NO: 863919 - DNA, 25 bp, Mus musculus
accaggctgcaggcctgtgggccga

SEQ ID NO: 863920 - DNA, 25 bp, Mus musculus
accagggaaactcggatctgttggc

SEQ ID NO: 863921 - DNA, 25 bp, Mus musculus
accagggaaactgggatctgttggc

SEQ ID NO: 863922 - DNA, 25 bp, Mus musculus
accagggagagcgacaagaatttta

SEQ ID NO: 863923 - DNA, 25 bp, Mus musculus
accagggagagcgagaagaatttta

SEQ ID NO: 863924 - DNA, 25 bp, Mus musculus
accagggcaaagcgaagtttgccat

SEQ ID NO: 863925 - DNA, 25 bp, Mus musculus
accagggcaaagggaagtttgccat

SEQ ID NO: 863926 - DNA, 25 bp, Mus musculus
accagggctgtggacgtgatgccta

SEQ ID NO: 863927 - DNA, 25 bp, Mus musculus
accagggctgtggaggtgatgccta

SEQ ID NO: 863928 - DNA, 25 bp, Mus musculus
accaggggcaaccgcatcgccttct

SEQ ID NO: 863929 - DNA, 25 bp, Mus musculus
accaggggcaacggcatcgccttct

SEQ ID NO: 863930 - DNA, 25 bp, Mus musculus
accagggtcagccggagcacctggc

SEQ ID NO: 863931 - DNA, 25 bp, Mus musculus
accagggtcagcgggagcacctggc

SEQ ID NO: 863932 - DNA, 25 bp, Mus musculus
accagggttcagcgggcagacagca

SEQ ID NO: 863933 - DNA, 25 bp, Mus musculus
accagggttcagggggcagacagca

SEQ ID NO: 863934 - DNA, 25 bp, Mus musculus
accaggtccatgaccgaaatgcgac

SEQ ID NO: 863935 - DNA, 25 bp, Mus musculus
accaggtccatgacggaaatgcgac

SEQ ID NO: 863936 - DNA, 25 bp, Mus musculus
accaggtttcagccccacccagtgc

SEQ ID NO: 863937 - DNA, 25 bp, Mus musculus
accaggtttcaggcccacccagtgc

SEQ ID NO: 863938 - DNA, 25 bp, Mus musculus
accagtacagctcacagcctctgta

SEQ ID NO: 863939 - DNA, 25 bp, Mus musculus
accagtacaggtcacagcctctgta

SEQ ID NO: 863940 - DNA, 25 bp, Mus musculus
accagtacctcgagtggctcaccca

SEQ ID NO: 863941 - DNA, 25 bp, Mus musculus
accagtacctcgtgtggctcaccca

SEQ ID NO: 863942 - DNA, 25 bp, Mus musculus
accagtattcgaaacatgcactgct

SEQ ID NO: 863943 - DNA, 25 bp, Mus musculus
accagtattcgaaagatgcactgct

SEQ ID NO: 863944 - DNA, 25 bp, Mus musculus
accagtcactatctgctgtgagtgg

SEQ ID NO: 863945 - DNA, 25 bp, Mus musculus
accagtcactatgtgctgtgagtgg

SEQ ID NO: 863946 - DNA, 25 bp, Mus musculus
accagtcatgaggagaaccctgcct

SEQ ID NO: 863947 - DNA, 25 bp, Mus musculus
accagtcatgtggagaaccctgcct

SEQ ID NO: 863948 - DNA, 25 bp, Mus musculus
accagtcctgcccacctcaatggtg

SEQ ID NO: 863949 - DNA, 25 bp, Mus musculus
accagtcctgcccacgatggcagta

SEQ ID NO: 863950 - DNA, 25 bp, Mus musculus
accagtcctgcccagctcaatggtg

SEQ ID NO: 863951 - DNA, 25 bp, Mus musculus
accagtcctgcccaggatggcagta

SEQ ID NO: 863952 - DNA, 25 bp, Mus musculus
accagtctcatcaccgtgctggcat

SEQ ID NO: 863953 - DNA, 25 bp, Mus musculus
accagtctcatcacggtgctggcat

SEQ ID NO: 863954 - DNA, 25 bp, Mus musculus
accagtctccaacatggcggtaaat

SEQ ID NO: 863955 - DNA, 25 bp, Mus musculus
accagtctccaagatggcggtaaat

SEQ ID NO: 863956 - DNA, 25 bp, Mus musculus
accagtctttagctgacctgaataa

SEQ ID NO: 863957 - DNA, 25 bp, Mus musculus
accagtctttaggtgacctgaataa

SEQ ID NO: 863958 - DNA, 25 bp, Mus musculus
accagtgaaatgactgcccagaaaa

SEQ ID NO: 863959 - DNA, 25 bp, Mus musculus
accagtgaaatgtctgcccagaaaa

SEQ ID NO: 863960 - DNA, 25 bp, Mus musculus
accagtgaagaatttgacaaatttc

SEQ ID NO: 863961 - DNA, 25 bp, Mus musculus
accagtgaagtatttgacaaatttc

SEQ ID NO: 863962 - DNA, 25 bp, Mus musculus
accagtgactaaaactagtagaagg

SEQ ID NO: 863963 - DNA, 25 bp, Mus musculus
accagtgactaaaagtagtagaagg

SEQ ID NO: 863964 - DNA, 25 bp, Mus musculus
accagtgactccaatatgcctgaag

SEQ ID NO: 863965 - DNA, 25 bp, Mus musculus
accagtgactgcaatatgcctgaag

SEQ ID NO: 863966 - DNA, 25 bp, Mus musculus
accagtgcaaaactaatgatggagg

SEQ ID NO: 863967 - DNA, 25 bp, Mus musculus
accagtgcaaaagtaatgatggagg

SEQ ID NO: 863968 - DNA, 25 bp, Mus musculus
accagtgcccatcatcatctttgct

SEQ ID NO: 863969 - DNA, 25 bp, Mus musculus
accagtgcccatgatcatctttgct

SEQ ID NO: 863970 - DNA, 25 bp, Mus musculus
accagtggaaatcccactgctgaga

SEQ ID NO: 863971 - DNA, 25 bp, Mus musculus
accagtggaaatgccactgctgaga

SEQ ID NO: 863972 - DNA, 25 bp, Mus musculus
accagtgtgtcccacatttccagaa

SEQ ID NO: 863973 - DNA, 25 bp, Mus musculus
accagtgtgtcccagatttccagaa

SEQ ID NO: 863974 - DNA, 25 bp, Mus musculus
accagtgtgtggatgtggacgagtg

SEQ ID NO: 863975 - DNA, 25 bp, Mus musculus
accagtgtgtggttgtggacgagtg

SEQ ID NO: 863976 - DNA, 25 bp, Mus musculus
accagtgttacacgattcaactaat

SEQ ID NO: 863977 - DNA, 25 bp, Mus musculus
accagtgttacaggattcaactaat

SEQ ID NO: 863978 - DNA, 25 bp, Mus musculus
accagttcagctcctcagcaagaaa

SEQ ID NO: 863979 - DNA, 25 bp, Mus musculus
accagttcaggtcctcagcaagaaa

SEQ ID NO: 863980 - DNA, 25 bp, Mus musculus
accagttcatccgacagctgcagca

SEQ ID NO: 863981 - DNA, 25 bp, Mus musculus
accagttcatccgagagctgcagca

SEQ ID NO: 863982 - DNA, 25 bp, Mus musculus
accagttcgaggcggctgaagaata

SEQ ID NO: 863983 - DNA, 25 bp, Mus musculus
accagttcgagggggctgaagaata

SEQ ID NO: 863984 - DNA, 25 bp, Mus musculus
accagtttgacacgacacagagctg

SEQ ID NO: 863985 - DNA, 25 bp, Mus musculus
accagtttgacaggacacagagctg

SEQ ID NO: 863986 - DNA, 25 bp, Mus musculus
accataaagattcacttctctcgga

SEQ ID NO: 863987 - DNA, 25 bp, Mus musculus
accataaagattcagttctctcgga

SEQ ID NO: 863988 - DNA, 25 bp, Mus musculus
accatacactcgcacgagacaaagc

SEQ ID NO: 863989 - DNA, 25 bp, Mus musculus
accatacactcgcaggagacaaagc

SEQ ID NO: 863990 - DNA, 25 bp, Mus musculus
accatacatgcaccaaagaccagtg

SEQ ID NO: 863991 - DNA, 25 bp, Mus musculus
accatacatgcagcaaagaccagtg

SEQ ID NO: 863992 - DNA, 25 bp, Mus musculus
accataccaaaatggcagacctttc

SEQ ID NO: 863993 - DNA, 25 bp, Mus musculus
accataccaatatggcagacctttc

SEQ ID NO: 863994 - DNA, 25 bp, Mus musculus
accatactatatgcttttgccaaga

SEQ ID NO: 863995 - DNA, 25 bp, Mus musculus
accatactatccattatccaattgg

SEQ ID NO: 863996 - DNA, 25 bp, Mus musculus
accatactatgcattatccaattgg

SEQ ID NO: 863997 - DNA, 25 bp, Mus musculus
accatactatttgcttttgccaaga

SEQ ID NO: 863998 - DNA, 25 bp, Mus musculus
accatatgccaacagccaccgttcc

SEQ ID NO: 863999 - DNA, 25 bp, Mus musculus
accatatgccaagagccaccgttcc

SEQ ID NO: 864000 - DNA, 25 bp, Mus musculus
accatatttgagcatcgcgtctact

SEQ ID NO: 864001 - DNA, 25 bp, Mus musculus
accatatttgaggatcgcgtctact

SEQ ID NO: 864002 - DNA, 25 bp, Mus musculus
accatcaaaaagctggacagtgctc

SEQ ID NO: 864003 - DNA, 25 bp, Mus musculus
accatcaaaaaggtggacagtgctc

SEQ ID NO: 864004 - DNA, 25 bp, Mus musculus
accatcacaaagactgcttcatcca

SEQ ID NO: 864005 - DNA, 25 bp, Mus musculus
accatcacaaggactgatactcttg

SEQ ID NO: 864006 - DNA, 25 bp, Mus musculus
accatcacaaggtctgatactcttg

SEQ ID NO: 864007 - DNA, 25 bp, Mus musculus
accatcacaatgactgcttcatcca

SEQ ID NO: 864008 - DNA, 25 bp, Mus musculus
accatcacacagcctcggcccacac

SEQ ID NO: 864009 - DNA, 25 bp, Mus musculus
accatcacacaggctcggcccacac

SEQ ID NO: 864010 - DNA, 25 bp, Mus musculus
accatcaccaagctcctccagacaa

SEQ ID NO: 864011 - DNA, 25 bp, Mus musculus
accatcaccaaggtcctccagacaa

SEQ ID NO: 864012 - DNA, 25 bp, Mus musculus
accatcagtcctcacatgcggtgag

SEQ ID NO: 864013 - DNA, 25 bp, Mus musculus
accatcagtcctcagatgcggtgag

SEQ ID NO: 864014 - DNA, 25 bp, Mus musculus
accatcagtgatcccgatgttgccg

SEQ ID NO: 864015 - DNA, 25 bp, Mus musculus
accatcagtggatcagaccctgaaa

SEQ ID NO: 864016 - DNA, 25 bp, Mus musculus
accatcagtggatctgaccctgaaa

SEQ ID NO: 864017 - DNA, 25 bp, Mus musculus
accatcagtgttcccgatgttgccg

SEQ ID NO: 864018 - DNA, 25 bp, Mus musculus
accatcatcacacacaccacggcga

SEQ ID NO: 864019 - DNA, 25 bp, Mus musculus
accatcatcacacattctcgagcag

SEQ ID NO: 864020 - DNA, 25 bp, Mus musculus
accatcatcacagacaccacggcga

SEQ ID NO: 864021 - DNA, 25 bp, Mus musculus
accatcatcacagattctcgagcag

SEQ ID NO: 864022 - DNA, 25 bp, Mus musculus
accatcatgccacgtacccgcaaga

SEQ ID NO: 864023 - DNA, 25 bp, Mus musculus
accatcatgccaggtacccgcaaga

SEQ ID NO: 864024 - DNA, 25 bp, Mus musculus
accatcatggcgcgtttgagcaggt

SEQ ID NO: 864025 - DNA, 25 bp, Mus musculus
accatcatggcgggtttgagcaggt

SEQ ID NO: 864026 - DNA, 25 bp, Mus musculus
accatcccaaggcctgacccagtgc

SEQ ID NO: 864027 - DNA, 25 bp, Mus musculus
accatcccaagggctgacccagtgc

SEQ ID NO: 864028 - DNA, 25 bp, Mus musculus
accatcccagtacacgaagatgagt

SEQ ID NO: 864029 - DNA, 25 bp, Mus musculus
accatcccagtacaggaagatgagt

SEQ ID NO: 864030 - DNA, 25 bp, Mus musculus
accatcccagtgaattcagtcagca

SEQ ID NO: 864031 - DNA, 25 bp, Mus musculus
accatcccagtgtattcagtcagca

SEQ ID NO: 864032 - DNA, 25 bp, Mus musculus
accatcccatccactacaagggctc

SEQ ID NO: 864033 - DNA, 25 bp, Mus musculus
accatcccatgcactacaagggctc

SEQ ID NO: 864034 - DNA, 25 bp, Mus musculus
accatccccaagacatcaagcctcc

SEQ ID NO: 864035 - DNA, 25 bp, Mus musculus
accatccccaagtcatcaagcctcc

SEQ ID NO: 864036 - DNA, 25 bp, Mus musculus
accatccccacacatgacaacgttg

SEQ ID NO: 864037 - DNA, 25 bp, Mus musculus
accatccccacagatgacaacgttg

SEQ ID NO: 864038 - DNA, 25 bp, Mus musculus
accatccgagagggaatgctggttg

SEQ ID NO: 864039 - DNA, 25 bp, Mus musculus
accatccgagtgggaatgctggttg

SEQ ID NO: 864040 - DNA, 25 bp, Mus musculus
accatccgcccaattcagcctttta

SEQ ID NO: 864041 - DNA, 25 bp, Mus musculus
accatccgcccatttcagcctttta

SEQ ID NO: 864042 - DNA, 25 bp, Mus musculus
accatcctccaccccaatggtaaca

SEQ ID NO: 864043 - DNA, 25 bp, Mus musculus
accatcctccacccgaatggtaaca

SEQ ID NO: 864044 - DNA, 25 bp, Mus musculus
accatcctgaaacgcgagaaaggtg

SEQ ID NO: 864045 - DNA, 25 bp, Mus musculus
accatcctgaaaggcgagaaaggtg

SEQ ID NO: 864046 - DNA, 25 bp, Mus musculus
accatcgcagcggcggaacacaagt

SEQ ID NO: 864047 - DNA, 25 bp, Mus musculus
accatcgcaggggcggaacacaagt

SEQ ID NO: 864048 - DNA, 25 bp, Mus musculus
accatcgtcagccaatggctcgtgg

SEQ ID NO: 864049 - DNA, 25 bp, Mus musculus
accatcgtcagcgaatggctcgtgg

SEQ ID NO: 864050 - DNA, 25 bp, Mus musculus
accatcgtgactgactggaaccttg

SEQ ID NO: 864051 - DNA, 25 bp, Mus musculus
accatcgtgactgagtggaaccttg

SEQ ID NO: 864052 - DNA, 25 bp, Mus musculus
accatctacatggacgcccactctc

SEQ ID NO: 864053 - DNA, 25 bp, Mus musculus
accatctacatggaggcccactctc

SEQ ID NO: 864054 - DNA, 25 bp, Mus musculus
accatctattttcaggactattttt

SEQ ID NO: 864055 - DNA, 25 bp, Mus musculus
accatctattttgaggactattttt

SEQ ID NO: 864056 - DNA, 25 bp, Mus musculus
accatctgaaagctgggttgcaggc

SEQ ID NO: 864057 - DNA, 25 bp, Mus musculus
accatctgaaaggtgggttgcaggc

SEQ ID NO: 864058 - DNA, 25 bp, Mus musculus
accatctgctccacctgtttgatga

SEQ ID NO: 864059 - DNA, 25 bp, Mus musculus
accatctgctccacgtgtttgatga

SEQ ID NO: 864060 - DNA, 25 bp, Mus musculus
accatcttcaagccctgggctaaag

SEQ ID NO: 864061 - DNA, 25 bp, Mus musculus
accatcttcaaggcctgggctaaag

SEQ ID NO: 864062 - DNA, 25 bp, Mus musculus
accatctttgcacccaggattcaat

SEQ ID NO: 864063 - DNA, 25 bp, Mus musculus
accatctttgcatgaaagccccttc

SEQ ID NO: 864064 - DNA, 25 bp, Mus musculus
accatctttgcattcaattttttgc

SEQ ID NO: 864065 - DNA, 25 bp, Mus musculus
accatctttggacccaggattcaat

SEQ ID NO: 864066 - DNA, 25 bp, Mus musculus
accatctttggatgaaagccccttc

SEQ ID NO: 864067 - DNA, 25 bp, Mus musculus
accatctttggattcaattttttgc

SEQ ID NO: 864068 - DNA, 25 bp, Mus musculus
accatgaaaacaagagatgagacca

SEQ ID NO: 864069 - DNA, 25 bp, Mus musculus
accatgaaaagaagagatgagacca

SEQ ID NO: 864070 - DNA, 25 bp, Mus musculus
accatgaaagagctccagacgatgg

SEQ ID NO: 864071 - DNA, 25 bp, Mus musculus
accatgaaagctctatcatgacaga

SEQ ID NO: 864072 - DNA, 25 bp, Mus musculus
accatgaaaggtctatcatgacaga

SEQ ID NO: 864073 - DNA, 25 bp, Mus musculus
accatgaaagtgctccagacgatgg

SEQ ID NO: 864074 - DNA, 25 bp, Mus musculus
accatgaagcataacggctttgcct

SEQ ID NO: 864075 - DNA, 25 bp, Mus musculus
accatgaagcataagggctttgcct

SEQ ID NO: 864076 - DNA, 25 bp, Mus musculus
accatgaaggatcacgatgacgatg

SEQ ID NO: 864077 - DNA, 25 bp, Mus musculus
accatgaaggatcacgcccttaagg

SEQ ID NO: 864078 - DNA, 25 bp, Mus musculus
accatgaaggatcaggatgacgatg

SEQ ID NO: 864079 - DNA, 25 bp, Mus musculus
accatgaaggatcaggcccttaagg

SEQ ID NO: 864080 - DNA, 25 bp, Mus musculus
accatgaagtacctcaacgtgctgg

SEQ ID NO: 864081 - DNA, 25 bp, Mus musculus
accatgaagtacctgaacgtgctgg

SEQ ID NO: 864082 - DNA, 25 bp, Mus musculus
accatgaccgcgaactgtggggtga

SEQ ID NO: 864083 - DNA, 25 bp, Mus musculus
accatgaccgggaactgtggggtga

SEQ ID NO: 864084 - DNA, 25 bp, Mus musculus
accatgaccttgacttgatccggct

SEQ ID NO: 864085 - DNA, 25 bp, Mus musculus
accatgaccttgtcttgatccggct

SEQ ID NO: 864086 - DNA, 25 bp, Mus musculus
accatgagagacatccagacagaac

SEQ ID NO: 864087 - DNA, 25 bp, Mus musculus
accatgagagacttccagacagaac

SEQ ID NO: 864088 - DNA, 25 bp, Mus musculus
accatgagattgcgagcccagcgga

SEQ ID NO: 864089 - DNA, 25 bp, Mus musculus
accatgagattgggagcccagcgga

SEQ ID NO: 864090 - DNA, 25 bp, Mus musculus
accatgagcgaccaagatcactcca

SEQ ID NO: 864091 - DNA, 25 bp, Mus musculus
accatgagcgtccaagatcactcca

SEQ ID NO: 864092 - DNA, 25 bp, Mus musculus
accatgatataggaccatgtgtttc

SEQ ID NO: 864093 - DNA, 25 bp, Mus musculus
accatgatattggaccatgtgtttc

SEQ ID NO: 864094 - DNA, 25 bp, Mus musculus
accatgcaacagcctgctgttcatg

SEQ ID NO: 864095 - DNA, 25 bp, Mus musculus
accatgcaacaggctgctgttcatg

SEQ ID NO: 864096 - DNA, 25 bp, Mus musculus
accatggacgagcacattgtgattc

SEQ ID NO: 864097 - DNA, 25 bp, Mus musculus
accatggacgaggacattgtgattc

SEQ ID NO: 864098 - DNA, 25 bp, Mus musculus
accatggagaaaagcaaccatatct

SEQ ID NO: 864099 - DNA, 25 bp, Mus musculus
accatggagaaatgcaaccatatct

SEQ ID NO: 864100 - DNA, 25 bp, Mus musculus
accatggatccaccagtgagtgagg

SEQ ID NO: 864101 - DNA, 25 bp, Mus musculus
accatggatccagcagtgagtgagg

SEQ ID NO: 864102 - DNA, 25 bp, Mus musculus
accatggatcctaaattgtcagcaa

SEQ ID NO: 864103 - DNA, 25 bp, Mus musculus
accatggatccttaattgtcagcaa

SEQ ID NO: 864104 - DNA, 25 bp, Mus musculus
accatggcaacactggtgctgaccg

SEQ ID NO: 864105 - DNA, 25 bp, Mus musculus
accatggcaacagtggtgctgaccg

SEQ ID NO: 864106 - DNA, 25 bp, Mus musculus
accatggcaacatctccaaggagaa

SEQ ID NO: 864107 - DNA, 25 bp, Mus musculus
accatggcaagatctccaaggagaa

SEQ ID NO: 864108 - DNA, 25 bp, Mus musculus
accatggcagaacaaaaatcagatg

SEQ ID NO: 864109 - DNA, 25 bp, Mus musculus
accatggcagctacagagctatcgt

SEQ ID NO: 864110 - DNA, 25 bp, Mus musculus
accatggcaggtacagagctatcgt

SEQ ID NO: 864111 - DNA, 25 bp, Mus musculus
accatggcagtacaaaaatcagatg

SEQ ID NO: 864112 - DNA, 25 bp, Mus musculus
accatggccaagatggagttccaga

SEQ ID NO: 864113 - DNA, 25 bp, Mus musculus
accatggccaagttggagttccaga

SEQ ID NO: 864114 - DNA, 25 bp, Mus musculus
accatggcgttccacaatgacgtgt

SEQ ID NO: 864115 - DNA, 25 bp, Mus musculus
accatggcgttccagaatgacgtgt

SEQ ID NO: 864116 - DNA, 25 bp, Mus musculus
accatggcttaaaacccgaagaagc

SEQ ID NO: 864117 - DNA, 25 bp, Mus musculus
accatggcttaaaacctcgtgtggc

SEQ ID NO: 864118 - DNA, 25 bp, Mus musculus
accatggcttaaaagccgaagaagc

SEQ ID NO: 864119 - DNA, 25 bp, Mus musculus
accatggcttaaaagctcgtgtggc

SEQ ID NO: 864120 - DNA, 25 bp, Mus musculus
accatgggcaatcacacgtccccat

SEQ ID NO: 864121 - DNA, 25 bp, Mus musculus
accatgggcaatgacacgtccccat

SEQ ID NO: 864122 - DNA, 25 bp, Mus musculus
accatgggtgatcctcctgactatg

SEQ ID NO: 864123 - DNA, 25 bp, Mus musculus
accatgggtgatgctcctgactatg

SEQ ID NO: 864124 - DNA, 25 bp, Mus musculus
accatgtatacacatgccgatgaat

SEQ ID NO: 864125 - DNA, 25 bp, Mus musculus
accatgtatacagatgccgatgaat

SEQ ID NO: 864126 - DNA, 25 bp, Mus musculus
accatgtgcagcctgagctgctgtg

SEQ ID NO: 864127 - DNA, 25 bp, Mus musculus
accatgtgcagcgcactgagctgct

SEQ ID NO: 864128 - DNA, 25 bp, Mus musculus
accatgtgcagcgctctgagctgct

SEQ ID NO: 864129 - DNA, 25 bp, Mus musculus
accatgtgcagcgtgagctgctgtg

SEQ ID NO: 864130 - DNA, 25 bp, Mus musculus
accatgtgtgagcacgtgaatgagt

SEQ ID NO: 864131 - DNA, 25 bp, Mus musculus
accatgtgtgaggacgtgaatgagt

SEQ ID NO: 864132 - DNA, 25 bp, Mus musculus
accattagtataccaagaagccagt

SEQ ID NO: 864133 - DNA, 25 bp, Mus musculus
accattagtatagcaagaagccagt

SEQ ID NO: 864134 - DNA, 25 bp, Mus musculus
accattatcttgaatgtggaatggg

SEQ ID NO: 864135 - DNA, 25 bp, Mus musculus
accattatcttgtatgtggaatggg

SEQ ID NO: 864136 - DNA, 25 bp, Mus musculus
accattcaagccaacatcgagtaca

SEQ ID NO: 864137 - DNA, 25 bp, Mus musculus
accattcaagccattatttgaaatt

SEQ ID NO: 864138 - DNA, 25 bp, Mus musculus
accattcaagcctttatttgaaatt

SEQ ID NO: 864139 - DNA, 25 bp, Mus musculus
accattcaaggcaacatcgagtaca

SEQ ID NO: 864140 - DNA, 25 bp, Mus musculus
accattgaaaacccagcctgcagtt

SEQ ID NO: 864141 - DNA, 25 bp, Mus musculus
accattgaaatcccagcctgcagtt

SEQ ID NO: 864142 - DNA, 25 bp, Mus musculus
accattgaagctcctcaactttgac

SEQ ID NO: 864143 - DNA, 25 bp, Mus musculus
accattgaaggtcctcaactttgac

SEQ ID NO: 864144 - DNA, 25 bp, Mus musculus
accattgaccagcctgtgcagatta

SEQ ID NO: 864145 - DNA, 25 bp, Mus musculus
accattgaccaggctgtgcagatta

SEQ ID NO: 864146 - DNA, 25 bp, Mus musculus
accattggagccagagcaccctgct

SEQ ID NO: 864147 - DNA, 25 bp, Mus musculus
accattggaggcagagcaccctgct

SEQ ID NO: 864148 - DNA, 25 bp, Mus musculus
accattggcaggcacctgattgagg

SEQ ID NO: 864149 - DNA, 25 bp, Mus musculus
accattggcagggacctgattgagg

SEQ ID NO: 864150 - DNA, 25 bp, Mus musculus
accattggtctgcaggcaccgctcc

SEQ ID NO: 864151 - DNA, 25 bp, Mus musculus
accattggtctggaggcaccgctcc

SEQ ID NO: 864152 - DNA, 25 bp, Mus musculus
accattgtgacagactgggacttgg

SEQ ID NO: 864153 - DNA, 25 bp, Mus musculus
accattgtgacagagtgggacttgg

SEQ ID NO: 864154 - DNA, 25 bp, Mus musculus
accattgtgttggacgatgatggca

SEQ ID NO: 864155 - DNA, 25 bp, Mus musculus
accattgtgttggaggatgatggca

SEQ ID NO: 864156 - DNA, 25 bp, Mus musculus
accatttacttcaacggcctgtgga

SEQ ID NO: 864157 - DNA, 25 bp, Mus musculus
accatttacttcaagggcctgtgga

SEQ ID NO: 864158 - DNA, 25 bp, Mus musculus
accatttcagagtcagcttgcgaag

SEQ ID NO: 864159 - DNA, 25 bp, Mus musculus
accatttcagtgtcagcttgcgaag

SEQ ID NO: 864160 - DNA, 25 bp, Mus musculus
accatttttaagccttgggctgtgg

SEQ ID NO: 864161 - DNA, 25 bp, Mus musculus
accatttttaaggcttgggctgtgg

SEQ ID NO: 864162 - DNA, 25 bp, Mus musculus
acccaaacatagagaagttgttcga

SEQ ID NO: 864163 - DNA, 25 bp, Mus musculus
acccaaacatagtgaagttgttcga

SEQ ID NO: 864164 - DNA, 25 bp, Mus musculus
acccaaactactcggacaagcatga

SEQ ID NO: 864165 - DNA, 25 bp, Mus musculus
acccaaactactgggacaagcatga

SEQ ID NO: 864166 - DNA, 25 bp, Mus musculus
acccaactgatactttatattgctg

SEQ ID NO: 864167 - DNA, 25 bp, Mus musculus
acccaactgatagtttatattgctg

SEQ ID NO: 864168 - DNA, 25 bp, Mus musculus
acccaagaagcacgcagagacagtc

SEQ ID NO: 864169 - DNA, 25 bp, Mus musculus
acccaagaagcaggcagagacagtc

SEQ ID NO: 864170 - DNA, 25 bp, Mus musculus
acccaagaggctggggtctcagaat

SEQ ID NO: 864171 - DNA, 25 bp, Mus musculus
acccaagagggtggggtctcagaat

SEQ ID NO: 864172 - DNA, 25 bp, Mus musculus
acccaagcccagcacaccgtgcatt

SEQ ID NO: 864173 - DNA, 25 bp, Mus musculus
acccaagcccaggacaccgtgcatt

SEQ ID NO: 864174 - DNA, 25 bp, Mus musculus
acccaagccgacgttgaagtatgtg

SEQ ID NO: 864175 - DNA, 25 bp, Mus musculus
acccaagccgtcgttgaagtatgtg

SEQ ID NO: 864176 - DNA, 25 bp, Mus musculus
acccaagttgcatttaaatattaga

SEQ ID NO: 864177 - DNA, 25 bp, Mus musculus
acccaagttgctggacaaatttgcc

SEQ ID NO: 864178 - DNA, 25 bp, Mus musculus
acccaagttggatttaaatattaga

SEQ ID NO: 864179 - DNA, 25 bp, Mus musculus
acccaagttggtggacaaatttgcc

SEQ ID NO: 864180 - DNA, 25 bp, Mus musculus
acccaatcataaagtcttgtccaga

SEQ ID NO: 864181 - DNA, 25 bp, Mus musculus
acccaatcataatgtcttgtccaga

SEQ ID NO: 864182 - DNA, 25 bp, Mus musculus
acccacaaagcagaatgtggaatat

SEQ ID NO: 864183 - DNA, 25 bp, Mus musculus
acccacaaaggagaatgtggaatat

SEQ ID NO: 864184 - DNA, 25 bp, Mus musculus
acccacaccacgactactgtgaaga

SEQ ID NO: 864185 - DNA, 25 bp, Mus musculus
acccacaccaggactactgtgaaga

SEQ ID NO: 864186 - DNA, 25 bp, Mus musculus
acccacactgcactgcagaagggac

SEQ ID NO: 864187 - DNA, 25 bp, Mus musculus
acccacactgctgagaagccattct

SEQ ID NO: 864188 - DNA, 25 bp, Mus musculus
acccacactggactgcagaagggac

SEQ ID NO: 864189 - DNA, 25 bp, Mus musculus
acccacactggtgagaagccattct

SEQ ID NO: 864190 - DNA, 25 bp, Mus musculus
acccacagaacgagagcgccatctg

SEQ ID NO: 864191 - DNA, 25 bp, Mus musculus
acccacagaacgtgagcgccatctg

SEQ ID NO: 864192 - DNA, 25 bp, Mus musculus
acccacagacaacgtggagcgaatc

SEQ ID NO: 864193 - DNA, 25 bp, Mus musculus
acccacagacaaggtggagcgaatc

SEQ ID NO: 864194 - DNA, 25 bp, Mus musculus
acccacagagatataaactacactc

SEQ ID NO: 864195 - DNA, 25 bp, Mus musculus
acccacagagcaaacgaatccagac

SEQ ID NO: 864196 - DNA, 25 bp, Mus musculus
acccacagagcaaaggaatccagac

SEQ ID NO: 864197 - DNA, 25 bp, Mus musculus
acccacagagttataaactacactc

SEQ ID NO: 864198 - DNA, 25 bp, Mus musculus
acccacagcaagcaccctactggac

SEQ ID NO: 864199 - DNA, 25 bp, Mus musculus
acccacagcaaggaccctactggac

SEQ ID NO: 864200 - DNA, 25 bp, Mus musculus
acccacagccccgcagacactgggt

SEQ ID NO: 864201 - DNA, 25 bp, Mus musculus
acccacagccccgctgacactgggt

SEQ ID NO: 864202 - DNA, 25 bp, Mus musculus
acccacatgtcacacctaaagtcca

SEQ ID NO: 864203 - DNA, 25 bp, Mus musculus
acccacatgtcacagctaaagtcca

SEQ ID NO: 864204 - DNA, 25 bp, Mus musculus
acccaccacaagctacccagccctg

SEQ ID NO: 864205 - DNA, 25 bp, Mus musculus
acccaccacaaggtacccagccctg

SEQ ID NO: 864206 - DNA, 25 bp, Mus musculus
acccaccacacaccttgtctgagca

SEQ ID NO: 864207 - DNA, 25 bp, Mus musculus
acccaccacacagcttgtctgagca

SEQ ID NO: 864208 - DNA, 25 bp, Mus musculus
acccaccacgcgagccaggtatgcc

SEQ ID NO: 864209 - DNA, 25 bp, Mus musculus
acccaccacgggagccaggtatgcc

SEQ ID NO: 864210 - DNA, 25 bp, Mus musculus
acccacccagcaacaattgtgagaa

SEQ ID NO: 864211 - DNA, 25 bp, Mus musculus
acccacccaggaacaattgtgagaa

SEQ ID NO: 864212 - DNA, 25 bp, Mus musculus
acccaccctgaaaactgcaggtgtg

SEQ ID NO: 864213 - DNA, 25 bp, Mus musculus
acccaccctgaaaagtgcaggtgtg

SEQ ID NO: 864214 - DNA, 25 bp, Mus musculus
acccaccgccaacagaataaagact

SEQ ID NO: 864215 - DNA, 25 bp, Mus musculus
acccaccgccaacatggattcatgg

SEQ ID NO: 864216 - DNA, 25 bp, Mus musculus
acccaccgccaagagaataaagact

SEQ ID NO: 864217 - DNA, 25 bp, Mus musculus
acccaccgccaagatggattcatgg

SEQ ID NO: 864218 - DNA, 25 bp, Mus musculus
acccaccgcgcacgcagctgaaaaa

SEQ ID NO: 864219 - DNA, 25 bp, Mus musculus
acccaccgcgcaggcagctgaaaaa

SEQ ID NO: 864220 - DNA, 25 bp, Mus musculus
acccacctatctgctcccaagatgc

SEQ ID NO: 864221 - DNA, 25 bp, Mus musculus
acccacctatgtgctcccaagatgc

SEQ ID NO: 864222 - DNA, 25 bp, Mus musculus
acccacctgcaacattctggtgcta

SEQ ID NO: 864223 - DNA, 25 bp, Mus musculus
acccacctgcaactctacagagagc

SEQ ID NO: 864224 - DNA, 25 bp, Mus musculus
acccacctgcaagattctggtgcta

SEQ ID NO: 864225 - DNA, 25 bp, Mus musculus
acccacctgcaagtctacagagagc

SEQ ID NO: 864226 - DNA, 25 bp, Mus musculus
acccacgagcgctaaatggtgtcag

SEQ ID NO: 864227 - DNA, 25 bp, Mus musculus
acccacgagcgctatatggtgtcag

SEQ ID NO: 864228 - DNA, 25 bp, Mus musculus
acccacgaggagcacgagcagttga

SEQ ID NO: 864229 - DNA, 25 bp, Mus musculus
acccacgaggaggacgagcagttga

SEQ ID NO: 864230 - DNA, 25 bp, Mus musculus
acccacggaaagcccatgtagaaga

SEQ ID NO: 864231 - DNA, 25 bp, Mus musculus
acccacggaaaggccatgtagaaga

SEQ ID NO: 864232 - DNA, 25 bp, Mus musculus
acccactcaaaacttcttcagtgag

SEQ ID NO: 864233 - DNA, 25 bp, Mus musculus
acccactcaaaagttcttcagtgag

SEQ ID NO: 864234 - DNA, 25 bp, Mus musculus
acccactgccagcatatcaacgaat

SEQ ID NO: 864235 - DNA, 25 bp, Mus musculus
acccactgccaggatatcaacgaat

SEQ ID NO: 864236 - DNA, 25 bp, Mus musculus
acccactgcggacacgtggatgaat

SEQ ID NO: 864237 - DNA, 25 bp, Mus musculus
acccactgcggagacgtggatgaat

SEQ ID NO: 864238 - DNA, 25 bp, Mus musculus
acccactgtggacacaccaacgagt

SEQ ID NO: 864239 - DNA, 25 bp, Mus musculus
acccactgtggagacaccaacgagt

SEQ ID NO: 864240 - DNA, 25 bp, Mus musculus
acccagaaagcccgtggccctgctc

SEQ ID NO: 864241 - DNA, 25 bp, Mus musculus
acccagaaagccggtggccctgctc

SEQ ID NO: 864242 - DNA, 25 bp, Mus musculus
acccagacaagaacgattatttctc

SEQ ID NO: 864243 - DNA, 25 bp, Mus musculus
acccagacaagatcgattatttctc

SEQ ID NO: 864244 - DNA, 25 bp, Mus musculus
acccagacaagtaggtatcgcaggg

SEQ ID NO: 864245 - DNA, 25 bp, Mus musculus
acccagacaagttggtatcgcaggg

SEQ ID NO: 864246 - DNA, 25 bp, Mus musculus
acccagacacaaccattcccactat

SEQ ID NO: 864247 - DNA, 25 bp, Mus musculus
acccagacacaagcattcccactat

SEQ ID NO: 864248 - DNA, 25 bp, Mus musculus
acccagagaaaactgtcctgaccca

SEQ ID NO: 864249 - DNA, 25 bp, Mus musculus
acccagagaatactgtcctgaccca

SEQ ID NO: 864250 - DNA, 25 bp, Mus musculus
acccagagacagctgtattcactgc

SEQ ID NO: 864251 - DNA, 25 bp, Mus musculus
acccagagacaggtgtattcactgc

SEQ ID NO: 864252 - DNA, 25 bp, Mus musculus
acccagaggataaatgcagctgtag

SEQ ID NO: 864253 - DNA, 25 bp, Mus musculus
acccagaggatatatgcagctgtag

SEQ ID NO: 864254 - DNA, 25 bp, Mus musculus
acccagagtacctcacactcgctgc

SEQ ID NO: 864255 - DNA, 25 bp, Mus musculus
acccagagtagctcacactcgctgc

SEQ ID NO: 864256 - DNA, 25 bp, Mus musculus
acccagatggtgactgaggcaaatg

SEQ ID NO: 864257 - DNA, 25 bp, Mus musculus
acccagatggtgtctgaggcaaatg

SEQ ID NO: 864258 - DNA, 25 bp, Mus musculus
acccagcaagccatcgtgtttccat

SEQ ID NO: 864259 - DNA, 25 bp, Mus musculus
acccagcaagccatggtgtttccat

SEQ ID NO: 864260 - DNA, 25 bp, Mus musculus
acccagccagactcaggcgagccat

SEQ ID NO: 864261 - DNA, 25 bp, Mus musculus
acccagccagtctcaggcgagccat

SEQ ID NO: 864262 - DNA, 25 bp, Mus musculus
acccagccccagcacagaaaagaag

SEQ ID NO: 864263 - DNA, 25 bp, Mus musculus
acccagccccagcagagaaaagaag

SEQ ID NO: 864264 - DNA, 25 bp, Mus musculus
acccagcctgcactcctgggtggag

SEQ ID NO: 864265 - DNA, 25 bp, Mus musculus
acccagcctgcagtcctgggtggag

SEQ ID NO: 864266 - DNA, 25 bp, Mus musculus
acccagctcaaaccaaccagctccc

SEQ ID NO: 864267 - DNA, 25 bp, Mus musculus
acccagctcaaagcaaccagctccc

SEQ ID NO: 864268 - DNA, 25 bp, Mus musculus
acccagctgcagcaagctgagcaga

SEQ ID NO: 864269 - DNA, 25 bp, Mus musculus
acccagctgcaggaagctgagcaga

SEQ ID NO: 864270 - DNA, 25 bp, Mus musculus
acccagctggcagacgcatacttgt

SEQ ID NO: 864271 - DNA, 25 bp, Mus musculus
acccagctggcagaggcatacttgt

SEQ ID NO: 864272 - DNA, 25 bp, Mus musculus
acccaggaagagatggcctgtggcc

SEQ ID NO: 864273 - DNA, 25 bp, Mus musculus
acccaggaagtgatggcctgtggcc

SEQ ID NO: 864274 - DNA, 25 bp, Mus musculus
acccaggcaccacaaacctcatcca

SEQ ID NO: 864275 - DNA, 25 bp, Mus musculus
acccaggcaccacccagtaagtgct

SEQ ID NO: 864276 - DNA, 25 bp, Mus musculus
acccaggcaccacgttgctccagga

SEQ ID NO: 864277 - DNA, 25 bp, Mus musculus
acccaggcaccactgtgtccattgt

SEQ ID NO: 864278 - DNA, 25 bp, Mus musculus
acccaggcaccagaaacctcatcca

SEQ ID NO: 864279 - DNA, 25 bp, Mus musculus
acccaggcaccagccagtaagtgct

SEQ ID NO: 864280 - DNA, 25 bp, Mus musculus
acccaggcaccaggttgctccagga

SEQ ID NO: 864281 - DNA, 25 bp, Mus musculus
acccaggcaccagtgtgtccattgt

SEQ ID NO: 864282 - DNA, 25 bp, Mus musculus
acccaggccaagcaggagtcagaaa

SEQ ID NO: 864283 - DNA, 25 bp, Mus musculus
acccaggccaaggaggagtcagaaa

SEQ ID NO: 864284 - DNA, 25 bp, Mus musculus
acccaggctgttcacaaggctgtgg

SEQ ID NO: 864285 - DNA, 25 bp, Mus musculus
acccaggctgttcacgtcctgctct

SEQ ID NO: 864286 - DNA, 25 bp, Mus musculus
acccaggctgttcagaaggctgtgg

SEQ ID NO: 864287 - DNA, 25 bp, Mus musculus
acccaggctgttcaggtcctgctct

SEQ ID NO: 864288 - DNA, 25 bp, Mus musculus
acccagttagaccctggcaggctgt

SEQ ID NO: 864289 - DNA, 25 bp, Mus musculus
acccagttagtccctggcaggctgt

SEQ ID NO: 864290 - DNA, 25 bp, Mus musculus
acccataatctgcgctgaatcatga

SEQ ID NO: 864291 - DNA, 25 bp, Mus musculus
acccataatctgggctgaatcatga

SEQ ID NO: 864292 - DNA, 25 bp, Mus musculus
acccatacagaaattagacggctgc

SEQ ID NO: 864293 - DNA, 25 bp, Mus musculus
acccatacagtaattagacggctgc

SEQ ID NO: 864294 - DNA, 25 bp, Mus musculus
acccatcacacgctgcctgcagctt

SEQ ID NO: 864295 - DNA, 25 bp, Mus musculus
acccatcacacggtgcctgcagctt

SEQ ID NO: 864296 - DNA, 25 bp, Mus musculus
acccatcagaagacctaggtactgg

SEQ ID NO: 864297 - DNA, 25 bp, Mus musculus
acccatcagaagtcctaggtactgg

SEQ ID NO: 864298 - DNA, 25 bp, Mus musculus
acccatcttgaaagctcacttccgg

SEQ ID NO: 864299 - DNA, 25 bp, Mus musculus
acccatcttgaatgctcacttccgg

SEQ ID NO: 864300 - DNA, 25 bp, Mus musculus
acccatgatgctaacggagacagtg

SEQ ID NO: 864301 - DNA, 25 bp, Mus musculus
acccatgatgctaagggagacagtg

SEQ ID NO: 864302 - DNA, 25 bp, Mus musculus
acccatgctggtaacgattcactaa

SEQ ID NO: 864303 - DNA, 25 bp, Mus musculus
acccatgctggtaaggattcactaa

SEQ ID NO: 864304 - DNA, 25 bp, Mus musculus
acccatggctcacactccgtggttt

SEQ ID NO: 864305 - DNA, 25 bp, Mus musculus
acccatggctcagactccgtggttt

SEQ ID NO: 864306 - DNA, 25 bp, Mus musculus
acccatgtcaccaaaactgtgaagg

SEQ ID NO: 864307 - DNA, 25 bp, Mus musculus
acccatgtcaccaatactgtgaagg

SEQ ID NO: 864308 - DNA, 25 bp, Mus musculus
acccattcagcgcatatttggaatc

SEQ ID NO: 864309 - DNA, 25 bp, Mus musculus
acccattcagggcatatttggaatc

SEQ ID NO: 864310 - DNA, 25 bp, Mus musculus
acccattttctcaatgagtattgga

SEQ ID NO: 864311 - DNA, 25 bp, Mus musculus
acccattttctctatgagtattgga

SEQ ID NO: 864312 - DNA, 25 bp, Mus musculus
accccaaaagagaatcgcacgtcca

SEQ ID NO: 864313 - DNA, 25 bp, Mus musculus
accccaaaagtgaatcgcacgtcca

SEQ ID NO: 864314 - DNA, 25 bp, Mus musculus
accccaaagtgcaaccccgcgtgca

SEQ ID NO: 864315 - DNA, 25 bp, Mus musculus
accccaaagtgcaagcccgcgtgca

SEQ ID NO: 864316 - DNA, 25 bp, Mus musculus
accccaaatcagctaccaactggat

SEQ ID NO: 864317 - DNA, 25 bp, Mus musculus
accccaaatcaggtaccaactggat

SEQ ID NO: 864318 - DNA, 25 bp, Mus musculus
accccaaatcgacagccaacctcac

SEQ ID NO: 864319 - DNA, 25 bp, Mus musculus
accccaaatcgagagccaacctcac

SEQ ID NO: 864320 - DNA, 25 bp, Mus musculus
accccaaatgctcgggagcccacca

SEQ ID NO: 864321 - DNA, 25 bp, Mus musculus
accccaaatgctggggagcccacca

SEQ ID NO: 864322 - DNA, 25 bp, Mus musculus
accccaagagatccgatgcctcaac

SEQ ID NO: 864323 - DNA, 25 bp, Mus musculus
accccaagagttccgatgcctcaac

SEQ ID NO: 864324 - DNA, 25 bp, Mus musculus
accccaatagagataatgcagggga

SEQ ID NO: 864325 - DNA, 25 bp, Mus musculus
accccaatagagatggcttgccagt

SEQ ID NO: 864326 - DNA, 25 bp, Mus musculus
accccaatagagttaatgcagggga

SEQ ID NO: 864327 - DNA, 25 bp, Mus musculus
accccaatagagttggcttgccagt

SEQ ID NO: 864328 - DNA, 25 bp, Mus musculus
accccaatctcgaagatatgtttga

SEQ ID NO: 864329 - DNA, 25 bp, Mus musculus
accccaatctcgatatgtttgatga

SEQ ID NO: 864330 - DNA, 25 bp, Mus musculus
accccaatctcgtagatatgtttga

SEQ ID NO: 864331 - DNA, 25 bp, Mus musculus
accccaatctcgttatgtttgatga

SEQ ID NO: 864332 - DNA, 25 bp, Mus musculus
accccacaatcgaagatgcttataa

SEQ ID NO: 864333 - DNA, 25 bp, Mus musculus
accccacaatcgccagagttcacgg

SEQ ID NO: 864334 - DNA, 25 bp, Mus musculus
accccacaatcggcagagttcacgg

SEQ ID NO: 864335 - DNA, 25 bp, Mus musculus
accccacaatcgtagatgcttataa

SEQ ID NO: 864336 - DNA, 25 bp, Mus musculus
accccacatgcaatctttccagcgg

SEQ ID NO: 864337 - DNA, 25 bp, Mus musculus
accccacatgcaatgtttccagcgg

SEQ ID NO: 864338 - DNA, 25 bp, Mus musculus
accccaccattgaagatgcttataa

SEQ ID NO: 864339 - DNA, 25 bp, Mus musculus
accccaccattgtagatgcttataa

SEQ ID NO: 864340 - DNA, 25 bp, Mus musculus
accccacctccacgcattatggctc

SEQ ID NO: 864341 - DNA, 25 bp, Mus musculus
accccacctccaggcattatggctc

SEQ ID NO: 864342 - DNA, 25 bp, Mus musculus
accccacgcaagccccacttgtgcc

SEQ ID NO: 864343 - DNA, 25 bp, Mus musculus
accccacgcatgccccacttgtgcc

SEQ ID NO: 864344 - DNA, 25 bp, Mus musculus
accccactcattcgcctgggtgtga

SEQ ID NO: 864345 - DNA, 25 bp, Mus musculus
accccactcattggcctgggtgtga

SEQ ID NO: 864346 - DNA, 25 bp, Mus musculus
accccagaacaacagctgaggctgc

SEQ ID NO: 864347 - DNA, 25 bp, Mus musculus
accccagaacaagagctgaggctgc

SEQ ID NO: 864348 - DNA, 25 bp, Mus musculus
accccagagaactgtattcaactca

SEQ ID NO: 864349 - DNA, 25 bp, Mus musculus
accccagagatctgtattcaactca

SEQ ID NO: 864350 - DNA, 25 bp, Mus musculus
accccagagcagctggcagaggagg

SEQ ID NO: 864351 - DNA, 25 bp, Mus musculus
accccagagcaggtggcagaggagg

SEQ ID NO: 864352 - DNA, 25 bp, Mus musculus
accccagatgcaccatgggcttggc

SEQ ID NO: 864353 - DNA, 25 bp, Mus musculus
accccagatggaccatgggcttggc

SEQ ID NO: 864354 - DNA, 25 bp, Mus musculus
accccagccagcaaaggtgctcaga

SEQ ID NO: 864355 - DNA, 25 bp, Mus musculus
accccagccagcaatggtgctcaga

SEQ ID NO: 864356 - DNA, 25 bp, Mus musculus
accccagcctataccatacctttct

SEQ ID NO: 864357 - DNA, 25 bp, Mus musculus
accccagcctattccatacctttct

SEQ ID NO: 864358 - DNA, 25 bp, Mus musculus
accccaggaagaccctccacctctc

SEQ ID NO: 864359 - DNA, 25 bp, Mus musculus
accccaggaagacgacatgacagat

SEQ ID NO: 864360 - DNA, 25 bp, Mus musculus
accccaggaagagcctccacctctc

SEQ ID NO: 864361 - DNA, 25 bp, Mus musculus
accccaggaagaggacatgacagat

SEQ ID NO: 864362 - DNA, 25 bp, Mus musculus
accccaggctaccacagcgtggctt

SEQ ID NO: 864363 - DNA, 25 bp, Mus musculus
accccaggctaccagagcgtggctt

SEQ ID NO: 864364 - DNA, 25 bp, Mus musculus
accccagtggaaatcacggttatct

SEQ ID NO: 864365 - DNA, 25 bp, Mus musculus
accccagtggaattcacggttatct

SEQ ID NO: 864366 - DNA, 25 bp, Mus musculus
accccataccagatgtgagatccag

SEQ ID NO: 864367 - DNA, 25 bp, Mus musculus
accccataccagttgtgagatccag

SEQ ID NO: 864368 - DNA, 25 bp, Mus musculus
accccattagtgctctgggtggcac

SEQ ID NO: 864369 - DNA, 25 bp, Mus musculus
accccattagtggtctgggtggcac

SEQ ID NO: 864370 - DNA, 25 bp, Mus musculus
accccattccggaacgacctcatca

SEQ ID NO: 864371 - DNA, 25 bp, Mus musculus
accccattccggaaggacctcatca

SEQ ID NO: 864372 - DNA, 25 bp, Mus musculus
accccattgtcaagactcttgcaca

SEQ ID NO: 864373 - DNA, 25 bp, Mus musculus
accccattgtcatgactcttgcaca

SEQ ID NO: 864374 - DNA, 25 bp, Mus musculus
acccccaagtcaaacgtggcctcag

SEQ ID NO: 864375 - DNA, 25 bp, Mus musculus
acccccaagtcaaaggtggcctcag

SEQ ID NO: 864376 - DNA, 25 bp, Mus musculus
acccccaccccccaccaagagccag

SEQ ID NO: 864377 - DNA, 25 bp, Mus musculus
acccccaccccccagcaagagccag

SEQ ID NO: 864378 - DNA, 25 bp, Mus musculus
acccccagatagctcacctctggga

SEQ ID NO: 864379 - DNA, 25 bp, Mus musculus
acccccagataggtcacctctggga

SEQ ID NO: 864380 - DNA, 25 bp, Mus musculus
acccccaggactcacgtactgcggt

SEQ ID NO: 864381 - DNA, 25 bp, Mus musculus
acccccaggactcaggtactgcggt

SEQ ID NO: 864382 - DNA, 25 bp, Mus musculus
acccccagtaggcacagatggcacc

SEQ ID NO: 864383 - DNA, 25 bp, Mus musculus
acccccagtaggcagagatggcacc

SEQ ID NO: 864384 - DNA, 25 bp, Mus musculus
acccccatctcagacatgggctttg

SEQ ID NO: 864385 - DNA, 25 bp, Mus musculus
acccccatctcagacgctggtgttt

SEQ ID NO: 864386 - DNA, 25 bp, Mus musculus
acccccatctcagagatgggctttg

SEQ ID NO: 864387 - DNA, 25 bp, Mus musculus
acccccatctcagaggctggtgttt

SEQ ID NO: 864388 - DNA, 25 bp, Mus musculus
acccccattacaaatcttgtgaagt

SEQ ID NO: 864389 - DNA, 25 bp, Mus musculus
acccccattacatatcttgtgaagt

SEQ ID NO: 864390 - DNA, 25 bp, Mus musculus
acccccattttacacaactgtatga

SEQ ID NO: 864391 - DNA, 25 bp, Mus musculus
acccccattttacagaactgtatga

SEQ ID NO: 864392 - DNA, 25 bp, Mus musculus
acccccgctacactgccttgcccaa

SEQ ID NO: 864393 - DNA, 25 bp, Mus musculus
acccccgctacagtgccttgcccaa

SEQ ID NO: 864394 - DNA, 25 bp, Mus musculus
acccccgctgcataacaagcccggc

SEQ ID NO: 864395 - DNA, 25 bp, Mus musculus
acccccgctggataacaagcccggc

SEQ ID NO: 864396 - DNA, 25 bp, Mus musculus
acccccggcggacacagttgatggt

SEQ ID NO: 864397 - DNA, 25 bp, Mus musculus
acccccggcggacagagttgatggt

SEQ ID NO: 864398 - DNA, 25 bp, Mus musculus
accccgaaagagctcctgggctcca

SEQ ID NO: 864399 - DNA, 25 bp, Mus musculus
accccgaaagtgctcctgggctcca

SEQ ID NO: 864400 - DNA, 25 bp, Mus musculus
accccgaagcagaggatgaaggacg

SEQ ID NO: 864401 - DNA, 25 bp, Mus musculus
accccgaagcagtggatgaaggacg

SEQ ID NO: 864402 - DNA, 25 bp, Mus musculus
accccgagagtcaaacagcgtgctt

SEQ ID NO: 864403 - DNA, 25 bp, Mus musculus
accccgagagtcaaacgtgcttccg

SEQ ID NO: 864404 - DNA, 25 bp, Mus musculus
accccgagagtcaatcagcgtgctt

SEQ ID NO: 864405 - DNA, 25 bp, Mus musculus
accccgagagtcaatcgtgcttccg

SEQ ID NO: 864406 - DNA, 25 bp, Mus musculus
accccgatgaagagaactccctcat

SEQ ID NO: 864407 - DNA, 25 bp, Mus musculus
accccgatgaagtgaactccctcat

SEQ ID NO: 864408 - DNA, 25 bp, Mus musculus
accccggatgagccctgggcatttc

SEQ ID NO: 864409 - DNA, 25 bp, Mus musculus
accccggatgaggcctgggcatttc

SEQ ID NO: 864410 - DNA, 25 bp, Mus musculus
accccggccccacctgagtgatcgc

SEQ ID NO: 864411 - DNA, 25 bp, Mus musculus
accccggccccacggctggctgtgg

SEQ ID NO: 864412 - DNA, 25 bp, Mus musculus
accccggccccagctgagtgatcgc

SEQ ID NO: 864413 - DNA, 25 bp, Mus musculus
accccggccccagggctggctgtgg

SEQ ID NO: 864414 - DNA, 25 bp, Mus musculus
accccgggagccaccaggatcatct

SEQ ID NO: 864415 - DNA, 25 bp, Mus musculus
accccgggaggcaccaggatcatct

SEQ ID NO: 864416 - DNA, 25 bp, Mus musculus
acccctaggcaacactggacgagta

SEQ ID NO: 864417 - DNA, 25 bp, Mus musculus
acccctaggcaagactggacgagta

SEQ ID NO: 864418 - DNA, 25 bp, Mus musculus
acccctataagccgtcaccttcaga

SEQ ID NO: 864419 - DNA, 25 bp, Mus musculus
acccctataagcggtcaccttcaga

SEQ ID NO: 864420 - DNA, 25 bp, Mus musculus
acccctatgcaacagctgcaaaagc

SEQ ID NO: 864421 - DNA, 25 bp, Mus musculus
acccctatgcaagagctgcaaaagc

SEQ ID NO: 864422 - DNA, 25 bp, Mus musculus
acccctatggctcgccacagattgt

SEQ ID NO: 864423 - DNA, 25 bp, Mus musculus
acccctatggctggccacagattgt

SEQ ID NO: 864424 - DNA, 25 bp, Mus musculus
acccctccacctcttccaggtgagc

SEQ ID NO: 864425 - DNA, 25 bp, Mus musculus
acccctccacctgttccaggtgagc

SEQ ID NO: 864426 - DNA, 25 bp, Mus musculus
acccctctggagatcctctggacct

SEQ ID NO: 864427 - DNA, 25 bp, Mus musculus
acccctctggagttcctctggacct

SEQ ID NO: 864428 - DNA, 25 bp, Mus musculus
acccctgaaatgccattatccaatt

SEQ ID NO: 864429 - DNA, 25 bp, Mus musculus
acccctgaaatggcattatccaatt

SEQ ID NO: 864430 - DNA, 25 bp, Mus musculus
acccctgaagcacatagcattgttg

SEQ ID NO: 864431 - DNA, 25 bp, Mus musculus
acccctgaagcttacagtctctagc

SEQ ID NO: 864432 - DNA, 25 bp, Mus musculus
acccctgaaggacatagcattgttg

SEQ ID NO: 864433 - DNA, 25 bp, Mus musculus
acccctgaaggttacagtctctagc

SEQ ID NO: 864434 - DNA, 25 bp, Mus musculus
acccctgactgccattacaattcct

SEQ ID NO: 864435 - DNA, 25 bp, Mus musculus
acccctgactgcgattacaattcct

SEQ ID NO: 864436 - DNA, 25 bp, Mus musculus
acccctgcacagccaggtcctggtg

SEQ ID NO: 864437 - DNA, 25 bp, Mus musculus
acccctgcacaggcaggtcctggtg

SEQ ID NO: 864438 - DNA, 25 bp, Mus musculus
acccctgcagagctcaccaagctcc

SEQ ID NO: 864439 - DNA, 25 bp, Mus musculus
acccctgcagaggtcaccaagctcc

SEQ ID NO: 864440 - DNA, 25 bp, Mus musculus
acccctgcccctatgacccatgcct

SEQ ID NO: 864441 - DNA, 25 bp, Mus musculus
acccctgcccctttgacccatgcct

SEQ ID NO: 864442 - DNA, 25 bp, Mus musculus
acccctgcgacgcggtgctggtgga

SEQ ID NO: 864443 - DNA, 25 bp, Mus musculus
acccctgcgaggcggtgctggtgga

SEQ ID NO: 864444 - DNA, 25 bp, Mus musculus
acccctgcttggatggtgccataca

SEQ ID NO: 864445 - DNA, 25 bp, Mus musculus
acccctgcttggttggtgccataca

SEQ ID NO: 864446 - DNA, 25 bp, Mus musculus
acccctggccagctgcgcaccctgt

SEQ ID NO: 864447 - DNA, 25 bp, Mus musculus
acccctggccaggtgcgcaccctgt

SEQ ID NO: 864448 - DNA, 25 bp, Mus musculus
acccctggcccagtcggtagccatg

SEQ ID NO: 864449 - DNA, 25 bp, Mus musculus
acccctggcccagtgggtagccatg

SEQ ID NO: 864450 - DNA, 25 bp, Mus musculus
acccctgggactagctcaggccctg

SEQ ID NO: 864451 - DNA, 25 bp, Mus musculus
acccctgggacttgctcaggccctg

SEQ ID NO: 864452 - DNA, 25 bp, Mus musculus
acccctgtccttcccaaccagtgtc

SEQ ID NO: 864453 - DNA, 25 bp, Mus musculus
acccctgtccttgccaaccagtgtc

SEQ ID NO: 864454 - DNA, 25 bp, Mus musculus
accccttcacagcaatcagcaggag

SEQ ID NO: 864455 - DNA, 25 bp, Mus musculus
accccttcacaggaatcagcaggag

SEQ ID NO: 864456 - DNA, 25 bp, Mus musculus
accccttctacacgggcaatgaaga

SEQ ID NO: 864457 - DNA, 25 bp, Mus musculus
accccttctacaggggcaatgaaga

SEQ ID NO: 864458 - DNA, 25 bp, Mus musculus
accccttctactaccatgatactac

SEQ ID NO: 864459 - DNA, 25 bp, Mus musculus
accccttctactacgatgatactac

SEQ ID NO: 864460 - DNA, 25 bp, Mus musculus
accccttctcagaatacagcccagt

SEQ ID NO: 864461 - DNA, 25 bp, Mus musculus
accccttctcagtatacagcccagt

SEQ ID NO: 864462 - DNA, 25 bp, Mus musculus
accccttcttcgcagaatacaaaca

SEQ ID NO: 864463 - DNA, 25 bp, Mus musculus
accccttcttcgctgattcttttct

SEQ ID NO: 864464 - DNA, 25 bp, Mus musculus
accccttcttcggagaatacaaaca

SEQ ID NO: 864465 - DNA, 25 bp, Mus musculus
accccttcttcggtgattcttttct

SEQ ID NO: 864466 - DNA, 25 bp, Mus musculus
accccttggttgcacgtttgcaata

SEQ ID NO: 864467 - DNA, 25 bp, Mus musculus
accccttggttgcaggtttgcaata

SEQ ID NO: 864468 - DNA, 25 bp, Mus musculus
acccctttatcacggtatcagagca

SEQ ID NO: 864469 - DNA, 25 bp, Mus musculus
acccctttatcagggtatcagagca

SEQ ID NO: 864470 - DNA, 25 bp, Mus musculus
acccgacaggcccgcagcctcgtgt

SEQ ID NO: 864471 - DNA, 25 bp, Mus musculus
acccgacagggccgcagcctcgtgt

SEQ ID NO: 864472 - DNA, 25 bp, Mus musculus
acccgactcgacagagactctaaat

SEQ ID NO: 864473 - DNA, 25 bp, Mus musculus
acccgactcgtcagagactctaaat

SEQ ID NO: 864474 - DNA, 25 bp, Mus musculus
acccgagtcccctgagggatctgag

SEQ ID NO: 864475 - DNA, 25 bp, Mus musculus
acccgagtccgctgagggatctgag

SEQ ID NO: 864476 - DNA, 25 bp, Mus musculus
acccgcatccagagcagcgaggcct

SEQ ID NO: 864477 - DNA, 25 bp, Mus musculus
acccgcatccagtgcagcgaggcct

SEQ ID NO: 864478 - DNA, 25 bp, Mus musculus
acccgccgctcgccggccctgctga

SEQ ID NO: 864479 - DNA, 25 bp, Mus musculus
acccgccgctcgcttacctgccttg

SEQ ID NO: 864480 - DNA, 25 bp, Mus musculus
acccgccgctcggcggccctgctga

SEQ ID NO: 864481 - DNA, 25 bp, Mus musculus
acccgccgctcggttacctgccttg

SEQ ID NO: 864482 - DNA, 25 bp, Mus musculus
acccgcggctacgaccacgtggaca

SEQ ID NO: 864483 - DNA, 25 bp, Mus musculus
acccgcggctacgagcacgtggaca

SEQ ID NO: 864484 - DNA, 25 bp, Mus musculus
acccggaacctgcacgaggttctag

SEQ ID NO: 864485 - DNA, 25 bp, Mus musculus
acccggaacctgcaggaggttctag

SEQ ID NO: 864486 - DNA, 25 bp, Mus musculus
acccggaccaagactggatgacaga

SEQ ID NO: 864487 - DNA, 25 bp, Mus musculus
acccggaccaagtctggatgacaga

SEQ ID NO: 864488 - DNA, 25 bp, Mus musculus
acccggactcagatcatctttagat

SEQ ID NO: 864489 - DNA, 25 bp, Mus musculus
acccggactcagttcatctttagat

SEQ ID NO: 864490 - DNA, 25 bp, Mus musculus
acccggattacatacccaacaagga

SEQ ID NO: 864491 - DNA, 25 bp, Mus musculus
acccggattacatactgtatcccct

SEQ ID NO: 864492 - DNA, 25 bp, Mus musculus
acccggattacatagccaacaagga

SEQ ID NO: 864493 - DNA, 25 bp, Mus musculus
acccggattacatagtgtatcccct

SEQ ID NO: 864494 - DNA, 25 bp, Mus musculus
acccggcaagaaagtccatggcaga

SEQ ID NO: 864495 - DNA, 25 bp, Mus musculus
acccggcaagaccttcaagagtcga

SEQ ID NO: 864496 - DNA, 25 bp, Mus musculus
acccggcaagcagaccttcaagagt

SEQ ID NO: 864497 - DNA, 25 bp, Mus musculus
acccggcaaggagaccttcaagagt

SEQ ID NO: 864498 - DNA, 25 bp, Mus musculus
acccggcaagtaagtccatggcaga

SEQ ID NO: 864499 - DNA, 25 bp, Mus musculus
acccggcaagtccttcaagagtcga

SEQ ID NO: 864500 - DNA, 25 bp, Mus musculus
accctaaatcagctactacttggct

SEQ ID NO: 864501 - DNA, 25 bp, Mus musculus
accctaaatcaggtactacttggct

SEQ ID NO: 864502 - DNA, 25 bp, Mus musculus
accctaacagatgttgctgtggtca

SEQ ID NO: 864503 - DNA, 25 bp, Mus musculus
accctaacagttgttgctgtggtca

SEQ ID NO: 864504 - DNA, 25 bp, Mus musculus
accctaatacagctctagccctgga

SEQ ID NO: 864505 - DNA, 25 bp, Mus musculus
accctaatacaggtctagccctgga

SEQ ID NO: 864506 - DNA, 25 bp, Mus musculus
accctaatatgacgaactgtactga

SEQ ID NO: 864507 - DNA, 25 bp, Mus musculus
accctaatatgaggaactgtactga

SEQ ID NO: 864508 - DNA, 25 bp, Mus musculus
accctacacagacgctcggtggggg

SEQ ID NO: 864509 - DNA, 25 bp, Mus musculus
accctacacagaggctcggtggggg

SEQ ID NO: 864510 - DNA, 25 bp, Mus musculus
accctacatcagcttcctgacgcag

SEQ ID NO: 864511 - DNA, 25 bp, Mus musculus
accctacatcaggttcctgacgcag

SEQ ID NO: 864512 - DNA, 25 bp, Mus musculus
accctacgcacacagtatgataggc

SEQ ID NO: 864513 - DNA, 25 bp, Mus musculus
accctacgcacagagtatgataggc

SEQ ID NO: 864514 - DNA, 25 bp, Mus musculus
accctactcatgacaggcaaactga

SEQ ID NO: 864515 - DNA, 25 bp, Mus musculus
accctactcatgtcaggcaaactga

SEQ ID NO: 864516 - DNA, 25 bp, Mus musculus
accctacttcctatcaatgctgcca

SEQ ID NO: 864517 - DNA, 25 bp, Mus musculus
accctacttcctttcaatgctgcca

SEQ ID NO: 864518 - DNA, 25 bp, Mus musculus
accctagatgagccagctgcggcag

SEQ ID NO: 864519 - DNA, 25 bp, Mus musculus
accctagatgaggcagctgcggcag

SEQ ID NO: 864520 - DNA, 25 bp, Mus musculus
accctagccgcacgctcgcgcggct

SEQ ID NO: 864521 - DNA, 25 bp, Mus musculus
accctagccgcaggctcgcgcggct

SEQ ID NO: 864522 - DNA, 25 bp, Mus musculus
accctagcttaactatacctggcct

SEQ ID NO: 864523 - DNA, 25 bp, Mus musculus
accctagcttaagtatacctggcct

SEQ ID NO: 864524 - DNA, 25 bp, Mus musculus
accctattgatgcgtacctgtccca

SEQ ID NO: 864525 - DNA, 25 bp, Mus musculus
accctattgatgggtacctgtccca

SEQ ID NO: 864526 - DNA, 25 bp, Mus musculus
accctcaaaccacgtgatcatgcta

SEQ ID NO: 864527 - DNA, 25 bp, Mus musculus
accctcaaaccaggtgatcatgcta

SEQ ID NO: 864528 - DNA, 25 bp, Mus musculus
accctcaaccctgttaggagtggat

SEQ ID NO: 864529 - DNA, 25 bp, Mus musculus
accctcaaccgtgttaggagtggat

SEQ ID NO: 864530 - DNA, 25 bp, Mus musculus
accctcacagatgtcttccaggatg

SEQ ID NO: 864531 - DNA, 25 bp, Mus musculus
accctcacagttgtcttccaggatg

SEQ ID NO: 864532 - DNA, 25 bp, Mus musculus
accctcagagctttaataagattca

SEQ ID NO: 864533 - DNA, 25 bp, Mus musculus
accctcagaggtttaataagattca

SEQ ID NO: 864534 - DNA, 25 bp, Mus musculus
accctcatctctggcggatcctaaa

SEQ ID NO: 864535 - DNA, 25 bp, Mus musculus
accctcatctctgggggatcctaaa

SEQ ID NO: 864536 - DNA, 25 bp, Mus musculus
accctcccccagagtgctgacctag

SEQ ID NO: 864537 - DNA, 25 bp, Mus musculus
accctcccccagtgtgctgacctag

SEQ ID NO: 864538 - DNA, 25 bp, Mus musculus
accctccggaagaatctctgtggcc

SEQ ID NO: 864539 - DNA, 25 bp, Mus musculus
accctccggaagtatctctgtggcc

SEQ ID NO: 864540 - DNA, 25 bp, Mus musculus
accctcctacacagaccgagtccta

SEQ ID NO: 864541 - DNA, 25 bp, Mus musculus
accctcctacactgaccgagtccta

SEQ ID NO: 864542 - DNA, 25 bp, Mus musculus
accctcctatctgctcccaagatgc

SEQ ID NO: 864543 - DNA, 25 bp, Mus musculus
accctcctatgtgctcccaagatgc

SEQ ID NO: 864544 - DNA, 25 bp, Mus musculus
accctcctcagtgacgtgatgactc

SEQ ID NO: 864545 - DNA, 25 bp, Mus musculus
accctcctcagtgaggtgatgactc

SEQ ID NO: 864546 - DNA, 25 bp, Mus musculus
accctcctggagcaactggtgatct

SEQ ID NO: 864547 - DNA, 25 bp, Mus musculus
accctcctggtgcaactggtgatct

SEQ ID NO: 864548 - DNA, 25 bp, Mus musculus
accctcggctcacacatggctgcca

SEQ ID NO: 864549 - DNA, 25 bp, Mus musculus
accctcggctcacacgcagaagact

SEQ ID NO: 864550 - DNA, 25 bp, Mus musculus
accctcggctcacagatggctgcca

SEQ ID NO: 864551 - DNA, 25 bp, Mus musculus
accctcggctcacaggcagaagact

SEQ ID NO: 864552 - DNA, 25 bp, Mus musculus
accctctgaaacagtgccgatcccc

SEQ ID NO: 864553 - DNA, 25 bp, Mus musculus
accctctgaaactgtgccgatcccc

SEQ ID NO: 864554 - DNA, 25 bp, Mus musculus
accctcttccagacccatgacaaca

SEQ ID NO: 864555 - DNA, 25 bp, Mus musculus
accctcttccagtcccatgacaaca

SEQ ID NO: 864556 - DNA, 25 bp, Mus musculus
accctcttctgtgacgtgagtgtag

SEQ ID NO: 864557 - DNA, 25 bp, Mus musculus
accctcttctgtgaggtgagtgtag

SEQ ID NO: 864558 - DNA, 25 bp, Mus musculus
accctctttcaagccgtaattgctg

SEQ ID NO: 864559 - DNA, 25 bp, Mus musculus
accctctttcaagcggtaattgctg

SEQ ID NO: 864560 - DNA, 25 bp, Mus musculus
accctgaaagagttaaacatcttat

SEQ ID NO: 864561 - DNA, 25 bp, Mus musculus
accctgaaagtgttaaacatcttat

SEQ ID NO: 864562 - DNA, 25 bp, Mus musculus
accctgaacaagctggcaatgaagc

SEQ ID NO: 864563 - DNA, 25 bp, Mus musculus
accctgaacaaggtggcaatgaagc

SEQ ID NO: 864564 - DNA, 25 bp, Mus musculus
accctgaaccaaaattttcatggac

SEQ ID NO: 864565 - DNA, 25 bp, Mus musculus
accctgaaccaatattttcatggac

SEQ ID NO: 864566 - DNA, 25 bp, Mus musculus
accctgactcagcttctgcggacga

SEQ ID NO: 864567 - DNA, 25 bp, Mus musculus
accctgactcaggttctgcggacga

SEQ ID NO: 864568 - DNA, 25 bp, Mus musculus
accctgagagaatgttggctcaatt

SEQ ID NO: 864569 - DNA, 25 bp, Mus musculus
accctgagagtatgttggctcaatt

SEQ ID NO: 864570 - DNA, 25 bp, Mus musculus
accctgagatggcagcctgcatggt

SEQ ID NO: 864571 - DNA, 25 bp, Mus musculus
accctgagatgggagcctgcatggt

SEQ ID NO: 864572 - DNA, 25 bp, Mus musculus
accctgagcaaacagatcctttttc

SEQ ID NO: 864573 - DNA, 25 bp, Mus musculus
accctgagcaaagagatcctttttc

SEQ ID NO: 864574 - DNA, 25 bp, Mus musculus
accctgagcacaaacgaaccctttg

SEQ ID NO: 864575 - DNA, 25 bp, Mus musculus
accctgagcacaaaggaaccctttg

SEQ ID NO: 864576 - DNA, 25 bp, Mus musculus
accctgagctggccaaaaggccaga

SEQ ID NO: 864577 - DNA, 25 bp, Mus musculus
accctgagctggctctctgacaaat

SEQ ID NO: 864578 - DNA, 25 bp, Mus musculus
accctgagctgggcaaaaggccaga

SEQ ID NO: 864579 - DNA, 25 bp, Mus musculus
accctgagctgggtctctgacaaat

SEQ ID NO: 864580 - DNA, 25 bp, Mus musculus
accctgaggctgctactttttaaag

SEQ ID NO: 864581 - DNA, 25 bp, Mus musculus
accctgaggctgctagggaaccaac

SEQ ID NO: 864582 - DNA, 25 bp, Mus musculus
accctgaggctgcttctttttaaag

SEQ ID NO: 864583 - DNA, 25 bp, Mus musculus
accctgaggctgcttgggaaccaac

SEQ ID NO: 864584 - DNA, 25 bp, Mus musculus
accctgatgtcaatcctgagctggc

SEQ ID NO: 864585 - DNA, 25 bp, Mus musculus
accctgatgtcaatgctgagctggc

SEQ ID NO: 864586 - DNA, 25 bp, Mus musculus
accctgcaaaaccacatccaagtgg

SEQ ID NO: 864587 - DNA, 25 bp, Mus musculus
accctgcaaaaccagatccaagtgg

SEQ ID NO: 864588 - DNA, 25 bp, Mus musculus
accctgcaagagttctttttgcaga

SEQ ID NO: 864589 - DNA, 25 bp, Mus musculus
accctgcaagatggagggggcagaa

SEQ ID NO: 864590 - DNA, 25 bp, Mus musculus
accctgcaagtgttctttttgcaga

SEQ ID NO: 864591 - DNA, 25 bp, Mus musculus
accctgcaagttggagggggcagaa

SEQ ID NO: 864592 - DNA, 25 bp, Mus musculus
accctgcaggcagagagaatcaatg

SEQ ID NO: 864593 - DNA, 25 bp, Mus musculus
accctgcagggagagagaatcaatg

SEQ ID NO: 864594 - DNA, 25 bp, Mus musculus
accctgcctgaccggccttcaacac

SEQ ID NO: 864595 - DNA, 25 bp, Mus musculus
accctgcctgacgggccttcaacac

SEQ ID NO: 864596 - DNA, 25 bp, Mus musculus
accctgccttctgatgacactccgt

SEQ ID NO: 864597 - DNA, 25 bp, Mus musculus
accctgccttgtgatgacactccgt

SEQ ID NO: 864598 - DNA, 25 bp, Mus musculus
accctggaaggaacaatgctgttgg

SEQ ID NO: 864599 - DNA, 25 bp, Mus musculus
accctggaaggaactatgctgttgg

SEQ ID NO: 864600 - DNA, 25 bp, Mus musculus
accctggacaacttcggctacagaa

SEQ ID NO: 864601 - DNA, 25 bp, Mus musculus
accctggacaacttgggctacagaa

SEQ ID NO: 864602 - DNA, 25 bp, Mus musculus
accctggacattcagacactgacat

SEQ ID NO: 864603 - DNA, 25 bp, Mus musculus
accctggacattgagacactgacat

SEQ ID NO: 864604 - DNA, 25 bp, Mus musculus
accctggacgaactgctctctagac

SEQ ID NO: 864605 - DNA, 25 bp, Mus musculus
accctggacgaagtgctctctagac

SEQ ID NO: 864606 - DNA, 25 bp, Mus musculus
accctggactaaggatcaccactac

SEQ ID NO: 864607 - DNA, 25 bp, Mus musculus
accctggactaaggttcaccactac

SEQ ID NO: 864608 - DNA, 25 bp, Mus musculus
accctggagtaacctaccgcactcg

SEQ ID NO: 864609 - DNA, 25 bp, Mus musculus
accctggagtaagctaccgcactcg

SEQ ID NO: 864610 - DNA, 25 bp, Mus musculus
accctggggaagatatatgaagcct

SEQ ID NO: 864611 - DNA, 25 bp, Mus musculus
accctggggaagttatatgaagcct

SEQ ID NO: 864612 - DNA, 25 bp, Mus musculus
accctggtcagcaacaatgcctttg

SEQ ID NO: 864613 - DNA, 25 bp, Mus musculus
accctggtcagcaagaatgcctttg

SEQ ID NO: 864614 - DNA, 25 bp, Mus musculus
accctggtggcacaacgtgaaaagg

SEQ ID NO: 864615 - DNA, 25 bp, Mus musculus
accctggtggcagaacgtgaaaagg

SEQ ID NO: 864616 - DNA, 25 bp, Mus musculus
accctggttacaaattctgttgaca

SEQ ID NO: 864617 - DNA, 25 bp, Mus musculus
accctggttacatattctgttgaca

SEQ ID NO: 864618 - DNA, 25 bp, Mus musculus
accctggttgctggatataaagtat

SEQ ID NO: 864619 - DNA, 25 bp, Mus musculus
accctggttggtggatataaagtat

SEQ ID NO: 864620 - DNA, 25 bp, Mus musculus
accctgtgagagatctactgccatg

SEQ ID NO: 864621 - DNA, 25 bp, Mus musculus
accctgtgagagccagatctactgc

SEQ ID NO: 864622 - DNA, 25 bp, Mus musculus
accctgtgagaggcagatctactgc

SEQ ID NO: 864623 - DNA, 25 bp, Mus musculus
accctgtgagagttctactgccatg

SEQ ID NO: 864624 - DNA, 25 bp, Mus musculus
accctgtgcagaaatgagggaggac

SEQ ID NO: 864625 - DNA, 25 bp, Mus musculus
accctgtgcagatatgagggaggac

SEQ ID NO: 864626 - DNA, 25 bp, Mus musculus
accctgtgcatgccttcatgtactg

SEQ ID NO: 864627 - DNA, 25 bp, Mus musculus
accctgtgcatggcttcatgtactg

SEQ ID NO: 864628 - DNA, 25 bp, Mus musculus
accctgtgtcctccatcaaccttag

SEQ ID NO: 864629 - DNA, 25 bp, Mus musculus
accctgtgtcctgcatcaaccttag

SEQ ID NO: 864630 - DNA, 25 bp, Mus musculus
acccttaaatgtaacaatgttgctg

SEQ ID NO: 864631 - DNA, 25 bp, Mus musculus
acccttaaatgtaagaatgttgctg

SEQ ID NO: 864632 - DNA, 25 bp, Mus musculus
acccttacgacttgcctttgtggct

SEQ ID NO: 864633 - DNA, 25 bp, Mus musculus
acccttacgacttggctttgtggct

SEQ ID NO: 864634 - DNA, 25 bp, Mus musculus
acccttcacgagacagagttagcag

SEQ ID NO: 864635 - DNA, 25 bp, Mus musculus
acccttcacgagactgagttagcag

SEQ ID NO: 864636 - DNA, 25 bp, Mus musculus
acccttcccgccgccgaggagaatg

SEQ ID NO: 864637 - DNA, 25 bp, Mus musculus
acccttcccgccgcggaggagaatg

SEQ ID NO: 864638 - DNA, 25 bp, Mus musculus
acccttgatgaagatttagcgccac

SEQ ID NO: 864639 - DNA, 25 bp, Mus musculus
acccttgatgcagaagatttagcgc

SEQ ID NO: 864640 - DNA, 25 bp, Mus musculus
acccttgatggagaagatttagcgc

SEQ ID NO: 864641 - DNA, 25 bp, Mus musculus
acccttgatgtagatttagcgccac

SEQ ID NO: 864642 - DNA, 25 bp, Mus musculus
acccttgccacaacctgaagtgatt

SEQ ID NO: 864643 - DNA, 25 bp, Mus musculus
acccttgccacatcctgaagtgatt

SEQ ID NO: 864644 - DNA, 25 bp, Mus musculus
acccttgcggcacgcttccgggctg

SEQ ID NO: 864645 - DNA, 25 bp, Mus musculus
acccttgcggcaggcttccgggctg

SEQ ID NO: 864646 - DNA, 25 bp, Mus musculus
acccttgctgcaatgaagctgatga

SEQ ID NO: 864647 - DNA, 25 bp, Mus musculus
acccttgctggaatgaagctgatga

SEQ ID NO: 864648 - DNA, 25 bp, Mus musculus
acccttgcttcacgtacgccaggat

SEQ ID NO: 864649 - DNA, 25 bp, Mus musculus
acccttgcttcaggtacgccaggat

SEQ ID NO: 864650 - DNA, 25 bp, Mus musculus
acccttggctgacctatatgaagaa

SEQ ID NO: 864651 - DNA, 25 bp, Mus musculus
acccttggctgagctatatgaagaa

SEQ ID NO: 864652 - DNA, 25 bp, Mus musculus
acccttgggagtttcatactatttg

SEQ ID NO: 864653 - DNA, 25 bp, Mus musculus
acccttgggagtttgatactatttg

SEQ ID NO: 864654 - DNA, 25 bp, Mus musculus
accctttcataaccccaattataca

SEQ ID NO: 864655 - DNA, 25 bp, Mus musculus
accctttcataagcccaattataca

SEQ ID NO: 864656 - DNA, 25 bp, Mus musculus
accctttctttgatatgcacatgat

SEQ ID NO: 864657 - DNA, 25 bp, Mus musculus
accctttctttgttatgcacatgat

SEQ ID NO: 864658 - DNA, 25 bp, Mus musculus
accctttgggaaccgcctgctgaac

SEQ ID NO: 864659 - DNA, 25 bp, Mus musculus
accctttgggaagcgcctgctgaac

SEQ ID NO: 864660 - DNA, 25 bp, Mus musculus
accgaacaagcccacgagacaatca

SEQ ID NO: 864661 - DNA, 25 bp, Mus musculus
accgaacaagcccaggagacaatca

SEQ ID NO: 864662 - DNA, 25 bp, Mus musculus
accgaactaccacacggttctatga

SEQ ID NO: 864663 - DNA, 25 bp, Mus musculus
accgaactaccagacggttctatga

SEQ ID NO: 864664 - DNA, 25 bp, Mus musculus
accgaactcacccaagtgcaaaaca

SEQ ID NO: 864665 - DNA, 25 bp, Mus musculus
accgaactcacccaagtgttgccca

SEQ ID NO: 864666 - DNA, 25 bp, Mus musculus
accgaactcacccatgtgcaaaaca

SEQ ID NO: 864667 - DNA, 25 bp, Mus musculus
accgaactcacccatgtgttgccca

SEQ ID NO: 864668 - DNA, 25 bp, Mus musculus
accgaagcagagttttgccgaattg

SEQ ID NO: 864669 - DNA, 25 bp, Mus musculus
accgaagcagtgttttgccgaattg

SEQ ID NO: 864670 - DNA, 25 bp, Mus musculus
accgaagctgccagcatatcaatga

SEQ ID NO: 864671 - DNA, 25 bp, Mus musculus
accgaagctgccaggatatcaatga

SEQ ID NO: 864672 - DNA, 25 bp, Mus musculus
accgacacgcagcaccaccagaagc

SEQ ID NO: 864673 - DNA, 25 bp, Mus musculus
accgacacgcaggaccaccagaagc

SEQ ID NO: 864674 - DNA, 25 bp, Mus musculus
accgacatcaagcactccaaagctt

SEQ ID NO: 864675 - DNA, 25 bp, Mus musculus
accgacatcaaggactccaaagctt

SEQ ID NO: 864676 - DNA, 25 bp, Mus musculus
accgacctcatctacgtacgtaggt

SEQ ID NO: 864677 - DNA, 25 bp, Mus musculus
accgacctcatctaggtacgtaggt

SEQ ID NO: 864678 - DNA, 25 bp, Mus musculus
accgacgagaaaaacctggagagat

SEQ ID NO: 864679 - DNA, 25 bp, Mus musculus
accgacgagaaaaagctggagagat

SEQ ID NO: 864680 - DNA, 25 bp, Mus musculus
accgacggcacactcaaaagatccg

SEQ ID NO: 864681 - DNA, 25 bp, Mus musculus
accgacggcacactcatgagcgccc

SEQ ID NO: 864682 - DNA, 25 bp, Mus musculus
accgacggcacactgaaaagatccg

SEQ ID NO: 864683 - DNA, 25 bp, Mus musculus
accgacggcacactgatgagcgccc

SEQ ID NO: 864684 - DNA, 25 bp, Mus musculus
accgacgttaatgactgcaatgctc

SEQ ID NO: 864685 - DNA, 25 bp, Mus musculus
accgacgttaatgagtgcaatgctc

SEQ ID NO: 864686 - DNA, 25 bp, Mus musculus
accgacttttcacagccactcagca

SEQ ID NO: 864687 - DNA, 25 bp, Mus musculus
accgacttttcacggttcagactgg

SEQ ID NO: 864688 - DNA, 25 bp, Mus musculus
accgacttttcagagccactcagca

SEQ ID NO: 864689 - DNA, 25 bp, Mus musculus
accgacttttcagggttcagactgg

SEQ ID NO: 864690 - DNA, 25 bp, Mus musculus
accgagaagaggatcgctgctccca

SEQ ID NO: 864691 - DNA, 25 bp, Mus musculus
accgagaagaggatggctgctccca

SEQ ID NO: 864692 - DNA, 25 bp, Mus musculus
accgagaagcccttgaaaaggagaa

SEQ ID NO: 864693 - DNA, 25 bp, Mus musculus
accgagaagcgcttgaaaaggagaa

SEQ ID NO: 864694 - DNA, 25 bp, Mus musculus
accgagaatctgacctcccacgagt

SEQ ID NO: 864695 - DNA, 25 bp, Mus musculus
accgagaatctgtcctcccacgagt

SEQ ID NO: 864696 - DNA, 25 bp, Mus musculus
accgagacagctccttccgcttcca

SEQ ID NO: 864697 - DNA, 25 bp, Mus musculus
accgagacaggtccttccgcttcca

SEQ ID NO: 864698 - DNA, 25 bp, Mus musculus
accgagacctctattttgaaggtgg

SEQ ID NO: 864699 - DNA, 25 bp, Mus musculus
accgagacctgtattttgaaggtgg

SEQ ID NO: 864700 - DNA, 25 bp, Mus musculus
accgagagcatgaacactccgtggt

SEQ ID NO: 864701 - DNA, 25 bp, Mus musculus
accgagagcatgaacggcgtttttt

SEQ ID NO: 864702 - DNA, 25 bp, Mus musculus
accgagagcatgaactgggccaatc

SEQ ID NO: 864703 - DNA, 25 bp, Mus musculus
accgagagcatgaagactccgtggt

SEQ ID NO: 864704 - DNA, 25 bp, Mus musculus
accgagagcatgaagggcgtttttt

SEQ ID NO: 864705 - DNA, 25 bp, Mus musculus
accgagagcatgaagtgggccaatc

SEQ ID NO: 864706 - DNA, 25 bp, Mus musculus
accgagatatcaaacctgccaacgt

SEQ ID NO: 864707 - DNA, 25 bp, Mus musculus
accgagatatcaaagctgccaacgt

SEQ ID NO: 864708 - DNA, 25 bp, Mus musculus
accgagatgctcagcctttgctcct

SEQ ID NO: 864709 - DNA, 25 bp, Mus musculus
accgagatgctcaggctttgctcct

SEQ ID NO: 864710 - DNA, 25 bp, Mus musculus
accgagccagacccagatgtcaaga

SEQ ID NO: 864711 - DNA, 25 bp, Mus musculus
accgagccagtcccagatgtcaaga

SEQ ID NO: 864712 - DNA, 25 bp, Mus musculus
accgaggacgaagtctttgactttg

SEQ ID NO: 864713 - DNA, 25 bp, Mus musculus
accgaggacgaagtgtttgactttg

SEQ ID NO: 864714 - DNA, 25 bp, Mus musculus
accgaggcgcgtgacacgcagaggc

SEQ ID NO: 864715 - DNA, 25 bp, Mus musculus
accgaggcgcgtgacatgcccggaa

SEQ ID NO: 864716 - DNA, 25 bp, Mus musculus
accgaggcgcgtgagacgcagaggc

SEQ ID NO: 864717 - DNA, 25 bp, Mus musculus
accgaggcgcgtgagatgcccggaa

SEQ ID NO: 864718 - DNA, 25 bp, Mus musculus
accgagtcctcacgccaatgtgctt

SEQ ID NO: 864719 - DNA, 25 bp, Mus musculus
accgagtcctcaggccaatgtgctt

SEQ ID NO: 864720 - DNA, 25 bp, Mus musculus
accgagtgacagctggtcaagatgc

SEQ ID NO: 864721 - DNA, 25 bp, Mus musculus
accgagtgacaggtggtcaagatgc

SEQ ID NO: 864722 - DNA, 25 bp, Mus musculus
accgatcagtatatacacttctgat

SEQ ID NO: 864723 - DNA, 25 bp, Mus musculus
accgatcagtttatacacttctgat

SEQ ID NO: 864724 - DNA, 25 bp, Mus musculus
accgatgcctgccacggtgactccg

SEQ ID NO: 864725 - DNA, 25 bp, Mus musculus
accgatgcctgccagggtgactccg

SEQ ID NO: 864726 - DNA, 25 bp, Mus musculus
accgatttaaagcttgtgccccagc

SEQ ID NO: 864727 - DNA, 25 bp, Mus musculus
accgatttaaaggttgtgccccagc

SEQ ID NO: 864728 - DNA, 25 bp, Mus musculus
accgatttctggctagtgaggaatc

SEQ ID NO: 864729 - DNA, 25 bp, Mus musculus
accgatttctgggtagtgaggaatc

SEQ ID NO: 864730 - DNA, 25 bp, Mus musculus
accgcaagcgagaccccatcagtga

SEQ ID NO: 864731 - DNA, 25 bp, Mus musculus
accgcaagcgagtccccatcagtga

SEQ ID NO: 864732 - DNA, 25 bp, Mus musculus
accgcacaagccacaatttacaccc

SEQ ID NO: 864733 - DNA, 25 bp, Mus musculus
accgcacaagccactatttacaccc

SEQ ID NO: 864734 - DNA, 25 bp, Mus musculus
accgcagagtacgaccagttcctac

SEQ ID NO: 864735 - DNA, 25 bp, Mus musculus
accgcagagtacgacttcctacctg

SEQ ID NO: 864736 - DNA, 25 bp, Mus musculus
accgcagagtacgagcagttcctac

SEQ ID NO: 864737 - DNA, 25 bp, Mus musculus
accgcagagtacgagttcctacctg

SEQ ID NO: 864738 - DNA, 25 bp, Mus musculus
accgcagcgcccagcctgggaattg

SEQ ID NO: 864739 - DNA, 25 bp, Mus musculus
accgcagcgcccaggctgggaattg

SEQ ID NO: 864740 - DNA, 25 bp, Mus musculus
accgcagcttcaaaatattgtatct

SEQ ID NO: 864741 - DNA, 25 bp, Mus musculus
accgcagcttcataatattgtatct

SEQ ID NO: 864742 - DNA, 25 bp, Mus musculus
accgcattcagacggttctcatcgt

SEQ ID NO: 864743 - DNA, 25 bp, Mus musculus
accgcattcagagggttctcatcgt

SEQ ID NO: 864744 - DNA, 25 bp, Mus musculus
accgcattccagagtctgggggaga

SEQ ID NO: 864745 - DNA, 25 bp, Mus musculus
accgcattccagtgtctgggggaga

SEQ ID NO: 864746 - DNA, 25 bp, Mus musculus
accgccagatcttttggccacttga

SEQ ID NO: 864747 - DNA, 25 bp, Mus musculus
accgccagatgttttggccacttga

SEQ ID NO: 864748 - DNA, 25 bp, Mus musculus
accgccagctctgctgtggctggaa

SEQ ID NO: 864749 - DNA, 25 bp, Mus musculus
accgccagctgtgctgtggctggaa

SEQ ID NO: 864750 - DNA, 25 bp, Mus musculus
accgccaggatgaaacccatcctgc

SEQ ID NO: 864751 - DNA, 25 bp, Mus musculus
accgccaggatgtaacccatcctgc

SEQ ID NO: 864752 - DNA, 25 bp, Mus musculus
accgcccgagactgtgtttcctgtg

SEQ ID NO: 864753 - DNA, 25 bp, Mus musculus
accgcccgagtctgtgtttcctgtg

SEQ ID NO: 864754 - DNA, 25 bp, Mus musculus
accgccgccaagcctgaagctgacg

SEQ ID NO: 864755 - DNA, 25 bp, Mus musculus
accgccgccaaggctgaagctgacg

SEQ ID NO: 864756 - DNA, 25 bp, Mus musculus
accgccggagctcttttatgaccag

SEQ ID NO: 864757 - DNA, 25 bp, Mus musculus
accgccggagctgttttatgaccag

SEQ ID NO: 864758 - DNA, 25 bp, Mus musculus
accgcctctccctcgatgagtctct

SEQ ID NO: 864759 - DNA, 25 bp, Mus musculus
accgcctctcgctcgatgagtctct

SEQ ID NO: 864760 - DNA, 25 bp, Mus musculus
accgcctttggacgatggaagagtg

SEQ ID NO: 864761 - DNA, 25 bp, Mus musculus
accgcctttggaggatggaagagtg

SEQ ID NO: 864762 - DNA, 25 bp, Mus musculus
accgcgatgaggctgcccggaccaa

SEQ ID NO: 864763 - DNA, 25 bp, Mus musculus
accgcgatgagggtgcccggaccaa

SEQ ID NO: 864764 - DNA, 25 bp, Mus musculus
accgcgcttggcagagccagacatc

SEQ ID NO: 864765 - DNA, 25 bp, Mus musculus
accgcgcttggcagtgccagacatc

SEQ ID NO: 864766 - DNA, 25 bp, Mus musculus
accgcggcagcatgggtccctcggg

SEQ ID NO: 864767 - DNA, 25 bp, Mus musculus
accgcggcaggatgggtccctcggg

SEQ ID NO: 864768 - DNA, 25 bp, Mus musculus
accgcggccgtgcagttggaattga

SEQ ID NO: 864769 - DNA, 25 bp, Mus musculus
accgcggccgtggagttggaattga

SEQ ID NO: 864770 - DNA, 25 bp, Mus musculus
accgcggttacacggcatctgactg

SEQ ID NO: 864771 - DNA, 25 bp, Mus musculus
accgcggttacagggcatctgactg

SEQ ID NO: 864772 - DNA, 25 bp, Mus musculus
accgctaacttacacagttgagtgg

SEQ ID NO: 864773 - DNA, 25 bp, Mus musculus
accgctaacttacagagttgagtgg

SEQ ID NO: 864774 - DNA, 25 bp, Mus musculus
accgctactgtgttcatgtgaacga

SEQ ID NO: 864775 - DNA, 25 bp, Mus musculus
accgctactgtgttgatgtgaacga

SEQ ID NO: 864776 - DNA, 25 bp, Mus musculus
accgctcagaagaaggcctgagctg

SEQ ID NO: 864777 - DNA, 25 bp, Mus musculus
accgctcagaagtaggcctgagctg

SEQ ID NO: 864778 - DNA, 25 bp, Mus musculus
accgctccaatgagggtatgaactg

SEQ ID NO: 864779 - DNA, 25 bp, Mus musculus
accgctccaatgtgggtatgaactg

SEQ ID NO: 864780 - DNA, 25 bp, Mus musculus
accgctcccacacacccttggacaa

SEQ ID NO: 864781 - DNA, 25 bp, Mus musculus
accgctcccacacacgtgagaagcc

SEQ ID NO: 864782 - DNA, 25 bp, Mus musculus
accgctcccacacagccttggacaa

SEQ ID NO: 864783 - DNA, 25 bp, Mus musculus
accgctcccacacaggtgagaagcc

SEQ ID NO: 864784 - DNA, 25 bp, Mus musculus
accgctccgcccctgttggtggaat

SEQ ID NO: 864785 - DNA, 25 bp, Mus musculus
accgctccgcccgtgttggtggaat

SEQ ID NO: 864786 - DNA, 25 bp, Mus musculus
accgctccgcgtcagaatcaaatac

SEQ ID NO: 864787 - DNA, 25 bp, Mus musculus
accgctccgcgtgagaatcaaatac

SEQ ID NO: 864788 - DNA, 25 bp, Mus musculus
accgctcctcagccaaacactatgg

SEQ ID NO: 864789 - DNA, 25 bp, Mus musculus
accgctcctcaggcaaacactatgg

SEQ ID NO: 864790 - DNA, 25 bp, Mus musculus
accgctctagtgcacgggatgtcac

SEQ ID NO: 864791 - DNA, 25 bp, Mus musculus
accgctctagtgcaggggatgtcac

SEQ ID NO: 864792 - DNA, 25 bp, Mus musculus
accgctgcacgccggcatgtgtttc

SEQ ID NO: 864793 - DNA, 25 bp, Mus musculus
accgctgcacgccgtaatttctaat

SEQ ID NO: 864794 - DNA, 25 bp, Mus musculus
accgctgcacgcgggcatgtgtttc

SEQ ID NO: 864795 - DNA, 25 bp, Mus musculus
accgctgcacgcggtaatttctaat

SEQ ID NO: 864796 - DNA, 25 bp, Mus musculus
accgctgcagatacgaacacagcaa

SEQ ID NO: 864797 - DNA, 25 bp, Mus musculus
accgctgcagcctgtaaatgaaaat

SEQ ID NO: 864798 - DNA, 25 bp, Mus musculus
accgctgcagcgtcccagcctcaca

SEQ ID NO: 864799 - DNA, 25 bp, Mus musculus
accgctgcaggctgtaaatgaaaat

SEQ ID NO: 864800 - DNA, 25 bp, Mus musculus
accgctgcagggtcccagcctcaca

SEQ ID NO: 864801 - DNA, 25 bp, Mus musculus
accgctgcagttacgaacacagcaa

SEQ ID NO: 864802 - DNA, 25 bp, Mus musculus
accgctggaaaacttattaagtgca

SEQ ID NO: 864803 - DNA, 25 bp, Mus musculus
accgctggaaaagttattaagtgca

SEQ ID NO: 864804 - DNA, 25 bp, Mus musculus
accgcttcggcaatgaaggcttaat

SEQ ID NO: 864805 - DNA, 25 bp, Mus musculus
accgcttcgggaatgaaggcttaat

SEQ ID NO: 864806 - DNA, 25 bp, Mus musculus
accgctttggactgcgagctgaagt

SEQ ID NO: 864807 - DNA, 25 bp, Mus musculus
accgctttggactgggagctgaagt

SEQ ID NO: 864808 - DNA, 25 bp, Mus musculus
accgctttggcacacgcaactctat

SEQ ID NO: 864809 - DNA, 25 bp, Mus musculus
accgctttggcagacgcaactctat

SEQ ID NO: 864810 - DNA, 25 bp, Mus musculus
accggaaccaagatcgtcacataga

SEQ ID NO: 864811 - DNA, 25 bp, Mus musculus
accggaaccaagatggtcacataga

SEQ ID NO: 864812 - DNA, 25 bp, Mus musculus
accggactaccaccttctaacatcc

SEQ ID NO: 864813 - DNA, 25 bp, Mus musculus
accggactaccagcttctaacatcc

SEQ ID NO: 864814 - DNA, 25 bp, Mus musculus
accggagtcatgcgggtctgctgca

SEQ ID NO: 864815 - DNA, 25 bp, Mus musculus
accggagtcatgggggtctgctgca

SEQ ID NO: 864816 - DNA, 25 bp, Mus musculus
accggagttgcatcggtcatgggac

SEQ ID NO: 864817 - DNA, 25 bp, Mus musculus
accggagttggatcggtcatgggac

SEQ ID NO: 864818 - DNA, 25 bp, Mus musculus
accggatccgagctgccgccgccgg

SEQ ID NO: 864819 - DNA, 25 bp, Mus musculus
accggatccgaggtgccgccgccgg

SEQ ID NO: 864820 - DNA, 25 bp, Mus musculus
accggatgcccacactcaacgcaaa

SEQ ID NO: 864821 - DNA, 25 bp, Mus musculus
accggatgcccagactcaacgcaaa

SEQ ID NO: 864822 - DNA, 25 bp, Mus musculus
accggatgctcaccgaggacccgtg

SEQ ID NO: 864823 - DNA, 25 bp, Mus musculus
accggatgctcagcgaggacccgtg

SEQ ID NO: 864824 - DNA, 25 bp, Mus musculus
accggcaacgccaccggcaagctgg

SEQ ID NO: 864825 - DNA, 25 bp, Mus musculus
accggcaacgccacgggcaagctgg

SEQ ID NO: 864826 - DNA, 25 bp, Mus musculus
accggcacactccatctgatttgta

SEQ ID NO: 864827 - DNA, 25 bp, Mus musculus
accggcacactcgatctgatttgta

SEQ ID NO: 864828 - DNA, 25 bp, Mus musculus
accggcagactgcaccctaggatgt

SEQ ID NO: 864829 - DNA, 25 bp, Mus musculus
accggcagactgcactttcaggtca

SEQ ID NO: 864830 - DNA, 25 bp, Mus musculus
accggcagactgcagcctaggatgt

SEQ ID NO: 864831 - DNA, 25 bp, Mus musculus
accggcagactgcagtttcaggtca

SEQ ID NO: 864832 - DNA, 25 bp, Mus musculus
accggcattgatgtccagctcgccg

SEQ ID NO: 864833 - DNA, 25 bp, Mus musculus
accggcattgttgtccagctcgccg

SEQ ID NO: 864834 - DNA, 25 bp, Mus musculus
accggccaagccaccaagtattcag

SEQ ID NO: 864835 - DNA, 25 bp, Mus musculus
accggccaagccacgaagtattcag

SEQ ID NO: 864836 - DNA, 25 bp, Mus musculus
accggcctgccccaccatcagaatg

SEQ ID NO: 864837 - DNA, 25 bp, Mus musculus
accggcctgccccagcatcagaatg

SEQ ID NO: 864838 - DNA, 25 bp, Mus musculus
accggcgtcatcatccctgtctccg

SEQ ID NO: 864839 - DNA, 25 bp, Mus musculus
accggcgtcatcatgcctgtctccg

SEQ ID NO: 864840 - DNA, 25 bp, Mus musculus
accggctccacagacgttggaaagc

SEQ ID NO: 864841 - DNA, 25 bp, Mus musculus
accggctccacagaggttggaaagc

SEQ ID NO: 864842 - DNA, 25 bp, Mus musculus
accggctgacctccaaatctggttc

SEQ ID NO: 864843 - DNA, 25 bp, Mus musculus
accggctgacctcgccctctgtcct

SEQ ID NO: 864844 - DNA, 25 bp, Mus musculus
accggctgacctcttgaacactctg

SEQ ID NO: 864845 - DNA, 25 bp, Mus musculus
accggctgacctgcaaatctggttc

SEQ ID NO: 864846 - DNA, 25 bp, Mus musculus
accggctgacctggccctctgtcct

SEQ ID NO: 864847 - DNA, 25 bp, Mus musculus
accggctgacctgttgaacactctg

SEQ ID NO: 864848 - DNA, 25 bp, Mus musculus
accggctgcacaccccatctctgag

SEQ ID NO: 864849 - DNA, 25 bp, Mus musculus
accggctgcacacgagcaacacgtc

SEQ ID NO: 864850 - DNA, 25 bp, Mus musculus
accggctgcacagcccatctctgag

SEQ ID NO: 864851 - DNA, 25 bp, Mus musculus
accggctgcacaggagcaacacgtc

SEQ ID NO: 864852 - DNA, 25 bp, Mus musculus
accggctgtggaatttactgtgcca

SEQ ID NO: 864853 - DNA, 25 bp, Mus musculus
accggctgtggatgatttactgtgc

SEQ ID NO: 864854 - DNA, 25 bp, Mus musculus
accggctgtggatgttttactgtgc

SEQ ID NO: 864855 - DNA, 25 bp, Mus musculus
accggctgtggattttactgtgcca

SEQ ID NO: 864856 - DNA, 25 bp, Mus musculus
accggcttaatgctgattttgctca

SEQ ID NO: 864857 - DNA, 25 bp, Mus musculus
accggcttaatggtgattttgctca

SEQ ID NO: 864858 - DNA, 25 bp, Mus musculus
accgggaccagacaattggagttga

SEQ ID NO: 864859 - DNA, 25 bp, Mus musculus
accgggaccagagaattggagttga

SEQ ID NO: 864860 - DNA, 25 bp, Mus musculus
accgggcacttcgacaggttgcagg

SEQ ID NO: 864861 - DNA, 25 bp, Mus musculus
accgggcacttcgagaggttgcagg

SEQ ID NO: 864862 - DNA, 25 bp, Mus musculus
accgggcagaggcggaacgtgatgt

SEQ ID NO: 864863 - DNA, 25 bp, Mus musculus
accgggcagagggggaacgtgatgt

SEQ ID NO: 864864 - DNA, 25 bp, Mus musculus
accgggctaccttttatgcagctga

SEQ ID NO: 864865 - DNA, 25 bp, Mus musculus
accgggctacgttttatgcagctga

SEQ ID NO: 864866 - DNA, 25 bp, Mus musculus
accgggctcaccttcaaaatgaagt

SEQ ID NO: 864867 - DNA, 25 bp, Mus musculus
accgggctcaccttctgttcgactt

SEQ ID NO: 864868 - DNA, 25 bp, Mus musculus
accgggctcaccttgaaaatgaagt

SEQ ID NO: 864869 - DNA, 25 bp, Mus musculus
accgggctcaccttgtgttcgactt

SEQ ID NO: 864870 - DNA, 25 bp, Mus musculus
accggtcatcgacgcgcacaacgac

SEQ ID NO: 864871 - DNA, 25 bp, Mus musculus
accggtcatcgacgggcacaacgac

SEQ ID NO: 864872 - DNA, 25 bp, Mus musculus
accggtgtcgatatcgaaaggcgcc

SEQ ID NO: 864873 - DNA, 25 bp, Mus musculus
accggtgtcgatatggaaaggcgcc

SEQ ID NO: 864874 - DNA, 25 bp, Mus musculus
accgtacactttgtcatgtagatgc

SEQ ID NO: 864875 - DNA, 25 bp, Mus musculus
accgtacactttgtgatgtagatgc

SEQ ID NO: 864876 - DNA, 25 bp, Mus musculus
accgtacgagccagctgtggccctg

SEQ ID NO: 864877 - DNA, 25 bp, Mus musculus
accgtacgaggcagctgtggccctg

SEQ ID NO: 864878 - DNA, 25 bp, Mus musculus
accgtagcccagaaaaatatgaaga

SEQ ID NO: 864879 - DNA, 25 bp, Mus musculus
accgtagcccagagcaagtccctcc

SEQ ID NO: 864880 - DNA, 25 bp, Mus musculus
accgtagcccagtaaaatatgaaga

SEQ ID NO: 864881 - DNA, 25 bp, Mus musculus
accgtagcccagtgcaagtccctcc

SEQ ID NO: 864882 - DNA, 25 bp, Mus musculus
accgtccttggtagatccgccagga

SEQ ID NO: 864883 - DNA, 25 bp, Mus musculus
accgtccttggttgatccgccagga

SEQ ID NO: 864884 - DNA, 25 bp, Mus musculus
accgtcggtgctccgatccggagga

SEQ ID NO: 864885 - DNA, 25 bp, Mus musculus
accgtcggtgctcgccttcccagaa

SEQ ID NO: 864886 - DNA, 25 bp, Mus musculus
accgtcggtgctgcgatccggagga

SEQ ID NO: 864887 - DNA, 25 bp, Mus musculus
accgtcggtgctggccttcccagaa

SEQ ID NO: 864888 - DNA, 25 bp, Mus musculus
accgtctcctcacagtctgcgagaa

SEQ ID NO: 864889 - DNA, 25 bp, Mus musculus
accgtctcctcagagtctgcgagaa

SEQ ID NO: 864890 - DNA, 25 bp, Mus musculus
accgtgagccagattacaagattcc

SEQ ID NO: 864891 - DNA, 25 bp, Mus musculus
accgtgagccagtttacaagattcc

SEQ ID NO: 864892 - DNA, 25 bp, Mus musculus
accgtgctgtgactgtttccaccac

SEQ ID NO: 864893 - DNA, 25 bp, Mus musculus
accgtgctgtgagtgtttccaccac

SEQ ID NO: 864894 - DNA, 25 bp, Mus musculus
accgtggcagcggttcttacagaca

SEQ ID NO: 864895 - DNA, 25 bp, Mus musculus
accgtggcaggggttcttacagaca

SEQ ID NO: 864896 - DNA, 25 bp, Mus musculus
accgttctggaacccctggaagaga

SEQ ID NO: 864897 - DNA, 25 bp, Mus musculus
accgttctggaagccctggaagaga

SEQ ID NO: 864898 - DNA, 25 bp, Mus musculus
accgttgcaatgatacaatccctga

SEQ ID NO: 864899 - DNA, 25 bp, Mus musculus
accgttgcaatgttacaatccctga

SEQ ID NO: 864900 - DNA, 25 bp, Mus musculus
accgttgtagagagtgtaatgctgt

SEQ ID NO: 864901 - DNA, 25 bp, Mus musculus
accgttgtagagtgtgtaatgctgt

SEQ ID NO: 864902 - DNA, 25 bp, Mus musculus
acctaaacacagcgctgtgagtcag

SEQ ID NO: 864903 - DNA, 25 bp, Mus musculus
acctaaacacagggctgtgagtcag

SEQ ID NO: 864904 - DNA, 25 bp, Mus musculus
acctaaagataataagtttcacaag

SEQ ID NO: 864905 - DNA, 25 bp, Mus musculus
acctaaagataatatgtttcacaag

SEQ ID NO: 864906 - DNA, 25 bp, Mus musculus
acctaattgaatatcattgcatggt

SEQ ID NO: 864907 - DNA, 25 bp, Mus musculus
acctaattgaatttcattgcatggt

SEQ ID NO: 864908 - DNA, 25 bp, Mus musculus
acctacaaaccacaggccactacat

SEQ ID NO: 864909 - DNA, 25 bp, Mus musculus
acctacaaaccagaggccactacat

SEQ ID NO: 864910 - DNA, 25 bp, Mus musculus
acctacaaatcacaatgtttctcca

SEQ ID NO: 864911 - DNA, 25 bp, Mus musculus
acctacaaatcagaatgtttctcca

SEQ ID NO: 864912 - DNA, 25 bp, Mus musculus
acctacagagagcaggcttctcaga

SEQ ID NO: 864913 - DNA, 25 bp, Mus musculus
acctacagagaggaggcttctcaga

SEQ ID NO: 864914 - DNA, 25 bp, Mus musculus
acctacagatagctatgtaggattt

SEQ ID NO: 864915 - DNA, 25 bp, Mus musculus
acctacagataggtatgtaggattt

SEQ ID NO: 864916 - DNA, 25 bp, Mus musculus
acctacagtcagctccagtgtcaca

SEQ ID NO: 864917 - DNA, 25 bp, Mus musculus
acctacagtcaggtccagtgtcaca

SEQ ID NO: 864918 - DNA, 25 bp, Mus musculus
acctacattaacgtcgttcattatg

SEQ ID NO: 864919 - DNA, 25 bp, Mus musculus
acctacattaacgtggttcattatg

SEQ ID NO: 864920 - DNA, 25 bp, Mus musculus
acctacatttcaaacgttagcgatg

SEQ ID NO: 864921 - DNA, 25 bp, Mus musculus
acctacatttcaaaggttagcgatg

SEQ ID NO: 864922 - DNA, 25 bp, Mus musculus
acctaccagccaatccagtctccca

SEQ ID NO: 864923 - DNA, 25 bp, Mus musculus
acctaccagccattccagtctccca

SEQ ID NO: 864924 - DNA, 25 bp, Mus musculus
acctacccagaacgacggcactaga

SEQ ID NO: 864925 - DNA, 25 bp, Mus musculus
acctacccagaacgacggcattaga

SEQ ID NO: 864926 - DNA, 25 bp, Mus musculus
acctacccagaaggacggcactaga

SEQ ID NO: 864927 - DNA, 25 bp, Mus musculus
acctacccagaaggacggcattaga

SEQ ID NO: 864928 - DNA, 25 bp, Mus musculus
acctacccctcaagaaaagctactg

SEQ ID NO: 864929 - DNA, 25 bp, Mus musculus
acctacccctcaagccttcctgcct

SEQ ID NO: 864930 - DNA, 25 bp, Mus musculus
acctacccctcatgaaaagctactg

SEQ ID NO: 864931 - DNA, 25 bp, Mus musculus
acctacccctcatgccttcctgcct

SEQ ID NO: 864932 - DNA, 25 bp, Mus musculus
acctacctgcacagcgtggccagag

SEQ ID NO: 864933 - DNA, 25 bp, Mus musculus
acctacctgcacagggtggccagag

SEQ ID NO: 864934 - DNA, 25 bp, Mus musculus
acctacgtcacgctgagagtgagca

SEQ ID NO: 864935 - DNA, 25 bp, Mus musculus
acctacgtcacggtgagagtgagca

SEQ ID NO: 864936 - DNA, 25 bp, Mus musculus
acctactcaacctctcagaactgtg

SEQ ID NO: 864937 - DNA, 25 bp, Mus musculus
acctactcaagctctcagaactgtg

SEQ ID NO: 864938 - DNA, 25 bp, Mus musculus
acctactcacagagaattgaaggac

SEQ ID NO: 864939 - DNA, 25 bp, Mus musculus
acctactcacagtgaattgaaggac

SEQ ID NO: 864940 - DNA, 25 bp, Mus musculus
acctactcccagagaccttcagaat

SEQ ID NO: 864941 - DNA, 25 bp, Mus musculus
acctactcccagtgaccttcagaat

SEQ ID NO: 864942 - DNA, 25 bp, Mus musculus
acctactctgtcccaggcgtgggga

SEQ ID NO: 864943 - DNA, 25 bp, Mus musculus
acctactctgtccctggcgtgggga

SEQ ID NO: 864944 - DNA, 25 bp, Mus musculus
acctacttgttcaacggtagtcagt

SEQ ID NO: 864945 - DNA, 25 bp, Mus musculus
acctacttgttcaagggtagtcagt

SEQ ID NO: 864946 - DNA, 25 bp, Mus musculus
acctagacagattgaaggataagct

SEQ ID NO: 864947 - DNA, 25 bp, Mus musculus
acctagacagtttgaaggataagct

SEQ ID NO: 864948 - DNA, 25 bp, Mus musculus
acctagagaagacggaatggttcca

SEQ ID NO: 864949 - DNA, 25 bp, Mus musculus
acctagagaagagggaatggttcca

SEQ ID NO: 864950 - DNA, 25 bp, Mus musculus
acctagaggctacggcacctggact

SEQ ID NO: 864951 - DNA, 25 bp, Mus musculus
acctagaggctagggcacctggact

SEQ ID NO: 864952 - DNA, 25 bp, Mus musculus
acctagatctcacagcatctaactc

SEQ ID NO: 864953 - DNA, 25 bp, Mus musculus
acctagatctcagagcatctaactc

SEQ ID NO: 864954 - DNA, 25 bp, Mus musculus
acctagcaagattatccagctgact

SEQ ID NO: 864955 - DNA, 25 bp, Mus musculus
acctagcaagtttatccagctgact

SEQ ID NO: 864956 - DNA, 25 bp, Mus musculus
acctagcatcaggccgtgaccatgc

SEQ ID NO: 864957 - DNA, 25 bp, Mus musculus
acctagcatcaggcggtgaccatgc

SEQ ID NO: 864958 - DNA, 25 bp, Mus musculus
acctagccagcaccaccaccaacag

SEQ ID NO: 864959 - DNA, 25 bp, Mus musculus
acctagccaggaccaccaccaacag

SEQ ID NO: 864960 - DNA, 25 bp, Mus musculus
acctagcccgcaaggagctgaagaa

SEQ ID NO: 864961 - DNA, 25 bp, Mus musculus
acctagcccggaaggagctgaagaa

SEQ ID NO: 864962 - DNA, 25 bp, Mus musculus
acctagctacagaactgtgccggat

SEQ ID NO: 864963 - DNA, 25 bp, Mus musculus
acctagctacagtactgtgccggat

SEQ ID NO: 864964 - DNA, 25 bp, Mus musculus
acctaggccccactcgggccatgta

SEQ ID NO: 864965 - DNA, 25 bp, Mus musculus
acctaggccccactggggccatgta

SEQ ID NO: 864966 - DNA, 25 bp, Mus musculus
acctataaggtcaaccctgtgggcc

SEQ ID NO: 864967 - DNA, 25 bp, Mus musculus
acctataaggtcaagcctgtgggcc

SEQ ID NO: 864968 - DNA, 25 bp, Mus musculus
acctatgacaagccttacacggatg

SEQ ID NO: 864969 - DNA, 25 bp, Mus musculus
acctatgacaaggcttacacggatg

SEQ ID NO: 864970 - DNA, 25 bp, Mus musculus
acctatgagaaacggaagacctcgg

SEQ ID NO: 864971 - DNA, 25 bp, Mus musculus
acctatgagaaagggaagacctcgg

SEQ ID NO: 864972 - DNA, 25 bp, Mus musculus
acctatgaggagcccttaagatact

SEQ ID NO: 864973 - DNA, 25 bp, Mus musculus
acctatgaggaggccttaagatact

SEQ ID NO: 864974 - DNA, 25 bp, Mus musculus
acctatgatgaggactaccagcagc

SEQ ID NO: 864975 - DNA, 25 bp, Mus musculus
acctatgatgatggcatttgcaaat

SEQ ID NO: 864976 - DNA, 25 bp, Mus musculus
acctatgatgcacaagaagctgatc

SEQ ID NO: 864977 - DNA, 25 bp, Mus musculus
acctatgatggacaagaagctgatc

SEQ ID NO: 864978 - DNA, 25 bp, Mus musculus
acctatgatgtggactaccagcagc

SEQ ID NO: 864979 - DNA, 25 bp, Mus musculus
acctatgatgttggcatttgcaaat

SEQ ID NO: 864980 - DNA, 25 bp, Mus musculus
acctatggctatctcaccgtcctta

SEQ ID NO: 864981 - DNA, 25 bp, Mus musculus
acctatggctatgtcaccgtcctta

SEQ ID NO: 864982 - DNA, 25 bp, Mus musculus
acctatgtcatgatcgtgtttggcc

SEQ ID NO: 864983 - DNA, 25 bp, Mus musculus
acctatgtcatgatggtgtttggcc

SEQ ID NO: 864984 - DNA, 25 bp, Mus musculus
acctatgtgggacgatgatgcaaat

SEQ ID NO: 864985 - DNA, 25 bp, Mus musculus
acctatgtgggaggatgatgcaaat

SEQ ID NO: 864986 - DNA, 25 bp, Mus musculus
acctatttagaggaactctgtagcc

SEQ ID NO: 864987 - DNA, 25 bp, Mus musculus
acctatttagtggaactctgtagcc

SEQ ID NO: 864988 - DNA, 25 bp, Mus musculus
acctcaaataaacaagatacattat

SEQ ID NO: 864989 - DNA, 25 bp, Mus musculus
acctcaaataaagaagatacattat

SEQ ID NO: 864990 - DNA, 25 bp, Mus musculus
acctcaacagacatttgctccaagt

SEQ ID NO: 864991 - DNA, 25 bp, Mus musculus
acctcaacagacttttgctccaagt

SEQ ID NO: 864992 - DNA, 25 bp, Mus musculus
acctcaacagagggcagctgatcac

SEQ ID NO: 864993 - DNA, 25 bp, Mus musculus
acctcaacagtgggcagctgatcac

SEQ ID NO: 864994 - DNA, 25 bp, Mus musculus
acctcaactactgccaggaggcggt

SEQ ID NO: 864995 - DNA, 25 bp, Mus musculus
acctcaactactgcgaggaggcggt

SEQ ID NO: 864996 - DNA, 25 bp, Mus musculus
acctcaactgatcggaccctgccac

SEQ ID NO: 864997 - DNA, 25 bp, Mus musculus
acctcaactgatgggaccctgccac

SEQ ID NO: 864998 - DNA, 25 bp, Mus musculus
acctcaacttcacaatgttcgatgt

SEQ ID NO: 864999 - DNA, 25 bp, Mus musculus
acctcaacttcagaatgttcgatgt

SEQ ID NO: 865000 - DNA, 25 bp, Mus musculus
acctcaagagcgagagaaaatgaaa

SEQ ID NO: 865001 - DNA, 25 bp, Mus musculus
acctcaagagctacctaagagtaag

SEQ ID NO: 865002 - DNA, 25 bp, Mus musculus
acctcaagagggagagaaaatgaaa

SEQ ID NO: 865003 - DNA, 25 bp, Mus musculus
acctcaagaggtacctaagagtaag

SEQ ID NO: 865004 - DNA, 25 bp, Mus musculus
acctcaaggagcagtaggtggcgat

SEQ ID NO: 865005 - DNA, 25 bp, Mus musculus
acctcaaggagctgtaggtggcgat

SEQ ID NO: 865006 - DNA, 25 bp, Mus musculus
acctcaatgaaacgaggcactgtgt

SEQ ID NO: 865007 - DNA, 25 bp, Mus musculus
acctcaatgaaaggaggcactgtgt

SEQ ID NO: 865008 - DNA, 25 bp, Mus musculus
acctcaatgaagcaagtgcttgctc

SEQ ID NO: 865009 - DNA, 25 bp, Mus musculus
acctcaatgaaggaagtgcttgctc

SEQ ID NO: 865010 - DNA, 25 bp, Mus musculus
acctcaatgctgaacgtgtgattag

SEQ ID NO: 865011 - DNA, 25 bp, Mus musculus
acctcaatgctgaaggtgtgattag

SEQ ID NO: 865012 - DNA, 25 bp, Mus musculus
acctcacaagagcacgatctgattt

SEQ ID NO: 865013 - DNA, 25 bp, Mus musculus
acctcacaagctgactggacagaag

SEQ ID NO: 865014 - DNA, 25 bp, Mus musculus
acctcacaaggtgactggacagaag

SEQ ID NO: 865015 - DNA, 25 bp, Mus musculus
acctcacaagtgcacgatctgattt

SEQ ID NO: 865016 - DNA, 25 bp, Mus musculus
acctcacatacaaacctgggagctg

SEQ ID NO: 865017 - DNA, 25 bp, Mus musculus
acctcacatacatacctgggagctg

SEQ ID NO: 865018 - DNA, 25 bp, Mus musculus
acctcaccagcatgtccaaaattct

SEQ ID NO: 865019 - DNA, 25 bp, Mus musculus
acctcaccaggatgtccaaaattct

SEQ ID NO: 865020 - DNA, 25 bp, Mus musculus
acctcacctaaacatactgagccaa

SEQ ID NO: 865021 - DNA, 25 bp, Mus musculus
acctcacctaaagatactgagccaa

SEQ ID NO: 865022 - DNA, 25 bp, Mus musculus
acctcacgagcttcctggacatcag

SEQ ID NO: 865023 - DNA, 25 bp, Mus musculus
acctcacgaggttcctggacatcag

SEQ ID NO: 865024 - DNA, 25 bp, Mus musculus
acctcactgtgcatattgcgccaac

SEQ ID NO: 865025 - DNA, 25 bp, Mus musculus
acctcactgtgcattttgcgccaac

SEQ ID NO: 865026 - DNA, 25 bp, Mus musculus
acctcagactcacggttgagctcca

SEQ ID NO: 865027 - DNA, 25 bp, Mus musculus
acctcagactcagggttgagctcca

SEQ ID NO: 865028 - DNA, 25 bp, Mus musculus
acctcagcaaatctggtaaacagct

SEQ ID NO: 865029 - DNA, 25 bp, Mus musculus
acctcagcaaatgtggtaaacagct

SEQ ID NO: 865030 - DNA, 25 bp, Mus musculus
acctcagcagcctcaagcaagacgt

SEQ ID NO: 865031 - DNA, 25 bp, Mus musculus
acctcagcaggctcaagcaagacgt

SEQ ID NO: 865032 - DNA, 25 bp, Mus musculus
acctcagctggtagtgcagacaaaa

SEQ ID NO: 865033 - DNA, 25 bp, Mus musculus
acctcagctggtagtgcagtcaaaa

SEQ ID NO: 865034 - DNA, 25 bp, Mus musculus
acctcagctggttgtgcagacaaaa

SEQ ID NO: 865035 - DNA, 25 bp, Mus musculus
acctcagctggttgtgcagtcaaaa

SEQ ID NO: 865036 - DNA, 25 bp, Mus musculus
acctcagggcgacctgactgtgatg

SEQ ID NO: 865037 - DNA, 25 bp, Mus musculus
acctcagggcgagctgactgtgatg

SEQ ID NO: 865038 - DNA, 25 bp, Mus musculus
acctcaggggctgggggatgtgcaa

SEQ ID NO: 865039 - DNA, 25 bp, Mus musculus
acctcagggggtgggggatgtgcaa

SEQ ID NO: 865040 - DNA, 25 bp, Mus musculus
acctcagtggtgtccgcattgctag

SEQ ID NO: 865041 - DNA, 25 bp, Mus musculus
acctcagtggtgtccgtgttgccag

SEQ ID NO: 865042 - DNA, 25 bp, Mus musculus
acctcagtggtgtcggcattgctag

SEQ ID NO: 865043 - DNA, 25 bp, Mus musculus
acctcagtggtgtcggtgttgccag

SEQ ID NO: 865044 - DNA, 25 bp, Mus musculus
acctcatacagacacaacgacagaa

SEQ ID NO: 865045 - DNA, 25 bp, Mus musculus
acctcatacagacagaacgacagaa

SEQ ID NO: 865046 - DNA, 25 bp, Mus musculus
acctcatcctggactacgtgagcgg

SEQ ID NO: 865047 - DNA, 25 bp, Mus musculus
acctcatcctggtctacgtgagcgg

SEQ ID NO: 865048 - DNA, 25 bp, Mus musculus
acctcatcgtgtagagccttccagt

SEQ ID NO: 865049 - DNA, 25 bp, Mus musculus
acctcatcgtgttgagccttccagt

SEQ ID NO: 865050 - DNA, 25 bp, Mus musculus
acctcatgccagctatgaacctgaa

SEQ ID NO: 865051 - DNA, 25 bp, Mus musculus
acctcatgccaggtatgaacctgaa

SEQ ID NO: 865052 - DNA, 25 bp, Mus musculus
acctccaaccagcagtatctggacc

SEQ ID NO: 865053 - DNA, 25 bp, Mus musculus
acctccaaccaggagtatctggacc

SEQ ID NO: 865054 - DNA, 25 bp, Mus musculus
acctccaagagtcacatccaggctt

SEQ ID NO: 865055 - DNA, 25 bp, Mus musculus
acctccaagagtcagatccaggctt

SEQ ID NO: 865056 - DNA, 25 bp, Mus musculus
acctccacagagaaaaagctgccac

SEQ ID NO: 865057 - DNA, 25 bp, Mus musculus
acctccacagcacaagagcaagatg

SEQ ID NO: 865058 - DNA, 25 bp, Mus musculus
acctccacagcgcacagaatccatc

SEQ ID NO: 865059 - DNA, 25 bp, Mus musculus
acctccacaggacaagagcaagatg

SEQ ID NO: 865060 - DNA, 25 bp, Mus musculus
acctccacagggcacagaatccatc

SEQ ID NO: 865061 - DNA, 25 bp, Mus musculus
acctccacagtgaaaaagctgccac

SEQ ID NO: 865062 - DNA, 25 bp, Mus musculus
acctccaccttctcactcttcctcc

SEQ ID NO: 865063 - DNA, 25 bp, Mus musculus
acctccaccttctctctcttcctcc

SEQ ID NO: 865064 - DNA, 25 bp, Mus musculus
acctccacttcacgctgtttgacgt

SEQ ID NO: 865065 - DNA, 25 bp, Mus musculus
acctccacttcaggctgtttgacgt

SEQ ID NO: 865066 - DNA, 25 bp, Mus musculus
acctccagaaaacacatctttgtac

SEQ ID NO: 865067 - DNA, 25 bp, Mus musculus
acctccagaaaacagatctttgtac

SEQ ID NO: 865068 - DNA, 25 bp, Mus musculus
acctccagaccacgctgcagtgttg

SEQ ID NO: 865069 - DNA, 25 bp, Mus musculus
acctccagaccaggctgcagtgttg

SEQ ID NO: 865070 - DNA, 25 bp, Mus musculus
acctccagagaggtggattgtccag

SEQ ID NO: 865071 - DNA, 25 bp, Mus musculus
acctccagagtggtggattgtccag

SEQ ID NO: 865072 - DNA, 25 bp, Mus musculus
acctccaggacgagtctcccactcc

SEQ ID NO: 865073 - DNA, 25 bp, Mus musculus
acctccaggacgattctaagctgac

SEQ ID NO: 865074 - DNA, 25 bp, Mus musculus
acctccaggacgcggtctgcctgga

SEQ ID NO: 865075 - DNA, 25 bp, Mus musculus
acctccaggacggggtctgcctgga

SEQ ID NO: 865076 - DNA, 25 bp, Mus musculus
acctccaggacgtgtctcccactcc

SEQ ID NO: 865077 - DNA, 25 bp, Mus musculus
acctccaggacgtttctaagctgac

SEQ ID NO: 865078 - DNA, 25 bp, Mus musculus
acctccaggccagacccgacagagt

SEQ ID NO: 865079 - DNA, 25 bp, Mus musculus
acctccaggccagagccgacagagt

SEQ ID NO: 865080 - DNA, 25 bp, Mus musculus
acctcccaagattccactttgaaga

SEQ ID NO: 865081 - DNA, 25 bp, Mus musculus
acctcccaagtttccactttgaaga

SEQ ID NO: 865082 - DNA, 25 bp, Mus musculus
acctcccctgcaagagccagcagct

SEQ ID NO: 865083 - DNA, 25 bp, Mus musculus
acctcccctggaagagccagcagct

SEQ ID NO: 865084 - DNA, 25 bp, Mus musculus
acctccctagcattctcaaagctgg

SEQ ID NO: 865085 - DNA, 25 bp, Mus musculus
acctccctagctgaggattatgaag

SEQ ID NO: 865086 - DNA, 25 bp, Mus musculus
acctccctaggattctcaaagctgg

SEQ ID NO: 865087 - DNA, 25 bp, Mus musculus
acctccctaggtgaggattatgaag

SEQ ID NO: 865088 - DNA, 25 bp, Mus musculus
acctccctcaccaaccttagcaagg

SEQ ID NO: 865089 - DNA, 25 bp, Mus musculus
acctccctcaccaagcttagcaagg

SEQ ID NO: 865090 - DNA, 25 bp, Mus musculus
acctccctctaaccccaacgcctgg

SEQ ID NO: 865091 - DNA, 25 bp, Mus musculus
acctccctctaagcccaacgcctgg

SEQ ID NO: 865092 - DNA, 25 bp, Mus musculus
acctccctgccaaacgggctgactg

SEQ ID NO: 865093 - DNA, 25 bp, Mus musculus
acctccctgccaaaggggctgactg

SEQ ID NO: 865094 - DNA, 25 bp, Mus musculus
acctccgaacctcattcacagatgg

SEQ ID NO: 865095 - DNA, 25 bp, Mus musculus
acctccgaacctgattcacagatgg

SEQ ID NO: 865096 - DNA, 25 bp, Mus musculus
acctccgaagccgcaacagacgagg

SEQ ID NO: 865097 - DNA, 25 bp, Mus musculus
acctccgaaggcgcaacagacgagg

SEQ ID NO: 865098 - DNA, 25 bp, Mus musculus
acctccgagcagcggactcgtgggg

SEQ ID NO: 865099 - DNA, 25 bp, Mus musculus
acctccgagcaggggactcgtgggg

SEQ ID NO: 865100 - DNA, 25 bp, Mus musculus
acctccgggacactcggatcttcct

SEQ ID NO: 865101 - DNA, 25 bp, Mus musculus
acctccgggacactgggatcttcct

SEQ ID NO: 865102 - DNA, 25 bp, Mus musculus
acctcctaaagaaactggcattgct

SEQ ID NO: 865103 - DNA, 25 bp, Mus musculus
acctcctaaagatactggcattgct

SEQ ID NO: 865104 - DNA, 25 bp, Mus musculus
acctcctaggaaagctgtagaggaa

SEQ ID NO: 865105 - DNA, 25 bp, Mus musculus
acctcctaggtaagctgtagaggaa

SEQ ID NO: 865106 - DNA, 25 bp, Mus musculus
acctcctcagaatccgtatattcct

SEQ ID NO: 865107 - DNA, 25 bp, Mus musculus
acctcctcagtatccgtatattcct

SEQ ID NO: 865108 - DNA, 25 bp, Mus musculus
acctcctggcagtgcgaagtcagag

SEQ ID NO: 865109 - DNA, 25 bp, Mus musculus
acctcctggcagtgcgaggccagag

SEQ ID NO: 865110 - DNA, 25 bp, Mus musculus
acctcctggcagtgggaagtcagag

SEQ ID NO: 865111 - DNA, 25 bp, Mus musculus
acctcctggcagtgggaggccagag

SEQ ID NO: 865112 - DNA, 25 bp, Mus musculus
acctccttggagaccgcctcacaga

SEQ ID NO: 865113 - DNA, 25 bp, Mus musculus
acctccttggagacggcctcacaga

SEQ ID NO: 865114 - DNA, 25 bp, Mus musculus
acctcgatgtcgttcaacggtcacc

SEQ ID NO: 865115 - DNA, 25 bp, Mus musculus
acctcgatgtcgttgaacggtcacc

SEQ ID NO: 865116 - DNA, 25 bp, Mus musculus
acctcgccagcctgcctaaaccacg

SEQ ID NO: 865117 - DNA, 25 bp, Mus musculus
acctcgccagcgtgcactcgtgaaa

SEQ ID NO: 865118 - DNA, 25 bp, Mus musculus
acctcgccaggctgcctaaaccacg

SEQ ID NO: 865119 - DNA, 25 bp, Mus musculus
acctcgccagggtgcactcgtgaaa

SEQ ID NO: 865120 - DNA, 25 bp, Mus musculus
acctcgcctgcacgttgtcaggtgc

SEQ ID NO: 865121 - DNA, 25 bp, Mus musculus
acctcgcctggacgttgtcaggtgc

SEQ ID NO: 865122 - DNA, 25 bp, Mus musculus
acctcggaacagcatggttcgagga

SEQ ID NO: 865123 - DNA, 25 bp, Mus musculus
acctcggaacaggatggttcgagga

SEQ ID NO: 865124 - DNA, 25 bp, Mus musculus
acctcggggaagaccctcagtgtgt

SEQ ID NO: 865125 - DNA, 25 bp, Mus musculus
acctcggggaagtccctcagtgtgt

SEQ ID NO: 865126 - DNA, 25 bp, Mus musculus
acctcggtgcagcctatctatgtgc

SEQ ID NO: 865127 - DNA, 25 bp, Mus musculus
acctcggtgcaggctatctatgtgc

SEQ ID NO: 865128 - DNA, 25 bp, Mus musculus
acctcggtggcgtacgcctgggctg

SEQ ID NO: 865129 - DNA, 25 bp, Mus musculus
acctcggtggcgtaggcctgggctg

SEQ ID NO: 865130 - DNA, 25 bp, Mus musculus
acctcgtcaccactactataatcaa

SEQ ID NO: 865131 - DNA, 25 bp, Mus musculus
acctcgtcaccagtactataatcaa

SEQ ID NO: 865132 - DNA, 25 bp, Mus musculus
acctcgttaggatcccaccagagta

SEQ ID NO: 865133 - DNA, 25 bp, Mus musculus
acctcgttaggatcgcaccagagta

SEQ ID NO: 865134 - DNA, 25 bp, Mus musculus
acctcgttcctcaacatggccgact

SEQ ID NO: 865135 - DNA, 25 bp, Mus musculus
acctcgttcctcaagatggccgact

SEQ ID NO: 865136 - DNA, 25 bp, Mus musculus
acctctatagcacgtatggaggagg

SEQ ID NO: 865137 - DNA, 25 bp, Mus musculus
acctctatagcaggtatggaggagg

SEQ ID NO: 865138 - DNA, 25 bp, Mus musculus
acctctcatccacgtcagattgtca

SEQ ID NO: 865139 - DNA, 25 bp, Mus musculus
acctctcatccaggtcagattgtca

SEQ ID NO: 865140 - DNA, 25 bp, Mus musculus
acctctccatcgcatacagtagcgt

SEQ ID NO: 865141 - DNA, 25 bp, Mus musculus
acctctccatcggatacagtagcgt

SEQ ID NO: 865142 - DNA, 25 bp, Mus musculus
acctctccgtgactcactcatctga

SEQ ID NO: 865143 - DNA, 25 bp, Mus musculus
acctctccgtgactgactcatctga

SEQ ID NO: 865144 - DNA, 25 bp, Mus musculus
acctctcgtcagatgtcgtcaccgt

SEQ ID NO: 865145 - DNA, 25 bp, Mus musculus
acctctcgtcagcactgcaagaggc

SEQ ID NO: 865146 - DNA, 25 bp, Mus musculus
acctctcgtcaggactgcaagaggc

SEQ ID NO: 865147 - DNA, 25 bp, Mus musculus
acctctcgtcagttgtcgtcaccgt

SEQ ID NO: 865148 - DNA, 25 bp, Mus musculus
acctctgaaactccctgaagaatgt

SEQ ID NO: 865149 - DNA, 25 bp, Mus musculus
acctctgaaactgcctgaagaatgt

SEQ ID NO: 865150 - DNA, 25 bp, Mus musculus
acctctgaagcttacagcatcaagt

SEQ ID NO: 865151 - DNA, 25 bp, Mus musculus
acctctgaaggttacagcatcaagt

SEQ ID NO: 865152 - DNA, 25 bp, Mus musculus
acctctgacctccacaaaggtgctg

SEQ ID NO: 865153 - DNA, 25 bp, Mus musculus
acctctgacctccagaaaggtgctg

SEQ ID NO: 865154 - DNA, 25 bp, Mus musculus
acctctgactctcactttcatgaag

SEQ ID NO: 865155 - DNA, 25 bp, Mus musculus
acctctgactctcagtttcatgaag

SEQ ID NO: 865156 - DNA, 25 bp, Mus musculus
acctctgcagatcattgtgaacact

SEQ ID NO: 865157 - DNA, 25 bp, Mus musculus
acctctgcagatgattgtgaacact

SEQ ID NO: 865158 - DNA, 25 bp, Mus musculus
acctctgcagcttcaggtctcaagg

SEQ ID NO: 865159 - DNA, 25 bp, Mus musculus
acctctgcaggttcaggtctcaagg

SEQ ID NO: 865160 - DNA, 25 bp, Mus musculus
acctctgcggcggtatctgacctca

SEQ ID NO: 865161 - DNA, 25 bp, Mus musculus
acctctgcgggggtatctgacctca

SEQ ID NO: 865162 - DNA, 25 bp, Mus musculus
acctctggatgtagaacagcgtcac

SEQ ID NO: 865163 - DNA, 25 bp, Mus musculus
acctctggatgtcgtcacgctggcc

SEQ ID NO: 865164 - DNA, 25 bp, Mus musculus
acctctggatgtctcttcggagcct

SEQ ID NO: 865165 - DNA, 25 bp, Mus musculus
acctctggatgtggtcacgctggcc

SEQ ID NO: 865166 - DNA, 25 bp, Mus musculus
acctctggatgtgtcttcggagcct

SEQ ID NO: 865167 - DNA, 25 bp, Mus musculus
acctctggatgttgaacagcgtcac

SEQ ID NO: 865168 - DNA, 25 bp, Mus musculus
acctctgggacaatcatcaccctga

SEQ ID NO: 865169 - DNA, 25 bp, Mus musculus
acctctgggacattcatcaccctga

SEQ ID NO: 865170 - DNA, 25 bp, Mus musculus
acctctgggcgacccgtcacttcat

SEQ ID NO: 865171 - DNA, 25 bp, Mus musculus
acctctgggcgaccggtcacttcat

SEQ ID NO: 865172 - DNA, 25 bp, Mus musculus
acctctgtcacccacctttacacgc

SEQ ID NO: 865173 - DNA, 25 bp, Mus musculus
acctctgtcacccagctttacacgc

SEQ ID NO: 865174 - DNA, 25 bp, Mus musculus
acctctgtttactgcatgtccgatc

SEQ ID NO: 865175 - DNA, 25 bp, Mus musculus
acctctgtttactggatgtccgatc

SEQ ID NO: 865176 - DNA, 25 bp, Mus musculus
acctcttatatgcttctctgacaac

SEQ ID NO: 865177 - DNA, 25 bp, Mus musculus
acctcttatatggttctctgacaac

SEQ ID NO: 865178 - DNA, 25 bp, Mus musculus
acctcttcaccacacgtgtggtcta

SEQ ID NO: 865179 - DNA, 25 bp, Mus musculus
acctcttcaccacaggtgtggtcta

SEQ ID NO: 865180 - DNA, 25 bp, Mus musculus
acctctttaaagatactatcgtgga

SEQ ID NO: 865181 - DNA, 25 bp, Mus musculus
acctctttaaagttactatcgtgga

SEQ ID NO: 865182 - DNA, 25 bp, Mus musculus
acctctttggagctcggtttgacac

SEQ ID NO: 865183 - DNA, 25 bp, Mus musculus
acctctttggagctgggtttgacac

SEQ ID NO: 865184 - DNA, 25 bp, Mus musculus
acctgaaaagcaaacctgcagatct

SEQ ID NO: 865185 - DNA, 25 bp, Mus musculus
acctgaaaaggaaacctgcagatct

SEQ ID NO: 865186 - DNA, 25 bp, Mus musculus
acctgaaacgcttcgcatcctcaac

SEQ ID NO: 865187 - DNA, 25 bp, Mus musculus
acctgaaacggttcgcatcctcaac

SEQ ID NO: 865188 - DNA, 25 bp, Mus musculus
acctgaacacagcggagccgatggc

SEQ ID NO: 865189 - DNA, 25 bp, Mus musculus
acctgaacacaggggagccgatggc

SEQ ID NO: 865190 - DNA, 25 bp, Mus musculus
acctgaacagcgacccagaagggca

SEQ ID NO: 865191 - DNA, 25 bp, Mus musculus
acctgaacagggacccagaagggca

SEQ ID NO: 865192 - DNA, 25 bp, Mus musculus
acctgaagagcacgagcagaggaaa

SEQ ID NO: 865193 - DNA, 25 bp, Mus musculus
acctgaagagcaggagcagaggaaa

SEQ ID NO: 865194 - DNA, 25 bp, Mus musculus
acctgaagagcttgccaggctctgg

SEQ ID NO: 865195 - DNA, 25 bp, Mus musculus
acctgaagaggttgccaggctctgg

SEQ ID NO: 865196 - DNA, 25 bp, Mus musculus
acctgaagctcgcgtatgtgtcccg

SEQ ID NO: 865197 - DNA, 25 bp, Mus musculus
acctgaagctcgggtatgtgtcccg

SEQ ID NO: 865198 - DNA, 25 bp, Mus musculus
acctgaaggagccgtcgcctgcctc

SEQ ID NO: 865199 - DNA, 25 bp, Mus musculus
acctgaaggagcggtcgcctgcctc

SEQ ID NO: 865200 - DNA, 25 bp, Mus musculus
acctgaataagcaccgtaagcagat

SEQ ID NO: 865201 - DNA, 25 bp, Mus musculus
acctgaataagcacggtaagcagat

SEQ ID NO: 865202 - DNA, 25 bp, Mus musculus
acctgaatgcagattgaggatgggt

SEQ ID NO: 865203 - DNA, 25 bp, Mus musculus
acctgaatgcagtttgaggatgggt

SEQ ID NO: 865204 - DNA, 25 bp, Mus musculus
acctgacaggcacgccaggagtgtg

SEQ ID NO: 865205 - DNA, 25 bp, Mus musculus
acctgacaggcaggccaggagtgtg

SEQ ID NO: 865206 - DNA, 25 bp, Mus musculus
acctgacagtcaatacgccccctca

SEQ ID NO: 865207 - DNA, 25 bp, Mus musculus
acctgacagtcaattcgccccctca

SEQ ID NO: 865208 - DNA, 25 bp, Mus musculus
acctgacatccccgtctgccttcta

SEQ ID NO: 865209 - DNA, 25 bp, Mus musculus
acctgacatcccggtctgccttcta

SEQ ID NO: 865210 - DNA, 25 bp, Mus musculus
acctgaccagtcaatatatattggg

SEQ ID NO: 865211 - DNA, 25 bp, Mus musculus
acctgaccagtctatatatattggg

SEQ ID NO: 865212 - DNA, 25 bp, Mus musculus
acctgacgagaccgtaaaggtgctg

SEQ ID NO: 865213 - DNA, 25 bp, Mus musculus
acctgacgagacggtaaaggtgctg

SEQ ID NO: 865214 - DNA, 25 bp, Mus musculus
acctgagaagcacgctgtgcagcta

SEQ ID NO: 865215 - DNA, 25 bp, Mus musculus
acctgagaagcacgtctgttctcct

SEQ ID NO: 865216 - DNA, 25 bp, Mus musculus
acctgagaagcaggctgtgcagcta

SEQ ID NO: 865217 - DNA, 25 bp, Mus musculus
acctgagaagcaggtctgttctcct

SEQ ID NO: 865218 - DNA, 25 bp, Mus musculus
acctgagacaatcctaaaggacttt

SEQ ID NO: 865219 - DNA, 25 bp, Mus musculus
acctgagacattcctaaaggacttt

SEQ ID NO: 865220 - DNA, 25 bp, Mus musculus
acctgagagaagcgtgtgctaatga

SEQ ID NO: 865221 - DNA, 25 bp, Mus musculus
acctgagagaagggtgtgctaatga

SEQ ID NO: 865222 - DNA, 25 bp, Mus musculus
acctgagcactacccggtcctgggc

SEQ ID NO: 865223 - DNA, 25 bp, Mus musculus
acctgagcactaccgggtcctgggc

SEQ ID NO: 865224 - DNA, 25 bp, Mus musculus
acctgaggtgtcaaatagctgaaac

SEQ ID NO: 865225 - DNA, 25 bp, Mus musculus
acctgaggtgtctaatagctgaaac

SEQ ID NO: 865226 - DNA, 25 bp, Mus musculus
acctgagtcgccagaacgctttcca

SEQ ID NO: 865227 - DNA, 25 bp, Mus musculus
acctgagtcggcagaacgctttcca

SEQ ID NO: 865228 - DNA, 25 bp, Mus musculus
acctgatactctacatgaacttgga

SEQ ID NO: 865229 - DNA, 25 bp, Mus musculus
acctgatactctacttgaacttgga

SEQ ID NO: 865230 - DNA, 25 bp, Mus musculus
acctgatagcagctgtgagtaccag

SEQ ID NO: 865231 - DNA, 25 bp, Mus musculus
acctgatagcaggtgtgagtaccag

SEQ ID NO: 865232 - DNA, 25 bp, Mus musculus
acctgatctaagcagattacctgga

SEQ ID NO: 865233 - DNA, 25 bp, Mus musculus
acctgatctaaggagattacctgga

SEQ ID NO: 865234 - DNA, 25 bp, Mus musculus
acctgatctccatacagaaaacacg

SEQ ID NO: 865235 - DNA, 25 bp, Mus musculus
acctgatctccatagagaaaacacg

SEQ ID NO: 865236 - DNA, 25 bp, Mus musculus
acctgatgatgaaggtatatttgta

SEQ ID NO: 865237 - DNA, 25 bp, Mus musculus
acctgatgatgatggtatatttgta

SEQ ID NO: 865238 - DNA, 25 bp, Mus musculus
acctgatggactttgaccctgaccc

SEQ ID NO: 865239 - DNA, 25 bp, Mus musculus
acctgatggagtttgaccctgaccc

SEQ ID NO: 865240 - DNA, 25 bp, Mus musculus
acctgatggccgcgaaattgtcttc

SEQ ID NO: 865241 - DNA, 25 bp, Mus musculus
acctgatggccgggaaattgtcttc

SEQ ID NO: 865242 - DNA, 25 bp, Mus musculus
acctgatgtctggacgcatctgccc

SEQ ID NO: 865243 - DNA, 25 bp, Mus musculus
acctgatgtctggaggcatctgccc

SEQ ID NO: 865244 - DNA, 25 bp, Mus musculus
acctgcaaagacaatgggccctgcc

SEQ ID NO: 865245 - DNA, 25 bp, Mus musculus
acctgcaaagtcaatgggccctgcc

SEQ ID NO: 865246 - DNA, 25 bp, Mus musculus
acctgcaaccaacatgagtccttcc

SEQ ID NO: 865247 - DNA, 25 bp, Mus musculus
acctgcaaccaagatgagtccttcc

SEQ ID NO: 865248 - DNA, 25 bp, Mus musculus
acctgcacagacatcgatgagtgtg

SEQ ID NO: 865249 - DNA, 25 bp, Mus musculus
acctgcacagtcatcgatgagtgtg

SEQ ID NO: 865250 - DNA, 25 bp, Mus musculus
acctgcaccaagcttccgctgcttc

SEQ ID NO: 865251 - DNA, 25 bp, Mus musculus
acctgcaccaaggttccgctgcttc

SEQ ID NO: 865252 - DNA, 25 bp, Mus musculus
acctgcacctgacacctcctgagca

SEQ ID NO: 865253 - DNA, 25 bp, Mus musculus
acctgcacctgacagctcctgagca

SEQ ID NO: 865254 - DNA, 25 bp, Mus musculus
acctgcagagatgactcaaggaatg

SEQ ID NO: 865255 - DNA, 25 bp, Mus musculus
acctgcagagatgagtcaaggaatg

SEQ ID NO: 865256 - DNA, 25 bp, Mus musculus
acctgcagccgccccgccatctgct

SEQ ID NO: 865257 - DNA, 25 bp, Mus musculus
acctgcagccgccccggacaggcca

SEQ ID NO: 865258 - DNA, 25 bp, Mus musculus
acctgcagccgcccggccatctgct

SEQ ID NO: 865259 - DNA, 25 bp, Mus musculus
acctgcagccgcccgggacaggcca

SEQ ID NO: 865260 - DNA, 25 bp, Mus musculus
acctgcagggagcctgtttgtgttc

SEQ ID NO: 865261 - DNA, 25 bp, Mus musculus
acctgcagggaggctgtttgtgttc

SEQ ID NO: 865262 - DNA, 25 bp, Mus musculus
acctgcatgaagctggtctacatag

SEQ ID NO: 865263 - DNA, 25 bp, Mus musculus
acctgcatgaaggtggtctacatag

SEQ ID NO: 865264 - DNA, 25 bp, Mus musculus
acctgccaaaagatgtggagctcct

SEQ ID NO: 865265 - DNA, 25 bp, Mus musculus
acctgccaaaagttgtggagctcct

SEQ ID NO: 865266 - DNA, 25 bp, Mus musculus
acctgccacacggacagctgcccag

SEQ ID NO: 865267 - DNA, 25 bp, Mus musculus
acctgccacacggagagctgcccag

SEQ ID NO: 865268 - DNA, 25 bp, Mus musculus
acctgccagccacaaaatgacctga

SEQ ID NO: 865269 - DNA, 25 bp, Mus musculus
acctgccagccagaaaatgacctga

SEQ ID NO: 865270 - DNA, 25 bp, Mus musculus
acctgcccagttgccggcctaacct

SEQ ID NO: 865271 - DNA, 25 bp, Mus musculus
acctgcccagttgcgggcctaacct

SEQ ID NO: 865272 - DNA, 25 bp, Mus musculus
acctgccccaagcgtctgaatccgg

SEQ ID NO: 865273 - DNA, 25 bp, Mus musculus
acctgccccaagggtctgaatccgg

SEQ ID NO: 865274 - DNA, 25 bp, Mus musculus
acctgccgcccacatagaggtgccc

SEQ ID NO: 865275 - DNA, 25 bp, Mus musculus
acctgccgcccagatagaggtgccc

SEQ ID NO: 865276 - DNA, 25 bp, Mus musculus
acctgcctaaaaccagcagcagcag

SEQ ID NO: 865277 - DNA, 25 bp, Mus musculus
acctgcctaataccagcagcagcag

SEQ ID NO: 865278 - DNA, 25 bp, Mus musculus
acctgcctccttcacatgacggatt

SEQ ID NO: 865279 - DNA, 25 bp, Mus musculus
acctgcctccttcagatgacggatt

SEQ ID NO: 865280 - DNA, 25 bp, Mus musculus
acctgcctcttcccgtttgtctact

SEQ ID NO: 865281 - DNA, 25 bp, Mus musculus
acctgcctcttcgcgtttgtctact

SEQ ID NO: 865282 - DNA, 25 bp, Mus musculus
acctgcctggagaaaagctcctgta

SEQ ID NO: 865283 - DNA, 25 bp, Mus musculus
acctgcctggagaatagctcctgta

SEQ ID NO: 865284 - DNA, 25 bp, Mus musculus
acctgcgacccacccattcattgag

SEQ ID NO: 865285 - DNA, 25 bp, Mus musculus
acctgcgacccacgtgcctggctgc

SEQ ID NO: 865286 - DNA, 25 bp, Mus musculus
acctgcgacccagccattcattgag

SEQ ID NO: 865287 - DNA, 25 bp, Mus musculus
acctgcgacccaggtgcctggctgc

SEQ ID NO: 865288 - DNA, 25 bp, Mus musculus
acctgcgcactaaacggggctgcct

SEQ ID NO: 865289 - DNA, 25 bp, Mus musculus
acctgcgcactaaagggggctgcct

SEQ ID NO: 865290 - DNA, 25 bp, Mus musculus
acctgcggatcgttcaggataagac

SEQ ID NO: 865291 - DNA, 25 bp, Mus musculus
acctgcggatgcaggttcaggataa

SEQ ID NO: 865292 - DNA, 25 bp, Mus musculus
acctgcggatgctggttcaggataa

SEQ ID NO: 865293 - DNA, 25 bp, Mus musculus
acctgcggatggttcaggataagac

SEQ ID NO: 865294 - DNA, 25 bp, Mus musculus
acctgcggcacaaaaatttcacacg

SEQ ID NO: 865295 - DNA, 25 bp, Mus musculus
acctgcggcacataaatttcacacg

SEQ ID NO: 865296 - DNA, 25 bp, Mus musculus
acctgctcactgaaccctctgcagg

SEQ ID NO: 865297 - DNA, 25 bp, Mus musculus
acctgctcactgtaccctctgcagg

SEQ ID NO: 865298 - DNA, 25 bp, Mus musculus
acctgctcagcacaatcgggttgag

SEQ ID NO: 865299 - DNA, 25 bp, Mus musculus
acctgctcagcagaatcgggttgag

SEQ ID NO: 865300 - DNA, 25 bp, Mus musculus
acctgctctgcagtcacacctgctg

SEQ ID NO: 865301 - DNA, 25 bp, Mus musculus
acctgctctgcagtgacacctgctg

SEQ ID NO: 865302 - DNA, 25 bp, Mus musculus
acctgctgacagcgcgcgtgtatga

SEQ ID NO: 865303 - DNA, 25 bp, Mus musculus
acctgctgacagggcgcgtgtatga

SEQ ID NO: 865304 - DNA, 25 bp, Mus musculus
acctgctgagcacacgacaaggtgt

SEQ ID NO: 865305 - DNA, 25 bp, Mus musculus
acctgctgagcacaggacaaggtgt

SEQ ID NO: 865306 - DNA, 25 bp, Mus musculus
acctgctgcagcttcgctcttgtgg

SEQ ID NO: 865307 - DNA, 25 bp, Mus musculus
acctgctgcagcttggctcttgtgg

SEQ ID NO: 865308 - DNA, 25 bp, Mus musculus
acctgctggaagcagcagcggtcag

SEQ ID NO: 865309 - DNA, 25 bp, Mus musculus
acctgctggaagctgtgaccccaca

SEQ ID NO: 865310 - DNA, 25 bp, Mus musculus
acctgctggaaggagcagcggtcag

SEQ ID NO: 865311 - DNA, 25 bp, Mus musculus
acctgctggaaggtgtgaccccaca

SEQ ID NO: 865312 - DNA, 25 bp, Mus musculus
acctgctgtccacaatgtgctggat

SEQ ID NO: 865313 - DNA, 25 bp, Mus musculus
acctgctgtccagaatgtgctggat

SEQ ID NO: 865314 - DNA, 25 bp, Mus musculus
acctgctgtcctgacgattcggccc

SEQ ID NO: 865315 - DNA, 25 bp, Mus musculus
acctgctgtcctgaggattcggccc

SEQ ID NO: 865316 - DNA, 25 bp, Mus musculus
acctgctgttctcgttccttgcctt

SEQ ID NO: 865317 - DNA, 25 bp, Mus musculus
acctgctgttctggttccttgcctt

SEQ ID NO: 865318 - DNA, 25 bp, Mus musculus
acctgcttaccgctatgacccatat

SEQ ID NO: 865319 - DNA, 25 bp, Mus musculus
acctgcttaccggtatgacccatat

SEQ ID NO: 865320 - DNA, 25 bp, Mus musculus
acctggaacaacccccaatactgga

SEQ ID NO: 865321 - DNA, 25 bp, Mus musculus
acctggaacaacccgcaatactgga

SEQ ID NO: 865322 - DNA, 25 bp, Mus musculus
acctggaacgcgcacacggtgacac

SEQ ID NO: 865323 - DNA, 25 bp, Mus musculus
acctggaacgggcacacggtgacac

SEQ ID NO: 865324 - DNA, 25 bp, Mus musculus
acctggacaactctgtgcacctgtg

SEQ ID NO: 865325 - DNA, 25 bp, Mus musculus
acctggacaagtctgtgcacctgtg

SEQ ID NO: 865326 - DNA, 25 bp, Mus musculus
acctggagacaaaacgcatggagta

SEQ ID NO: 865327 - DNA, 25 bp, Mus musculus
acctggagacaacctacgcatggag

SEQ ID NO: 865328 - DNA, 25 bp, Mus musculus
acctggagacaagctacgcatggag

SEQ ID NO: 865329 - DNA, 25 bp, Mus musculus
acctggagacaatacgcatggagta

SEQ ID NO: 865330 - DNA, 25 bp, Mus musculus
acctggagcccaatcaagtccgact

SEQ ID NO: 865331 - DNA, 25 bp, Mus musculus
acctggagcccaatgaagtccgact

SEQ ID NO: 865332 - DNA, 25 bp, Mus musculus
acctggatcataaaatagagaagaa

SEQ ID NO: 865333 - DNA, 25 bp, Mus musculus
acctggatcatataatagagaagaa

SEQ ID NO: 865334 - DNA, 25 bp, Mus musculus
acctggatgttgtgcgatacccctt

SEQ ID NO: 865335 - DNA, 25 bp, Mus musculus
acctggatgttgtgggatacccctt

SEQ ID NO: 865336 - DNA, 25 bp, Mus musculus
acctggcaggatcggagcctcctgc

SEQ ID NO: 865337 - DNA, 25 bp, Mus musculus
acctggcaggatcggccaccgctga

SEQ ID NO: 865338 - DNA, 25 bp, Mus musculus
acctggcaggatgggagcctcctgc

SEQ ID NO: 865339 - DNA, 25 bp, Mus musculus
acctggcaggatgggccaccgctga

SEQ ID NO: 865340 - DNA, 25 bp, Mus musculus
acctggcataagcccactcagaagg

SEQ ID NO: 865341 - DNA, 25 bp, Mus musculus
acctggcataaggccactcagaagg

SEQ ID NO: 865342 - DNA, 25 bp, Mus musculus
acctggcatcctatctgaaaaggct

SEQ ID NO: 865343 - DNA, 25 bp, Mus musculus
acctggcatcctcagggaactctcc

SEQ ID NO: 865344 - DNA, 25 bp, Mus musculus
acctggcatcctctctgaaatgcct

SEQ ID NO: 865345 - DNA, 25 bp, Mus musculus
acctggcatcctgagggaactctcc

SEQ ID NO: 865346 - DNA, 25 bp, Mus musculus
acctggcatcctgtctgaaatgcct

SEQ ID NO: 865347 - DNA, 25 bp, Mus musculus
acctggcatcctttctgaaaaggct

SEQ ID NO: 865348 - DNA, 25 bp, Mus musculus
acctggcatgagccccagcaagacc

SEQ ID NO: 865349 - DNA, 25 bp, Mus musculus
acctggcatggcaatgtgagtgaca

SEQ ID NO: 865350 - DNA, 25 bp, Mus musculus
acctggcatggctatgtgagtgaca

SEQ ID NO: 865351 - DNA, 25 bp, Mus musculus
acctggcatgtgccccagcaagacc

SEQ ID NO: 865352 - DNA, 25 bp, Mus musculus
acctggccaaagcgtcattatcgtt

SEQ ID NO: 865353 - DNA, 25 bp, Mus musculus
acctggccaaagctcagcctccaag

SEQ ID NO: 865354 - DNA, 25 bp, Mus musculus
acctggccaaagctcggacatcaaa

SEQ ID NO: 865355 - DNA, 25 bp, Mus musculus
acctggccaaagggtcattatcgtt

SEQ ID NO: 865356 - DNA, 25 bp, Mus musculus
acctggccaaaggtcagcctccaag

SEQ ID NO: 865357 - DNA, 25 bp, Mus musculus
acctggccaaaggtcggacatcaaa

SEQ ID NO: 865358 - DNA, 25 bp, Mus musculus
acctggccagaatattattctccat

SEQ ID NO: 865359 - DNA, 25 bp, Mus musculus
acctggccagtatattattctccat

SEQ ID NO: 865360 - DNA, 25 bp, Mus musculus
acctggccgaagcatgacccgccgg

SEQ ID NO: 865361 - DNA, 25 bp, Mus musculus
acctggccgaaggatgacccgccgg

SEQ ID NO: 865362 - DNA, 25 bp, Mus musculus
acctggcctcgctgcgattcccatt

SEQ ID NO: 865363 - DNA, 25 bp, Mus musculus
acctggcctcgctgggattcccatt

SEQ ID NO: 865364 - DNA, 25 bp, Mus musculus
acctggcggacacgctgggccgtcg

SEQ ID NO: 865365 - DNA, 25 bp, Mus musculus
acctggcggacaggctgggccgtcg

SEQ ID NO: 865366 - DNA, 25 bp, Mus musculus
acctggctattgacaagaaggcttg

SEQ ID NO: 865367 - DNA, 25 bp, Mus musculus
acctggctattgactccacggctga

SEQ ID NO: 865368 - DNA, 25 bp, Mus musculus
acctggctattggcagttatgttgg

SEQ ID NO: 865369 - DNA, 25 bp, Mus musculus
acctggctattggctgttatgttgg

SEQ ID NO: 865370 - DNA, 25 bp, Mus musculus
acctggctattgtcaagaaggcttg

SEQ ID NO: 865371 - DNA, 25 bp, Mus musculus
acctggctattgtctccacggctga

SEQ ID NO: 865372 - DNA, 25 bp, Mus musculus
acctgggaccagctctttgtctggg

SEQ ID NO: 865373 - DNA, 25 bp, Mus musculus
acctgggaccagctgttcttgtgga

SEQ ID NO: 865374 - DNA, 25 bp, Mus musculus
acctgggaccaggtctttgtctggg

SEQ ID NO: 865375 - DNA, 25 bp, Mus musculus
acctgggaccaggtgttcttgtgga

SEQ ID NO: 865376 - DNA, 25 bp, Mus musculus
acctgggacccatccgagcaaatgg

SEQ ID NO: 865377 - DNA, 25 bp, Mus musculus
acctgggacccatcggagcaaatgg

SEQ ID NO: 865378 - DNA, 25 bp, Mus musculus
acctgggatttgtccccagagagac

SEQ ID NO: 865379 - DNA, 25 bp, Mus musculus
acctgggatttgtcgccagagagac

SEQ ID NO: 865380 - DNA, 25 bp, Mus musculus
acctgggcagctcagccggctccgt

SEQ ID NO: 865381 - DNA, 25 bp, Mus musculus
acctgggcaggtcagccggctccgt

SEQ ID NO: 865382 - DNA, 25 bp, Mus musculus
acctggggaaagcagtgctgaaggc

SEQ ID NO: 865383 - DNA, 25 bp, Mus musculus
acctggggaaaggagtgctgaaggc

SEQ ID NO: 865384 - DNA, 25 bp, Mus musculus
acctggggacagaattgccctagaa

SEQ ID NO: 865385 - DNA, 25 bp, Mus musculus
acctggggacagtattgccctagaa

SEQ ID NO: 865386 - DNA, 25 bp, Mus musculus
acctgggggacctcagaaggtctat

SEQ ID NO: 865387 - DNA, 25 bp, Mus musculus
acctgggggacctctgaaggtctat

SEQ ID NO: 865388 - DNA, 25 bp, Mus musculus
acctggtcattagacgtttggccaa

SEQ ID NO: 865389 - DNA, 25 bp, Mus musculus
acctggtcattagaggtttggccaa

SEQ ID NO: 865390 - DNA, 25 bp, Mus musculus
acctggtccgagaacgtgagattgc

SEQ ID NO: 865391 - DNA, 25 bp, Mus musculus
acctggtccgagaaggtgagattgc

SEQ ID NO: 865392 - DNA, 25 bp, Mus musculus
acctggtctctgtgcctctttctca

SEQ ID NO: 865393 - DNA, 25 bp, Mus musculus
acctggtctctgtggctctttctca

SEQ ID NO: 865394 - DNA, 25 bp, Mus musculus
acctggtgcccccggtcttgctggc

SEQ ID NO: 865395 - DNA, 25 bp, Mus musculus
acctggtgccccgggtcttgctggc

SEQ ID NO: 865396 - DNA, 25 bp, Mus musculus
acctggtggaagtccccctgttatg

SEQ ID NO: 865397 - DNA, 25 bp, Mus musculus
acctggtggaagtcgccctgttatg

SEQ ID NO: 865398 - DNA, 25 bp, Mus musculus
acctggtggacaatgatggagaaat

SEQ ID NO: 865399 - DNA, 25 bp, Mus musculus
acctggtggacattgatggagaaat

SEQ ID NO: 865400 - DNA, 25 bp, Mus musculus
acctggtgtcgctccagttcctgag

SEQ ID NO: 865401 - DNA, 25 bp, Mus musculus
acctggtgtcgctccggtatcaagt

SEQ ID NO: 865402 - DNA, 25 bp, Mus musculus
acctggtgtcgctcgagttcctgag

SEQ ID NO: 865403 - DNA, 25 bp, Mus musculus
acctggtgtcgctcgggtatcaagt

SEQ ID NO: 865404 - DNA, 25 bp, Mus musculus
acctggttcctagacaggcaacctt

SEQ ID NO: 865405 - DNA, 25 bp, Mus musculus
acctggttcctagagaggcaacctt

SEQ ID NO: 865406 - DNA, 25 bp, Mus musculus
acctgtatagaactgggaagatgcc

SEQ ID NO: 865407 - DNA, 25 bp, Mus musculus
acctgtatagaagtgggaagatgcc

SEQ ID NO: 865408 - DNA, 25 bp, Mus musculus
acctgtccagctagctgtgctaaaa

SEQ ID NO: 865409 - DNA, 25 bp, Mus musculus
acctgtccagcttgctgtgctaaaa

SEQ ID NO: 865410 - DNA, 25 bp, Mus musculus
acctgtccctcacgtacatttgtca

SEQ ID NO: 865411 - DNA, 25 bp, Mus musculus
acctgtccctcaggtacatttgtca

SEQ ID NO: 865412 - DNA, 25 bp, Mus musculus
acctgtcttaagaccttcacagcct

SEQ ID NO: 865413 - DNA, 25 bp, Mus musculus
acctgtcttaagtccttcacagcct

SEQ ID NO: 865414 - DNA, 25 bp, Mus musculus
acctgtcttcaacgtgccgccatgc

SEQ ID NO: 865415 - DNA, 25 bp, Mus musculus
acctgtcttcaaggtgccgccatgc

SEQ ID NO: 865416 - DNA, 25 bp, Mus musculus
acctgtgaaaagatcatctgttctc

SEQ ID NO: 865417 - DNA, 25 bp, Mus musculus
acctgtgaaatgatcatctgttctc

SEQ ID NO: 865418 - DNA, 25 bp, Mus musculus
acctgtgagcagcagccagaggaag

SEQ ID NO: 865419 - DNA, 25 bp, Mus musculus
acctgtgagcaggagccagaggaag

SEQ ID NO: 865420 - DNA, 25 bp, Mus musculus
acctgtgaggagacgaagacaggtg

SEQ ID NO: 865421 - DNA, 25 bp, Mus musculus
acctgtgaggagtcgaagacaggtg

SEQ ID NO: 865422 - DNA, 25 bp, Mus musculus
acctgtgataaacatcaggaaatgg

SEQ ID NO: 865423 - DNA, 25 bp, Mus musculus
acctgtgataaagatcaggaaatgg

SEQ ID NO: 865424 - DNA, 25 bp, Mus musculus
acctgtgattatcgatatggaactt

SEQ ID NO: 865425 - DNA, 25 bp, Mus musculus
acctgtgattatggatatggaactt

SEQ ID NO: 865426 - DNA, 25 bp, Mus musculus
acctgtgcagtaacctcgcatccct

SEQ ID NO: 865427 - DNA, 25 bp, Mus musculus
acctgtgcagtacggacggaggcaa

SEQ ID NO: 865428 - DNA, 25 bp, Mus musculus
acctgtgcagtacgggacggaggca

SEQ ID NO: 865429 - DNA, 25 bp, Mus musculus
acctgtgcagtagggacggaggcaa

SEQ ID NO: 865430 - DNA, 25 bp, Mus musculus
acctgtgcagtaggggacggaggca

SEQ ID NO: 865431 - DNA, 25 bp, Mus musculus
acctgtgcagtatcctcgcatccct

SEQ ID NO: 865432 - DNA, 25 bp, Mus musculus
acctgtggacctcatggggtgacac

SEQ ID NO: 865433 - DNA, 25 bp, Mus musculus
acctgtggacctgatggggtgacac

SEQ ID NO: 865434 - DNA, 25 bp, Mus musculus
acctgtggagacggtgctacggatc

SEQ ID NO: 865435 - DNA, 25 bp, Mus musculus
acctgtggagatattgatgaatgcc

SEQ ID NO: 865436 - DNA, 25 bp, Mus musculus
acctgtggagtcggtgctacggatc

SEQ ID NO: 865437 - DNA, 25 bp, Mus musculus
acctgtggagttattgatgaatgcc

SEQ ID NO: 865438 - DNA, 25 bp, Mus musculus
acctgtggatctgctcggccctagc

SEQ ID NO: 865439 - DNA, 25 bp, Mus musculus
acctgtggatgtgctcggccctagc

SEQ ID NO: 865440 - DNA, 25 bp, Mus musculus
acctgtgtctgcacggaaggagtaa

SEQ ID NO: 865441 - DNA, 25 bp, Mus musculus
acctgtgtctgctcggaaggagtaa

SEQ ID NO: 865442 - DNA, 25 bp, Mus musculus
acctgtgtggatattgatgaatgtg

SEQ ID NO: 865443 - DNA, 25 bp, Mus musculus
acctgtgtggttattgatgaatgtg

SEQ ID NO: 865444 - DNA, 25 bp, Mus musculus
acctgttacctgcgcccccagattg

SEQ ID NO: 865445 - DNA, 25 bp, Mus musculus
acctgttacctgggcccccagattg

SEQ ID NO: 865446 - DNA, 25 bp, Mus musculus
acctgttcaaaacccaccccagaga

SEQ ID NO: 865447 - DNA, 25 bp, Mus musculus
acctgttcaaaagccaccccagaga

SEQ ID NO: 865448 - DNA, 25 bp, Mus musculus
acctgttcagctgtgcctcctgaag

SEQ ID NO: 865449 - DNA, 25 bp, Mus musculus
acctgttcaggtgtgcctcctgaag

SEQ ID NO: 865450 - DNA, 25 bp, Mus musculus
acctgttcgtgaccattagtgatca

SEQ ID NO: 865451 - DNA, 25 bp, Mus musculus
acctgttcgtgagcattagtgatca

SEQ ID NO: 865452 - DNA, 25 bp, Mus musculus
accttaaagacaaactagagcagat

SEQ ID NO: 865453 - DNA, 25 bp, Mus musculus
accttaaagagaaactagagcagat

SEQ ID NO: 865454 - DNA, 25 bp, Mus musculus
accttacagatccacggagcatggc

SEQ ID NO: 865455 - DNA, 25 bp, Mus musculus
accttacagatccagggagcatggc

SEQ ID NO: 865456 - DNA, 25 bp, Mus musculus
accttacaggataacatagtgaaag

SEQ ID NO: 865457 - DNA, 25 bp, Mus musculus
accttacaggataagatagtgaaag

SEQ ID NO: 865458 - DNA, 25 bp, Mus musculus
accttactggctaatgcatgtcagg

SEQ ID NO: 865459 - DNA, 25 bp, Mus musculus
accttactgggtaatgcatgtcagg

SEQ ID NO: 865460 - DNA, 25 bp, Mus musculus
accttactgtgctgctgccccccag

SEQ ID NO: 865461 - DNA, 25 bp, Mus musculus
accttactgtgctggtgccccccag

SEQ ID NO: 865462 - DNA, 25 bp, Mus musculus
accttagcaaagcgatattatggtt

SEQ ID NO: 865463 - DNA, 25 bp, Mus musculus
accttagcaaagggatattatggtt

SEQ ID NO: 865464 - DNA, 25 bp, Mus musculus
accttaggagagtaaagagctggcc

SEQ ID NO: 865465 - DNA, 25 bp, Mus musculus
accttaggagtgtaaagagctggcc

SEQ ID NO: 865466 - DNA, 25 bp, Mus musculus
accttatcaaaaccatgcttcatga

SEQ ID NO: 865467 - DNA, 25 bp, Mus musculus
accttatcaaaagcatgcttcatga

SEQ ID NO: 865468 - DNA, 25 bp, Mus musculus
accttcaaaacgcgcagcatcctca

SEQ ID NO: 865469 - DNA, 25 bp, Mus musculus
accttcaaaacgggcagcatcctca

SEQ ID NO: 865470 - DNA, 25 bp, Mus musculus
accttcaaagctgtggaacagttac

SEQ ID NO: 865471 - DNA, 25 bp, Mus musculus
accttcaaaggtgtggaacagttac

SEQ ID NO: 865472 - DNA, 25 bp, Mus musculus
accttcaacaggctgggcggtctgc

SEQ ID NO: 865473 - DNA, 25 bp, Mus musculus
accttcaacagggtgggcggtctgc

SEQ ID NO: 865474 - DNA, 25 bp, Mus musculus
accttcaatagtctgctggaaaaag

SEQ ID NO: 865475 - DNA, 25 bp, Mus musculus
accttcaatagtgtgctggaaaaag

SEQ ID NO: 865476 - DNA, 25 bp, Mus musculus
accttcaatgcctacaaactggacc

SEQ ID NO: 865477 - DNA, 25 bp, Mus musculus
accttcaatggctacaaactggacc

SEQ ID NO: 865478 - DNA, 25 bp, Mus musculus
accttcacagctctgccctgtaact

SEQ ID NO: 865479 - DNA, 25 bp, Mus musculus
accttcacaggtctgccctgtaact

SEQ ID NO: 865480 - DNA, 25 bp, Mus musculus
accttcaccactaacgactctgaca

SEQ ID NO: 865481 - DNA, 25 bp, Mus musculus
accttcaccactaacgggactcaga

SEQ ID NO: 865482 - DNA, 25 bp, Mus musculus
accttcaccactaaggactctgaca

SEQ ID NO: 865483 - DNA, 25 bp, Mus musculus
accttcaccactaaggggactcaga

SEQ ID NO: 865484 - DNA, 25 bp, Mus musculus
accttcaggaaacgctgcacaaggc

SEQ ID NO: 865485 - DNA, 25 bp, Mus musculus
accttcaggaaaggctgcacaaggc

SEQ ID NO: 865486 - DNA, 25 bp, Mus musculus
accttcagtatcctcatcacatttg

SEQ ID NO: 865487 - DNA, 25 bp, Mus musculus
accttcagtatcctgatcacatttg

SEQ ID NO: 865488 - DNA, 25 bp, Mus musculus
accttcatcaccaacacagacgtct

SEQ ID NO: 865489 - DNA, 25 bp, Mus musculus
accttcatcaccaacacgtctttat

SEQ ID NO: 865490 - DNA, 25 bp, Mus musculus
accttcatcaccaagacagacgtct

SEQ ID NO: 865491 - DNA, 25 bp, Mus musculus
accttcatcaccaagacgtctttat

SEQ ID NO: 865492 - DNA, 25 bp, Mus musculus
accttcatgaaacgaatacagatgt

SEQ ID NO: 865493 - DNA, 25 bp, Mus musculus
accttcatgaaacttccgacgagat

SEQ ID NO: 865494 - DNA, 25 bp, Mus musculus
accttcatgaaaggaatacagatgt

SEQ ID NO: 865495 - DNA, 25 bp, Mus musculus
accttcatgaaagttccgacgagat

SEQ ID NO: 865496 - DNA, 25 bp, Mus musculus
accttcattgagaatggccaatggg

SEQ ID NO: 865497 - DNA, 25 bp, Mus musculus
accttcattgatctcgttatccagg

SEQ ID NO: 865498 - DNA, 25 bp, Mus musculus
accttcattgatctggttatccagg

SEQ ID NO: 865499 - DNA, 25 bp, Mus musculus
accttcattgtgaatggccaatggg

SEQ ID NO: 865500 - DNA, 25 bp, Mus musculus
accttccagaccaacgaccacctgt

SEQ ID NO: 865501 - DNA, 25 bp, Mus musculus
accttccagaccaaggaccacctgt

SEQ ID NO: 865502 - DNA, 25 bp, Mus musculus
accttccagaggaacgctttcggca

SEQ ID NO: 865503 - DNA, 25 bp, Mus musculus
accttccagaggaaggctttcggca

SEQ ID NO: 865504 - DNA, 25 bp, Mus musculus
accttccagttgagtcacctgatat

SEQ ID NO: 865505 - DNA, 25 bp, Mus musculus
accttccagttgcagagtcacctga

SEQ ID NO: 865506 - DNA, 25 bp, Mus musculus
accttccagttggagagtcacctga

SEQ ID NO: 865507 - DNA, 25 bp, Mus musculus
accttccagttgtgtcacctgatat

SEQ ID NO: 865508 - DNA, 25 bp, Mus musculus
accttccatcaccaccatccatgtc

SEQ ID NO: 865509 - DNA, 25 bp, Mus musculus
accttccatcaccacgtgcgtgatg

SEQ ID NO: 865510 - DNA, 25 bp, Mus musculus
accttccatcaccagcatccatgtc

SEQ ID NO: 865511 - DNA, 25 bp, Mus musculus
accttccatcaccaggtgcgtgatg

SEQ ID NO: 865512 - DNA, 25 bp, Mus musculus
accttcccaactctgctcctgacat

SEQ ID NO: 865513 - DNA, 25 bp, Mus musculus
accttcccaactgtgctcctgacat

SEQ ID NO: 865514 - DNA, 25 bp, Mus musculus
accttccctttgcacgggaactcat

SEQ ID NO: 865515 - DNA, 25 bp, Mus musculus
accttccctttgcaggggaactcat

SEQ ID NO: 865516 - DNA, 25 bp, Mus musculus
accttccgccagattcgtgatcctg

SEQ ID NO: 865517 - DNA, 25 bp, Mus musculus
accttccgccagtttcgtgatcctg

SEQ ID NO: 865518 - DNA, 25 bp, Mus musculus
accttccggcaacgtgttggagcca

SEQ ID NO: 865519 - DNA, 25 bp, Mus musculus
accttccggcaaggtgttggagcca

SEQ ID NO: 865520 - DNA, 25 bp, Mus musculus
accttccggcagccagttcctccat

SEQ ID NO: 865521 - DNA, 25 bp, Mus musculus
accttccggcaggcagttcctccat

SEQ ID NO: 865522 - DNA, 25 bp, Mus musculus
accttcctcccactggccaggcttc

SEQ ID NO: 865523 - DNA, 25 bp, Mus musculus
accttcctcccagtggccaggcttc

SEQ ID NO: 865524 - DNA, 25 bp, Mus musculus
accttcctgagtcagctcattgccc

SEQ ID NO: 865525 - DNA, 25 bp, Mus musculus
accttcctgagtgagctcattgccc

SEQ ID NO: 865526 - DNA, 25 bp, Mus musculus
accttcctgtctgacatccgttggg

SEQ ID NO: 865527 - DNA, 25 bp, Mus musculus
accttcctgtctgagatccgttggg

SEQ ID NO: 865528 - DNA, 25 bp, Mus musculus
accttcgaaactctgatcgtctgat

SEQ ID NO: 865529 - DNA, 25 bp, Mus musculus
accttcgaaagtctgatcgtctgat

SEQ ID NO: 865530 - DNA, 25 bp, Mus musculus
accttcgaggcgaggtgcaagattt

SEQ ID NO: 865531 - DNA, 25 bp, Mus musculus
accttcgaggcgtggtgcaagattt

SEQ ID NO: 865532 - DNA, 25 bp, Mus musculus
accttctacatcctcgtgtttgtgg

SEQ ID NO: 865533 - DNA, 25 bp, Mus musculus
accttctacatcctggtgtttgtgg

SEQ ID NO: 865534 - DNA, 25 bp, Mus musculus
accttctacgtgcgcatctacattc

SEQ ID NO: 865535 - DNA, 25 bp, Mus musculus
accttctacgtgggcatctacattc

SEQ ID NO: 865536 - DNA, 25 bp, Mus musculus
accttctcggccagtgttctgccca

SEQ ID NO: 865537 - DNA, 25 bp, Mus musculus
accttctcgggcagtgttctgccca

SEQ ID NO: 865538 - DNA, 25 bp, Mus musculus
accttctctacacgaggtgtagggg

SEQ ID NO: 865539 - DNA, 25 bp, Mus musculus
accttctctacaggaggtgtagggg

SEQ ID NO: 865540 - DNA, 25 bp, Mus musculus
accttctgagtaaacgtgaacgacg

SEQ ID NO: 865541 - DNA, 25 bp, Mus musculus
accttctgagtaaaggtgaacgacg

SEQ ID NO: 865542 - DNA, 25 bp, Mus musculus
accttctgcagcaaatctcccggaa

SEQ ID NO: 865543 - DNA, 25 bp, Mus musculus
accttctgcagctaatctcccggaa

SEQ ID NO: 865544 - DNA, 25 bp, Mus musculus
accttcttgcagcgggaataccagc

SEQ ID NO: 865545 - DNA, 25 bp, Mus musculus
accttcttgcagggggaataccagc

SEQ ID NO: 865546 - DNA, 25 bp, Mus musculus
accttctttccccgtcaatctgtgt

SEQ ID NO: 865547 - DNA, 25 bp, Mus musculus
accttctttcccggtcaatctgtgt

SEQ ID NO: 865548 - DNA, 25 bp, Mus musculus
accttgaacaaattgctaccagtag

SEQ ID NO: 865549 - DNA, 25 bp, Mus musculus
accttgaacatattgctaccagtag

SEQ ID NO: 865550 - DNA, 25 bp, Mus musculus
accttgaaccagaatgtctgtaagg

SEQ ID NO: 865551 - DNA, 25 bp, Mus musculus
accttgaaccagtatgtctgtaagg

SEQ ID NO: 865552 - DNA, 25 bp, Mus musculus
accttgaaccccagagtgcctactc

SEQ ID NO: 865553 - DNA, 25 bp, Mus musculus
accttgaaccccagtgtgcctactc

SEQ ID NO: 865554 - DNA, 25 bp, Mus musculus
accttgaagaaccaccgtgccaagt

SEQ ID NO: 865555 - DNA, 25 bp, Mus musculus
accttgaagaaccagcgtgccaagt

SEQ ID NO: 865556 - DNA, 25 bp, Mus musculus
accttgaatcagagaaaccattcgc

SEQ ID NO: 865557 - DNA, 25 bp, Mus musculus
accttgaatcagtgaaaccattcgc

SEQ ID NO: 865558 - DNA, 25 bp, Mus musculus
accttgaggacaatcgttccttgga

SEQ ID NO: 865559 - DNA, 25 bp, Mus musculus
accttgaggacaatggttccttgga

SEQ ID NO: 865560 - DNA, 25 bp, Mus musculus
accttgccagcagactacggataaa

SEQ ID NO: 865561 - DNA, 25 bp, Mus musculus
accttgccaggagactacggataaa

SEQ ID NO: 865562 - DNA, 25 bp, Mus musculus
accttggaaccacacgggcatgcgg

SEQ ID NO: 865563 - DNA, 25 bp, Mus musculus
accttggaaccagacgggcatgcgg

SEQ ID NO: 865564 - DNA, 25 bp, Mus musculus
accttggagaagataaaaatatata

SEQ ID NO: 865565 - DNA, 25 bp, Mus musculus
accttggagaagttaaaaatatata

SEQ ID NO: 865566 - DNA, 25 bp, Mus musculus
accttggccaccactcctaatagta

SEQ ID NO: 865567 - DNA, 25 bp, Mus musculus
accttggccacctctcctaatagta

SEQ ID NO: 865568 - DNA, 25 bp, Mus musculus
accttgggccagattgtgtcacaaa

SEQ ID NO: 865569 - DNA, 25 bp, Mus musculus
accttgggccagtttgtgtcacaaa

SEQ ID NO: 865570 - DNA, 25 bp, Mus musculus
accttggggagacggatgagttcag

SEQ ID NO: 865571 - DNA, 25 bp, Mus musculus
accttggggagagggatgagttcag

SEQ ID NO: 865572 - DNA, 25 bp, Mus musculus
accttggtctgctgcacgcctttag

SEQ ID NO: 865573 - DNA, 25 bp, Mus musculus
accttggtctgctgcgaagcggaac

SEQ ID NO: 865574 - DNA, 25 bp, Mus musculus
accttggtctgctggacgcctttag

SEQ ID NO: 865575 - DNA, 25 bp, Mus musculus
accttggtctgctgggaagcggaac

SEQ ID NO: 865576 - DNA, 25 bp, Mus musculus
accttgtacaggcaccctcatgtgg

SEQ ID NO: 865577 - DNA, 25 bp, Mus musculus
accttgtacagggaccctcatgtgg

SEQ ID NO: 865578 - DNA, 25 bp, Mus musculus
accttgtcaaagtggccctgcttga

SEQ ID NO: 865579 - DNA, 25 bp, Mus musculus
accttgtcaatgtggccctgcttga

SEQ ID NO: 865580 - DNA, 25 bp, Mus musculus
accttgtgcaagcgcccagacttcc

SEQ ID NO: 865581 - DNA, 25 bp, Mus musculus
accttgtgcaagggcccagacttcc

SEQ ID NO: 865582 - DNA, 25 bp, Mus musculus
accttgtgttcctgcgtcttgcttt

SEQ ID NO: 865583 - DNA, 25 bp, Mus musculus
accttgtgttcctgggtcttgcttt

SEQ ID NO: 865584 - DNA, 25 bp, Mus musculus
acctttaccaagagctgggtcgacg

SEQ ID NO: 865585 - DNA, 25 bp, Mus musculus
acctttaccaagtgctgggtcgacg

SEQ ID NO: 865586 - DNA, 25 bp, Mus musculus
acctttaccagccgcactcagtccc

SEQ ID NO: 865587 - DNA, 25 bp, Mus musculus
acctttaccagcggcactcagtccc

SEQ ID NO: 865588 - DNA, 25 bp, Mus musculus
acctttataatgatagtccttggat

SEQ ID NO: 865589 - DNA, 25 bp, Mus musculus
acctttataatgattgtccttggat

SEQ ID NO: 865590 - DNA, 25 bp, Mus musculus
acctttgatgagatatgtgtcacaa

SEQ ID NO: 865591 - DNA, 25 bp, Mus musculus
acctttgatgagttatgtgtcacaa

SEQ ID NO: 865592 - DNA, 25 bp, Mus musculus
acctttgcaatccatggcagctcaa

SEQ ID NO: 865593 - DNA, 25 bp, Mus musculus
acctttgcaatcgatggcagctcaa

SEQ ID NO: 865594 - DNA, 25 bp, Mus musculus
acctttgcagaaagaagaatcctca

SEQ ID NO: 865595 - DNA, 25 bp, Mus musculus
acctttgcagagaactatcttcctg

SEQ ID NO: 865596 - DNA, 25 bp, Mus musculus
acctttgcagagaagtatcttcctg

SEQ ID NO: 865597 - DNA, 25 bp, Mus musculus
acctttgcagtaagaagaatcctca

SEQ ID NO: 865598 - DNA, 25 bp, Mus musculus
acctttgccaaacgccactgtggaa

SEQ ID NO: 865599 - DNA, 25 bp, Mus musculus
acctttgccaaaggccactgtggaa

SEQ ID NO: 865600 - DNA, 25 bp, Mus musculus
acctttgccgctcattttccagatc

SEQ ID NO: 865601 - DNA, 25 bp, Mus musculus
acctttgccggtcattttccagatc

SEQ ID NO: 865602 - DNA, 25 bp, Mus musculus
acctttgcctctctggagcagttct

SEQ ID NO: 865603 - DNA, 25 bp, Mus musculus
acctttgcctctgtggagcagttct

SEQ ID NO: 865604 - DNA, 25 bp, Mus musculus
acctttggcatgaacattccctcag

SEQ ID NO: 865605 - DNA, 25 bp, Mus musculus
acctttggcatgaagattccctcag

SEQ ID NO: 865606 - DNA, 25 bp, Mus musculus
acctttggccagccttacagttcct

SEQ ID NO: 865607 - DNA, 25 bp, Mus musculus
acctttggccaggcttacagttcct

SEQ ID NO: 865608 - DNA, 25 bp, Mus musculus
acctttgtggcactcttcccaggcc

SEQ ID NO: 865609 - DNA, 25 bp, Mus musculus
acctttgtggcactctttcagccaa

SEQ ID NO: 865610 - DNA, 25 bp, Mus musculus
acctttgtggcagtcttcccaggcc

SEQ ID NO: 865611 - DNA, 25 bp, Mus musculus
acctttgtggcagtctttcagccaa

SEQ ID NO: 865612 - DNA, 25 bp, Mus musculus
acctttgtgttgaacgtgcaggacc

SEQ ID NO: 865613 - DNA, 25 bp, Mus musculus
acctttgtgttgaaggtgcaggacc

SEQ ID NO: 865614 - DNA, 25 bp, Mus musculus
accttttcatagcttggatgataca

SEQ ID NO: 865615 - DNA, 25 bp, Mus musculus
accttttcataggttggatgataca

SEQ ID NO: 865616 - DNA, 25 bp, Mus musculus
acctttttgacatgaagccctttga

SEQ ID NO: 865617 - DNA, 25 bp, Mus musculus
acctttttgacatgtagccctttga

SEQ ID NO: 865618 - DNA, 25 bp, Mus musculus
acgaaacaaaagaggtccatgccgt

SEQ ID NO: 865619 - DNA, 25 bp, Mus musculus
acgaaacaaaagtggtccatgccgt

SEQ ID NO: 865620 - DNA, 25 bp, Mus musculus
acgaaacataagcaggaagctccta

SEQ ID NO: 865621 - DNA, 25 bp, Mus musculus
acgaaacataaggaggaagctccta

SEQ ID NO: 865622 - DNA, 25 bp, Mus musculus
acgaaactggctggaagaatggtgg

SEQ ID NO: 865623 - DNA, 25 bp, Mus musculus
acgaaactgggtggaagaatggtgg

SEQ ID NO: 865624 - DNA, 25 bp, Mus musculus
acgaaagttgcacgatgtgtttgag

SEQ ID NO: 865625 - DNA, 25 bp, Mus musculus
acgaaagttgcaggatgtgtttgag

SEQ ID NO: 865626 - DNA, 25 bp, Mus musculus
acgaaatgagcaagatgcaacagag

SEQ ID NO: 865627 - DNA, 25 bp, Mus musculus
acgaaatgaggaagatgcaacagag

SEQ ID NO: 865628 - DNA, 25 bp, Mus musculus
acgaacacgcgcaacccctgaggtg

SEQ ID NO: 865629 - DNA, 25 bp, Mus musculus
acgaacacgcgcaagccctgaggtg

SEQ ID NO: 865630 - DNA, 25 bp, Mus musculus
acgaaccacactctaccagcaaggt

SEQ ID NO: 865631 - DNA, 25 bp, Mus musculus
acgaaccacactgtaccagcaaggt

SEQ ID NO: 865632 - DNA, 25 bp, Mus musculus
acgaacggagacacagttcgatcct

SEQ ID NO: 865633 - DNA, 25 bp, Mus musculus
acgaacggaggcagaacacagttcg

SEQ ID NO: 865634 - DNA, 25 bp, Mus musculus
acgaacggaggcagtacacagttcg

SEQ ID NO: 865635 - DNA, 25 bp, Mus musculus
acgaacggagtcacagttcgatcct

SEQ ID NO: 865636 - DNA, 25 bp, Mus musculus
acgaactatgatcgcctgactcccc

SEQ ID NO: 865637 - DNA, 25 bp, Mus musculus
acgaactatgatggcctgactcccc

SEQ ID NO: 865638 - DNA, 25 bp, Mus musculus
acgaagacatagattcatctaagga

SEQ ID NO: 865639 - DNA, 25 bp, Mus musculus
acgaagacattgattcatctaagga

SEQ ID NO: 865640 - DNA, 25 bp, Mus musculus
acgaagaccacacgcaaatcctaag

SEQ ID NO: 865641 - DNA, 25 bp, Mus musculus
acgaagaccacaggcaaatcctaag

SEQ ID NO: 865642 - DNA, 25 bp, Mus musculus
acgaagagcagactgccttctgctg

SEQ ID NO: 865643 - DNA, 25 bp, Mus musculus
acgaagagcagagtgccttctgctg

SEQ ID NO: 865644 - DNA, 25 bp, Mus musculus
acgaagaggcaccgaacacagtggg

SEQ ID NO: 865645 - DNA, 25 bp, Mus musculus
acgaagaggcacggaacacagtggg

SEQ ID NO: 865646 - DNA, 25 bp, Mus musculus
acgaagatgaagctcaaactgggct

SEQ ID NO: 865647 - DNA, 25 bp, Mus musculus
acgaagatgaaggtcaaactgggct

SEQ ID NO: 865648 - DNA, 25 bp, Mus musculus
acgaagcaggcttgcaaaacctgta

SEQ ID NO: 865649 - DNA, 25 bp, Mus musculus
acgaagcagggttgcaaaacctgta

SEQ ID NO: 865650 - DNA, 25 bp, Mus musculus
acgaagcgccctttccgtcagaata

SEQ ID NO: 865651 - DNA, 25 bp, Mus musculus
acgaagcgccgtttccgtcagaata

SEQ ID NO: 865652 - DNA, 25 bp, Mus musculus
acgaagctcccacacggaagccctg

SEQ ID NO: 865653 - DNA, 25 bp, Mus musculus
acgaagctcccacagggaagccctg

SEQ ID NO: 865654 - DNA, 25 bp, Mus musculus
acgaaggaagagctgggagagttca

SEQ ID NO: 865655 - DNA, 25 bp, Mus musculus
acgaaggaagaggtgggagagttca

SEQ ID NO: 865656 - DNA, 25 bp, Mus musculus
acgaaggaggagtcataaacgagtc

SEQ ID NO: 865657 - DNA, 25 bp, Mus musculus
acgaaggaggtgtcataaacgagtc

SEQ ID NO: 865658 - DNA, 25 bp, Mus musculus
acgacaaataagatgcacgccatcc

SEQ ID NO: 865659 - DNA, 25 bp, Mus musculus
acgacaaataagttgcacgccatcc

SEQ ID NO: 865660 - DNA, 25 bp, Mus musculus
acgacacagaagagtatatggttgt

SEQ ID NO: 865661 - DNA, 25 bp, Mus musculus
acgacacagaagtgtatatggttgt

SEQ ID NO: 865662 - DNA, 25 bp, Mus musculus
acgacaccaaaacggctcaggatgc

SEQ ID NO: 865663 - DNA, 25 bp, Mus musculus
acgacaccaaaagggctcaggatgc

SEQ ID NO: 865664 - DNA, 25 bp, Mus musculus
acgacaccaaggagtcagtccgacc

SEQ ID NO: 865665 - DNA, 25 bp, Mus musculus
acgacaccaaggtgtcagtccgacc

SEQ ID NO: 865666 - DNA, 25 bp, Mus musculus
acgacagcactgctctcattcgctt

SEQ ID NO: 865667 - DNA, 25 bp, Mus musculus
acgacagcactggtctcattcgctt

SEQ ID NO: 865668 - DNA, 25 bp, Mus musculus
acgacagctgatcgttccagcatct

SEQ ID NO: 865669 - DNA, 25 bp, Mus musculus
acgacagctgatggttccagcatct

SEQ ID NO: 865670 - DNA, 25 bp, Mus musculus
acgacagctgcctcctagctttccc

SEQ ID NO: 865671 - DNA, 25 bp, Mus musculus
acgacagctgcgctacttgattagc

SEQ ID NO: 865672 - DNA, 25 bp, Mus musculus
acgacagctggctcctagctttccc

SEQ ID NO: 865673 - DNA, 25 bp, Mus musculus
acgacagctgggctacttgattagc

SEQ ID NO: 865674 - DNA, 25 bp, Mus musculus
acgacagggctccgagccgcaagga

SEQ ID NO: 865675 - DNA, 25 bp, Mus musculus
acgacagggctcggagccgcaagga

SEQ ID NO: 865676 - DNA, 25 bp, Mus musculus
acgacatcgctgatcgttgcatcta

SEQ ID NO: 865677 - DNA, 25 bp, Mus musculus
acgacatcgctgatggttgcatcta

SEQ ID NO: 865678 - DNA, 25 bp, Mus musculus
acgaccaagacgcaaatggaacttc

SEQ ID NO: 865679 - DNA, 25 bp, Mus musculus
acgaccaagacggaaatggaacttc

SEQ ID NO: 865680 - DNA, 25 bp, Mus musculus
acgaccagagcagctgtctgaagcc

SEQ ID NO: 865681 - DNA, 25 bp, Mus musculus
acgaccagaggagctgtctgaagcc

SEQ ID NO: 865682 - DNA, 25 bp, Mus musculus
acgaccccacaatccaagatgctta

SEQ ID NO: 865683 - DNA, 25 bp, Mus musculus
acgaccccacaatccgcagagttca

SEQ ID NO: 865684 - DNA, 25 bp, Mus musculus
acgaccccacaatcgaagatgctta

SEQ ID NO: 865685 - DNA, 25 bp, Mus musculus
acgaccccacaatcggcagagttca

SEQ ID NO: 865686 - DNA, 25 bp, Mus musculus
acgacctcagctgcccggagaggcc

SEQ ID NO: 865687 - DNA, 25 bp, Mus musculus
acgacctcaggtgcccggagaggcc

SEQ ID NO: 865688 - DNA, 25 bp, Mus musculus
acgacctccctacgattctcaaagc

SEQ ID NO: 865689 - DNA, 25 bp, Mus musculus
acgacctccctacgtgaggattatg

SEQ ID NO: 865690 - DNA, 25 bp, Mus musculus
acgacctccctaggattctcaaagc

SEQ ID NO: 865691 - DNA, 25 bp, Mus musculus
acgacctccctaggtgaggattatg

SEQ ID NO: 865692 - DNA, 25 bp, Mus musculus
acgacctgagctcccagaagccatc

SEQ ID NO: 865693 - DNA, 25 bp, Mus musculus
acgacctgaggtcccagaagccatc

SEQ ID NO: 865694 - DNA, 25 bp, Mus musculus
acgacgaacaagtggctgcacagat

SEQ ID NO: 865695 - DNA, 25 bp, Mus musculus
acgacgaacatgtggctgcacagat

SEQ ID NO: 865696 - DNA, 25 bp, Mus musculus
acgacgacgaggatggagatgaaga

SEQ ID NO: 865697 - DNA, 25 bp, Mus musculus
acgacgacgaggttggagatgaaga

SEQ ID NO: 865698 - DNA, 25 bp, Mus musculus
acgacgccacatcggaagggggtgc

SEQ ID NO: 865699 - DNA, 25 bp, Mus musculus
acgacgccacttcggaagggggtgc

SEQ ID NO: 865700 - DNA, 25 bp, Mus musculus
acgacgcctcagcagctatgaagac

SEQ ID NO: 865701 - DNA, 25 bp, Mus musculus
acgacgcctcaggagctatgaagac

SEQ ID NO: 865702 - DNA, 25 bp, Mus musculus
acgacgctttggatcagtgtgaact

SEQ ID NO: 865703 - DNA, 25 bp, Mus musculus
acgacgctttggatcgctcccggac

SEQ ID NO: 865704 - DNA, 25 bp, Mus musculus
acgacgctttggatcgtgatgatga

SEQ ID NO: 865705 - DNA, 25 bp, Mus musculus
acgacgctttggatctgccttcgga

SEQ ID NO: 865706 - DNA, 25 bp, Mus musculus
acgacgctttggatgagtgtgaact

SEQ ID NO: 865707 - DNA, 25 bp, Mus musculus
acgacgctttggatggctcccggac

SEQ ID NO: 865708 - DNA, 25 bp, Mus musculus
acgacgctttggatggtgatgatga

SEQ ID NO: 865709 - DNA, 25 bp, Mus musculus
acgacgctttggatgtgccttcgga

SEQ ID NO: 865710 - DNA, 25 bp, Mus musculus
acgactacttggcgctcgtgagctg

SEQ ID NO: 865711 - DNA, 25 bp, Mus musculus
acgactacttggggctcgtgagctg

SEQ ID NO: 865712 - DNA, 25 bp, Mus musculus
acgactcactagcgaagctatgcga

SEQ ID NO: 865713 - DNA, 25 bp, Mus musculus
acgactcactagggaagctatgcga

SEQ ID NO: 865714 - DNA, 25 bp, Mus musculus
acgactggagcgcacgagacatcca

SEQ ID NO: 865715 - DNA, 25 bp, Mus musculus
acgactggagcggacgagacatcca

SEQ ID NO: 865716 - DNA, 25 bp, Mus musculus
acgacttcgccggcatctctgagga

SEQ ID NO: 865717 - DNA, 25 bp, Mus musculus
acgacttcgccggcttctctgagga

SEQ ID NO: 865718 - DNA, 25 bp, Mus musculus
acgagaaatgagacaaaagaagtta

SEQ ID NO: 865719 - DNA, 25 bp, Mus musculus
acgagaaatgagtcaaaagaagtta

SEQ ID NO: 865720 - DNA, 25 bp, Mus musculus
acgagaacagcgactactgtgaaga

SEQ ID NO: 865721 - DNA, 25 bp, Mus musculus
acgagaacagggactactgtgaaga

SEQ ID NO: 865722 - DNA, 25 bp, Mus musculus
acgagaagaaagcgctgaaggactg

SEQ ID NO: 865723 - DNA, 25 bp, Mus musculus
acgagaagaaagggctgaaggactg

SEQ ID NO: 865724 - DNA, 25 bp, Mus musculus
acgagaagaactgtctaaagaagac

SEQ ID NO: 865725 - DNA, 25 bp, Mus musculus
acgagaagaactgtgtaaagaagac

SEQ ID NO: 865726 - DNA, 25 bp, Mus musculus
acgagaagcggactcacgaccacct

SEQ ID NO: 865727 - DNA, 25 bp, Mus musculus
acgagaagcggagtcacgaccacct

SEQ ID NO: 865728 - DNA, 25 bp, Mus musculus
acgagacaggcctcagtgtgaccgc

SEQ ID NO: 865729 - DNA, 25 bp, Mus musculus
acgagacaggcctctgtgtgaccgc

SEQ ID NO: 865730 - DNA, 25 bp, Mus musculus
acgagactgaggaccagtattcact

SEQ ID NO: 865731 - DNA, 25 bp, Mus musculus
acgagactgaggtccagtattcact

SEQ ID NO: 865732 - DNA, 25 bp, Mus musculus
acgagccggagaccatggcggacta

SEQ ID NO: 865733 - DNA, 25 bp, Mus musculus
acgagccggagagcatggcggacta

SEQ ID NO: 865734 - DNA, 25 bp, Mus musculus
acgagcctctgacatttgtctagat

SEQ ID NO: 865735 - DNA, 25 bp, Mus musculus
acgagcctctgagatttgtctagat

SEQ ID NO: 865736 - DNA, 25 bp, Mus musculus
acgagctgccgtcggttgaaaaata

SEQ ID NO: 865737 - DNA, 25 bp, Mus musculus
acgagctgccgtgggttgaaaaata

SEQ ID NO: 865738 - DNA, 25 bp, Mus musculus
acgagctgtagcctcaacctcaagg

SEQ ID NO: 865739 - DNA, 25 bp, Mus musculus
acgagctgtagcctgaacctcaagg

SEQ ID NO: 865740 - DNA, 25 bp, Mus musculus
acgaggaccgcccatccccagtgct

SEQ ID NO: 865741 - DNA, 25 bp, Mus musculus
acgaggaccggccatccccagtgct

SEQ ID NO: 865742 - DNA, 25 bp, Mus musculus
acgaggagagcaacttcccacatgc

SEQ ID NO: 865743 - DNA, 25 bp, Mus musculus
acgaggagagcatcttcccacatgc

SEQ ID NO: 865744 - DNA, 25 bp, Mus musculus
acgaggagtgcttccgatctaagta

SEQ ID NO: 865745 - DNA, 25 bp, Mus musculus
acgaggagtggttccgatctaagta

SEQ ID NO: 865746 - DNA, 25 bp, Mus musculus
acgaggcttccacctccagaaatct

SEQ ID NO: 865747 - DNA, 25 bp, Mus musculus
acgaggcttccagctccagaaatct

SEQ ID NO: 865748 - DNA, 25 bp, Mus musculus
acgagggcaaaatcagtgagaagga

SEQ ID NO: 865749 - DNA, 25 bp, Mus musculus
acgagggcaaaatctgtgagaagga

SEQ ID NO: 865750 - DNA, 25 bp, Mus musculus
acgagggcgcggagtggacaaatgt

SEQ ID NO: 865751 - DNA, 25 bp, Mus musculus
acgagggcgcggtgtggacaaatgt

SEQ ID NO: 865752 - DNA, 25 bp, Mus musculus
acgaggtgctgcagcaggctgtgcc

SEQ ID NO: 865753 - DNA, 25 bp, Mus musculus
acgaggtgctgcaggaggctgtgcc

SEQ ID NO: 865754 - DNA, 25 bp, Mus musculus
acgagtaccgccatgtcatgttacc

SEQ ID NO: 865755 - DNA, 25 bp, Mus musculus
acgagtaccggcatgtcatgttacc

SEQ ID NO: 865756 - DNA, 25 bp, Mus musculus
acgagtcctatgctgaaggctgcat

SEQ ID NO: 865757 - DNA, 25 bp, Mus musculus
acgagtcctatggtgaaggctgcat

SEQ ID NO: 865758 - DNA, 25 bp, Mus musculus
acgagtgtagtacgtctgttcctgc

SEQ ID NO: 865759 - DNA, 25 bp, Mus musculus
acgagtgtagtaggtctgttcctgc

SEQ ID NO: 865760 - DNA, 25 bp, Mus musculus
acgagtgtcgagattcctaatcatc

SEQ ID NO: 865761 - DNA, 25 bp, Mus musculus
acgagtgtcgagtttcctaatcatc

SEQ ID NO: 865762 - DNA, 25 bp, Mus musculus
acgagtttcataccctggagattca

SEQ ID NO: 865763 - DNA, 25 bp, Mus musculus
acgagtttcatagcctggagattca

SEQ ID NO: 865764 - DNA, 25 bp, Mus musculus
acgatataccagaagtctacaaccc

SEQ ID NO: 865765 - DNA, 25 bp, Mus musculus
acgatataccagtagtctacaaccc

SEQ ID NO: 865766 - DNA, 25 bp, Mus musculus
acgatatcaaaccacttggcaccaa

SEQ ID NO: 865767 - DNA, 25 bp, Mus musculus
acgatatcaaaccagttggcaccaa

SEQ ID NO: 865768 - DNA, 25 bp, Mus musculus
acgatatcacaaatgttaactcatt

SEQ ID NO: 865769 - DNA, 25 bp, Mus musculus
acgatatcacaattgttaactcatt

SEQ ID NO: 865770 - DNA, 25 bp, Mus musculus
acgatccacagacatccagaagccc

SEQ ID NO: 865771 - DNA, 25 bp, Mus musculus
acgatccacagagatccagaagccc

SEQ ID NO: 865772 - DNA, 25 bp, Mus musculus
acgatgaacacgtagctgcacaaat

SEQ ID NO: 865773 - DNA, 25 bp, Mus musculus
acgatgaacaggtagctgcacaaat

SEQ ID NO: 865774 - DNA, 25 bp, Mus musculus
acgatgacagctatctccccagtga

SEQ ID NO: 865775 - DNA, 25 bp, Mus musculus
acgatgacagctatgtccccagtga

SEQ ID NO: 865776 - DNA, 25 bp, Mus musculus
acgatgatattcaaccgtctgttgc

SEQ ID NO: 865777 - DNA, 25 bp, Mus musculus
acgatgatattcaacgaacagcgtc

SEQ ID NO: 865778 - DNA, 25 bp, Mus musculus
acgatgatattcaagcgtctgttgc

SEQ ID NO: 865779 - DNA, 25 bp, Mus musculus
acgatgatattcaaggaacagcgtc

SEQ ID NO: 865780 - DNA, 25 bp, Mus musculus
acgatggcagagtgaatgggaaacg

SEQ ID NO: 865781 - DNA, 25 bp, Mus musculus
acgatggcagtgtgaatgggaaacg

SEQ ID NO: 865782 - DNA, 25 bp, Mus musculus
acgatggctctgacagccgcaagtc

SEQ ID NO: 865783 - DNA, 25 bp, Mus musculus
acgatggctctgactgccgcaagtc

SEQ ID NO: 865784 - DNA, 25 bp, Mus musculus
acgatggtgacggacggtggcatgt

SEQ ID NO: 865785 - DNA, 25 bp, Mus musculus
acgatggtgacggagggtggcatgt

SEQ ID NO: 865786 - DNA, 25 bp, Mus musculus
acgattcaagcaggagccccgaaca

SEQ ID NO: 865787 - DNA, 25 bp, Mus musculus
acgattcaagctcttgcttctagtg

SEQ ID NO: 865788 - DNA, 25 bp, Mus musculus
acgattcaaggaggagccccgaaca

SEQ ID NO: 865789 - DNA, 25 bp, Mus musculus
acgattcaaggtcttgcttctagtg

SEQ ID NO: 865790 - DNA, 25 bp, Mus musculus
acgattcacgaggtcctgtaataaa

SEQ ID NO: 865791 - DNA, 25 bp, Mus musculus
acgattcacgtggtcctgtaataaa

SEQ ID NO: 865792 - DNA, 25 bp, Mus musculus
acgattggatcagccgatgacagag

SEQ ID NO: 865793 - DNA, 25 bp, Mus musculus
acgattggatcagcggatgacagag

SEQ ID NO: 865794 - DNA, 25 bp, Mus musculus
acgatttctgcgaccttcgagaacg

SEQ ID NO: 865795 - DNA, 25 bp, Mus musculus
acgatttctgggaccttcgagaacg

SEQ ID NO: 865796 - DNA, 25 bp, Mus musculus
acgatttgaaaacaatgggatcaaa

SEQ ID NO: 865797 - DNA, 25 bp, Mus musculus
acgatttgaaaagaatgggatcaaa

SEQ ID NO: 865798 - DNA, 25 bp, Mus musculus
acgcaaaaggagcacgtgcttttgg

SEQ ID NO: 865799 - DNA, 25 bp, Mus musculus
acgcaaaaggagcaggtgcttttgg

SEQ ID NO: 865800 - DNA, 25 bp, Mus musculus
acgcaagccctcagcctgtgaatct

SEQ ID NO: 865801 - DNA, 25 bp, Mus musculus
acgcaagccctcaggctgtgaatct

SEQ ID NO: 865802 - DNA, 25 bp, Mus musculus
acgcaataagagtttctaattatga

SEQ ID NO: 865803 - DNA, 25 bp, Mus musculus
acgcaataagtgtttctaattatga

SEQ ID NO: 865804 - DNA, 25 bp, Mus musculus
acgcaatgacaacgtgttctttgcc

SEQ ID NO: 865805 - DNA, 25 bp, Mus musculus
acgcaatgacaaggtgttctttgcc

SEQ ID NO: 865806 - DNA, 25 bp, Mus musculus
acgcacactatgaacacctgggtac

SEQ ID NO: 865807 - DNA, 25 bp, Mus musculus
acgcacactatgtacacctgggtac

SEQ ID NO: 865808 - DNA, 25 bp, Mus musculus
acgcacccttcactacaagcccacc

SEQ ID NO: 865809 - DNA, 25 bp, Mus musculus
acgcacccttcagtacaagcccacc

SEQ ID NO: 865810 - DNA, 25 bp, Mus musculus
acgcagaaccaggctcggctgacag

SEQ ID NO: 865811 - DNA, 25 bp, Mus musculus
acgcagaacctggctcggctgacag

SEQ ID NO: 865812 - DNA, 25 bp, Mus musculus
acgcagacagagctggacagtcaca

SEQ ID NO: 865813 - DNA, 25 bp, Mus musculus
acgcagacagaggacatttggtccg

SEQ ID NO: 865814 - DNA, 25 bp, Mus musculus
acgcagacagaggtggacagtcaca

SEQ ID NO: 865815 - DNA, 25 bp, Mus musculus
acgcagacagtggacatttggtccg

SEQ ID NO: 865816 - DNA, 25 bp, Mus musculus
acgcagaggccacgtgctcctctgg

SEQ ID NO: 865817 - DNA, 25 bp, Mus musculus
acgcagaggccaggtgctcctctgg

SEQ ID NO: 865818 - DNA, 25 bp, Mus musculus
acgcagcacgccatcaatgatgatg

SEQ ID NO: 865819 - DNA, 25 bp, Mus musculus
acgcagcacgccctatgtgcaggag

SEQ ID NO: 865820 - DNA, 25 bp, Mus musculus
acgcagcacgccgtatgtgcaggag

SEQ ID NO: 865821 - DNA, 25 bp, Mus musculus
acgcagcacgccttcaatgatgatg

SEQ ID NO: 865822 - DNA, 25 bp, Mus musculus
acgcagcagcagttagagggcgtgc

SEQ ID NO: 865823 - DNA, 25 bp, Mus musculus
acgcagcagcagtttgagggcgtgc

SEQ ID NO: 865824 - DNA, 25 bp, Mus musculus
acgcagccagagagggaaactgagg

SEQ ID NO: 865825 - DNA, 25 bp, Mus musculus
acgcagccagagcttgtccaggtga

SEQ ID NO: 865826 - DNA, 25 bp, Mus musculus
acgcagccagaggttgtccaggtga

SEQ ID NO: 865827 - DNA, 25 bp, Mus musculus
acgcagccagagtgggaaactgagg

SEQ ID NO: 865828 - DNA, 25 bp, Mus musculus
acgcagccttcacgctcagttctga

SEQ ID NO: 865829 - DNA, 25 bp, Mus musculus
acgcagccttcaggctcagttctga

SEQ ID NO: 865830 - DNA, 25 bp, Mus musculus
acgcagcgcgggcccgtgtacattg

SEQ ID NO: 865831 - DNA, 25 bp, Mus musculus
acgcagcgcgggccggtgtacattg

SEQ ID NO: 865832 - DNA, 25 bp, Mus musculus
acgcaggagcccaacccacaggtag

SEQ ID NO: 865833 - DNA, 25 bp, Mus musculus
acgcaggagcccaagccacaggtag

SEQ ID NO: 865834 - DNA, 25 bp, Mus musculus
acgcaggatgagtatccatcgagat

SEQ ID NO: 865835 - DNA, 25 bp, Mus musculus
acgcaggatgcacctctctacgtca

SEQ ID NO: 865836 - DNA, 25 bp, Mus musculus
acgcaggatggacctctctacgtca

SEQ ID NO: 865837 - DNA, 25 bp, Mus musculus
acgcaggatgtgtatccatcgagat

SEQ ID NO: 865838 - DNA, 25 bp, Mus musculus
acgcaggcagcccacggatgcagcg

SEQ ID NO: 865839 - DNA, 25 bp, Mus musculus
acgcaggcagcccagggatgcagcg

SEQ ID NO: 865840 - DNA, 25 bp, Mus musculus
acgcaggcctcatacgcaccgtggt

SEQ ID NO: 865841 - DNA, 25 bp, Mus musculus
acgcaggcctcataggcaccgtggt

SEQ ID NO: 865842 - DNA, 25 bp, Mus musculus
acgcagtccatgcagggttccagta

SEQ ID NO: 865843 - DNA, 25 bp, Mus musculus
acgcagtccatggagggttccagta

SEQ ID NO: 865844 - DNA, 25 bp, Mus musculus
acgcatatctaccacgtaagattaa

SEQ ID NO: 865845 - DNA, 25 bp, Mus musculus
acgcatatctaccaggtaagattaa

SEQ ID NO: 865846 - DNA, 25 bp, Mus musculus
acgcatcaccagctggtacagagga

SEQ ID NO: 865847 - DNA, 25 bp, Mus musculus
acgcatcaccaggtggtacagagga

SEQ ID NO: 865848 - DNA, 25 bp, Mus musculus
acgcatcgagggcgctacccgactc

SEQ ID NO: 865849 - DNA, 25 bp, Mus musculus
acgcatcgagggggctacccgactc

SEQ ID NO: 865850 - DNA, 25 bp, Mus musculus
acgcattttgcccgaacccagataa

SEQ ID NO: 865851 - DNA, 25 bp, Mus musculus
acgcattttgccggaacccagataa

SEQ ID NO: 865852 - DNA, 25 bp, Mus musculus
acgccaaactctcgtggataccctc

SEQ ID NO: 865853 - DNA, 25 bp, Mus musculus
acgccaaactctcgttcttctggtt

SEQ ID NO: 865854 - DNA, 25 bp, Mus musculus
acgccaaactctggtggataccctc

SEQ ID NO: 865855 - DNA, 25 bp, Mus musculus
acgccaaactctggttcttctggtt

SEQ ID NO: 865856 - DNA, 25 bp, Mus musculus
acgccaacgcaaatgccgtgcagac

SEQ ID NO: 865857 - DNA, 25 bp, Mus musculus
acgccaacgcaattgccgtgcagac

SEQ ID NO: 865858 - DNA, 25 bp, Mus musculus
acgccaagctagagcacaaccttct

SEQ ID NO: 865859 - DNA, 25 bp, Mus musculus
acgccaagctagaggacaaccttct

SEQ ID NO: 865860 - DNA, 25 bp, Mus musculus
acgccaatgtgtcccacttcccgga

SEQ ID NO: 865861 - DNA, 25 bp, Mus musculus
acgccaatgtgtccgacttcccgga

SEQ ID NO: 865862 - DNA, 25 bp, Mus musculus
acgccagcagctcctgctggtgaga

SEQ ID NO: 865863 - DNA, 25 bp, Mus musculus
acgccagcaggtcctgctggtgaga

SEQ ID NO: 865864 - DNA, 25 bp, Mus musculus
acgccagctacccttctctacagtg

SEQ ID NO: 865865 - DNA, 25 bp, Mus musculus
acgccagctagccttctctacagtg

SEQ ID NO: 865866 - DNA, 25 bp, Mus musculus
acgccaggccaatccctccctcttc

SEQ ID NO: 865867 - DNA, 25 bp, Mus musculus
acgccaggccaatcgctccctcttc

SEQ ID NO: 865868 - DNA, 25 bp, Mus musculus
acgccatcaaatatgaagcacacag

SEQ ID NO: 865869 - DNA, 25 bp, Mus musculus
acgccatcaaatttgaagcacacag

SEQ ID NO: 865870 - DNA, 25 bp, Mus musculus
acgccatcaggaagcagcaggaaga

SEQ ID NO: 865871 - DNA, 25 bp, Mus musculus
acgccatcaggaaggagcaggaaga

SEQ ID NO: 865872 - DNA, 25 bp, Mus musculus
acgccatcgtagaagccctggaaac

SEQ ID NO: 865873 - DNA, 25 bp, Mus musculus
acgccatcgtagtagccctggaaac

SEQ ID NO: 865874 - DNA, 25 bp, Mus musculus
acgccatgccaacgctagcagtaac

SEQ ID NO: 865875 - DNA, 25 bp, Mus musculus
acgccatgccaaggctagcagtaac

SEQ ID NO: 865876 - DNA, 25 bp, Mus musculus
acgccatggctgacaagatcctgag

SEQ ID NO: 865877 - DNA, 25 bp, Mus musculus
acgccatggctgtcaagatcctgag

SEQ ID NO: 865878 - DNA, 25 bp, Mus musculus
acgccatgggggaccctcctgacta

SEQ ID NO: 865879 - DNA, 25 bp, Mus musculus
acgccatgggggacgctcctgacta

SEQ ID NO: 865880 - DNA, 25 bp, Mus musculus
acgccatgtatgattccaccggctc

SEQ ID NO: 865881 - DNA, 25 bp, Mus musculus
acgccatgtatgtttccaccggctc

SEQ ID NO: 865882 - DNA, 25 bp, Mus musculus
acgcccaagaaacgtggcaggagat

SEQ ID NO: 865883 - DNA, 25 bp, Mus musculus
acgcccaagaaaggtggcaggagat

SEQ ID NO: 865884 - DNA, 25 bp, Mus musculus
acgcccacccagcttatgaacaggc

SEQ ID NO: 865885 - DNA, 25 bp, Mus musculus
acgcccacccaggttatgaacaggc

SEQ ID NO: 865886 - DNA, 25 bp, Mus musculus
acgcccagctcgcataccgtgtcaa

SEQ ID NO: 865887 - DNA, 25 bp, Mus musculus
acgcccagctcggataccgtgtcaa

SEQ ID NO: 865888 - DNA, 25 bp, Mus musculus
acgcccaggccgctcccggatgttg

SEQ ID NO: 865889 - DNA, 25 bp, Mus musculus
acgcccaggccggtcccggatgttg

SEQ ID NO: 865890 - DNA, 25 bp, Mus musculus
acgcccatggaacagaccgtgcggg

SEQ ID NO: 865891 - DNA, 25 bp, Mus musculus
acgcccatggaagagaccgtgcggg

SEQ ID NO: 865892 - DNA, 25 bp, Mus musculus
acgcccccagatgaagactgtcccc

SEQ ID NO: 865893 - DNA, 25 bp, Mus musculus
acgcccccagttgaagactgtcccc

SEQ ID NO: 865894 - DNA, 25 bp, Mus musculus
acgccccttccccggcagcaggagc

SEQ ID NO: 865895 - DNA, 25 bp, Mus musculus
acgccccttcccgggcagcaggagc

SEQ ID NO: 865896 - DNA, 25 bp, Mus musculus
acgcccggacctcaccagaaatctc

SEQ ID NO: 865897 - DNA, 25 bp, Mus musculus
acgcccggacctcacgtctctgcct

SEQ ID NO: 865898 - DNA, 25 bp, Mus musculus
acgcccggacctcagcagaaatctc

SEQ ID NO: 865899 - DNA, 25 bp, Mus musculus
acgcccggacctcaggtctctgcct

SEQ ID NO: 865900 - DNA, 25 bp, Mus musculus
acgcccttccagctgactggttatc

SEQ ID NO: 865901 - DNA, 25 bp, Mus musculus
acgcccttccaggtgactggttatc

SEQ ID NO: 865902 - DNA, 25 bp, Mus musculus
acgcccttgctcctccttgcttccc

SEQ ID NO: 865903 - DNA, 25 bp, Mus musculus
acgcccttgctcctcgaggcagtga

SEQ ID NO: 865904 - DNA, 25 bp, Mus musculus
acgcccttgctcctgcttgcttccc

SEQ ID NO: 865905 - DNA, 25 bp, Mus musculus
acgcccttgctcctggaggcagtga

SEQ ID NO: 865906 - DNA, 25 bp, Mus musculus
acgccgacgcagaaagaagaagtaa

SEQ ID NO: 865907 - DNA, 25 bp, Mus musculus
acgccgacgcagtaagaagaagtaa

SEQ ID NO: 865908 - DNA, 25 bp, Mus musculus
acgccggaagatcatgccagaccag

SEQ ID NO: 865909 - DNA, 25 bp, Mus musculus
acgccggaagatgatgccagaccag

SEQ ID NO: 865910 - DNA, 25 bp, Mus musculus
acgcctacagcttcctggtggctga

SEQ ID NO: 865911 - DNA, 25 bp, Mus musculus
acgcctacaggttcctggtggctga

SEQ ID NO: 865912 - DNA, 25 bp, Mus musculus
acgcctactgtgaacacattgacga

SEQ ID NO: 865913 - DNA, 25 bp, Mus musculus
acgcctactgtgaagacattgacga

SEQ ID NO: 865914 - DNA, 25 bp, Mus musculus
acgcctcagctgcacactgccccat

SEQ ID NO: 865915 - DNA, 25 bp, Mus musculus
acgcctcagctggacactgccccat

SEQ ID NO: 865916 - DNA, 25 bp, Mus musculus
acgcctccaccacgtaaaaatagca

SEQ ID NO: 865917 - DNA, 25 bp, Mus musculus
acgcctccaccaggtaaaaatagca

SEQ ID NO: 865918 - DNA, 25 bp, Mus musculus
acgcctgcccaaataatggaggctg

SEQ ID NO: 865919 - DNA, 25 bp, Mus musculus
acgcctgcccaattaatggaggctg

SEQ ID NO: 865920 - DNA, 25 bp, Mus musculus
acgcctgcctggcgaatgaattcca

SEQ ID NO: 865921 - DNA, 25 bp, Mus musculus
acgcctgcctggggaatgaattcca

SEQ ID NO: 865922 - DNA, 25 bp, Mus musculus
acgcgactcaagcagggggccaaca

SEQ ID NO: 865923 - DNA, 25 bp, Mus musculus
acgcgactcaaggagggggccaaca

SEQ ID NO: 865924 - DNA, 25 bp, Mus musculus
acgcgataggtacacttctgacaca

SEQ ID NO: 865925 - DNA, 25 bp, Mus musculus
acgcgataggtacagttctgacaca

SEQ ID NO: 865926 - DNA, 25 bp, Mus musculus
acgcgcaaggcccacgattttcact

SEQ ID NO: 865927 - DNA, 25 bp, Mus musculus
acgcgcaaggcccaggattttcact

SEQ ID NO: 865928 - DNA, 25 bp, Mus musculus
acgcgcacctgccgcctgcgaccga

SEQ ID NO: 865929 - DNA, 25 bp, Mus musculus
acgcgcacctgccggctgcgaccga

SEQ ID NO: 865930 - DNA, 25 bp, Mus musculus
acgcgccaggcaatggacctgtcag

SEQ ID NO: 865931 - DNA, 25 bp, Mus musculus
acgcgccagggaatggacctgtcag

SEQ ID NO: 865932 - DNA, 25 bp, Mus musculus
acgcgccctcagagggaagatgccc

SEQ ID NO: 865933 - DNA, 25 bp, Mus musculus
acgcgccctcagatgtcacctgtac

SEQ ID NO: 865934 - DNA, 25 bp, Mus musculus
acgcgccctcagtgggaagatgccc

SEQ ID NO: 865935 - DNA, 25 bp, Mus musculus
acgcgccctcagttgtcacctgtac

SEQ ID NO: 865936 - DNA, 25 bp, Mus musculus
acgcgcggcgcggaccttagcagat

SEQ ID NO: 865937 - DNA, 25 bp, Mus musculus
acgcgcggcgcggactcacattagc

SEQ ID NO: 865938 - DNA, 25 bp, Mus musculus
acgcgcggcgcggagcttagcagat

SEQ ID NO: 865939 - DNA, 25 bp, Mus musculus
acgcgcggcgcggagtcacattagc

SEQ ID NO: 865940 - DNA, 25 bp, Mus musculus
acgcgcggggaacagtcttgcgctc

SEQ ID NO: 865941 - DNA, 25 bp, Mus musculus
acgcgcggggaagagtcttgcgctc

SEQ ID NO: 865942 - DNA, 25 bp, Mus musculus
acgcggagggccccaacaccaagaa

SEQ ID NO: 865943 - DNA, 25 bp, Mus musculus
acgcggagggccgcaacaccaagaa

SEQ ID NO: 865944 - DNA, 25 bp, Mus musculus
acgcggagtccactcaccacaggct

SEQ ID NO: 865945 - DNA, 25 bp, Mus musculus
acgcggagtccagtcaccacaggct

SEQ ID NO: 865946 - DNA, 25 bp, Mus musculus
acgcggcgacagctcttctacttac

SEQ ID NO: 865947 - DNA, 25 bp, Mus musculus
acgcggcgacaggtcttctacttac

SEQ ID NO: 865948 - DNA, 25 bp, Mus musculus
acgcggcggccccacgctgcggcca

SEQ ID NO: 865949 - DNA, 25 bp, Mus musculus
acgcggcggcccgacgctgcggcca

SEQ ID NO: 865950 - DNA, 25 bp, Mus musculus
acgcgggattcccgtcacagtttgc

SEQ ID NO: 865951 - DNA, 25 bp, Mus musculus
acgcgggattccggtcacagtttgc

SEQ ID NO: 865952 - DNA, 25 bp, Mus musculus
acgcggggatcacggcagagatggc

SEQ ID NO: 865953 - DNA, 25 bp, Mus musculus
acgcggggatcagggcagagatggc

SEQ ID NO: 865954 - DNA, 25 bp, Mus musculus
acgcggtcagaactgtgccggatca

SEQ ID NO: 865955 - DNA, 25 bp, Mus musculus
acgcggtcagagaaagccaagtaga

SEQ ID NO: 865956 - DNA, 25 bp, Mus musculus
acgcggtcagtactgtgccggatca

SEQ ID NO: 865957 - DNA, 25 bp, Mus musculus
acgcggtcagtgaaagccaagtaga

SEQ ID NO: 865958 - DNA, 25 bp, Mus musculus
acgcgtcaacacagggctgcatggc

SEQ ID NO: 865959 - DNA, 25 bp, Mus musculus
acgcgtcaacactgggctgcatggc

SEQ ID NO: 865960 - DNA, 25 bp, Mus musculus
acgcgtgtgtggagttcaccttcca

SEQ ID NO: 865961 - DNA, 25 bp, Mus musculus
acgcgtgtgtggtgttcaccttcca

SEQ ID NO: 865962 - DNA, 25 bp, Mus musculus
acgctaacccagcagaacgtcagct

SEQ ID NO: 865963 - DNA, 25 bp, Mus musculus
acgctaacccaggagaacgtcagct

SEQ ID NO: 865964 - DNA, 25 bp, Mus musculus
acgctacggaatgaagctacccagc

SEQ ID NO: 865965 - DNA, 25 bp, Mus musculus
acgctacggattgaagctacccagc

SEQ ID NO: 865966 - DNA, 25 bp, Mus musculus
acgctcacacccaaaagatggcgac

SEQ ID NO: 865967 - DNA, 25 bp, Mus musculus
acgctcacacccatggcgacgccgt

SEQ ID NO: 865968 - DNA, 25 bp, Mus musculus
acgctcacaccctaaagatggcgac

SEQ ID NO: 865969 - DNA, 25 bp, Mus musculus
acgctcacacccttggcgacgccgt

SEQ ID NO: 865970 - DNA, 25 bp, Mus musculus
acgctcagagacgagttcaggaaag

SEQ ID NO: 865971 - DNA, 25 bp, Mus musculus
acgctcagagtcgagttcaggaaag

SEQ ID NO: 865972 - DNA, 25 bp, Mus musculus
acgctcatagcactgccgctccatg

SEQ ID NO: 865973 - DNA, 25 bp, Mus musculus
acgctcatagcagtgccgctccatg

SEQ ID NO: 865974 - DNA, 25 bp, Mus musculus
acgctcatctcccacacatacggga

SEQ ID NO: 865975 - DNA, 25 bp, Mus musculus
acgctcatctcccagacatacggga

SEQ ID NO: 865976 - DNA, 25 bp, Mus musculus
acgctctacacgatgcggccgaaag

SEQ ID NO: 865977 - DNA, 25 bp, Mus musculus
acgctctacacgttgcggccgaaag

SEQ ID NO: 865978 - DNA, 25 bp, Mus musculus
acgctctgacctccccctcttcagt

SEQ ID NO: 865979 - DNA, 25 bp, Mus musculus
acgctctgacctccgcctcttcagt

SEQ ID NO: 865980 - DNA, 25 bp, Mus musculus
acgctgatgcagaccgagaagcagt

SEQ ID NO: 865981 - DNA, 25 bp, Mus musculus
acgctgatgcagacggagaagcagt

SEQ ID NO: 865982 - DNA, 25 bp, Mus musculus
acgctgcagccaaaaaacgggaaga

SEQ ID NO: 865983 - DNA, 25 bp, Mus musculus
acgctgcagccataaaacgggaaga

SEQ ID NO: 865984 - DNA, 25 bp, Mus musculus
acgctgcccccccaccgctaccacc

SEQ ID NO: 865985 - DNA, 25 bp, Mus musculus
acgctgcccccccagcgctaccacc

SEQ ID NO: 865986 - DNA, 25 bp, Mus musculus
acgctgccggccatcgtcgttcttg

SEQ ID NO: 865987 - DNA, 25 bp, Mus musculus
acgctgccggctctcttccactgta

SEQ ID NO: 865988 - DNA, 25 bp, Mus musculus
acgctgccgggcatcgtcgttcttg

SEQ ID NO: 865989 - DNA, 25 bp, Mus musculus
acgctgccgggtctcttccactgta

SEQ ID NO: 865990 - DNA, 25 bp, Mus musculus
acgctgcgaccacgggagccccaga

SEQ ID NO: 865991 - DNA, 25 bp, Mus musculus
acgctgcgaccaggggagccccaga

SEQ ID NO: 865992 - DNA, 25 bp, Mus musculus
acgctgcgagcaagagccctgggga

SEQ ID NO: 865993 - DNA, 25 bp, Mus musculus
acgctgcgaggaagagccctgggga

SEQ ID NO: 865994 - DNA, 25 bp, Mus musculus
acgctgcgccaaattttcacctgac

SEQ ID NO: 865995 - DNA, 25 bp, Mus musculus
acgctgcgccaatttttcacctgac

SEQ ID NO: 865996 - DNA, 25 bp, Mus musculus
acgctgctggaaaagctgaagtggt

SEQ ID NO: 865997 - DNA, 25 bp, Mus musculus
acgctgctggaatagctgaagtggt

SEQ ID NO: 865998 - DNA, 25 bp, Mus musculus
acgctggaagcccatgcgatgccca

SEQ ID NO: 865999 - DNA, 25 bp, Mus musculus
acgctggaaggccatgcgatgccca

SEQ ID NO: 866000 - DNA, 25 bp, Mus musculus
acgctggacgccaacggtcatggag

SEQ ID NO: 866001 - DNA, 25 bp, Mus musculus
acgctggacgccaagggtcatggag

SEQ ID NO: 866002 - DNA, 25 bp, Mus musculus
acgctgggagagcaccgggaacttc

SEQ ID NO: 866003 - DNA, 25 bp, Mus musculus
acgctgggagagcacgaggtgtaaa

SEQ ID NO: 866004 - DNA, 25 bp, Mus musculus
acgctgggagagcagcgggaacttc

SEQ ID NO: 866005 - DNA, 25 bp, Mus musculus
acgctgggagagcaggaggtgtaaa

SEQ ID NO: 866006 - DNA, 25 bp, Mus musculus
acgctgggcactacgtcggtgactc

SEQ ID NO: 866007 - DNA, 25 bp, Mus musculus
acgctgggcagtacgtcggtgactc

SEQ ID NO: 866008 - DNA, 25 bp, Mus musculus
acgctggtcaaacgcatcatcgaca

SEQ ID NO: 866009 - DNA, 25 bp, Mus musculus
acgctggtcaaaggcatcatcgaca

SEQ ID NO: 866010 - DNA, 25 bp, Mus musculus
acgctggttcagatcacgtctaata

SEQ ID NO: 866011 - DNA, 25 bp, Mus musculus
acgctggttcagttcacgtctaata

SEQ ID NO: 866012 - DNA, 25 bp, Mus musculus
acgctgtcagctctgtctgcactcc

SEQ ID NO: 866013 - DNA, 25 bp, Mus musculus
acgctgtcaggtctgtctgcactcc

SEQ ID NO: 866014 - DNA, 25 bp, Mus musculus
acgctgtcagtcatcttttctttca

SEQ ID NO: 866015 - DNA, 25 bp, Mus musculus
acgctgtcagtcatgttttctttca

SEQ ID NO: 866016 - DNA, 25 bp, Mus musculus
acgctgtcctgtcgaggtgtaaaga

SEQ ID NO: 866017 - DNA, 25 bp, Mus musculus
acgctgtcctgtggaggtgtaaaga

SEQ ID NO: 866018 - DNA, 25 bp, Mus musculus
acgctgtgacagatctgagcactga

SEQ ID NO: 866019 - DNA, 25 bp, Mus musculus
acgctgtgacagcacctccgtccga

SEQ ID NO: 866020 - DNA, 25 bp, Mus musculus
acgctgtgacaggacctccgtccga

SEQ ID NO: 866021 - DNA, 25 bp, Mus musculus
acgctgtgacagttctgagcactga

SEQ ID NO: 866022 - DNA, 25 bp, Mus musculus
acgctgtgctcaatgagcaacataa

SEQ ID NO: 866023 - DNA, 25 bp, Mus musculus
acgctgtgctgaatgagcaacataa

SEQ ID NO: 866024 - DNA, 25 bp, Mus musculus
acgctgtgtcctgacgatctttcca

SEQ ID NO: 866025 - DNA, 25 bp, Mus musculus
acgctgtgtcctgactatcccaggc

SEQ ID NO: 866026 - DNA, 25 bp, Mus musculus
acgctgtgtcctgaggatctttcca

SEQ ID NO: 866027 - DNA, 25 bp, Mus musculus
acgctgtgtcctgagtatcccaggc

SEQ ID NO: 866028 - DNA, 25 bp, Mus musculus
acgcttacggactacgccagcaggt

SEQ ID NO: 866029 - DNA, 25 bp, Mus musculus
acgcttacggactacggccctgcac

SEQ ID NO: 866030 - DNA, 25 bp, Mus musculus
acgcttacggactaggccagcaggt

SEQ ID NO: 866031 - DNA, 25 bp, Mus musculus
acgcttacggactagggccctgcac

SEQ ID NO: 866032 - DNA, 25 bp, Mus musculus
acgcttactgcccgaacccagacaa

SEQ ID NO: 866033 - DNA, 25 bp, Mus musculus
acgcttactgccggaacccagacaa

SEQ ID NO: 866034 - DNA, 25 bp, Mus musculus
acgcttattaaacgtggagcacgag

SEQ ID NO: 866035 - DNA, 25 bp, Mus musculus
acgcttattaaaggtggagcacgag

SEQ ID NO: 866036 - DNA, 25 bp, Mus musculus
acgcttcaaatgcatagtcacatgc

SEQ ID NO: 866037 - DNA, 25 bp, Mus musculus
acgcttcaaatggatagtcacatgc

SEQ ID NO: 866038 - DNA, 25 bp, Mus musculus
acgcttcctgaacggatgggctctt

SEQ ID NO: 866039 - DNA, 25 bp, Mus musculus
acgcttcctgaagggatgggctctt

SEQ ID NO: 866040 - DNA, 25 bp, Mus musculus
acgcttgcaaagctgtgccaatatc

SEQ ID NO: 866041 - DNA, 25 bp, Mus musculus
acgcttgcaaaggtgtgccaatatc

SEQ ID NO: 866042 - DNA, 25 bp, Mus musculus
acgcttgccttgcttgctcctgcaa

SEQ ID NO: 866043 - DNA, 25 bp, Mus musculus
acgcttgccttggttgctcctgcaa

SEQ ID NO: 866044 - DNA, 25 bp, Mus musculus
acgctttggatgagccttcggaggc

SEQ ID NO: 866045 - DNA, 25 bp, Mus musculus
acgctttggatgagtgtgaactgga

SEQ ID NO: 866046 - DNA, 25 bp, Mus musculus
acgctttggatgcctcccggacctc

SEQ ID NO: 866047 - DNA, 25 bp, Mus musculus
acgctttggatgctgatgatgaaga

SEQ ID NO: 866048 - DNA, 25 bp, Mus musculus
acgctttggatggctcccggacctc

SEQ ID NO: 866049 - DNA, 25 bp, Mus musculus
acgctttggatggtgatgatgaaga

SEQ ID NO: 866050 - DNA, 25 bp, Mus musculus
acgctttggatgtgccttcggaggc

SEQ ID NO: 866051 - DNA, 25 bp, Mus musculus
acgctttggatgtgtgtgaactgga

SEQ ID NO: 866052 - DNA, 25 bp, Mus musculus
acgctttgtgatcgaagaggttcct

SEQ ID NO: 866053 - DNA, 25 bp, Mus musculus
acgctttgtgttcgaagaggttcct

SEQ ID NO: 866054 - DNA, 25 bp, Mus musculus
acgcttttgccacacaagcagtgaa

SEQ ID NO: 866055 - DNA, 25 bp, Mus musculus
acgcttttgccacgtgatggaaaac

SEQ ID NO: 866056 - DNA, 25 bp, Mus musculus
acgcttttgccagacaagcagtgaa

SEQ ID NO: 866057 - DNA, 25 bp, Mus musculus
acgcttttgccaggtgatggaaaac

SEQ ID NO: 866058 - DNA, 25 bp, Mus musculus
acggaaaaccagagtccagcctctg

SEQ ID NO: 866059 - DNA, 25 bp, Mus musculus
acggaaaaccagtgtccagcctctg

SEQ ID NO: 866060 - DNA, 25 bp, Mus musculus
acggaaagatattgagtcatataaa

SEQ ID NO: 866061 - DNA, 25 bp, Mus musculus
acggaaagatattgtgtcatataaa

SEQ ID NO: 866062 - DNA, 25 bp, Mus musculus
acggaaatagccaaatactgtggtc

SEQ ID NO: 866063 - DNA, 25 bp, Mus musculus
acggaaataggcaaatactgtggtc

SEQ ID NO: 866064 - DNA, 25 bp, Mus musculus
acggaaatctagagttctccagttt

SEQ ID NO: 866065 - DNA, 25 bp, Mus musculus
acggaaatctagtgttctccagttt

SEQ ID NO: 866066 - DNA, 25 bp, Mus musculus
acggaacaagaccttaacagaagat

SEQ ID NO: 866067 - DNA, 25 bp, Mus musculus
acggaacaagacgttaacagaagat

SEQ ID NO: 866068 - DNA, 25 bp, Mus musculus
acggaacaagctagatgccaccctg

SEQ ID NO: 866069 - DNA, 25 bp, Mus musculus
acggaacaaggtagatgccaccctg

SEQ ID NO: 866070 - DNA, 25 bp, Mus musculus
acggaactcgagaatgataccaatg

SEQ ID NO: 866071 - DNA, 25 bp, Mus musculus
acggaactcgctaagccgggcaagt

SEQ ID NO: 866072 - DNA, 25 bp, Mus musculus
acggaactcggtaagccgggcaagt

SEQ ID NO: 866073 - DNA, 25 bp, Mus musculus
acggaactcgtgaatgataccaatg

SEQ ID NO: 866074 - DNA, 25 bp, Mus musculus
acggaagaagaacatcagaaagcct

SEQ ID NO: 866075 - DNA, 25 bp, Mus musculus
acggaagaagtacatcagaaagcct

SEQ ID NO: 866076 - DNA, 25 bp, Mus musculus
acggaagacacgcagtatatatcct

SEQ ID NO: 866077 - DNA, 25 bp, Mus musculus
acggaagacacggagtatatatcct

SEQ ID NO: 866078 - DNA, 25 bp, Mus musculus
acggaagattaaagtgtggagacat

SEQ ID NO: 866079 - DNA, 25 bp, Mus musculus
acggaagattaatgtgtggagacat

SEQ ID NO: 866080 - DNA, 25 bp, Mus musculus
acggaaggtcaacaagtttgagcaa

SEQ ID NO: 866081 - DNA, 25 bp, Mus musculus
acggaaggtcaagaagtttgagcaa

SEQ ID NO: 866082 - DNA, 25 bp, Mus musculus
acggaagtgacacaatgaatcgcac

SEQ ID NO: 866083 - DNA, 25 bp, Mus musculus
acggaagtgacagaatgaatcgcac

SEQ ID NO: 866084 - DNA, 25 bp, Mus musculus
acggaattaaactacgcctgaggag

SEQ ID NO: 866085 - DNA, 25 bp, Mus musculus
acggaattaaactaggcctgaggag

SEQ ID NO: 866086 - DNA, 25 bp, Mus musculus
acggacacacagaatcgatcgatct

SEQ ID NO: 866087 - DNA, 25 bp, Mus musculus
acggacacacagtatcgatcgatct

SEQ ID NO: 866088 - DNA, 25 bp, Mus musculus
acggacagtgcccaatgctggcggt

SEQ ID NO: 866089 - DNA, 25 bp, Mus musculus
acggacagtgcccattgctggcggt

SEQ ID NO: 866090 - DNA, 25 bp, Mus musculus
acggaccaaatgcaatgaataaaat

SEQ ID NO: 866091 - DNA, 25 bp, Mus musculus
acggaccaaatggaatgaataaaat

SEQ ID NO: 866092 - DNA, 25 bp, Mus musculus
acggaccacaaggaacaccatatga

SEQ ID NO: 866093 - DNA, 25 bp, Mus musculus
acggaccacaaggatcaccatatga

SEQ ID NO: 866094 - DNA, 25 bp, Mus musculus
acggaccgcagaccggactatacaa

SEQ ID NO: 866095 - DNA, 25 bp, Mus musculus
acggaccgcagacggactatacaac

SEQ ID NO: 866096 - DNA, 25 bp, Mus musculus
acggaccgcagagcggactatacaa

SEQ ID NO: 866097 - DNA, 25 bp, Mus musculus
acggaccgcagagggactatacaac

SEQ ID NO: 866098 - DNA, 25 bp, Mus musculus
acggacctcccacgagctgcagatg

SEQ ID NO: 866099 - DNA, 25 bp, Mus musculus
acggacctcccaggagctgcagatg

SEQ ID NO: 866100 - DNA, 25 bp, Mus musculus
acggactgaggccacatcatggccc

SEQ ID NO: 866101 - DNA, 25 bp, Mus musculus
acggactgaggccagatcatggccc

SEQ ID NO: 866102 - DNA, 25 bp, Mus musculus
acggacttgatcctgagcccctgcc

SEQ ID NO: 866103 - DNA, 25 bp, Mus musculus
acggacttgatcgtgagcccctgcc

SEQ ID NO: 866104 - DNA, 25 bp, Mus musculus
acggagacaacccatccaactacta

SEQ ID NO: 866105 - DNA, 25 bp, Mus musculus
acggagacaaccgatccaactacta

SEQ ID NO: 866106 - DNA, 25 bp, Mus musculus
acggagacagattctatgaatttga

SEQ ID NO: 866107 - DNA, 25 bp, Mus musculus
acggagacagtttctatgaatttga

SEQ ID NO: 866108 - DNA, 25 bp, Mus musculus
acggagaccacactcaaaaaagttg

SEQ ID NO: 866109 - DNA, 25 bp, Mus musculus
acggagaccacagtcaaaaaagttg

SEQ ID NO: 866110 - DNA, 25 bp, Mus musculus
acggagactccacatgaggacgatg

SEQ ID NO: 866111 - DNA, 25 bp, Mus musculus
acggagactccacgccacaatggag

SEQ ID NO: 866112 - DNA, 25 bp, Mus musculus
acggagactccagatgaggacgatg

SEQ ID NO: 866113 - DNA, 25 bp, Mus musculus
acggagactccaggccacaatggag

SEQ ID NO: 866114 - DNA, 25 bp, Mus musculus
acggagactgagcatgaggctgtag

SEQ ID NO: 866115 - DNA, 25 bp, Mus musculus
acggagactgaggatgaggctgtag

SEQ ID NO: 866116 - DNA, 25 bp, Mus musculus
acggagagatagatctagctagtga

SEQ ID NO: 866117 - DNA, 25 bp, Mus musculus
acggagagatagttctagctagtga

SEQ ID NO: 866118 - DNA, 25 bp, Mus musculus
acggagattagccgagccaggtatg

SEQ ID NO: 866119 - DNA, 25 bp, Mus musculus
acggagattagcggagccaggtatg

SEQ ID NO: 866120 - DNA, 25 bp, Mus musculus
acggagcagatcaaagaaattggag

SEQ ID NO: 866121 - DNA, 25 bp, Mus musculus
acggagcagatcaatgaaattggag

SEQ ID NO: 866122 - DNA, 25 bp, Mus musculus
acggagcatgcttggagcctctctg

SEQ ID NO: 866123 - DNA, 25 bp, Mus musculus
acggagcatggttggagcctctctg

SEQ ID NO: 866124 - DNA, 25 bp, Mus musculus
acggagccagccatgagaagttgct

SEQ ID NO: 866125 - DNA, 25 bp, Mus musculus
acggagccagcgcatgaagctaccc

SEQ ID NO: 866126 - DNA, 25 bp, Mus musculus
acggagccagcggatgaagctaccc

SEQ ID NO: 866127 - DNA, 25 bp, Mus musculus
acggagccaggcatgagaagttgct

SEQ ID NO: 866128 - DNA, 25 bp, Mus musculus
acggagccgcgcgtctctccacaga

SEQ ID NO: 866129 - DNA, 25 bp, Mus musculus
acggagccgcgcgtgtctccacaga

SEQ ID NO: 866130 - DNA, 25 bp, Mus musculus
acggaggatgacccgcatggttcga

SEQ ID NO: 866131 - DNA, 25 bp, Mus musculus
acggaggatgaggatgaggaagaga

SEQ ID NO: 866132 - DNA, 25 bp, Mus musculus
acggaggatgtcccgcatggttcga

SEQ ID NO: 866133 - DNA, 25 bp, Mus musculus
acggaggatgtggatgaggaagaga

SEQ ID NO: 866134 - DNA, 25 bp, Mus musculus
acggaggcacagctttacacgccgc

SEQ ID NO: 866135 - DNA, 25 bp, Mus musculus
acggaggcacaggtttacacgccgc

SEQ ID NO: 866136 - DNA, 25 bp, Mus musculus
acggaggctgagatcactggagatt

SEQ ID NO: 866137 - DNA, 25 bp, Mus musculus
acggaggctgagttcactggagatt

SEQ ID NO: 866138 - DNA, 25 bp, Mus musculus
acggagggcactaaatcgtcctggg

SEQ ID NO: 866139 - DNA, 25 bp, Mus musculus
acggagggcagtaaatcgtcctggg

SEQ ID NO: 866140 - DNA, 25 bp, Mus musculus
acggagtctgagcgaaccttcagaa

SEQ ID NO: 866141 - DNA, 25 bp, Mus musculus
acggagtctgagggaaccttcagaa

SEQ ID NO: 866142 - DNA, 25 bp, Mus musculus
acggagtggtgccacctgggggctc

SEQ ID NO: 866143 - DNA, 25 bp, Mus musculus
acggagtggtgccagctgggggctc

SEQ ID NO: 866144 - DNA, 25 bp, Mus musculus
acggagttatagctatcagaagaga

SEQ ID NO: 866145 - DNA, 25 bp, Mus musculus
acggagttataggtatcagaagaga

SEQ ID NO: 866146 - DNA, 25 bp, Mus musculus
acggagttggagaatgataccaatg

SEQ ID NO: 866147 - DNA, 25 bp, Mus musculus
acggagttggtgaatgataccaatg

SEQ ID NO: 866148 - DNA, 25 bp, Mus musculus
acggatatttctcgttcttggaaca

SEQ ID NO: 866149 - DNA, 25 bp, Mus musculus
acggatatttctggttcttggaaca

SEQ ID NO: 866150 - DNA, 25 bp, Mus musculus
acggatcataaacagctgcgagtcc

SEQ ID NO: 866151 - DNA, 25 bp, Mus musculus
acggatcataaagagctgcgagtcc

SEQ ID NO: 866152 - DNA, 25 bp, Mus musculus
acggatccagaacgaactgactgat

SEQ ID NO: 866153 - DNA, 25 bp, Mus musculus
acggatccagaacgttgctttcact

SEQ ID NO: 866154 - DNA, 25 bp, Mus musculus
acggatccagaaggaactgactgat

SEQ ID NO: 866155 - DNA, 25 bp, Mus musculus
acggatccagaaggttgctttcact

SEQ ID NO: 866156 - DNA, 25 bp, Mus musculus
acggatccctggcctcgggcgatat

SEQ ID NO: 866157 - DNA, 25 bp, Mus musculus
acggatccctgggctcgggcgatat

SEQ ID NO: 866158 - DNA, 25 bp, Mus musculus
acggatctcagaaaataaccaaaga

SEQ ID NO: 866159 - DNA, 25 bp, Mus musculus
acggatctcagataataaccaaaga

SEQ ID NO: 866160 - DNA, 25 bp, Mus musculus
acggatgaaacattggcaggagatc

SEQ ID NO: 866161 - DNA, 25 bp, Mus musculus
acggatgaaagattggcaggagatc

SEQ ID NO: 866162 - DNA, 25 bp, Mus musculus
acggatttatcccacgatctgcagc

SEQ ID NO: 866163 - DNA, 25 bp, Mus musculus
acggatttatcccaggatctgcagc

SEQ ID NO: 866164 - DNA, 25 bp, Mus musculus
acggattttaaagacttgattccag

SEQ ID NO: 866165 - DNA, 25 bp, Mus musculus
acggattttaaagagttgattccag

SEQ ID NO: 866166 - DNA, 25 bp, Mus musculus
acggcaagtgtgaaccgtgtgctcc

SEQ ID NO: 866167 - DNA, 25 bp, Mus musculus
acggcaagtgtgtaccgtgtgctcc

SEQ ID NO: 866168 - DNA, 25 bp, Mus musculus
acggcactgcggctacctggcgctg

SEQ ID NO: 866169 - DNA, 25 bp, Mus musculus
acggcactgcgggtacctggcgctg

SEQ ID NO: 866170 - DNA, 25 bp, Mus musculus
acggcactggtgcacattctgggcc

SEQ ID NO: 866171 - DNA, 25 bp, Mus musculus
acggcactggtgcagattctgggcc

SEQ ID NO: 866172 - DNA, 25 bp, Mus musculus
acggcacttgtaccttggactctat

SEQ ID NO: 866173 - DNA, 25 bp, Mus musculus
acggcacttgtagcttggactctat

SEQ ID NO: 866174 - DNA, 25 bp, Mus musculus
acggcagagcctcacaatctatcac

SEQ ID NO: 866175 - DNA, 25 bp, Mus musculus
acggcagagcctcagaatctatcac

SEQ ID NO: 866176 - DNA, 25 bp, Mus musculus
acggcagaggagattaacaacatga

SEQ ID NO: 866177 - DNA, 25 bp, Mus musculus
acggcagaggagtttaacaacatga

SEQ ID NO: 866178 - DNA, 25 bp, Mus musculus
acggcagatgaggtacacggatgaa

SEQ ID NO: 866179 - DNA, 25 bp, Mus musculus
acggcagatgataatgttcactttc

SEQ ID NO: 866180 - DNA, 25 bp, Mus musculus
acggcagatgtggtacacggatgaa

SEQ ID NO: 866181 - DNA, 25 bp, Mus musculus
acggcagatgttaatgttcactttc

SEQ ID NO: 866182 - DNA, 25 bp, Mus musculus
acggcaggagctggtagatttgctg

SEQ ID NO: 866183 - DNA, 25 bp, Mus musculus
acggcaggaggtggtagatttgctg

SEQ ID NO: 866184 - DNA, 25 bp, Mus musculus
acggcaggtaatcagtattcatgat

SEQ ID NO: 866185 - DNA, 25 bp, Mus musculus
acggcaggtaatgagtattcatgat

SEQ ID NO: 866186 - DNA, 25 bp, Mus musculus
acggcatcagccgcagatagatcat

SEQ ID NO: 866187 - DNA, 25 bp, Mus musculus
acggcatcaggcgcagatagatcat

SEQ ID NO: 866188 - DNA, 25 bp, Mus musculus
acggcatccgggagggccatgcagt

SEQ ID NO: 866189 - DNA, 25 bp, Mus musculus
acggcatccgggtgggccatgcagt

SEQ ID NO: 866190 - DNA, 25 bp, Mus musculus
acggcatccggtctcacctcttcta

SEQ ID NO: 866191 - DNA, 25 bp, Mus musculus
acggcatccggtgtcacctcttcta

SEQ ID NO: 866192 - DNA, 25 bp, Mus musculus
acggcatgtacgctaacttgggtat

SEQ ID NO: 866193 - DNA, 25 bp, Mus musculus
acggcatgtacggtaacttgggtat

SEQ ID NO: 866194 - DNA, 25 bp, Mus musculus
acggccaagccccacgagtcggtga

SEQ ID NO: 866195 - DNA, 25 bp, Mus musculus
acggccaagccccaggagtcggtga

SEQ ID NO: 866196 - DNA, 25 bp, Mus musculus
acggccaaggccaccgagctctttg

SEQ ID NO: 866197 - DNA, 25 bp, Mus musculus
acggccaaggccacggagctctttg

SEQ ID NO: 866198 - DNA, 25 bp, Mus musculus
acggccaatgtgccaactcatgaag

SEQ ID NO: 866199 - DNA, 25 bp, Mus musculus
acggccaatgtggcaactcatgaag

SEQ ID NO: 866200 - DNA, 25 bp, Mus musculus
acggccacattgattttcctcgcat

SEQ ID NO: 866201 - DNA, 25 bp, Mus musculus
acggccacattgccctgtcagcctc

SEQ ID NO: 866202 - DNA, 25 bp, Mus musculus
acggccacattggcctgtcagcctc

SEQ ID NO: 866203 - DNA, 25 bp, Mus musculus
acggccacattgtttttcctcgcat

SEQ ID NO: 866204 - DNA, 25 bp, Mus musculus
acggccaggacactatagtggagat

SEQ ID NO: 866205 - DNA, 25 bp, Mus musculus
acggccaggacagtatagtggagat

SEQ ID NO: 866206 - DNA, 25 bp, Mus musculus
acggccccagaaattactgtgcttt

SEQ ID NO: 866207 - DNA, 25 bp, Mus musculus
acggccccagaagctgactgcggag

SEQ ID NO: 866208 - DNA, 25 bp, Mus musculus
acggccccagtaattactgtgcttt

SEQ ID NO: 866209 - DNA, 25 bp, Mus musculus
acggccccagtagctgactgcggag

SEQ ID NO: 866210 - DNA, 25 bp, Mus musculus
acggccgcagcaccatggcactgca

SEQ ID NO: 866211 - DNA, 25 bp, Mus musculus
acggccgcaggaccatggcactgca

SEQ ID NO: 866212 - DNA, 25 bp, Mus musculus
acggcctacactcttacgagaagcg

SEQ ID NO: 866213 - DNA, 25 bp, Mus musculus
acggcctacactgttacgagaagcg

SEQ ID NO: 866214 - DNA, 25 bp, Mus musculus
acggcctcgctggtcgctggagggg

SEQ ID NO: 866215 - DNA, 25 bp, Mus musculus
acggcctcgctggtggctggagggg

SEQ ID NO: 866216 - DNA, 25 bp, Mus musculus
acggcctgagagcctggtttccagc

SEQ ID NO: 866217 - DNA, 25 bp, Mus musculus
acggcctgagaggctggtttccagc

SEQ ID NO: 866218 - DNA, 25 bp, Mus musculus
acggccttgagtccatggccatgac

SEQ ID NO: 866219 - DNA, 25 bp, Mus musculus
acggccttgagtgcatggccatgac

SEQ ID NO: 866220 - DNA, 25 bp, Mus musculus
acggcgtggtcccaccgggaggctc

SEQ ID NO: 866221 - DNA, 25 bp, Mus musculus
acggcgtggtcccagcgggaggctc

SEQ ID NO: 866222 - DNA, 25 bp, Mus musculus
acggctacaatgatgtcgccattgg

SEQ ID NO: 866223 - DNA, 25 bp, Mus musculus
acggctacaatgttgtcgccattgg

SEQ ID NO: 866224 - DNA, 25 bp, Mus musculus
acggctccagaaagatgacaggaaa

SEQ ID NO: 866225 - DNA, 25 bp, Mus musculus
acggctccagtaagatgacaggaaa

SEQ ID NO: 866226 - DNA, 25 bp, Mus musculus
acggctcccccacctcctcacctgg

SEQ ID NO: 866227 - DNA, 25 bp, Mus musculus
acggctcccccagctcctcacctgg

SEQ ID NO: 866228 - DNA, 25 bp, Mus musculus
acggctcgggacgcagtggatatgg

SEQ ID NO: 866229 - DNA, 25 bp, Mus musculus
acggctcgggacgctgtggatatgg

SEQ ID NO: 866230 - DNA, 25 bp, Mus musculus
acggctgccgcgttgtgagccccgg

SEQ ID NO: 866231 - DNA, 25 bp, Mus musculus
acggctgccgggttgtgagccccgg

SEQ ID NO: 866232 - DNA, 25 bp, Mus musculus
acggctttgaagatattgctattgg

SEQ ID NO: 866233 - DNA, 25 bp, Mus musculus
acggctttgaagttattgctattgg

SEQ ID NO: 866234 - DNA, 25 bp, Mus musculus
acgggaaggacacgacagcaaggta

SEQ ID NO: 866235 - DNA, 25 bp, Mus musculus
acgggaaggacacgttcaactggag

SEQ ID NO: 866236 - DNA, 25 bp, Mus musculus
acgggaaggacaggacagcaaggta

SEQ ID NO: 866237 - DNA, 25 bp, Mus musculus
acgggaaggacaggttcaactggag

SEQ ID NO: 866238 - DNA, 25 bp, Mus musculus
acgggaatgaccctgactacatcgt

SEQ ID NO: 866239 - DNA, 25 bp, Mus musculus
acgggaatgaccgtgactacatcgt

SEQ ID NO: 866240 - DNA, 25 bp, Mus musculus
acgggacaagcaagctgttcgggct

SEQ ID NO: 866241 - DNA, 25 bp, Mus musculus
acgggacaagcaaggaagctgttcg

SEQ ID NO: 866242 - DNA, 25 bp, Mus musculus
acgggacaagcacgagctgctcaat

SEQ ID NO: 866243 - DNA, 25 bp, Mus musculus
acgggacaagcaggagctgctcaat

SEQ ID NO: 866244 - DNA, 25 bp, Mus musculus
acgggacaaggaagctgttcgggct

SEQ ID NO: 866245 - DNA, 25 bp, Mus musculus
acgggacaaggaaggaagctgttcg

SEQ ID NO: 866246 - DNA, 25 bp, Mus musculus
acgggacgctgcgacgaagagccct

SEQ ID NO: 866247 - DNA, 25 bp, Mus musculus
acgggacgctgcgaggaagagccct

SEQ ID NO: 866248 - DNA, 25 bp, Mus musculus
acgggactgtgaaatgggcctgctc

SEQ ID NO: 866249 - DNA, 25 bp, Mus musculus
acgggactgtgatatgggcctgctc

SEQ ID NO: 866250 - DNA, 25 bp, Mus musculus
acgggatcacagctatatccattcc

SEQ ID NO: 866251 - DNA, 25 bp, Mus musculus
acgggatcacaggtatatccattcc

SEQ ID NO: 866252 - DNA, 25 bp, Mus musculus
acgggattgaatattgcctggatga

SEQ ID NO: 866253 - DNA, 25 bp, Mus musculus
acgggattgattattgcctggatga

SEQ ID NO: 866254 - DNA, 25 bp, Mus musculus
acgggcaggtgacacgcatcgactg

SEQ ID NO: 866255 - DNA, 25 bp, Mus musculus
acgggcaggtgacaggcatcgactg

SEQ ID NO: 866256 - DNA, 25 bp, Mus musculus
acgggcataaagcttacatatatgg

SEQ ID NO: 866257 - DNA, 25 bp, Mus musculus
acgggcataaaggttacatatatgg

SEQ ID NO: 866258 - DNA, 25 bp, Mus musculus
acgggcattgcccacgtgaaaatcc

SEQ ID NO: 866259 - DNA, 25 bp, Mus musculus
acgggcattgcccaggtgaaaatcc

SEQ ID NO: 866260 - DNA, 25 bp, Mus musculus
acgggccccgcacccacagccgccg

SEQ ID NO: 866261 - DNA, 25 bp, Mus musculus
acgggccccgcagccacagccgccg

SEQ ID NO: 866262 - DNA, 25 bp, Mus musculus
acgggccgtccgagcatgtggatga

SEQ ID NO: 866263 - DNA, 25 bp, Mus musculus
acgggccgtccgaggatgtggatga

SEQ ID NO: 866264 - DNA, 25 bp, Mus musculus
acgggctgagatctcttgatgctat

SEQ ID NO: 866265 - DNA, 25 bp, Mus musculus
acgggctgagctctgtgcagacgtt

SEQ ID NO: 866266 - DNA, 25 bp, Mus musculus
acgggctgaggtctgtgcagacgtt

SEQ ID NO: 866267 - DNA, 25 bp, Mus musculus
acgggctgagttctcttgatgctat

SEQ ID NO: 866268 - DNA, 25 bp, Mus musculus
acgggctgattccacttacttcctg

SEQ ID NO: 866269 - DNA, 25 bp, Mus musculus
acgggctgattccagttacttcctg

SEQ ID NO: 866270 - DNA, 25 bp, Mus musculus
acgggctgctggaaagggataaaca

SEQ ID NO: 866271 - DNA, 25 bp, Mus musculus
acgggctgctggtaagggataaaca

SEQ ID NO: 866272 - DNA, 25 bp, Mus musculus
acggggaaagagctagctgtgaaga

SEQ ID NO: 866273 - DNA, 25 bp, Mus musculus
acggggaaagaggtagctgtgaaga

SEQ ID NO: 866274 - DNA, 25 bp, Mus musculus
acggggccagccatcgtggctgggg

SEQ ID NO: 866275 - DNA, 25 bp, Mus musculus
acggggccagccatcttcatgctgc

SEQ ID NO: 866276 - DNA, 25 bp, Mus musculus
acggggccagccatggtggctgggg

SEQ ID NO: 866277 - DNA, 25 bp, Mus musculus
acggggccaggcatcttcatgctgc

SEQ ID NO: 866278 - DNA, 25 bp, Mus musculus
acggggctgcagctcacagcggagt

SEQ ID NO: 866279 - DNA, 25 bp, Mus musculus
acggggctgcaggtcacagcggagt

SEQ ID NO: 866280 - DNA, 25 bp, Mus musculus
acggggctgtctatggagtcaaaat

SEQ ID NO: 866281 - DNA, 25 bp, Mus musculus
acggggctgtgtatggagtcaaaat

SEQ ID NO: 866282 - DNA, 25 bp, Mus musculus
acggggtagtgcaacgtggagtgtc

SEQ ID NO: 866283 - DNA, 25 bp, Mus musculus
acggggtagtgcaaggtggagtgtc

SEQ ID NO: 866284 - DNA, 25 bp, Mus musculus
acgggtatgagtcgcccaggatggg

SEQ ID NO: 866285 - DNA, 25 bp, Mus musculus
acgggtatgagtggcccaggatggg

SEQ ID NO: 866286 - DNA, 25 bp, Mus musculus
acgggtcctgctcaagtgccctatc

SEQ ID NO: 866287 - DNA, 25 bp, Mus musculus
acgggtcctgctcatgtgccctatc

SEQ ID NO: 866288 - DNA, 25 bp, Mus musculus
acgggtgatgctcgacaagtgggag

SEQ ID NO: 866289 - DNA, 25 bp, Mus musculus
acgggtgatgctggacaagtgggag

SEQ ID NO: 866290 - DNA, 25 bp, Mus musculus
acgggtgtcgcccacgtgaagatca

SEQ ID NO: 866291 - DNA, 25 bp, Mus musculus
acgggtgtcgcccaggtgaagatca

SEQ ID NO: 866292 - DNA, 25 bp, Mus musculus
acggtacaccacgtccacctctgtt

SEQ ID NO: 866293 - DNA, 25 bp, Mus musculus
acggtacaccacgtgcacctctgtt

SEQ ID NO: 866294 - DNA, 25 bp, Mus musculus
acggtacctgcattgtgcttcttct

SEQ ID NO: 866295 - DNA, 25 bp, Mus musculus
acggtacctggattgtgcttcttct

SEQ ID NO: 866296 - DNA, 25 bp, Mus musculus
acggtcaataagcctgtggctctgg

SEQ ID NO: 866297 - DNA, 25 bp, Mus musculus
acggtcaataaggctgtggctctgg

SEQ ID NO: 866298 - DNA, 25 bp, Mus musculus
acggtcacctatgacaatgatgtca

SEQ ID NO: 866299 - DNA, 25 bp, Mus musculus
acggtcacctatgagaatgatgtca

SEQ ID NO: 866300 - DNA, 25 bp, Mus musculus
acggtcatcgatgaagttcgcaccg

SEQ ID NO: 866301 - DNA, 25 bp, Mus musculus
acggtcatcgttgaagttcgcaccg

SEQ ID NO: 866302 - DNA, 25 bp, Mus musculus
acggtcctagcctcagcgttctcac

SEQ ID NO: 866303 - DNA, 25 bp, Mus musculus
acggtcctaggctcagcgttctcac

SEQ ID NO: 866304 - DNA, 25 bp, Mus musculus
acggtcctttcccggatgcagctca

SEQ ID NO: 866305 - DNA, 25 bp, Mus musculus
acggtcctttccgggatgcagctca

SEQ ID NO: 866306 - DNA, 25 bp, Mus musculus
acggtcgagtggaaagcacaatcca

SEQ ID NO: 866307 - DNA, 25 bp, Mus musculus
acggtcgagtggtaagcacaatcca

SEQ ID NO: 866308 - DNA, 25 bp, Mus musculus
acggtctgattaaacaaattggaga

SEQ ID NO: 866309 - DNA, 25 bp, Mus musculus
acggtctgattatacaaattggaga

SEQ ID NO: 866310 - DNA, 25 bp, Mus musculus
acggtgaagccacgcaaagttataa

SEQ ID NO: 866311 - DNA, 25 bp, Mus musculus
acggtgaagccaggcaaagttataa

SEQ ID NO: 866312 - DNA, 25 bp, Mus musculus
acggtgaatccacgtttgatctgtg

SEQ ID NO: 866313 - DNA, 25 bp, Mus musculus
acggtgaatccaggtttgatctgtg

SEQ ID NO: 866314 - DNA, 25 bp, Mus musculus
acggtgacatcgttattgatgaaga

SEQ ID NO: 866315 - DNA, 25 bp, Mus musculus
acggtgacatggttattgatgaaga

SEQ ID NO: 866316 - DNA, 25 bp, Mus musculus
acggtgatgacgatggcacctgtga

SEQ ID NO: 866317 - DNA, 25 bp, Mus musculus
acggtgatgacgttggcacctgtga

SEQ ID NO: 866318 - DNA, 25 bp, Mus musculus
acggtgctgccacaggaagacctca

SEQ ID NO: 866319 - DNA, 25 bp, Mus musculus
acggtgctgccagaggaagacctca

SEQ ID NO: 866320 - DNA, 25 bp, Mus musculus
acggttctagatccctttcagctcc

SEQ ID NO: 866321 - DNA, 25 bp, Mus musculus
acggttctagttccctttcagctcc

SEQ ID NO: 866322 - DNA, 25 bp, Mus musculus
acgtacatctcgctacgaataagta

SEQ ID NO: 866323 - DNA, 25 bp, Mus musculus
acgtacatctcggtacgaataagta

SEQ ID NO: 866324 - DNA, 25 bp, Mus musculus
acgtacctagaacaccacgctgcag

SEQ ID NO: 866325 - DNA, 25 bp, Mus musculus
acgtacctagtacaccacgctgcag

SEQ ID NO: 866326 - DNA, 25 bp, Mus musculus
acgtacctcacgccaagtgctttag

SEQ ID NO: 866327 - DNA, 25 bp, Mus musculus
acgtacctcaggccaagtgctttag

SEQ ID NO: 866328 - DNA, 25 bp, Mus musculus
acgtagccaaagcgatgcattactt

SEQ ID NO: 866329 - DNA, 25 bp, Mus musculus
acgtagccaaagggatgcattactt

SEQ ID NO: 866330 - DNA, 25 bp, Mus musculus
acgtagtcaagcacattgaaagcaa

SEQ ID NO: 866331 - DNA, 25 bp, Mus musculus
acgtagtcaagctcattgaaagcaa

SEQ ID NO: 866332 - DNA, 25 bp, Mus musculus
acgtatgatgcaaatttctatggca

SEQ ID NO: 866333 - DNA, 25 bp, Mus musculus
acgtatgatggaaatttctatggca

SEQ ID NO: 866334 - DNA, 25 bp, Mus musculus
acgtatgcagcctctgcctggtacc

SEQ ID NO: 866335 - DNA, 25 bp, Mus musculus
acgtatgcaggctctgcctggtacc

SEQ ID NO: 866336 - DNA, 25 bp, Mus musculus
acgtcaaccctccacaaagccatcg

SEQ ID NO: 866337 - DNA, 25 bp, Mus musculus
acgtcaaccctccagaaagccatcg

SEQ ID NO: 866338 - DNA, 25 bp, Mus musculus
acgtcacagtagaacagcctccacg

SEQ ID NO: 866339 - DNA, 25 bp, Mus musculus
acgtcacagtagaagagcctccacg

SEQ ID NO: 866340 - DNA, 25 bp, Mus musculus
acgtcacgagcgaccgtgaaggtga

SEQ ID NO: 866341 - DNA, 25 bp, Mus musculus
acgtcacgagggaccgtgaaggtga

SEQ ID NO: 866342 - DNA, 25 bp, Mus musculus
acgtcagccaagatgtccagagctg

SEQ ID NO: 866343 - DNA, 25 bp, Mus musculus
acgtcagccaagttgtccagagctg

SEQ ID NO: 866344 - DNA, 25 bp, Mus musculus
acgtcagttcccaacttatttcaca

SEQ ID NO: 866345 - DNA, 25 bp, Mus musculus
acgtcagttcccaagttatttcaca

SEQ ID NO: 866346 - DNA, 25 bp, Mus musculus
acgtcagttgttcgatcgaaatgtg

SEQ ID NO: 866347 - DNA, 25 bp, Mus musculus
acgtcagttgttggatcgaaatgtg

SEQ ID NO: 866348 - DNA, 25 bp, Mus musculus
acgtcatcctacaccgcatcgacgg

SEQ ID NO: 866349 - DNA, 25 bp, Mus musculus
acgtcatcctacacggcatcgacgg

SEQ ID NO: 866350 - DNA, 25 bp, Mus musculus
acgtccaggataaactcttcgtacc

SEQ ID NO: 866351 - DNA, 25 bp, Mus musculus
acgtccaggatatactcttcgtacc

SEQ ID NO: 866352 - DNA, 25 bp, Mus musculus
acgtccaggatatgaactcttcgta

SEQ ID NO: 866353 - DNA, 25 bp, Mus musculus
acgtccaggatatgtactcttcgta

SEQ ID NO: 866354 - DNA, 25 bp, Mus musculus
acgtcgacgacacggaacgaatgga

SEQ ID NO: 866355 - DNA, 25 bp, Mus musculus
acgtcgacgacagggaacgaatgga

SEQ ID NO: 866356 - DNA, 25 bp, Mus musculus
acgtcgcaagctcatcaaacaggcc

SEQ ID NO: 866357 - DNA, 25 bp, Mus musculus
acgtcgcaaggtcatcaaacaggcc

SEQ ID NO: 866358 - DNA, 25 bp, Mus musculus
acgtcgcggccgcatggcggacaag

SEQ ID NO: 866359 - DNA, 25 bp, Mus musculus
acgtcgcggccggatggcggacaag

SEQ ID NO: 866360 - DNA, 25 bp, Mus musculus
acgtcggagcagctcaaaagcttga

SEQ ID NO: 866361 - DNA, 25 bp, Mus musculus
acgtcggagcagctgaaaagcttga

SEQ ID NO: 866362 - DNA, 25 bp, Mus musculus
acgtcgtgtgccatgtgggcacatt

SEQ ID NO: 866363 - DNA, 25 bp, Mus musculus
acgtcgtgtggcatgtgggcacatt

SEQ ID NO: 866364 - DNA, 25 bp, Mus musculus
acgtctatgcaaaacgtataaatcc

SEQ ID NO: 866365 - DNA, 25 bp, Mus musculus
acgtctatgcaaaactgcttcaccg

SEQ ID NO: 866366 - DNA, 25 bp, Mus musculus
acgtctatgcaaaaggtataaatcc

SEQ ID NO: 866367 - DNA, 25 bp, Mus musculus
acgtctatgcaaaagtgcttcaccg

SEQ ID NO: 866368 - DNA, 25 bp, Mus musculus
acgtctcaagcctatgcttctggca

SEQ ID NO: 866369 - DNA, 25 bp, Mus musculus
acgtctcaaggctatgcttctggca

SEQ ID NO: 866370 - DNA, 25 bp, Mus musculus
acgtctcacgagcaccatgacttct

SEQ ID NO: 866371 - DNA, 25 bp, Mus musculus
acgtctcacgaggaccatgacttct

SEQ ID NO: 866372 - DNA, 25 bp, Mus musculus
acgtctctgtggacacagaagccat

SEQ ID NO: 866373 - DNA, 25 bp, Mus musculus
acgtctctgtggtcacagaagccat

SEQ ID NO: 866374 - DNA, 25 bp, Mus musculus
acgtctgcaccacacccacaggctg

SEQ ID NO: 866375 - DNA, 25 bp, Mus musculus
acgtctgcaccagacccacaggctg

SEQ ID NO: 866376 - DNA, 25 bp, Mus musculus
acgtctgcattgaatgtaactgtaa

SEQ ID NO: 866377 - DNA, 25 bp, Mus musculus
acgtctgcattgtatgtaactgtaa

SEQ ID NO: 866378 - DNA, 25 bp, Mus musculus
acgtctgcccctgtgctgatgtcaa

SEQ ID NO: 866379 - DNA, 25 bp, Mus musculus
acgtctgcccgtgtgctgatgtcaa

SEQ ID NO: 866380 - DNA, 25 bp, Mus musculus
acgtcttccagccggttgataaaga

SEQ ID NO: 866381 - DNA, 25 bp, Mus musculus
acgtcttccagcgggttgataaaga

SEQ ID NO: 866382 - DNA, 25 bp, Mus musculus
acgtctttgaccatccatgggaaac

SEQ ID NO: 866383 - DNA, 25 bp, Mus musculus
acgtctttgacttattggtgcagca

SEQ ID NO: 866384 - DNA, 25 bp, Mus musculus
acgtctttgagcatccatgggaaac

SEQ ID NO: 866385 - DNA, 25 bp, Mus musculus
acgtctttgagttattggtgcagca

SEQ ID NO: 866386 - DNA, 25 bp, Mus musculus
acgtgaacagctggttggactggca

SEQ ID NO: 866387 - DNA, 25 bp, Mus musculus
acgtgaacaggtggttggactggca

SEQ ID NO: 866388 - DNA, 25 bp, Mus musculus
acgtgaacttctacatgtttatagg

SEQ ID NO: 866389 - DNA, 25 bp, Mus musculus
acgtgaacttgtacatgtttatagg

SEQ ID NO: 866390 - DNA, 25 bp, Mus musculus
acgtgaagagagggcacatctgctg

SEQ ID NO: 866391 - DNA, 25 bp, Mus musculus
acgtgaagagtgggcacatctgctg

SEQ ID NO: 866392 - DNA, 25 bp, Mus musculus
acgtgaagcccgccaacaaggaacg

SEQ ID NO: 866393 - DNA, 25 bp, Mus musculus
acgtgaagcccggcaacaaggaacg

SEQ ID NO: 866394 - DNA, 25 bp, Mus musculus
acgtgaccagaatggcaagaagaag

SEQ ID NO: 866395 - DNA, 25 bp, Mus musculus
acgtgaccagtatggcaagaagaag

SEQ ID NO: 866396 - DNA, 25 bp, Mus musculus
acgtgaccgactccgggacgcagat

SEQ ID NO: 866397 - DNA, 25 bp, Mus musculus
acgtgaccgagtccgggacgcagat

SEQ ID NO: 866398 - DNA, 25 bp, Mus musculus
acgtgacgagcgcagaactttccaa

SEQ ID NO: 866399 - DNA, 25 bp, Mus musculus
acgtgacgagggcagaactttccaa

SEQ ID NO: 866400 - DNA, 25 bp, Mus musculus
acgtgagccttctacacctcacccc

SEQ ID NO: 866401 - DNA, 25 bp, Mus musculus
acgtgagccttctagacctcacccc

SEQ ID NO: 866402 - DNA, 25 bp, Mus musculus
acgtgatcgttacgactggagagag

SEQ ID NO: 866403 - DNA, 25 bp, Mus musculus
acgtgatcgttaggactggagagag

SEQ ID NO: 866404 - DNA, 25 bp, Mus musculus
acgtgcaaagctttctgcaaagatg

SEQ ID NO: 866405 - DNA, 25 bp, Mus musculus
acgtgcaaaggtttctgcaaagatg

SEQ ID NO: 866406 - DNA, 25 bp, Mus musculus
acgtgcatcgagacatgtgcagtga

SEQ ID NO: 866407 - DNA, 25 bp, Mus musculus
acgtgcatcgtgacatgtgcagtga

SEQ ID NO: 866408 - DNA, 25 bp, Mus musculus
acgtgccaagcccagcactatggtg

SEQ ID NO: 866409 - DNA, 25 bp, Mus musculus
acgtgccaaggccagcactatggtg

SEQ ID NO: 866410 - DNA, 25 bp, Mus musculus
acgtgccctgcgcatcctaatcgtg

SEQ ID NO: 866411 - DNA, 25 bp, Mus musculus
acgtgccctgcggatcctaatcgtg

SEQ ID NO: 866412 - DNA, 25 bp, Mus musculus
acgtgcgataggctgtctataaccc

SEQ ID NO: 866413 - DNA, 25 bp, Mus musculus
acgtgcgatagggtgtctataaccc

SEQ ID NO: 866414 - DNA, 25 bp, Mus musculus
acgtgcgcccagacccagcacccca

SEQ ID NO: 866415 - DNA, 25 bp, Mus musculus
acgtgcgcccagtcccagcacccca

SEQ ID NO: 866416 - DNA, 25 bp, Mus musculus
acgtgctcagagcagagcctctaaa

SEQ ID NO: 866417 - DNA, 25 bp, Mus musculus
acgtgctcagccctttgttcaggcc

SEQ ID NO: 866418 - DNA, 25 bp, Mus musculus
acgtgctcaggcctttgttcaggcc

SEQ ID NO: 866419 - DNA, 25 bp, Mus musculus
acgtgctcagtgcagagcctctaaa

SEQ ID NO: 866420 - DNA, 25 bp, Mus musculus
acgtgctcgccaccaagtagcatct

SEQ ID NO: 866421 - DNA, 25 bp, Mus musculus
acgtgctcgccagcaagtagcatct

SEQ ID NO: 866422 - DNA, 25 bp, Mus musculus
acgtgctgctcctacgcaatgacta

SEQ ID NO: 866423 - DNA, 25 bp, Mus musculus
acgtgctgctcctaggcaatgacta

SEQ ID NO: 866424 - DNA, 25 bp, Mus musculus
acgtgctggtagccccacagaacat

SEQ ID NO: 866425 - DNA, 25 bp, Mus musculus
acgtgctggtaggcccacagaacat

SEQ ID NO: 866426 - DNA, 25 bp, Mus musculus
acgtgcttggcgccgcctgtgagag

SEQ ID NO: 866427 - DNA, 25 bp, Mus musculus
acgtgcttggcggcgcctgtgagag

SEQ ID NO: 866428 - DNA, 25 bp, Mus musculus
acgtggaacaagagctagccattga

SEQ ID NO: 866429 - DNA, 25 bp, Mus musculus
acgtggaacaagtgctagccattga

SEQ ID NO: 866430 - DNA, 25 bp, Mus musculus
acgtggaaggcattttgtgactttt

SEQ ID NO: 866431 - DNA, 25 bp, Mus musculus
acgtggaaggccttgatcctgctcc

SEQ ID NO: 866432 - DNA, 25 bp, Mus musculus
acgtggaagggattttgtgactttt

SEQ ID NO: 866433 - DNA, 25 bp, Mus musculus
acgtggaagggcttgatcctgctcc

SEQ ID NO: 866434 - DNA, 25 bp, Mus musculus
acgtggacatctacactttccccaa

SEQ ID NO: 866435 - DNA, 25 bp, Mus musculus
acgtggacatctactctttccccaa

SEQ ID NO: 866436 - DNA, 25 bp, Mus musculus
acgtggactcagacatataaagaac

SEQ ID NO: 866437 - DNA, 25 bp, Mus musculus
acgtggactcagtcatataaagaac

SEQ ID NO: 866438 - DNA, 25 bp, Mus musculus
acgtggatgatgagttcctgcgggt

SEQ ID NO: 866439 - DNA, 25 bp, Mus musculus
acgtggatgatgtgttcctgcgggt

SEQ ID NO: 866440 - DNA, 25 bp, Mus musculus
acgtggcctccacaagccaccatgg

SEQ ID NO: 866441 - DNA, 25 bp, Mus musculus
acgtggcctccagaagccaccatgg

SEQ ID NO: 866442 - DNA, 25 bp, Mus musculus
acgtggcgctgtatactccatgttt

SEQ ID NO: 866443 - DNA, 25 bp, Mus musculus
acgtggcgctgtttactccatgttt

SEQ ID NO: 866444 - DNA, 25 bp, Mus musculus
acgtggcttgcacacgcatagcctg

SEQ ID NO: 866445 - DNA, 25 bp, Mus musculus
acgtggcttgcagacgcatagcctg

SEQ ID NO: 866446 - DNA, 25 bp, Mus musculus
acgtgggagcagcaactgtggaatt

SEQ ID NO: 866447 - DNA, 25 bp, Mus musculus
acgtgggagcaggaactgtggaatt

SEQ ID NO: 866448 - DNA, 25 bp, Mus musculus
acgtggtcagccactggcaggactc

SEQ ID NO: 866449 - DNA, 25 bp, Mus musculus
acgtggtcaggcactggcaggactc

SEQ ID NO: 866450 - DNA, 25 bp, Mus musculus
acgtggtgagttcacgtactcagtt

SEQ ID NO: 866451 - DNA, 25 bp, Mus musculus
acgtggtgagttcaggtactcagtt

SEQ ID NO: 866452 - DNA, 25 bp, Mus musculus
acgtgtacaacactccaaccaacca

SEQ ID NO: 866453 - DNA, 25 bp, Mus musculus
acgtgtacaacactgcaaccaacca

SEQ ID NO: 866454 - DNA, 25 bp, Mus musculus
acgtgtcataatatcattgacaact

SEQ ID NO: 866455 - DNA, 25 bp, Mus musculus
acgtgtcatattatcattgacaact

SEQ ID NO: 866456 - DNA, 25 bp, Mus musculus
acgtgtccgtgacagaagaggaagt

SEQ ID NO: 866457 - DNA, 25 bp, Mus musculus
acgtgtccgtgagagaagaggaagt

SEQ ID NO: 866458 - DNA, 25 bp, Mus musculus
acgtgtcgccagagtggaaggggag

SEQ ID NO: 866459 - DNA, 25 bp, Mus musculus
acgtgtcgccagctcagccatgtca

SEQ ID NO: 866460 - DNA, 25 bp, Mus musculus
acgtgtcgccaggtcagccatgtca

SEQ ID NO: 866461 - DNA, 25 bp, Mus musculus
acgtgtcgccagtgtggaaggggag

SEQ ID NO: 866462 - DNA, 25 bp, Mus musculus
acgtgtctgaagagcaggtgctggg

SEQ ID NO: 866463 - DNA, 25 bp, Mus musculus
acgtgtctgaagaggaggtgctggg

SEQ ID NO: 866464 - DNA, 25 bp, Mus musculus
acgtgtgcagcgtcctgtgggcact

SEQ ID NO: 866465 - DNA, 25 bp, Mus musculus
acgtgtgcagggtcctgtgggcact

SEQ ID NO: 866466 - DNA, 25 bp, Mus musculus
acgtgtgctagacacgtggaaggct

SEQ ID NO: 866467 - DNA, 25 bp, Mus musculus
acgtgtgctagacaggtggaaggct

SEQ ID NO: 866468 - DNA, 25 bp, Mus musculus
acgtgtgtgcccgtcgtatcgatgt

SEQ ID NO: 866469 - DNA, 25 bp, Mus musculus
acgtgtgtgcccgtggtatcgatgt

SEQ ID NO: 866470 - DNA, 25 bp, Mus musculus
acgtgtgttgagcagcccaccgcaa

SEQ ID NO: 866471 - DNA, 25 bp, Mus musculus
acgtgtgttgaggagcccaccgcaa

SEQ ID NO: 866472 - DNA, 25 bp, Mus musculus
acgtgttagtcacagccacctgtat

SEQ ID NO: 866473 - DNA, 25 bp, Mus musculus
acgtgttagtcagagccacctgtat

SEQ ID NO: 866474 - DNA, 25 bp, Mus musculus
acgttacaaacacattgttctaaca

SEQ ID NO: 866475 - DNA, 25 bp, Mus musculus
acgttacaaacagattgttctaaca

SEQ ID NO: 866476 - DNA, 25 bp, Mus musculus
acgttatgctcaaggaaggatatga

SEQ ID NO: 866477 - DNA, 25 bp, Mus musculus
acgttatgctcatggaaggatatga

SEQ ID NO: 866478 - DNA, 25 bp, Mus musculus
acgttcagagcttcatcgtgggatc

SEQ ID NO: 866479 - DNA, 25 bp, Mus musculus
acgttcagaggttcatcgtgggatc

SEQ ID NO: 866480 - DNA, 25 bp, Mus musculus
acgttcatcgagcacctgaagaagt

SEQ ID NO: 866481 - DNA, 25 bp, Mus musculus
acgttcatcgaggacctgaagaagt

SEQ ID NO: 866482 - DNA, 25 bp, Mus musculus
acgttccgagcccataaggaagctg

SEQ ID NO: 866483 - DNA, 25 bp, Mus musculus
acgttccgaggccataaggaagctg

SEQ ID NO: 866484 - DNA, 25 bp, Mus musculus
acgttccggaagctgcagcttcaac

SEQ ID NO: 866485 - DNA, 25 bp, Mus musculus
acgttccggaaggtgcagcttcaac

SEQ ID NO: 866486 - DNA, 25 bp, Mus musculus
acgttcgcaactcacggatgattga

SEQ ID NO: 866487 - DNA, 25 bp, Mus musculus
acgttcgcaagtcacggatgattga

SEQ ID NO: 866488 - DNA, 25 bp, Mus musculus
acgttctctgagccgcagtaacagc

SEQ ID NO: 866489 - DNA, 25 bp, Mus musculus
acgttctctgaggcgcagtaacagc

SEQ ID NO: 866490 - DNA, 25 bp, Mus musculus
acgttcttccagaagatggacaaaa

SEQ ID NO: 866491 - DNA, 25 bp, Mus musculus
acgttcttccagtagatggacaaaa

SEQ ID NO: 866492 - DNA, 25 bp, Mus musculus
acgttgccgaatttgtcctggatga

SEQ ID NO: 866493 - DNA, 25 bp, Mus musculus
acgttgccgacaacctgccagatgt

SEQ ID NO: 866494 - DNA, 25 bp, Mus musculus
acgttgccgacttcctggtggctga

SEQ ID NO: 866495 - DNA, 25 bp, Mus musculus
acgttgccgagaacctgccagatgt

SEQ ID NO: 866496 - DNA, 25 bp, Mus musculus
acgttgccgagttcctggtggctga

SEQ ID NO: 866497 - DNA, 25 bp, Mus musculus
acgttgccgattttgtcctggatga

SEQ ID NO: 866498 - DNA, 25 bp, Mus musculus
acgttggtctcgctgctcttagtag

SEQ ID NO: 866499 - DNA, 25 bp, Mus musculus
acgttggtctcggtgctcttagtag

SEQ ID NO: 866500 - DNA, 25 bp, Mus musculus
acgttgtattcaaccgcttctttga

SEQ ID NO: 866501 - DNA, 25 bp, Mus musculus
acgttgtattcaacggcttctttga

SEQ ID NO: 866502 - DNA, 25 bp, Mus musculus
acgttgtcatcacaccttagcgctc

SEQ ID NO: 866503 - DNA, 25 bp, Mus musculus
acgttgtcatcacagcttagcgctc

SEQ ID NO: 866504 - DNA, 25 bp, Mus musculus
acgttttcattgagatctctgggct

SEQ ID NO: 866505 - DNA, 25 bp, Mus musculus
acgttttcattgtgatctctgggct

SEQ ID NO: 866506 - DNA, 25 bp, Mus musculus
actaaaaaaatccatgataccatct

SEQ ID NO: 866507 - DNA, 25 bp, Mus musculus
actaaaaaaatcgatgataccatct

SEQ ID NO: 866508 - DNA, 25 bp, Mus musculus
actaaaacagccatcaggaaagaat

SEQ ID NO: 866509 - DNA, 25 bp, Mus musculus
actaaaacaggcatcaggaaagaat

SEQ ID NO: 866510 - DNA, 25 bp, Mus musculus
actaaaagaagacatgcaaagctta

SEQ ID NO: 866511 - DNA, 25 bp, Mus musculus
actaaaagaagagatgcaaagctta

SEQ ID NO: 866512 - DNA, 25 bp, Mus musculus
actaaacactctacaggatgactgg

SEQ ID NO: 866513 - DNA, 25 bp, Mus musculus
actaaacactctactggatgactgg

SEQ ID NO: 866514 - DNA, 25 bp, Mus musculus
actaaactaaagattgcgcagctgt

SEQ ID NO: 866515 - DNA, 25 bp, Mus musculus
actaaactaaagtttgcgcagctgt

SEQ ID NO: 866516 - DNA, 25 bp, Mus musculus
actaaatattaactcatgttcgttc

SEQ ID NO: 866517 - DNA, 25 bp, Mus musculus
actaaatattaagtcatgttcgttc

SEQ ID NO: 866518 - DNA, 25 bp, Mus musculus
actaacagagcctgtggtggattct

SEQ ID NO: 866519 - DNA, 25 bp, Mus musculus
actaacagaggctgtggtggattct

SEQ ID NO: 866520 - DNA, 25 bp, Mus musculus
actaacatctaacgtgccaagtgct

SEQ ID NO: 866521 - DNA, 25 bp, Mus musculus
actaacatctaaggtgccaagtgct

SEQ ID NO: 866522 - DNA, 25 bp, Mus musculus
actaacattcagaggaaatatctga

SEQ ID NO: 866523 - DNA, 25 bp, Mus musculus
actaacattcagtggaaatatctga

SEQ ID NO: 866524 - DNA, 25 bp, Mus musculus
actaaccatcatgacatatctgcca

SEQ ID NO: 866525 - DNA, 25 bp, Mus musculus
actaaccatcatgagatatctgcca

SEQ ID NO: 866526 - DNA, 25 bp, Mus musculus
actaacctctctcacgttgtacggc

SEQ ID NO: 866527 - DNA, 25 bp, Mus musculus
actaacctctctcaggttgtacggc

SEQ ID NO: 866528 - DNA, 25 bp, Mus musculus
actaactatatggaccaacctcgga

SEQ ID NO: 866529 - DNA, 25 bp, Mus musculus
actaactatatggagcaacctcgga

SEQ ID NO: 866530 - DNA, 25 bp, Mus musculus
actaactctgagaacgtctattaca

SEQ ID NO: 866531 - DNA, 25 bp, Mus musculus
actaactctgagaaggtctattaca

SEQ ID NO: 866532 - DNA, 25 bp, Mus musculus
actaagacagcttgaagaagagaaa

SEQ ID NO: 866533 - DNA, 25 bp, Mus musculus
actaagacaggttgaagaagagaaa

SEQ ID NO: 866534 - DNA, 25 bp, Mus musculus
actaagagagcacacccgtctgaaa

SEQ ID NO: 866535 - DNA, 25 bp, Mus musculus
actaagagagcagacccgtctgaaa

SEQ ID NO: 866536 - DNA, 25 bp, Mus musculus
actaagagcccacgttgtctgttct

SEQ ID NO: 866537 - DNA, 25 bp, Mus musculus
actaagagcccactgccatgtcgga

SEQ ID NO: 866538 - DNA, 25 bp, Mus musculus
actaagagcccaggttgtctgttct

SEQ ID NO: 866539 - DNA, 25 bp, Mus musculus
actaagagcccagtgccatgtcgga

SEQ ID NO: 866540 - DNA, 25 bp, Mus musculus
actaagcatttagaatgcacaaaac

SEQ ID NO: 866541 - DNA, 25 bp, Mus musculus
actaagcatttagattgcacaaaac

SEQ ID NO: 866542 - DNA, 25 bp, Mus musculus
actaagccagatggcacagtggagg

SEQ ID NO: 866543 - DNA, 25 bp, Mus musculus
actaagccagatgggacagtggagg

SEQ ID NO: 866544 - DNA, 25 bp, Mus musculus
actaagcctttgcttcacagcagcc

SEQ ID NO: 866545 - DNA, 25 bp, Mus musculus
actaagcctttggttcacagcagcc

SEQ ID NO: 866546 - DNA, 25 bp, Mus musculus
actaataaagaagtgtgctggtgtc

SEQ ID NO: 866547 - DNA, 25 bp, Mus musculus
actaataaagtagtgtgctggtgtc

SEQ ID NO: 866548 - DNA, 25 bp, Mus musculus
actaatagttaacggtcgtgcatct

SEQ ID NO: 866549 - DNA, 25 bp, Mus musculus
actaatagttaagggtcgtgcatct

SEQ ID NO: 866550 - DNA, 25 bp, Mus musculus
actaatcaaaatacgcctactatta

SEQ ID NO: 866551 - DNA, 25 bp, Mus musculus
actaatcaaactggacccaacagta

SEQ ID NO: 866552 - DNA, 25 bp, Mus musculus
actaatcaaagtggacccaacagta

SEQ ID NO: 866553 - DNA, 25 bp, Mus musculus
actaatcaaattacgcctactatta

SEQ ID NO: 866554 - DNA, 25 bp, Mus musculus
actaatgagaagattcaagttgtgt

SEQ ID NO: 866555 - DNA, 25 bp, Mus musculus
actaatgagaagtttcaagttgtgt

SEQ ID NO: 866556 - DNA, 25 bp, Mus musculus
actaatggaatgcgcattatattta

SEQ ID NO: 866557 - DNA, 25 bp, Mus musculus
actaatggaatgcgccttgcattta

SEQ ID NO: 866558 - DNA, 25 bp, Mus musculus
actaatggaatgggcattatattta

SEQ ID NO: 866559 - DNA, 25 bp, Mus musculus
actaatggaatgggccttgcattta

SEQ ID NO: 866560 - DNA, 25 bp, Mus musculus
actaattgatgacatggttggtaaa

SEQ ID NO: 866561 - DNA, 25 bp, Mus musculus
actaattgatgagatggttggtaaa

SEQ ID NO: 866562 - DNA, 25 bp, Mus musculus
actaatttagagatgaaatccttca

SEQ ID NO: 866563 - DNA, 25 bp, Mus musculus
actaatttagagcggctccatagac

SEQ ID NO: 866564 - DNA, 25 bp, Mus musculus
actaatttagaggggctccatagac

SEQ ID NO: 866565 - DNA, 25 bp, Mus musculus
actaatttagagttgaaatccttca

SEQ ID NO: 866566 - DNA, 25 bp, Mus musculus
actacaaagctccacgtggagtgtc

SEQ ID NO: 866567 - DNA, 25 bp, Mus musculus
actacaaagctccaggtggagtgtc

SEQ ID NO: 866568 - DNA, 25 bp, Mus musculus
actacaaagctgcagtatgaacagg

SEQ ID NO: 866569 - DNA, 25 bp, Mus musculus
actacaaagctggagtatgaacagg

SEQ ID NO: 866570 - DNA, 25 bp, Mus musculus
actacaaccactcacggcttcacac

SEQ ID NO: 866571 - DNA, 25 bp, Mus musculus
actacaaccactcagggcttcacac

SEQ ID NO: 866572 - DNA, 25 bp, Mus musculus
actacaagagcgttatgatcatagc

SEQ ID NO: 866573 - DNA, 25 bp, Mus musculus
actacaagagggttatgatcatagc

SEQ ID NO: 866574 - DNA, 25 bp, Mus musculus
actacaagatccacaggtgggagaa

SEQ ID NO: 866575 - DNA, 25 bp, Mus musculus
actacaagatccactggtgggagaa

SEQ ID NO: 866576 - DNA, 25 bp, Mus musculus
actacaaggtatatgggtatgtgac

SEQ ID NO: 866577 - DNA, 25 bp, Mus musculus
actacaaggtttatgggtatgtgac

SEQ ID NO: 866578 - DNA, 25 bp, Mus musculus
actacaataactgtttcctcaatgt

SEQ ID NO: 866579 - DNA, 25 bp, Mus musculus
actacaataagtgtttcctcaatgt

SEQ ID NO: 866580 - DNA, 25 bp, Mus musculus
actacacaagcacaccacggccctg

SEQ ID NO: 866581 - DNA, 25 bp, Mus musculus
actacacaagcacagcacggccctg

SEQ ID NO: 866582 - DNA, 25 bp, Mus musculus
actacacgagacctgtgttcctgtg

SEQ ID NO: 866583 - DNA, 25 bp, Mus musculus
actacacgagtcctgtgttcctgtg

SEQ ID NO: 866584 - DNA, 25 bp, Mus musculus
actacacttctggacaccacatgtg

SEQ ID NO: 866585 - DNA, 25 bp, Mus musculus
actacacttctggacgaaaatatgt

SEQ ID NO: 866586 - DNA, 25 bp, Mus musculus
actacacttctggagaccacatgtg

SEQ ID NO: 866587 - DNA, 25 bp, Mus musculus
actacacttctggaggaaaatatgt

SEQ ID NO: 866588 - DNA, 25 bp, Mus musculus
actacagactggatgggaacttctc

SEQ ID NO: 866589 - DNA, 25 bp, Mus musculus
actacagactggttgggaacttctc

SEQ ID NO: 866590 - DNA, 25 bp, Mus musculus
actacagagagacacgccatccatt

SEQ ID NO: 866591 - DNA, 25 bp, Mus musculus
actacagagagacaggccatccatt

SEQ ID NO: 866592 - DNA, 25 bp, Mus musculus
actacagcagcccagaagcacccaa

SEQ ID NO: 866593 - DNA, 25 bp, Mus musculus
actacagcaggccagaagcacccaa

SEQ ID NO: 866594 - DNA, 25 bp, Mus musculus
actacatcagctgcatcaagccaaa

SEQ ID NO: 866595 - DNA, 25 bp, Mus musculus
actacatcaggtgcatcaagccaaa

SEQ ID NO: 866596 - DNA, 25 bp, Mus musculus
actacatgaagacgctgtgaggaaa

SEQ ID NO: 866597 - DNA, 25 bp, Mus musculus
actacatgaagaggctgtgaggaaa

SEQ ID NO: 866598 - DNA, 25 bp, Mus musculus
actacatgcaatacttagctgccac

SEQ ID NO: 866599 - DNA, 25 bp, Mus musculus
actacatgcaattcttagctgccac

SEQ ID NO: 866600 - DNA, 25 bp, Mus musculus
actacattagcttatttgggaatag

SEQ ID NO: 866601 - DNA, 25 bp, Mus musculus
actacattaggttatttgggaatag

SEQ ID NO: 866602 - DNA, 25 bp, Mus musculus
actacattatatatgcaagttctgc

SEQ ID NO: 866603 - DNA, 25 bp, Mus musculus
actacattatatctacatcaaatgg

SEQ ID NO: 866604 - DNA, 25 bp, Mus musculus
actacattatatgtacatcaaatgg

SEQ ID NO: 866605 - DNA, 25 bp, Mus musculus
actacattatatttgcaagttctgc

SEQ ID NO: 866606 - DNA, 25 bp, Mus musculus
actaccaacaagcactcagacttgt

SEQ ID NO: 866607 - DNA, 25 bp, Mus musculus
actaccaacaaggactcagacttgt

SEQ ID NO: 866608 - DNA, 25 bp, Mus musculus
actaccaggcagctgatgacaccga

SEQ ID NO: 866609 - DNA, 25 bp, Mus musculus
actaccaggcaggtgatgacaccga

SEQ ID NO: 866610 - DNA, 25 bp, Mus musculus
actaccatgcagcttactccatgtt

SEQ ID NO: 866611 - DNA, 25 bp, Mus musculus
actaccatgcaggttactccatgtt

SEQ ID NO: 866612 - DNA, 25 bp, Mus musculus
actacccaggcgctggatgggctgt

SEQ ID NO: 866613 - DNA, 25 bp, Mus musculus
actacccaggggctggatgggctgt

SEQ ID NO: 866614 - DNA, 25 bp, Mus musculus
actaccccgggacgcaccaggatca

SEQ ID NO: 866615 - DNA, 25 bp, Mus musculus
actaccccgggaggcaccaggatca

SEQ ID NO: 866616 - DNA, 25 bp, Mus musculus
actaccgccaagggcagcccattcc

SEQ ID NO: 866617 - DNA, 25 bp, Mus musculus
actaccgccatgggcagcccattcc

SEQ ID NO: 866618 - DNA, 25 bp, Mus musculus
actacctcaacagacatttgctcca

SEQ ID NO: 866619 - DNA, 25 bp, Mus musculus
actacctcaacagagatttgctcca

SEQ ID NO: 866620 - DNA, 25 bp, Mus musculus
actacctcagtgctaatcattgcag

SEQ ID NO: 866621 - DNA, 25 bp, Mus musculus
actacctcagtggtaatcattgcag

SEQ ID NO: 866622 - DNA, 25 bp, Mus musculus
actacctctggatgacgtcacgctg

SEQ ID NO: 866623 - DNA, 25 bp, Mus musculus
actacctctggatgagtcttcggag

SEQ ID NO: 866624 - DNA, 25 bp, Mus musculus
actacctctggatgatgaacagcgt

SEQ ID NO: 866625 - DNA, 25 bp, Mus musculus
actacctctggatgtcgtcacgctg

SEQ ID NO: 866626 - DNA, 25 bp, Mus musculus
actacctctggatgtgtcttcggag

SEQ ID NO: 866627 - DNA, 25 bp, Mus musculus
actacctctggatgttgaacagcgt

SEQ ID NO: 866628 - DNA, 25 bp, Mus musculus
actacctcttagctctctttgagcc

SEQ ID NO: 866629 - DNA, 25 bp, Mus musculus
actacctcttaggtctctttgagcc

SEQ ID NO: 866630 - DNA, 25 bp, Mus musculus
actacctctttaaacatactatcgt

SEQ ID NO: 866631 - DNA, 25 bp, Mus musculus
actacctctttaaagatactatcgt

SEQ ID NO: 866632 - DNA, 25 bp, Mus musculus
actacctgagcctttttggcaccac

SEQ ID NO: 866633 - DNA, 25 bp, Mus musculus
actacctgaggctttttggcaccac

SEQ ID NO: 866634 - DNA, 25 bp, Mus musculus
actacctgcggaaggttcaggataa

SEQ ID NO: 866635 - DNA, 25 bp, Mus musculus
actacctgcggatggttcaggataa

SEQ ID NO: 866636 - DNA, 25 bp, Mus musculus
actacctgtgaggacacgaagacag

SEQ ID NO: 866637 - DNA, 25 bp, Mus musculus
actacctgtgaggagacgaagacag

SEQ ID NO: 866638 - DNA, 25 bp, Mus musculus
actacgagtacccgcatgtcatgtt

SEQ ID NO: 866639 - DNA, 25 bp, Mus musculus
actacgagtaccggcatgtcatgtt

SEQ ID NO: 866640 - DNA, 25 bp, Mus musculus
actacgggagattcttggcaccaac

SEQ ID NO: 866641 - DNA, 25 bp, Mus musculus
actacgggagtttcttggcaccaac

SEQ ID NO: 866642 - DNA, 25 bp, Mus musculus
actacgtcagcctgttcggcatcaa

SEQ ID NO: 866643 - DNA, 25 bp, Mus musculus
actacgtcaggctgttcggcatcaa

SEQ ID NO: 866644 - DNA, 25 bp, Mus musculus
actacgtggcagctggatcagacat

SEQ ID NO: 866645 - DNA, 25 bp, Mus musculus
actacgtggcaggtggatcagacat

SEQ ID NO: 866646 - DNA, 25 bp, Mus musculus
actacgttgaacacctcaaccagaa

SEQ ID NO: 866647 - DNA, 25 bp, Mus musculus
actacgttgatcacctcaaccagaa

SEQ ID NO: 866648 - DNA, 25 bp, Mus musculus
actactacagcaaacttctgcgcta

SEQ ID NO: 866649 - DNA, 25 bp, Mus musculus
actactacaggaaacttctgcgcta

SEQ ID NO: 866650 - DNA, 25 bp, Mus musculus
actactacatctccaaacctatcta

SEQ ID NO: 866651 - DNA, 25 bp, Mus musculus
actactacatctgcaaacctatcta

SEQ ID NO: 866652 - DNA, 25 bp, Mus musculus
actactacgaagctggcataggaga

SEQ ID NO: 866653 - DNA, 25 bp, Mus musculus
actactacgaaggtggcataggaga

SEQ ID NO: 866654 - DNA, 25 bp, Mus musculus
actactcacctgcttcaaccagatg

SEQ ID NO: 866655 - DNA, 25 bp, Mus musculus
actactcacctggttcaaccagatg

SEQ ID NO: 866656 - DNA, 25 bp, Mus musculus
actactcactcacggatgactatga

SEQ ID NO: 866657 - DNA, 25 bp, Mus musculus
actactcactcagggatgactatga

SEQ ID NO: 866658 - DNA, 25 bp, Mus musculus
actactcgtccacctcaagtctctg

SEQ ID NO: 866659 - DNA, 25 bp, Mus musculus
actactcgtccagctcaagtctctg

SEQ ID NO: 866660 - DNA, 25 bp, Mus musculus
actactgcagagcctgaagagatcc

SEQ ID NO: 866661 - DNA, 25 bp, Mus musculus
actactgcagaggctgaagagatcc

SEQ ID NO: 866662 - DNA, 25 bp, Mus musculus
actactgcagccagcggccccgcct

SEQ ID NO: 866663 - DNA, 25 bp, Mus musculus
actactgcaggcagcggccccgcct

SEQ ID NO: 866664 - DNA, 25 bp, Mus musculus
actactggagccactgccagtcaga

SEQ ID NO: 866665 - DNA, 25 bp, Mus musculus
actactggagcctctgccagtcaga

SEQ ID NO: 866666 - DNA, 25 bp, Mus musculus
actactggcacgatcctcaccacga

SEQ ID NO: 866667 - DNA, 25 bp, Mus musculus
actactggcacgttcctcaccacga

SEQ ID NO: 866668 - DNA, 25 bp, Mus musculus
actactggccctcctctctgctctc

SEQ ID NO: 866669 - DNA, 25 bp, Mus musculus
actactggccctgctctctgctctc

SEQ ID NO: 866670 - DNA, 25 bp, Mus musculus
actactgttcaaaaacgaacaccaa

SEQ ID NO: 866671 - DNA, 25 bp, Mus musculus
actactgttcaaaatcgaacaccaa

SEQ ID NO: 866672 - DNA, 25 bp, Mus musculus
actacttgaatacaccactcctgaa

SEQ ID NO: 866673 - DNA, 25 bp, Mus musculus
actacttgaatacagcactcctgaa

SEQ ID NO: 866674 - DNA, 25 bp, Mus musculus
actagaaaaagacctataccaagag

SEQ ID NO: 866675 - DNA, 25 bp, Mus musculus
actagaaaaagagctataccaagag

SEQ ID NO: 866676 - DNA, 25 bp, Mus musculus
actagaaaagcacacacgagctaaa

SEQ ID NO: 866677 - DNA, 25 bp, Mus musculus
actagaaaagcacagacgagctaaa

SEQ ID NO: 866678 - DNA, 25 bp, Mus musculus
actagaaacccacaactggagcaag

SEQ ID NO: 866679 - DNA, 25 bp, Mus musculus
actagaaacccagaactggagcaag

SEQ ID NO: 866680 - DNA, 25 bp, Mus musculus
actagaactgatcacgacagcagaa

SEQ ID NO: 866681 - DNA, 25 bp, Mus musculus
actagaactgatcaggacagcagaa

SEQ ID NO: 866682 - DNA, 25 bp, Mus musculus
actagaatcagcaacactacagatg

SEQ ID NO: 866683 - DNA, 25 bp, Mus musculus
actagaatcagcaagactacagatg

SEQ ID NO: 866684 - DNA, 25 bp, Mus musculus
actagacaagatgtcttgggaaggc

SEQ ID NO: 866685 - DNA, 25 bp, Mus musculus
actagacaagttgtcttgggaaggc

SEQ ID NO: 866686 - DNA, 25 bp, Mus musculus
actagaccagaactttgtctatgta

SEQ ID NO: 866687 - DNA, 25 bp, Mus musculus
actagaccagaagtttgtctatgta

SEQ ID NO: 866688 - DNA, 25 bp, Mus musculus
actagagttgttaggagaacactga

SEQ ID NO: 866689 - DNA, 25 bp, Mus musculus
actagagttgtttggagaacactga

SEQ ID NO: 866690 - DNA, 25 bp, Mus musculus
actagattttagcaggtcaatggcc

SEQ ID NO: 866691 - DNA, 25 bp, Mus musculus
actagattttaggaggtcaatggcc

SEQ ID NO: 866692 - DNA, 25 bp, Mus musculus
actagcaaatcacaagttacgagac

SEQ ID NO: 866693 - DNA, 25 bp, Mus musculus
actagcaaatcacgaggtgcttgtc

SEQ ID NO: 866694 - DNA, 25 bp, Mus musculus
actagcaaatcagaagttacgagac

SEQ ID NO: 866695 - DNA, 25 bp, Mus musculus
actagcaaatcaggaggtgcttgtc

SEQ ID NO: 866696 - DNA, 25 bp, Mus musculus
actagcaatcagaacccaagagatg

SEQ ID NO: 866697 - DNA, 25 bp, Mus musculus
actagcaatcagtacccaagagatg

SEQ ID NO: 866698 - DNA, 25 bp, Mus musculus
actagccagaaacgtccacaccagt

SEQ ID NO: 866699 - DNA, 25 bp, Mus musculus
actagccagaaactttcaggccatc

SEQ ID NO: 866700 - DNA, 25 bp, Mus musculus
actagccagaaaggtccacaccagt

SEQ ID NO: 866701 - DNA, 25 bp, Mus musculus
actagccagaaagtttcaggccatc

SEQ ID NO: 866702 - DNA, 25 bp, Mus musculus
actagctaagcctcaaactcagaaa

SEQ ID NO: 866703 - DNA, 25 bp, Mus musculus
actagctaaggctcaaactcagaaa

SEQ ID NO: 866704 - DNA, 25 bp, Mus musculus
actagctcttcacctctggggacac

SEQ ID NO: 866705 - DNA, 25 bp, Mus musculus
actagctcttcacgactgggcagct

SEQ ID NO: 866706 - DNA, 25 bp, Mus musculus
actagctcttcagctctggggacac

SEQ ID NO: 866707 - DNA, 25 bp, Mus musculus
actagctcttcaggactgggcagct

SEQ ID NO: 866708 - DNA, 25 bp, Mus musculus
actagggaagctcccggatgttgcg

SEQ ID NO: 866709 - DNA, 25 bp, Mus musculus
actagggaaggtcccggatgttgcg

SEQ ID NO: 866710 - DNA, 25 bp, Mus musculus
actaggttttcacgtcatcttcaca

SEQ ID NO: 866711 - DNA, 25 bp, Mus musculus
actaggttttcaggtcatcttcaca

SEQ ID NO: 866712 - DNA, 25 bp, Mus musculus
actagtatttccaactttcactcag

SEQ ID NO: 866713 - DNA, 25 bp, Mus musculus
actagtatttccaagtttcactcag

SEQ ID NO: 866714 - DNA, 25 bp, Mus musculus
actagtccagttcggttgccatcta

SEQ ID NO: 866715 - DNA, 25 bp, Mus musculus
actagtccagttgggttgccatcta

SEQ ID NO: 866716 - DNA, 25 bp, Mus musculus
actagtgactaccacgttatttctg

SEQ ID NO: 866717 - DNA, 25 bp, Mus musculus
actagtgactaccaggttatttctg

SEQ ID NO: 866718 - DNA, 25 bp, Mus musculus
actataaaggcactcgttactacac

SEQ ID NO: 866719 - DNA, 25 bp, Mus musculus
actataaaggcactggttactacac

SEQ ID NO: 866720 - DNA, 25 bp, Mus musculus
actataaagtcgaaaaatatgaaag

SEQ ID NO: 866721 - DNA, 25 bp, Mus musculus
actataaagtcgtaaaatatgaaag

SEQ ID NO: 866722 - DNA, 25 bp, Mus musculus
actataaccagacactggatatttg

SEQ ID NO: 866723 - DNA, 25 bp, Mus musculus
actataaccagacagtggatatttg

SEQ ID NO: 866724 - DNA, 25 bp, Mus musculus
actataccaccagaaacatcttgcc

SEQ ID NO: 866725 - DNA, 25 bp, Mus musculus
actataccacgagaaacatcttgcc

SEQ ID NO: 866726 - DNA, 25 bp, Mus musculus
actataccagctctggagaagacat

SEQ ID NO: 866727 - DNA, 25 bp, Mus musculus
actataccaggtctggagaagacat

SEQ ID NO: 866728 - DNA, 25 bp, Mus musculus
actatagcatagcaaaccttcaaaa

SEQ ID NO: 866729 - DNA, 25 bp, Mus musculus
actatagcataggaaaccttcaaaa

SEQ ID NO: 866730 - DNA, 25 bp, Mus musculus
actatagctctcagctcagtacaag

SEQ ID NO: 866731 - DNA, 25 bp, Mus musculus
actatagctctccaggtcaatggcc

SEQ ID NO: 866732 - DNA, 25 bp, Mus musculus
actatagctctcgaggtcaatggcc

SEQ ID NO: 866733 - DNA, 25 bp, Mus musculus
actatagctctctgctcagtacaag

SEQ ID NO: 866734 - DNA, 25 bp, Mus musculus
actatagtgttatgatttgattcca

SEQ ID NO: 866735 - DNA, 25 bp, Mus musculus
actatagtgttatgttttgattcca

SEQ ID NO: 866736 - DNA, 25 bp, Mus musculus
actatatcaaccacgagacccaaac

SEQ ID NO: 866737 - DNA, 25 bp, Mus musculus
actatatcaagcacgagacccaaac

SEQ ID NO: 866738 - DNA, 25 bp, Mus musculus
actatattgagaaacttgttgcaat

SEQ ID NO: 866739 - DNA, 25 bp, Mus musculus
actatattgagaaagttgttgcaat

SEQ ID NO: 866740 - DNA, 25 bp, Mus musculus
actatatttcgtattctcatcgcag

SEQ ID NO: 866741 - DNA, 25 bp, Mus musculus
actatatttcgttttctcatcgcag

SEQ ID NO: 866742 - DNA, 25 bp, Mus musculus
actatcaaagaattctgcagatgct

SEQ ID NO: 866743 - DNA, 25 bp, Mus musculus
actatcaaagtattctgcagatgct

SEQ ID NO: 866744 - DNA, 25 bp, Mus musculus
actatcaaatgaaacgttctggaga

SEQ ID NO: 866745 - DNA, 25 bp, Mus musculus
actatcaaatgaaaggttctggaga

SEQ ID NO: 866746 - DNA, 25 bp, Mus musculus
actatcaacaagaacgaccccagca

SEQ ID NO: 866747 - DNA, 25 bp, Mus musculus
actatcaacaagaaggaccccagca

SEQ ID NO: 866748 - DNA, 25 bp, Mus musculus
actatcaagaagcgtgtgactgagt

SEQ ID NO: 866749 - DNA, 25 bp, Mus musculus
actatcaagaagggtgtgactgagt

SEQ ID NO: 866750 - DNA, 25 bp, Mus musculus
actatcacagacacgtgcgaccgca

SEQ ID NO: 866751 - DNA, 25 bp, Mus musculus
actatcacagaccatctagaagcaa

SEQ ID NO: 866752 - DNA, 25 bp, Mus musculus
actatcacagacgatctagaagcaa

SEQ ID NO: 866753 - DNA, 25 bp, Mus musculus
actatcacagactcgtgcgaccgca

SEQ ID NO: 866754 - DNA, 25 bp, Mus musculus
actatcacagattcagctccagagt

SEQ ID NO: 866755 - DNA, 25 bp, Mus musculus
actatcacagtttcagctccagagt

SEQ ID NO: 866756 - DNA, 25 bp, Mus musculus
actatcgggggccaccgttatcagg

SEQ ID NO: 866757 - DNA, 25 bp, Mus musculus
actatcgggggccagcgttatcagg

SEQ ID NO: 866758 - DNA, 25 bp, Mus musculus
actatcgtgaagctgcacaggatct

SEQ ID NO: 866759 - DNA, 25 bp, Mus musculus
actatcgtgaaggtgcacaggatct

SEQ ID NO: 866760 - DNA, 25 bp, Mus musculus
actatcttgtaaccgtggggatgtc

SEQ ID NO: 866761 - DNA, 25 bp, Mus musculus
actatcttgtaagcgtggggatgtc

SEQ ID NO: 866762 - DNA, 25 bp, Mus musculus
actatgaactttatatggctatttc

SEQ ID NO: 866763 - DNA, 25 bp, Mus musculus
actatgaactttttatggctatttc

SEQ ID NO: 866764 - DNA, 25 bp, Mus musculus
actatgacagagataagcggttccc

SEQ ID NO: 866765 - DNA, 25 bp, Mus musculus
actatgacagtgataagcggttccc

SEQ ID NO: 866766 - DNA, 25 bp, Mus musculus
actatgactgagcgaagtcaaatat

SEQ ID NO: 866767 - DNA, 25 bp, Mus musculus
actatgactgagggaagtcaaatat

SEQ ID NO: 866768 - DNA, 25 bp, Mus musculus
actatgactgcatcggccacaatga

SEQ ID NO: 866769 - DNA, 25 bp, Mus musculus
actatgactggatcggccacaatga

SEQ ID NO: 866770 - DNA, 25 bp, Mus musculus
actatgccgataatatcaaagccca

SEQ ID NO: 866771 - DNA, 25 bp, Mus musculus
actatgccgatattatcaaagccca

SEQ ID NO: 866772 - DNA, 25 bp, Mus musculus
actatgctggagataattatgtcca

SEQ ID NO: 866773 - DNA, 25 bp, Mus musculus
actatgctggagttaattatgtcca

SEQ ID NO: 866774 - DNA, 25 bp, Mus musculus
actatgggaaagagattctgaaaag

SEQ ID NO: 866775 - DNA, 25 bp, Mus musculus
actatgggaaagtgattctgaaaag

SEQ ID NO: 866776 - DNA, 25 bp, Mus musculus
actatgggaagctgcccttcaacct

SEQ ID NO: 866777 - DNA, 25 bp, Mus musculus
actatgggaagctggccttcaacct

SEQ ID NO: 866778 - DNA, 25 bp, Mus musculus
actatggtaaagatccctcaagaac

SEQ ID NO: 866779 - DNA, 25 bp, Mus musculus
actatggtaaagttccctcaagaac

SEQ ID NO: 866780 - DNA, 25 bp, Mus musculus
actatgtcccatctccccctgaaag

SEQ ID NO: 866781 - DNA, 25 bp, Mus musculus
actatgtcccatctgcccctgaaag

SEQ ID NO: 866782 - DNA, 25 bp, Mus musculus
actatgtgcaagacggcccccttga

SEQ ID NO: 866783 - DNA, 25 bp, Mus musculus
actatgtgcaagtcggcccccttga

SEQ ID NO: 866784 - DNA, 25 bp, Mus musculus
actatgtggaagaccgcaaggggat

SEQ ID NO: 866785 - DNA, 25 bp, Mus musculus
actatgtggaagacggcaaggggat

SEQ ID NO: 866786 - DNA, 25 bp, Mus musculus
actattagatgtatatgcaggtccc

SEQ ID NO: 866787 - DNA, 25 bp, Mus musculus
actattagatgtttatgcaggtccc

SEQ ID NO: 866788 - DNA, 25 bp, Mus musculus
actattattcagctgtggaaagaaa

SEQ ID NO: 866789 - DNA, 25 bp, Mus musculus
actattattcaggtgtggaaagaaa

SEQ ID NO: 866790 - DNA, 25 bp, Mus musculus
actattattccccgtgtggaatatt

SEQ ID NO: 866791 - DNA, 25 bp, Mus musculus
actattattcccggtgtggaatatt

SEQ ID NO: 866792 - DNA, 25 bp, Mus musculus
actattgcaatacaaagtgccagaa

SEQ ID NO: 866793 - DNA, 25 bp, Mus musculus
actattgcaatagaaagtgccagaa

SEQ ID NO: 866794 - DNA, 25 bp, Mus musculus
actattgctaagctgacaagcaaga

SEQ ID NO: 866795 - DNA, 25 bp, Mus musculus
actattgctaaggtgacaagcaaga

SEQ ID NO: 866796 - DNA, 25 bp, Mus musculus
actattggctggccaatgaatgcag

SEQ ID NO: 866797 - DNA, 25 bp, Mus musculus
actattggctgggcaatgaatgcag

SEQ ID NO: 866798 - DNA, 25 bp, Mus musculus
actattggtgagcttccaatttcat

SEQ ID NO: 866799 - DNA, 25 bp, Mus musculus
actattggtgaggttccaatttcat

SEQ ID NO: 866800 - DNA, 25 bp, Mus musculus
actcaaaaggagagagaaaattcat

SEQ ID NO: 866801 - DNA, 25 bp, Mus musculus
actcaaaaggagctctgtggggctt

SEQ ID NO: 866802 - DNA, 25 bp, Mus musculus
actcaaaaggaggtctgtggggctt

SEQ ID NO: 866803 - DNA, 25 bp, Mus musculus
actcaaaaggagtgagaaaattcat

SEQ ID NO: 866804 - DNA, 25 bp, Mus musculus
actcaaagcaacccaaagccacgga

SEQ ID NO: 866805 - DNA, 25 bp, Mus musculus
actcaaagcaacgcaaagccacgga

SEQ ID NO: 866806 - DNA, 25 bp, Mus musculus
actcaacaagcagatggcttcagag

SEQ ID NO: 866807 - DNA, 25 bp, Mus musculus
actcaacaaggagatggcttcagag

SEQ ID NO: 866808 - DNA, 25 bp, Mus musculus
actcaacaatgcaaagtatgccatc

SEQ ID NO: 866809 - DNA, 25 bp, Mus musculus
actcaacaatgcaatgtatgccatc

SEQ ID NO: 866810 - DNA, 25 bp, Mus musculus
actcaacagccacgctctgaggtca

SEQ ID NO: 866811 - DNA, 25 bp, Mus musculus
actcaacagccaggctctgaggtca

SEQ ID NO: 866812 - DNA, 25 bp, Mus musculus
actcaacatccacgcaggcattaat

SEQ ID NO: 866813 - DNA, 25 bp, Mus musculus
actcaacatccaggcaggcattaat

SEQ ID NO: 866814 - DNA, 25 bp, Mus musculus
actcaaccagaaactgaagaattgc

SEQ ID NO: 866815 - DNA, 25 bp, Mus musculus
actcaaccagcgtgaacacttcgga

SEQ ID NO: 866816 - DNA, 25 bp, Mus musculus
actcaaccagggtgaacacttcgga

SEQ ID NO: 866817 - DNA, 25 bp, Mus musculus
actcaaccagtaactgaagaattgc

SEQ ID NO: 866818 - DNA, 25 bp, Mus musculus
actcaactaaggcgtcactgaatcc

SEQ ID NO: 866819 - DNA, 25 bp, Mus musculus
actcaactaaggggtcactgaatcc

SEQ ID NO: 866820 - DNA, 25 bp, Mus musculus
actcaagaagaagaatgtcccttct

SEQ ID NO: 866821 - DNA, 25 bp, Mus musculus
actcaagaagaatgtcccttctaag

SEQ ID NO: 866822 - DNA, 25 bp, Mus musculus
actcaagaagtagaatgtcccttct

SEQ ID NO: 866823 - DNA, 25 bp, Mus musculus
actcaagaagtatgtcccttctaag

SEQ ID NO: 866824 - DNA, 25 bp, Mus musculus
actcaagagcagagggtaaggttgg

SEQ ID NO: 866825 - DNA, 25 bp, Mus musculus
actcaagagcagtgggtaaggttgg

SEQ ID NO: 866826 - DNA, 25 bp, Mus musculus
actcaagcagctgttctttggcttt

SEQ ID NO: 866827 - DNA, 25 bp, Mus musculus
actcaagcaggtgttctttggcttt

SEQ ID NO: 866828 - DNA, 25 bp, Mus musculus
actcaaggagccagagacccgtgct

SEQ ID NO: 866829 - DNA, 25 bp, Mus musculus
actcaaggaggcagagacccgtgct

SEQ ID NO: 866830 - DNA, 25 bp, Mus musculus
actcaagtgaagctaattgcagcca

SEQ ID NO: 866831 - DNA, 25 bp, Mus musculus
actcaagtgaaggtaattgcagcca

SEQ ID NO: 866832 - DNA, 25 bp, Mus musculus
actcaataggagcgttaaggtcaat

SEQ ID NO: 866833 - DNA, 25 bp, Mus musculus
actcaataggagggttaaggtcaat

SEQ ID NO: 866834 - DNA, 25 bp, Mus musculus
actcaatgaaaaagtcatggttttt

SEQ ID NO: 866835 - DNA, 25 bp, Mus musculus
actcaatgaaaatgtcatggttttt

SEQ ID NO: 866836 - DNA, 25 bp, Mus musculus
actcaatttagtgacccacagtaca

SEQ ID NO: 866837 - DNA, 25 bp, Mus musculus
actcaatttagtgagccacagtaca

SEQ ID NO: 866838 - DNA, 25 bp, Mus musculus
actcacaactttcctcggaaaacgt

SEQ ID NO: 866839 - DNA, 25 bp, Mus musculus
actcacaactttgctcggaaaacgt

SEQ ID NO: 866840 - DNA, 25 bp, Mus musculus
actcacaagaagaaacatgtcattc

SEQ ID NO: 866841 - DNA, 25 bp, Mus musculus
actcacaagaagacgcaatgtgtct

SEQ ID NO: 866842 - DNA, 25 bp, Mus musculus
actcacaagaagacttccaactgaa

SEQ ID NO: 866843 - DNA, 25 bp, Mus musculus
actcacaagaagtaacatgtcattc

SEQ ID NO: 866844 - DNA, 25 bp, Mus musculus
actcacaagaagtcgcaatgtgtct

SEQ ID NO: 866845 - DNA, 25 bp, Mus musculus
actcacaagaagtcttccaactgaa

SEQ ID NO: 866846 - DNA, 25 bp, Mus musculus
actcacaccaaacgagtgccaggag

SEQ ID NO: 866847 - DNA, 25 bp, Mus musculus
actcacaccaaaggagtgccaggag

SEQ ID NO: 866848 - DNA, 25 bp, Mus musculus
actcacagaaagctgtccacccagc

SEQ ID NO: 866849 - DNA, 25 bp, Mus musculus
actcacagaaaggtgtccacccagc

SEQ ID NO: 866850 - DNA, 25 bp, Mus musculus
actcacccaactgcaaaacatgtct

SEQ ID NO: 866851 - DNA, 25 bp, Mus musculus
actcacccaactgttgcccaccaac

SEQ ID NO: 866852 - DNA, 25 bp, Mus musculus
actcacccaagtgcaaaacatgtct

SEQ ID NO: 866853 - DNA, 25 bp, Mus musculus
actcacccaagtgttgcccaccaac

SEQ ID NO: 866854 - DNA, 25 bp, Mus musculus
actcaccctcagcgaagtgatttcc

SEQ ID NO: 866855 - DNA, 25 bp, Mus musculus
actcaccctcagggaagtgatttcc

SEQ ID NO: 866856 - DNA, 25 bp, Mus musculus
actcactcagcgatgactatgaggt

SEQ ID NO: 866857 - DNA, 25 bp, Mus musculus
actcactcagggatgactatgaggt

SEQ ID NO: 866858 - DNA, 25 bp, Mus musculus
actcacttgaagcccatctctgagc

SEQ ID NO: 866859 - DNA, 25 bp, Mus musculus
actcacttgaaggccatctctgagc

SEQ ID NO: 866860 - DNA, 25 bp, Mus musculus
actcagaaactacacgaagttgaaa

SEQ ID NO: 866861 - DNA, 25 bp, Mus musculus
actcagaaactacaggaagttgaaa

SEQ ID NO: 866862 - DNA, 25 bp, Mus musculus
actcagaactcacatcaccacaatg

SEQ ID NO: 866863 - DNA, 25 bp, Mus musculus
actcagaactcagatcaccacaatg

SEQ ID NO: 866864 - DNA, 25 bp, Mus musculus
actcagacaatgatgaaggcactga

SEQ ID NO: 866865 - DNA, 25 bp, Mus musculus
actcagacaatgttgaaggcactga

SEQ ID NO: 866866 - DNA, 25 bp, Mus musculus
actcagacacctcctcaacatggcg

SEQ ID NO: 866867 - DNA, 25 bp, Mus musculus
actcagacacctcgcagtgcttaat

SEQ ID NO: 866868 - DNA, 25 bp, Mus musculus
actcagacacctgctcaacatggcg

SEQ ID NO: 866869 - DNA, 25 bp, Mus musculus
actcagacacctggcagtgcttaat

SEQ ID NO: 866870 - DNA, 25 bp, Mus musculus
actcagacagcattatggcttcatt

SEQ ID NO: 866871 - DNA, 25 bp, Mus musculus
actcagacagcgttcctccagcccg

SEQ ID NO: 866872 - DNA, 25 bp, Mus musculus
actcagacaggattatggcttcatt

SEQ ID NO: 866873 - DNA, 25 bp, Mus musculus
actcagacagggttcctccagcccg

SEQ ID NO: 866874 - DNA, 25 bp, Mus musculus
actcagacatagacctgaagaagct

SEQ ID NO: 866875 - DNA, 25 bp, Mus musculus
actcagacatagtcctgaagaagct

SEQ ID NO: 866876 - DNA, 25 bp, Mus musculus
actcagactgggcccagtcttctgg

SEQ ID NO: 866877 - DNA, 25 bp, Mus musculus
actcagactggggccagtcttctgg

SEQ ID NO: 866878 - DNA, 25 bp, Mus musculus
actcagagacagccctcaggatatc

SEQ ID NO: 866879 - DNA, 25 bp, Mus musculus
actcagagacaggcctcaggatatc

SEQ ID NO: 866880 - DNA, 25 bp, Mus musculus
actcagagcaagaggtggatataga

SEQ ID NO: 866881 - DNA, 25 bp, Mus musculus
actcagagcaagtggtggatataga

SEQ ID NO: 866882 - DNA, 25 bp, Mus musculus
actcagcagaaacatgttaaacact

SEQ ID NO: 866883 - DNA, 25 bp, Mus musculus
actcagcagaaagatgttaaacact

SEQ ID NO: 866884 - DNA, 25 bp, Mus musculus
actcagcaggagatgaggaatttaa

SEQ ID NO: 866885 - DNA, 25 bp, Mus musculus
actcagcaggtgatgaggaatttaa

SEQ ID NO: 866886 - DNA, 25 bp, Mus musculus
actcagcatgaaaccatatgaactt

SEQ ID NO: 866887 - DNA, 25 bp, Mus musculus
actcagcatgaaacgatatgaactt

SEQ ID NO: 866888 - DNA, 25 bp, Mus musculus
actcagccagagcccccttagcacc

SEQ ID NO: 866889 - DNA, 25 bp, Mus musculus
actcagccagtgaacaggaagttag

SEQ ID NO: 866890 - DNA, 25 bp, Mus musculus
actcagccagtgaagaggaagttag

SEQ ID NO: 866891 - DNA, 25 bp, Mus musculus
actcagccagtgcccccttagcacc

SEQ ID NO: 866892 - DNA, 25 bp, Mus musculus
actcagcccactcgatcaaacaaca

SEQ ID NO: 866893 - DNA, 25 bp, Mus musculus
actcagcccactggatcaaacaaca

SEQ ID NO: 866894 - DNA, 25 bp, Mus musculus
actcagccgcttactacctgaatga

SEQ ID NO: 866895 - DNA, 25 bp, Mus musculus
actcagccgctttctacctgaatga

SEQ ID NO: 866896 - DNA, 25 bp, Mus musculus
actcagcctgcacaccaactggtat

SEQ ID NO: 866897 - DNA, 25 bp, Mus musculus
actcagcctgcagaccaactggtat

SEQ ID NO: 866898 - DNA, 25 bp, Mus musculus
actcagcctggacgacacagagctg

SEQ ID NO: 866899 - DNA, 25 bp, Mus musculus
actcagcctggaggacacagagctg

SEQ ID NO: 866900 - DNA, 25 bp, Mus musculus
actcagccttatgccctggttccac

SEQ ID NO: 866901 - DNA, 25 bp, Mus musculus
actcagccttatgcgctggttccac

SEQ ID NO: 866902 - DNA, 25 bp, Mus musculus
actcagcgtgatcgcaatgagaggt

SEQ ID NO: 866903 - DNA, 25 bp, Mus musculus
actcagcgtgatggcaatgagaggt

SEQ ID NO: 866904 - DNA, 25 bp, Mus musculus
actcagctactacgagccctaaact

SEQ ID NO: 866905 - DNA, 25 bp, Mus musculus
actcagctactaggagccctaaact

SEQ ID NO: 866906 - DNA, 25 bp, Mus musculus
actcagctcctacaccacccgtttg

SEQ ID NO: 866907 - DNA, 25 bp, Mus musculus
actcagctcctacagcacccgtttg

SEQ ID NO: 866908 - DNA, 25 bp, Mus musculus
actcaggaaaagcttggatgtcgat

SEQ ID NO: 866909 - DNA, 25 bp, Mus musculus
actcaggaaaaggttggatgtcgat

SEQ ID NO: 866910 - DNA, 25 bp, Mus musculus
actcaggaagcgcccctgtacgtga

SEQ ID NO: 866911 - DNA, 25 bp, Mus musculus
actcaggaagggcccctgtacgtga

SEQ ID NO: 866912 - DNA, 25 bp, Mus musculus
actcaggccatgctccagagaaatc

SEQ ID NO: 866913 - DNA, 25 bp, Mus musculus
actcaggccatggtccagagaaatc

SEQ ID NO: 866914 - DNA, 25 bp, Mus musculus
actcaggtcaacaacgttggacttt

SEQ ID NO: 866915 - DNA, 25 bp, Mus musculus
actcaggtcaacaaggttggacttt

SEQ ID NO: 866916 - DNA, 25 bp, Mus musculus
actcaggtcacacagaccgatgagt

SEQ ID NO: 866917 - DNA, 25 bp, Mus musculus
actcaggtcacagagaccgatgagt

SEQ ID NO: 866918 - DNA, 25 bp, Mus musculus
actcagtatgttcacgcatatcctc

SEQ ID NO: 866919 - DNA, 25 bp, Mus musculus
actcagtatgttcaggcatatcctc

SEQ ID NO: 866920 - DNA, 25 bp, Mus musculus
actcagtgcaagaacagagactcag

SEQ ID NO: 866921 - DNA, 25 bp, Mus musculus
actcagtgcaagtacagagactcag

SEQ ID NO: 866922 - DNA, 25 bp, Mus musculus
actcatacaccaccaactctgatga

SEQ ID NO: 866923 - DNA, 25 bp, Mus musculus
actcatacaccagcaactctgatga

SEQ ID NO: 866924 - DNA, 25 bp, Mus musculus
actcatacagcagaaaagccgtaca

SEQ ID NO: 866925 - DNA, 25 bp, Mus musculus
actcatacaggagaaaagccgtaca

SEQ ID NO: 866926 - DNA, 25 bp, Mus musculus
actcatcaagcttatgaactttggt

SEQ ID NO: 866927 - DNA, 25 bp, Mus musculus
actcatcaaggttatgaactttggt

SEQ ID NO: 866928 - DNA, 25 bp, Mus musculus
actcatcagcctcaacgagaaggat

SEQ ID NO: 866929 - DNA, 25 bp, Mus musculus
actcatcagcctgaacgagaaggat

SEQ ID NO: 866930 - DNA, 25 bp, Mus musculus
actcatcatccacctggacaagtct

SEQ ID NO: 866931 - DNA, 25 bp, Mus musculus
actcatcatccagctggacaagtct

SEQ ID NO: 866932 - DNA, 25 bp, Mus musculus
actcatcatgcgcgagtgcatttca

SEQ ID NO: 866933 - DNA, 25 bp, Mus musculus
actcatcatgctggacaatgccaag

SEQ ID NO: 866934 - DNA, 25 bp, Mus musculus
actcatcatgggcgagtgcatttca

SEQ ID NO: 866935 - DNA, 25 bp, Mus musculus
actcatcatggtggacaatgccaag

SEQ ID NO: 866936 - DNA, 25 bp, Mus musculus
actcatcgactcaacgatggatcaa

SEQ ID NO: 866937 - DNA, 25 bp, Mus musculus
actcatcgactcaaggatggatcaa

SEQ ID NO: 866938 - DNA, 25 bp, Mus musculus
actcatctgctagacaagggcaagt

SEQ ID NO: 866939 - DNA, 25 bp, Mus musculus
actcatctgctagacactggctctc

SEQ ID NO: 866940 - DNA, 25 bp, Mus musculus
actcatctgctagacctctggtgtt

SEQ ID NO: 866941 - DNA, 25 bp, Mus musculus
actcatctgctagacgttcacaaca

SEQ ID NO: 866942 - DNA, 25 bp, Mus musculus
actcatctgctagactaggtgcttc

SEQ ID NO: 866943 - DNA, 25 bp, Mus musculus
actcatctgctagagaagggcaagt

SEQ ID NO: 866944 - DNA, 25 bp, Mus musculus
actcatctgctagagactggctctc

SEQ ID NO: 866945 - DNA, 25 bp, Mus musculus
actcatctgctagagctctggtgtt

SEQ ID NO: 866946 - DNA, 25 bp, Mus musculus
actcatctgctagaggttcacaaca

SEQ ID NO: 866947 - DNA, 25 bp, Mus musculus
actcatctgctagagtaggtgcttc

SEQ ID NO: 866948 - DNA, 25 bp, Mus musculus
actcatcttgcaaaggacttggttg

SEQ ID NO: 866949 - DNA, 25 bp, Mus musculus
actcatcttggaaaggacttggttg

SEQ ID NO: 866950 - DNA, 25 bp, Mus musculus
actcatgagcgccacatacttcaat

SEQ ID NO: 866951 - DNA, 25 bp, Mus musculus
actcatgagcgcgacatacttcaat

SEQ ID NO: 866952 - DNA, 25 bp, Mus musculus
actcatgcaatacaaatgatcaaaa

SEQ ID NO: 866953 - DNA, 25 bp, Mus musculus
actcatgcaatacttccagttcaga

SEQ ID NO: 866954 - DNA, 25 bp, Mus musculus
actcatgcaatagaaatgatcaaaa

SEQ ID NO: 866955 - DNA, 25 bp, Mus musculus
actcatgcaatagttccagttcaga

SEQ ID NO: 866956 - DNA, 25 bp, Mus musculus
actcatgcgaagatatgagttgtat

SEQ ID NO: 866957 - DNA, 25 bp, Mus musculus
actcatgcgaagatttgagttgtat

SEQ ID NO: 866958 - DNA, 25 bp, Mus musculus
actcatggactagccgcctggtctc

SEQ ID NO: 866959 - DNA, 25 bp, Mus musculus
actcatggactagcctttcaggcct

SEQ ID NO: 866960 - DNA, 25 bp, Mus musculus
actcatggactagcggcctggtctc

SEQ ID NO: 866961 - DNA, 25 bp, Mus musculus
actcatggactagcgtttcaggcct

SEQ ID NO: 866962 - DNA, 25 bp, Mus musculus
actcatgtacagaacatgatgagtg

SEQ ID NO: 866963 - DNA, 25 bp, Mus musculus
actcatgtacagtacatgatgagtg

SEQ ID NO: 866964 - DNA, 25 bp, Mus musculus
actcattattctcaagtggctgatg

SEQ ID NO: 866965 - DNA, 25 bp, Mus musculus
actcattattctgaagtggctgatg

SEQ ID NO: 866966 - DNA, 25 bp, Mus musculus
actcattcagcgagtgttgtgaaga

SEQ ID NO: 866967 - DNA, 25 bp, Mus musculus
actcattcagggagtgttgtgaaga

SEQ ID NO: 866968 - DNA, 25 bp, Mus musculus
actcattgactgcacgtccctggaa

SEQ ID NO: 866969 - DNA, 25 bp, Mus musculus
actcattgactgcaggtccctggaa

SEQ ID NO: 866970 - DNA, 25 bp, Mus musculus
actcatttgttccgttcagttccca

SEQ ID NO: 866971 - DNA, 25 bp, Mus musculus
actcatttgttcggttcagttccca

SEQ ID NO: 866972 - DNA, 25 bp, Mus musculus
actcattttgcccaccccgtgaatg

SEQ ID NO: 866973 - DNA, 25 bp, Mus musculus
actcattttggccaccccgtgaatg

SEQ ID NO: 866974 - DNA, 25 bp, Mus musculus
actccaaaagagagtcctgccatag

SEQ ID NO: 866975 - DNA, 25 bp, Mus musculus
actccaaaagagtgtcctgccatag

SEQ ID NO: 866976 - DNA, 25 bp, Mus musculus
actccaaaggaaacagctgtcgaga

SEQ ID NO: 866977 - DNA, 25 bp, Mus musculus
actccaaaggaaactgctgtcgaga

SEQ ID NO: 866978 - DNA, 25 bp, Mus musculus
actccaaagtcacacaagaagatga

SEQ ID NO: 866979 - DNA, 25 bp, Mus musculus
actccaaagtcagacaagaagatga

SEQ ID NO: 866980 - DNA, 25 bp, Mus musculus
actccaaataaacgtgcaatgatga

SEQ ID NO: 866981 - DNA, 25 bp, Mus musculus
actccaaataaaggtgcaatgatga

SEQ ID NO: 866982 - DNA, 25 bp, Mus musculus
actccaagcccactcgcgctgacct

SEQ ID NO: 866983 - DNA, 25 bp, Mus musculus
actccaagcccactggcgctgacct

SEQ ID NO: 866984 - DNA, 25 bp, Mus musculus
actccaaggagacgtcaatactatc

SEQ ID NO: 866985 - DNA, 25 bp, Mus musculus
actccaaggagaggtcaatactatc

SEQ ID NO: 866986 - DNA, 25 bp, Mus musculus
actccacacgagaggctcacaatat

SEQ ID NO: 866987 - DNA, 25 bp, Mus musculus
actccacacgagcagccagatgtta

SEQ ID NO: 866988 - DNA, 25 bp, Mus musculus
actccacacgaggagccagatgtta

SEQ ID NO: 866989 - DNA, 25 bp, Mus musculus
actccacacgagtggctcacaatat

SEQ ID NO: 866990 - DNA, 25 bp, Mus musculus
actccacagactcagctgcagctcc

SEQ ID NO: 866991 - DNA, 25 bp, Mus musculus
actccacagagtcagctgcagctcc

SEQ ID NO: 866992 - DNA, 25 bp, Mus musculus
actccaccagcacctccagacaaga

SEQ ID NO: 866993 - DNA, 25 bp, Mus musculus
actccaccagcagctccagacaaga

SEQ ID NO: 866994 - DNA, 25 bp, Mus musculus
actccaccggctatgaagctaaaat

SEQ ID NO: 866995 - DNA, 25 bp, Mus musculus
actccaccgggtatgaagctaaaat

SEQ ID NO: 866996 - DNA, 25 bp, Mus musculus
actccaccgtcacagtgtgggatgt

SEQ ID NO: 866997 - DNA, 25 bp, Mus musculus
actccaccgtcagagtgtgggatgt

SEQ ID NO: 866998 - DNA, 25 bp, Mus musculus
actccacctgccatgtaaagtgagt

SEQ ID NO: 866999 - DNA, 25 bp, Mus musculus
actccacctggcatgtaaagtgagt

SEQ ID NO: 867000 - DNA, 25 bp, Mus musculus
actccagaagagccccaacccagct

SEQ ID NO: 867001 - DNA, 25 bp, Mus musculus
actccagaagaggcccaacccagct

SEQ ID NO: 867002 - DNA, 25 bp, Mus musculus
actccagactagcgaacgacacaga

SEQ ID NO: 867003 - DNA, 25 bp, Mus musculus
actccagactagggaacgacacaga

SEQ ID NO: 867004 - DNA, 25 bp, Mus musculus
actccagagaaactcaagtatcttc

SEQ ID NO: 867005 - DNA, 25 bp, Mus musculus
actccagagaaactctatcttcagg

SEQ ID NO: 867006 - DNA, 25 bp, Mus musculus
actccagagaaactgaagtatcttc

SEQ ID NO: 867007 - DNA, 25 bp, Mus musculus
actccagagaaactgtatcttcagg

SEQ ID NO: 867008 - DNA, 25 bp, Mus musculus
actccagagaagctctgtgcaagta

SEQ ID NO: 867009 - DNA, 25 bp, Mus musculus
actccagagaaggtctgtgcaagta

SEQ ID NO: 867010 - DNA, 25 bp, Mus musculus
actccagcccagaattaaccctgaa

SEQ ID NO: 867011 - DNA, 25 bp, Mus musculus
actccagcccagatggaggatgagg

SEQ ID NO: 867012 - DNA, 25 bp, Mus musculus
actccagcccagcagacaggaggat

SEQ ID NO: 867013 - DNA, 25 bp, Mus musculus
actccagcccagctggagatggagg

SEQ ID NO: 867014 - DNA, 25 bp, Mus musculus
actccagcccaggagacaggaggat

SEQ ID NO: 867015 - DNA, 25 bp, Mus musculus
actccagcccaggtggagatggagg

SEQ ID NO: 867016 - DNA, 25 bp, Mus musculus
actccagcccagtattaaccctgaa

SEQ ID NO: 867017 - DNA, 25 bp, Mus musculus
actccagcccagttggaggatgagg

SEQ ID NO: 867018 - DNA, 25 bp, Mus musculus
actccaggaactcacaaccaagttg

SEQ ID NO: 867019 - DNA, 25 bp, Mus musculus
actccaggaactcacacagaaccaa

SEQ ID NO: 867020 - DNA, 25 bp, Mus musculus
actccaggaactcagaaccaagttg

SEQ ID NO: 867021 - DNA, 25 bp, Mus musculus
actccaggaactcagacagaaccaa

SEQ ID NO: 867022 - DNA, 25 bp, Mus musculus
actccaggagcagcgacagttttga

SEQ ID NO: 867023 - DNA, 25 bp, Mus musculus
actccaggagccttccagcttgtct

SEQ ID NO: 867024 - DNA, 25 bp, Mus musculus
actccaggaggagcgacagttttga

SEQ ID NO: 867025 - DNA, 25 bp, Mus musculus
actccaggaggcttccagcttgtct

SEQ ID NO: 867026 - DNA, 25 bp, Mus musculus
actccaggatccagccgccaggcag

SEQ ID NO: 867027 - DNA, 25 bp, Mus musculus
actccaggatccagcttttatccag

SEQ ID NO: 867028 - DNA, 25 bp, Mus musculus
actccaggatccaggcgccaggcag

SEQ ID NO: 867029 - DNA, 25 bp, Mus musculus
actccaggatccaggttttatccag

SEQ ID NO: 867030 - DNA, 25 bp, Mus musculus
actccagggcaacccccaggactgg

SEQ ID NO: 867031 - DNA, 25 bp, Mus musculus
actccagggcaagccccaggactgg

SEQ ID NO: 867032 - DNA, 25 bp, Mus musculus
actccagggtcttgcgctcgaaatg

SEQ ID NO: 867033 - DNA, 25 bp, Mus musculus
actccagggtcttgggctcgaaatg

SEQ ID NO: 867034 - DNA, 25 bp, Mus musculus
actccagtaaagactccttgttgca

SEQ ID NO: 867035 - DNA, 25 bp, Mus musculus
actccagtaaagtctccttgttgca

SEQ ID NO: 867036 - DNA, 25 bp, Mus musculus
actccagtccagcaatcccaggatc

SEQ ID NO: 867037 - DNA, 25 bp, Mus musculus
actccagtccaggaatcccaggatc

SEQ ID NO: 867038 - DNA, 25 bp, Mus musculus
actccagtgaagctcattcagctgg

SEQ ID NO: 867039 - DNA, 25 bp, Mus musculus
actccagtgaaggtcattcagctgg

SEQ ID NO: 867040 - DNA, 25 bp, Mus musculus
actccataaacactctgtccagtgt

SEQ ID NO: 867041 - DNA, 25 bp, Mus musculus
actccataaacagtctgtccagtgt

SEQ ID NO: 867042 - DNA, 25 bp, Mus musculus
actccatcagatctcatcgcagaca

SEQ ID NO: 867043 - DNA, 25 bp, Mus musculus
actccatcagttctcatcgcagaca

SEQ ID NO: 867044 - DNA, 25 bp, Mus musculus
actccatcgaccagcgtgcagagga

SEQ ID NO: 867045 - DNA, 25 bp, Mus musculus
actccatcgaccagggtgcagagga

SEQ ID NO: 867046 - DNA, 25 bp, Mus musculus
actccatcttagaacatcctttact

SEQ ID NO: 867047 - DNA, 25 bp, Mus musculus
actccatcttagaagatcctttact

SEQ ID NO: 867048 - DNA, 25 bp, Mus musculus
actccatctttgctctggctcccat

SEQ ID NO: 867049 - DNA, 25 bp, Mus musculus
actccatctttggtctggctcccat

SEQ ID NO: 867050 - DNA, 25 bp, Mus musculus
actccatgcaagagccaaatttacg

SEQ ID NO: 867051 - DNA, 25 bp, Mus musculus
actccatgcaagtgccaaatttacg

SEQ ID NO: 867052 - DNA, 25 bp, Mus musculus
actccattaatactgaggttggaat

SEQ ID NO: 867053 - DNA, 25 bp, Mus musculus
actccattaatagtgaggttggaat

SEQ ID NO: 867054 - DNA, 25 bp, Mus musculus
actccattcaaactacgatgagatg

SEQ ID NO: 867055 - DNA, 25 bp, Mus musculus
actccattcaaagtacgatgagatg

SEQ ID NO: 867056 - DNA, 25 bp, Mus musculus
actcccaagaagagtgactggccgg

SEQ ID NO: 867057 - DNA, 25 bp, Mus musculus
actcccaagaagtgtgactggccgg

SEQ ID NO: 867058 - DNA, 25 bp, Mus musculus
actcccaagattcataattaggaaa

SEQ ID NO: 867059 - DNA, 25 bp, Mus musculus
actcccaagattgataattaggaaa

SEQ ID NO: 867060 - DNA, 25 bp, Mus musculus
actcccaatgaccgtcaagatgctg

SEQ ID NO: 867061 - DNA, 25 bp, Mus musculus
actcccaatgacggtcaagatgctg

SEQ ID NO: 867062 - DNA, 25 bp, Mus musculus
actcccacaagtccctggcagacaa

SEQ ID NO: 867063 - DNA, 25 bp, Mus musculus
actcccacaagtgcctggcagacaa

SEQ ID NO: 867064 - DNA, 25 bp, Mus musculus
actcccaccgatgagctgtgactat

SEQ ID NO: 867065 - DNA, 25 bp, Mus musculus
actcccaccgttgagctgtgactat

SEQ ID NO: 867066 - DNA, 25 bp, Mus musculus
actcccagagcagagacggaggcac

SEQ ID NO: 867067 - DNA, 25 bp, Mus musculus
actcccagaggagagacggaggcac

SEQ ID NO: 867068 - DNA, 25 bp, Mus musculus
actcccagattgaaagtttgaatga

SEQ ID NO: 867069 - DNA, 25 bp, Mus musculus
actcccagattgaatgtttgaatga

SEQ ID NO: 867070 - DNA, 25 bp, Mus musculus
actcccatggcttctccatatcgag

SEQ ID NO: 867071 - DNA, 25 bp, Mus musculus
actcccatgggttctccatatcgag

SEQ ID NO: 867072 - DNA, 25 bp, Mus musculus
actcccggcagcagtacgttttggg

SEQ ID NO: 867073 - DNA, 25 bp, Mus musculus
actcccggcagctgtacgttttggg

SEQ ID NO: 867074 - DNA, 25 bp, Mus musculus
actccctaacatcacaaaatatctt

SEQ ID NO: 867075 - DNA, 25 bp, Mus musculus
actccctaacatgacaaaatatctt

SEQ ID NO: 867076 - DNA, 25 bp, Mus musculus
actccctcagcagggagctctccta

SEQ ID NO: 867077 - DNA, 25 bp, Mus musculus
actccctcaggagggagctctccta

SEQ ID NO: 867078 - DNA, 25 bp, Mus musculus
actccctggaagccatgaccaggcg

SEQ ID NO: 867079 - DNA, 25 bp, Mus musculus
actccctggaccaacgtgcttcacc

SEQ ID NO: 867080 - DNA, 25 bp, Mus musculus
actccctggaccaaggtgcttcacc

SEQ ID NO: 867081 - DNA, 25 bp, Mus musculus
actccctggatgccatgaccaggcg

SEQ ID NO: 867082 - DNA, 25 bp, Mus musculus
actccctgtgccagcctttaatgtg

SEQ ID NO: 867083 - DNA, 25 bp, Mus musculus
actccctgtgcctgcctttaatgtg

SEQ ID NO: 867084 - DNA, 25 bp, Mus musculus
actccgacagctttccaccaccagg

SEQ ID NO: 867085 - DNA, 25 bp, Mus musculus
actccgacagctttgtcaagggcta

SEQ ID NO: 867086 - DNA, 25 bp, Mus musculus
actccgacaggtttccaccaccagg

SEQ ID NO: 867087 - DNA, 25 bp, Mus musculus
actccgacaggtttgtcaagggcta

SEQ ID NO: 867088 - DNA, 25 bp, Mus musculus
actccgacatcgagatccgggccaa

SEQ ID NO: 867089 - DNA, 25 bp, Mus musculus
actccgacatcgatcctgcagtagt

SEQ ID NO: 867090 - DNA, 25 bp, Mus musculus
actccgacatcgccagacagacaca

SEQ ID NO: 867091 - DNA, 25 bp, Mus musculus
actccgacatcggcagacagacaca

SEQ ID NO: 867092 - DNA, 25 bp, Mus musculus
actccgacatcgtgatccgggccaa

SEQ ID NO: 867093 - DNA, 25 bp, Mus musculus
actccgacatcgttcctgcagtagt

SEQ ID NO: 867094 - DNA, 25 bp, Mus musculus
actccgccggctactatctctcaga

SEQ ID NO: 867095 - DNA, 25 bp, Mus musculus
actccgccggcttctatctctcaga

SEQ ID NO: 867096 - DNA, 25 bp, Mus musculus
actccggacacacaatatccagtta

SEQ ID NO: 867097 - DNA, 25 bp, Mus musculus
actccggacacagaatatccagtta

SEQ ID NO: 867098 - DNA, 25 bp, Mus musculus
actccggcaacgacatgtcccgtgg

SEQ ID NO: 867099 - DNA, 25 bp, Mus musculus
actccggcaacgacttgtcccgtgg

SEQ ID NO: 867100 - DNA, 25 bp, Mus musculus
actccgtgaatatacgaaggaagag

SEQ ID NO: 867101 - DNA, 25 bp, Mus musculus
actccgtgaatataggaaggaagag

SEQ ID NO: 867102 - DNA, 25 bp, Mus musculus
actccgtgtgacacattagcttttt

SEQ ID NO: 867103 - DNA, 25 bp, Mus musculus
actccgtgtgtcacattagcttttt

SEQ ID NO: 867104 - DNA, 25 bp, Mus musculus
actccgtgttggcagatggcaaatt

SEQ ID NO: 867105 - DNA, 25 bp, Mus musculus
actccgtgttgggagatggcaaatt

SEQ ID NO: 867106 - DNA, 25 bp, Mus musculus
actcctatagctcaccgtggagtaa

SEQ ID NO: 867107 - DNA, 25 bp, Mus musculus
actcctataggtcaccgtggagtaa

SEQ ID NO: 867108 - DNA, 25 bp, Mus musculus
actcctctatcacgtttggcatcgg

SEQ ID NO: 867109 - DNA, 25 bp, Mus musculus
actcctctatcaggtttggcatcgg

SEQ ID NO: 867110 - DNA, 25 bp, Mus musculus
actcctgactaccccccagatcctg

SEQ ID NO: 867111 - DNA, 25 bp, Mus musculus
actcctgactacgccccagatcctg

SEQ ID NO: 867112 - DNA, 25 bp, Mus musculus
actcctgagcagattgggaagctgc

SEQ ID NO: 867113 - DNA, 25 bp, Mus musculus
actcctgagcagtttgggaagctgc

SEQ ID NO: 867114 - DNA, 25 bp, Mus musculus
actcctgcagactggcataacactg

SEQ ID NO: 867115 - DNA, 25 bp, Mus musculus
actcctgcagctttagccgacaatg

SEQ ID NO: 867116 - DNA, 25 bp, Mus musculus
actcctgcaggtttagccgacaatg

SEQ ID NO: 867117 - DNA, 25 bp, Mus musculus
actcctgcagtctggcataacactg

SEQ ID NO: 867118 - DNA, 25 bp, Mus musculus
actcctgcatttctcttccttagtg

SEQ ID NO: 867119 - DNA, 25 bp, Mus musculus
actcctgcatttgtcttccttagtg

SEQ ID NO: 867120 - DNA, 25 bp, Mus musculus
actcctgggatgctcatcagaacaa

SEQ ID NO: 867121 - DNA, 25 bp, Mus musculus
actcctgggatggtcatcagaacaa

SEQ ID NO: 867122 - DNA, 25 bp, Mus musculus
actcctggtcagctcaaagagctgg

SEQ ID NO: 867123 - DNA, 25 bp, Mus musculus
actcctggtcaggtcaaagagctgg

SEQ ID NO: 867124 - DNA, 25 bp, Mus musculus
actcctggtgctcactagctctgaa

SEQ ID NO: 867125 - DNA, 25 bp, Mus musculus
actcctggtggtcaccgcagggagg

SEQ ID NO: 867126 - DNA, 25 bp, Mus musculus
actcctggtggtcactagctctgaa

SEQ ID NO: 867127 - DNA, 25 bp, Mus musculus
actcctggtggtccgtcttctggga

SEQ ID NO: 867128 - DNA, 25 bp, Mus musculus
actcctggtggtgaccgcagggagg

SEQ ID NO: 867129 - DNA, 25 bp, Mus musculus
actcctggtggtgcgtcttctggga

SEQ ID NO: 867130 - DNA, 25 bp, Mus musculus
actcctgtaccgctgcccgtcatgg

SEQ ID NO: 867131 - DNA, 25 bp, Mus musculus
actcctgtaccggtgcccgtcatgg

SEQ ID NO: 867132 - DNA, 25 bp, Mus musculus
actcctgtacctcggcaaagcatgt

SEQ ID NO: 867133 - DNA, 25 bp, Mus musculus
actcctgtacctgggcaaagcatgt

SEQ ID NO: 867134 - DNA, 25 bp, Mus musculus
actcctgtccagagccgagtggtcc

SEQ ID NO: 867135 - DNA, 25 bp, Mus musculus
actcctgtccagtgccgagtggtcc

SEQ ID NO: 867136 - DNA, 25 bp, Mus musculus
actcctgtgttcaacgctgcaaatt

SEQ ID NO: 867137 - DNA, 25 bp, Mus musculus
actcctgtgttcaaggctgcaaatt

SEQ ID NO: 867138 - DNA, 25 bp, Mus musculus
actccttccagtcggatgatctggc

SEQ ID NO: 867139 - DNA, 25 bp, Mus musculus
actccttccagtgggatgatctggc

SEQ ID NO: 867140 - DNA, 25 bp, Mus musculus
actcctttgccaagctttcactgac

SEQ ID NO: 867141 - DNA, 25 bp, Mus musculus
actcctttgccatgctttcactgac

SEQ ID NO: 867142 - DNA, 25 bp, Mus musculus
actcgaagtcagaaacgtggtatct

SEQ ID NO: 867143 - DNA, 25 bp, Mus musculus
actcgaagtcagtaacgtggtatct

SEQ ID NO: 867144 - DNA, 25 bp, Mus musculus
actcgacatatggacgctgtgaaga

SEQ ID NO: 867145 - DNA, 25 bp, Mus musculus
actcgacatatggaggctgtgaaga

SEQ ID NO: 867146 - DNA, 25 bp, Mus musculus
actcgagacgggccattgctcctgt

SEQ ID NO: 867147 - DNA, 25 bp, Mus musculus
actcgagacggggcattgctcctgt

SEQ ID NO: 867148 - DNA, 25 bp, Mus musculus
actcgcacagaaccctctctggatg

SEQ ID NO: 867149 - DNA, 25 bp, Mus musculus
actcgcacagaagcctctctggatg

SEQ ID NO: 867150 - DNA, 25 bp, Mus musculus
actcgcactacgaatgtgacatcag

SEQ ID NO: 867151 - DNA, 25 bp, Mus musculus
actcgcactacgtatgtgacatcag

SEQ ID NO: 867152 - DNA, 25 bp, Mus musculus
actcgccttgaacgctcagaagtac

SEQ ID NO: 867153 - DNA, 25 bp, Mus musculus
actcgccttgaaggctcagaagtac

SEQ ID NO: 867154 - DNA, 25 bp, Mus musculus
actcgcggagagcgctcccgtaggc

SEQ ID NO: 867155 - DNA, 25 bp, Mus musculus
actcgcggagagcggtcccgtaggc

SEQ ID NO: 867156 - DNA, 25 bp, Mus musculus
actcgctctggagccagctggtcat

SEQ ID NO: 867157 - DNA, 25 bp, Mus musculus
actcgctctggagcgagctggtcat

SEQ ID NO: 867158 - DNA, 25 bp, Mus musculus
actcggacctggacataagggctaa

SEQ ID NO: 867159 - DNA, 25 bp, Mus musculus
actcggacctggatgctaaaaggat

SEQ ID NO: 867160 - DNA, 25 bp, Mus musculus
actcggacctggtcataagggctaa

SEQ ID NO: 867161 - DNA, 25 bp, Mus musculus
actcggacctggttgctaaaaggat

SEQ ID NO: 867162 - DNA, 25 bp, Mus musculus
actcggcaaactcttattatcaact

SEQ ID NO: 867163 - DNA, 25 bp, Mus musculus
actcggcaaactgttattatcaact

SEQ ID NO: 867164 - DNA, 25 bp, Mus musculus
actcggcaaggggacactggccaat

SEQ ID NO: 867165 - DNA, 25 bp, Mus musculus
actcggcaaggggagactggccaat

SEQ ID NO: 867166 - DNA, 25 bp, Mus musculus
actcggcatcttactacctgaacca

SEQ ID NO: 867167 - DNA, 25 bp, Mus musculus
actcggcatctttctacctgaacca

SEQ ID NO: 867168 - DNA, 25 bp, Mus musculus
actcggctgcagatcgcaacgagcg

SEQ ID NO: 867169 - DNA, 25 bp, Mus musculus
actcggctgcagttcgcaacgagcg

SEQ ID NO: 867170 - DNA, 25 bp, Mus musculus
actcggctggggacattctcagagc

SEQ ID NO: 867171 - DNA, 25 bp, Mus musculus
actcggctggggtcattctcagagc

SEQ ID NO: 867172 - DNA, 25 bp, Mus musculus
actcggctttgacacctgcaggtcc

SEQ ID NO: 867173 - DNA, 25 bp, Mus musculus
actcggctttgacagctgcaggtcc

SEQ ID NO: 867174 - DNA, 25 bp, Mus musculus
actcggctttgtaaagagctgtcgg

SEQ ID NO: 867175 - DNA, 25 bp, Mus musculus
actcggctttgttaagagctgtcgg

SEQ ID NO: 867176 - DNA, 25 bp, Mus musculus
actcgggagacaccattcgaactgt

SEQ ID NO: 867177 - DNA, 25 bp, Mus musculus
actcgggagacagcattcgaactgt

SEQ ID NO: 867178 - DNA, 25 bp, Mus musculus
actcgggaggcagacgctggccttg

SEQ ID NO: 867179 - DNA, 25 bp, Mus musculus
actcgggaggcagaggctggccttg

SEQ ID NO: 867180 - DNA, 25 bp, Mus musculus
actcggtgcaagaaagctgtagtag

SEQ ID NO: 867181 - DNA, 25 bp, Mus musculus
actcggtgcaagcagaaagctgtag

SEQ ID NO: 867182 - DNA, 25 bp, Mus musculus
actcggtgcaaggagaaagctgtag

SEQ ID NO: 867183 - DNA, 25 bp, Mus musculus
actcggtgcaagtaagctgtagtag

SEQ ID NO: 867184 - DNA, 25 bp, Mus musculus
actcggtgggcaaacgcaagagaat

SEQ ID NO: 867185 - DNA, 25 bp, Mus musculus
actcggtgggcaaaggcaagagaat

SEQ ID NO: 867186 - DNA, 25 bp, Mus musculus
actcgtacagcgactgtatgctgct

SEQ ID NO: 867187 - DNA, 25 bp, Mus musculus
actcgtacagggactgtatgctgct

SEQ ID NO: 867188 - DNA, 25 bp, Mus musculus
actcgtcaaacccaatagaatcctg

SEQ ID NO: 867189 - DNA, 25 bp, Mus musculus
actcgtcaaagccaatagaatcctg

SEQ ID NO: 867190 - DNA, 25 bp, Mus musculus
actcgtcaacctaacccctgacaag

SEQ ID NO: 867191 - DNA, 25 bp, Mus musculus
actcgtcaacctaagccctgacaag

SEQ ID NO: 867192 - DNA, 25 bp, Mus musculus
actcgtccagctcaagtctctgcga

SEQ ID NO: 867193 - DNA, 25 bp, Mus musculus
actcgtccaggtcaagtctctgcga

SEQ ID NO: 867194 - DNA, 25 bp, Mus musculus
actcgtcggcatcacaacggccggt

SEQ ID NO: 867195 - DNA, 25 bp, Mus musculus
actcgtcggcatcagaacggccggt

SEQ ID NO: 867196 - DNA, 25 bp, Mus musculus
actcgtgcctaccgaaacatgacag

SEQ ID NO: 867197 - DNA, 25 bp, Mus musculus
actcgtgcctacggaaacatgacag

SEQ ID NO: 867198 - DNA, 25 bp, Mus musculus
actctaaactccctgccgagctagc

SEQ ID NO: 867199 - DNA, 25 bp, Mus musculus
actctaaactgcctgccgagctagc

SEQ ID NO: 867200 - DNA, 25 bp, Mus musculus
actctaatctgtcgctgagcagtgg

SEQ ID NO: 867201 - DNA, 25 bp, Mus musculus
actctaatctgtggctgagcagtgg

SEQ ID NO: 867202 - DNA, 25 bp, Mus musculus
actctaatgtcacctccggccctgc

SEQ ID NO: 867203 - DNA, 25 bp, Mus musculus
actctaatgtcagctccggccctgc

SEQ ID NO: 867204 - DNA, 25 bp, Mus musculus
actctacaagaggtacctgctgccc

SEQ ID NO: 867205 - DNA, 25 bp, Mus musculus
actctacaagcaatgctgtgactgc

SEQ ID NO: 867206 - DNA, 25 bp, Mus musculus
actctacaagcactccctgctgctg

SEQ ID NO: 867207 - DNA, 25 bp, Mus musculus
actctacaaggaatgctgtgactgc

SEQ ID NO: 867208 - DNA, 25 bp, Mus musculus
actctacaaggactccctgctgctg

SEQ ID NO: 867209 - DNA, 25 bp, Mus musculus
actctacaagtggtacctgctgccc

SEQ ID NO: 867210 - DNA, 25 bp, Mus musculus
actctaccacagagactcatgttca

SEQ ID NO: 867211 - DNA, 25 bp, Mus musculus
actctaccacagtgactcatgttca

SEQ ID NO: 867212 - DNA, 25 bp, Mus musculus
actctaccagagagtcttttatcca

SEQ ID NO: 867213 - DNA, 25 bp, Mus musculus
actctaccagagtgtcttttatcca

SEQ ID NO: 867214 - DNA, 25 bp, Mus musculus
actctaccaggactgcaggccttgg

SEQ ID NO: 867215 - DNA, 25 bp, Mus musculus
actctaccaggagtgcaggccttgg

SEQ ID NO: 867216 - DNA, 25 bp, Mus musculus
actctaccgggctacgttttatgca

SEQ ID NO: 867217 - DNA, 25 bp, Mus musculus
actctaccgggctaggttttatgca

SEQ ID NO: 867218 - DNA, 25 bp, Mus musculus
actctacgacaccaacctgccagat

SEQ ID NO: 867219 - DNA, 25 bp, Mus musculus
actctacgacacgaacctgccagat

SEQ ID NO: 867220 - DNA, 25 bp, Mus musculus
actctagacgaaccttctagccagc

SEQ ID NO: 867221 - DNA, 25 bp, Mus musculus
actctagacgtaccttctagccagc

SEQ ID NO: 867222 - DNA, 25 bp, Mus musculus
actctagctgggcgaggacccgtgg

SEQ ID NO: 867223 - DNA, 25 bp, Mus musculus
actctagctgggggaggacccgtgg

SEQ ID NO: 867224 - DNA, 25 bp, Mus musculus
actctatacacagacgaccgcctgg

SEQ ID NO: 867225 - DNA, 25 bp, Mus musculus
actctatacacagaggaccgcctgg

SEQ ID NO: 867226 - DNA, 25 bp, Mus musculus
actctatatgagagttttggcagtg

SEQ ID NO: 867227 - DNA, 25 bp, Mus musculus
actctatatgagtgttttggcagtg

SEQ ID NO: 867228 - DNA, 25 bp, Mus musculus
actctatctagccacggtcacagct

SEQ ID NO: 867229 - DNA, 25 bp, Mus musculus
actctatctagccagggtcacagct

SEQ ID NO: 867230 - DNA, 25 bp, Mus musculus
actctcaacatgcagaggcaccact

SEQ ID NO: 867231 - DNA, 25 bp, Mus musculus
actctcaacatggagaggcaccact

SEQ ID NO: 867232 - DNA, 25 bp, Mus musculus
actctcacaatgagtcctactgaaa

SEQ ID NO: 867233 - DNA, 25 bp, Mus musculus
actctcacaatgctctgtcagaaac

SEQ ID NO: 867234 - DNA, 25 bp, Mus musculus
actctcacaatggtctgtcagaaac

SEQ ID NO: 867235 - DNA, 25 bp, Mus musculus
actctcacaatgtgtcctactgaaa

SEQ ID NO: 867236 - DNA, 25 bp, Mus musculus
actctcaccaaaatgtgagcgtgtt

SEQ ID NO: 867237 - DNA, 25 bp, Mus musculus
actctcaccataatgtgagcgtgtt

SEQ ID NO: 867238 - DNA, 25 bp, Mus musculus
actctcaccctacacgatagaattt

SEQ ID NO: 867239 - DNA, 25 bp, Mus musculus
actctcaccctacaggatagaattt

SEQ ID NO: 867240 - DNA, 25 bp, Mus musculus
actctcagagaaccgagcccgaaaa

SEQ ID NO: 867241 - DNA, 25 bp, Mus musculus
actctcagagctctggcagctcagc

SEQ ID NO: 867242 - DNA, 25 bp, Mus musculus
actctcagagctgtggcagctcagc

SEQ ID NO: 867243 - DNA, 25 bp, Mus musculus
actctcagagtaccgagcccgaaaa

SEQ ID NO: 867244 - DNA, 25 bp, Mus musculus
actctcatctccaacttcaagtcgc

SEQ ID NO: 867245 - DNA, 25 bp, Mus musculus
actctcatctccaagttcaagtcgc

SEQ ID NO: 867246 - DNA, 25 bp, Mus musculus
actctcatgcagatcccagtcaagt

SEQ ID NO: 867247 - DNA, 25 bp, Mus musculus
actctcatgcagttcccagtcaagt

SEQ ID NO: 867248 - DNA, 25 bp, Mus musculus
actctccaaccacccaatagttaca

SEQ ID NO: 867249 - DNA, 25 bp, Mus musculus
actctccaaccacttacagttagtg

SEQ ID NO: 867250 - DNA, 25 bp, Mus musculus
actctccaaccagccaatagttaca

SEQ ID NO: 867251 - DNA, 25 bp, Mus musculus
actctccaaccagttacagttagtg

SEQ ID NO: 867252 - DNA, 25 bp, Mus musculus
actctcccagcgctttctgagggtc

SEQ ID NO: 867253 - DNA, 25 bp, Mus musculus
actctcccagggctttctgagggtc

SEQ ID NO: 867254 - DNA, 25 bp, Mus musculus
actctccgagcattcgggttcttca

SEQ ID NO: 867255 - DNA, 25 bp, Mus musculus
actctccgaggattcgggttcttca

SEQ ID NO: 867256 - DNA, 25 bp, Mus musculus
actctccttacacacggaggcaagg

SEQ ID NO: 867257 - DNA, 25 bp, Mus musculus
actctccttacacagggaggcaagg

SEQ ID NO: 867258 - DNA, 25 bp, Mus musculus
actctctctggcagagtgactgggt

SEQ ID NO: 867259 - DNA, 25 bp, Mus musculus
actctctctggctgagtgactgggt

SEQ ID NO: 867260 - DNA, 25 bp, Mus musculus
actctcttttttgacattgagctcc

SEQ ID NO: 867261 - DNA, 25 bp, Mus musculus
actctcttttttgagattgagctcc

SEQ ID NO: 867262 - DNA, 25 bp, Mus musculus
actctgaaagatattaccaggagac

SEQ ID NO: 867263 - DNA, 25 bp, Mus musculus
actctgaaagattttaccaggagac

SEQ ID NO: 867264 - DNA, 25 bp, Mus musculus
actctgaagaagctggcctttcagt

SEQ ID NO: 867265 - DNA, 25 bp, Mus musculus
actctgaagaaggtggcctttcagt

SEQ ID NO: 867266 - DNA, 25 bp, Mus musculus
actctgaagtggatggtgctctcgt

SEQ ID NO: 867267 - DNA, 25 bp, Mus musculus
actctgaagtggttggtgctctcgt

SEQ ID NO: 867268 - DNA, 25 bp, Mus musculus
actctgacaaaaaggatgcaccccc

SEQ ID NO: 867269 - DNA, 25 bp, Mus musculus
actctgacaaaatggatgcaccccc

SEQ ID NO: 867270 - DNA, 25 bp, Mus musculus
actctgactttgacctcctgactgt

SEQ ID NO: 867271 - DNA, 25 bp, Mus musculus
actctgactttgtcctcctgactgt

SEQ ID NO: 867272 - DNA, 25 bp, Mus musculus
actctgatgaagcaaccacactggg

SEQ ID NO: 867273 - DNA, 25 bp, Mus musculus
actctgatgaagcatccacactggg

SEQ ID NO: 867274 - DNA, 25 bp, Mus musculus
actctgcaaacactgccaccaaaag

SEQ ID NO: 867275 - DNA, 25 bp, Mus musculus
actctgcaaacagtgccaccaaaag

SEQ ID NO: 867276 - DNA, 25 bp, Mus musculus
actctgccaaatactacctggacag

SEQ ID NO: 867277 - DNA, 25 bp, Mus musculus
actctgccaaattctacctggacag

SEQ ID NO: 867278 - DNA, 25 bp, Mus musculus
actctgccaatgaacagaacaagta

SEQ ID NO: 867279 - DNA, 25 bp, Mus musculus
actctgccaatgaagagaacaagta

SEQ ID NO: 867280 - DNA, 25 bp, Mus musculus
actctgccagacacagcagagatcg

SEQ ID NO: 867281 - DNA, 25 bp, Mus musculus
actctgccagtcacagcagagatcg

SEQ ID NO: 867282 - DNA, 25 bp, Mus musculus
actctgccctttttcgctgcagaga

SEQ ID NO: 867283 - DNA, 25 bp, Mus musculus
actctgccctttttctgccgtggtg

SEQ ID NO: 867284 - DNA, 25 bp, Mus musculus
actctgccctttttggctgcagaga

SEQ ID NO: 867285 - DNA, 25 bp, Mus musculus
actctgccctttttgtgccgtggtg

SEQ ID NO: 867286 - DNA, 25 bp, Mus musculus
actctgcctttgggcatgtcgtcac

SEQ ID NO: 867287 - DNA, 25 bp, Mus musculus
actctgcctttggggatgtcgtcac

SEQ ID NO: 867288 - DNA, 25 bp, Mus musculus
actctgcgcagggacggactatagg

SEQ ID NO: 867289 - DNA, 25 bp, Mus musculus
actctgcgcagggagggactatagg

SEQ ID NO: 867290 - DNA, 25 bp, Mus musculus
actctgcgtgctcttccggaattgt

SEQ ID NO: 867291 - DNA, 25 bp, Mus musculus
actctgcgtgctgttccggaattgt

SEQ ID NO: 867292 - DNA, 25 bp, Mus musculus
actctgctagccaacatatcaacct

SEQ ID NO: 867293 - DNA, 25 bp, Mus musculus
actctgctagccaacgtgctggatt

SEQ ID NO: 867294 - DNA, 25 bp, Mus musculus
actctgctagccaagatatcaacct

SEQ ID NO: 867295 - DNA, 25 bp, Mus musculus
actctgctagccaaggtgctggatt

SEQ ID NO: 867296 - DNA, 25 bp, Mus musculus
actctgctgacacacactgtcctgt

SEQ ID NO: 867297 - DNA, 25 bp, Mus musculus
actctgctgacagacactgtcctgt

SEQ ID NO: 867298 - DNA, 25 bp, Mus musculus
actctgctgccgccttttctcctga

SEQ ID NO: 867299 - DNA, 25 bp, Mus musculus
actctgctgccgcgtcagcacctcg

SEQ ID NO: 867300 - DNA, 25 bp, Mus musculus
actctgctgccggcttttctcctga

SEQ ID NO: 867301 - DNA, 25 bp, Mus musculus
actctgctgccgggtcagcacctcg

SEQ ID NO: 867302 - DNA, 25 bp, Mus musculus
actctggaagatgggtgtgttttac

SEQ ID NO: 867303 - DNA, 25 bp, Mus musculus
actctggaagttgggtgtgttttac

SEQ ID NO: 867304 - DNA, 25 bp, Mus musculus
actctggaccagctcttagaagatg

SEQ ID NO: 867305 - DNA, 25 bp, Mus musculus
actctggaccaggtcttagaagatg

SEQ ID NO: 867306 - DNA, 25 bp, Mus musculus
actctggagcagaacacaaaagaaa

SEQ ID NO: 867307 - DNA, 25 bp, Mus musculus
actctggagcagaacgttatgttct

SEQ ID NO: 867308 - DNA, 25 bp, Mus musculus
actctggagcagaagacaaaagaaa

SEQ ID NO: 867309 - DNA, 25 bp, Mus musculus
actctggagcagaaggttatgttct

SEQ ID NO: 867310 - DNA, 25 bp, Mus musculus
actctggaggagctgttcctatatt

SEQ ID NO: 867311 - DNA, 25 bp, Mus musculus
actctggaggaggtgttcctatatt

SEQ ID NO: 867312 - DNA, 25 bp, Mus musculus
actctggaggcacagtaaaagacat

SEQ ID NO: 867313 - DNA, 25 bp, Mus musculus
actctggaggcagagtaaaagacat

SEQ ID NO: 867314 - DNA, 25 bp, Mus musculus
actctggccaaccgctttcctgccg

SEQ ID NO: 867315 - DNA, 25 bp, Mus musculus
actctggccatccgctttcctgccg

SEQ ID NO: 867316 - DNA, 25 bp, Mus musculus
actctggccgtcccggctggactgt

SEQ ID NO: 867317 - DNA, 25 bp, Mus musculus
actctggccgtcgcggctggactgt

SEQ ID NO: 867318 - DNA, 25 bp, Mus musculus
actctgggcacgctaataattttca

SEQ ID NO: 867319 - DNA, 25 bp, Mus musculus
actctgggcacggtaataattttca

SEQ ID NO: 867320 - DNA, 25 bp, Mus musculus
actctgggcatttgcgacacagcag

SEQ ID NO: 867321 - DNA, 25 bp, Mus musculus
actctgggcatttgggacacagcag

SEQ ID NO: 867322 - DNA, 25 bp, Mus musculus
actctggttatgaacctccccggat

SEQ ID NO: 867323 - DNA, 25 bp, Mus musculus
actctggttatgaagctccccggat

SEQ ID NO: 867324 - DNA, 25 bp, Mus musculus
actctgtaggatttgcaaattttgt

SEQ ID NO: 867325 - DNA, 25 bp, Mus musculus
actctgtaggttttgcaaattttgt

SEQ ID NO: 867326 - DNA, 25 bp, Mus musculus
actctgtcgcagattggaagaattg

SEQ ID NO: 867327 - DNA, 25 bp, Mus musculus
actctgtcgcagtttggaagaattg

SEQ ID NO: 867328 - DNA, 25 bp, Mus musculus
actctgtgccagaacgggaccgaga

SEQ ID NO: 867329 - DNA, 25 bp, Mus musculus
actctgtgccagaaggggaccgaga

SEQ ID NO: 867330 - DNA, 25 bp, Mus musculus
actctgtgccagacatcctgcagtt

SEQ ID NO: 867331 - DNA, 25 bp, Mus musculus
actctgtgccagccatgaatgtcct

SEQ ID NO: 867332 - DNA, 25 bp, Mus musculus
actctgtgccaggcatgaatgtcct

SEQ ID NO: 867333 - DNA, 25 bp, Mus musculus
actctgtgccagtcatcctgcagtt

SEQ ID NO: 867334 - DNA, 25 bp, Mus musculus
actctgtggacaacagggtcctgtc

SEQ ID NO: 867335 - DNA, 25 bp, Mus musculus
actctgtggacaaggtcctgtcaga

SEQ ID NO: 867336 - DNA, 25 bp, Mus musculus
actctgtggacatcagggtcctgtc

SEQ ID NO: 867337 - DNA, 25 bp, Mus musculus
actctgtggacatggtcctgtcaga

SEQ ID NO: 867338 - DNA, 25 bp, Mus musculus
actctgttcagtcaacctaacactg

SEQ ID NO: 867339 - DNA, 25 bp, Mus musculus
actctgttcagtgaacctaacactg

SEQ ID NO: 867340 - DNA, 25 bp, Mus musculus
actctgtttcagaggaaacaagttg

SEQ ID NO: 867341 - DNA, 25 bp, Mus musculus
actctgtttcagtggaaacaagttg

SEQ ID NO: 867342 - DNA, 25 bp, Mus musculus
actcttacaaagctgtatgatggat

SEQ ID NO: 867343 - DNA, 25 bp, Mus musculus
actcttacaaaggtgtatgatggat

SEQ ID NO: 867344 - DNA, 25 bp, Mus musculus
actcttactcagaggaagaaaagta

SEQ ID NO: 867345 - DNA, 25 bp, Mus musculus
actcttactcagcaagaaaagtatg

SEQ ID NO: 867346 - DNA, 25 bp, Mus musculus
actcttactcaggaagaaaagtatg

SEQ ID NO: 867347 - DNA, 25 bp, Mus musculus
actcttactcagtggaagaaaagta

SEQ ID NO: 867348 - DNA, 25 bp, Mus musculus
actcttagctgccagcctgctgtcc

SEQ ID NO: 867349 - DNA, 25 bp, Mus musculus
actcttagctgcgagcctgctgtcc

SEQ ID NO: 867350 - DNA, 25 bp, Mus musculus
actcttattgatggaaatctacatt

SEQ ID NO: 867351 - DNA, 25 bp, Mus musculus
actcttattgcgctgtgcctaagag

SEQ ID NO: 867352 - DNA, 25 bp, Mus musculus
actcttattgggctgtgcctaagag

SEQ ID NO: 867353 - DNA, 25 bp, Mus musculus
actcttattgttggaaatctacatt

SEQ ID NO: 867354 - DNA, 25 bp, Mus musculus
actcttcaagaatgccatgagggcc

SEQ ID NO: 867355 - DNA, 25 bp, Mus musculus
actcttcaagctaaagtggatcttc

SEQ ID NO: 867356 - DNA, 25 bp, Mus musculus
actcttcaaggtaaagtggatcttc

SEQ ID NO: 867357 - DNA, 25 bp, Mus musculus
actcttcaagtatgccatgagggcc

SEQ ID NO: 867358 - DNA, 25 bp, Mus musculus
actcttcaatcgtgtgttgtccctg

SEQ ID NO: 867359 - DNA, 25 bp, Mus musculus
actcttcaatggtgtgttgtccctg

SEQ ID NO: 867360 - DNA, 25 bp, Mus musculus
actcttcacacacacttccgtgttt

SEQ ID NO: 867361 - DNA, 25 bp, Mus musculus
actcttcacacagacttccgtgttt

SEQ ID NO: 867362 - DNA, 25 bp, Mus musculus
actcttcacgatagccaaggggaag

SEQ ID NO: 867363 - DNA, 25 bp, Mus musculus
actcttcacgataggcaaggggaag

SEQ ID NO: 867364 - DNA, 25 bp, Mus musculus
actcttcagcttcaaatcagtacca

SEQ ID NO: 867365 - DNA, 25 bp, Mus musculus
actcttcagcttcaaggtttggatt

SEQ ID NO: 867366 - DNA, 25 bp, Mus musculus
actcttcagcttcatatcagtacca

SEQ ID NO: 867367 - DNA, 25 bp, Mus musculus
actcttcagcttcatggtttggatt

SEQ ID NO: 867368 - DNA, 25 bp, Mus musculus
actcttcccaagctaaagcccatta

SEQ ID NO: 867369 - DNA, 25 bp, Mus musculus
actcttcccaaggtaaagcccatta

SEQ ID NO: 867370 - DNA, 25 bp, Mus musculus
actcttcttcaccgtgccttggagc

SEQ ID NO: 867371 - DNA, 25 bp, Mus musculus
actcttcttcacggtgccttggagc

SEQ ID NO: 867372 - DNA, 25 bp, Mus musculus
actcttgatagtcatctttccagaa

SEQ ID NO: 867373 - DNA, 25 bp, Mus musculus
actcttgatagtgatctttccagaa

SEQ ID NO: 867374 - DNA, 25 bp, Mus musculus
actcttgcagcatgagaaaactaag

SEQ ID NO: 867375 - DNA, 25 bp, Mus musculus
actcttgcaggatgagaaaactaag

SEQ ID NO: 867376 - DNA, 25 bp, Mus musculus
actcttgggttcaacatcttggcaa

SEQ ID NO: 867377 - DNA, 25 bp, Mus musculus
actcttgggttcaagatcttggcaa

SEQ ID NO: 867378 - DNA, 25 bp, Mus musculus
actctttataaaaaactgctgtatc

SEQ ID NO: 867379 - DNA, 25 bp, Mus musculus
actctttataaaaatctgctgtatc

SEQ ID NO: 867380 - DNA, 25 bp, Mus musculus
actctttctcagatcacaaacaata

SEQ ID NO: 867381 - DNA, 25 bp, Mus musculus
actctttctcagttcacaaacaata

SEQ ID NO: 867382 - DNA, 25 bp, Mus musculus
actctttgagcaagaaatggacacc

SEQ ID NO: 867383 - DNA, 25 bp, Mus musculus
actctttgaggaagaaatggacacc

SEQ ID NO: 867384 - DNA, 25 bp, Mus musculus
actcttttgtgccacagaaagagag

SEQ ID NO: 867385 - DNA, 25 bp, Mus musculus
actcttttgtgccagagaaagagag

SEQ ID NO: 867386 - DNA, 25 bp, Mus musculus
actctttttgctatgatcactgctg

SEQ ID NO: 867387 - DNA, 25 bp, Mus musculus
actctttttggtatgatcactgctg

SEQ ID NO: 867388 - DNA, 25 bp, Mus musculus
actgaaaaagatccaccaggtgaga

SEQ ID NO: 867389 - DNA, 25 bp, Mus musculus
actgaaaaagttccaccaggtgaga

SEQ ID NO: 867390 - DNA, 25 bp, Mus musculus
actgaaaaatctagttcctaatatt

SEQ ID NO: 867391 - DNA, 25 bp, Mus musculus
actgaaaaatgtagttcctaatatt

SEQ ID NO: 867392 - DNA, 25 bp, Mus musculus
actgaaaataagcagactggatgac

SEQ ID NO: 867393 - DNA, 25 bp, Mus musculus
actgaaaataaggagactggatgac

SEQ ID NO: 867394 - DNA, 25 bp, Mus musculus
actgaaattccacaagctgatcaac

SEQ ID NO: 867395 - DNA, 25 bp, Mus musculus
actgaaattccacatgctgatcaac

SEQ ID NO: 867396 - DNA, 25 bp, Mus musculus
actgaacaaacccatccttccatca

SEQ ID NO: 867397 - DNA, 25 bp, Mus musculus
actgaacaaaccgatccttccatca

SEQ ID NO: 867398 - DNA, 25 bp, Mus musculus
actgaaccacgaagactgctacatc

SEQ ID NO: 867399 - DNA, 25 bp, Mus musculus
actgaaccacgatgactgctacatc

SEQ ID NO: 867400 - DNA, 25 bp, Mus musculus
actgaactgaagaatccctccaaca

SEQ ID NO: 867401 - DNA, 25 bp, Mus musculus
actgaactgatgaatccctccaaca

SEQ ID NO: 867402 - DNA, 25 bp, Mus musculus
actgaagaacagagcctttttagta

SEQ ID NO: 867403 - DNA, 25 bp, Mus musculus
actgaagaacagtgcctttttagta

SEQ ID NO: 867404 - DNA, 25 bp, Mus musculus
actgaagaagataaagcgctcatcc

SEQ ID NO: 867405 - DNA, 25 bp, Mus musculus
actgaagaagttaaagcgctcatcc

SEQ ID NO: 867406 - DNA, 25 bp, Mus musculus
actgaagacgatatgttcatatcag

SEQ ID NO: 867407 - DNA, 25 bp, Mus musculus
actgaagacgatgtctatttttggg

SEQ ID NO: 867408 - DNA, 25 bp, Mus musculus
actgaagacgatgtgtatttttggg

SEQ ID NO: 867409 - DNA, 25 bp, Mus musculus
actgaagacgttatgttcatatcag

SEQ ID NO: 867410 - DNA, 25 bp, Mus musculus
actgaagagaacgcagagctcgttt

SEQ ID NO: 867411 - DNA, 25 bp, Mus musculus
actgaagagaacgctgagctcgttt

SEQ ID NO: 867412 - DNA, 25 bp, Mus musculus
actgaagagctagacatatgtgtca

SEQ ID NO: 867413 - DNA, 25 bp, Mus musculus
actgaagagctagagatatgtgtca

SEQ ID NO: 867414 - DNA, 25 bp, Mus musculus
actgaagatcaccacgtgtgtggag

SEQ ID NO: 867415 - DNA, 25 bp, Mus musculus
actgaagatcaccaggtgtgtggag

SEQ ID NO: 867416 - DNA, 25 bp, Mus musculus
actgaagcagctatgtttgcaattc

SEQ ID NO: 867417 - DNA, 25 bp, Mus musculus
actgaagcaggtatgtttgcaattc

SEQ ID NO: 867418 - DNA, 25 bp, Mus musculus
actgaagcccagcacatttggcctg

SEQ ID NO: 867419 - DNA, 25 bp, Mus musculus
actgaagcccagcacgccagtgtgc

SEQ ID NO: 867420 - DNA, 25 bp, Mus musculus
actgaagcccagcagatttggcctg

SEQ ID NO: 867421 - DNA, 25 bp, Mus musculus
actgaagcccagcaggccagtgtgc

SEQ ID NO: 867422 - DNA, 25 bp, Mus musculus
actgaagcggcactaccctgatgcc

SEQ ID NO: 867423 - DNA, 25 bp, Mus musculus
actgaagcgggactaccctgatgcc

SEQ ID NO: 867424 - DNA, 25 bp, Mus musculus
actgaagtgctagaatctcttgaaa

SEQ ID NO: 867425 - DNA, 25 bp, Mus musculus
actgaagtgctagattctcttgaaa

SEQ ID NO: 867426 - DNA, 25 bp, Mus musculus
actgaatggtcttgcgagtcccaaa

SEQ ID NO: 867427 - DNA, 25 bp, Mus musculus
actgaatggtcttgggagtcccaaa

SEQ ID NO: 867428 - DNA, 25 bp, Mus musculus
actgaatttatcctcagatacagag

SEQ ID NO: 867429 - DNA, 25 bp, Mus musculus
actgaatttatcgtcagatacagag

SEQ ID NO: 867430 - DNA, 25 bp, Mus musculus
actgacaaagaacgctggattctca

SEQ ID NO: 867431 - DNA, 25 bp, Mus musculus
actgacaaagaaggctggattctca

SEQ ID NO: 867432 - DNA, 25 bp, Mus musculus
actgacaacgatcacgaaatcatcc

SEQ ID NO: 867433 - DNA, 25 bp, Mus musculus
actgacaacgatcaggaaatcatcc

SEQ ID NO: 867434 - DNA, 25 bp, Mus musculus
actgacccagatggtttctggcccc

SEQ ID NO: 867435 - DNA, 25 bp, Mus musculus
actgacccagttggtttctggcccc

SEQ ID NO: 867436 - DNA, 25 bp, Mus musculus
actgaccctcagatagtgtttctag

SEQ ID NO: 867437 - DNA, 25 bp, Mus musculus
actgaccctcagttagtgtttctag

SEQ ID NO: 867438 - DNA, 25 bp, Mus musculus
actgaccgagaagtgcccccgcctg

SEQ ID NO: 867439 - DNA, 25 bp, Mus musculus
actgaccgagtagtgcccccgcctg

SEQ ID NO: 867440 - DNA, 25 bp, Mus musculus
actgacctggagttgctgcacctaa

SEQ ID NO: 867441 - DNA, 25 bp, Mus musculus
actgacctggagtttacagtgttgc

SEQ ID NO: 867442 - DNA, 25 bp, Mus musculus
actgacctggtgttgctgcacctaa

SEQ ID NO: 867443 - DNA, 25 bp, Mus musculus
actgacctggtgtttacagtgttgc

SEQ ID NO: 867444 - DNA, 25 bp, Mus musculus
actgaccttgaacgggactcagaag

SEQ ID NO: 867445 - DNA, 25 bp, Mus musculus
actgaccttgaaggggactcagaag

SEQ ID NO: 867446 - DNA, 25 bp, Mus musculus
actgacggtcagatatatgaaatct

SEQ ID NO: 867447 - DNA, 25 bp, Mus musculus
actgacggtcagttatatgaaatct

SEQ ID NO: 867448 - DNA, 25 bp, Mus musculus
actgactatgaacaaataggagaca

SEQ ID NO: 867449 - DNA, 25 bp, Mus musculus
actgactatgaacatataggagaca

SEQ ID NO: 867450 - DNA, 25 bp, Mus musculus
actgactctacacccactacgaagg

SEQ ID NO: 867451 - DNA, 25 bp, Mus musculus
actgactctacacgcattgggcatg

SEQ ID NO: 867452 - DNA, 25 bp, Mus musculus
actgactctacagccactacgaagg

SEQ ID NO: 867453 - DNA, 25 bp, Mus musculus
actgactctacaggcattgggcatg

SEQ ID NO: 867454 - DNA, 25 bp, Mus musculus
actgactgtgaacaggctgccctgg

SEQ ID NO: 867455 - DNA, 25 bp, Mus musculus
actgactgtgaagaggctgccctgg

SEQ ID NO: 867456 - DNA, 25 bp, Mus musculus
actgacttgctacgaggtcttttct

SEQ ID NO: 867457 - DNA, 25 bp, Mus musculus
actgacttgctaggaggtcttttct

SEQ ID NO: 867458 - DNA, 25 bp, Mus musculus
actgagaaagatctccaagaggatg

SEQ ID NO: 867459 - DNA, 25 bp, Mus musculus
actgagaaagttctccaagaggatg

SEQ ID NO: 867460 - DNA, 25 bp, Mus musculus
actgagaacctgccctgcagttaaa

SEQ ID NO: 867461 - DNA, 25 bp, Mus musculus
actgagaacctggcctgcagttaaa

SEQ ID NO: 867462 - DNA, 25 bp, Mus musculus
actgagaattcaagtctgtcaccta

SEQ ID NO: 867463 - DNA, 25 bp, Mus musculus
actgagaattcatgtctgtcaccta

SEQ ID NO: 867464 - DNA, 25 bp, Mus musculus
actgagacagcccttgcaaggagac

SEQ ID NO: 867465 - DNA, 25 bp, Mus musculus
actgagacagcgctttctgagggtc

SEQ ID NO: 867466 - DNA, 25 bp, Mus musculus
actgagacaggccttgcaaggagac

SEQ ID NO: 867467 - DNA, 25 bp, Mus musculus
actgagacagggctttctgagggtc

SEQ ID NO: 867468 - DNA, 25 bp, Mus musculus
actgagagatgcaacctgataggag

SEQ ID NO: 867469 - DNA, 25 bp, Mus musculus
actgagagatgcaagctgataggag

SEQ ID NO: 867470 - DNA, 25 bp, Mus musculus
actgagagccaaattgttcagaagg

SEQ ID NO: 867471 - DNA, 25 bp, Mus musculus
actgagagccaatttgttcagaagg

SEQ ID NO: 867472 - DNA, 25 bp, Mus musculus
actgagagtgagaaccatttcttca

SEQ ID NO: 867473 - DNA, 25 bp, Mus musculus
actgagagtgagaagcatttcttca

SEQ ID NO: 867474 - DNA, 25 bp, Mus musculus
actgagcaaccaagagtgtcacttg

SEQ ID NO: 867475 - DNA, 25 bp, Mus musculus
actgagcaaccaagtgtgtcacttg

SEQ ID NO: 867476 - DNA, 25 bp, Mus musculus
actgagcaagagtccaactttatcc

SEQ ID NO: 867477 - DNA, 25 bp, Mus musculus
actgagcaagtgtccaactttatcc

SEQ ID NO: 867478 - DNA, 25 bp, Mus musculus
actgagccaccaagagttcttcatg

SEQ ID NO: 867479 - DNA, 25 bp, Mus musculus
actgagccaccatgagttcttcatg

SEQ ID NO: 867480 - DNA, 25 bp, Mus musculus
actgagccccggaacaggctccgtg

SEQ ID NO: 867481 - DNA, 25 bp, Mus musculus
actgagccccggtacaggctccgtg

SEQ ID NO: 867482 - DNA, 25 bp, Mus musculus
actgagccctcacaactttgctttg

SEQ ID NO: 867483 - DNA, 25 bp, Mus musculus
actgagccctcacatctttgctttg

SEQ ID NO: 867484 - DNA, 25 bp, Mus musculus
actgagcgaggcgaccgtgcacagt

SEQ ID NO: 867485 - DNA, 25 bp, Mus musculus
actgagcgaggcgacgcaccatgac

SEQ ID NO: 867486 - DNA, 25 bp, Mus musculus
actgagcgaggcgagcgtgcacagt

SEQ ID NO: 867487 - DNA, 25 bp, Mus musculus
actgagcgaggcgaggcaccatgac

SEQ ID NO: 867488 - DNA, 25 bp, Mus musculus
actgaggaactgggcctttgaacca

SEQ ID NO: 867489 - DNA, 25 bp, Mus musculus
actgaggaactggggctttgaacca

SEQ ID NO: 867490 - DNA, 25 bp, Mus musculus
actgaggagaagagtgagaaacttt

SEQ ID NO: 867491 - DNA, 25 bp, Mus musculus
actgaggagaagctgcctttcattt

SEQ ID NO: 867492 - DNA, 25 bp, Mus musculus
actgaggagaaggtgcctttcattt

SEQ ID NO: 867493 - DNA, 25 bp, Mus musculus
actgaggagaagtgtgagaaacttt

SEQ ID NO: 867494 - DNA, 25 bp, Mus musculus
actgaggatggcagcgtatttatga

SEQ ID NO: 867495 - DNA, 25 bp, Mus musculus
actgaggatggcagggtatttatga

SEQ ID NO: 867496 - DNA, 25 bp, Mus musculus
actgaggcggcaagcctgtgggacc

SEQ ID NO: 867497 - DNA, 25 bp, Mus musculus
actgaggcgggaagcctgtgggacc

SEQ ID NO: 867498 - DNA, 25 bp, Mus musculus
actgagggactacactggacaaggc

SEQ ID NO: 867499 - DNA, 25 bp, Mus musculus
actgagggactacagtggacaaggc

SEQ ID NO: 867500 - DNA, 25 bp, Mus musculus
actgagtcactcaacagcctcatcc

SEQ ID NO: 867501 - DNA, 25 bp, Mus musculus
actgagtcactcaagagcctcatcc

SEQ ID NO: 867502 - DNA, 25 bp, Mus musculus
actgagtctctgcgcacggaggtgc

SEQ ID NO: 867503 - DNA, 25 bp, Mus musculus
actgagtctctgggcacggaggtgc

SEQ ID NO: 867504 - DNA, 25 bp, Mus musculus
actgagtcttatctatgttcaaagg

SEQ ID NO: 867505 - DNA, 25 bp, Mus musculus
actgagtcttatgtatgttcaaagg

SEQ ID NO: 867506 - DNA, 25 bp, Mus musculus
actgagtgagcacgcatgaaaattt

SEQ ID NO: 867507 - DNA, 25 bp, Mus musculus
actgagtgagcacggatgaaaattt

SEQ ID NO: 867508 - DNA, 25 bp, Mus musculus
actgataaagatcccaaggaagaga

SEQ ID NO: 867509 - DNA, 25 bp, Mus musculus
actgataaagttcccaaggaagaga

SEQ ID NO: 867510 - DNA, 25 bp, Mus musculus
actgatacagccgctgcagctgcct

SEQ ID NO: 867511 - DNA, 25 bp, Mus musculus
actgatacaggcgctgcagctgcct

SEQ ID NO: 867512 - DNA, 25 bp, Mus musculus
actgatcaagcaactggctaaatat

SEQ ID NO: 867513 - DNA, 25 bp, Mus musculus
actgatcaaggaactggctaaatat

SEQ ID NO: 867514 - DNA, 25 bp, Mus musculus
actgatcctggacgctgttcatcag

SEQ ID NO: 867515 - DNA, 25 bp, Mus musculus
actgatcctggaggctgttcatcag

SEQ ID NO: 867516 - DNA, 25 bp, Mus musculus
actgatcgaaatgaaagaattcaga

SEQ ID NO: 867517 - DNA, 25 bp, Mus musculus
actgatcgaattgaaagaattcaga

SEQ ID NO: 867518 - DNA, 25 bp, Mus musculus
actgatgaggagcacactttcctgc

SEQ ID NO: 867519 - DNA, 25 bp, Mus musculus
actgatgaggagcagactttcctgc

SEQ ID NO: 867520 - DNA, 25 bp, Mus musculus
actgatgaggcgaacgaaagctcac

SEQ ID NO: 867521 - DNA, 25 bp, Mus musculus
actgatgaggcgaaggaaagctcac

SEQ ID NO: 867522 - DNA, 25 bp, Mus musculus
actgatgcaaagatccaggtgttcc

SEQ ID NO: 867523 - DNA, 25 bp, Mus musculus
actgatgcaaagttccaggtgttcc

SEQ ID NO: 867524 - DNA, 25 bp, Mus musculus
actgatgcatctaacagacagactg

SEQ ID NO: 867525 - DNA, 25 bp, Mus musculus
actgatgcatgtaacagacagactg

SEQ ID NO: 867526 - DNA, 25 bp, Mus musculus
actgatgtctggaccctaggctgtg

SEQ ID NO: 867527 - DNA, 25 bp, Mus musculus
actgatgtctggtccctaggctgtg

SEQ ID NO: 867528 - DNA, 25 bp, Mus musculus
actgattaagcattcaggaggggaa

SEQ ID NO: 867529 - DNA, 25 bp, Mus musculus
actgattaaggattcaggaggggaa

SEQ ID NO: 867530 - DNA, 25 bp, Mus musculus
actgattatggacacgactgaaaga

SEQ ID NO: 867531 - DNA, 25 bp, Mus musculus
actgattatggacaggactgaaaga

SEQ ID NO: 867532 - DNA, 25 bp, Mus musculus
actgatttaaggccagcagggaacc

SEQ ID NO: 867533 - DNA, 25 bp, Mus musculus
actgatttaaggcttttgcctacca

SEQ ID NO: 867534 - DNA, 25 bp, Mus musculus
actgatttaagggcagcagggaacc

SEQ ID NO: 867535 - DNA, 25 bp, Mus musculus
actgatttaagggttttgcctacca

SEQ ID NO: 867536 - DNA, 25 bp, Mus musculus
actgcaaaaacgacaatcagtgcct

SEQ ID NO: 867537 - DNA, 25 bp, Mus musculus
actgcaaaaacgtcaatcagtgcct

SEQ ID NO: 867538 - DNA, 25 bp, Mus musculus
actgcaaaagttgaaactggacaac

SEQ ID NO: 867539 - DNA, 25 bp, Mus musculus
actgcaaaagttgatactggacaac

SEQ ID NO: 867540 - DNA, 25 bp, Mus musculus
actgcaaacaaattcctactgcttc

SEQ ID NO: 867541 - DNA, 25 bp, Mus musculus
actgcaaacaaattgctactgcttc

SEQ ID NO: 867542 - DNA, 25 bp, Mus musculus
actgcaaacaatattatgccttaga

SEQ ID NO: 867543 - DNA, 25 bp, Mus musculus
actgcaaacattattatgccttaga

SEQ ID NO: 867544 - DNA, 25 bp, Mus musculus
actgcaaaggaacctcaatgacagt

SEQ ID NO: 867545 - DNA, 25 bp, Mus musculus
actgcaaaggaagctcaatgacagt

SEQ ID NO: 867546 - DNA, 25 bp, Mus musculus
actgcaagcgcgaagaaagccaaat

SEQ ID NO: 867547 - DNA, 25 bp, Mus musculus
actgcaagcgggaagaaagccaaat

SEQ ID NO: 867548 - DNA, 25 bp, Mus musculus
actgcaaggttcctcccgctaacgt

SEQ ID NO: 867549 - DNA, 25 bp, Mus musculus
actgcaaggttcctgccgctaacgt

SEQ ID NO: 867550 - DNA, 25 bp, Mus musculus
actgcaagtactgggcactacattg

SEQ ID NO: 867551 - DNA, 25 bp, Mus musculus
actgcaagtagtgggcactacattg

SEQ ID NO: 867552 - DNA, 25 bp, Mus musculus
actgcaataacatctatgaacgagt

SEQ ID NO: 867553 - DNA, 25 bp, Mus musculus
actgcaataagatctatgaacgagt

SEQ ID NO: 867554 - DNA, 25 bp, Mus musculus
actgcaatagctgtggggaccattt

SEQ ID NO: 867555 - DNA, 25 bp, Mus musculus
actgcaataggtgtggggaccattt

SEQ ID NO: 867556 - DNA, 25 bp, Mus musculus
actgcaatatgactcaaacggcatg

SEQ ID NO: 867557 - DNA, 25 bp, Mus musculus
actgcaatatgactccccgaagcct

SEQ ID NO: 867558 - DNA, 25 bp, Mus musculus
actgcaatatgactgaaacggcatg

SEQ ID NO: 867559 - DNA, 25 bp, Mus musculus
actgcaatatgactgcccgaagcct

SEQ ID NO: 867560 - DNA, 25 bp, Mus musculus
actgcacacacacacggattgagtc

SEQ ID NO: 867561 - DNA, 25 bp, Mus musculus
actgcacacacacagggattgagtc

SEQ ID NO: 867562 - DNA, 25 bp, Mus musculus
actgcaccacagcctttttccaggg

SEQ ID NO: 867563 - DNA, 25 bp, Mus musculus
actgcaccacaggctttttccaggg

SEQ ID NO: 867564 - DNA, 25 bp, Mus musculus
actgcaccccaaccctccatgatgt

SEQ ID NO: 867565 - DNA, 25 bp, Mus musculus
actgcaccccaagcctccatgatgt

SEQ ID NO: 867566 - DNA, 25 bp, Mus musculus
actgcaccctggcgtaaaacattca

SEQ ID NO: 867567 - DNA, 25 bp, Mus musculus
actgcaccctggggtaaaacattca

SEQ ID NO: 867568 - DNA, 25 bp, Mus musculus
actgcactgccaccacggggtctgg

SEQ ID NO: 867569 - DNA, 25 bp, Mus musculus
actgcactgccagcacggggtctgg

SEQ ID NO: 867570 - DNA, 25 bp, Mus musculus
actgcactggaacctcaatgagagt

SEQ ID NO: 867571 - DNA, 25 bp, Mus musculus
actgcactggaagctcaatgagagt

SEQ ID NO: 867572 - DNA, 25 bp, Mus musculus
actgcacttgacaccatggtatgca

SEQ ID NO: 867573 - DNA, 25 bp, Mus musculus
actgcacttgtcaccatggtatgca

SEQ ID NO: 867574 - DNA, 25 bp, Mus musculus
actgcagaagcgagaactttctgga

SEQ ID NO: 867575 - DNA, 25 bp, Mus musculus
actgcagaagctgctgatggaatgg

SEQ ID NO: 867576 - DNA, 25 bp, Mus musculus
actgcagaagggagaactttctgga

SEQ ID NO: 867577 - DNA, 25 bp, Mus musculus
actgcagaaggtgctgatggaatgg

SEQ ID NO: 867578 - DNA, 25 bp, Mus musculus
actgcagcctaaatggcaaaatgtc

SEQ ID NO: 867579 - DNA, 25 bp, Mus musculus
actgcagccttaatggcaaaatgtc

SEQ ID NO: 867580 - DNA, 25 bp, Mus musculus
actgcagctggtcaagaacacaagt

SEQ ID NO: 867581 - DNA, 25 bp, Mus musculus
actgcagctggtgaagaacacaagt

SEQ ID NO: 867582 - DNA, 25 bp, Mus musculus
actgcaggacagcaggattacaacc

SEQ ID NO: 867583 - DNA, 25 bp, Mus musculus
actgcaggacaggaggattacaacc

SEQ ID NO: 867584 - DNA, 25 bp, Mus musculus
actgcataaaatcacctgctcgact

SEQ ID NO: 867585 - DNA, 25 bp, Mus musculus
actgcataaaatcagctgctcgact

SEQ ID NO: 867586 - DNA, 25 bp, Mus musculus
actgcatacactcagccctctcaca

SEQ ID NO: 867587 - DNA, 25 bp, Mus musculus
actgcatacactgagccctctcaca

SEQ ID NO: 867588 - DNA, 25 bp, Mus musculus
actgcatgacactaaacatggagtg

SEQ ID NO: 867589 - DNA, 25 bp, Mus musculus
actgcatgacactatacatggagtg

SEQ ID NO: 867590 - DNA, 25 bp, Mus musculus
actgcattcacacggacctggctgc

SEQ ID NO: 867591 - DNA, 25 bp, Mus musculus
actgcattcacagggacctggctgc

SEQ ID NO: 867592 - DNA, 25 bp, Mus musculus
actgccaagaagcttcaacgggcag

SEQ ID NO: 867593 - DNA, 25 bp, Mus musculus
actgccaagaaggttcaacgggcag

SEQ ID NO: 867594 - DNA, 25 bp, Mus musculus
actgccacatcgctgatgccttcag

SEQ ID NO: 867595 - DNA, 25 bp, Mus musculus
actgccacatcggtgatgccttcag

SEQ ID NO: 867596 - DNA, 25 bp, Mus musculus
actgccaccccaaggtaagtgcagt

SEQ ID NO: 867597 - DNA, 25 bp, Mus musculus
actgccacccgaaggtaagtgcagt

SEQ ID NO: 867598 - DNA, 25 bp, Mus musculus
actgccagaacatctgcagaggtgg

SEQ ID NO: 867599 - DNA, 25 bp, Mus musculus
actgccagaagatctgcagaggtgg

SEQ ID NO: 867600 - DNA, 25 bp, Mus musculus
actgccagccagcattttgtggacg

SEQ ID NO: 867601 - DNA, 25 bp, Mus musculus
actgccagccaggattttgtggacg

SEQ ID NO: 867602 - DNA, 25 bp, Mus musculus
actgccagtccgaagatcttagacg

SEQ ID NO: 867603 - DNA, 25 bp, Mus musculus
actgccagtcggaagatcttagacg

SEQ ID NO: 867604 - DNA, 25 bp, Mus musculus
actgccataatgacaagtaccaggt

SEQ ID NO: 867605 - DNA, 25 bp, Mus musculus
actgccataatgtcaagtaccaggt

SEQ ID NO: 867606 - DNA, 25 bp, Mus musculus
actgccatgactatctacggagaag

SEQ ID NO: 867607 - DNA, 25 bp, Mus musculus
actgccatgactttctacggagaag

SEQ ID NO: 867608 - DNA, 25 bp, Mus musculus
actgccatgcagagagctgctggtg

SEQ ID NO: 867609 - DNA, 25 bp, Mus musculus
actgccatgcagtgagctgctggtg

SEQ ID NO: 867610 - DNA, 25 bp, Mus musculus
actgccatgtcacccagtataatgt

SEQ ID NO: 867611 - DNA, 25 bp, Mus musculus
actgccatgtcagccagtataatgt

SEQ ID NO: 867612 - DNA, 25 bp, Mus musculus
actgccattcagctcatccagtttg

SEQ ID NO: 867613 - DNA, 25 bp, Mus musculus
actgccattcagctgatccagtttg

SEQ ID NO: 867614 - DNA, 25 bp, Mus musculus
actgcccaattgatggatgcctgtc

SEQ ID NO: 867615 - DNA, 25 bp, Mus musculus
actgcccaattgttggatgcctgtc

SEQ ID NO: 867616 - DNA, 25 bp, Mus musculus
actgcccaggagccacagtccctcg

SEQ ID NO: 867617 - DNA, 25 bp, Mus musculus
actgcccaggaggcacagtccctcg

SEQ ID NO: 867618 - DNA, 25 bp, Mus musculus
actgccccagctggcagaagagatc

SEQ ID NO: 867619 - DNA, 25 bp, Mus musculus
actgccccaggtggcagaagagatc

SEQ ID NO: 867620 - DNA, 25 bp, Mus musculus
actgccccgcgacctaaaatgggta

SEQ ID NO: 867621 - DNA, 25 bp, Mus musculus
actgccccgcgagctaaaatgggta

SEQ ID NO: 867622 - DNA, 25 bp, Mus musculus
actgcccgcaccccatcttctgttg

SEQ ID NO: 867623 - DNA, 25 bp, Mus musculus
actgcccgcaccgcatcttctgttg

SEQ ID NO: 867624 - DNA, 25 bp, Mus musculus
actgccctcatacgagttgctgcaa

SEQ ID NO: 867625 - DNA, 25 bp, Mus musculus
actgccctcataggagttgctgcaa

SEQ ID NO: 867626 - DNA, 25 bp, Mus musculus
actgccctgcagcacaagaaagact

SEQ ID NO: 867627 - DNA, 25 bp, Mus musculus
actgccctgcaggacaagaaagact

SEQ ID NO: 867628 - DNA, 25 bp, Mus musculus
actgccgagccaggtgtggacctcg

SEQ ID NO: 867629 - DNA, 25 bp, Mus musculus
actgccgagcgaggtgtggacctcg

SEQ ID NO: 867630 - DNA, 25 bp, Mus musculus
actgccgccccaacccgtgtcacaa

SEQ ID NO: 867631 - DNA, 25 bp, Mus musculus
actgccgccccatcccgtgtcacaa

SEQ ID NO: 867632 - DNA, 25 bp, Mus musculus
actgccgctatccacgttgtcattt

SEQ ID NO: 867633 - DNA, 25 bp, Mus musculus
actgccgctatccaggttgtcattt

SEQ ID NO: 867634 - DNA, 25 bp, Mus musculus
actgcctcatcattcggggaggagg

SEQ ID NO: 867635 - DNA, 25 bp, Mus musculus
actgcctcatcattgggggaggagg

SEQ ID NO: 867636 - DNA, 25 bp, Mus musculus
actgcctcgtcaactgggagggcat

SEQ ID NO: 867637 - DNA, 25 bp, Mus musculus
actgcctcgtcaagcacaccaagat

SEQ ID NO: 867638 - DNA, 25 bp, Mus musculus
actgcctcgtcatctgggagggcat

SEQ ID NO: 867639 - DNA, 25 bp, Mus musculus
actgcctcgtcatgcacaccaagat

SEQ ID NO: 867640 - DNA, 25 bp, Mus musculus
actgcctcttggcagcccttgcaat

SEQ ID NO: 867641 - DNA, 25 bp, Mus musculus
actgcctcttgggagcccttgcaat

SEQ ID NO: 867642 - DNA, 25 bp, Mus musculus
actgcctgactgcaaagccaccatg

SEQ ID NO: 867643 - DNA, 25 bp, Mus musculus
actgcctgactggaaagccaccatg

SEQ ID NO: 867644 - DNA, 25 bp, Mus musculus
actgcctgataaatacaacaccaga

SEQ ID NO: 867645 - DNA, 25 bp, Mus musculus
actgcctgatcttgtccaggaagcg

SEQ ID NO: 867646 - DNA, 25 bp, Mus musculus
actgcctgatgttgtccaggaagcg

SEQ ID NO: 867647 - DNA, 25 bp, Mus musculus
actgcctgattaatacaacaccaga

SEQ ID NO: 867648 - DNA, 25 bp, Mus musculus
actgcctgccagcattttaccggaa

SEQ ID NO: 867649 - DNA, 25 bp, Mus musculus
actgcctgccaggattttaccggaa

SEQ ID NO: 867650 - DNA, 25 bp, Mus musculus
actgcctggccacttcagcatatag

SEQ ID NO: 867651 - DNA, 25 bp, Mus musculus
actgcctggccagttcagcatatag

SEQ ID NO: 867652 - DNA, 25 bp, Mus musculus
actgcctgggaagacgtccgtgagc

SEQ ID NO: 867653 - DNA, 25 bp, Mus musculus
actgcctgggaagaggtccgtgagc

SEQ ID NO: 867654 - DNA, 25 bp, Mus musculus
actgcctgtgaacacttggatgaat

SEQ ID NO: 867655 - DNA, 25 bp, Mus musculus
actgcctgtgaagacttggatgaat

SEQ ID NO: 867656 - DNA, 25 bp, Mus musculus
actgcctgtgctaatccatactttt

SEQ ID NO: 867657 - DNA, 25 bp, Mus musculus
actgcctgtgcttatccatactttt

SEQ ID NO: 867658 - DNA, 25 bp, Mus musculus
actgcgaggccaaactgcattgctc

SEQ ID NO: 867659 - DNA, 25 bp, Mus musculus
actgcgaggccaaagtgcattgctc

SEQ ID NO: 867660 - DNA, 25 bp, Mus musculus
actgcgccacagcaaagcactgcca

SEQ ID NO: 867661 - DNA, 25 bp, Mus musculus
actgcgccacaggaaagcactgcca

SEQ ID NO: 867662 - DNA, 25 bp, Mus musculus
actgcggcacagcccttcacagtgg

SEQ ID NO: 867663 - DNA, 25 bp, Mus musculus
actgcggcacaggccttcacagtgg

SEQ ID NO: 867664 - DNA, 25 bp, Mus musculus
actgcgggcccaccagcccctggcg

SEQ ID NO: 867665 - DNA, 25 bp, Mus musculus
actgcgggcccaccccctggcgcag

SEQ ID NO: 867666 - DNA, 25 bp, Mus musculus
actgcgggcccacttgctgatagcc

SEQ ID NO: 867667 - DNA, 25 bp, Mus musculus
actgcgggcccagcagcccctggcg

SEQ ID NO: 867668 - DNA, 25 bp, Mus musculus
actgcgggcccagcccctggcgcag

SEQ ID NO: 867669 - DNA, 25 bp, Mus musculus
actgcgggcccagttgctgatagcc

SEQ ID NO: 867670 - DNA, 25 bp, Mus musculus
actgcggggtgacacgatcctcctg

SEQ ID NO: 867671 - DNA, 25 bp, Mus musculus
actgcggggtgagacgatcctcctg

SEQ ID NO: 867672 - DNA, 25 bp, Mus musculus
actgcgtggataccctttccctgag

SEQ ID NO: 867673 - DNA, 25 bp, Mus musculus
actgcgtggatagcctttccctgag

SEQ ID NO: 867674 - DNA, 25 bp, Mus musculus
actgctaatgagactcagtccgcta

SEQ ID NO: 867675 - DNA, 25 bp, Mus musculus
actgctaatgagtctcagtccgcta

SEQ ID NO: 867676 - DNA, 25 bp, Mus musculus
actgctaccgccatcttagaactgg

SEQ ID NO: 867677 - DNA, 25 bp, Mus musculus
actgctaccgctgtggcaatgtggc

SEQ ID NO: 867678 - DNA, 25 bp, Mus musculus
actgctaccggcatcttagaactgg

SEQ ID NO: 867679 - DNA, 25 bp, Mus musculus
actgctaccggtgtggcaatgtggc

SEQ ID NO: 867680 - DNA, 25 bp, Mus musculus
actgctatggcaaccagtataatgt

SEQ ID NO: 867681 - DNA, 25 bp, Mus musculus
actgctatggcatccagtataatgt

SEQ ID NO: 867682 - DNA, 25 bp, Mus musculus
actgctcaccaccaactccccggaa

SEQ ID NO: 867683 - DNA, 25 bp, Mus musculus
actgctcaccaccatctccccggaa

SEQ ID NO: 867684 - DNA, 25 bp, Mus musculus
actgctcactatctttgtgctgctg

SEQ ID NO: 867685 - DNA, 25 bp, Mus musculus
actgctcactttctttgtgctgctg

SEQ ID NO: 867686 - DNA, 25 bp, Mus musculus
actgctccacttctatcagcaatcc

SEQ ID NO: 867687 - DNA, 25 bp, Mus musculus
actgctccacttgtatcagcaatcc

SEQ ID NO: 867688 - DNA, 25 bp, Mus musculus
actgctcggtgatgcaagcaacaga

SEQ ID NO: 867689 - DNA, 25 bp, Mus musculus
actgctcggtgatgccaacagaaga

SEQ ID NO: 867690 - DNA, 25 bp, Mus musculus
actgctcggtgatggaagcaacaga

SEQ ID NO: 867691 - DNA, 25 bp, Mus musculus
actgctcggtgatggcaacagaaga

SEQ ID NO: 867692 - DNA, 25 bp, Mus musculus
actgctcgtcagaatcaggtggaca

SEQ ID NO: 867693 - DNA, 25 bp, Mus musculus
actgctcgtcagtatcaggtggaca

SEQ ID NO: 867694 - DNA, 25 bp, Mus musculus
actgctctcaatccaggtcaatggc

SEQ ID NO: 867695 - DNA, 25 bp, Mus musculus
actgctctcaatgcaggtcaatggc

SEQ ID NO: 867696 - DNA, 25 bp, Mus musculus
actgctgaagacgtgactgcgcccc

SEQ ID NO: 867697 - DNA, 25 bp, Mus musculus
actgctgaagtcgtgactgcgcccc

SEQ ID NO: 867698 - DNA, 25 bp, Mus musculus
actgctgccctaccagggtcggagc

SEQ ID NO: 867699 - DNA, 25 bp, Mus musculus
actgctgccctacggtcggagcttc

SEQ ID NO: 867700 - DNA, 25 bp, Mus musculus
actgctgccctagcagggtcggagc

SEQ ID NO: 867701 - DNA, 25 bp, Mus musculus
actgctgccctagggtcggagcttc

SEQ ID NO: 867702 - DNA, 25 bp, Mus musculus
actgctggacagcacgccccagttc

SEQ ID NO: 867703 - DNA, 25 bp, Mus musculus
actgctggacagcaggccccagttc

SEQ ID NO: 867704 - DNA, 25 bp, Mus musculus
actgctggcatcaacgtgtcggccc

SEQ ID NO: 867705 - DNA, 25 bp, Mus musculus
actgctggcatcaaggtgtcggccc

SEQ ID NO: 867706 - DNA, 25 bp, Mus musculus
actgctggtcagccagagttcacgg

SEQ ID NO: 867707 - DNA, 25 bp, Mus musculus
actgctggtcagctctgcaatctga

SEQ ID NO: 867708 - DNA, 25 bp, Mus musculus
actgctggtcaggcagagttcacgg

SEQ ID NO: 867709 - DNA, 25 bp, Mus musculus
actgctggtcaggtctgcaatctga

SEQ ID NO: 867710 - DNA, 25 bp, Mus musculus
actgctggttgacgccttgagtgcc

SEQ ID NO: 867711 - DNA, 25 bp, Mus musculus
actgctggttgaggccttgagtgcc

SEQ ID NO: 867712 - DNA, 25 bp, Mus musculus
actgctgtcaggcgatgggccgagc

SEQ ID NO: 867713 - DNA, 25 bp, Mus musculus
actgctgtcaggggatgggccgagc

SEQ ID NO: 867714 - DNA, 25 bp, Mus musculus
actgcttaaacaaggtgattctgct

SEQ ID NO: 867715 - DNA, 25 bp, Mus musculus
actgcttaaacatggtgattctgct

SEQ ID NO: 867716 - DNA, 25 bp, Mus musculus
actgcttaagagaacgtgttaggag

SEQ ID NO: 867717 - DNA, 25 bp, Mus musculus
actgcttaagagaaggtgttaggag

SEQ ID NO: 867718 - DNA, 25 bp, Mus musculus
actgcttaagctagatagacgagtg

SEQ ID NO: 867719 - DNA, 25 bp, Mus musculus
actgcttaaggtagatagacgagtg

SEQ ID NO: 867720 - DNA, 25 bp, Mus musculus
actgcttcagctccaagaggttttt

SEQ ID NO: 867721 - DNA, 25 bp, Mus musculus
actgcttcaggtccaagaggttttt

SEQ ID NO: 867722 - DNA, 25 bp, Mus musculus
actgcttccctgcacctacaaactc

SEQ ID NO: 867723 - DNA, 25 bp, Mus musculus
actgcttccctgcagctacaaactc

SEQ ID NO: 867724 - DNA, 25 bp, Mus musculus
actgcttctaagacaggaagtctta

SEQ ID NO: 867725 - DNA, 25 bp, Mus musculus
actgcttctaagactggaagtctta

SEQ ID NO: 867726 - DNA, 25 bp, Mus musculus
actgcttgagtccacgttcacattg

SEQ ID NO: 867727 - DNA, 25 bp, Mus musculus
actgcttgagtccaggttcacattg

SEQ ID NO: 867728 - DNA, 25 bp, Mus musculus
actgctttttagaggtgatcatgtg

SEQ ID NO: 867729 - DNA, 25 bp, Mus musculus
actgctttttagtggtgatcatgtg

SEQ ID NO: 867730 - DNA, 25 bp, Mus musculus
actggaaaagacagaaaatatgttg

SEQ ID NO: 867731 - DNA, 25 bp, Mus musculus
actggaaaagtcagaaaatatgttg

SEQ ID NO: 867732 - DNA, 25 bp, Mus musculus
actggaagacaacgtggttccatca

SEQ ID NO: 867733 - DNA, 25 bp, Mus musculus
actggaagacaaggtggttccatca

SEQ ID NO: 867734 - DNA, 25 bp, Mus musculus
actggaagagcgcatctgtggtcgt

SEQ ID NO: 867735 - DNA, 25 bp, Mus musculus
actggaagagggcatctgtggtcgt

SEQ ID NO: 867736 - DNA, 25 bp, Mus musculus
actggaaggacacccctcagttcct

SEQ ID NO: 867737 - DNA, 25 bp, Mus musculus
actggaaggacagccctcagttcct

SEQ ID NO: 867738 - DNA, 25 bp, Mus musculus
actggaaggaggaacagtgagctgg

SEQ ID NO: 867739 - DNA, 25 bp, Mus musculus
actggaaggaggaagagtgagctgg

SEQ ID NO: 867740 - DNA, 25 bp, Mus musculus
actggaagggaacgatgcacaggcc

SEQ ID NO: 867741 - DNA, 25 bp, Mus musculus
actggaagggaaggatgcacaggcc

SEQ ID NO: 867742 - DNA, 25 bp, Mus musculus
actggaatgatgcggctatcctggg

SEQ ID NO: 867743 - DNA, 25 bp, Mus musculus
actggaatgatggggctatcctggg

SEQ ID NO: 867744 - DNA, 25 bp, Mus musculus
actggacaagcacagcggccaccct

SEQ ID NO: 867745 - DNA, 25 bp, Mus musculus
actggacaaggacagcggccaccct

SEQ ID NO: 867746 - DNA, 25 bp, Mus musculus
actggacagccactttgttgaagtc

SEQ ID NO: 867747 - DNA, 25 bp, Mus musculus
actggacagccagtttgttgaagtc

SEQ ID NO: 867748 - DNA, 25 bp, Mus musculus
actggacagtgctcagagaacagta

SEQ ID NO: 867749 - DNA, 25 bp, Mus musculus
actggacagtgctctgagaacagta

SEQ ID NO: 867750 - DNA, 25 bp, Mus musculus
actggacatgcgtgaagaaggggac

SEQ ID NO: 867751 - DNA, 25 bp, Mus musculus
actggacatgggtgaagaaggggac

SEQ ID NO: 867752 - DNA, 25 bp, Mus musculus
actggacccctgaacgacatagcat

SEQ ID NO: 867753 - DNA, 25 bp, Mus musculus
actggacccctgaacgttacagtct

SEQ ID NO: 867754 - DNA, 25 bp, Mus musculus
actggacccctgaaggacatagcat

SEQ ID NO: 867755 - DNA, 25 bp, Mus musculus
actggacccctgaaggttacagtct

SEQ ID NO: 867756 - DNA, 25 bp, Mus musculus
actggacggcagcccatgttggagc

SEQ ID NO: 867757 - DNA, 25 bp, Mus musculus
actggacggcaggccatgttggagc

SEQ ID NO: 867758 - DNA, 25 bp, Mus musculus
actggacttgctgaaacctggtccc

SEQ ID NO: 867759 - DNA, 25 bp, Mus musculus
actggacttggtgaaacctggtccc

SEQ ID NO: 867760 - DNA, 25 bp, Mus musculus
actggagaaactcacgcaacgcctg

SEQ ID NO: 867761 - DNA, 25 bp, Mus musculus
actggagaaactcaggcaacgcctg

SEQ ID NO: 867762 - DNA, 25 bp, Mus musculus
actggagaagaagtcttggacaggc

SEQ ID NO: 867763 - DNA, 25 bp, Mus musculus
actggagaagatatttccgagagac

SEQ ID NO: 867764 - DNA, 25 bp, Mus musculus
actggagaagctgcaaaacatgtct

SEQ ID NO: 867765 - DNA, 25 bp, Mus musculus
actggagaaggtgcaaaacatgtct

SEQ ID NO: 867766 - DNA, 25 bp, Mus musculus
actggagaagtagtcttggacaggc

SEQ ID NO: 867767 - DNA, 25 bp, Mus musculus
actggagaagttatttccgagagac

SEQ ID NO: 867768 - DNA, 25 bp, Mus musculus
actggagaataacgtttgtgagatg

SEQ ID NO: 867769 - DNA, 25 bp, Mus musculus
actggagaataaggtttgtgagatg

SEQ ID NO: 867770 - DNA, 25 bp, Mus musculus
actggagagaagctggatgtctacg

SEQ ID NO: 867771 - DNA, 25 bp, Mus musculus
actggagagaaggtggatgtctacg

SEQ ID NO: 867772 - DNA, 25 bp, Mus musculus
actggagaggtggactgggatgcct

SEQ ID NO: 867773 - DNA, 25 bp, Mus musculus
actggagaggtggagtgggatgcct

SEQ ID NO: 867774 - DNA, 25 bp, Mus musculus
actggagcctctgccagtcagactg

SEQ ID NO: 867775 - DNA, 25 bp, Mus musculus
actggagcctgtgccagtcagactg

SEQ ID NO: 867776 - DNA, 25 bp, Mus musculus
actggagcgtctcgtgctacaagtg

SEQ ID NO: 867777 - DNA, 25 bp, Mus musculus
actggagcgtctggtgctacaagtg

SEQ ID NO: 867778 - DNA, 25 bp, Mus musculus
actggagctggccacgactgccgct

SEQ ID NO: 867779 - DNA, 25 bp, Mus musculus
actggagctggccaggactgccgct

SEQ ID NO: 867780 - DNA, 25 bp, Mus musculus
actggaggatacctcctctgccaga

SEQ ID NO: 867781 - DNA, 25 bp, Mus musculus
actggaggatacgtcctctgccaga

SEQ ID NO: 867782 - DNA, 25 bp, Mus musculus
actggagtatgccacgtactacatg

SEQ ID NO: 867783 - DNA, 25 bp, Mus musculus
actggagtatgccaggtactacatg

SEQ ID NO: 867784 - DNA, 25 bp, Mus musculus
actggagtcccacaaggaacggctg

SEQ ID NO: 867785 - DNA, 25 bp, Mus musculus
actggagtcccagaaggaacggctg

SEQ ID NO: 867786 - DNA, 25 bp, Mus musculus
actggagtgaggaaaatggcacacc

SEQ ID NO: 867787 - DNA, 25 bp, Mus musculus
actggagtgaggacaagggtcttct

SEQ ID NO: 867788 - DNA, 25 bp, Mus musculus
actggagtgaggagaagaaacactg

SEQ ID NO: 867789 - DNA, 25 bp, Mus musculus
actggagtgaggtaaatggcacacc

SEQ ID NO: 867790 - DNA, 25 bp, Mus musculus
actggagtgaggtcaagggtcttct

SEQ ID NO: 867791 - DNA, 25 bp, Mus musculus
actggagtgaggtgaagaaacactg

SEQ ID NO: 867792 - DNA, 25 bp, Mus musculus
actggagttagacgtgaccatttga

SEQ ID NO: 867793 - DNA, 25 bp, Mus musculus
actggagttagaggtgaccatttga

SEQ ID NO: 867794 - DNA, 25 bp, Mus musculus
actggataacagagcctccggagcc

SEQ ID NO: 867795 - DNA, 25 bp, Mus musculus
actggataacagtgcctccggagcc

SEQ ID NO: 867796 - DNA, 25 bp, Mus musculus
actggataagcctagagaaggccgg

SEQ ID NO: 867797 - DNA, 25 bp, Mus musculus
actggataaggctagagaaggccgg

SEQ ID NO: 867798 - DNA, 25 bp, Mus musculus
actggatatgaacgggctgaagagg

SEQ ID NO: 867799 - DNA, 25 bp, Mus musculus
actggatatgaaggggctgaagagg

SEQ ID NO: 867800 - DNA, 25 bp, Mus musculus
actggatcctgacccacgctgttgc

SEQ ID NO: 867801 - DNA, 25 bp, Mus musculus
actggatcctgagccacgctgttgc

SEQ ID NO: 867802 - DNA, 25 bp, Mus musculus
actggatgatgcagtaaaaagaatc

SEQ ID NO: 867803 - DNA, 25 bp, Mus musculus
actggatgatgctgtaaaaagaatc

SEQ ID NO: 867804 - DNA, 25 bp, Mus musculus
actggatgggggctgtgccagcctt

SEQ ID NO: 867805 - DNA, 25 bp, Mus musculus
actggatggggggtgtgccagcctt

SEQ ID NO: 867806 - DNA, 25 bp, Mus musculus
actggcaacctgagcgtggccagga

SEQ ID NO: 867807 - DNA, 25 bp, Mus musculus
actggcaacctgagggtggccagga

SEQ ID NO: 867808 - DNA, 25 bp, Mus musculus
actggcaagagactgctaacagcca

SEQ ID NO: 867809 - DNA, 25 bp, Mus musculus
actggcaagagagtgctaacagcca

SEQ ID NO: 867810 - DNA, 25 bp, Mus musculus
actggcaatgaatgaatgcaaagtt

SEQ ID NO: 867811 - DNA, 25 bp, Mus musculus
actggcaatgtatgaatgcaaagtt

SEQ ID NO: 867812 - DNA, 25 bp, Mus musculus
actggcaattgccgttatcaatgtc

SEQ ID NO: 867813 - DNA, 25 bp, Mus musculus
actggcaattgcggttatcaatgtc

SEQ ID NO: 867814 - DNA, 25 bp, Mus musculus
actggcacagcgttactactcactt

SEQ ID NO: 867815 - DNA, 25 bp, Mus musculus
actggcacagggttactactcactt

SEQ ID NO: 867816 - DNA, 25 bp, Mus musculus
actggcacgaaaacctagtttcgtc

SEQ ID NO: 867817 - DNA, 25 bp, Mus musculus
actggcacgaaatcctagtttcgtc

SEQ ID NO: 867818 - DNA, 25 bp, Mus musculus
actggcactacacatgctcatgaca

SEQ ID NO: 867819 - DNA, 25 bp, Mus musculus
actggcactacagatgctcatgaca

SEQ ID NO: 867820 - DNA, 25 bp, Mus musculus
actggcagagtcctcgttgtgttag

SEQ ID NO: 867821 - DNA, 25 bp, Mus musculus
actggcagagtcctggttgtgttag

SEQ ID NO: 867822 - DNA, 25 bp, Mus musculus
actggcaggccacaacgtggcccag

SEQ ID NO: 867823 - DNA, 25 bp, Mus musculus
actggcaggccacatcgtggcccag

SEQ ID NO: 867824 - DNA, 25 bp, Mus musculus
actggcagtgagatccgccatcgcg

SEQ ID NO: 867825 - DNA, 25 bp, Mus musculus
actggcagtgagttccgccatcgcg

SEQ ID NO: 867826 - DNA, 25 bp, Mus musculus
actggccaaaatatatgagaagatc

SEQ ID NO: 867827 - DNA, 25 bp, Mus musculus
actggccaaaatatcctctgtgaag

SEQ ID NO: 867828 - DNA, 25 bp, Mus musculus
actggccaaaatttatgagaagatc

SEQ ID NO: 867829 - DNA, 25 bp, Mus musculus
actggccaaaatttcctctgtgaag

SEQ ID NO: 867830 - DNA, 25 bp, Mus musculus
actggccaagaccgggagcccactc

SEQ ID NO: 867831 - DNA, 25 bp, Mus musculus
actggccaagggcaagttcccccag

SEQ ID NO: 867832 - DNA, 25 bp, Mus musculus
actggccaaggggaagttcccccag

SEQ ID NO: 867833 - DNA, 25 bp, Mus musculus
actggccaagtccgggagcccactc

SEQ ID NO: 867834 - DNA, 25 bp, Mus musculus
actggccagaaacacatctggagaa

SEQ ID NO: 867835 - DNA, 25 bp, Mus musculus
actggccagaaacagatctggagaa

SEQ ID NO: 867836 - DNA, 25 bp, Mus musculus
actggccagaagcatgtcaatgggc

SEQ ID NO: 867837 - DNA, 25 bp, Mus musculus
actggccagaaggatgtcaatgggc

SEQ ID NO: 867838 - DNA, 25 bp, Mus musculus
actggccaggaagtgccgagggccc

SEQ ID NO: 867839 - DNA, 25 bp, Mus musculus
actggccaggcaatatggtgttcct

SEQ ID NO: 867840 - DNA, 25 bp, Mus musculus
actggccagggaatatggtgttcct

SEQ ID NO: 867841 - DNA, 25 bp, Mus musculus
actggccaggtagtgccgagggccc

SEQ ID NO: 867842 - DNA, 25 bp, Mus musculus
actggccattaacctgctggagtat

SEQ ID NO: 867843 - DNA, 25 bp, Mus musculus
actggccattaagctgctggagtat

SEQ ID NO: 867844 - DNA, 25 bp, Mus musculus
actggcccacagcattgcaaatgga

SEQ ID NO: 867845 - DNA, 25 bp, Mus musculus
actggcccacaggattgcaaatgga

SEQ ID NO: 867846 - DNA, 25 bp, Mus musculus
actggccctcagcctcagcagggaa

SEQ ID NO: 867847 - DNA, 25 bp, Mus musculus
actggccctcaggctcagcagggaa

SEQ ID NO: 867848 - DNA, 25 bp, Mus musculus
actggccctgctctctgctctctgc

SEQ ID NO: 867849 - DNA, 25 bp, Mus musculus
actggccctggtctctgctctctgc

SEQ ID NO: 867850 - DNA, 25 bp, Mus musculus
actggccgagcgatggaattcgaag

SEQ ID NO: 867851 - DNA, 25 bp, Mus musculus
actggccgagggatggaattcgaag

SEQ ID NO: 867852 - DNA, 25 bp, Mus musculus
actggccgtaaaaggttcagactgg

SEQ ID NO: 867853 - DNA, 25 bp, Mus musculus
actggccgtaaatggttcagactgg

SEQ ID NO: 867854 - DNA, 25 bp, Mus musculus
actggcctggcaggggagcacaaaa

SEQ ID NO: 867855 - DNA, 25 bp, Mus musculus
actggcctgggaggggagcacaaaa

SEQ ID NO: 867856 - DNA, 25 bp, Mus musculus
actggcgagtagcacgaataaacac

SEQ ID NO: 867857 - DNA, 25 bp, Mus musculus
actggcgagtagcaggaataaacac

SEQ ID NO: 867858 - DNA, 25 bp, Mus musculus
actggctacactctcaacagcgaga

SEQ ID NO: 867859 - DNA, 25 bp, Mus musculus
actggctacagtctcaacagcgaga

SEQ ID NO: 867860 - DNA, 25 bp, Mus musculus
actggctgaaagacaaacccgtggt

SEQ ID NO: 867861 - DNA, 25 bp, Mus musculus
actggctgaaagtcaaacccgtggt

SEQ ID NO: 867862 - DNA, 25 bp, Mus musculus
actggctgactgcacatctgatttg

SEQ ID NO: 867863 - DNA, 25 bp, Mus musculus
actggctgactgcagatctgatttg

SEQ ID NO: 867864 - DNA, 25 bp, Mus musculus
actggctggaaacgccaagaccaag

SEQ ID NO: 867865 - DNA, 25 bp, Mus musculus
actggctggaaaggccaagaccaag

SEQ ID NO: 867866 - DNA, 25 bp, Mus musculus
actggctgtctgaccaagtaactta

SEQ ID NO: 867867 - DNA, 25 bp, Mus musculus
actggctgtctgctttaacttgcac

SEQ ID NO: 867868 - DNA, 25 bp, Mus musculus
actggctgtctggtttaacttgcac

SEQ ID NO: 867869 - DNA, 25 bp, Mus musculus
actggctgtctgtccaagtaactta

SEQ ID NO: 867870 - DNA, 25 bp, Mus musculus
actgggaaaagcagaggatggtagc

SEQ ID NO: 867871 - DNA, 25 bp, Mus musculus
actgggaaaagctgaggatggtagc

SEQ ID NO: 867872 - DNA, 25 bp, Mus musculus
actgggaccgagcctgcaggtgtat

SEQ ID NO: 867873 - DNA, 25 bp, Mus musculus
actgggaccgtgcctgcaggtgtat

SEQ ID NO: 867874 - DNA, 25 bp, Mus musculus
actgggataaagcattccagcagat

SEQ ID NO: 867875 - DNA, 25 bp, Mus musculus
actgggataaaggattccagcagat

SEQ ID NO: 867876 - DNA, 25 bp, Mus musculus
actgggatcgggcacgttggtggaa

SEQ ID NO: 867877 - DNA, 25 bp, Mus musculus
actgggatcgggcaggttggtggaa

SEQ ID NO: 867878 - DNA, 25 bp, Mus musculus
actgggattaaacatggcagacttt

SEQ ID NO: 867879 - DNA, 25 bp, Mus musculus
actgggattaaagatggcagacttt

SEQ ID NO: 867880 - DNA, 25 bp, Mus musculus
actgggattacacgggctgagattt

SEQ ID NO: 867881 - DNA, 25 bp, Mus musculus
actgggattacaggggctgagattt

SEQ ID NO: 867882 - DNA, 25 bp, Mus musculus
actggggaacagatccagagctggt

SEQ ID NO: 867883 - DNA, 25 bp, Mus musculus
actggggaacagttccagagctggt

SEQ ID NO: 867884 - DNA, 25 bp, Mus musculus
actggggaggaacgtgacctggctg

SEQ ID NO: 867885 - DNA, 25 bp, Mus musculus
actggggaggaaggtgacctggctg

SEQ ID NO: 867886 - DNA, 25 bp, Mus musculus
actggggccgctgattccctctgct

SEQ ID NO: 867887 - DNA, 25 bp, Mus musculus
actggggccggtgattccctctgct

SEQ ID NO: 867888 - DNA, 25 bp, Mus musculus
actggggtactgctgcaggtcctgg

SEQ ID NO: 867889 - DNA, 25 bp, Mus musculus
actggggtactggtgcaggtcctgg

SEQ ID NO: 867890 - DNA, 25 bp, Mus musculus
actgggtatcaaattatgaaaaata

SEQ ID NO: 867891 - DNA, 25 bp, Mus musculus
actgggtatcaatttatgaaaaata

SEQ ID NO: 867892 - DNA, 25 bp, Mus musculus
actgggtttatgaacaggaagtctt

SEQ ID NO: 867893 - DNA, 25 bp, Mus musculus
actgggtttatgaagaggaagtctt

SEQ ID NO: 867894 - DNA, 25 bp, Mus musculus
actggtacagaacaatatctccctg

SEQ ID NO: 867895 - DNA, 25 bp, Mus musculus
actggtacagtacaatatctccctg

SEQ ID NO: 867896 - DNA, 25 bp, Mus musculus
actggtagcccccacctcaattcac

SEQ ID NO: 867897 - DNA, 25 bp, Mus musculus
actggtagcccccagctcaattcac

SEQ ID NO: 867898 - DNA, 25 bp, Mus musculus
actggtcaacacaaaacacagatac

SEQ ID NO: 867899 - DNA, 25 bp, Mus musculus
actggtcaacactaaacacagatac

SEQ ID NO: 867900 - DNA, 25 bp, Mus musculus
actggtcagccacagccaagctgtg

SEQ ID NO: 867901 - DNA, 25 bp, Mus musculus
actggtcagccagagccaagctgtg

SEQ ID NO: 867902 - DNA, 25 bp, Mus musculus
actggtcctcagccattaacaagtg

SEQ ID NO: 867903 - DNA, 25 bp, Mus musculus
actggtcctcaggcattaacaagtg

SEQ ID NO: 867904 - DNA, 25 bp, Mus musculus
actggtcctcggcgcataacgagtg

SEQ ID NO: 867905 - DNA, 25 bp, Mus musculus
actggtcctcggggcataacgagtg

SEQ ID NO: 867906 - DNA, 25 bp, Mus musculus
actggtgcagattctgggcctcacc

SEQ ID NO: 867907 - DNA, 25 bp, Mus musculus
actggtgcagctgtatccagatggc

SEQ ID NO: 867908 - DNA, 25 bp, Mus musculus
actggtgcaggtgtatccagatggc

SEQ ID NO: 867909 - DNA, 25 bp, Mus musculus
actggtgcagtttctgggcctcacc

SEQ ID NO: 867910 - DNA, 25 bp, Mus musculus
actggtgcctattcccccacagact

SEQ ID NO: 867911 - DNA, 25 bp, Mus musculus
actggtgccttttcccccacagact

SEQ ID NO: 867912 - DNA, 25 bp, Mus musculus
actggtgctccgcaacgagaagtgt

SEQ ID NO: 867913 - DNA, 25 bp, Mus musculus
actggtgctccggaacgagaagtgt

SEQ ID NO: 867914 - DNA, 25 bp, Mus musculus
actggtggagcaagaaatagtatct

SEQ ID NO: 867915 - DNA, 25 bp, Mus musculus
actggtggaggaagaaatagtatct

SEQ ID NO: 867916 - DNA, 25 bp, Mus musculus
actggtgggcagcgccttcgtatac

SEQ ID NO: 867917 - DNA, 25 bp, Mus musculus
actggtgggcagcttcatgttgtgt

SEQ ID NO: 867918 - DNA, 25 bp, Mus musculus
actggtgggcagggccttcgtatac

SEQ ID NO: 867919 - DNA, 25 bp, Mus musculus
actggtgggcaggttcatgttgtgt

SEQ ID NO: 867920 - DNA, 25 bp, Mus musculus
actggtgtcaagcctgagggatctg

SEQ ID NO: 867921 - DNA, 25 bp, Mus musculus
actggtgtcaagctcccagactcca

SEQ ID NO: 867922 - DNA, 25 bp, Mus musculus
actggtgtcaaggctgagggatctg

SEQ ID NO: 867923 - DNA, 25 bp, Mus musculus
actggtgtcaaggtcccagactcca

SEQ ID NO: 867924 - DNA, 25 bp, Mus musculus
actggttatgcatccatctgttggc

SEQ ID NO: 867925 - DNA, 25 bp, Mus musculus
actggttatgctttccatgaagtgg

SEQ ID NO: 867926 - DNA, 25 bp, Mus musculus
actggttatggatccatctgttggc

SEQ ID NO: 867927 - DNA, 25 bp, Mus musculus
actggttatggtttccatgaagtgg

SEQ ID NO: 867928 - DNA, 25 bp, Mus musculus
actggttgagatcctctttaggagg

SEQ ID NO: 867929 - DNA, 25 bp, Mus musculus
actggttgagcgcaatggcatctcc

SEQ ID NO: 867930 - DNA, 25 bp, Mus musculus
actggttgagggcaatggcatctcc

SEQ ID NO: 867931 - DNA, 25 bp, Mus musculus
actggttgagttcctctttaggagg

SEQ ID NO: 867932 - DNA, 25 bp, Mus musculus
actggtttctcacacccctatgtga

SEQ ID NO: 867933 - DNA, 25 bp, Mus musculus
actggtttctcagacccctatgtga

SEQ ID NO: 867934 - DNA, 25 bp, Mus musculus
actggttttggacgctgataagctg

SEQ ID NO: 867935 - DNA, 25 bp, Mus musculus
actggttttggaggctgataagctg

SEQ ID NO: 867936 - DNA, 25 bp, Mus musculus
actgtaaggcccatcctttgtgaga

SEQ ID NO: 867937 - DNA, 25 bp, Mus musculus
actgtaaggcccttcctttgtgaga

SEQ ID NO: 867938 - DNA, 25 bp, Mus musculus
actgtaatcgatgagatccgaaatg

SEQ ID NO: 867939 - DNA, 25 bp, Mus musculus
actgtaatcgttgagatccgaaatg

SEQ ID NO: 867940 - DNA, 25 bp, Mus musculus
actgtacaagcacgccacagaagga

SEQ ID NO: 867941 - DNA, 25 bp, Mus musculus
actgtacaagcaggccacagaagga

SEQ ID NO: 867942 - DNA, 25 bp, Mus musculus
actgtacagcctatcgtcgggagga

SEQ ID NO: 867943 - DNA, 25 bp, Mus musculus
actgtacagcctatggtcgggagga

SEQ ID NO: 867944 - DNA, 25 bp, Mus musculus
actgtaccagagacttcaatgcaga

SEQ ID NO: 867945 - DNA, 25 bp, Mus musculus
actgtaccagccccagtctgtgcga

SEQ ID NO: 867946 - DNA, 25 bp, Mus musculus
actgtaccagcgccacaccctacgc

SEQ ID NO: 867947 - DNA, 25 bp, Mus musculus
actgtaccaggcccagtctgtgcga

SEQ ID NO: 867948 - DNA, 25 bp, Mus musculus
actgtaccagggccacaccctacgc

SEQ ID NO: 867949 - DNA, 25 bp, Mus musculus
actgtaccagtgacttcaatgcaga

SEQ ID NO: 867950 - DNA, 25 bp, Mus musculus
actgtaccatccctgagatctggac

SEQ ID NO: 867951 - DNA, 25 bp, Mus musculus
actgtaccatccgtgagatctggac

SEQ ID NO: 867952 - DNA, 25 bp, Mus musculus
actgtactcaagacctggatcagtg

SEQ ID NO: 867953 - DNA, 25 bp, Mus musculus
actgtactcaagactgcaggcgcta

SEQ ID NO: 867954 - DNA, 25 bp, Mus musculus
actgtactcaagtcctggatcagtg

SEQ ID NO: 867955 - DNA, 25 bp, Mus musculus
actgtactcaagtctgcaggcgcta

SEQ ID NO: 867956 - DNA, 25 bp, Mus musculus
actgtactgagacctcctgcttcaa

SEQ ID NO: 867957 - DNA, 25 bp, Mus musculus
actgtactgagagctcctgcttcaa

SEQ ID NO: 867958 - DNA, 25 bp, Mus musculus
actgtagtggaacaagaatgactgt

SEQ ID NO: 867959 - DNA, 25 bp, Mus musculus
actgtagtggaacagaaatcactgt

SEQ ID NO: 867960 - DNA, 25 bp, Mus musculus
actgtagtggaagaagaatgactgt

SEQ ID NO: 867961 - DNA, 25 bp, Mus musculus
actgtagtggaagagaaatcactgt

SEQ ID NO: 867962 - DNA, 25 bp, Mus musculus
actgtagtttctctgttcctggtgg

SEQ ID NO: 867963 - DNA, 25 bp, Mus musculus
actgtagtttctgtgttcctggtgg

SEQ ID NO: 867964 - DNA, 25 bp, Mus musculus
actgtatcaaaccctacctggggga

SEQ ID NO: 867965 - DNA, 25 bp, Mus musculus
actgtatcaaacgctacctggggga

SEQ ID NO: 867966 - DNA, 25 bp, Mus musculus
actgtatcattacacaatttgcaaa

SEQ ID NO: 867967 - DNA, 25 bp, Mus musculus
actgtatcattacagaatttgcaaa

SEQ ID NO: 867968 - DNA, 25 bp, Mus musculus
actgtatgaccacaattatcccatc

SEQ ID NO: 867969 - DNA, 25 bp, Mus musculus
actgtatgaccagaattatcccatc

SEQ ID NO: 867970 - DNA, 25 bp, Mus musculus
actgtatggcaccaatgaggaagag

SEQ ID NO: 867971 - DNA, 25 bp, Mus musculus
actgtatggcacgaatgaggaagag

SEQ ID NO: 867972 - DNA, 25 bp, Mus musculus
actgtatgggggcacgtggctttgt

SEQ ID NO: 867973 - DNA, 25 bp, Mus musculus
actgtatgggggcaggtggctttgt

SEQ ID NO: 867974 - DNA, 25 bp, Mus musculus
actgtcaagaagctaatatcttatt

SEQ ID NO: 867975 - DNA, 25 bp, Mus musculus
actgtcaagaaggtaatatcttatt

SEQ ID NO: 867976 - DNA, 25 bp, Mus musculus
actgtcaagcacggcgcgggggcag

SEQ ID NO: 867977 - DNA, 25 bp, Mus musculus
actgtcaagcacggggcgggggcag

SEQ ID NO: 867978 - DNA, 25 bp, Mus musculus
actgtcacaaggatcacatgaaagg

SEQ ID NO: 867979 - DNA, 25 bp, Mus musculus
actgtcacaaggttcacatgaaagg

SEQ ID NO: 867980 - DNA, 25 bp, Mus musculus
actgtcactgcacgccacagcccca

SEQ ID NO: 867981 - DNA, 25 bp, Mus musculus
actgtcactgcaggccacagcccca

SEQ ID NO: 867982 - DNA, 25 bp, Mus musculus
actgtcagacagctttggccgcaag

SEQ ID NO: 867983 - DNA, 25 bp, Mus musculus
actgtcagacaggtttggccgcaag

SEQ ID NO: 867984 - DNA, 25 bp, Mus musculus
actgtcagcctgctactttctgcag

SEQ ID NO: 867985 - DNA, 25 bp, Mus musculus
actgtcagcctggtactttctgcag

SEQ ID NO: 867986 - DNA, 25 bp, Mus musculus
actgtcaggactctcccagtgaata

SEQ ID NO: 867987 - DNA, 25 bp, Mus musculus
actgtcaggagtctcccagtgaata

SEQ ID NO: 867988 - DNA, 25 bp, Mus musculus
actgtcatccttctctcattgggag

SEQ ID NO: 867989 - DNA, 25 bp, Mus musculus
actgtcatccttgtctcattgggag

SEQ ID NO: 867990 - DNA, 25 bp, Mus musculus
actgtcattgagaactgccccaagc

SEQ ID NO: 867991 - DNA, 25 bp, Mus musculus
actgtcattgagaagtgccccaagc

SEQ ID NO: 867992 - DNA, 25 bp, Mus musculus
actgtccaagacccagcaactacat

SEQ ID NO: 867993 - DNA, 25 bp, Mus musculus
actgtccaagaggacacgggccttt

SEQ ID NO: 867994 - DNA, 25 bp, Mus musculus
actgtccaagcgcccaagtccagca

SEQ ID NO: 867995 - DNA, 25 bp, Mus musculus
actgtccaagggcccaagtccagca

SEQ ID NO: 867996 - DNA, 25 bp, Mus musculus
actgtccaagtcccagcaactacat

SEQ ID NO: 867997 - DNA, 25 bp, Mus musculus
actgtccaagtggacacgggccttt

SEQ ID NO: 867998 - DNA, 25 bp, Mus musculus
actgtccacctgattgaattcgcca

SEQ ID NO: 867999 - DNA, 25 bp, Mus musculus
actgtccacctgtttgaattcgcca

SEQ ID NO: 868000 - DNA, 25 bp, Mus musculus
actgtccctcaaaggcacgctcctg

SEQ ID NO: 868001 - DNA, 25 bp, Mus musculus
actgtccctcaaattcgaggactcc

SEQ ID NO: 868002 - DNA, 25 bp, Mus musculus
actgtccctcaacttgcctgcagga

SEQ ID NO: 868003 - DNA, 25 bp, Mus musculus
actgtccctcaagttgcctgcagga

SEQ ID NO: 868004 - DNA, 25 bp, Mus musculus
actgtccctcaatggcacgctcctg

SEQ ID NO: 868005 - DNA, 25 bp, Mus musculus
actgtccctcaatttcgaggactcc

SEQ ID NO: 868006 - DNA, 25 bp, Mus musculus
actgtccctgcatgcggcgctttgg

SEQ ID NO: 868007 - DNA, 25 bp, Mus musculus
actgtccctgcatggggcgctttgg

SEQ ID NO: 868008 - DNA, 25 bp, Mus musculus
actgtcctcaaacagatctttgcaa

SEQ ID NO: 868009 - DNA, 25 bp, Mus musculus
actgtcctcaaagagatctttgcaa

SEQ ID NO: 868010 - DNA, 25 bp, Mus musculus
actgtctctgcacagtctgcgagaa

SEQ ID NO: 868011 - DNA, 25 bp, Mus musculus
actgtctctgcagagtctgcgagaa

SEQ ID NO: 868012 - DNA, 25 bp, Mus musculus
actgtctggaagctcgctgtgctat

SEQ ID NO: 868013 - DNA, 25 bp, Mus musculus
actgtctggaaggtcgctgtgctat

SEQ ID NO: 868014 - DNA, 25 bp, Mus musculus
actgtctttgcaatcaccactgttt

SEQ ID NO: 868015 - DNA, 25 bp, Mus musculus
actgtctttggaatcaccactgttt

SEQ ID NO: 868016 - DNA, 25 bp, Mus musculus
actgtgaaacagacaagcagatggg

SEQ ID NO: 868017 - DNA, 25 bp, Mus musculus
actgtgaaacagcgaagcagctggc

SEQ ID NO: 868018 - DNA, 25 bp, Mus musculus
actgtgaaacagggaagcagctggc

SEQ ID NO: 868019 - DNA, 25 bp, Mus musculus
actgtgaaacagtcaagcagatggg

SEQ ID NO: 868020 - DNA, 25 bp, Mus musculus
actgtgaacagtacaaattccatca

SEQ ID NO: 868021 - DNA, 25 bp, Mus musculus
actgtgaacagtataaagcatgcta

SEQ ID NO: 868022 - DNA, 25 bp, Mus musculus
actgtgaacagttcaaattccatca

SEQ ID NO: 868023 - DNA, 25 bp, Mus musculus
actgtgaacagtttaaagcatgcta

SEQ ID NO: 868024 - DNA, 25 bp, Mus musculus
actgtgaagatggacagcttcccta

SEQ ID NO: 868025 - DNA, 25 bp, Mus musculus
actgtgaagatggagagcttcccta

SEQ ID NO: 868026 - DNA, 25 bp, Mus musculus
actgtgacagcagggctggcggcac

SEQ ID NO: 868027 - DNA, 25 bp, Mus musculus
actgtgacaggagggctggcggcac

SEQ ID NO: 868028 - DNA, 25 bp, Mus musculus
actgtgacatcacacctggtgaatg

SEQ ID NO: 868029 - DNA, 25 bp, Mus musculus
actgtgacatcacagctggtgaatg

SEQ ID NO: 868030 - DNA, 25 bp, Mus musculus
actgtgacctgcttcgttcaactgg

SEQ ID NO: 868031 - DNA, 25 bp, Mus musculus
actgtgacctgcttggttcaactgg

SEQ ID NO: 868032 - DNA, 25 bp, Mus musculus
actgtgagataaattgtcagaaaat

SEQ ID NO: 868033 - DNA, 25 bp, Mus musculus
actgtgagattaattgtcagaaaat

SEQ ID NO: 868034 - DNA, 25 bp, Mus musculus
actgtgatctacagtacagagctat

SEQ ID NO: 868035 - DNA, 25 bp, Mus musculus
actgtgatctactgtacagagctat

SEQ ID NO: 868036 - DNA, 25 bp, Mus musculus
actgtgcacaaggcccccagagtgt

SEQ ID NO: 868037 - DNA, 25 bp, Mus musculus
actgtgcacatggcccccagagtgt

SEQ ID NO: 868038 - DNA, 25 bp, Mus musculus
actgtgcaggatgaaaacgaggctc

SEQ ID NO: 868039 - DNA, 25 bp, Mus musculus
actgtgcaggttgaaaacgaggctc

SEQ ID NO: 868040 - DNA, 25 bp, Mus musculus
actgtgcattatgcgccaactatca

SEQ ID NO: 868041 - DNA, 25 bp, Mus musculus
actgtgcattttgcgccaactatca

SEQ ID NO: 868042 - DNA, 25 bp, Mus musculus
actgtgccaagaaactctgacctct

SEQ ID NO: 868043 - DNA, 25 bp, Mus musculus
actgtgccaagaaagtctgacctct

SEQ ID NO: 868044 - DNA, 25 bp, Mus musculus
actgtgcgcaatggatctgtccgtg

SEQ ID NO: 868045 - DNA, 25 bp, Mus musculus
actgtgcgcattggatctgtccgtg

SEQ ID NO: 868046 - DNA, 25 bp, Mus musculus
actgtgcggcgacacacaccagaag

SEQ ID NO: 868047 - DNA, 25 bp, Mus musculus
actgtgcggcgacatcccacgggtt

SEQ ID NO: 868048 - DNA, 25 bp, Mus musculus
actgtgcggcgagacacaccagaag

SEQ ID NO: 868049 - DNA, 25 bp, Mus musculus
actgtgcggcgagatcccacgggtt

SEQ ID NO: 868050 - DNA, 25 bp, Mus musculus
actgtgctaaaggcccacgttgtgt

SEQ ID NO: 868051 - DNA, 25 bp, Mus musculus
actgtgctaatggcccacgttgtgt

SEQ ID NO: 868052 - DNA, 25 bp, Mus musculus
actgtgctcgcaatcccacagaaac

SEQ ID NO: 868053 - DNA, 25 bp, Mus musculus
actgtgctcggaatcccacagaaac

SEQ ID NO: 868054 - DNA, 25 bp, Mus musculus
actgtgctctacccagcccaggtga

SEQ ID NO: 868055 - DNA, 25 bp, Mus musculus
actgtgctcttcccagcccaggtga

SEQ ID NO: 868056 - DNA, 25 bp, Mus musculus
actgtgctggagccccccagtcacc

SEQ ID NO: 868057 - DNA, 25 bp, Mus musculus
actgtgctggtgccccccagtcacc

SEQ ID NO: 868058 - DNA, 25 bp, Mus musculus
actgtggaatgttacagactcagcc

SEQ ID NO: 868059 - DNA, 25 bp, Mus musculus
actgtggaatgttactacagagact

SEQ ID NO: 868060 - DNA, 25 bp, Mus musculus
actgtggaatgttagagactcagcc

SEQ ID NO: 868061 - DNA, 25 bp, Mus musculus
actgtggaatgttagtacagagact

SEQ ID NO: 868062 - DNA, 25 bp, Mus musculus
actgtggacatgatgtacggtggca

SEQ ID NO: 868063 - DNA, 25 bp, Mus musculus
actgtggacatgttgtacggtggca

SEQ ID NO: 868064 - DNA, 25 bp, Mus musculus
actgtggagaagcgtcaactgctgc

SEQ ID NO: 868065 - DNA, 25 bp, Mus musculus
actgtggagaagcgtttcaaagctg

SEQ ID NO: 868066 - DNA, 25 bp, Mus musculus
actgtggagaagggtcaactgctgc

SEQ ID NO: 868067 - DNA, 25 bp, Mus musculus
actgtggagaagggtttcaaagctg

SEQ ID NO: 868068 - DNA, 25 bp, Mus musculus
actgtggcacagagaaatgctttga

SEQ ID NO: 868069 - DNA, 25 bp, Mus musculus
actgtggcacagtgaaatgctttga

SEQ ID NO: 868070 - DNA, 25 bp, Mus musculus
actgtggccgtactgccccttcctg

SEQ ID NO: 868071 - DNA, 25 bp, Mus musculus
actgtggccgtagtgccccttcctg

SEQ ID NO: 868072 - DNA, 25 bp, Mus musculus
actgtgggaacacgaacagaatgga

SEQ ID NO: 868073 - DNA, 25 bp, Mus musculus
actgtgggaacacgtattgaagccc

SEQ ID NO: 868074 - DNA, 25 bp, Mus musculus
actgtgggaacaggaacagaatgga

SEQ ID NO: 868075 - DNA, 25 bp, Mus musculus
actgtgggaacaggtattgaagccc

SEQ ID NO: 868076 - DNA, 25 bp, Mus musculus
actgtggggtctgccttcttcacaa

SEQ ID NO: 868077 - DNA, 25 bp, Mus musculus
actgtggggtgtgccttcttcacaa

SEQ ID NO: 868078 - DNA, 25 bp, Mus musculus
actgtggtacagccaaaattggcaa

SEQ ID NO: 868079 - DNA, 25 bp, Mus musculus
actgtggtacaggcaaaattggcaa

SEQ ID NO: 868080 - DNA, 25 bp, Mus musculus
actgtggttgcctgggacccacgaa

SEQ ID NO: 868081 - DNA, 25 bp, Mus musculus
actgtggttgctgagcggggcacaa

SEQ ID NO: 868082 - DNA, 25 bp, Mus musculus
actgtggttggctgggacccacgaa

SEQ ID NO: 868083 - DNA, 25 bp, Mus musculus
actgtggttggtgagcggggcacaa

SEQ ID NO: 868084 - DNA, 25 bp, Mus musculus
actgtgtaaaagcccttaaccatgg

SEQ ID NO: 868085 - DNA, 25 bp, Mus musculus
actgtgtaaaaggccttaaccatgg

SEQ ID NO: 868086 - DNA, 25 bp, Mus musculus
actgtgtacttcaacggaggcaagt

SEQ ID NO: 868087 - DNA, 25 bp, Mus musculus
actgtgtacttcaagggaggcaagt

SEQ ID NO: 868088 - DNA, 25 bp, Mus musculus
actgtgtatattcttctggataaag

SEQ ID NO: 868089 - DNA, 25 bp, Mus musculus
actgtgtatattgttctggataaag

SEQ ID NO: 868090 - DNA, 25 bp, Mus musculus
actgtgtcagctgtggcccatagag

SEQ ID NO: 868091 - DNA, 25 bp, Mus musculus
actgtgtcaggtgtggcccatagag

SEQ ID NO: 868092 - DNA, 25 bp, Mus musculus
actgtgtctaaacggcttctctgcc

SEQ ID NO: 868093 - DNA, 25 bp, Mus musculus
actgtgtctaaacgtaaaacagact

SEQ ID NO: 868094 - DNA, 25 bp, Mus musculus
actgtgtctaaagggcttctctgcc

SEQ ID NO: 868095 - DNA, 25 bp, Mus musculus
actgtgtctaaaggtaaaacagact

SEQ ID NO: 868096 - DNA, 25 bp, Mus musculus
actgtgtgcttctgaagaaggggtg

SEQ ID NO: 868097 - DNA, 25 bp, Mus musculus
actgtgtgcttctgtagaaggggtg

SEQ ID NO: 868098 - DNA, 25 bp, Mus musculus
actgtgtggaagaacccctcagcag

SEQ ID NO: 868099 - DNA, 25 bp, Mus musculus
actgtgtggaagtacccctcagcag

SEQ ID NO: 868100 - DNA, 25 bp, Mus musculus
actgtgtgtctgcctcgtgcctcaa

SEQ ID NO: 868101 - DNA, 25 bp, Mus musculus
actgtgtgtctggctcgtgcctcaa

SEQ ID NO: 868102 - DNA, 25 bp, Mus musculus
actgtgtgtgcgatggagtttgcag

SEQ ID NO: 868103 - DNA, 25 bp, Mus musculus
actgtgtgtgcgttggagtttgcag

SEQ ID NO: 868104 - DNA, 25 bp, Mus musculus
actgtgttagatgaacccacagtga

SEQ ID NO: 868105 - DNA, 25 bp, Mus musculus
actgtgttagatgctcctgaagttt

SEQ ID NO: 868106 - DNA, 25 bp, Mus musculus
actgtgttagttgaacccacagtga

SEQ ID NO: 868107 - DNA, 25 bp, Mus musculus
actgtgttagttgctcctgaagttt

SEQ ID NO: 868108 - DNA, 25 bp, Mus musculus
actgtgttctagactcaagaatgaa

SEQ ID NO: 868109 - DNA, 25 bp, Mus musculus
actgtgttctagtctcaagaatgaa

SEQ ID NO: 868110 - DNA, 25 bp, Mus musculus
actgtgttggagatgacatcaccat

SEQ ID NO: 868111 - DNA, 25 bp, Mus musculus
actgtgttggagttgacatcaccat

SEQ ID NO: 868112 - DNA, 25 bp, Mus musculus
actgtgttggctcacgagggtgtga

SEQ ID NO: 868113 - DNA, 25 bp, Mus musculus
actgtgttggctcaggagggtgtga

SEQ ID NO: 868114 - DNA, 25 bp, Mus musculus
actgttatctaatgatactcctgaa

SEQ ID NO: 868115 - DNA, 25 bp, Mus musculus
actgttatcttatgatactcctgaa

SEQ ID NO: 868116 - DNA, 25 bp, Mus musculus
actgttcaaaatcgaacaccaaaca

SEQ ID NO: 868117 - DNA, 25 bp, Mus musculus
actgttcaaaatggaacaccaaaca

SEQ ID NO: 868118 - DNA, 25 bp, Mus musculus
actgttcaaaccaacagtggcctcc

SEQ ID NO: 868119 - DNA, 25 bp, Mus musculus
actgttcaaaccaagagtggcctcc

SEQ ID NO: 868120 - DNA, 25 bp, Mus musculus
actgttcagcagctccagtgtccca

SEQ ID NO: 868121 - DNA, 25 bp, Mus musculus
actgttcagcaggtccagtgtccca

SEQ ID NO: 868122 - DNA, 25 bp, Mus musculus
actgttctgcagctacatttgtcaa

SEQ ID NO: 868123 - DNA, 25 bp, Mus musculus
actgttctgcaggtacatttgtcaa

SEQ ID NO: 868124 - DNA, 25 bp, Mus musculus
actgttctggaacctgatgttgttg

SEQ ID NO: 868125 - DNA, 25 bp, Mus musculus
actgttctggtacctgatgttgttg

SEQ ID NO: 868126 - DNA, 25 bp, Mus musculus
actgttcttgatatacatgataatc

SEQ ID NO: 868127 - DNA, 25 bp, Mus musculus
actgttcttgatccataacaaactg

SEQ ID NO: 868128 - DNA, 25 bp, Mus musculus
actgttcttgatgcataacaaactg

SEQ ID NO: 868129 - DNA, 25 bp, Mus musculus
actgttcttgatttacatgataatc

SEQ ID NO: 868130 - DNA, 25 bp, Mus musculus
actgttgcttcccacaggaagtcac

SEQ ID NO: 868131 - DNA, 25 bp, Mus musculus
actgttgcttcccagaggaagtcac

SEQ ID NO: 868132 - DNA, 25 bp, Mus musculus
actgttggcccacgtgacaagctac

SEQ ID NO: 868133 - DNA, 25 bp, Mus musculus
actgttggcccaggtgacaagctac

SEQ ID NO: 868134 - DNA, 25 bp, Mus musculus
actgttgtggctcaaaaggaccgtc

SEQ ID NO: 868135 - DNA, 25 bp, Mus musculus
actgttgtggctgaaaaggaccgtc

SEQ ID NO: 868136 - DNA, 25 bp, Mus musculus
actgtttcagaaatgctgcaaccct

SEQ ID NO: 868137 - DNA, 25 bp, Mus musculus
actgtttcagtaatgctgcaaccct

SEQ ID NO: 868138 - DNA, 25 bp, Mus musculus
actgttttcacacgaactggtgact

SEQ ID NO: 868139 - DNA, 25 bp, Mus musculus
actgttttcacaggaactggtgact

SEQ ID NO: 868140 - DNA, 25 bp, Mus musculus
acttaaagaaaacctgaaagcaatg

SEQ ID NO: 868141 - DNA, 25 bp, Mus musculus
acttaaagaaaagctgaaagcaatg

SEQ ID NO: 868142 - DNA, 25 bp, Mus musculus
acttaagagtatctgtgtcccggct

SEQ ID NO: 868143 - DNA, 25 bp, Mus musculus
acttaagagtttctgtgtcccggct

SEQ ID NO: 868144 - DNA, 25 bp, Mus musculus
acttaagtacaacaaaggaggtgtg

SEQ ID NO: 868145 - DNA, 25 bp, Mus musculus
acttaagtacaagaaaggaggtgtg

SEQ ID NO: 868146 - DNA, 25 bp, Mus musculus
acttaagtaccacgtgctggacgga

SEQ ID NO: 868147 - DNA, 25 bp, Mus musculus
acttaagtaccaggtgctggacgga

SEQ ID NO: 868148 - DNA, 25 bp, Mus musculus
acttaataacactgtctggctgccc

SEQ ID NO: 868149 - DNA, 25 bp, Mus musculus
acttaataactctgtctggctgccc

SEQ ID NO: 868150 - DNA, 25 bp, Mus musculus
acttaatatgcgtccggaccagtcc

SEQ ID NO: 868151 - DNA, 25 bp, Mus musculus
acttaatatgcgtcgggaccagtcc

SEQ ID NO: 868152 - DNA, 25 bp, Mus musculus
acttaatgtcagccataacaaactg

SEQ ID NO: 868153 - DNA, 25 bp, Mus musculus
acttaatgtcaggcataacaaactg

SEQ ID NO: 868154 - DNA, 25 bp, Mus musculus
acttaattttctatcgtgccattaa

SEQ ID NO: 868155 - DNA, 25 bp, Mus musculus
acttaattttctatggtgccattaa

SEQ ID NO: 868156 - DNA, 25 bp, Mus musculus
acttacacagataccaggaatggtc

SEQ ID NO: 868157 - DNA, 25 bp, Mus musculus
acttacacagttaccaggaatggtc

SEQ ID NO: 868158 - DNA, 25 bp, Mus musculus
acttacacttcaacggtctgagcgc

SEQ ID NO: 868159 - DNA, 25 bp, Mus musculus
acttacacttcaagatgtttgatgt

SEQ ID NO: 868160 - DNA, 25 bp, Mus musculus
acttacacttcatcggtctgagcgc

SEQ ID NO: 868161 - DNA, 25 bp, Mus musculus
acttacacttcatgatgtttgatgt

SEQ ID NO: 868162 - DNA, 25 bp, Mus musculus
acttacagcacacacgcagaggtgt

SEQ ID NO: 868163 - DNA, 25 bp, Mus musculus
acttacagcacacaggcagaggtgt

SEQ ID NO: 868164 - DNA, 25 bp, Mus musculus
acttacaggaagttgtgccagccat

SEQ ID NO: 868165 - DNA, 25 bp, Mus musculus
acttacaggaggatgtgccagccat

SEQ ID NO: 868166 - DNA, 25 bp, Mus musculus
acttacaggaggttgtgccagccat

SEQ ID NO: 868167 - DNA, 25 bp, Mus musculus
acttacaggatgttgtgccagccat

SEQ ID NO: 868168 - DNA, 25 bp, Mus musculus
acttacattgatgaaccagagcctc

SEQ ID NO: 868169 - DNA, 25 bp, Mus musculus
acttacattgttgaaccagagcctc

SEQ ID NO: 868170 - DNA, 25 bp, Mus musculus
acttacgactacagaagtgacctct

SEQ ID NO: 868171 - DNA, 25 bp, Mus musculus
acttacgactacagtagtgacctct

SEQ ID NO: 868172 - DNA, 25 bp, Mus musculus
acttacgccaagcgcttcaccatta

SEQ ID NO: 868173 - DNA, 25 bp, Mus musculus
acttacgccaagggcttcaccatta

SEQ ID NO: 868174 - DNA, 25 bp, Mus musculus
acttacgttcactccagacctatga

SEQ ID NO: 868175 - DNA, 25 bp, Mus musculus
acttacgttcactcgagacctatga

SEQ ID NO: 868176 - DNA, 25 bp, Mus musculus
acttagacagacttacaacagctgt

SEQ ID NO: 868177 - DNA, 25 bp, Mus musculus
acttagacagctatccattatgatg

SEQ ID NO: 868178 - DNA, 25 bp, Mus musculus
acttagacaggtatccattatgatg

SEQ ID NO: 868179 - DNA, 25 bp, Mus musculus
acttagacagtcttacaacagctgt

SEQ ID NO: 868180 - DNA, 25 bp, Mus musculus
acttagaggagacccaagttgaagt

SEQ ID NO: 868181 - DNA, 25 bp, Mus musculus
acttagaggagagccaagttgaagt

SEQ ID NO: 868182 - DNA, 25 bp, Mus musculus
acttagtcagctgtcaaaagaccag

SEQ ID NO: 868183 - DNA, 25 bp, Mus musculus
acttagtcaggtgtcaaaagaccag

SEQ ID NO: 868184 - DNA, 25 bp, Mus musculus
acttagtgcgcctgtgtggagatgg

SEQ ID NO: 868185 - DNA, 25 bp, Mus musculus
acttagtgcggctgtgtggagatgg

SEQ ID NO: 868186 - DNA, 25 bp, Mus musculus
acttataaaatgctgtgactatcaa

SEQ ID NO: 868187 - DNA, 25 bp, Mus musculus
acttataaaatggtgtgactatcaa

SEQ ID NO: 868188 - DNA, 25 bp, Mus musculus
acttatacacagctgcaaactcgta

SEQ ID NO: 868189 - DNA, 25 bp, Mus musculus
acttatacacaggtgcaaactcgta

SEQ ID NO: 868190 - DNA, 25 bp, Mus musculus
acttatacagcaggcctgatggaat

SEQ ID NO: 868191 - DNA, 25 bp, Mus musculus
acttatacagccctgatggaattat

SEQ ID NO: 868192 - DNA, 25 bp, Mus musculus
acttatacaggaggcctgatggaat

SEQ ID NO: 868193 - DNA, 25 bp, Mus musculus
acttatacaggcctgatggaattat

SEQ ID NO: 868194 - DNA, 25 bp, Mus musculus
acttattcacagccaaacgcactcc

SEQ ID NO: 868195 - DNA, 25 bp, Mus musculus
acttattcacaggcaaacgcactcc

SEQ ID NO: 868196 - DNA, 25 bp, Mus musculus
acttcaaaaccaccagagaaaaata

SEQ ID NO: 868197 - DNA, 25 bp, Mus musculus
acttcaaaaccagcagagaaaaata

SEQ ID NO: 868198 - DNA, 25 bp, Mus musculus
acttcaaagaatagtgcaaaaatac

SEQ ID NO: 868199 - DNA, 25 bp, Mus musculus
acttcaaagaattgtgcaaaaatac

SEQ ID NO: 868200 - DNA, 25 bp, Mus musculus
acttcaaatgcacagtgttctctgc

SEQ ID NO: 868201 - DNA, 25 bp, Mus musculus
acttcaaatgcagagtgttctctgc

SEQ ID NO: 868202 - DNA, 25 bp, Mus musculus
acttcaacagcactcatttcacctg

SEQ ID NO: 868203 - DNA, 25 bp, Mus musculus
acttcaacaggactcatttcacctg

SEQ ID NO: 868204 - DNA, 25 bp, Mus musculus
acttcaaccacaaacgccatgccta

SEQ ID NO: 868205 - DNA, 25 bp, Mus musculus
acttcaaccacaaaggccatgccta

SEQ ID NO: 868206 - DNA, 25 bp, Mus musculus
acttcaagaaccatacagtttcttg

SEQ ID NO: 868207 - DNA, 25 bp, Mus musculus
acttcaagaactaccagtacatatc

SEQ ID NO: 868208 - DNA, 25 bp, Mus musculus
acttcaagaagacacgcaaacattt

SEQ ID NO: 868209 - DNA, 25 bp, Mus musculus
acttcaagaagacaggcaaacattt

SEQ ID NO: 868210 - DNA, 25 bp, Mus musculus
acttcaagaagcatacagtttcttg

SEQ ID NO: 868211 - DNA, 25 bp, Mus musculus
acttcaagaagtaccagtacatatc

SEQ ID NO: 868212 - DNA, 25 bp, Mus musculus
acttcaagcccacctatgggacccc

SEQ ID NO: 868213 - DNA, 25 bp, Mus musculus
acttcaagcccactcttgcctccag

SEQ ID NO: 868214 - DNA, 25 bp, Mus musculus
acttcaagcccagctatgggacccc

SEQ ID NO: 868215 - DNA, 25 bp, Mus musculus
acttcaagcccagtcttgcctccag

SEQ ID NO: 868216 - DNA, 25 bp, Mus musculus
acttcaaggactgccgctctaaggt

SEQ ID NO: 868217 - DNA, 25 bp, Mus musculus
acttcaaggactgcggctctaaggt

SEQ ID NO: 868218 - DNA, 25 bp, Mus musculus
acttcaaggtggatcacccggcggg

SEQ ID NO: 868219 - DNA, 25 bp, Mus musculus
acttcaaggtggatgacccggcggg

SEQ ID NO: 868220 - DNA, 25 bp, Mus musculus
acttcaagtgcacgatcttctctgc

SEQ ID NO: 868221 - DNA, 25 bp, Mus musculus
acttcaagtgcaggatcttctctgc

SEQ ID NO: 868222 - DNA, 25 bp, Mus musculus
acttcaatgaattcctgttccgcca

SEQ ID NO: 868223 - DNA, 25 bp, Mus musculus
acttcaatgatttcctgttccgcca

SEQ ID NO: 868224 - DNA, 25 bp, Mus musculus
acttcacagactactacctggtgat

SEQ ID NO: 868225 - DNA, 25 bp, Mus musculus
acttcacagacttctacctggtgat

SEQ ID NO: 868226 - DNA, 25 bp, Mus musculus
acttcacctcgccacgctgcctaaa

SEQ ID NO: 868227 - DNA, 25 bp, Mus musculus
acttcacctcgccacggtgcactcg

SEQ ID NO: 868228 - DNA, 25 bp, Mus musculus
acttcacctcgccaggctgcctaaa

SEQ ID NO: 868229 - DNA, 25 bp, Mus musculus
acttcacctcgccagggtgcactcg

SEQ ID NO: 868230 - DNA, 25 bp, Mus musculus
acttcacttgtgctggatccaacac

SEQ ID NO: 868231 - DNA, 25 bp, Mus musculus
acttcacttgtggtggatccaacac

SEQ ID NO: 868232 - DNA, 25 bp, Mus musculus
acttcagaaacaactcctttcagcc

SEQ ID NO: 868233 - DNA, 25 bp, Mus musculus
acttcagaaacacacctcgatgcag

SEQ ID NO: 868234 - DNA, 25 bp, Mus musculus
acttcagaaacagacctcgatgcag

SEQ ID NO: 868235 - DNA, 25 bp, Mus musculus
acttcagaaacatctcctttcagcc

SEQ ID NO: 868236 - DNA, 25 bp, Mus musculus
acttcagacaggactctagcaagga

SEQ ID NO: 868237 - DNA, 25 bp, Mus musculus
acttcagacaggtctctagcaagga

SEQ ID NO: 868238 - DNA, 25 bp, Mus musculus
acttcagagctgaacccagcaagcc

SEQ ID NO: 868239 - DNA, 25 bp, Mus musculus
acttcagagctgaacgctattctag

SEQ ID NO: 868240 - DNA, 25 bp, Mus musculus
acttcagagctgaagccagcaagcc

SEQ ID NO: 868241 - DNA, 25 bp, Mus musculus
acttcagagctgaaggctattctag

SEQ ID NO: 868242 - DNA, 25 bp, Mus musculus
acttcagaggataccaagaagacag

SEQ ID NO: 868243 - DNA, 25 bp, Mus musculus
acttcagaggttaccaagaagacag

SEQ ID NO: 868244 - DNA, 25 bp, Mus musculus
acttcagcaccacatccctgctgtc

SEQ ID NO: 868245 - DNA, 25 bp, Mus musculus
acttcagcaccagatccctgctgtc

SEQ ID NO: 868246 - DNA, 25 bp, Mus musculus
acttcaggaccaagtatgagacaga

SEQ ID NO: 868247 - DNA, 25 bp, Mus musculus
acttcaggaccaagtatgagtcaga

SEQ ID NO: 868248 - DNA, 25 bp, Mus musculus
acttcaggaccatgtatgagacaga

SEQ ID NO: 868249 - DNA, 25 bp, Mus musculus
acttcaggaccatgtatgagtcaga

SEQ ID NO: 868250 - DNA, 25 bp, Mus musculus
acttcaggccgtcactaatgtttca

SEQ ID NO: 868251 - DNA, 25 bp, Mus musculus
acttcaggccgtcagtaatgtttca

SEQ ID NO: 868252 - DNA, 25 bp, Mus musculus
acttcaggcgcgcttttgcaggggc

SEQ ID NO: 868253 - DNA, 25 bp, Mus musculus
acttcaggcgggcttttgcaggggc

SEQ ID NO: 868254 - DNA, 25 bp, Mus musculus
acttcaggctcaagtatgagaatga

SEQ ID NO: 868255 - DNA, 25 bp, Mus musculus
acttcaggctcatgtatgagaatga

SEQ ID NO: 868256 - DNA, 25 bp, Mus musculus
acttcagtggtcgtcgtggctttgg

SEQ ID NO: 868257 - DNA, 25 bp, Mus musculus
acttcagtggtcgtggtggctttgg

SEQ ID NO: 868258 - DNA, 25 bp, Mus musculus
acttcagttccacgtggcccagcag

SEQ ID NO: 868259 - DNA, 25 bp, Mus musculus
acttcagttccaggtggcccagcag

SEQ ID NO: 868260 - DNA, 25 bp, Mus musculus
acttcatatacaaacgcagtttgag

SEQ ID NO: 868261 - DNA, 25 bp, Mus musculus
acttcatatacaaaggcagtttgag

SEQ ID NO: 868262 - DNA, 25 bp, Mus musculus
acttcatcaagccacgtaagcagcc

SEQ ID NO: 868263 - DNA, 25 bp, Mus musculus
acttcatcaagccaggtaagcagcc

SEQ ID NO: 868264 - DNA, 25 bp, Mus musculus
acttcatggacgccctggttgctgc

SEQ ID NO: 868265 - DNA, 25 bp, Mus musculus
acttcatggacggcctggttgctgc

SEQ ID NO: 868266 - DNA, 25 bp, Mus musculus
acttcattgaacataatacgaagac

SEQ ID NO: 868267 - DNA, 25 bp, Mus musculus
acttcattgatcataatacgaagac

SEQ ID NO: 868268 - DNA, 25 bp, Mus musculus
acttcatttatgctagcattaaagg

SEQ ID NO: 868269 - DNA, 25 bp, Mus musculus
acttcatttatggtagcattaaagg

SEQ ID NO: 868270 - DNA, 25 bp, Mus musculus
acttccaacatggtcgatgtattca

SEQ ID NO: 868271 - DNA, 25 bp, Mus musculus
acttccaacatggtggatgtattca

SEQ ID NO: 868272 - DNA, 25 bp, Mus musculus
acttccaatgcaccctgtggcatct

SEQ ID NO: 868273 - DNA, 25 bp, Mus musculus
acttccaatgcagcctgtggcatct

SEQ ID NO: 868274 - DNA, 25 bp, Mus musculus
acttccactactcgtttgtggagtc

SEQ ID NO: 868275 - DNA, 25 bp, Mus musculus
acttccactactggtttgtggagtc

SEQ ID NO: 868276 - DNA, 25 bp, Mus musculus
acttccactatgcagctggacaccc

SEQ ID NO: 868277 - DNA, 25 bp, Mus musculus
acttccactatggagctggacaccc

SEQ ID NO: 868278 - DNA, 25 bp, Mus musculus
acttccatatcacctggaaggacgg

SEQ ID NO: 868279 - DNA, 25 bp, Mus musculus
acttccatatcagctggaaggacgg

SEQ ID NO: 868280 - DNA, 25 bp, Mus musculus
acttcccacactctctgaactacgg

SEQ ID NO: 868281 - DNA, 25 bp, Mus musculus
acttcccacagacgttgaaatgggc

SEQ ID NO: 868282 - DNA, 25 bp, Mus musculus
acttcccacagaggttgaaatgggc

SEQ ID NO: 868283 - DNA, 25 bp, Mus musculus
acttcccacagtctctgaactacgg

SEQ ID NO: 868284 - DNA, 25 bp, Mus musculus
acttcccagggacgtcagcacctcg

SEQ ID NO: 868285 - DNA, 25 bp, Mus musculus
acttcccagggaggtcagcacctcg

SEQ ID NO: 868286 - DNA, 25 bp, Mus musculus
acttcccctcctcaagctgattggc

SEQ ID NO: 868287 - DNA, 25 bp, Mus musculus
acttcccctcctgaagctgattggc

SEQ ID NO: 868288 - DNA, 25 bp, Mus musculus
acttccgtggagggattttcctgtg

SEQ ID NO: 868289 - DNA, 25 bp, Mus musculus
acttccgtggtgggattttcctgtg

SEQ ID NO: 868290 - DNA, 25 bp, Mus musculus
acttcctaaacttgtatctagttct

SEQ ID NO: 868291 - DNA, 25 bp, Mus musculus
acttcctaaagttgtatctagttct

SEQ ID NO: 868292 - DNA, 25 bp, Mus musculus
acttcctgtagtgccgtgtgcaaaa

SEQ ID NO: 868293 - DNA, 25 bp, Mus musculus
acttcctgtagtgcggtgtgcaaaa

SEQ ID NO: 868294 - DNA, 25 bp, Mus musculus
acttcctgtccacagagaacattat

SEQ ID NO: 868295 - DNA, 25 bp, Mus musculus
acttcctgtccacgagagaacacaa

SEQ ID NO: 868296 - DNA, 25 bp, Mus musculus
acttcctgtccagagagaacattat

SEQ ID NO: 868297 - DNA, 25 bp, Mus musculus
acttcctgtccaggagagaacacaa

SEQ ID NO: 868298 - DNA, 25 bp, Mus musculus
acttccttattacacttcctggagg

SEQ ID NO: 868299 - DNA, 25 bp, Mus musculus
acttccttattacagttcctggagg

SEQ ID NO: 868300 - DNA, 25 bp, Mus musculus
acttcctttccacttcagttcaggg

SEQ ID NO: 868301 - DNA, 25 bp, Mus musculus
acttcctttccagttcagttcaggg

SEQ ID NO: 868302 - DNA, 25 bp, Mus musculus
acttcctttgatattccagctacat

SEQ ID NO: 868303 - DNA, 25 bp, Mus musculus
acttcctttgattttccagctacat

SEQ ID NO: 868304 - DNA, 25 bp, Mus musculus
acttcgaaaccacgacaccttctct

SEQ ID NO: 868305 - DNA, 25 bp, Mus musculus
acttcgaaaccaggacaccttctct

SEQ ID NO: 868306 - DNA, 25 bp, Mus musculus
acttcgacagctatctcctgttaat

SEQ ID NO: 868307 - DNA, 25 bp, Mus musculus
acttcgacaggtatctcctgttaat

SEQ ID NO: 868308 - DNA, 25 bp, Mus musculus
acttcgacgaactccaggatgtgtt

SEQ ID NO: 868309 - DNA, 25 bp, Mus musculus
acttcgacgaactcgaggatgtgtt

SEQ ID NO: 868310 - DNA, 25 bp, Mus musculus
acttcgacgggacgtggcccaggca

SEQ ID NO: 868311 - DNA, 25 bp, Mus musculus
acttcgacgggaggtggcccaggca

SEQ ID NO: 868312 - DNA, 25 bp, Mus musculus
acttcgccagtgctcgaacagcaaa

SEQ ID NO: 868313 - DNA, 25 bp, Mus musculus
acttcgccagtgctggaacagcaaa

SEQ ID NO: 868314 - DNA, 25 bp, Mus musculus
acttcgccggcaactctgaggaaca

SEQ ID NO: 868315 - DNA, 25 bp, Mus musculus
acttcgccggcatctctgaggaaca

SEQ ID NO: 868316 - DNA, 25 bp, Mus musculus
acttcggacacactacatgaagtat

SEQ ID NO: 868317 - DNA, 25 bp, Mus musculus
acttcggacacagtacatgaagtat

SEQ ID NO: 868318 - DNA, 25 bp, Mus musculus
acttcggagagtccaacagtggtcc

SEQ ID NO: 868319 - DNA, 25 bp, Mus musculus
acttcggagagtgcaacagtggtcc

SEQ ID NO: 868320 - DNA, 25 bp, Mus musculus
acttcggcccagaacaatgctaaag

SEQ ID NO: 868321 - DNA, 25 bp, Mus musculus
acttcggcccagtacaatgctaaag

SEQ ID NO: 868322 - DNA, 25 bp, Mus musculus
acttcgggaagaccgccaccaggag

SEQ ID NO: 868323 - DNA, 25 bp, Mus musculus
acttcgggaagagcgccaccaggag

SEQ ID NO: 868324 - DNA, 25 bp, Mus musculus
acttcgggagcacgtgatatatccc

SEQ ID NO: 868325 - DNA, 25 bp, Mus musculus
acttcgggagcaggtgatatatccc

SEQ ID NO: 868326 - DNA, 25 bp, Mus musculus
acttcgggcactcagcaccagtttt

SEQ ID NO: 868327 - DNA, 25 bp, Mus musculus
acttcgggcactgagcaccagtttt

SEQ ID NO: 868328 - DNA, 25 bp, Mus musculus
acttcgggccatctttctcttgcaa

SEQ ID NO: 868329 - DNA, 25 bp, Mus musculus
acttcgggccatgtttctcttgcaa

SEQ ID NO: 868330 - DNA, 25 bp, Mus musculus
acttctacaagccacgagccatgcg

SEQ ID NO: 868331 - DNA, 25 bp, Mus musculus
acttctacaagccaggagccatgcg

SEQ ID NO: 868332 - DNA, 25 bp, Mus musculus
acttctacccgacacacatacttcc

SEQ ID NO: 868333 - DNA, 25 bp, Mus musculus
acttctacccgacacggtgtgaaca

SEQ ID NO: 868334 - DNA, 25 bp, Mus musculus
acttctacccgacagacatacttcc

SEQ ID NO: 868335 - DNA, 25 bp, Mus musculus
acttctacccgacagggtgtgaaca

SEQ ID NO: 868336 - DNA, 25 bp, Mus musculus
acttctatgaggcgcaaggccgtct

SEQ ID NO: 868337 - DNA, 25 bp, Mus musculus
acttctatgaggggcaaggccgtct

SEQ ID NO: 868338 - DNA, 25 bp, Mus musculus
acttctcaagaccaccttgtcaatg

SEQ ID NO: 868339 - DNA, 25 bp, Mus musculus
acttctcaagagagtgaatgacatt

SEQ ID NO: 868340 - DNA, 25 bp, Mus musculus
acttctcaagagtgtgaatgacatt

SEQ ID NO: 868341 - DNA, 25 bp, Mus musculus
acttctcaagcaaacttcattctcc

SEQ ID NO: 868342 - DNA, 25 bp, Mus musculus
acttctcaagcaggcgcttccatga

SEQ ID NO: 868343 - DNA, 25 bp, Mus musculus
acttctcaaggaaacttcattctcc

SEQ ID NO: 868344 - DNA, 25 bp, Mus musculus
acttctcaaggaggcgcttccatga

SEQ ID NO: 868345 - DNA, 25 bp, Mus musculus
acttctcaagtccaccttgtcaatg

SEQ ID NO: 868346 - DNA, 25 bp, Mus musculus
acttctcagtggcacaatgccagct

SEQ ID NO: 868347 - DNA, 25 bp, Mus musculus
acttctcagtggcagaatgccagct

SEQ ID NO: 868348 - DNA, 25 bp, Mus musculus
acttctccagcctagaaaatgccca

SEQ ID NO: 868349 - DNA, 25 bp, Mus musculus
acttctccaggctagaaaatgccca

SEQ ID NO: 868350 - DNA, 25 bp, Mus musculus
acttctcccagaatacccaggcgtc

SEQ ID NO: 868351 - DNA, 25 bp, Mus musculus
acttctcccagattacccaggcgtc

SEQ ID NO: 868352 - DNA, 25 bp, Mus musculus
acttctcctccactctgggcatcca

SEQ ID NO: 868353 - DNA, 25 bp, Mus musculus
acttctcctcgactctgggcatcca

SEQ ID NO: 868354 - DNA, 25 bp, Mus musculus
acttctcctgctactggctctggta

SEQ ID NO: 868355 - DNA, 25 bp, Mus musculus
acttctcctggacgaatgtggcctg

SEQ ID NO: 868356 - DNA, 25 bp, Mus musculus
acttctcctggaggaatgtggcctg

SEQ ID NO: 868357 - DNA, 25 bp, Mus musculus
acttctcctggtactggctctggta

SEQ ID NO: 868358 - DNA, 25 bp, Mus musculus
acttctctaccaaccgaattgaata

SEQ ID NO: 868359 - DNA, 25 bp, Mus musculus
acttctctaccaacggaattgaata

SEQ ID NO: 868360 - DNA, 25 bp, Mus musculus
acttctctggcaagcgttgtgtaaa

SEQ ID NO: 868361 - DNA, 25 bp, Mus musculus
acttctctggcaagggttgtgtaaa

SEQ ID NO: 868362 - DNA, 25 bp, Mus musculus
acttctgacgatcttgaccggccca

SEQ ID NO: 868363 - DNA, 25 bp, Mus musculus
acttctgacgttcttgaccggccca

SEQ ID NO: 868364 - DNA, 25 bp, Mus musculus
acttctgagaccaactacatggaga

SEQ ID NO: 868365 - DNA, 25 bp, Mus musculus
acttctgagaccaagtacatggaga

SEQ ID NO: 868366 - DNA, 25 bp, Mus musculus
acttctgcaaaaagcggatggaatt

SEQ ID NO: 868367 - DNA, 25 bp, Mus musculus
acttctgcaaaaaggggatggaatt

SEQ ID NO: 868368 - DNA, 25 bp, Mus musculus
acttctgcctagcatcaacgatata

SEQ ID NO: 868369 - DNA, 25 bp, Mus musculus
acttctgcctagctatgtctatata

SEQ ID NO: 868370 - DNA, 25 bp, Mus musculus
acttctgcctagctcctcaactttg

SEQ ID NO: 868371 - DNA, 25 bp, Mus musculus
acttctgcctaggatcaacgatata

SEQ ID NO: 868372 - DNA, 25 bp, Mus musculus
acttctgcctaggtatgtctatata

SEQ ID NO: 868373 - DNA, 25 bp, Mus musculus
acttctgcctaggtcctcaactttg

SEQ ID NO: 868374 - DNA, 25 bp, Mus musculus
acttctggagaccacatgtgtcgct

SEQ ID NO: 868375 - DNA, 25 bp, Mus musculus
acttctggagcaaaatatgtcgtaa

SEQ ID NO: 868376 - DNA, 25 bp, Mus musculus
acttctggaggaaaatatgtcgtaa

SEQ ID NO: 868377 - DNA, 25 bp, Mus musculus
acttctggagtccacatgtgtcgct

SEQ ID NO: 868378 - DNA, 25 bp, Mus musculus
acttctggcaagcccagatcctgtc

SEQ ID NO: 868379 - DNA, 25 bp, Mus musculus
acttctggcaaggccagatcctgtc

SEQ ID NO: 868380 - DNA, 25 bp, Mus musculus
acttcttcaaggcgaagcagtactg

SEQ ID NO: 868381 - DNA, 25 bp, Mus musculus
acttcttcaaggggaagcagtactg

SEQ ID NO: 868382 - DNA, 25 bp, Mus musculus
acttcttcaataaacctactgaact

SEQ ID NO: 868383 - DNA, 25 bp, Mus musculus
acttcttcaatatacctactgaact

SEQ ID NO: 868384 - DNA, 25 bp, Mus musculus
acttcttcctcccttaaccatggca

SEQ ID NO: 868385 - DNA, 25 bp, Mus musculus
acttcttcctgaacggaccgccgct

SEQ ID NO: 868386 - DNA, 25 bp, Mus musculus
acttcttcctgatcggaccgccgct

SEQ ID NO: 868387 - DNA, 25 bp, Mus musculus
acttcttcctgccttaaccatggca

SEQ ID NO: 868388 - DNA, 25 bp, Mus musculus
acttctttgacatcagtgatgagag

SEQ ID NO: 868389 - DNA, 25 bp, Mus musculus
acttctttgacatctgtgatgagag

SEQ ID NO: 868390 - DNA, 25 bp, Mus musculus
acttcttttgaatccgagacagttc

SEQ ID NO: 868391 - DNA, 25 bp, Mus musculus
acttcttttgaatcggagacagttc

SEQ ID NO: 868392 - DNA, 25 bp, Mus musculus
acttgaaaaacacatagaagaagtg

SEQ ID NO: 868393 - DNA, 25 bp, Mus musculus
acttgaaaaacagatagaagaagtg

SEQ ID NO: 868394 - DNA, 25 bp, Mus musculus
acttgaacagcattgaggatcctga

SEQ ID NO: 868395 - DNA, 25 bp, Mus musculus
acttgaacaggattgaggatcctga

SEQ ID NO: 868396 - DNA, 25 bp, Mus musculus
acttgaagaaatcgagcgccttatg

SEQ ID NO: 868397 - DNA, 25 bp, Mus musculus
acttgaagaaatggagcgccttatg

SEQ ID NO: 868398 - DNA, 25 bp, Mus musculus
acttgaatacagcactcctgaaatt

SEQ ID NO: 868399 - DNA, 25 bp, Mus musculus
acttgaatacaggactcctgaaatt

SEQ ID NO: 868400 - DNA, 25 bp, Mus musculus
acttgaatccagaacacattgatca

SEQ ID NO: 868401 - DNA, 25 bp, Mus musculus
acttgaatccagaagacattgatca

SEQ ID NO: 868402 - DNA, 25 bp, Mus musculus
acttgaatgtaacacattgccacac

SEQ ID NO: 868403 - DNA, 25 bp, Mus musculus
acttgaatgtaacagattgccacac

SEQ ID NO: 868404 - DNA, 25 bp, Mus musculus
acttgacaatagctctggtgcaagt

SEQ ID NO: 868405 - DNA, 25 bp, Mus musculus
acttgacaataggtctggtgcaagt

SEQ ID NO: 868406 - DNA, 25 bp, Mus musculus
acttgactagacacgctgagagtca

SEQ ID NO: 868407 - DNA, 25 bp, Mus musculus
acttgactagtcacgctgagagtca

SEQ ID NO: 868408 - DNA, 25 bp, Mus musculus
acttgagcacaggacacaatctgga

SEQ ID NO: 868409 - DNA, 25 bp, Mus musculus
acttgagcacaggagacaatctgga

SEQ ID NO: 868410 - DNA, 25 bp, Mus musculus
acttgagcagctattatctacgtca

SEQ ID NO: 868411 - DNA, 25 bp, Mus musculus
acttgagcaggtattatctacgtca

SEQ ID NO: 868412 - DNA, 25 bp, Mus musculus
acttgataaaacatcctggaggcat

SEQ ID NO: 868413 - DNA, 25 bp, Mus musculus
acttgataaaacatcgcattctgca

SEQ ID NO: 868414 - DNA, 25 bp, Mus musculus
acttgataaaacatgctggaggcat

SEQ ID NO: 868415 - DNA, 25 bp, Mus musculus
acttgataaaacatggcattctgca

SEQ ID NO: 868416 - DNA, 25 bp, Mus musculus
acttgataagcctaaagaggccata

SEQ ID NO: 868417 - DNA, 25 bp, Mus musculus
acttgataaggctaaagaggccata

SEQ ID NO: 868418 - DNA, 25 bp, Mus musculus
acttgatgtgccaactaatgtatat

SEQ ID NO: 868419 - DNA, 25 bp, Mus musculus
acttgatgtgccaagtaatgtatat

SEQ ID NO: 868420 - DNA, 25 bp, Mus musculus
acttgcaactctatcgtgctttttg

SEQ ID NO: 868421 - DNA, 25 bp, Mus musculus
acttgcaactctatggtgctttttg

SEQ ID NO: 868422 - DNA, 25 bp, Mus musculus
acttgcattgatgtgaacgaatgct

SEQ ID NO: 868423 - DNA, 25 bp, Mus musculus
acttgcattgttgtgaacgaatgct

SEQ ID NO: 868424 - DNA, 25 bp, Mus musculus
acttgccacgattgtcttcatcctg

SEQ ID NO: 868425 - DNA, 25 bp, Mus musculus
acttgccacgtttgtcttcatcctg

SEQ ID NO: 868426 - DNA, 25 bp, Mus musculus
acttgctatcagctgtactgcagtc

SEQ ID NO: 868427 - DNA, 25 bp, Mus musculus
acttgctatcaggtgtactgcagtc

SEQ ID NO: 868428 - DNA, 25 bp, Mus musculus
acttgctccaagcgccccgccgtca

SEQ ID NO: 868429 - DNA, 25 bp, Mus musculus
acttgctccaagggccccgccgtca

SEQ ID NO: 868430 - DNA, 25 bp, Mus musculus
acttgctccctcccttagcgctctg

SEQ ID NO: 868431 - DNA, 25 bp, Mus musculus
acttgctccctcgcttagcgctctg

SEQ ID NO: 868432 - DNA, 25 bp, Mus musculus
acttgctggactttcccttagagaa

SEQ ID NO: 868433 - DNA, 25 bp, Mus musculus
acttgctggactttgccttagagaa

SEQ ID NO: 868434 - DNA, 25 bp, Mus musculus
acttgctgttcttgcggcactgcaa

SEQ ID NO: 868435 - DNA, 25 bp, Mus musculus
acttgctgttcttggggcactgcaa

SEQ ID NO: 868436 - DNA, 25 bp, Mus musculus
acttggaacatgcgtaatgcacccc

SEQ ID NO: 868437 - DNA, 25 bp, Mus musculus
acttggaacatgggtaatgcacccc

SEQ ID NO: 868438 - DNA, 25 bp, Mus musculus
acttggaatcccagaacaggagtac

SEQ ID NO: 868439 - DNA, 25 bp, Mus musculus
acttggaatccctgaacaggagtac

SEQ ID NO: 868440 - DNA, 25 bp, Mus musculus
acttggagagattaatattacagga

SEQ ID NO: 868441 - DNA, 25 bp, Mus musculus
acttggagagtttaatattacagga

SEQ ID NO: 868442 - DNA, 25 bp, Mus musculus
acttggaggcaacgaaggagcacga

SEQ ID NO: 868443 - DNA, 25 bp, Mus musculus
acttggaggcaaggaaggagcacga

SEQ ID NO: 868444 - DNA, 25 bp, Mus musculus
acttggaggtttaaagtgtctcatg

SEQ ID NO: 868445 - DNA, 25 bp, Mus musculus
acttggaggtttaatgtgtctcatg

SEQ ID NO: 868446 - DNA, 25 bp, Mus musculus
acttggagtgctgaatcaaagactt

SEQ ID NO: 868447 - DNA, 25 bp, Mus musculus
acttggagtggtgaatcaaagactt

SEQ ID NO: 868448 - DNA, 25 bp, Mus musculus
acttggatattagaaatgctacaaa

SEQ ID NO: 868449 - DNA, 25 bp, Mus musculus
acttggatattagatatgctacaaa

SEQ ID NO: 868450 - DNA, 25 bp, Mus musculus
acttggatcacacgtacctggaact

SEQ ID NO: 868451 - DNA, 25 bp, Mus musculus
acttggatcacaggtacctggaact

SEQ ID NO: 868452 - DNA, 25 bp, Mus musculus
acttggcaacagcgtctctgtgatg

SEQ ID NO: 868453 - DNA, 25 bp, Mus musculus
acttggcaacagggtctctgtgatg

SEQ ID NO: 868454 - DNA, 25 bp, Mus musculus
acttggcacgaaagcaatatagaaa

SEQ ID NO: 868455 - DNA, 25 bp, Mus musculus
acttggcacgtaagcaatatagaaa

SEQ ID NO: 868456 - DNA, 25 bp, Mus musculus
acttggctgacgcgcaccaacccca

SEQ ID NO: 868457 - DNA, 25 bp, Mus musculus
acttggctgacgggcaccaacccca

SEQ ID NO: 868458 - DNA, 25 bp, Mus musculus
acttgggcaaagagcagagccgccg

SEQ ID NO: 868459 - DNA, 25 bp, Mus musculus
acttgggcaaagagccgccgggatg

SEQ ID NO: 868460 - DNA, 25 bp, Mus musculus
acttgggcaaagtgcagagccgccg

SEQ ID NO: 868461 - DNA, 25 bp, Mus musculus
acttgggcaaagtgccgccgggatg

SEQ ID NO: 868462 - DNA, 25 bp, Mus musculus
acttgggcatccttcggccaccaat

SEQ ID NO: 868463 - DNA, 25 bp, Mus musculus
acttgggcatccttgggccaccaat

SEQ ID NO: 868464 - DNA, 25 bp, Mus musculus
acttggtatttttacgctgttcatt

SEQ ID NO: 868465 - DNA, 25 bp, Mus musculus
acttggtatttttaggctgttcatt

SEQ ID NO: 868466 - DNA, 25 bp, Mus musculus
acttggtcagctactggatctcagc

SEQ ID NO: 868467 - DNA, 25 bp, Mus musculus
acttggtcaggtactggatctcagc

SEQ ID NO: 868468 - DNA, 25 bp, Mus musculus
acttggtgataaggtacagttttgc

SEQ ID NO: 868469 - DNA, 25 bp, Mus musculus
acttggtgatcaaaccattagagga

SEQ ID NO: 868470 - DNA, 25 bp, Mus musculus
acttggtgatgaaaccattagagga

SEQ ID NO: 868471 - DNA, 25 bp, Mus musculus
acttggtgattaggtacagttttgc

SEQ ID NO: 868472 - DNA, 25 bp, Mus musculus
acttggtggacaatgttgctaaaga

SEQ ID NO: 868473 - DNA, 25 bp, Mus musculus
acttggtggacattgttgctaaaga

SEQ ID NO: 868474 - DNA, 25 bp, Mus musculus
acttggtggatgcatgagtttcatc

SEQ ID NO: 868475 - DNA, 25 bp, Mus musculus
acttggtggatggatgagtttcatc

SEQ ID NO: 868476 - DNA, 25 bp, Mus musculus
acttggttagaattatcttctgtga

SEQ ID NO: 868477 - DNA, 25 bp, Mus musculus
acttggttagtattatcttctgtga

SEQ ID NO: 868478 - DNA, 25 bp, Mus musculus
acttgtaataaacctgcgaagctgg

SEQ ID NO: 868479 - DNA, 25 bp, Mus musculus
acttgtaataaagctgcgaagctgg

SEQ ID NO: 868480 - DNA, 25 bp, Mus musculus
acttgtacagcgacttatcggatgc

SEQ ID NO: 868481 - DNA, 25 bp, Mus musculus
acttgtacagggacttatcggatgc

SEQ ID NO: 868482 - DNA, 25 bp, Mus musculus
acttgtcacagcactgtctatgagc

SEQ ID NO: 868483 - DNA, 25 bp, Mus musculus
acttgtcacagctctgtctatgagc

SEQ ID NO: 868484 - DNA, 25 bp, Mus musculus
acttgtccaaattcgaggactccac

SEQ ID NO: 868485 - DNA, 25 bp, Mus musculus
acttgtccaatttcgaggactccac

SEQ ID NO: 868486 - DNA, 25 bp, Mus musculus
acttgtctgaccagatcctgacggg

SEQ ID NO: 868487 - DNA, 25 bp, Mus musculus
acttgtctgacctgatcctgacggg

SEQ ID NO: 868488 - DNA, 25 bp, Mus musculus
acttgtctgacttccgtcagccatg

SEQ ID NO: 868489 - DNA, 25 bp, Mus musculus
acttgtctgacttcggtcagccatg

SEQ ID NO: 868490 - DNA, 25 bp, Mus musculus
acttgtgaaaattctgatttgtgga

SEQ ID NO: 868491 - DNA, 25 bp, Mus musculus
acttgtgaaatttctgatttgtgga

SEQ ID NO: 868492 - DNA, 25 bp, Mus musculus
acttgtgagttccactgtgatttac

SEQ ID NO: 868493 - DNA, 25 bp, Mus musculus
acttgtgagttcgactgtgatttac

SEQ ID NO: 868494 - DNA, 25 bp, Mus musculus
acttgtgcaagaacccctggtgcaa

SEQ ID NO: 868495 - DNA, 25 bp, Mus musculus
acttgtgcaagaacgcctggtgcaa

SEQ ID NO: 868496 - DNA, 25 bp, Mus musculus
acttgtgcccatctcagcagtcacc

SEQ ID NO: 868497 - DNA, 25 bp, Mus musculus
acttgtgcccatgtcagcagtcacc

SEQ ID NO: 868498 - DNA, 25 bp, Mus musculus
acttgtgttggcaacagagatgaag

SEQ ID NO: 868499 - DNA, 25 bp, Mus musculus
acttgtgttggcaacaggccacagc

SEQ ID NO: 868500 - DNA, 25 bp, Mus musculus
acttgtgttggcaagagagatgaag

SEQ ID NO: 868501 - DNA, 25 bp, Mus musculus
acttgtgttggcaagaggccacagc

SEQ ID NO: 868502 - DNA, 25 bp, Mus musculus
acttgttgcgtgccagtaacggagc

SEQ ID NO: 868503 - DNA, 25 bp, Mus musculus
acttgttgcgtggcagtaacggagc

SEQ ID NO: 868504 - DNA, 25 bp, Mus musculus
actttaactggaaacaatgtcttga

SEQ ID NO: 868505 - DNA, 25 bp, Mus musculus
actttaactggaaacgatataattg

SEQ ID NO: 868506 - DNA, 25 bp, Mus musculus
actttaactggaaagaatgtcttga

SEQ ID NO: 868507 - DNA, 25 bp, Mus musculus
actttaactggaaaggatataattg

SEQ ID NO: 868508 - DNA, 25 bp, Mus musculus
actttaaggggagacctcctgcttt

SEQ ID NO: 868509 - DNA, 25 bp, Mus musculus
actttaaggggagagctcctgcttt

SEQ ID NO: 868510 - DNA, 25 bp, Mus musculus
actttaattgcgcaaggcatcaacg

SEQ ID NO: 868511 - DNA, 25 bp, Mus musculus
actttaattgcgcatggcatcaacg

SEQ ID NO: 868512 - DNA, 25 bp, Mus musculus
actttacatatgcacacatcaagcc

SEQ ID NO: 868513 - DNA, 25 bp, Mus musculus
actttacatatgcacgaatctccac

SEQ ID NO: 868514 - DNA, 25 bp, Mus musculus
actttacatatgcagacatcaagcc

SEQ ID NO: 868515 - DNA, 25 bp, Mus musculus
actttacatatgcaggaatctccac

SEQ ID NO: 868516 - DNA, 25 bp, Mus musculus
actttacttttataaggctgtgtgc

SEQ ID NO: 868517 - DNA, 25 bp, Mus musculus
actttacttttatatggctgtgtgc

SEQ ID NO: 868518 - DNA, 25 bp, Mus musculus
actttatcagcttcctggagagcca

SEQ ID NO: 868519 - DNA, 25 bp, Mus musculus
actttatcaggttcctggagagcca

SEQ ID NO: 868520 - DNA, 25 bp, Mus musculus
actttatgaggaagtatgatgccta

SEQ ID NO: 868521 - DNA, 25 bp, Mus musculus
actttatgaggatgtatgatgccta

SEQ ID NO: 868522 - DNA, 25 bp, Mus musculus
actttatttgtcagtctcttctcac

SEQ ID NO: 868523 - DNA, 25 bp, Mus musculus
actttatttgtctgtctcttctcac

SEQ ID NO: 868524 - DNA, 25 bp, Mus musculus
actttcaaagccatctagtcttgct

SEQ ID NO: 868525 - DNA, 25 bp, Mus musculus
actttcaaaggcatctagtcttgct

SEQ ID NO: 868526 - DNA, 25 bp, Mus musculus
actttcaatggacagccgtgcagcg

SEQ ID NO: 868527 - DNA, 25 bp, Mus musculus
actttcaatggagagccgtgcagcg

SEQ ID NO: 868528 - DNA, 25 bp, Mus musculus
actttcaccaggcaagacagtgacc

SEQ ID NO: 868529 - DNA, 25 bp, Mus musculus
actttcaccagggaagacagtgacc

SEQ ID NO: 868530 - DNA, 25 bp, Mus musculus
actttcagataacgttccgagaagt

SEQ ID NO: 868531 - DNA, 25 bp, Mus musculus
actttcagataaggttccgagaagt

SEQ ID NO: 868532 - DNA, 25 bp, Mus musculus
actttcatgcacagtggtgtggccc

SEQ ID NO: 868533 - DNA, 25 bp, Mus musculus
actttcatgcactgtggtgtggccc

SEQ ID NO: 868534 - DNA, 25 bp, Mus musculus
actttcattgccacagtacgagtga

SEQ ID NO: 868535 - DNA, 25 bp, Mus musculus
actttcattggcacagtacgagtga

SEQ ID NO: 868536 - DNA, 25 bp, Mus musculus
actttccaccagactcctaggctcc

SEQ ID NO: 868537 - DNA, 25 bp, Mus musculus
actttccaccagtctcctaggctcc

SEQ ID NO: 868538 - DNA, 25 bp, Mus musculus
actttcctccaacaaatgcagaacc

SEQ ID NO: 868539 - DNA, 25 bp, Mus musculus
actttcctccaacatatgcagaacc

SEQ ID NO: 868540 - DNA, 25 bp, Mus musculus
actttcctccagattgttggtgtct

SEQ ID NO: 868541 - DNA, 25 bp, Mus musculus
actttcctccagtttgttggtgtct

SEQ ID NO: 868542 - DNA, 25 bp, Mus musculus
actttcctgactgacgtgaaagtga

SEQ ID NO: 868543 - DNA, 25 bp, Mus musculus
actttcctgactgaggtgaaagtga

SEQ ID NO: 868544 - DNA, 25 bp, Mus musculus
actttcctttgactctggcagccac

SEQ ID NO: 868545 - DNA, 25 bp, Mus musculus
actttcctttgactgtggcagccac

SEQ ID NO: 868546 - DNA, 25 bp, Mus musculus
actttcgccatccacatagtgatcg

SEQ ID NO: 868547 - DNA, 25 bp, Mus musculus
actttcgccatccagatagtgatcg

SEQ ID NO: 868548 - DNA, 25 bp, Mus musculus
actttcgtatacaacttccctctag

SEQ ID NO: 868549 - DNA, 25 bp, Mus musculus
actttcgtatacaagttccctctag

SEQ ID NO: 868550 - DNA, 25 bp, Mus musculus
actttctactagccttttgggctct

SEQ ID NO: 868551 - DNA, 25 bp, Mus musculus
actttctactaggcttttgggctct

SEQ ID NO: 868552 - DNA, 25 bp, Mus musculus
actttctatgtgcacgctgatagcc

SEQ ID NO: 868553 - DNA, 25 bp, Mus musculus
actttctatgtgcaggctgatagcc

SEQ ID NO: 868554 - DNA, 25 bp, Mus musculus
actttctcatatctcggaactctca

SEQ ID NO: 868555 - DNA, 25 bp, Mus musculus
actttctcatatctgggaactctca

SEQ ID NO: 868556 - DNA, 25 bp, Mus musculus
actttctctcagcacattccaaagg

SEQ ID NO: 868557 - DNA, 25 bp, Mus musculus
actttctctcagcacgccttgagcc

SEQ ID NO: 868558 - DNA, 25 bp, Mus musculus
actttctctcagcagattccaaagg

SEQ ID NO: 868559 - DNA, 25 bp, Mus musculus
actttctctcagcaggccttgagcc

SEQ ID NO: 868560 - DNA, 25 bp, Mus musculus
actttcttccatgatagagtctaga

SEQ ID NO: 868561 - DNA, 25 bp, Mus musculus
actttcttccgacaactggaggagt

SEQ ID NO: 868562 - DNA, 25 bp, Mus musculus
actttcttccgagaactggaggagt

SEQ ID NO: 868563 - DNA, 25 bp, Mus musculus
actttcttccttgatagagtctaga

SEQ ID NO: 868564 - DNA, 25 bp, Mus musculus
actttctttagcacagggctaaagt

SEQ ID NO: 868565 - DNA, 25 bp, Mus musculus
actttctttagcactgggctaaagt

SEQ ID NO: 868566 - DNA, 25 bp, Mus musculus
actttgaccaacttcaggatgtttt

SEQ ID NO: 868567 - DNA, 25 bp, Mus musculus
actttgaccaacttgaggatgtttt

SEQ ID NO: 868568 - DNA, 25 bp, Mus musculus
actttgatgaggaacagtatcagat

SEQ ID NO: 868569 - DNA, 25 bp, Mus musculus
actttgatgaggtacagtatcagat

SEQ ID NO: 868570 - DNA, 25 bp, Mus musculus
actttgcaaacgcaaaatcatgggg

SEQ ID NO: 868571 - DNA, 25 bp, Mus musculus
actttgcaaaggcaaaatcatgggg

SEQ ID NO: 868572 - DNA, 25 bp, Mus musculus
actttgcacagcacagccaggggga

SEQ ID NO: 868573 - DNA, 25 bp, Mus musculus
actttgcacagcactgccaggggga

SEQ ID NO: 868574 - DNA, 25 bp, Mus musculus
actttgccagctcctttaagattgt

SEQ ID NO: 868575 - DNA, 25 bp, Mus musculus
actttgccaggtcctttaagattgt

SEQ ID NO: 868576 - DNA, 25 bp, Mus musculus
actttgccgaatcacaggaccagat

SEQ ID NO: 868577 - DNA, 25 bp, Mus musculus
actttgccgattcacaggaccagat

SEQ ID NO: 868578 - DNA, 25 bp, Mus musculus
actttgctaaagatggcagactgtg

SEQ ID NO: 868579 - DNA, 25 bp, Mus musculus
actttgctaaagttggcagactgtg

SEQ ID NO: 868580 - DNA, 25 bp, Mus musculus
actttggaacagattcaagtcaatc

SEQ ID NO: 868581 - DNA, 25 bp, Mus musculus
actttggaacagtttcaagtcaatc

SEQ ID NO: 868582 - DNA, 25 bp, Mus musculus
actttggaagagctcattgcccacc

SEQ ID NO: 868583 - DNA, 25 bp, Mus musculus
actttggaagtgctcattgcccacc

SEQ ID NO: 868584 - DNA, 25 bp, Mus musculus
actttggacagtcttgcaatgtttc

SEQ ID NO: 868585 - DNA, 25 bp, Mus musculus
actttggacagtgttgcaatgtttc

SEQ ID NO: 868586 - DNA, 25 bp, Mus musculus
actttggaccaaagacccagccatt

SEQ ID NO: 868587 - DNA, 25 bp, Mus musculus
actttggaccaactgttctcagttt

SEQ ID NO: 868588 - DNA, 25 bp, Mus musculus
actttggaccaagtgttctcagttt

SEQ ID NO: 868589 - DNA, 25 bp, Mus musculus
actttggaccaatgacccagccatt

SEQ ID NO: 868590 - DNA, 25 bp, Mus musculus
actttgtcaactttctggatgctta

SEQ ID NO: 868591 - DNA, 25 bp, Mus musculus
actttgtcaagtttctggatgctta

SEQ ID NO: 868592 - DNA, 25 bp, Mus musculus
actttgtctccacttcatctgacaa

SEQ ID NO: 868593 - DNA, 25 bp, Mus musculus
actttgtctccagttcatctgacaa

SEQ ID NO: 868594 - DNA, 25 bp, Mus musculus
actttgtctttaagctctctaatag

SEQ ID NO: 868595 - DNA, 25 bp, Mus musculus
actttgtctttaagctggtgctgat

SEQ ID NO: 868596 - DNA, 25 bp, Mus musculus
actttgtctttaaggtctctaatag

SEQ ID NO: 868597 - DNA, 25 bp, Mus musculus
actttgtctttaaggtggtgctgat

SEQ ID NO: 868598 - DNA, 25 bp, Mus musculus
actttgtgctgacgatgaacaaggc

SEQ ID NO: 868599 - DNA, 25 bp, Mus musculus
actttgtgctgaggatgaacaaggc

SEQ ID NO: 868600 - DNA, 25 bp, Mus musculus
actttgtttacacgtgatgttgcca

SEQ ID NO: 868601 - DNA, 25 bp, Mus musculus
actttgtttacaggtgatgttgcca

SEQ ID NO: 868602 - DNA, 25 bp, Mus musculus
acttttataacgctgtgtgcaagaa

SEQ ID NO: 868603 - DNA, 25 bp, Mus musculus
acttttataaggctgtgtgcaagaa

SEQ ID NO: 868604 - DNA, 25 bp, Mus musculus
acttttatacagcactgacagacga

SEQ ID NO: 868605 - DNA, 25 bp, Mus musculus
acttttatacaggactgacagacga

SEQ ID NO: 868606 - DNA, 25 bp, Mus musculus
acttttccagagtgtccattgtcca

SEQ ID NO: 868607 - DNA, 25 bp, Mus musculus
acttttccagtgtgtccattgtcca

SEQ ID NO: 868608 - DNA, 25 bp, Mus musculus
acttttccttagatcgctgccagac

SEQ ID NO: 868609 - DNA, 25 bp, Mus musculus
acttttcctttgatcgctgccagac

SEQ ID NO: 868610 - DNA, 25 bp, Mus musculus
acttttctccagaactggaggaggt

SEQ ID NO: 868611 - DNA, 25 bp, Mus musculus
acttttctccagaagtggaggaggt

SEQ ID NO: 868612 - DNA, 25 bp, Mus musculus
acttttctccagccttcagataaac

SEQ ID NO: 868613 - DNA, 25 bp, Mus musculus
acttttctccaggcttcagataaac

SEQ ID NO: 868614 - DNA, 25 bp, Mus musculus
acttttcttccacactgcctccgga

SEQ ID NO: 868615 - DNA, 25 bp, Mus musculus
acttttcttccacagtgcctccgga

SEQ ID NO: 868616 - DNA, 25 bp, Mus musculus
acttttggggcagctgaagaagaag

SEQ ID NO: 868617 - DNA, 25 bp, Mus musculus
acttttgggggagctgaagaagaag

SEQ ID NO: 868618 - DNA, 25 bp, Mus musculus
acttttggtatcaacgtcccgtcag

SEQ ID NO: 868619 - DNA, 25 bp, Mus musculus
acttttggtatcaaggtcccgtcag

SEQ ID NO: 868620 - DNA, 25 bp, Mus musculus
actttttacaaactgattggagttg

SEQ ID NO: 868621 - DNA, 25 bp, Mus musculus
actttttacaaagtgattggagttg

SEQ ID NO: 868622 - DNA, 25 bp, Mus musculus
actttttacataatccccagatgca

SEQ ID NO: 868623 - DNA, 25 bp, Mus musculus
actttttacatattccccagatgca

SEQ ID NO: 868624 - DNA, 25 bp, Mus musculus
actttttcatcccacgtctgtcggg

SEQ ID NO: 868625 - DNA, 25 bp, Mus musculus
actttttcatcccaggtctgtcggg

SEQ ID NO: 868626 - DNA, 25 bp, Mus musculus
actttttcattccaatgtgagttct

SEQ ID NO: 868627 - DNA, 25 bp, Mus musculus
actttttcattccattgtgagttct

SEQ ID NO: 868628 - DNA, 25 bp, Mus musculus
actttttgagcaagagatggacagc

SEQ ID NO: 868629 - DNA, 25 bp, Mus musculus
actttttgaggaagagatggacagc

SEQ ID NO: 868630 - DNA, 25 bp, Mus musculus
agaaaaaaagctggacatgagcaaa

SEQ ID NO: 868631 - DNA, 25 bp, Mus musculus
agaaaaaaagctttatgaagctgat

SEQ ID NO: 868632 - DNA, 25 bp, Mus musculus
agaaaaaaaggtggacatgagcaaa

SEQ ID NO: 868633 - DNA, 25 bp, Mus musculus
agaaaaaaaggtttatgaagctgat

SEQ ID NO: 868634 - DNA, 25 bp, Mus musculus
agaaaaaatggtgacgccatcttct

SEQ ID NO: 868635 - DNA, 25 bp, Mus musculus
agaaaaaatggtgaggccatcttct

SEQ ID NO: 868636 - DNA, 25 bp, Mus musculus
agaaaaacagcacacgatgtcaaaa

SEQ ID NO: 868637 - DNA, 25 bp, Mus musculus
agaaaaacagcacaggatgtcaaaa

SEQ ID NO: 868638 - DNA, 25 bp, Mus musculus
agaaaaacataaaattacaagatct

SEQ ID NO: 868639 - DNA, 25 bp, Mus musculus
agaaaaacataaacaagatcttatt

SEQ ID NO: 868640 - DNA, 25 bp, Mus musculus
agaaaaacataatattacaagatct

SEQ ID NO: 868641 - DNA, 25 bp, Mus musculus
agaaaaacataatcaagatcttatt

SEQ ID NO: 868642 - DNA, 25 bp, Mus musculus
agaaaaactgtaccccgatttgcat

SEQ ID NO: 868643 - DNA, 25 bp, Mus musculus
agaaaaactgtaccgcgatttgcat

SEQ ID NO: 868644 - DNA, 25 bp, Mus musculus
agaaaaagagctataccaagaggct

SEQ ID NO: 868645 - DNA, 25 bp, Mus musculus
agaaaaagaggtataccaagaggct

SEQ ID NO: 868646 - DNA, 25 bp, Mus musculus
agaaaaagcagaatcccgtgatgag

SEQ ID NO: 868647 - DNA, 25 bp, Mus musculus
agaaaaagcagaatgccgtgatgag

SEQ ID NO: 868648 - DNA, 25 bp, Mus musculus
agaaaaagtcaaagccatagcacga

SEQ ID NO: 868649 - DNA, 25 bp, Mus musculus
agaaaaagtcaacgtgatgttagag

SEQ ID NO: 868650 - DNA, 25 bp, Mus musculus
agaaaaagtcaaggtgatgttagag

SEQ ID NO: 868651 - DNA, 25 bp, Mus musculus
agaaaaagtcaatgccatagcacga

SEQ ID NO: 868652 - DNA, 25 bp, Mus musculus
agaaaaatacatatcgatttaccaa

SEQ ID NO: 868653 - DNA, 25 bp, Mus musculus
agaaaaatacttatcgatttaccaa

SEQ ID NO: 868654 - DNA, 25 bp, Mus musculus
agaaaaatttagaatatgacatctg

SEQ ID NO: 868655 - DNA, 25 bp, Mus musculus
agaaaaatttagtatatgacatctg

SEQ ID NO: 868656 - DNA, 25 bp, Mus musculus
agaaaacaagatgatgaaggttcta

SEQ ID NO: 868657 - DNA, 25 bp, Mus musculus
agaaaacaagttgatgaaggttcta

SEQ ID NO: 868658 - DNA, 25 bp, Mus musculus
agaaaacagatgatccagaggagta

SEQ ID NO: 868659 - DNA, 25 bp, Mus musculus
agaaaacagatgctacaaagaagcg

SEQ ID NO: 868660 - DNA, 25 bp, Mus musculus
agaaaacagatggtacaaagaagcg

SEQ ID NO: 868661 - DNA, 25 bp, Mus musculus
agaaaacagatgttccagaggagta

SEQ ID NO: 868662 - DNA, 25 bp, Mus musculus
agaaaacaggagactacagtgatgg

SEQ ID NO: 868663 - DNA, 25 bp, Mus musculus
agaaaacaggagtctacagtgatgg

SEQ ID NO: 868664 - DNA, 25 bp, Mus musculus
agaaaaccaagaagtcgcctggctg

SEQ ID NO: 868665 - DNA, 25 bp, Mus musculus
agaaaaccaagatgtcgcctggctg

SEQ ID NO: 868666 - DNA, 25 bp, Mus musculus
agaaaaccacagagtcctgtgcatg

SEQ ID NO: 868667 - DNA, 25 bp, Mus musculus
agaaaaccacagtgtcctgtgcatg

SEQ ID NO: 868668 - DNA, 25 bp, Mus musculus
agaaaactgtacattcgtatcttga

SEQ ID NO: 868669 - DNA, 25 bp, Mus musculus
agaaaactgttcattcgtatcttga

SEQ ID NO: 868670 - DNA, 25 bp, Mus musculus
agaaaagaagcctggtgaggacttc

SEQ ID NO: 868671 - DNA, 25 bp, Mus musculus
agaaaagaagcgactgaccatgcgt

SEQ ID NO: 868672 - DNA, 25 bp, Mus musculus
agaaaagaaggctggtgaggacttc

SEQ ID NO: 868673 - DNA, 25 bp, Mus musculus
agaaaagaagggactgaccatgcgt

SEQ ID NO: 868674 - DNA, 25 bp, Mus musculus
agaaaagagaagctcttgcaggaag

SEQ ID NO: 868675 - DNA, 25 bp, Mus musculus
agaaaagagaagctgttgcaggaag

SEQ ID NO: 868676 - DNA, 25 bp, Mus musculus
agaaaagatcataaccttggatgag

SEQ ID NO: 868677 - DNA, 25 bp, Mus musculus
agaaaagatcattaccttggatgag

SEQ ID NO: 868678 - DNA, 25 bp, Mus musculus
agaaaagcacagacgagctaaactc

SEQ ID NO: 868679 - DNA, 25 bp, Mus musculus
agaaaagcacagtcgagctaaactc

SEQ ID NO: 868680 - DNA, 25 bp, Mus musculus
agaaaagcagagtaagcttcttgag

SEQ ID NO: 868681 - DNA, 25 bp, Mus musculus
agaaaagcagtgtaagcttcttgag

SEQ ID NO: 868682 - DNA, 25 bp, Mus musculus
agaaaagcccagatctaattcagaa

SEQ ID NO: 868683 - DNA, 25 bp, Mus musculus
agaaaagcccagttctaattcagaa

SEQ ID NO: 868684 - DNA, 25 bp, Mus musculus
agaaaagctcaggcagcaagcctga

SEQ ID NO: 868685 - DNA, 25 bp, Mus musculus
agaaaagctcaggcaggcaaatgag

SEQ ID NO: 868686 - DNA, 25 bp, Mus musculus
agaaaagctcaggctgcaagcctga

SEQ ID NO: 868687 - DNA, 25 bp, Mus musculus
agaaaagctcaggctggcaaatgag

SEQ ID NO: 868688 - DNA, 25 bp, Mus musculus
agaaaaggtgcacatcctggggcag

SEQ ID NO: 868689 - DNA, 25 bp, Mus musculus
agaaaaggtgcaccaactgctttgc

SEQ ID NO: 868690 - DNA, 25 bp, Mus musculus
agaaaaggtgcagatcctggggcag

SEQ ID NO: 868691 - DNA, 25 bp, Mus musculus
agaaaaggtgcagcaactgctttgc

SEQ ID NO: 868692 - DNA, 25 bp, Mus musculus
agaaaatagataatcgaatattttg

SEQ ID NO: 868693 - DNA, 25 bp, Mus musculus
agaaaatagataatggaatattttg

SEQ ID NO: 868694 - DNA, 25 bp, Mus musculus
agaaaatatgcctttattgaaacga

SEQ ID NO: 868695 - DNA, 25 bp, Mus musculus
agaaaatatggctttattgaaacga

SEQ ID NO: 868696 - DNA, 25 bp, Mus musculus
agaaaatatttacattgaggatggg

SEQ ID NO: 868697 - DNA, 25 bp, Mus musculus
agaaaatatttagattgaggatggg

SEQ ID NO: 868698 - DNA, 25 bp, Mus musculus
agaaaatgagatgccaaaaggcttg

SEQ ID NO: 868699 - DNA, 25 bp, Mus musculus
agaaaatgagcagttacttaaggat

SEQ ID NO: 868700 - DNA, 25 bp, Mus musculus
agaaaatgaggagttacttaaggat

SEQ ID NO: 868701 - DNA, 25 bp, Mus musculus
agaaaatgagttgccaaaaggcttg

SEQ ID NO: 868702 - DNA, 25 bp, Mus musculus
agaaaatgatgccgtaaccattcaa

SEQ ID NO: 868703 - DNA, 25 bp, Mus musculus
agaaaatgatgcggtaaccattcaa

SEQ ID NO: 868704 - DNA, 25 bp, Mus musculus
agaaaatgccagagctaatcctcca

SEQ ID NO: 868705 - DNA, 25 bp, Mus musculus
agaaaatgccagtgctaatcctcca

SEQ ID NO: 868706 - DNA, 25 bp, Mus musculus
agaaaatgggaccggaaaatgctca

SEQ ID NO: 868707 - DNA, 25 bp, Mus musculus
agaaaatgggacgggaaaatgctca

SEQ ID NO: 868708 - DNA, 25 bp, Mus musculus
agaaaatgtgcgcgtggcaatagtt

SEQ ID NO: 868709 - DNA, 25 bp, Mus musculus
agaaaatgtgcgggtggcaatagtt

SEQ ID NO: 868710 - DNA, 25 bp, Mus musculus
agaaaattaaagagtacatccagaa

SEQ ID NO: 868711 - DNA, 25 bp, Mus musculus
agaaaattaaagatgaactaatgac

SEQ ID NO: 868712 - DNA, 25 bp, Mus musculus
agaaaattaaagtgtacatccagaa

SEQ ID NO: 868713 - DNA, 25 bp, Mus musculus
agaaaattaaagttgaactaatgac

SEQ ID NO: 868714 - DNA, 25 bp, Mus musculus
agaaaattctcacactcaggagaaa

SEQ ID NO: 868715 - DNA, 25 bp, Mus musculus
agaaaattctcacagtcaggagaaa

SEQ ID NO: 868716 - DNA, 25 bp, Mus musculus
agaaaattgaccagcctgagtacca

SEQ ID NO: 868717 - DNA, 25 bp, Mus musculus
agaaaattgacctgcctgagtacca

SEQ ID NO: 868718 - DNA, 25 bp, Mus musculus
agaaacaaaacacagctgaacttgg

SEQ ID NO: 868719 - DNA, 25 bp, Mus musculus
agaaacaaaacagagctgaacttgg

SEQ ID NO: 868720 - DNA, 25 bp, Mus musculus
agaaacaataagcattgctatggca

SEQ ID NO: 868721 - DNA, 25 bp, Mus musculus
agaaacaataaggattgctatggca

SEQ ID NO: 868722 - DNA, 25 bp, Mus musculus
agaaacacacagccagatgtcatca

SEQ ID NO: 868723 - DNA, 25 bp, Mus musculus
agaaacacacaggcagatgtcatca

SEQ ID NO: 868724 - DNA, 25 bp, Mus musculus
agaaacacagctccttcacccactt

SEQ ID NO: 868725 - DNA, 25 bp, Mus musculus
agaaacacaggtccttcacccactt

SEQ ID NO: 868726 - DNA, 25 bp, Mus musculus
agaaacagaacacgcttagaaacag

SEQ ID NO: 868727 - DNA, 25 bp, Mus musculus
agaaacagaacaggcttagaaacag

SEQ ID NO: 868728 - DNA, 25 bp, Mus musculus
agaaacatcgataaccctgctattg

SEQ ID NO: 868729 - DNA, 25 bp, Mus musculus
agaaacatcgattaccctgctattg

SEQ ID NO: 868730 - DNA, 25 bp, Mus musculus
agaaacatgctgctggctgggacaa

SEQ ID NO: 868731 - DNA, 25 bp, Mus musculus
agaaacatgctgctggtgtcacagg

SEQ ID NO: 868732 - DNA, 25 bp, Mus musculus
agaaacatgctggtggctgggacaa

SEQ ID NO: 868733 - DNA, 25 bp, Mus musculus
agaaacatgctggtggtgtcacagg

SEQ ID NO: 868734 - DNA, 25 bp, Mus musculus
agaaacatgtaggcctcattcacat

SEQ ID NO: 868735 - DNA, 25 bp, Mus musculus
agaaacatgttggcctcattcacat

SEQ ID NO: 868736 - DNA, 25 bp, Mus musculus
agaaaccaagcagttggccaaagac

SEQ ID NO: 868737 - DNA, 25 bp, Mus musculus
agaaaccaaggagttggccaaagac

SEQ ID NO: 868738 - DNA, 25 bp, Mus musculus
agaaacccagacaccgcccaggaga

SEQ ID NO: 868739 - DNA, 25 bp, Mus musculus
agaaacccagctcgtctctgcggtc

SEQ ID NO: 868740 - DNA, 25 bp, Mus musculus
agaaacccagctggtctctgcggtc

SEQ ID NO: 868741 - DNA, 25 bp, Mus musculus
agaaacccagtcaccgcccaggaga

SEQ ID NO: 868742 - DNA, 25 bp, Mus musculus
agaaacccgctgatgcccctcgaca

SEQ ID NO: 868743 - DNA, 25 bp, Mus musculus
agaaacccgctgttgcccctcgaca

SEQ ID NO: 868744 - DNA, 25 bp, Mus musculus
agaaacctggtctcactctttctca

SEQ ID NO: 868745 - DNA, 25 bp, Mus musculus
agaaacctggtctctctctttctca

SEQ ID NO: 868746 - DNA, 25 bp, Mus musculus
agaaacgagaagcaacaagagctca

SEQ ID NO: 868747 - DNA, 25 bp, Mus musculus
agaaacgagaaggaacaagagctca

SEQ ID NO: 868748 - DNA, 25 bp, Mus musculus
agaaacgctgcccccaagttgaagt

SEQ ID NO: 868749 - DNA, 25 bp, Mus musculus
agaaacgctgccgccaagttgaagt

SEQ ID NO: 868750 - DNA, 25 bp, Mus musculus
agaaacggacacacagttgatccga

SEQ ID NO: 868751 - DNA, 25 bp, Mus musculus
agaaacggacacactgttgatccga

SEQ ID NO: 868752 - DNA, 25 bp, Mus musculus
agaaactaaaaaaaagtgacgagat

SEQ ID NO: 868753 - DNA, 25 bp, Mus musculus
agaaactaaaaataagtgacgagat

SEQ ID NO: 868754 - DNA, 25 bp, Mus musculus
agaaactcagccaacgcctggacct

SEQ ID NO: 868755 - DNA, 25 bp, Mus musculus
agaaactcaggcaacgcctggacct

SEQ ID NO: 868756 - DNA, 25 bp, Mus musculus
agaaactgcaagcgaaagaccatgt

SEQ ID NO: 868757 - DNA, 25 bp, Mus musculus
agaaactgcaagggaaagaccatgt

SEQ ID NO: 868758 - DNA, 25 bp, Mus musculus
agaaactgcctgcaagcggcagctg

SEQ ID NO: 868759 - DNA, 25 bp, Mus musculus
agaaactgcctggaagcggcagctg

SEQ ID NO: 868760 - DNA, 25 bp, Mus musculus
agaaactgtgtgactacttctccac

SEQ ID NO: 868761 - DNA, 25 bp, Mus musculus
agaaactgtgtgtctacttctccac

SEQ ID NO: 868762 - DNA, 25 bp, Mus musculus
agaaacttatgaaatgggacaccag

SEQ ID NO: 868763 - DNA, 25 bp, Mus musculus
agaaacttatgatatgggacaccag

SEQ ID NO: 868764 - DNA, 25 bp, Mus musculus
agaaacttccaaaaccccctgtcat

SEQ ID NO: 868765 - DNA, 25 bp, Mus musculus
agaaacttccaaaagcccctgtcat

SEQ ID NO: 868766 - DNA, 25 bp, Mus musculus
agaaagaaaaccccttatgttagct

SEQ ID NO: 868767 - DNA, 25 bp, Mus musculus
agaaagaaaagcccttatgttagct

SEQ ID NO: 868768 - DNA, 25 bp, Mus musculus
agaaagaatccacagaggaagacga

SEQ ID NO: 868769 - DNA, 25 bp, Mus musculus
agaaagaatccagagaggaagacga

SEQ ID NO: 868770 - DNA, 25 bp, Mus musculus
agaaagacaaaaaacccaagcagca

SEQ ID NO: 868771 - DNA, 25 bp, Mus musculus
agaaagacaaaaaagccaagcagca

SEQ ID NO: 868772 - DNA, 25 bp, Mus musculus
agaaagactgcatcatgacttgtaa

SEQ ID NO: 868773 - DNA, 25 bp, Mus musculus
agaaagactgcatcttgacttgtaa

SEQ ID NO: 868774 - DNA, 25 bp, Mus musculus
agaaagactggacagaagctgaaga

SEQ ID NO: 868775 - DNA, 25 bp, Mus musculus
agaaagactggagagaagctgaaga

SEQ ID NO: 868776 - DNA, 25 bp, Mus musculus
agaaagagagaccagagggacaagg

SEQ ID NO: 868777 - DNA, 25 bp, Mus musculus
agaaagagagagaacgaattcgctt

SEQ ID NO: 868778 - DNA, 25 bp, Mus musculus
agaaagagagatggcagcagcagca

SEQ ID NO: 868779 - DNA, 25 bp, Mus musculus
agaaagagagtccagagggacaagg

SEQ ID NO: 868780 - DNA, 25 bp, Mus musculus
agaaagagagtgaacgaattcgctt

SEQ ID NO: 868781 - DNA, 25 bp, Mus musculus
agaaagagagttggcagcagcagca

SEQ ID NO: 868782 - DNA, 25 bp, Mus musculus
agaaagagatcacatccctgaatcc

SEQ ID NO: 868783 - DNA, 25 bp, Mus musculus
agaaagagatcagatccctgaatcc

SEQ ID NO: 868784 - DNA, 25 bp, Mus musculus
agaaagagccagctgcaaagaagca

SEQ ID NO: 868785 - DNA, 25 bp, Mus musculus
agaaagagccaggtgcaaagaagca

SEQ ID NO: 868786 - DNA, 25 bp, Mus musculus
agaaagagctgacgatcatctgtcc

SEQ ID NO: 868787 - DNA, 25 bp, Mus musculus
agaaagagctgaggatcatctgtcc

SEQ ID NO: 868788 - DNA, 25 bp, Mus musculus
agaaagagtgcctcgcccacgtcag

SEQ ID NO: 868789 - DNA, 25 bp, Mus musculus
agaaagagtggctcgcccacgtcag

SEQ ID NO: 868790 - DNA, 25 bp, Mus musculus
agaaagatgaaacgctgtggtcaat

SEQ ID NO: 868791 - DNA, 25 bp, Mus musculus
agaaagatgaaaggctgtggtcaat

SEQ ID NO: 868792 - DNA, 25 bp, Mus musculus
agaaagatgacaagttgaccccaaa

SEQ ID NO: 868793 - DNA, 25 bp, Mus musculus
agaaagatgacatgttgaccccaaa

SEQ ID NO: 868794 - DNA, 25 bp, Mus musculus
agaaagattacacgcagagtggcat

SEQ ID NO: 868795 - DNA, 25 bp, Mus musculus
agaaagattacaggcagagtggcat

SEQ ID NO: 868796 - DNA, 25 bp, Mus musculus
agaaagcaatgacgattctgatcat

SEQ ID NO: 868797 - DNA, 25 bp, Mus musculus
agaaagcaatgaggattctgatcat

SEQ ID NO: 868798 - DNA, 25 bp, Mus musculus
agaaagcaccagctccccggcgcta

SEQ ID NO: 868799 - DNA, 25 bp, Mus musculus
agaaagcaccaggtccccggcgcta

SEQ ID NO: 868800 - DNA, 25 bp, Mus musculus
agaaagcataagaatgttttgagtt

SEQ ID NO: 868801 - DNA, 25 bp, Mus musculus
agaaagcataagctgactcatattc

SEQ ID NO: 868802 - DNA, 25 bp, Mus musculus
agaaagcataaggtgactcatattc

SEQ ID NO: 868803 - DNA, 25 bp, Mus musculus
agaaagcataagtatgttttgagtt

SEQ ID NO: 868804 - DNA, 25 bp, Mus musculus
agaaagccaagtcaaacacccatag

SEQ ID NO: 868805 - DNA, 25 bp, Mus musculus
agaaagccaagtgaaacacccatag

SEQ ID NO: 868806 - DNA, 25 bp, Mus musculus
agaaagccacaacctaatccacacc

SEQ ID NO: 868807 - DNA, 25 bp, Mus musculus
agaaagccacaagctaatccacacc

SEQ ID NO: 868808 - DNA, 25 bp, Mus musculus
agaaagccatcaacgacctagacag

SEQ ID NO: 868809 - DNA, 25 bp, Mus musculus
agaaagccatcaagttgcctgcagg

SEQ ID NO: 868810 - DNA, 25 bp, Mus musculus
agaaagccatcatcgacctagacag

SEQ ID NO: 868811 - DNA, 25 bp, Mus musculus
agaaagccatcatgttgcctgcagg

SEQ ID NO: 868812 - DNA, 25 bp, Mus musculus
agaaagcctgggctgcggcgaagcc

SEQ ID NO: 868813 - DNA, 25 bp, Mus musculus
agaaagcctggggtgcggcgaagcc

SEQ ID NO: 868814 - DNA, 25 bp, Mus musculus
agaaagccttcatacctggtggtga

SEQ ID NO: 868815 - DNA, 25 bp, Mus musculus
agaaagccttcatagctggtggtga

SEQ ID NO: 868816 - DNA, 25 bp, Mus musculus
agaaagcgaggatgctcatgaaagt

SEQ ID NO: 868817 - DNA, 25 bp, Mus musculus
agaaagcgaggatggtcatgaaagt

SEQ ID NO: 868818 - DNA, 25 bp, Mus musculus
agaaagcggaagctctggaagctgc

SEQ ID NO: 868819 - DNA, 25 bp, Mus musculus
agaaagcggaaggtctggaagctgc

SEQ ID NO: 868820 - DNA, 25 bp, Mus musculus
agaaagcttcagctttggaatggga

SEQ ID NO: 868821 - DNA, 25 bp, Mus musculus
agaaagcttcaggtttggaatggga

SEQ ID NO: 868822 - DNA, 25 bp, Mus musculus
agaaagcttgcacgcctttctcata

SEQ ID NO: 868823 - DNA, 25 bp, Mus musculus
agaaagcttgcaggcctttctcata

SEQ ID NO: 868824 - DNA, 25 bp, Mus musculus
agaaaggagaaagacgattgaagaa

SEQ ID NO: 868825 - DNA, 25 bp, Mus musculus
agaaaggagaaagaggattgaagaa

SEQ ID NO: 868826 - DNA, 25 bp, Mus musculus
agaaaggagatgcacgtcttcttgg

SEQ ID NO: 868827 - DNA, 25 bp, Mus musculus
agaaaggagatgcaggtcttcttgg

SEQ ID NO: 868828 - DNA, 25 bp, Mus musculus
agaaaggagggaagataattatgcc

SEQ ID NO: 868829 - DNA, 25 bp, Mus musculus
agaaaggagggaagttaattatgcc

SEQ ID NO: 868830 - DNA, 25 bp, Mus musculus
agaaaggatgcacgaccatcagcac

SEQ ID NO: 868831 - DNA, 25 bp, Mus musculus
agaaaggatgcaggaccatcagcac

SEQ ID NO: 868832 - DNA, 25 bp, Mus musculus
agaaaggccaagctcgccctgcttg

SEQ ID NO: 868833 - DNA, 25 bp, Mus musculus
agaaaggccaagctggccctgcttg

SEQ ID NO: 868834 - DNA, 25 bp, Mus musculus
agaaaggctgcagctggaaccttga

SEQ ID NO: 868835 - DNA, 25 bp, Mus musculus
agaaaggctgcgtgaagacccttat

SEQ ID NO: 868836 - DNA, 25 bp, Mus musculus
agaaaggctggagctggaaccttga

SEQ ID NO: 868837 - DNA, 25 bp, Mus musculus
agaaaggctgggtgaagacccttat

SEQ ID NO: 868838 - DNA, 25 bp, Mus musculus
agaaagtagaagcctcagaaccaac

SEQ ID NO: 868839 - DNA, 25 bp, Mus musculus
agaaagtagaaggctcagaaccaac

SEQ ID NO: 868840 - DNA, 25 bp, Mus musculus
agaaagtatcacattctggcacaat

SEQ ID NO: 868841 - DNA, 25 bp, Mus musculus
agaaagtatcactttctggcacaat

SEQ ID NO: 868842 - DNA, 25 bp, Mus musculus
agaaagtcttcacttgaatggcggc

SEQ ID NO: 868843 - DNA, 25 bp, Mus musculus
agaaagtcttcagttgaatggcggc

SEQ ID NO: 868844 - DNA, 25 bp, Mus musculus
agaaagtgaaagaccattgcagcaa

SEQ ID NO: 868845 - DNA, 25 bp, Mus musculus
agaaagtgaaagtccattgcagcaa

SEQ ID NO: 868846 - DNA, 25 bp, Mus musculus
agaaagtgacagctggtcgaaatgg

SEQ ID NO: 868847 - DNA, 25 bp, Mus musculus
agaaagtgacaggtggtcgaaatgg

SEQ ID NO: 868848 - DNA, 25 bp, Mus musculus
agaaagtgagcacttttgctgccac

SEQ ID NO: 868849 - DNA, 25 bp, Mus musculus
agaaagtgaggacttttgctgccac

SEQ ID NO: 868850 - DNA, 25 bp, Mus musculus
agaaagtgatgacttcctaagggaa

SEQ ID NO: 868851 - DNA, 25 bp, Mus musculus
agaaagtgatgagttcctaagggaa

SEQ ID NO: 868852 - DNA, 25 bp, Mus musculus
agaaagtggcaacatcttagggttg

SEQ ID NO: 868853 - DNA, 25 bp, Mus musculus
agaaagtggcaactcagtacaggct

SEQ ID NO: 868854 - DNA, 25 bp, Mus musculus
agaaagtggcaagatcttagggttg

SEQ ID NO: 868855 - DNA, 25 bp, Mus musculus
agaaagtggcaagtcagtacaggct

SEQ ID NO: 868856 - DNA, 25 bp, Mus musculus
agaaagtggcttaatctgtaacatc

SEQ ID NO: 868857 - DNA, 25 bp, Mus musculus
agaaagtggctttatctgtaacatc

SEQ ID NO: 868858 - DNA, 25 bp, Mus musculus
agaaagttcagtagtaccgcatcca

SEQ ID NO: 868859 - DNA, 25 bp, Mus musculus
agaaagttcagttgtaccgcatcca

SEQ ID NO: 868860 - DNA, 25 bp, Mus musculus
agaaataaaaaacaaatttgcattg

SEQ ID NO: 868861 - DNA, 25 bp, Mus musculus
agaaataaaaaagaaatttgcattg

SEQ ID NO: 868862 - DNA, 25 bp, Mus musculus
agaaataaccagatatcagtttttc

SEQ ID NO: 868863 - DNA, 25 bp, Mus musculus
agaaataaccagctgaagcaagatg

SEQ ID NO: 868864 - DNA, 25 bp, Mus musculus
agaaataaccaggtgaagcaagatg

SEQ ID NO: 868865 - DNA, 25 bp, Mus musculus
agaaataaccagttatcagtttttc

SEQ ID NO: 868866 - DNA, 25 bp, Mus musculus
agaaatacagagtgcttggtataaa

SEQ ID NO: 868867 - DNA, 25 bp, Mus musculus
agaaatacagtgtgcttggtataaa

SEQ ID NO: 868868 - DNA, 25 bp, Mus musculus
agaaatcgagctgaggaaacgtgtg

SEQ ID NO: 868869 - DNA, 25 bp, Mus musculus
agaaatcgaggtgaggaaacgtgtg

SEQ ID NO: 868870 - DNA, 25 bp, Mus musculus
agaaatctatgaatggtaccacaag

SEQ ID NO: 868871 - DNA, 25 bp, Mus musculus
agaaatctatgattggtaccacaag

SEQ ID NO: 868872 - DNA, 25 bp, Mus musculus
agaaatctgattctcgttttgctat

SEQ ID NO: 868873 - DNA, 25 bp, Mus musculus
agaaatctgattctggttttgctat

SEQ ID NO: 868874 - DNA, 25 bp, Mus musculus
agaaatgaaaagggctcggtgtgct

SEQ ID NO: 868875 - DNA, 25 bp, Mus musculus
agaaatgaaatgggctcggtgtgct

SEQ ID NO: 868876 - DNA, 25 bp, Mus musculus
agaaatgaagagagctaaagaagag

SEQ ID NO: 868877 - DNA, 25 bp, Mus musculus
agaaatgaagctctgattgctcttt

SEQ ID NO: 868878 - DNA, 25 bp, Mus musculus
agaaatgaaggtctgattgctcttt

SEQ ID NO: 868879 - DNA, 25 bp, Mus musculus
agaaatgaagtgagctaaagaagag

SEQ ID NO: 868880 - DNA, 25 bp, Mus musculus
agaaatgcaaaacgaccctgataga

SEQ ID NO: 868881 - DNA, 25 bp, Mus musculus
agaaatgcaaaaggaccctgataga

SEQ ID NO: 868882 - DNA, 25 bp, Mus musculus
agaaatgcagaaagtttttaaagag

SEQ ID NO: 868883 - DNA, 25 bp, Mus musculus
agaaatgcagcaatctccggttcca

SEQ ID NO: 868884 - DNA, 25 bp, Mus musculus
agaaatgcaggaatctccggttcca

SEQ ID NO: 868885 - DNA, 25 bp, Mus musculus
agaaatgcagtaagtttttaaagag

SEQ ID NO: 868886 - DNA, 25 bp, Mus musculus
agaaatggagagaagcccgggacgg

SEQ ID NO: 868887 - DNA, 25 bp, Mus musculus
agaaatggagtcaaactgggtgtcg

SEQ ID NO: 868888 - DNA, 25 bp, Mus musculus
agaaatggagtcaatctgggtgtcg

SEQ ID NO: 868889 - DNA, 25 bp, Mus musculus
agaaatggagtgaagcccgggacgg

SEQ ID NO: 868890 - DNA, 25 bp, Mus musculus
agaaatggcccaagattttgttctt

SEQ ID NO: 868891 - DNA, 25 bp, Mus musculus
agaaatggcccaagtgctctgtaac

SEQ ID NO: 868892 - DNA, 25 bp, Mus musculus
agaaatggcccaatgaaaagagtca

SEQ ID NO: 868893 - DNA, 25 bp, Mus musculus
agaaatggcccatgattttgttctt

SEQ ID NO: 868894 - DNA, 25 bp, Mus musculus
agaaatggcccatgtgctctgtaac

SEQ ID NO: 868895 - DNA, 25 bp, Mus musculus
agaaatggcccattgaaaagagtca

SEQ ID NO: 868896 - DNA, 25 bp, Mus musculus
agaaatggtcatcacagctgtactg

SEQ ID NO: 868897 - DNA, 25 bp, Mus musculus
agaaatggtcatcactgtcctccta

SEQ ID NO: 868898 - DNA, 25 bp, Mus musculus
agaaatggtcatcagagctgtactg

SEQ ID NO: 868899 - DNA, 25 bp, Mus musculus
agaaatggtcatcagtgtcctccta

SEQ ID NO: 868900 - DNA, 25 bp, Mus musculus
agaaatgtcatgcaaacttgacatc

SEQ ID NO: 868901 - DNA, 25 bp, Mus musculus
agaaatgtcatggaaacttgacatc

SEQ ID NO: 868902 - DNA, 25 bp, Mus musculus
agaaatgttccaccctagagaagtt

SEQ ID NO: 868903 - DNA, 25 bp, Mus musculus
agaaatgttccagcctagagaagtt

SEQ ID NO: 868904 - DNA, 25 bp, Mus musculus
agaaattatagcaaaaggaactcaa

SEQ ID NO: 868905 - DNA, 25 bp, Mus musculus
agaaattatagctaaaggaactcaa

SEQ ID NO: 868906 - DNA, 25 bp, Mus musculus
agaaattgaacagagagaagcgctt

SEQ ID NO: 868907 - DNA, 25 bp, Mus musculus
agaaattgaagacggcaaactggtt

SEQ ID NO: 868908 - DNA, 25 bp, Mus musculus
agaaattgaagagagagaagcgctt

SEQ ID NO: 868909 - DNA, 25 bp, Mus musculus
agaaattgaagagggcaaactggtt

SEQ ID NO: 868910 - DNA, 25 bp, Mus musculus
agaaattgccaaagctacaactaaa

SEQ ID NO: 868911 - DNA, 25 bp, Mus musculus
agaaattgccaatgctacaactaaa

SEQ ID NO: 868912 - DNA, 25 bp, Mus musculus
agaacaaaggcgacctgcaccgctg

SEQ ID NO: 868913 - DNA, 25 bp, Mus musculus
agaacaaaggcgtcctgcaccgctg

SEQ ID NO: 868914 - DNA, 25 bp, Mus musculus
agaacaaatgctgaaagagatcacc

SEQ ID NO: 868915 - DNA, 25 bp, Mus musculus
agaacaaatggtgaaagagatcacc

SEQ ID NO: 868916 - DNA, 25 bp, Mus musculus
agaacaacagcaacctgaggagaag

SEQ ID NO: 868917 - DNA, 25 bp, Mus musculus
agaacaacagcactccgggagaagc

SEQ ID NO: 868918 - DNA, 25 bp, Mus musculus
agaacaacagcgacagctatttgag

SEQ ID NO: 868919 - DNA, 25 bp, Mus musculus
agaacaacagctgttgggagccctt

SEQ ID NO: 868920 - DNA, 25 bp, Mus musculus
agaacaacaggaacctgaggagaag

SEQ ID NO: 868921 - DNA, 25 bp, Mus musculus
agaacaacaggactccgggagaagc

SEQ ID NO: 868922 - DNA, 25 bp, Mus musculus
agaacaacagggacagctatttgag

SEQ ID NO: 868923 - DNA, 25 bp, Mus musculus
agaacaacaggtgttgggagccctt

SEQ ID NO: 868924 - DNA, 25 bp, Mus musculus
agaacaacttaacgtactgggagat

SEQ ID NO: 868925 - DNA, 25 bp, Mus musculus
agaacaacttaaggtactgggagat

SEQ ID NO: 868926 - DNA, 25 bp, Mus musculus
agaacaagaaagcgacgagccgcaa

SEQ ID NO: 868927 - DNA, 25 bp, Mus musculus
agaacaagaaagggacgagccgcaa

SEQ ID NO: 868928 - DNA, 25 bp, Mus musculus
agaacaagatcgatggaatgccaag

SEQ ID NO: 868929 - DNA, 25 bp, Mus musculus
agaacaagatcgcttctctttgtag

SEQ ID NO: 868930 - DNA, 25 bp, Mus musculus
agaacaagatcggttctctttgtag

SEQ ID NO: 868931 - DNA, 25 bp, Mus musculus
agaacaagatcgttggaatgccaag

SEQ ID NO: 868932 - DNA, 25 bp, Mus musculus
agaacaagcagccatcacactaatc

SEQ ID NO: 868933 - DNA, 25 bp, Mus musculus
agaacaagcagcgatcacactaatc

SEQ ID NO: 868934 - DNA, 25 bp, Mus musculus
agaacaatcgattggaagaattgtt

SEQ ID NO: 868935 - DNA, 25 bp, Mus musculus
agaacaatcgcgaacagactgcttt

SEQ ID NO: 868936 - DNA, 25 bp, Mus musculus
agaacaatcgggaacagactgcttt

SEQ ID NO: 868937 - DNA, 25 bp, Mus musculus
agaacaatcgtttggaagaattgtt

SEQ ID NO: 868938 - DNA, 25 bp, Mus musculus
agaacaatgaggccctggagctgct

SEQ ID NO: 868939 - DNA, 25 bp, Mus musculus
agaacaatgagggcctggagctgct

SEQ ID NO: 868940 - DNA, 25 bp, Mus musculus
agaacaattaaacctttttgatgac

SEQ ID NO: 868941 - DNA, 25 bp, Mus musculus
agaacaattaaagctttttgatgac

SEQ ID NO: 868942 - DNA, 25 bp, Mus musculus
agaacacaaaagcgttttgtgcatc

SEQ ID NO: 868943 - DNA, 25 bp, Mus musculus
agaacacaaaagggttttgtgcatc

SEQ ID NO: 868944 - DNA, 25 bp, Mus musculus
agaacaccaaagagtgagtaaagga

SEQ ID NO: 868945 - DNA, 25 bp, Mus musculus
agaacaccaatgagtgagtaaagga

SEQ ID NO: 868946 - DNA, 25 bp, Mus musculus
agaacaccagctacgctctatggat

SEQ ID NO: 868947 - DNA, 25 bp, Mus musculus
agaacaccaggtacgctctatggat

SEQ ID NO: 868948 - DNA, 25 bp, Mus musculus
agaacaccatctttccacccaggat

SEQ ID NO: 868949 - DNA, 25 bp, Mus musculus
agaacaccatctttccatgaaagcc

SEQ ID NO: 868950 - DNA, 25 bp, Mus musculus
agaacaccatctttcgattcaattt

SEQ ID NO: 868951 - DNA, 25 bp, Mus musculus
agaacaccatctttgcacccaggat

SEQ ID NO: 868952 - DNA, 25 bp, Mus musculus
agaacaccatctttgcatgaaagcc

SEQ ID NO: 868953 - DNA, 25 bp, Mus musculus
agaacaccatctttggattcaattt

SEQ ID NO: 868954 - DNA, 25 bp, Mus musculus
agaacaccattgaaatcccagcctg

SEQ ID NO: 868955 - DNA, 25 bp, Mus musculus
agaacaccattgaattcccagcctg

SEQ ID NO: 868956 - DNA, 25 bp, Mus musculus
agaacacccaagccttgatatttgt

SEQ ID NO: 868957 - DNA, 25 bp, Mus musculus
agaacacccaagccttgatcttcgt

SEQ ID NO: 868958 - DNA, 25 bp, Mus musculus
agaacacccaaggcttgatatttgt

SEQ ID NO: 868959 - DNA, 25 bp, Mus musculus
agaacacccaaggcttgatcttcgt

SEQ ID NO: 868960 - DNA, 25 bp, Mus musculus
agaacacccgcaatgattacagcgg

SEQ ID NO: 868961 - DNA, 25 bp, Mus musculus
agaacacccgcattgattacagcgg

SEQ ID NO: 868962 - DNA, 25 bp, Mus musculus
agaacacctgcacagagaagggtcg

SEQ ID NO: 868963 - DNA, 25 bp, Mus musculus
agaacacctgcagagagaagggtcg

SEQ ID NO: 868964 - DNA, 25 bp, Mus musculus
agaacactcaagaacaagaatgtcc

SEQ ID NO: 868965 - DNA, 25 bp, Mus musculus
agaacactcaagaacaatgtccctt

SEQ ID NO: 868966 - DNA, 25 bp, Mus musculus
agaacactcaagaagaagaatgtcc

SEQ ID NO: 868967 - DNA, 25 bp, Mus musculus
agaacactcaagaagaatgtccctt

SEQ ID NO: 868968 - DNA, 25 bp, Mus musculus
agaacactcaagctctgattttcgt

SEQ ID NO: 868969 - DNA, 25 bp, Mus musculus
agaacactcaaggtctgattttcgt

SEQ ID NO: 868970 - DNA, 25 bp, Mus musculus
agaacagagcagctacgaagaaatg

SEQ ID NO: 868971 - DNA, 25 bp, Mus musculus
agaacagagcaggtacgaagaaatg

SEQ ID NO: 868972 - DNA, 25 bp, Mus musculus
agaacagattcacagcctctctccc

SEQ ID NO: 868973 - DNA, 25 bp, Mus musculus
agaacagattcaccagcagcaacag

SEQ ID NO: 868974 - DNA, 25 bp, Mus musculus
agaacagattcagagcctctctccc

SEQ ID NO: 868975 - DNA, 25 bp, Mus musculus
agaacagattcagcagcagcaacag

SEQ ID NO: 868976 - DNA, 25 bp, Mus musculus
agaacagcatcactcaagtgtctat

SEQ ID NO: 868977 - DNA, 25 bp, Mus musculus
agaacagcatcagtcaagtgtctat

SEQ ID NO: 868978 - DNA, 25 bp, Mus musculus
agaacagtgtcacccaaatctcggt

SEQ ID NO: 868979 - DNA, 25 bp, Mus musculus
agaacagtgtcagccaaatctcggt

SEQ ID NO: 868980 - DNA, 25 bp, Mus musculus
agaacagtttgcatagagactcgct

SEQ ID NO: 868981 - DNA, 25 bp, Mus musculus
agaacagtttgcattgagactcgct

SEQ ID NO: 868982 - DNA, 25 bp, Mus musculus
agaacatcacattgccgtcttctgg

SEQ ID NO: 868983 - DNA, 25 bp, Mus musculus
agaacatcacattggcgtcttctgg

SEQ ID NO: 868984 - DNA, 25 bp, Mus musculus
agaacatctctacgcctgaggctgt

SEQ ID NO: 868985 - DNA, 25 bp, Mus musculus
agaacatctctaggcctgaggctgt

SEQ ID NO: 868986 - DNA, 25 bp, Mus musculus
agaacatgaacatcttgcgtctgct

SEQ ID NO: 868987 - DNA, 25 bp, Mus musculus
agaacatgaagatcttgcgtctgct

SEQ ID NO: 868988 - DNA, 25 bp, Mus musculus
agaacatggaggcccctggtgacca

SEQ ID NO: 868989 - DNA, 25 bp, Mus musculus
agaacatggagggccctggtgacca

SEQ ID NO: 868990 - DNA, 25 bp, Mus musculus
agaacatgtacacagcttggaaacc

SEQ ID NO: 868991 - DNA, 25 bp, Mus musculus
agaacatgtacagagcttggaaacc

SEQ ID NO: 868992 - DNA, 25 bp, Mus musculus
agaacattagttcataatgcttaca

SEQ ID NO: 868993 - DNA, 25 bp, Mus musculus
agaacattagttgataatgcttaca

SEQ ID NO: 868994 - DNA, 25 bp, Mus musculus
agaacattgcagcgccgtgcaggcc

SEQ ID NO: 868995 - DNA, 25 bp, Mus musculus
agaacattgcagctaaagatgagcc

SEQ ID NO: 868996 - DNA, 25 bp, Mus musculus
agaacattgcagggccgtgcaggcc

SEQ ID NO: 868997 - DNA, 25 bp, Mus musculus
agaacattgcaggtaaagatgagcc

SEQ ID NO: 868998 - DNA, 25 bp, Mus musculus
agaaccacagccaacgacccctgcg

SEQ ID NO: 868999 - DNA, 25 bp, Mus musculus
agaaccacagccaaggacccctgcg

SEQ ID NO: 869000 - DNA, 25 bp, Mus musculus
agaaccagagcatcgtgctggagct

SEQ ID NO: 869001 - DNA, 25 bp, Mus musculus
agaaccagagcgacagcatcgtgct

SEQ ID NO: 869002 - DNA, 25 bp, Mus musculus
agaaccagaggatcgtgctggagct

SEQ ID NO: 869003 - DNA, 25 bp, Mus musculus
agaaccagagggacagcatcgtgct

SEQ ID NO: 869004 - DNA, 25 bp, Mus musculus
agaaccataaagctgtggaacacaa

SEQ ID NO: 869005 - DNA, 25 bp, Mus musculus
agaaccataaaggtgtggaacacaa

SEQ ID NO: 869006 - DNA, 25 bp, Mus musculus
agaaccatactaagcattatccaat

SEQ ID NO: 869007 - DNA, 25 bp, Mus musculus
agaaccatactaattgcttttgcca

SEQ ID NO: 869008 - DNA, 25 bp, Mus musculus
agaaccatactatgcattatccaat

SEQ ID NO: 869009 - DNA, 25 bp, Mus musculus
agaaccatactatttgcttttgcca

SEQ ID NO: 869010 - DNA, 25 bp, Mus musculus
agaaccatcccaagcactacaaggg

SEQ ID NO: 869011 - DNA, 25 bp, Mus musculus
agaaccatcccatgcactacaaggg

SEQ ID NO: 869012 - DNA, 25 bp, Mus musculus
agaaccattcaacgcaacatcgagt

SEQ ID NO: 869013 - DNA, 25 bp, Mus musculus
agaaccattcaaggcaacatcgagt

SEQ ID NO: 869014 - DNA, 25 bp, Mus musculus
agaacccaactgatccccagctcaa

SEQ ID NO: 869015 - DNA, 25 bp, Mus musculus
agaacccaactgttccccagctcaa

SEQ ID NO: 869016 - DNA, 25 bp, Mus musculus
agaacccaagagcctggggtctcag

SEQ ID NO: 869017 - DNA, 25 bp, Mus musculus
agaacccaagaggctggggtctcag

SEQ ID NO: 869018 - DNA, 25 bp, Mus musculus
agaacccacagacatataaactaca

SEQ ID NO: 869019 - DNA, 25 bp, Mus musculus
agaacccacagagatataaactaca

SEQ ID NO: 869020 - DNA, 25 bp, Mus musculus
agaacccagaaagccggtggccctg

SEQ ID NO: 869021 - DNA, 25 bp, Mus musculus
agaacccagaaagcgggtggccctg

SEQ ID NO: 869022 - DNA, 25 bp, Mus musculus
agaacccagcagcttccatcacatc

SEQ ID NO: 869023 - DNA, 25 bp, Mus musculus
agaacccagcaggttccatcacatc

SEQ ID NO: 869024 - DNA, 25 bp, Mus musculus
agaaccctcaaccgtgttaggagtg

SEQ ID NO: 869025 - DNA, 25 bp, Mus musculus
agaaccctcaacggtgttaggagtg

SEQ ID NO: 869026 - DNA, 25 bp, Mus musculus
agaaccgaagccgtcctcctgagga

SEQ ID NO: 869027 - DNA, 25 bp, Mus musculus
agaaccgaaggcgtcctcctgagga

SEQ ID NO: 869028 - DNA, 25 bp, Mus musculus
agaacctgagctcattgctgcagta

SEQ ID NO: 869029 - DNA, 25 bp, Mus musculus
agaacctgaggtcattgctgcagta

SEQ ID NO: 869030 - DNA, 25 bp, Mus musculus
agaacctggacaactctgtgcacct

SEQ ID NO: 869031 - DNA, 25 bp, Mus musculus
agaacctggacatctctgtgcacct

SEQ ID NO: 869032 - DNA, 25 bp, Mus musculus
agaacctgtcttaacaccttcacag

SEQ ID NO: 869033 - DNA, 25 bp, Mus musculus
agaacctgtcttaagaccttcacag

SEQ ID NO: 869034 - DNA, 25 bp, Mus musculus
agaaccttaaagagaaactagagca

SEQ ID NO: 869035 - DNA, 25 bp, Mus musculus
agaaccttaaagtgaaactagagca

SEQ ID NO: 869036 - DNA, 25 bp, Mus musculus
agaaccttacagctcactgcaggga

SEQ ID NO: 869037 - DNA, 25 bp, Mus musculus
agaaccttacaggtcactgcaggga

SEQ ID NO: 869038 - DNA, 25 bp, Mus musculus
agaaccttcgaggcctggtgcaaga

SEQ ID NO: 869039 - DNA, 25 bp, Mus musculus
agaaccttcgaggcgtggtgcaaga

SEQ ID NO: 869040 - DNA, 25 bp, Mus musculus
agaacgacatcaataatgcaagata

SEQ ID NO: 869041 - DNA, 25 bp, Mus musculus
agaacgacatgaataatgcaagata

SEQ ID NO: 869042 - DNA, 25 bp, Mus musculus
agaacgagaaatgacacaaaagaag

SEQ ID NO: 869043 - DNA, 25 bp, Mus musculus
agaacgagaaatgagacaaaagaag

SEQ ID NO: 869044 - DNA, 25 bp, Mus musculus
agaacgagaagaaacggctgaagga

SEQ ID NO: 869045 - DNA, 25 bp, Mus musculus
agaacgagaagaaagggctgaagga

SEQ ID NO: 869046 - DNA, 25 bp, Mus musculus
agaacgctgtgacacatctgagcac

SEQ ID NO: 869047 - DNA, 25 bp, Mus musculus
agaacgctgtgacaccacctccgtc

SEQ ID NO: 869048 - DNA, 25 bp, Mus musculus
agaacgctgtgacagatctgagcac

SEQ ID NO: 869049 - DNA, 25 bp, Mus musculus
agaacgctgtgacagcacctccgtc

SEQ ID NO: 869050 - DNA, 25 bp, Mus musculus
agaacggaaatacgcaaatactgtg

SEQ ID NO: 869051 - DNA, 25 bp, Mus musculus
agaacggaaataggcaaatactgtg

SEQ ID NO: 869052 - DNA, 25 bp, Mus musculus
agaacggagagatacatctagctag

SEQ ID NO: 869053 - DNA, 25 bp, Mus musculus
agaacggagagatagatctagctag

SEQ ID NO: 869054 - DNA, 25 bp, Mus musculus
agaacggcgatgctttccgtcagaa

SEQ ID NO: 869055 - DNA, 25 bp, Mus musculus
agaacggcgatggtttccgtcagaa

SEQ ID NO: 869056 - DNA, 25 bp, Mus musculus
agaacgtcagcaggctgtcgcgcac

SEQ ID NO: 869057 - DNA, 25 bp, Mus musculus
agaacgtcaggaggctgtcgcgcac

SEQ ID NO: 869058 - DNA, 25 bp, Mus musculus
agaacgtccaggcatgtgagacaac

SEQ ID NO: 869059 - DNA, 25 bp, Mus musculus
agaacgtccagggatgtgagacaac

SEQ ID NO: 869060 - DNA, 25 bp, Mus musculus
agaacgtctgcattcaatgtaactg

SEQ ID NO: 869061 - DNA, 25 bp, Mus musculus
agaacgtctgcattgaatgtaactg

SEQ ID NO: 869062 - DNA, 25 bp, Mus musculus
agaacgttagcactatcctgttaag

SEQ ID NO: 869063 - DNA, 25 bp, Mus musculus
agaacgttaggactatcctgttaag

SEQ ID NO: 869064 - DNA, 25 bp, Mus musculus
agaactacaaacgctgtttggagat

SEQ ID NO: 869065 - DNA, 25 bp, Mus musculus
agaactacaataagtgtttcctcaa

SEQ ID NO: 869066 - DNA, 25 bp, Mus musculus
agaactacaatatgtgtttcctcaa

SEQ ID NO: 869067 - DNA, 25 bp, Mus musculus
agaactacaatcgctgtttggagat

SEQ ID NO: 869068 - DNA, 25 bp, Mus musculus
agaactacagcacgccagaagcacc

SEQ ID NO: 869069 - DNA, 25 bp, Mus musculus
agaactacagcaggccagaagcacc

SEQ ID NO: 869070 - DNA, 25 bp, Mus musculus
agaactagaaacccagaactggagc

SEQ ID NO: 869071 - DNA, 25 bp, Mus musculus
agaactagaaaccctgaactggagc

SEQ ID NO: 869072 - DNA, 25 bp, Mus musculus
agaactagctaacgctcaaactcag

SEQ ID NO: 869073 - DNA, 25 bp, Mus musculus
agaactagctaaggctcaaactcag

SEQ ID NO: 869074 - DNA, 25 bp, Mus musculus
agaactatcccgaggtctccattga

SEQ ID NO: 869075 - DNA, 25 bp, Mus musculus
agaactatcccgtggtctccattga

SEQ ID NO: 869076 - DNA, 25 bp, Mus musculus
agaactcaactaagcggtcactgaa

SEQ ID NO: 869077 - DNA, 25 bp, Mus musculus
agaactcaactaaggggtcactgaa

SEQ ID NO: 869078 - DNA, 25 bp, Mus musculus
agaactcaagaaagatagatttgaa

SEQ ID NO: 869079 - DNA, 25 bp, Mus musculus
agaactcaagaatgatagatttgaa

SEQ ID NO: 869080 - DNA, 25 bp, Mus musculus
agaactcacaagccttattcctggc

SEQ ID NO: 869081 - DNA, 25 bp, Mus musculus
agaactcacatgccttattcctggc

SEQ ID NO: 869082 - DNA, 25 bp, Mus musculus
agaactcagacacgattatggcttc

SEQ ID NO: 869083 - DNA, 25 bp, Mus musculus
agaactcagacaggattatggcttc

SEQ ID NO: 869084 - DNA, 25 bp, Mus musculus
agaactcatacacgagaaaagccgt

SEQ ID NO: 869085 - DNA, 25 bp, Mus musculus
agaactcatacaggagaaaagccgt

SEQ ID NO: 869086 - DNA, 25 bp, Mus musculus
agaactccagaagacgcccaaccca

SEQ ID NO: 869087 - DNA, 25 bp, Mus musculus
agaactccagaagaggcccaaccca

SEQ ID NO: 869088 - DNA, 25 bp, Mus musculus
agaactccagagactcactggcaat

SEQ ID NO: 869089 - DNA, 25 bp, Mus musculus
agaactccagtgactcactggcaat

SEQ ID NO: 869090 - DNA, 25 bp, Mus musculus
agaactcccacaagtatgcacataa

SEQ ID NO: 869091 - DNA, 25 bp, Mus musculus
agaactcccacatgtatgcacataa

SEQ ID NO: 869092 - DNA, 25 bp, Mus musculus
agaactccgacacgtttgtcaaggg

SEQ ID NO: 869093 - DNA, 25 bp, Mus musculus
agaactccgacaggtttgtcaaggg

SEQ ID NO: 869094 - DNA, 25 bp, Mus musculus
agaactcgcaccagggtccacgctt

SEQ ID NO: 869095 - DNA, 25 bp, Mus musculus
agaactcgcagcagggtccacgctt

SEQ ID NO: 869096 - DNA, 25 bp, Mus musculus
agaactgacccacatggtttctggc

SEQ ID NO: 869097 - DNA, 25 bp, Mus musculus
agaactgacccagatggtttctggc

SEQ ID NO: 869098 - DNA, 25 bp, Mus musculus
agaactgagccaccatgagttcttc

SEQ ID NO: 869099 - DNA, 25 bp, Mus musculus
agaactgagccaccttgagttcttc

SEQ ID NO: 869100 - DNA, 25 bp, Mus musculus
agaactgatcagcacagcagaacag

SEQ ID NO: 869101 - DNA, 25 bp, Mus musculus
agaactgatcaggacagcagaacag

SEQ ID NO: 869102 - DNA, 25 bp, Mus musculus
agaactgcaacctcgagggaaaaag

SEQ ID NO: 869103 - DNA, 25 bp, Mus musculus
agaactgcaagctcgagggaaaaag

SEQ ID NO: 869104 - DNA, 25 bp, Mus musculus
agaactgcagaacggagaactttct

SEQ ID NO: 869105 - DNA, 25 bp, Mus musculus
agaactgcagaacgtgctgatggaa

SEQ ID NO: 869106 - DNA, 25 bp, Mus musculus
agaactgcagaagggagaactttct

SEQ ID NO: 869107 - DNA, 25 bp, Mus musculus
agaactgcagaaggtgctgatggaa

SEQ ID NO: 869108 - DNA, 25 bp, Mus musculus
agaactgcagatattccgaggaaag

SEQ ID NO: 869109 - DNA, 25 bp, Mus musculus
agaactgcagccatcagaaggggac

SEQ ID NO: 869110 - DNA, 25 bp, Mus musculus
agaactgcagcttctcccatgggca

SEQ ID NO: 869111 - DNA, 25 bp, Mus musculus
agaactgcaggcatcagaaggggac

SEQ ID NO: 869112 - DNA, 25 bp, Mus musculus
agaactgcaggttctcccatgggca

SEQ ID NO: 869113 - DNA, 25 bp, Mus musculus
agaactgcagttattccgaggaaag

SEQ ID NO: 869114 - DNA, 25 bp, Mus musculus
agaactggagcccccaggtgttggt

SEQ ID NO: 869115 - DNA, 25 bp, Mus musculus
agaactggagcgctgctgggaacgc

SEQ ID NO: 869116 - DNA, 25 bp, Mus musculus
agaactggagcggtgctgggaacgc

SEQ ID NO: 869117 - DNA, 25 bp, Mus musculus
agaactggagcttgtcgaggccaag

SEQ ID NO: 869118 - DNA, 25 bp, Mus musculus
agaactggaggccccaggtgttggt

SEQ ID NO: 869119 - DNA, 25 bp, Mus musculus
agaactggaggttgtcgaggccaag

SEQ ID NO: 869120 - DNA, 25 bp, Mus musculus
agaactggcaagctctggcctgtct

SEQ ID NO: 869121 - DNA, 25 bp, Mus musculus
agaactggcaaggtctggcctgtct

SEQ ID NO: 869122 - DNA, 25 bp, Mus musculus
agaactggccagacaccttgttgcc

SEQ ID NO: 869123 - DNA, 25 bp, Mus musculus
agaactggccagatccgtctacctt

SEQ ID NO: 869124 - DNA, 25 bp, Mus musculus
agaactggccagccccctgcctttc

SEQ ID NO: 869125 - DNA, 25 bp, Mus musculus
agaactggccaggcccctgcctttc

SEQ ID NO: 869126 - DNA, 25 bp, Mus musculus
agaactggccagtcaccttgttgcc

SEQ ID NO: 869127 - DNA, 25 bp, Mus musculus
agaactggccagttccgtctacctt

SEQ ID NO: 869128 - DNA, 25 bp, Mus musculus
agaactggcgctatcccattatcga

SEQ ID NO: 869129 - DNA, 25 bp, Mus musculus
agaactggcggtatcccattatcga

SEQ ID NO: 869130 - DNA, 25 bp, Mus musculus
agaactggctacactctcaacagcg

SEQ ID NO: 869131 - DNA, 25 bp, Mus musculus
agaactggctactctctcaacagcg

SEQ ID NO: 869132 - DNA, 25 bp, Mus musculus
agaactgtcagacacgtttggccgc

SEQ ID NO: 869133 - DNA, 25 bp, Mus musculus
agaactgtcagacaggtttggccgc

SEQ ID NO: 869134 - DNA, 25 bp, Mus musculus
agaactgtctttcgaatcaccactg

SEQ ID NO: 869135 - DNA, 25 bp, Mus musculus
agaactgtctttggaatcaccactg

SEQ ID NO: 869136 - DNA, 25 bp, Mus musculus
agaactgtggagaatcacggtgatc

SEQ ID NO: 869137 - DNA, 25 bp, Mus musculus
agaactgtggagtatcacggtgatc

SEQ ID NO: 869138 - DNA, 25 bp, Mus musculus
agaactgttaggaatgcgatgcaga

SEQ ID NO: 869139 - DNA, 25 bp, Mus musculus
agaactgttaggtatgcgatgcaga

SEQ ID NO: 869140 - DNA, 25 bp, Mus musculus
agaactgttatcaaatgatactcct

SEQ ID NO: 869141 - DNA, 25 bp, Mus musculus
agaactgttatctaatgatactcct

SEQ ID NO: 869142 - DNA, 25 bp, Mus musculus
agaactgttctgcacgtacatttgt

SEQ ID NO: 869143 - DNA, 25 bp, Mus musculus
agaactgttctgcaggtacatttgt

SEQ ID NO: 869144 - DNA, 25 bp, Mus musculus
agaacttcatttatcctagcattaa

SEQ ID NO: 869145 - DNA, 25 bp, Mus musculus
agaacttcatttatgctagcattaa

SEQ ID NO: 869146 - DNA, 25 bp, Mus musculus
agaacttctcagacaattgacatat

SEQ ID NO: 869147 - DNA, 25 bp, Mus musculus
agaacttctcagtcaattgacatat

SEQ ID NO: 869148 - DNA, 25 bp, Mus musculus
agaacttctgcaaaatctcagtttt

SEQ ID NO: 869149 - DNA, 25 bp, Mus musculus
agaacttctggaaaatctcagtttt

SEQ ID NO: 869150 - DNA, 25 bp, Mus musculus
agaacttggtggatcgatgagtttc

SEQ ID NO: 869151 - DNA, 25 bp, Mus musculus
agaacttggtggatggatgagtttc

SEQ ID NO: 869152 - DNA, 25 bp, Mus musculus
agaacttggttactattatcttctg

SEQ ID NO: 869153 - DNA, 25 bp, Mus musculus
agaacttggttagtattatcttctg

SEQ ID NO: 869154 - DNA, 25 bp, Mus musculus
agaactttccagctgtctcctggga

SEQ ID NO: 869155 - DNA, 25 bp, Mus musculus
agaactttccaggtgtctcctggga

SEQ ID NO: 869156 - DNA, 25 bp, Mus musculus
agaactttgtagacacagtccgtga

SEQ ID NO: 869157 - DNA, 25 bp, Mus musculus
agaactttgtagtcacagtccgtga

SEQ ID NO: 869158 - DNA, 25 bp, Mus musculus
agaagaaaagaagaaacaagagcaa

SEQ ID NO: 869159 - DNA, 25 bp, Mus musculus
agaagaaaagatgatggagtttctt

SEQ ID NO: 869160 - DNA, 25 bp, Mus musculus
agaagaaaagtagaaacaagagcaa

SEQ ID NO: 869161 - DNA, 25 bp, Mus musculus
agaagaaaagttgatggagtttctt

SEQ ID NO: 869162 - DNA, 25 bp, Mus musculus
agaagaaaatacagatgtccaactt

SEQ ID NO: 869163 - DNA, 25 bp, Mus musculus
agaagaaaatgccactgctaatcct

SEQ ID NO: 869164 - DNA, 25 bp, Mus musculus
agaagaaaatgccagtgctaatcct

SEQ ID NO: 869165 - DNA, 25 bp, Mus musculus
agaagaaaattcagatgtccaactt

SEQ ID NO: 869166 - DNA, 25 bp, Mus musculus
agaagaaacaataaccattgctatg

SEQ ID NO: 869167 - DNA, 25 bp, Mus musculus
agaagaaacaataagcattgctatg

SEQ ID NO: 869168 - DNA, 25 bp, Mus musculus
agaagaaacacatggtgatgtggac

SEQ ID NO: 869169 - DNA, 25 bp, Mus musculus
agaagaaacagatggtgatgtggac

SEQ ID NO: 869170 - DNA, 25 bp, Mus musculus
agaagaaacccagcaggtctctgcg

SEQ ID NO: 869171 - DNA, 25 bp, Mus musculus
agaagaaacccagctggtctctgcg

SEQ ID NO: 869172 - DNA, 25 bp, Mus musculus
agaagaaactgcctccaagcggcag

SEQ ID NO: 869173 - DNA, 25 bp, Mus musculus
agaagaaactgcctgcaagcggcag

SEQ ID NO: 869174 - DNA, 25 bp, Mus musculus
agaagaaagagccacgtgcaaagaa

SEQ ID NO: 869175 - DNA, 25 bp, Mus musculus
agaagaaagagccaggtgcaaagaa

SEQ ID NO: 869176 - DNA, 25 bp, Mus musculus
agaagaaagtgacacgtggtcgaaa

SEQ ID NO: 869177 - DNA, 25 bp, Mus musculus
agaagaaagtgacaggtggtcgaaa

SEQ ID NO: 869178 - DNA, 25 bp, Mus musculus
agaagaaataaccacatatcagttt

SEQ ID NO: 869179 - DNA, 25 bp, Mus musculus
agaagaaataaccacgtgaagcaag

SEQ ID NO: 869180 - DNA, 25 bp, Mus musculus
agaagaaataaccagatatcagttt

SEQ ID NO: 869181 - DNA, 25 bp, Mus musculus
agaagaaataaccaggtgaagcaag

SEQ ID NO: 869182 - DNA, 25 bp, Mus musculus
agaagaaatacacagtgcttggtat

SEQ ID NO: 869183 - DNA, 25 bp, Mus musculus
agaagaaatacagagtgcttggtat

SEQ ID NO: 869184 - DNA, 25 bp, Mus musculus
agaagaacaatgctaccatcacctg

SEQ ID NO: 869185 - DNA, 25 bp, Mus musculus
agaagaacaatggtaccatcacctg

SEQ ID NO: 869186 - DNA, 25 bp, Mus musculus
agaagaactgagattcctactggac

SEQ ID NO: 869187 - DNA, 25 bp, Mus musculus
agaagaactggccctatcccattat

SEQ ID NO: 869188 - DNA, 25 bp, Mus musculus
agaagaactggcgctatcccattat

SEQ ID NO: 869189 - DNA, 25 bp, Mus musculus
agaagaactgtgaaaagaagacgtg

SEQ ID NO: 869190 - DNA, 25 bp, Mus musculus
agaagaactgtgattcctactggac

SEQ ID NO: 869191 - DNA, 25 bp, Mus musculus
agaagaactgtgtaaagaagacgtg

SEQ ID NO: 869192 - DNA, 25 bp, Mus musculus
agaagaagaaataactctgctgttt

SEQ ID NO: 869193 - DNA, 25 bp, Mus musculus
agaagaagaaattgggcttcctgta

SEQ ID NO: 869194 - DNA, 25 bp, Mus musculus
agaagaagaacctggcagagaagaa

SEQ ID NO: 869195 - DNA, 25 bp, Mus musculus
agaagaagaagctggcagagaagaa

SEQ ID NO: 869196 - DNA, 25 bp, Mus musculus
agaagaagaattaactctgctgttt

SEQ ID NO: 869197 - DNA, 25 bp, Mus musculus
agaagaagaatttgggcttcctgta

SEQ ID NO: 869198 - DNA, 25 bp, Mus musculus
agaagaagataacacgtatcgtaac

SEQ ID NO: 869199 - DNA, 25 bp, Mus musculus
agaagaagataacaggtatcgtaac

SEQ ID NO: 869200 - DNA, 25 bp, Mus musculus
agaagaagcgagaaacatcaatgga

SEQ ID NO: 869201 - DNA, 25 bp, Mus musculus
agaagaagcgagtaacatcaatgga

SEQ ID NO: 869202 - DNA, 25 bp, Mus musculus
agaagaaggccattcggcacaatca

SEQ ID NO: 869203 - DNA, 25 bp, Mus musculus
agaagaaggccattgggcacaatca

SEQ ID NO: 869204 - DNA, 25 bp, Mus musculus
agaagaaggcgcaagtcccctggac

SEQ ID NO: 869205 - DNA, 25 bp, Mus musculus
agaagaaggcgctagtcccctggac

SEQ ID NO: 869206 - DNA, 25 bp, Mus musculus
agaagaatgcagctgggagaggaag

SEQ ID NO: 869207 - DNA, 25 bp, Mus musculus
agaagaatgcaggtgggagaggaag

SEQ ID NO: 869208 - DNA, 25 bp, Mus musculus
agaagacacaagtccaccagtcctg

SEQ ID NO: 869209 - DNA, 25 bp, Mus musculus
agaagacacaagtcgaccagtcctg

SEQ ID NO: 869210 - DNA, 25 bp, Mus musculus
agaagacacacaccaccacctccca

SEQ ID NO: 869211 - DNA, 25 bp, Mus musculus
agaagacacacagcaccacctccca

SEQ ID NO: 869212 - DNA, 25 bp, Mus musculus
agaagacacaggatgctgggacaca

SEQ ID NO: 869213 - DNA, 25 bp, Mus musculus
agaagacacaggttgctgggacaca

SEQ ID NO: 869214 - DNA, 25 bp, Mus musculus
agaagacaccatcctgcttgcacct

SEQ ID NO: 869215 - DNA, 25 bp, Mus musculus
agaagacaccatgctgcttgcacct

SEQ ID NO: 869216 - DNA, 25 bp, Mus musculus
agaagacagagcaacgtcctgttta

SEQ ID NO: 869217 - DNA, 25 bp, Mus musculus
agaagacagagcaaggtcctgttta

SEQ ID NO: 869218 - DNA, 25 bp, Mus musculus
agaagacatcaactgctgtaacagt

SEQ ID NO: 869219 - DNA, 25 bp, Mus musculus
agaagacatcaagtgctgtaacagt

SEQ ID NO: 869220 - DNA, 25 bp, Mus musculus
agaagacatcacaacgtactacctg

SEQ ID NO: 869221 - DNA, 25 bp, Mus musculus
agaagacatcacaaggtactacctg

SEQ ID NO: 869222 - DNA, 25 bp, Mus musculus
agaagaccatagcaggcgcaattca

SEQ ID NO: 869223 - DNA, 25 bp, Mus musculus
agaagaccatagccgcaattcagat

SEQ ID NO: 869224 - DNA, 25 bp, Mus musculus
agaagaccataggaggcgcaattca

SEQ ID NO: 869225 - DNA, 25 bp, Mus musculus
agaagaccataggcgcaattcagat

SEQ ID NO: 869226 - DNA, 25 bp, Mus musculus
agaagaccgagaagcgcttgaaaag

SEQ ID NO: 869227 - DNA, 25 bp, Mus musculus
agaagaccgagaagggcttgaaaag

SEQ ID NO: 869228 - DNA, 25 bp, Mus musculus
agaagactagattgaggaggaggag

SEQ ID NO: 869229 - DNA, 25 bp, Mus musculus
agaagactagccgccgtgccacgtc

SEQ ID NO: 869230 - DNA, 25 bp, Mus musculus
agaagactaggcgccgtgccacgtc

SEQ ID NO: 869231 - DNA, 25 bp, Mus musculus
agaagactagtttgaggaggaggag

SEQ ID NO: 869232 - DNA, 25 bp, Mus musculus
agaagagaatagatattatggtggg

SEQ ID NO: 869233 - DNA, 25 bp, Mus musculus
agaagagaatagttattatggtggg

SEQ ID NO: 869234 - DNA, 25 bp, Mus musculus
agaagagacgagctctgtgccctga

SEQ ID NO: 869235 - DNA, 25 bp, Mus musculus
agaagagacgagctgtgtgccctga

SEQ ID NO: 869236 - DNA, 25 bp, Mus musculus
agaagagatggacttttttggacca

SEQ ID NO: 869237 - DNA, 25 bp, Mus musculus
agaagagatggagttttttggacca

SEQ ID NO: 869238 - DNA, 25 bp, Mus musculus
agaagagcaaagagagtgccatcgc

SEQ ID NO: 869239 - DNA, 25 bp, Mus musculus
agaagagcaaagagtgtgccatcgc

SEQ ID NO: 869240 - DNA, 25 bp, Mus musculus
agaagagcaagcacccccccagagg

SEQ ID NO: 869241 - DNA, 25 bp, Mus musculus
agaagagcaagcacgcccccagagg

SEQ ID NO: 869242 - DNA, 25 bp, Mus musculus
agaagagccccactcacgcggtgtt

SEQ ID NO: 869243 - DNA, 25 bp, Mus musculus
agaagagccccagactggtaaacag

SEQ ID NO: 869244 - DNA, 25 bp, Mus musculus
agaagagccccagagtggtaaacag

SEQ ID NO: 869245 - DNA, 25 bp, Mus musculus
agaagagccccagtcacgcggtgtt

SEQ ID NO: 869246 - DNA, 25 bp, Mus musculus
agaagagcggacacagcccttggac

SEQ ID NO: 869247 - DNA, 25 bp, Mus musculus
agaagagcggtcacagcccttggac

SEQ ID NO: 869248 - DNA, 25 bp, Mus musculus
agaagagctatgagtatggccccat

SEQ ID NO: 869249 - DNA, 25 bp, Mus musculus
agaagagctatgtgtatggccccat

SEQ ID NO: 869250 - DNA, 25 bp, Mus musculus
agaagaggagatctcagcaatgtat

SEQ ID NO: 869251 - DNA, 25 bp, Mus musculus
agaagaggagcttgtcatccctcag

SEQ ID NO: 869252 - DNA, 25 bp, Mus musculus
agaagaggaggttgtcatccctcag

SEQ ID NO: 869253 - DNA, 25 bp, Mus musculus
agaagaggagttctcagcaatgtat

SEQ ID NO: 869254 - DNA, 25 bp, Mus musculus
agaagagggatacccccgacagtga

SEQ ID NO: 869255 - DNA, 25 bp, Mus musculus
agaagagggatagccccgacagtga

SEQ ID NO: 869256 - DNA, 25 bp, Mus musculus
agaagaggttctcagtcttaggtcc

SEQ ID NO: 869257 - DNA, 25 bp, Mus musculus
agaagaggttctgagtcttaggtcc

SEQ ID NO: 869258 - DNA, 25 bp, Mus musculus
agaagagtaccacgcattcctggtc

SEQ ID NO: 869259 - DNA, 25 bp, Mus musculus
agaagagtaccaggcattcctggtc

SEQ ID NO: 869260 - DNA, 25 bp, Mus musculus
agaagagtatgacgagcgagactcc

SEQ ID NO: 869261 - DNA, 25 bp, Mus musculus
agaagagtatgaggagcgagactcc

SEQ ID NO: 869262 - DNA, 25 bp, Mus musculus
agaagagtccaacacctcagccaac

SEQ ID NO: 869263 - DNA, 25 bp, Mus musculus
agaagagtccaacagctcagccaac

SEQ ID NO: 869264 - DNA, 25 bp, Mus musculus
agaagagtggcacggctgttctcag

SEQ ID NO: 869265 - DNA, 25 bp, Mus musculus
agaagagtgggacggctgttctcag

SEQ ID NO: 869266 - DNA, 25 bp, Mus musculus
agaagataaacacatacagacagaa

SEQ ID NO: 869267 - DNA, 25 bp, Mus musculus
agaagataaacagatacagacagaa

SEQ ID NO: 869268 - DNA, 25 bp, Mus musculus
agaagataaagcgacgctgaaagga

SEQ ID NO: 869269 - DNA, 25 bp, Mus musculus
agaagataaagcgactttcactttc

SEQ ID NO: 869270 - DNA, 25 bp, Mus musculus
agaagataaagcgaggctgaaagga

SEQ ID NO: 869271 - DNA, 25 bp, Mus musculus
agaagataaagcgagtttcactttc

SEQ ID NO: 869272 - DNA, 25 bp, Mus musculus
agaagataacagctatcgtaaccac

SEQ ID NO: 869273 - DNA, 25 bp, Mus musculus
agaagataacaggtatcgtaaccac

SEQ ID NO: 869274 - DNA, 25 bp, Mus musculus
agaagatatatcaaggaatatgtca

SEQ ID NO: 869275 - DNA, 25 bp, Mus musculus
agaagatatatctaggaatatgtca

SEQ ID NO: 869276 - DNA, 25 bp, Mus musculus
agaagatcaacacaaggctgggcca

SEQ ID NO: 869277 - DNA, 25 bp, Mus musculus
agaagatcaacacatggctgggcca

SEQ ID NO: 869278 - DNA, 25 bp, Mus musculus
agaagatcagaaaatatttctagac

SEQ ID NO: 869279 - DNA, 25 bp, Mus musculus
agaagatcagtaaatatttctagac

SEQ ID NO: 869280 - DNA, 25 bp, Mus musculus
agaagatgattcaggatttggaatg

SEQ ID NO: 869281 - DNA, 25 bp, Mus musculus
agaagatgattctggatttggaatg

SEQ ID NO: 869282 - DNA, 25 bp, Mus musculus
agaagatgcgtggccgatccatcct

SEQ ID NO: 869283 - DNA, 25 bp, Mus musculus
agaagatgcgtggcggatccatcct

SEQ ID NO: 869284 - DNA, 25 bp, Mus musculus
agaagatgctaccgatgccttccgt

SEQ ID NO: 869285 - DNA, 25 bp, Mus musculus
agaagatgctacggatgccttccgt

SEQ ID NO: 869286 - DNA, 25 bp, Mus musculus
agaagatggcagaatagtgattgac

SEQ ID NO: 869287 - DNA, 25 bp, Mus musculus
agaagatggcagtatagtgattgac

SEQ ID NO: 869288 - DNA, 25 bp, Mus musculus
agaagatggccctctctttcagcgt

SEQ ID NO: 869289 - DNA, 25 bp, Mus musculus
agaagatggccgtggcaaccctggc

SEQ ID NO: 869290 - DNA, 25 bp, Mus musculus
agaagatggcgctctctttcagcgt

SEQ ID NO: 869291 - DNA, 25 bp, Mus musculus
agaagatggcggtggcaaccctggc

SEQ ID NO: 869292 - DNA, 25 bp, Mus musculus
agaagatgtgtaggcgagctgtccc

SEQ ID NO: 869293 - DNA, 25 bp, Mus musculus
agaagatgtgtaggggagctgtccc

SEQ ID NO: 869294 - DNA, 25 bp, Mus musculus
agaagatttacatctttcaagcaat

SEQ ID NO: 869295 - DNA, 25 bp, Mus musculus
agaagatttagatctttcaagcaat

SEQ ID NO: 869296 - DNA, 25 bp, Mus musculus
agaagcaaagcataaacaagctgag

SEQ ID NO: 869297 - DNA, 25 bp, Mus musculus
agaagcaaaggataaacaagctgag

SEQ ID NO: 869298 - DNA, 25 bp, Mus musculus
agaagcaaatgttgcgtgaacggct

SEQ ID NO: 869299 - DNA, 25 bp, Mus musculus
agaagcaaatgttgggtgaacggct

SEQ ID NO: 869300 - DNA, 25 bp, Mus musculus
agaagcaacaagcaggatctcagcc

SEQ ID NO: 869301 - DNA, 25 bp, Mus musculus
agaagcaacaagctgctccgccagc

SEQ ID NO: 869302 - DNA, 25 bp, Mus musculus
agaagcaacaaggaggatctcagcc

SEQ ID NO: 869303 - DNA, 25 bp, Mus musculus
agaagcaacaaggtgctccgccagc

SEQ ID NO: 869304 - DNA, 25 bp, Mus musculus
agaagcaagcagcccactcctgacc

SEQ ID NO: 869305 - DNA, 25 bp, Mus musculus
agaagcaagcagctagaggatgaac

SEQ ID NO: 869306 - DNA, 25 bp, Mus musculus
agaagcaagcaggccactcctgacc

SEQ ID NO: 869307 - DNA, 25 bp, Mus musculus
agaagcaagcaggtagaggatgaac

SEQ ID NO: 869308 - DNA, 25 bp, Mus musculus
agaagcaaggacagtcagcgtgaga

SEQ ID NO: 869309 - DNA, 25 bp, Mus musculus
agaagcaaggactgtcagcgtgaga

SEQ ID NO: 869310 - DNA, 25 bp, Mus musculus
agaagcactccaaaaactaaagctg

SEQ ID NO: 869311 - DNA, 25 bp, Mus musculus
agaagcactccaagtgtgtctgaag

SEQ ID NO: 869312 - DNA, 25 bp, Mus musculus
agaagcactccataaactaaagctg

SEQ ID NO: 869313 - DNA, 25 bp, Mus musculus
agaagcactccatgtgtgtctgaag

SEQ ID NO: 869314 - DNA, 25 bp, Mus musculus
agaagcagaagccccaccaccaaag

SEQ ID NO: 869315 - DNA, 25 bp, Mus musculus
agaagcagaagcgccaccaccaaag

SEQ ID NO: 869316 - DNA, 25 bp, Mus musculus
agaagcagagcaagcccatgattct

SEQ ID NO: 869317 - DNA, 25 bp, Mus musculus
agaagcagaggaagcccatgattct

SEQ ID NO: 869318 - DNA, 25 bp, Mus musculus
agaagcagatccggagtagcccctg

SEQ ID NO: 869319 - DNA, 25 bp, Mus musculus
agaagcagatccggtgtagcccctg

SEQ ID NO: 869320 - DNA, 25 bp, Mus musculus
agaagcagatgctgcgggagcgtct

SEQ ID NO: 869321 - DNA, 25 bp, Mus musculus
agaagcagatgctgggggagcgtct

SEQ ID NO: 869322 - DNA, 25 bp, Mus musculus
agaagcagcagaaggaaggcttgct

SEQ ID NO: 869323 - DNA, 25 bp, Mus musculus
agaagcagcagatggaaggcttgct

SEQ ID NO: 869324 - DNA, 25 bp, Mus musculus
agaagcagctggcgcccttctcaag

SEQ ID NO: 869325 - DNA, 25 bp, Mus musculus
agaagcagctggggcccttctcaag

SEQ ID NO: 869326 - DNA, 25 bp, Mus musculus
agaagcaggcaacgtatacttgaag

SEQ ID NO: 869327 - DNA, 25 bp, Mus musculus
agaagcaggcaaggtatacttgaag

SEQ ID NO: 869328 - DNA, 25 bp, Mus musculus
agaagcagtgagtacaacacatgga

SEQ ID NO: 869329 - DNA, 25 bp, Mus musculus
agaagcagtgctatttatgagcctc

SEQ ID NO: 869330 - DNA, 25 bp, Mus musculus
agaagcagtggtatttatgagcctc

SEQ ID NO: 869331 - DNA, 25 bp, Mus musculus
agaagcagtgtgtacaacacatgga

SEQ ID NO: 869332 - DNA, 25 bp, Mus musculus
agaagccagcagatgtgttctgagc

SEQ ID NO: 869333 - DNA, 25 bp, Mus musculus
agaagccagcagttgtgttctgagc

SEQ ID NO: 869334 - DNA, 25 bp, Mus musculus
agaagccagccacacgcccaggcct

SEQ ID NO: 869335 - DNA, 25 bp, Mus musculus
agaagccagccacaggcccaggcct

SEQ ID NO: 869336 - DNA, 25 bp, Mus musculus
agaagccagtcaatcctatcattga

SEQ ID NO: 869337 - DNA, 25 bp, Mus musculus
agaagccagtcaatgctatcattga

SEQ ID NO: 869338 - DNA, 25 bp, Mus musculus
agaagccatcagacatattggctgg

SEQ ID NO: 869339 - DNA, 25 bp, Mus musculus
agaagccatcagacttattggctgg

SEQ ID NO: 869340 - DNA, 25 bp, Mus musculus
agaagccattacaatgtgagatctg

SEQ ID NO: 869341 - DNA, 25 bp, Mus musculus
agaagccattactatgtgagatctg

SEQ ID NO: 869342 - DNA, 25 bp, Mus musculus
agaagccatttgcacatgaaaagaa

SEQ ID NO: 869343 - DNA, 25 bp, Mus musculus
agaagccatttgcagatgaaaagaa

SEQ ID NO: 869344 - DNA, 25 bp, Mus musculus
agaagcccagatcgccggtcctccc

SEQ ID NO: 869345 - DNA, 25 bp, Mus musculus
agaagcccagttcgccggtcctccc

SEQ ID NO: 869346 - DNA, 25 bp, Mus musculus
agaagccctcgaagcttgcagctcc

SEQ ID NO: 869347 - DNA, 25 bp, Mus musculus
agaagccctcgaaggttgcagctcc

SEQ ID NO: 869348 - DNA, 25 bp, Mus musculus
agaagccctcgacccctcatctttg

SEQ ID NO: 869349 - DNA, 25 bp, Mus musculus
agaagccctcgaccgctcatctttg

SEQ ID NO: 869350 - DNA, 25 bp, Mus musculus
agaagccgggcgctctgccagtagc

SEQ ID NO: 869351 - DNA, 25 bp, Mus musculus
agaagccgggggctctgccagtagc

SEQ ID NO: 869352 - DNA, 25 bp, Mus musculus
agaagcgaagttcacatcttgaagg

SEQ ID NO: 869353 - DNA, 25 bp, Mus musculus
agaagcgaagttcagatcttgaagg

SEQ ID NO: 869354 - DNA, 25 bp, Mus musculus
agaagcgctgcaaaatcttaaaaat

SEQ ID NO: 869355 - DNA, 25 bp, Mus musculus
agaagcgctggaaaatcttaaaaat

SEQ ID NO: 869356 - DNA, 25 bp, Mus musculus
agaagcggagacacgaccacctgct

SEQ ID NO: 869357 - DNA, 25 bp, Mus musculus
agaagcggagtcacgaccacctgct

SEQ ID NO: 869358 - DNA, 25 bp, Mus musculus
agaagcggcctgcatgacccgccgg

SEQ ID NO: 869359 - DNA, 25 bp, Mus musculus
agaagcggcctggatgacccgccgg

SEQ ID NO: 869360 - DNA, 25 bp, Mus musculus
agaagcggcgcgagtacctgacagg

SEQ ID NO: 869361 - DNA, 25 bp, Mus musculus
agaagcggcgggagtacctgacagg

SEQ ID NO: 869362 - DNA, 25 bp, Mus musculus
agaagcgggcctccagtgctcgtgc

SEQ ID NO: 869363 - DNA, 25 bp, Mus musculus
agaagcgggcgtccagtgctcgtgc

SEQ ID NO: 869364 - DNA, 25 bp, Mus musculus
agaagctataaacgatgttaagatt

SEQ ID NO: 869365 - DNA, 25 bp, Mus musculus
agaagctataaaggatgttaagatt

SEQ ID NO: 869366 - DNA, 25 bp, Mus musculus
agaagctccccgacctgcactcttg

SEQ ID NO: 869367 - DNA, 25 bp, Mus musculus
agaagctccccgtcctgcactcttg

SEQ ID NO: 869368 - DNA, 25 bp, Mus musculus
agaagctctatgactttgtgaagac

SEQ ID NO: 869369 - DNA, 25 bp, Mus musculus
agaagctctatgtctttgtgaagac

SEQ ID NO: 869370 - DNA, 25 bp, Mus musculus
agaagctctgaatgacaaaaagcat

SEQ ID NO: 869371 - DNA, 25 bp, Mus musculus
agaagctctgtatgacaaaaagcat

SEQ ID NO: 869372 - DNA, 25 bp, Mus musculus
agaagctgaaaaagaccgagcctgc

SEQ ID NO: 869373 - DNA, 25 bp, Mus musculus
agaagctgaaaatgaccgagcctgc

SEQ ID NO: 869374 - DNA, 25 bp, Mus musculus
agaagctgacctttaagagtgcaga

SEQ ID NO: 869375 - DNA, 25 bp, Mus musculus
agaagctgacgtttaagagtgcaga

SEQ ID NO: 869376 - DNA, 25 bp, Mus musculus
agaagctgagcacaagatctaattt

SEQ ID NO: 869377 - DNA, 25 bp, Mus musculus
agaagctgagcgttcaaggaaggtg

SEQ ID NO: 869378 - DNA, 25 bp, Mus musculus
agaagctgaggacaagatctaattt

SEQ ID NO: 869379 - DNA, 25 bp, Mus musculus
agaagctgagggttcaaggaaggtg

SEQ ID NO: 869380 - DNA, 25 bp, Mus musculus
agaagctgcctacagcaagagggca

SEQ ID NO: 869381 - DNA, 25 bp, Mus musculus
agaagctgcctagagcaagagggca

SEQ ID NO: 869382 - DNA, 25 bp, Mus musculus
agaagctgctacaactgtccctcca

SEQ ID NO: 869383 - DNA, 25 bp, Mus musculus
agaagctgctacaagtgtccctcca

SEQ ID NO: 869384 - DNA, 25 bp, Mus musculus
agaagctgctagagcactgggaaaa

SEQ ID NO: 869385 - DNA, 25 bp, Mus musculus
agaagctgctagtgcactgggaaaa

SEQ ID NO: 869386 - DNA, 25 bp, Mus musculus
agaagctgcttgcccccatcagcca

SEQ ID NO: 869387 - DNA, 25 bp, Mus musculus
agaagctgcttggccccatcagcca

SEQ ID NO: 869388 - DNA, 25 bp, Mus musculus
agaagctgtcggctcagggacttct

SEQ ID NO: 869389 - DNA, 25 bp, Mus musculus
agaagctgtcgggtcagggacttct

SEQ ID NO: 869390 - DNA, 25 bp, Mus musculus
agaaggaacatgattccagagtgtg

SEQ ID NO: 869391 - DNA, 25 bp, Mus musculus
agaaggaacatgtttccagagtgtg

SEQ ID NO: 869392 - DNA, 25 bp, Mus musculus
agaaggaacggaacgctctggagga

SEQ ID NO: 869393 - DNA, 25 bp, Mus musculus
agaaggaacggatcgctctggagga

SEQ ID NO: 869394 - DNA, 25 bp, Mus musculus
agaaggaagacacacgtacaagctc

SEQ ID NO: 869395 - DNA, 25 bp, Mus musculus
agaaggaagacacaggtacaagctc

SEQ ID NO: 869396 - DNA, 25 bp, Mus musculus
agaaggaaggagagcagtgaggatt

SEQ ID NO: 869397 - DNA, 25 bp, Mus musculus
agaaggaaggtgagcagtgaggatt

SEQ ID NO: 869398 - DNA, 25 bp, Mus musculus
agaaggaagtataaatccatcgaat

SEQ ID NO: 869399 - DNA, 25 bp, Mus musculus
agaaggaagtattaatccatcgaat

SEQ ID NO: 869400 - DNA, 25 bp, Mus musculus
agaaggactctgatcgtgatggccg

SEQ ID NO: 869401 - DNA, 25 bp, Mus musculus
agaaggactctgatggtgatggccg

SEQ ID NO: 869402 - DNA, 25 bp, Mus musculus
agaaggactgcaactgcctgcatgt

SEQ ID NO: 869403 - DNA, 25 bp, Mus musculus
agaaggactgcacactaacctgtaa

SEQ ID NO: 869404 - DNA, 25 bp, Mus musculus
agaaggactgcacagtaacctgtaa

SEQ ID NO: 869405 - DNA, 25 bp, Mus musculus
agaaggactggaactgcctgcatgt

SEQ ID NO: 869406 - DNA, 25 bp, Mus musculus
agaaggactgtgtgcagatgaacgg

SEQ ID NO: 869407 - DNA, 25 bp, Mus musculus
agaaggactgtgtggagatgaacgg

SEQ ID NO: 869408 - DNA, 25 bp, Mus musculus
agaaggagacagaggccattctcaa

SEQ ID NO: 869409 - DNA, 25 bp, Mus musculus
agaaggagacagtggccattctcaa

SEQ ID NO: 869410 - DNA, 25 bp, Mus musculus
agaaggagataaccccgatgtggac

SEQ ID NO: 869411 - DNA, 25 bp, Mus musculus
agaaggagataagcccgatgtggac

SEQ ID NO: 869412 - DNA, 25 bp, Mus musculus
agaaggagcactcaagcacatgctg

SEQ ID NO: 869413 - DNA, 25 bp, Mus musculus
agaaggagcactgaagcacatgctg

SEQ ID NO: 869414 - DNA, 25 bp, Mus musculus
agaaggaggaggcccaagaagcact

SEQ ID NO: 869415 - DNA, 25 bp, Mus musculus
agaaggaggaggccgaagaagcact

SEQ ID NO: 869416 - DNA, 25 bp, Mus musculus
agaaggagggtgatctcacagctcc

SEQ ID NO: 869417 - DNA, 25 bp, Mus musculus
agaaggagggtgatgtcacagctcc

SEQ ID NO: 869418 - DNA, 25 bp, Mus musculus
agaaggagttttccaatacagcaaa

SEQ ID NO: 869419 - DNA, 25 bp, Mus musculus
agaaggagttttcctatacagcaaa

SEQ ID NO: 869420 - DNA, 25 bp, Mus musculus
agaaggataaagcgctgcagacaag

SEQ ID NO: 869421 - DNA, 25 bp, Mus musculus
agaaggataaagggctgcagacaag

SEQ ID NO: 869422 - DNA, 25 bp, Mus musculus
agaaggatacgagcaatcatttcca

SEQ ID NO: 869423 - DNA, 25 bp, Mus musculus
agaaggatacgagcagtagtaccgt

SEQ ID NO: 869424 - DNA, 25 bp, Mus musculus
agaaggatacgagctatcatttcca

SEQ ID NO: 869425 - DNA, 25 bp, Mus musculus
agaaggatacgagctgtagtaccgt

SEQ ID NO: 869426 - DNA, 25 bp, Mus musculus
agaaggatgagccgaactaccatgt

SEQ ID NO: 869427 - DNA, 25 bp, Mus musculus
agaaggatgagcggaactaccatgt

SEQ ID NO: 869428 - DNA, 25 bp, Mus musculus
agaaggcaaatgctatgctggatga

SEQ ID NO: 869429 - DNA, 25 bp, Mus musculus
agaaggcaaatggtatgctggatga

SEQ ID NO: 869430 - DNA, 25 bp, Mus musculus
agaaggcaagattactgtgtagcct

SEQ ID NO: 869431 - DNA, 25 bp, Mus musculus
agaaggcaagcacctgagcacagcc

SEQ ID NO: 869432 - DNA, 25 bp, Mus musculus
agaaggcaagcttcggctcctggct

SEQ ID NO: 869433 - DNA, 25 bp, Mus musculus
agaaggcaaggacctgagcacagcc

SEQ ID NO: 869434 - DNA, 25 bp, Mus musculus
agaaggcaaggttcggctcctggct

SEQ ID NO: 869435 - DNA, 25 bp, Mus musculus
agaaggcaagtttactgtgtagcct

SEQ ID NO: 869436 - DNA, 25 bp, Mus musculus
agaaggcaatcacgacgtaaagtat

SEQ ID NO: 869437 - DNA, 25 bp, Mus musculus
agaaggcaatcaggacgtaaagtat

SEQ ID NO: 869438 - DNA, 25 bp, Mus musculus
agaaggcagagaactgtgccaagtg

SEQ ID NO: 869439 - DNA, 25 bp, Mus musculus
agaaggcagagatctgtgccaagtg

SEQ ID NO: 869440 - DNA, 25 bp, Mus musculus
agaaggcagcagctataagtagccc

SEQ ID NO: 869441 - DNA, 25 bp, Mus musculus
agaaggcagcaggtataagtagccc

SEQ ID NO: 869442 - DNA, 25 bp, Mus musculus
agaaggccagcggccgctttggcgt

SEQ ID NO: 869443 - DNA, 25 bp, Mus musculus
agaaggccaggggccgctttggcgt

SEQ ID NO: 869444 - DNA, 25 bp, Mus musculus
agaaggccattgcgcacaatcatga

SEQ ID NO: 869445 - DNA, 25 bp, Mus musculus
agaaggccattgggcacaatcatga

SEQ ID NO: 869446 - DNA, 25 bp, Mus musculus
agaaggccctttgcatggatctctt

SEQ ID NO: 869447 - DNA, 25 bp, Mus musculus
agaaggccctttgcttggatctctt

SEQ ID NO: 869448 - DNA, 25 bp, Mus musculus
agaaggccgtgccacggatgatgac

SEQ ID NO: 869449 - DNA, 25 bp, Mus musculus
agaaggccgtgccagggatgatgac

SEQ ID NO: 869450 - DNA, 25 bp, Mus musculus
agaaggccttgaaaccttttagcct

SEQ ID NO: 869451 - DNA, 25 bp, Mus musculus
agaaggccttgaaagcttttagcct

SEQ ID NO: 869452 - DNA, 25 bp, Mus musculus
agaaggctctgcagctggtcctggc

SEQ ID NO: 869453 - DNA, 25 bp, Mus musculus
agaaggctctgcaggtggtcctggc

SEQ ID NO: 869454 - DNA, 25 bp, Mus musculus
agaagggatggacacggtccagcct

SEQ ID NO: 869455 - DNA, 25 bp, Mus musculus
agaagggatggagacggtccagcct

SEQ ID NO: 869456 - DNA, 25 bp, Mus musculus
agaagggcaaagatgagtggttctc

SEQ ID NO: 869457 - DNA, 25 bp, Mus musculus
agaagggcaaagttgagtggttctc

SEQ ID NO: 869458 - DNA, 25 bp, Mus musculus
agaagggctgccgacatgtggacga

SEQ ID NO: 869459 - DNA, 25 bp, Mus musculus
agaagggctgccgagatgtggacga

SEQ ID NO: 869460 - DNA, 25 bp, Mus musculus
agaaggtcacaacaactaaaagaag

SEQ ID NO: 869461 - DNA, 25 bp, Mus musculus
agaaggtcacaagaactaaaagaag

SEQ ID NO: 869462 - DNA, 25 bp, Mus musculus
agaaggtgacggtgagaggaggatg

SEQ ID NO: 869463 - DNA, 25 bp, Mus musculus
agaaggtgacggtgtgaggaggatg

SEQ ID NO: 869464 - DNA, 25 bp, Mus musculus
agaaggtgtatacacgaaagcagtc

SEQ ID NO: 869465 - DNA, 25 bp, Mus musculus
agaaggtgtatacaggaaagcagtc

SEQ ID NO: 869466 - DNA, 25 bp, Mus musculus
agaagtatccatcatcagaagtact

SEQ ID NO: 869467 - DNA, 25 bp, Mus musculus
agaagtatccatcttctgtatctca

SEQ ID NO: 869468 - DNA, 25 bp, Mus musculus
agaagtatccatgatcagaagtact

SEQ ID NO: 869469 - DNA, 25 bp, Mus musculus
agaagtatccatgttctgtatctca

SEQ ID NO: 869470 - DNA, 25 bp, Mus musculus
agaagtattgaggaagccattcctg

SEQ ID NO: 869471 - DNA, 25 bp, Mus musculus
agaagtattgtggaagccattcctg

SEQ ID NO: 869472 - DNA, 25 bp, Mus musculus
agaagtcaagcgcaaggcatctggt

SEQ ID NO: 869473 - DNA, 25 bp, Mus musculus
agaagtcaagggcaaggcatctggt

SEQ ID NO: 869474 - DNA, 25 bp, Mus musculus
agaagtcatcagccagctcttgaaa

SEQ ID NO: 869475 - DNA, 25 bp, Mus musculus
agaagtcatcaggcagctcttgaaa

SEQ ID NO: 869476 - DNA, 25 bp, Mus musculus
agaagtcatgacaacacaccctgtt

SEQ ID NO: 869477 - DNA, 25 bp, Mus musculus
agaagtcatgacaagacaccctgtt

SEQ ID NO: 869478 - DNA, 25 bp, Mus musculus
agaagtccagaggctggttcccatc

SEQ ID NO: 869479 - DNA, 25 bp, Mus musculus
agaagtccagcaagatgggctcctg

SEQ ID NO: 869480 - DNA, 25 bp, Mus musculus
agaagtccaggaagatgggctcctg

SEQ ID NO: 869481 - DNA, 25 bp, Mus musculus
agaagtccagtggctggttcccatc

SEQ ID NO: 869482 - DNA, 25 bp, Mus musculus
agaagtctgccaccaacagcaggca

SEQ ID NO: 869483 - DNA, 25 bp, Mus musculus
agaagtctgccagcaacagcaggca

SEQ ID NO: 869484 - DNA, 25 bp, Mus musculus
agaagtcttaagcgtgtagtggaga

SEQ ID NO: 869485 - DNA, 25 bp, Mus musculus
agaagtcttaagggtgtagtggaga

SEQ ID NO: 869486 - DNA, 25 bp, Mus musculus
agaagtcttgccaacatgtggatga

SEQ ID NO: 869487 - DNA, 25 bp, Mus musculus
agaagtcttgccaagatgtggatga

SEQ ID NO: 869488 - DNA, 25 bp, Mus musculus
agaagtgaagaccgttactgtcaaa

SEQ ID NO: 869489 - DNA, 25 bp, Mus musculus
agaagtgaagacggttactgtcaaa

SEQ ID NO: 869490 - DNA, 25 bp, Mus musculus
agaagtgctcagcacaacatcaaaa

SEQ ID NO: 869491 - DNA, 25 bp, Mus musculus
agaagtgctcaggacaacatcaaaa

SEQ ID NO: 869492 - DNA, 25 bp, Mus musculus
agaagtgctgcaccaaaagccaaat

SEQ ID NO: 869493 - DNA, 25 bp, Mus musculus
agaagtgctgcagcaaaagccaaat

SEQ ID NO: 869494 - DNA, 25 bp, Mus musculus
agaagtgcttacagtcttcttctct

SEQ ID NO: 869495 - DNA, 25 bp, Mus musculus
agaagtgcttactgtcttcttctct

SEQ ID NO: 869496 - DNA, 25 bp, Mus musculus
agaagtggacttcatccctgctgtc

SEQ ID NO: 869497 - DNA, 25 bp, Mus musculus
agaagtggacttgatccctgctgtc

SEQ ID NO: 869498 - DNA, 25 bp, Mus musculus
agaagtgtcgccatccttatcacca

SEQ ID NO: 869499 - DNA, 25 bp, Mus musculus
agaagtgtcgccatgcttatcacca

SEQ ID NO: 869500 - DNA, 25 bp, Mus musculus
agaagtgtctagcctttgcttcact

SEQ ID NO: 869501 - DNA, 25 bp, Mus musculus
agaagtgtcttgcctttgcttcact

SEQ ID NO: 869502 - DNA, 25 bp, Mus musculus
agaagtgttaagctccaaaaatatg

SEQ ID NO: 869503 - DNA, 25 bp, Mus musculus
agaagtgttaaggtccaaaaatatg

SEQ ID NO: 869504 - DNA, 25 bp, Mus musculus
agaagttaagcaaacatattcaaga

SEQ ID NO: 869505 - DNA, 25 bp, Mus musculus
agaagttaaggaaacatattcaaga

SEQ ID NO: 869506 - DNA, 25 bp, Mus musculus
agaagttcacaacctggttcatggg

SEQ ID NO: 869507 - DNA, 25 bp, Mus musculus
agaagttcacaagctggttcatggg

SEQ ID NO: 869508 - DNA, 25 bp, Mus musculus
agaagttcacagcagaaaacatctg

SEQ ID NO: 869509 - DNA, 25 bp, Mus musculus
agaagttcacaggagaaaacatctg

SEQ ID NO: 869510 - DNA, 25 bp, Mus musculus
agaagttccaacctagatacttgtt

SEQ ID NO: 869511 - DNA, 25 bp, Mus musculus
agaagttccaagaccccagatggac

SEQ ID NO: 869512 - DNA, 25 bp, Mus musculus
agaagttccatcctagatacttgtt

SEQ ID NO: 869513 - DNA, 25 bp, Mus musculus
agaagttccatgaccccagatggac

SEQ ID NO: 869514 - DNA, 25 bp, Mus musculus
agaagttccgacatcgatatagtga

SEQ ID NO: 869515 - DNA, 25 bp, Mus musculus
agaagttccgacatggatatagtga

SEQ ID NO: 869516 - DNA, 25 bp, Mus musculus
agaagttcctggctttgatgaagat

SEQ ID NO: 869517 - DNA, 25 bp, Mus musculus
agaagttcctgggtttgatgaagat

SEQ ID NO: 869518 - DNA, 25 bp, Mus musculus
agaagttggcttcgcttgagatttt

SEQ ID NO: 869519 - DNA, 25 bp, Mus musculus
agaagttggcttggcttgagatttt

SEQ ID NO: 869520 - DNA, 25 bp, Mus musculus
agaagtttgatgaattcttcaaaga

SEQ ID NO: 869521 - DNA, 25 bp, Mus musculus
agaagtttgatgtattcttcaaaga

SEQ ID NO: 869522 - DNA, 25 bp, Mus musculus
agaataaaaggtcccacaggcacca

SEQ ID NO: 869523 - DNA, 25 bp, Mus musculus
agaataaaaggtgccacaggcacca

SEQ ID NO: 869524 - DNA, 25 bp, Mus musculus
agaataagtacaggagatcaaccga

SEQ ID NO: 869525 - DNA, 25 bp, Mus musculus
agaataagtagaggagatcaaccga

SEQ ID NO: 869526 - DNA, 25 bp, Mus musculus
agaataatttagcggctgctgtgtt

SEQ ID NO: 869527 - DNA, 25 bp, Mus musculus
agaataatttaggggctgctgtgtt

SEQ ID NO: 869528 - DNA, 25 bp, Mus musculus
agaatacaggcattacagcaatgac

SEQ ID NO: 869529 - DNA, 25 bp, Mus musculus
agaatacaggctctgttcactagag

SEQ ID NO: 869530 - DNA, 25 bp, Mus musculus
agaatacagggattacagcaatgac

SEQ ID NO: 869531 - DNA, 25 bp, Mus musculus
agaatacagggtctgttcactagag

SEQ ID NO: 869532 - DNA, 25 bp, Mus musculus
agaatacatgctttacatgttcaaa

SEQ ID NO: 869533 - DNA, 25 bp, Mus musculus
agaatacatggacgaggccatcatg

SEQ ID NO: 869534 - DNA, 25 bp, Mus musculus
agaatacatggaggaggccatcatg

SEQ ID NO: 869535 - DNA, 25 bp, Mus musculus
agaatacatggtttacatgttcaaa

SEQ ID NO: 869536 - DNA, 25 bp, Mus musculus
agaatacatgtcaacatgtgaatga

SEQ ID NO: 869537 - DNA, 25 bp, Mus musculus
agaatacatgtcaacatgtggatga

SEQ ID NO: 869538 - DNA, 25 bp, Mus musculus
agaatacatgtcaaccatcagtgaa

SEQ ID NO: 869539 - DNA, 25 bp, Mus musculus
agaatacatgtcaagatgtgaatga

SEQ ID NO: 869540 - DNA, 25 bp, Mus musculus
agaatacatgtcaagatgtggatga

SEQ ID NO: 869541 - DNA, 25 bp, Mus musculus
agaatacatgtcaagcatcagtgaa

SEQ ID NO: 869542 - DNA, 25 bp, Mus musculus
agaatactgatacacgcgctgcagc

SEQ ID NO: 869543 - DNA, 25 bp, Mus musculus
agaatactgatacaggcgctgcagc

SEQ ID NO: 869544 - DNA, 25 bp, Mus musculus
agaataggaggccgtaaccatagag

SEQ ID NO: 869545 - DNA, 25 bp, Mus musculus
agaataggaggcggtaaccatagag

SEQ ID NO: 869546 - DNA, 25 bp, Mus musculus
agaatatatcagaccacgacggagc

SEQ ID NO: 869547 - DNA, 25 bp, Mus musculus
agaatatatcagtccacgacggagc

SEQ ID NO: 869548 - DNA, 25 bp, Mus musculus
agaatatcagatacacaaaattgtc

SEQ ID NO: 869549 - DNA, 25 bp, Mus musculus
agaatatcagctgcaagaaaaatga

SEQ ID NO: 869550 - DNA, 25 bp, Mus musculus
agaatatcagctgttgaactcttga

SEQ ID NO: 869551 - DNA, 25 bp, Mus musculus
agaatatcaggtgcaagaaaaatga

SEQ ID NO: 869552 - DNA, 25 bp, Mus musculus
agaatatcaggtgttgaactcttga

SEQ ID NO: 869553 - DNA, 25 bp, Mus musculus
agaatatcagttacacaaaattgtc

SEQ ID NO: 869554 - DNA, 25 bp, Mus musculus
agaatatgaaaacgcttctgagaac

SEQ ID NO: 869555 - DNA, 25 bp, Mus musculus
agaatatgaaaaggcttctgagaac

SEQ ID NO: 869556 - DNA, 25 bp, Mus musculus
agaatatgagaatgctcttttcagt

SEQ ID NO: 869557 - DNA, 25 bp, Mus musculus
agaatatgagatcgaggtccacgag

SEQ ID NO: 869558 - DNA, 25 bp, Mus musculus
agaatatgagtatgctcttttcagt

SEQ ID NO: 869559 - DNA, 25 bp, Mus musculus
agaatatgagttcgaggtccacgag

SEQ ID NO: 869560 - DNA, 25 bp, Mus musculus
agaatattctaacatgctcctgcca

SEQ ID NO: 869561 - DNA, 25 bp, Mus musculus
agaatattctaagatgctcctgcca

SEQ ID NO: 869562 - DNA, 25 bp, Mus musculus
agaatattctcacgtctttgaaatg

SEQ ID NO: 869563 - DNA, 25 bp, Mus musculus
agaatattctcaggtctttgaaatg

SEQ ID NO: 869564 - DNA, 25 bp, Mus musculus
agaatcaaaacttccgatgtgacct

SEQ ID NO: 869565 - DNA, 25 bp, Mus musculus
agaatcaaaacttcggatgtgacct

SEQ ID NO: 869566 - DNA, 25 bp, Mus musculus
agaatcaaatggacttcccagctgg

SEQ ID NO: 869567 - DNA, 25 bp, Mus musculus
agaatcaaatggtcttcccagctgg

SEQ ID NO: 869568 - DNA, 25 bp, Mus musculus
agaatcaaggtctgcatattgaagt

SEQ ID NO: 869569 - DNA, 25 bp, Mus musculus
agaatcaaggtctgctgagaagctg

SEQ ID NO: 869570 - DNA, 25 bp, Mus musculus
agaatcaaggtctggatattgaagt

SEQ ID NO: 869571 - DNA, 25 bp, Mus musculus
agaatcaaggtctggtgagaagctg

SEQ ID NO: 869572 - DNA, 25 bp, Mus musculus
agaatcaatgatacagcagctcgtc

SEQ ID NO: 869573 - DNA, 25 bp, Mus musculus
agaatcaatgttacagcagctcgtc

SEQ ID NO: 869574 - DNA, 25 bp, Mus musculus
agaatcacagatcgaacaatgttgc

SEQ ID NO: 869575 - DNA, 25 bp, Mus musculus
agaatcacagatggaacaatgttgc

SEQ ID NO: 869576 - DNA, 25 bp, Mus musculus
agaatcagacagcaatctgcttgaa

SEQ ID NO: 869577 - DNA, 25 bp, Mus musculus
agaatcagacagctgatttgaactg

SEQ ID NO: 869578 - DNA, 25 bp, Mus musculus
agaatcagacaggaatctgcttgaa

SEQ ID NO: 869579 - DNA, 25 bp, Mus musculus
agaatcagacaggtgatttgaactg

SEQ ID NO: 869580 - DNA, 25 bp, Mus musculus
agaatcagagagcctgcagcggtgt

SEQ ID NO: 869581 - DNA, 25 bp, Mus musculus
agaatcagagaggctgcagcggtgt

SEQ ID NO: 869582 - DNA, 25 bp, Mus musculus
agaatcagcaagacagacaccaaac

SEQ ID NO: 869583 - DNA, 25 bp, Mus musculus
agaatcagcaagactacagatgctg

SEQ ID NO: 869584 - DNA, 25 bp, Mus musculus
agaatcagcaagtcagacaccaaac

SEQ ID NO: 869585 - DNA, 25 bp, Mus musculus
agaatcagcaagtctacagatgctg

SEQ ID NO: 869586 - DNA, 25 bp, Mus musculus
agaatccacacacgcgacaagccac

SEQ ID NO: 869587 - DNA, 25 bp, Mus musculus
agaatccacacaggcgacaagccac

SEQ ID NO: 869588 - DNA, 25 bp, Mus musculus
agaatccacccccacctcccaaaga

SEQ ID NO: 869589 - DNA, 25 bp, Mus musculus
agaatccacccccagctcccaaaga

SEQ ID NO: 869590 - DNA, 25 bp, Mus musculus
agaatccagaaaatgtaaagcaatt

SEQ ID NO: 869591 - DNA, 25 bp, Mus musculus
agaatccagaaattgtaaagcaatt

SEQ ID NO: 869592 - DNA, 25 bp, Mus musculus
agaatccatttctgcctctgttccc

SEQ ID NO: 869593 - DNA, 25 bp, Mus musculus
agaatccatttctggctctgttccc

SEQ ID NO: 869594 - DNA, 25 bp, Mus musculus
agaatcccagactcctcactacttg

SEQ ID NO: 869595 - DNA, 25 bp, Mus musculus
agaatcccagaggggaaacggcatt

SEQ ID NO: 869596 - DNA, 25 bp, Mus musculus
agaatcccagtctcctcactacttg

SEQ ID NO: 869597 - DNA, 25 bp, Mus musculus
agaatcccagtggggaaacggcatt

SEQ ID NO: 869598 - DNA, 25 bp, Mus musculus
agaatcgtggataccatcgacatcg

SEQ ID NO: 869599 - DNA, 25 bp, Mus musculus
agaatcgtggttaccatcgacatcg

SEQ ID NO: 869600 - DNA, 25 bp, Mus musculus
agaatctatggagacagtgctgagg

SEQ ID NO: 869601 - DNA, 25 bp, Mus musculus
agaatctatggagagagtgctgagg

SEQ ID NO: 869602 - DNA, 25 bp, Mus musculus
agaatctctgagcttcgttgccttc

SEQ ID NO: 869603 - DNA, 25 bp, Mus musculus
agaatctctgaggttcgttgccttc

SEQ ID NO: 869604 - DNA, 25 bp, Mus musculus
agaatctgaatataaaaagaaagaa

SEQ ID NO: 869605 - DNA, 25 bp, Mus musculus
agaatctgaatatataaagaaagaa

SEQ ID NO: 869606 - DNA, 25 bp, Mus musculus
agaatcttcgccggcaggcctgtct

SEQ ID NO: 869607 - DNA, 25 bp, Mus musculus
agaatcttcggcggcaggcctgtct

SEQ ID NO: 869608 - DNA, 25 bp, Mus musculus
agaatgaaaacattaaagcacttgg

SEQ ID NO: 869609 - DNA, 25 bp, Mus musculus
agaatgaaaagattaaagcacttgg

SEQ ID NO: 869610 - DNA, 25 bp, Mus musculus
agaatgacagcagacgaaatggcta

SEQ ID NO: 869611 - DNA, 25 bp, Mus musculus
agaatgacagcagaggaaatggcta

SEQ ID NO: 869612 - DNA, 25 bp, Mus musculus
agaatgactgctgggtgagcaagca

SEQ ID NO: 869613 - DNA, 25 bp, Mus musculus
agaatgactgctgggtgtgcaaaca

SEQ ID NO: 869614 - DNA, 25 bp, Mus musculus
agaatgactggtgggtgagcaagca

SEQ ID NO: 869615 - DNA, 25 bp, Mus musculus
agaatgactggtgggtgtgcaaaca

SEQ ID NO: 869616 - DNA, 25 bp, Mus musculus
agaatgatgaagatctggagcaaga

SEQ ID NO: 869617 - DNA, 25 bp, Mus musculus
agaatgatgaagatgtggagcaaga

SEQ ID NO: 869618 - DNA, 25 bp, Mus musculus
agaatgccaaacaccgtgtcgacca

SEQ ID NO: 869619 - DNA, 25 bp, Mus musculus
agaatgccaaactccgtgtcgacca

SEQ ID NO: 869620 - DNA, 25 bp, Mus musculus
agaatgctagagtacagtgatgtag

SEQ ID NO: 869621 - DNA, 25 bp, Mus musculus
agaatgctagtgtacagtgatgtag

SEQ ID NO: 869622 - DNA, 25 bp, Mus musculus
agaatgctgactagtgcattgcttc

SEQ ID NO: 869623 - DNA, 25 bp, Mus musculus
agaatgctgacttgtgcattgcttc

SEQ ID NO: 869624 - DNA, 25 bp, Mus musculus
agaatggcatgaatgaggactggga

SEQ ID NO: 869625 - DNA, 25 bp, Mus musculus
agaatggcatgattgaggactggga

SEQ ID NO: 869626 - DNA, 25 bp, Mus musculus
agaatggcatggatgaagactggga

SEQ ID NO: 869627 - DNA, 25 bp, Mus musculus
agaatggcatggttgaagactggga

SEQ ID NO: 869628 - DNA, 25 bp, Mus musculus
agaatgggccaaccagaaaagaaat

SEQ ID NO: 869629 - DNA, 25 bp, Mus musculus
agaatgggccaagcagaaaagaaat

SEQ ID NO: 869630 - DNA, 25 bp, Mus musculus
agaatgggctagacacagttgcaga

SEQ ID NO: 869631 - DNA, 25 bp, Mus musculus
agaatgggctagccaaaagatgtga

SEQ ID NO: 869632 - DNA, 25 bp, Mus musculus
agaatgggctaggcaaaagatgtga

SEQ ID NO: 869633 - DNA, 25 bp, Mus musculus
agaatgggctagtcacagttgcaga

SEQ ID NO: 869634 - DNA, 25 bp, Mus musculus
agaatggggagctgcccccacaggg

SEQ ID NO: 869635 - DNA, 25 bp, Mus musculus
agaatggggagctgcctaagctggt

SEQ ID NO: 869636 - DNA, 25 bp, Mus musculus
agaatggggagctggccccacaggg

SEQ ID NO: 869637 - DNA, 25 bp, Mus musculus
agaatggggagctggctaagctggt

SEQ ID NO: 869638 - DNA, 25 bp, Mus musculus
agaatgtgaacaaactgaattccaa

SEQ ID NO: 869639 - DNA, 25 bp, Mus musculus
agaatgtgaacaaagtgaattccaa

SEQ ID NO: 869640 - DNA, 25 bp, Mus musculus
agaatgtgttaaccaagtgataagt

SEQ ID NO: 869641 - DNA, 25 bp, Mus musculus
agaatgtgttaagcaagtgataagt

SEQ ID NO: 869642 - DNA, 25 bp, Mus musculus
agaattaaagcagattgatgtggaa

SEQ ID NO: 869643 - DNA, 25 bp, Mus musculus
agaattaaaggagattgatgtggaa

SEQ ID NO: 869644 - DNA, 25 bp, Mus musculus
agaattacagaactgtttatcagac

SEQ ID NO: 869645 - DNA, 25 bp, Mus musculus
agaattacagtactgtttatcagac

SEQ ID NO: 869646 - DNA, 25 bp, Mus musculus
agaattactgcatctcccctcaact

SEQ ID NO: 869647 - DNA, 25 bp, Mus musculus
agaattactggatctcccctcaact

SEQ ID NO: 869648 - DNA, 25 bp, Mus musculus
agaattatggaacgccctgcattca

SEQ ID NO: 869649 - DNA, 25 bp, Mus musculus
agaattatggaaggccctgcattca

SEQ ID NO: 869650 - DNA, 25 bp, Mus musculus
agaattcagatctgactatgtggta

SEQ ID NO: 869651 - DNA, 25 bp, Mus musculus
agaattcagatctgtctatgtggta

SEQ ID NO: 869652 - DNA, 25 bp, Mus musculus
agaattcaggggcgaggatgacttg

SEQ ID NO: 869653 - DNA, 25 bp, Mus musculus
agaattcaggggggaggatgacttg

SEQ ID NO: 869654 - DNA, 25 bp, Mus musculus
agaattcatgctagaattgggcaag

SEQ ID NO: 869655 - DNA, 25 bp, Mus musculus
agaattcatgcttgaattgggcaag

SEQ ID NO: 869656 - DNA, 25 bp, Mus musculus
agaattccacggacctagactcagc

SEQ ID NO: 869657 - DNA, 25 bp, Mus musculus
agaattccacggtcctagactcagc

SEQ ID NO: 869658 - DNA, 25 bp, Mus musculus
agaattccataatgtgagctctcag

SEQ ID NO: 869659 - DNA, 25 bp, Mus musculus
agaattccattatgtgagctctcag

SEQ ID NO: 869660 - DNA, 25 bp, Mus musculus
agaattcctccacgagtacatcata

SEQ ID NO: 869661 - DNA, 25 bp, Mus musculus
agaattcctccaggagtacatcata

SEQ ID NO: 869662 - DNA, 25 bp, Mus musculus
agaattgctacactccacaagaatt

SEQ ID NO: 869663 - DNA, 25 bp, Mus musculus
agaattgctacagtccacaagaatt

SEQ ID NO: 869664 - DNA, 25 bp, Mus musculus
agaattgctctgataagctggccca

SEQ ID NO: 869665 - DNA, 25 bp, Mus musculus
agaattgctctgttaagctggccca

SEQ ID NO: 869666 - DNA, 25 bp, Mus musculus
agaattgggtacaactggttctata

SEQ ID NO: 869667 - DNA, 25 bp, Mus musculus
agaattgggtacaagtggttctata

SEQ ID NO: 869668 - DNA, 25 bp, Mus musculus
agaattgtagataatttattagaaa

SEQ ID NO: 869669 - DNA, 25 bp, Mus musculus
agaattgtagattatttattagaaa

SEQ ID NO: 869670 - DNA, 25 bp, Mus musculus
agaattgtgctacacgttgattttc

SEQ ID NO: 869671 - DNA, 25 bp, Mus musculus
agaattgtgctacaggttgattttc

SEQ ID NO: 869672 - DNA, 25 bp, Mus musculus
agaattgtttggccttggatctctg

SEQ ID NO: 869673 - DNA, 25 bp, Mus musculus
agaattgtttgggcttggatctctg

SEQ ID NO: 869674 - DNA, 25 bp, Mus musculus
agaatttcaagatgattacatagtc

SEQ ID NO: 869675 - DNA, 25 bp, Mus musculus
agaatttcaagatgtttacatagtc

SEQ ID NO: 869676 - DNA, 25 bp, Mus musculus
agaatttcagcaatagtggtcttac

SEQ ID NO: 869677 - DNA, 25 bp, Mus musculus
agaatttcaggaatagtggtcttac

SEQ ID NO: 869678 - DNA, 25 bp, Mus musculus
agaatttctgaaagtgcaacagtat

SEQ ID NO: 869679 - DNA, 25 bp, Mus musculus
agaatttctgtaagtgcaacagtat

SEQ ID NO: 869680 - DNA, 25 bp, Mus musculus
agaatttgatgacgacagtggtgac

SEQ ID NO: 869681 - DNA, 25 bp, Mus musculus
agaatttgatgaggacagtggtgac

SEQ ID NO: 869682 - DNA, 25 bp, Mus musculus
agaatttgctgtagacattttaagt

SEQ ID NO: 869683 - DNA, 25 bp, Mus musculus
agaatttgctgttgacattttaagt

SEQ ID NO: 869684 - DNA, 25 bp, Mus musculus
agaatttggaaatcattacttgtat

SEQ ID NO: 869685 - DNA, 25 bp, Mus musculus
agaatttggaaatctttacttgtat

SEQ ID NO: 869686 - DNA, 25 bp, Mus musculus
agaattttccagatccagtgcagac

SEQ ID NO: 869687 - DNA, 25 bp, Mus musculus
agaattttccagttccagtgcagac

SEQ ID NO: 869688 - DNA, 25 bp, Mus musculus
agacaaaaaggacgtggcaatcgtt

SEQ ID NO: 869689 - DNA, 25 bp, Mus musculus
agacaaaaaggaggtggcaatcgtt

SEQ ID NO: 869690 - DNA, 25 bp, Mus musculus
agacaaagagcgacgaacagctttg

SEQ ID NO: 869691 - DNA, 25 bp, Mus musculus
agacaaagagggacgaacagctttg

SEQ ID NO: 869692 - DNA, 25 bp, Mus musculus
agacaaatcaagctgattcccaaac

SEQ ID NO: 869693 - DNA, 25 bp, Mus musculus
agacaaatcaaggtgattcccaaac

SEQ ID NO: 869694 - DNA, 25 bp, Mus musculus
agacaaatctaacgagttgccgtta

SEQ ID NO: 869695 - DNA, 25 bp, Mus musculus
agacaaatctaaggagttgccgtta

SEQ ID NO: 869696 - DNA, 25 bp, Mus musculus
agacaacaccctattttataggcaa

SEQ ID NO: 869697 - DNA, 25 bp, Mus musculus
agacaacacccttttttataggcaa

SEQ ID NO: 869698 - DNA, 25 bp, Mus musculus
agacaacatacacgataagaacaag

SEQ ID NO: 869699 - DNA, 25 bp, Mus musculus
agacaacatacaggataagaacaag

SEQ ID NO: 869700 - DNA, 25 bp, Mus musculus
agacaaccaaagctctgcgcagttc

SEQ ID NO: 869701 - DNA, 25 bp, Mus musculus
agacaaccaaaggtctgcgcagttc

SEQ ID NO: 869702 - DNA, 25 bp, Mus musculus
agacaaccacacagtccattttgag

SEQ ID NO: 869703 - DNA, 25 bp, Mus musculus
agacaaccacactgtccattttgag

SEQ ID NO: 869704 - DNA, 25 bp, Mus musculus
agacaactacccagcggctggatgg

SEQ ID NO: 869705 - DNA, 25 bp, Mus musculus
agacaactacccaggggctggatgg

SEQ ID NO: 869706 - DNA, 25 bp, Mus musculus
agacaacttaacattgtggacatcg

SEQ ID NO: 869707 - DNA, 25 bp, Mus musculus
agacaacttaactttgtggacatcg

SEQ ID NO: 869708 - DNA, 25 bp, Mus musculus
agacaagagggagacaatatgctgg

SEQ ID NO: 869709 - DNA, 25 bp, Mus musculus
agacaagagggagagaatatgctgg

SEQ ID NO: 869710 - DNA, 25 bp, Mus musculus
agacaagattgccacctggaatgtg

SEQ ID NO: 869711 - DNA, 25 bp, Mus musculus
agacaagattgccagctggaatgtg

SEQ ID NO: 869712 - DNA, 25 bp, Mus musculus
agacaagcagaacgtggtgaagcta

SEQ ID NO: 869713 - DNA, 25 bp, Mus musculus
agacaagcagaaggtggtgaagcta

SEQ ID NO: 869714 - DNA, 25 bp, Mus musculus
agacaagcagatggcacagcaaaga

SEQ ID NO: 869715 - DNA, 25 bp, Mus musculus
agacaagcagatgggacagcaaaga

SEQ ID NO: 869716 - DNA, 25 bp, Mus musculus
agacaaggacacaacggtgaagagg

SEQ ID NO: 869717 - DNA, 25 bp, Mus musculus
agacaaggacacaagggtgaagagg

SEQ ID NO: 869718 - DNA, 25 bp, Mus musculus
agacaaggcccctacccccatctct

SEQ ID NO: 869719 - DNA, 25 bp, Mus musculus
agacaaggcccctagccccatctct

SEQ ID NO: 869720 - DNA, 25 bp, Mus musculus
agacaagttatcacggcaatggaag

SEQ ID NO: 869721 - DNA, 25 bp, Mus musculus
agacaagttatctcggcaatggaag

SEQ ID NO: 869722 - DNA, 25 bp, Mus musculus
agacaatcagcgcaagaaaattcct

SEQ ID NO: 869723 - DNA, 25 bp, Mus musculus
agacaatcagggcaagaaaattcct

SEQ ID NO: 869724 - DNA, 25 bp, Mus musculus
agacaatcctatggtctttgccagt

SEQ ID NO: 869725 - DNA, 25 bp, Mus musculus
agacaatcctttggtctttgccagt

SEQ ID NO: 869726 - DNA, 25 bp, Mus musculus
agacaatgacctcccgttggcccag

SEQ ID NO: 869727 - DNA, 25 bp, Mus musculus
agacaatgacctccggttggcccag

SEQ ID NO: 869728 - DNA, 25 bp, Mus musculus
agacaattctaacacagatataccg

SEQ ID NO: 869729 - DNA, 25 bp, Mus musculus
agacaattctaacagagatataccg

SEQ ID NO: 869730 - DNA, 25 bp, Mus musculus
agacacaacaaaaagcatggtagaa

SEQ ID NO: 869731 - DNA, 25 bp, Mus musculus
agacacaacaaatagcatggtagaa

SEQ ID NO: 869732 - DNA, 25 bp, Mus musculus
agacacaacagaccaggttaggaaa

SEQ ID NO: 869733 - DNA, 25 bp, Mus musculus
agacacaacagacgcttccacttct

SEQ ID NO: 869734 - DNA, 25 bp, Mus musculus
agacacaacagagcaggttaggaaa

SEQ ID NO: 869735 - DNA, 25 bp, Mus musculus
agacacaacagaggcttccacttct

SEQ ID NO: 869736 - DNA, 25 bp, Mus musculus
agacacaagcagctcagatgtacca

SEQ ID NO: 869737 - DNA, 25 bp, Mus musculus
agacacaagcaggtcagatgtacca

SEQ ID NO: 869738 - DNA, 25 bp, Mus musculus
agacacaagtcgaccagtcctgaca

SEQ ID NO: 869739 - DNA, 25 bp, Mus musculus
agacacaagtcgtccagtcctgaca

SEQ ID NO: 869740 - DNA, 25 bp, Mus musculus
agacacacagcaccacctcccaggc

SEQ ID NO: 869741 - DNA, 25 bp, Mus musculus
agacacacaggaccacctcccaggc

SEQ ID NO: 869742 - DNA, 25 bp, Mus musculus
agacacaccagacataccatgatgg

SEQ ID NO: 869743 - DNA, 25 bp, Mus musculus
agacacaccagaccagataccatga

SEQ ID NO: 869744 - DNA, 25 bp, Mus musculus
agacacaccagagataccatgatgg

SEQ ID NO: 869745 - DNA, 25 bp, Mus musculus
agacacaccagagcagataccatga

SEQ ID NO: 869746 - DNA, 25 bp, Mus musculus
agacacagaccacgtgggagcatgc

SEQ ID NO: 869747 - DNA, 25 bp, Mus musculus
agacacagaccaggtgggagcatgc

SEQ ID NO: 869748 - DNA, 25 bp, Mus musculus
agacacagagagaggtgctgcagct

SEQ ID NO: 869749 - DNA, 25 bp, Mus musculus
agacacagagagtggtgctgcagct

SEQ ID NO: 869750 - DNA, 25 bp, Mus musculus
agacacagcctgcttctacctggca

SEQ ID NO: 869751 - DNA, 25 bp, Mus musculus
agacacagcctggttctacctggca

SEQ ID NO: 869752 - DNA, 25 bp, Mus musculus
agacacaggactgaccaagcaatga

SEQ ID NO: 869753 - DNA, 25 bp, Mus musculus
agacacaggactgagcaagcaatga

SEQ ID NO: 869754 - DNA, 25 bp, Mus musculus
agacaccacatgagccctgtgggac

SEQ ID NO: 869755 - DNA, 25 bp, Mus musculus
agacaccacatgtgccctgtgggac

SEQ ID NO: 869756 - DNA, 25 bp, Mus musculus
agacaccagaaggactacctgaaca

SEQ ID NO: 869757 - DNA, 25 bp, Mus musculus
agacaccagaaggagtacctgaaca

SEQ ID NO: 869758 - DNA, 25 bp, Mus musculus
agacaccagagcagcgtcatctccg

SEQ ID NO: 869759 - DNA, 25 bp, Mus musculus
agacaccagagcagggtcatctccg

SEQ ID NO: 869760 - DNA, 25 bp, Mus musculus
agacaccatcagcctgaccagcctc

SEQ ID NO: 869761 - DNA, 25 bp, Mus musculus
agacaccatcaggctgaccagcctc

SEQ ID NO: 869762 - DNA, 25 bp, Mus musculus
agacaccatgccagcccactcaaga

SEQ ID NO: 869763 - DNA, 25 bp, Mus musculus
agacaccatgctgcttgcacctgct

SEQ ID NO: 869764 - DNA, 25 bp, Mus musculus
agacaccatggcagcccactcaaga

SEQ ID NO: 869765 - DNA, 25 bp, Mus musculus
agacaccatggtgcttgcacctgct

SEQ ID NO: 869766 - DNA, 25 bp, Mus musculus
agacacccagaatgggctacacata

SEQ ID NO: 869767 - DNA, 25 bp, Mus musculus
agacacccagaggctggtccaggag

SEQ ID NO: 869768 - DNA, 25 bp, Mus musculus
agacacccagcccagccacgctgag

SEQ ID NO: 869769 - DNA, 25 bp, Mus musculus
agacacccaggccagccacgctgag

SEQ ID NO: 869770 - DNA, 25 bp, Mus musculus
agacacccagggaacttctccagcc

SEQ ID NO: 869771 - DNA, 25 bp, Mus musculus
agacacccagggtacttctccagcc

SEQ ID NO: 869772 - DNA, 25 bp, Mus musculus
agacacccagtatgggctacacata

SEQ ID NO: 869773 - DNA, 25 bp, Mus musculus
agacacccagtggctggtccaggag

SEQ ID NO: 869774 - DNA, 25 bp, Mus musculus
agacaccgagagtgtgggttcgcag

SEQ ID NO: 869775 - DNA, 25 bp, Mus musculus
agacaccgagtgtgtgggttcgcag

SEQ ID NO: 869776 - DNA, 25 bp, Mus musculus
agacaccgctcgagtcttatctagc

SEQ ID NO: 869777 - DNA, 25 bp, Mus musculus
agacaccgctcgtgtcttatctagc

SEQ ID NO: 869778 - DNA, 25 bp, Mus musculus
agacaccggcagctgggtaatgctg

SEQ ID NO: 869779 - DNA, 25 bp, Mus musculus
agacaccggcaggtgggtaatgctg

SEQ ID NO: 869780 - DNA, 25 bp, Mus musculus
agacacgacttgagctttgtgggac

SEQ ID NO: 869781 - DNA, 25 bp, Mus musculus
agacacgacttgtgctttgtgggac

SEQ ID NO: 869782 - DNA, 25 bp, Mus musculus
agacacgcggcatacgccttcagaa

SEQ ID NO: 869783 - DNA, 25 bp, Mus musculus
agacacgcggcataggccttcagaa

SEQ ID NO: 869784 - DNA, 25 bp, Mus musculus
agacacggatcgcacgtgcctgtcc

SEQ ID NO: 869785 - DNA, 25 bp, Mus musculus
agacacggatcgcaggtgcctgtcc

SEQ ID NO: 869786 - DNA, 25 bp, Mus musculus
agacactaagcatctccgtgtgtga

SEQ ID NO: 869787 - DNA, 25 bp, Mus musculus
agacactaaggatctccgtgtgtga

SEQ ID NO: 869788 - DNA, 25 bp, Mus musculus
agacactctccagacgttggggcga

SEQ ID NO: 869789 - DNA, 25 bp, Mus musculus
agacactctccagaggttggggcga

SEQ ID NO: 869790 - DNA, 25 bp, Mus musculus
agacactgaaaaccacatttcacat

SEQ ID NO: 869791 - DNA, 25 bp, Mus musculus
agacactgaaaaccgccatggctac

SEQ ID NO: 869792 - DNA, 25 bp, Mus musculus
agacactgaaaagcacatttcacat

SEQ ID NO: 869793 - DNA, 25 bp, Mus musculus
agacactgaaaagcgccatggctac

SEQ ID NO: 869794 - DNA, 25 bp, Mus musculus
agacacttgtgccgaggcccactga

SEQ ID NO: 869795 - DNA, 25 bp, Mus musculus
agacacttgtgccggtgactcagga

SEQ ID NO: 869796 - DNA, 25 bp, Mus musculus
agacacttgtgcggaggcccactga

SEQ ID NO: 869797 - DNA, 25 bp, Mus musculus
agacacttgtgcgggtgactcagga

SEQ ID NO: 869798 - DNA, 25 bp, Mus musculus
agacagaagaagcacgagtacctgg

SEQ ID NO: 869799 - DNA, 25 bp, Mus musculus
agacagaagaagcaggagtacctgg

SEQ ID NO: 869800 - DNA, 25 bp, Mus musculus
agacagacagctgcagtgcttacag

SEQ ID NO: 869801 - DNA, 25 bp, Mus musculus
agacagacagctgctgtgcttacag

SEQ ID NO: 869802 - DNA, 25 bp, Mus musculus
agacagactgcctagatggcaagca

SEQ ID NO: 869803 - DNA, 25 bp, Mus musculus
agacagactggctagatggcaagca

SEQ ID NO: 869804 - DNA, 25 bp, Mus musculus
agacagagagatttgtgtcagaaat

SEQ ID NO: 869805 - DNA, 25 bp, Mus musculus
agacagagagttttgtgtcagaaat

SEQ ID NO: 869806 - DNA, 25 bp, Mus musculus
agacagagcaagctcctgtttattg

SEQ ID NO: 869807 - DNA, 25 bp, Mus musculus
agacagagcaaggtcctgtttattg

SEQ ID NO: 869808 - DNA, 25 bp, Mus musculus
agacagattttgatgaatataaaaa

SEQ ID NO: 869809 - DNA, 25 bp, Mus musculus
agacagattttgttgaatataaaaa

SEQ ID NO: 869810 - DNA, 25 bp, Mus musculus
agacagcaaccaaaagccagtcttc

SEQ ID NO: 869811 - DNA, 25 bp, Mus musculus
agacagcaaccaaatgccagtcttc

SEQ ID NO: 869812 - DNA, 25 bp, Mus musculus
agacagcacccacgttgatgggggt

SEQ ID NO: 869813 - DNA, 25 bp, Mus musculus
agacagcacccaggttgatgggggt

SEQ ID NO: 869814 - DNA, 25 bp, Mus musculus
agacagcagacaagacgaaaatgtg

SEQ ID NO: 869815 - DNA, 25 bp, Mus musculus
agacagcagagaagacgaaaatgtg

SEQ ID NO: 869816 - DNA, 25 bp, Mus musculus
agacagcagagcagctgaagagaag

SEQ ID NO: 869817 - DNA, 25 bp, Mus musculus
agacagcagagcaggtgaagagaag

SEQ ID NO: 869818 - DNA, 25 bp, Mus musculus
agacagcagatcaacatttccatgg

SEQ ID NO: 869819 - DNA, 25 bp, Mus musculus
agacagcagatcaagatttccatgg

SEQ ID NO: 869820 - DNA, 25 bp, Mus musculus
agacagcatcagcattgctgaaaga

SEQ ID NO: 869821 - DNA, 25 bp, Mus musculus
agacagcatcaggattgctgaaaga

SEQ ID NO: 869822 - DNA, 25 bp, Mus musculus
agacagcatctgcggattttctggg

SEQ ID NO: 869823 - DNA, 25 bp, Mus musculus
agacagcatctggggattttctggg

SEQ ID NO: 869824 - DNA, 25 bp, Mus musculus
agacagcatttgcacactccaaaaa

SEQ ID NO: 869825 - DNA, 25 bp, Mus musculus
agacagcatttgcagactccaaaaa

SEQ ID NO: 869826 - DNA, 25 bp, Mus musculus
agacagctagcacccagaggccagc

SEQ ID NO: 869827 - DNA, 25 bp, Mus musculus
agacagctaggacccagaggccagc

SEQ ID NO: 869828 - DNA, 25 bp, Mus musculus
agacagctccagattttcaggaatc

SEQ ID NO: 869829 - DNA, 25 bp, Mus musculus
agacagctccagtttttcaggaatc

SEQ ID NO: 869830 - DNA, 25 bp, Mus musculus
agacaggaactgagcctccggaggg

SEQ ID NO: 869831 - DNA, 25 bp, Mus musculus
agacaggaactgaggctccggaggg

SEQ ID NO: 869832 - DNA, 25 bp, Mus musculus
agacaggagtggcagtctgctgggc

SEQ ID NO: 869833 - DNA, 25 bp, Mus musculus
agacaggagtgggagtctgctgggc

SEQ ID NO: 869834 - DNA, 25 bp, Mus musculus
agacaggcaggccaccttcggacag

SEQ ID NO: 869835 - DNA, 25 bp, Mus musculus
agacaggcaggcgaccttcggacag

SEQ ID NO: 869836 - DNA, 25 bp, Mus musculus
agacaggcctcactgtgaccgccag

SEQ ID NO: 869837 - DNA, 25 bp, Mus musculus
agacaggcctcagtgtgaccgccag

SEQ ID NO: 869838 - DNA, 25 bp, Mus musculus
agacaggctaagcaactcaccaggg

SEQ ID NO: 869839 - DNA, 25 bp, Mus musculus
agacaggctaaggaactcaccaggg

SEQ ID NO: 869840 - DNA, 25 bp, Mus musculus
agacagggagccacagctggtgaaa

SEQ ID NO: 869841 - DNA, 25 bp, Mus musculus
agacagggaggcacagctggtgaaa

SEQ ID NO: 869842 - DNA, 25 bp, Mus musculus
agacaggtaacactgtcagctgact

SEQ ID NO: 869843 - DNA, 25 bp, Mus musculus
agacaggtaacagtgtcagctgact

SEQ ID NO: 869844 - DNA, 25 bp, Mus musculus
agacagtaaccaccttgctccgggc

SEQ ID NO: 869845 - DNA, 25 bp, Mus musculus
agacagtaaccagcttgctccgggc

SEQ ID NO: 869846 - DNA, 25 bp, Mus musculus
agacagtaagcttgtggagaattgt

SEQ ID NO: 869847 - DNA, 25 bp, Mus musculus
agacagtaaggttgtggagaattgt

SEQ ID NO: 869848 - DNA, 25 bp, Mus musculus
agacagtacagacgctttttcaggg

SEQ ID NO: 869849 - DNA, 25 bp, Mus musculus
agacagtacagacgtctatggccag

SEQ ID NO: 869850 - DNA, 25 bp, Mus musculus
agacagtacagaggctttttcaggg

SEQ ID NO: 869851 - DNA, 25 bp, Mus musculus
agacagtacagaggtctatggccag

SEQ ID NO: 869852 - DNA, 25 bp, Mus musculus
agacagtcactgaaccttctgggtg

SEQ ID NO: 869853 - DNA, 25 bp, Mus musculus
agacagtcactgaagcttctgggtg

SEQ ID NO: 869854 - DNA, 25 bp, Mus musculus
agacagtgagcggaaacaggcactt

SEQ ID NO: 869855 - DNA, 25 bp, Mus musculus
agacagtgagggaacagcctcagga

SEQ ID NO: 869856 - DNA, 25 bp, Mus musculus
agacagtgagggaagagcctcagga

SEQ ID NO: 869857 - DNA, 25 bp, Mus musculus
agacagtgaggggaaacaggcactt

SEQ ID NO: 869858 - DNA, 25 bp, Mus musculus
agacataaagaagacccggatggca

SEQ ID NO: 869859 - DNA, 25 bp, Mus musculus
agacataaagacccggatggcactg

SEQ ID NO: 869860 - DNA, 25 bp, Mus musculus
agacataaagctacatacttcactc

SEQ ID NO: 869861 - DNA, 25 bp, Mus musculus
agacataaaggtacatacttcactc

SEQ ID NO: 869862 - DNA, 25 bp, Mus musculus
agacataaagtagacccggatggca

SEQ ID NO: 869863 - DNA, 25 bp, Mus musculus
agacataaagtcccggatggcactg

SEQ ID NO: 869864 - DNA, 25 bp, Mus musculus
agacatacagcctggacgaagatgg

SEQ ID NO: 869865 - DNA, 25 bp, Mus musculus
agacatacagcggcatgaccccggg

SEQ ID NO: 869866 - DNA, 25 bp, Mus musculus
agacatacaggctggacgaagatgg

SEQ ID NO: 869867 - DNA, 25 bp, Mus musculus
agacatacaggggcatgaccccggg

SEQ ID NO: 869868 - DNA, 25 bp, Mus musculus
agacataccagcagcaatatggaag

SEQ ID NO: 869869 - DNA, 25 bp, Mus musculus
agacataccagcaggaatatggaag

SEQ ID NO: 869870 - DNA, 25 bp, Mus musculus
agacataccccacgacacccagcat

SEQ ID NO: 869871 - DNA, 25 bp, Mus musculus
agacataccccaggacacccagcat

SEQ ID NO: 869872 - DNA, 25 bp, Mus musculus
agacataggaagatcaccagcaaaa

SEQ ID NO: 869873 - DNA, 25 bp, Mus musculus
agacataggaagttcaccagcaaaa

SEQ ID NO: 869874 - DNA, 25 bp, Mus musculus
agacatatagagcactaccaaatat

SEQ ID NO: 869875 - DNA, 25 bp, Mus musculus
agacatatagagcagtaccaaatat

SEQ ID NO: 869876 - DNA, 25 bp, Mus musculus
agacatatcaagcccagcaccaaag

SEQ ID NO: 869877 - DNA, 25 bp, Mus musculus
agacatatcaaggccagcaccaaag

SEQ ID NO: 869878 - DNA, 25 bp, Mus musculus
agacatcaaaagaggaattcctaat

SEQ ID NO: 869879 - DNA, 25 bp, Mus musculus
agacatcaaaagtggaattcctaat

SEQ ID NO: 869880 - DNA, 25 bp, Mus musculus
agacatcaaaccctcaaacttcgcc

SEQ ID NO: 869881 - DNA, 25 bp, Mus musculus
agacatcaaaccgtcaaacttcgcc

SEQ ID NO: 869882 - DNA, 25 bp, Mus musculus
agacatcacaagctactacctgtgc

SEQ ID NO: 869883 - DNA, 25 bp, Mus musculus
agacatcacaaggtactacctgtgc

SEQ ID NO: 869884 - DNA, 25 bp, Mus musculus
agacatcatcaacgaaagggaacag

SEQ ID NO: 869885 - DNA, 25 bp, Mus musculus
agacatcatcaaggaaagggaacag

SEQ ID NO: 869886 - DNA, 25 bp, Mus musculus
agacatgaagccctttgttgaaaat

SEQ ID NO: 869887 - DNA, 25 bp, Mus musculus
agacatgaaggcctttgttgaaaat

SEQ ID NO: 869888 - DNA, 25 bp, Mus musculus
agacatgaggaggtcgttcaggttc

SEQ ID NO: 869889 - DNA, 25 bp, Mus musculus
agacatgaggaggtggttcaggttc

SEQ ID NO: 869890 - DNA, 25 bp, Mus musculus
agacatgcaaagacatcaacgagtg

SEQ ID NO: 869891 - DNA, 25 bp, Mus musculus
agacatgcaaagtcatcaacgagtg

SEQ ID NO: 869892 - DNA, 25 bp, Mus musculus
agacatgcagcagatgctgcaggag

SEQ ID NO: 869893 - DNA, 25 bp, Mus musculus
agacatgcaggagatgctgcaggag

SEQ ID NO: 869894 - DNA, 25 bp, Mus musculus
agacatgcgccacgcactgaacaac

SEQ ID NO: 869895 - DNA, 25 bp, Mus musculus
agacatgcgccaggcactgaacaac

SEQ ID NO: 869896 - DNA, 25 bp, Mus musculus
agacatgctggaaactccagatttt

SEQ ID NO: 869897 - DNA, 25 bp, Mus musculus
agacatgctggaaagtccagatttt

SEQ ID NO: 869898 - DNA, 25 bp, Mus musculus
agacatggaaggcctgggactgctc

SEQ ID NO: 869899 - DNA, 25 bp, Mus musculus
agacatggaagggctgggactgctc

SEQ ID NO: 869900 - DNA, 25 bp, Mus musculus
agacatggatctcgtgtgagtgttg

SEQ ID NO: 869901 - DNA, 25 bp, Mus musculus
agacatggatctggtgtgagtgttg

SEQ ID NO: 869902 - DNA, 25 bp, Mus musculus
agacatgggatacaaagtcctctca

SEQ ID NO: 869903 - DNA, 25 bp, Mus musculus
agacatgggatacaagaacaatttt

SEQ ID NO: 869904 - DNA, 25 bp, Mus musculus
agacatgggatacatagtcctctca

SEQ ID NO: 869905 - DNA, 25 bp, Mus musculus
agacatgggatacatgaacaatttt

SEQ ID NO: 869906 - DNA, 25 bp, Mus musculus
agacatgtaaagatatcgatgagtg

SEQ ID NO: 869907 - DNA, 25 bp, Mus musculus
agacatgtaaagttatcgatgagtg

SEQ ID NO: 869908 - DNA, 25 bp, Mus musculus
agacatgtcggaaacaaatgtccca

SEQ ID NO: 869909 - DNA, 25 bp, Mus musculus
agacatgtcggaaagaaatgtccca

SEQ ID NO: 869910 - DNA, 25 bp, Mus musculus
agacatgtgtgtgacgaggttcccc

SEQ ID NO: 869911 - DNA, 25 bp, Mus musculus
agacatgtgtgtgaggaggttcccc

SEQ ID NO: 869912 - DNA, 25 bp, Mus musculus
agacatgtttcacgtgggcaggtca

SEQ ID NO: 869913 - DNA, 25 bp, Mus musculus
agacatgtttcaggtgggcaggtca

SEQ ID NO: 869914 - DNA, 25 bp, Mus musculus
agacattcagagccacaggcaccat

SEQ ID NO: 869915 - DNA, 25 bp, Mus musculus
agacattcagaggcacaggcaccat

SEQ ID NO: 869916 - DNA, 25 bp, Mus musculus
agacattccgcactggtatcagaag

SEQ ID NO: 869917 - DNA, 25 bp, Mus musculus
agacattccgcagtggtatcagaag

SEQ ID NO: 869918 - DNA, 25 bp, Mus musculus
agacattctcagactccttggatgt

SEQ ID NO: 869919 - DNA, 25 bp, Mus musculus
agacattctcagtctccttggatgt

SEQ ID NO: 869920 - DNA, 25 bp, Mus musculus
agacattctgcacgattatacacac

SEQ ID NO: 869921 - DNA, 25 bp, Mus musculus
agacattctgcaggattatacacac

SEQ ID NO: 869922 - DNA, 25 bp, Mus musculus
agacattcttaaccgtttaaaggct

SEQ ID NO: 869923 - DNA, 25 bp, Mus musculus
agacattcttaagcgtttaaaggct

SEQ ID NO: 869924 - DNA, 25 bp, Mus musculus
agacattgacagccacataacagat

SEQ ID NO: 869925 - DNA, 25 bp, Mus musculus
agacattgacaggcacataacagat

SEQ ID NO: 869926 - DNA, 25 bp, Mus musculus
agacattgagacaatagagtccaat

SEQ ID NO: 869927 - DNA, 25 bp, Mus musculus
agacattgagccaccacctaccctg

SEQ ID NO: 869928 - DNA, 25 bp, Mus musculus
agacattgaggcaccacctaccctg

SEQ ID NO: 869929 - DNA, 25 bp, Mus musculus
agacattgagtcaatagagtccaat

SEQ ID NO: 869930 - DNA, 25 bp, Mus musculus
agacattgatcacgtggtgactgca

SEQ ID NO: 869931 - DNA, 25 bp, Mus musculus
agacattgatcaggtggtgactgca

SEQ ID NO: 869932 - DNA, 25 bp, Mus musculus
agacattgcctcaacgtgagctgtc

SEQ ID NO: 869933 - DNA, 25 bp, Mus musculus
agacattgcctcaaggtgagctgtc

SEQ ID NO: 869934 - DNA, 25 bp, Mus musculus
agacattgctagcatttgaagacat

SEQ ID NO: 869935 - DNA, 25 bp, Mus musculus
agacattgctaggatttgaagacat

SEQ ID NO: 869936 - DNA, 25 bp, Mus musculus
agacatttctggcgacacccagaaa

SEQ ID NO: 869937 - DNA, 25 bp, Mus musculus
agacatttctggggacacccagaaa

SEQ ID NO: 869938 - DNA, 25 bp, Mus musculus
agacattttaaataattttgaaaat

SEQ ID NO: 869939 - DNA, 25 bp, Mus musculus
agacattttagcaggttttctgatt

SEQ ID NO: 869940 - DNA, 25 bp, Mus musculus
agacattttagcatataattttgaa

SEQ ID NO: 869941 - DNA, 25 bp, Mus musculus
agacattttagctggttttctgatt

SEQ ID NO: 869942 - DNA, 25 bp, Mus musculus
agacattttagcttataattttgaa

SEQ ID NO: 869943 - DNA, 25 bp, Mus musculus
agacattttatataattttgaaaat

SEQ ID NO: 869944 - DNA, 25 bp, Mus musculus
agaccaagaaatcaagcgctggctg

SEQ ID NO: 869945 - DNA, 25 bp, Mus musculus
agaccaagaaatgaagcgctggctg

SEQ ID NO: 869946 - DNA, 25 bp, Mus musculus
agaccaagatggagcacctggcaca

SEQ ID NO: 869947 - DNA, 25 bp, Mus musculus
agaccaagatggaggacctggcaca

SEQ ID NO: 869948 - DNA, 25 bp, Mus musculus
agaccaagattgaacggctggacat

SEQ ID NO: 869949 - DNA, 25 bp, Mus musculus
agaccaagattgaagggctggacat

SEQ ID NO: 869950 - DNA, 25 bp, Mus musculus
agaccaagcgcatctctttcctgca

SEQ ID NO: 869951 - DNA, 25 bp, Mus musculus
agaccaagcgctggaaggtaggccc

SEQ ID NO: 869952 - DNA, 25 bp, Mus musculus
agaccaagcggatctctttcctgca

SEQ ID NO: 869953 - DNA, 25 bp, Mus musculus
agaccaagcggtggaaggtaggccc

SEQ ID NO: 869954 - DNA, 25 bp, Mus musculus
agaccacacaggacaccctgaagct

SEQ ID NO: 869955 - DNA, 25 bp, Mus musculus
agaccacacaggactccctgaagct

SEQ ID NO: 869956 - DNA, 25 bp, Mus musculus
agaccacagcagcgcaacccagaga

SEQ ID NO: 869957 - DNA, 25 bp, Mus musculus
agaccacagcagggcaacccagaga

SEQ ID NO: 869958 - DNA, 25 bp, Mus musculus
agaccaccagcccccagtgtgagga

SEQ ID NO: 869959 - DNA, 25 bp, Mus musculus
agaccaccagccccgagtgtgagga

SEQ ID NO: 869960 - DNA, 25 bp, Mus musculus
agaccacccacgctttaaagatcct

SEQ ID NO: 869961 - DNA, 25 bp, Mus musculus
agaccacccaggctttaaagatcct

SEQ ID NO: 869962 - DNA, 25 bp, Mus musculus
agaccacctatgagcaagtccctcc

SEQ ID NO: 869963 - DNA, 25 bp, Mus musculus
agaccacctatgcaagtccctccac

SEQ ID NO: 869964 - DNA, 25 bp, Mus musculus
agaccacctatggaagtccctccac

SEQ ID NO: 869965 - DNA, 25 bp, Mus musculus
agaccacctatgtgcaagtccctcc

SEQ ID NO: 869966 - DNA, 25 bp, Mus musculus
agaccacgactgcgtacaagaaaac

SEQ ID NO: 869967 - DNA, 25 bp, Mus musculus
agaccacgactgggtacaagaaaac

SEQ ID NO: 869968 - DNA, 25 bp, Mus musculus
agaccacgcagacgaaagatggtcc

SEQ ID NO: 869969 - DNA, 25 bp, Mus musculus
agaccacgcagacggaaggtgtgaa

SEQ ID NO: 869970 - DNA, 25 bp, Mus musculus
agaccacgcagaggaaagatggtcc

SEQ ID NO: 869971 - DNA, 25 bp, Mus musculus
agaccacgcagagggaaggtgtgaa

SEQ ID NO: 869972 - DNA, 25 bp, Mus musculus
agaccactggttgacatcctcttta

SEQ ID NO: 869973 - DNA, 25 bp, Mus musculus
agaccactggttgacggcaatggca

SEQ ID NO: 869974 - DNA, 25 bp, Mus musculus
agaccactggttgagatcctcttta

SEQ ID NO: 869975 - DNA, 25 bp, Mus musculus
agaccactggttgagggcaatggca

SEQ ID NO: 869976 - DNA, 25 bp, Mus musculus
agaccagaagattcgtaagacagaa

SEQ ID NO: 869977 - DNA, 25 bp, Mus musculus
agaccagaagctctgctgagaggtc

SEQ ID NO: 869978 - DNA, 25 bp, Mus musculus
agaccagaaggtctgctgagaggtc

SEQ ID NO: 869979 - DNA, 25 bp, Mus musculus
agaccagaagtttcgtaagacagaa

SEQ ID NO: 869980 - DNA, 25 bp, Mus musculus
agaccagactgacgctgtgtttcaa

SEQ ID NO: 869981 - DNA, 25 bp, Mus musculus
agaccagactgaggctgtgtttcaa

SEQ ID NO: 869982 - DNA, 25 bp, Mus musculus
agaccagcagaacgagatggtgcgg

SEQ ID NO: 869983 - DNA, 25 bp, Mus musculus
agaccagcagacagtaaaacagact

SEQ ID NO: 869984 - DNA, 25 bp, Mus musculus
agaccagcagacattctcctgtcta

SEQ ID NO: 869985 - DNA, 25 bp, Mus musculus
agaccagcagactgtaaaacagact

SEQ ID NO: 869986 - DNA, 25 bp, Mus musculus
agaccagcagactttctcctgtcta

SEQ ID NO: 869987 - DNA, 25 bp, Mus musculus
agaccagcagtacgagatggtgcgg

SEQ ID NO: 869988 - DNA, 25 bp, Mus musculus
agaccagcagtgccatcttctgctg

SEQ ID NO: 869989 - DNA, 25 bp, Mus musculus
agaccagcagtggcatcttctgctg

SEQ ID NO: 869990 - DNA, 25 bp, Mus musculus
agaccagcctgacacatttctatca

SEQ ID NO: 869991 - DNA, 25 bp, Mus musculus
agaccagcctgacagatttctatca

SEQ ID NO: 869992 - DNA, 25 bp, Mus musculus
agaccaggcaccgagtactaacagt

SEQ ID NO: 869993 - DNA, 25 bp, Mus musculus
agaccaggcagcgagtactaacagt

SEQ ID NO: 869994 - DNA, 25 bp, Mus musculus
agaccagtgacccacagggttctcc

SEQ ID NO: 869995 - DNA, 25 bp, Mus musculus
agaccagtgagccacagggttctcc

SEQ ID NO: 869996 - DNA, 25 bp, Mus musculus
agaccataggacaaggatgagagcg

SEQ ID NO: 869997 - DNA, 25 bp, Mus musculus
agaccataggtcaaggatgagagcg

SEQ ID NO: 869998 - DNA, 25 bp, Mus musculus
agaccatcagacccctgttctcagg

SEQ ID NO: 869999 - DNA, 25 bp, Mus musculus
agaccatcagattatgggacagtcg

SEQ ID NO: 870000 - DNA, 25 bp, Mus musculus
agaccatcagtcccctgttctcagg

SEQ ID NO: 870001 - DNA, 25 bp, Mus musculus
agaccatcagtgatcccgatgttgc

SEQ ID NO: 870002 - DNA, 25 bp, Mus musculus
agaccatcagtgttcccgatgttgc

SEQ ID NO: 870003 - DNA, 25 bp, Mus musculus
agaccatcagtttatgggacagtcg

SEQ ID NO: 870004 - DNA, 25 bp, Mus musculus
agaccatccccgagcttctcaagtg

SEQ ID NO: 870005 - DNA, 25 bp, Mus musculus
agaccatccccgtgcttctcaagtg

SEQ ID NO: 870006 - DNA, 25 bp, Mus musculus
agaccatctgcacgtacaacttgcc

SEQ ID NO: 870007 - DNA, 25 bp, Mus musculus
agaccatctgcaggtacaacttgcc

SEQ ID NO: 870008 - DNA, 25 bp, Mus musculus
agaccatgagattgcgagcccagcg

SEQ ID NO: 870009 - DNA, 25 bp, Mus musculus
agaccatgagattgggagcccagcg

SEQ ID NO: 870010 - DNA, 25 bp, Mus musculus
agaccatgggcccgaggaggacaag

SEQ ID NO: 870011 - DNA, 25 bp, Mus musculus
agaccatggggccgaggaggacaag

SEQ ID NO: 870012 - DNA, 25 bp, Mus musculus
agacccacaccacgactactgtgaa

SEQ ID NO: 870013 - DNA, 25 bp, Mus musculus
agacccacaccaggactactgtgaa

SEQ ID NO: 870014 - DNA, 25 bp, Mus musculus
agacccacagacttccaaattgaga

SEQ ID NO: 870015 - DNA, 25 bp, Mus musculus
agacccacagaggctcccaaacacc

SEQ ID NO: 870016 - DNA, 25 bp, Mus musculus
agacccacagtcttccaaattgaga

SEQ ID NO: 870017 - DNA, 25 bp, Mus musculus
agacccacagtggctcccaaacacc

SEQ ID NO: 870018 - DNA, 25 bp, Mus musculus
agacccagcccacaacaagcctgcc

SEQ ID NO: 870019 - DNA, 25 bp, Mus musculus
agacccagcccacgttccgagtccg

SEQ ID NO: 870020 - DNA, 25 bp, Mus musculus
agacccagcccagaacaagcctgcc

SEQ ID NO: 870021 - DNA, 25 bp, Mus musculus
agacccagcccaggttccgagtccg

SEQ ID NO: 870022 - DNA, 25 bp, Mus musculus
agacccattgagccccaattcctgc

SEQ ID NO: 870023 - DNA, 25 bp, Mus musculus
agacccattgtgccccaattcctgc

SEQ ID NO: 870024 - DNA, 25 bp, Mus musculus
agaccccaagagaagggagtggatc

SEQ ID NO: 870025 - DNA, 25 bp, Mus musculus
agaccccaagagagacaacaatcct

SEQ ID NO: 870026 - DNA, 25 bp, Mus musculus
agaccccaagagtagggagtggatc

SEQ ID NO: 870027 - DNA, 25 bp, Mus musculus
agaccccaagagtgacaacaatcct

SEQ ID NO: 870028 - DNA, 25 bp, Mus musculus
agaccccaagcgagagatggctgcc

SEQ ID NO: 870029 - DNA, 25 bp, Mus musculus
agaccccaagggagagatggctgcc

SEQ ID NO: 870030 - DNA, 25 bp, Mus musculus
agaccccattgtcaagactcttgca

SEQ ID NO: 870031 - DNA, 25 bp, Mus musculus
agaccccattgtcatgactcttgca

SEQ ID NO: 870032 - DNA, 25 bp, Mus musculus
agacccccagccaggaagttatgag

SEQ ID NO: 870033 - DNA, 25 bp, Mus musculus
agacccccaggcaggaagttatgag

SEQ ID NO: 870034 - DNA, 25 bp, Mus musculus
agacccggcaagaaagtccatggca

SEQ ID NO: 870035 - DNA, 25 bp, Mus musculus
agacccggcaagaccttcaagagtc

SEQ ID NO: 870036 - DNA, 25 bp, Mus musculus
agacccggcaagcagaccttcaaga

SEQ ID NO: 870037 - DNA, 25 bp, Mus musculus
agacccggcaaggagaccttcaaga

SEQ ID NO: 870038 - DNA, 25 bp, Mus musculus
agacccggcaagtaagtccatggca

SEQ ID NO: 870039 - DNA, 25 bp, Mus musculus
agacccggcaagtccttcaagagtc

SEQ ID NO: 870040 - DNA, 25 bp, Mus musculus
agaccctaacagatgttgctgtggt

SEQ ID NO: 870041 - DNA, 25 bp, Mus musculus
agaccctaacagttgttgctgtggt

SEQ ID NO: 870042 - DNA, 25 bp, Mus musculus
agaccctcacagatgtcttccagga

SEQ ID NO: 870043 - DNA, 25 bp, Mus musculus
agaccctcacagttgtcttccagga

SEQ ID NO: 870044 - DNA, 25 bp, Mus musculus
agaccctgagctctatgaccccttc

SEQ ID NO: 870045 - DNA, 25 bp, Mus musculus
agaccctgaggtctatgaccccttc

SEQ ID NO: 870046 - DNA, 25 bp, Mus musculus
agaccctgcaggcagagagaatcaa

SEQ ID NO: 870047 - DNA, 25 bp, Mus musculus
agaccctgcaggcgagagaatcaat

SEQ ID NO: 870048 - DNA, 25 bp, Mus musculus
agaccctgcagggagagagaatcaa

SEQ ID NO: 870049 - DNA, 25 bp, Mus musculus
agaccctgcaggggagagaatcaat

SEQ ID NO: 870050 - DNA, 25 bp, Mus musculus
agacccttgaacagaggaacgggca

SEQ ID NO: 870051 - DNA, 25 bp, Mus musculus
agacccttgaactgaggaacgggca

SEQ ID NO: 870052 - DNA, 25 bp, Mus musculus
agaccctttcataaccccaattata

SEQ ID NO: 870053 - DNA, 25 bp, Mus musculus
agaccctttcataagcccaattata

SEQ ID NO: 870054 - DNA, 25 bp, Mus musculus
agaccgacacaacagcaagctgatt

SEQ ID NO: 870055 - DNA, 25 bp, Mus musculus
agaccgacacaagagcaagctgatt

SEQ ID NO: 870056 - DNA, 25 bp, Mus musculus
agaccgacacgcagcaccaccagaa

SEQ ID NO: 870057 - DNA, 25 bp, Mus musculus
agaccgacacgcaggaccaccagaa

SEQ ID NO: 870058 - DNA, 25 bp, Mus musculus
agaccgagaagcccttgaaaaggag

SEQ ID NO: 870059 - DNA, 25 bp, Mus musculus
agaccgagaagcgcttgaaaaggag

SEQ ID NO: 870060 - DNA, 25 bp, Mus musculus
agaccgagtcctcacgccaatgtgc

SEQ ID NO: 870061 - DNA, 25 bp, Mus musculus
agaccgagtcctcaggccaatgtgc

SEQ ID NO: 870062 - DNA, 25 bp, Mus musculus
agaccgcaggacccggaaccatgtg

SEQ ID NO: 870063 - DNA, 25 bp, Mus musculus
agaccgcaggacgcggaaccatgtg

SEQ ID NO: 870064 - DNA, 25 bp, Mus musculus
agaccgcggcagcatgggtccctcg

SEQ ID NO: 870065 - DNA, 25 bp, Mus musculus
agaccgcggcaggatgggtccctcg

SEQ ID NO: 870066 - DNA, 25 bp, Mus musculus
agaccgctgcagatacgaacacagc

SEQ ID NO: 870067 - DNA, 25 bp, Mus musculus
agaccgctgcagttacgaacacagc

SEQ ID NO: 870068 - DNA, 25 bp, Mus musculus
agaccgcttcggcaatgaaggctta

SEQ ID NO: 870069 - DNA, 25 bp, Mus musculus
agaccgcttcgggaatgaaggctta

SEQ ID NO: 870070 - DNA, 25 bp, Mus musculus
agaccgtgctcacgatcaaggagac

SEQ ID NO: 870071 - DNA, 25 bp, Mus musculus
agaccgtgctcaggatcaaggagac

SEQ ID NO: 870072 - DNA, 25 bp, Mus musculus
agacctacaaaccacaggccactac

SEQ ID NO: 870073 - DNA, 25 bp, Mus musculus
agacctacaaaccagaggccactac

SEQ ID NO: 870074 - DNA, 25 bp, Mus musculus
agacctcaagcctgaaaatctgtta

SEQ ID NO: 870075 - DNA, 25 bp, Mus musculus
agacctcaagccttccaaggaatgc

SEQ ID NO: 870076 - DNA, 25 bp, Mus musculus
agacctcaaggctgaaaatctgtta

SEQ ID NO: 870077 - DNA, 25 bp, Mus musculus
agacctcaaggcttccaaggaatgc

SEQ ID NO: 870078 - DNA, 25 bp, Mus musculus
agacctcaccatcctcacaggtctg

SEQ ID NO: 870079 - DNA, 25 bp, Mus musculus
agacctcacccacacactggatgcc

SEQ ID NO: 870080 - DNA, 25 bp, Mus musculus
agacctcaccgacacactggatgcc

SEQ ID NO: 870081 - DNA, 25 bp, Mus musculus
agacctcaccttcctcacaggtctg

SEQ ID NO: 870082 - DNA, 25 bp, Mus musculus
agacctcagcaaatctggtaaacag

SEQ ID NO: 870083 - DNA, 25 bp, Mus musculus
agacctcagcaaatgtggtaaacag

SEQ ID NO: 870084 - DNA, 25 bp, Mus musculus
agacctcagctggtagtgcagacaa

SEQ ID NO: 870085 - DNA, 25 bp, Mus musculus
agacctcagctggtagtgcagtcaa

SEQ ID NO: 870086 - DNA, 25 bp, Mus musculus
agacctcagctggttgtgcagacaa

SEQ ID NO: 870087 - DNA, 25 bp, Mus musculus
agacctcagctggttgtgcagtcaa

SEQ ID NO: 870088 - DNA, 25 bp, Mus musculus
agacctcatccacaccagagggcct

SEQ ID NO: 870089 - DNA, 25 bp, Mus musculus
agacctcatccaccttactggcggt

SEQ ID NO: 870090 - DNA, 25 bp, Mus musculus
agacctcatccagaccagagggcct

SEQ ID NO: 870091 - DNA, 25 bp, Mus musculus
agacctcatccagcttactggcggt

SEQ ID NO: 870092 - DNA, 25 bp, Mus musculus
agacctcatccattccagaatatgc

SEQ ID NO: 870093 - DNA, 25 bp, Mus musculus
agacctcatcgattccagaatatgc

SEQ ID NO: 870094 - DNA, 25 bp, Mus musculus
agacctcatgcgtcaaactgaagga

SEQ ID NO: 870095 - DNA, 25 bp, Mus musculus
agacctcatgggtcaaactgaagga

SEQ ID NO: 870096 - DNA, 25 bp, Mus musculus
agacctccagagaggtggattgtcc

SEQ ID NO: 870097 - DNA, 25 bp, Mus musculus
agacctccagagtggtggattgtcc

SEQ ID NO: 870098 - DNA, 25 bp, Mus musculus
agacctcccctgcaagagccagcag

SEQ ID NO: 870099 - DNA, 25 bp, Mus musculus
agacctcccctggaagagccagcag

SEQ ID NO: 870100 - DNA, 25 bp, Mus musculus
agacctcttgcacgaagggttggcg

SEQ ID NO: 870101 - DNA, 25 bp, Mus musculus
agacctcttgcaggaagggttggcg

SEQ ID NO: 870102 - DNA, 25 bp, Mus musculus
agacctgaagctgtcccccttgtct

SEQ ID NO: 870103 - DNA, 25 bp, Mus musculus
agacctgaaggtgtcccccttgtct

SEQ ID NO: 870104 - DNA, 25 bp, Mus musculus
agacctgagcaaaagtgaactcaat

SEQ ID NO: 870105 - DNA, 25 bp, Mus musculus
agacctgagcaatagtgaactcaat

SEQ ID NO: 870106 - DNA, 25 bp, Mus musculus
agacctgaggtgtcaaatagctgaa

SEQ ID NO: 870107 - DNA, 25 bp, Mus musculus
agacctgaggtgtctaatagctgaa

SEQ ID NO: 870108 - DNA, 25 bp, Mus musculus
agacctgataacacaaagcctcctg

SEQ ID NO: 870109 - DNA, 25 bp, Mus musculus
agacctgataactcaaagcctcctg

SEQ ID NO: 870110 - DNA, 25 bp, Mus musculus
agacctgatgatgaaggtatatttg

SEQ ID NO: 870111 - DNA, 25 bp, Mus musculus
agacctgatgatgatggtatatttg

SEQ ID NO: 870112 - DNA, 25 bp, Mus musculus
agacctgccagccacaaaatgacct

SEQ ID NO: 870113 - DNA, 25 bp, Mus musculus
agacctgccagccagaaaatgacct

SEQ ID NO: 870114 - DNA, 25 bp, Mus musculus
agacctggagcatccccaggacgcc

SEQ ID NO: 870115 - DNA, 25 bp, Mus musculus
agacctggaggatccccaggacgcc

SEQ ID NO: 870116 - DNA, 25 bp, Mus musculus
agacctggcatgagccccagcaaga

SEQ ID NO: 870117 - DNA, 25 bp, Mus musculus
agacctggcatggcaatgtgagtga

SEQ ID NO: 870118 - DNA, 25 bp, Mus musculus
agacctggcatggctatgtgagtga

SEQ ID NO: 870119 - DNA, 25 bp, Mus musculus
agacctggcatgtgccccagcaaga

SEQ ID NO: 870120 - DNA, 25 bp, Mus musculus
agacctggccagaatattattctcc

SEQ ID NO: 870121 - DNA, 25 bp, Mus musculus
agacctggccagtatattattctcc

SEQ ID NO: 870122 - DNA, 25 bp, Mus musculus
agacctggctccagtctgttctcct

SEQ ID NO: 870123 - DNA, 25 bp, Mus musculus
agacctggctccattccatgaggcg

SEQ ID NO: 870124 - DNA, 25 bp, Mus musculus
agacctggctcctgtctgttctcct

SEQ ID NO: 870125 - DNA, 25 bp, Mus musculus
agacctggctcctttccatgaggcg

SEQ ID NO: 870126 - DNA, 25 bp, Mus musculus
agacctggtgcgtgtgaacaaagac

SEQ ID NO: 870127 - DNA, 25 bp, Mus musculus
agacctggtgggtgtgaacaaagac

SEQ ID NO: 870128 - DNA, 25 bp, Mus musculus
agacctgtccctcacgtacatttgt

SEQ ID NO: 870129 - DNA, 25 bp, Mus musculus
agacctgtccctcaggtacatttgt

SEQ ID NO: 870130 - DNA, 25 bp, Mus musculus
agacctgttcgtgaccattagtgat

SEQ ID NO: 870131 - DNA, 25 bp, Mus musculus
agacctgttcgtgagcattagtgat

SEQ ID NO: 870132 - DNA, 25 bp, Mus musculus
agaccttatcaaaaccatgcttcat

SEQ ID NO: 870133 - DNA, 25 bp, Mus musculus
agaccttatcaaaagcatgcttcat

SEQ ID NO: 870134 - DNA, 25 bp, Mus musculus
agaccttatgaacctctttgaacag

SEQ ID NO: 870135 - DNA, 25 bp, Mus musculus
agaccttatgaagctctttgaacag

SEQ ID NO: 870136 - DNA, 25 bp, Mus musculus
agaccttcaaagctgtggaacagtt

SEQ ID NO: 870137 - DNA, 25 bp, Mus musculus
agaccttcaaaggtgtggaacagtt

SEQ ID NO: 870138 - DNA, 25 bp, Mus musculus
agaccttcagcaagctcttagctga

SEQ ID NO: 870139 - DNA, 25 bp, Mus musculus
agaccttcagcggctcagctgcacc

SEQ ID NO: 870140 - DNA, 25 bp, Mus musculus
agaccttcagctcttagctgacgac

SEQ ID NO: 870141 - DNA, 25 bp, Mus musculus
agaccttcaggaagctcttagctga

SEQ ID NO: 870142 - DNA, 25 bp, Mus musculus
agaccttcaggggctcagctgcacc

SEQ ID NO: 870143 - DNA, 25 bp, Mus musculus
agaccttcaggtcttagctgacgac

SEQ ID NO: 870144 - DNA, 25 bp, Mus musculus
agaccttctctacacgaggtgtagg

SEQ ID NO: 870145 - DNA, 25 bp, Mus musculus
agaccttctctacaggaggtgtagg

SEQ ID NO: 870146 - DNA, 25 bp, Mus musculus
agaccttgctgacgctacagaatcc

SEQ ID NO: 870147 - DNA, 25 bp, Mus musculus
agaccttgctgaggctacagaatcc

SEQ ID NO: 870148 - DNA, 25 bp, Mus musculus
agacgaaattcacgatgaagaggac

SEQ ID NO: 870149 - DNA, 25 bp, Mus musculus
agacgaaattcaggatgaagaggac

SEQ ID NO: 870150 - DNA, 25 bp, Mus musculus
agacgaagagaaacgactcagaaga

SEQ ID NO: 870151 - DNA, 25 bp, Mus musculus
agacgaagagtaacgactcagaaga

SEQ ID NO: 870152 - DNA, 25 bp, Mus musculus
agacgaattaccaattgaagtggac

SEQ ID NO: 870153 - DNA, 25 bp, Mus musculus
agacgaattacctattgaagtggac

SEQ ID NO: 870154 - DNA, 25 bp, Mus musculus
agacgaccctcaagtgccctgtgat

SEQ ID NO: 870155 - DNA, 25 bp, Mus musculus
agacgaccctcatgtgccctgtgat

SEQ ID NO: 870156 - DNA, 25 bp, Mus musculus
agacgagctgagtgccctgatcttg

SEQ ID NO: 870157 - DNA, 25 bp, Mus musculus
agacgagctgtgtgccctgatcttg

SEQ ID NO: 870158 - DNA, 25 bp, Mus musculus
agacgaggagtgcttccgatctaag

SEQ ID NO: 870159 - DNA, 25 bp, Mus musculus
agacgaggagtggttccgatctaag

SEQ ID NO: 870160 - DNA, 25 bp, Mus musculus
agacgaggcttccacctccagaaat

SEQ ID NO: 870161 - DNA, 25 bp, Mus musculus
agacgaggcttccagctccagaaat

SEQ ID NO: 870162 - DNA, 25 bp, Mus musculus
agacgatgcacacgccatagaagcc

SEQ ID NO: 870163 - DNA, 25 bp, Mus musculus
agacgatgcacaggccatagaagcc

SEQ ID NO: 870164 - DNA, 25 bp, Mus musculus
agacgatgtgaatttttgggttcag

SEQ ID NO: 870165 - DNA, 25 bp, Mus musculus
agacgatgtgtatttttgggttcag

SEQ ID NO: 870166 - DNA, 25 bp, Mus musculus
agacgcaattcactcaggatggcta

SEQ ID NO: 870167 - DNA, 25 bp, Mus musculus
agacgcaattcagtcaggatggcta

SEQ ID NO: 870168 - DNA, 25 bp, Mus musculus
agacgcacagccatatctgctgttc

SEQ ID NO: 870169 - DNA, 25 bp, Mus musculus
agacgcacaggcatatctgctgttc

SEQ ID NO: 870170 - DNA, 25 bp, Mus musculus
agacgccagcagctcctgctggtga

SEQ ID NO: 870171 - DNA, 25 bp, Mus musculus
agacgccagcaggtcctgctggtga

SEQ ID NO: 870172 - DNA, 25 bp, Mus musculus
agacgccagctacccttctctacag

SEQ ID NO: 870173 - DNA, 25 bp, Mus musculus
agacgccagctagccttctctacag

SEQ ID NO: 870174 - DNA, 25 bp, Mus musculus
agacgccatcgtagaagccctggaa

SEQ ID NO: 870175 - DNA, 25 bp, Mus musculus
agacgccatcgtagtagccctggaa

SEQ ID NO: 870176 - DNA, 25 bp, Mus musculus
agacgcccctgacgtgtgtgagcca

SEQ ID NO: 870177 - DNA, 25 bp, Mus musculus
agacgcccctgaggtgtgtgagcca

SEQ ID NO: 870178 - DNA, 25 bp, Mus musculus
agacgccggaagatcatgccagacc

SEQ ID NO: 870179 - DNA, 25 bp, Mus musculus
agacgccggaagatgatgccagacc

SEQ ID NO: 870180 - DNA, 25 bp, Mus musculus
agacgcctccaccacgtaaaaatag

SEQ ID NO: 870181 - DNA, 25 bp, Mus musculus
agacgcctccaccaggtaaaaatag

SEQ ID NO: 870182 - DNA, 25 bp, Mus musculus
agacgctcagacctcacgtggtagg

SEQ ID NO: 870183 - DNA, 25 bp, Mus musculus
agacgctcagagacgagttcaggaa

SEQ ID NO: 870184 - DNA, 25 bp, Mus musculus
agacgctcagagtcgagttcaggaa

SEQ ID NO: 870185 - DNA, 25 bp, Mus musculus
agacgctcagtcctcacgtggtagg

SEQ ID NO: 870186 - DNA, 25 bp, Mus musculus
agacgctgagccatggcagtttctt

SEQ ID NO: 870187 - DNA, 25 bp, Mus musculus
agacgctgaggcatggcagtttctt

SEQ ID NO: 870188 - DNA, 25 bp, Mus musculus
agacgctgcagccaaaaaacgggaa

SEQ ID NO: 870189 - DNA, 25 bp, Mus musculus
agacgctgcagccataaaacgggaa

SEQ ID NO: 870190 - DNA, 25 bp, Mus musculus
agacgcttattaaacgtggagcacg

SEQ ID NO: 870191 - DNA, 25 bp, Mus musculus
agacgcttattaaaggtggagcacg

SEQ ID NO: 870192 - DNA, 25 bp, Mus musculus
agacggacggaaaggcagccctgga

SEQ ID NO: 870193 - DNA, 25 bp, Mus musculus
agacggacggaatggcagccctgga

SEQ ID NO: 870194 - DNA, 25 bp, Mus musculus
agacggaggaagcccccaaagatgc

SEQ ID NO: 870195 - DNA, 25 bp, Mus musculus
agacggaggaaggccccaaagatgc

SEQ ID NO: 870196 - DNA, 25 bp, Mus musculus
agacggatctcagaaaataaccaaa

SEQ ID NO: 870197 - DNA, 25 bp, Mus musculus
agacggatctcagataataaccaaa

SEQ ID NO: 870198 - DNA, 25 bp, Mus musculus
agacggcaagcactatgtcatcaaa

SEQ ID NO: 870199 - DNA, 25 bp, Mus musculus
agacggcaagcagtatgtcatcaaa

SEQ ID NO: 870200 - DNA, 25 bp, Mus musculus
agacgggaagcctcttatccgagaa

SEQ ID NO: 870201 - DNA, 25 bp, Mus musculus
agacgggaagctgtacagagaggca

SEQ ID NO: 870202 - DNA, 25 bp, Mus musculus
agacgggaaggctcttatccgagaa

SEQ ID NO: 870203 - DNA, 25 bp, Mus musculus
agacgggaaggtgtacagagaggca

SEQ ID NO: 870204 - DNA, 25 bp, Mus musculus
agacggggagcgcagaagatgctgc

SEQ ID NO: 870205 - DNA, 25 bp, Mus musculus
agacggggagggcagaagatgctgc

SEQ ID NO: 870206 - DNA, 25 bp, Mus musculus
agacggtctgattaaacaaattgga

SEQ ID NO: 870207 - DNA, 25 bp, Mus musculus
agacggtctgattatacaaattgga

SEQ ID NO: 870208 - DNA, 25 bp, Mus musculus
agacggtgaagccacgcaaagttat

SEQ ID NO: 870209 - DNA, 25 bp, Mus musculus
agacggtgaagccaggcaaagttat

SEQ ID NO: 870210 - DNA, 25 bp, Mus musculus
agacggtgacatcgttattgatgaa

SEQ ID NO: 870211 - DNA, 25 bp, Mus musculus
agacggtgacatggttattgatgaa

SEQ ID NO: 870212 - DNA, 25 bp, Mus musculus
agacggttctagatccctttcagct

SEQ ID NO: 870213 - DNA, 25 bp, Mus musculus
agacggttctagttccctttcagct

SEQ ID NO: 870214 - DNA, 25 bp, Mus musculus
agacgtcgagctgttaatggagcct

SEQ ID NO: 870215 - DNA, 25 bp, Mus musculus
agacgtcgaggtgttaatggagcct

SEQ ID NO: 870216 - DNA, 25 bp, Mus musculus
agacgtcgatgactgcaaagaagtg

SEQ ID NO: 870217 - DNA, 25 bp, Mus musculus
agacgtcgatgagtgcaaagaagtg

SEQ ID NO: 870218 - DNA, 25 bp, Mus musculus
agacgtcgcaagctcatcaaacagg

SEQ ID NO: 870219 - DNA, 25 bp, Mus musculus
agacgtcgcaaggtcatcaaacagg

SEQ ID NO: 870220 - DNA, 25 bp, Mus musculus
agacgtcgtgtgccatgtgggcaca

SEQ ID NO: 870221 - DNA, 25 bp, Mus musculus
agacgtcgtgtggcatgtgggcaca

SEQ ID NO: 870222 - DNA, 25 bp, Mus musculus
agacgtgaagattgtgtgtgttggt

SEQ ID NO: 870223 - DNA, 25 bp, Mus musculus
agacgtgaagtttgtgtgtgttggt

SEQ ID NO: 870224 - DNA, 25 bp, Mus musculus
agacgtgcttcacactggtttacct

SEQ ID NO: 870225 - DNA, 25 bp, Mus musculus
agacgtgcttcagactggtttacct

SEQ ID NO: 870226 - DNA, 25 bp, Mus musculus
agacgtttgtccagctgtgtttcaa

SEQ ID NO: 870227 - DNA, 25 bp, Mus musculus
agacgtttgtcctgctgtgtttcaa

SEQ ID NO: 870228 - DNA, 25 bp, Mus musculus
agactaaatgcgtgaccgaggtcca

SEQ ID NO: 870229 - DNA, 25 bp, Mus musculus
agactaaatgggtgaccgaggtcca

SEQ ID NO: 870230 - DNA, 25 bp, Mus musculus
agactacaagagcgttatgatcata

SEQ ID NO: 870231 - DNA, 25 bp, Mus musculus
agactacaagagggttatgatcata

SEQ ID NO: 870232 - DNA, 25 bp, Mus musculus
agactaccaacctccacttcgaagc

SEQ ID NO: 870233 - DNA, 25 bp, Mus musculus
agactaccaactgaacacctttatg

SEQ ID NO: 870234 - DNA, 25 bp, Mus musculus
agactaccaagctccacttcgaagc

SEQ ID NO: 870235 - DNA, 25 bp, Mus musculus
agactaccaagtgaacacctttatg

SEQ ID NO: 870236 - DNA, 25 bp, Mus musculus
agactatcacagattcagctccaga

SEQ ID NO: 870237 - DNA, 25 bp, Mus musculus
agactatcacagtttcagctccaga

SEQ ID NO: 870238 - DNA, 25 bp, Mus musculus
agactatcatatatttccgagagac

SEQ ID NO: 870239 - DNA, 25 bp, Mus musculus
agactatcatcttccaagatgcctc

SEQ ID NO: 870240 - DNA, 25 bp, Mus musculus
agactatcatgttccaagatgcctc

SEQ ID NO: 870241 - DNA, 25 bp, Mus musculus
agactatcatttatttccgagagac

SEQ ID NO: 870242 - DNA, 25 bp, Mus musculus
agactatgactgcatcggccacaat

SEQ ID NO: 870243 - DNA, 25 bp, Mus musculus
agactatgactggatcggccacaat

SEQ ID NO: 870244 - DNA, 25 bp, Mus musculus
agactatgagttactcaagagctgg

SEQ ID NO: 870245 - DNA, 25 bp, Mus musculus
agactatgagtttctcaagagctgg

SEQ ID NO: 870246 - DNA, 25 bp, Mus musculus
agactatgggcacgtgttcacctac

SEQ ID NO: 870247 - DNA, 25 bp, Mus musculus
agactatgggcaggtgttcacctac

SEQ ID NO: 870248 - DNA, 25 bp, Mus musculus
agactcaacatccacgcaggcatta

SEQ ID NO: 870249 - DNA, 25 bp, Mus musculus
agactcaacatccaggcaggcatta

SEQ ID NO: 870250 - DNA, 25 bp, Mus musculus
agactcaataggagcgttaaggtca

SEQ ID NO: 870251 - DNA, 25 bp, Mus musculus
agactcaataggagggttaaggtca

SEQ ID NO: 870252 - DNA, 25 bp, Mus musculus
agactcagaaaaaatagaagaatgg

SEQ ID NO: 870253 - DNA, 25 bp, Mus musculus
agactcagaaaatatagaagaatgg

SEQ ID NO: 870254 - DNA, 25 bp, Mus musculus
agactcagacaccccttgatggtga

SEQ ID NO: 870255 - DNA, 25 bp, Mus musculus
agactcagacacgccttgatggtga

SEQ ID NO: 870256 - DNA, 25 bp, Mus musculus
agactcagcaggagatgaggaattt

SEQ ID NO: 870257 - DNA, 25 bp, Mus musculus
agactcagcaggtgatgaggaattt

SEQ ID NO: 870258 - DNA, 25 bp, Mus musculus
agactcagcccactcgatcaaacaa

SEQ ID NO: 870259 - DNA, 25 bp, Mus musculus
agactcagcccactggatcaaacaa

SEQ ID NO: 870260 - DNA, 25 bp, Mus musculus
agactcagcgtgatcgcaatgagag

SEQ ID NO: 870261 - DNA, 25 bp, Mus musculus
agactcagcgtgatggcaatgagag

SEQ ID NO: 870262 - DNA, 25 bp, Mus musculus
agactcatcatccacctggacaagt

SEQ ID NO: 870263 - DNA, 25 bp, Mus musculus
agactcatcatccagctggacaagt

SEQ ID NO: 870264 - DNA, 25 bp, Mus musculus
agactcatgcaatacaaatgatcaa

SEQ ID NO: 870265 - DNA, 25 bp, Mus musculus
agactcatgcaatacttccagttca

SEQ ID NO: 870266 - DNA, 25 bp, Mus musculus
agactcatgcaatagaaatgatcaa

SEQ ID NO: 870267 - DNA, 25 bp, Mus musculus
agactcatgcaatagttccagttca

SEQ ID NO: 870268 - DNA, 25 bp, Mus musculus
agactcattaaacgaaaaggatata

SEQ ID NO: 870269 - DNA, 25 bp, Mus musculus
agactcattaaaggaaaaggatata

SEQ ID NO: 870270 - DNA, 25 bp, Mus musculus
agactcattgttcgaaactctgctc

SEQ ID NO: 870271 - DNA, 25 bp, Mus musculus
agactcattgttggaaactctgctc

SEQ ID NO: 870272 - DNA, 25 bp, Mus musculus
agactccaagcacatgacccggaag

SEQ ID NO: 870273 - DNA, 25 bp, Mus musculus
agactccaagcagatgacccggaag

SEQ ID NO: 870274 - DNA, 25 bp, Mus musculus
agactccaccgtcacagtgtgggat

SEQ ID NO: 870275 - DNA, 25 bp, Mus musculus
agactccaccgtcagagtgtgggat

SEQ ID NO: 870276 - DNA, 25 bp, Mus musculus
agactccctaacatcacaaaatatc

SEQ ID NO: 870277 - DNA, 25 bp, Mus musculus
agactccctaacatgacaaaatatc

SEQ ID NO: 870278 - DNA, 25 bp, Mus musculus
agactccctcagcagggagctctcc

SEQ ID NO: 870279 - DNA, 25 bp, Mus musculus
agactccctcaggagggagctctcc

SEQ ID NO: 870280 - DNA, 25 bp, Mus musculus
agactccctggacgtttgcctcaaa

SEQ ID NO: 870281 - DNA, 25 bp, Mus musculus
agactccctggaggtttgcctcaaa

SEQ ID NO: 870282 - DNA, 25 bp, Mus musculus
agactccgagcgacatctctacact

SEQ ID NO: 870283 - DNA, 25 bp, Mus musculus
agactccgagggacatctctacact

SEQ ID NO: 870284 - DNA, 25 bp, Mus musculus
agactccgtgtgacacattagcttt

SEQ ID NO: 870285 - DNA, 25 bp, Mus musculus
agactccgtgtgtcacattagcttt

SEQ ID NO: 870286 - DNA, 25 bp, Mus musculus
agactcgtcaaacccaatagaatcc

SEQ ID NO: 870287 - DNA, 25 bp, Mus musculus
agactcgtcaaagccaatagaatcc

SEQ ID NO: 870288 - DNA, 25 bp, Mus musculus
agactctagacgaaccttctagcca

SEQ ID NO: 870289 - DNA, 25 bp, Mus musculus
agactctagacgtaccttctagcca

SEQ ID NO: 870290 - DNA, 25 bp, Mus musculus
agactctgagcttggattcctgtga

SEQ ID NO: 870291 - DNA, 25 bp, Mus musculus
agactctgaggttggattcctgtga

SEQ ID NO: 870292 - DNA, 25 bp, Mus musculus
agactctgccagacacagcagagat

SEQ ID NO: 870293 - DNA, 25 bp, Mus musculus
agactctgccagtcacagcagagat

SEQ ID NO: 870294 - DNA, 25 bp, Mus musculus
agactctgtaggatttgcaaatttt

SEQ ID NO: 870295 - DNA, 25 bp, Mus musculus
agactctgtaggttttgcaaatttt

SEQ ID NO: 870296 - DNA, 25 bp, Mus musculus
agactcttcacacacacttccgtgt

SEQ ID NO: 870297 - DNA, 25 bp, Mus musculus
agactcttcacacagacttccgtgt

SEQ ID NO: 870298 - DNA, 25 bp, Mus musculus
agactgaacaaacccatccttccat

SEQ ID NO: 870299 - DNA, 25 bp, Mus musculus
agactgaacaaaccgatccttccat

SEQ ID NO: 870300 - DNA, 25 bp, Mus musculus
agactgaactaacacagaaagacat

SEQ ID NO: 870301 - DNA, 25 bp, Mus musculus
agactgaactaagacagaaagacat

SEQ ID NO: 870302 - DNA, 25 bp, Mus musculus
agactgaatgcctggatggcaagca

SEQ ID NO: 870303 - DNA, 25 bp, Mus musculus
agactgaatggctggatggcaagca

SEQ ID NO: 870304 - DNA, 25 bp, Mus musculus
agactgaccttgaacgggactcaga

SEQ ID NO: 870305 - DNA, 25 bp, Mus musculus
agactgaccttgaaggggactcaga

SEQ ID NO: 870306 - DNA, 25 bp, Mus musculus
agactgaggaccagtattcactgat

SEQ ID NO: 870307 - DNA, 25 bp, Mus musculus
agactgaggagcagtattcactgat

SEQ ID NO: 870308 - DNA, 25 bp, Mus musculus
agactgatgcatctaacagacagac

SEQ ID NO: 870309 - DNA, 25 bp, Mus musculus
agactgatgcatgtaacagacagac

SEQ ID NO: 870310 - DNA, 25 bp, Mus musculus
agactgattttgagcaccgcatgcc

SEQ ID NO: 870311 - DNA, 25 bp, Mus musculus
agactgattttgtgcaccgcatgcc

SEQ ID NO: 870312 - DNA, 25 bp, Mus musculus
agactgcatgcaactacatgaatga

SEQ ID NO: 870313 - DNA, 25 bp, Mus musculus
agactgcatgcctctgagggtaagt

SEQ ID NO: 870314 - DNA, 25 bp, Mus musculus
agactgcatgcgtagcctctgaggg

SEQ ID NO: 870315 - DNA, 25 bp, Mus musculus
agactgcatggaactacatgaatga

SEQ ID NO: 870316 - DNA, 25 bp, Mus musculus
agactgcatggctctgagggtaagt

SEQ ID NO: 870317 - DNA, 25 bp, Mus musculus
agactgcatgggtagcctctgaggg

SEQ ID NO: 870318 - DNA, 25 bp, Mus musculus
agactgcgtggataccctttccctg

SEQ ID NO: 870319 - DNA, 25 bp, Mus musculus
agactgcgtggatagcctttccctg

SEQ ID NO: 870320 - DNA, 25 bp, Mus musculus
agactggaggatacctcctctgcca

SEQ ID NO: 870321 - DNA, 25 bp, Mus musculus
agactggaggatacgtcctctgcca

SEQ ID NO: 870322 - DNA, 25 bp, Mus musculus
agactggctcttcgcgacaactggc

SEQ ID NO: 870323 - DNA, 25 bp, Mus musculus
agactggctcttggcgacaactggc

SEQ ID NO: 870324 - DNA, 25 bp, Mus musculus
agactggtggagcaagaaatagtat

SEQ ID NO: 870325 - DNA, 25 bp, Mus musculus
agactggtggaggaagaaatagtat

SEQ ID NO: 870326 - DNA, 25 bp, Mus musculus
agactggttttggacgctgataagc

SEQ ID NO: 870327 - DNA, 25 bp, Mus musculus
agactggttttggaggctgataagc

SEQ ID NO: 870328 - DNA, 25 bp, Mus musculus
agactgtaagaacaatgtctgcacc

SEQ ID NO: 870329 - DNA, 25 bp, Mus musculus
agactgtaagaagaatgtctgcacc

SEQ ID NO: 870330 - DNA, 25 bp, Mus musculus
agactgtaccagagacttcaatgca

SEQ ID NO: 870331 - DNA, 25 bp, Mus musculus
agactgtaccagccccagtctgtgc

SEQ ID NO: 870332 - DNA, 25 bp, Mus musculus
agactgtaccagcgccacaccctac

SEQ ID NO: 870333 - DNA, 25 bp, Mus musculus
agactgtaccaggcccagtctgtgc

SEQ ID NO: 870334 - DNA, 25 bp, Mus musculus
agactgtaccagggccacaccctac

SEQ ID NO: 870335 - DNA, 25 bp, Mus musculus
agactgtaccagtgacttcaatgca

SEQ ID NO: 870336 - DNA, 25 bp, Mus musculus
agactgtatggcaccaatgaggaag

SEQ ID NO: 870337 - DNA, 25 bp, Mus musculus
agactgtatggcacgaatgaggaag

SEQ ID NO: 870338 - DNA, 25 bp, Mus musculus
agactgtcctcaaacagatctttgc

SEQ ID NO: 870339 - DNA, 25 bp, Mus musculus
agactgtcctcaaagagatctttgc

SEQ ID NO: 870340 - DNA, 25 bp, Mus musculus
agactgtgctagcaacggtccaggc

SEQ ID NO: 870341 - DNA, 25 bp, Mus musculus
agactgtgctaggaacggtccaggc

SEQ ID NO: 870342 - DNA, 25 bp, Mus musculus
agactgtgtgctaatgagagatcca

SEQ ID NO: 870343 - DNA, 25 bp, Mus musculus
agactgtgtggtaatgagagatcca

SEQ ID NO: 870344 - DNA, 25 bp, Mus musculus
agactgttctggaacctgatgttgt

SEQ ID NO: 870345 - DNA, 25 bp, Mus musculus
agactgttctggtacctgatgttgt

SEQ ID NO: 870346 - DNA, 25 bp, Mus musculus
agacttaaagaggcccagacgtcac

SEQ ID NO: 870347 - DNA, 25 bp, Mus musculus
agacttaaagatttcacaggtctat

SEQ ID NO: 870348 - DNA, 25 bp, Mus musculus
agacttaaagtggcccagacgtcac

SEQ ID NO: 870349 - DNA, 25 bp, Mus musculus
agacttaaagttttcacaggtctat

SEQ ID NO: 870350 - DNA, 25 bp, Mus musculus
agacttacagcacgttattgcaagt

SEQ ID NO: 870351 - DNA, 25 bp, Mus musculus
agacttacagcaggttattgcaagt

SEQ ID NO: 870352 - DNA, 25 bp, Mus musculus
agacttagggcatggtggttgttat

SEQ ID NO: 870353 - DNA, 25 bp, Mus musculus
agacttaggggatggtggttgttat

SEQ ID NO: 870354 - DNA, 25 bp, Mus musculus
agacttataatgatggaaaaagatg

SEQ ID NO: 870355 - DNA, 25 bp, Mus musculus
agacttataatgttggaaaaagatg

SEQ ID NO: 870356 - DNA, 25 bp, Mus musculus
agacttatatcacaaaagagagatg

SEQ ID NO: 870357 - DNA, 25 bp, Mus musculus
agacttatatcagaaaagagagatg

SEQ ID NO: 870358 - DNA, 25 bp, Mus musculus
agacttcaagaggacgctggtagag

SEQ ID NO: 870359 - DNA, 25 bp, Mus musculus
agacttcaagtggacgctggtagag

SEQ ID NO: 870360 - DNA, 25 bp, Mus musculus
agacttcaccacagtgtttacaaaa

SEQ ID NO: 870361 - DNA, 25 bp, Mus musculus
agacttcaccactgtgtttacaaaa

SEQ ID NO: 870362 - DNA, 25 bp, Mus musculus
agacttcagaggataccaagaagac

SEQ ID NO: 870363 - DNA, 25 bp, Mus musculus
agacttcagaggttaccaagaagac

SEQ ID NO: 870364 - DNA, 25 bp, Mus musculus
agacttcaggaataaagtggtgaca

SEQ ID NO: 870365 - DNA, 25 bp, Mus musculus
agacttcaggtataaagtggtgaca

SEQ ID NO: 870366 - DNA, 25 bp, Mus musculus
agacttcagttccacgtggcccagc

SEQ ID NO: 870367 - DNA, 25 bp, Mus musculus
agacttcagttccaggtggcccagc

SEQ ID NO: 870368 - DNA, 25 bp, Mus musculus
agacttccagctgaatctaaacaat

SEQ ID NO: 870369 - DNA, 25 bp, Mus musculus
agacttccaggtgaatctaaacaat

SEQ ID NO: 870370 - DNA, 25 bp, Mus musculus
agacttcccacactctctgaactac

SEQ ID NO: 870371 - DNA, 25 bp, Mus musculus
agacttcccacagtctctgaactac

SEQ ID NO: 870372 - DNA, 25 bp, Mus musculus
agacttcccctccgatgcagatggg

SEQ ID NO: 870373 - DNA, 25 bp, Mus musculus
agacttcccctcggatgcagatggg

SEQ ID NO: 870374 - DNA, 25 bp, Mus musculus
agacttctccagcctagaaaatgcc

SEQ ID NO: 870375 - DNA, 25 bp, Mus musculus
agacttctccaggctagaaaatgcc

SEQ ID NO: 870376 - DNA, 25 bp, Mus musculus
agacttctcgctgaaggaggactgg

SEQ ID NO: 870377 - DNA, 25 bp, Mus musculus
agacttctcggtgaaggaggactgg

SEQ ID NO: 870378 - DNA, 25 bp, Mus musculus
agacttgaacagcattgaggatcct

SEQ ID NO: 870379 - DNA, 25 bp, Mus musculus
agacttgaacaggattgaggatcct

SEQ ID NO: 870380 - DNA, 25 bp, Mus musculus
agacttgactagacacgctgagagt

SEQ ID NO: 870381 - DNA, 25 bp, Mus musculus
agacttgactagtcacgctgagagt

SEQ ID NO: 870382 - DNA, 25 bp, Mus musculus
agacttgcattgctttgccattttc

SEQ ID NO: 870383 - DNA, 25 bp, Mus musculus
agacttgcattggtttgccattttc

SEQ ID NO: 870384 - DNA, 25 bp, Mus musculus
agacttggccagcgagccacagcta

SEQ ID NO: 870385 - DNA, 25 bp, Mus musculus
agacttggccagggagccacagcta

SEQ ID NO: 870386 - DNA, 25 bp, Mus musculus
agacttggctccaactttctgcact

SEQ ID NO: 870387 - DNA, 25 bp, Mus musculus
agacttggctccagcctgaggagcg

SEQ ID NO: 870388 - DNA, 25 bp, Mus musculus
agacttggctcctactttctgcact

SEQ ID NO: 870389 - DNA, 25 bp, Mus musculus
agacttggctcctgcctgaggagcg

SEQ ID NO: 870390 - DNA, 25 bp, Mus musculus
agactttatttgtcagtctcttctc

SEQ ID NO: 870391 - DNA, 25 bp, Mus musculus
agactttatttgtctgtctcttctc

SEQ ID NO: 870392 - DNA, 25 bp, Mus musculus
agactttcattgccacagtacgagt

SEQ ID NO: 870393 - DNA, 25 bp, Mus musculus
agactttcattggcacagtacgagt

SEQ ID NO: 870394 - DNA, 25 bp, Mus musculus
agactttgaaccccgctacgtccag

SEQ ID NO: 870395 - DNA, 25 bp, Mus musculus
agactttgaagcccgctacgtccag

SEQ ID NO: 870396 - DNA, 25 bp, Mus musculus
agactttgagcaggaagaagtgcta

SEQ ID NO: 870397 - DNA, 25 bp, Mus musculus
agactttgaggaggaagaagtgcta

SEQ ID NO: 870398 - DNA, 25 bp, Mus musculus
agactttgccagctcctttaagatt

SEQ ID NO: 870399 - DNA, 25 bp, Mus musculus
agactttgccaggtcctttaagatt

SEQ ID NO: 870400 - DNA, 25 bp, Mus musculus
agactttgtcagccatgccaaagcc

SEQ ID NO: 870401 - DNA, 25 bp, Mus musculus
agactttgtcaggcatgccaaagcc

SEQ ID NO: 870402 - DNA, 25 bp, Mus musculus
agactttgttatgtggaagttcaca

SEQ ID NO: 870403 - DNA, 25 bp, Mus musculus
agactttgttttgtggaagttcaca

SEQ ID NO: 870404 - DNA, 25 bp, Mus musculus
agactttttacataatccccagatg

SEQ ID NO: 870405 - DNA, 25 bp, Mus musculus
agactttttacatattccccagatg

SEQ ID NO: 870406 - DNA, 25 bp, Mus musculus
agagaaaacaagatgatgaaggttc

SEQ ID NO: 870407 - DNA, 25 bp, Mus musculus
agagaaaacaagttgatgaaggttc

SEQ ID NO: 870408 - DNA, 25 bp, Mus musculus
agagaaaactctccctaatgctaga

SEQ ID NO: 870409 - DNA, 25 bp, Mus musculus
agagaaaactgtccctaatgctaga

SEQ ID NO: 870410 - DNA, 25 bp, Mus musculus
agagaaaagcaactgctgtcttcct

SEQ ID NO: 870411 - DNA, 25 bp, Mus musculus
agagaaaagcaagtgctgtcttcct

SEQ ID NO: 870412 - DNA, 25 bp, Mus musculus
agagaaaatatgcctttattgaaac

SEQ ID NO: 870413 - DNA, 25 bp, Mus musculus
agagaaaatatggctttattgaaac

SEQ ID NO: 870414 - DNA, 25 bp, Mus musculus
agagaaaatgagatgccaaaaggct

SEQ ID NO: 870415 - DNA, 25 bp, Mus musculus
agagaaaatgagttgccaaaaggct

SEQ ID NO: 870416 - DNA, 25 bp, Mus musculus
agagaaacagaacacgcttagaaac

SEQ ID NO: 870417 - DNA, 25 bp, Mus musculus
agagaaacagaacaggcttagaaac

SEQ ID NO: 870418 - DNA, 25 bp, Mus musculus
agagaaaccaaacactgtgatgctt

SEQ ID NO: 870419 - DNA, 25 bp, Mus musculus
agagaaaccaaagactgtgatgctt

SEQ ID NO: 870420 - DNA, 25 bp, Mus musculus
agagaaactgaagtatcttcaggac

SEQ ID NO: 870421 - DNA, 25 bp, Mus musculus
agagaaactgaatcttcaggacata

SEQ ID NO: 870422 - DNA, 25 bp, Mus musculus
agagaaactgtagtatcttcaggac

SEQ ID NO: 870423 - DNA, 25 bp, Mus musculus
agagaaactgtatcttcaggacata

SEQ ID NO: 870424 - DNA, 25 bp, Mus musculus
agagaaagagccagaaatcctgagc

SEQ ID NO: 870425 - DNA, 25 bp, Mus musculus
agagaaagaggcagaaatcctgagc

SEQ ID NO: 870426 - DNA, 25 bp, Mus musculus
agagaaagcaccagctccccggcgc

SEQ ID NO: 870427 - DNA, 25 bp, Mus musculus
agagaaagcaccaggtccccggcgc

SEQ ID NO: 870428 - DNA, 25 bp, Mus musculus
agagaaagtgctggacatagaaatc

SEQ ID NO: 870429 - DNA, 25 bp, Mus musculus
agagaaagtggtggacatagaaatc

SEQ ID NO: 870430 - DNA, 25 bp, Mus musculus
agagaaatatctgcatgagctcatt

SEQ ID NO: 870431 - DNA, 25 bp, Mus musculus
agagaaatatgtgcatgagctcatt

SEQ ID NO: 870432 - DNA, 25 bp, Mus musculus
agagaaatggagagaagcccgggac

SEQ ID NO: 870433 - DNA, 25 bp, Mus musculus
agagaaatggagtgaagcccgggac

SEQ ID NO: 870434 - DNA, 25 bp, Mus musculus
agagaaattatagcaaaaggaactc

SEQ ID NO: 870435 - DNA, 25 bp, Mus musculus
agagaaattatagctaaaggaactc

SEQ ID NO: 870436 - DNA, 25 bp, Mus musculus
agagaacaagcagccatcacactaa

SEQ ID NO: 870437 - DNA, 25 bp, Mus musculus
agagaacaagcagcgatcacactaa

SEQ ID NO: 870438 - DNA, 25 bp, Mus musculus
agagaacatgcacgagcaactggac

SEQ ID NO: 870439 - DNA, 25 bp, Mus musculus
agagaacatgcaggagcaactggac

SEQ ID NO: 870440 - DNA, 25 bp, Mus musculus
agagaaccattcaacgcaacatcga

SEQ ID NO: 870441 - DNA, 25 bp, Mus musculus
agagaaccattcaaggcaacatcga

SEQ ID NO: 870442 - DNA, 25 bp, Mus musculus
agagaacgcacagctcgtttcagaa

SEQ ID NO: 870443 - DNA, 25 bp, Mus musculus
agagaacgcagagctcgtttcagaa

SEQ ID NO: 870444 - DNA, 25 bp, Mus musculus
agagaactccagagactcactggca

SEQ ID NO: 870445 - DNA, 25 bp, Mus musculus
agagaactccagtgactcactggca

SEQ ID NO: 870446 - DNA, 25 bp, Mus musculus
agagaactgttatcaaatgatactc

SEQ ID NO: 870447 - DNA, 25 bp, Mus musculus
agagaactgttatctaatgatactc

SEQ ID NO: 870448 - DNA, 25 bp, Mus musculus
agagaagaagaaataactctgctgt

SEQ ID NO: 870449 - DNA, 25 bp, Mus musculus
agagaagaagaaattgggcttcctg

SEQ ID NO: 870450 - DNA, 25 bp, Mus musculus
agagaagaagaattaactctgctgt

SEQ ID NO: 870451 - DNA, 25 bp, Mus musculus
agagaagaagaatttgggcttcctg

SEQ ID NO: 870452 - DNA, 25 bp, Mus musculus
agagaagacaagattgacataaaac

SEQ ID NO: 870453 - DNA, 25 bp, Mus musculus
agagaagacacacaccaccacctcc

SEQ ID NO: 870454 - DNA, 25 bp, Mus musculus
agagaagacacacagcaccacctcc

SEQ ID NO: 870455 - DNA, 25 bp, Mus musculus
agagaagacatgattgacataaaac

SEQ ID NO: 870456 - DNA, 25 bp, Mus musculus
agagaagatattcctgtgatccgaa

SEQ ID NO: 870457 - DNA, 25 bp, Mus musculus
agagaagatattgctgtgatccgaa

SEQ ID NO: 870458 - DNA, 25 bp, Mus musculus
agagaagcacctcatgttcattcag

SEQ ID NO: 870459 - DNA, 25 bp, Mus musculus
agagaagcacctgatgttcattcag

SEQ ID NO: 870460 - DNA, 25 bp, Mus musculus
agagaagcagagcaagcccatgatt

SEQ ID NO: 870461 - DNA, 25 bp, Mus musculus
agagaagcagaggaagcccatgatt

SEQ ID NO: 870462 - DNA, 25 bp, Mus musculus
agagaagcagcggtacctggatgag

SEQ ID NO: 870463 - DNA, 25 bp, Mus musculus
agagaagcaggcaacgtatacttga

SEQ ID NO: 870464 - DNA, 25 bp, Mus musculus
agagaagcaggcaaggtatacttga

SEQ ID NO: 870465 - DNA, 25 bp, Mus musculus
agagaagcaggggtacctggatgag

SEQ ID NO: 870466 - DNA, 25 bp, Mus musculus
agagaagcccaacgagggtgtgaag

SEQ ID NO: 870467 - DNA, 25 bp, Mus musculus
agagaagcccaaggagggtgtgaag

SEQ ID NO: 870468 - DNA, 25 bp, Mus musculus
agagaagcccagatcgccggtcctc

SEQ ID NO: 870469 - DNA, 25 bp, Mus musculus
agagaagcccagttcgccggtcctc

SEQ ID NO: 870470 - DNA, 25 bp, Mus musculus
agagaagcggcgcgagtacctgaca

SEQ ID NO: 870471 - DNA, 25 bp, Mus musculus
agagaagcggcgggagtacctgaca

SEQ ID NO: 870472 - DNA, 25 bp, Mus musculus
agagaagctgatgcaggaagaggcc

SEQ ID NO: 870473 - DNA, 25 bp, Mus musculus
agagaagctgttgcaggaagaggcc

SEQ ID NO: 870474 - DNA, 25 bp, Mus musculus
agagaaggaagacccagagaagttg

SEQ ID NO: 870475 - DNA, 25 bp, Mus musculus
agagaaggaagagccagagaagttg

SEQ ID NO: 870476 - DNA, 25 bp, Mus musculus
agagaaggctcactgccatggagaa

SEQ ID NO: 870477 - DNA, 25 bp, Mus musculus
agagaaggctcactgctgtatgcca

SEQ ID NO: 870478 - DNA, 25 bp, Mus musculus
agagaaggctcagtgccatggagaa

SEQ ID NO: 870479 - DNA, 25 bp, Mus musculus
agagaaggctcagtgctgtatgcca

SEQ ID NO: 870480 - DNA, 25 bp, Mus musculus
agagaagtattgaggaagccattcc

SEQ ID NO: 870481 - DNA, 25 bp, Mus musculus
agagaagtattgtggaagccattcc

SEQ ID NO: 870482 - DNA, 25 bp, Mus musculus
agagaagtcaagcgcaaggcatctg

SEQ ID NO: 870483 - DNA, 25 bp, Mus musculus
agagaagtcaagggcaaggcatctg

SEQ ID NO: 870484 - DNA, 25 bp, Mus musculus
agagaagtccagcaagatgggctcc

SEQ ID NO: 870485 - DNA, 25 bp, Mus musculus
agagaagtccaggaagatgggctcc

SEQ ID NO: 870486 - DNA, 25 bp, Mus musculus
agagaatatcagctgcaagaaaaat

SEQ ID NO: 870487 - DNA, 25 bp, Mus musculus
agagaatatcaggtgcaagaaaaat

SEQ ID NO: 870488 - DNA, 25 bp, Mus musculus
agagaatatccacgtatttgatttt

SEQ ID NO: 870489 - DNA, 25 bp, Mus musculus
agagaatatccaggtatttgatttt

SEQ ID NO: 870490 - DNA, 25 bp, Mus musculus
agagaatatgcacgtttttgaattt

SEQ ID NO: 870491 - DNA, 25 bp, Mus musculus
agagaatatgcaggtttttgaattt

SEQ ID NO: 870492 - DNA, 25 bp, Mus musculus
agagaatcgtggataccatcgacat

SEQ ID NO: 870493 - DNA, 25 bp, Mus musculus
agagaatcgtggttaccatcgacat

SEQ ID NO: 870494 - DNA, 25 bp, Mus musculus
agagaatcttataggatttaaacgg

SEQ ID NO: 870495 - DNA, 25 bp, Mus musculus
agagaatcttttaggatttaaacgg

SEQ ID NO: 870496 - DNA, 25 bp, Mus musculus
agagaatgagaaacttcataaagaa

SEQ ID NO: 870497 - DNA, 25 bp, Mus musculus
agagaatgagaatcttcataaagaa

SEQ ID NO: 870498 - DNA, 25 bp, Mus musculus
agagaatgagcgtaagatgatcatg

SEQ ID NO: 870499 - DNA, 25 bp, Mus musculus
agagaatgagggtaagatgatcatg

SEQ ID NO: 870500 - DNA, 25 bp, Mus musculus
agagaatgcgcacgctgaagcgcaa

SEQ ID NO: 870501 - DNA, 25 bp, Mus musculus
agagaatgcgcaggctgaagcgcaa

SEQ ID NO: 870502 - DNA, 25 bp, Mus musculus
agagaatgtgaacaatagtcctgtc

SEQ ID NO: 870503 - DNA, 25 bp, Mus musculus
agagaatgtgaagaatagtcctgtc

SEQ ID NO: 870504 - DNA, 25 bp, Mus musculus
agagaatttcagcaatagtggtctt

SEQ ID NO: 870505 - DNA, 25 bp, Mus musculus
agagaatttcaggaatagtggtctt

SEQ ID NO: 870506 - DNA, 25 bp, Mus musculus
agagaattttcacagattccttcag

SEQ ID NO: 870507 - DNA, 25 bp, Mus musculus
agagaattttcagagattccttcag

SEQ ID NO: 870508 - DNA, 25 bp, Mus musculus
agagacaaagcggaccgtgctgatt

SEQ ID NO: 870509 - DNA, 25 bp, Mus musculus
agagacaaaggggaccgtgctgatt

SEQ ID NO: 870510 - DNA, 25 bp, Mus musculus
agagacaacaatcgactatagagtt

SEQ ID NO: 870511 - DNA, 25 bp, Mus musculus
agagacaacaatggactatagagtt

SEQ ID NO: 870512 - DNA, 25 bp, Mus musculus
agagacaacagacataacactgcag

SEQ ID NO: 870513 - DNA, 25 bp, Mus musculus
agagacaacagagataacactgcag

SEQ ID NO: 870514 - DNA, 25 bp, Mus musculus
agagacaacttaacattgtggacat

SEQ ID NO: 870515 - DNA, 25 bp, Mus musculus
agagacaacttaactttgtggacat

SEQ ID NO: 870516 - DNA, 25 bp, Mus musculus
agagacacaccagacataccatgat

SEQ ID NO: 870517 - DNA, 25 bp, Mus musculus
agagacacaccagaccagataccat

SEQ ID NO: 870518 - DNA, 25 bp, Mus musculus
agagacacaccagagataccatgat

SEQ ID NO: 870519 - DNA, 25 bp, Mus musculus
agagacacaccagagcagataccat

SEQ ID NO: 870520 - DNA, 25 bp, Mus musculus
agagacacagcaacctgaggagaag

SEQ ID NO: 870521 - DNA, 25 bp, Mus musculus
agagacacaggaacctgaggagaag

SEQ ID NO: 870522 - DNA, 25 bp, Mus musculus
agagacaggcctccaacggttccag

SEQ ID NO: 870523 - DNA, 25 bp, Mus musculus
agagacaggcctgcaacggttccag

SEQ ID NO: 870524 - DNA, 25 bp, Mus musculus
agagacataaagaagacccggatgg

SEQ ID NO: 870525 - DNA, 25 bp, Mus musculus
agagacataaagacccggatggcac

SEQ ID NO: 870526 - DNA, 25 bp, Mus musculus
agagacataaagtagacccggatgg

SEQ ID NO: 870527 - DNA, 25 bp, Mus musculus
agagacataaagtcccggatggcac

SEQ ID NO: 870528 - DNA, 25 bp, Mus musculus
agagacataccccacgacacccagc

SEQ ID NO: 870529 - DNA, 25 bp, Mus musculus
agagacataccccaggacacccagc

SEQ ID NO: 870530 - DNA, 25 bp, Mus musculus
agagacatcaaaccctcaaacttcg

SEQ ID NO: 870531 - DNA, 25 bp, Mus musculus
agagacatcaaaccgtcaaacttcg

SEQ ID NO: 870532 - DNA, 25 bp, Mus musculus
agagacatgcagcagatgctgcagg

SEQ ID NO: 870533 - DNA, 25 bp, Mus musculus
agagacatgcaggagatgctgcagg

SEQ ID NO: 870534 - DNA, 25 bp, Mus musculus
agagacattctgcacgattatacac

SEQ ID NO: 870535 - DNA, 25 bp, Mus musculus
agagacattctgcaggattatacac

SEQ ID NO: 870536 - DNA, 25 bp, Mus musculus
agagaccagaagattcgtaagacag

SEQ ID NO: 870537 - DNA, 25 bp, Mus musculus
agagaccagaagtttcgtaagacag

SEQ ID NO: 870538 - DNA, 25 bp, Mus musculus
agagacccaactgcataagtaaagg

SEQ ID NO: 870539 - DNA, 25 bp, Mus musculus
agagacccaagtgcataagtaaagg

SEQ ID NO: 870540 - DNA, 25 bp, Mus musculus
agagacccagaaagacctggggagc

SEQ ID NO: 870541 - DNA, 25 bp, Mus musculus
agagacccagtaagacctggggagc

SEQ ID NO: 870542 - DNA, 25 bp, Mus musculus
agagaccgagcgagggagccatcac

SEQ ID NO: 870543 - DNA, 25 bp, Mus musculus
agagaccgagggagggagccatcac

SEQ ID NO: 870544 - DNA, 25 bp, Mus musculus
agagaccgcaatctcactggtctgg

SEQ ID NO: 870545 - DNA, 25 bp, Mus musculus
agagaccgcaatgtgtatgtcgaca

SEQ ID NO: 870546 - DNA, 25 bp, Mus musculus
agagaccgcattctcactggtctgg

SEQ ID NO: 870547 - DNA, 25 bp, Mus musculus
agagaccgcattgtgtatgtcgaca

SEQ ID NO: 870548 - DNA, 25 bp, Mus musculus
agagacctcaagcctgaaaatctgt

SEQ ID NO: 870549 - DNA, 25 bp, Mus musculus
agagacctcaaggctgaaaatctgt

SEQ ID NO: 870550 - DNA, 25 bp, Mus musculus
agagacgagctgagtgccctgatct

SEQ ID NO: 870551 - DNA, 25 bp, Mus musculus
agagacgagctgtgtgccctgatct

SEQ ID NO: 870552 - DNA, 25 bp, Mus musculus
agagactcagcattgaaaagatgaa

SEQ ID NO: 870553 - DNA, 25 bp, Mus musculus
agagactcaggattgaaaagatgaa

SEQ ID NO: 870554 - DNA, 25 bp, Mus musculus
agagactcattgttcgaaactctgc

SEQ ID NO: 870555 - DNA, 25 bp, Mus musculus
agagactcattgttggaaactctgc

SEQ ID NO: 870556 - DNA, 25 bp, Mus musculus
agagactccaagcacatgacccgga

SEQ ID NO: 870557 - DNA, 25 bp, Mus musculus
agagactccaagcagatgacccgga

SEQ ID NO: 870558 - DNA, 25 bp, Mus musculus
agagactccagaccatggtttttgg

SEQ ID NO: 870559 - DNA, 25 bp, Mus musculus
agagactccagacggtttttggaat

SEQ ID NO: 870560 - DNA, 25 bp, Mus musculus
agagactccagagcatggtttttgg

SEQ ID NO: 870561 - DNA, 25 bp, Mus musculus
agagactccagagggtttttggaat

SEQ ID NO: 870562 - DNA, 25 bp, Mus musculus
agagactgattttgagcaccgcatg

SEQ ID NO: 870563 - DNA, 25 bp, Mus musculus
agagactgattttgtgcaccgcatg

SEQ ID NO: 870564 - DNA, 25 bp, Mus musculus
agagactgtgctagcaacggtccag

SEQ ID NO: 870565 - DNA, 25 bp, Mus musculus
agagactgtgctaggaacggtccag

SEQ ID NO: 870566 - DNA, 25 bp, Mus musculus
agagacttataatgatggaaaaaga

SEQ ID NO: 870567 - DNA, 25 bp, Mus musculus
agagacttataatgttggaaaaaga

SEQ ID NO: 870568 - DNA, 25 bp, Mus musculus
agagacttatatcacaaaagagaga

SEQ ID NO: 870569 - DNA, 25 bp, Mus musculus
agagacttatatcagaaaagagaga

SEQ ID NO: 870570 - DNA, 25 bp, Mus musculus
agagacttcccctccgatgcagatg

SEQ ID NO: 870571 - DNA, 25 bp, Mus musculus
agagacttcccctcggatgcagatg

SEQ ID NO: 870572 - DNA, 25 bp, Mus musculus
agagacttgccacggaaaatcatag

SEQ ID NO: 870573 - DNA, 25 bp, Mus musculus
agagacttgccagggaaaatcatag

SEQ ID NO: 870574 - DNA, 25 bp, Mus musculus
agagactttgtgcctgagttcctgt

SEQ ID NO: 870575 - DNA, 25 bp, Mus musculus
agagactttgtgcgcctgctgtccc

SEQ ID NO: 870576 - DNA, 25 bp, Mus musculus
agagactttgtggctgagttcctgt

SEQ ID NO: 870577 - DNA, 25 bp, Mus musculus
agagactttgtgggcctgctgtccc

SEQ ID NO: 870578 - DNA, 25 bp, Mus musculus
agagagaaagattcagtttaaggag

SEQ ID NO: 870579 - DNA, 25 bp, Mus musculus
agagagaaagtttcagtttaaggag

SEQ ID NO: 870580 - DNA, 25 bp, Mus musculus
agagagaatatccacgtatttgatt

SEQ ID NO: 870581 - DNA, 25 bp, Mus musculus
agagagaatatccaggtatttgatt

SEQ ID NO: 870582 - DNA, 25 bp, Mus musculus
agagagacagcacccttcccagtcc

SEQ ID NO: 870583 - DNA, 25 bp, Mus musculus
agagagacagcacggtccaccaaca

SEQ ID NO: 870584 - DNA, 25 bp, Mus musculus
agagagacagcagccttcccagtcc

SEQ ID NO: 870585 - DNA, 25 bp, Mus musculus
agagagacagcagggtccaccaaca

SEQ ID NO: 870586 - DNA, 25 bp, Mus musculus
agagagacagcccatccatttaaag

SEQ ID NO: 870587 - DNA, 25 bp, Mus musculus
agagagacaggccatccatttaaag

SEQ ID NO: 870588 - DNA, 25 bp, Mus musculus
agagagacttgccacggaaaatcat

SEQ ID NO: 870589 - DNA, 25 bp, Mus musculus
agagagacttgccagggaaaatcat

SEQ ID NO: 870590 - DNA, 25 bp, Mus musculus
agagagactttgtgcctgagttcct

SEQ ID NO: 870591 - DNA, 25 bp, Mus musculus
agagagactttgtgcgcctgctgtc

SEQ ID NO: 870592 - DNA, 25 bp, Mus musculus
agagagactttgtggctgagttcct

SEQ ID NO: 870593 - DNA, 25 bp, Mus musculus
agagagactttgtgggcctgctgtc

SEQ ID NO: 870594 - DNA, 25 bp, Mus musculus
agagagagagaacaggcagttttgg

SEQ ID NO: 870595 - DNA, 25 bp, Mus musculus
agagagagagagaacaggcagtttt

SEQ ID NO: 870596 - DNA, 25 bp, Mus musculus
agagagagagagtacaggcagtttt

SEQ ID NO: 870597 - DNA, 25 bp, Mus musculus
agagagagagtacaggcagttttgg

SEQ ID NO: 870598 - DNA, 25 bp, Mus musculus
agagagagggcaccatggcagccgt

SEQ ID NO: 870599 - DNA, 25 bp, Mus musculus
agagagaggggaccatggcagccgt

SEQ ID NO: 870600 - DNA, 25 bp, Mus musculus
agagagagggtggacgtaacaactt

SEQ ID NO: 870601 - DNA, 25 bp, Mus musculus
agagagagggtggaggtaacaactt

SEQ ID NO: 870602 - DNA, 25 bp, Mus musculus
agagagatgcagaatgacttctcct

SEQ ID NO: 870603 - DNA, 25 bp, Mus musculus
agagagatgcagctaacccctctaa

SEQ ID NO: 870604 - DNA, 25 bp, Mus musculus
agagagatgcaggtaacccctctaa

SEQ ID NO: 870605 - DNA, 25 bp, Mus musculus
agagagatgcagtatgacttctcct

SEQ ID NO: 870606 - DNA, 25 bp, Mus musculus
agagagatggcagtcgagcaaataa

SEQ ID NO: 870607 - DNA, 25 bp, Mus musculus
agagagatggcagtggagcaaataa

SEQ ID NO: 870608 - DNA, 25 bp, Mus musculus
agagagcaagatcattacagcatca

SEQ ID NO: 870609 - DNA, 25 bp, Mus musculus
agagagcaagctcatcattctggcc

SEQ ID NO: 870610 - DNA, 25 bp, Mus musculus
agagagcaaggtcatcattctggcc

SEQ ID NO: 870611 - DNA, 25 bp, Mus musculus
agagagcaagttcattacagcatca

SEQ ID NO: 870612 - DNA, 25 bp, Mus musculus
agagagcagttacccgtgaatcaag

SEQ ID NO: 870613 - DNA, 25 bp, Mus musculus
agagagcagttagccgtgaatcaag

SEQ ID NO: 870614 - DNA, 25 bp, Mus musculus
agagagcatgcgttcgcatctctgg

SEQ ID NO: 870615 - DNA, 25 bp, Mus musculus
agagagcatgcgttggcatctctgg

SEQ ID NO: 870616 - DNA, 25 bp, Mus musculus
agagagccatcattgacatgtacac

SEQ ID NO: 870617 - DNA, 25 bp, Mus musculus
agagagccatgattgacatgtacac

SEQ ID NO: 870618 - DNA, 25 bp, Mus musculus
agagagcgcacactttccagagtat

SEQ ID NO: 870619 - DNA, 25 bp, Mus musculus
agagagcgcacagtttccagagtat

SEQ ID NO: 870620 - DNA, 25 bp, Mus musculus
agagagctagaactgcagcatcctg

SEQ ID NO: 870621 - DNA, 25 bp, Mus musculus
agagagctagaagtgcagcatcctg

SEQ ID NO: 870622 - DNA, 25 bp, Mus musculus
agagagctgacactcaccaaatctt

SEQ ID NO: 870623 - DNA, 25 bp, Mus musculus
agagagctgacactgaccaaatctt

SEQ ID NO: 870624 - DNA, 25 bp, Mus musculus
agagagctgcaaccaggggtagagc

SEQ ID NO: 870625 - DNA, 25 bp, Mus musculus
agagagctgcaagcaggggtagagc

SEQ ID NO: 870626 - DNA, 25 bp, Mus musculus
agagagctgtcattgaggcggaaat

SEQ ID NO: 870627 - DNA, 25 bp, Mus musculus
agagagctgtgattgaggcggaaat

SEQ ID NO: 870628 - DNA, 25 bp, Mus musculus
agagaggaaaagccatttatatgtg

SEQ ID NO: 870629 - DNA, 25 bp, Mus musculus
agagaggaaaaggcatttatatgtg

SEQ ID NO: 870630 - DNA, 25 bp, Mus musculus
agagaggacaaccatgtcattgaag

SEQ ID NO: 870631 - DNA, 25 bp, Mus musculus
agagaggacaacgatgtcattgaag

SEQ ID NO: 870632 - DNA, 25 bp, Mus musculus
agagaggatgagacagaaaacaaca

SEQ ID NO: 870633 - DNA, 25 bp, Mus musculus
agagaggatgtgacagaaaacaaca

SEQ ID NO: 870634 - DNA, 25 bp, Mus musculus
agagaggcccagctctgctctggct

SEQ ID NO: 870635 - DNA, 25 bp, Mus musculus
agagaggcccaggtctgctctggct

SEQ ID NO: 870636 - DNA, 25 bp, Mus musculus
agagaggcccgacccagccaagggc

SEQ ID NO: 870637 - DNA, 25 bp, Mus musculus
agagaggcccgaccgagccaagggc

SEQ ID NO: 870638 - DNA, 25 bp, Mus musculus
agagaggcgagaaacatgagacgga

SEQ ID NO: 870639 - DNA, 25 bp, Mus musculus
agagaggcgagaaagatgagacgga

SEQ ID NO: 870640 - DNA, 25 bp, Mus musculus
agagagggtggacgtaacaacttat

SEQ ID NO: 870641 - DNA, 25 bp, Mus musculus
agagagggtggaggtaacaacttat

SEQ ID NO: 870642 - DNA, 25 bp, Mus musculus
agagaggtcacataccgccgaggcc

SEQ ID NO: 870643 - DNA, 25 bp, Mus musculus
agagaggtcacatagcgccgaggcc

SEQ ID NO: 870644 - DNA, 25 bp, Mus musculus
agagaggtggaacaccatgtctgct

SEQ ID NO: 870645 - DNA, 25 bp, Mus musculus
agagaggtggaagaccatgtctgct

SEQ ID NO: 870646 - DNA, 25 bp, Mus musculus
agagaggttcagatctctgctccct

SEQ ID NO: 870647 - DNA, 25 bp, Mus musculus
agagaggttcagttctctgctccct

SEQ ID NO: 870648 - DNA, 25 bp, Mus musculus
agagagtcctcacaatggcaatgtt

SEQ ID NO: 870649 - DNA, 25 bp, Mus musculus
agagagtcctcacgcacctccaagt

SEQ ID NO: 870650 - DNA, 25 bp, Mus musculus
agagagtcctcagaatggcaatgtt

SEQ ID NO: 870651 - DNA, 25 bp, Mus musculus
agagagtcctcaggcacctccaagt

SEQ ID NO: 870652 - DNA, 25 bp, Mus musculus
agagagtgaactcacagtgaccaca

SEQ ID NO: 870653 - DNA, 25 bp, Mus musculus
agagagtgaactcagagtgaccaca

SEQ ID NO: 870654 - DNA, 25 bp, Mus musculus
agagagttcaagcggctgagattta

SEQ ID NO: 870655 - DNA, 25 bp, Mus musculus
agagagttcaaggggctgagattta

SEQ ID NO: 870656 - DNA, 25 bp, Mus musculus
agagataagagcgtactctggtgca

SEQ ID NO: 870657 - DNA, 25 bp, Mus musculus
agagataagagcgttctctggtgca

SEQ ID NO: 870658 - DNA, 25 bp, Mus musculus
agagatacccatcgaagtatttaaa

SEQ ID NO: 870659 - DNA, 25 bp, Mus musculus
agagatacccatggaagtatttaaa

SEQ ID NO: 870660 - DNA, 25 bp, Mus musculus
agagatatatttctgcaacaggaca

SEQ ID NO: 870661 - DNA, 25 bp, Mus musculus
agagatatatttgtgcaacaggaca

SEQ ID NO: 870662 - DNA, 25 bp, Mus musculus
agagatattacacattgctatgcag

SEQ ID NO: 870663 - DNA, 25 bp, Mus musculus
agagatattacagattgctatgcag

SEQ ID NO: 870664 - DNA, 25 bp, Mus musculus
agagatattgccaaacttaaagggc

SEQ ID NO: 870665 - DNA, 25 bp, Mus musculus
agagatattgcctaacttaaagggc

SEQ ID NO: 870666 - DNA, 25 bp, Mus musculus
agagatcacagtccatttccgctat

SEQ ID NO: 870667 - DNA, 25 bp, Mus musculus
agagatcacagtgcatttccgctat

SEQ ID NO: 870668 - DNA, 25 bp, Mus musculus
agagatcatttcactttgtaaacga

SEQ ID NO: 870669 - DNA, 25 bp, Mus musculus
agagatcatttctctttgtaaacga

SEQ ID NO: 870670 - DNA, 25 bp, Mus musculus
agagatccacctagtccctattctt

SEQ ID NO: 870671 - DNA, 25 bp, Mus musculus
agagatccaccttgtccctattctt

SEQ ID NO: 870672 - DNA, 25 bp, Mus musculus
agagatcccaggatatcaatgagtg

SEQ ID NO: 870673 - DNA, 25 bp, Mus musculus
agagatcccaggttatcaatgagtg

SEQ ID NO: 870674 - DNA, 25 bp, Mus musculus
agagatccgagtcaccccaatcgtc

SEQ ID NO: 870675 - DNA, 25 bp, Mus musculus
agagatccgagtcagcccaatcgtc

SEQ ID NO: 870676 - DNA, 25 bp, Mus musculus
agagatcctcaacttcaaagagcgt

SEQ ID NO: 870677 - DNA, 25 bp, Mus musculus
agagatcctcaagttcaaagagcgt

SEQ ID NO: 870678 - DNA, 25 bp, Mus musculus
agagatctaaagccagaaaacctgc

SEQ ID NO: 870679 - DNA, 25 bp, Mus musculus
agagatctaaaggcagaaaacctgc

SEQ ID NO: 870680 - DNA, 25 bp, Mus musculus
agagatctacagcggtggatgcgta

SEQ ID NO: 870681 - DNA, 25 bp, Mus musculus
agagatctacaggggtggatgcgta

SEQ ID NO: 870682 - DNA, 25 bp, Mus musculus
agagatctcgctgtgccaccaggtc

SEQ ID NO: 870683 - DNA, 25 bp, Mus musculus
agagatctcggtgtgccaccaggtc

SEQ ID NO: 870684 - DNA, 25 bp, Mus musculus
agagatgaaggaagatgaggaattt

SEQ ID NO: 870685 - DNA, 25 bp, Mus musculus
agagatgaaggatgatgaggaattt

SEQ ID NO: 870686 - DNA, 25 bp, Mus musculus
agagatgaagggccagcagaaaaca

SEQ ID NO: 870687 - DNA, 25 bp, Mus musculus
agagatgaaggggcagcagaaaaca

SEQ ID NO: 870688 - DNA, 25 bp, Mus musculus
agagatgagcaacttctatagtcca

SEQ ID NO: 870689 - DNA, 25 bp, Mus musculus
agagatgagcaagttctatagtcca

SEQ ID NO: 870690 - DNA, 25 bp, Mus musculus
agagatgataagcagagaccccctt

SEQ ID NO: 870691 - DNA, 25 bp, Mus musculus
agagatgataagctccagagttcaa

SEQ ID NO: 870692 - DNA, 25 bp, Mus musculus
agagatgataaggagagaccccctt

SEQ ID NO: 870693 - DNA, 25 bp, Mus musculus
agagatgataaggtccagagttcaa

SEQ ID NO: 870694 - DNA, 25 bp, Mus musculus
agagatgatcaacgtcacaaagaca

SEQ ID NO: 870695 - DNA, 25 bp, Mus musculus
agagatgatcaaggtcacaaagaca

SEQ ID NO: 870696 - DNA, 25 bp, Mus musculus
agagatgcagaatgacttctccttg

SEQ ID NO: 870697 - DNA, 25 bp, Mus musculus
agagatgcagctaacccctctaaat

SEQ ID NO: 870698 - DNA, 25 bp, Mus musculus
agagatgcaggtaacccctctaaat

SEQ ID NO: 870699 - DNA, 25 bp, Mus musculus
agagatgcagtatgacttctccttg

SEQ ID NO: 870700 - DNA, 25 bp, Mus musculus
agagatgccaaggtccctcatgtgc

SEQ ID NO: 870701 - DNA, 25 bp, Mus musculus
agagatgccaaggtgcctcatgtgc

SEQ ID NO: 870702 - DNA, 25 bp, Mus musculus
agagatgctgaactttgccgtggtc

SEQ ID NO: 870703 - DNA, 25 bp, Mus musculus
agagatgctgaagtttgccgtggtc

SEQ ID NO: 870704 - DNA, 25 bp, Mus musculus
agagatggaaaacgaccataagcgg

SEQ ID NO: 870705 - DNA, 25 bp, Mus musculus
agagatggaatacgaccataagcgg

SEQ ID NO: 870706 - DNA, 25 bp, Mus musculus
agagatggagagcctggaatgacac

SEQ ID NO: 870707 - DNA, 25 bp, Mus musculus
agagatggagaggctggaatgacac

SEQ ID NO: 870708 - DNA, 25 bp, Mus musculus
agagatggagatttttggaccatat

SEQ ID NO: 870709 - DNA, 25 bp, Mus musculus
agagatggagttttttggaccatat

SEQ ID NO: 870710 - DNA, 25 bp, Mus musculus
agagatggcagtcgagcaaataaga

SEQ ID NO: 870711 - DNA, 25 bp, Mus musculus
agagatggcagtggagcaaataaga

SEQ ID NO: 870712 - DNA, 25 bp, Mus musculus
agagatggccatatacgcctactat

SEQ ID NO: 870713 - DNA, 25 bp, Mus musculus
agagatggccatttacgcctactat

SEQ ID NO: 870714 - DNA, 25 bp, Mus musculus
agagatgtcggcaacgtagtcgata

SEQ ID NO: 870715 - DNA, 25 bp, Mus musculus
agagatgtcggcaaggtagtcgata

SEQ ID NO: 870716 - DNA, 25 bp, Mus musculus
agagattaccccagaagacttggac

SEQ ID NO: 870717 - DNA, 25 bp, Mus musculus
agagattaccgcagaagacttggac

SEQ ID NO: 870718 - DNA, 25 bp, Mus musculus
agagattagaagaaaaccacgagct

SEQ ID NO: 870719 - DNA, 25 bp, Mus musculus
agagattagaagtaaaccacgagct

SEQ ID NO: 870720 - DNA, 25 bp, Mus musculus
agagattcagatgtggagttgctct

SEQ ID NO: 870721 - DNA, 25 bp, Mus musculus
agagattcagcttctcccctatggg

SEQ ID NO: 870722 - DNA, 25 bp, Mus musculus
agagattcaggttctcccctatggg

SEQ ID NO: 870723 - DNA, 25 bp, Mus musculus
agagattcagttgtggagttgctct

SEQ ID NO: 870724 - DNA, 25 bp, Mus musculus
agagattgagaacgtcatagaagag

SEQ ID NO: 870725 - DNA, 25 bp, Mus musculus
agagattgagaaggtcatagaagag

SEQ ID NO: 870726 - DNA, 25 bp, Mus musculus
agagattggacgcgatatcctacag

SEQ ID NO: 870727 - DNA, 25 bp, Mus musculus
agagattggacgggatatcctacag

SEQ ID NO: 870728 - DNA, 25 bp, Mus musculus
agagattggcagcggtgccttctcc

SEQ ID NO: 870729 - DNA, 25 bp, Mus musculus
agagattggcaggggtgccttctcc

SEQ ID NO: 870730 - DNA, 25 bp, Mus musculus
agagattgttgtccattctgactcc

SEQ ID NO: 870731 - DNA, 25 bp, Mus musculus
agagattgttgtgcattctgactcc

SEQ ID NO: 870732 - DNA, 25 bp, Mus musculus
agagcaaagaagacagcaaaagcca

SEQ ID NO: 870733 - DNA, 25 bp, Mus musculus
agagcaaagaagtcagcaaaagcca

SEQ ID NO: 870734 - DNA, 25 bp, Mus musculus
agagcaaagagactgccatcgccag

SEQ ID NO: 870735 - DNA, 25 bp, Mus musculus
agagcaaagagagtgccatcgccag

SEQ ID NO: 870736 - DNA, 25 bp, Mus musculus
agagcaaccgattctatggcgttat

SEQ ID NO: 870737 - DNA, 25 bp, Mus musculus
agagcaaccgtttctatggcgttat

SEQ ID NO: 870738 - DNA, 25 bp, Mus musculus
agagcaagcacgcccccagaggtac

SEQ ID NO: 870739 - DNA, 25 bp, Mus musculus
agagcaagcacggccccagaggtac

SEQ ID NO: 870740 - DNA, 25 bp, Mus musculus
agagcaagctatcgatctggtgaaa

SEQ ID NO: 870741 - DNA, 25 bp, Mus musculus
agagcaagctatggatctggtgaaa

SEQ ID NO: 870742 - DNA, 25 bp, Mus musculus
agagcaatattccacaaaccccacc

SEQ ID NO: 870743 - DNA, 25 bp, Mus musculus
agagcaatattccagaaaccccacc

SEQ ID NO: 870744 - DNA, 25 bp, Mus musculus
agagcaatgaagcatgtgccacggc

SEQ ID NO: 870745 - DNA, 25 bp, Mus musculus
agagcaatgaaggatgtgccacggc

SEQ ID NO: 870746 - DNA, 25 bp, Mus musculus
agagcacagccccacgccagcagag

SEQ ID NO: 870747 - DNA, 25 bp, Mus musculus
agagcacagccccactgctctctct

SEQ ID NO: 870748 - DNA, 25 bp, Mus musculus
agagcacagccccaggccagcagag

SEQ ID NO: 870749 - DNA, 25 bp, Mus musculus
agagcacagccccagtgctctctct

SEQ ID NO: 870750 - DNA, 25 bp, Mus musculus
agagcaccctcctgctgaataatga

SEQ ID NO: 870751 - DNA, 25 bp, Mus musculus
agagcaccctgctgctgaataatga

SEQ ID NO: 870752 - DNA, 25 bp, Mus musculus
agagcaccggattgattttgtcgcc

SEQ ID NO: 870753 - DNA, 25 bp, Mus musculus
agagcaccggccaagagtccatcct

SEQ ID NO: 870754 - DNA, 25 bp, Mus musculus
agagcaccggcgactcctgagacat

SEQ ID NO: 870755 - DNA, 25 bp, Mus musculus
agagcaccgggcaagagtccatcct

SEQ ID NO: 870756 - DNA, 25 bp, Mus musculus
agagcaccggggactcctgagacat

SEQ ID NO: 870757 - DNA, 25 bp, Mus musculus
agagcaccggtttgattttgtcgcc

SEQ ID NO: 870758 - DNA, 25 bp, Mus musculus
agagcacttttgagcacaagtgcag

SEQ ID NO: 870759 - DNA, 25 bp, Mus musculus
agagcacttttgcactacattgcag

SEQ ID NO: 870760 - DNA, 25 bp, Mus musculus
agagcacttttggactacattgcag

SEQ ID NO: 870761 - DNA, 25 bp, Mus musculus
agagcacttttgtgcacaagtgcag

SEQ ID NO: 870762 - DNA, 25 bp, Mus musculus
agagcagacagacagctgcagaaat

SEQ ID NO: 870763 - DNA, 25 bp, Mus musculus
agagcagacagagagctgcagaaat

SEQ ID NO: 870764 - DNA, 25 bp, Mus musculus
agagcagaggctcacatatctgccc

SEQ ID NO: 870765 - DNA, 25 bp, Mus musculus
agagcagagggtcacatatctgccc

SEQ ID NO: 870766 - DNA, 25 bp, Mus musculus
agagcagcaagactacaaactcaca

SEQ ID NO: 870767 - DNA, 25 bp, Mus musculus
agagcagcaagagtacaaactcaca

SEQ ID NO: 870768 - DNA, 25 bp, Mus musculus
agagcagcagcaacctgtgtctcca

SEQ ID NO: 870769 - DNA, 25 bp, Mus musculus
agagcagcagcgccctgttctccgg

SEQ ID NO: 870770 - DNA, 25 bp, Mus musculus
agagcagcaggaacctgtgtctcca

SEQ ID NO: 870771 - DNA, 25 bp, Mus musculus
agagcagcagggccctgttctccgg

SEQ ID NO: 870772 - DNA, 25 bp, Mus musculus
agagcagggccacatgtagtgctga

SEQ ID NO: 870773 - DNA, 25 bp, Mus musculus
agagcagggccactgctgagcagcg

SEQ ID NO: 870774 - DNA, 25 bp, Mus musculus
agagcagggccagatgtagtgctga

SEQ ID NO: 870775 - DNA, 25 bp, Mus musculus
agagcagggccagtgctgagcagcg

SEQ ID NO: 870776 - DNA, 25 bp, Mus musculus
agagcaggtaaactaccaaatatgc

SEQ ID NO: 870777 - DNA, 25 bp, Mus musculus
agagcaggtaaagtaccaaatatgc

SEQ ID NO: 870778 - DNA, 25 bp, Mus musculus
agagcagtaaccgacctcacgtcgc

SEQ ID NO: 870779 - DNA, 25 bp, Mus musculus
agagcagtaaccgagctcacgtcgc

SEQ ID NO: 870780 - DNA, 25 bp, Mus musculus
agagcataagctttatctcaagtct

SEQ ID NO: 870781 - DNA, 25 bp, Mus musculus
agagcataaggtttatctcaagtct

SEQ ID NO: 870782 - DNA, 25 bp, Mus musculus
agagcatctcagccaactttataaa

SEQ ID NO: 870783 - DNA, 25 bp, Mus musculus
agagcatctcaggcaactttataaa

SEQ ID NO: 870784 - DNA, 25 bp, Mus musculus
agagcatgcgttcgcatctctgggg

SEQ ID NO: 870785 - DNA, 25 bp, Mus musculus
agagcatgcgttggcatctctgggg

SEQ ID NO: 870786 - DNA, 25 bp, Mus musculus
agagcatggacgactctcacacact

SEQ ID NO: 870787 - DNA, 25 bp, Mus musculus
agagcatggacgtctctcacacact

SEQ ID NO: 870788 - DNA, 25 bp, Mus musculus
agagccaacagaagaagaaacaact

SEQ ID NO: 870789 - DNA, 25 bp, Mus musculus
agagccaacagatgaagaaacaact

SEQ ID NO: 870790 - DNA, 25 bp, Mus musculus
agagccactgattgccacagcagtg

SEQ ID NO: 870791 - DNA, 25 bp, Mus musculus
agagccactgcactgacagacgaag

SEQ ID NO: 870792 - DNA, 25 bp, Mus musculus
agagccactggactgacagacgaag

SEQ ID NO: 870793 - DNA, 25 bp, Mus musculus
agagccactgtttgccacagcagtg

SEQ ID NO: 870794 - DNA, 25 bp, Mus musculus
agagccagagccactgagagtatga

SEQ ID NO: 870795 - DNA, 25 bp, Mus musculus
agagccagaggcactgagagtatga

SEQ ID NO: 870796 - DNA, 25 bp, Mus musculus
agagccagcctgccgacccagtgga

SEQ ID NO: 870797 - DNA, 25 bp, Mus musculus
agagccagcctggcgacccagtgga

SEQ ID NO: 870798 - DNA, 25 bp, Mus musculus
agagccagctggctggccttgggat

SEQ ID NO: 870799 - DNA, 25 bp, Mus musculus
agagccagctgggtggccttgggat

SEQ ID NO: 870800 - DNA, 25 bp, Mus musculus
agagccaggcggagcacgccccaga

SEQ ID NO: 870801 - DNA, 25 bp, Mus musculus
agagccaggcggtgcacgccccaga

SEQ ID NO: 870802 - DNA, 25 bp, Mus musculus
agagccagtgagccctgcctagccc

SEQ ID NO: 870803 - DNA, 25 bp, Mus musculus
agagccagtgtgccctgcctagccc

SEQ ID NO: 870804 - DNA, 25 bp, Mus musculus
agagccatggagatcgagcagttga

SEQ ID NO: 870805 - DNA, 25 bp, Mus musculus
agagccatggagatggagcagttga

SEQ ID NO: 870806 - DNA, 25 bp, Mus musculus
agagccatgtctactttccgcctgg

SEQ ID NO: 870807 - DNA, 25 bp, Mus musculus
agagccatgtcttctttccgcctgg

SEQ ID NO: 870808 - DNA, 25 bp, Mus musculus
agagcccaggaacgagactgagagt

SEQ ID NO: 870809 - DNA, 25 bp, Mus musculus
agagcccaggaaggagactgagagt

SEQ ID NO: 870810 - DNA, 25 bp, Mus musculus
agagccccagagaggtaaacagctg

SEQ ID NO: 870811 - DNA, 25 bp, Mus musculus
agagccccagagtggtaaacagctg

SEQ ID NO: 870812 - DNA, 25 bp, Mus musculus
agagccccggaggacgtgacagagt

SEQ ID NO: 870813 - DNA, 25 bp, Mus musculus
agagccccggaggaggtgacagagt

SEQ ID NO: 870814 - DNA, 25 bp, Mus musculus
agagcccctgggctcgtggctctcg

SEQ ID NO: 870815 - DNA, 25 bp, Mus musculus
agagcccctgggctggtggctctcg

SEQ ID NO: 870816 - DNA, 25 bp, Mus musculus
agagccccttataatccattgggca

SEQ ID NO: 870817 - DNA, 25 bp, Mus musculus
agagccccttattatccattgggca

SEQ ID NO: 870818 - DNA, 25 bp, Mus musculus
agagccctcagactgctcctggaag

SEQ ID NO: 870819 - DNA, 25 bp, Mus musculus
agagccctcagagtgctcctggaag

SEQ ID NO: 870820 - DNA, 25 bp, Mus musculus
agagccctccatcgacatagtcttg

SEQ ID NO: 870821 - DNA, 25 bp, Mus musculus
agagccctccatggacatagtcttg

SEQ ID NO: 870822 - DNA, 25 bp, Mus musculus
agagcccttcagcaactctgcctgc

SEQ ID NO: 870823 - DNA, 25 bp, Mus musculus
agagcccttcaggaactctgcctgc

SEQ ID NO: 870824 - DNA, 25 bp, Mus musculus
agagccgcggccagagtctggaaat

SEQ ID NO: 870825 - DNA, 25 bp, Mus musculus
agagccgcggccagtgtctggaaat

SEQ ID NO: 870826 - DNA, 25 bp, Mus musculus
agagccgtcaagcagaagaagatct

SEQ ID NO: 870827 - DNA, 25 bp, Mus musculus
agagccgtcaaggagaagaagatct

SEQ ID NO: 870828 - DNA, 25 bp, Mus musculus
agagcctatgcatctgactgtagta

SEQ ID NO: 870829 - DNA, 25 bp, Mus musculus
agagcctatggatctgactgtagta

SEQ ID NO: 870830 - DNA, 25 bp, Mus musculus
agagcctcaagacaacgagtgctgc

SEQ ID NO: 870831 - DNA, 25 bp, Mus musculus
agagcctcaagacatcgagtgctgc

SEQ ID NO: 870832 - DNA, 25 bp, Mus musculus
agagcctcagaatctatcactgatg

SEQ ID NO: 870833 - DNA, 25 bp, Mus musculus
agagcctcagtatctatcactgatg

SEQ ID NO: 870834 - DNA, 25 bp, Mus musculus
agagcctccctgaacggctaccagt

SEQ ID NO: 870835 - DNA, 25 bp, Mus musculus
agagcctccctgaagggctaccagt

SEQ ID NO: 870836 - DNA, 25 bp, Mus musculus
agagcctctaggccctaggaccatg

SEQ ID NO: 870837 - DNA, 25 bp, Mus musculus
agagcctctagggcctaggaccatg

SEQ ID NO: 870838 - DNA, 25 bp, Mus musculus
agagcctgaaagcacaccggcattc

SEQ ID NO: 870839 - DNA, 25 bp, Mus musculus
agagcctgaaagcagaccggcattc

SEQ ID NO: 870840 - DNA, 25 bp, Mus musculus
agagcctgaacacagagctgaaatt

SEQ ID NO: 870841 - DNA, 25 bp, Mus musculus
agagcctgaacagagagctgaaatt

SEQ ID NO: 870842 - DNA, 25 bp, Mus musculus
agagcctgagatctggtggctctga

SEQ ID NO: 870843 - DNA, 25 bp, Mus musculus
agagcctgagccccaggatgggtga

SEQ ID NO: 870844 - DNA, 25 bp, Mus musculus
agagcctgagctgtttaaatacaac

SEQ ID NO: 870845 - DNA, 25 bp, Mus musculus
agagcctgaggaaacagttaaaaat

SEQ ID NO: 870846 - DNA, 25 bp, Mus musculus
agagcctgaggaaagagttaaaaat

SEQ ID NO: 870847 - DNA, 25 bp, Mus musculus
agagcctgaggcccaggatgggtga

SEQ ID NO: 870848 - DNA, 25 bp, Mus musculus
agagcctgaggtgtttaaatacaac

SEQ ID NO: 870849 - DNA, 25 bp, Mus musculus
agagcctgagttctggtggctctga

SEQ ID NO: 870850 - DNA, 25 bp, Mus musculus
agagcctgcgaacttctgctcacaa

SEQ ID NO: 870851 - DNA, 25 bp, Mus musculus
agagcctgcgaagttctgctcacaa

SEQ ID NO: 870852 - DNA, 25 bp, Mus musculus
agagcctgctggcaatcatctgggg

SEQ ID NO: 870853 - DNA, 25 bp, Mus musculus
agagcctgctgggaatcatctgggg

SEQ ID NO: 870854 - DNA, 25 bp, Mus musculus
agagcgaatgatgaaggatgtcttc

SEQ ID NO: 870855 - DNA, 25 bp, Mus musculus
agagcgaatgttgaaggatgtcttc

SEQ ID NO: 870856 - DNA, 25 bp, Mus musculus
agagcgacccacacctcaaactaca

SEQ ID NO: 870857 - DNA, 25 bp, Mus musculus
agagcgacccacacgtcaaactaca

SEQ ID NO: 870858 - DNA, 25 bp, Mus musculus
agagcgaccctgacagagtcatgtg

SEQ ID NO: 870859 - DNA, 25 bp, Mus musculus
agagcgaccctgactgagtcatgtg

SEQ ID NO: 870860 - DNA, 25 bp, Mus musculus
agagcgagggctccgtctcccaggg

SEQ ID NO: 870861 - DNA, 25 bp, Mus musculus
agagcgaggggtccgtctcccaggg

SEQ ID NO: 870862 - DNA, 25 bp, Mus musculus
agagcgatgctgctgggaaggcggg

SEQ ID NO: 870863 - DNA, 25 bp, Mus musculus
agagcgatgctggtgggaaggcggg

SEQ ID NO: 870864 - DNA, 25 bp, Mus musculus
agagcgatgtctggtccttcggggt

SEQ ID NO: 870865 - DNA, 25 bp, Mus musculus
agagcgatgtctggtcttttggagt

SEQ ID NO: 870866 - DNA, 25 bp, Mus musculus
agagcgatgtgtggtccttcggggt

SEQ ID NO: 870867 - DNA, 25 bp, Mus musculus
agagcgatgtgtggtcttttggagt

SEQ ID NO: 870868 - DNA, 25 bp, Mus musculus
agagcgcagaggctcgggacagtac

SEQ ID NO: 870869 - DNA, 25 bp, Mus musculus
agagcgcagaggctggggacagtac

SEQ ID NO: 870870 - DNA, 25 bp, Mus musculus
agagcgcatcagctgcagttaaagc

SEQ ID NO: 870871 - DNA, 25 bp, Mus musculus
agagcgcatcaggtgcagttaaagc

SEQ ID NO: 870872 - DNA, 25 bp, Mus musculus
agagcgccagagccatgcccagagg

SEQ ID NO: 870873 - DNA, 25 bp, Mus musculus
agagcgccagaggcatgcccagagg

SEQ ID NO: 870874 - DNA, 25 bp, Mus musculus
agagcggaattcacaagtggatcag

SEQ ID NO: 870875 - DNA, 25 bp, Mus musculus
agagcggaattcactagtggatcag

SEQ ID NO: 870876 - DNA, 25 bp, Mus musculus
agagcggcagaggttccagggcctg

SEQ ID NO: 870877 - DNA, 25 bp, Mus musculus
agagcggcagtggttccagggcctg

SEQ ID NO: 870878 - DNA, 25 bp, Mus musculus
agagcgggatgtcgatattctgaac

SEQ ID NO: 870879 - DNA, 25 bp, Mus musculus
agagcgggatgtggatattctgaac

SEQ ID NO: 870880 - DNA, 25 bp, Mus musculus
agagcggtgagccacatgtccttcc

SEQ ID NO: 870881 - DNA, 25 bp, Mus musculus
agagcggtgagcgacatgtccttcc

SEQ ID NO: 870882 - DNA, 25 bp, Mus musculus
agagcggtttgccacggaaaatcat

SEQ ID NO: 870883 - DNA, 25 bp, Mus musculus
agagcggtttgccacgtcggatgat

SEQ ID NO: 870884 - DNA, 25 bp, Mus musculus
agagcggtttgccagggaaaatcat

SEQ ID NO: 870885 - DNA, 25 bp, Mus musculus
agagcggtttgccaggtcggatgat

SEQ ID NO: 870886 - DNA, 25 bp, Mus musculus
agagcgtctcatcatggagagaaga

SEQ ID NO: 870887 - DNA, 25 bp, Mus musculus
agagcgtctcatgatggagagaaga

SEQ ID NO: 870888 - DNA, 25 bp, Mus musculus
agagcgtgtgcgcatcgttctgcct

SEQ ID NO: 870889 - DNA, 25 bp, Mus musculus
agagcgtgtgggcatcgttctgcct

SEQ ID NO: 870890 - DNA, 25 bp, Mus musculus
agagcgtgtgttaacccatcaaaca

SEQ ID NO: 870891 - DNA, 25 bp, Mus musculus
agagcgtgtgttaacgttaccaaca

SEQ ID NO: 870892 - DNA, 25 bp, Mus musculus
agagcgtgtgttaagccatcaaaca

SEQ ID NO: 870893 - DNA, 25 bp, Mus musculus
agagcgtgtgttaaggttaccaaca

SEQ ID NO: 870894 - DNA, 25 bp, Mus musculus
agagctaaagcgtttggatccagct

SEQ ID NO: 870895 - DNA, 25 bp, Mus musculus
agagctaaagggtttggatccagct

SEQ ID NO: 870896 - DNA, 25 bp, Mus musculus
agagctacggatatgttctaccaaa

SEQ ID NO: 870897 - DNA, 25 bp, Mus musculus
agagctacggttatgttctaccaaa

SEQ ID NO: 870898 - DNA, 25 bp, Mus musculus
agagctagaactgcagcatcctgct

SEQ ID NO: 870899 - DNA, 25 bp, Mus musculus
agagctagaagtgcagcatcctgct

SEQ ID NO: 870900 - DNA, 25 bp, Mus musculus
agagctagagatatgtgtcacaaag

SEQ ID NO: 870901 - DNA, 25 bp, Mus musculus
agagctagagctcacctggaggaag

SEQ ID NO: 870902 - DNA, 25 bp, Mus musculus
agagctagaggtcacctggaggaag

SEQ ID NO: 870903 - DNA, 25 bp, Mus musculus
agagctagagttatgtgtcacaaag

SEQ ID NO: 870904 - DNA, 25 bp, Mus musculus
agagctatgggcgaccagctcttgc

SEQ ID NO: 870905 - DNA, 25 bp, Mus musculus
agagctatgggcgagcagctcttgc

SEQ ID NO: 870906 - DNA, 25 bp, Mus musculus
agagctcaaaggcaagctaacagga

SEQ ID NO: 870907 - DNA, 25 bp, Mus musculus
agagctcaaagggaagctaacagga

SEQ ID NO: 870908 - DNA, 25 bp, Mus musculus
agagctcaagaatggatttgctatc

SEQ ID NO: 870909 - DNA, 25 bp, Mus musculus
agagctcaagcagcgaatctgcatg

SEQ ID NO: 870910 - DNA, 25 bp, Mus musculus
agagctcaagcctaaccctttcaag

SEQ ID NO: 870911 - DNA, 25 bp, Mus musculus
agagctcaaggagcgaatctgcatg

SEQ ID NO: 870912 - DNA, 25 bp, Mus musculus
agagctcaaggctaaccctttcaag

SEQ ID NO: 870913 - DNA, 25 bp, Mus musculus
agagctcaagtatggatttgctatc

SEQ ID NO: 870914 - DNA, 25 bp, Mus musculus
agagctcagggacgttgctacctgt

SEQ ID NO: 870915 - DNA, 25 bp, Mus musculus
agagctcagggaggttgctacctgt

SEQ ID NO: 870916 - DNA, 25 bp, Mus musculus
agagctccagatccatgatgaggag

SEQ ID NO: 870917 - DNA, 25 bp, Mus musculus
agagctccagttccatgatgaggag

SEQ ID NO: 870918 - DNA, 25 bp, Mus musculus
agagctccggcctcaagtccacccc

SEQ ID NO: 870919 - DNA, 25 bp, Mus musculus
agagctccgggctcaagtccacccc

SEQ ID NO: 870920 - DNA, 25 bp, Mus musculus
agagctcctgattattcatggaggg

SEQ ID NO: 870921 - DNA, 25 bp, Mus musculus
agagctcctgtttattcatggaggg

SEQ ID NO: 870922 - DNA, 25 bp, Mus musculus
agagctcgggagctacagtggtccc

SEQ ID NO: 870923 - DNA, 25 bp, Mus musculus
agagctcgggagcttcccgtgagaa

SEQ ID NO: 870924 - DNA, 25 bp, Mus musculus
agagctcgggaggtacagtggtccc

SEQ ID NO: 870925 - DNA, 25 bp, Mus musculus
agagctcgggaggttcccgtgagaa

SEQ ID NO: 870926 - DNA, 25 bp, Mus musculus
agagctctttagaacgcttcagaaa

SEQ ID NO: 870927 - DNA, 25 bp, Mus musculus
agagctctttagaaggcttcagaaa

SEQ ID NO: 870928 - DNA, 25 bp, Mus musculus
agagctgaacatcgacctgttccgc

SEQ ID NO: 870929 - DNA, 25 bp, Mus musculus
agagctgaacatggacctgttccgc

SEQ ID NO: 870930 - DNA, 25 bp, Mus musculus
agagctgaagccagcaagcctgcct

SEQ ID NO: 870931 - DNA, 25 bp, Mus musculus
agagctgaagcctattctagactca

SEQ ID NO: 870932 - DNA, 25 bp, Mus musculus
agagctgaaggcagcaagcctgcct

SEQ ID NO: 870933 - DNA, 25 bp, Mus musculus
agagctgaaggctattctagactca

SEQ ID NO: 870934 - DNA, 25 bp, Mus musculus
agagctgacactcaccaaatcttat

SEQ ID NO: 870935 - DNA, 25 bp, Mus musculus
agagctgacactgaccaaatcttat

SEQ ID NO: 870936 - DNA, 25 bp, Mus musculus
agagctgatgcaacctgtaggtggt

SEQ ID NO: 870937 - DNA, 25 bp, Mus musculus
agagctgatgcacgccatgctggag

SEQ ID NO: 870938 - DNA, 25 bp, Mus musculus
agagctgatgcaggccatgctggag

SEQ ID NO: 870939 - DNA, 25 bp, Mus musculus
agagctgatgcatcctgtaggtggt

SEQ ID NO: 870940 - DNA, 25 bp, Mus musculus
agagctgcaaccaggggtagagcca

SEQ ID NO: 870941 - DNA, 25 bp, Mus musculus
agagctgcaagcaggggtagagcca

SEQ ID NO: 870942 - DNA, 25 bp, Mus musculus
agagctgcacaccacgattttgcta

SEQ ID NO: 870943 - DNA, 25 bp, Mus musculus
agagctgcacaccaggattttgcta

SEQ ID NO: 870944 - DNA, 25 bp, Mus musculus
agagctggacaccgctgtccagggc

SEQ ID NO: 870945 - DNA, 25 bp, Mus musculus
agagctggacacggctgtccagggc

SEQ ID NO: 870946 - DNA, 25 bp, Mus musculus
agagctggagcacaggagataatcg

SEQ ID NO: 870947 - DNA, 25 bp, Mus musculus
agagctggagcacaggagatcatcg

SEQ ID NO: 870948 - DNA, 25 bp, Mus musculus
agagctggagcacgttcgggaggcc

SEQ ID NO: 870949 - DNA, 25 bp, Mus musculus
agagctggagcagaggagataatcg

SEQ ID NO: 870950 - DNA, 25 bp, Mus musculus
agagctggagcagaggagatcatcg

SEQ ID NO: 870951 - DNA, 25 bp, Mus musculus
agagctggagcaggttcgggaggcc

SEQ ID NO: 870952 - DNA, 25 bp, Mus musculus
agagctggcactcacggagcatggc

SEQ ID NO: 870953 - DNA, 25 bp, Mus musculus
agagctggcactcagggagcatggc

SEQ ID NO: 870954 - DNA, 25 bp, Mus musculus
agagctgtgaagacatcaacgagtg

SEQ ID NO: 870955 - DNA, 25 bp, Mus musculus
agagctgtgaagtcatcaacgagtg

SEQ ID NO: 870956 - DNA, 25 bp, Mus musculus
agagctgtgacccgtgccgggaggg

SEQ ID NO: 870957 - DNA, 25 bp, Mus musculus
agagctgtgaccggtgccgggaggg

SEQ ID NO: 870958 - DNA, 25 bp, Mus musculus
agagctgtggcacacatcactcaac

SEQ ID NO: 870959 - DNA, 25 bp, Mus musculus
agagctgtggcacagatcactcaac

SEQ ID NO: 870960 - DNA, 25 bp, Mus musculus
agagctgttcagctgtcccactcca

SEQ ID NO: 870961 - DNA, 25 bp, Mus musculus
agagctgttcaggtgtcccactcca

SEQ ID NO: 870962 - DNA, 25 bp, Mus musculus
agagctgttgcgacaaggtcaagga

SEQ ID NO: 870963 - DNA, 25 bp, Mus musculus
agagctgttgcgactaggtcaagga

SEQ ID NO: 870964 - DNA, 25 bp, Mus musculus
agagctgttttgcgttgcatgagac

SEQ ID NO: 870965 - DNA, 25 bp, Mus musculus
agagctgttttgggttgcatgagac

SEQ ID NO: 870966 - DNA, 25 bp, Mus musculus
agagcttcccagctctctttgagcc

SEQ ID NO: 870967 - DNA, 25 bp, Mus musculus
agagcttcccaggtctctttgagcc

SEQ ID NO: 870968 - DNA, 25 bp, Mus musculus
agagcttcccggaggagatggccac

SEQ ID NO: 870969 - DNA, 25 bp, Mus musculus
agagcttcccggtggagatggccac

SEQ ID NO: 870970 - DNA, 25 bp, Mus musculus
agagcttcgcctcaaacctcagctt

SEQ ID NO: 870971 - DNA, 25 bp, Mus musculus
agagcttcgcctgaaacctcagctt

SEQ ID NO: 870972 - DNA, 25 bp, Mus musculus
agagcttcttctcctcatgtctctg

SEQ ID NO: 870973 - DNA, 25 bp, Mus musculus
agagcttcttctgctcatgtctctg

SEQ ID NO: 870974 - DNA, 25 bp, Mus musculus
agagcttctttgctccgcagaacac

SEQ ID NO: 870975 - DNA, 25 bp, Mus musculus
agagcttctttggtccgcagaacac

SEQ ID NO: 870976 - DNA, 25 bp, Mus musculus
agagcttggttccacatgggtgtgt

SEQ ID NO: 870977 - DNA, 25 bp, Mus musculus
agagcttggttccacggtgactgac

SEQ ID NO: 870978 - DNA, 25 bp, Mus musculus
agagcttggttccagatgggtgtgt

SEQ ID NO: 870979 - DNA, 25 bp, Mus musculus
agagcttggttccagggtgactgac

SEQ ID NO: 870980 - DNA, 25 bp, Mus musculus
agagcttgtcagaatcaggtctgat

SEQ ID NO: 870981 - DNA, 25 bp, Mus musculus
agagcttgtcagtatcaggtctgat

SEQ ID NO: 870982 - DNA, 25 bp, Mus musculus
agagcttttgcacagaagaatggtt

SEQ ID NO: 870983 - DNA, 25 bp, Mus musculus
agagcttttgcagagaagaatggtt

SEQ ID NO: 870984 - DNA, 25 bp, Mus musculus
agaggaaaacaacatctcaaagacg

SEQ ID NO: 870985 - DNA, 25 bp, Mus musculus
agaggaaaacaagatctcaaagacg

SEQ ID NO: 870986 - DNA, 25 bp, Mus musculus
agaggaaaagccatttatatgtggg

SEQ ID NO: 870987 - DNA, 25 bp, Mus musculus
agaggaaaaggcatttatatgtggg

SEQ ID NO: 870988 - DNA, 25 bp, Mus musculus
agaggaaacgatcctggggcagagt

SEQ ID NO: 870989 - DNA, 25 bp, Mus musculus
agaggaaacgttcctggggcagagt

SEQ ID NO: 870990 - DNA, 25 bp, Mus musculus
agaggaaatgaggtccttgtagacc

SEQ ID NO: 870991 - DNA, 25 bp, Mus musculus
agaggaaatgaggtgcttgtagacc

SEQ ID NO: 870992 - DNA, 25 bp, Mus musculus
agaggaacagctgtcttggctctca

SEQ ID NO: 870993 - DNA, 25 bp, Mus musculus
agaggaacaggtgtcttggctctca

SEQ ID NO: 870994 - DNA, 25 bp, Mus musculus
agaggaacagttcatccctaaagga

SEQ ID NO: 870995 - DNA, 25 bp, Mus musculus
agaggaacagttgatccctaaagga

SEQ ID NO: 870996 - DNA, 25 bp, Mus musculus
agaggaagacttcccttctttgaat

SEQ ID NO: 870997 - DNA, 25 bp, Mus musculus
agaggaagacttgccttctttgaat

SEQ ID NO: 870998 - DNA, 25 bp, Mus musculus
agaggaagagctccagagaatgcta

SEQ ID NO: 870999 - DNA, 25 bp, Mus musculus
agaggaagaggaaacagaaagagag

SEQ ID NO: 871000 - DNA, 25 bp, Mus musculus
agaggaagaggaaagagaaagagag

SEQ ID NO: 871001 - DNA, 25 bp, Mus musculus
agaggaagaggtccagagaatgcta

SEQ ID NO: 871002 - DNA, 25 bp, Mus musculus
agaggaaggaggaaatcttcctgat

SEQ ID NO: 871003 - DNA, 25 bp, Mus musculus
agaggaaggaggtaatcttcctgat

SEQ ID NO: 871004 - DNA, 25 bp, Mus musculus
agaggaatgtggcttcctatttcta

SEQ ID NO: 871005 - DNA, 25 bp, Mus musculus
agaggaatgtgggttcctatttcta

SEQ ID NO: 871006 - DNA, 25 bp, Mus musculus
agaggacaagccccagatcttgctg

SEQ ID NO: 871007 - DNA, 25 bp, Mus musculus
agaggacaaggcccagatcttgctg

SEQ ID NO: 871008 - DNA, 25 bp, Mus musculus
agaggacaccaacggtccaccaaca

SEQ ID NO: 871009 - DNA, 25 bp, Mus musculus
agaggacaccaagggtccaccaaca

SEQ ID NO: 871010 - DNA, 25 bp, Mus musculus
agaggacacccaagcatgtgaatga

SEQ ID NO: 871011 - DNA, 25 bp, Mus musculus
agaggacacccaaggatgtgaatga

SEQ ID NO: 871012 - DNA, 25 bp, Mus musculus
agaggacagaagcgaccttagaaga

SEQ ID NO: 871013 - DNA, 25 bp, Mus musculus
agaggacagaagggaccttagaaga

SEQ ID NO: 871014 - DNA, 25 bp, Mus musculus
agaggacagcagcaaagatggtcca

SEQ ID NO: 871015 - DNA, 25 bp, Mus musculus
agaggacagcagcaggaaagatggt

SEQ ID NO: 871016 - DNA, 25 bp, Mus musculus
agaggacagcagcgaaggtgtgaac

SEQ ID NO: 871017 - DNA, 25 bp, Mus musculus
agaggacagcagctgtgaacctgag

SEQ ID NO: 871018 - DNA, 25 bp, Mus musculus
agaggacagcaggaaagatggtcca

SEQ ID NO: 871019 - DNA, 25 bp, Mus musculus
agaggacagcaggaggaaagatggt

SEQ ID NO: 871020 - DNA, 25 bp, Mus musculus
agaggacagcagggaaggtgtgaac

SEQ ID NO: 871021 - DNA, 25 bp, Mus musculus
agaggacagcaggtgtgaacctgag

SEQ ID NO: 871022 - DNA, 25 bp, Mus musculus
agaggaccagctggtctccacggac

SEQ ID NO: 871023 - DNA, 25 bp, Mus musculus
agaggaccaggtggtctccacggac

SEQ ID NO: 871024 - DNA, 25 bp, Mus musculus
agaggacctccaagcgctcatcgac

SEQ ID NO: 871025 - DNA, 25 bp, Mus musculus
agaggacctccatgcgctcatcgac

SEQ ID NO: 871026 - DNA, 25 bp, Mus musculus
agaggaccttcgcggctgggcttca

SEQ ID NO: 871027 - DNA, 25 bp, Mus musculus
agaggaccttcggggctgggcttca

SEQ ID NO: 871028 - DNA, 25 bp, Mus musculus
agaggactcttgcaactattctcat

SEQ ID NO: 871029 - DNA, 25 bp, Mus musculus
agaggactcttggaactattctcat

SEQ ID NO: 871030 - DNA, 25 bp, Mus musculus
agaggagaagatcaagactctggac

SEQ ID NO: 871031 - DNA, 25 bp, Mus musculus
agaggagaagttcaagactctggac

SEQ ID NO: 871032 - DNA, 25 bp, Mus musculus
agaggagaatgacgatgctcgcacc

SEQ ID NO: 871033 - DNA, 25 bp, Mus musculus
agaggagaatgaggatgctcgcacc

SEQ ID NO: 871034 - DNA, 25 bp, Mus musculus
agaggagacagacgtattgacctca

SEQ ID NO: 871035 - DNA, 25 bp, Mus musculus
agaggagacagaggtattgacctca

SEQ ID NO: 871036 - DNA, 25 bp, Mus musculus
agaggagagcagcgacgaccaggac

SEQ ID NO: 871037 - DNA, 25 bp, Mus musculus
agaggagagcagggacgaccaggac

SEQ ID NO: 871038 - DNA, 25 bp, Mus musculus
agaggagagtcacacctaaagaacg

SEQ ID NO: 871039 - DNA, 25 bp, Mus musculus
agaggagagtcacagctaaagaacg

SEQ ID NO: 871040 - DNA, 25 bp, Mus musculus
agaggagataagcgagaagctggtt

SEQ ID NO: 871041 - DNA, 25 bp, Mus musculus
agaggagataagggagaagctggtt

SEQ ID NO: 871042 - DNA, 25 bp, Mus musculus
agaggagatcaactttgaacagcat

SEQ ID NO: 871043 - DNA, 25 bp, Mus musculus
agaggagatcaagtttgaacagcat

SEQ ID NO: 871044 - DNA, 25 bp, Mus musculus
agaggagattgacgaccttgttgct

SEQ ID NO: 871045 - DNA, 25 bp, Mus musculus
agaggagattgaggaccttgttgct

SEQ ID NO: 871046 - DNA, 25 bp, Mus musculus
agaggagcaaaagacggaataattc

SEQ ID NO: 871047 - DNA, 25 bp, Mus musculus
agaggagcaaaagagggaataattc

SEQ ID NO: 871048 - DNA, 25 bp, Mus musculus
agaggagcagcattttctgcaatct

SEQ ID NO: 871049 - DNA, 25 bp, Mus musculus
agaggagcaggattttctgcaatct

SEQ ID NO: 871050 - DNA, 25 bp, Mus musculus
agaggagccgcagacgtgctttgtc

SEQ ID NO: 871051 - DNA, 25 bp, Mus musculus
agaggagccgcagaggtgctttgtc

SEQ ID NO: 871052 - DNA, 25 bp, Mus musculus
agaggagctgcagacccattgacta

SEQ ID NO: 871053 - DNA, 25 bp, Mus musculus
agaggagctgcagagccattgacta

SEQ ID NO: 871054 - DNA, 25 bp, Mus musculus
agaggagcttggcactggccaattt

SEQ ID NO: 871055 - DNA, 25 bp, Mus musculus
agaggagcttggcagtggccaattt

SEQ ID NO: 871056 - DNA, 25 bp, Mus musculus
agaggaggagaacgacaagcctgtg

SEQ ID NO: 871057 - DNA, 25 bp, Mus musculus
agaggaggagaaggacaagcctgtg

SEQ ID NO: 871058 - DNA, 25 bp, Mus musculus
agaggaggagagagagttcacccat

SEQ ID NO: 871059 - DNA, 25 bp, Mus musculus
agaggaggagagtgagttcacccat

SEQ ID NO: 871060 - DNA, 25 bp, Mus musculus
agaggaggagcaggctccgccccca

SEQ ID NO: 871061 - DNA, 25 bp, Mus musculus
agaggaggagctcacgctcacgctg

SEQ ID NO: 871062 - DNA, 25 bp, Mus musculus
agaggaggaggaggctccgccccca

SEQ ID NO: 871063 - DNA, 25 bp, Mus musculus
agaggaggaggtcacgctcacgctg

SEQ ID NO: 871064 - DNA, 25 bp, Mus musculus
agaggagggacacgagtgacactgt

SEQ ID NO: 871065 - DNA, 25 bp, Mus musculus
agaggagggacaggagtgacactgt

SEQ ID NO: 871066 - DNA, 25 bp, Mus musculus
agaggaggggatatcatgcttttgg

SEQ ID NO: 871067 - DNA, 25 bp, Mus musculus
agaggaggggccatgaatcctacaa

SEQ ID NO: 871068 - DNA, 25 bp, Mus musculus
agaggagggggcatgaatcctacaa

SEQ ID NO: 871069 - DNA, 25 bp, Mus musculus
agaggaggggttatcatgcttttgg

SEQ ID NO: 871070 - DNA, 25 bp, Mus musculus
agaggaggtgcacaatgtggacgac

SEQ ID NO: 871071 - DNA, 25 bp, Mus musculus
agaggaggtgcagaatgtggacgac

SEQ ID NO: 871072 - DNA, 25 bp, Mus musculus
agaggagtaacgcaccaggaaacct

SEQ ID NO: 871073 - DNA, 25 bp, Mus musculus
agaggagtaacgcagcaggaaacct

SEQ ID NO: 871074 - DNA, 25 bp, Mus musculus
agaggagtattaaacattgtcaaaa

SEQ ID NO: 871075 - DNA, 25 bp, Mus musculus
agaggagtattaaagattgtcaaaa

SEQ ID NO: 871076 - DNA, 25 bp, Mus musculus
agaggagttaatctagtctcctcga

SEQ ID NO: 871077 - DNA, 25 bp, Mus musculus
agaggagttaatctagtctcttctc

SEQ ID NO: 871078 - DNA, 25 bp, Mus musculus
agaggagttaatctagtttgagtct

SEQ ID NO: 871079 - DNA, 25 bp, Mus musculus
agaggagttaatcttgtctcctcga

SEQ ID NO: 871080 - DNA, 25 bp, Mus musculus
agaggagttaatcttgtctcttctc

SEQ ID NO: 871081 - DNA, 25 bp, Mus musculus
agaggagttaatcttgtttgagtct

SEQ ID NO: 871082 - DNA, 25 bp, Mus musculus
agaggagttccacgcccacacggtg

SEQ ID NO: 871083 - DNA, 25 bp, Mus musculus
agaggagttccacggccacacggtg

SEQ ID NO: 871084 - DNA, 25 bp, Mus musculus
agaggataagaactctcagaaggaa

SEQ ID NO: 871085 - DNA, 25 bp, Mus musculus
agaggataagtactctcagaaggaa

SEQ ID NO: 871086 - DNA, 25 bp, Mus musculus
agaggatgagatcgactggggtgac

SEQ ID NO: 871087 - DNA, 25 bp, Mus musculus
agaggatgaggacaacaacgagaac

SEQ ID NO: 871088 - DNA, 25 bp, Mus musculus
agaggatgaggagaacaacgagaac

SEQ ID NO: 871089 - DNA, 25 bp, Mus musculus
agaggatgagttcgactggggtgac

SEQ ID NO: 871090 - DNA, 25 bp, Mus musculus
agaggatgatattgcgtttgatctg

SEQ ID NO: 871091 - DNA, 25 bp, Mus musculus
agaggatgatattgggtttgatctg

SEQ ID NO: 871092 - DNA, 25 bp, Mus musculus
agaggatgcgagccatttccaagag

SEQ ID NO: 871093 - DNA, 25 bp, Mus musculus
agaggatgcgaggcatttccaagag

SEQ ID NO: 871094 - DNA, 25 bp, Mus musculus
agaggattcacacacattctggaac

SEQ ID NO: 871095 - DNA, 25 bp, Mus musculus
agaggattcacacagattctggaac

SEQ ID NO: 871096 - DNA, 25 bp, Mus musculus
agaggattgcgacgatcgccacgac

SEQ ID NO: 871097 - DNA, 25 bp, Mus musculus
agaggattgcgaggatcgccacgac

SEQ ID NO: 871098 - DNA, 25 bp, Mus musculus
agaggatttaagaaagaatgcccca

SEQ ID NO: 871099 - DNA, 25 bp, Mus musculus
agaggatttaagaatgaatgcccca

SEQ ID NO: 871100 - DNA, 25 bp, Mus musculus
agaggcaagaagatcgccaatgccc

SEQ ID NO: 871101 - DNA, 25 bp, Mus musculus
agaggcaagaagttcgccaatgccc

SEQ ID NO: 871102 - DNA, 25 bp, Mus musculus
agaggcacagattcggtcattttat

SEQ ID NO: 871103 - DNA, 25 bp, Mus musculus
agaggcacagtttcggtcattttat

SEQ ID NO: 871104 - DNA, 25 bp, Mus musculus
agaggcacccaacaggctctgggct

SEQ ID NO: 871105 - DNA, 25 bp, Mus musculus
agaggcacccaagaggctctgggct

SEQ ID NO: 871106 - DNA, 25 bp, Mus musculus
agaggcaccgaagacagtgtgaaca

SEQ ID NO: 871107 - DNA, 25 bp, Mus musculus
agaggcaccgaagagagtgtgaaca

SEQ ID NO: 871108 - DNA, 25 bp, Mus musculus
agaggcaccgcgatgtgctggctgc

SEQ ID NO: 871109 - DNA, 25 bp, Mus musculus
agaggcaccgcgcaccgtctgggca

SEQ ID NO: 871110 - DNA, 25 bp, Mus musculus
agaggcaccgcggaccgtctgggca

SEQ ID NO: 871111 - DNA, 25 bp, Mus musculus
agaggcaccgcgttgtgctggctgc

SEQ ID NO: 871112 - DNA, 25 bp, Mus musculus
agaggcactttagaccaaattatga

SEQ ID NO: 871113 - DNA, 25 bp, Mus musculus
agaggcactttagagcaaattatga

SEQ ID NO: 871114 - DNA, 25 bp, Mus musculus
agaggcagacctaacgattcaggcc

SEQ ID NO: 871115 - DNA, 25 bp, Mus musculus
agaggcagacctaaggattcaggcc

SEQ ID NO: 871116 - DNA, 25 bp, Mus musculus
agaggcagacctcactggcttggat

SEQ ID NO: 871117 - DNA, 25 bp, Mus musculus
agaggcagacctcagtggcttggat

SEQ ID NO: 871118 - DNA, 25 bp, Mus musculus
agaggcaggtccaacgcttgagatt

SEQ ID NO: 871119 - DNA, 25 bp, Mus musculus
agaggcaggtccaaggcttgagatt

SEQ ID NO: 871120 - DNA, 25 bp, Mus musculus
agaggccaagcacctgctcactcag

SEQ ID NO: 871121 - DNA, 25 bp, Mus musculus
agaggccaagcatgctggggctgac

SEQ ID NO: 871122 - DNA, 25 bp, Mus musculus
agaggccaaggacctgctcactcag

SEQ ID NO: 871123 - DNA, 25 bp, Mus musculus
agaggccaaggatgctggggctgac

SEQ ID NO: 871124 - DNA, 25 bp, Mus musculus
agaggccagacctccggacagattg

SEQ ID NO: 871125 - DNA, 25 bp, Mus musculus
agaggccagacctcgggacagattg

SEQ ID NO: 871126 - DNA, 25 bp, Mus musculus
agaggccagattcgtggaggttact

SEQ ID NO: 871127 - DNA, 25 bp, Mus musculus
agaggccagattggtggaggttact

SEQ ID NO: 871128 - DNA, 25 bp, Mus musculus
agaggcccagctctgctctggctgc

SEQ ID NO: 871129 - DNA, 25 bp, Mus musculus
agaggcccaggacacctggatcgcc

SEQ ID NO: 871130 - DNA, 25 bp, Mus musculus
agaggcccaggacagctggatcgcc

SEQ ID NO: 871131 - DNA, 25 bp, Mus musculus
agaggcccaggtctgctctggctgc

SEQ ID NO: 871132 - DNA, 25 bp, Mus musculus
agaggcccgacccagccaagggcta

SEQ ID NO: 871133 - DNA, 25 bp, Mus musculus
agaggcccgaccgagccaagggcta

SEQ ID NO: 871134 - DNA, 25 bp, Mus musculus
agaggcccttgccaccctttctgca

SEQ ID NO: 871135 - DNA, 25 bp, Mus musculus
agaggcccttgccagcctttctgca

SEQ ID NO: 871136 - DNA, 25 bp, Mus musculus
agaggcgagaaacatgagacggagt

SEQ ID NO: 871137 - DNA, 25 bp, Mus musculus
agaggcgagaaagatgagacggagt

SEQ ID NO: 871138 - DNA, 25 bp, Mus musculus
agaggcgcaggccgaggtcagacct

SEQ ID NO: 871139 - DNA, 25 bp, Mus musculus
agaggcgcaggcggaggtcagacct

SEQ ID NO: 871140 - DNA, 25 bp, Mus musculus
agaggcggctcacgtgttatagact

SEQ ID NO: 871141 - DNA, 25 bp, Mus musculus
agaggcggctcacgtttctcccatt

SEQ ID NO: 871142 - DNA, 25 bp, Mus musculus
agaggcggctcaggtgttatagact

SEQ ID NO: 871143 - DNA, 25 bp, Mus musculus
agaggcggctcaggtttctcccatt

SEQ ID NO: 871144 - DNA, 25 bp, Mus musculus
agaggctgagaaaataatgttgagt

SEQ ID NO: 871145 - DNA, 25 bp, Mus musculus
agaggctgagcacaaatgagaagca

SEQ ID NO: 871146 - DNA, 25 bp, Mus musculus
agaggctgaggacaaatgagaagca

SEQ ID NO: 871147 - DNA, 25 bp, Mus musculus
agaggctgagtaaataatgttgagt

SEQ ID NO: 871148 - DNA, 25 bp, Mus musculus
agaggctgctcgattatgtccccat

SEQ ID NO: 871149 - DNA, 25 bp, Mus musculus
agaggctgctcgtttatgtccccat

SEQ ID NO: 871150 - DNA, 25 bp, Mus musculus
agaggctgtgcatgaagatgtgcct

SEQ ID NO: 871151 - DNA, 25 bp, Mus musculus
agaggctgtggatgaagatgtgcct

SEQ ID NO: 871152 - DNA, 25 bp, Mus musculus
agaggctgtttcctgcttgtccatt

SEQ ID NO: 871153 - DNA, 25 bp, Mus musculus
agaggctgtttcgtgcttgtccatt

SEQ ID NO: 871154 - DNA, 25 bp, Mus musculus
agaggcttccctcccactcctctgc

SEQ ID NO: 871155 - DNA, 25 bp, Mus musculus
agaggcttccctccgactcctctgc

SEQ ID NO: 871156 - DNA, 25 bp, Mus musculus
agaggcttcctgactttggcaccga

SEQ ID NO: 871157 - DNA, 25 bp, Mus musculus
agaggcttcctgtctttggcaccga

SEQ ID NO: 871158 - DNA, 25 bp, Mus musculus
agagggagagaatatgctggcttat

SEQ ID NO: 871159 - DNA, 25 bp, Mus musculus
agagggagagcctgaagaaacagcc

SEQ ID NO: 871160 - DNA, 25 bp, Mus musculus
agagggagaggctgaagaaacagcc

SEQ ID NO: 871161 - DNA, 25 bp, Mus musculus
agagggagagtatatgctggcttat

SEQ ID NO: 871162 - DNA, 25 bp, Mus musculus
agagggagatccacttaaatggatg

SEQ ID NO: 871163 - DNA, 25 bp, Mus musculus
agagggagatgcacttaaatggatg

SEQ ID NO: 871164 - DNA, 25 bp, Mus musculus
agagggaggaggaacgctatcaagc

SEQ ID NO: 871165 - DNA, 25 bp, Mus musculus
agagggaggaggtacgctatcaagc

SEQ ID NO: 871166 - DNA, 25 bp, Mus musculus
agagggagtagacgaacattgacca

SEQ ID NO: 871167 - DNA, 25 bp, Mus musculus
agagggagtagaggaacattgacca

SEQ ID NO: 871168 - DNA, 25 bp, Mus musculus
agagggatagccccgacagtgagaa

SEQ ID NO: 871169 - DNA, 25 bp, Mus musculus
agagggataggcccgacagtgagaa

SEQ ID NO: 871170 - DNA, 25 bp, Mus musculus
agagggcggagaaacagctctccga

SEQ ID NO: 871171 - DNA, 25 bp, Mus musculus
agagggcggagaaacctctccgagc

SEQ ID NO: 871172 - DNA, 25 bp, Mus musculus
agagggcggagaaagagctctccga

SEQ ID NO: 871173 - DNA, 25 bp, Mus musculus
agagggcggagaaagctctccgagc

SEQ ID NO: 871174 - DNA, 25 bp, Mus musculus
agaggggaagaaaatcggcaccacc

SEQ ID NO: 871175 - DNA, 25 bp, Mus musculus
agaggggaagaacgtggctgtgttc

SEQ ID NO: 871176 - DNA, 25 bp, Mus musculus
agaggggaagaaggtggctgtgttc

SEQ ID NO: 871177 - DNA, 25 bp, Mus musculus
agaggggaagaatatcggcaccacc

SEQ ID NO: 871178 - DNA, 25 bp, Mus musculus
agaggggcagctggcagctcagcag

SEQ ID NO: 871179 - DNA, 25 bp, Mus musculus
agaggggcaggtggcagctcagcag

SEQ ID NO: 871180 - DNA, 25 bp, Mus musculus
agaggggcgcgggactcaccaggct

SEQ ID NO: 871181 - DNA, 25 bp, Mus musculus
agaggggcgcgggagtcaccaggct

SEQ ID NO: 871182 - DNA, 25 bp, Mus musculus
agaggggggctgatcctgggctcac

SEQ ID NO: 871183 - DNA, 25 bp, Mus musculus
agaggggggctgttcctgggctcac

SEQ ID NO: 871184 - DNA, 25 bp, Mus musculus
agaggggttaagagactgtgaagtc

SEQ ID NO: 871185 - DNA, 25 bp, Mus musculus
agaggggttaagtgactgtgaagtc

SEQ ID NO: 871186 - DNA, 25 bp, Mus musculus
agagggtatccacattgcaagaagg

SEQ ID NO: 871187 - DNA, 25 bp, Mus musculus
agagggtatccagattgcaagaagg

SEQ ID NO: 871188 - DNA, 25 bp, Mus musculus
agagggtcagagagatggcacatac

SEQ ID NO: 871189 - DNA, 25 bp, Mus musculus
agagggtcagatccaggaagacagc

SEQ ID NO: 871190 - DNA, 25 bp, Mus musculus
agagggtcagtgagatggcacatac

SEQ ID NO: 871191 - DNA, 25 bp, Mus musculus
agagggtcagttccaggaagacagc

SEQ ID NO: 871192 - DNA, 25 bp, Mus musculus
agaggtaaacagaatagaatccctc

SEQ ID NO: 871193 - DNA, 25 bp, Mus musculus
agaggtaaacagtatagaatccctc

SEQ ID NO: 871194 - DNA, 25 bp, Mus musculus
agaggtacacaaacaagtattcctc

SEQ ID NO: 871195 - DNA, 25 bp, Mus musculus
agaggtacacaatcaagtattcctc

SEQ ID NO: 871196 - DNA, 25 bp, Mus musculus
agaggtcaagcccccacgcatgggc

SEQ ID NO: 871197 - DNA, 25 bp, Mus musculus
agaggtcaaggccccacgcatgggc

SEQ ID NO: 871198 - DNA, 25 bp, Mus musculus
agaggtcacataccgccgaggccgt

SEQ ID NO: 871199 - DNA, 25 bp, Mus musculus
agaggtcacatagcgccgaggccgt

SEQ ID NO: 871200 - DNA, 25 bp, Mus musculus
agaggtccaatgtgcgaacatcagt

SEQ ID NO: 871201 - DNA, 25 bp, Mus musculus
agaggtccaatgtgggaacatcagt

SEQ ID NO: 871202 - DNA, 25 bp, Mus musculus
agaggtgaacagggatgccttcagc

SEQ ID NO: 871203 - DNA, 25 bp, Mus musculus
agaggtgaactgggatgccttcagc

SEQ ID NO: 871204 - DNA, 25 bp, Mus musculus
agaggtgaagcacaatgatatggaa

SEQ ID NO: 871205 - DNA, 25 bp, Mus musculus
agaggtgaagcagaatgatatggaa

SEQ ID NO: 871206 - DNA, 25 bp, Mus musculus
agaggtgagtgcagcagtaagccca

SEQ ID NO: 871207 - DNA, 25 bp, Mus musculus
agaggtgagtgctgcagtaagccca

SEQ ID NO: 871208 - DNA, 25 bp, Mus musculus
agaggtggagagggatgccttttcc

SEQ ID NO: 871209 - DNA, 25 bp, Mus musculus
agaggtggagtgggatgccttttcc

SEQ ID NO: 871210 - DNA, 25 bp, Mus musculus
agaggttcagatctctgctccctac

SEQ ID NO: 871211 - DNA, 25 bp, Mus musculus
agaggttcagttctctgctccctac

SEQ ID NO: 871212 - DNA, 25 bp, Mus musculus
agaggttccatgatcagaatttagg

SEQ ID NO: 871213 - DNA, 25 bp, Mus musculus
agaggttccatgttcagaatttagg

SEQ ID NO: 871214 - DNA, 25 bp, Mus musculus
agaggttctgagtcttaggtcctct

SEQ ID NO: 871215 - DNA, 25 bp, Mus musculus
agaggttctgtgtcttaggtcctct

SEQ ID NO: 871216 - DNA, 25 bp, Mus musculus
agagtaacgacgaatctcacacgct

SEQ ID NO: 871217 - DNA, 25 bp, Mus musculus
agagtaacgacgtatctcacacgct

SEQ ID NO: 871218 - DNA, 25 bp, Mus musculus
agagtaaggacgaatctcacacgct

SEQ ID NO: 871219 - DNA, 25 bp, Mus musculus
agagtaaggacgtatctcacacgct

SEQ ID NO: 871220 - DNA, 25 bp, Mus musculus
agagtaattggctacgtttgagatt

SEQ ID NO: 871221 - DNA, 25 bp, Mus musculus
agagtaattggctaggtttgagatt

SEQ ID NO: 871222 - DNA, 25 bp, Mus musculus
agagtacagcacagcctaaataaaa

SEQ ID NO: 871223 - DNA, 25 bp, Mus musculus
agagtacagcacagcttaccagtgc

SEQ ID NO: 871224 - DNA, 25 bp, Mus musculus
agagtacagcacagcttgctggttg

SEQ ID NO: 871225 - DNA, 25 bp, Mus musculus
agagtacagcacaggctaaataaaa

SEQ ID NO: 871226 - DNA, 25 bp, Mus musculus
agagtacagcacaggttaccagtgc

SEQ ID NO: 871227 - DNA, 25 bp, Mus musculus
agagtacagcacaggttgctggttg

SEQ ID NO: 871228 - DNA, 25 bp, Mus musculus
agagtacatatgagacgaacaccaa

SEQ ID NO: 871229 - DNA, 25 bp, Mus musculus
agagtacatatgagtcgaacaccaa

SEQ ID NO: 871230 - DNA, 25 bp, Mus musculus
agagtacatgtgctttctcctgtac

SEQ ID NO: 871231 - DNA, 25 bp, Mus musculus
agagtacatgtggtttctcctgtac

SEQ ID NO: 871232 - DNA, 25 bp, Mus musculus
agagtaccagccattcctggtctac

SEQ ID NO: 871233 - DNA, 25 bp, Mus musculus
agagtaccaggcattcctggtctac

SEQ ID NO: 871234 - DNA, 25 bp, Mus musculus
agagtacctctgcgcatcttctccg

SEQ ID NO: 871235 - DNA, 25 bp, Mus musculus
agagtacctctgggcatcttctccg

SEQ ID NO: 871236 - DNA, 25 bp, Mus musculus
agagtacgagatcctacctggctgt

SEQ ID NO: 871237 - DNA, 25 bp, Mus musculus
agagtacgagcagttcctacctggc

SEQ ID NO: 871238 - DNA, 25 bp, Mus musculus
agagtacgaggagttcctacctggc

SEQ ID NO: 871239 - DNA, 25 bp, Mus musculus
agagtacgagttcctacctggctgt

SEQ ID NO: 871240 - DNA, 25 bp, Mus musculus
agagtacgggcgtcctagtgtgtca

SEQ ID NO: 871241 - DNA, 25 bp, Mus musculus
agagtacgggggtcctagtgtgtca

SEQ ID NO: 871242 - DNA, 25 bp, Mus musculus
agagtatagtagctatgaccaaggt

SEQ ID NO: 871243 - DNA, 25 bp, Mus musculus
agagtatagtaggtatgaccaaggt

SEQ ID NO: 871244 - DNA, 25 bp, Mus musculus
agagtatatgcagctgtgtgaccca

SEQ ID NO: 871245 - DNA, 25 bp, Mus musculus
agagtatatggagctgtgtgaccca

SEQ ID NO: 871246 - DNA, 25 bp, Mus musculus
agagtatcacaccaaagatgaccac

SEQ ID NO: 871247 - DNA, 25 bp, Mus musculus
agagtatcacaccatagatgaccac

SEQ ID NO: 871248 - DNA, 25 bp, Mus musculus
agagtatgaaaaaacagaagtgagc

SEQ ID NO: 871249 - DNA, 25 bp, Mus musculus
agagtatgaaaaaagagaagtgagc

SEQ ID NO: 871250 - DNA, 25 bp, Mus musculus
agagtatgagaaaataaaggactcc

SEQ ID NO: 871251 - DNA, 25 bp, Mus musculus
agagtatgagaggctgttatgttta

SEQ ID NO: 871252 - DNA, 25 bp, Mus musculus
agagtatgagattctcctcatctat

SEQ ID NO: 871253 - DNA, 25 bp, Mus musculus
agagtatgagcaagaagattccaga

SEQ ID NO: 871254 - DNA, 25 bp, Mus musculus
agagtatgagcagcgagactcctcc

SEQ ID NO: 871255 - DNA, 25 bp, Mus musculus
agagtatgaggaagaagattccaga

SEQ ID NO: 871256 - DNA, 25 bp, Mus musculus
agagtatgaggagcgagactcctcc

SEQ ID NO: 871257 - DNA, 25 bp, Mus musculus
agagtatgagtaaataaaggactcc

SEQ ID NO: 871258 - DNA, 25 bp, Mus musculus
agagtatgagtggctgttatgttta

SEQ ID NO: 871259 - DNA, 25 bp, Mus musculus
agagtatgagtttctcctcatctat

SEQ ID NO: 871260 - DNA, 25 bp, Mus musculus
agagtattaattacagttctccaag

SEQ ID NO: 871261 - DNA, 25 bp, Mus musculus
agagtattaattactgttctccaag

SEQ ID NO: 871262 - DNA, 25 bp, Mus musculus
agagtattctcaaatgcaacaacag

SEQ ID NO: 871263 - DNA, 25 bp, Mus musculus
agagtattctgaaatgcaacaacag

SEQ ID NO: 871264 - DNA, 25 bp, Mus musculus
agagtattttaacgcatacattaaa

SEQ ID NO: 871265 - DNA, 25 bp, Mus musculus
agagtattttaaggcatacattaaa

SEQ ID NO: 871266 - DNA, 25 bp, Mus musculus
agagtcacagaaatcactcaaggac

SEQ ID NO: 871267 - DNA, 25 bp, Mus musculus
agagtcacagctaaagaacgcttct

SEQ ID NO: 871268 - DNA, 25 bp, Mus musculus
agagtcacaggtaaagaacgcttct

SEQ ID NO: 871269 - DNA, 25 bp, Mus musculus
agagtcacagtaatcactcaaggac

SEQ ID NO: 871270 - DNA, 25 bp, Mus musculus
agagtcagaagtcttcgctataaag

SEQ ID NO: 871271 - DNA, 25 bp, Mus musculus
agagtcagaagtgttcgctataaag

SEQ ID NO: 871272 - DNA, 25 bp, Mus musculus
agagtcatgagtcgaaggagtctct

SEQ ID NO: 871273 - DNA, 25 bp, Mus musculus
agagtcatgagtggaaggagtctct

SEQ ID NO: 871274 - DNA, 25 bp, Mus musculus
agagtcattcagctgacaagtgacg

SEQ ID NO: 871275 - DNA, 25 bp, Mus musculus
agagtcattcaggtgacaagtgacg

SEQ ID NO: 871276 - DNA, 25 bp, Mus musculus
agagtccaacagctcagccaacaag

SEQ ID NO: 871277 - DNA, 25 bp, Mus musculus
agagtccaacaggtcagccaacaag

SEQ ID NO: 871278 - DNA, 25 bp, Mus musculus
agagtccatcagcagtttggaacaa

SEQ ID NO: 871279 - DNA, 25 bp, Mus musculus
agagtccatcaggagtttggaacaa

SEQ ID NO: 871280 - DNA, 25 bp, Mus musculus
agagtcccgaagcggacagcttcgt

SEQ ID NO: 871281 - DNA, 25 bp, Mus musculus
agagtcccgaaggggacagcttcgt

SEQ ID NO: 871282 - DNA, 25 bp, Mus musculus
agagtcctgacgattgtgaacaggc

SEQ ID NO: 871283 - DNA, 25 bp, Mus musculus
agagtcctgaggattgtgaacaggc

SEQ ID NO: 871284 - DNA, 25 bp, Mus musculus
agagtcggcctgcacgcctgtcgag

SEQ ID NO: 871285 - DNA, 25 bp, Mus musculus
agagtcggcctgcacgtgcggacct

SEQ ID NO: 871286 - DNA, 25 bp, Mus musculus
agagtcggcctgcactttcaggcct

SEQ ID NO: 871287 - DNA, 25 bp, Mus musculus
agagtcggcctgcaggcctgtcgag

SEQ ID NO: 871288 - DNA, 25 bp, Mus musculus
agagtcggcctgcaggtgcggacct

SEQ ID NO: 871289 - DNA, 25 bp, Mus musculus
agagtcggcctgcagtttcaggcct

SEQ ID NO: 871290 - DNA, 25 bp, Mus musculus
agagtcgtgcaacagcattttgcgg

SEQ ID NO: 871291 - DNA, 25 bp, Mus musculus
agagtcgtgcaagagcattttgcgg

SEQ ID NO: 871292 - DNA, 25 bp, Mus musculus
agagtctaaagaaacataagatcag

SEQ ID NO: 871293 - DNA, 25 bp, Mus musculus
agagtctaaagaaacatcagcatcc

SEQ ID NO: 871294 - DNA, 25 bp, Mus musculus
agagtctaaagaaagataagatcag

SEQ ID NO: 871295 - DNA, 25 bp, Mus musculus
agagtctaaagaaagatcagcatcc

SEQ ID NO: 871296 - DNA, 25 bp, Mus musculus
agagtctgcaggaaaacagcagacc

SEQ ID NO: 871297 - DNA, 25 bp, Mus musculus
agagtctgcaggtaaacagcagacc

SEQ ID NO: 871298 - DNA, 25 bp, Mus musculus
agagtctgtgctgcaggctgtgaca

SEQ ID NO: 871299 - DNA, 25 bp, Mus musculus
agagtctgtggtgcaggctgtgaca

SEQ ID NO: 871300 - DNA, 25 bp, Mus musculus
agagtgaactcacagtgaccacatc

SEQ ID NO: 871301 - DNA, 25 bp, Mus musculus
agagtgaactcagagtgaccacatc

SEQ ID NO: 871302 - DNA, 25 bp, Mus musculus
agagtgaagaagaactcctacctgg

SEQ ID NO: 871303 - DNA, 25 bp, Mus musculus
agagtgaagaagcgagatcatcagt

SEQ ID NO: 871304 - DNA, 25 bp, Mus musculus
agagtgaagaagggagatcatcagt

SEQ ID NO: 871305 - DNA, 25 bp, Mus musculus
agagtgaagaagtactcctacctgg

SEQ ID NO: 871306 - DNA, 25 bp, Mus musculus
agagtgaagcccaaccctccagaac

SEQ ID NO: 871307 - DNA, 25 bp, Mus musculus
agagtgaagcccaagcctccagaac

SEQ ID NO: 871308 - DNA, 25 bp, Mus musculus
agagtgaccattgaccaagaactat

SEQ ID NO: 871309 - DNA, 25 bp, Mus musculus
agagtgaccattgacgttatctggc

SEQ ID NO: 871310 - DNA, 25 bp, Mus musculus
agagtgaccattgagcaagaactat

SEQ ID NO: 871311 - DNA, 25 bp, Mus musculus
agagtgaccattgaggttatctggc

SEQ ID NO: 871312 - DNA, 25 bp, Mus musculus
agagtgacgtctggtctttcgggat

SEQ ID NO: 871313 - DNA, 25 bp, Mus musculus
agagtgacgtgtggtctttcgggat

SEQ ID NO: 871314 - DNA, 25 bp, Mus musculus
agagtgagagaggcatgaaagtcat

SEQ ID NO: 871315 - DNA, 25 bp, Mus musculus
agagtgagagaggtatgaaggtgat

SEQ ID NO: 871316 - DNA, 25 bp, Mus musculus
agagtgagagtggcatgaaagtcat

SEQ ID NO: 871317 - DNA, 25 bp, Mus musculus
agagtgagagtggtatgaaggtgat

SEQ ID NO: 871318 - DNA, 25 bp, Mus musculus
agagtgagatcatcatccaagtctg

SEQ ID NO: 871319 - DNA, 25 bp, Mus musculus
agagtgagatgatcatccaagtctg

SEQ ID NO: 871320 - DNA, 25 bp, Mus musculus
agagtgaggtggcccagacatcaga

SEQ ID NO: 871321 - DNA, 25 bp, Mus musculus
agagtgaggtgggccagacatcaga

SEQ ID NO: 871322 - DNA, 25 bp, Mus musculus
agagtgatgtatggtcttttggtgt

SEQ ID NO: 871323 - DNA, 25 bp, Mus musculus
agagtgatgtttggtcttttggtgt

SEQ ID NO: 871324 - DNA, 25 bp, Mus musculus
agagtgcaagcacttgaatgctgtt

SEQ ID NO: 871325 - DNA, 25 bp, Mus musculus
agagtgcaaggacttgaatgctgtt

SEQ ID NO: 871326 - DNA, 25 bp, Mus musculus
agagtgctgcctgacccctaggacc

SEQ ID NO: 871327 - DNA, 25 bp, Mus musculus
agagtgctgcctgagccctaggacc

SEQ ID NO: 871328 - DNA, 25 bp, Mus musculus
agagtgctggagaataaactgatga

SEQ ID NO: 871329 - DNA, 25 bp, Mus musculus
agagtgctggagtataaactgatga

SEQ ID NO: 871330 - DNA, 25 bp, Mus musculus
agagtggaacagatcgctgtagtgc

SEQ ID NO: 871331 - DNA, 25 bp, Mus musculus
agagtggaacagttcgctgtagtgc

SEQ ID NO: 871332 - DNA, 25 bp, Mus musculus
agagtggatcagatcatcatggcaa

SEQ ID NO: 871333 - DNA, 25 bp, Mus musculus
agagtggatcagttcatcatggcaa

SEQ ID NO: 871334 - DNA, 25 bp, Mus musculus
agagtggcagagcgataccacactc

SEQ ID NO: 871335 - DNA, 25 bp, Mus musculus
agagtggcagagggataccacactc

SEQ ID NO: 871336 - DNA, 25 bp, Mus musculus
agagtgggacatcgggggcttacct

SEQ ID NO: 871337 - DNA, 25 bp, Mus musculus
agagtgggacatggggggcttacct

SEQ ID NO: 871338 - DNA, 25 bp, Mus musculus
agagtggttggacggctacctcagc

SEQ ID NO: 871339 - DNA, 25 bp, Mus musculus
agagtggttggagggctacctcagc

SEQ ID NO: 871340 - DNA, 25 bp, Mus musculus
agagtgtcacaaacaccaatagctg

SEQ ID NO: 871341 - DNA, 25 bp, Mus musculus
agagtgtcacaatcaccaatagctg

SEQ ID NO: 871342 - DNA, 25 bp, Mus musculus
agagtgtgagcccggcgtgtctgtg

SEQ ID NO: 871343 - DNA, 25 bp, Mus musculus
agagtgtgaggccggcgtgtctgtg

SEQ ID NO: 871344 - DNA, 25 bp, Mus musculus
agagtgtgcgccagtgcccgtccag

SEQ ID NO: 871345 - DNA, 25 bp, Mus musculus
agagtgtgcgcctgtgcccgtccag

SEQ ID NO: 871346 - DNA, 25 bp, Mus musculus
agagtgtgtgcacgctatttcaggt

SEQ ID NO: 871347 - DNA, 25 bp, Mus musculus
agagtgtgtgcaggctatttcaggt

SEQ ID NO: 871348 - DNA, 25 bp, Mus musculus
agagttaaagaacatttctggattt

SEQ ID NO: 871349 - DNA, 25 bp, Mus musculus
agagttaaagtacatttctggattt

SEQ ID NO: 871350 - DNA, 25 bp, Mus musculus
agagttaaatagcttaaagcaattg

SEQ ID NO: 871351 - DNA, 25 bp, Mus musculus
agagttaaattgcttaaagcaattg

SEQ ID NO: 871352 - DNA, 25 bp, Mus musculus
agagttaattcacctagaagacgaa

SEQ ID NO: 871353 - DNA, 25 bp, Mus musculus
agagttaattcagctagaagacgaa

SEQ ID NO: 871354 - DNA, 25 bp, Mus musculus
agagttacagcaacgtcatccatgc

SEQ ID NO: 871355 - DNA, 25 bp, Mus musculus
agagttacaggaacgtcatccatgc

SEQ ID NO: 871356 - DNA, 25 bp, Mus musculus
agagttagagcaaccgaagaagccc

SEQ ID NO: 871357 - DNA, 25 bp, Mus musculus
agagttagagcatccgaagaagccc

SEQ ID NO: 871358 - DNA, 25 bp, Mus musculus
agagttagcaagaaacatccatggg

SEQ ID NO: 871359 - DNA, 25 bp, Mus musculus
agagttagcaagaagaaacatccat

SEQ ID NO: 871360 - DNA, 25 bp, Mus musculus
agagttagcaagtaacatccatggg

SEQ ID NO: 871361 - DNA, 25 bp, Mus musculus
agagttagcaagtagaaacatccat

SEQ ID NO: 871362 - DNA, 25 bp, Mus musculus
agagttaggaaacgaaagcactgcc

SEQ ID NO: 871363 - DNA, 25 bp, Mus musculus
agagttaggaaaggaaagcactgcc

SEQ ID NO: 871364 - DNA, 25 bp, Mus musculus
agagttagtgagcacatgtgcatga

SEQ ID NO: 871365 - DNA, 25 bp, Mus musculus
agagttagtgaggacatgtgcatga

SEQ ID NO: 871366 - DNA, 25 bp, Mus musculus
agagttcaagagtaaactggagctg

SEQ ID NO: 871367 - DNA, 25 bp, Mus musculus
agagttcaagcccagcctgtcccca

SEQ ID NO: 871368 - DNA, 25 bp, Mus musculus
agagttcaagcggctgagatttatt

SEQ ID NO: 871369 - DNA, 25 bp, Mus musculus
agagttcaagctgatggtgaacaag

SEQ ID NO: 871370 - DNA, 25 bp, Mus musculus
agagttcaaggccagcctgtcccca

SEQ ID NO: 871371 - DNA, 25 bp, Mus musculus
agagttcaaggggctgagatttatt

SEQ ID NO: 871372 - DNA, 25 bp, Mus musculus
agagttcaaggtgatggtgaacaag

SEQ ID NO: 871373 - DNA, 25 bp, Mus musculus
agagttcaagtgtaaactggagctg

SEQ ID NO: 871374 - DNA, 25 bp, Mus musculus
agagttcatcaccactgtgcaacag

SEQ ID NO: 871375 - DNA, 25 bp, Mus musculus
agagttcatcacgactgtgcaacag

SEQ ID NO: 871376 - DNA, 25 bp, Mus musculus
agagttccagcgtttgctgccaatt

SEQ ID NO: 871377 - DNA, 25 bp, Mus musculus
agagttccagggtttgctgccaatt

SEQ ID NO: 871378 - DNA, 25 bp, Mus musculus
agagttcccaagcatgaacagggct

SEQ ID NO: 871379 - DNA, 25 bp, Mus musculus
agagttcccaaggatgaacagggct

SEQ ID NO: 871380 - DNA, 25 bp, Mus musculus
agagttctcacggagctgacaatca

SEQ ID NO: 871381 - DNA, 25 bp, Mus musculus
agagttctcagggagctgacaatca

SEQ ID NO: 871382 - DNA, 25 bp, Mus musculus
agagttctctctaaacctttgacat

SEQ ID NO: 871383 - DNA, 25 bp, Mus musculus
agagttctctcttaacctttgacat

SEQ ID NO: 871384 - DNA, 25 bp, Mus musculus
agagttctgactgccacatttacat

SEQ ID NO: 871385 - DNA, 25 bp, Mus musculus
agagttctgactgccgttgaaatgg

SEQ ID NO: 871386 - DNA, 25 bp, Mus musculus
agagttctgactgcgacatttacat

SEQ ID NO: 871387 - DNA, 25 bp, Mus musculus
agagttctgactgcggttgaaatgg

SEQ ID NO: 871388 - DNA, 25 bp, Mus musculus
agagtttgagacgctccagcaacag

SEQ ID NO: 871389 - DNA, 25 bp, Mus musculus
agagtttgagtcgctccagcaacag

SEQ ID NO: 871390 - DNA, 25 bp, Mus musculus
agagtttggcagagtatacgaagca

SEQ ID NO: 871391 - DNA, 25 bp, Mus musculus
agagtttggcagagtcaaaggtccc

SEQ ID NO: 871392 - DNA, 25 bp, Mus musculus
agagtttggcagtgtatacgaagca

SEQ ID NO: 871393 - DNA, 25 bp, Mus musculus
agagtttggcagtgtcaaaggtccc

SEQ ID NO: 871394 - DNA, 25 bp, Mus musculus
agagtttgtctgcggcctcaacaag

SEQ ID NO: 871395 - DNA, 25 bp, Mus musculus
agagtttgtctggggcctcaacaag

SEQ ID NO: 871396 - DNA, 25 bp, Mus musculus
agataaaatggagacaggtaagaag

SEQ ID NO: 871397 - DNA, 25 bp, Mus musculus
agataaaatggagactctggatgtg

SEQ ID NO: 871398 - DNA, 25 bp, Mus musculus
agataaaatggagagaggtaagaag

SEQ ID NO: 871399 - DNA, 25 bp, Mus musculus
agataaaatggagagtctggatgtg

SEQ ID NO: 871400 - DNA, 25 bp, Mus musculus
agataaacactaaatttatgtggtt

SEQ ID NO: 871401 - DNA, 25 bp, Mus musculus
agataaacactatatttatgtggtt

SEQ ID NO: 871402 - DNA, 25 bp, Mus musculus
agataaacagatacagacagaagct

SEQ ID NO: 871403 - DNA, 25 bp, Mus musculus
agataaacagttacagacagaagct

SEQ ID NO: 871404 - DNA, 25 bp, Mus musculus
agataaagcgagattcactttcagg

SEQ ID NO: 871405 - DNA, 25 bp, Mus musculus
agataaagcgagcctgaaaggaaat

SEQ ID NO: 871406 - DNA, 25 bp, Mus musculus
agataaagcgaggctgaaaggaaat

SEQ ID NO: 871407 - DNA, 25 bp, Mus musculus
agataaagcgagtttcactttcagg

SEQ ID NO: 871408 - DNA, 25 bp, Mus musculus
agataaccgagccacacccagatgt

SEQ ID NO: 871409 - DNA, 25 bp, Mus musculus
agataaccgagccagacccagatgt

SEQ ID NO: 871410 - DNA, 25 bp, Mus musculus
agataagaaacactgtacatttatt

SEQ ID NO: 871411 - DNA, 25 bp, Mus musculus
agataagaaagactgtacatttatt

SEQ ID NO: 871412 - DNA, 25 bp, Mus musculus
agataagagcgtactctggtgcaag

SEQ ID NO: 871413 - DNA, 25 bp, Mus musculus
agataagagcgttctctggtgcaag

SEQ ID NO: 871414 - DNA, 25 bp, Mus musculus
agataataaaagagagtctgttggg

SEQ ID NO: 871415 - DNA, 25 bp, Mus musculus
agataataaaagtgagtctgttggg

SEQ ID NO: 871416 - DNA, 25 bp, Mus musculus
agataatcagaccaaacctctgata

SEQ ID NO: 871417 - DNA, 25 bp, Mus musculus
agataatcagacggcgcttgcagct

SEQ ID NO: 871418 - DNA, 25 bp, Mus musculus
agataatcagattataccgaaaaga

SEQ ID NO: 871419 - DNA, 25 bp, Mus musculus
agataatcagccgtggggccaattt

SEQ ID NO: 871420 - DNA, 25 bp, Mus musculus
agataatcaggcgtggggccaattt

SEQ ID NO: 871421 - DNA, 25 bp, Mus musculus
agataatcagtccaaacctctgata

SEQ ID NO: 871422 - DNA, 25 bp, Mus musculus
agataatcagtcggcgcttgcagct

SEQ ID NO: 871423 - DNA, 25 bp, Mus musculus
agataatcagtttataccgaaaaga

SEQ ID NO: 871424 - DNA, 25 bp, Mus musculus
agataatgaaagagaactatgagca

SEQ ID NO: 871425 - DNA, 25 bp, Mus musculus
agataatgaaagtgaactatgagca

SEQ ID NO: 871426 - DNA, 25 bp, Mus musculus
agataatgtgaacttgtttttattt

SEQ ID NO: 871427 - DNA, 25 bp, Mus musculus
agataatgtgaagttgtttttattt

SEQ ID NO: 871428 - DNA, 25 bp, Mus musculus
agatacattgctaggtatgggctga

SEQ ID NO: 871429 - DNA, 25 bp, Mus musculus
agatacattggtaggtatgggctga

SEQ ID NO: 871430 - DNA, 25 bp, Mus musculus
agataccaaaaaaagcgaccagttc

SEQ ID NO: 871431 - DNA, 25 bp, Mus musculus
agataccaaaaatagcgaccagttc

SEQ ID NO: 871432 - DNA, 25 bp, Mus musculus
agataccagaatgacgatcccagaa

SEQ ID NO: 871433 - DNA, 25 bp, Mus musculus
agataccagaatgaggatcccagaa

SEQ ID NO: 871434 - DNA, 25 bp, Mus musculus
agatacccaattgtcgtctgccatc

SEQ ID NO: 871435 - DNA, 25 bp, Mus musculus
agatacccaattgtggtctgccatc

SEQ ID NO: 871436 - DNA, 25 bp, Mus musculus
agatacccagagccctgcaactccc

SEQ ID NO: 871437 - DNA, 25 bp, Mus musculus
agatacccagaggcctgcaactccc

SEQ ID NO: 871438 - DNA, 25 bp, Mus musculus
agataccttccacgtgtgaacccca

SEQ ID NO: 871439 - DNA, 25 bp, Mus musculus
agataccttccaggtgtgaacccca

SEQ ID NO: 871440 - DNA, 25 bp, Mus musculus
agatactcataactatggctatgct

SEQ ID NO: 871441 - DNA, 25 bp, Mus musculus
agatactcataagtatggctatgct

SEQ ID NO: 871442 - DNA, 25 bp, Mus musculus
agatactcgagccacgttctctcca

SEQ ID NO: 871443 - DNA, 25 bp, Mus musculus
agatactcgagccaggttctctcca

SEQ ID NO: 871444 - DNA, 25 bp, Mus musculus
agatactgagcgaatttgtaaactg

SEQ ID NO: 871445 - DNA, 25 bp, Mus musculus
agatactgagggaatttgtaaactg

SEQ ID NO: 871446 - DNA, 25 bp, Mus musculus
agatacttgcaacggtgactcagga

SEQ ID NO: 871447 - DNA, 25 bp, Mus musculus
agatacttgcaagggtgactcagga

SEQ ID NO: 871448 - DNA, 25 bp, Mus musculus
agatagactccgtacgggctgagga

SEQ ID NO: 871449 - DNA, 25 bp, Mus musculus
agatagactccgtaggggctgagga

SEQ ID NO: 871450 - DNA, 25 bp, Mus musculus
agatagcaaggacaaagaaaagtca

SEQ ID NO: 871451 - DNA, 25 bp, Mus musculus
agatagcaaggacggattttgaact

SEQ ID NO: 871452 - DNA, 25 bp, Mus musculus
agatagcaaggagaaagaaaagtca

SEQ ID NO: 871453 - DNA, 25 bp, Mus musculus
agatagcaaggagggattttgaact

SEQ ID NO: 871454 - DNA, 25 bp, Mus musculus
agataggcaaggcgcgcctggtgat

SEQ ID NO: 871455 - DNA, 25 bp, Mus musculus
agataggcaaggcgggcctggtgat

SEQ ID NO: 871456 - DNA, 25 bp, Mus musculus
agatagtcatcgccatgatgatgac

SEQ ID NO: 871457 - DNA, 25 bp, Mus musculus
agatagtcatggccatgatgatgac

SEQ ID NO: 871458 - DNA, 25 bp, Mus musculus
agatatagtcatcgtggatgaaagc

SEQ ID NO: 871459 - DNA, 25 bp, Mus musculus
agatatagtcatggtggatgaaagc

SEQ ID NO: 871460 - DNA, 25 bp, Mus musculus
agatatatcaaggaatatgtcactt

SEQ ID NO: 871461 - DNA, 25 bp, Mus musculus
agatatatcatggaatatgtcactt

SEQ ID NO: 871462 - DNA, 25 bp, Mus musculus
agatatatgtccacaacatgggtga

SEQ ID NO: 871463 - DNA, 25 bp, Mus musculus
agatatatgtgcacaacatgggtga

SEQ ID NO: 871464 - DNA, 25 bp, Mus musculus
agatatcaaaaacggaatcttactt

SEQ ID NO: 871465 - DNA, 25 bp, Mus musculus
agatatcaaaaagggaatcttactt

SEQ ID NO: 871466 - DNA, 25 bp, Mus musculus
agatatcctcagagtttgtgcctgt

SEQ ID NO: 871467 - DNA, 25 bp, Mus musculus
agatatcctcagtgtttgtgcctgt

SEQ ID NO: 871468 - DNA, 25 bp, Mus musculus
agatatcctgagcagaggggcaggc

SEQ ID NO: 871469 - DNA, 25 bp, Mus musculus
agatatcctgtgcagaggggcaggc

SEQ ID NO: 871470 - DNA, 25 bp, Mus musculus
agatatctgtaaacaattacatcgt

SEQ ID NO: 871471 - DNA, 25 bp, Mus musculus
agatatctgtaaactattacatcgt

SEQ ID NO: 871472 - DNA, 25 bp, Mus musculus
agatatgcccagccaatagagatgg

SEQ ID NO: 871473 - DNA, 25 bp, Mus musculus
agatatgcccaggcaatagagatgg

SEQ ID NO: 871474 - DNA, 25 bp, Mus musculus
agatattaagcagaactgcctcaac

SEQ ID NO: 871475 - DNA, 25 bp, Mus musculus
agatattaaggagaactgcctcaac

SEQ ID NO: 871476 - DNA, 25 bp, Mus musculus
agatattcagctggatccagaccga

SEQ ID NO: 871477 - DNA, 25 bp, Mus musculus
agatattcaggtggatccagaccga

SEQ ID NO: 871478 - DNA, 25 bp, Mus musculus
agatattcgtgagccctctctgctc

SEQ ID NO: 871479 - DNA, 25 bp, Mus musculus
agatattcgtgagccgcaattcaaa

SEQ ID NO: 871480 - DNA, 25 bp, Mus musculus
agatattcgtgagcgctctctgctc

SEQ ID NO: 871481 - DNA, 25 bp, Mus musculus
agatattcgtgagcggcaattcaaa

SEQ ID NO: 871482 - DNA, 25 bp, Mus musculus
agatattctgcctgcgtgctgtaaa

SEQ ID NO: 871483 - DNA, 25 bp, Mus musculus
agatattctgcctgggtgctgtaaa

SEQ ID NO: 871484 - DNA, 25 bp, Mus musculus
agatcaaaagaatcctcgcaaggcc

SEQ ID NO: 871485 - DNA, 25 bp, Mus musculus
agatcaaaagctcattgagttggtc

SEQ ID NO: 871486 - DNA, 25 bp, Mus musculus
agatcaaaaggtcattgagttggtc

SEQ ID NO: 871487 - DNA, 25 bp, Mus musculus
agatcaaaagtatcctcgcaaggcc

SEQ ID NO: 871488 - DNA, 25 bp, Mus musculus
agatcaaagagcaacagaaagcagc

SEQ ID NO: 871489 - DNA, 25 bp, Mus musculus
agatcaaagagcaagagaaagcagc

SEQ ID NO: 871490 - DNA, 25 bp, Mus musculus
agatcaaagcagctcataaagcaat

SEQ ID NO: 871491 - DNA, 25 bp, Mus musculus
agatcaaagcagctgataaagcaat

SEQ ID NO: 871492 - DNA, 25 bp, Mus musculus
agatcaaaggctcacgttgccaaag

SEQ ID NO: 871493 - DNA, 25 bp, Mus musculus
agatcaaaggctcaggttgccaaag

SEQ ID NO: 871494 - DNA, 25 bp, Mus musculus
agatcaaatatgctgaccttcttcc

SEQ ID NO: 871495 - DNA, 25 bp, Mus musculus
agatcaaatatggtgaccttcttcc

SEQ ID NO: 871496 - DNA, 25 bp, Mus musculus
agatcaacacaacgctgggccaggg

SEQ ID NO: 871497 - DNA, 25 bp, Mus musculus
agatcaacacaaggctgggccaggg

SEQ ID NO: 871498 - DNA, 25 bp, Mus musculus
agatcaacatgaacctgggtggcca

SEQ ID NO: 871499 - DNA, 25 bp, Mus musculus
agatcaacatgaacgtgggtggcca

SEQ ID NO: 871500 - DNA, 25 bp, Mus musculus
agatcaagaaagaggaagactcggc

SEQ ID NO: 871501 - DNA, 25 bp, Mus musculus
agatcaagaaagtggaagactcggc

SEQ ID NO: 871502 - DNA, 25 bp, Mus musculus
agatcaagcatttccgcatgctcca

SEQ ID NO: 871503 - DNA, 25 bp, Mus musculus
agatcaagcatttcggcatgctcca

SEQ ID NO: 871504 - DNA, 25 bp, Mus musculus
agatcaatcaagatgactgtgatga

SEQ ID NO: 871505 - DNA, 25 bp, Mus musculus
agatcaatcaagttgactgtgatga

SEQ ID NO: 871506 - DNA, 25 bp, Mus musculus
agatcacagtccatttccgctatgg

SEQ ID NO: 871507 - DNA, 25 bp, Mus musculus
agatcacagtgcatttccgctatgg

SEQ ID NO: 871508 - DNA, 25 bp, Mus musculus
agatcacatattccccgtatacagc

SEQ ID NO: 871509 - DNA, 25 bp, Mus musculus
agatcacatattgcccgtatacagc

SEQ ID NO: 871510 - DNA, 25 bp, Mus musculus
agatcacatatttaccccgtataca

SEQ ID NO: 871511 - DNA, 25 bp, Mus musculus
agatcacatatttagcccgtataca

SEQ ID NO: 871512 - DNA, 25 bp, Mus musculus
agatcaccaaagatgcatttttgga

SEQ ID NO: 871513 - DNA, 25 bp, Mus musculus
agatcaccaaagttgcatttttgga

SEQ ID NO: 871514 - DNA, 25 bp, Mus musculus
agatcaccacaggacgaggtgttac

SEQ ID NO: 871515 - DNA, 25 bp, Mus musculus
agatcaccacaggacgtgttacagc

SEQ ID NO: 871516 - DNA, 25 bp, Mus musculus
agatcaccacaggaggaggtgttac

SEQ ID NO: 871517 - DNA, 25 bp, Mus musculus
agatcaccacaggaggtgttacagc

SEQ ID NO: 871518 - DNA, 25 bp, Mus musculus
agatcaccacctgtgtggagatgct

SEQ ID NO: 871519 - DNA, 25 bp, Mus musculus
agatcaccacgtgtgtggagatgct

SEQ ID NO: 871520 - DNA, 25 bp, Mus musculus
agatcaccgaagccaacctcaccgg

SEQ ID NO: 871521 - DNA, 25 bp, Mus musculus
agatcaccgaaggcaacctcaccgg

SEQ ID NO: 871522 - DNA, 25 bp, Mus musculus
agatcacttcaactgggtaaagcag

SEQ ID NO: 871523 - DNA, 25 bp, Mus musculus
agatcacttcaagtgggtaaagcag

SEQ ID NO: 871524 - DNA, 25 bp, Mus musculus
agatcagaagcacaattatatgaaa

SEQ ID NO: 871525 - DNA, 25 bp, Mus musculus
agatcagaagccttatggtagcatc

SEQ ID NO: 871526 - DNA, 25 bp, Mus musculus
agatcagaaggacaattatatgaaa

SEQ ID NO: 871527 - DNA, 25 bp, Mus musculus
agatcagaaggcttatggtagcatc

SEQ ID NO: 871528 - DNA, 25 bp, Mus musculus
agatcagacccacgctcttgccatc

SEQ ID NO: 871529 - DNA, 25 bp, Mus musculus
agatcagacccaggctcttgccatc

SEQ ID NO: 871530 - DNA, 25 bp, Mus musculus
agatcagcaagcagattaccaggaa

SEQ ID NO: 871531 - DNA, 25 bp, Mus musculus
agatcagcaagcagcttcaggatct

SEQ ID NO: 871532 - DNA, 25 bp, Mus musculus
agatcagcaagctgattaccaggaa

SEQ ID NO: 871533 - DNA, 25 bp, Mus musculus
agatcagcaagctgcttcaggatct

SEQ ID NO: 871534 - DNA, 25 bp, Mus musculus
agatcagcatacaacggagactctg

SEQ ID NO: 871535 - DNA, 25 bp, Mus musculus
agatcagcatacaagggagactctg

SEQ ID NO: 871536 - DNA, 25 bp, Mus musculus
agatcagcgtggcaccttctatcag

SEQ ID NO: 871537 - DNA, 25 bp, Mus musculus
agatcagcgtggcagcttctatcag

SEQ ID NO: 871538 - DNA, 25 bp, Mus musculus
agatcataaactcctgccccgaatg

SEQ ID NO: 871539 - DNA, 25 bp, Mus musculus
agatcataaagtcctgccccgaatg

SEQ ID NO: 871540 - DNA, 25 bp, Mus musculus
agatcatatacacgagcagtacagt

SEQ ID NO: 871541 - DNA, 25 bp, Mus musculus
agatcatatacaggagcagtacagt

SEQ ID NO: 871542 - DNA, 25 bp, Mus musculus
agatcatcaaaccagaagatttctt

SEQ ID NO: 871543 - DNA, 25 bp, Mus musculus
agatcatcaatccagaagatttctt

SEQ ID NO: 871544 - DNA, 25 bp, Mus musculus
agatcatccaaacgtgcagctagtg

SEQ ID NO: 871545 - DNA, 25 bp, Mus musculus
agatcatccaaaggtgcagctagtg

SEQ ID NO: 871546 - DNA, 25 bp, Mus musculus
agatcatgtcatcacgcagcctgat

SEQ ID NO: 871547 - DNA, 25 bp, Mus musculus
agatcatgtcatcaggcagcctgat

SEQ ID NO: 871548 - DNA, 25 bp, Mus musculus
agatcattagcaaacaggtctcagc

SEQ ID NO: 871549 - DNA, 25 bp, Mus musculus
agatcattagctctcagccactaaa

SEQ ID NO: 871550 - DNA, 25 bp, Mus musculus
agatcattaggaaacaggtctcagc

SEQ ID NO: 871551 - DNA, 25 bp, Mus musculus
agatcattaggtctcagccactaaa

SEQ ID NO: 871552 - DNA, 25 bp, Mus musculus
agatccaagggggtccctgtgggcc

SEQ ID NO: 871553 - DNA, 25 bp, Mus musculus
agatccaagggggtgcctgtgggcc

SEQ ID NO: 871554 - DNA, 25 bp, Mus musculus
agatccacaaagaggcggttacagg

SEQ ID NO: 871555 - DNA, 25 bp, Mus musculus
agatccacaaagtggcggttacagg

SEQ ID NO: 871556 - DNA, 25 bp, Mus musculus
agatccacctagtccctattcttgc

SEQ ID NO: 871557 - DNA, 25 bp, Mus musculus
agatccaccttgtccctattcttgc

SEQ ID NO: 871558 - DNA, 25 bp, Mus musculus
agatccagggacgacattgaagaag

SEQ ID NO: 871559 - DNA, 25 bp, Mus musculus
agatccagggacgagattgaagaag

SEQ ID NO: 871560 - DNA, 25 bp, Mus musculus
agatccatgaaaagcaagatgggca

SEQ ID NO: 871561 - DNA, 25 bp, Mus musculus
agatccatgaaatgcaagatgggca

SEQ ID NO: 871562 - DNA, 25 bp, Mus musculus
agatcccaccagcctgcaacctgaa

SEQ ID NO: 871563 - DNA, 25 bp, Mus musculus
agatcccaccaggctgcaacctgaa

SEQ ID NO: 871564 - DNA, 25 bp, Mus musculus
agatcccaggatatcaatgagtgcc

SEQ ID NO: 871565 - DNA, 25 bp, Mus musculus
agatcccaggttatcaatgagtgcc

SEQ ID NO: 871566 - DNA, 25 bp, Mus musculus
agatccccagagactttgcaatttt

SEQ ID NO: 871567 - DNA, 25 bp, Mus musculus
agatccccagtgactttgcaatttt

SEQ ID NO: 871568 - DNA, 25 bp, Mus musculus
agatcccgctggctggagacctggc

SEQ ID NO: 871569 - DNA, 25 bp, Mus musculus
agatcccgctgggtggagacctggc

SEQ ID NO: 871570 - DNA, 25 bp, Mus musculus
agatccctattaaggcaatgactct

SEQ ID NO: 871571 - DNA, 25 bp, Mus musculus
agatccctattatggcaatgactct

SEQ ID NO: 871572 - DNA, 25 bp, Mus musculus
agatccgaatgaaggagcgagagcg

SEQ ID NO: 871573 - DNA, 25 bp, Mus musculus
agatccgaatgatggagcgagagcg

SEQ ID NO: 871574 - DNA, 25 bp, Mus musculus
agatccgactccagtgcggactgcc

SEQ ID NO: 871575 - DNA, 25 bp, Mus musculus
agatccgactcctgtgcggactgcc

SEQ ID NO: 871576 - DNA, 25 bp, Mus musculus
agatccgagactgtgtgatctgtat

SEQ ID NO: 871577 - DNA, 25 bp, Mus musculus
agatccgagagtgtgtgatctgtat

SEQ ID NO: 871578 - DNA, 25 bp, Mus musculus
agatccgagtcaccccaatcgtctc

SEQ ID NO: 871579 - DNA, 25 bp, Mus musculus
agatccgagtcagcccaatcgtctc

SEQ ID NO: 871580 - DNA, 25 bp, Mus musculus
agatcctcaacttcaaagagcgtgt

SEQ ID NO: 871581 - DNA, 25 bp, Mus musculus
agatcctcaagttcaaagagcgtgt

SEQ ID NO: 871582 - DNA, 25 bp, Mus musculus
agatcctcagcaagaacctgaacaa

SEQ ID NO: 871583 - DNA, 25 bp, Mus musculus
agatcctcaggaagaacctgaacaa

SEQ ID NO: 871584 - DNA, 25 bp, Mus musculus
agatcctccgacagttcaaccagac

SEQ ID NO: 871585 - DNA, 25 bp, Mus musculus
agatcctccgactgttcaaccagac

SEQ ID NO: 871586 - DNA, 25 bp, Mus musculus
agatcctcctagcccacagacgctt

SEQ ID NO: 871587 - DNA, 25 bp, Mus musculus
agatcctccttgcccacagacgctt

SEQ ID NO: 871588 - DNA, 25 bp, Mus musculus
agatcctctgatggagccagagaac

SEQ ID NO: 871589 - DNA, 25 bp, Mus musculus
agatcctctgttggagccagagaac

SEQ ID NO: 871590 - DNA, 25 bp, Mus musculus
agatcctggaggaaccttcgctgcc

SEQ ID NO: 871591 - DNA, 25 bp, Mus musculus
agatcctggaggtaccttcgctgcc

SEQ ID NO: 871592 - DNA, 25 bp, Mus musculus
agatcctgggcgcagtgtatggggt

SEQ ID NO: 871593 - DNA, 25 bp, Mus musculus
agatcctgggggcagtgtatggggt

SEQ ID NO: 871594 - DNA, 25 bp, Mus musculus
agatcgacaacacgttcctacacga

SEQ ID NO: 871595 - DNA, 25 bp, Mus musculus
agatcgacaacaggttcctacacga

SEQ ID NO: 871596 - DNA, 25 bp, Mus musculus
agatcgcctccaccctatttaagag

SEQ ID NO: 871597 - DNA, 25 bp, Mus musculus
agatcgcctccacgccagcagcaac

SEQ ID NO: 871598 - DNA, 25 bp, Mus musculus
agatcgcctccagcctatttaagag

SEQ ID NO: 871599 - DNA, 25 bp, Mus musculus
agatcgcctccaggccagcagcaac

SEQ ID NO: 871600 - DNA, 25 bp, Mus musculus
agatcgccttcacgttgcaggaacc

SEQ ID NO: 871601 - DNA, 25 bp, Mus musculus
agatcgccttcaggttgcaggaacc

SEQ ID NO: 871602 - DNA, 25 bp, Mus musculus
agatcggatccacgccctggggctt

SEQ ID NO: 871603 - DNA, 25 bp, Mus musculus
agatcggatccaggccctggggctt

SEQ ID NO: 871604 - DNA, 25 bp, Mus musculus
agatctaaagccagaaaacctgctc

SEQ ID NO: 871605 - DNA, 25 bp, Mus musculus
agatctaaaggcagaaaacctgctc

SEQ ID NO: 871606 - DNA, 25 bp, Mus musculus
agatctacagcgccctgatggacca

SEQ ID NO: 871607 - DNA, 25 bp, Mus musculus
agatctacagggccctgatggacca

SEQ ID NO: 871608 - DNA, 25 bp, Mus musculus
agatctacgtcctccgaggctatga

SEQ ID NO: 871609 - DNA, 25 bp, Mus musculus
agatctacgtcctcggaggctatga

SEQ ID NO: 871610 - DNA, 25 bp, Mus musculus
agatctatgatgaacaacatgccaa

SEQ ID NO: 871611 - DNA, 25 bp, Mus musculus
agatctatgatgtacaacatgccaa

SEQ ID NO: 871612 - DNA, 25 bp, Mus musculus
agatctatgccgtgcacaacaatta

SEQ ID NO: 871613 - DNA, 25 bp, Mus musculus
agatctatgccgtgcatgaacgggg

SEQ ID NO: 871614 - DNA, 25 bp, Mus musculus
agatctatgccgtggacaacaatta

SEQ ID NO: 871615 - DNA, 25 bp, Mus musculus
agatctatgccgtggatgaacgggg

SEQ ID NO: 871616 - DNA, 25 bp, Mus musculus
agatctcaagatcccagtgggaaaa

SEQ ID NO: 871617 - DNA, 25 bp, Mus musculus
agatctcaagttcccagtgggaaaa

SEQ ID NO: 871618 - DNA, 25 bp, Mus musculus
agatctccaatgctcctgtctctgt

SEQ ID NO: 871619 - DNA, 25 bp, Mus musculus
agatctccaatgctgctgtctctgt

SEQ ID NO: 871620 - DNA, 25 bp, Mus musculus
agatctctacagaggaaggcattac

SEQ ID NO: 871621 - DNA, 25 bp, Mus musculus
agatctctacaggtagggacccgaa

SEQ ID NO: 871622 - DNA, 25 bp, Mus musculus
agatctctacaggttgggacccgaa

SEQ ID NO: 871623 - DNA, 25 bp, Mus musculus
agatctctacagtggaaggcattac

SEQ ID NO: 871624 - DNA, 25 bp, Mus musculus
agatctctggcacgtcaagtccggg

SEQ ID NO: 871625 - DNA, 25 bp, Mus musculus
agatctctggcaggtcaagtccggg

SEQ ID NO: 871626 - DNA, 25 bp, Mus musculus
agatctcttcagcttcctagataga

SEQ ID NO: 871627 - DNA, 25 bp, Mus musculus
agatctcttcaggttcctagataga

SEQ ID NO: 871628 - DNA, 25 bp, Mus musculus
agatctgaaacttgggatggctacc

SEQ ID NO: 871629 - DNA, 25 bp, Mus musculus
agatctgaaagttgggatggctacc

SEQ ID NO: 871630 - DNA, 25 bp, Mus musculus
agatctgaacgaatcgaccaatgac

SEQ ID NO: 871631 - DNA, 25 bp, Mus musculus
agatctgaacgaatggaccaatgac

SEQ ID NO: 871632 - DNA, 25 bp, Mus musculus
agatctggaaaacacgcccacagaa

SEQ ID NO: 871633 - DNA, 25 bp, Mus musculus
agatctggaaaacaggcccacagaa

SEQ ID NO: 871634 - DNA, 25 bp, Mus musculus
agatctggatcacacgagaaaataa

SEQ ID NO: 871635 - DNA, 25 bp, Mus musculus
agatctggatcacaggagaaaataa

SEQ ID NO: 871636 - DNA, 25 bp, Mus musculus
agatctggcgggcaaatatcgtcag

SEQ ID NO: 871637 - DNA, 25 bp, Mus musculus
agatctggcgggcaatggtgaatga

SEQ ID NO: 871638 - DNA, 25 bp, Mus musculus
agatctggcgggcatatatcgtcag

SEQ ID NO: 871639 - DNA, 25 bp, Mus musculus
agatctggcgggcattggtgaatga

SEQ ID NO: 871640 - DNA, 25 bp, Mus musculus
agatctgggagtaacttccttggag

SEQ ID NO: 871641 - DNA, 25 bp, Mus musculus
agatctgggagtaagttccttggag

SEQ ID NO: 871642 - DNA, 25 bp, Mus musculus
agatcttcacactgcgtggcacccc

SEQ ID NO: 871643 - DNA, 25 bp, Mus musculus
agatcttcacactgggtggcacccc

SEQ ID NO: 871644 - DNA, 25 bp, Mus musculus
agatcttctatggacagaaacaacc

SEQ ID NO: 871645 - DNA, 25 bp, Mus musculus
agatcttctatggagagaaacaacc

SEQ ID NO: 871646 - DNA, 25 bp, Mus musculus
agatcttctggagacaagtgtgctg

SEQ ID NO: 871647 - DNA, 25 bp, Mus musculus
agatcttctggagacggcatcatgg

SEQ ID NO: 871648 - DNA, 25 bp, Mus musculus
agatcttctggagagaagtgtgctg

SEQ ID NO: 871649 - DNA, 25 bp, Mus musculus
agatcttctggagagggcatcatgg

SEQ ID NO: 871650 - DNA, 25 bp, Mus musculus
agatcttgcttacatggcaggttca

SEQ ID NO: 871651 - DNA, 25 bp, Mus musculus
agatcttgcttagatggcaggttca

SEQ ID NO: 871652 - DNA, 25 bp, Mus musculus
agatcttgtgctcaagagcaatctg

SEQ ID NO: 871653 - DNA, 25 bp, Mus musculus
agatcttgtggtcaagagcaatctg

SEQ ID NO: 871654 - DNA, 25 bp, Mus musculus
agatgaaacaaactgctgctgcttc

SEQ ID NO: 871655 - DNA, 25 bp, Mus musculus
agatgaaacaaagtgctgctgcttc

SEQ ID NO: 871656 - DNA, 25 bp, Mus musculus
agatgaagaaagcgtccatcttcag

SEQ ID NO: 871657 - DNA, 25 bp, Mus musculus
agatgaagaaagggtccatcttcag

SEQ ID NO: 871658 - DNA, 25 bp, Mus musculus
agatgaagatatcgtaaccgagatc

SEQ ID NO: 871659 - DNA, 25 bp, Mus musculus
agatgaagatatggtaaccgagatc

SEQ ID NO: 871660 - DNA, 25 bp, Mus musculus
agatgaagatcttttcacgaagtac

SEQ ID NO: 871661 - DNA, 25 bp, Mus musculus
agatgaagatgttttcacgaagtac

SEQ ID NO: 871662 - DNA, 25 bp, Mus musculus
agatgaagcagacaccatgacggac

SEQ ID NO: 871663 - DNA, 25 bp, Mus musculus
agatgaagcagacagcatgacggac

SEQ ID NO: 871664 - DNA, 25 bp, Mus musculus
agatgaagcgaacttgcaacagaca

SEQ ID NO: 871665 - DNA, 25 bp, Mus musculus
agatgaagcgaagttgcaacagaca

SEQ ID NO: 871666 - DNA, 25 bp, Mus musculus
agatgaaggaagatgaggaatttaa

SEQ ID NO: 871667 - DNA, 25 bp, Mus musculus
agatgaaggatgatgaggaatttaa

SEQ ID NO: 871668 - DNA, 25 bp, Mus musculus
agatgaagggccagcagaaaacagc

SEQ ID NO: 871669 - DNA, 25 bp, Mus musculus
agatgaaggggcagcagaaaacagc

SEQ ID NO: 871670 - DNA, 25 bp, Mus musculus
agatgaagtagacgtatattcaaga

SEQ ID NO: 871671 - DNA, 25 bp, Mus musculus
agatgaagtagaggtatattcaaga

SEQ ID NO: 871672 - DNA, 25 bp, Mus musculus
agatgaatgtcactcctgatgtgaa

SEQ ID NO: 871673 - DNA, 25 bp, Mus musculus
agatgaatgtcagtcctgatgtgaa

SEQ ID NO: 871674 - DNA, 25 bp, Mus musculus
agatgacaaagtatattccacaaac

SEQ ID NO: 871675 - DNA, 25 bp, Mus musculus
agatgacaaagtttattccacaaac

SEQ ID NO: 871676 - DNA, 25 bp, Mus musculus
agatgacaatcaaactggattatgg

SEQ ID NO: 871677 - DNA, 25 bp, Mus musculus
agatgacaatcatactggattatgg

SEQ ID NO: 871678 - DNA, 25 bp, Mus musculus
agatgacatgataccacatgactcc

SEQ ID NO: 871679 - DNA, 25 bp, Mus musculus
agatgacatgttaccacatgactcc

SEQ ID NO: 871680 - DNA, 25 bp, Mus musculus
agatgaccatgactcgcttgccctg

SEQ ID NO: 871681 - DNA, 25 bp, Mus musculus
agatgaccatgagtcgcttgccctg

SEQ ID NO: 871682 - DNA, 25 bp, Mus musculus
agatgagaaacgcacctcccgtcat

SEQ ID NO: 871683 - DNA, 25 bp, Mus musculus
agatgagaaacggacctcccgtcat

SEQ ID NO: 871684 - DNA, 25 bp, Mus musculus
agatgagagtgagacaggcatgaaa

SEQ ID NO: 871685 - DNA, 25 bp, Mus musculus
agatgagagtgagagaggcatgaaa

SEQ ID NO: 871686 - DNA, 25 bp, Mus musculus
agatgagcaacttctatagtccacc

SEQ ID NO: 871687 - DNA, 25 bp, Mus musculus
agatgagcaagttctatagtccacc

SEQ ID NO: 871688 - DNA, 25 bp, Mus musculus
agatgagcagcctaacatccactta

SEQ ID NO: 871689 - DNA, 25 bp, Mus musculus
agatgagcaggctaacatccactta

SEQ ID NO: 871690 - DNA, 25 bp, Mus musculus
agatgagtctcacgaacctgacaga

SEQ ID NO: 871691 - DNA, 25 bp, Mus musculus
agatgagtctcacgttccacgagta

SEQ ID NO: 871692 - DNA, 25 bp, Mus musculus
agatgagtctcaggaacctgacaga

SEQ ID NO: 871693 - DNA, 25 bp, Mus musculus
agatgagtctcaggttccacgagta

SEQ ID NO: 871694 - DNA, 25 bp, Mus musculus
agatgagtgggacatccacttcaca

SEQ ID NO: 871695 - DNA, 25 bp, Mus musculus
agatgagtgggagatccacttcaca

SEQ ID NO: 871696 - DNA, 25 bp, Mus musculus
agatgagttcaacgccttgctgtat

SEQ ID NO: 871697 - DNA, 25 bp, Mus musculus
agatgagttcaacgtggtggtcgtg

SEQ ID NO: 871698 - DNA, 25 bp, Mus musculus
agatgagttcaaggccttgctgtat

SEQ ID NO: 871699 - DNA, 25 bp, Mus musculus
agatgagttcaaggtggtggtcgtg

SEQ ID NO: 871700 - DNA, 25 bp, Mus musculus
agatgataagcagagaccccctttc

SEQ ID NO: 871701 - DNA, 25 bp, Mus musculus
agatgataagctccagagttcaaat

SEQ ID NO: 871702 - DNA, 25 bp, Mus musculus
agatgataaggagagaccccctttc

SEQ ID NO: 871703 - DNA, 25 bp, Mus musculus
agatgataaggtccagagttcaaat

SEQ ID NO: 871704 - DNA, 25 bp, Mus musculus
agatgatatgctggacaaatttgcc

SEQ ID NO: 871705 - DNA, 25 bp, Mus musculus
agatgatatggtggacaaatttgcc

SEQ ID NO: 871706 - DNA, 25 bp, Mus musculus
agatgatcagagtggtaagaaaagt

SEQ ID NO: 871707 - DNA, 25 bp, Mus musculus
agatgatcagtgtggtaagaaaagt

SEQ ID NO: 871708 - DNA, 25 bp, Mus musculus
agatgatgaaagccctctctatagc

SEQ ID NO: 871709 - DNA, 25 bp, Mus musculus
agatgatgaaaggcctctctatagc

SEQ ID NO: 871710 - DNA, 25 bp, Mus musculus
agatgatgacgatgcatccgtgcca

SEQ ID NO: 871711 - DNA, 25 bp, Mus musculus
agatgatgacgatgctccgtgccac

SEQ ID NO: 871712 - DNA, 25 bp, Mus musculus
agatgatgacgatgctctcccttct

SEQ ID NO: 871713 - DNA, 25 bp, Mus musculus
agatgatgacgatggatccgtgcca

SEQ ID NO: 871714 - DNA, 25 bp, Mus musculus
agatgatgacgatggtccgtgccac

SEQ ID NO: 871715 - DNA, 25 bp, Mus musculus
agatgatgacgatggtctcccttct

SEQ ID NO: 871716 - DNA, 25 bp, Mus musculus
agatgatgtcccagcaccagatgga

SEQ ID NO: 871717 - DNA, 25 bp, Mus musculus
agatgatgtccctgcaccagatgga

SEQ ID NO: 871718 - DNA, 25 bp, Mus musculus
agatgatgttggagatctgaaaaca

SEQ ID NO: 871719 - DNA, 25 bp, Mus musculus
agatgatgttggtgatctgaaaaca

SEQ ID NO: 871720 - DNA, 25 bp, Mus musculus
agatgattcacgatttggaatgcct

SEQ ID NO: 871721 - DNA, 25 bp, Mus musculus
agatgattcaggatttggaatgcct

SEQ ID NO: 871722 - DNA, 25 bp, Mus musculus
agatgcaaagccagaagaagagttc

SEQ ID NO: 871723 - DNA, 25 bp, Mus musculus
agatgcaaaggcagaagaagagttc

SEQ ID NO: 871724 - DNA, 25 bp, Mus musculus
agatgcaaggtgatggggaataata

SEQ ID NO: 871725 - DNA, 25 bp, Mus musculus
agatgcaaggtgttggggaataata

SEQ ID NO: 871726 - DNA, 25 bp, Mus musculus
agatgcaccccgcggcacatggtca

SEQ ID NO: 871727 - DNA, 25 bp, Mus musculus
agatgcaccccggggcacatggtca

SEQ ID NO: 871728 - DNA, 25 bp, Mus musculus
agatgcagagcatcctgctgaactc

SEQ ID NO: 871729 - DNA, 25 bp, Mus musculus
agatgcagaggatcctgctgaactc

SEQ ID NO: 871730 - DNA, 25 bp, Mus musculus
agatgcatctcgcaaatactgctga

SEQ ID NO: 871731 - DNA, 25 bp, Mus musculus
agatgcatctcggaaatactgctga

SEQ ID NO: 871732 - DNA, 25 bp, Mus musculus
agatgcattctttacctattccttt

SEQ ID NO: 871733 - DNA, 25 bp, Mus musculus
agatgcattctttagctattccttt

SEQ ID NO: 871734 - DNA, 25 bp, Mus musculus
agatgccaaaaacggcttcatccgg

SEQ ID NO: 871735 - DNA, 25 bp, Mus musculus
agatgccaaaaagggcttcatccgg

SEQ ID NO: 871736 - DNA, 25 bp, Mus musculus
agatgccaaggtccctcatgtgcct

SEQ ID NO: 871737 - DNA, 25 bp, Mus musculus
agatgccaaggtgcctcatgtgcct

SEQ ID NO: 871738 - DNA, 25 bp, Mus musculus
agatgccaggatgttgatgaatgtg

SEQ ID NO: 871739 - DNA, 25 bp, Mus musculus
agatgccaggttgttgatgaatgtg

SEQ ID NO: 871740 - DNA, 25 bp, Mus musculus
agatgccatttccatcttccactat

SEQ ID NO: 871741 - DNA, 25 bp, Mus musculus
agatgccatttcgatcttccactat

SEQ ID NO: 871742 - DNA, 25 bp, Mus musculus
agatgcccaaatcaacgtccgggtg

SEQ ID NO: 871743 - DNA, 25 bp, Mus musculus
agatgcccaattcaacgtccgggtg

SEQ ID NO: 871744 - DNA, 25 bp, Mus musculus
agatgcccagcaccccttggggaaa

SEQ ID NO: 871745 - DNA, 25 bp, Mus musculus
agatgcccaggaccccttggggaaa

SEQ ID NO: 871746 - DNA, 25 bp, Mus musculus
agatgccgtgctggaatgtaactca

SEQ ID NO: 871747 - DNA, 25 bp, Mus musculus
agatgccgtggtggaatgtaactca

SEQ ID NO: 871748 - DNA, 25 bp, Mus musculus
agatgcctacagcaccggaagcagc

SEQ ID NO: 871749 - DNA, 25 bp, Mus musculus
agatgcctacaggaccggaagcagc

SEQ ID NO: 871750 - DNA, 25 bp, Mus musculus
agatgcgaagatgtggatgagtgtg

SEQ ID NO: 871751 - DNA, 25 bp, Mus musculus
agatgcgaagttgtggatgagtgtg

SEQ ID NO: 871752 - DNA, 25 bp, Mus musculus
agatgcgcagaaagctgtggatgag

SEQ ID NO: 871753 - DNA, 25 bp, Mus musculus
agatgcgcagaatgctgtggatgag

SEQ ID NO: 871754 - DNA, 25 bp, Mus musculus
agatgcgcagctcttgatttggagg

SEQ ID NO: 871755 - DNA, 25 bp, Mus musculus
agatgcgcaggtcttgatttggagg

SEQ ID NO: 871756 - DNA, 25 bp, Mus musculus
agatgcgtggcgcatccatcctaag

SEQ ID NO: 871757 - DNA, 25 bp, Mus musculus
agatgcgtggcggatccatcctaag

SEQ ID NO: 871758 - DNA, 25 bp, Mus musculus
agatgctaaataagttctagaagcc

SEQ ID NO: 871759 - DNA, 25 bp, Mus musculus
agatgctaaatatgttctagaagcc

SEQ ID NO: 871760 - DNA, 25 bp, Mus musculus
agatgctacgagcttccatatcaac

SEQ ID NO: 871761 - DNA, 25 bp, Mus musculus
agatgctacgaggttccatatcaac

SEQ ID NO: 871762 - DNA, 25 bp, Mus musculus
agatgctacgcatgccttccgtgcc

SEQ ID NO: 871763 - DNA, 25 bp, Mus musculus
agatgctacggatgccttccgtgcc

SEQ ID NO: 871764 - DNA, 25 bp, Mus musculus
agatgctagatgcacctgtcattaa

SEQ ID NO: 871765 - DNA, 25 bp, Mus musculus
agatgctagatgcagctgtcattaa

SEQ ID NO: 871766 - DNA, 25 bp, Mus musculus
agatgctcatcgcctacccaccatt

SEQ ID NO: 871767 - DNA, 25 bp, Mus musculus
agatgctcatcggctacccaccatt

SEQ ID NO: 871768 - DNA, 25 bp, Mus musculus
agatgctcggcctgtcatttcgctg

SEQ ID NO: 871769 - DNA, 25 bp, Mus musculus
agatgctcgggctgtcatttcgctg

SEQ ID NO: 871770 - DNA, 25 bp, Mus musculus
agatgctgaaagacaatgcctccga

SEQ ID NO: 871771 - DNA, 25 bp, Mus musculus
agatgctgaaagatgatgcgactga

SEQ ID NO: 871772 - DNA, 25 bp, Mus musculus
agatgctgaaagtcaatgcctccga

SEQ ID NO: 871773 - DNA, 25 bp, Mus musculus
agatgctgaaagttgatgcgactga

SEQ ID NO: 871774 - DNA, 25 bp, Mus musculus
agatgctgaaatcgacagccagaag

SEQ ID NO: 871775 - DNA, 25 bp, Mus musculus
agatgctgaaatggacagccagaag

SEQ ID NO: 871776 - DNA, 25 bp, Mus musculus
agatgctgaatgccaagagctacga

SEQ ID NO: 871777 - DNA, 25 bp, Mus musculus
agatgctgaatggcaagagctacga

SEQ ID NO: 871778 - DNA, 25 bp, Mus musculus
agatgctgcagagcaacatctcaga

SEQ ID NO: 871779 - DNA, 25 bp, Mus musculus
agatgctgcagagctacatctcaga

SEQ ID NO: 871780 - DNA, 25 bp, Mus musculus
agatgctgccctcacgccctgcagt

SEQ ID NO: 871781 - DNA, 25 bp, Mus musculus
agatgctgccctcaggccctgcagt

SEQ ID NO: 871782 - DNA, 25 bp, Mus musculus
agatgctgtacacaagagtgtggaa

SEQ ID NO: 871783 - DNA, 25 bp, Mus musculus
agatgctgtacacagtgtggaaaca

SEQ ID NO: 871784 - DNA, 25 bp, Mus musculus
agatgctgtacagaagagtgtggaa

SEQ ID NO: 871785 - DNA, 25 bp, Mus musculus
agatgctgtacagagtgtggaaaca

SEQ ID NO: 871786 - DNA, 25 bp, Mus musculus
agatgcttctcggacggtctgccag

SEQ ID NO: 871787 - DNA, 25 bp, Mus musculus
agatgcttctcggagggtctgccag

SEQ ID NO: 871788 - DNA, 25 bp, Mus musculus
agatggaaaacacgctgagaatgac

SEQ ID NO: 871789 - DNA, 25 bp, Mus musculus
agatggaaaacaggctgagaatgac

SEQ ID NO: 871790 - DNA, 25 bp, Mus musculus
agatggaaagtgataagaaagattg

SEQ ID NO: 871791 - DNA, 25 bp, Mus musculus
agatggaaagtgttaagaaagattg

SEQ ID NO: 871792 - DNA, 25 bp, Mus musculus
agatggaaccctcaaaaagctggag

SEQ ID NO: 871793 - DNA, 25 bp, Mus musculus
agatggaaccctgaaaaagctggag

SEQ ID NO: 871794 - DNA, 25 bp, Mus musculus
agatggaatctgactctctcctctc

SEQ ID NO: 871795 - DNA, 25 bp, Mus musculus
agatggaatctgtctctctcctctc

SEQ ID NO: 871796 - DNA, 25 bp, Mus musculus
agatggaattataagtactattaat

SEQ ID NO: 871797 - DNA, 25 bp, Mus musculus
agatggaattattagtactattaat

SEQ ID NO: 871798 - DNA, 25 bp, Mus musculus
agatggagaatgctaccgcgcccgg

SEQ ID NO: 871799 - DNA, 25 bp, Mus musculus
agatggagaatggtaccgcgcccgg

SEQ ID NO: 871800 - DNA, 25 bp, Mus musculus
agatggagagcctggaatgacactc

SEQ ID NO: 871801 - DNA, 25 bp, Mus musculus
agatggagaggctggaatgacactc

SEQ ID NO: 871802 - DNA, 25 bp, Mus musculus
agatggagcagacgctccaggagtt

SEQ ID NO: 871803 - DNA, 25 bp, Mus musculus
agatggagcagaggctccaggagtt

SEQ ID NO: 871804 - DNA, 25 bp, Mus musculus
agatggcaaatgagggtgttaatgc

SEQ ID NO: 871805 - DNA, 25 bp, Mus musculus
agatggcaaatgtgggtgttaatgc

SEQ ID NO: 871806 - DNA, 25 bp, Mus musculus
agatggcagcggcggtggcggaggt

SEQ ID NO: 871807 - DNA, 25 bp, Mus musculus
agatggcagcgggggtggcggaggt

SEQ ID NO: 871808 - DNA, 25 bp, Mus musculus
agatggcattgaaggtgaccgaggt

SEQ ID NO: 871809 - DNA, 25 bp, Mus musculus
agatggcattgatggtgaccgaggt

SEQ ID NO: 871810 - DNA, 25 bp, Mus musculus
agatggccatatacgcctactatta

SEQ ID NO: 871811 - DNA, 25 bp, Mus musculus
agatggccatttacgcctactatta

SEQ ID NO: 871812 - DNA, 25 bp, Mus musculus
agatggccctctttgagcaagaagt

SEQ ID NO: 871813 - DNA, 25 bp, Mus musculus
agatggccctgtttgagcaagaagt

SEQ ID NO: 871814 - DNA, 25 bp, Mus musculus
agatggcgtcaccacagtgggcaga

SEQ ID NO: 871815 - DNA, 25 bp, Mus musculus
agatggcgtcaccagagtgggcaga

SEQ ID NO: 871816 - DNA, 25 bp, Mus musculus
agatggctcaaacgcaataataaat

SEQ ID NO: 871817 - DNA, 25 bp, Mus musculus
agatggctcaaaggcaataataaat

SEQ ID NO: 871818 - DNA, 25 bp, Mus musculus
agatgggattcacaagataattgga

SEQ ID NO: 871819 - DNA, 25 bp, Mus musculus
agatgggattcagaagataattgga

SEQ ID NO: 871820 - DNA, 25 bp, Mus musculus
agatgggcagaatcttcgaccgaga

SEQ ID NO: 871821 - DNA, 25 bp, Mus musculus
agatgggcagtatcttcgaccgaga

SEQ ID NO: 871822 - DNA, 25 bp, Mus musculus
agatgggctgtgcctcttaggcagg

SEQ ID NO: 871823 - DNA, 25 bp, Mus musculus
agatgggctgtggctcttaggcagg

SEQ ID NO: 871824 - DNA, 25 bp, Mus musculus
agatggtctgctgtagccgtcctcg

SEQ ID NO: 871825 - DNA, 25 bp, Mus musculus
agatggtctggtgtagccgtcctcg

SEQ ID NO: 871826 - DNA, 25 bp, Mus musculus
agatggtcttctatccccaatatct

SEQ ID NO: 871827 - DNA, 25 bp, Mus musculus
agatggtcttctatgcccaatatct

SEQ ID NO: 871828 - DNA, 25 bp, Mus musculus
agatggtgacacctttctccatatt

SEQ ID NO: 871829 - DNA, 25 bp, Mus musculus
agatggtgacacgtttctccatatt

SEQ ID NO: 871830 - DNA, 25 bp, Mus musculus
agatggtgcccaaccacgtgaaagg

SEQ ID NO: 871831 - DNA, 25 bp, Mus musculus
agatggtgcccatccacgtgaaagg

SEQ ID NO: 871832 - DNA, 25 bp, Mus musculus
agatggtggcaggtcactccagctc

SEQ ID NO: 871833 - DNA, 25 bp, Mus musculus
agatggtggcaggtcggacctgacc

SEQ ID NO: 871834 - DNA, 25 bp, Mus musculus
agatggtggcaggtgactccagctc

SEQ ID NO: 871835 - DNA, 25 bp, Mus musculus
agatggtggcaggtgggacctgacc

SEQ ID NO: 871836 - DNA, 25 bp, Mus musculus
agatgtacaaagcaggaaaagctga

SEQ ID NO: 871837 - DNA, 25 bp, Mus musculus
agatgtacaaaggaggaaaagctga

SEQ ID NO: 871838 - DNA, 25 bp, Mus musculus
agatgtacagcggtggcaaaatatg

SEQ ID NO: 871839 - DNA, 25 bp, Mus musculus
agatgtacagctgggtccttggctg

SEQ ID NO: 871840 - DNA, 25 bp, Mus musculus
agatgtacaggggtggcaaaatatg

SEQ ID NO: 871841 - DNA, 25 bp, Mus musculus
agatgtacaggtgggtccttggctg

SEQ ID NO: 871842 - DNA, 25 bp, Mus musculus
agatgtacctagaaaccatgtgaat

SEQ ID NO: 871843 - DNA, 25 bp, Mus musculus
agatgtaccttgaaaccatgtgaat

SEQ ID NO: 871844 - DNA, 25 bp, Mus musculus
agatgtagcagactgtgatcttgtt

SEQ ID NO: 871845 - DNA, 25 bp, Mus musculus
agatgtagcagagtgtgatcttgtt

SEQ ID NO: 871846 - DNA, 25 bp, Mus musculus
agatgtatcctgcacgctgccccga

SEQ ID NO: 871847 - DNA, 25 bp, Mus musculus
agatgtatcctggacgctgccccga

SEQ ID NO: 871848 - DNA, 25 bp, Mus musculus
agatgtatggcgcgcgcgggaaggg

SEQ ID NO: 871849 - DNA, 25 bp, Mus musculus
agatgtatggcgggcgcgggaaggg

SEQ ID NO: 871850 - DNA, 25 bp, Mus musculus
agatgtcaagaaagcgtgtaccttc

SEQ ID NO: 871851 - DNA, 25 bp, Mus musculus
agatgtcaagatatctgtttcaaat

SEQ ID NO: 871852 - DNA, 25 bp, Mus musculus
agatgtcaagtaagcgtgtaccttc

SEQ ID NO: 871853 - DNA, 25 bp, Mus musculus
agatgtcaagttatctgtttcaaat

SEQ ID NO: 871854 - DNA, 25 bp, Mus musculus
agatgtcacagccgacttttatggc

SEQ ID NO: 871855 - DNA, 25 bp, Mus musculus
agatgtcacagcggacttttatggc

SEQ ID NO: 871856 - DNA, 25 bp, Mus musculus
agatgtcatcaccgtgctcgaacag

SEQ ID NO: 871857 - DNA, 25 bp, Mus musculus
agatgtcatcacggtgctcgaacag

SEQ ID NO: 871858 - DNA, 25 bp, Mus musculus
agatgtcatcagcatccagccatgc

SEQ ID NO: 871859 - DNA, 25 bp, Mus musculus
agatgtcatcaggatccagccatgc

SEQ ID NO: 871860 - DNA, 25 bp, Mus musculus
agatgtcggcaacgtagtcgatagc

SEQ ID NO: 871861 - DNA, 25 bp, Mus musculus
agatgtcggcaaggtagtcgatagc

SEQ ID NO: 871862 - DNA, 25 bp, Mus musculus
agatgtgaagttcaagctgtacgat

SEQ ID NO: 871863 - DNA, 25 bp, Mus musculus
agatgtgaagttcatgctgtacgat

SEQ ID NO: 871864 - DNA, 25 bp, Mus musculus
agatgtgagcagcaggcctctgaag

SEQ ID NO: 871865 - DNA, 25 bp, Mus musculus
agatgtgagcaggaggcctctgaag

SEQ ID NO: 871866 - DNA, 25 bp, Mus musculus
agatgtgatggtcacctctgacgga

SEQ ID NO: 871867 - DNA, 25 bp, Mus musculus
agatgtgatggtcagctctgacgga

SEQ ID NO: 871868 - DNA, 25 bp, Mus musculus
agatgtggagatcacttggactgat

SEQ ID NO: 871869 - DNA, 25 bp, Mus musculus
agatgtggagatcgagtatacaatg

SEQ ID NO: 871870 - DNA, 25 bp, Mus musculus
agatgtggagatgacttggactgat

SEQ ID NO: 871871 - DNA, 25 bp, Mus musculus
agatgtggagatggagtatacaatg

SEQ ID NO: 871872 - DNA, 25 bp, Mus musculus
agatgtggagattctagtgcagctg

SEQ ID NO: 871873 - DNA, 25 bp, Mus musculus
agatgtggagtttctagtgcagctg

SEQ ID NO: 871874 - DNA, 25 bp, Mus musculus
agatgtgtagggcagctgtcccgac

SEQ ID NO: 871875 - DNA, 25 bp, Mus musculus
agatgtgtaggggagctgtcccgac

SEQ ID NO: 871876 - DNA, 25 bp, Mus musculus
agatgtgttggacgtcctggatgac

SEQ ID NO: 871877 - DNA, 25 bp, Mus musculus
agatgtgttggaggtcctggatgac

SEQ ID NO: 871878 - DNA, 25 bp, Mus musculus
agatgttcaaaacgtatgatgctgg

SEQ ID NO: 871879 - DNA, 25 bp, Mus musculus
agatgttcaaaaggtatgatgctgg

SEQ ID NO: 871880 - DNA, 25 bp, Mus musculus
agatgttcacagaacaacagctgct

SEQ ID NO: 871881 - DNA, 25 bp, Mus musculus
agatgttcacagtacaacagctgct

SEQ ID NO: 871882 - DNA, 25 bp, Mus musculus
agatgttcacttcacgtattgacct

SEQ ID NO: 871883 - DNA, 25 bp, Mus musculus
agatgttcacttcacgtgtggacct

SEQ ID NO: 871884 - DNA, 25 bp, Mus musculus
agatgttcacttcaggtattgacct

SEQ ID NO: 871885 - DNA, 25 bp, Mus musculus
agatgttcacttcaggtgtggacct

SEQ ID NO: 871886 - DNA, 25 bp, Mus musculus
agatgttgaaagatgatgccacaga

SEQ ID NO: 871887 - DNA, 25 bp, Mus musculus
agatgttgaaagttgatgccacaga

SEQ ID NO: 871888 - DNA, 25 bp, Mus musculus
agatgttgaagtccgacgcaacgga

SEQ ID NO: 871889 - DNA, 25 bp, Mus musculus
agatgttgaagtgcgacgcaacgga

SEQ ID NO: 871890 - DNA, 25 bp, Mus musculus
agatgttgtcaaagtttatgaacct

SEQ ID NO: 871891 - DNA, 25 bp, Mus musculus
agatgttgtcaatgtttatgaacct

SEQ ID NO: 871892 - DNA, 25 bp, Mus musculus
agatgttgtttccctcttcattaca

SEQ ID NO: 871893 - DNA, 25 bp, Mus musculus
agatgttgtttcgctcttcattaca

SEQ ID NO: 871894 - DNA, 25 bp, Mus musculus
agatgtttcacacggaagcagatga

SEQ ID NO: 871895 - DNA, 25 bp, Mus musculus
agatgtttcacagggaagcagatga

SEQ ID NO: 871896 - DNA, 25 bp, Mus musculus
agattaacccagctccgtacactgt

SEQ ID NO: 871897 - DNA, 25 bp, Mus musculus
agattaacccaggtccgtacactgt

SEQ ID NO: 871898 - DNA, 25 bp, Mus musculus
agattagaagaaaaccacgagctgt

SEQ ID NO: 871899 - DNA, 25 bp, Mus musculus
agattagaagtaaaccacgagctgt

SEQ ID NO: 871900 - DNA, 25 bp, Mus musculus
agattagcagacatgaatgctacca

SEQ ID NO: 871901 - DNA, 25 bp, Mus musculus
agattagcagtcatgaatgctacca

SEQ ID NO: 871902 - DNA, 25 bp, Mus musculus
agattatatcagcttgtacgggatc

SEQ ID NO: 871903 - DNA, 25 bp, Mus musculus
agattatatcaggttgtacgggatc

SEQ ID NO: 871904 - DNA, 25 bp, Mus musculus
agattatgagcgcggaggttgccga

SEQ ID NO: 871905 - DNA, 25 bp, Mus musculus
agattatgagggcggaggttgccga

SEQ ID NO: 871906 - DNA, 25 bp, Mus musculus
agattcaaacagccgtggtgagaag

SEQ ID NO: 871907 - DNA, 25 bp, Mus musculus
agattcaaactgccgtggtgagaag

SEQ ID NO: 871908 - DNA, 25 bp, Mus musculus
agattcaaagccaatgttagtggga

SEQ ID NO: 871909 - DNA, 25 bp, Mus musculus
agattcaaaggcaatgttagtggga

SEQ ID NO: 871910 - DNA, 25 bp, Mus musculus
agattcaagccaaagacaccatagg

SEQ ID NO: 871911 - DNA, 25 bp, Mus musculus
agattcaagccatagacaccatagg

SEQ ID NO: 871912 - DNA, 25 bp, Mus musculus
agattcagagcgctctggaactgct

SEQ ID NO: 871913 - DNA, 25 bp, Mus musculus
agattcagagggctctggaactgct

SEQ ID NO: 871914 - DNA, 25 bp, Mus musculus
agattcaggaagccgcagtggctac

SEQ ID NO: 871915 - DNA, 25 bp, Mus musculus
agattcaggaaggcgcagtggctac

SEQ ID NO: 871916 - DNA, 25 bp, Mus musculus
agattcatcatttgcactttctaaa

SEQ ID NO: 871917 - DNA, 25 bp, Mus musculus
agattcatcatttggactttctaaa

SEQ ID NO: 871918 - DNA, 25 bp, Mus musculus
agattccacaaacgattgttgagct

SEQ ID NO: 871919 - DNA, 25 bp, Mus musculus
agattccacaaaggattgttgagct

SEQ ID NO: 871920 - DNA, 25 bp, Mus musculus
agattccttaacacatgcagatgtc

SEQ ID NO: 871921 - DNA, 25 bp, Mus musculus
agattccttaacagcaacaagtttt

SEQ ID NO: 871922 - DNA, 25 bp, Mus musculus
agattccttaactcatgcagatgtc

SEQ ID NO: 871923 - DNA, 25 bp, Mus musculus
agattccttaactgcaacaagtttt

SEQ ID NO: 871924 - DNA, 25 bp, Mus musculus
agattccttgaggccgtataaaggc

SEQ ID NO: 871925 - DNA, 25 bp, Mus musculus
agattccttgtggccgtataaaggc

SEQ ID NO: 871926 - DNA, 25 bp, Mus musculus
agattcgagccaaattctttgcaac

SEQ ID NO: 871927 - DNA, 25 bp, Mus musculus
agattcgagcgaaattctttgcaac

SEQ ID NO: 871928 - DNA, 25 bp, Mus musculus
agattcgcacagcgcaacctccgca

SEQ ID NO: 871929 - DNA, 25 bp, Mus musculus
agattcgcacagggcaacctccgca

SEQ ID NO: 871930 - DNA, 25 bp, Mus musculus
agattcgctgagctaccatcgtgga

SEQ ID NO: 871931 - DNA, 25 bp, Mus musculus
agattcgctgaggtaccatcgtgga

SEQ ID NO: 871932 - DNA, 25 bp, Mus musculus
agattctacaagcaagacccaagag

SEQ ID NO: 871933 - DNA, 25 bp, Mus musculus
agattctacaagcatgacccaagag

SEQ ID NO: 871934 - DNA, 25 bp, Mus musculus
agattctaccagcaaatgttggctg

SEQ ID NO: 871935 - DNA, 25 bp, Mus musculus
agattctaccaggaaatgttggctg

SEQ ID NO: 871936 - DNA, 25 bp, Mus musculus
agattctccgagcacattccatggc

SEQ ID NO: 871937 - DNA, 25 bp, Mus musculus
agattctccgagcagattccatggc

SEQ ID NO: 871938 - DNA, 25 bp, Mus musculus
agattctgagaccttgctacatctc

SEQ ID NO: 871939 - DNA, 25 bp, Mus musculus
agattctgagccgaatggacccgct

SEQ ID NO: 871940 - DNA, 25 bp, Mus musculus
agattctgaggcgaatggacccgct

SEQ ID NO: 871941 - DNA, 25 bp, Mus musculus
agattctgagtccttgctacatctc

SEQ ID NO: 871942 - DNA, 25 bp, Mus musculus
agattgaagggacgttgcctgttgc

SEQ ID NO: 871943 - DNA, 25 bp, Mus musculus
agattgaagggaggttgcctgttgc

SEQ ID NO: 871944 - DNA, 25 bp, Mus musculus
agattgaatgcgacgacctggccca

SEQ ID NO: 871945 - DNA, 25 bp, Mus musculus
agattgaatgggacgacctggccca

SEQ ID NO: 871946 - DNA, 25 bp, Mus musculus
agattgacaatgaaacccagaaaat

SEQ ID NO: 871947 - DNA, 25 bp, Mus musculus
agattgacaatgaatcccagaaaat

SEQ ID NO: 871948 - DNA, 25 bp, Mus musculus
agattgagcaccacctcttccccac

SEQ ID NO: 871949 - DNA, 25 bp, Mus musculus
agattgagcacctcctcttccccac

SEQ ID NO: 871950 - DNA, 25 bp, Mus musculus
agattgaggaagctatatatcaaga

SEQ ID NO: 871951 - DNA, 25 bp, Mus musculus
agattgaggaaggtatatatcaaga

SEQ ID NO: 871952 - DNA, 25 bp, Mus musculus
agattgcacttccgcgctggccttg

SEQ ID NO: 871953 - DNA, 25 bp, Mus musculus
agattgcacttcggcgctggccttg

SEQ ID NO: 871954 - DNA, 25 bp, Mus musculus
agattgccaagaaccgtatttgaat

SEQ ID NO: 871955 - DNA, 25 bp, Mus musculus
agattgccaagaacggtatttgaat

SEQ ID NO: 871956 - DNA, 25 bp, Mus musculus
agattgccagattctataagcttca

SEQ ID NO: 871957 - DNA, 25 bp, Mus musculus
agattgccagctggaatgtgctggg

SEQ ID NO: 871958 - DNA, 25 bp, Mus musculus
agattgccaggtggaatgtgctggg

SEQ ID NO: 871959 - DNA, 25 bp, Mus musculus
agattgccagtttctataagcttca

SEQ ID NO: 871960 - DNA, 25 bp, Mus musculus
agattgctctcccatcacctgtttg

SEQ ID NO: 871961 - DNA, 25 bp, Mus musculus
agattgctctgccatcacctgtttg

SEQ ID NO: 871962 - DNA, 25 bp, Mus musculus
agattggaagaatcaagatcattat

SEQ ID NO: 871963 - DNA, 25 bp, Mus musculus
agattggaagtatcaagatcattat

SEQ ID NO: 871964 - DNA, 25 bp, Mus musculus
agattggacgcgatatcctacagga

SEQ ID NO: 871965 - DNA, 25 bp, Mus musculus
agattggacgggatatcctacagga

SEQ ID NO: 871966 - DNA, 25 bp, Mus musculus
agattggcagcaagatcaaactgga

SEQ ID NO: 871967 - DNA, 25 bp, Mus musculus
agattggcagcggtgccttctccta

SEQ ID NO: 871968 - DNA, 25 bp, Mus musculus
agattggcaggaagatcaaactgga

SEQ ID NO: 871969 - DNA, 25 bp, Mus musculus
agattggcaggggtgccttctccta

SEQ ID NO: 871970 - DNA, 25 bp, Mus musculus
agattggccatgagttcaagcgctg

SEQ ID NO: 871971 - DNA, 25 bp, Mus musculus
agattggccatgtgttcaagcgctg

SEQ ID NO: 871972 - DNA, 25 bp, Mus musculus
agattggcctggcacgcccttttag

SEQ ID NO: 871973 - DNA, 25 bp, Mus musculus
agattggcctggcaggcccttttag

SEQ ID NO: 871974 - DNA, 25 bp, Mus musculus
agattggcgttttactgaacaacgt

SEQ ID NO: 871975 - DNA, 25 bp, Mus musculus
agattggcgttttagtgaacaacgt

SEQ ID NO: 871976 - DNA, 25 bp, Mus musculus
agattggttgtgcccatcttttgat

SEQ ID NO: 871977 - DNA, 25 bp, Mus musculus
agattggttgtggccatcttttgat

SEQ ID NO: 871978 - DNA, 25 bp, Mus musculus
agattgtctggacatggctgcagca

SEQ ID NO: 871979 - DNA, 25 bp, Mus musculus
agattgtctggagatggctgcagca

SEQ ID NO: 871980 - DNA, 25 bp, Mus musculus
agattgtttttgctcatgggaactt

SEQ ID NO: 871981 - DNA, 25 bp, Mus musculus
agattgtttttgctcatttctaagt

SEQ ID NO: 871982 - DNA, 25 bp, Mus musculus
agattgtttttgctgatgggaactt

SEQ ID NO: 871983 - DNA, 25 bp, Mus musculus
agattgtttttgctgatttctaagt

SEQ ID NO: 871984 - DNA, 25 bp, Mus musculus
agatttattaagcctctcagcaatg

SEQ ID NO: 871985 - DNA, 25 bp, Mus musculus
agatttattaaggctctcagcaatg

SEQ ID NO: 871986 - DNA, 25 bp, Mus musculus
agatttccgatgagttcctggtaca

SEQ ID NO: 871987 - DNA, 25 bp, Mus musculus
agatttccgatgtgttcctggtaca

SEQ ID NO: 871988 - DNA, 25 bp, Mus musculus
agatttcctgagccactgatgcgtt

SEQ ID NO: 871989 - DNA, 25 bp, Mus musculus
agatttcctgaggcactgatgcgtt

SEQ ID NO: 871990 - DNA, 25 bp, Mus musculus
agatttccttgataagtattctctg

SEQ ID NO: 871991 - DNA, 25 bp, Mus musculus
agatttccttgatatgtattctctg

SEQ ID NO: 871992 - DNA, 25 bp, Mus musculus
agatttctgaagcggcttgtcaatg

SEQ ID NO: 871993 - DNA, 25 bp, Mus musculus
agatttctgaaggggcttgtcaatg

SEQ ID NO: 871994 - DNA, 25 bp, Mus musculus
agatttgaagctgggctctgtggaa

SEQ ID NO: 871995 - DNA, 25 bp, Mus musculus
agatttgaaggtgggctctgtggaa

SEQ ID NO: 871996 - DNA, 25 bp, Mus musculus
agatttgaatttcacgatgtttgat

SEQ ID NO: 871997 - DNA, 25 bp, Mus musculus
agatttgaatttcaggatgtttgat

SEQ ID NO: 871998 - DNA, 25 bp, Mus musculus
agatttgcagaccaacgtcgtgcac

SEQ ID NO: 871999 - DNA, 25 bp, Mus musculus
agatttgcagtccaacgtcgtgcac

SEQ ID NO: 872000 - DNA, 25 bp, Mus musculus
agatttggacagattccagcaggag

SEQ ID NO: 872001 - DNA, 25 bp, Mus musculus
agatttggacagcttccttgtgact

SEQ ID NO: 872002 - DNA, 25 bp, Mus musculus
agatttggacaggttccttgtgact

SEQ ID NO: 872003 - DNA, 25 bp, Mus musculus
agatttggacagtttccagcaggag

SEQ ID NO: 872004 - DNA, 25 bp, Mus musculus
agattttagcagctgaatatgacca

SEQ ID NO: 872005 - DNA, 25 bp, Mus musculus
agattttagcagcttcttactgtgt

SEQ ID NO: 872006 - DNA, 25 bp, Mus musculus
agattttagcaggtgaatatgacca

SEQ ID NO: 872007 - DNA, 25 bp, Mus musculus
agattttagcaggttcttactgtgt

SEQ ID NO: 872008 - DNA, 25 bp, Mus musculus
agattttcagggcattgtgcttctt

SEQ ID NO: 872009 - DNA, 25 bp, Mus musculus
agattttcaggggattgtgcttctt

SEQ ID NO: 872010 - DNA, 25 bp, Mus musculus
agcaaaactgaacgatctgaaccaa

SEQ ID NO: 872011 - DNA, 25 bp, Mus musculus
agcaaaactgaacgatggcgtggtt

SEQ ID NO: 872012 - DNA, 25 bp, Mus musculus
agcaaaactgaaggatctgaaccaa

SEQ ID NO: 872013 - DNA, 25 bp, Mus musculus
agcaaaactgaaggatggcgtggtt

SEQ ID NO: 872014 - DNA, 25 bp, Mus musculus
agcaaaagagcgaataattctcttc

SEQ ID NO: 872015 - DNA, 25 bp, Mus musculus
agcaaaagagggaataattctcttc

SEQ ID NO: 872016 - DNA, 25 bp, Mus musculus
agcaaaagccagagcccaggctgtc

SEQ ID NO: 872017 - DNA, 25 bp, Mus musculus
agcaaaagccagagttggaggtgag

SEQ ID NO: 872018 - DNA, 25 bp, Mus musculus
agcaaaagccagtgcccaggctgtc

SEQ ID NO: 872019 - DNA, 25 bp, Mus musculus
agcaaaagccagtgttggaggtgag

SEQ ID NO: 872020 - DNA, 25 bp, Mus musculus
agcaaaatcagccagtacattgtag

SEQ ID NO: 872021 - DNA, 25 bp, Mus musculus
agcaaaatcagcgagtacattgtag

SEQ ID NO: 872022 - DNA, 25 bp, Mus musculus
agcaaaatctcaaattgctcttaaa

SEQ ID NO: 872023 - DNA, 25 bp, Mus musculus
agcaaaatctcatattgctcttaaa

SEQ ID NO: 872024 - DNA, 25 bp, Mus musculus
agcaaacaatcacgctgccgaatct

SEQ ID NO: 872025 - DNA, 25 bp, Mus musculus
agcaaacaatcaggctgccgaatct

SEQ ID NO: 872026 - DNA, 25 bp, Mus musculus
agcaaacataatctgaccccatctc

SEQ ID NO: 872027 - DNA, 25 bp, Mus musculus
agcaaacataatgtgaccccatctc

SEQ ID NO: 872028 - DNA, 25 bp, Mus musculus
agcaaagaagcaaacgataaacaag

SEQ ID NO: 872029 - DNA, 25 bp, Mus musculus
agcaaagaagcaaaggataaacaag

SEQ ID NO: 872030 - DNA, 25 bp, Mus musculus
agcaaagagactgccatcgccagca

SEQ ID NO: 872031 - DNA, 25 bp, Mus musculus
agcaaagagagtgccatcgccagca

SEQ ID NO: 872032 - DNA, 25 bp, Mus musculus
agcaaagatgtacacctgggtcctt

SEQ ID NO: 872033 - DNA, 25 bp, Mus musculus
agcaaagatgtacacgggtggcaaa

SEQ ID NO: 872034 - DNA, 25 bp, Mus musculus
agcaaagatgtacagctgggtcctt

SEQ ID NO: 872035 - DNA, 25 bp, Mus musculus
agcaaagatgtacaggggtggcaaa

SEQ ID NO: 872036 - DNA, 25 bp, Mus musculus
agcaaagctccacacgggatctttc

SEQ ID NO: 872037 - DNA, 25 bp, Mus musculus
agcaaagctccacaggggatctttc

SEQ ID NO: 872038 - DNA, 25 bp, Mus musculus
agcaaaggagagcacggcgcacctg

SEQ ID NO: 872039 - DNA, 25 bp, Mus musculus
agcaaaggagagcagggcgcacctg

SEQ ID NO: 872040 - DNA, 25 bp, Mus musculus
agcaaaggctcacgacagaggcggt

SEQ ID NO: 872041 - DNA, 25 bp, Mus musculus
agcaaaggctcaggacagaggcggt

SEQ ID NO: 872042 - DNA, 25 bp, Mus musculus
agcaaagtgacacgagcaacgccta

SEQ ID NO: 872043 - DNA, 25 bp, Mus musculus
agcaaagtgacaggagcaacgccta

SEQ ID NO: 872044 - DNA, 25 bp, Mus musculus
agcaaagtgtccgtcgatgaccatg

SEQ ID NO: 872045 - DNA, 25 bp, Mus musculus
agcaaagtgtccgtcgtgaacccca

SEQ ID NO: 872046 - DNA, 25 bp, Mus musculus
agcaaagtgtccgtggatgaccatg

SEQ ID NO: 872047 - DNA, 25 bp, Mus musculus
agcaaagtgtccgtggtgaacccca

SEQ ID NO: 872048 - DNA, 25 bp, Mus musculus
agcaaataaaaggaaacagaaggag

SEQ ID NO: 872049 - DNA, 25 bp, Mus musculus
agcaaataaatggaaacagaaggag

SEQ ID NO: 872050 - DNA, 25 bp, Mus musculus
agcaaataagcagacagtgatggca

SEQ ID NO: 872051 - DNA, 25 bp, Mus musculus
agcaaataaggagacagtgatggca

SEQ ID NO: 872052 - DNA, 25 bp, Mus musculus
agcaaataatgacgtccagacctgg

SEQ ID NO: 872053 - DNA, 25 bp, Mus musculus
agcaaataatgaggtccagacctgg

SEQ ID NO: 872054 - DNA, 25 bp, Mus musculus
agcaaatcagaagttacgagactac

SEQ ID NO: 872055 - DNA, 25 bp, Mus musculus
agcaaatcagcaggtgcttgtctgg

SEQ ID NO: 872056 - DNA, 25 bp, Mus musculus
agcaaatcaggaggtgcttgtctgg

SEQ ID NO: 872057 - DNA, 25 bp, Mus musculus
agcaaatcagtagttacgagactac

SEQ ID NO: 872058 - DNA, 25 bp, Mus musculus
agcaaatccagacgatctctctcaa

SEQ ID NO: 872059 - DNA, 25 bp, Mus musculus
agcaaatccagacgtgaaaatccag

SEQ ID NO: 872060 - DNA, 25 bp, Mus musculus
agcaaatccagaggatctctctcaa

SEQ ID NO: 872061 - DNA, 25 bp, Mus musculus
agcaaatccagaggtgaaaatccag

SEQ ID NO: 872062 - DNA, 25 bp, Mus musculus
agcaaatgttggctgaacggctgtt

SEQ ID NO: 872063 - DNA, 25 bp, Mus musculus
agcaaatgttgggtgaacggctgtt

SEQ ID NO: 872064 - DNA, 25 bp, Mus musculus
agcaaattaacacagtgtccaagca

SEQ ID NO: 872065 - DNA, 25 bp, Mus musculus
agcaaattaacagagtgtccaagca

SEQ ID NO: 872066 - DNA, 25 bp, Mus musculus
agcaacaaagcctgtactttggagg

SEQ ID NO: 872067 - DNA, 25 bp, Mus musculus
agcaacaaaggctgtactttggagg

SEQ ID NO: 872068 - DNA, 25 bp, Mus musculus
agcaacaacccgccttttgtcatac

SEQ ID NO: 872069 - DNA, 25 bp, Mus musculus
agcaacaacccggcttttgtcatac

SEQ ID NO: 872070 - DNA, 25 bp, Mus musculus
agcaacagagagtgcactgaccttg

SEQ ID NO: 872071 - DNA, 25 bp, Mus musculus
agcaacagagatcttgcctctcgcc

SEQ ID NO: 872072 - DNA, 25 bp, Mus musculus
agcaacagagtgtgcactgaccttg

SEQ ID NO: 872073 - DNA, 25 bp, Mus musculus
agcaacagagttcttgcctctcgcc

SEQ ID NO: 872074 - DNA, 25 bp, Mus musculus
agcaacagcaggaacacctttggga

SEQ ID NO: 872075 - DNA, 25 bp, Mus musculus
agcaacagcaggaagacctttggga

SEQ ID NO: 872076 - DNA, 25 bp, Mus musculus
agcaacagggatgaagtacaacttg

SEQ ID NO: 872077 - DNA, 25 bp, Mus musculus
agcaacagggttgaagtacaacttg

SEQ ID NO: 872078 - DNA, 25 bp, Mus musculus
agcaacatgaagctcatgtaggaaa

SEQ ID NO: 872079 - DNA, 25 bp, Mus musculus
agcaacatgaaggtcatgtaggaaa

SEQ ID NO: 872080 - DNA, 25 bp, Mus musculus
agcaacatggctgaccctttcagtg

SEQ ID NO: 872081 - DNA, 25 bp, Mus musculus
agcaacatggctgactgctacggag

SEQ ID NO: 872082 - DNA, 25 bp, Mus musculus
agcaacatggctgagcctttcagtg

SEQ ID NO: 872083 - DNA, 25 bp, Mus musculus
agcaacatggctgagtgctacggag

SEQ ID NO: 872084 - DNA, 25 bp, Mus musculus
agcaaccaagcagacagtgatggca

SEQ ID NO: 872085 - DNA, 25 bp, Mus musculus
agcaaccaagctgtgattggactgg

SEQ ID NO: 872086 - DNA, 25 bp, Mus musculus
agcaaccaaggagacagtgatggca

SEQ ID NO: 872087 - DNA, 25 bp, Mus musculus
agcaaccaaggtgtgattggactgg

SEQ ID NO: 872088 - DNA, 25 bp, Mus musculus
agcaaccagaagcaattgagaagcc

SEQ ID NO: 872089 - DNA, 25 bp, Mus musculus
agcaaccagaaggaattgagaagcc

SEQ ID NO: 872090 - DNA, 25 bp, Mus musculus
agcaaccagacagcaccgtactgga

SEQ ID NO: 872091 - DNA, 25 bp, Mus musculus
agcaaccagagagcaccgtactgga

SEQ ID NO: 872092 - DNA, 25 bp, Mus musculus
agcaaccatgcgtgagtgcatctcc

SEQ ID NO: 872093 - DNA, 25 bp, Mus musculus
agcaaccatgggtgagtgcatctcc

SEQ ID NO: 872094 - DNA, 25 bp, Mus musculus
agcaaccctgagcactggaaagaaa

SEQ ID NO: 872095 - DNA, 25 bp, Mus musculus
agcaaccctgaggactggaaagaaa

SEQ ID NO: 872096 - DNA, 25 bp, Mus musculus
agcaacctacaacaacacacagatc

SEQ ID NO: 872097 - DNA, 25 bp, Mus musculus
agcaacctacaacatcacacagatc

SEQ ID NO: 872098 - DNA, 25 bp, Mus musculus
agcaacctatttcactgcttcatgg

SEQ ID NO: 872099 - DNA, 25 bp, Mus musculus
agcaacctatttgactgcttcatgg

SEQ ID NO: 872100 - DNA, 25 bp, Mus musculus
agcaacctccaaccctgaagggcac

SEQ ID NO: 872101 - DNA, 25 bp, Mus musculus
agcaacctccaagcctgaagggcac

SEQ ID NO: 872102 - DNA, 25 bp, Mus musculus
agcaacggtgcgccagcgtgcttcc

SEQ ID NO: 872103 - DNA, 25 bp, Mus musculus
agcaacggtgcggcagcgtgcttcc

SEQ ID NO: 872104 - DNA, 25 bp, Mus musculus
agcaacgtgtccaactcttggctac

SEQ ID NO: 872105 - DNA, 25 bp, Mus musculus
agcaacgtgtccaagtcttggctac

SEQ ID NO: 872106 - DNA, 25 bp, Mus musculus
agcaactatgagctgttccagttac

SEQ ID NO: 872107 - DNA, 25 bp, Mus musculus
agcaactatgaggtgttccagttac

SEQ ID NO: 872108 - DNA, 25 bp, Mus musculus
agcaactgaaaagtgaacttcagct

SEQ ID NO: 872109 - DNA, 25 bp, Mus musculus
agcaactgaatagtgaacttcagct

SEQ ID NO: 872110 - DNA, 25 bp, Mus musculus
agcaactgagagcggagcaaatttt

SEQ ID NO: 872111 - DNA, 25 bp, Mus musculus
agcaactgagaggggagcaaatttt

SEQ ID NO: 872112 - DNA, 25 bp, Mus musculus
agcaactggagatacaactgtttct

SEQ ID NO: 872113 - DNA, 25 bp, Mus musculus
agcaactggagatagaactgtttct

SEQ ID NO: 872114 - DNA, 25 bp, Mus musculus
agcaacttgtcacatgtttctgtgg

SEQ ID NO: 872115 - DNA, 25 bp, Mus musculus
agcaacttgtcagatgtttctgtgg

SEQ ID NO: 872116 - DNA, 25 bp, Mus musculus
agcaagaaagcgaagctgcccatag

SEQ ID NO: 872117 - DNA, 25 bp, Mus musculus
agcaagaaagctacccctgcagtct

SEQ ID NO: 872118 - DNA, 25 bp, Mus musculus
agcaagaaagggaagctgcccatag

SEQ ID NO: 872119 - DNA, 25 bp, Mus musculus
agcaagaaaggtacccctgcagtct

SEQ ID NO: 872120 - DNA, 25 bp, Mus musculus
agcaagaacaccatcagtgagatga

SEQ ID NO: 872121 - DNA, 25 bp, Mus musculus
agcaagaacaccttcagtgagatga

SEQ ID NO: 872122 - DNA, 25 bp, Mus musculus
agcaagaaggacctagaccgcgact

SEQ ID NO: 872123 - DNA, 25 bp, Mus musculus
agcaagaaggctcttgttgcagcat

SEQ ID NO: 872124 - DNA, 25 bp, Mus musculus
agcaagaagggtcttgttgcagcat

SEQ ID NO: 872125 - DNA, 25 bp, Mus musculus
agcaagaaggtcctagaccgcgact

SEQ ID NO: 872126 - DNA, 25 bp, Mus musculus
agcaagaatacacgtatggttttct

SEQ ID NO: 872127 - DNA, 25 bp, Mus musculus
agcaagaatacaggtatggttttct

SEQ ID NO: 872128 - DNA, 25 bp, Mus musculus
agcaagactgggactgaaggtagag

SEQ ID NO: 872129 - DNA, 25 bp, Mus musculus
agcaagactgggtctgaaggtagag

SEQ ID NO: 872130 - DNA, 25 bp, Mus musculus
agcaagagaagaaactagttccagc

SEQ ID NO: 872131 - DNA, 25 bp, Mus musculus
agcaagagaagaaacttccagcagc

SEQ ID NO: 872132 - DNA, 25 bp, Mus musculus
agcaagagaagaaagtagttccagc

SEQ ID NO: 872133 - DNA, 25 bp, Mus musculus
agcaagagaagaaagttccagcagc

SEQ ID NO: 872134 - DNA, 25 bp, Mus musculus
agcaagagagagaaccacgtattgt

SEQ ID NO: 872135 - DNA, 25 bp, Mus musculus
agcaagagagtgaaccacgtattgt

SEQ ID NO: 872136 - DNA, 25 bp, Mus musculus
agcaagagcaagcccatgatgatgc

SEQ ID NO: 872137 - DNA, 25 bp, Mus musculus
agcaagagcaaggccatgatgatgc

SEQ ID NO: 872138 - DNA, 25 bp, Mus musculus
agcaagataaagaagagcagaggaa

SEQ ID NO: 872139 - DNA, 25 bp, Mus musculus
agcaagataaagaagcagaggaaga

SEQ ID NO: 872140 - DNA, 25 bp, Mus musculus
agcaagataaagtagagcagaggaa

SEQ ID NO: 872141 - DNA, 25 bp, Mus musculus
agcaagataaagtagcagaggaaga

SEQ ID NO: 872142 - DNA, 25 bp, Mus musculus
agcaagatcaaacatgatagaacca

SEQ ID NO: 872143 - DNA, 25 bp, Mus musculus
agcaagatcaaagatgatagaacca

SEQ ID NO: 872144 - DNA, 25 bp, Mus musculus
agcaagatccttcgttctcgctgga

SEQ ID NO: 872145 - DNA, 25 bp, Mus musculus
agcaagatccttggttctcgctgga

SEQ ID NO: 872146 - DNA, 25 bp, Mus musculus
agcaagattaaacatgtacaagcat

SEQ ID NO: 872147 - DNA, 25 bp, Mus musculus
agcaagattaaagatgtacaagcat

SEQ ID NO: 872148 - DNA, 25 bp, Mus musculus
agcaagcacaaccgaccagagaact

SEQ ID NO: 872149 - DNA, 25 bp, Mus musculus
agcaagcacaacggaccagagaact

SEQ ID NO: 872150 - DNA, 25 bp, Mus musculus
agcaagcacgcccccagaggtactc

SEQ ID NO: 872151 - DNA, 25 bp, Mus musculus
agcaagcacggccccagaggtactc

SEQ ID NO: 872152 - DNA, 25 bp, Mus musculus
agcaagcacgtgcttgaagacttga

SEQ ID NO: 872153 - DNA, 25 bp, Mus musculus
agcaagcacgtggttgaagacttga

SEQ ID NO: 872154 - DNA, 25 bp, Mus musculus
agcaagccacgagacgtgagggagt

SEQ ID NO: 872155 - DNA, 25 bp, Mus musculus
agcaagccacgagaggtgagggagt

SEQ ID NO: 872156 - DNA, 25 bp, Mus musculus
agcaagccagccactgaaacaccca

SEQ ID NO: 872157 - DNA, 25 bp, Mus musculus
agcaagccaggcactgaaacaccca

SEQ ID NO: 872158 - DNA, 25 bp, Mus musculus
agcaagctgctccactggctggtgg

SEQ ID NO: 872159 - DNA, 25 bp, Mus musculus
agcaagctgctcgactggctggtgg

SEQ ID NO: 872160 - DNA, 25 bp, Mus musculus
agcaagctggaacaagagacttttc

SEQ ID NO: 872161 - DNA, 25 bp, Mus musculus
agcaagctggaacaagctgggaggg

SEQ ID NO: 872162 - DNA, 25 bp, Mus musculus
agcaagctggaacctgaaattaaaa

SEQ ID NO: 872163 - DNA, 25 bp, Mus musculus
agcaagctggaacgggctgcagtgc

SEQ ID NO: 872164 - DNA, 25 bp, Mus musculus
agcaagctggaagaagagacttttc

SEQ ID NO: 872165 - DNA, 25 bp, Mus musculus
agcaagctggaagaagctgggaggg

SEQ ID NO: 872166 - DNA, 25 bp, Mus musculus
agcaagctggaagctgaaattaaaa

SEQ ID NO: 872167 - DNA, 25 bp, Mus musculus
agcaagctggaaggggctgcagtgc

SEQ ID NO: 872168 - DNA, 25 bp, Mus musculus
agcaaggactctcagcgtgagactc

SEQ ID NO: 872169 - DNA, 25 bp, Mus musculus
agcaaggactgtcagcgtgagactc

SEQ ID NO: 872170 - DNA, 25 bp, Mus musculus
agcaaggagagccaggctggactgg

SEQ ID NO: 872171 - DNA, 25 bp, Mus musculus
agcaaggagagcgaggctggactgg

SEQ ID NO: 872172 - DNA, 25 bp, Mus musculus
agcaaggcctggaccaaaaccacga

SEQ ID NO: 872173 - DNA, 25 bp, Mus musculus
agcaaggcctggaccacgctgagca

SEQ ID NO: 872174 - DNA, 25 bp, Mus musculus
agcaaggcctggacgaaaaccacga

SEQ ID NO: 872175 - DNA, 25 bp, Mus musculus
agcaaggcctggacgacgctgagca

SEQ ID NO: 872176 - DNA, 25 bp, Mus musculus
agcaaggctacggacgctatggggc

SEQ ID NO: 872177 - DNA, 25 bp, Mus musculus
agcaaggctacggaggctatggggc

SEQ ID NO: 872178 - DNA, 25 bp, Mus musculus
agcaaggtgacgatgctgcttgttg

SEQ ID NO: 872179 - DNA, 25 bp, Mus musculus
agcaaggtgacgttgctgcttgttg

SEQ ID NO: 872180 - DNA, 25 bp, Mus musculus
agcaagtagctgatattgacgggca

SEQ ID NO: 872181 - DNA, 25 bp, Mus musculus
agcaagtagctgttattgacgggca

SEQ ID NO: 872182 - DNA, 25 bp, Mus musculus
agcaagtgcaagcaatagctgtctg

SEQ ID NO: 872183 - DNA, 25 bp, Mus musculus
agcaagtgcaagccaaaggcagagc

SEQ ID NO: 872184 - DNA, 25 bp, Mus musculus
agcaagtgcaagctttctgaaagac

SEQ ID NO: 872185 - DNA, 25 bp, Mus musculus
agcaagtgcaaggaatagctgtctg

SEQ ID NO: 872186 - DNA, 25 bp, Mus musculus
agcaagtgcaaggcaaaggcagagc

SEQ ID NO: 872187 - DNA, 25 bp, Mus musculus
agcaagtgcaaggtttctgaaagac

SEQ ID NO: 872188 - DNA, 25 bp, Mus musculus
agcaagtggagagacgataccggat

SEQ ID NO: 872189 - DNA, 25 bp, Mus musculus
agcaagtggagagaggataccggat

SEQ ID NO: 872190 - DNA, 25 bp, Mus musculus
agcaagtttgagaacttgtgcaaga

SEQ ID NO: 872191 - DNA, 25 bp, Mus musculus
agcaagtttgagaagttgtgcaaga

SEQ ID NO: 872192 - DNA, 25 bp, Mus musculus
agcaataaagacaccacagtgctac

SEQ ID NO: 872193 - DNA, 25 bp, Mus musculus
agcaataaagacacgacagtgctac

SEQ ID NO: 872194 - DNA, 25 bp, Mus musculus
agcaatacagctccttccaaaattg

SEQ ID NO: 872195 - DNA, 25 bp, Mus musculus
agcaatacaggtccttccaaaattg

SEQ ID NO: 872196 - DNA, 25 bp, Mus musculus
agcaatatacagctcctttctgaca

SEQ ID NO: 872197 - DNA, 25 bp, Mus musculus
agcaatatacaggtcctttctgaca

SEQ ID NO: 872198 - DNA, 25 bp, Mus musculus
agcaatattccacaaaccccacctc

SEQ ID NO: 872199 - DNA, 25 bp, Mus musculus
agcaatattccagaaaccccacctc

SEQ ID NO: 872200 - DNA, 25 bp, Mus musculus
agcaatcatgactgtgggtaagagt

SEQ ID NO: 872201 - DNA, 25 bp, Mus musculus
agcaatcatgtctgtgggtaagagt

SEQ ID NO: 872202 - DNA, 25 bp, Mus musculus
agcaatccaacgatcttatttgagg

SEQ ID NO: 872203 - DNA, 25 bp, Mus musculus
agcaatccaaggatcttatttgagg

SEQ ID NO: 872204 - DNA, 25 bp, Mus musculus
agcaatccatgacatcagggcactg

SEQ ID NO: 872205 - DNA, 25 bp, Mus musculus
agcaatccatgagatcagggcactg

SEQ ID NO: 872206 - DNA, 25 bp, Mus musculus
agcaatgaagcatgtgccacggccc

SEQ ID NO: 872207 - DNA, 25 bp, Mus musculus
agcaatgaaggatgtgccacggccc

SEQ ID NO: 872208 - DNA, 25 bp, Mus musculus
agcaatgataccacagtgctgctgc

SEQ ID NO: 872209 - DNA, 25 bp, Mus musculus
agcaatgataccactgtgctgctgc

SEQ ID NO: 872210 - DNA, 25 bp, Mus musculus
agcaatgccatgcatgtcatcctgc

SEQ ID NO: 872211 - DNA, 25 bp, Mus musculus
agcaatgccatggatgtcatcctgc

SEQ ID NO: 872212 - DNA, 25 bp, Mus musculus
agcaatgtggacctggccatgggca

SEQ ID NO: 872213 - DNA, 25 bp, Mus musculus
agcaatgtggacgtggccatgggca

SEQ ID NO: 872214 - DNA, 25 bp, Mus musculus
agcaatgtgggtcgcctcctcagcc

SEQ ID NO: 872215 - DNA, 25 bp, Mus musculus
agcaatgtgggtggcctcctcagcc

SEQ ID NO: 872216 - DNA, 25 bp, Mus musculus
agcaattaagcaactagaggctgcc

SEQ ID NO: 872217 - DNA, 25 bp, Mus musculus
agcaattaagcgagtggccaggttc

SEQ ID NO: 872218 - DNA, 25 bp, Mus musculus
agcaattaaggaactagaggctgcc

SEQ ID NO: 872219 - DNA, 25 bp, Mus musculus
agcaattaagggagtggccaggttc

SEQ ID NO: 872220 - DNA, 25 bp, Mus musculus
agcaattcgtgcaccgtaacgtacc

SEQ ID NO: 872221 - DNA, 25 bp, Mus musculus
agcaattcgtgcacggtaacgtacc

SEQ ID NO: 872222 - DNA, 25 bp, Mus musculus
agcacaaataatagtgcttacagac

SEQ ID NO: 872223 - DNA, 25 bp, Mus musculus
agcacaaataattgtgcttacagac

SEQ ID NO: 872224 - DNA, 25 bp, Mus musculus
agcacaaatatgcgcgctagcggac

SEQ ID NO: 872225 - DNA, 25 bp, Mus musculus
agcacaaatatgggcgctagcggac

SEQ ID NO: 872226 - DNA, 25 bp, Mus musculus
agcacaacctgtctggagagacaga

SEQ ID NO: 872227 - DNA, 25 bp, Mus musculus
agcacaacctgtctggggagacaga

SEQ ID NO: 872228 - DNA, 25 bp, Mus musculus
agcacaacctgtgtggagagacaga

SEQ ID NO: 872229 - DNA, 25 bp, Mus musculus
agcacaacctgtgtggggagacaga

SEQ ID NO: 872230 - DNA, 25 bp, Mus musculus
agcacaagcatggacatcagtatca

SEQ ID NO: 872231 - DNA, 25 bp, Mus musculus
agcacaagcatggagatcagtatca

SEQ ID NO: 872232 - DNA, 25 bp, Mus musculus
agcacaaggaacagtttgatgaact

SEQ ID NO: 872233 - DNA, 25 bp, Mus musculus
agcacaaggaactgtttgatgaact

SEQ ID NO: 872234 - DNA, 25 bp, Mus musculus
agcacaagggatggtagcaagacca

SEQ ID NO: 872235 - DNA, 25 bp, Mus musculus
agcacaagggcagttggtagcaaga

SEQ ID NO: 872236 - DNA, 25 bp, Mus musculus
agcacaaggggagttggtagcaaga

SEQ ID NO: 872237 - DNA, 25 bp, Mus musculus
agcacaagggttggtagcaagacca

SEQ ID NO: 872238 - DNA, 25 bp, Mus musculus
agcacacagtacctagtcactcgag

SEQ ID NO: 872239 - DNA, 25 bp, Mus musculus
agcacacagttcctagtcactcgag

SEQ ID NO: 872240 - DNA, 25 bp, Mus musculus
agcacacatcaacaaacttgaagaa

SEQ ID NO: 872241 - DNA, 25 bp, Mus musculus
agcacacatcaagaaacttgaagaa

SEQ ID NO: 872242 - DNA, 25 bp, Mus musculus
agcacaccagaactatgccgagtgg

SEQ ID NO: 872243 - DNA, 25 bp, Mus musculus
agcacaccagtactatgccgagtgg

SEQ ID NO: 872244 - DNA, 25 bp, Mus musculus
agcacacgtgctcacagcagagcct

SEQ ID NO: 872245 - DNA, 25 bp, Mus musculus
agcacacgtgctcacccctttgttc

SEQ ID NO: 872246 - DNA, 25 bp, Mus musculus
agcacacgtgctcagagcagagcct

SEQ ID NO: 872247 - DNA, 25 bp, Mus musculus
agcacacgtgctcagccctttgttc

SEQ ID NO: 872248 - DNA, 25 bp, Mus musculus
agcacagcagaatcgccagccgctt

SEQ ID NO: 872249 - DNA, 25 bp, Mus musculus
agcacagcagtatcgccagccgctt

SEQ ID NO: 872250 - DNA, 25 bp, Mus musculus
agcacagccaaacatgaactgacct

SEQ ID NO: 872251 - DNA, 25 bp, Mus musculus
agcacagccaaagatgaactgacct

SEQ ID NO: 872252 - DNA, 25 bp, Mus musculus
agcacagccccacgccagcagagga

SEQ ID NO: 872253 - DNA, 25 bp, Mus musculus
agcacagccccactgctctctctgt

SEQ ID NO: 872254 - DNA, 25 bp, Mus musculus
agcacagccccaggccagcagagga

SEQ ID NO: 872255 - DNA, 25 bp, Mus musculus
agcacagccccagtgctctctctgt

SEQ ID NO: 872256 - DNA, 25 bp, Mus musculus
agcacaggagacaatctggagcaaa

SEQ ID NO: 872257 - DNA, 25 bp, Mus musculus
agcacaggagtcaatctggagcaaa

SEQ ID NO: 872258 - DNA, 25 bp, Mus musculus
agcacagtagatctgttggacagta

SEQ ID NO: 872259 - DNA, 25 bp, Mus musculus
agcacagtagttctgttggacagta

SEQ ID NO: 872260 - DNA, 25 bp, Mus musculus
agcacataattgaacgactgaaagc

SEQ ID NO: 872261 - DNA, 25 bp, Mus musculus
agcacataattgaaggactgaaagc

SEQ ID NO: 872262 - DNA, 25 bp, Mus musculus
agcacatccaaaaacccacctgtgc

SEQ ID NO: 872263 - DNA, 25 bp, Mus musculus
agcacatccaaatacccacctgtgc

SEQ ID NO: 872264 - DNA, 25 bp, Mus musculus
agcacatccacaaggagcttgtgga

SEQ ID NO: 872265 - DNA, 25 bp, Mus musculus
agcacatccagaaggagcttgtgga

SEQ ID NO: 872266 - DNA, 25 bp, Mus musculus
agcacatcccagccttccccagtct

SEQ ID NO: 872267 - DNA, 25 bp, Mus musculus
agcacatcccaggcttccccagtct

SEQ ID NO: 872268 - DNA, 25 bp, Mus musculus
agcacatgatgtcacgaaaccacac

SEQ ID NO: 872269 - DNA, 25 bp, Mus musculus
agcacatgatgtcaggaaaccacac

SEQ ID NO: 872270 - DNA, 25 bp, Mus musculus
agcaccaagcagccttctctccgtg

SEQ ID NO: 872271 - DNA, 25 bp, Mus musculus
agcaccaagcaggcttctctccgtg

SEQ ID NO: 872272 - DNA, 25 bp, Mus musculus
agcaccaattccacactgttcaacc

SEQ ID NO: 872273 - DNA, 25 bp, Mus musculus
agcaccaattcctcactgttcaacc

SEQ ID NO: 872274 - DNA, 25 bp, Mus musculus
agcaccacagcaaaagttgaggtta

SEQ ID NO: 872275 - DNA, 25 bp, Mus musculus
agcaccacaggaaaagttgaggtta

SEQ ID NO: 872276 - DNA, 25 bp, Mus musculus
agcaccacagtatgcgagttatgga

SEQ ID NO: 872277 - DNA, 25 bp, Mus musculus
agcaccacagtatgggagttatgga

SEQ ID NO: 872278 - DNA, 25 bp, Mus musculus
agcaccaccactattgtcaacccca

SEQ ID NO: 872279 - DNA, 25 bp, Mus musculus
agcaccaccagtattgtcaacccca

SEQ ID NO: 872280 - DNA, 25 bp, Mus musculus
agcaccagctctaattcagaccatt

SEQ ID NO: 872281 - DNA, 25 bp, Mus musculus
agcaccagctcttattcagaccatt

SEQ ID NO: 872282 - DNA, 25 bp, Mus musculus
agcaccatgcagcctgtcttctcgt

SEQ ID NO: 872283 - DNA, 25 bp, Mus musculus
agcaccatgcaggctgtcttctcgt

SEQ ID NO: 872284 - DNA, 25 bp, Mus musculus
agcaccattggcagcgacctgattg

SEQ ID NO: 872285 - DNA, 25 bp, Mus musculus
agcaccattggcagggacctgattg

SEQ ID NO: 872286 - DNA, 25 bp, Mus musculus
agcacccaccacaacgtacccagcc

SEQ ID NO: 872287 - DNA, 25 bp, Mus musculus
agcacccaccacaaggtacccagcc

SEQ ID NO: 872288 - DNA, 25 bp, Mus musculus
agcacccagaagcctcagaagcaga

SEQ ID NO: 872289 - DNA, 25 bp, Mus musculus
agcacccagaaggctcagaagcaga

SEQ ID NO: 872290 - DNA, 25 bp, Mus musculus
agcacccgggatacacttttggcgt

SEQ ID NO: 872291 - DNA, 25 bp, Mus musculus
agcacccgggcaggcagagtaagaa

SEQ ID NO: 872292 - DNA, 25 bp, Mus musculus
agcacccggggaggcagagtaagaa

SEQ ID NO: 872293 - DNA, 25 bp, Mus musculus
agcacccgggttacacttttggcgt

SEQ ID NO: 872294 - DNA, 25 bp, Mus musculus
agcacccttgatcaagatttagcgc

SEQ ID NO: 872295 - DNA, 25 bp, Mus musculus
agcacccttgatccagaagatttag

SEQ ID NO: 872296 - DNA, 25 bp, Mus musculus
agcacccttgatgaagatttagcgc

SEQ ID NO: 872297 - DNA, 25 bp, Mus musculus
agcacccttgatgcagaagatttag

SEQ ID NO: 872298 - DNA, 25 bp, Mus musculus
agcaccgacatcaacgactccaaag

SEQ ID NO: 872299 - DNA, 25 bp, Mus musculus
agcaccgacatcaaggactccaaag

SEQ ID NO: 872300 - DNA, 25 bp, Mus musculus
agcaccgcagctatcagcctagcag

SEQ ID NO: 872301 - DNA, 25 bp, Mus musculus
agcaccgcaggtatcagcctagcag

SEQ ID NO: 872302 - DNA, 25 bp, Mus musculus
agcaccggaacaaacatgcctgcaa

SEQ ID NO: 872303 - DNA, 25 bp, Mus musculus
agcaccggaacatacatgcctgcaa

SEQ ID NO: 872304 - DNA, 25 bp, Mus musculus
agcaccggagcgatcccagccactc

SEQ ID NO: 872305 - DNA, 25 bp, Mus musculus
agcaccggagcgttcccagccactc

SEQ ID NO: 872306 - DNA, 25 bp, Mus musculus
agcaccgtggccgcagagtgtgaac

SEQ ID NO: 872307 - DNA, 25 bp, Mus musculus
agcaccgtgggcgcagagtgtgaac

SEQ ID NO: 872308 - DNA, 25 bp, Mus musculus
agcacctaccagaacctagaactgc

SEQ ID NO: 872309 - DNA, 25 bp, Mus musculus
agcacctaccagtacctagaactgc

SEQ ID NO: 872310 - DNA, 25 bp, Mus musculus
agcacctatgcggctgaatgcgacc

SEQ ID NO: 872311 - DNA, 25 bp, Mus musculus
agcacctatggggctgaatgcgacc

SEQ ID NO: 872312 - DNA, 25 bp, Mus musculus
agcacctcagcacgctcaagcaaga

SEQ ID NO: 872313 - DNA, 25 bp, Mus musculus
agcacctcagcaggctcaagcaaga

SEQ ID NO: 872314 - DNA, 25 bp, Mus musculus
agcacctcagctttctaaggacttg

SEQ ID NO: 872315 - DNA, 25 bp, Mus musculus
agcacctcaggtttctaaggacttg

SEQ ID NO: 872316 - DNA, 25 bp, Mus musculus
agcacctcatggagatacattggtc

SEQ ID NO: 872317 - DNA, 25 bp, Mus musculus
agcacctcatggtgatacattggtc

SEQ ID NO: 872318 - DNA, 25 bp, Mus musculus
agcacctccacacagaaaaagctgc

SEQ ID NO: 872319 - DNA, 25 bp, Mus musculus
agcacctccacagagaaaaagctgc

SEQ ID NO: 872320 - DNA, 25 bp, Mus musculus
agcaccttaggactgtaaagagctg

SEQ ID NO: 872321 - DNA, 25 bp, Mus musculus
agcaccttaggagtgtaaagagctg

SEQ ID NO: 872322 - DNA, 25 bp, Mus musculus
agcacgaatgctgcagtctttgtca

SEQ ID NO: 872323 - DNA, 25 bp, Mus musculus
agcacgaatggtgcagtctttgtca

SEQ ID NO: 872324 - DNA, 25 bp, Mus musculus
agcacgacagagggcgtccctcagg

SEQ ID NO: 872325 - DNA, 25 bp, Mus musculus
agcacgacagtgggcgtccctcagg

SEQ ID NO: 872326 - DNA, 25 bp, Mus musculus
agcacgacattgagctgtctcttat

SEQ ID NO: 872327 - DNA, 25 bp, Mus musculus
agcacgacattgtgctgtctcttat

SEQ ID NO: 872328 - DNA, 25 bp, Mus musculus
agcacgacttggctctgctgcgcct

SEQ ID NO: 872329 - DNA, 25 bp, Mus musculus
agcacgacttgggtctgctgcgcct

SEQ ID NO: 872330 - DNA, 25 bp, Mus musculus
agcacgagaacaccgactactgtga

SEQ ID NO: 872331 - DNA, 25 bp, Mus musculus
agcacgagaacagcgactactgtga

SEQ ID NO: 872332 - DNA, 25 bp, Mus musculus
agcacgcgaggaccatgtcatgttg

SEQ ID NO: 872333 - DNA, 25 bp, Mus musculus
agcacgcgaggagcatgtcatgttg

SEQ ID NO: 872334 - DNA, 25 bp, Mus musculus
agcacggggaagctgatctacttta

SEQ ID NO: 872335 - DNA, 25 bp, Mus musculus
agcacggggaaggtgatctacttta

SEQ ID NO: 872336 - DNA, 25 bp, Mus musculus
agcacggggtagagatccattgtag

SEQ ID NO: 872337 - DNA, 25 bp, Mus musculus
agcacggggtagtgatccattgtag

SEQ ID NO: 872338 - DNA, 25 bp, Mus musculus
agcacgtctttgaccatccatggga

SEQ ID NO: 872339 - DNA, 25 bp, Mus musculus
agcacgtctttgacttattggtgca

SEQ ID NO: 872340 - DNA, 25 bp, Mus musculus
agcacgtctttgtccatccatggga

SEQ ID NO: 872341 - DNA, 25 bp, Mus musculus
agcacgtctttgtcttattggtgca

SEQ ID NO: 872342 - DNA, 25 bp, Mus musculus
agcacgtggaacaactgctagccat

SEQ ID NO: 872343 - DNA, 25 bp, Mus musculus
agcacgtggaacaagtgctagccat

SEQ ID NO: 872344 - DNA, 25 bp, Mus musculus
agcacgttcatcgacgacctgaaga

SEQ ID NO: 872345 - DNA, 25 bp, Mus musculus
agcacgttcatcgaggacctgaaga

SEQ ID NO: 872346 - DNA, 25 bp, Mus musculus
agcactaccaagatcacagctgcgg

SEQ ID NO: 872347 - DNA, 25 bp, Mus musculus
agcactaccaagttcacagctgcgg

SEQ ID NO: 872348 - DNA, 25 bp, Mus musculus
agcactaccctgcctgtatcaacct

SEQ ID NO: 872349 - DNA, 25 bp, Mus musculus
agcactaccctggctgtatcaacct

SEQ ID NO: 872350 - DNA, 25 bp, Mus musculus
agcactaccgcgtcctgggcagcgt

SEQ ID NO: 872351 - DNA, 25 bp, Mus musculus
agcactaccgggtcctgggcagcgt

SEQ ID NO: 872352 - DNA, 25 bp, Mus musculus
agcactatgggaaacagattctgaa

SEQ ID NO: 872353 - DNA, 25 bp, Mus musculus
agcactatgggaaagagattctgaa

SEQ ID NO: 872354 - DNA, 25 bp, Mus musculus
agcactccataaactaaagctgcag

SEQ ID NO: 872355 - DNA, 25 bp, Mus musculus
agcactccatctgtgtctgaagaca

SEQ ID NO: 872356 - DNA, 25 bp, Mus musculus
agcactccatgtgtgtctgaagaca

SEQ ID NO: 872357 - DNA, 25 bp, Mus musculus
agcactccattaactaaagctgcag

SEQ ID NO: 872358 - DNA, 25 bp, Mus musculus
agcactcggctttgaaaagagctgt

SEQ ID NO: 872359 - DNA, 25 bp, Mus musculus
agcactcggctttgtaaagagctgt

SEQ ID NO: 872360 - DNA, 25 bp, Mus musculus
agcactcttactcacaggaagaaaa

SEQ ID NO: 872361 - DNA, 25 bp, Mus musculus
agcactcttactcacgaagaaaagt

SEQ ID NO: 872362 - DNA, 25 bp, Mus musculus
agcactcttactcagaggaagaaaa

SEQ ID NO: 872363 - DNA, 25 bp, Mus musculus
agcactcttactcaggaagaaaagt

SEQ ID NO: 872364 - DNA, 25 bp, Mus musculus
agcactggggatgtccagctcgccg

SEQ ID NO: 872365 - DNA, 25 bp, Mus musculus
agcactggggttgtccagctcgccg

SEQ ID NO: 872366 - DNA, 25 bp, Mus musculus
agcactgtcaagcatgtgtttgagt

SEQ ID NO: 872367 - DNA, 25 bp, Mus musculus
agcactgtcaagcggaagatggaga

SEQ ID NO: 872368 - DNA, 25 bp, Mus musculus
agcactgtcaagcttctcatgctgc

SEQ ID NO: 872369 - DNA, 25 bp, Mus musculus
agcactgtcaaggatgtgtttgagt

SEQ ID NO: 872370 - DNA, 25 bp, Mus musculus
agcactgtcaaggggaagatggaga

SEQ ID NO: 872371 - DNA, 25 bp, Mus musculus
agcactgtcaaggttctcatgctgc

SEQ ID NO: 872372 - DNA, 25 bp, Mus musculus
agcactgtggttcgctgggacccac

SEQ ID NO: 872373 - DNA, 25 bp, Mus musculus
agcactgtggttcgtgagcggggca

SEQ ID NO: 872374 - DNA, 25 bp, Mus musculus
agcactgtggttggctgggacccac

SEQ ID NO: 872375 - DNA, 25 bp, Mus musculus
agcactgtggttggtgagcggggca

SEQ ID NO: 872376 - DNA, 25 bp, Mus musculus
agcactgtgttggacatgacatcac

SEQ ID NO: 872377 - DNA, 25 bp, Mus musculus
agcactgtgttggagatgacatcac

SEQ ID NO: 872378 - DNA, 25 bp, Mus musculus
agcacttcagagctgtcttcctgct

SEQ ID NO: 872379 - DNA, 25 bp, Mus musculus
agcacttcagtgctgtcttcctgct

SEQ ID NO: 872380 - DNA, 25 bp, Mus musculus
agcacttcccagaggctccagaaga

SEQ ID NO: 872381 - DNA, 25 bp, Mus musculus
agcacttcccagtggctccagaaga

SEQ ID NO: 872382 - DNA, 25 bp, Mus musculus
agcacttcctttccacttcagttca

SEQ ID NO: 872383 - DNA, 25 bp, Mus musculus
agcacttcctttcctcttcagttca

SEQ ID NO: 872384 - DNA, 25 bp, Mus musculus
agcacttcggatggttcgagtggcc

SEQ ID NO: 872385 - DNA, 25 bp, Mus musculus
agcacttcggcccacaacaatgcta

SEQ ID NO: 872386 - DNA, 25 bp, Mus musculus
agcacttcggcccagaacaatgcta

SEQ ID NO: 872387 - DNA, 25 bp, Mus musculus
agcacttcggttggttcgagtggcc

SEQ ID NO: 872388 - DNA, 25 bp, Mus musculus
agcacttggagtcgtgaatcaaaga

SEQ ID NO: 872389 - DNA, 25 bp, Mus musculus
agcacttggagtggtgaatcaaaga

SEQ ID NO: 872390 - DNA, 25 bp, Mus musculus
agcacttgtgaaatttctgatttgt

SEQ ID NO: 872391 - DNA, 25 bp, Mus musculus
agcacttgtgaattttctgatttgt

SEQ ID NO: 872392 - DNA, 25 bp, Mus musculus
agcactttgcagcttggtgagacca

SEQ ID NO: 872393 - DNA, 25 bp, Mus musculus
agcactttgcaggttggtgagacca

SEQ ID NO: 872394 - DNA, 25 bp, Mus musculus
agcacttttcctatgatcgctgcca

SEQ ID NO: 872395 - DNA, 25 bp, Mus musculus
agcacttttcctttgatcgctgcca

SEQ ID NO: 872396 - DNA, 25 bp, Mus musculus
agcacttttgagcacaagtgcagcc

SEQ ID NO: 872397 - DNA, 25 bp, Mus musculus
agcacttttgcactacattgcagaa

SEQ ID NO: 872398 - DNA, 25 bp, Mus musculus
agcacttttggactacattgcagaa

SEQ ID NO: 872399 - DNA, 25 bp, Mus musculus
agcacttttgtgcacaagtgcagcc

SEQ ID NO: 872400 - DNA, 25 bp, Mus musculus
agcagaaaaaaacgtttatgaagct

SEQ ID NO: 872401 - DNA, 25 bp, Mus musculus
agcagaaaaaaaggtttatgaagct

SEQ ID NO: 872402 - DNA, 25 bp, Mus musculus
agcagaaaaccgcttgctgtggttc

SEQ ID NO: 872403 - DNA, 25 bp, Mus musculus
agcagaaaaccggttgctgtggttc

SEQ ID NO: 872404 - DNA, 25 bp, Mus musculus
agcagaaaagaaatatggaaggtga

SEQ ID NO: 872405 - DNA, 25 bp, Mus musculus
agcagaaaagaacggactgaccatg

SEQ ID NO: 872406 - DNA, 25 bp, Mus musculus
agcagaaaagaagggactgaccatg

SEQ ID NO: 872407 - DNA, 25 bp, Mus musculus
agcagaaaagtaatatggaaggtga

SEQ ID NO: 872408 - DNA, 25 bp, Mus musculus
agcagaaaattaaacagtacatcca

SEQ ID NO: 872409 - DNA, 25 bp, Mus musculus
agcagaaaattaaagagtacatcca

SEQ ID NO: 872410 - DNA, 25 bp, Mus musculus
agcagaaagagacagaacgaattcg

SEQ ID NO: 872411 - DNA, 25 bp, Mus musculus
agcagaaagagagagaacgaattcg

SEQ ID NO: 872412 - DNA, 25 bp, Mus musculus
agcagaaatgaaatgggctcggtgt

SEQ ID NO: 872413 - DNA, 25 bp, Mus musculus
agcagaaatgaacctctgattgctc

SEQ ID NO: 872414 - DNA, 25 bp, Mus musculus
agcagaaatgaagctctgattgctc

SEQ ID NO: 872415 - DNA, 25 bp, Mus musculus
agcagaaatgaattgggctcggtgt

SEQ ID NO: 872416 - DNA, 25 bp, Mus musculus
agcagaaatgcacaaagtttttaaa

SEQ ID NO: 872417 - DNA, 25 bp, Mus musculus
agcagaaatgcagaaagtttttaaa

SEQ ID NO: 872418 - DNA, 25 bp, Mus musculus
agcagaacagctgtttggatttgtg

SEQ ID NO: 872419 - DNA, 25 bp, Mus musculus
agcagaacaggtgtttggatttgtg

SEQ ID NO: 872420 - DNA, 25 bp, Mus musculus
agcagaagaaaaatcagatgtccaa

SEQ ID NO: 872421 - DNA, 25 bp, Mus musculus
agcagaagaaaacaagaaacaagag

SEQ ID NO: 872422 - DNA, 25 bp, Mus musculus
agcagaagaaaagaagaaacaagag

SEQ ID NO: 872423 - DNA, 25 bp, Mus musculus
agcagaagaaaattcagatgtccaa

SEQ ID NO: 872424 - DNA, 25 bp, Mus musculus
agcagaagagtgcgacggctgttct

SEQ ID NO: 872425 - DNA, 25 bp, Mus musculus
agcagaagagtgggacggctgttct

SEQ ID NO: 872426 - DNA, 25 bp, Mus musculus
agcagaagccccaccaccaaagatc

SEQ ID NO: 872427 - DNA, 25 bp, Mus musculus
agcagaagccgcaccaccaaagatc

SEQ ID NO: 872428 - DNA, 25 bp, Mus musculus
agcagaagtcagaaattacacttgt

SEQ ID NO: 872429 - DNA, 25 bp, Mus musculus
agcagaagtcagtaattacacttgt

SEQ ID NO: 872430 - DNA, 25 bp, Mus musculus
agcagaagtccacaggctggttccc

SEQ ID NO: 872431 - DNA, 25 bp, Mus musculus
agcagaagtccagaggctggttccc

SEQ ID NO: 872432 - DNA, 25 bp, Mus musculus
agcagaatgaaaagattaaagcact

SEQ ID NO: 872433 - DNA, 25 bp, Mus musculus
agcagaatgaaatgattaaagcact

SEQ ID NO: 872434 - DNA, 25 bp, Mus musculus
agcagacaagagcctttcctggaaa

SEQ ID NO: 872435 - DNA, 25 bp, Mus musculus
agcagacaagaggctttcctggaaa

SEQ ID NO: 872436 - DNA, 25 bp, Mus musculus
agcagacatcagaaaccttacaatc

SEQ ID NO: 872437 - DNA, 25 bp, Mus musculus
agcagacatcagaaagcacaatggg

SEQ ID NO: 872438 - DNA, 25 bp, Mus musculus
agcagacatcagataatggaggtga

SEQ ID NO: 872439 - DNA, 25 bp, Mus musculus
agcagacatcagtaaccttacaatc

SEQ ID NO: 872440 - DNA, 25 bp, Mus musculus
agcagacatcagtaagcacaatggg

SEQ ID NO: 872441 - DNA, 25 bp, Mus musculus
agcagacatcagttaatggaggtga

SEQ ID NO: 872442 - DNA, 25 bp, Mus musculus
agcagacatgaacgcctttgttgaa

SEQ ID NO: 872443 - DNA, 25 bp, Mus musculus
agcagacatgaaggcctttgttgaa

SEQ ID NO: 872444 - DNA, 25 bp, Mus musculus
agcagacatgtgatatcaggctccg

SEQ ID NO: 872445 - DNA, 25 bp, Mus musculus
agcagacatgtgttatcaggctccg

SEQ ID NO: 872446 - DNA, 25 bp, Mus musculus
agcagacattttatataattttgaa

SEQ ID NO: 872447 - DNA, 25 bp, Mus musculus
agcagacattttttataattttgaa

SEQ ID NO: 872448 - DNA, 25 bp, Mus musculus
agcagaccagaaggggcaagcgcaa

SEQ ID NO: 872449 - DNA, 25 bp, Mus musculus
agcagaccagcaaacataagcaaaa

SEQ ID NO: 872450 - DNA, 25 bp, Mus musculus
agcagaccagctgactggttatcct

SEQ ID NO: 872451 - DNA, 25 bp, Mus musculus
agcagaccaggaaacataagcaaaa

SEQ ID NO: 872452 - DNA, 25 bp, Mus musculus
agcagaccaggtgactggttatcct

SEQ ID NO: 872453 - DNA, 25 bp, Mus musculus
agcagaccagtaggggcaagcgcaa

SEQ ID NO: 872454 - DNA, 25 bp, Mus musculus
agcagacctgcaaagcaaagccacc

SEQ ID NO: 872455 - DNA, 25 bp, Mus musculus
agcagacctggaaagcaaagccacc

SEQ ID NO: 872456 - DNA, 25 bp, Mus musculus
agcagactcgactcaaggagctgga

SEQ ID NO: 872457 - DNA, 25 bp, Mus musculus
agcagactcgtctcaaggagctgga

SEQ ID NO: 872458 - DNA, 25 bp, Mus musculus
agcagactctctgtgtggtctgctt

SEQ ID NO: 872459 - DNA, 25 bp, Mus musculus
agcagactctgtgtgtggtctgctt

SEQ ID NO: 872460 - DNA, 25 bp, Mus musculus
agcagagaagaaagcccgctgggtc

SEQ ID NO: 872461 - DNA, 25 bp, Mus musculus
agcagagaagaactgaccattaatc

SEQ ID NO: 872462 - DNA, 25 bp, Mus musculus
agcagagaagaagtgaccattaatc

SEQ ID NO: 872463 - DNA, 25 bp, Mus musculus
agcagagaagacatgattgacataa

SEQ ID NO: 872464 - DNA, 25 bp, Mus musculus
agcagagaagacttgattgacataa

SEQ ID NO: 872465 - DNA, 25 bp, Mus musculus
agcagagaagcagacgaagcccatg

SEQ ID NO: 872466 - DNA, 25 bp, Mus musculus
agcagagaagcagaggaagcccatg

SEQ ID NO: 872467 - DNA, 25 bp, Mus musculus
agcagagaagcgcggtgctggtgga

SEQ ID NO: 872468 - DNA, 25 bp, Mus musculus
agcagagaagggcggtgctggtgga

SEQ ID NO: 872469 - DNA, 25 bp, Mus musculus
agcagagaagtaagcccgctgggtc

SEQ ID NO: 872470 - DNA, 25 bp, Mus musculus
agcagagcacagaggctcctccaag

SEQ ID NO: 872471 - DNA, 25 bp, Mus musculus
agcagagcacagcttattaaaagca

SEQ ID NO: 872472 - DNA, 25 bp, Mus musculus
agcagagcacaggttattaaaagca

SEQ ID NO: 872473 - DNA, 25 bp, Mus musculus
agcagagcacagtggctcctccaag

SEQ ID NO: 872474 - DNA, 25 bp, Mus musculus
agcagagcagcttctgctggacacc

SEQ ID NO: 872475 - DNA, 25 bp, Mus musculus
agcagagcaggttctgctggacacc

SEQ ID NO: 872476 - DNA, 25 bp, Mus musculus
agcagagcgaggcgtccgtctccca

SEQ ID NO: 872477 - DNA, 25 bp, Mus musculus
agcagagcgaggggtccgtctccca

SEQ ID NO: 872478 - DNA, 25 bp, Mus musculus
agcagaggagactctaacacgtgaa

SEQ ID NO: 872479 - DNA, 25 bp, Mus musculus
agcagaggaggacgtcacgctcacg

SEQ ID NO: 872480 - DNA, 25 bp, Mus musculus
agcagaggaggaggtcacgctcacg

SEQ ID NO: 872481 - DNA, 25 bp, Mus musculus
agcagaggagtctctaacacgtgaa

SEQ ID NO: 872482 - DNA, 25 bp, Mus musculus
agcagaggcaagaacttcgccaatg

SEQ ID NO: 872483 - DNA, 25 bp, Mus musculus
agcagaggcaagaagttcgccaatg

SEQ ID NO: 872484 - DNA, 25 bp, Mus musculus
agcagagtacagcagacagacagtg

SEQ ID NO: 872485 - DNA, 25 bp, Mus musculus
agcagagtacaggagacagacagtg

SEQ ID NO: 872486 - DNA, 25 bp, Mus musculus
agcagagtcattcacgtgacaagtg

SEQ ID NO: 872487 - DNA, 25 bp, Mus musculus
agcagagtcattcaggtgacaagtg

SEQ ID NO: 872488 - DNA, 25 bp, Mus musculus
agcagagtgaagcgagcaagagcag

SEQ ID NO: 872489 - DNA, 25 bp, Mus musculus
agcagagtgaagggagcaagagcag

SEQ ID NO: 872490 - DNA, 25 bp, Mus musculus
agcagagttcccaacgatgaacagg

SEQ ID NO: 872491 - DNA, 25 bp, Mus musculus
agcagagttcccaaggatgaacagg

SEQ ID NO: 872492 - DNA, 25 bp, Mus musculus
agcagataccggccccaacgaagga

SEQ ID NO: 872493 - DNA, 25 bp, Mus musculus
agcagataccggctggggacgacga

SEQ ID NO: 872494 - DNA, 25 bp, Mus musculus
agcagataccgggcccaacgaagga

SEQ ID NO: 872495 - DNA, 25 bp, Mus musculus
agcagataccgggtggggacgacga

SEQ ID NO: 872496 - DNA, 25 bp, Mus musculus
agcagatccggactagcccctggaa

SEQ ID NO: 872497 - DNA, 25 bp, Mus musculus
agcagatccggagtagcccctggaa

SEQ ID NO: 872498 - DNA, 25 bp, Mus musculus
agcagatgaacatcatccatgaaga

SEQ ID NO: 872499 - DNA, 25 bp, Mus musculus
agcagatgaagatcatccatgaaga

SEQ ID NO: 872500 - DNA, 25 bp, Mus musculus
agcagatgagaaaccgacctcccgt

SEQ ID NO: 872501 - DNA, 25 bp, Mus musculus
agcagatgagaaacggacctcccgt

SEQ ID NO: 872502 - DNA, 25 bp, Mus musculus
agcagatgctcgcgctgtcatttcg

SEQ ID NO: 872503 - DNA, 25 bp, Mus musculus
agcagatgctcgggctgtcatttcg

SEQ ID NO: 872504 - DNA, 25 bp, Mus musculus
agcagatgctggcggagcgtctgtt

SEQ ID NO: 872505 - DNA, 25 bp, Mus musculus
agcagatgctgggggagcgtctgtt

SEQ ID NO: 872506 - DNA, 25 bp, Mus musculus
agcagatgggacagcaaagagccct

SEQ ID NO: 872507 - DNA, 25 bp, Mus musculus
agcagatgggtcagcaaagagccct

SEQ ID NO: 872508 - DNA, 25 bp, Mus musculus
agcagatggtctcgtgtagccgtcc

SEQ ID NO: 872509 - DNA, 25 bp, Mus musculus
agcagatggtctggtgtagccgtcc

SEQ ID NO: 872510 - DNA, 25 bp, Mus musculus
agcagattagcacacatgaatgcta

SEQ ID NO: 872511 - DNA, 25 bp, Mus musculus
agcagattagcagacatgaatgcta

SEQ ID NO: 872512 - DNA, 25 bp, Mus musculus
agcagattgcagaggaggatttcta

SEQ ID NO: 872513 - DNA, 25 bp, Mus musculus
agcagattgcagcaggatttctatg

SEQ ID NO: 872514 - DNA, 25 bp, Mus musculus
agcagattgcaggaggatttctatg

SEQ ID NO: 872515 - DNA, 25 bp, Mus musculus
agcagattgcagtggaggatttcta

SEQ ID NO: 872516 - DNA, 25 bp, Mus musculus
agcagattgctgaattcaaggaagc

SEQ ID NO: 872517 - DNA, 25 bp, Mus musculus
agcagattgctgtattcaaggaagc

SEQ ID NO: 872518 - DNA, 25 bp, Mus musculus
agcagatttgcactgaatcatccag

SEQ ID NO: 872519 - DNA, 25 bp, Mus musculus
agcagatttgcagtgaatcatccag

SEQ ID NO: 872520 - DNA, 25 bp, Mus musculus
agcagattttagcaccttcttactg

SEQ ID NO: 872521 - DNA, 25 bp, Mus musculus
agcagattttagcacgtgaatatga

SEQ ID NO: 872522 - DNA, 25 bp, Mus musculus
agcagattttagcagcttcttactg

SEQ ID NO: 872523 - DNA, 25 bp, Mus musculus
agcagattttagcaggtgaatatga

SEQ ID NO: 872524 - DNA, 25 bp, Mus musculus
agcagcaaacataaagtgaccccat

SEQ ID NO: 872525 - DNA, 25 bp, Mus musculus
agcagcaaacataatgtgaccccat

SEQ ID NO: 872526 - DNA, 25 bp, Mus musculus
agcagcaaccatccgtgagtgcatc

SEQ ID NO: 872527 - DNA, 25 bp, Mus musculus
agcagcaaccatgcgtgagtgcatc

SEQ ID NO: 872528 - DNA, 25 bp, Mus musculus
agcagcaagaaacgtacccctgcag

SEQ ID NO: 872529 - DNA, 25 bp, Mus musculus
agcagcaagaaaggtacccctgcag

SEQ ID NO: 872530 - DNA, 25 bp, Mus musculus
agcagcaatgctaaatatgtgtgtg

SEQ ID NO: 872531 - DNA, 25 bp, Mus musculus
agcagcaatggtaaatatgtgtgtg

SEQ ID NO: 872532 - DNA, 25 bp, Mus musculus
agcagcacggaggacttccctgacc

SEQ ID NO: 872533 - DNA, 25 bp, Mus musculus
agcagcacggtggacttccctgacc

SEQ ID NO: 872534 - DNA, 25 bp, Mus musculus
agcagcactaccctcgctgtatcaa

SEQ ID NO: 872535 - DNA, 25 bp, Mus musculus
agcagcactaccctggctgtatcaa

SEQ ID NO: 872536 - DNA, 25 bp, Mus musculus
agcagcacttcccactggctccaga

SEQ ID NO: 872537 - DNA, 25 bp, Mus musculus
agcagcacttcccagtggctccaga

SEQ ID NO: 872538 - DNA, 25 bp, Mus musculus
agcagcagaaaaactctgagccctg

SEQ ID NO: 872539 - DNA, 25 bp, Mus musculus
agcagcagaaaatctctgagccctg

SEQ ID NO: 872540 - DNA, 25 bp, Mus musculus
agcagcagaacgctgacttgaaaga

SEQ ID NO: 872541 - DNA, 25 bp, Mus musculus
agcagcagaacggtgacttgaaaga

SEQ ID NO: 872542 - DNA, 25 bp, Mus musculus
agcagcagactcctctcaaggagct

SEQ ID NO: 872543 - DNA, 25 bp, Mus musculus
agcagcagactcgtctcaaggagct

SEQ ID NO: 872544 - DNA, 25 bp, Mus musculus
agcagcagatattgtggccctaata

SEQ ID NO: 872545 - DNA, 25 bp, Mus musculus
agcagcagatcccagagtcccaggg

SEQ ID NO: 872546 - DNA, 25 bp, Mus musculus
agcagcagatgccagagtcccaggg

SEQ ID NO: 872547 - DNA, 25 bp, Mus musculus
agcagcagattttgtggccctaata

SEQ ID NO: 872548 - DNA, 25 bp, Mus musculus
agcagcagcagaaaatctctgagcc

SEQ ID NO: 872549 - DNA, 25 bp, Mus musculus
agcagcagcagaaattctctgagcc

SEQ ID NO: 872550 - DNA, 25 bp, Mus musculus
agcagcagcccaaacaatcctcctg

SEQ ID NO: 872551 - DNA, 25 bp, Mus musculus
agcagcagcccatacaatcctcctg

SEQ ID NO: 872552 - DNA, 25 bp, Mus musculus
agcagcagccggcaggaacccactt

SEQ ID NO: 872553 - DNA, 25 bp, Mus musculus
agcagcagccgggaggaacccactt

SEQ ID NO: 872554 - DNA, 25 bp, Mus musculus
agcagcagggaacgctttgccacca

SEQ ID NO: 872555 - DNA, 25 bp, Mus musculus
agcagcagggaactcaggctttgcc

SEQ ID NO: 872556 - DNA, 25 bp, Mus musculus
agcagcagggaaggctttgccacca

SEQ ID NO: 872557 - DNA, 25 bp, Mus musculus
agcagcagggaagtcaggctttgcc

SEQ ID NO: 872558 - DNA, 25 bp, Mus musculus
agcagcagtgagcaaatttttaaac

SEQ ID NO: 872559 - DNA, 25 bp, Mus musculus
agcagcagtgaggaaatttttaaac

SEQ ID NO: 872560 - DNA, 25 bp, Mus musculus
agcagcataacatgagattgactct

SEQ ID NO: 872561 - DNA, 25 bp, Mus musculus
agcagcataagatgagattgactct

SEQ ID NO: 872562 - DNA, 25 bp, Mus musculus
agcagccaacatcgttcgagctggt

SEQ ID NO: 872563 - DNA, 25 bp, Mus musculus
agcagccaacatggttcgagctggt

SEQ ID NO: 872564 - DNA, 25 bp, Mus musculus
agcagccaagctcacagtgcctgct

SEQ ID NO: 872565 - DNA, 25 bp, Mus musculus
agcagccaagctcagagtgcctgct

SEQ ID NO: 872566 - DNA, 25 bp, Mus musculus
agcagccaattgccagtgatggtgt

SEQ ID NO: 872567 - DNA, 25 bp, Mus musculus
agcagccaattgcctgtgatggtgt

SEQ ID NO: 872568 - DNA, 25 bp, Mus musculus
agcagccacatataccaggccttgc

SEQ ID NO: 872569 - DNA, 25 bp, Mus musculus
agcagccacatatacctggtgtatt

SEQ ID NO: 872570 - DNA, 25 bp, Mus musculus
agcagccacatatacgccttgctcc

SEQ ID NO: 872571 - DNA, 25 bp, Mus musculus
agcagccacatatagcaggccttgc

SEQ ID NO: 872572 - DNA, 25 bp, Mus musculus
agcagccacatatagctggtgtatt

SEQ ID NO: 872573 - DNA, 25 bp, Mus musculus
agcagccacatataggccttgctcc

SEQ ID NO: 872574 - DNA, 25 bp, Mus musculus
agcagccagctgaccctgagagggc

SEQ ID NO: 872575 - DNA, 25 bp, Mus musculus
agcagccagctgacgctgagagggc

SEQ ID NO: 872576 - DNA, 25 bp, Mus musculus
agcagccaggcccacatcaaactga

SEQ ID NO: 872577 - DNA, 25 bp, Mus musculus
agcagccagggccacatcaaactga

SEQ ID NO: 872578 - DNA, 25 bp, Mus musculus
agcagcccagcacttggagtgaagt

SEQ ID NO: 872579 - DNA, 25 bp, Mus musculus
agcagcccaggacttggagtgaagt

SEQ ID NO: 872580 - DNA, 25 bp, Mus musculus
agcagcccagtgcacgcctgccact

SEQ ID NO: 872581 - DNA, 25 bp, Mus musculus
agcagcccagtgcaggcctgccact

SEQ ID NO: 872582 - DNA, 25 bp, Mus musculus
agcagcccatacaatcctcctgatc

SEQ ID NO: 872583 - DNA, 25 bp, Mus musculus
agcagcccattcaatcctcctgatc

SEQ ID NO: 872584 - DNA, 25 bp, Mus musculus
agcagccggcggacccggaacgtgc

SEQ ID NO: 872585 - DNA, 25 bp, Mus musculus
agcagccggcggacgcggaacgtgc

SEQ ID NO: 872586 - DNA, 25 bp, Mus musculus
agcagccgggaggaacccactttct

SEQ ID NO: 872587 - DNA, 25 bp, Mus musculus
agcagccgggcacgtttgccaagct

SEQ ID NO: 872588 - DNA, 25 bp, Mus musculus
agcagccgggcaggtttgccaagct

SEQ ID NO: 872589 - DNA, 25 bp, Mus musculus
agcagccgggtggaacccactttct

SEQ ID NO: 872590 - DNA, 25 bp, Mus musculus
agcagcctaaaaaagggcaagaaat

SEQ ID NO: 872591 - DNA, 25 bp, Mus musculus
agcagcctaaaatagggcaagaaat

SEQ ID NO: 872592 - DNA, 25 bp, Mus musculus
agcagcctcgcagacaggagcttcc

SEQ ID NO: 872593 - DNA, 25 bp, Mus musculus
agcagcctcggagacaggagcttcc

SEQ ID NO: 872594 - DNA, 25 bp, Mus musculus
agcagcctgttcaacaaatcaacat

SEQ ID NO: 872595 - DNA, 25 bp, Mus musculus
agcagcctgttcaacgttcgcccag

SEQ ID NO: 872596 - DNA, 25 bp, Mus musculus
agcagcctgttcaagaaatcaacat

SEQ ID NO: 872597 - DNA, 25 bp, Mus musculus
agcagcctgttcaaggttcgcccag

SEQ ID NO: 872598 - DNA, 25 bp, Mus musculus
agcagcgaagtccacatgctgagcg

SEQ ID NO: 872599 - DNA, 25 bp, Mus musculus
agcagcgaagtccagatgctgagcg

SEQ ID NO: 872600 - DNA, 25 bp, Mus musculus
agcagcgagcagatgtctcatttcc

SEQ ID NO: 872601 - DNA, 25 bp, Mus musculus
agcagcgagcagttgtctcatttcc

SEQ ID NO: 872602 - DNA, 25 bp, Mus musculus
agcagcgagtcactaccatctgcca

SEQ ID NO: 872603 - DNA, 25 bp, Mus musculus
agcagcgagtcagtaccatctgcca

SEQ ID NO: 872604 - DNA, 25 bp, Mus musculus
agcagcgagtggcacagttgcacag

SEQ ID NO: 872605 - DNA, 25 bp, Mus musculus
agcagcgagtggcagagttgcacag

SEQ ID NO: 872606 - DNA, 25 bp, Mus musculus
agcagcgcagcctcaggctggctac

SEQ ID NO: 872607 - DNA, 25 bp, Mus musculus
agcagcgcaggctcaggctggctac

SEQ ID NO: 872608 - DNA, 25 bp, Mus musculus
agcagcgctcagcgcgacgcaggag

SEQ ID NO: 872609 - DNA, 25 bp, Mus musculus
agcagcgctcagggcgacgcaggag

SEQ ID NO: 872610 - DNA, 25 bp, Mus musculus
agcagcggcacgacagcacccaaga

SEQ ID NO: 872611 - DNA, 25 bp, Mus musculus
agcagcggcacgtcagcacccaaga

SEQ ID NO: 872612 - DNA, 25 bp, Mus musculus
agcagcggcattcacgttctaaatg

SEQ ID NO: 872613 - DNA, 25 bp, Mus musculus
agcagcggcattcaggttctaaatg

SEQ ID NO: 872614 - DNA, 25 bp, Mus musculus
agcagcgtccttcagctgaggctgc

SEQ ID NO: 872615 - DNA, 25 bp, Mus musculus
agcagcgtccttgagctgaggctgc

SEQ ID NO: 872616 - DNA, 25 bp, Mus musculus
agcagctacttcgacaggcttcagg

SEQ ID NO: 872617 - DNA, 25 bp, Mus musculus
agcagctacttcgagaggcttcagg

SEQ ID NO: 872618 - DNA, 25 bp, Mus musculus
agcagctagagccacagcagttgga

SEQ ID NO: 872619 - DNA, 25 bp, Mus musculus
agcagctagagcgacagcagttgga

SEQ ID NO: 872620 - DNA, 25 bp, Mus musculus
agcagctagtctttaaatggagaat

SEQ ID NO: 872621 - DNA, 25 bp, Mus musculus
agcagctagtctttaaggtaagaag

SEQ ID NO: 872622 - DNA, 25 bp, Mus musculus
agcagctagtcttttaatggagaat

SEQ ID NO: 872623 - DNA, 25 bp, Mus musculus
agcagctagtcttttaggtaagaag

SEQ ID NO: 872624 - DNA, 25 bp, Mus musculus
agcagctcaaagagacatgtctctt

SEQ ID NO: 872625 - DNA, 25 bp, Mus musculus
agcagctcaatgagacatgtctctt

SEQ ID NO: 872626 - DNA, 25 bp, Mus musculus
agcagctcagagccccatcagcatt

SEQ ID NO: 872627 - DNA, 25 bp, Mus musculus
agcagctcagaggcccatcagcatt

SEQ ID NO: 872628 - DNA, 25 bp, Mus musculus
agcagctcctgacaaacgtcctgga

SEQ ID NO: 872629 - DNA, 25 bp, Mus musculus
agcagctcctgagaaacgtcctgga

SEQ ID NO: 872630 - DNA, 25 bp, Mus musculus
agcagctctgcccacactcgggggc

SEQ ID NO: 872631 - DNA, 25 bp, Mus musculus
agcagctctgcccagactcgggggc

SEQ ID NO: 872632 - DNA, 25 bp, Mus musculus
agcagctctgtgctgtattttcatc

SEQ ID NO: 872633 - DNA, 25 bp, Mus musculus
agcagctctgtgctttgggctcagt

SEQ ID NO: 872634 - DNA, 25 bp, Mus musculus
agcagctctgtggtgtattttcatc

SEQ ID NO: 872635 - DNA, 25 bp, Mus musculus
agcagctctgtggtttgggctcagt

SEQ ID NO: 872636 - DNA, 25 bp, Mus musculus
agcagctgaacaagaaggcagaagg

SEQ ID NO: 872637 - DNA, 25 bp, Mus musculus
agcagctgaacatgaaggcagaagg

SEQ ID NO: 872638 - DNA, 25 bp, Mus musculus
agcagctgacagacctgaagagtgc

SEQ ID NO: 872639 - DNA, 25 bp, Mus musculus
agcagctgacagcattcagtttgcc

SEQ ID NO: 872640 - DNA, 25 bp, Mus musculus
agcagctgacaggattcagtttgcc

SEQ ID NO: 872641 - DNA, 25 bp, Mus musculus
agcagctgacagtcctgaagagtgc

SEQ ID NO: 872642 - DNA, 25 bp, Mus musculus
agcagctgcagaacatggacaagga

SEQ ID NO: 872643 - DNA, 25 bp, Mus musculus
agcagctgcagatcatggacaagga

SEQ ID NO: 872644 - DNA, 25 bp, Mus musculus
agcagctgccagactctgatagact

SEQ ID NO: 872645 - DNA, 25 bp, Mus musculus
agcagctgccagtctctgatagact

SEQ ID NO: 872646 - DNA, 25 bp, Mus musculus
agcagctggactttttggctttttt

SEQ ID NO: 872647 - DNA, 25 bp, Mus musculus
agcagctggagtttttggctttttt

SEQ ID NO: 872648 - DNA, 25 bp, Mus musculus
agcagctggccctgcatcttttctc

SEQ ID NO: 872649 - DNA, 25 bp, Mus musculus
agcagctggccctggatcttttctc

SEQ ID NO: 872650 - DNA, 25 bp, Mus musculus
agcagctgggccccttctcaagaag

SEQ ID NO: 872651 - DNA, 25 bp, Mus musculus
agcagctggggcccttctcaagaag

SEQ ID NO: 872652 - DNA, 25 bp, Mus musculus
agcagcttggctcttgacgaagtga

SEQ ID NO: 872653 - DNA, 25 bp, Mus musculus
agcagcttgggtcttgacgaagtga

SEQ ID NO: 872654 - DNA, 25 bp, Mus musculus
agcaggacagccagagtttacagcc

SEQ ID NO: 872655 - DNA, 25 bp, Mus musculus
agcaggacaggcagagtttacagcc

SEQ ID NO: 872656 - DNA, 25 bp, Mus musculus
agcaggacagtgacagcatcacggc

SEQ ID NO: 872657 - DNA, 25 bp, Mus musculus
agcaggacagtgactgcatcacggc

SEQ ID NO: 872658 - DNA, 25 bp, Mus musculus
agcaggacatcctggcctcaaactt

SEQ ID NO: 872659 - DNA, 25 bp, Mus musculus
agcaggacatctttgcacaccctta

SEQ ID NO: 872660 - DNA, 25 bp, Mus musculus
agcaggacatgatacacggcttgaa

SEQ ID NO: 872661 - DNA, 25 bp, Mus musculus
agcaggacatgatagacggcttgaa

SEQ ID NO: 872662 - DNA, 25 bp, Mus musculus
agcaggacatgctggcctcaaactt

SEQ ID NO: 872663 - DNA, 25 bp, Mus musculus
agcaggacatgtttgcacaccctta

SEQ ID NO: 872664 - DNA, 25 bp, Mus musculus
agcaggaccaggcacgagtacctgg

SEQ ID NO: 872665 - DNA, 25 bp, Mus musculus
agcaggaccaggcactacacctatg

SEQ ID NO: 872666 - DNA, 25 bp, Mus musculus
agcaggaccaggcaggagtacctgg

SEQ ID NO: 872667 - DNA, 25 bp, Mus musculus
agcaggaccaggcagtacacctatg

SEQ ID NO: 872668 - DNA, 25 bp, Mus musculus
agcaggacggcaaggatgcgaacgc

SEQ ID NO: 872669 - DNA, 25 bp, Mus musculus
agcaggacgggaaggatgcgaacgc

SEQ ID NO: 872670 - DNA, 25 bp, Mus musculus
agcaggagagcgagaaagagttcct

SEQ ID NO: 872671 - DNA, 25 bp, Mus musculus
agcaggagagcgtgaaagagttcct

SEQ ID NO: 872672 - DNA, 25 bp, Mus musculus
agcaggagatgcctcatcaacatga

SEQ ID NO: 872673 - DNA, 25 bp, Mus musculus
agcaggagatgcctgatcaacatga

SEQ ID NO: 872674 - DNA, 25 bp, Mus musculus
agcaggagcgcacgttcctcatgag

SEQ ID NO: 872675 - DNA, 25 bp, Mus musculus
agcaggagcgcaggttcctcatgag

SEQ ID NO: 872676 - DNA, 25 bp, Mus musculus
agcaggatgacgctaaaatgtttat

SEQ ID NO: 872677 - DNA, 25 bp, Mus musculus
agcaggatgacggtaaaatgtttat

SEQ ID NO: 872678 - DNA, 25 bp, Mus musculus
agcaggatgattgacgatgcaattc

SEQ ID NO: 872679 - DNA, 25 bp, Mus musculus
agcaggatgattgaggatgcaattc

SEQ ID NO: 872680 - DNA, 25 bp, Mus musculus
agcaggatggaacagaagctgaaga

SEQ ID NO: 872681 - DNA, 25 bp, Mus musculus
agcaggatggaagagaagctgaaga

SEQ ID NO: 872682 - DNA, 25 bp, Mus musculus
agcaggcaagctatacttgaaggct

SEQ ID NO: 872683 - DNA, 25 bp, Mus musculus
agcaggcaaggtatacttgaaggct

SEQ ID NO: 872684 - DNA, 25 bp, Mus musculus
agcaggcatattagcctgcataagt

SEQ ID NO: 872685 - DNA, 25 bp, Mus musculus
agcaggcatatttgcctgcataagt

SEQ ID NO: 872686 - DNA, 25 bp, Mus musculus
agcaggccaactctacaatggcttc

SEQ ID NO: 872687 - DNA, 25 bp, Mus musculus
agcaggccaagtctacaatggcttc

SEQ ID NO: 872688 - DNA, 25 bp, Mus musculus
agcaggccgtagcacagtatacaac

SEQ ID NO: 872689 - DNA, 25 bp, Mus musculus
agcaggccgtaggacagtatacaac

SEQ ID NO: 872690 - DNA, 25 bp, Mus musculus
agcaggcgccgacggcgtccctgtc

SEQ ID NO: 872691 - DNA, 25 bp, Mus musculus
agcaggcgccgagggcgtccctgtc

SEQ ID NO: 872692 - DNA, 25 bp, Mus musculus
agcaggcgcttgcacaaggggcgcc

SEQ ID NO: 872693 - DNA, 25 bp, Mus musculus
agcaggcgcttgcacgcatgacgag

SEQ ID NO: 872694 - DNA, 25 bp, Mus musculus
agcaggcgcttgcagaaggggcgcc

SEQ ID NO: 872695 - DNA, 25 bp, Mus musculus
agcaggcgcttgcaggcatgacgag

SEQ ID NO: 872696 - DNA, 25 bp, Mus musculus
agcaggctcagacatgggcccagtg

SEQ ID NO: 872697 - DNA, 25 bp, Mus musculus
agcaggctcagagatgggcccagtg

SEQ ID NO: 872698 - DNA, 25 bp, Mus musculus
agcaggctggagctctttgcaagag

SEQ ID NO: 872699 - DNA, 25 bp, Mus musculus
agcaggctggaggtctttgcaagag

SEQ ID NO: 872700 - DNA, 25 bp, Mus musculus
agcaggctgtcatgccaggcactgg

SEQ ID NO: 872701 - DNA, 25 bp, Mus musculus
agcaggctgtcatgcgcactgggga

SEQ ID NO: 872702 - DNA, 25 bp, Mus musculus
agcaggctgtcatggcaggcactgg

SEQ ID NO: 872703 - DNA, 25 bp, Mus musculus
agcaggctgtcatgggcactgggga

SEQ ID NO: 872704 - DNA, 25 bp, Mus musculus
agcagggaagacaggctttgccacc

SEQ ID NO: 872705 - DNA, 25 bp, Mus musculus
agcagggaagcctttgccaccacca

SEQ ID NO: 872706 - DNA, 25 bp, Mus musculus
agcagggaaggctttgccaccacca

SEQ ID NO: 872707 - DNA, 25 bp, Mus musculus
agcagggaagtcaggctttgccacc

SEQ ID NO: 872708 - DNA, 25 bp, Mus musculus
agcagggcatcaactataaaaaggg

SEQ ID NO: 872709 - DNA, 25 bp, Mus musculus
agcagggcatcatctataaaaaggg

SEQ ID NO: 872710 - DNA, 25 bp, Mus musculus
agcaggggggagatcgcatttttgg

SEQ ID NO: 872711 - DNA, 25 bp, Mus musculus
agcaggggggagttcgcatttttgg

SEQ ID NO: 872712 - DNA, 25 bp, Mus musculus
agcaggggttcaatcagacccagtc

SEQ ID NO: 872713 - DNA, 25 bp, Mus musculus
agcaggggttcattcagacccagtc

SEQ ID NO: 872714 - DNA, 25 bp, Mus musculus
agcaggttcagccattccatttgta

SEQ ID NO: 872715 - DNA, 25 bp, Mus musculus
agcaggttcagcgattccatttgta

SEQ ID NO: 872716 - DNA, 25 bp, Mus musculus
agcaggttcaggctaaccaggaata

SEQ ID NO: 872717 - DNA, 25 bp, Mus musculus
agcaggttcagggtaaccaggaata

SEQ ID NO: 872718 - DNA, 25 bp, Mus musculus
agcaggttccagacaatcctcctga

SEQ ID NO: 872719 - DNA, 25 bp, Mus musculus
agcaggttccagctctcccaggaaa

SEQ ID NO: 872720 - DNA, 25 bp, Mus musculus
agcaggttccaggtctcccaggaaa

SEQ ID NO: 872721 - DNA, 25 bp, Mus musculus
agcaggttccagtcaatcctcctga

SEQ ID NO: 872722 - DNA, 25 bp, Mus musculus
agcagtaaccgacctcacgtcgctc

SEQ ID NO: 872723 - DNA, 25 bp, Mus musculus
agcagtaaccgagctcacgtcgctc

SEQ ID NO: 872724 - DNA, 25 bp, Mus musculus
agcagtaatacgaaagccgcaaagg

SEQ ID NO: 872725 - DNA, 25 bp, Mus musculus
agcagtaataggaaagccgcaaagg

SEQ ID NO: 872726 - DNA, 25 bp, Mus musculus
agcagtacaaacctctttctcatca

SEQ ID NO: 872727 - DNA, 25 bp, Mus musculus
agcagtacaaacgtctttctcatca

SEQ ID NO: 872728 - DNA, 25 bp, Mus musculus
agcagtacagccagtctgagagtct

SEQ ID NO: 872729 - DNA, 25 bp, Mus musculus
agcagtacagcgattgtgcagagtg

SEQ ID NO: 872730 - DNA, 25 bp, Mus musculus
agcagtacaggcagtctgagagtct

SEQ ID NO: 872731 - DNA, 25 bp, Mus musculus
agcagtacagggattgtgcagagtg

SEQ ID NO: 872732 - DNA, 25 bp, Mus musculus
agcagtaccgatcgtaccagatgct

SEQ ID NO: 872733 - DNA, 25 bp, Mus musculus
agcagtaccgatggtaccagatgct

SEQ ID NO: 872734 - DNA, 25 bp, Mus musculus
agcagtaccgcaagctgctcaggtc

SEQ ID NO: 872735 - DNA, 25 bp, Mus musculus
agcagtaccggaagctgctcaggtc

SEQ ID NO: 872736 - DNA, 25 bp, Mus musculus
agcagtaggtatcacggtggactca

SEQ ID NO: 872737 - DNA, 25 bp, Mus musculus
agcagtaggtatcagggtggactca

SEQ ID NO: 872738 - DNA, 25 bp, Mus musculus
agcagtattccaatgattttggcca

SEQ ID NO: 872739 - DNA, 25 bp, Mus musculus
agcagtattccattgattttggcca

SEQ ID NO: 872740 - DNA, 25 bp, Mus musculus
agcagtccgcagctctttggccagt

SEQ ID NO: 872741 - DNA, 25 bp, Mus musculus
agcagtccgcaggtctttggccagt

SEQ ID NO: 872742 - DNA, 25 bp, Mus musculus
agcagtcgaaagaggcagacatcga

SEQ ID NO: 872743 - DNA, 25 bp, Mus musculus
agcagtcgaaagtggcagacatcga

SEQ ID NO: 872744 - DNA, 25 bp, Mus musculus
agcagtctgtgcacatagtagaaaa

SEQ ID NO: 872745 - DNA, 25 bp, Mus musculus
agcagtctgtgcacttagtagaaaa

SEQ ID NO: 872746 - DNA, 25 bp, Mus musculus
agcagtcttcatctcactctggctc

SEQ ID NO: 872747 - DNA, 25 bp, Mus musculus
agcagtcttcatctgactctggctc

SEQ ID NO: 872748 - DNA, 25 bp, Mus musculus
agcagtgaccaaactctgcgctgag

SEQ ID NO: 872749 - DNA, 25 bp, Mus musculus
agcagtgaccaatctctgcgctgag

SEQ ID NO: 872750 - DNA, 25 bp, Mus musculus
agcagtgaggcacttgaaagtgact

SEQ ID NO: 872751 - DNA, 25 bp, Mus musculus
agcagtgagggacttgaaagtgact

SEQ ID NO: 872752 - DNA, 25 bp, Mus musculus
agcagtgcagctgccaacaggaaag

SEQ ID NO: 872753 - DNA, 25 bp, Mus musculus
agcagtgcaggtgccaacaggaaag

SEQ ID NO: 872754 - DNA, 25 bp, Mus musculus
agcagtgggggctgcgcggagttca

SEQ ID NO: 872755 - DNA, 25 bp, Mus musculus
agcagtgggggctgggcggagttca

SEQ ID NO: 872756 - DNA, 25 bp, Mus musculus
agcagtggtgattgatccaaccaga

SEQ ID NO: 872757 - DNA, 25 bp, Mus musculus
agcagtggtgtttgatccaaccaga

SEQ ID NO: 872758 - DNA, 25 bp, Mus musculus
agcagtgtgaagcgctcaggatgct

SEQ ID NO: 872759 - DNA, 25 bp, Mus musculus
agcagtgtgaagggctcaggatgct

SEQ ID NO: 872760 - DNA, 25 bp, Mus musculus
agcagtgtgacacccctcacgtagt

SEQ ID NO: 872761 - DNA, 25 bp, Mus musculus
agcagtgtgacagccctcacgtagt

SEQ ID NO: 872762 - DNA, 25 bp, Mus musculus
agcagtgttggattcttcggggcag

SEQ ID NO: 872763 - DNA, 25 bp, Mus musculus
agcagtgttggattgttcggggcag

SEQ ID NO: 872764 - DNA, 25 bp, Mus musculus
agcagttaaccactgctgagcctac

SEQ ID NO: 872765 - DNA, 25 bp, Mus musculus
agcagttaaccagtgctgagcctac

SEQ ID NO: 872766 - DNA, 25 bp, Mus musculus
agcagttcagtacctatgagccaga

SEQ ID NO: 872767 - DNA, 25 bp, Mus musculus
agcagttcagtagctatgagccaga

SEQ ID NO: 872768 - DNA, 25 bp, Mus musculus
agcagttcattgcacagtccggcgg

SEQ ID NO: 872769 - DNA, 25 bp, Mus musculus
agcagttcattgcagagtccggcgg

SEQ ID NO: 872770 - DNA, 25 bp, Mus musculus
agcagttcgcagaacagaaactgga

SEQ ID NO: 872771 - DNA, 25 bp, Mus musculus
agcagttcgcagtacagaaactgga

SEQ ID NO: 872772 - DNA, 25 bp, Mus musculus
agcagttgaccccacgccctgcagg

SEQ ID NO: 872773 - DNA, 25 bp, Mus musculus
agcagttgaccccaggccctgcagg

SEQ ID NO: 872774 - DNA, 25 bp, Mus musculus
agcagtttctcaatcagctcatcct

SEQ ID NO: 872775 - DNA, 25 bp, Mus musculus
agcagtttctcaatgagctcatcct

SEQ ID NO: 872776 - DNA, 25 bp, Mus musculus
agcataaacgatatgtgtcacaaag

SEQ ID NO: 872777 - DNA, 25 bp, Mus musculus
agcataaacgttatgtgtcacaaag

SEQ ID NO: 872778 - DNA, 25 bp, Mus musculus
agcataaagcagacaatagtatcag

SEQ ID NO: 872779 - DNA, 25 bp, Mus musculus
agcataaagcagtcaatagtatcag

SEQ ID NO: 872780 - DNA, 25 bp, Mus musculus
agcataacagcgtcttggcagctgc

SEQ ID NO: 872781 - DNA, 25 bp, Mus musculus
agcataacagggtcttggcagctgc

SEQ ID NO: 872782 - DNA, 25 bp, Mus musculus
agcataagcaactgcatgtgggaga

SEQ ID NO: 872783 - DNA, 25 bp, Mus musculus
agcataagcaactggatgtgggaga

SEQ ID NO: 872784 - DNA, 25 bp, Mus musculus
agcataattcagaaaatcagaaaat

SEQ ID NO: 872785 - DNA, 25 bp, Mus musculus
agcataattcagtaaatcagaaaat

SEQ ID NO: 872786 - DNA, 25 bp, Mus musculus
agcatacaaattcgtttcatgactt

SEQ ID NO: 872787 - DNA, 25 bp, Mus musculus
agcatacaaattggtttcatgactt

SEQ ID NO: 872788 - DNA, 25 bp, Mus musculus
agcatacaagcgagactctggagga

SEQ ID NO: 872789 - DNA, 25 bp, Mus musculus
agcatacaagggagactctggagga

SEQ ID NO: 872790 - DNA, 25 bp, Mus musculus
agcatacagaccctatcagaattat

SEQ ID NO: 872791 - DNA, 25 bp, Mus musculus
agcatacagagcctatcagaattat

SEQ ID NO: 872792 - DNA, 25 bp, Mus musculus
agcatacagtctcgaggaagaagga

SEQ ID NO: 872793 - DNA, 25 bp, Mus musculus
agcatacagtctggaggaagaagga

SEQ ID NO: 872794 - DNA, 25 bp, Mus musculus
agcatagcagagtaagtcacagaaa

SEQ ID NO: 872795 - DNA, 25 bp, Mus musculus
agcatagcagtgtaagtcacagaaa

SEQ ID NO: 872796 - DNA, 25 bp, Mus musculus
agcatatggaaaatctttcaacctg

SEQ ID NO: 872797 - DNA, 25 bp, Mus musculus
agcatatggaaaatgtttcaacctg

SEQ ID NO: 872798 - DNA, 25 bp, Mus musculus
agcatcaaccagctggtgtacatgg

SEQ ID NO: 872799 - DNA, 25 bp, Mus musculus
agcatcaaccaggtggtgtacatgg

SEQ ID NO: 872800 - DNA, 25 bp, Mus musculus
agcatcaagatctgcgacttggagg

SEQ ID NO: 872801 - DNA, 25 bp, Mus musculus
agcatcaagatctgggacttggagg

SEQ ID NO: 872802 - DNA, 25 bp, Mus musculus
agcatcaatctgcacaagcggcctc

SEQ ID NO: 872803 - DNA, 25 bp, Mus musculus
agcatcaatctgcagaagcggcctc

SEQ ID NO: 872804 - DNA, 25 bp, Mus musculus
agcatcacagagcctgcgctacctg

SEQ ID NO: 872805 - DNA, 25 bp, Mus musculus
agcatcacagtgcctgcgctacctg

SEQ ID NO: 872806 - DNA, 25 bp, Mus musculus
agcatcacccccagcagtcagagca

SEQ ID NO: 872807 - DNA, 25 bp, Mus musculus
agcatcacccgcagcagtcagagca

SEQ ID NO: 872808 - DNA, 25 bp, Mus musculus
agcatcacccttatgactcggggat

SEQ ID NO: 872809 - DNA, 25 bp, Mus musculus
agcatcacccttttgactcggggat

SEQ ID NO: 872810 - DNA, 25 bp, Mus musculus
agcatcacgaatcccactttccaaa

SEQ ID NO: 872811 - DNA, 25 bp, Mus musculus
agcatcacgaatgccactttccaaa

SEQ ID NO: 872812 - DNA, 25 bp, Mus musculus
agcatcactcaacgagaagctgtgt

SEQ ID NO: 872813 - DNA, 25 bp, Mus musculus
agcatcactcaaggagaagctgtgt

SEQ ID NO: 872814 - DNA, 25 bp, Mus musculus
agcatcactgcacatcagagtaaag

SEQ ID NO: 872815 - DNA, 25 bp, Mus musculus
agcatcactgcagatcagagtaaag

SEQ ID NO: 872816 - DNA, 25 bp, Mus musculus
agcatcagcaaacgatcgaccatta

SEQ ID NO: 872817 - DNA, 25 bp, Mus musculus
agcatcagcaaaggatcgaccatta

SEQ ID NO: 872818 - DNA, 25 bp, Mus musculus
agcatcatacagaccagagggatta

SEQ ID NO: 872819 - DNA, 25 bp, Mus musculus
agcatcatacagtccagagggatta

SEQ ID NO: 872820 - DNA, 25 bp, Mus musculus
agcatcattacgaacctcctttacc

SEQ ID NO: 872821 - DNA, 25 bp, Mus musculus
agcatcattacgtacctcctttacc

SEQ ID NO: 872822 - DNA, 25 bp, Mus musculus
agcatcattgggaacaagggagaga

SEQ ID NO: 872823 - DNA, 25 bp, Mus musculus
agcatcattgggaagaagggagaga

SEQ ID NO: 872824 - DNA, 25 bp, Mus musculus
agcatccatcagagctccagcatga

SEQ ID NO: 872825 - DNA, 25 bp, Mus musculus
agcatccatcagaggtccagcatga

SEQ ID NO: 872826 - DNA, 25 bp, Mus musculus
agcatcccactgcaaagggcatcgg

SEQ ID NO: 872827 - DNA, 25 bp, Mus musculus
agcatcccactggaaagggcatcgg

SEQ ID NO: 872828 - DNA, 25 bp, Mus musculus
agcatccgaaaagtcacggaagaga

SEQ ID NO: 872829 - DNA, 25 bp, Mus musculus
agcatccgaaaagtgacggaagaga

SEQ ID NO: 872830 - DNA, 25 bp, Mus musculus
agcatccgtgagctatttgaatatc

SEQ ID NO: 872831 - DNA, 25 bp, Mus musculus
agcatccgtgaggtatttgaatatc

SEQ ID NO: 872832 - DNA, 25 bp, Mus musculus
agcatcctccaagacgcggagtcgc

SEQ ID NO: 872833 - DNA, 25 bp, Mus musculus
agcatcctccaagaggcggagtcgc

SEQ ID NO: 872834 - DNA, 25 bp, Mus musculus
agcatcgagaaagacgagtaggtaa

SEQ ID NO: 872835 - DNA, 25 bp, Mus musculus
agcatcgagaaagaggagtaggtaa

SEQ ID NO: 872836 - DNA, 25 bp, Mus musculus
agcatcgaggagcaagaattcaacg

SEQ ID NO: 872837 - DNA, 25 bp, Mus musculus
agcatcgaggaggaagaattcaacg

SEQ ID NO: 872838 - DNA, 25 bp, Mus musculus
agcatctagttgagaggagtttaag

SEQ ID NO: 872839 - DNA, 25 bp, Mus musculus
agcatctagttgtgaggagtttaag

SEQ ID NO: 872840 - DNA, 25 bp, Mus musculus
agcatctatcaacggagcaccatca

SEQ ID NO: 872841 - DNA, 25 bp, Mus musculus
agcatctatcaagggagcaccatca

SEQ ID NO: 872842 - DNA, 25 bp, Mus musculus
agcatctcaaaccacgattatccca

SEQ ID NO: 872843 - DNA, 25 bp, Mus musculus
agcatctcaaaccaggattatccca

SEQ ID NO: 872844 - DNA, 25 bp, Mus musculus
agcatctcaagcaaaacgaagagat

SEQ ID NO: 872845 - DNA, 25 bp, Mus musculus
agcatctcaagcccaagcagtagct

SEQ ID NO: 872846 - DNA, 25 bp, Mus musculus
agcatctcaagcgcaagcagtagct

SEQ ID NO: 872847 - DNA, 25 bp, Mus musculus
agcatctcaagctaaacgaagagat

SEQ ID NO: 872848 - DNA, 25 bp, Mus musculus
agcatctcccagctaaatcacaaca

SEQ ID NO: 872849 - DNA, 25 bp, Mus musculus
agcatctcccaggtaaatcacaaca

SEQ ID NO: 872850 - DNA, 25 bp, Mus musculus
agcatctctgcccggtcatcgagca

SEQ ID NO: 872851 - DNA, 25 bp, Mus musculus
agcatctctgccgggtcatcgagca

SEQ ID NO: 872852 - DNA, 25 bp, Mus musculus
agcatctgagcaacaagcaatggca

SEQ ID NO: 872853 - DNA, 25 bp, Mus musculus
agcatctgagcaagactcttcaatc

SEQ ID NO: 872854 - DNA, 25 bp, Mus musculus
agcatctgaggaacaagcaatggca

SEQ ID NO: 872855 - DNA, 25 bp, Mus musculus
agcatctgaggaagactcttcaatc

SEQ ID NO: 872856 - DNA, 25 bp, Mus musculus
agcatctgccagcacaatggcattg

SEQ ID NO: 872857 - DNA, 25 bp, Mus musculus
agcatctgccagcagaatggcattg

SEQ ID NO: 872858 - DNA, 25 bp, Mus musculus
agcatctgggaacaagccaccatgg

SEQ ID NO: 872859 - DNA, 25 bp, Mus musculus
agcatctgggaagaagccaccatgg

SEQ ID NO: 872860 - DNA, 25 bp, Mus musculus
agcatctgggatttctgggaacgcg

SEQ ID NO: 872861 - DNA, 25 bp, Mus musculus
agcatctgggttttctgggaacgcg

SEQ ID NO: 872862 - DNA, 25 bp, Mus musculus
agcatcttctaacgttttccattat

SEQ ID NO: 872863 - DNA, 25 bp, Mus musculus
agcatcttctaaggttttccattat

SEQ ID NO: 872864 - DNA, 25 bp, Mus musculus
agcatctttgcgtacctttcaacag

SEQ ID NO: 872865 - DNA, 25 bp, Mus musculus
agcatctttgggtacctttcaacag

SEQ ID NO: 872866 - DNA, 25 bp, Mus musculus
agcatgaaggcccccggccgccttc

SEQ ID NO: 872867 - DNA, 25 bp, Mus musculus
agcatgaaggccccgggccgccttc

SEQ ID NO: 872868 - DNA, 25 bp, Mus musculus
agcatgaatcttcacgggctggctg

SEQ ID NO: 872869 - DNA, 25 bp, Mus musculus
agcatgaatcttcaggggctggctg

SEQ ID NO: 872870 - DNA, 25 bp, Mus musculus
agcatgactctgctgatcaagatat

SEQ ID NO: 872871 - DNA, 25 bp, Mus musculus
agcatgactctggtgatcaagatat

SEQ ID NO: 872872 - DNA, 25 bp, Mus musculus
agcatgactgagtgtccattgtcca

SEQ ID NO: 872873 - DNA, 25 bp, Mus musculus
agcatgactgtgtgtccattgtcca

SEQ ID NO: 872874 - DNA, 25 bp, Mus musculus
agcatgcagaacagtcacagcggag

SEQ ID NO: 872875 - DNA, 25 bp, Mus musculus
agcatgcagaactgtcacagcggag

SEQ ID NO: 872876 - DNA, 25 bp, Mus musculus
agcatgcaggcgagccctggaggac

SEQ ID NO: 872877 - DNA, 25 bp, Mus musculus
agcatgcaggggagccctggaggac

SEQ ID NO: 872878 - DNA, 25 bp, Mus musculus
agcatgctggcacagcccaacgatg

SEQ ID NO: 872879 - DNA, 25 bp, Mus musculus
agcatgctggcagagcccaacgatg

SEQ ID NO: 872880 - DNA, 25 bp, Mus musculus
agcatggaataacctcagctatgta

SEQ ID NO: 872881 - DNA, 25 bp, Mus musculus
agcatggaataagctcagctatgta

SEQ ID NO: 872882 - DNA, 25 bp, Mus musculus
agcatggacaaacaagaccgtctta

SEQ ID NO: 872883 - DNA, 25 bp, Mus musculus
agcatggacaaagaagaccgtctta

SEQ ID NO: 872884 - DNA, 25 bp, Mus musculus
agcatggacgactctcacacactac

SEQ ID NO: 872885 - DNA, 25 bp, Mus musculus
agcatggacgcacgttctccaaacc

SEQ ID NO: 872886 - DNA, 25 bp, Mus musculus
agcatggacgcaggttctccaaacc

SEQ ID NO: 872887 - DNA, 25 bp, Mus musculus
agcatggacgtctctcacacactac

SEQ ID NO: 872888 - DNA, 25 bp, Mus musculus
agcatggcagagcctcctcttccag

SEQ ID NO: 872889 - DNA, 25 bp, Mus musculus
agcatggcagaggctcctcttccag

SEQ ID NO: 872890 - DNA, 25 bp, Mus musculus
agcatggcagatgaaccggacaaaa

SEQ ID NO: 872891 - DNA, 25 bp, Mus musculus
agcatggcagttgaaccggacaaaa

SEQ ID NO: 872892 - DNA, 25 bp, Mus musculus
agcatggctctacattcattcagct

SEQ ID NO: 872893 - DNA, 25 bp, Mus musculus
agcatggctctagattcattcagct

SEQ ID NO: 872894 - DNA, 25 bp, Mus musculus
agcatgggcaatcaagtgcttcaga

SEQ ID NO: 872895 - DNA, 25 bp, Mus musculus
agcatgggcaatgaagtgcttcaga

SEQ ID NO: 872896 - DNA, 25 bp, Mus musculus
agcatgggtcagcttttctactatt

SEQ ID NO: 872897 - DNA, 25 bp, Mus musculus
agcatgggtcaggttttctactatt

SEQ ID NO: 872898 - DNA, 25 bp, Mus musculus
agcatgggtgtgagcaggtggagca

SEQ ID NO: 872899 - DNA, 25 bp, Mus musculus
agcatgggtgtgaggaggtggagca

SEQ ID NO: 872900 - DNA, 25 bp, Mus musculus
agcatggtccagcattgaggctaag

SEQ ID NO: 872901 - DNA, 25 bp, Mus musculus
agcatggtccaggattgaggctaag

SEQ ID NO: 872902 - DNA, 25 bp, Mus musculus
agcatggtgaaatacattatgaagc

SEQ ID NO: 872903 - DNA, 25 bp, Mus musculus
agcatggtgaaatagattatgaagc

SEQ ID NO: 872904 - DNA, 25 bp, Mus musculus
agcatggttcaacatgaagtgtccg

SEQ ID NO: 872905 - DNA, 25 bp, Mus musculus
agcatggttcaagatgaagtgtccg

SEQ ID NO: 872906 - DNA, 25 bp, Mus musculus
agcatggttccacattcatacagca

SEQ ID NO: 872907 - DNA, 25 bp, Mus musculus
agcatggttccagattcatacagca

SEQ ID NO: 872908 - DNA, 25 bp, Mus musculus
agcatgtgaagaaacccccacgcct

SEQ ID NO: 872909 - DNA, 25 bp, Mus musculus
agcatgtgaagaaagccccacgcct

SEQ ID NO: 872910 - DNA, 25 bp, Mus musculus
agcatgtgatttcacgttgatgact

SEQ ID NO: 872911 - DNA, 25 bp, Mus musculus
agcatgtgatttcaggttgatgact

SEQ ID NO: 872912 - DNA, 25 bp, Mus musculus
agcatgtggggccacgtgtcctgtc

SEQ ID NO: 872913 - DNA, 25 bp, Mus musculus
agcatgtggggccaggtgtcctgtc

SEQ ID NO: 872914 - DNA, 25 bp, Mus musculus
agcattacaacgaggtgcccctgaa

SEQ ID NO: 872915 - DNA, 25 bp, Mus musculus
agcattacaaggaggtgcccctgaa

SEQ ID NO: 872916 - DNA, 25 bp, Mus musculus
agcattactcagagaaagctgatgg

SEQ ID NO: 872917 - DNA, 25 bp, Mus musculus
agcattactcagagagagccgcagg

SEQ ID NO: 872918 - DNA, 25 bp, Mus musculus
agcattactcagtgaaagctgatgg

SEQ ID NO: 872919 - DNA, 25 bp, Mus musculus
agcattactcagtgagagccgcagg

SEQ ID NO: 872920 - DNA, 25 bp, Mus musculus
agcattcatttaaggatccagaaaa

SEQ ID NO: 872921 - DNA, 25 bp, Mus musculus
agcattcatttatggatccagaaaa

SEQ ID NO: 872922 - DNA, 25 bp, Mus musculus
agcattcctgaacatgcgaccatca

SEQ ID NO: 872923 - DNA, 25 bp, Mus musculus
agcattcctgaagatgcgaccatca

SEQ ID NO: 872924 - DNA, 25 bp, Mus musculus
agcattccttttccccctcatattg

SEQ ID NO: 872925 - DNA, 25 bp, Mus musculus
agcattccttttgcccctcatattg

SEQ ID NO: 872926 - DNA, 25 bp, Mus musculus
agcattctcaagcagatttctcctc

SEQ ID NO: 872927 - DNA, 25 bp, Mus musculus
agcattctcaaggagatttctcctc

SEQ ID NO: 872928 - DNA, 25 bp, Mus musculus
agcattctgcaagtcggtgggacca

SEQ ID NO: 872929 - DNA, 25 bp, Mus musculus
agcattctgcaagtgggtgggacca

SEQ ID NO: 872930 - DNA, 25 bp, Mus musculus
agcattgctgagcttgaaaatgagg

SEQ ID NO: 872931 - DNA, 25 bp, Mus musculus
agcattgctgaggttgaaaatgagg

SEQ ID NO: 872932 - DNA, 25 bp, Mus musculus
agcattgctgtcactgaaaaatgaa

SEQ ID NO: 872933 - DNA, 25 bp, Mus musculus
agcattgctgtctctgaaaaatgaa

SEQ ID NO: 872934 - DNA, 25 bp, Mus musculus
agcattggaagactgtatcctcaga

SEQ ID NO: 872935 - DNA, 25 bp, Mus musculus
agcattggaagagtgtatcctcaga

SEQ ID NO: 872936 - DNA, 25 bp, Mus musculus
agcattggatatcaaggccctgcac

SEQ ID NO: 872937 - DNA, 25 bp, Mus musculus
agcattggatatcatggccctgcac

SEQ ID NO: 872938 - DNA, 25 bp, Mus musculus
agcatttacacccaccaatcccagg

SEQ ID NO: 872939 - DNA, 25 bp, Mus musculus
agcatttacacccagcaatcccagg

SEQ ID NO: 872940 - DNA, 25 bp, Mus musculus
agcatttcgcaacggtcatgtaaaa

SEQ ID NO: 872941 - DNA, 25 bp, Mus musculus
agcatttcgcaagggtcatgtaaaa

SEQ ID NO: 872942 - DNA, 25 bp, Mus musculus
agcatttcttgacgtaaatgaggaa

SEQ ID NO: 872943 - DNA, 25 bp, Mus musculus
agcatttcttgaggtaaatgaggaa

SEQ ID NO: 872944 - DNA, 25 bp, Mus musculus
agcatttgcccacaggagggcattg

SEQ ID NO: 872945 - DNA, 25 bp, Mus musculus
agcatttgcccagaggagggcattg

SEQ ID NO: 872946 - DNA, 25 bp, Mus musculus
agcatttggtgacgtgcggcttgtt

SEQ ID NO: 872947 - DNA, 25 bp, Mus musculus
agcatttggtgaggtgcggcttgtt

SEQ ID NO: 872948 - DNA, 25 bp, Mus musculus
agcattttctggcgaatgaattcca

SEQ ID NO: 872949 - DNA, 25 bp, Mus musculus
agcattttctggggaatgaattcca

SEQ ID NO: 872950 - DNA, 25 bp, Mus musculus
agccaaaaagaagaagcacttaaag

SEQ ID NO: 872951 - DNA, 25 bp, Mus musculus
agccaaaaagagcaagaagcggaac

SEQ ID NO: 872952 - DNA, 25 bp, Mus musculus
agccaaaaagtagaagcacttaaag

SEQ ID NO: 872953 - DNA, 25 bp, Mus musculus
agccaaaaagtgcaagaagcggaac

SEQ ID NO: 872954 - DNA, 25 bp, Mus musculus
agccaaacacggcctctcaggtcct

SEQ ID NO: 872955 - DNA, 25 bp, Mus musculus
agccaaacacgggctctcaggtcct

SEQ ID NO: 872956 - DNA, 25 bp, Mus musculus
agccaaactgctcacgaataaagct

SEQ ID NO: 872957 - DNA, 25 bp, Mus musculus
agccaaactgctcaggaataaagct

SEQ ID NO: 872958 - DNA, 25 bp, Mus musculus
agccaaagaaaaccaaagacaagct

SEQ ID NO: 872959 - DNA, 25 bp, Mus musculus
agccaaagaaaagcaaagacaagct

SEQ ID NO: 872960 - DNA, 25 bp, Mus musculus
agccaaatccagcttctagcaccga

SEQ ID NO: 872961 - DNA, 25 bp, Mus musculus
agccaaatccaggttctagcaccga

SEQ ID NO: 872962 - DNA, 25 bp, Mus musculus
agccaacaaccgcagctctccagct

SEQ ID NO: 872963 - DNA, 25 bp, Mus musculus
agccaacaacggcagctctccagct

SEQ ID NO: 872964 - DNA, 25 bp, Mus musculus
agccaacaagagctctgaagatatc

SEQ ID NO: 872965 - DNA, 25 bp, Mus musculus
agccaacaagtgctctgaagatatc

SEQ ID NO: 872966 - DNA, 25 bp, Mus musculus
agccaacacaaacggcatttgcttc

SEQ ID NO: 872967 - DNA, 25 bp, Mus musculus
agccaacacaaagggcatttgcttc

SEQ ID NO: 872968 - DNA, 25 bp, Mus musculus
agccaacagaagaagaaacaactgg

SEQ ID NO: 872969 - DNA, 25 bp, Mus musculus
agccaacagatgaagaaacaactgg

SEQ ID NO: 872970 - DNA, 25 bp, Mus musculus
agccaacatcaaagtgtgctccctt

SEQ ID NO: 872971 - DNA, 25 bp, Mus musculus
agccaacatcaatgtgtgctccctt

SEQ ID NO: 872972 - DNA, 25 bp, Mus musculus
agccaacatcatcaaactaggggat

SEQ ID NO: 872973 - DNA, 25 bp, Mus musculus
agccaacatcatgaaactaggggat

SEQ ID NO: 872974 - DNA, 25 bp, Mus musculus
agccaacatccttcgagctggtgag

SEQ ID NO: 872975 - DNA, 25 bp, Mus musculus
agccaacatcgttcgagctggtgag

SEQ ID NO: 872976 - DNA, 25 bp, Mus musculus
agccaacatgctcgtgaaaatacat

SEQ ID NO: 872977 - DNA, 25 bp, Mus musculus
agccaacatggtcgtgaaaatacat

SEQ ID NO: 872978 - DNA, 25 bp, Mus musculus
agccaaccagacatgccatgtcgga

SEQ ID NO: 872979 - DNA, 25 bp, Mus musculus
agccaaccagacttgccatgtcgga

SEQ ID NO: 872980 - DNA, 25 bp, Mus musculus
agccaaccagcgcaaatgtgagcgt

SEQ ID NO: 872981 - DNA, 25 bp, Mus musculus
agccaaccagcggaaatgtgagcgt

SEQ ID NO: 872982 - DNA, 25 bp, Mus musculus
agccaacccaaaagcccggcccaca

SEQ ID NO: 872983 - DNA, 25 bp, Mus musculus
agccaacccaaatgcccggcccaca

SEQ ID NO: 872984 - DNA, 25 bp, Mus musculus
agccaacgtctgatttccagtccct

SEQ ID NO: 872985 - DNA, 25 bp, Mus musculus
agccaacgtctgttttccagtccct

SEQ ID NO: 872986 - DNA, 25 bp, Mus musculus
agccaagaacaataccattgtgaac

SEQ ID NO: 872987 - DNA, 25 bp, Mus musculus
agccaagaactataccattgtgaac

SEQ ID NO: 872988 - DNA, 25 bp, Mus musculus
agccaagaagctggcctggcccgcc

SEQ ID NO: 872989 - DNA, 25 bp, Mus musculus
agccaagaaggtggcctggcccgcc

SEQ ID NO: 872990 - DNA, 25 bp, Mus musculus
agccaagagaaaacagtccctaatg

SEQ ID NO: 872991 - DNA, 25 bp, Mus musculus
agccaagagaaaactgtccctaatg

SEQ ID NO: 872992 - DNA, 25 bp, Mus musculus
agccaagatgcccaaatcaacgtcc

SEQ ID NO: 872993 - DNA, 25 bp, Mus musculus
agccaagatgcccatatcaacgtcc

SEQ ID NO: 872994 - DNA, 25 bp, Mus musculus
agccaagcagagtttgaaaggaaca

SEQ ID NO: 872995 - DNA, 25 bp, Mus musculus
agccaagcagcacaacatgcccttc

SEQ ID NO: 872996 - DNA, 25 bp, Mus musculus
agccaagcagctattcctcagtacc

SEQ ID NO: 872997 - DNA, 25 bp, Mus musculus
agccaagcaggacaacatgcccttc

SEQ ID NO: 872998 - DNA, 25 bp, Mus musculus
agccaagcaggtattcctcagtacc

SEQ ID NO: 872999 - DNA, 25 bp, Mus musculus
agccaagcagtgtttgaaaggaaca

SEQ ID NO: 873000 - DNA, 25 bp, Mus musculus
agccaagcccatctaaaacagacta

SEQ ID NO: 873001 - DNA, 25 bp, Mus musculus
agccaagcccatgtaaaacagacta

SEQ ID NO: 873002 - DNA, 25 bp, Mus musculus
agccaagctcagagtgcctgctcac

SEQ ID NO: 873003 - DNA, 25 bp, Mus musculus
agccaagctcagtgtgcctgctcac

SEQ ID NO: 873004 - DNA, 25 bp, Mus musculus
agccaaggcatgacatcggggtagc

SEQ ID NO: 873005 - DNA, 25 bp, Mus musculus
agccaaggcatgagacactgcccca

SEQ ID NO: 873006 - DNA, 25 bp, Mus musculus
agccaaggcatgccagtcatcgggg

SEQ ID NO: 873007 - DNA, 25 bp, Mus musculus
agccaaggcatggcagtcatcgggg

SEQ ID NO: 873008 - DNA, 25 bp, Mus musculus
agccaaggcatgtcatcggggtagc

SEQ ID NO: 873009 - DNA, 25 bp, Mus musculus
agccaaggcatgtgacactgcccca

SEQ ID NO: 873010 - DNA, 25 bp, Mus musculus
agccaaggccagcatcaaccctgtg

SEQ ID NO: 873011 - DNA, 25 bp, Mus musculus
agccaaggccaggatcaaccctgtg

SEQ ID NO: 873012 - DNA, 25 bp, Mus musculus
agccaaggtgatgaagaaactgtca

SEQ ID NO: 873013 - DNA, 25 bp, Mus musculus
agccaaggtgatgatgaaactgtca

SEQ ID NO: 873014 - DNA, 25 bp, Mus musculus
agccaagttcaaatcagacatccta

SEQ ID NO: 873015 - DNA, 25 bp, Mus musculus
agccaagttcaaatgagacatccta

SEQ ID NO: 873016 - DNA, 25 bp, Mus musculus
agccaatcagctgtccggtacctgg

SEQ ID NO: 873017 - DNA, 25 bp, Mus musculus
agccaatcaggtgtccggtacctgg

SEQ ID NO: 873018 - DNA, 25 bp, Mus musculus
agccaatcccagatatgctcctggg

SEQ ID NO: 873019 - DNA, 25 bp, Mus musculus
agccaatcccagttatgctcctggg

SEQ ID NO: 873020 - DNA, 25 bp, Mus musculus
agccaatctgccaacagacaaacag

SEQ ID NO: 873021 - DNA, 25 bp, Mus musculus
agccaatctgccaactggtccagtg

SEQ ID NO: 873022 - DNA, 25 bp, Mus musculus
agccaatctgccaagagacaaacag

SEQ ID NO: 873023 - DNA, 25 bp, Mus musculus
agccaatctgccaagtggtccagtg

SEQ ID NO: 873024 - DNA, 25 bp, Mus musculus
agccaatgctgacagcaactgtggg

SEQ ID NO: 873025 - DNA, 25 bp, Mus musculus
agccaatgctgacgatgcccaagaa

SEQ ID NO: 873026 - DNA, 25 bp, Mus musculus
agccaatgctgagagcaactgtggg

SEQ ID NO: 873027 - DNA, 25 bp, Mus musculus
agccaatgctgaggatgcccaagaa

SEQ ID NO: 873028 - DNA, 25 bp, Mus musculus
agccaatggcgaatacatccctgct

SEQ ID NO: 873029 - DNA, 25 bp, Mus musculus
agccaatggcgattacatccctgct

SEQ ID NO: 873030 - DNA, 25 bp, Mus musculus
agccaattacagaatctgggagcag

SEQ ID NO: 873031 - DNA, 25 bp, Mus musculus
agccaattactgaatctgggagcag

SEQ ID NO: 873032 - DNA, 25 bp, Mus musculus
agccaattgcctctgatggtgtgga

SEQ ID NO: 873033 - DNA, 25 bp, Mus musculus
agccaattgcctgtgatggtgtgga

SEQ ID NO: 873034 - DNA, 25 bp, Mus musculus
agccaattggctctctgaatactgg

SEQ ID NO: 873035 - DNA, 25 bp, Mus musculus
agccaattgggtctctgaatactgg

SEQ ID NO: 873036 - DNA, 25 bp, Mus musculus
agccacaaaaaaatcctgcagctca

SEQ ID NO: 873037 - DNA, 25 bp, Mus musculus
agccacaaaaaattcctgcagctca

SEQ ID NO: 873038 - DNA, 25 bp, Mus musculus
agccacacagccacagtctggtgta

SEQ ID NO: 873039 - DNA, 25 bp, Mus musculus
agccacacaggcacagtctggtgta

SEQ ID NO: 873040 - DNA, 25 bp, Mus musculus
agccacaccacccacactatgaaat

SEQ ID NO: 873041 - DNA, 25 bp, Mus musculus
agccacaccacccagactatgaaat

SEQ ID NO: 873042 - DNA, 25 bp, Mus musculus
agccacagagcccgttcccatatcc

SEQ ID NO: 873043 - DNA, 25 bp, Mus musculus
agccacagaggccgttcccatatcc

SEQ ID NO: 873044 - DNA, 25 bp, Mus musculus
agccacaggatgaaataacagttac

SEQ ID NO: 873045 - DNA, 25 bp, Mus musculus
agccacaggatgatggcagtgaaat

SEQ ID NO: 873046 - DNA, 25 bp, Mus musculus
agccacaggatgtaataacagttac

SEQ ID NO: 873047 - DNA, 25 bp, Mus musculus
agccacaggatgttggcagtgaaat

SEQ ID NO: 873048 - DNA, 25 bp, Mus musculus
agccacagtcaacgactcattgtgg

SEQ ID NO: 873049 - DNA, 25 bp, Mus musculus
agccacagtcaaggactcattgtgg

SEQ ID NO: 873050 - DNA, 25 bp, Mus musculus
agccacagtttcttcgtctggaata

SEQ ID NO: 873051 - DNA, 25 bp, Mus musculus
agccacagtttcttggtctggaata

SEQ ID NO: 873052 - DNA, 25 bp, Mus musculus
agccacatatagcaggccttgctcc

SEQ ID NO: 873053 - DNA, 25 bp, Mus musculus
agccacatatagcccttgctccagc

SEQ ID NO: 873054 - DNA, 25 bp, Mus musculus
agccacatatagctggtgtattctc

SEQ ID NO: 873055 - DNA, 25 bp, Mus musculus
agccacatataggaggccttgctcc

SEQ ID NO: 873056 - DNA, 25 bp, Mus musculus
agccacatataggccttgctccagc

SEQ ID NO: 873057 - DNA, 25 bp, Mus musculus
agccacatataggtggtgtattctc

SEQ ID NO: 873058 - DNA, 25 bp, Mus musculus
agccaccaagacccatctgaagcaa

SEQ ID NO: 873059 - DNA, 25 bp, Mus musculus
agccaccaagtcccatctgaagcaa

SEQ ID NO: 873060 - DNA, 25 bp, Mus musculus
agccacccaattcgctgttaacaaa

SEQ ID NO: 873061 - DNA, 25 bp, Mus musculus
agccacccaattggctgttaacaaa

SEQ ID NO: 873062 - DNA, 25 bp, Mus musculus
agccacccagaagacgtagaggccg

SEQ ID NO: 873063 - DNA, 25 bp, Mus musculus
agccacccagaagaggtagaggccg

SEQ ID NO: 873064 - DNA, 25 bp, Mus musculus
agccaccgaacacactgaggatgcc

SEQ ID NO: 873065 - DNA, 25 bp, Mus musculus
agccaccgaacacagtgaggatgcc

SEQ ID NO: 873066 - DNA, 25 bp, Mus musculus
agccacctggacctattccaccgaa

SEQ ID NO: 873067 - DNA, 25 bp, Mus musculus
agccacctggacgtattccaccgaa

SEQ ID NO: 873068 - DNA, 25 bp, Mus musculus
agccacgaagacccttctgcagtcc

SEQ ID NO: 873069 - DNA, 25 bp, Mus musculus
agccacgaagtcccttctgcagtcc

SEQ ID NO: 873070 - DNA, 25 bp, Mus musculus
agccacgatgtgtgcaaattctctg

SEQ ID NO: 873071 - DNA, 25 bp, Mus musculus
agccacgatgtgtggaaattctctg

SEQ ID NO: 873072 - DNA, 25 bp, Mus musculus
agccacggagaggacggagggagcc

SEQ ID NO: 873073 - DNA, 25 bp, Mus musculus
agccacggagaggagggagggagcc

SEQ ID NO: 873074 - DNA, 25 bp, Mus musculus
agccacggagctggaaatgagctgg

SEQ ID NO: 873075 - DNA, 25 bp, Mus musculus
agccacggaggtggaaatgagctgg

SEQ ID NO: 873076 - DNA, 25 bp, Mus musculus
agccacgtaaagatggagaaatgga

SEQ ID NO: 873077 - DNA, 25 bp, Mus musculus
agccacgtaaagttggagaaatgga

SEQ ID NO: 873078 - DNA, 25 bp, Mus musculus
agccactcagaacccctggcctcct

SEQ ID NO: 873079 - DNA, 25 bp, Mus musculus
agccactcagtacccctggcctcct

SEQ ID NO: 873080 - DNA, 25 bp, Mus musculus
agccactccctctgcctctctcaaa

SEQ ID NO: 873081 - DNA, 25 bp, Mus musculus
agccactccctctggctctctcaaa

SEQ ID NO: 873082 - DNA, 25 bp, Mus musculus
agccactctagcagtgttccgaatg

SEQ ID NO: 873083 - DNA, 25 bp, Mus musculus
agccactctagctgtgttccgaatg

SEQ ID NO: 873084 - DNA, 25 bp, Mus musculus
agccacttaagaccaattactgaca

SEQ ID NO: 873085 - DNA, 25 bp, Mus musculus
agccacttaagacctattactgaca

SEQ ID NO: 873086 - DNA, 25 bp, Mus musculus
agccacttactacaatttctgaagt

SEQ ID NO: 873087 - DNA, 25 bp, Mus musculus
agccacttactagaatttctgaagt

SEQ ID NO: 873088 - DNA, 25 bp, Mus musculus
agccagaaaacacgtgctgcctagg

SEQ ID NO: 873089 - DNA, 25 bp, Mus musculus
agccagaaaacaggtgctgcctagg

SEQ ID NO: 873090 - DNA, 25 bp, Mus musculus
agccagaaaatgcacatttgggctt

SEQ ID NO: 873091 - DNA, 25 bp, Mus musculus
agccagaaaatggacatttgggctt

SEQ ID NO: 873092 - DNA, 25 bp, Mus musculus
agccagaaagattcaggccatccat

SEQ ID NO: 873093 - DNA, 25 bp, Mus musculus
agccagaaagctccacaccagtcac

SEQ ID NO: 873094 - DNA, 25 bp, Mus musculus
agccagaaaggtccacaccagtcac

SEQ ID NO: 873095 - DNA, 25 bp, Mus musculus
agccagaaagtttcaggccatccat

SEQ ID NO: 873096 - DNA, 25 bp, Mus musculus
agccagaagcaacgagttcacaggc

SEQ ID NO: 873097 - DNA, 25 bp, Mus musculus
agccagaagcaaggagttcacaggc

SEQ ID NO: 873098 - DNA, 25 bp, Mus musculus
agccagaagcagccttggttcctgc

SEQ ID NO: 873099 - DNA, 25 bp, Mus musculus
agccagaagcaggcttggttcctgc

SEQ ID NO: 873100 - DNA, 25 bp, Mus musculus
agccagaatactcgggtggctacat

SEQ ID NO: 873101 - DNA, 25 bp, Mus musculus
agccagaatactggggtggctacat

SEQ ID NO: 873102 - DNA, 25 bp, Mus musculus
agccagacaaagctacactaggagg

SEQ ID NO: 873103 - DNA, 25 bp, Mus musculus
agccagacaaaggtacactaggagg

SEQ ID NO: 873104 - DNA, 25 bp, Mus musculus
agccagacacatatgttcagcatat

SEQ ID NO: 873105 - DNA, 25 bp, Mus musculus
agccagacacatttgttcagcatat

SEQ ID NO: 873106 - DNA, 25 bp, Mus musculus
agccagagagcgtctgcgagcttta

SEQ ID NO: 873107 - DNA, 25 bp, Mus musculus
agccagagaggacgttttttcgccg

SEQ ID NO: 873108 - DNA, 25 bp, Mus musculus
agccagagaggaggttttttcgccg

SEQ ID NO: 873109 - DNA, 25 bp, Mus musculus
agccagagagggtctgcgagcttta

SEQ ID NO: 873110 - DNA, 25 bp, Mus musculus
agccagagcaccctcgactacattg

SEQ ID NO: 873111 - DNA, 25 bp, Mus musculus
agccagagcaccctggactacattg

SEQ ID NO: 873112 - DNA, 25 bp, Mus musculus
agccagaggatgaactccaatggac

SEQ ID NO: 873113 - DNA, 25 bp, Mus musculus
agccagaggatgaagtccaatggac

SEQ ID NO: 873114 - DNA, 25 bp, Mus musculus
agccagaggcagagtgaagaaatcg

SEQ ID NO: 873115 - DNA, 25 bp, Mus musculus
agccagaggcagtgtgaagaaatcg

SEQ ID NO: 873116 - DNA, 25 bp, Mus musculus
agccagagttagctgtcaagactcc

SEQ ID NO: 873117 - DNA, 25 bp, Mus musculus
agccagagttaggtgtcaagactcc

SEQ ID NO: 873118 - DNA, 25 bp, Mus musculus
agccagatcgacagcaaagagccct

SEQ ID NO: 873119 - DNA, 25 bp, Mus musculus
agccagatcgccctacatgaagatc

SEQ ID NO: 873120 - DNA, 25 bp, Mus musculus
agccagatcggcctacatgaagatc

SEQ ID NO: 873121 - DNA, 25 bp, Mus musculus
agccagatcgtcagcaaagagccct

SEQ ID NO: 873122 - DNA, 25 bp, Mus musculus
agccagcaacaacacatacaacagc

SEQ ID NO: 873123 - DNA, 25 bp, Mus musculus
agccagcaacaacagatacaacagc

SEQ ID NO: 873124 - DNA, 25 bp, Mus musculus
agccagcaagaccaacaagcttcgt

SEQ ID NO: 873125 - DNA, 25 bp, Mus musculus
agccagcaagtccaacaagcttcgt

SEQ ID NO: 873126 - DNA, 25 bp, Mus musculus
agccagcaatcgtgctcagacctgc

SEQ ID NO: 873127 - DNA, 25 bp, Mus musculus
agccagcaatggtgctcagacctgc

SEQ ID NO: 873128 - DNA, 25 bp, Mus musculus
agccagcatgagttcctggcgcctc

SEQ ID NO: 873129 - DNA, 25 bp, Mus musculus
agccagcatgtgttcctggcgcctc

SEQ ID NO: 873130 - DNA, 25 bp, Mus musculus
agccagccaactaagactcctgcgc

SEQ ID NO: 873131 - DNA, 25 bp, Mus musculus
agccagccaacttagactcctgcgc

SEQ ID NO: 873132 - DNA, 25 bp, Mus musculus
agccagccacagccccaggccttgt

SEQ ID NO: 873133 - DNA, 25 bp, Mus musculus
agccagccacaggcccaggccttgt

SEQ ID NO: 873134 - DNA, 25 bp, Mus musculus
agccagccacttcccgtcaactatt

SEQ ID NO: 873135 - DNA, 25 bp, Mus musculus
agccagccacttccggtcaactatt

SEQ ID NO: 873136 - DNA, 25 bp, Mus musculus
agccagcccaaccaagctgctgaac

SEQ ID NO: 873137 - DNA, 25 bp, Mus musculus
agccagcccaaccatgctgctgaac

SEQ ID NO: 873138 - DNA, 25 bp, Mus musculus
agccagccctcgccttactggcaga

SEQ ID NO: 873139 - DNA, 25 bp, Mus musculus
agccagccctcggcttactggcaga

SEQ ID NO: 873140 - DNA, 25 bp, Mus musculus
agccagcctgagcgagccagaggaa

SEQ ID NO: 873141 - DNA, 25 bp, Mus musculus
agccagcctgagggagccagaggaa

SEQ ID NO: 873142 - DNA, 25 bp, Mus musculus
agccagcctgccgacccagtggaat

SEQ ID NO: 873143 - DNA, 25 bp, Mus musculus
agccagcctggagacgtccatatcc

SEQ ID NO: 873144 - DNA, 25 bp, Mus musculus
agccagcctggagaggtccatatcc

SEQ ID NO: 873145 - DNA, 25 bp, Mus musculus
agccagcctggcgacccagtggaat

SEQ ID NO: 873146 - DNA, 25 bp, Mus musculus
agccagctaaagctatgctaacaga

SEQ ID NO: 873147 - DNA, 25 bp, Mus musculus
agccagctaaaggtatgctaacaga

SEQ ID NO: 873148 - DNA, 25 bp, Mus musculus
agccagctccagagtgtggacctgg

SEQ ID NO: 873149 - DNA, 25 bp, Mus musculus
agccagctccagtgtgtggacctgg

SEQ ID NO: 873150 - DNA, 25 bp, Mus musculus
agccagctctcacccagcgcagcct

SEQ ID NO: 873151 - DNA, 25 bp, Mus musculus
agccagctctcaccgagcgcagcct

SEQ ID NO: 873152 - DNA, 25 bp, Mus musculus
agccagctgacgctgagagggcctt

SEQ ID NO: 873153 - DNA, 25 bp, Mus musculus
agccagctgacggtgagagggcctt

SEQ ID NO: 873154 - DNA, 25 bp, Mus musculus
agccagctgctgagaacccaatatg

SEQ ID NO: 873155 - DNA, 25 bp, Mus musculus
agccagctgctgtgaacccaatatg

SEQ ID NO: 873156 - DNA, 25 bp, Mus musculus
agccagctggctggccttgggatgg

SEQ ID NO: 873157 - DNA, 25 bp, Mus musculus
agccagctgggtggccttgggatgg

SEQ ID NO: 873158 - DNA, 25 bp, Mus musculus
agccagctgttacatgacggccata

SEQ ID NO: 873159 - DNA, 25 bp, Mus musculus
agccagctgttagatgacggccata

SEQ ID NO: 873160 - DNA, 25 bp, Mus musculus
agccagcttcctgacatagaagaca

SEQ ID NO: 873161 - DNA, 25 bp, Mus musculus
agccagcttcctgagatagaagaca

SEQ ID NO: 873162 - DNA, 25 bp, Mus musculus
agccagcttgctctgacagaagttg

SEQ ID NO: 873163 - DNA, 25 bp, Mus musculus
agccagcttggtctgacagaagttg

SEQ ID NO: 873164 - DNA, 25 bp, Mus musculus
agccaggaaaataacttctgaaaat

SEQ ID NO: 873165 - DNA, 25 bp, Mus musculus
agccaggaaaataagttctgaaaat

SEQ ID NO: 873166 - DNA, 25 bp, Mus musculus
agccaggaagagcacgatttcatca

SEQ ID NO: 873167 - DNA, 25 bp, Mus musculus
agccaggaagagcaggatttcatca

SEQ ID NO: 873168 - DNA, 25 bp, Mus musculus
agccaggacgagctgacagtccaga

SEQ ID NO: 873169 - DNA, 25 bp, Mus musculus
agccaggacgtgctgacagtccaga

SEQ ID NO: 873170 - DNA, 25 bp, Mus musculus
agccaggagaatcgtccgtctccca

SEQ ID NO: 873171 - DNA, 25 bp, Mus musculus
agccaggagaatggtccgtctccca

SEQ ID NO: 873172 - DNA, 25 bp, Mus musculus
agccaggagcagctcgctgcagagc

SEQ ID NO: 873173 - DNA, 25 bp, Mus musculus
agccaggagcagctggctgcagagc

SEQ ID NO: 873174 - DNA, 25 bp, Mus musculus
agccaggcagtgaacgaccgtgcag

SEQ ID NO: 873175 - DNA, 25 bp, Mus musculus
agccaggcagtgaacgcccttgctg

SEQ ID NO: 873176 - DNA, 25 bp, Mus musculus
agccaggcagtgaaggaccgtgcag

SEQ ID NO: 873177 - DNA, 25 bp, Mus musculus
agccaggcagtgaaggcccttgctg

SEQ ID NO: 873178 - DNA, 25 bp, Mus musculus
agccaggcggagcacgccccagaga

SEQ ID NO: 873179 - DNA, 25 bp, Mus musculus
agccaggcggtgcacgccccagaga

SEQ ID NO: 873180 - DNA, 25 bp, Mus musculus
agccaggcgtggcgccgcagcctcg

SEQ ID NO: 873181 - DNA, 25 bp, Mus musculus
agccaggcgtggggccgcagcctcg

SEQ ID NO: 873182 - DNA, 25 bp, Mus musculus
agccaggctagacatcctgcagctt

SEQ ID NO: 873183 - DNA, 25 bp, Mus musculus
agccaggctagagatcctgcagctt

SEQ ID NO: 873184 - DNA, 25 bp, Mus musculus
agccagggaggacattttacatctc

SEQ ID NO: 873185 - DNA, 25 bp, Mus musculus
agccagggaggagattttacatctc

SEQ ID NO: 873186 - DNA, 25 bp, Mus musculus
agccagggccagatgtcatggacca

SEQ ID NO: 873187 - DNA, 25 bp, Mus musculus
agccagggccagttgtcatggacca

SEQ ID NO: 873188 - DNA, 25 bp, Mus musculus
agccaggtacctcatgtgatggtgg

SEQ ID NO: 873189 - DNA, 25 bp, Mus musculus
agccaggtacctgatgtgatggtgg

SEQ ID NO: 873190 - DNA, 25 bp, Mus musculus
agccagtcaatgctatcattgagca

SEQ ID NO: 873191 - DNA, 25 bp, Mus musculus
agccagtcaatggtatcattgagca

SEQ ID NO: 873192 - DNA, 25 bp, Mus musculus
agccagtcagagcgcgccagcgctt

SEQ ID NO: 873193 - DNA, 25 bp, Mus musculus
agccagtcagagggcgccagcgctt

SEQ ID NO: 873194 - DNA, 25 bp, Mus musculus
agccagtgagagagcagggctgagg

SEQ ID NO: 873195 - DNA, 25 bp, Mus musculus
agccagtgagtgagcagggctgagg

SEQ ID NO: 873196 - DNA, 25 bp, Mus musculus
agccagtgtgacagttgcagggctg

SEQ ID NO: 873197 - DNA, 25 bp, Mus musculus
agccagtgtgatgcagggctgggac

SEQ ID NO: 873198 - DNA, 25 bp, Mus musculus
agccagtgtgtcagttgcagggctg

SEQ ID NO: 873199 - DNA, 25 bp, Mus musculus
agccagtgtgttgcagggctgggac

SEQ ID NO: 873200 - DNA, 25 bp, Mus musculus
agccagtttgctaagaccctaagtg

SEQ ID NO: 873201 - DNA, 25 bp, Mus musculus
agccagtttggtaagaccctaagtg

SEQ ID NO: 873202 - DNA, 25 bp, Mus musculus
agccataacctgaatgtagagtaca

SEQ ID NO: 873203 - DNA, 25 bp, Mus musculus
agccataacctgtatgtagagtaca

SEQ ID NO: 873204 - DNA, 25 bp, Mus musculus
agccatactatgatccctcaagaac

SEQ ID NO: 873205 - DNA, 25 bp, Mus musculus
agccatactatgttccctcaagaac

SEQ ID NO: 873206 - DNA, 25 bp, Mus musculus
agccatactccgacccactcgctga

SEQ ID NO: 873207 - DNA, 25 bp, Mus musculus
agccatactcggacccactcgctga

SEQ ID NO: 873208 - DNA, 25 bp, Mus musculus
agccatcaaagactcctggacacac

SEQ ID NO: 873209 - DNA, 25 bp, Mus musculus
agccatcaaagagtcctggacacac

SEQ ID NO: 873210 - DNA, 25 bp, Mus musculus
agccatcacccgaaacaggccacca

SEQ ID NO: 873211 - DNA, 25 bp, Mus musculus
agccatcacccgtaacaggccacca

SEQ ID NO: 873212 - DNA, 25 bp, Mus musculus
agccatcacctctgcgtactatcgt

SEQ ID NO: 873213 - DNA, 25 bp, Mus musculus
agccatcacctctgggtactatcgt

SEQ ID NO: 873214 - DNA, 25 bp, Mus musculus
agccatcactaacatcaaaccacat

SEQ ID NO: 873215 - DNA, 25 bp, Mus musculus
agccatcactaagatcaaaccacat

SEQ ID NO: 873216 - DNA, 25 bp, Mus musculus
agccatcagacaaattggctggatc

SEQ ID NO: 873217 - DNA, 25 bp, Mus musculus
agccatcagacatattggctggatc

SEQ ID NO: 873218 - DNA, 25 bp, Mus musculus
agccatcagagagacatcttctctg

SEQ ID NO: 873219 - DNA, 25 bp, Mus musculus
agccatcagagagagatcttctctg

SEQ ID NO: 873220 - DNA, 25 bp, Mus musculus
agccatcaggaggacgtttgaaaag

SEQ ID NO: 873221 - DNA, 25 bp, Mus musculus
agccatcaggaggaggtttgaaaag

SEQ ID NO: 873222 - DNA, 25 bp, Mus musculus
agccatcattcgctgtatgatgttc

SEQ ID NO: 873223 - DNA, 25 bp, Mus musculus
agccatcattcggtgtatgatgttc

SEQ ID NO: 873224 - DNA, 25 bp, Mus musculus
agccatcccccgagctacaaatgga

SEQ ID NO: 873225 - DNA, 25 bp, Mus musculus
agccatcccccgcagtgctacaaat

SEQ ID NO: 873226 - DNA, 25 bp, Mus musculus
agccatcccccgcttgaaagatgcc

SEQ ID NO: 873227 - DNA, 25 bp, Mus musculus
agccatcccccggagtgctacaaat

SEQ ID NO: 873228 - DNA, 25 bp, Mus musculus
agccatcccccggttgaaagatgcc

SEQ ID NO: 873229 - DNA, 25 bp, Mus musculus
agccatcccccgtgctacaaatgga

SEQ ID NO: 873230 - DNA, 25 bp, Mus musculus
agccatcccgagcgagaaatgtctg

SEQ ID NO: 873231 - DNA, 25 bp, Mus musculus
agccatcccgagggagaaatgtctg

SEQ ID NO: 873232 - DNA, 25 bp, Mus musculus
agccatcgctcagaagcgtaggaag

SEQ ID NO: 873233 - DNA, 25 bp, Mus musculus
agccatcgctgagaagcgtaggaag

SEQ ID NO: 873234 - DNA, 25 bp, Mus musculus
agccatcgttaacgtcttccatggt

SEQ ID NO: 873235 - DNA, 25 bp, Mus musculus
agccatcgttaaggtcttccatggt

SEQ ID NO: 873236 - DNA, 25 bp, Mus musculus
agccatctccaacgaactggcttcc

SEQ ID NO: 873237 - DNA, 25 bp, Mus musculus
agccatctccaaggaactggcttcc

SEQ ID NO: 873238 - DNA, 25 bp, Mus musculus
agccatctcccacggtgtagagtca

SEQ ID NO: 873239 - DNA, 25 bp, Mus musculus
agccatctcccagggtgtagagtca

SEQ ID NO: 873240 - DNA, 25 bp, Mus musculus
agccatgcggcgcccagagaccgct

SEQ ID NO: 873241 - DNA, 25 bp, Mus musculus
agccatgcggcggccagagaccgct

SEQ ID NO: 873242 - DNA, 25 bp, Mus musculus
agccatgctgcacgtgctgggcccc

SEQ ID NO: 873243 - DNA, 25 bp, Mus musculus
agccatgctgcaggtgctgggcccc

SEQ ID NO: 873244 - DNA, 25 bp, Mus musculus
agccatggagatcgagcagttgacc

SEQ ID NO: 873245 - DNA, 25 bp, Mus musculus
agccatggagatggagcagttgacc

SEQ ID NO: 873246 - DNA, 25 bp, Mus musculus
agccatgtactccggccgtcgttcc

SEQ ID NO: 873247 - DNA, 25 bp, Mus musculus
agccatgtactcgggccgtcgttcc

SEQ ID NO: 873248 - DNA, 25 bp, Mus musculus
agccattacaatgtgagatctgtgg

SEQ ID NO: 873249 - DNA, 25 bp, Mus musculus
agccattacattgtgagatctgtgg

SEQ ID NO: 873250 - DNA, 25 bp, Mus musculus
agccattactcgcacggcaacaaag

SEQ ID NO: 873251 - DNA, 25 bp, Mus musculus
agccattactcgcactgagatgagt

SEQ ID NO: 873252 - DNA, 25 bp, Mus musculus
agccattactcgcagggcaacaaag

SEQ ID NO: 873253 - DNA, 25 bp, Mus musculus
agccattactcgcagtgagatgagt

SEQ ID NO: 873254 - DNA, 25 bp, Mus musculus
agccattgaatatacacctgaaaac

SEQ ID NO: 873255 - DNA, 25 bp, Mus musculus
agccattgaatatagacctgaaaac

SEQ ID NO: 873256 - DNA, 25 bp, Mus musculus
agccattgataacaattttgattct

SEQ ID NO: 873257 - DNA, 25 bp, Mus musculus
agccattgataagaattttgattct

SEQ ID NO: 873258 - DNA, 25 bp, Mus musculus
agccattggaagatgccatgtaccg

SEQ ID NO: 873259 - DNA, 25 bp, Mus musculus
agccattggaagttgccatgtaccg

SEQ ID NO: 873260 - DNA, 25 bp, Mus musculus
agccattgtgctggccttaggtgcg

SEQ ID NO: 873261 - DNA, 25 bp, Mus musculus
agccattgtggtggccttaggtgcg

SEQ ID NO: 873262 - DNA, 25 bp, Mus musculus
agccatttagaacgtgtgccgatgc

SEQ ID NO: 873263 - DNA, 25 bp, Mus musculus
agccatttagaaggtgtgccgatgc

SEQ ID NO: 873264 - DNA, 25 bp, Mus musculus
agccatttgcagatgaaaagaacat

SEQ ID NO: 873265 - DNA, 25 bp, Mus musculus
agccatttgcagttgaaaagaacat

SEQ ID NO: 873266 - DNA, 25 bp, Mus musculus
agcccaaaaacatggcacttccaaa

SEQ ID NO: 873267 - DNA, 25 bp, Mus musculus
agcccaaaaagatggcacttccaaa

SEQ ID NO: 873268 - DNA, 25 bp, Mus musculus
agcccaagtatgcactgctcgatga

SEQ ID NO: 873269 - DNA, 25 bp, Mus musculus
agcccaagtatgcagtgctcgatga

SEQ ID NO: 873270 - DNA, 25 bp, Mus musculus
agcccacaagacctgcacaggattc

SEQ ID NO: 873271 - DNA, 25 bp, Mus musculus
agcccacaagataactggccttacg

SEQ ID NO: 873272 - DNA, 25 bp, Mus musculus
agcccacaagtcctgcacaggattc

SEQ ID NO: 873273 - DNA, 25 bp, Mus musculus
agcccacaagttaactggccttacg

SEQ ID NO: 873274 - DNA, 25 bp, Mus musculus
agcccacacgctgacagaaaccgca

SEQ ID NO: 873275 - DNA, 25 bp, Mus musculus
agcccacacggtgacagaaaccgca

SEQ ID NO: 873276 - DNA, 25 bp, Mus musculus
agcccacagtcacactctcttgaga

SEQ ID NO: 873277 - DNA, 25 bp, Mus musculus
agcccacagtcagactctcttgaga

SEQ ID NO: 873278 - DNA, 25 bp, Mus musculus
agcccaccacacctctctcctcctt

SEQ ID NO: 873279 - DNA, 25 bp, Mus musculus
agcccaccacacctgtctcctcctt

SEQ ID NO: 873280 - DNA, 25 bp, Mus musculus
agcccacctgcagcttctgtcagca

SEQ ID NO: 873281 - DNA, 25 bp, Mus musculus
agcccacctgcttctgtcagcagtc

SEQ ID NO: 873282 - DNA, 25 bp, Mus musculus
agcccacctggagcttctgtcagca

SEQ ID NO: 873283 - DNA, 25 bp, Mus musculus
agcccacctggttctgtcagcagtc

SEQ ID NO: 873284 - DNA, 25 bp, Mus musculus
agcccacgccggccttaagcgacac

SEQ ID NO: 873285 - DNA, 25 bp, Mus musculus
agcccacgccgggcttaagcgacac

SEQ ID NO: 873286 - DNA, 25 bp, Mus musculus
agcccacgtgtgcacggtcctgtgg

SEQ ID NO: 873287 - DNA, 25 bp, Mus musculus
agcccacgtgtgcagggtcctgtgg

SEQ ID NO: 873288 - DNA, 25 bp, Mus musculus
agcccactcagacacggttcctcca

SEQ ID NO: 873289 - DNA, 25 bp, Mus musculus
agcccactcagacagggttcctcca

SEQ ID NO: 873290 - DNA, 25 bp, Mus musculus
agcccactgacaggagcttccagga

SEQ ID NO: 873291 - DNA, 25 bp, Mus musculus
agcccactgagaggagcttccagga

SEQ ID NO: 873292 - DNA, 25 bp, Mus musculus
agcccactgccagaagatctgcaga

SEQ ID NO: 873293 - DNA, 25 bp, Mus musculus
agcccactgccagatgatctgcaga

SEQ ID NO: 873294 - DNA, 25 bp, Mus musculus
agcccagaaccacgccaagaaagga

SEQ ID NO: 873295 - DNA, 25 bp, Mus musculus
agcccagaaccaggccaagaaagga

SEQ ID NO: 873296 - DNA, 25 bp, Mus musculus
agcccagaagccctacccatgtctc

SEQ ID NO: 873297 - DNA, 25 bp, Mus musculus
agcccagaagcgtgtgcagattata

SEQ ID NO: 873298 - DNA, 25 bp, Mus musculus
agcccagaagctgtgattggactgg

SEQ ID NO: 873299 - DNA, 25 bp, Mus musculus
agcccagaaggcctacccatgtctc

SEQ ID NO: 873300 - DNA, 25 bp, Mus musculus
agcccagaagggtgtgcagattata

SEQ ID NO: 873301 - DNA, 25 bp, Mus musculus
agcccagaaggtgtgattggactgg

SEQ ID NO: 873302 - DNA, 25 bp, Mus musculus
agcccagacacactggctgctttgc

SEQ ID NO: 873303 - DNA, 25 bp, Mus musculus
agcccagacacagtggctgctttgc

SEQ ID NO: 873304 - DNA, 25 bp, Mus musculus
agcccagagatccagctgccaaacg

SEQ ID NO: 873305 - DNA, 25 bp, Mus musculus
agcccagagatcgagctgccaaacg

SEQ ID NO: 873306 - DNA, 25 bp, Mus musculus
agcccagagctacatttgtcaaatc

SEQ ID NO: 873307 - DNA, 25 bp, Mus musculus
agcccagagctagatttgtcaaatc

SEQ ID NO: 873308 - DNA, 25 bp, Mus musculus
agcccagcagatgatgccagaagtc

SEQ ID NO: 873309 - DNA, 25 bp, Mus musculus
agcccagcagatttggcctggcacg

SEQ ID NO: 873310 - DNA, 25 bp, Mus musculus
agcccagcagcccagtgtgctttct

SEQ ID NO: 873311 - DNA, 25 bp, Mus musculus
agcccagcaggccagtgtgctttct

SEQ ID NO: 873312 - DNA, 25 bp, Mus musculus
agcccagcaggtcagggccccctgg

SEQ ID NO: 873313 - DNA, 25 bp, Mus musculus
agcccagcaggtgagggccccctgg

SEQ ID NO: 873314 - DNA, 25 bp, Mus musculus
agcccagcagttgatgccagaagtc

SEQ ID NO: 873315 - DNA, 25 bp, Mus musculus
agcccagcagttttggcctggcacg

SEQ ID NO: 873316 - DNA, 25 bp, Mus musculus
agcccagcctcattcgtggcaacca

SEQ ID NO: 873317 - DNA, 25 bp, Mus musculus
agcccagcctcattggtggcaacca

SEQ ID NO: 873318 - DNA, 25 bp, Mus musculus
agcccagcgcgtcgcatgaagcact

SEQ ID NO: 873319 - DNA, 25 bp, Mus musculus
agcccagcgcgtcggacgaattcat

SEQ ID NO: 873320 - DNA, 25 bp, Mus musculus
agcccagcgcgtggcatgaagcact

SEQ ID NO: 873321 - DNA, 25 bp, Mus musculus
agcccagcgcgtgggacgaattcat

SEQ ID NO: 873322 - DNA, 25 bp, Mus musculus
agcccagctatgcttacccagtgcg

SEQ ID NO: 873323 - DNA, 25 bp, Mus musculus
agcccagctatggttacccagtgcg

SEQ ID NO: 873324 - DNA, 25 bp, Mus musculus
agcccaggagagcacgtcggcagct

SEQ ID NO: 873325 - DNA, 25 bp, Mus musculus
agcccaggagagcaggtcggcagct

SEQ ID NO: 873326 - DNA, 25 bp, Mus musculus
agcccaggatgaccctttcttccag

SEQ ID NO: 873327 - DNA, 25 bp, Mus musculus
agcccaggatgaccgtttcttccag

SEQ ID NO: 873328 - DNA, 25 bp, Mus musculus
agcccagggaagaggctacagatgt

SEQ ID NO: 873329 - DNA, 25 bp, Mus musculus
agcccagggaagtggctacagatgt

SEQ ID NO: 873330 - DNA, 25 bp, Mus musculus
agcccagtgcagccctgccactggt

SEQ ID NO: 873331 - DNA, 25 bp, Mus musculus
agcccagtgcaggcctgccactggt

SEQ ID NO: 873332 - DNA, 25 bp, Mus musculus
agcccataaccctcttggcttcact

SEQ ID NO: 873333 - DNA, 25 bp, Mus musculus
agcccataacgctcttggcttcact

SEQ ID NO: 873334 - DNA, 25 bp, Mus musculus
agcccatcagaaaatcaccgtgctg

SEQ ID NO: 873335 - DNA, 25 bp, Mus musculus
agcccatcagtaaatcaccgtgctg

SEQ ID NO: 873336 - DNA, 25 bp, Mus musculus
agcccatgagaggaaacaagttgag

SEQ ID NO: 873337 - DNA, 25 bp, Mus musculus
agcccatgagtggaaacaagttgag

SEQ ID NO: 873338 - DNA, 25 bp, Mus musculus
agcccatggaaaagacgaagagagt

SEQ ID NO: 873339 - DNA, 25 bp, Mus musculus
agcccatggaaatgacgaagagagt

SEQ ID NO: 873340 - DNA, 25 bp, Mus musculus
agccccacgccacgattacatcttc

SEQ ID NO: 873341 - DNA, 25 bp, Mus musculus
agccccacgccaggattacatcttc

SEQ ID NO: 873342 - DNA, 25 bp, Mus musculus
agccccagagaggtaaacagctgga

SEQ ID NO: 873343 - DNA, 25 bp, Mus musculus
agccccagaggcaacacagaagatg

SEQ ID NO: 873344 - DNA, 25 bp, Mus musculus
agccccagaggctacacagaagatg

SEQ ID NO: 873345 - DNA, 25 bp, Mus musculus
agccccagagtggtaaacagctgga

SEQ ID NO: 873346 - DNA, 25 bp, Mus musculus
agccccagcgagacagaggcttaca

SEQ ID NO: 873347 - DNA, 25 bp, Mus musculus
agccccagcgagaccttcggggagc

SEQ ID NO: 873348 - DNA, 25 bp, Mus musculus
agccccagcgagagctagctgagcc

SEQ ID NO: 873349 - DNA, 25 bp, Mus musculus
agccccagcgagtcagaggcttaca

SEQ ID NO: 873350 - DNA, 25 bp, Mus musculus
agccccagcgagtccttcggggagc

SEQ ID NO: 873351 - DNA, 25 bp, Mus musculus
agccccagcgagtgctagctgagcc

SEQ ID NO: 873352 - DNA, 25 bp, Mus musculus
agccccagctcgccaacgagtccca

SEQ ID NO: 873353 - DNA, 25 bp, Mus musculus
agccccagctcggcaacgagtccca

SEQ ID NO: 873354 - DNA, 25 bp, Mus musculus
agccccagggaacaggaacagctca

SEQ ID NO: 873355 - DNA, 25 bp, Mus musculus
agccccagggaagaggaacagctca

SEQ ID NO: 873356 - DNA, 25 bp, Mus musculus
agccccatttccctcgcaggttcac

SEQ ID NO: 873357 - DNA, 25 bp, Mus musculus
agccccatttccctggcaggttcac

SEQ ID NO: 873358 - DNA, 25 bp, Mus musculus
agcccccaagaaagcaatggcttca

SEQ ID NO: 873359 - DNA, 25 bp, Mus musculus
agcccccaagaaaggaatggcttca

SEQ ID NO: 873360 - DNA, 25 bp, Mus musculus
agcccccaccagcttcccttcaggg

SEQ ID NO: 873361 - DNA, 25 bp, Mus musculus
agcccccaccaggttcccttcaggg

SEQ ID NO: 873362 - DNA, 25 bp, Mus musculus
agccccccaactgacggcaggctgg

SEQ ID NO: 873363 - DNA, 25 bp, Mus musculus
agccccccaactgagggcaggctgg

SEQ ID NO: 873364 - DNA, 25 bp, Mus musculus
agccccccagaagtgtcaaccacca

SEQ ID NO: 873365 - DNA, 25 bp, Mus musculus
agccccccagcacacaaaggctcac

SEQ ID NO: 873366 - DNA, 25 bp, Mus musculus
agccccccaggacacaaaggctcac

SEQ ID NO: 873367 - DNA, 25 bp, Mus musculus
agccccccagtagtgtcaaccacca

SEQ ID NO: 873368 - DNA, 25 bp, Mus musculus
agcccccgatcactacatgccattg

SEQ ID NO: 873369 - DNA, 25 bp, Mus musculus
agcccccgatcagtacatgccattg

SEQ ID NO: 873370 - DNA, 25 bp, Mus musculus
agcccccggagtcgcacatcatcat

SEQ ID NO: 873371 - DNA, 25 bp, Mus musculus
agcccccggagtcggacatcatcat

SEQ ID NO: 873372 - DNA, 25 bp, Mus musculus
agccccctgcaacggtgactctgga

SEQ ID NO: 873373 - DNA, 25 bp, Mus musculus
agccccctgcaagggtgactctgga

SEQ ID NO: 873374 - DNA, 25 bp, Mus musculus
agccccctgtggcacaatccctgtg

SEQ ID NO: 873375 - DNA, 25 bp, Mus musculus
agccccctgtggcagaatccctgtg

SEQ ID NO: 873376 - DNA, 25 bp, Mus musculus
agccccggaggacgtgacagagtta

SEQ ID NO: 873377 - DNA, 25 bp, Mus musculus
agccccggaggaggtgacagagtta

SEQ ID NO: 873378 - DNA, 25 bp, Mus musculus
agccccggctgcccactccgccttg

SEQ ID NO: 873379 - DNA, 25 bp, Mus musculus
agccccggctgccctctccgccttg

SEQ ID NO: 873380 - DNA, 25 bp, Mus musculus
agccccggggctgacctggctagag

SEQ ID NO: 873381 - DNA, 25 bp, Mus musculus
agccccggggctgagctggctagag

SEQ ID NO: 873382 - DNA, 25 bp, Mus musculus
agccccggtagacgtatggatggat

SEQ ID NO: 873383 - DNA, 25 bp, Mus musculus
agccccggtagaggtatggatggat

SEQ ID NO: 873384 - DNA, 25 bp, Mus musculus
agcccctcagcttctgtgctgaacg

SEQ ID NO: 873385 - DNA, 25 bp, Mus musculus
agcccctcaggttctgtgctgaacg

SEQ ID NO: 873386 - DNA, 25 bp, Mus musculus
agcccctggcagctgacggcttctc

SEQ ID NO: 873387 - DNA, 25 bp, Mus musculus
agcccctggcaggtgacggcttctc

SEQ ID NO: 873388 - DNA, 25 bp, Mus musculus
agcccctgggctcgtggctctcgag

SEQ ID NO: 873389 - DNA, 25 bp, Mus musculus
agcccctgggctggtggctctcgag

SEQ ID NO: 873390 - DNA, 25 bp, Mus musculus
agcccctgttctcgtgattgaggct

SEQ ID NO: 873391 - DNA, 25 bp, Mus musculus
agcccctgttctggtgattgaggct

SEQ ID NO: 873392 - DNA, 25 bp, Mus musculus
agccccttctcaatctgaaattcag

SEQ ID NO: 873393 - DNA, 25 bp, Mus musculus
agccccttctcaatgtgaaattcag

SEQ ID NO: 873394 - DNA, 25 bp, Mus musculus
agcccgcaaaagctccctccaacat

SEQ ID NO: 873395 - DNA, 25 bp, Mus musculus
agcccgcaaaaggtccctccaacat

SEQ ID NO: 873396 - DNA, 25 bp, Mus musculus
agcccgcaactgcgaaagcagctga

SEQ ID NO: 873397 - DNA, 25 bp, Mus musculus
agcccgcaactgggaaagcagctga

SEQ ID NO: 873398 - DNA, 25 bp, Mus musculus
agcccggatgagctggctctggtcc

SEQ ID NO: 873399 - DNA, 25 bp, Mus musculus
agcccggatgaggtggctctggtcc

SEQ ID NO: 873400 - DNA, 25 bp, Mus musculus
agcccggcagcatgatgcccggaag

SEQ ID NO: 873401 - DNA, 25 bp, Mus musculus
agcccggcaggatgatgcccggaag

SEQ ID NO: 873402 - DNA, 25 bp, Mus musculus
agcccggctctgaccatgaagatga

SEQ ID NO: 873403 - DNA, 25 bp, Mus musculus
agcccggctctgacgatgaagatga

SEQ ID NO: 873404 - DNA, 25 bp, Mus musculus
agcccggtttcacttgagagcacat

SEQ ID NO: 873405 - DNA, 25 bp, Mus musculus
agcccggtttcagttgagagcacat

SEQ ID NO: 873406 - DNA, 25 bp, Mus musculus
agcccgtcagaaccgttggtgagaa

SEQ ID NO: 873407 - DNA, 25 bp, Mus musculus
agcccgtcagaagcgttggtgagaa

SEQ ID NO: 873408 - DNA, 25 bp, Mus musculus
agccctatttcacgaaactcccatc

SEQ ID NO: 873409 - DNA, 25 bp, Mus musculus
agccctatttcacgttgtctacttt

SEQ ID NO: 873410 - DNA, 25 bp, Mus musculus
agccctatttcaggaaactcccatc

SEQ ID NO: 873411 - DNA, 25 bp, Mus musculus
agccctatttcaggttgtctacttt

SEQ ID NO: 873412 - DNA, 25 bp, Mus musculus
agccctcaggctgtgaatctcctgg

SEQ ID NO: 873413 - DNA, 25 bp, Mus musculus
agccctcagggtgtgaatctcctgg

SEQ ID NO: 873414 - DNA, 25 bp, Mus musculus
agccctcgaaggatgcagctccacc

SEQ ID NO: 873415 - DNA, 25 bp, Mus musculus
agccctcgaaggttgcagctccacc

SEQ ID NO: 873416 - DNA, 25 bp, Mus musculus
agccctcgaccgctcatctttggtg

SEQ ID NO: 873417 - DNA, 25 bp, Mus musculus
agccctcgaccggtcatctttggtg

SEQ ID NO: 873418 - DNA, 25 bp, Mus musculus
agccctcgagcggacattgggatag

SEQ ID NO: 873419 - DNA, 25 bp, Mus musculus
agccctcgaggggacattgggatag

SEQ ID NO: 873420 - DNA, 25 bp, Mus musculus
agccctcgccttcaccacaggtgca

SEQ ID NO: 873421 - DNA, 25 bp, Mus musculus
agccctcgccttcacgtgcagcagt

SEQ ID NO: 873422 - DNA, 25 bp, Mus musculus
agccctcgccttcagcacaggtgca

SEQ ID NO: 873423 - DNA, 25 bp, Mus musculus
agccctcgccttcaggtgcagcagt

SEQ ID NO: 873424 - DNA, 25 bp, Mus musculus
agccctctaaaacactgcctcccca

SEQ ID NO: 873425 - DNA, 25 bp, Mus musculus
agccctctaaaacagtgcctcccca

SEQ ID NO: 873426 - DNA, 25 bp, Mus musculus
agccctctacagattcaggcctggt

SEQ ID NO: 873427 - DNA, 25 bp, Mus musculus
agccctctacagtttcaggcctggt

SEQ ID NO: 873428 - DNA, 25 bp, Mus musculus
agccctctaccacgttccaccacag

SEQ ID NO: 873429 - DNA, 25 bp, Mus musculus
agccctctaccaggttccaccacag

SEQ ID NO: 873430 - DNA, 25 bp, Mus musculus
agccctgacaacaacagcctggcca

SEQ ID NO: 873431 - DNA, 25 bp, Mus musculus
agccctgacaacaagagcctggcca

SEQ ID NO: 873432 - DNA, 25 bp, Mus musculus
agccctgagcagcagtctgcaggtg

SEQ ID NO: 873433 - DNA, 25 bp, Mus musculus
agccctgagcaggagtctgcaggtg

SEQ ID NO: 873434 - DNA, 25 bp, Mus musculus
agccctgccccaccaccacctaccc

SEQ ID NO: 873435 - DNA, 25 bp, Mus musculus
agccctgccccagcaccacctaccc

SEQ ID NO: 873436 - DNA, 25 bp, Mus musculus
agccctgctccactgcctcaacctg

SEQ ID NO: 873437 - DNA, 25 bp, Mus musculus
agccctgctccagtgcctcaacctg

SEQ ID NO: 873438 - DNA, 25 bp, Mus musculus
agccctggacagctttgcgcagttt

SEQ ID NO: 873439 - DNA, 25 bp, Mus musculus
agccctggacaggtttgcgcagttt

SEQ ID NO: 873440 - DNA, 25 bp, Mus musculus
agccctggagactccaccaactcca

SEQ ID NO: 873441 - DNA, 25 bp, Mus musculus
agccctggagcagtctcagctagtt

SEQ ID NO: 873442 - DNA, 25 bp, Mus musculus
agccctggagcattaccaggcaatt

SEQ ID NO: 873443 - DNA, 25 bp, Mus musculus
agccctggaggagtctcagctagtt

SEQ ID NO: 873444 - DNA, 25 bp, Mus musculus
agccctggaggattaccaggcaatt

SEQ ID NO: 873445 - DNA, 25 bp, Mus musculus
agccctggagtctccaccaactcca

SEQ ID NO: 873446 - DNA, 25 bp, Mus musculus
agccctggctggcggatgggctctt

SEQ ID NO: 873447 - DNA, 25 bp, Mus musculus
agccctggctgggggatgggctctt

SEQ ID NO: 873448 - DNA, 25 bp, Mus musculus
agccctggtcaccaccacgttcatc

SEQ ID NO: 873449 - DNA, 25 bp, Mus musculus
agccctggtcaccagcacgttcatc

SEQ ID NO: 873450 - DNA, 25 bp, Mus musculus
agccctgtcagactttgtagacacg

SEQ ID NO: 873451 - DNA, 25 bp, Mus musculus
agccctgtcagagtttgtagacacg

SEQ ID NO: 873452 - DNA, 25 bp, Mus musculus
agccctgtgacgaatggcacacgaa

SEQ ID NO: 873453 - DNA, 25 bp, Mus musculus
agccctgtgacgtatggcacacgaa

SEQ ID NO: 873454 - DNA, 25 bp, Mus musculus
agccctgtgcagatttccctcaggg

SEQ ID NO: 873455 - DNA, 25 bp, Mus musculus
agccctgtgcagccttgtgacagat

SEQ ID NO: 873456 - DNA, 25 bp, Mus musculus
agccctgtgcaggcttgtgacagat

SEQ ID NO: 873457 - DNA, 25 bp, Mus musculus
agccctgtgcagttttccctcaggg

SEQ ID NO: 873458 - DNA, 25 bp, Mus musculus
agcccttcagcaactctgcctgctc

SEQ ID NO: 873459 - DNA, 25 bp, Mus musculus
agcccttcaggaactctgcctgctc

SEQ ID NO: 873460 - DNA, 25 bp, Mus musculus
agcccttcatctggctatctacagt

SEQ ID NO: 873461 - DNA, 25 bp, Mus musculus
agcccttcatctgggtatctacagt

SEQ ID NO: 873462 - DNA, 25 bp, Mus musculus
agcccttccgctgccgtgtcatgga

SEQ ID NO: 873463 - DNA, 25 bp, Mus musculus
agcccttccgctgcggtgtcatgga

SEQ ID NO: 873464 - DNA, 25 bp, Mus musculus
agcccttcggtgttcgtctggtcag

SEQ ID NO: 873465 - DNA, 25 bp, Mus musculus
agcccttcggtgttggtctggtcag

SEQ ID NO: 873466 - DNA, 25 bp, Mus musculus
agcccttggggcgacatgtacaaca

SEQ ID NO: 873467 - DNA, 25 bp, Mus musculus
agcccttggggcgagatgtacaaca

SEQ ID NO: 873468 - DNA, 25 bp, Mus musculus
agcccttggttgcacatttgcaata

SEQ ID NO: 873469 - DNA, 25 bp, Mus musculus
agcccttggttgcagatttgcaata

SEQ ID NO: 873470 - DNA, 25 bp, Mus musculus
agccgaagctcaatgacaatgtcag

SEQ ID NO: 873471 - DNA, 25 bp, Mus musculus
agccgaagctcattgacaatgtcag

SEQ ID NO: 873472 - DNA, 25 bp, Mus musculus
agccgaattctcaacgcccggctag

SEQ ID NO: 873473 - DNA, 25 bp, Mus musculus
agccgaattctcaaggcccggctag

SEQ ID NO: 873474 - DNA, 25 bp, Mus musculus
agccgacagtacaccgctcgacgac

SEQ ID NO: 873475 - DNA, 25 bp, Mus musculus
agccgacagtacacggctcgacgac

SEQ ID NO: 873476 - DNA, 25 bp, Mus musculus
agccgagcgtaacatcccctgcttc

SEQ ID NO: 873477 - DNA, 25 bp, Mus musculus
agccgagcgtaacgctgatggatgt

SEQ ID NO: 873478 - DNA, 25 bp, Mus musculus
agccgagcgtaagatcccctgcttc

SEQ ID NO: 873479 - DNA, 25 bp, Mus musculus
agccgagcgtaaggctgatggatgt

SEQ ID NO: 873480 - DNA, 25 bp, Mus musculus
agccgagggagacgcaatacagagt

SEQ ID NO: 873481 - DNA, 25 bp, Mus musculus
agccgagggagacgcactgatggag

SEQ ID NO: 873482 - DNA, 25 bp, Mus musculus
agccgagggagaggcaatacagagt

SEQ ID NO: 873483 - DNA, 25 bp, Mus musculus
agccgagggagaggcactgatggag

SEQ ID NO: 873484 - DNA, 25 bp, Mus musculus
agccgaggggacccgaaggctgcat

SEQ ID NO: 873485 - DNA, 25 bp, Mus musculus
agccgaggggtcccgaaggctgcat

SEQ ID NO: 873486 - DNA, 25 bp, Mus musculus
agccgagttcagattctccgagtca

SEQ ID NO: 873487 - DNA, 25 bp, Mus musculus
agccgagttcagcgaacagattctc

SEQ ID NO: 873488 - DNA, 25 bp, Mus musculus
agccgagttcagggaacagattctc

SEQ ID NO: 873489 - DNA, 25 bp, Mus musculus
agccgagttcagtttctccgagtca

SEQ ID NO: 873490 - DNA, 25 bp, Mus musculus
agccgcaaagaacttccaccaggtg

SEQ ID NO: 873491 - DNA, 25 bp, Mus musculus
agccgcaaagaagttccaccaggtg

SEQ ID NO: 873492 - DNA, 25 bp, Mus musculus
agccgcaagtttcgggaggcgatcg

SEQ ID NO: 873493 - DNA, 25 bp, Mus musculus
agccgcaagtttggggaggcgatcg

SEQ ID NO: 873494 - DNA, 25 bp, Mus musculus
agccgcaatgcatccaagttcgaaa

SEQ ID NO: 873495 - DNA, 25 bp, Mus musculus
agccgcaatggatccaagttcgaaa

SEQ ID NO: 873496 - DNA, 25 bp, Mus musculus
agccgcagagctgctttgtctggga

SEQ ID NO: 873497 - DNA, 25 bp, Mus musculus
agccgcagaggtgctttgtctggga

SEQ ID NO: 873498 - DNA, 25 bp, Mus musculus
agccgcagccatgaccaaagtctca

SEQ ID NO: 873499 - DNA, 25 bp, Mus musculus
agccgcagccatgaccagcaaagtc

SEQ ID NO: 873500 - DNA, 25 bp, Mus musculus
agccgcagccatgagcaaagtctca

SEQ ID NO: 873501 - DNA, 25 bp, Mus musculus
agccgcagccatgagcagcaaagtc

SEQ ID NO: 873502 - DNA, 25 bp, Mus musculus
agccgcagcgcacaccgcagaggcc

SEQ ID NO: 873503 - DNA, 25 bp, Mus musculus
agccgcagcgcagaccgcagaggcc

SEQ ID NO: 873504 - DNA, 25 bp, Mus musculus
agccgcatcgctctgaagaaagagg

SEQ ID NO: 873505 - DNA, 25 bp, Mus musculus
agccgcatcggtctgaagaaagagg

SEQ ID NO: 873506 - DNA, 25 bp, Mus musculus
agccgccaccatcacggtgggcaag

SEQ ID NO: 873507 - DNA, 25 bp, Mus musculus
agccgccaccatgacggtgggcaag

SEQ ID NO: 873508 - DNA, 25 bp, Mus musculus
agccgccatgaacctcaacgtggac

SEQ ID NO: 873509 - DNA, 25 bp, Mus musculus
agccgccatgaagctcaacgtggac

SEQ ID NO: 873510 - DNA, 25 bp, Mus musculus
agccgcccggagctgcttgaggcga

SEQ ID NO: 873511 - DNA, 25 bp, Mus musculus
agccgcccggaggtgcttgaggcga

SEQ ID NO: 873512 - DNA, 25 bp, Mus musculus
agccgccgcggacgtctttggccag

SEQ ID NO: 873513 - DNA, 25 bp, Mus musculus
agccgccgcggaggtctttggccag

SEQ ID NO: 873514 - DNA, 25 bp, Mus musculus
agccgccgggagatgctgttgacgg

SEQ ID NO: 873515 - DNA, 25 bp, Mus musculus
agccgccgggagttgctgttgacgg

SEQ ID NO: 873516 - DNA, 25 bp, Mus musculus
agccgcctcaccaacgtgtctctga

SEQ ID NO: 873517 - DNA, 25 bp, Mus musculus
agccgcctcaccaaggtgtctctga

SEQ ID NO: 873518 - DNA, 25 bp, Mus musculus
agccgcgagtgcgacattaagtaca

SEQ ID NO: 873519 - DNA, 25 bp, Mus musculus
agccgcgagtgcgagattaagtaca

SEQ ID NO: 873520 - DNA, 25 bp, Mus musculus
agccgcggatccccatttgcaggcc

SEQ ID NO: 873521 - DNA, 25 bp, Mus musculus
agccgcggatccgcatttgcaggcc

SEQ ID NO: 873522 - DNA, 25 bp, Mus musculus
agccgcggccagagtctggaaataa

SEQ ID NO: 873523 - DNA, 25 bp, Mus musculus
agccgcggccagtgtctggaaataa

SEQ ID NO: 873524 - DNA, 25 bp, Mus musculus
agccgctcaccaaacgtactcgttt

SEQ ID NO: 873525 - DNA, 25 bp, Mus musculus
agccgctcaccaaaggtactcgttt

SEQ ID NO: 873526 - DNA, 25 bp, Mus musculus
agccgctcatcttcacacagcagcc

SEQ ID NO: 873527 - DNA, 25 bp, Mus musculus
agccgctcatcttcacagcacagca

SEQ ID NO: 873528 - DNA, 25 bp, Mus musculus
agccgctcatcttctcacagcagcc

SEQ ID NO: 873529 - DNA, 25 bp, Mus musculus
agccgctcatcttctcagcacagca

SEQ ID NO: 873530 - DNA, 25 bp, Mus musculus
agccgctgagctcaacaagcagcta

SEQ ID NO: 873531 - DNA, 25 bp, Mus musculus
agccgctgaggtcaacaagcagcta

SEQ ID NO: 873532 - DNA, 25 bp, Mus musculus
agccgctgtgagcacattgatgaat

SEQ ID NO: 873533 - DNA, 25 bp, Mus musculus
agccgctgtgaggacattgatgaat

SEQ ID NO: 873534 - DNA, 25 bp, Mus musculus
agccgcttcgccattctggaattta

SEQ ID NO: 873535 - DNA, 25 bp, Mus musculus
agccgcttcggcattctggaattta

SEQ ID NO: 873536 - DNA, 25 bp, Mus musculus
agccggacactgtgcgctgtgctct

SEQ ID NO: 873537 - DNA, 25 bp, Mus musculus
agccggacactgtgggctgtgctct

SEQ ID NO: 873538 - DNA, 25 bp, Mus musculus
agccggagactcaacgtcactggag

SEQ ID NO: 873539 - DNA, 25 bp, Mus musculus
agccggagactcaaggtcactggag

SEQ ID NO: 873540 - DNA, 25 bp, Mus musculus
agccggagagcatggcggactacct

SEQ ID NO: 873541 - DNA, 25 bp, Mus musculus
agccggagaggatggcggactacct

SEQ ID NO: 873542 - DNA, 25 bp, Mus musculus
agccggaggcgagacgccccacgca

SEQ ID NO: 873543 - DNA, 25 bp, Mus musculus
agccggaggcgagaggccccacgca

SEQ ID NO: 873544 - DNA, 25 bp, Mus musculus
agccggagtccgactacagagagcc

SEQ ID NO: 873545 - DNA, 25 bp, Mus musculus
agccggagtccgtctacagagagcc

SEQ ID NO: 873546 - DNA, 25 bp, Mus musculus
agccggattcagcaggtggatgccc

SEQ ID NO: 873547 - DNA, 25 bp, Mus musculus
agccggattcaggaggtggatgccc

SEQ ID NO: 873548 - DNA, 25 bp, Mus musculus
agccggattgcctgcagagtgtgaa

SEQ ID NO: 873549 - DNA, 25 bp, Mus musculus
agccggattgcctggagagtgtgaa

SEQ ID NO: 873550 - DNA, 25 bp, Mus musculus
agccggcactcgcgctcctcccacc

SEQ ID NO: 873551 - DNA, 25 bp, Mus musculus
agccggcactcgggctcctcccacc

SEQ ID NO: 873552 - DNA, 25 bp, Mus musculus
agccggcgagagcttaattctcaag

SEQ ID NO: 873553 - DNA, 25 bp, Mus musculus
agccggcgagaggttaattctcaag

SEQ ID NO: 873554 - DNA, 25 bp, Mus musculus
agccggcggacgcggaacgtgcttt

SEQ ID NO: 873555 - DNA, 25 bp, Mus musculus
agccggcggacggggaacgtgcttt

SEQ ID NO: 873556 - DNA, 25 bp, Mus musculus
agccgggaagagctgctgagctatg

SEQ ID NO: 873557 - DNA, 25 bp, Mus musculus
agccgggaagaggtgctgagctatg

SEQ ID NO: 873558 - DNA, 25 bp, Mus musculus
agccgggacaccatcttccagaaag

SEQ ID NO: 873559 - DNA, 25 bp, Mus musculus
agccgggacaccatgttccagaaag

SEQ ID NO: 873560 - DNA, 25 bp, Mus musculus
agccgggatacacgtgtgaatgagg

SEQ ID NO: 873561 - DNA, 25 bp, Mus musculus
agccgggatacaggtgtgaatgagg

SEQ ID NO: 873562 - DNA, 25 bp, Mus musculus
agccgggcagcgccctggaggaggg

SEQ ID NO: 873563 - DNA, 25 bp, Mus musculus
agccgggcagcggcctggaggaggg

SEQ ID NO: 873564 - DNA, 25 bp, Mus musculus
agccgggcagctttgccaagctgct

SEQ ID NO: 873565 - DNA, 25 bp, Mus musculus
agccgggcaggtttgccaagctgct

SEQ ID NO: 873566 - DNA, 25 bp, Mus musculus
agccggggagctggtggagaagctg

SEQ ID NO: 873567 - DNA, 25 bp, Mus musculus
agccggggaggtggtggagaagctg

SEQ ID NO: 873568 - DNA, 25 bp, Mus musculus
agccggggctcccatcagtcaccag

SEQ ID NO: 873569 - DNA, 25 bp, Mus musculus
agccggggctccgatcagtcaccag

SEQ ID NO: 873570 - DNA, 25 bp, Mus musculus
agccgtcaagcagaagaagatcttt

SEQ ID NO: 873571 - DNA, 25 bp, Mus musculus
agccgtcaaggagaagaagatcttt

SEQ ID NO: 873572 - DNA, 25 bp, Mus musculus
agccgtctcctttaccacaggtgca

SEQ ID NO: 873573 - DNA, 25 bp, Mus musculus
agccgtctcctttagcacaggtgca

SEQ ID NO: 873574 - DNA, 25 bp, Mus musculus
agccgtgcagagcaagccatacagg

SEQ ID NO: 873575 - DNA, 25 bp, Mus musculus
agccgtgcagagcatctactgccga

SEQ ID NO: 873576 - DNA, 25 bp, Mus musculus
agccgtgcagaggaagccatacagg

SEQ ID NO: 873577 - DNA, 25 bp, Mus musculus
agccgtgcagaggatctactgccga

SEQ ID NO: 873578 - DNA, 25 bp, Mus musculus
agccgtggctagcggatggcctctt

SEQ ID NO: 873579 - DNA, 25 bp, Mus musculus
agccgtggctaggggatggcctctt

SEQ ID NO: 873580 - DNA, 25 bp, Mus musculus
agccgtgtgcaccgtgaaacctaca

SEQ ID NO: 873581 - DNA, 25 bp, Mus musculus
agccgtgtgcacggtgaaacctaca

SEQ ID NO: 873582 - DNA, 25 bp, Mus musculus
agccgttttaagataccgatttctg

SEQ ID NO: 873583 - DNA, 25 bp, Mus musculus
agccgttttaagttaccgatttctg

SEQ ID NO: 873584 - DNA, 25 bp, Mus musculus
agcctaaccagacacatggagaaag

SEQ ID NO: 873585 - DNA, 25 bp, Mus musculus
agcctaaccagacagatggagaaag

SEQ ID NO: 873586 - DNA, 25 bp, Mus musculus
agcctaagcctgacgtgcagccaga

SEQ ID NO: 873587 - DNA, 25 bp, Mus musculus
agcctaagcctgcagacgtgcagcc

SEQ ID NO: 873588 - DNA, 25 bp, Mus musculus
agcctaagcctggagacgtgcagcc

SEQ ID NO: 873589 - DNA, 25 bp, Mus musculus
agcctaagcctgtcgtgcagccaga

SEQ ID NO: 873590 - DNA, 25 bp, Mus musculus
agcctaattaaagacgctcattggg

SEQ ID NO: 873591 - DNA, 25 bp, Mus musculus
agcctaattaaagaggctcattggg

SEQ ID NO: 873592 - DNA, 25 bp, Mus musculus
agcctacaaagacgcctttgccagt

SEQ ID NO: 873593 - DNA, 25 bp, Mus musculus
agcctacaaagaggcctttgccagt

SEQ ID NO: 873594 - DNA, 25 bp, Mus musculus
agcctacaatctcaatgaagaaaga

SEQ ID NO: 873595 - DNA, 25 bp, Mus musculus
agcctacaatctgaatgaagaaaga

SEQ ID NO: 873596 - DNA, 25 bp, Mus musculus
agcctacagaaactgttccgagaag

SEQ ID NO: 873597 - DNA, 25 bp, Mus musculus
agcctacagaaagtgttccgagaag

SEQ ID NO: 873598 - DNA, 25 bp, Mus musculus
agcctacagtctcaatgaagaaaga

SEQ ID NO: 873599 - DNA, 25 bp, Mus musculus
agcctacagtctgaatgaagaaaga

SEQ ID NO: 873600 - DNA, 25 bp, Mus musculus
agcctacccaagcaaactgccagga

SEQ ID NO: 873601 - DNA, 25 bp, Mus musculus
agcctacccaagcaaactgccaggc

SEQ ID NO: 873602 - DNA, 25 bp, Mus musculus
agcctacccaaggaaactgccagga

SEQ ID NO: 873603 - DNA, 25 bp, Mus musculus
agcctacccaaggaaactgccaggc

SEQ ID NO: 873604 - DNA, 25 bp, Mus musculus
agcctacctgccccaaatctcccag

SEQ ID NO: 873605 - DNA, 25 bp, Mus musculus
agcctacctgccgcaaatctcccag

SEQ ID NO: 873606 - DNA, 25 bp, Mus musculus
agcctacgtgagaacaggctggcca

SEQ ID NO: 873607 - DNA, 25 bp, Mus musculus
agcctacgtgtgaacaggctggcca

SEQ ID NO: 873608 - DNA, 25 bp, Mus musculus
agcctactgtaatccatgagatccg

SEQ ID NO: 873609 - DNA, 25 bp, Mus musculus
agcctactgtaatcgatgagatccg

SEQ ID NO: 873610 - DNA, 25 bp, Mus musculus
agcctagcagccccagcaacacagc

SEQ ID NO: 873611 - DNA, 25 bp, Mus musculus
agcctagcaggcccagcaacacagc

SEQ ID NO: 873612 - DNA, 25 bp, Mus musculus
agcctagccttgatgaaagaatatt

SEQ ID NO: 873613 - DNA, 25 bp, Mus musculus
agcctagccttgttgaaagaatatt

SEQ ID NO: 873614 - DNA, 25 bp, Mus musculus
agcctagcgggaacagcagtagcag

SEQ ID NO: 873615 - DNA, 25 bp, Mus musculus
agcctagcgggatcagcagtagcag

SEQ ID NO: 873616 - DNA, 25 bp, Mus musculus
agcctataagcagcctctaaagagc

SEQ ID NO: 873617 - DNA, 25 bp, Mus musculus
agcctataaggagcctctaaagagc

SEQ ID NO: 873618 - DNA, 25 bp, Mus musculus
agcctatctgcctctcaggctgacg

SEQ ID NO: 873619 - DNA, 25 bp, Mus musculus
agcctatctggctctcaggctgacg

SEQ ID NO: 873620 - DNA, 25 bp, Mus musculus
agcctatgatggcaaaattaaagtg

SEQ ID NO: 873621 - DNA, 25 bp, Mus musculus
agcctatgatgggaaaattaaagtg

SEQ ID NO: 873622 - DNA, 25 bp, Mus musculus
agcctatgccaccacgtacgccatc

SEQ ID NO: 873623 - DNA, 25 bp, Mus musculus
agcctatgccaccaggtacgccatc

SEQ ID NO: 873624 - DNA, 25 bp, Mus musculus
agcctattttagccggctgcactgc

SEQ ID NO: 873625 - DNA, 25 bp, Mus musculus
agcctattttaggcggctgcactgc

SEQ ID NO: 873626 - DNA, 25 bp, Mus musculus
agcctcaagacaacgagtgctgcgg

SEQ ID NO: 873627 - DNA, 25 bp, Mus musculus
agcctcaagacatcgagtgctgcgg

SEQ ID NO: 873628 - DNA, 25 bp, Mus musculus
agcctcacatcgcaggtttagctcc

SEQ ID NO: 873629 - DNA, 25 bp, Mus musculus
agcctcacatcggaggtttagctcc

SEQ ID NO: 873630 - DNA, 25 bp, Mus musculus
agcctcactgctgggtgtgcaaaca

SEQ ID NO: 873631 - DNA, 25 bp, Mus musculus
agcctcactggtgggtgtgcaaaca

SEQ ID NO: 873632 - DNA, 25 bp, Mus musculus
agcctcagagatgctggagtgtcca

SEQ ID NO: 873633 - DNA, 25 bp, Mus musculus
agcctcagagttgctggagtgtcca

SEQ ID NO: 873634 - DNA, 25 bp, Mus musculus
agcctcaggacacgtataaggcagt

SEQ ID NO: 873635 - DNA, 25 bp, Mus musculus
agcctcaggacaggtataaggcagt

SEQ ID NO: 873636 - DNA, 25 bp, Mus musculus
agcctcagtgagcccataactgcac

SEQ ID NO: 873637 - DNA, 25 bp, Mus musculus
agcctcagtgaggccataactgcac

SEQ ID NO: 873638 - DNA, 25 bp, Mus musculus
agcctcattgctggcaaccactcca

SEQ ID NO: 873639 - DNA, 25 bp, Mus musculus
agcctcattggtggcaaccactcca

SEQ ID NO: 873640 - DNA, 25 bp, Mus musculus
agcctccaaaagctgttcttctgta

SEQ ID NO: 873641 - DNA, 25 bp, Mus musculus
agcctccaaaaggtgttcttctgta

SEQ ID NO: 873642 - DNA, 25 bp, Mus musculus
agcctccaccagcggcacgttagat

SEQ ID NO: 873643 - DNA, 25 bp, Mus musculus
agcctccaccaggggcacgttagat

SEQ ID NO: 873644 - DNA, 25 bp, Mus musculus
agcctccacccccacaaacgtgtgc

SEQ ID NO: 873645 - DNA, 25 bp, Mus musculus
agcctccacccccagaaacgtgtgc

SEQ ID NO: 873646 - DNA, 25 bp, Mus musculus
agcctccaccgacgcgatcggcttt

SEQ ID NO: 873647 - DNA, 25 bp, Mus musculus
agcctccaccgacgggatcggcttt

SEQ ID NO: 873648 - DNA, 25 bp, Mus musculus
agcctccactttcgtgaaagtcaac

SEQ ID NO: 873649 - DNA, 25 bp, Mus musculus
agcctccactttggtgaaagtcaac

SEQ ID NO: 873650 - DNA, 25 bp, Mus musculus
agcctccagagaaacgtgcttaaac

SEQ ID NO: 873651 - DNA, 25 bp, Mus musculus
agcctccagagaaaggtgcttaaac

SEQ ID NO: 873652 - DNA, 25 bp, Mus musculus
agcctccagatgttcgcaagaagac

SEQ ID NO: 873653 - DNA, 25 bp, Mus musculus
agcctccagatgttggcaagaagac

SEQ ID NO: 873654 - DNA, 25 bp, Mus musculus
agcctccagcctcattaaagtgaac

SEQ ID NO: 873655 - DNA, 25 bp, Mus musculus
agcctccagcctgattaaagtgaac

SEQ ID NO: 873656 - DNA, 25 bp, Mus musculus
agcctccaggagtcatccatcaacg

SEQ ID NO: 873657 - DNA, 25 bp, Mus musculus
agcctccaggtgtcatccatcaacg

SEQ ID NO: 873658 - DNA, 25 bp, Mus musculus
agcctcccaagaaaccgagtgagaa

SEQ ID NO: 873659 - DNA, 25 bp, Mus musculus
agcctcccaagaaagcgagtgagaa

SEQ ID NO: 873660 - DNA, 25 bp, Mus musculus
agcctcccaggaagagagggagaag

SEQ ID NO: 873661 - DNA, 25 bp, Mus musculus
agcctcccaggatgagagggagaag

SEQ ID NO: 873662 - DNA, 25 bp, Mus musculus
agcctcccagtacttccaactggga

SEQ ID NO: 873663 - DNA, 25 bp, Mus musculus
agcctcccagtagttccaactggga

SEQ ID NO: 873664 - DNA, 25 bp, Mus musculus
agcctccctgaacggctaccagtgg

SEQ ID NO: 873665 - DNA, 25 bp, Mus musculus
agcctccctgaagggctaccagtgg

SEQ ID NO: 873666 - DNA, 25 bp, Mus musculus
agcctccgccggcagtgagtccctc

SEQ ID NO: 873667 - DNA, 25 bp, Mus musculus
agcctccgccgggagtgagtccctc

SEQ ID NO: 873668 - DNA, 25 bp, Mus musculus
agcctccgtcatgacgcaacttcgg

SEQ ID NO: 873669 - DNA, 25 bp, Mus musculus
agcctccgtcatgaggcaacttcgg

SEQ ID NO: 873670 - DNA, 25 bp, Mus musculus
agcctcctaaggaacgctcagagaa

SEQ ID NO: 873671 - DNA, 25 bp, Mus musculus
agcctcctaaggaaggctcagagaa

SEQ ID NO: 873672 - DNA, 25 bp, Mus musculus
agcctcctctttgacggcgagacca

SEQ ID NO: 873673 - DNA, 25 bp, Mus musculus
agcctcctctttgagggcgagacca

SEQ ID NO: 873674 - DNA, 25 bp, Mus musculus
agcctcctgaatcgacagtcaccac

SEQ ID NO: 873675 - DNA, 25 bp, Mus musculus
agcctcctgaatggacagtcaccac

SEQ ID NO: 873676 - DNA, 25 bp, Mus musculus
agcctcctggagaacgcaccagcag

SEQ ID NO: 873677 - DNA, 25 bp, Mus musculus
agcctcctggagaaggcaccagcag

SEQ ID NO: 873678 - DNA, 25 bp, Mus musculus
agcctcctggctgttctcttccaca

SEQ ID NO: 873679 - DNA, 25 bp, Mus musculus
agcctcctggcttggctgcaagctc

SEQ ID NO: 873680 - DNA, 25 bp, Mus musculus
agcctcctgggtgttctcttccaca

SEQ ID NO: 873681 - DNA, 25 bp, Mus musculus
agcctcctgggttggctgcaagctc

SEQ ID NO: 873682 - DNA, 25 bp, Mus musculus
agcctccttcagccctcaggcttgg

SEQ ID NO: 873683 - DNA, 25 bp, Mus musculus
agcctccttcaggcctcaggcttgg

SEQ ID NO: 873684 - DNA, 25 bp, Mus musculus
agcctcgcagatcagagccttgagc

SEQ ID NO: 873685 - DNA, 25 bp, Mus musculus
agcctcgcagatgagagccttgagc

SEQ ID NO: 873686 - DNA, 25 bp, Mus musculus
agcctctaagaactgtgttcaccga

SEQ ID NO: 873687 - DNA, 25 bp, Mus musculus
agcctctaagaagtgtgttcaccga

SEQ ID NO: 873688 - DNA, 25 bp, Mus musculus
agcctctaggccctaggaccatgaa

SEQ ID NO: 873689 - DNA, 25 bp, Mus musculus
agcctctagggcctaggaccatgaa

SEQ ID NO: 873690 - DNA, 25 bp, Mus musculus
agcctctccgtacacatcttcgtcc

SEQ ID NO: 873691 - DNA, 25 bp, Mus musculus
agcctctccgtacaccgccatggct

SEQ ID NO: 873692 - DNA, 25 bp, Mus musculus
agcctctccgtacagatcttcgtcc

SEQ ID NO: 873693 - DNA, 25 bp, Mus musculus
agcctctccgtacagcgccatggct

SEQ ID NO: 873694 - DNA, 25 bp, Mus musculus
agcctctcgaagcgaaacagcatgc

SEQ ID NO: 873695 - DNA, 25 bp, Mus musculus
agcctctcgaagggaaacagcatgc

SEQ ID NO: 873696 - DNA, 25 bp, Mus musculus
agcctctgagatttgtctagatgat

SEQ ID NO: 873697 - DNA, 25 bp, Mus musculus
agcctctgagttttgtctagatgat

SEQ ID NO: 873698 - DNA, 25 bp, Mus musculus
agcctctgctctcaccaggccaagc

SEQ ID NO: 873699 - DNA, 25 bp, Mus musculus
agcctctgctctcacgccaagctcc

SEQ ID NO: 873700 - DNA, 25 bp, Mus musculus
agcctctgctctcagcaggccaagc

SEQ ID NO: 873701 - DNA, 25 bp, Mus musculus
agcctctgctctcaggccaagctcc

SEQ ID NO: 873702 - DNA, 25 bp, Mus musculus
agcctctgtacacgtccggatagct

SEQ ID NO: 873703 - DNA, 25 bp, Mus musculus
agcctctgtacaggtccggatagct

SEQ ID NO: 873704 - DNA, 25 bp, Mus musculus
agcctgaaaacttcctagacaaaga

SEQ ID NO: 873705 - DNA, 25 bp, Mus musculus
agcctgaaaagttcctagacaaaga

SEQ ID NO: 873706 - DNA, 25 bp, Mus musculus
agcctgaaagaacccgagctgtccc

SEQ ID NO: 873707 - DNA, 25 bp, Mus musculus
agcctgaaagcacaccggcattctc

SEQ ID NO: 873708 - DNA, 25 bp, Mus musculus
agcctgaaagcagaccggcattctc

SEQ ID NO: 873709 - DNA, 25 bp, Mus musculus
agcctgaaagtacccgagctgtccc

SEQ ID NO: 873710 - DNA, 25 bp, Mus musculus
agcctgacagatttctatcactcca

SEQ ID NO: 873711 - DNA, 25 bp, Mus musculus
agcctgacagttttctatcactcca

SEQ ID NO: 873712 - DNA, 25 bp, Mus musculus
agcctgaggaaacagttaaaaattg

SEQ ID NO: 873713 - DNA, 25 bp, Mus musculus
agcctgaggaaagagttaaaaattg

SEQ ID NO: 873714 - DNA, 25 bp, Mus musculus
agcctgagtgagcatcatggctgct

SEQ ID NO: 873715 - DNA, 25 bp, Mus musculus
agcctgagtgaggatcatggctgct

SEQ ID NO: 873716 - DNA, 25 bp, Mus musculus
agcctgatgaaaatgcctttgagta

SEQ ID NO: 873717 - DNA, 25 bp, Mus musculus
agcctgatgaaaccatctgtggcaa

SEQ ID NO: 873718 - DNA, 25 bp, Mus musculus
agcctgatgaaagcatctgtggcaa

SEQ ID NO: 873719 - DNA, 25 bp, Mus musculus
agcctgatgaaattgcctttgagta

SEQ ID NO: 873720 - DNA, 25 bp, Mus musculus
agcctgccacagcaagagagctcag

SEQ ID NO: 873721 - DNA, 25 bp, Mus musculus
agcctgccacaggaagagagctcag

SEQ ID NO: 873722 - DNA, 25 bp, Mus musculus
agcctgcctctgcgcttcctcggtg

SEQ ID NO: 873723 - DNA, 25 bp, Mus musculus
agcctgcctctgggcttcctcggtg

SEQ ID NO: 873724 - DNA, 25 bp, Mus musculus
agcctgcgcaagcgcaaagagccca

SEQ ID NO: 873725 - DNA, 25 bp, Mus musculus
agcctgcgcaagggcaaagagccca

SEQ ID NO: 873726 - DNA, 25 bp, Mus musculus
agcctgctcacccactgtgtcctga

SEQ ID NO: 873727 - DNA, 25 bp, Mus musculus
agcctgctcacccagtgtgtcctga

SEQ ID NO: 873728 - DNA, 25 bp, Mus musculus
agcctgctcacgctgtccctggatc

SEQ ID NO: 873729 - DNA, 25 bp, Mus musculus
agcctgctcacggtgtccctggatc

SEQ ID NO: 873730 - DNA, 25 bp, Mus musculus
agcctgctggcaatcatctggggaa

SEQ ID NO: 873731 - DNA, 25 bp, Mus musculus
agcctgctgggaatcatctggggaa

SEQ ID NO: 873732 - DNA, 25 bp, Mus musculus
agcctggagaagctcccacctgctc

SEQ ID NO: 873733 - DNA, 25 bp, Mus musculus
agcctggagaaggtcccacctgctc

SEQ ID NO: 873734 - DNA, 25 bp, Mus musculus
agcctggatagacgagaagttgtta

SEQ ID NO: 873735 - DNA, 25 bp, Mus musculus
agcctggatagaggagaagttgtta

SEQ ID NO: 873736 - DNA, 25 bp, Mus musculus
agcctggatcctcatgatgaggaca

SEQ ID NO: 873737 - DNA, 25 bp, Mus musculus
agcctggatcctcggctttttgtag

SEQ ID NO: 873738 - DNA, 25 bp, Mus musculus
agcctggatcctctttagatgatga

SEQ ID NO: 873739 - DNA, 25 bp, Mus musculus
agcctggatcctgatgatgaggaca

SEQ ID NO: 873740 - DNA, 25 bp, Mus musculus
agcctggatcctgggctttttgtag

SEQ ID NO: 873741 - DNA, 25 bp, Mus musculus
agcctggatcctgtttagatgatga

SEQ ID NO: 873742 - DNA, 25 bp, Mus musculus
agcctggccaaaaccgcatttgatg

SEQ ID NO: 873743 - DNA, 25 bp, Mus musculus
agcctggccaaaacggcatttgatg

SEQ ID NO: 873744 - DNA, 25 bp, Mus musculus
agcctggccctcaccgtatatgcta

SEQ ID NO: 873745 - DNA, 25 bp, Mus musculus
agcctggccctcacggtatatgcta

SEQ ID NO: 873746 - DNA, 25 bp, Mus musculus
agcctgggatcgcgaggcacacacc

SEQ ID NO: 873747 - DNA, 25 bp, Mus musculus
agcctgggatcgggaggcacacacc

SEQ ID NO: 873748 - DNA, 25 bp, Mus musculus
agcctgggccaccaaagaaaatgaa

SEQ ID NO: 873749 - DNA, 25 bp, Mus musculus
agcctgggccaccgagcagctgaag

SEQ ID NO: 873750 - DNA, 25 bp, Mus musculus
agcctgggccacgaaagaaaatgaa

SEQ ID NO: 873751 - DNA, 25 bp, Mus musculus
agcctgggccacggagcagctgaag

SEQ ID NO: 873752 - DNA, 25 bp, Mus musculus
agcctgggctgacatgaggtgccac

SEQ ID NO: 873753 - DNA, 25 bp, Mus musculus
agcctgggctgagatgaggtgccac

SEQ ID NO: 873754 - DNA, 25 bp, Mus musculus
agcctggggatgctgtgaccccaca

SEQ ID NO: 873755 - DNA, 25 bp, Mus musculus
agcctggggatggtgtgaccccaca

SEQ ID NO: 873756 - DNA, 25 bp, Mus musculus
agcctgggtggacacgtgagcaatg

SEQ ID NO: 873757 - DNA, 25 bp, Mus musculus
agcctgggtggacaggtgagcaatg

SEQ ID NO: 873758 - DNA, 25 bp, Mus musculus
agcctggtctaaagaatcagaagta

SEQ ID NO: 873759 - DNA, 25 bp, Mus musculus
agcctggtctaaagtatcagaagta

SEQ ID NO: 873760 - DNA, 25 bp, Mus musculus
agcctggtgcaagacaactgaacat

SEQ ID NO: 873761 - DNA, 25 bp, Mus musculus
agcctggtgcaagacggatacccct

SEQ ID NO: 873762 - DNA, 25 bp, Mus musculus
agcctggtgcaagacgtagaactga

SEQ ID NO: 873763 - DNA, 25 bp, Mus musculus
agcctggtgcaagagaactgaacat

SEQ ID NO: 873764 - DNA, 25 bp, Mus musculus
agcctggtgcaagagggatacccct

SEQ ID NO: 873765 - DNA, 25 bp, Mus musculus
agcctggtgcaagaggtagaactga

SEQ ID NO: 873766 - DNA, 25 bp, Mus musculus
agcctgtaagatcttgcagatacag

SEQ ID NO: 873767 - DNA, 25 bp, Mus musculus
agcctgtaagcccagcactatggtg

SEQ ID NO: 873768 - DNA, 25 bp, Mus musculus
agcctgtaaggccagcactatggtg

SEQ ID NO: 873769 - DNA, 25 bp, Mus musculus
agcctgtaagttcttgcagatacag

SEQ ID NO: 873770 - DNA, 25 bp, Mus musculus
agcctgtcctaaacatgaccttcaa

SEQ ID NO: 873771 - DNA, 25 bp, Mus musculus
agcctgtcctaaacttgaccttcaa

SEQ ID NO: 873772 - DNA, 25 bp, Mus musculus
agcctgtgccttcgacggctgttct

SEQ ID NO: 873773 - DNA, 25 bp, Mus musculus
agcctgtgccttggacggctgttct

SEQ ID NO: 873774 - DNA, 25 bp, Mus musculus
agcctgtggacattcgcacatctct

SEQ ID NO: 873775 - DNA, 25 bp, Mus musculus
agcctgtggacattggcacatctct

SEQ ID NO: 873776 - DNA, 25 bp, Mus musculus
agcctgtggcacagcagtggactcc

SEQ ID NO: 873777 - DNA, 25 bp, Mus musculus
agcctgtggcacaggagtggactcc

SEQ ID NO: 873778 - DNA, 25 bp, Mus musculus
agcctgtgtgcagtggttttggcca

SEQ ID NO: 873779 - DNA, 25 bp, Mus musculus
agcctgtgtggagtggttttggcca

SEQ ID NO: 873780 - DNA, 25 bp, Mus musculus
agcctgttcaagaaatcaacatgca

SEQ ID NO: 873781 - DNA, 25 bp, Mus musculus
agcctgttcaagcttcgcccagaga

SEQ ID NO: 873782 - DNA, 25 bp, Mus musculus
agcctgttcaaggttcgcccagaga

SEQ ID NO: 873783 - DNA, 25 bp, Mus musculus
agcctgttcaagtaatcaacatgca

SEQ ID NO: 873784 - DNA, 25 bp, Mus musculus
agccttataccccgagagagaagcg

SEQ ID NO: 873785 - DNA, 25 bp, Mus musculus
agccttatacccggagagagaagcg

SEQ ID NO: 873786 - DNA, 25 bp, Mus musculus
agccttcagcaacatgaggatgtgt

SEQ ID NO: 873787 - DNA, 25 bp, Mus musculus
agccttcagcaagatgaggatgtgt

SEQ ID NO: 873788 - DNA, 25 bp, Mus musculus
agccttccagcatgcctgaaggcca

SEQ ID NO: 873789 - DNA, 25 bp, Mus musculus
agccttccaggatgcctgaaggcca

SEQ ID NO: 873790 - DNA, 25 bp, Mus musculus
agccttcctgcgctttacatatgtg

SEQ ID NO: 873791 - DNA, 25 bp, Mus musculus
agccttcctggaccatgtggacgat

SEQ ID NO: 873792 - DNA, 25 bp, Mus musculus
agccttcctggagcatgtggacgat

SEQ ID NO: 873793 - DNA, 25 bp, Mus musculus
agccttcctgggctttacatatgtg

SEQ ID NO: 873794 - DNA, 25 bp, Mus musculus
agccttcgagagctgctgagcttgt

SEQ ID NO: 873795 - DNA, 25 bp, Mus musculus
agccttcgagaggtgctgagcttgt

SEQ ID NO: 873796 - DNA, 25 bp, Mus musculus
agccttctagacctcacccctacca

SEQ ID NO: 873797 - DNA, 25 bp, Mus musculus
agccttctagtcctcacccctacca

SEQ ID NO: 873798 - DNA, 25 bp, Mus musculus
agccttctcctgaaacactgtgccc

SEQ ID NO: 873799 - DNA, 25 bp, Mus musculus
agccttctcctgtaacactgtgccc

SEQ ID NO: 873800 - DNA, 25 bp, Mus musculus
agccttctggcacggtccctgcatg

SEQ ID NO: 873801 - DNA, 25 bp, Mus musculus
agccttctggcagggtccctgcatg

SEQ ID NO: 873802 - DNA, 25 bp, Mus musculus
agccttgactacatcgccacctgga

SEQ ID NO: 873803 - DNA, 25 bp, Mus musculus
agccttgactacatggccacctgga

SEQ ID NO: 873804 - DNA, 25 bp, Mus musculus
agccttgagaagattcactcctggg

SEQ ID NO: 873805 - DNA, 25 bp, Mus musculus
agccttgagaagtttcactcctggg

SEQ ID NO: 873806 - DNA, 25 bp, Mus musculus
agccttgatggaccagagttctccc

SEQ ID NO: 873807 - DNA, 25 bp, Mus musculus
agccttgatggagcagagttctccc

SEQ ID NO: 873808 - DNA, 25 bp, Mus musculus
agccttggagaaaacagagaaacag

SEQ ID NO: 873809 - DNA, 25 bp, Mus musculus
agccttggagtaaacagagaaacag

SEQ ID NO: 873810 - DNA, 25 bp, Mus musculus
agccttggataactggttagatgaa

SEQ ID NO: 873811 - DNA, 25 bp, Mus musculus
agccttggataagtggttagatgaa

SEQ ID NO: 873812 - DNA, 25 bp, Mus musculus
agccttggccaacgccaggttatca

SEQ ID NO: 873813 - DNA, 25 bp, Mus musculus
agccttggccaaggccaggttatca

SEQ ID NO: 873814 - DNA, 25 bp, Mus musculus
agccttgtcagaacctggcaccacc

SEQ ID NO: 873815 - DNA, 25 bp, Mus musculus
agccttgtcagaacgtggcaccacc

SEQ ID NO: 873816 - DNA, 25 bp, Mus musculus
agccttgttgcaagagaaccatcct

SEQ ID NO: 873817 - DNA, 25 bp, Mus musculus
agccttgttgcaagtgaaccatcct

SEQ ID NO: 873818 - DNA, 25 bp, Mus musculus
agcctttcagatccagagacaccgc

SEQ ID NO: 873819 - DNA, 25 bp, Mus musculus
agcctttcagttccagagacaccgc

SEQ ID NO: 873820 - DNA, 25 bp, Mus musculus
agcctttctgtgaacaaaagacatg

SEQ ID NO: 873821 - DNA, 25 bp, Mus musculus
agcctttctgtgaagaaaagacatg

SEQ ID NO: 873822 - DNA, 25 bp, Mus musculus
agcctttgagctgtgcctgcagtcc

SEQ ID NO: 873823 - DNA, 25 bp, Mus musculus
agcctttgaggtgtgcctgcagtcc

SEQ ID NO: 873824 - DNA, 25 bp, Mus musculus
agcctttggagacatagaaaatatt

SEQ ID NO: 873825 - DNA, 25 bp, Mus musculus
agcctttggagagatagaaaatatt

SEQ ID NO: 873826 - DNA, 25 bp, Mus musculus
agcctttgggaacgcgacagactta

SEQ ID NO: 873827 - DNA, 25 bp, Mus musculus
agcctttgggaaggcgacagactta

SEQ ID NO: 873828 - DNA, 25 bp, Mus musculus
agcgaagacccacacatggctgaca

SEQ ID NO: 873829 - DNA, 25 bp, Mus musculus
agcgaagacccagacatggctgaca

SEQ ID NO: 873830 - DNA, 25 bp, Mus musculus
agcgaagagccgctctctggggaag

SEQ ID NO: 873831 - DNA, 25 bp, Mus musculus
agcgaagagccggtctctggggaag

SEQ ID NO: 873832 - DNA, 25 bp, Mus musculus
agcgaagccatactcggacccactc

SEQ ID NO: 873833 - DNA, 25 bp, Mus musculus
agcgaagccatactgggacccactc

SEQ ID NO: 873834 - DNA, 25 bp, Mus musculus
agcgaagtccagatgctgagcgagt

SEQ ID NO: 873835 - DNA, 25 bp, Mus musculus
agcgaagtccagttgctgagcgagt

SEQ ID NO: 873836 - DNA, 25 bp, Mus musculus
agcgaagttcagatcttgaagggcc

SEQ ID NO: 873837 - DNA, 25 bp, Mus musculus
agcgaagttcagttcttgaagggcc

SEQ ID NO: 873838 - DNA, 25 bp, Mus musculus
agcgaatcagaacaaacagaatcct

SEQ ID NO: 873839 - DNA, 25 bp, Mus musculus
agcgaatcagtacaaacagaatcct

SEQ ID NO: 873840 - DNA, 25 bp, Mus musculus
agcgacaacatctgcagagagactt

SEQ ID NO: 873841 - DNA, 25 bp, Mus musculus
agcgacaacatctggagagagactt

SEQ ID NO: 873842 - DNA, 25 bp, Mus musculus
agcgacacttctccttcacacaccc

SEQ ID NO: 873843 - DNA, 25 bp, Mus musculus
agcgacacttgtccttcacacaccc

SEQ ID NO: 873844 - DNA, 25 bp, Mus musculus
agcgacagaaagatgtccgaccccg

SEQ ID NO: 873845 - DNA, 25 bp, Mus musculus
agcgacagaaagttgtccgaccccg

SEQ ID NO: 873846 - DNA, 25 bp, Mus musculus
agcgacagccctcacaggagaccca

SEQ ID NO: 873847 - DNA, 25 bp, Mus musculus
agcgacagccctcagaggagaccca

SEQ ID NO: 873848 - DNA, 25 bp, Mus musculus
agcgacagcggcaaaatagtgtttc

SEQ ID NO: 873849 - DNA, 25 bp, Mus musculus
agcgacagcggcaatatagtgtttc

SEQ ID NO: 873850 - DNA, 25 bp, Mus musculus
agcgacatagatcaagatgaatgcc

SEQ ID NO: 873851 - DNA, 25 bp, Mus musculus
agcgacatagttcaagatgaatgcc

SEQ ID NO: 873852 - DNA, 25 bp, Mus musculus
agcgaccagaggcacagtgaagaaa

SEQ ID NO: 873853 - DNA, 25 bp, Mus musculus
agcgaccagaggcagagtgaagaaa

SEQ ID NO: 873854 - DNA, 25 bp, Mus musculus
agcgaccagcacattcagctgcagc

SEQ ID NO: 873855 - DNA, 25 bp, Mus musculus
agcgaccagcactttcagctgcagc

SEQ ID NO: 873856 - DNA, 25 bp, Mus musculus
agcgacccacacctcaaactacaac

SEQ ID NO: 873857 - DNA, 25 bp, Mus musculus
agcgacccacacgtcaaactacaac

SEQ ID NO: 873858 - DNA, 25 bp, Mus musculus
agcgaccctgacagagtcatgtggc

SEQ ID NO: 873859 - DNA, 25 bp, Mus musculus
agcgaccctgactgagtcatgtggc

SEQ ID NO: 873860 - DNA, 25 bp, Mus musculus
agcgacctgactgacattggagagc

SEQ ID NO: 873861 - DNA, 25 bp, Mus musculus
agcgacctgactgagattggagagc

SEQ ID NO: 873862 - DNA, 25 bp, Mus musculus
agcgacggtcagcgctggattttga

SEQ ID NO: 873863 - DNA, 25 bp, Mus musculus
agcgacggtcagggctggattttga

SEQ ID NO: 873864 - DNA, 25 bp, Mus musculus
agcgactaagcacgaagggatggaa

SEQ ID NO: 873865 - DNA, 25 bp, Mus musculus
agcgactaagcaggaagggatggaa

SEQ ID NO: 873866 - DNA, 25 bp, Mus musculus
agcgactgagccaattaaaaacccg

SEQ ID NO: 873867 - DNA, 25 bp, Mus musculus
agcgactgagctctgccgacggggc

SEQ ID NO: 873868 - DNA, 25 bp, Mus musculus
agcgactgaggcaattaaaaacccg

SEQ ID NO: 873869 - DNA, 25 bp, Mus musculus
agcgactgaggtctgccgacggggc

SEQ ID NO: 873870 - DNA, 25 bp, Mus musculus
agcgactttgagttccaggcccgtg

SEQ ID NO: 873871 - DNA, 25 bp, Mus musculus
agcgactttgtgttccaggcccgtg

SEQ ID NO: 873872 - DNA, 25 bp, Mus musculus
agcgagaaggagaaattctcccaga

SEQ ID NO: 873873 - DNA, 25 bp, Mus musculus
agcgagaaggtgaaattctcccaga

SEQ ID NO: 873874 - DNA, 25 bp, Mus musculus
agcgagacttgcaaaaggtgctgga

SEQ ID NO: 873875 - DNA, 25 bp, Mus musculus
agcgagacttgctaaaggtgctgga

SEQ ID NO: 873876 - DNA, 25 bp, Mus musculus
agcgagagagcgaactggaggagtg

SEQ ID NO: 873877 - DNA, 25 bp, Mus musculus
agcgagagagggaactggaggagtg

SEQ ID NO: 873878 - DNA, 25 bp, Mus musculus
agcgagagcaagctctctgagatgt

SEQ ID NO: 873879 - DNA, 25 bp, Mus musculus
agcgagagcaaggtctctgagatgt

SEQ ID NO: 873880 - DNA, 25 bp, Mus musculus
agcgagatcaagatcatgaagagtg

SEQ ID NO: 873881 - DNA, 25 bp, Mus musculus
agcgagatcaagttcatgaagagtg

SEQ ID NO: 873882 - DNA, 25 bp, Mus musculus
agcgagatgctcatcctctccccgg

SEQ ID NO: 873883 - DNA, 25 bp, Mus musculus
agcgagatgctcatgctctccccgg

SEQ ID NO: 873884 - DNA, 25 bp, Mus musculus
agcgagcaggccgtaagaacaagag

SEQ ID NO: 873885 - DNA, 25 bp, Mus musculus
agcgagcagggcgtaagaacaagag

SEQ ID NO: 873886 - DNA, 25 bp, Mus musculus
agcgagccagcaaccgtatagaaaa

SEQ ID NO: 873887 - DNA, 25 bp, Mus musculus
agcgagccagcaacggtatagaaaa

SEQ ID NO: 873888 - DNA, 25 bp, Mus musculus
agcgagcccgcgctgttgataatca

SEQ ID NO: 873889 - DNA, 25 bp, Mus musculus
agcgagcccgggctgttgataatca

SEQ ID NO: 873890 - DNA, 25 bp, Mus musculus
agcgagcgagaggtgatcatgtgtg

SEQ ID NO: 873891 - DNA, 25 bp, Mus musculus
agcgagcgagtggtgatcatgtgtg

SEQ ID NO: 873892 - DNA, 25 bp, Mus musculus
agcgaggaaacacgcactctcgatt

SEQ ID NO: 873893 - DNA, 25 bp, Mus musculus
agcgaggaaacaggcactctcgatt

SEQ ID NO: 873894 - DNA, 25 bp, Mus musculus
agcgaggaagatgaggacgatgtgc

SEQ ID NO: 873895 - DNA, 25 bp, Mus musculus
agcgaggaagccacctgatgcagta

SEQ ID NO: 873896 - DNA, 25 bp, Mus musculus
agcgaggaagcgatcgcttacactt

SEQ ID NO: 873897 - DNA, 25 bp, Mus musculus
agcgaggaaggcacctgatgcagta

SEQ ID NO: 873898 - DNA, 25 bp, Mus musculus
agcgaggaagggatcgcttacactt

SEQ ID NO: 873899 - DNA, 25 bp, Mus musculus
agcgaggaagttgaggacgatgtgc

SEQ ID NO: 873900 - DNA, 25 bp, Mus musculus
agcgaggacttccacaaaagccagt

SEQ ID NO: 873901 - DNA, 25 bp, Mus musculus
agcgaggacttccagaaaagccagt

SEQ ID NO: 873902 - DNA, 25 bp, Mus musculus
agcgaggcccagctgatgctggcgc

SEQ ID NO: 873903 - DNA, 25 bp, Mus musculus
agcgaggcccaggtgatgctggcgc

SEQ ID NO: 873904 - DNA, 25 bp, Mus musculus
agcgaggccctgctcacaggctctg

SEQ ID NO: 873905 - DNA, 25 bp, Mus musculus
agcgaggccctggtcacaggctctg

SEQ ID NO: 873906 - DNA, 25 bp, Mus musculus
agcgaggccgagatctgtcgcttta

SEQ ID NO: 873907 - DNA, 25 bp, Mus musculus
agcgaggccgagttctgtcgcttta

SEQ ID NO: 873908 - DNA, 25 bp, Mus musculus
agcgaggctggacgcaccatgagcc

SEQ ID NO: 873909 - DNA, 25 bp, Mus musculus
agcgaggctggaggcaccatgagcc

SEQ ID NO: 873910 - DNA, 25 bp, Mus musculus
agcgagtcagaaccatctgccagca

SEQ ID NO: 873911 - DNA, 25 bp, Mus musculus
agcgagtcagtaccatctgccagca

SEQ ID NO: 873912 - DNA, 25 bp, Mus musculus
agcgagtcctcgcccagtgacttct

SEQ ID NO: 873913 - DNA, 25 bp, Mus musculus
agcgagtcctcggccagtgacttct

SEQ ID NO: 873914 - DNA, 25 bp, Mus musculus
agcgagtcgccggacgacacagagc

SEQ ID NO: 873915 - DNA, 25 bp, Mus musculus
agcgagtcgccggaggacacagagc

SEQ ID NO: 873916 - DNA, 25 bp, Mus musculus
agcgagtggcagagttgcacagcaa

SEQ ID NO: 873917 - DNA, 25 bp, Mus musculus
agcgagtggcagtgttgcacagcaa

SEQ ID NO: 873918 - DNA, 25 bp, Mus musculus
agcgagttattacgatgcctggtgt

SEQ ID NO: 873919 - DNA, 25 bp, Mus musculus
agcgagttattacgcacatgactca

SEQ ID NO: 873920 - DNA, 25 bp, Mus musculus
agcgagttattaggatgcctggtgt

SEQ ID NO: 873921 - DNA, 25 bp, Mus musculus
agcgagttattaggcacatgactca

SEQ ID NO: 873922 - DNA, 25 bp, Mus musculus
agcgatcctggcaactctggagacc

SEQ ID NO: 873923 - DNA, 25 bp, Mus musculus
agcgatcctggctactctggagacc

SEQ ID NO: 873924 - DNA, 25 bp, Mus musculus
agcgatgaaatgccctttggttgta

SEQ ID NO: 873925 - DNA, 25 bp, Mus musculus
agcgatgaaatgccgtttggttgta

SEQ ID NO: 873926 - DNA, 25 bp, Mus musculus
agcgatgctgatctttttgactcac

SEQ ID NO: 873927 - DNA, 25 bp, Mus musculus
agcgatgctgctgggaaggcgggcc

SEQ ID NO: 873928 - DNA, 25 bp, Mus musculus
agcgatgctggtgggaaggcgggcc

SEQ ID NO: 873929 - DNA, 25 bp, Mus musculus
agcgatgctgttctttttgactcac

SEQ ID NO: 873930 - DNA, 25 bp, Mus musculus
agcgatgggagtcggagccgagggg

SEQ ID NO: 873931 - DNA, 25 bp, Mus musculus
agcgatgggagtgggagccgagggg

SEQ ID NO: 873932 - DNA, 25 bp, Mus musculus
agcgattctgaaggtgaagagattg

SEQ ID NO: 873933 - DNA, 25 bp, Mus musculus
agcgattctgtaggtgaagagattg

SEQ ID NO: 873934 - DNA, 25 bp, Mus musculus
agcgatttaaaacggatgtcaatga

SEQ ID NO: 873935 - DNA, 25 bp, Mus musculus
agcgatttaaaagggatgtcaatga

SEQ ID NO: 873936 - DNA, 25 bp, Mus musculus
agcgcaaacggcagcaggaggaaga

SEQ ID NO: 873937 - DNA, 25 bp, Mus musculus
agcgcaaacggcaggaggaggaaga

SEQ ID NO: 873938 - DNA, 25 bp, Mus musculus
agcgcaacagctcacctggaggaag

SEQ ID NO: 873939 - DNA, 25 bp, Mus musculus
agcgcaacaggtcacctggaggaag

SEQ ID NO: 873940 - DNA, 25 bp, Mus musculus
agcgcaactcagatggctccagatg

SEQ ID NO: 873941 - DNA, 25 bp, Mus musculus
agcgcaactcagcctgactccccta

SEQ ID NO: 873942 - DNA, 25 bp, Mus musculus
agcgcaactcaggctgactccccta

SEQ ID NO: 873943 - DNA, 25 bp, Mus musculus
agcgcaactcagttggctccagatg

SEQ ID NO: 873944 - DNA, 25 bp, Mus musculus
agcgcaagttcacacatgtgacctt

SEQ ID NO: 873945 - DNA, 25 bp, Mus musculus
agcgcaagttcacagatgtgacctt

SEQ ID NO: 873946 - DNA, 25 bp, Mus musculus
agcgcacctacgcgctgactcctca

SEQ ID NO: 873947 - DNA, 25 bp, Mus musculus
agcgcacctacgggctgactcctca

SEQ ID NO: 873948 - DNA, 25 bp, Mus musculus
agcgcagaagcctgagaccgctgcc

SEQ ID NO: 873949 - DNA, 25 bp, Mus musculus
agcgcagaaggctgagaccgctgcc

SEQ ID NO: 873950 - DNA, 25 bp, Mus musculus
agcgcagagctagacgtcacctgga

SEQ ID NO: 873951 - DNA, 25 bp, Mus musculus
agcgcagagctagaggtcacctgga

SEQ ID NO: 873952 - DNA, 25 bp, Mus musculus
agcgcagaggctcgggacagtactt

SEQ ID NO: 873953 - DNA, 25 bp, Mus musculus
agcgcagaggctggggacagtactt

SEQ ID NO: 873954 - DNA, 25 bp, Mus musculus
agcgcagagtttcactatccctctg

SEQ ID NO: 873955 - DNA, 25 bp, Mus musculus
agcgcagagtttgactatccctctg

SEQ ID NO: 873956 - DNA, 25 bp, Mus musculus
agcgcagcaagaaacggaagctgcc

SEQ ID NO: 873957 - DNA, 25 bp, Mus musculus
agcgcagcaagaaagggaagctgcc

SEQ ID NO: 873958 - DNA, 25 bp, Mus musculus
agcgcaggagcttcagccagatggt

SEQ ID NO: 873959 - DNA, 25 bp, Mus musculus
agcgcaggaggttcagccagatggt

SEQ ID NO: 873960 - DNA, 25 bp, Mus musculus
agcgcagggagcgacagtgtgaaca

SEQ ID NO: 873961 - DNA, 25 bp, Mus musculus
agcgcagggagcgagagtgtgaaca

SEQ ID NO: 873962 - DNA, 25 bp, Mus musculus
agcgcagtatcacaccctgaagctg

SEQ ID NO: 873963 - DNA, 25 bp, Mus musculus
agcgcagtatcacagcctgaagctg

SEQ ID NO: 873964 - DNA, 25 bp, Mus musculus
agcgcatcagctgcagttaaagcaa

SEQ ID NO: 873965 - DNA, 25 bp, Mus musculus
agcgcatcaggtgcagttaaagcaa

SEQ ID NO: 873966 - DNA, 25 bp, Mus musculus
agcgccaagtgacagtcagcttgcg

SEQ ID NO: 873967 - DNA, 25 bp, Mus musculus
agcgccaagtgagagtcagcttgcg

SEQ ID NO: 873968 - DNA, 25 bp, Mus musculus
agcgccacagcaggctccatgacct

SEQ ID NO: 873969 - DNA, 25 bp, Mus musculus
agcgccacagccatggggaggattc

SEQ ID NO: 873970 - DNA, 25 bp, Mus musculus
agcgccacagcctccatgacctaca

SEQ ID NO: 873971 - DNA, 25 bp, Mus musculus
agcgccacaggaggctccatgacct

SEQ ID NO: 873972 - DNA, 25 bp, Mus musculus
agcgccacaggcatggggaggattc

SEQ ID NO: 873973 - DNA, 25 bp, Mus musculus
agcgccacaggctccatgacctaca

SEQ ID NO: 873974 - DNA, 25 bp, Mus musculus
agcgccagagccatgcccagaggtc

SEQ ID NO: 873975 - DNA, 25 bp, Mus musculus
agcgccagaggcatgcccagaggtc

SEQ ID NO: 873976 - DNA, 25 bp, Mus musculus
agcgcccaggctgggaattgctggc

SEQ ID NO: 873977 - DNA, 25 bp, Mus musculus
agcgcccagggtgggaattgctggc

SEQ ID NO: 873978 - DNA, 25 bp, Mus musculus
agcgcccagtctcatacacttttgg

SEQ ID NO: 873979 - DNA, 25 bp, Mus musculus
agcgcccagtctgatacacttttgg

SEQ ID NO: 873980 - DNA, 25 bp, Mus musculus
agcgcccgagcccctgggacgggag

SEQ ID NO: 873981 - DNA, 25 bp, Mus musculus
agcgcccgaggccctgggacgggag

SEQ ID NO: 873982 - DNA, 25 bp, Mus musculus
agcgccctggagctattgaagtctc

SEQ ID NO: 873983 - DNA, 25 bp, Mus musculus
agcgccctggaggtattgaagtctc

SEQ ID NO: 873984 - DNA, 25 bp, Mus musculus
agcgccgcaactttctggagacggt

SEQ ID NO: 873985 - DNA, 25 bp, Mus musculus
agcgccgcaagtttctggagacggt

SEQ ID NO: 873986 - DNA, 25 bp, Mus musculus
agcgccgccgctggagagatgtctg

SEQ ID NO: 873987 - DNA, 25 bp, Mus musculus
agcgccgccggtggagagatgtctg

SEQ ID NO: 873988 - DNA, 25 bp, Mus musculus
agcgccggagctttcaacaaagagt

SEQ ID NO: 873989 - DNA, 25 bp, Mus musculus
agcgccggagctttgaacaaagagt

SEQ ID NO: 873990 - DNA, 25 bp, Mus musculus
agcgcctcatcgtgcattactcctg

SEQ ID NO: 873991 - DNA, 25 bp, Mus musculus
agcgcctcatcgtggattactcctg

SEQ ID NO: 873992 - DNA, 25 bp, Mus musculus
agcgcgctttgacggcctgaagaag

SEQ ID NO: 873993 - DNA, 25 bp, Mus musculus
agcgcgctttgagggcctgaagaag

SEQ ID NO: 873994 - DNA, 25 bp, Mus musculus
agcgcggctctcaaccagaaaaatg

SEQ ID NO: 873995 - DNA, 25 bp, Mus musculus
agcgcggctctcaacgaggccaaag

SEQ ID NO: 873996 - DNA, 25 bp, Mus musculus
agcgcggctctcaagcagaaaaatg

SEQ ID NO: 873997 - DNA, 25 bp, Mus musculus
agcgcggctctcaaggaggccaaag

SEQ ID NO: 873998 - DNA, 25 bp, Mus musculus
agcgctcacgatcttgagagtcgat

SEQ ID NO: 873999 - DNA, 25 bp, Mus musculus
agcgctcacgttcttgagagtcgat

SEQ ID NO: 874000 - DNA, 25 bp, Mus musculus
agcgctgactttcagaaacggaagc

SEQ ID NO: 874001 - DNA, 25 bp, Mus musculus
agcgctgactttcgcctgcatgagg

SEQ ID NO: 874002 - DNA, 25 bp, Mus musculus
agcgctgactttgagaaacggaagc

SEQ ID NO: 874003 - DNA, 25 bp, Mus musculus
agcgctgactttggcctgcatgagg

SEQ ID NO: 874004 - DNA, 25 bp, Mus musculus
agcgctgatggccacattttcattt

SEQ ID NO: 874005 - DNA, 25 bp, Mus musculus
agcgctgatggccagattttcattt

SEQ ID NO: 874006 - DNA, 25 bp, Mus musculus
agcgctgcccggcatctccatcttt

SEQ ID NO: 874007 - DNA, 25 bp, Mus musculus
agcgctgcccgggatctccatcttt

SEQ ID NO: 874008 - DNA, 25 bp, Mus musculus
agcgctgcctcacagcccaccgcaa

SEQ ID NO: 874009 - DNA, 25 bp, Mus musculus
agcgctgcctcagagcccaccgcaa

SEQ ID NO: 874010 - DNA, 25 bp, Mus musculus
agcgctggacggctggagtgtcatc

SEQ ID NO: 874011 - DNA, 25 bp, Mus musculus
agcgctggacgggtggagtgtcatc

SEQ ID NO: 874012 - DNA, 25 bp, Mus musculus
agcgcttaatagattcttctggatc

SEQ ID NO: 874013 - DNA, 25 bp, Mus musculus
agcgcttaatagtttcttctggatc

SEQ ID NO: 874014 - DNA, 25 bp, Mus musculus
agcgcttcagagttcctggttcatc

SEQ ID NO: 874015 - DNA, 25 bp, Mus musculus
agcgcttcagtgttcctggttcatc

SEQ ID NO: 874016 - DNA, 25 bp, Mus musculus
agcgcttcctccagcttttctttat

SEQ ID NO: 874017 - DNA, 25 bp, Mus musculus
agcgcttcctgcagcttttctttat

SEQ ID NO: 874018 - DNA, 25 bp, Mus musculus
agcgcttcggagaacatgtggaccc

SEQ ID NO: 874019 - DNA, 25 bp, Mus musculus
agcgcttcggagaacgcctcctgcc

SEQ ID NO: 874020 - DNA, 25 bp, Mus musculus
agcgcttcggagaagatgtggaccc

SEQ ID NO: 874021 - DNA, 25 bp, Mus musculus
agcgcttcggagaaggcctcctgcc

SEQ ID NO: 874022 - DNA, 25 bp, Mus musculus
agcggaaatatccacagcgacgaga

SEQ ID NO: 874023 - DNA, 25 bp, Mus musculus
agcggaaatatccacatttagagcg

SEQ ID NO: 874024 - DNA, 25 bp, Mus musculus
agcggaaatatccagagcgacgaga

SEQ ID NO: 874025 - DNA, 25 bp, Mus musculus
agcggaaatatccagatttagagcg

SEQ ID NO: 874026 - DNA, 25 bp, Mus musculus
agcggaagcatgcaaactagagaga

SEQ ID NO: 874027 - DNA, 25 bp, Mus musculus
agcggaagcatggaaactagagaga

SEQ ID NO: 874028 - DNA, 25 bp, Mus musculus
agcggaattcacaagtggatcagcg

SEQ ID NO: 874029 - DNA, 25 bp, Mus musculus
agcggaattcactagtggatcagcg

SEQ ID NO: 874030 - DNA, 25 bp, Mus musculus
agcggacatcatcgagtatgctgtg

SEQ ID NO: 874031 - DNA, 25 bp, Mus musculus
agcggacatcatggagtatgctgtg

SEQ ID NO: 874032 - DNA, 25 bp, Mus musculus
agcggacatgccaacacattgacga

SEQ ID NO: 874033 - DNA, 25 bp, Mus musculus
agcggacatgccaagacattgacga

SEQ ID NO: 874034 - DNA, 25 bp, Mus musculus
agcggacgctgtcacgtctgtctgc

SEQ ID NO: 874035 - DNA, 25 bp, Mus musculus
agcggacgctgtcaggtctgtctgc

SEQ ID NO: 874036 - DNA, 25 bp, Mus musculus
agcggagaagtgcatgtcgcgtgga

SEQ ID NO: 874037 - DNA, 25 bp, Mus musculus
agcggagaagtgctgaaggccttgg

SEQ ID NO: 874038 - DNA, 25 bp, Mus musculus
agcggagaagtggatgtcgcgtgga

SEQ ID NO: 874039 - DNA, 25 bp, Mus musculus
agcggagaagtggtgaaggccttgg

SEQ ID NO: 874040 - DNA, 25 bp, Mus musculus
agcggagatatgcaaggagatggct

SEQ ID NO: 874041 - DNA, 25 bp, Mus musculus
agcggagatatggaaggagatggct

SEQ ID NO: 874042 - DNA, 25 bp, Mus musculus
agcggatagatatccggaactatgt

SEQ ID NO: 874043 - DNA, 25 bp, Mus musculus
agcggatagatatcgggaactatgt

SEQ ID NO: 874044 - DNA, 25 bp, Mus musculus
agcggcactggagacgtatcttcag

SEQ ID NO: 874045 - DNA, 25 bp, Mus musculus
agcggcactggagaggtatcttcag

SEQ ID NO: 874046 - DNA, 25 bp, Mus musculus
agcggcagcgacatggcctttgcct

SEQ ID NO: 874047 - DNA, 25 bp, Mus musculus
agcggcagcgacttggcctttgcct

SEQ ID NO: 874048 - DNA, 25 bp, Mus musculus
agcggcagtagactcagatacagag

SEQ ID NO: 874049 - DNA, 25 bp, Mus musculus
agcggcagtagagtcagatacagag

SEQ ID NO: 874050 - DNA, 25 bp, Mus musculus
agcggcatgccactacctgtaattg

SEQ ID NO: 874051 - DNA, 25 bp, Mus musculus
agcggcatgccagtacctgtaattg

SEQ ID NO: 874052 - DNA, 25 bp, Mus musculus
agcggcattcagcttctaaatggct

SEQ ID NO: 874053 - DNA, 25 bp, Mus musculus
agcggcattcaggttctaaatggct

SEQ ID NO: 874054 - DNA, 25 bp, Mus musculus
agcggccagtcagaatacagtttgg

SEQ ID NO: 874055 - DNA, 25 bp, Mus musculus
agcggccagtcagattacagtttgg

SEQ ID NO: 874056 - DNA, 25 bp, Mus musculus
agcggcccagcggcttgacttacaa

SEQ ID NO: 874057 - DNA, 25 bp, Mus musculus
agcggcccaggcccaccctgcaact

SEQ ID NO: 874058 - DNA, 25 bp, Mus musculus
agcggcccaggcccattattgtgat

SEQ ID NO: 874059 - DNA, 25 bp, Mus musculus
agcggcccaggccctccctgcaact

SEQ ID NO: 874060 - DNA, 25 bp, Mus musculus
agcggcccaggccctttattgtgat

SEQ ID NO: 874061 - DNA, 25 bp, Mus musculus
agcggcccaggggcttgacttacaa

SEQ ID NO: 874062 - DNA, 25 bp, Mus musculus
agcggccgccagactccacagaggc

SEQ ID NO: 874063 - DNA, 25 bp, Mus musculus
agcggccgccagtctccacagaggc

SEQ ID NO: 874064 - DNA, 25 bp, Mus musculus
agcggccggaagagttactgtgaca

SEQ ID NO: 874065 - DNA, 25 bp, Mus musculus
agcggccggaagatggcagactttc

SEQ ID NO: 874066 - DNA, 25 bp, Mus musculus
agcggccggaagcagtggaatgtga

SEQ ID NO: 874067 - DNA, 25 bp, Mus musculus
agcggccggaaggagtggaatgtga

SEQ ID NO: 874068 - DNA, 25 bp, Mus musculus
agcggccggaagtgttactgtgaca

SEQ ID NO: 874069 - DNA, 25 bp, Mus musculus
agcggccggaagttggcagactttc

SEQ ID NO: 874070 - DNA, 25 bp, Mus musculus
agcggcgggtggatcgggaatctgt

SEQ ID NO: 874071 - DNA, 25 bp, Mus musculus
agcggcgggtggatggggaatctgt

SEQ ID NO: 874072 - DNA, 25 bp, Mus musculus
agcggcggtgagatccattgtaggt

SEQ ID NO: 874073 - DNA, 25 bp, Mus musculus
agcggcggtgctgtgccaagtgttt

SEQ ID NO: 874074 - DNA, 25 bp, Mus musculus
agcggcggtggtgtgccaagtgttt

SEQ ID NO: 874075 - DNA, 25 bp, Mus musculus
agcggcggtgtgatccattgtaggt

SEQ ID NO: 874076 - DNA, 25 bp, Mus musculus
agcggctcagcttccagctacggtc

SEQ ID NO: 874077 - DNA, 25 bp, Mus musculus
agcggctcaggttccagctacggtc

SEQ ID NO: 874078 - DNA, 25 bp, Mus musculus
agcggctgatactgaatcactgcaa

SEQ ID NO: 874079 - DNA, 25 bp, Mus musculus
agcggctgattctgaatcactgcaa

SEQ ID NO: 874080 - DNA, 25 bp, Mus musculus
agcggcttccggcagctgtgccaac

SEQ ID NO: 874081 - DNA, 25 bp, Mus musculus
agcggcttccgggagctgtgccaac

SEQ ID NO: 874082 - DNA, 25 bp, Mus musculus
agcgggagaactatgacaacatggc

SEQ ID NO: 874083 - DNA, 25 bp, Mus musculus
agcgggagaagtatgacaacatggc

SEQ ID NO: 874084 - DNA, 25 bp, Mus musculus
agcgggctgccacgagccgtggacg

SEQ ID NO: 874085 - DNA, 25 bp, Mus musculus
agcgggctgccaggagccgtggacg

SEQ ID NO: 874086 - DNA, 25 bp, Mus musculus
agcggggccgcggtctgcgtgctgc

SEQ ID NO: 874087 - DNA, 25 bp, Mus musculus
agcggggccggggtctgcgtgctgc

SEQ ID NO: 874088 - DNA, 25 bp, Mus musculus
agcggggctgtgcatctttccagaa

SEQ ID NO: 874089 - DNA, 25 bp, Mus musculus
agcggggctgtggatctttccagaa

SEQ ID NO: 874090 - DNA, 25 bp, Mus musculus
agcggtaatagtcgtgctttagccc

SEQ ID NO: 874091 - DNA, 25 bp, Mus musculus
agcggtaatagtggtgctttagccc

SEQ ID NO: 874092 - DNA, 25 bp, Mus musculus
agcggtgcagatgacagttcgtgaa

SEQ ID NO: 874093 - DNA, 25 bp, Mus musculus
agcggtgcagttgacagttcgtgaa

SEQ ID NO: 874094 - DNA, 25 bp, Mus musculus
agcggttcagctctgtgacgagaag

SEQ ID NO: 874095 - DNA, 25 bp, Mus musculus
agcggttcaggtctgtgacgagaag

SEQ ID NO: 874096 - DNA, 25 bp, Mus musculus
agcggttctgagatatgcattggct

SEQ ID NO: 874097 - DNA, 25 bp, Mus musculus
agcggttctgtgatatgcattggct

SEQ ID NO: 874098 - DNA, 25 bp, Mus musculus
agcggtttgccacggaaaatcatag

SEQ ID NO: 874099 - DNA, 25 bp, Mus musculus
agcggtttgccacgtcggatgatga

SEQ ID NO: 874100 - DNA, 25 bp, Mus musculus
agcggtttgccagggaaaatcatag

SEQ ID NO: 874101 - DNA, 25 bp, Mus musculus
agcggtttgccaggtcggatgatga

SEQ ID NO: 874102 - DNA, 25 bp, Mus musculus
agcgtagggaccgacaggccgagca

SEQ ID NO: 874103 - DNA, 25 bp, Mus musculus
agcgtagggaccgacgccgagcacg

SEQ ID NO: 874104 - DNA, 25 bp, Mus musculus
agcgtagggaccgagaggccgagca

SEQ ID NO: 874105 - DNA, 25 bp, Mus musculus
agcgtagggaccgaggccgagcacg

SEQ ID NO: 874106 - DNA, 25 bp, Mus musculus
agcgtccagcgtccgcccctccagc

SEQ ID NO: 874107 - DNA, 25 bp, Mus musculus
agcgtccagcgtgcgcccctccagc

SEQ ID NO: 874108 - DNA, 25 bp, Mus musculus
agcgtcctcccggtagctgggagta

SEQ ID NO: 874109 - DNA, 25 bp, Mus musculus
agcgtcctccgggtagctgggagta

SEQ ID NO: 874110 - DNA, 25 bp, Mus musculus
agcgtccttgagctgaggctgcagc

SEQ ID NO: 874111 - DNA, 25 bp, Mus musculus
agcgtccttgtgctgaggctgcagc

SEQ ID NO: 874112 - DNA, 25 bp, Mus musculus
agcgtcgtgcaacatttcctgccaa

SEQ ID NO: 874113 - DNA, 25 bp, Mus musculus
agcgtcgtgcaagatttcctgccaa

SEQ ID NO: 874114 - DNA, 25 bp, Mus musculus
agcgtctcctagacaaagccaccag

SEQ ID NO: 874115 - DNA, 25 bp, Mus musculus
agcgtctcctagtcaaagccaccag

SEQ ID NO: 874116 - DNA, 25 bp, Mus musculus
agcgtctggcagctccaagggtagc

SEQ ID NO: 874117 - DNA, 25 bp, Mus musculus
agcgtctggcaggtccaagggtagc

SEQ ID NO: 874118 - DNA, 25 bp, Mus musculus
agcgtcttccaaatatggcatgaat

SEQ ID NO: 874119 - DNA, 25 bp, Mus musculus
agcgtcttccaattatggcatgaat

SEQ ID NO: 874120 - DNA, 25 bp, Mus musculus
agcgtgaacacacaaatcccttcac

SEQ ID NO: 874121 - DNA, 25 bp, Mus musculus
agcgtgaacacacggggcttccgaa

SEQ ID NO: 874122 - DNA, 25 bp, Mus musculus
agcgtgaacacagaaatcccttcac

SEQ ID NO: 874123 - DNA, 25 bp, Mus musculus
agcgtgaacacagggggcttccgaa

SEQ ID NO: 874124 - DNA, 25 bp, Mus musculus
agcgtgaatgggcgcaatggcatct

SEQ ID NO: 874125 - DNA, 25 bp, Mus musculus
agcgtgaatgggggcaatggcatct

SEQ ID NO: 874126 - DNA, 25 bp, Mus musculus
agcgtgacagagaagcgctatgtcc

SEQ ID NO: 874127 - DNA, 25 bp, Mus musculus
agcgtgacagtgaagcgctatgtcc

SEQ ID NO: 874128 - DNA, 25 bp, Mus musculus
agcgtgatctcgcagtcctccgggc

SEQ ID NO: 874129 - DNA, 25 bp, Mus musculus
agcgtgatctcgcgcaatggcagca

SEQ ID NO: 874130 - DNA, 25 bp, Mus musculus
agcgtgatctcggagtcctccgggc

SEQ ID NO: 874131 - DNA, 25 bp, Mus musculus
agcgtgatctcgggcaatggcagca

SEQ ID NO: 874132 - DNA, 25 bp, Mus musculus
agcgtgccattgacctggagacgac

SEQ ID NO: 874133 - DNA, 25 bp, Mus musculus
agcgtgccattgtcctggagacgac

SEQ ID NO: 874134 - DNA, 25 bp, Mus musculus
agcgtggagaagcacccagatgcag

SEQ ID NO: 874135 - DNA, 25 bp, Mus musculus
agcgtggagaaggacccagatgcag

SEQ ID NO: 874136 - DNA, 25 bp, Mus musculus
agcgtggagaatgtcggctcatggc

SEQ ID NO: 874137 - DNA, 25 bp, Mus musculus
agcgtggagaatgtgggctcatggc

SEQ ID NO: 874138 - DNA, 25 bp, Mus musculus
agcgtggagaccatcttcaacaagg

SEQ ID NO: 874139 - DNA, 25 bp, Mus musculus
agcgtggagagcatcttcaacaagg

SEQ ID NO: 874140 - DNA, 25 bp, Mus musculus
agcgtggcagcttctatcagccttg

SEQ ID NO: 874141 - DNA, 25 bp, Mus musculus
agcgtggcaggttctatcagccttg

SEQ ID NO: 874142 - DNA, 25 bp, Mus musculus
agcgtggtggctgccggccatgact

SEQ ID NO: 874143 - DNA, 25 bp, Mus musculus
agcgtggtggctgcgggccatgact

SEQ ID NO: 874144 - DNA, 25 bp, Mus musculus
agcgtggttgatctggtggctctga

SEQ ID NO: 874145 - DNA, 25 bp, Mus musculus
agcgtggttgttctggtggctctga

SEQ ID NO: 874146 - DNA, 25 bp, Mus musculus
agcgtgtctcatactacaaggaacc

SEQ ID NO: 874147 - DNA, 25 bp, Mus musculus
agcgtgtctcttactacaaggaacc

SEQ ID NO: 874148 - DNA, 25 bp, Mus musculus
agcgtgtgcagacgttctcacacag

SEQ ID NO: 874149 - DNA, 25 bp, Mus musculus
agcgtgtgcagaggttctcacacag

SEQ ID NO: 874150 - DNA, 25 bp, Mus musculus
agcgtgtggatcaacccggaagacc

SEQ ID NO: 874151 - DNA, 25 bp, Mus musculus
agcgtgtggatcaagccggaagacc

SEQ ID NO: 874152 - DNA, 25 bp, Mus musculus
agcgtgtgttaacccatcaaacaat

SEQ ID NO: 874153 - DNA, 25 bp, Mus musculus
agcgtgtgttaacgttaccaacata

SEQ ID NO: 874154 - DNA, 25 bp, Mus musculus
agcgtgtgttaagccatcaaacaat

SEQ ID NO: 874155 - DNA, 25 bp, Mus musculus
agcgtgtgttaaggttaccaacata

SEQ ID NO: 874156 - DNA, 25 bp, Mus musculus
agcgttcacaagactgagttcactt

SEQ ID NO: 874157 - DNA, 25 bp, Mus musculus
agcgttcacaagatcatttccatgt

SEQ ID NO: 874158 - DNA, 25 bp, Mus musculus
agcgttcacaagtctgagttcactt

SEQ ID NO: 874159 - DNA, 25 bp, Mus musculus
agcgttcacaagttcatttccatgt

SEQ ID NO: 874160 - DNA, 25 bp, Mus musculus
agcgtttgcttcatgactttatatg

SEQ ID NO: 874161 - DNA, 25 bp, Mus musculus
agcgtttgcttcttgactttatatg

SEQ ID NO: 874162 - DNA, 25 bp, Mus musculus
agcgttttggcaggcaattcacgca

SEQ ID NO: 874163 - DNA, 25 bp, Mus musculus
agcgttttggcagggaattcacgca

SEQ ID NO: 874164 - DNA, 25 bp, Mus musculus
agctaaaattaacgagctgacaagt

SEQ ID NO: 874165 - DNA, 25 bp, Mus musculus
agctaaaattaaggagctgacaagt

SEQ ID NO: 874166 - DNA, 25 bp, Mus musculus
agctaaagaaaagtggagaccattc

SEQ ID NO: 874167 - DNA, 25 bp, Mus musculus
agctaaagaatagtggagaccattc

SEQ ID NO: 874168 - DNA, 25 bp, Mus musculus
agctaaagagaatggactcgctaca

SEQ ID NO: 874169 - DNA, 25 bp, Mus musculus
agctaaagagtatggactcgctaca

SEQ ID NO: 874170 - DNA, 25 bp, Mus musculus
agctaacgaagcagcgttgcaaaac

SEQ ID NO: 874171 - DNA, 25 bp, Mus musculus
agctaacgaagcagggttgcaaaac

SEQ ID NO: 874172 - DNA, 25 bp, Mus musculus
agctaagagccacgtaatttctaat

SEQ ID NO: 874173 - DNA, 25 bp, Mus musculus
agctaagagccaggtaatttctaat

SEQ ID NO: 874174 - DNA, 25 bp, Mus musculus
agctaatgtccgctttgttgctcat

SEQ ID NO: 874175 - DNA, 25 bp, Mus musculus
agctaatgtccggtttgttgctcat

SEQ ID NO: 874176 - DNA, 25 bp, Mus musculus
agctaattcttggtcgtctctaggt

SEQ ID NO: 874177 - DNA, 25 bp, Mus musculus
agctaattcttggtggtctctaggt

SEQ ID NO: 874178 - DNA, 25 bp, Mus musculus
agctaattttggcacattaactaaa

SEQ ID NO: 874179 - DNA, 25 bp, Mus musculus
agctaattttggcagattaactaaa

SEQ ID NO: 874180 - DNA, 25 bp, Mus musculus
agctacaaagtgaactgctcaggag

SEQ ID NO: 874181 - DNA, 25 bp, Mus musculus
agctacaaagtgaagtgctcaggag

SEQ ID NO: 874182 - DNA, 25 bp, Mus musculus
agctacaacagcgtatatggggccc

SEQ ID NO: 874183 - DNA, 25 bp, Mus musculus
agctacaacagcgtttatggggccc

SEQ ID NO: 874184 - DNA, 25 bp, Mus musculus
agctacacagaggccgtgaaggaat

SEQ ID NO: 874185 - DNA, 25 bp, Mus musculus
agctacacagaggcggtgaaggaat

SEQ ID NO: 874186 - DNA, 25 bp, Mus musculus
agctacacagcttttgtccaaggat

SEQ ID NO: 874187 - DNA, 25 bp, Mus musculus
agctacacaggttttgtccaaggat

SEQ ID NO: 874188 - DNA, 25 bp, Mus musculus
agctacacggcttggagctggagga

SEQ ID NO: 874189 - DNA, 25 bp, Mus musculus
agctacacgggttggagctggagga

SEQ ID NO: 874190 - DNA, 25 bp, Mus musculus
agctacactgcctatagggcagcat

SEQ ID NO: 874191 - DNA, 25 bp, Mus musculus
agctacactggctatagggcagcat

SEQ ID NO: 874192 - DNA, 25 bp, Mus musculus
agctacagacaaattttgacacttt

SEQ ID NO: 874193 - DNA, 25 bp, Mus musculus
agctacagacaatttttgacacttt

SEQ ID NO: 874194 - DNA, 25 bp, Mus musculus
agctacagcatgcaagccaaaggag

SEQ ID NO: 874195 - DNA, 25 bp, Mus musculus
agctacagcatggaagccaaaggag

SEQ ID NO: 874196 - DNA, 25 bp, Mus musculus
agctacagtaaaagcccatccaaaa

SEQ ID NO: 874197 - DNA, 25 bp, Mus musculus
agctacagtaaatgcccatccaaaa

SEQ ID NO: 874198 - DNA, 25 bp, Mus musculus
agctacatctcacgccagggctttg

SEQ ID NO: 874199 - DNA, 25 bp, Mus musculus
agctacatctcacgcccctggtttg

SEQ ID NO: 874200 - DNA, 25 bp, Mus musculus
agctacatctcaggccagggctttg

SEQ ID NO: 874201 - DNA, 25 bp, Mus musculus
agctacatctcaggcccctggtttg

SEQ ID NO: 874202 - DNA, 25 bp, Mus musculus
agctaccatctgaacagtctactcg

SEQ ID NO: 874203 - DNA, 25 bp, Mus musculus
agctaccatctgaagagtctactcg

SEQ ID NO: 874204 - DNA, 25 bp, Mus musculus
agctaccccaacaatgcaccttccg

SEQ ID NO: 874205 - DNA, 25 bp, Mus musculus
agctaccccaactatgcaccttccg

SEQ ID NO: 874206 - DNA, 25 bp, Mus musculus
agctacctaactcgccccaccaagc

SEQ ID NO: 874207 - DNA, 25 bp, Mus musculus
agctacctaactggccccaccaagc

SEQ ID NO: 874208 - DNA, 25 bp, Mus musculus
agctacctagcatgtccaaaattct

SEQ ID NO: 874209 - DNA, 25 bp, Mus musculus
agctacctaggatgtccaaaattct

SEQ ID NO: 874210 - DNA, 25 bp, Mus musculus
agctaccttctgatactgtttgctt

SEQ ID NO: 874211 - DNA, 25 bp, Mus musculus
agctaccttctgttactgtttgctt

SEQ ID NO: 874212 - DNA, 25 bp, Mus musculus
agctacgcaccaaacgtgtgacttt

SEQ ID NO: 874213 - DNA, 25 bp, Mus musculus
agctacgcaccaaaggtgtgacttt

SEQ ID NO: 874214 - DNA, 25 bp, Mus musculus
agctacgtgaaggaactggtggttc

SEQ ID NO: 874215 - DNA, 25 bp, Mus musculus
agctacgtgaaggatctggtggttc

SEQ ID NO: 874216 - DNA, 25 bp, Mus musculus
agctactagagacacctgtaaaacc

SEQ ID NO: 874217 - DNA, 25 bp, Mus musculus
agctactagagacagctgtaaaacc

SEQ ID NO: 874218 - DNA, 25 bp, Mus musculus
agctactaggcaccaaaatggctgg

SEQ ID NO: 874219 - DNA, 25 bp, Mus musculus
agctactaggcagcaaaatggctgg

SEQ ID NO: 874220 - DNA, 25 bp, Mus musculus
agctactcagatggacgtcctatac

SEQ ID NO: 874221 - DNA, 25 bp, Mus musculus
agctactcagccctgcctactttgg

SEQ ID NO: 874222 - DNA, 25 bp, Mus musculus
agctactcagctcaaggctttgaca

SEQ ID NO: 874223 - DNA, 25 bp, Mus musculus
agctactcaggcctgcctactttgg

SEQ ID NO: 874224 - DNA, 25 bp, Mus musculus
agctactcaggtcaaggctttgaca

SEQ ID NO: 874225 - DNA, 25 bp, Mus musculus
agctactcagttggacgtcctatac

SEQ ID NO: 874226 - DNA, 25 bp, Mus musculus
agctactccaaacggttatgagcca

SEQ ID NO: 874227 - DNA, 25 bp, Mus musculus
agctactccaaagggttatgagcca

SEQ ID NO: 874228 - DNA, 25 bp, Mus musculus
agctactcccagcttgcccacattc

SEQ ID NO: 874229 - DNA, 25 bp, Mus musculus
agctactcccaggttgcccacattc

SEQ ID NO: 874230 - DNA, 25 bp, Mus musculus
agctactccgtgcacaactgaactt

SEQ ID NO: 874231 - DNA, 25 bp, Mus musculus
agctactccgtgcagaactgaactt

SEQ ID NO: 874232 - DNA, 25 bp, Mus musculus
agctactctgctggagagctctact

SEQ ID NO: 874233 - DNA, 25 bp, Mus musculus
agctactctggtggagagctctact

SEQ ID NO: 874234 - DNA, 25 bp, Mus musculus
agctacttagcctactcagttggag

SEQ ID NO: 874235 - DNA, 25 bp, Mus musculus
agctacttaggctactcagttggag

SEQ ID NO: 874236 - DNA, 25 bp, Mus musculus
agctacttcgagaggcttcagggat

SEQ ID NO: 874237 - DNA, 25 bp, Mus musculus
agctacttcgagtggcttcagggat

SEQ ID NO: 874238 - DNA, 25 bp, Mus musculus
agctacttggcatactctgtggctg

SEQ ID NO: 874239 - DNA, 25 bp, Mus musculus
agctacttgggatactctgtggctg

SEQ ID NO: 874240 - DNA, 25 bp, Mus musculus
agctactttcagctgctgtgcagca

SEQ ID NO: 874241 - DNA, 25 bp, Mus musculus
agctactttcaggtgctgtgcagca

SEQ ID NO: 874242 - DNA, 25 bp, Mus musculus
agctagaagccgaatacttggccat

SEQ ID NO: 874243 - DNA, 25 bp, Mus musculus
agctagaagcggaatacttggccat

SEQ ID NO: 874244 - DNA, 25 bp, Mus musculus
agctagagccaacggccgggcgtgg

SEQ ID NO: 874245 - DNA, 25 bp, Mus musculus
agctagagccaagggccgggcgtgg

SEQ ID NO: 874246 - DNA, 25 bp, Mus musculus
agctagagcgacagcagttggaaac

SEQ ID NO: 874247 - DNA, 25 bp, Mus musculus
agctagagcgtcagcagttggaaac

SEQ ID NO: 874248 - DNA, 25 bp, Mus musculus
agctagatgaaactaaaactacttc

SEQ ID NO: 874249 - DNA, 25 bp, Mus musculus
agctagatgaaagtaaaactacttc

SEQ ID NO: 874250 - DNA, 25 bp, Mus musculus
agctagccgcctcacgtgtttgaac

SEQ ID NO: 874251 - DNA, 25 bp, Mus musculus
agctagccgcctcaggtgtttgaac

SEQ ID NO: 874252 - DNA, 25 bp, Mus musculus
agctagctactccacgtacgtaggt

SEQ ID NO: 874253 - DNA, 25 bp, Mus musculus
agctagctactccaggtacgtaggt

SEQ ID NO: 874254 - DNA, 25 bp, Mus musculus
agctaggaagagctcagccatgtca

SEQ ID NO: 874255 - DNA, 25 bp, Mus musculus
agctaggaagaggtcagccatgtca

SEQ ID NO: 874256 - DNA, 25 bp, Mus musculus
agctagggaatgaaggtgaagagat

SEQ ID NO: 874257 - DNA, 25 bp, Mus musculus
agctagggaatgtaggtgaagagat

SEQ ID NO: 874258 - DNA, 25 bp, Mus musculus
agctagtagcagaagctgggagggc

SEQ ID NO: 874259 - DNA, 25 bp, Mus musculus
agctagtagcagtagctgggagggc

SEQ ID NO: 874260 - DNA, 25 bp, Mus musculus
agctagtcttttaatggagaatgga

SEQ ID NO: 874261 - DNA, 25 bp, Mus musculus
agctagtcttttaggtaagaagtat

SEQ ID NO: 874262 - DNA, 25 bp, Mus musculus
agctagtctttttatggagaatgga

SEQ ID NO: 874263 - DNA, 25 bp, Mus musculus
agctagtctttttggtaagaagtat

SEQ ID NO: 874264 - DNA, 25 bp, Mus musculus
agctagttgtggctcgcatccgaaa

SEQ ID NO: 874265 - DNA, 25 bp, Mus musculus
agctagttgtgggtcgcatccgaaa

SEQ ID NO: 874266 - DNA, 25 bp, Mus musculus
agctataaagcatgttaagattgag

SEQ ID NO: 874267 - DNA, 25 bp, Mus musculus
agctataaaggatgttaagattgag

SEQ ID NO: 874268 - DNA, 25 bp, Mus musculus
agctatatcggacacacagcttcat

SEQ ID NO: 874269 - DNA, 25 bp, Mus musculus
agctatatcggagacacagcttcat

SEQ ID NO: 874270 - DNA, 25 bp, Mus musculus
agctatccagcacagccatggaact

SEQ ID NO: 874271 - DNA, 25 bp, Mus musculus
agctatccagcagagccatggaact

SEQ ID NO: 874272 - DNA, 25 bp, Mus musculus
agctatcccacacactcagaaccgt

SEQ ID NO: 874273 - DNA, 25 bp, Mus musculus
agctatcccacagactcagaaccgt

SEQ ID NO: 874274 - DNA, 25 bp, Mus musculus
agctatgaagcaaacgtgaatcttc

SEQ ID NO: 874275 - DNA, 25 bp, Mus musculus
agctatgaagcaaaggtgaatcttc

SEQ ID NO: 874276 - DNA, 25 bp, Mus musculus
agctatgaagccaacattgtaaggg

SEQ ID NO: 874277 - DNA, 25 bp, Mus musculus
agctatgaagccaagattgtaaggg

SEQ ID NO: 874278 - DNA, 25 bp, Mus musculus
agctatgccagactggtggaaccaa

SEQ ID NO: 874279 - DNA, 25 bp, Mus musculus
agctatgccagagtggtggaaccaa

SEQ ID NO: 874280 - DNA, 25 bp, Mus musculus
agctatggaacactctgtcccagaa

SEQ ID NO: 874281 - DNA, 25 bp, Mus musculus
agctatggaacagtctgtcccagaa

SEQ ID NO: 874282 - DNA, 25 bp, Mus musculus
agctatgggcgaccagctcttgcca

SEQ ID NO: 874283 - DNA, 25 bp, Mus musculus
agctatgggcgagcagctcttgcca

SEQ ID NO: 874284 - DNA, 25 bp, Mus musculus
agctattcagcggatgatggcgtgg

SEQ ID NO: 874285 - DNA, 25 bp, Mus musculus
agctattcagctgctgggcatgctg

SEQ ID NO: 874286 - DNA, 25 bp, Mus musculus
agctattcaggggatgatggcgtgg

SEQ ID NO: 874287 - DNA, 25 bp, Mus musculus
agctattcaggtgctgggcatgctg

SEQ ID NO: 874288 - DNA, 25 bp, Mus musculus
agctattgcacgcatggtgaacttt

SEQ ID NO: 874289 - DNA, 25 bp, Mus musculus
agctattgcacggatggtgaacttt

SEQ ID NO: 874290 - DNA, 25 bp, Mus musculus
agctcaaaagcgaaattatcgcttt

SEQ ID NO: 874291 - DNA, 25 bp, Mus musculus
agctcaaaagggaaattatcgcttt

SEQ ID NO: 874292 - DNA, 25 bp, Mus musculus
agctcaaaccaacaccctccaccag

SEQ ID NO: 874293 - DNA, 25 bp, Mus musculus
agctcaaaccaagaccctccaccag

SEQ ID NO: 874294 - DNA, 25 bp, Mus musculus
agctcaaaggcaagctaacaggaat

SEQ ID NO: 874295 - DNA, 25 bp, Mus musculus
agctcaaagggaagctaacaggaat

SEQ ID NO: 874296 - DNA, 25 bp, Mus musculus
agctcaaccgctacatccccacagc

SEQ ID NO: 874297 - DNA, 25 bp, Mus musculus
agctcaaccggtacatccccacagc

SEQ ID NO: 874298 - DNA, 25 bp, Mus musculus
agctcacacccacgtgctggctgag

SEQ ID NO: 874299 - DNA, 25 bp, Mus musculus
agctcacacccaggtgctggctgag

SEQ ID NO: 874300 - DNA, 25 bp, Mus musculus
agctcacagaagcctgcagagccta

SEQ ID NO: 874301 - DNA, 25 bp, Mus musculus
agctcacagaaggctgcagagccta

SEQ ID NO: 874302 - DNA, 25 bp, Mus musculus
agctcacagatgcccactttgagga

SEQ ID NO: 874303 - DNA, 25 bp, Mus musculus
agctcacagatggccactttgagga

SEQ ID NO: 874304 - DNA, 25 bp, Mus musculus
agctcacagtctcacaaaccattga

SEQ ID NO: 874305 - DNA, 25 bp, Mus musculus
agctcacagtctcacccacagagaa

SEQ ID NO: 874306 - DNA, 25 bp, Mus musculus
agctcacagtctcacgacccatcga

SEQ ID NO: 874307 - DNA, 25 bp, Mus musculus
agctcacagtctcagaaaccattga

SEQ ID NO: 874308 - DNA, 25 bp, Mus musculus
agctcacagtctcagccacagagaa

SEQ ID NO: 874309 - DNA, 25 bp, Mus musculus
agctcacagtctcaggacccatcga

SEQ ID NO: 874310 - DNA, 25 bp, Mus musculus
agctcaccattggacgcagagcacc

SEQ ID NO: 874311 - DNA, 25 bp, Mus musculus
agctcaccattggaggcagagcacc

SEQ ID NO: 874312 - DNA, 25 bp, Mus musculus
agctcacgagaacatgtgtatgtcg

SEQ ID NO: 874313 - DNA, 25 bp, Mus musculus
agctcacgagaagatgtgtatgtcg

SEQ ID NO: 874314 - DNA, 25 bp, Mus musculus
agctcacgcctcacttctgtattat

SEQ ID NO: 874315 - DNA, 25 bp, Mus musculus
agctcacgcctcatgaccagcagtt

SEQ ID NO: 874316 - DNA, 25 bp, Mus musculus
agctcacgcctctcttctgtattat

SEQ ID NO: 874317 - DNA, 25 bp, Mus musculus
agctcacgcctcttgaccagcagtt

SEQ ID NO: 874318 - DNA, 25 bp, Mus musculus
agctcagaaacacgcggaaaaactg

SEQ ID NO: 874319 - DNA, 25 bp, Mus musculus
agctcagaaacaggcggaaaaactg

SEQ ID NO: 874320 - DNA, 25 bp, Mus musculus
agctcagagacccaagtgcataagt

SEQ ID NO: 874321 - DNA, 25 bp, Mus musculus
agctcagagacccatgtgcataagt

SEQ ID NO: 874322 - DNA, 25 bp, Mus musculus
agctcagagttctcagggagctgac

SEQ ID NO: 874323 - DNA, 25 bp, Mus musculus
agctcagagttctctgggagctgac

SEQ ID NO: 874324 - DNA, 25 bp, Mus musculus
agctcagatcagctaagggagcaca

SEQ ID NO: 874325 - DNA, 25 bp, Mus musculus
agctcagatcaggtaagggagcaca

SEQ ID NO: 874326 - DNA, 25 bp, Mus musculus
agctcagcaaagaagttgggatatc

SEQ ID NO: 874327 - DNA, 25 bp, Mus musculus
agctcagcaaagagtacacactgga

SEQ ID NO: 874328 - DNA, 25 bp, Mus musculus
agctcagcaaagtagttgggatatc

SEQ ID NO: 874329 - DNA, 25 bp, Mus musculus
agctcagcaatgagtacacactgga

SEQ ID NO: 874330 - DNA, 25 bp, Mus musculus
agctcagcacgacacagggcgtccc

SEQ ID NO: 874331 - DNA, 25 bp, Mus musculus
agctcagcacgacagagggcgtccc

SEQ ID NO: 874332 - DNA, 25 bp, Mus musculus
agctcagcagaacgttccagatgaa

SEQ ID NO: 874333 - DNA, 25 bp, Mus musculus
agctcagcagaaggttccagatgaa

SEQ ID NO: 874334 - DNA, 25 bp, Mus musculus
agctcagcctggaagacctgccagg

SEQ ID NO: 874335 - DNA, 25 bp, Mus musculus
agctcagcctggtagacctgccagg

SEQ ID NO: 874336 - DNA, 25 bp, Mus musculus
agctcaggagcagccggtttattgc

SEQ ID NO: 874337 - DNA, 25 bp, Mus musculus
agctcaggagcagcgggtttattgc

SEQ ID NO: 874338 - DNA, 25 bp, Mus musculus
agctcaggctccaagcctgaggaag

SEQ ID NO: 874339 - DNA, 25 bp, Mus musculus
agctcaggctcgcaaatgaggagat

SEQ ID NO: 874340 - DNA, 25 bp, Mus musculus
agctcaggctgcaagcctgaggaag

SEQ ID NO: 874341 - DNA, 25 bp, Mus musculus
agctcaggctggcaaatgaggagat

SEQ ID NO: 874342 - DNA, 25 bp, Mus musculus
agctcagggaatggactatttgcat

SEQ ID NO: 874343 - DNA, 25 bp, Mus musculus
agctcagggaatggtctatttgcat

SEQ ID NO: 874344 - DNA, 25 bp, Mus musculus
agctcagggcagcaaaccttctgga

SEQ ID NO: 874345 - DNA, 25 bp, Mus musculus
agctcagggcaggaaaccttctgga

SEQ ID NO: 874346 - DNA, 25 bp, Mus musculus
agctcagtatgaaacttacaggtct

SEQ ID NO: 874347 - DNA, 25 bp, Mus musculus
agctcagtatgaaagttacaggtct

SEQ ID NO: 874348 - DNA, 25 bp, Mus musculus
agctcagttcttcgtgaaagcagcc

SEQ ID NO: 874349 - DNA, 25 bp, Mus musculus
agctcagttcttggtgaaagcagcc

SEQ ID NO: 874350 - DNA, 25 bp, Mus musculus
agctcatatttaagcgaaaatctct

SEQ ID NO: 874351 - DNA, 25 bp, Mus musculus
agctcatatttaagggaaaatctct

SEQ ID NO: 874352 - DNA, 25 bp, Mus musculus
agctcatcaagtgacgaatctgagg

SEQ ID NO: 874353 - DNA, 25 bp, Mus musculus
agctcatcaagtgaggaatctgagg

SEQ ID NO: 874354 - DNA, 25 bp, Mus musculus
agctcatgagaacgtacacactgaa

SEQ ID NO: 874355 - DNA, 25 bp, Mus musculus
agctcatgagaaggtacacactgaa

SEQ ID NO: 874356 - DNA, 25 bp, Mus musculus
agctcatgcccaatcgtctgcgcgg

SEQ ID NO: 874357 - DNA, 25 bp, Mus musculus
agctcatgcccaatggtctgcgcgg

SEQ ID NO: 874358 - DNA, 25 bp, Mus musculus
agctcatgtcagcacgaaatgatgg

SEQ ID NO: 874359 - DNA, 25 bp, Mus musculus
agctcatgtcagcacgctggcgcat

SEQ ID NO: 874360 - DNA, 25 bp, Mus musculus
agctcatgtcagcaggaaatgatgg

SEQ ID NO: 874361 - DNA, 25 bp, Mus musculus
agctcatgtcagcaggctggcgcat

SEQ ID NO: 874362 - DNA, 25 bp, Mus musculus
agctcatttcagattgccctctgcc

SEQ ID NO: 874363 - DNA, 25 bp, Mus musculus
agctcatttcagtttgccctctgcc

SEQ ID NO: 874364 - DNA, 25 bp, Mus musculus
agctccaaccaccacttttggttca

SEQ ID NO: 874365 - DNA, 25 bp, Mus musculus
agctccaaccaccagttttggttca

SEQ ID NO: 874366 - DNA, 25 bp, Mus musculus
agctccaacgatctgaaagagttcc

SEQ ID NO: 874367 - DNA, 25 bp, Mus musculus
agctccaacgatgtgaaagagttcc

SEQ ID NO: 874368 - DNA, 25 bp, Mus musculus
agctccaaggctaacgtgatttacg

SEQ ID NO: 874369 - DNA, 25 bp, Mus musculus
agctccaaggctaaggtgatttacg

SEQ ID NO: 874370 - DNA, 25 bp, Mus musculus
agctccacagcggatctttccagca

SEQ ID NO: 874371 - DNA, 25 bp, Mus musculus
agctccacaggggatctttccagca

SEQ ID NO: 874372 - DNA, 25 bp, Mus musculus
agctccagcacacgatgcgggctcc

SEQ ID NO: 874373 - DNA, 25 bp, Mus musculus
agctccagcacacgctcggctgacc

SEQ ID NO: 874374 - DNA, 25 bp, Mus musculus
agctccagcacaggatgcgggctcc

SEQ ID NO: 874375 - DNA, 25 bp, Mus musculus
agctccagcacaggctcggctgacc

SEQ ID NO: 874376 - DNA, 25 bp, Mus musculus
agctccagctggctagccccagtgg

SEQ ID NO: 874377 - DNA, 25 bp, Mus musculus
agctccagctgggtagccccagtgg

SEQ ID NO: 874378 - DNA, 25 bp, Mus musculus
agctccaggcagcgtggagtgtcat

SEQ ID NO: 874379 - DNA, 25 bp, Mus musculus
agctccaggcagggtggagtgtcat

SEQ ID NO: 874380 - DNA, 25 bp, Mus musculus
agctccagtctgcacgtcctaggtg

SEQ ID NO: 874381 - DNA, 25 bp, Mus musculus
agctccagtctgcaggtcctaggtg

SEQ ID NO: 874382 - DNA, 25 bp, Mus musculus
agctccatccgccgtctgtcatccc

SEQ ID NO: 874383 - DNA, 25 bp, Mus musculus
agctccatccgcggtctgtcatccc

SEQ ID NO: 874384 - DNA, 25 bp, Mus musculus
agctccatggatggttcctggcaag

SEQ ID NO: 874385 - DNA, 25 bp, Mus musculus
agctccatggcgaagtcatcaggac

SEQ ID NO: 874386 - DNA, 25 bp, Mus musculus
agctccatggggaagtcatcaggac

SEQ ID NO: 874387 - DNA, 25 bp, Mus musculus
agctccatggttggttcctggcaag

SEQ ID NO: 874388 - DNA, 25 bp, Mus musculus
agctccatgtcccacacattcagta

SEQ ID NO: 874389 - DNA, 25 bp, Mus musculus
agctccatgtcccagacattcagta

SEQ ID NO: 874390 - DNA, 25 bp, Mus musculus
agctccatgtcgctagttgatcttg

SEQ ID NO: 874391 - DNA, 25 bp, Mus musculus
agctccatgtcgcttgatcttgaaa

SEQ ID NO: 874392 - DNA, 25 bp, Mus musculus
agctccatgtcggtagttgatcttg

SEQ ID NO: 874393 - DNA, 25 bp, Mus musculus
agctccatgtcggttgatcttgaaa

SEQ ID NO: 874394 - DNA, 25 bp, Mus musculus
agctcccaggccctcaatgaagaag

SEQ ID NO: 874395 - DNA, 25 bp, Mus musculus
agctcccaggccctgaatgaagaag

SEQ ID NO: 874396 - DNA, 25 bp, Mus musculus
agctccccgttacgccagcaggtgg

SEQ ID NO: 874397 - DNA, 25 bp, Mus musculus
agctccccgttaggccagcaggtgg

SEQ ID NO: 874398 - DNA, 25 bp, Mus musculus
agctccctagaacatggattcatgg

SEQ ID NO: 874399 - DNA, 25 bp, Mus musculus
agctccctagaacggcaacaacccg

SEQ ID NO: 874400 - DNA, 25 bp, Mus musculus
agctccctagaagatggattcatgg

SEQ ID NO: 874401 - DNA, 25 bp, Mus musculus
agctccctagaagggcaacaacccg

SEQ ID NO: 874402 - DNA, 25 bp, Mus musculus
agctccctgacacaggatggtttgt

SEQ ID NO: 874403 - DNA, 25 bp, Mus musculus
agctccctgacacctatattgtctt

SEQ ID NO: 874404 - DNA, 25 bp, Mus musculus
agctccctgacagaggatggtttgt

SEQ ID NO: 874405 - DNA, 25 bp, Mus musculus
agctccctgacagctatattgtctt

SEQ ID NO: 874406 - DNA, 25 bp, Mus musculus
agctccgagtgcttcctgccccagc

SEQ ID NO: 874407 - DNA, 25 bp, Mus musculus
agctccgagtgcttgctgccccagc

SEQ ID NO: 874408 - DNA, 25 bp, Mus musculus
agctcctcattgcaagcaatccgga

SEQ ID NO: 874409 - DNA, 25 bp, Mus musculus
agctcctcattggaagcaatccgga

SEQ ID NO: 874410 - DNA, 25 bp, Mus musculus
agctcctccgacctggtgacgtatg

SEQ ID NO: 874411 - DNA, 25 bp, Mus musculus
agctcctccgacgtggtgacgtatg

SEQ ID NO: 874412 - DNA, 25 bp, Mus musculus
agctcctcctcacgactgtgcctca

SEQ ID NO: 874413 - DNA, 25 bp, Mus musculus
agctcctcctcaggactgtgcctca

SEQ ID NO: 874414 - DNA, 25 bp, Mus musculus
agctcctctgatgttgccacccacc

SEQ ID NO: 874415 - DNA, 25 bp, Mus musculus
agctcctctgttgttgccacccacc

SEQ ID NO: 874416 - DNA, 25 bp, Mus musculus
agctcctgagataaccaggatgctg

SEQ ID NO: 874417 - DNA, 25 bp, Mus musculus
agctcctgagataacgatgctgcgg

SEQ ID NO: 874418 - DNA, 25 bp, Mus musculus
agctcctgagataagcaggatgctg

SEQ ID NO: 874419 - DNA, 25 bp, Mus musculus
agctcctgagataaggatgctgcgg

SEQ ID NO: 874420 - DNA, 25 bp, Mus musculus
agctcctggtctcacgtaatctcca

SEQ ID NO: 874421 - DNA, 25 bp, Mus musculus
agctcctggtctcaggtaatctcca

SEQ ID NO: 874422 - DNA, 25 bp, Mus musculus
agctcgacagatgccaaagtctgag

SEQ ID NO: 874423 - DNA, 25 bp, Mus musculus
agctcgacagctgcagggccctgtc

SEQ ID NO: 874424 - DNA, 25 bp, Mus musculus
agctcgacaggtgcagggccctgtc

SEQ ID NO: 874425 - DNA, 25 bp, Mus musculus
agctcgacagttgccaaagtctgag

SEQ ID NO: 874426 - DNA, 25 bp, Mus musculus
agctcgcagccgcgcaagctgagga

SEQ ID NO: 874427 - DNA, 25 bp, Mus musculus
agctcgcagccgggcaagctgagga

SEQ ID NO: 874428 - DNA, 25 bp, Mus musculus
agctcgccagcgcgaagattgtcga

SEQ ID NO: 874429 - DNA, 25 bp, Mus musculus
agctcgccagggcgaagattgtcga

SEQ ID NO: 874430 - DNA, 25 bp, Mus musculus
agctcgccaggtcggcgaagattgt

SEQ ID NO: 874431 - DNA, 25 bp, Mus musculus
agctcgccaggtgggcgaagattgt

SEQ ID NO: 874432 - DNA, 25 bp, Mus musculus
agctcggacccacccccaaaaggag

SEQ ID NO: 874433 - DNA, 25 bp, Mus musculus
agctcggacccagccccaaaaggag

SEQ ID NO: 874434 - DNA, 25 bp, Mus musculus
agctcggcagccatttcagggaaga

SEQ ID NO: 874435 - DNA, 25 bp, Mus musculus
agctcggcaggcatttcagggaaga

SEQ ID NO: 874436 - DNA, 25 bp, Mus musculus
agctcgggagctacagtggtcccac

SEQ ID NO: 874437 - DNA, 25 bp, Mus musculus
agctcgggagcttcccgtgagaacg

SEQ ID NO: 874438 - DNA, 25 bp, Mus musculus
agctcgggaggtacagtggtcccac

SEQ ID NO: 874439 - DNA, 25 bp, Mus musculus
agctcgggaggttcccgtgagaacg

SEQ ID NO: 874440 - DNA, 25 bp, Mus musculus
agctcgggtgcccacgatcgatccg

SEQ ID NO: 874441 - DNA, 25 bp, Mus musculus
agctcgggtgcccaggatcgatccg

SEQ ID NO: 874442 - DNA, 25 bp, Mus musculus
agctcggtccagcacttcaaagagg

SEQ ID NO: 874443 - DNA, 25 bp, Mus musculus
agctcggtccagcagttcaaagagg

SEQ ID NO: 874444 - DNA, 25 bp, Mus musculus
agctcgtcagaaaacgcgagtcttc

SEQ ID NO: 874445 - DNA, 25 bp, Mus musculus
agctcgtcagaaaaggcgagtcttc

SEQ ID NO: 874446 - DNA, 25 bp, Mus musculus
agctcgtcagaagacaagacgccag

SEQ ID NO: 874447 - DNA, 25 bp, Mus musculus
agctcgtcagaagacgagtccaaaa

SEQ ID NO: 874448 - DNA, 25 bp, Mus musculus
agctcgtcagaagagaagacgccag

SEQ ID NO: 874449 - DNA, 25 bp, Mus musculus
agctcgtcagaagaggagtccaaaa

SEQ ID NO: 874450 - DNA, 25 bp, Mus musculus
agctcgtgagatttttgatgaaatt

SEQ ID NO: 874451 - DNA, 25 bp, Mus musculus
agctcgtgagttttttgatgaaatt

SEQ ID NO: 874452 - DNA, 25 bp, Mus musculus
agctctactgcaaactttgctatgc

SEQ ID NO: 874453 - DNA, 25 bp, Mus musculus
agctctactgcaaagtttgctatgc

SEQ ID NO: 874454 - DNA, 25 bp, Mus musculus
agctctcagaagccaaatgtgccga

SEQ ID NO: 874455 - DNA, 25 bp, Mus musculus
agctctcagaagcccaagttcgaca

SEQ ID NO: 874456 - DNA, 25 bp, Mus musculus
agctctcagaaggcaaatgtgccga

SEQ ID NO: 874457 - DNA, 25 bp, Mus musculus
agctctcagaaggccaagttcgaca

SEQ ID NO: 874458 - DNA, 25 bp, Mus musculus
agctctcagcagctcagtcagctgt

SEQ ID NO: 874459 - DNA, 25 bp, Mus musculus
agctctcagcagctgagtcagctgt

SEQ ID NO: 874460 - DNA, 25 bp, Mus musculus
agctctcagctcaacggcaaatgac

SEQ ID NO: 874461 - DNA, 25 bp, Mus musculus
agctctcagctcaagggcaaatgac

SEQ ID NO: 874462 - DNA, 25 bp, Mus musculus
agctctccagccacagagtcatcca

SEQ ID NO: 874463 - DNA, 25 bp, Mus musculus
agctctccaggcacagagtcatcca

SEQ ID NO: 874464 - DNA, 25 bp, Mus musculus
agctctccgcagcacgatgagccgg

SEQ ID NO: 874465 - DNA, 25 bp, Mus musculus
agctctccgcagcactttacaatct

SEQ ID NO: 874466 - DNA, 25 bp, Mus musculus
agctctccgcagcaggatgagccgg

SEQ ID NO: 874467 - DNA, 25 bp, Mus musculus
agctctccgcagcagtttacaatct

SEQ ID NO: 874468 - DNA, 25 bp, Mus musculus
agctctctccccatgactgacttgg

SEQ ID NO: 874469 - DNA, 25 bp, Mus musculus
agctctctccccttgactgacttgg

SEQ ID NO: 874470 - DNA, 25 bp, Mus musculus
agctctctctgtaaactgaaggata

SEQ ID NO: 874471 - DNA, 25 bp, Mus musculus
agctctctctgtaatctgaaggata

SEQ ID NO: 874472 - DNA, 25 bp, Mus musculus
agctctctgacacgtgtccccagaa

SEQ ID NO: 874473 - DNA, 25 bp, Mus musculus
agctctctgacaggtgtccccagaa

SEQ ID NO: 874474 - DNA, 25 bp, Mus musculus
agctctgaagatagcagtggacctg

SEQ ID NO: 874475 - DNA, 25 bp, Mus musculus
agctctgaagttagcagtggacctg

SEQ ID NO: 874476 - DNA, 25 bp, Mus musculus
agctctgacagtgacgttggtgggg

SEQ ID NO: 874477 - DNA, 25 bp, Mus musculus
agctctgacagtgaggttggtgggg

SEQ ID NO: 874478 - DNA, 25 bp, Mus musculus
agctctgcagcacacgccatccatc

SEQ ID NO: 874479 - DNA, 25 bp, Mus musculus
agctctgcagcacaggccatccatc

SEQ ID NO: 874480 - DNA, 25 bp, Mus musculus
agctctgccaaccatatgggaagat

SEQ ID NO: 874481 - DNA, 25 bp, Mus musculus
agctctgccaacgatatgggaagat

SEQ ID NO: 874482 - DNA, 25 bp, Mus musculus
agctctgccaagcctgccctgaggg

SEQ ID NO: 874483 - DNA, 25 bp, Mus musculus
agctctgccaaggctgccctgaggg

SEQ ID NO: 874484 - DNA, 25 bp, Mus musculus
agctctgcccagactcgggggcaat

SEQ ID NO: 874485 - DNA, 25 bp, Mus musculus
agctctgcccagtctcgggggcaat

SEQ ID NO: 874486 - DNA, 25 bp, Mus musculus
agctctggaaagagattcaagggta

SEQ ID NO: 874487 - DNA, 25 bp, Mus musculus
agctctggaaagtgattcaagggta

SEQ ID NO: 874488 - DNA, 25 bp, Mus musculus
agctctggagcaccttggaagagtg

SEQ ID NO: 874489 - DNA, 25 bp, Mus musculus
agctctggagcttttgggcaacttc

SEQ ID NO: 874490 - DNA, 25 bp, Mus musculus
agctctggaggaccttggaagagtg

SEQ ID NO: 874491 - DNA, 25 bp, Mus musculus
agctctggaggttttgggcaacttc

SEQ ID NO: 874492 - DNA, 25 bp, Mus musculus
agctctggctgtacattggtatcaa

SEQ ID NO: 874493 - DNA, 25 bp, Mus musculus
agctctggctgtactttggtatcaa

SEQ ID NO: 874494 - DNA, 25 bp, Mus musculus
agctctggggaacccttggccacga

SEQ ID NO: 874495 - DNA, 25 bp, Mus musculus
agctctggggaacctgctgcccaga

SEQ ID NO: 874496 - DNA, 25 bp, Mus musculus
agctctggggaagccttggccacga

SEQ ID NO: 874497 - DNA, 25 bp, Mus musculus
agctctggggaagctgctgcccaga

SEQ ID NO: 874498 - DNA, 25 bp, Mus musculus
agctctggtcgacgaagatgggctc

SEQ ID NO: 874499 - DNA, 25 bp, Mus musculus
agctctggtcgaggaagatgggctc

SEQ ID NO: 874500 - DNA, 25 bp, Mus musculus
agctctgtgcagctatataatttgt

SEQ ID NO: 874501 - DNA, 25 bp, Mus musculus
agctctgtgcaggtatataatttgt

SEQ ID NO: 874502 - DNA, 25 bp, Mus musculus
agctcttagaattacacagttcatc

SEQ ID NO: 874503 - DNA, 25 bp, Mus musculus
agctcttagaattagacagttcatc

SEQ ID NO: 874504 - DNA, 25 bp, Mus musculus
agctcttcagcactgggcagctcag

SEQ ID NO: 874505 - DNA, 25 bp, Mus musculus
agctcttcagctctggggacactgt

SEQ ID NO: 874506 - DNA, 25 bp, Mus musculus
agctcttcaggactgggcagctcag

SEQ ID NO: 874507 - DNA, 25 bp, Mus musculus
agctcttcaggtctggggacactgt

SEQ ID NO: 874508 - DNA, 25 bp, Mus musculus
agctctttagaacgcttcagaaatg

SEQ ID NO: 874509 - DNA, 25 bp, Mus musculus
agctctttagaaggcttcagaaatg

SEQ ID NO: 874510 - DNA, 25 bp, Mus musculus
agctctttgaaacggctgctgaaaa

SEQ ID NO: 874511 - DNA, 25 bp, Mus musculus
agctctttgaaagggctgctgaaaa

SEQ ID NO: 874512 - DNA, 25 bp, Mus musculus
agctctttgtgtaggatgtttcgtc

SEQ ID NO: 874513 - DNA, 25 bp, Mus musculus
agctctttgtgttggatgtttcgtc

SEQ ID NO: 874514 - DNA, 25 bp, Mus musculus
agctgaaaaacaccgagcctgccgc

SEQ ID NO: 874515 - DNA, 25 bp, Mus musculus
agctgaaaaagaccgagcctgccgc

SEQ ID NO: 874516 - DNA, 25 bp, Mus musculus
agctgaaagcagcgcctgtgcaggt

SEQ ID NO: 874517 - DNA, 25 bp, Mus musculus
agctgaaagcagggcctgtgcaggt

SEQ ID NO: 874518 - DNA, 25 bp, Mus musculus
agctgaacaacaaggcagaagggaa

SEQ ID NO: 874519 - DNA, 25 bp, Mus musculus
agctgaacaagaaggcagaagggaa

SEQ ID NO: 874520 - DNA, 25 bp, Mus musculus
agctgaacttgaagaagcatctgat

SEQ ID NO: 874521 - DNA, 25 bp, Mus musculus
agctgaacttgatgaagcatctgat

SEQ ID NO: 874522 - DNA, 25 bp, Mus musculus
agctgaagaaaaaacatcctgtgac

SEQ ID NO: 874523 - DNA, 25 bp, Mus musculus
agctgaagaaaaaagatcctgtgac

SEQ ID NO: 874524 - DNA, 25 bp, Mus musculus
agctgaagaaaacgccttggcaatt

SEQ ID NO: 874525 - DNA, 25 bp, Mus musculus
agctgaagaaaaggccttggcaatt

SEQ ID NO: 874526 - DNA, 25 bp, Mus musculus
agctgaagcctgaacgtctccacca

SEQ ID NO: 874527 - DNA, 25 bp, Mus musculus
agctgaagcctgaaggtctccacca

SEQ ID NO: 874528 - DNA, 25 bp, Mus musculus
agctgaaggcagctgacactgtcat

SEQ ID NO: 874529 - DNA, 25 bp, Mus musculus
agctgaaggcaggtgacactgtcat

SEQ ID NO: 874530 - DNA, 25 bp, Mus musculus
agctgaaggctagacgcctgacagg

SEQ ID NO: 874531 - DNA, 25 bp, Mus musculus
agctgaaggctagaggcctgacagg

SEQ ID NO: 874532 - DNA, 25 bp, Mus musculus
agctgaaggctcccaacaccaagaa

SEQ ID NO: 874533 - DNA, 25 bp, Mus musculus
agctgaaggctcgcaacaccaagaa

SEQ ID NO: 874534 - DNA, 25 bp, Mus musculus
agctgaatgccaacaaactacaact

SEQ ID NO: 874535 - DNA, 25 bp, Mus musculus
agctgaatgccatcaaactacaact

SEQ ID NO: 874536 - DNA, 25 bp, Mus musculus
agctgaatgtttatcagaacactga

SEQ ID NO: 874537 - DNA, 25 bp, Mus musculus
agctgaatgtttatgagaacactga

SEQ ID NO: 874538 - DNA, 25 bp, Mus musculus
agctgaccaaagcggagaagctgca

SEQ ID NO: 874539 - DNA, 25 bp, Mus musculus
agctgaccaacttacagtccatcat

SEQ ID NO: 874540 - DNA, 25 bp, Mus musculus
agctgaccaagttacagtccatcat

SEQ ID NO: 874541 - DNA, 25 bp, Mus musculus
agctgaccaatgcggagaagctgca

SEQ ID NO: 874542 - DNA, 25 bp, Mus musculus
agctgacgatgacgctgactttgaa

SEQ ID NO: 874543 - DNA, 25 bp, Mus musculus
agctgacgatgaggctgactttgaa

SEQ ID NO: 874544 - DNA, 25 bp, Mus musculus
agctgactgataagtcttctatttt

SEQ ID NO: 874545 - DNA, 25 bp, Mus musculus
agctgactgatatgtcttctatttt

SEQ ID NO: 874546 - DNA, 25 bp, Mus musculus
agctgactgtgcacaaggcccccag

SEQ ID NO: 874547 - DNA, 25 bp, Mus musculus
agctgactgtgcactaggcccccag

SEQ ID NO: 874548 - DNA, 25 bp, Mus musculus
agctgacttcagcgatgttctatgt

SEQ ID NO: 874549 - DNA, 25 bp, Mus musculus
agctgacttcagggatgttctatgt

SEQ ID NO: 874550 - DNA, 25 bp, Mus musculus
agctgagagatctccgtgtgccacc

SEQ ID NO: 874551 - DNA, 25 bp, Mus musculus
agctgagagatctcggtgtgccacc

SEQ ID NO: 874552 - DNA, 25 bp, Mus musculus
agctgaggagcaaaccctgtgaact

SEQ ID NO: 874553 - DNA, 25 bp, Mus musculus
agctgaggagcaaagcctgtgaact

SEQ ID NO: 874554 - DNA, 25 bp, Mus musculus
agctgagggccacaaggattcccag

SEQ ID NO: 874555 - DNA, 25 bp, Mus musculus
agctgagggccagaaggattcccag

SEQ ID NO: 874556 - DNA, 25 bp, Mus musculus
agctgagtcacctgttgctcaaggg

SEQ ID NO: 874557 - DNA, 25 bp, Mus musculus
agctgagtcagctgttgctcaaggg

SEQ ID NO: 874558 - DNA, 25 bp, Mus musculus
agctgagtttacaatccaagagaaa

SEQ ID NO: 874559 - DNA, 25 bp, Mus musculus
agctgagtttacaattttctaatga

SEQ ID NO: 874560 - DNA, 25 bp, Mus musculus
agctgagtttactatccaagagaaa

SEQ ID NO: 874561 - DNA, 25 bp, Mus musculus
agctgagtttactattttctaatga

SEQ ID NO: 874562 - DNA, 25 bp, Mus musculus
agctgatcaacactggacctccata

SEQ ID NO: 874563 - DNA, 25 bp, Mus musculus
agctgatcaacagtggacctccata

SEQ ID NO: 874564 - DNA, 25 bp, Mus musculus
agctgatcctcataccgctattgtg

SEQ ID NO: 874565 - DNA, 25 bp, Mus musculus
agctgatcctgataccgctattgtg

SEQ ID NO: 874566 - DNA, 25 bp, Mus musculus
agctgatgaagtcgacctgacatca

SEQ ID NO: 874567 - DNA, 25 bp, Mus musculus
agctgatgaagtggacctgacatca

SEQ ID NO: 874568 - DNA, 25 bp, Mus musculus
agctgatgagacacatggccacaca

SEQ ID NO: 874569 - DNA, 25 bp, Mus musculus
agctgatgagcactgattctgcaac

SEQ ID NO: 874570 - DNA, 25 bp, Mus musculus
agctgatgagcagtgattctgcaac

SEQ ID NO: 874571 - DNA, 25 bp, Mus musculus
agctgatgagccatgaccccttgtt

SEQ ID NO: 874572 - DNA, 25 bp, Mus musculus
agctgatgaggcatgaccccttgtt

SEQ ID NO: 874573 - DNA, 25 bp, Mus musculus
agctgatgagtcacatggccacaca

SEQ ID NO: 874574 - DNA, 25 bp, Mus musculus
agctgcaaagcagggctgctggcct

SEQ ID NO: 874575 - DNA, 25 bp, Mus musculus
agctgcaaaggagggctgctggcct

SEQ ID NO: 874576 - DNA, 25 bp, Mus musculus
agctgcaaggcacgttggcgtgggt

SEQ ID NO: 874577 - DNA, 25 bp, Mus musculus
agctgcaaggcaggttggcgtgggt

SEQ ID NO: 874578 - DNA, 25 bp, Mus musculus
agctgcacaccacgattttgctaac

SEQ ID NO: 874579 - DNA, 25 bp, Mus musculus
agctgcacaccaggattttgctaac

SEQ ID NO: 874580 - DNA, 25 bp, Mus musculus
agctgcacagatcagagacaaattc

SEQ ID NO: 874581 - DNA, 25 bp, Mus musculus
agctgcacagatgagagacaaattc

SEQ ID NO: 874582 - DNA, 25 bp, Mus musculus
agctgcacttgaccaagcatcaaga

SEQ ID NO: 874583 - DNA, 25 bp, Mus musculus
agctgcacttgagcaagcatcaaga

SEQ ID NO: 874584 - DNA, 25 bp, Mus musculus
agctgcagagccattgactactgca

SEQ ID NO: 874585 - DNA, 25 bp, Mus musculus
agctgcagaggcattgactactgca

SEQ ID NO: 874586 - DNA, 25 bp, Mus musculus
agctgcagaggccacagctattaag

SEQ ID NO: 874587 - DNA, 25 bp, Mus musculus
agctgcagaggccagagctattaag

SEQ ID NO: 874588 - DNA, 25 bp, Mus musculus
agctgcagcatccacgtcacctact

SEQ ID NO: 874589 - DNA, 25 bp, Mus musculus
agctgcagcatccaggtcacctact

SEQ ID NO: 874590 - DNA, 25 bp, Mus musculus
agctgcagcctcagtccggatagct

SEQ ID NO: 874591 - DNA, 25 bp, Mus musculus
agctgcagcctctgtccggatagct

SEQ ID NO: 874592 - DNA, 25 bp, Mus musculus
agctgcagctcacggggtgatagct

SEQ ID NO: 874593 - DNA, 25 bp, Mus musculus
agctgcagctcagggggtgatagct

SEQ ID NO: 874594 - DNA, 25 bp, Mus musculus
agctgcagctgcacatcgaggagca

SEQ ID NO: 874595 - DNA, 25 bp, Mus musculus
agctgcagctgctcatcgaggagca

SEQ ID NO: 874596 - DNA, 25 bp, Mus musculus
agctgcaggccccgtcccgagatga

SEQ ID NO: 874597 - DNA, 25 bp, Mus musculus
agctgcaggcccggtcccgagatga

SEQ ID NO: 874598 - DNA, 25 bp, Mus musculus
agctgcaggtcaatctccccgtccg

SEQ ID NO: 874599 - DNA, 25 bp, Mus musculus
agctgcaggtcaatgtccccgtccg

SEQ ID NO: 874600 - DNA, 25 bp, Mus musculus
agctgcatgtgcaccctctctatag

SEQ ID NO: 874601 - DNA, 25 bp, Mus musculus
agctgcatgtgctccctctctatag

SEQ ID NO: 874602 - DNA, 25 bp, Mus musculus
agctgccaaacccaagctgacccca

SEQ ID NO: 874603 - DNA, 25 bp, Mus musculus
agctgccaaagccaagctgacccca

SEQ ID NO: 874604 - DNA, 25 bp, Mus musculus
agctgccagcagctagatcatgatc

SEQ ID NO: 874605 - DNA, 25 bp, Mus musculus
agctgccagcagctctccccctcct

SEQ ID NO: 874606 - DNA, 25 bp, Mus musculus
agctgccagcaggtagatcatgatc

SEQ ID NO: 874607 - DNA, 25 bp, Mus musculus
agctgccagcaggtctccccctcct

SEQ ID NO: 874608 - DNA, 25 bp, Mus musculus
agctgccaggatatcaatgaatgtg

SEQ ID NO: 874609 - DNA, 25 bp, Mus musculus
agctgccaggttatcaatgaatgtg

SEQ ID NO: 874610 - DNA, 25 bp, Mus musculus
agctgccatccacgcagcagcagca

SEQ ID NO: 874611 - DNA, 25 bp, Mus musculus
agctgccatccaggcagcagcagca

SEQ ID NO: 874612 - DNA, 25 bp, Mus musculus
agctgccatgacagatctggagaga

SEQ ID NO: 874613 - DNA, 25 bp, Mus musculus
agctgccatgactgatctggagaga

SEQ ID NO: 874614 - DNA, 25 bp, Mus musculus
agctgcccagaacgagtcgaaagcc

SEQ ID NO: 874615 - DNA, 25 bp, Mus musculus
agctgcccagaaggagtcgaaagcc

SEQ ID NO: 874616 - DNA, 25 bp, Mus musculus
agctgcccgttctacctactttgag

SEQ ID NO: 874617 - DNA, 25 bp, Mus musculus
agctgcccgttctagctactttgag

SEQ ID NO: 874618 - DNA, 25 bp, Mus musculus
agctgccgataactacgccctggag

SEQ ID NO: 874619 - DNA, 25 bp, Mus musculus
agctgccgataagtacgccctggag

SEQ ID NO: 874620 - DNA, 25 bp, Mus musculus
agctgccgcagcaaaagccacagga

SEQ ID NO: 874621 - DNA, 25 bp, Mus musculus
agctgccgcagcaccacaggaaagg

SEQ ID NO: 874622 - DNA, 25 bp, Mus musculus
agctgccgcagctaaagccacagga

SEQ ID NO: 874623 - DNA, 25 bp, Mus musculus
agctgccgcagctccacaggaaagg

SEQ ID NO: 874624 - DNA, 25 bp, Mus musculus
agctgccgtgcgttgaaaaatacag

SEQ ID NO: 874625 - DNA, 25 bp, Mus musculus
agctgccgtgggttgaaaaatacag

SEQ ID NO: 874626 - DNA, 25 bp, Mus musculus
agctgcctacggctatcataccagg

SEQ ID NO: 874627 - DNA, 25 bp, Mus musculus
agctgcctacgggtatcataccagg

SEQ ID NO: 874628 - DNA, 25 bp, Mus musculus
agctgcctagagcaagagggcactg

SEQ ID NO: 874629 - DNA, 25 bp, Mus musculus
agctgcctagtgcaagagggcactg

SEQ ID NO: 874630 - DNA, 25 bp, Mus musculus
agctgcctcacacaagtcgacactg

SEQ ID NO: 874631 - DNA, 25 bp, Mus musculus
agctgcctcacagaagtcgacactg

SEQ ID NO: 874632 - DNA, 25 bp, Mus musculus
agctgcgaagcctctgaggatgaaa

SEQ ID NO: 874633 - DNA, 25 bp, Mus musculus
agctgcgaaggctctgaggatgaaa

SEQ ID NO: 874634 - DNA, 25 bp, Mus musculus
agctgcgacagattcgttctaggtc

SEQ ID NO: 874635 - DNA, 25 bp, Mus musculus
agctgcgacagattggttctaggtc

SEQ ID NO: 874636 - DNA, 25 bp, Mus musculus
agctgcgaggccgcaatctgtcgct

SEQ ID NO: 874637 - DNA, 25 bp, Mus musculus
agctgcgaggccgctatctgtcgct

SEQ ID NO: 874638 - DNA, 25 bp, Mus musculus
agctgcgatgagcttaaaagatgat

SEQ ID NO: 874639 - DNA, 25 bp, Mus musculus
agctgcgatgaggttaaaagatgat

SEQ ID NO: 874640 - DNA, 25 bp, Mus musculus
agctgcgcaaggctgagcacctcag

SEQ ID NO: 874641 - DNA, 25 bp, Mus musculus
agctgcgcaagggtgagcacctcag

SEQ ID NO: 874642 - DNA, 25 bp, Mus musculus
agctgcgcagacaactttactggaa

SEQ ID NO: 874643 - DNA, 25 bp, Mus musculus
agctgcgcagactactttactggaa

SEQ ID NO: 874644 - DNA, 25 bp, Mus musculus
agctgcgctgacagaggatgacatt

SEQ ID NO: 874645 - DNA, 25 bp, Mus musculus
agctgcgctgactgaggatgacatt

SEQ ID NO: 874646 - DNA, 25 bp, Mus musculus
agctgcggggatcgaagctgtgcct

SEQ ID NO: 874647 - DNA, 25 bp, Mus musculus
agctgcggggatggaagctgtgcct

SEQ ID NO: 874648 - DNA, 25 bp, Mus musculus
agctgctaagaacagaaaaattgcc

SEQ ID NO: 874649 - DNA, 25 bp, Mus musculus
agctgctaagaagagaaaaattgcc

SEQ ID NO: 874650 - DNA, 25 bp, Mus musculus
agctgctacaacagtccctccaatg

SEQ ID NO: 874651 - DNA, 25 bp, Mus musculus
agctgctacaactgtccctccaatg

SEQ ID NO: 874652 - DNA, 25 bp, Mus musculus
agctgctagacacgaagatccatgt

SEQ ID NO: 874653 - DNA, 25 bp, Mus musculus
agctgctagacaggaagatccatgt

SEQ ID NO: 874654 - DNA, 25 bp, Mus musculus
agctgctagaccactgggaaaacac

SEQ ID NO: 874655 - DNA, 25 bp, Mus musculus
agctgctagagcactgggaaaacac

SEQ ID NO: 874656 - DNA, 25 bp, Mus musculus
agctgctagagcatcgcccacccct

SEQ ID NO: 874657 - DNA, 25 bp, Mus musculus
agctgctagagcatggcccacccct

SEQ ID NO: 874658 - DNA, 25 bp, Mus musculus
agctgctcagcagccgggctgggtc

SEQ ID NO: 874659 - DNA, 25 bp, Mus musculus
agctgctcaggagccgggctgggtc

SEQ ID NO: 874660 - DNA, 25 bp, Mus musculus
agctgctctgacaggagtcttttca

SEQ ID NO: 874661 - DNA, 25 bp, Mus musculus
agctgctctgactggagtcttttca

SEQ ID NO: 874662 - DNA, 25 bp, Mus musculus
agctgctgagcacgttcaattttat

SEQ ID NO: 874663 - DNA, 25 bp, Mus musculus
agctgctgagcaggttcaattttat

SEQ ID NO: 874664 - DNA, 25 bp, Mus musculus
agctgctgcggagacattttgagtc

SEQ ID NO: 874665 - DNA, 25 bp, Mus musculus
agctgctgcggagagattttgagtc

SEQ ID NO: 874666 - DNA, 25 bp, Mus musculus
agctgctgctcgcagagcgggacta

SEQ ID NO: 874667 - DNA, 25 bp, Mus musculus
agctgctgctcggagagcgggacta

SEQ ID NO: 874668 - DNA, 25 bp, Mus musculus
agctgctggacagacgagccaaccc

SEQ ID NO: 874669 - DNA, 25 bp, Mus musculus
agctgctggacagaggagccaaccc

SEQ ID NO: 874670 - DNA, 25 bp, Mus musculus
agctgctggactttcgttcagaaaa

SEQ ID NO: 874671 - DNA, 25 bp, Mus musculus
agctgctggactttggttcagaaaa

SEQ ID NO: 874672 - DNA, 25 bp, Mus musculus
agctgctggtgaacaatgtgtctga

SEQ ID NO: 874673 - DNA, 25 bp, Mus musculus
agctgctggtgaactatgtgtctga

SEQ ID NO: 874674 - DNA, 25 bp, Mus musculus
agctgctgttgctccgtgcgggcga

SEQ ID NO: 874675 - DNA, 25 bp, Mus musculus
agctgctgttgctcggtgcgggcga

SEQ ID NO: 874676 - DNA, 25 bp, Mus musculus
agctgcttaactaccaccctcgggt

SEQ ID NO: 874677 - DNA, 25 bp, Mus musculus
agctgcttaagtaccaccctcgggt

SEQ ID NO: 874678 - DNA, 25 bp, Mus musculus
agctgcttagagagttttgtcaaga

SEQ ID NO: 874679 - DNA, 25 bp, Mus musculus
agctgcttagagtgttttgtcaaga

SEQ ID NO: 874680 - DNA, 25 bp, Mus musculus
agctgcttccaattagccaataata

SEQ ID NO: 874681 - DNA, 25 bp, Mus musculus
agctgcttccaatttgccaataata

SEQ ID NO: 874682 - DNA, 25 bp, Mus musculus
agctgctttccccgctagccactct

SEQ ID NO: 874683 - DNA, 25 bp, Mus musculus
agctgctttcccggctagccactct

SEQ ID NO: 874684 - DNA, 25 bp, Mus musculus
agctggaaggagcaagatgggctcc

SEQ ID NO: 874685 - DNA, 25 bp, Mus musculus
agctggaaggaggaagatgggctcc

SEQ ID NO: 874686 - DNA, 25 bp, Mus musculus
agctggaagtggagctttttgcaag

SEQ ID NO: 874687 - DNA, 25 bp, Mus musculus
agctggaagtggaggtttttgcaag

SEQ ID NO: 874688 - DNA, 25 bp, Mus musculus
agctggaatcggaacgcaggagagt

SEQ ID NO: 874689 - DNA, 25 bp, Mus musculus
agctggaatcggaaggcaggagagt

SEQ ID NO: 874690 - DNA, 25 bp, Mus musculus
agctggacagcttaccagaagtgcc

SEQ ID NO: 874691 - DNA, 25 bp, Mus musculus
agctggacaggttaccagaagtgcc

SEQ ID NO: 874692 - DNA, 25 bp, Mus musculus
agctggacctagcacgcttacagtt

SEQ ID NO: 874693 - DNA, 25 bp, Mus musculus
agctggacctagcaggcttacagtt

SEQ ID NO: 874694 - DNA, 25 bp, Mus musculus
agctggagagaaaaatatcaggatt

SEQ ID NO: 874695 - DNA, 25 bp, Mus musculus
agctggagagacctgtgatcctgaa

SEQ ID NO: 874696 - DNA, 25 bp, Mus musculus
agctggagagcaaagccatagagga

SEQ ID NO: 874697 - DNA, 25 bp, Mus musculus
agctggagagcctgccttggggatt

SEQ ID NO: 874698 - DNA, 25 bp, Mus musculus
agctggagaggaaagccatagagga

SEQ ID NO: 874699 - DNA, 25 bp, Mus musculus
agctggagaggctgccttggggatt

SEQ ID NO: 874700 - DNA, 25 bp, Mus musculus
agctggagagtaaaatatcaggatt

SEQ ID NO: 874701 - DNA, 25 bp, Mus musculus
agctggagagtcctgtgatcctgaa

SEQ ID NO: 874702 - DNA, 25 bp, Mus musculus
agctggagatcaccattcttagatt

SEQ ID NO: 874703 - DNA, 25 bp, Mus musculus
agctggagatcagcattcttagatt

SEQ ID NO: 874704 - DNA, 25 bp, Mus musculus
agctggagccacaaactcctgcttc

SEQ ID NO: 874705 - DNA, 25 bp, Mus musculus
agctggagccacaaattgcggttgc

SEQ ID NO: 874706 - DNA, 25 bp, Mus musculus
agctggagccacaatctcctgcttc

SEQ ID NO: 874707 - DNA, 25 bp, Mus musculus
agctggagccacaatttgcggttgc

SEQ ID NO: 874708 - DNA, 25 bp, Mus musculus
agctggagccccgaccaggacaggt

SEQ ID NO: 874709 - DNA, 25 bp, Mus musculus
agctggagccccgaccccttccagc

SEQ ID NO: 874710 - DNA, 25 bp, Mus musculus
agctggagccccgacctcctctaat

SEQ ID NO: 874711 - DNA, 25 bp, Mus musculus
agctggagccccgacgacaggtgag

SEQ ID NO: 874712 - DNA, 25 bp, Mus musculus
agctggagccccgagcaggacaggt

SEQ ID NO: 874713 - DNA, 25 bp, Mus musculus
agctggagccccgagcccttccagc

SEQ ID NO: 874714 - DNA, 25 bp, Mus musculus
agctggagccccgagctcctctaat

SEQ ID NO: 874715 - DNA, 25 bp, Mus musculus
agctggagccccgaggacaggtgag

SEQ ID NO: 874716 - DNA, 25 bp, Mus musculus
agctggaggacaaacgtcaagcagg

SEQ ID NO: 874717 - DNA, 25 bp, Mus musculus
agctggaggacaaaggtcaagcagg

SEQ ID NO: 874718 - DNA, 25 bp, Mus musculus
agctggcaagctacggactcgagac

SEQ ID NO: 874719 - DNA, 25 bp, Mus musculus
agctggcaagcttatgaaaactaca

SEQ ID NO: 874720 - DNA, 25 bp, Mus musculus
agctggcaagcttcgaacctcagat

SEQ ID NO: 874721 - DNA, 25 bp, Mus musculus
agctggcaaggtacggactcgagac

SEQ ID NO: 874722 - DNA, 25 bp, Mus musculus
agctggcaaggttatgaaaactaca

SEQ ID NO: 874723 - DNA, 25 bp, Mus musculus
agctggcaaggttcgaacctcagat

SEQ ID NO: 874724 - DNA, 25 bp, Mus musculus
agctggcaccagctgaggatggttc

SEQ ID NO: 874725 - DNA, 25 bp, Mus musculus
agctggcaccaggtgaggatggttc

SEQ ID NO: 874726 - DNA, 25 bp, Mus musculus
agctggcactcacggagcatggcac

SEQ ID NO: 874727 - DNA, 25 bp, Mus musculus
agctggcactcagggagcatggcac

SEQ ID NO: 874728 - DNA, 25 bp, Mus musculus
agctggcagagtcccgttgccgaga

SEQ ID NO: 874729 - DNA, 25 bp, Mus musculus
agctggcagagtctaagtgttctga

SEQ ID NO: 874730 - DNA, 25 bp, Mus musculus
agctggcagagtgccgttgccgaga

SEQ ID NO: 874731 - DNA, 25 bp, Mus musculus
agctggcagagtgtaagtgttctga

SEQ ID NO: 874732 - DNA, 25 bp, Mus musculus
agctggcagatttccgtctggcaag

SEQ ID NO: 874733 - DNA, 25 bp, Mus musculus
agctggcagatttcggtctggcaag

SEQ ID NO: 874734 - DNA, 25 bp, Mus musculus
agctggcagccaaccgaatctatga

SEQ ID NO: 874735 - DNA, 25 bp, Mus musculus
agctggcagccatccgaatctatga

SEQ ID NO: 874736 - DNA, 25 bp, Mus musculus
agctggccagcactgccgcttcgct

SEQ ID NO: 874737 - DNA, 25 bp, Mus musculus
agctggccaggactgccgcttcgct

SEQ ID NO: 874738 - DNA, 25 bp, Mus musculus
agctggccatagcctggtgcctgag

SEQ ID NO: 874739 - DNA, 25 bp, Mus musculus
agctggccataggctggtgcctgag

SEQ ID NO: 874740 - DNA, 25 bp, Mus musculus
agctggccctggatcttttctcaga

SEQ ID NO: 874741 - DNA, 25 bp, Mus musculus
agctggccctggttcttttctcaga

SEQ ID NO: 874742 - DNA, 25 bp, Mus musculus
agctggctcggaatcgtgatatcga

SEQ ID NO: 874743 - DNA, 25 bp, Mus musculus
agctggctcggaatggtgatatcga

SEQ ID NO: 874744 - DNA, 25 bp, Mus musculus
agctggctggagctggcatgaactg

SEQ ID NO: 874745 - DNA, 25 bp, Mus musculus
agctggctggctttgactctgctga

SEQ ID NO: 874746 - DNA, 25 bp, Mus musculus
agctggctgggtttgactctgctga

SEQ ID NO: 874747 - DNA, 25 bp, Mus musculus
agctggctggtgctggcatgaactg

SEQ ID NO: 874748 - DNA, 25 bp, Mus musculus
agctgggacctacctgaactacctg

SEQ ID NO: 874749 - DNA, 25 bp, Mus musculus
agctgggacctacgtatcacaaggc

SEQ ID NO: 874750 - DNA, 25 bp, Mus musculus
agctgggacctagctgaactacctg

SEQ ID NO: 874751 - DNA, 25 bp, Mus musculus
agctgggacctaggtatcacaaggc

SEQ ID NO: 874752 - DNA, 25 bp, Mus musculus
agctgggagtgatccgcctgtggtc

SEQ ID NO: 874753 - DNA, 25 bp, Mus musculus
agctgggagtgatcggcctgtggtc

SEQ ID NO: 874754 - DNA, 25 bp, Mus musculus
agctgggagttgcccaagaaggaag

SEQ ID NO: 874755 - DNA, 25 bp, Mus musculus
agctgggagttggccaagaaggaag

SEQ ID NO: 874756 - DNA, 25 bp, Mus musculus
agctgggccaatcaaaaccaactct

SEQ ID NO: 874757 - DNA, 25 bp, Mus musculus
agctgggccaatgaaaaccaactct

SEQ ID NO: 874758 - DNA, 25 bp, Mus musculus
agctggggacttggcgacggctgtt

SEQ ID NO: 874759 - DNA, 25 bp, Mus musculus
agctggggacttggggacggctgtt

SEQ ID NO: 874760 - DNA, 25 bp, Mus musculus
agctggggccttcgtgttgggagcc

SEQ ID NO: 874761 - DNA, 25 bp, Mus musculus
agctggggccttggtgttgggagcc

SEQ ID NO: 874762 - DNA, 25 bp, Mus musculus
agctgggtctcgcaactgcctacat

SEQ ID NO: 874763 - DNA, 25 bp, Mus musculus
agctgggtctcggaactgcctacat

SEQ ID NO: 874764 - DNA, 25 bp, Mus musculus
agctgggttcggacccagcaatgtc

SEQ ID NO: 874765 - DNA, 25 bp, Mus musculus
agctgggttcggtcccagcaatgtc

SEQ ID NO: 874766 - DNA, 25 bp, Mus musculus
agctggtacagtatgctgtgtccca

SEQ ID NO: 874767 - DNA, 25 bp, Mus musculus
agctggtacagtttgctgtgtccca

SEQ ID NO: 874768 - DNA, 25 bp, Mus musculus
agctggtccgagcgctactgacagt

SEQ ID NO: 874769 - DNA, 25 bp, Mus musculus
agctggtccgagggctactgacagt

SEQ ID NO: 874770 - DNA, 25 bp, Mus musculus
agctggtgaaggaacgcaagatctc

SEQ ID NO: 874771 - DNA, 25 bp, Mus musculus
agctggtgaaggaaggcaagatctc

SEQ ID NO: 874772 - DNA, 25 bp, Mus musculus
agctggtgagaacaacagcagtggt

SEQ ID NO: 874773 - DNA, 25 bp, Mus musculus
agctggtgagaagaacagcagtggt

SEQ ID NO: 874774 - DNA, 25 bp, Mus musculus
agctggtgccagccccagattagat

SEQ ID NO: 874775 - DNA, 25 bp, Mus musculus
agctggtgccaggcccagattagat

SEQ ID NO: 874776 - DNA, 25 bp, Mus musculus
agctggtggtgacacgaatctatga

SEQ ID NO: 874777 - DNA, 25 bp, Mus musculus
agctggtggtgacaggaatctatga

SEQ ID NO: 874778 - DNA, 25 bp, Mus musculus
agctggtgtggactttgaagaaaaa

SEQ ID NO: 874779 - DNA, 25 bp, Mus musculus
agctggtgtggagtttgaagaaaaa

SEQ ID NO: 874780 - DNA, 25 bp, Mus musculus
agctgtaatgctgcgtctaatgctg

SEQ ID NO: 874781 - DNA, 25 bp, Mus musculus
agctgtaatggtgcgtctaatgctg

SEQ ID NO: 874782 - DNA, 25 bp, Mus musculus
agctgtacagcttgggcttaggtca

SEQ ID NO: 874783 - DNA, 25 bp, Mus musculus
agctgtacaggttgggcttaggtca

SEQ ID NO: 874784 - DNA, 25 bp, Mus musculus
agctgtagcctgaacctcaaggcct

SEQ ID NO: 874785 - DNA, 25 bp, Mus musculus
agctgtagcctgtacctcaaggcct

SEQ ID NO: 874786 - DNA, 25 bp, Mus musculus
agctgtcatcaacgtaaccccaagg

SEQ ID NO: 874787 - DNA, 25 bp, Mus musculus
agctgtcatcaaggtaaccccaagg

SEQ ID NO: 874788 - DNA, 25 bp, Mus musculus
agctgtcattatcatctttgagatg

SEQ ID NO: 874789 - DNA, 25 bp, Mus musculus
agctgtcattatgatctttgagatg

SEQ ID NO: 874790 - DNA, 25 bp, Mus musculus
agctgtcgggacagggacttctgca

SEQ ID NO: 874791 - DNA, 25 bp, Mus musculus
agctgtcgggtcagggacttctgca

SEQ ID NO: 874792 - DNA, 25 bp, Mus musculus
agctgtctacgacaccctgaagaat

SEQ ID NO: 874793 - DNA, 25 bp, Mus musculus
agctgtctacgagaccctgaagaat

SEQ ID NO: 874794 - DNA, 25 bp, Mus musculus
agctgtctagaccccatggacacct

SEQ ID NO: 874795 - DNA, 25 bp, Mus musculus
agctgtctagtccccatggacacct

SEQ ID NO: 874796 - DNA, 25 bp, Mus musculus
agctgtctgagtctcaagaagacaa

SEQ ID NO: 874797 - DNA, 25 bp, Mus musculus
agctgtctgagtctgaagaagacaa

SEQ ID NO: 874798 - DNA, 25 bp, Mus musculus
agctgtcttgcacgtggaatgccat

SEQ ID NO: 874799 - DNA, 25 bp, Mus musculus
agctgtcttgcaggtggaatgccat

SEQ ID NO: 874800 - DNA, 25 bp, Mus musculus
agctgtgaaaagcgtcaagcagtgt

SEQ ID NO: 874801 - DNA, 25 bp, Mus musculus
agctgtgaaaagggtcaagcagtgt

SEQ ID NO: 874802 - DNA, 25 bp, Mus musculus
agctgtgaagacatcaacgagtgtt

SEQ ID NO: 874803 - DNA, 25 bp, Mus musculus
agctgtgaagtcatcaacgagtgtt

SEQ ID NO: 874804 - DNA, 25 bp, Mus musculus
agctgtgacccgtgccgggagggcc

SEQ ID NO: 874805 - DNA, 25 bp, Mus musculus
agctgtgaccggtgccgggagggcc

SEQ ID NO: 874806 - DNA, 25 bp, Mus musculus
agctgtgacgagcgcaatgctgctg

SEQ ID NO: 874807 - DNA, 25 bp, Mus musculus
agctgtgacgagggcaatgctgctg

SEQ ID NO: 874808 - DNA, 25 bp, Mus musculus
agctgtgagacacacattgacgagt

SEQ ID NO: 874809 - DNA, 25 bp, Mus musculus
agctgtgagacacactcttcctgag

SEQ ID NO: 874810 - DNA, 25 bp, Mus musculus
agctgtgagacagacattgacgagt

SEQ ID NO: 874811 - DNA, 25 bp, Mus musculus
agctgtgagacagactcttcctgag

SEQ ID NO: 874812 - DNA, 25 bp, Mus musculus
agctgtgcaccgacacgttctcaat

SEQ ID NO: 874813 - DNA, 25 bp, Mus musculus
agctgtgcaccgtcacgttctcaat

SEQ ID NO: 874814 - DNA, 25 bp, Mus musculus
agctgtgcatcggacgtcaccttcg

SEQ ID NO: 874815 - DNA, 25 bp, Mus musculus
agctgtgcatcggaggtcaccttcg

SEQ ID NO: 874816 - DNA, 25 bp, Mus musculus
agctgtgctgaaccgcatcctggag

SEQ ID NO: 874817 - DNA, 25 bp, Mus musculus
agctgtgctgaagcgcatcctggag

SEQ ID NO: 874818 - DNA, 25 bp, Mus musculus
agctgtggcacacatcactcaactg

SEQ ID NO: 874819 - DNA, 25 bp, Mus musculus
agctgtggcacagatcactcaactg

SEQ ID NO: 874820 - DNA, 25 bp, Mus musculus
agctgtgggaagagcagcaagctgc

SEQ ID NO: 874821 - DNA, 25 bp, Mus musculus
agctgtgggaagtgcagcaagctgc

SEQ ID NO: 874822 - DNA, 25 bp, Mus musculus
agctgtggtggccacgggctggatg

SEQ ID NO: 874823 - DNA, 25 bp, Mus musculus
agctgtggtggccaggggctggatg

SEQ ID NO: 874824 - DNA, 25 bp, Mus musculus
agctgtgtagatgtcaatgagtgtc

SEQ ID NO: 874825 - DNA, 25 bp, Mus musculus
agctgtgtagttgtcaatgagtgtc

SEQ ID NO: 874826 - DNA, 25 bp, Mus musculus
agctgtgtcaagagagaaaggcact

SEQ ID NO: 874827 - DNA, 25 bp, Mus musculus
agctgtgtcaagtgagaaaggcact

SEQ ID NO: 874828 - DNA, 25 bp, Mus musculus
agctgttcagagttgaagaggacct

SEQ ID NO: 874829 - DNA, 25 bp, Mus musculus
agctgttcagctgtcccactccagg

SEQ ID NO: 874830 - DNA, 25 bp, Mus musculus
agctgttcaggtgtcccactccagg

SEQ ID NO: 874831 - DNA, 25 bp, Mus musculus
agctgttcagtgttgaagaggacct

SEQ ID NO: 874832 - DNA, 25 bp, Mus musculus
agctgttctgtaagcttcctgcggg

SEQ ID NO: 874833 - DNA, 25 bp, Mus musculus
agctgttctgtatgcttcctgcggg

SEQ ID NO: 874834 - DNA, 25 bp, Mus musculus
agctgttgcgacaaggtcaaggaga

SEQ ID NO: 874835 - DNA, 25 bp, Mus musculus
agctgttgcgactaggtcaaggaga

SEQ ID NO: 874836 - DNA, 25 bp, Mus musculus
agctgttggtgctacgaccccctgt

SEQ ID NO: 874837 - DNA, 25 bp, Mus musculus
agctgttggtgctaggaccccctgt

SEQ ID NO: 874838 - DNA, 25 bp, Mus musculus
agctgtttgctgtgcgaatcaagaa

SEQ ID NO: 874839 - DNA, 25 bp, Mus musculus
agctgtttgctgtgggaatcaagaa

SEQ ID NO: 874840 - DNA, 25 bp, Mus musculus
agcttaaacctgcgaggactcacaa

SEQ ID NO: 874841 - DNA, 25 bp, Mus musculus
agcttaaacctgggaggactcacaa

SEQ ID NO: 874842 - DNA, 25 bp, Mus musculus
agcttaaacttccacatttgaagag

SEQ ID NO: 874843 - DNA, 25 bp, Mus musculus
agcttaaacttccagatttgaagag

SEQ ID NO: 874844 - DNA, 25 bp, Mus musculus
agcttaaagcagcgagaattaccaa

SEQ ID NO: 874845 - DNA, 25 bp, Mus musculus
agcttaaagcagggagaattaccaa

SEQ ID NO: 874846 - DNA, 25 bp, Mus musculus
agcttacagacgcgctgactcctca

SEQ ID NO: 874847 - DNA, 25 bp, Mus musculus
agcttacagacgcgctttgctgttg

SEQ ID NO: 874848 - DNA, 25 bp, Mus musculus
agcttacagacgggctgactcctca

SEQ ID NO: 874849 - DNA, 25 bp, Mus musculus
agcttacagacgggctttgctgttg

SEQ ID NO: 874850 - DNA, 25 bp, Mus musculus
agcttacgaacggacacacagttcg

SEQ ID NO: 874851 - DNA, 25 bp, Mus musculus
agcttacgaacggagacacagttcg

SEQ ID NO: 874852 - DNA, 25 bp, Mus musculus
agcttagcgagcagcgcgtaagaac

SEQ ID NO: 874853 - DNA, 25 bp, Mus musculus
agcttagcgagcagggcgtaagaac

SEQ ID NO: 874854 - DNA, 25 bp, Mus musculus
agcttatgagcattgaggaggctct

SEQ ID NO: 874855 - DNA, 25 bp, Mus musculus
agcttatgaggattgaggaggctct

SEQ ID NO: 874856 - DNA, 25 bp, Mus musculus
agcttattgtcacgtctgtgagaac

SEQ ID NO: 874857 - DNA, 25 bp, Mus musculus
agcttattgtcaggtctgtgagaac

SEQ ID NO: 874858 - DNA, 25 bp, Mus musculus
agcttatttgctatgctaacagaac

SEQ ID NO: 874859 - DNA, 25 bp, Mus musculus
agcttatttggtatgctaacagaac

SEQ ID NO: 874860 - DNA, 25 bp, Mus musculus
agcttcaactagcgaaaagccttga

SEQ ID NO: 874861 - DNA, 25 bp, Mus musculus
agcttcaactagggaaaagccttga

SEQ ID NO: 874862 - DNA, 25 bp, Mus musculus
agcttcaagagaaacccttgtttgc

SEQ ID NO: 874863 - DNA, 25 bp, Mus musculus
agcttcaagagaaacgttcaatttt

SEQ ID NO: 874864 - DNA, 25 bp, Mus musculus
agcttcaagagaaagccttgtttgc

SEQ ID NO: 874865 - DNA, 25 bp, Mus musculus
agcttcaagagaaaggttcaatttt

SEQ ID NO: 874866 - DNA, 25 bp, Mus musculus
agcttcaatcagctccatcagctga

SEQ ID NO: 874867 - DNA, 25 bp, Mus musculus
agcttcaatcaggtccatcagctga

SEQ ID NO: 874868 - DNA, 25 bp, Mus musculus
agcttcacagcgtgcctggtccaca

SEQ ID NO: 874869 - DNA, 25 bp, Mus musculus
agcttcacagggtgcctggtccaca

SEQ ID NO: 874870 - DNA, 25 bp, Mus musculus
agcttcaccatcaacgatgtttatg

SEQ ID NO: 874871 - DNA, 25 bp, Mus musculus
agcttcaccatcaaggatgtttatg

SEQ ID NO: 874872 - DNA, 25 bp, Mus musculus
agcttcagagagagtttaattcctt

SEQ ID NO: 874873 - DNA, 25 bp, Mus musculus
agcttcagagagatggtgtcttgtc

SEQ ID NO: 874874 - DNA, 25 bp, Mus musculus
agcttcagagagctgccaggccgca

SEQ ID NO: 874875 - DNA, 25 bp, Mus musculus
agcttcagagaggtgccaggccgca

SEQ ID NO: 874876 - DNA, 25 bp, Mus musculus
agcttcagagagtgtttaattcctt

SEQ ID NO: 874877 - DNA, 25 bp, Mus musculus
agcttcagagagttggtgtcttgtc

SEQ ID NO: 874878 - DNA, 25 bp, Mus musculus
agcttcaggtcttcaaagccccaga

SEQ ID NO: 874879 - DNA, 25 bp, Mus musculus
agcttcaggtcttctaagccccaga

SEQ ID NO: 874880 - DNA, 25 bp, Mus musculus
agcttcatcaacaacgtgacaagag

SEQ ID NO: 874881 - DNA, 25 bp, Mus musculus
agcttcatcaacaaggtgacaagag

SEQ ID NO: 874882 - DNA, 25 bp, Mus musculus
agcttccaagaaccccaagatccac

SEQ ID NO: 874883 - DNA, 25 bp, Mus musculus
agcttccaagtaccccaagatccac

SEQ ID NO: 874884 - DNA, 25 bp, Mus musculus
agcttccaatacaaccacaggggag

SEQ ID NO: 874885 - DNA, 25 bp, Mus musculus
agcttccaatacaagcacaggggag

SEQ ID NO: 874886 - DNA, 25 bp, Mus musculus
agcttccacgagcaggaaagaagaa

SEQ ID NO: 874887 - DNA, 25 bp, Mus musculus
agcttccacgaggaggaaagaagaa

SEQ ID NO: 874888 - DNA, 25 bp, Mus musculus
agcttccaggcaagctcagggtatg

SEQ ID NO: 874889 - DNA, 25 bp, Mus musculus
agcttccaggcatgctcagggtatg

SEQ ID NO: 874890 - DNA, 25 bp, Mus musculus
agcttcccagacatttcagcctgtt

SEQ ID NO: 874891 - DNA, 25 bp, Mus musculus
agcttcccagcagatgtacgactaa

SEQ ID NO: 874892 - DNA, 25 bp, Mus musculus
agcttcccagctctctttgagcccg

SEQ ID NO: 874893 - DNA, 25 bp, Mus musculus
agcttcccaggagatgtacgactaa

SEQ ID NO: 874894 - DNA, 25 bp, Mus musculus
agcttcccaggtctctttgagcccg

SEQ ID NO: 874895 - DNA, 25 bp, Mus musculus
agcttcccagtcatttcagcctgtt

SEQ ID NO: 874896 - DNA, 25 bp, Mus musculus
agcttcccgctcctcgtagagcaat

SEQ ID NO: 874897 - DNA, 25 bp, Mus musculus
agcttcccgctcctggtagagcaat

SEQ ID NO: 874898 - DNA, 25 bp, Mus musculus
agcttcccggaggagatggccacct

SEQ ID NO: 874899 - DNA, 25 bp, Mus musculus
agcttcccggtggagatggccacct

SEQ ID NO: 874900 - DNA, 25 bp, Mus musculus
agcttccgggagatcctgctcattt

SEQ ID NO: 874901 - DNA, 25 bp, Mus musculus
agcttccgggagttcctgctcattt

SEQ ID NO: 874902 - DNA, 25 bp, Mus musculus
agcttcctcaagcctaacttaggag

SEQ ID NO: 874903 - DNA, 25 bp, Mus musculus
agcttcctcaaggctaacttaggag

SEQ ID NO: 874904 - DNA, 25 bp, Mus musculus
agcttcctgagtcgtatccttggca

SEQ ID NO: 874905 - DNA, 25 bp, Mus musculus
agcttcctgagtggtatccttggca

SEQ ID NO: 874906 - DNA, 25 bp, Mus musculus
agcttccttgaacacacccacagga

SEQ ID NO: 874907 - DNA, 25 bp, Mus musculus
agcttccttgaagacacccacagga

SEQ ID NO: 874908 - DNA, 25 bp, Mus musculus
agcttcctttgacgaggattctgga

SEQ ID NO: 874909 - DNA, 25 bp, Mus musculus
agcttcctttgaggaggattctgga

SEQ ID NO: 874910 - DNA, 25 bp, Mus musculus
agcttcgagaagcccaaagaatctt

SEQ ID NO: 874911 - DNA, 25 bp, Mus musculus
agcttcgagaaggccaaagaatctt

SEQ ID NO: 874912 - DNA, 25 bp, Mus musculus
agcttcgagtcacacggggtgacat

SEQ ID NO: 874913 - DNA, 25 bp, Mus musculus
agcttcgagtcacagggggtgacat

SEQ ID NO: 874914 - DNA, 25 bp, Mus musculus
agcttcgcccagaacgtagccgttg

SEQ ID NO: 874915 - DNA, 25 bp, Mus musculus
agcttcgcccagaaggtagccgttg

SEQ ID NO: 874916 - DNA, 25 bp, Mus musculus
agcttcgccctctgcatgaggaact

SEQ ID NO: 874917 - DNA, 25 bp, Mus musculus
agcttcgccctctggatgaggaact

SEQ ID NO: 874918 - DNA, 25 bp, Mus musculus
agcttcgcctagcaaagaatctgta

SEQ ID NO: 874919 - DNA, 25 bp, Mus musculus
agcttcgcctaggaaagaatctgta

SEQ ID NO: 874920 - DNA, 25 bp, Mus musculus
agcttcgcctcaaacctcagcttct

SEQ ID NO: 874921 - DNA, 25 bp, Mus musculus
agcttcgcctgaaacctcagcttct

SEQ ID NO: 874922 - DNA, 25 bp, Mus musculus
agcttcgctgcgtggatgtggccca

SEQ ID NO: 874923 - DNA, 25 bp, Mus musculus
agcttcgctgggtggatgtggccca

SEQ ID NO: 874924 - DNA, 25 bp, Mus musculus
agcttcggcagcctgcattcacctc

SEQ ID NO: 874925 - DNA, 25 bp, Mus musculus
agcttcggcagcgtgcattcacctc

SEQ ID NO: 874926 - DNA, 25 bp, Mus musculus
agcttcgggacctcacctccaactc

SEQ ID NO: 874927 - DNA, 25 bp, Mus musculus
agcttcgggacctctcctccaactc

SEQ ID NO: 874928 - DNA, 25 bp, Mus musculus
agcttcgtaaagattgcacttgggt

SEQ ID NO: 874929 - DNA, 25 bp, Mus musculus
agcttcgtaaagtttgcacttgggt

SEQ ID NO: 874930 - DNA, 25 bp, Mus musculus
agcttctagaactacgagccagtgt

SEQ ID NO: 874931 - DNA, 25 bp, Mus musculus
agcttctagaactaggagccagtgt

SEQ ID NO: 874932 - DNA, 25 bp, Mus musculus
agcttctatacaggaagggtccacc

SEQ ID NO: 874933 - DNA, 25 bp, Mus musculus
agcttctatagaggaagggtccacc

SEQ ID NO: 874934 - DNA, 25 bp, Mus musculus
agcttctccctgcatttgagctcat

SEQ ID NO: 874935 - DNA, 25 bp, Mus musculus
agcttctccctggatttgagctcat

SEQ ID NO: 874936 - DNA, 25 bp, Mus musculus
agcttctcggactcatcttctctgc

SEQ ID NO: 874937 - DNA, 25 bp, Mus musculus
agcttctcggactcttcttctctgc

SEQ ID NO: 874938 - DNA, 25 bp, Mus musculus
agcttctgagcagctagaagcgatc

SEQ ID NO: 874939 - DNA, 25 bp, Mus musculus
agcttctgaggagctagaagcgatc

SEQ ID NO: 874940 - DNA, 25 bp, Mus musculus
agcttctgtttccgcgtgccatgca

SEQ ID NO: 874941 - DNA, 25 bp, Mus musculus
agcttctgtttccgggtgccatgca

SEQ ID NO: 874942 - DNA, 25 bp, Mus musculus
agcttcttagtcaacggtctcatgt

SEQ ID NO: 874943 - DNA, 25 bp, Mus musculus
agcttcttagtcaacgttggcttcc

SEQ ID NO: 874944 - DNA, 25 bp, Mus musculus
agcttcttagtcaagggtctcatgt

SEQ ID NO: 874945 - DNA, 25 bp, Mus musculus
agcttcttagtcaaggttggcttcc

SEQ ID NO: 874946 - DNA, 25 bp, Mus musculus
agcttcttcagacgtagaactagac

SEQ ID NO: 874947 - DNA, 25 bp, Mus musculus
agcttcttcagaggtagaactagac

SEQ ID NO: 874948 - DNA, 25 bp, Mus musculus
agcttcttcgaaaaaatgttttggc

SEQ ID NO: 874949 - DNA, 25 bp, Mus musculus
agcttcttcgaaaatatgttttggc

SEQ ID NO: 874950 - DNA, 25 bp, Mus musculus
agcttctttgctccgcagaacacag

SEQ ID NO: 874951 - DNA, 25 bp, Mus musculus
agcttctttggtccgcagaacacag

SEQ ID NO: 874952 - DNA, 25 bp, Mus musculus
agcttcttttctatcatccagaaca

SEQ ID NO: 874953 - DNA, 25 bp, Mus musculus
agcttcttttctttcatccagaaca

SEQ ID NO: 874954 - DNA, 25 bp, Mus musculus
agcttgacgtcgtgcaacgatctcc

SEQ ID NO: 874955 - DNA, 25 bp, Mus musculus
agcttgacgtcgtggaacgatctcc

SEQ ID NO: 874956 - DNA, 25 bp, Mus musculus
agcttgagaaaaaccatggtgaatc

SEQ ID NO: 874957 - DNA, 25 bp, Mus musculus
agcttgagaaaatccatggtgaatc

SEQ ID NO: 874958 - DNA, 25 bp, Mus musculus
agcttgagcagggacatggcggtaa

SEQ ID NO: 874959 - DNA, 25 bp, Mus musculus
agcttgagcagggagatggcggtaa

SEQ ID NO: 874960 - DNA, 25 bp, Mus musculus
agcttgccaaaacgtacagtgattg

SEQ ID NO: 874961 - DNA, 25 bp, Mus musculus
agcttgccaaaaggtacagtgattg

SEQ ID NO: 874962 - DNA, 25 bp, Mus musculus
agcttgcctcagcgaaaatgggctg

SEQ ID NO: 874963 - DNA, 25 bp, Mus musculus
agcttgcctcagggaaaatgggctg

SEQ ID NO: 874964 - DNA, 25 bp, Mus musculus
agcttgcgcgcccggccgccccgcc

SEQ ID NO: 874965 - DNA, 25 bp, Mus musculus
agcttgcgcggccggccgccccgcc

SEQ ID NO: 874966 - DNA, 25 bp, Mus musculus
agcttgctgcagagcgcccgtgggg

SEQ ID NO: 874967 - DNA, 25 bp, Mus musculus
agcttgctgcagagggcccgtgggg

SEQ ID NO: 874968 - DNA, 25 bp, Mus musculus
agcttgcttactaatgcagactaca

SEQ ID NO: 874969 - DNA, 25 bp, Mus musculus
agcttgcttacttatgcagactaca

SEQ ID NO: 874970 - DNA, 25 bp, Mus musculus
agcttggagaggcgtcttatggcag

SEQ ID NO: 874971 - DNA, 25 bp, Mus musculus
agcttggagaggggtcttatggcag

SEQ ID NO: 874972 - DNA, 25 bp, Mus musculus
agcttggaggagcttagctattatt

SEQ ID NO: 874973 - DNA, 25 bp, Mus musculus
agcttggaggaggttagctattatt

SEQ ID NO: 874974 - DNA, 25 bp, Mus musculus
agcttggatctactcgttctgcagt

SEQ ID NO: 874975 - DNA, 25 bp, Mus musculus
agcttggatctactctgggcccagc

SEQ ID NO: 874976 - DNA, 25 bp, Mus musculus
agcttggatctactggttctgcagt

SEQ ID NO: 874977 - DNA, 25 bp, Mus musculus
agcttggatctactgtgggcccagc

SEQ ID NO: 874978 - DNA, 25 bp, Mus musculus
agcttggcagaggccaatttgccat

SEQ ID NO: 874979 - DNA, 25 bp, Mus musculus
agcttggcagtggccaatttgccat

SEQ ID NO: 874980 - DNA, 25 bp, Mus musculus
agcttggcgaagctaccagctcagg

SEQ ID NO: 874981 - DNA, 25 bp, Mus musculus
agcttggcgaaggtaccagctcagg

SEQ ID NO: 874982 - DNA, 25 bp, Mus musculus
agcttggttccacatgggtgtgttt

SEQ ID NO: 874983 - DNA, 25 bp, Mus musculus
agcttggttccacggtgactgactg

SEQ ID NO: 874984 - DNA, 25 bp, Mus musculus
agcttggttccagatgggtgtgttt

SEQ ID NO: 874985 - DNA, 25 bp, Mus musculus
agcttggttccagggtgactgactg

SEQ ID NO: 874986 - DNA, 25 bp, Mus musculus
agcttgtcagcacaggggaccaacc

SEQ ID NO: 874987 - DNA, 25 bp, Mus musculus
agcttgtcaggacaggggaccaacc

SEQ ID NO: 874988 - DNA, 25 bp, Mus musculus
agcttgtctgtccggtgctccagct

SEQ ID NO: 874989 - DNA, 25 bp, Mus musculus
agcttgtctgtcgggtgctccagct

SEQ ID NO: 874990 - DNA, 25 bp, Mus musculus
agcttgttctggcacgcactcttgg

SEQ ID NO: 874991 - DNA, 25 bp, Mus musculus
agcttgttctgggacgcactcttgg

SEQ ID NO: 874992 - DNA, 25 bp, Mus musculus
agcttgttgcctcgtacgacaacga

SEQ ID NO: 874993 - DNA, 25 bp, Mus musculus
agcttgttgcctggtacgacaacga

SEQ ID NO: 874994 - DNA, 25 bp, Mus musculus
agctttaaacaacaggctcaagatg

SEQ ID NO: 874995 - DNA, 25 bp, Mus musculus
agctttaaacaacgggcgcagagaa

SEQ ID NO: 874996 - DNA, 25 bp, Mus musculus
agctttaaacaagaggctcaagatg

SEQ ID NO: 874997 - DNA, 25 bp, Mus musculus
agctttaaacaaggggcgcagagaa

SEQ ID NO: 874998 - DNA, 25 bp, Mus musculus
agctttaatgccaccaccacctctg

SEQ ID NO: 874999 - DNA, 25 bp, Mus musculus
agctttaatggcaccaccacctctg

SEQ ID NO: 875000 - DNA, 25 bp, Mus musculus
agctttacttttcgtatatcatgta

SEQ ID NO: 875001 - DNA, 25 bp, Mus musculus
agctttacttttggtatatcatgta

SEQ ID NO: 875002 - DNA, 25 bp, Mus musculus
agctttagagggaacgattcgagca

SEQ ID NO: 875003 - DNA, 25 bp, Mus musculus
agctttagagggaaggattcgagca

SEQ ID NO: 875004 - DNA, 25 bp, Mus musculus
agctttagtcctcaaaggccagttg

SEQ ID NO: 875005 - DNA, 25 bp, Mus musculus
agctttagtcgtcaaaggccagttg

SEQ ID NO: 875006 - DNA, 25 bp, Mus musculus
agctttatcaaccagaagaaatacc

SEQ ID NO: 875007 - DNA, 25 bp, Mus musculus
agctttatcaacgagaagaaatacc

SEQ ID NO: 875008 - DNA, 25 bp, Mus musculus
agctttcagcagctggtgaaattaa

SEQ ID NO: 875009 - DNA, 25 bp, Mus musculus
agctttcagcaggtggtgaaattaa

SEQ ID NO: 875010 - DNA, 25 bp, Mus musculus
agctttccagaattcctcagagaga

SEQ ID NO: 875011 - DNA, 25 bp, Mus musculus
agctttccagacttacaacagctgt

SEQ ID NO: 875012 - DNA, 25 bp, Mus musculus
agctttccagctgggatcgaggaac

SEQ ID NO: 875013 - DNA, 25 bp, Mus musculus
agctttccaggtgggatcgaggaac

SEQ ID NO: 875014 - DNA, 25 bp, Mus musculus
agctttccagtattcctcagagaga

SEQ ID NO: 875015 - DNA, 25 bp, Mus musculus
agctttccagtcttacaacagctgt

SEQ ID NO: 875016 - DNA, 25 bp, Mus musculus
agctttcgaccccaggactatctcc

SEQ ID NO: 875017 - DNA, 25 bp, Mus musculus
agctttcgacccgaggactatctcc

SEQ ID NO: 875018 - DNA, 25 bp, Mus musculus
agctttctcccacgtgctcaccatt

SEQ ID NO: 875019 - DNA, 25 bp, Mus musculus
agctttctcccaggtgctcaccatt

SEQ ID NO: 875020 - DNA, 25 bp, Mus musculus
agctttctgaaacggtgaaggctgc

SEQ ID NO: 875021 - DNA, 25 bp, Mus musculus
agctttctgaaagggtgaaggctgc

SEQ ID NO: 875022 - DNA, 25 bp, Mus musculus
agctttcttaggcagcgagagggcc

SEQ ID NO: 875023 - DNA, 25 bp, Mus musculus
agctttcttagggagcgagagggcc

SEQ ID NO: 875024 - DNA, 25 bp, Mus musculus
agctttgaagatgggaaacctgtgt

SEQ ID NO: 875025 - DNA, 25 bp, Mus musculus
agctttgaagttgggaaacctgtgt

SEQ ID NO: 875026 - DNA, 25 bp, Mus musculus
agctttgataagcacaagttaacca

SEQ ID NO: 875027 - DNA, 25 bp, Mus musculus
agctttgataaggacaagttaacca

SEQ ID NO: 875028 - DNA, 25 bp, Mus musculus
agctttgcagattgaggcctgcaat

SEQ ID NO: 875029 - DNA, 25 bp, Mus musculus
agctttgcagtttgaggcctgcaat

SEQ ID NO: 875030 - DNA, 25 bp, Mus musculus
agctttgctgtggacgcagtggagc

SEQ ID NO: 875031 - DNA, 25 bp, Mus musculus
agctttgctgtggaggcagtggagc

SEQ ID NO: 875032 - DNA, 25 bp, Mus musculus
agctttggagcgctccactctagcc

SEQ ID NO: 875033 - DNA, 25 bp, Mus musculus
agctttggagggctccactctagcc

SEQ ID NO: 875034 - DNA, 25 bp, Mus musculus
agctttggcaagctgctgctggcag

SEQ ID NO: 875035 - DNA, 25 bp, Mus musculus
agctttggcaaggtgctgctggcag

SEQ ID NO: 875036 - DNA, 25 bp, Mus musculus
agctttggggcgctggctgtgggct

SEQ ID NO: 875037 - DNA, 25 bp, Mus musculus
agctttggggggctggctgtgggct

SEQ ID NO: 875038 - DNA, 25 bp, Mus musculus
agctttgtcaagaacctacatggac

SEQ ID NO: 875039 - DNA, 25 bp, Mus musculus
agctttgtcaagcgctggggagcag

SEQ ID NO: 875040 - DNA, 25 bp, Mus musculus
agctttgtcaagggctggggagcag

SEQ ID NO: 875041 - DNA, 25 bp, Mus musculus
agctttgtcaagtacctacatggac

SEQ ID NO: 875042 - DNA, 25 bp, Mus musculus
agctttgtttattgccatctctgga

SEQ ID NO: 875043 - DNA, 25 bp, Mus musculus
agctttgttttttgccatctctgga

SEQ ID NO: 875044 - DNA, 25 bp, Mus musculus
agcttttaaatcactagtttggtgc

SEQ ID NO: 875045 - DNA, 25 bp, Mus musculus
agcttttaaatctctagtttggtgc

SEQ ID NO: 875046 - DNA, 25 bp, Mus musculus
agcttttacaagcttcaaaaccgct

SEQ ID NO: 875047 - DNA, 25 bp, Mus musculus
agcttttacaaggttcaaaaccgct

SEQ ID NO: 875048 - DNA, 25 bp, Mus musculus
agcttttagaccacaacgaagcata

SEQ ID NO: 875049 - DNA, 25 bp, Mus musculus
agcttttagagcacaacgaagcata

SEQ ID NO: 875050 - DNA, 25 bp, Mus musculus
aggaaaaacagacacgcactcctag

SEQ ID NO: 875051 - DNA, 25 bp, Mus musculus
aggaaaaacagacaggcactcctag

SEQ ID NO: 875052 - DNA, 25 bp, Mus musculus
aggaaaaagctccccacccccatca

SEQ ID NO: 875053 - DNA, 25 bp, Mus musculus
aggaaaaagctcgccacccccatca

SEQ ID NO: 875054 - DNA, 25 bp, Mus musculus
aggaaaaatgcgagcaagatatgtg

SEQ ID NO: 875055 - DNA, 25 bp, Mus musculus
aggaaaaatgcgtgcaagatatgtg

SEQ ID NO: 875056 - DNA, 25 bp, Mus musculus
aggaaaacagactataaagcaccat

SEQ ID NO: 875057 - DNA, 25 bp, Mus musculus
aggaaaacagcacccatcctctgtc

SEQ ID NO: 875058 - DNA, 25 bp, Mus musculus
aggaaaacaggacccatcctctgtc

SEQ ID NO: 875059 - DNA, 25 bp, Mus musculus
aggaaaacagtctataaagcaccat

SEQ ID NO: 875060 - DNA, 25 bp, Mus musculus
aggaaaaccaatcgctcaccctgtg

SEQ ID NO: 875061 - DNA, 25 bp, Mus musculus
aggaaaaccaatggctcaccctgtg

SEQ ID NO: 875062 - DNA, 25 bp, Mus musculus
aggaaaatagcttggaacttagctg

SEQ ID NO: 875063 - DNA, 25 bp, Mus musculus
aggaaaataggttggaacttagctg

SEQ ID NO: 875064 - DNA, 25 bp, Mus musculus
aggaaaatccagcaactcagcaaaa

SEQ ID NO: 875065 - DNA, 25 bp, Mus musculus
aggaaaatccaggaactcagcaaaa

SEQ ID NO: 875066 - DNA, 25 bp, Mus musculus
aggaaaatgcctctcgacttgacta

SEQ ID NO: 875067 - DNA, 25 bp, Mus musculus
aggaaaatgcctctggacttgacta

SEQ ID NO: 875068 - DNA, 25 bp, Mus musculus
aggaaacaagagatggagcagatgg

SEQ ID NO: 875069 - DNA, 25 bp, Mus musculus
aggaaacaagagttggagcagatgg

SEQ ID NO: 875070 - DNA, 25 bp, Mus musculus
aggaaacagcagattcctcagacaa

SEQ ID NO: 875071 - DNA, 25 bp, Mus musculus
aggaaacagcagcgaaggatctgtc

SEQ ID NO: 875072 - DNA, 25 bp, Mus musculus
aggaaacagcagggaaggatctgtc

SEQ ID NO: 875073 - DNA, 25 bp, Mus musculus
aggaaacagcagtttcctcagacaa

SEQ ID NO: 875074 - DNA, 25 bp, Mus musculus
aggaaacagtgtagcatacactttg

SEQ ID NO: 875075 - DNA, 25 bp, Mus musculus
aggaaacagtgtaggatacactttg

SEQ ID NO: 875076 - DNA, 25 bp, Mus musculus
aggaaaccagcaatgacacgggatg

SEQ ID NO: 875077 - DNA, 25 bp, Mus musculus
aggaaaccaggaatgacacgggatg

SEQ ID NO: 875078 - DNA, 25 bp, Mus musculus
aggaaacccactcgcatagggcatg

SEQ ID NO: 875079 - DNA, 25 bp, Mus musculus
aggaaacccagtcgcatagggcatg

SEQ ID NO: 875080 - DNA, 25 bp, Mus musculus
aggaaactcagccacagccccctta

SEQ ID NO: 875081 - DNA, 25 bp, Mus musculus
aggaaactcagccagagccccctta

SEQ ID NO: 875082 - DNA, 25 bp, Mus musculus
aggaaactgagacacgccttgcaag

SEQ ID NO: 875083 - DNA, 25 bp, Mus musculus
aggaaactgagacaggccttgcaag

SEQ ID NO: 875084 - DNA, 25 bp, Mus musculus
aggaaactggagtgtgggttcgcag

SEQ ID NO: 875085 - DNA, 25 bp, Mus musculus
aggaaactggtgtgtgggttcgcag

SEQ ID NO: 875086 - DNA, 25 bp, Mus musculus
aggaaagaatatgacaatgctcttt

SEQ ID NO: 875087 - DNA, 25 bp, Mus musculus
aggaaagaatatgagaatgctcttt

SEQ ID NO: 875088 - DNA, 25 bp, Mus musculus
aggaaagacaagatactgtcagcag

SEQ ID NO: 875089 - DNA, 25 bp, Mus musculus
aggaaagacatgatactgtcagcag

SEQ ID NO: 875090 - DNA, 25 bp, Mus musculus
aggaaagagaagctctgggcccact

SEQ ID NO: 875091 - DNA, 25 bp, Mus musculus
aggaaagagaaggtctgggcccact

SEQ ID NO: 875092 - DNA, 25 bp, Mus musculus
aggaaagatgaccagaaagagaaag

SEQ ID NO: 875093 - DNA, 25 bp, Mus musculus
aggaaagatgtccagaaagagaaag

SEQ ID NO: 875094 - DNA, 25 bp, Mus musculus
aggaaagcaccgcacgtatcagcct

SEQ ID NO: 875095 - DNA, 25 bp, Mus musculus
aggaaagcaccgcaggtatcagcct

SEQ ID NO: 875096 - DNA, 25 bp, Mus musculus
aggaaagcatccttgaagaagtgtt

SEQ ID NO: 875097 - DNA, 25 bp, Mus musculus
aggaaagcatgcttgaagaagtgtt

SEQ ID NO: 875098 - DNA, 25 bp, Mus musculus
aggaaagttgcactattatccccta

SEQ ID NO: 875099 - DNA, 25 bp, Mus musculus
aggaaagttgcagtattatccccta

SEQ ID NO: 875100 - DNA, 25 bp, Mus musculus
aggaaatacatgctgtctgtgcttc

SEQ ID NO: 875101 - DNA, 25 bp, Mus musculus
aggaaatacatggtgtctgtgcttc

SEQ ID NO: 875102 - DNA, 25 bp, Mus musculus
aggaaatatgcgtgtttgctttgat

SEQ ID NO: 875103 - DNA, 25 bp, Mus musculus
aggaaatatgggtgtttgctttgat

SEQ ID NO: 875104 - DNA, 25 bp, Mus musculus
aggaaatctgcagacctggacgcta

SEQ ID NO: 875105 - DNA, 25 bp, Mus musculus
aggaaatctgcagagctggacgcta

SEQ ID NO: 875106 - DNA, 25 bp, Mus musculus
aggaaatgacacaggatatcgaaca

SEQ ID NO: 875107 - DNA, 25 bp, Mus musculus
aggaaatgactcaggatatcgaaca

SEQ ID NO: 875108 - DNA, 25 bp, Mus musculus
aggaaatgaggtccttgtagaccct

SEQ ID NO: 875109 - DNA, 25 bp, Mus musculus
aggaaatgaggtgcttgtagaccct

SEQ ID NO: 875110 - DNA, 25 bp, Mus musculus
aggaaatggagcagcagccctgcct

SEQ ID NO: 875111 - DNA, 25 bp, Mus musculus
aggaaatggagcaggagccctgcct

SEQ ID NO: 875112 - DNA, 25 bp, Mus musculus
aggaaatgtgggctggctgctgaat

SEQ ID NO: 875113 - DNA, 25 bp, Mus musculus
aggaaatgtggggtggctgctgaat

SEQ ID NO: 875114 - DNA, 25 bp, Mus musculus
aggaacaaagagaacctgcacccac

SEQ ID NO: 875115 - DNA, 25 bp, Mus musculus
aggaacaaagagaccccgaggcaag

SEQ ID NO: 875116 - DNA, 25 bp, Mus musculus
aggaacaaagctcaggtgcccattt

SEQ ID NO: 875117 - DNA, 25 bp, Mus musculus
aggaacaaaggtcaggtgcccattt

SEQ ID NO: 875118 - DNA, 25 bp, Mus musculus
aggaacaaagtgaacctgcacccac

SEQ ID NO: 875119 - DNA, 25 bp, Mus musculus
aggaacaaagtgaccccgaggcaag

SEQ ID NO: 875120 - DNA, 25 bp, Mus musculus
aggaacacaaactgaaagtcgctcg

SEQ ID NO: 875121 - DNA, 25 bp, Mus musculus
aggaacacaaagctaagaaagcacg

SEQ ID NO: 875122 - DNA, 25 bp, Mus musculus
aggaacacaaaggtaagaaagcacg

SEQ ID NO: 875123 - DNA, 25 bp, Mus musculus
aggaacacaatctgaaagtcgctcg

SEQ ID NO: 875124 - DNA, 25 bp, Mus musculus
aggaacacatagcacataaacttct

SEQ ID NO: 875125 - DNA, 25 bp, Mus musculus
aggaacacatagcagataaacttct

SEQ ID NO: 875126 - DNA, 25 bp, Mus musculus
aggaacagaagtcacaaagaaaaat

SEQ ID NO: 875127 - DNA, 25 bp, Mus musculus
aggaacagaagtcacaaagcacaat

SEQ ID NO: 875128 - DNA, 25 bp, Mus musculus
aggaacagaagtcagaaagaaaaat

SEQ ID NO: 875129 - DNA, 25 bp, Mus musculus
aggaacagaagtcagaaagcacaat

SEQ ID NO: 875130 - DNA, 25 bp, Mus musculus
aggaacagagagacttaaccactct

SEQ ID NO: 875131 - DNA, 25 bp, Mus musculus
aggaacagagtgacttaaccactct

SEQ ID NO: 875132 - DNA, 25 bp, Mus musculus
aggaacagattgcacagttcaagga

SEQ ID NO: 875133 - DNA, 25 bp, Mus musculus
aggaacagattgcagagttcaagga

SEQ ID NO: 875134 - DNA, 25 bp, Mus musculus
aggaacaggccgacatgctagatga

SEQ ID NO: 875135 - DNA, 25 bp, Mus musculus
aggaacaggccgtcatgctagatga

SEQ ID NO: 875136 - DNA, 25 bp, Mus musculus
aggaacagttcatccctaaaggatt

SEQ ID NO: 875137 - DNA, 25 bp, Mus musculus
aggaacagttgatccctaaaggatt

SEQ ID NO: 875138 - DNA, 25 bp, Mus musculus
aggaacatcaagctgggaagaccca

SEQ ID NO: 875139 - DNA, 25 bp, Mus musculus
aggaacatcaaggtgggaagaccca

SEQ ID NO: 875140 - DNA, 25 bp, Mus musculus
aggaacatcgagactttatatggag

SEQ ID NO: 875141 - DNA, 25 bp, Mus musculus
aggaacatcgtgactttatatggag

SEQ ID NO: 875142 - DNA, 25 bp, Mus musculus
aggaacatgtagaacgtccactgcc

SEQ ID NO: 875143 - DNA, 25 bp, Mus musculus
aggaacatgtagaaggtccactgcc

SEQ ID NO: 875144 - DNA, 25 bp, Mus musculus
aggaaccaaatctaaacctacatcg

SEQ ID NO: 875145 - DNA, 25 bp, Mus musculus
aggaaccaaatctatacctacatcg

SEQ ID NO: 875146 - DNA, 25 bp, Mus musculus
aggaaccagaaacgacagtctggac

SEQ ID NO: 875147 - DNA, 25 bp, Mus musculus
aggaaccagaaaggacagtctggac

SEQ ID NO: 875148 - DNA, 25 bp, Mus musculus
aggaaccatgaagacgaagtcaaca

SEQ ID NO: 875149 - DNA, 25 bp, Mus musculus
aggaaccatgaagaggaagtcaaca

SEQ ID NO: 875150 - DNA, 25 bp, Mus musculus
aggaacccgtgacgtcaatatccaa

SEQ ID NO: 875151 - DNA, 25 bp, Mus musculus
aggaacccgtgaggtcaatatccaa

SEQ ID NO: 875152 - DNA, 25 bp, Mus musculus
aggaaccgaaagactaagcatccca

SEQ ID NO: 875153 - DNA, 25 bp, Mus musculus
aggaaccgaaagtctaagcatccca

SEQ ID NO: 875154 - DNA, 25 bp, Mus musculus
aggaacgacaagcgcgattcgacag

SEQ ID NO: 875155 - DNA, 25 bp, Mus musculus
aggaacgacaagggcgattcgacag

SEQ ID NO: 875156 - DNA, 25 bp, Mus musculus
aggaacgcattgcgcgcctggtgga

SEQ ID NO: 875157 - DNA, 25 bp, Mus musculus
aggaacgcattgggcgcctggtgga

SEQ ID NO: 875158 - DNA, 25 bp, Mus musculus
aggaacggagacatcggcggtatgg

SEQ ID NO: 875159 - DNA, 25 bp, Mus musculus
aggaacggagacatgggcggtatgg

SEQ ID NO: 875160 - DNA, 25 bp, Mus musculus
aggaacggatcgctctggaggaaga

SEQ ID NO: 875161 - DNA, 25 bp, Mus musculus
aggaacggatggctctggaggaaga

SEQ ID NO: 875162 - DNA, 25 bp, Mus musculus
aggaactcaaagaagtcacagtaaa

SEQ ID NO: 875163 - DNA, 25 bp, Mus musculus
aggaactcaaagccaaatcagaggt

SEQ ID NO: 875164 - DNA, 25 bp, Mus musculus
aggaactcaaaggcaaatcagaggt

SEQ ID NO: 875165 - DNA, 25 bp, Mus musculus
aggaactcaaagtagtcacagtaaa

SEQ ID NO: 875166 - DNA, 25 bp, Mus musculus
aggaactcacaaccaagttgtgtta

SEQ ID NO: 875167 - DNA, 25 bp, Mus musculus
aggaactcacacagaaccaagttgt

SEQ ID NO: 875168 - DNA, 25 bp, Mus musculus
aggaactcacagctccattacttac

SEQ ID NO: 875169 - DNA, 25 bp, Mus musculus
aggaactcacaggtccattacttac

SEQ ID NO: 875170 - DNA, 25 bp, Mus musculus
aggaactcactaccaagttgtgtta

SEQ ID NO: 875171 - DNA, 25 bp, Mus musculus
aggaactcactcagaaccaagttgt

SEQ ID NO: 875172 - DNA, 25 bp, Mus musculus
aggaactcaggcagcagaacgagat

SEQ ID NO: 875173 - DNA, 25 bp, Mus musculus
aggaactcaggctgcagaacgagat

SEQ ID NO: 875174 - DNA, 25 bp, Mus musculus
aggaactcgcggcgcaagactgcta

SEQ ID NO: 875175 - DNA, 25 bp, Mus musculus
aggaactcgcggcggaagactgcta

SEQ ID NO: 875176 - DNA, 25 bp, Mus musculus
aggaactgcctaaggagcctcaagg

SEQ ID NO: 875177 - DNA, 25 bp, Mus musculus
aggaactgcctatggagcctcaagg

SEQ ID NO: 875178 - DNA, 25 bp, Mus musculus
aggaagaaaaagatgagtgtgttga

SEQ ID NO: 875179 - DNA, 25 bp, Mus musculus
aggaagaaaaagttgagtgtgttga

SEQ ID NO: 875180 - DNA, 25 bp, Mus musculus
aggaagaaaacacgaatctgcaagc

SEQ ID NO: 875181 - DNA, 25 bp, Mus musculus
aggaagaaaacaggaatctgcaagc

SEQ ID NO: 875182 - DNA, 25 bp, Mus musculus
aggaagaaagatgcttctgatgact

SEQ ID NO: 875183 - DNA, 25 bp, Mus musculus
aggaagaaagcaaaatcagaggctc

SEQ ID NO: 875184 - DNA, 25 bp, Mus musculus
aggaagaaagcctaaatgcttcagt

SEQ ID NO: 875185 - DNA, 25 bp, Mus musculus
aggaagaaagcctatatgcttcagt

SEQ ID NO: 875186 - DNA, 25 bp, Mus musculus
aggaagaaagctggcaccagagttc

SEQ ID NO: 875187 - DNA, 25 bp, Mus musculus
aggaagaaaggaaaatcagaggctc

SEQ ID NO: 875188 - DNA, 25 bp, Mus musculus
aggaagaaaggtggcaccagagttc

SEQ ID NO: 875189 - DNA, 25 bp, Mus musculus
aggaagaaagttgcttctgatgact

SEQ ID NO: 875190 - DNA, 25 bp, Mus musculus
aggaagaacaaaaaagcaagctggg

SEQ ID NO: 875191 - DNA, 25 bp, Mus musculus
aggaagaacaaaaatgcaagctggg

SEQ ID NO: 875192 - DNA, 25 bp, Mus musculus
aggaagaagaaaatcaagaccatca

SEQ ID NO: 875193 - DNA, 25 bp, Mus musculus
aggaagaagaaaatcaccatcaaat

SEQ ID NO: 875194 - DNA, 25 bp, Mus musculus
aggaagaagaaaatgaagaccatca

SEQ ID NO: 875195 - DNA, 25 bp, Mus musculus
aggaagaagaaaatgaccatcaaat

SEQ ID NO: 875196 - DNA, 25 bp, Mus musculus
aggaagaagaggaggaagagggtct

SEQ ID NO: 875197 - DNA, 25 bp, Mus musculus
aggaagaagaggtggaagagggtct

SEQ ID NO: 875198 - DNA, 25 bp, Mus musculus
aggaagaagcatttcggaactctca

SEQ ID NO: 875199 - DNA, 25 bp, Mus musculus
aggaagaagcatttgggaactctca

SEQ ID NO: 875200 - DNA, 25 bp, Mus musculus
aggaagaaggtgaccgtgaggagga

SEQ ID NO: 875201 - DNA, 25 bp, Mus musculus
aggaagaaggtgacggtgaggagga

SEQ ID NO: 875202 - DNA, 25 bp, Mus musculus
aggaagacacagctacaagctctga

SEQ ID NO: 875203 - DNA, 25 bp, Mus musculus
aggaagacacaggtacaagctctga

SEQ ID NO: 875204 - DNA, 25 bp, Mus musculus
aggaagagaacgaggacatcacata

SEQ ID NO: 875205 - DNA, 25 bp, Mus musculus
aggaagagaaggaggacatcacata

SEQ ID NO: 875206 - DNA, 25 bp, Mus musculus
aggaagagagagcagtgaccatgga

SEQ ID NO: 875207 - DNA, 25 bp, Mus musculus
aggaagagagaggagtgaccatgga

SEQ ID NO: 875208 - DNA, 25 bp, Mus musculus
aggaagagagattgctgctgaagag

SEQ ID NO: 875209 - DNA, 25 bp, Mus musculus
aggaagagagtttgctgctgaagag

SEQ ID NO: 875210 - DNA, 25 bp, Mus musculus
aggaagagatcgtgaagctggagag

SEQ ID NO: 875211 - DNA, 25 bp, Mus musculus
aggaagagatggtgaagctggagag

SEQ ID NO: 875212 - DNA, 25 bp, Mus musculus
aggaagaggaaacagaaagagagcg

SEQ ID NO: 875213 - DNA, 25 bp, Mus musculus
aggaagaggaaacagatgagccgcc

SEQ ID NO: 875214 - DNA, 25 bp, Mus musculus
aggaagaggaaagagaaagagagcg

SEQ ID NO: 875215 - DNA, 25 bp, Mus musculus
aggaagaggaaagagatgagccgcc

SEQ ID NO: 875216 - DNA, 25 bp, Mus musculus
aggaagaggccccactgaaggggca

SEQ ID NO: 875217 - DNA, 25 bp, Mus musculus
aggaagaggccccagtgaaggggca

SEQ ID NO: 875218 - DNA, 25 bp, Mus musculus
aggaagattgatctcggcagctctg

SEQ ID NO: 875219 - DNA, 25 bp, Mus musculus
aggaagattgatgtcggcagctctg

SEQ ID NO: 875220 - DNA, 25 bp, Mus musculus
aggaagcactggaggaggcagatga

SEQ ID NO: 875221 - DNA, 25 bp, Mus musculus
aggaagcactggcaaggggaccagg

SEQ ID NO: 875222 - DNA, 25 bp, Mus musculus
aggaagcactgggaaggggaccagg

SEQ ID NO: 875223 - DNA, 25 bp, Mus musculus
aggaagcactggtggaggcagatga

SEQ ID NO: 875224 - DNA, 25 bp, Mus musculus
aggaagcagagacgagaaaaggagg

SEQ ID NO: 875225 - DNA, 25 bp, Mus musculus
aggaagcagagaggagaaaaggagg

SEQ ID NO: 875226 - DNA, 25 bp, Mus musculus
aggaagcagatccccatggctatga

SEQ ID NO: 875227 - DNA, 25 bp, Mus musculus
aggaagcagatcccgatggctatga

SEQ ID NO: 875228 - DNA, 25 bp, Mus musculus
aggaagcagctggacgtggtcaagc

SEQ ID NO: 875229 - DNA, 25 bp, Mus musculus
aggaagcagctggacttgaactttc

SEQ ID NO: 875230 - DNA, 25 bp, Mus musculus
aggaagcagctggaggtggtcaagc

SEQ ID NO: 875231 - DNA, 25 bp, Mus musculus
aggaagcagctggagttgaactttc

SEQ ID NO: 875232 - DNA, 25 bp, Mus musculus
aggaagcattctggcggtcaaccgg

SEQ ID NO: 875233 - DNA, 25 bp, Mus musculus
aggaagcattctgggggtcaaccgg

SEQ ID NO: 875234 - DNA, 25 bp, Mus musculus
aggaagccaaaattctgaagcaata

SEQ ID NO: 875235 - DNA, 25 bp, Mus musculus
aggaagccaatattctgaagcaata

SEQ ID NO: 875236 - DNA, 25 bp, Mus musculus
aggaagccagcctcaggaaccctgg

SEQ ID NO: 875237 - DNA, 25 bp, Mus musculus
aggaagccagctctttggccagtat

SEQ ID NO: 875238 - DNA, 25 bp, Mus musculus
aggaagccaggctcaggaaccctgg

SEQ ID NO: 875239 - DNA, 25 bp, Mus musculus
aggaagccaggtctttggccagtat

SEQ ID NO: 875240 - DNA, 25 bp, Mus musculus
aggaagccctgacgtcacttggtcg

SEQ ID NO: 875241 - DNA, 25 bp, Mus musculus
aggaagccctgacgtgtggttccca

SEQ ID NO: 875242 - DNA, 25 bp, Mus musculus
aggaagccctgaggtcacttggtcg

SEQ ID NO: 875243 - DNA, 25 bp, Mus musculus
aggaagccctgaggtgtggttccca

SEQ ID NO: 875244 - DNA, 25 bp, Mus musculus
aggaagcctaagcatgatgctgttg

SEQ ID NO: 875245 - DNA, 25 bp, Mus musculus
aggaagcctaaggatgatgctgttg

SEQ ID NO: 875246 - DNA, 25 bp, Mus musculus
aggaagcgccacacccccagaggaa

SEQ ID NO: 875247 - DNA, 25 bp, Mus musculus
aggaagcgccactcccccagaggaa

SEQ ID NO: 875248 - DNA, 25 bp, Mus musculus
aggaagcgggaacagcacagtgtat

SEQ ID NO: 875249 - DNA, 25 bp, Mus musculus
aggaagcgggtacagcacagtgtat

SEQ ID NO: 875250 - DNA, 25 bp, Mus musculus
aggaagcttcagattataccgaaaa

SEQ ID NO: 875251 - DNA, 25 bp, Mus musculus
aggaagcttcagcctatgtctttca

SEQ ID NO: 875252 - DNA, 25 bp, Mus musculus
aggaagcttcaggctatgtctttca

SEQ ID NO: 875253 - DNA, 25 bp, Mus musculus
aggaagcttcagtttataccgaaaa

SEQ ID NO: 875254 - DNA, 25 bp, Mus musculus
aggaaggaagagctttatgggactg

SEQ ID NO: 875255 - DNA, 25 bp, Mus musculus
aggaaggaagaggtttatgggactg

SEQ ID NO: 875256 - DNA, 25 bp, Mus musculus
aggaaggaggaaatcttcctgatgc

SEQ ID NO: 875257 - DNA, 25 bp, Mus musculus
aggaaggaggtaatcttcctgatgc

SEQ ID NO: 875258 - DNA, 25 bp, Mus musculus
aggaaggatgctctgttttcacata

SEQ ID NO: 875259 - DNA, 25 bp, Mus musculus
aggaaggatgctgtcgatccttagc

SEQ ID NO: 875260 - DNA, 25 bp, Mus musculus
aggaaggatgctgtggatccttagc

SEQ ID NO: 875261 - DNA, 25 bp, Mus musculus
aggaaggatggtctgttttcacata

SEQ ID NO: 875262 - DNA, 25 bp, Mus musculus
aggaaggcctcacgaagaagatggt

SEQ ID NO: 875263 - DNA, 25 bp, Mus musculus
aggaaggcctcaggaagaagatggt

SEQ ID NO: 875264 - DNA, 25 bp, Mus musculus
aggaaggcgaagatttgcagtcctg

SEQ ID NO: 875265 - DNA, 25 bp, Mus musculus
aggaaggcgaagttttgcagtcctg

SEQ ID NO: 875266 - DNA, 25 bp, Mus musculus
aggaaggctcagaccagccaactct

SEQ ID NO: 875267 - DNA, 25 bp, Mus musculus
aggaaggctcagtccagccaactct

SEQ ID NO: 875268 - DNA, 25 bp, Mus musculus
aggaaggcttcacgaggaaccatgg

SEQ ID NO: 875269 - DNA, 25 bp, Mus musculus
aggaaggcttcaggaggaaccatgg

SEQ ID NO: 875270 - DNA, 25 bp, Mus musculus
aggaaggctttccacccatggccat

SEQ ID NO: 875271 - DNA, 25 bp, Mus musculus
aggaaggctttccacctccagcacc

SEQ ID NO: 875272 - DNA, 25 bp, Mus musculus
aggaaggctttccagccatggccat

SEQ ID NO: 875273 - DNA, 25 bp, Mus musculus
aggaaggctttccagctccagcacc

SEQ ID NO: 875274 - DNA, 25 bp, Mus musculus
aggaagggagaactttggagctgtc

SEQ ID NO: 875275 - DNA, 25 bp, Mus musculus
aggaagggagaagtttggagctgtc

SEQ ID NO: 875276 - DNA, 25 bp, Mus musculus
aggaaggtgtgcaacgaggggtggc

SEQ ID NO: 875277 - DNA, 25 bp, Mus musculus
aggaaggtgtgcaaggaggggtggc

SEQ ID NO: 875278 - DNA, 25 bp, Mus musculus
aggaaggttgtagacgtagagctga

SEQ ID NO: 875279 - DNA, 25 bp, Mus musculus
aggaaggttgtagaggtagagctga

SEQ ID NO: 875280 - DNA, 25 bp, Mus musculus
aggaagtagcaacaagctacctaaa

SEQ ID NO: 875281 - DNA, 25 bp, Mus musculus
aggaagtagcaacatgctacctaaa

SEQ ID NO: 875282 - DNA, 25 bp, Mus musculus
aggaagtatgaagacgtggctcgta

SEQ ID NO: 875283 - DNA, 25 bp, Mus musculus
aggaagtatgaagaggtggctcgta

SEQ ID NO: 875284 - DNA, 25 bp, Mus musculus
aggaagtcagaacgctgttatcaga

SEQ ID NO: 875285 - DNA, 25 bp, Mus musculus
aggaagtcagaaggctgttatcaga

SEQ ID NO: 875286 - DNA, 25 bp, Mus musculus
aggaagtcagctagcagccacatag

SEQ ID NO: 875287 - DNA, 25 bp, Mus musculus
aggaagtcaggtagcagccacatag

SEQ ID NO: 875288 - DNA, 25 bp, Mus musculus
aggaagtgcatacgaggagcttcct

SEQ ID NO: 875289 - DNA, 25 bp, Mus musculus
aggaagtgcatacgagtggctgcta

SEQ ID NO: 875290 - DNA, 25 bp, Mus musculus
aggaagtgcataggaggagcttcct

SEQ ID NO: 875291 - DNA, 25 bp, Mus musculus
aggaagtgcataggagtggctgcta

SEQ ID NO: 875292 - DNA, 25 bp, Mus musculus
aggaagtgccaacatatagatgagt

SEQ ID NO: 875293 - DNA, 25 bp, Mus musculus
aggaagtgccaagatatagatgagt

SEQ ID NO: 875294 - DNA, 25 bp, Mus musculus
aggaagtgccagcatcacaacgaat

SEQ ID NO: 875295 - DNA, 25 bp, Mus musculus
aggaagtgccaggatcacaacgaat

SEQ ID NO: 875296 - DNA, 25 bp, Mus musculus
aggaagtgcctgcacggtccagtgc

SEQ ID NO: 875297 - DNA, 25 bp, Mus musculus
aggaagtgcctgcagggtccagtgc

SEQ ID NO: 875298 - DNA, 25 bp, Mus musculus
aggaagtgctgggacgtgtcattgc

SEQ ID NO: 875299 - DNA, 25 bp, Mus musculus
aggaagtgctgggaggtgtcattgc

SEQ ID NO: 875300 - DNA, 25 bp, Mus musculus
aggaagtggaggcactgaacttttg

SEQ ID NO: 875301 - DNA, 25 bp, Mus musculus
aggaagtggagggactgaacttttg

SEQ ID NO: 875302 - DNA, 25 bp, Mus musculus
aggaagtgggctgccgtatcagcct

SEQ ID NO: 875303 - DNA, 25 bp, Mus musculus
aggaagtgggctgcggtatcagcct

SEQ ID NO: 875304 - DNA, 25 bp, Mus musculus
aggaagtgtgtgcacatcaatgagt

SEQ ID NO: 875305 - DNA, 25 bp, Mus musculus
aggaagtgtgtggacatcaatgagt

SEQ ID NO: 875306 - DNA, 25 bp, Mus musculus
aggaagtgttacaacagacttgcag

SEQ ID NO: 875307 - DNA, 25 bp, Mus musculus
aggaagtgttacaaccagagacttg

SEQ ID NO: 875308 - DNA, 25 bp, Mus musculus
aggaagtgttacaagagacttgcag

SEQ ID NO: 875309 - DNA, 25 bp, Mus musculus
aggaagtgttacaagcagagacttg

SEQ ID NO: 875310 - DNA, 25 bp, Mus musculus
aggaataataaaaactgctctatgc

SEQ ID NO: 875311 - DNA, 25 bp, Mus musculus
aggaataataaaaagtgctctatgc

SEQ ID NO: 875312 - DNA, 25 bp, Mus musculus
aggaatagtgtgagcagcttatgat

SEQ ID NO: 875313 - DNA, 25 bp, Mus musculus
aggaatagtgtgataattggccttt

SEQ ID NO: 875314 - DNA, 25 bp, Mus musculus
aggaatagtgtgtgcagcttatgat

SEQ ID NO: 875315 - DNA, 25 bp, Mus musculus
aggaatagtgtgttaattggccttt

SEQ ID NO: 875316 - DNA, 25 bp, Mus musculus
aggaatatccagaaggtgactccaa

SEQ ID NO: 875317 - DNA, 25 bp, Mus musculus
aggaatatccagtaggtgactccaa

SEQ ID NO: 875318 - DNA, 25 bp, Mus musculus
aggaatcgactactcgaaagcctac

SEQ ID NO: 875319 - DNA, 25 bp, Mus musculus
aggaatcgactactggaaagcctac

SEQ ID NO: 875320 - DNA, 25 bp, Mus musculus
aggaatgcagcgacattcctgtgtg

SEQ ID NO: 875321 - DNA, 25 bp, Mus musculus
aggaatgcagggacattcctgtgtg

SEQ ID NO: 875322 - DNA, 25 bp, Mus musculus
aggaatggaagcctgtgacttacaa

SEQ ID NO: 875323 - DNA, 25 bp, Mus musculus
aggaatggaagcgtgtgacttacaa

SEQ ID NO: 875324 - DNA, 25 bp, Mus musculus
aggaatggactcaattggtcaaaga

SEQ ID NO: 875325 - DNA, 25 bp, Mus musculus
aggaatggactctattggtcaaaga

SEQ ID NO: 875326 - DNA, 25 bp, Mus musculus
aggaatgtggcttcctatttctaca

SEQ ID NO: 875327 - DNA, 25 bp, Mus musculus
aggaatgtgggttcctatttctaca

SEQ ID NO: 875328 - DNA, 25 bp, Mus musculus
aggaatttatgccattagttggagt

SEQ ID NO: 875329 - DNA, 25 bp, Mus musculus
aggaatttatgcgattagttggagt

SEQ ID NO: 875330 - DNA, 25 bp, Mus musculus
aggaatttcctgcccgtgaagagca

SEQ ID NO: 875331 - DNA, 25 bp, Mus musculus
aggaatttcctggccgtgaagagca

SEQ ID NO: 875332 - DNA, 25 bp, Mus musculus
aggacaaaaacccaatgccagctcc

SEQ ID NO: 875333 - DNA, 25 bp, Mus musculus
aggacaaaaacccattgccagctcc

SEQ ID NO: 875334 - DNA, 25 bp, Mus musculus
aggacaaaacagagaccaagaagaa

SEQ ID NO: 875335 - DNA, 25 bp, Mus musculus
aggacaaaacagcaatggaagccct

SEQ ID NO: 875336 - DNA, 25 bp, Mus musculus
aggacaaaacaggaatggaagccct

SEQ ID NO: 875337 - DNA, 25 bp, Mus musculus
aggacaaaacagtgaccaagaagaa

SEQ ID NO: 875338 - DNA, 25 bp, Mus musculus
aggacaaacaaccagctaagttcag

SEQ ID NO: 875339 - DNA, 25 bp, Mus musculus
aggacaaacaacgagctaagttcag

SEQ ID NO: 875340 - DNA, 25 bp, Mus musculus
aggacaaagaacaacgctccgactg

SEQ ID NO: 875341 - DNA, 25 bp, Mus musculus
aggacaaagaacaaggctccgactg

SEQ ID NO: 875342 - DNA, 25 bp, Mus musculus
aggacaagaactaagtgatgtggag

SEQ ID NO: 875343 - DNA, 25 bp, Mus musculus
aggacaagaacttagtgatgtggag

SEQ ID NO: 875344 - DNA, 25 bp, Mus musculus
aggacaagagctgcccagctgtgga

SEQ ID NO: 875345 - DNA, 25 bp, Mus musculus
aggacaagaggtgcccagctgtgga

SEQ ID NO: 875346 - DNA, 25 bp, Mus musculus
aggacaatattcaaccaatggtgat

SEQ ID NO: 875347 - DNA, 25 bp, Mus musculus
aggacaatattcaagcaatggtgat

SEQ ID NO: 875348 - DNA, 25 bp, Mus musculus
aggacaatgacccggatggcgtggg

SEQ ID NO: 875349 - DNA, 25 bp, Mus musculus
aggacaatgaccgggatggcgtggg

SEQ ID NO: 875350 - DNA, 25 bp, Mus musculus
aggacaatgcagagctgaaaggagg

SEQ ID NO: 875351 - DNA, 25 bp, Mus musculus
aggacaatgcagcttcacttggttc

SEQ ID NO: 875352 - DNA, 25 bp, Mus musculus
aggacaatgcaggttcacttggttc

SEQ ID NO: 875353 - DNA, 25 bp, Mus musculus
aggacaatgcagtgctgaaaggagg

SEQ ID NO: 875354 - DNA, 25 bp, Mus musculus
aggacacaagcgtgaagagggtgac

SEQ ID NO: 875355 - DNA, 25 bp, Mus musculus
aggacacaagggtgaagagggtgac

SEQ ID NO: 875356 - DNA, 25 bp, Mus musculus
aggacacactagccctcggaaagac

SEQ ID NO: 875357 - DNA, 25 bp, Mus musculus
aggacacactaggcctcggaaagac

SEQ ID NO: 875358 - DNA, 25 bp, Mus musculus
aggacacagcgacaattggacaaat

SEQ ID NO: 875359 - DNA, 25 bp, Mus musculus
aggacacagcgagaattggacaaat

SEQ ID NO: 875360 - DNA, 25 bp, Mus musculus
aggacaccatgaaacgtctatcatg

SEQ ID NO: 875361 - DNA, 25 bp, Mus musculus
aggacaccatgaaaggtctatcatg

SEQ ID NO: 875362 - DNA, 25 bp, Mus musculus
aggacacccaagcatgtgaatgagt

SEQ ID NO: 875363 - DNA, 25 bp, Mus musculus
aggacacccaaggatgtgaatgagt

SEQ ID NO: 875364 - DNA, 25 bp, Mus musculus
aggacagaagaagagaactccaact

SEQ ID NO: 875365 - DNA, 25 bp, Mus musculus
aggacagaagcgaccttagaagatt

SEQ ID NO: 875366 - DNA, 25 bp, Mus musculus
aggacagaagggaccttagaagatt

SEQ ID NO: 875367 - DNA, 25 bp, Mus musculus
aggacagaagtagagaactccaact

SEQ ID NO: 875368 - DNA, 25 bp, Mus musculus
aggacagagggtcacagagatggca

SEQ ID NO: 875369 - DNA, 25 bp, Mus musculus
aggacagagggtcacttccaggaag

SEQ ID NO: 875370 - DNA, 25 bp, Mus musculus
aggacagagggtcagagagatggca

SEQ ID NO: 875371 - DNA, 25 bp, Mus musculus
aggacagagggtcagttccaggaag

SEQ ID NO: 875372 - DNA, 25 bp, Mus musculus
aggacagattgctcagccatcacct

SEQ ID NO: 875373 - DNA, 25 bp, Mus musculus
aggacagattgctctgccatcacct

SEQ ID NO: 875374 - DNA, 25 bp, Mus musculus
aggacagcaatgccatgcgccccct

SEQ ID NO: 875375 - DNA, 25 bp, Mus musculus
aggacagcaatggcatgcgccccct

SEQ ID NO: 875376 - DNA, 25 bp, Mus musculus
aggacagcagcaaagatggtccaga

SEQ ID NO: 875377 - DNA, 25 bp, Mus musculus
aggacagcagcaggaaagatggtcc

SEQ ID NO: 875378 - DNA, 25 bp, Mus musculus
aggacagcagcgaaggtgtgaacct

SEQ ID NO: 875379 - DNA, 25 bp, Mus musculus
aggacagcagctgtgaacctgaggc

SEQ ID NO: 875380 - DNA, 25 bp, Mus musculus
aggacagcaggaaagatggtccaga

SEQ ID NO: 875381 - DNA, 25 bp, Mus musculus
aggacagcaggaggaaagatggtcc

SEQ ID NO: 875382 - DNA, 25 bp, Mus musculus
aggacagcagggaaggtgtgaacct

SEQ ID NO: 875383 - DNA, 25 bp, Mus musculus
aggacagcaggtgtgaacctgaggc

SEQ ID NO: 875384 - DNA, 25 bp, Mus musculus
aggacagcagtgcacgtgccaacag

SEQ ID NO: 875385 - DNA, 25 bp, Mus musculus
aggacagcagtgcaggtgccaacag

SEQ ID NO: 875386 - DNA, 25 bp, Mus musculus
aggacaggcagtcgtccagagtcca

SEQ ID NO: 875387 - DNA, 25 bp, Mus musculus
aggacaggcagtggtccagagtcca

SEQ ID NO: 875388 - DNA, 25 bp, Mus musculus
aggacagtgacaccatcacggctgc

SEQ ID NO: 875389 - DNA, 25 bp, Mus musculus
aggacagtgacagcatcacggctgc

SEQ ID NO: 875390 - DNA, 25 bp, Mus musculus
aggacatagaagatgccttgtattc

SEQ ID NO: 875391 - DNA, 25 bp, Mus musculus
aggacatagaagttgccttgtattc

SEQ ID NO: 875392 - DNA, 25 bp, Mus musculus
aggacatatccaaacggctacaaac

SEQ ID NO: 875393 - DNA, 25 bp, Mus musculus
aggacatatccaaagggctacaaac

SEQ ID NO: 875394 - DNA, 25 bp, Mus musculus
aggacatccagctacattacaaaaa

SEQ ID NO: 875395 - DNA, 25 bp, Mus musculus
aggacatccagctagattacaaaaa

SEQ ID NO: 875396 - DNA, 25 bp, Mus musculus
aggacatccattcaaggcctacttg

SEQ ID NO: 875397 - DNA, 25 bp, Mus musculus
aggacatccattcatggcctacttg

SEQ ID NO: 875398 - DNA, 25 bp, Mus musculus
aggacatgatagacggcttgaagcc

SEQ ID NO: 875399 - DNA, 25 bp, Mus musculus
aggacatgatagtcggcttgaagcc

SEQ ID NO: 875400 - DNA, 25 bp, Mus musculus
aggacatgggactacgatgatgtct

SEQ ID NO: 875401 - DNA, 25 bp, Mus musculus
aggacatgggactaggatgatgtct

SEQ ID NO: 875402 - DNA, 25 bp, Mus musculus
aggacattagattgatcagggacca

SEQ ID NO: 875403 - DNA, 25 bp, Mus musculus
aggacattagtttgatcagggacca

SEQ ID NO: 875404 - DNA, 25 bp, Mus musculus
aggacatttgaacgtatcgccgggc

SEQ ID NO: 875405 - DNA, 25 bp, Mus musculus
aggacatttgaaggtatcgccgggc

SEQ ID NO: 875406 - DNA, 25 bp, Mus musculus
aggacatttgagaacggccacatcc

SEQ ID NO: 875407 - DNA, 25 bp, Mus musculus
aggacatttgagaagggccacatcc

SEQ ID NO: 875408 - DNA, 25 bp, Mus musculus
aggaccaaaatcacctggatgaaag

SEQ ID NO: 875409 - DNA, 25 bp, Mus musculus
aggaccaaaatcacgtggatgaaag

SEQ ID NO: 875410 - DNA, 25 bp, Mus musculus
aggaccaataagcaggtccccagca

SEQ ID NO: 875411 - DNA, 25 bp, Mus musculus
aggaccaataaggaggtccccagca

SEQ ID NO: 875412 - DNA, 25 bp, Mus musculus
aggaccacagaactacagctgaatc

SEQ ID NO: 875413 - DNA, 25 bp, Mus musculus
aggaccacagatatatatcttcagg

SEQ ID NO: 875414 - DNA, 25 bp, Mus musculus
aggaccacagtactacagctgaatc

SEQ ID NO: 875415 - DNA, 25 bp, Mus musculus
aggaccacagttatatatcttcagg

SEQ ID NO: 875416 - DNA, 25 bp, Mus musculus
aggaccactcagaacaacctactca

SEQ ID NO: 875417 - DNA, 25 bp, Mus musculus
aggaccactcagtacaacctactca

SEQ ID NO: 875418 - DNA, 25 bp, Mus musculus
aggaccactccccatgcaactccag

SEQ ID NO: 875419 - DNA, 25 bp, Mus musculus
aggaccactccccgaagatgcaact

SEQ ID NO: 875420 - DNA, 25 bp, Mus musculus
aggaccactcccgatgcaactccag

SEQ ID NO: 875421 - DNA, 25 bp, Mus musculus
aggaccactcccggaagatgcaact

SEQ ID NO: 875422 - DNA, 25 bp, Mus musculus
aggaccagcctttacaggacgcctt

SEQ ID NO: 875423 - DNA, 25 bp, Mus musculus
aggaccagcctttagaggacgcctt

SEQ ID NO: 875424 - DNA, 25 bp, Mus musculus
aggaccagcgagattcataggaccc

SEQ ID NO: 875425 - DNA, 25 bp, Mus musculus
aggaccagcgagtttcataggaccc

SEQ ID NO: 875426 - DNA, 25 bp, Mus musculus
aggaccaggcacccagagttttgct

SEQ ID NO: 875427 - DNA, 25 bp, Mus musculus
aggaccaggcaccctgagttttgct

SEQ ID NO: 875428 - DNA, 25 bp, Mus musculus
aggaccaggcagaacacctatggcg

SEQ ID NO: 875429 - DNA, 25 bp, Mus musculus
aggaccaggcagcagtacctggagt

SEQ ID NO: 875430 - DNA, 25 bp, Mus musculus
aggaccaggcaggagtacctggagt

SEQ ID NO: 875431 - DNA, 25 bp, Mus musculus
aggaccaggcagtacacctatggcg

SEQ ID NO: 875432 - DNA, 25 bp, Mus musculus
aggaccagttcacctcctcagcaag

SEQ ID NO: 875433 - DNA, 25 bp, Mus musculus
aggaccagttcagctcctcagcaag

SEQ ID NO: 875434 - DNA, 25 bp, Mus musculus
aggaccatcactaccagtttttgga

SEQ ID NO: 875435 - DNA, 25 bp, Mus musculus
aggaccatcagtaccagtttttgga

SEQ ID NO: 875436 - DNA, 25 bp, Mus musculus
aggaccattcaagccattatttgaa

SEQ ID NO: 875437 - DNA, 25 bp, Mus musculus
aggaccattcaagcgattatttgaa

SEQ ID NO: 875438 - DNA, 25 bp, Mus musculus
aggacccaagcgagagccaggtgct

SEQ ID NO: 875439 - DNA, 25 bp, Mus musculus
aggacccaagggagagccaggtgct

SEQ ID NO: 875440 - DNA, 25 bp, Mus musculus
aggacccacacgtgactcagggcct

SEQ ID NO: 875441 - DNA, 25 bp, Mus musculus
aggacccacaggtgactcagggcct

SEQ ID NO: 875442 - DNA, 25 bp, Mus musculus
aggacccagagaaaactgtcctgac

SEQ ID NO: 875443 - DNA, 25 bp, Mus musculus
aggacccagagataactgtcctgac

SEQ ID NO: 875444 - DNA, 25 bp, Mus musculus
aggacccagtcgaacaattggattt

SEQ ID NO: 875445 - DNA, 25 bp, Mus musculus
aggacccagtggaacaattggattt

SEQ ID NO: 875446 - DNA, 25 bp, Mus musculus
aggaccccagcaccttgccacactg

SEQ ID NO: 875447 - DNA, 25 bp, Mus musculus
aggaccccagctctgtcagcatccc

SEQ ID NO: 875448 - DNA, 25 bp, Mus musculus
aggaccccaggaccttgccacactg

SEQ ID NO: 875449 - DNA, 25 bp, Mus musculus
aggaccccaggtctgtcagcatccc

SEQ ID NO: 875450 - DNA, 25 bp, Mus musculus
aggaccccgaagcacaggatgaagg

SEQ ID NO: 875451 - DNA, 25 bp, Mus musculus
aggaccccgaagcagaggatgaagg

SEQ ID NO: 875452 - DNA, 25 bp, Mus musculus
aggacccgcgagatgctgaggatgc

SEQ ID NO: 875453 - DNA, 25 bp, Mus musculus
aggacccgcgtgatgctgaggatgc

SEQ ID NO: 875454 - DNA, 25 bp, Mus musculus
aggaccctgaacaacgtggcaatga

SEQ ID NO: 875455 - DNA, 25 bp, Mus musculus
aggaccctgaacaaggtggcaatga

SEQ ID NO: 875456 - DNA, 25 bp, Mus musculus
aggaccctggctcacctcagcatgg

SEQ ID NO: 875457 - DNA, 25 bp, Mus musculus
aggaccctggctgacctcagcatgg

SEQ ID NO: 875458 - DNA, 25 bp, Mus musculus
aggaccctttctttcatatgcacat

SEQ ID NO: 875459 - DNA, 25 bp, Mus musculus
aggaccctttctttgatatgcacat

SEQ ID NO: 875460 - DNA, 25 bp, Mus musculus
aggaccgagacacctccttccgctt

SEQ ID NO: 875461 - DNA, 25 bp, Mus musculus
aggaccgagacagctccttccgctt

SEQ ID NO: 875462 - DNA, 25 bp, Mus musculus
aggaccgaggattgaagtgagtgaa

SEQ ID NO: 875463 - DNA, 25 bp, Mus musculus
aggaccgaggtttgaagtgagtgaa

SEQ ID NO: 875464 - DNA, 25 bp, Mus musculus
aggaccgtacacagatcgccatctg

SEQ ID NO: 875465 - DNA, 25 bp, Mus musculus
aggaccgtacactgatcgccatctg

SEQ ID NO: 875466 - DNA, 25 bp, Mus musculus
aggacctccaagccaagatcacttc

SEQ ID NO: 875467 - DNA, 25 bp, Mus musculus
aggacctccaaggcaagatcacttc

SEQ ID NO: 875468 - DNA, 25 bp, Mus musculus
aggacctccacgacctcagggtctg

SEQ ID NO: 875469 - DNA, 25 bp, Mus musculus
aggacctccaggacctcagggtctg

SEQ ID NO: 875470 - DNA, 25 bp, Mus musculus
aggacctgccaaaacttgtggagct

SEQ ID NO: 875471 - DNA, 25 bp, Mus musculus
aggacctgccaaaagttgtggagct

SEQ ID NO: 875472 - DNA, 25 bp, Mus musculus
aggacctgtgtgcatattgatgaat

SEQ ID NO: 875473 - DNA, 25 bp, Mus musculus
aggacctgtgtggatattgatgaat

SEQ ID NO: 875474 - DNA, 25 bp, Mus musculus
aggacctttgatcaattctgagttc

SEQ ID NO: 875475 - DNA, 25 bp, Mus musculus
aggacctttgttcaattctgagttc

SEQ ID NO: 875476 - DNA, 25 bp, Mus musculus
aggacgaaacaaaactggtccatgc

SEQ ID NO: 875477 - DNA, 25 bp, Mus musculus
aggacgaaacaaaagtggtccatgc

SEQ ID NO: 875478 - DNA, 25 bp, Mus musculus
aggacgaccagacgagctgtctgaa

SEQ ID NO: 875479 - DNA, 25 bp, Mus musculus
aggacgaccagaggagctgtctgaa

SEQ ID NO: 875480 - DNA, 25 bp, Mus musculus
aggacgacccagctattctcataca

SEQ ID NO: 875481 - DNA, 25 bp, Mus musculus
aggacgacccaggtattctcataca

SEQ ID NO: 875482 - DNA, 25 bp, Mus musculus
aggacgagacaacatcccattagct

SEQ ID NO: 875483 - DNA, 25 bp, Mus musculus
aggacgagacaagatcccattagct

SEQ ID NO: 875484 - DNA, 25 bp, Mus musculus
aggacgagagctctatttcagtgct

SEQ ID NO: 875485 - DNA, 25 bp, Mus musculus
aggacgagagctctggtgcaagtgt

SEQ ID NO: 875486 - DNA, 25 bp, Mus musculus
aggacgagaggtctatttcagtgct

SEQ ID NO: 875487 - DNA, 25 bp, Mus musculus
aggacgagaggtctggtgcaagtgt

SEQ ID NO: 875488 - DNA, 25 bp, Mus musculus
aggacgagatgtccacaaaggtagt

SEQ ID NO: 875489 - DNA, 25 bp, Mus musculus
aggacgagatgtgcacaaaggtagt

SEQ ID NO: 875490 - DNA, 25 bp, Mus musculus
aggacgatgatgccttgtggaggct

SEQ ID NO: 875491 - DNA, 25 bp, Mus musculus
aggacgatgatggcttgtggaggct

SEQ ID NO: 875492 - DNA, 25 bp, Mus musculus
aggacgatttggcgctcatcacaag

SEQ ID NO: 875493 - DNA, 25 bp, Mus musculus
aggacgatttggctgtcctgctccc

SEQ ID NO: 875494 - DNA, 25 bp, Mus musculus
aggacgatttggggctcatcacaag

SEQ ID NO: 875495 - DNA, 25 bp, Mus musculus
aggacgatttgggtgtcctgctccc

SEQ ID NO: 875496 - DNA, 25 bp, Mus musculus
aggacgcagccagacagggaaactg

SEQ ID NO: 875497 - DNA, 25 bp, Mus musculus
aggacgcagccagaccttgtccagg

SEQ ID NO: 875498 - DNA, 25 bp, Mus musculus
aggacgcagccagagagggaaactg

SEQ ID NO: 875499 - DNA, 25 bp, Mus musculus
aggacgcagccagagcttgtccagg

SEQ ID NO: 875500 - DNA, 25 bp, Mus musculus
aggacgcagtccatccagggttcca

SEQ ID NO: 875501 - DNA, 25 bp, Mus musculus
aggacgcagtccatgcagggttcca

SEQ ID NO: 875502 - DNA, 25 bp, Mus musculus
aggacgcccaggcccgtcccggatg

SEQ ID NO: 875503 - DNA, 25 bp, Mus musculus
aggacgcccaggccggtcccggatg

SEQ ID NO: 875504 - DNA, 25 bp, Mus musculus
aggacgccccagctggaagtccgta

SEQ ID NO: 875505 - DNA, 25 bp, Mus musculus
aggacgccccaggtggaagtccgta

SEQ ID NO: 875506 - DNA, 25 bp, Mus musculus
aggacgcgatagatctgacacaaca

SEQ ID NO: 875507 - DNA, 25 bp, Mus musculus
aggacgcgatagttctgacacaaca

SEQ ID NO: 875508 - DNA, 25 bp, Mus musculus
aggacgcgtgtgtgcagttcacctt

SEQ ID NO: 875509 - DNA, 25 bp, Mus musculus
aggacgcgtgtgtggagttcacctt

SEQ ID NO: 875510 - DNA, 25 bp, Mus musculus
aggacgctgccgcccatcgtcgttc

SEQ ID NO: 875511 - DNA, 25 bp, Mus musculus
aggacgctgccgcgtctcttccact

SEQ ID NO: 875512 - DNA, 25 bp, Mus musculus
aggacgctgccggccatcgtcgttc

SEQ ID NO: 875513 - DNA, 25 bp, Mus musculus
aggacgctgccgggtctcttccact

SEQ ID NO: 875514 - DNA, 25 bp, Mus musculus
aggacgctggactgccatcaaagga

SEQ ID NO: 875515 - DNA, 25 bp, Mus musculus
aggacgctggtctgccatcaaagga

SEQ ID NO: 875516 - DNA, 25 bp, Mus musculus
aggacggaaaccgaatggacccgct

SEQ ID NO: 875517 - DNA, 25 bp, Mus musculus
aggacggaaagcgaatggacccgct

SEQ ID NO: 875518 - DNA, 25 bp, Mus musculus
aggacggagactgacgatgaggctg

SEQ ID NO: 875519 - DNA, 25 bp, Mus musculus
aggacggagactgaggatgaggctg

SEQ ID NO: 875520 - DNA, 25 bp, Mus musculus
aggacggagcatcgttggagcctct

SEQ ID NO: 875521 - DNA, 25 bp, Mus musculus
aggacggagcatggttggagcctct

SEQ ID NO: 875522 - DNA, 25 bp, Mus musculus
aggacggcaagtgtctaccgtgtgc

SEQ ID NO: 875523 - DNA, 25 bp, Mus musculus
aggacggcaagtgtgtaccgtgtgc

SEQ ID NO: 875524 - DNA, 25 bp, Mus musculus
aggacggcatgtaccctaacttggg

SEQ ID NO: 875525 - DNA, 25 bp, Mus musculus
aggacggcatgtacgctaacttggg

SEQ ID NO: 875526 - DNA, 25 bp, Mus musculus
aggacggtcctaccctcagcgttct

SEQ ID NO: 875527 - DNA, 25 bp, Mus musculus
aggacggtcctagcctcagcgttct

SEQ ID NO: 875528 - DNA, 25 bp, Mus musculus
aggacgtcagacacagcgttcacac

SEQ ID NO: 875529 - DNA, 25 bp, Mus musculus
aggacgtcagtcacagcgttcacac

SEQ ID NO: 875530 - DNA, 25 bp, Mus musculus
aggacgtgccaaccccagcactatg

SEQ ID NO: 875531 - DNA, 25 bp, Mus musculus
aggacgtgccaagcccagcactatg

SEQ ID NO: 875532 - DNA, 25 bp, Mus musculus
aggacgtgtcgccacgtcagccatg

SEQ ID NO: 875533 - DNA, 25 bp, Mus musculus
aggacgtgtcgccactgtggaaggg

SEQ ID NO: 875534 - DNA, 25 bp, Mus musculus
aggacgtgtcgccaggtcagccatg

SEQ ID NO: 875535 - DNA, 25 bp, Mus musculus
aggacgtgtcgccagtgtggaaggg

SEQ ID NO: 875536 - DNA, 25 bp, Mus musculus
aggactaacaagacagaggtcacaa

SEQ ID NO: 875537 - DNA, 25 bp, Mus musculus
aggactaacaagtcagaggtcacaa

SEQ ID NO: 875538 - DNA, 25 bp, Mus musculus
aggactacaaggaatatgggtatgt

SEQ ID NO: 875539 - DNA, 25 bp, Mus musculus
aggactacaaggtatatgggtatgt

SEQ ID NO: 875540 - DNA, 25 bp, Mus musculus
aggactacatctctccaaacatttg

SEQ ID NO: 875541 - DNA, 25 bp, Mus musculus
aggactacatctgtccaaacatttg

SEQ ID NO: 875542 - DNA, 25 bp, Mus musculus
aggactagattttaccaggtcaatg

SEQ ID NO: 875543 - DNA, 25 bp, Mus musculus
aggactagattttagcaggtcaatg

SEQ ID NO: 875544 - DNA, 25 bp, Mus musculus
aggactatgacactgataagcggtt

SEQ ID NO: 875545 - DNA, 25 bp, Mus musculus
aggactatgacagtgataagcggtt

SEQ ID NO: 875546 - DNA, 25 bp, Mus musculus
aggactatgccgataatatcaaagc

SEQ ID NO: 875547 - DNA, 25 bp, Mus musculus
aggactatgccgattatatcaaagc

SEQ ID NO: 875548 - DNA, 25 bp, Mus musculus
aggactccagccatgtcatgttacc

SEQ ID NO: 875549 - DNA, 25 bp, Mus musculus
aggactccaggcatgtcatgttacc

SEQ ID NO: 875550 - DNA, 25 bp, Mus musculus
aggactccatttacaacttcagggt

SEQ ID NO: 875551 - DNA, 25 bp, Mus musculus
aggactccattttcaacttcagggt

SEQ ID NO: 875552 - DNA, 25 bp, Mus musculus
aggactcgctctacctgtttgcagc

SEQ ID NO: 875553 - DNA, 25 bp, Mus musculus
aggactcgctgtacctgtttgcagc

SEQ ID NO: 875554 - DNA, 25 bp, Mus musculus
aggactctcagagcagtggcagctc

SEQ ID NO: 875555 - DNA, 25 bp, Mus musculus
aggactctcagagctgtggcagctc

SEQ ID NO: 875556 - DNA, 25 bp, Mus musculus
aggactctgaagaacgtggcctttc

SEQ ID NO: 875557 - DNA, 25 bp, Mus musculus
aggactctgaagaaggtggcctttc

SEQ ID NO: 875558 - DNA, 25 bp, Mus musculus
aggactctgatgctgatggccgagg

SEQ ID NO: 875559 - DNA, 25 bp, Mus musculus
aggactctgatggtgatggccgagg

SEQ ID NO: 875560 - DNA, 25 bp, Mus musculus
aggactcttgcaactattctcatca

SEQ ID NO: 875561 - DNA, 25 bp, Mus musculus
aggactcttggaactattctcatca

SEQ ID NO: 875562 - DNA, 25 bp, Mus musculus
aggactgaagcgagtggaaaatgtg

SEQ ID NO: 875563 - DNA, 25 bp, Mus musculus
aggactgaagggagtggaaaatgtg

SEQ ID NO: 875564 - DNA, 25 bp, Mus musculus
aggactgaggcagaaggatgacatc

SEQ ID NO: 875565 - DNA, 25 bp, Mus musculus
aggactgagggagaaggatgacatc

SEQ ID NO: 875566 - DNA, 25 bp, Mus musculus
aggactgatttaagccttttgccta

SEQ ID NO: 875567 - DNA, 25 bp, Mus musculus
aggactgatttaagcgcagcaggga

SEQ ID NO: 875568 - DNA, 25 bp, Mus musculus
aggactgatttaaggcttttgccta

SEQ ID NO: 875569 - DNA, 25 bp, Mus musculus
aggactgatttaagggcagcaggga

SEQ ID NO: 875570 - DNA, 25 bp, Mus musculus
aggactgcaacctaccttgcaaccc

SEQ ID NO: 875571 - DNA, 25 bp, Mus musculus
aggactgcaacctgccctgcaaccc

SEQ ID NO: 875572 - DNA, 25 bp, Mus musculus
aggactgcaagctaccttgcaaccc

SEQ ID NO: 875573 - DNA, 25 bp, Mus musculus
aggactgcaagctgccctgcaaccc

SEQ ID NO: 875574 - DNA, 25 bp, Mus musculus
aggactgcacacaaacctgtaacta

SEQ ID NO: 875575 - DNA, 25 bp, Mus musculus
aggactgcacactaacctgtaacta

SEQ ID NO: 875576 - DNA, 25 bp, Mus musculus
aggactgccatgcactgagctgctg

SEQ ID NO: 875577 - DNA, 25 bp, Mus musculus
aggactgccatgcagtgagctgctg

SEQ ID NO: 875578 - DNA, 25 bp, Mus musculus
aggactgcccaattcatggatgcct

SEQ ID NO: 875579 - DNA, 25 bp, Mus musculus
aggactgcccaattgatggatgcct

SEQ ID NO: 875580 - DNA, 25 bp, Mus musculus
aggactgtggcacacagaaatgctt

SEQ ID NO: 875581 - DNA, 25 bp, Mus musculus
aggactgtggcacagagaaatgctt

SEQ ID NO: 875582 - DNA, 25 bp, Mus musculus
aggactgtgtggagatgaacgggtg

SEQ ID NO: 875583 - DNA, 25 bp, Mus musculus
aggactgtgtggtgatgaacgggtg

SEQ ID NO: 875584 - DNA, 25 bp, Mus musculus
aggacttaataactctgtctggctg

SEQ ID NO: 875585 - DNA, 25 bp, Mus musculus
aggacttaataagtctgtctggctg

SEQ ID NO: 875586 - DNA, 25 bp, Mus musculus
aggacttaggagaacagagactcag

SEQ ID NO: 875587 - DNA, 25 bp, Mus musculus
aggacttaggagtacagagactcag

SEQ ID NO: 875588 - DNA, 25 bp, Mus musculus
aggacttcactgcaccttcaggcaa

SEQ ID NO: 875589 - DNA, 25 bp, Mus musculus
aggacttcactggaccttcaggcaa

SEQ ID NO: 875590 - DNA, 25 bp, Mus musculus
aggacttgcattcatgtgaacgaat

SEQ ID NO: 875591 - DNA, 25 bp, Mus musculus
aggacttgcattgatgtgaacgaat

SEQ ID NO: 875592 - DNA, 25 bp, Mus musculus
aggacttgctccaacggccccgccg

SEQ ID NO: 875593 - DNA, 25 bp, Mus musculus
aggacttgctccaagggccccgccg

SEQ ID NO: 875594 - DNA, 25 bp, Mus musculus
aggacttttatacacgactgacaga

SEQ ID NO: 875595 - DNA, 25 bp, Mus musculus
aggacttttatacaggactgacaga

SEQ ID NO: 875596 - DNA, 25 bp, Mus musculus
aggagaaaggctcgagctggaacct

SEQ ID NO: 875597 - DNA, 25 bp, Mus musculus
aggagaaaggctcggtgaagaccct

SEQ ID NO: 875598 - DNA, 25 bp, Mus musculus
aggagaaaggctggagctggaacct

SEQ ID NO: 875599 - DNA, 25 bp, Mus musculus
aggagaaaggctgggtgaagaccct

SEQ ID NO: 875600 - DNA, 25 bp, Mus musculus
aggagaaagtgacgacttttgctgc

SEQ ID NO: 875601 - DNA, 25 bp, Mus musculus
aggagaaagtgaggacttttgctgc

SEQ ID NO: 875602 - DNA, 25 bp, Mus musculus
aggagaacagatggcctcctacttc

SEQ ID NO: 875603 - DNA, 25 bp, Mus musculus
aggagaacagttggcctcctacttc

SEQ ID NO: 875604 - DNA, 25 bp, Mus musculus
aggagaacattgcacggccgtgcag

SEQ ID NO: 875605 - DNA, 25 bp, Mus musculus
aggagaacattgcacgtaaagatga

SEQ ID NO: 875606 - DNA, 25 bp, Mus musculus
aggagaacattgcagggccgtgcag

SEQ ID NO: 875607 - DNA, 25 bp, Mus musculus
aggagaacattgcaggtaaagatga

SEQ ID NO: 875608 - DNA, 25 bp, Mus musculus
aggagaactgcaagctcgagggaaa

SEQ ID NO: 875609 - DNA, 25 bp, Mus musculus
aggagaactgcacgcatcagaaggg

SEQ ID NO: 875610 - DNA, 25 bp, Mus musculus
aggagaactgcacgttctcccatgg

SEQ ID NO: 875611 - DNA, 25 bp, Mus musculus
aggagaactgcaggcatcagaaggg

SEQ ID NO: 875612 - DNA, 25 bp, Mus musculus
aggagaactgcaggttctcccatgg

SEQ ID NO: 875613 - DNA, 25 bp, Mus musculus
aggagaactgcatgctcgagggaaa

SEQ ID NO: 875614 - DNA, 25 bp, Mus musculus
aggagaagagccccagtcacgcggt

SEQ ID NO: 875615 - DNA, 25 bp, Mus musculus
aggagaagagcccctgtcacgcggt

SEQ ID NO: 875616 - DNA, 25 bp, Mus musculus
aggagaagatcacaagagggaagta

SEQ ID NO: 875617 - DNA, 25 bp, Mus musculus
aggagaagatcgtggatcgcactcg

SEQ ID NO: 875618 - DNA, 25 bp, Mus musculus
aggagaagatgacaagagggaagta

SEQ ID NO: 875619 - DNA, 25 bp, Mus musculus
aggagaagatggtggatcgcactcg

SEQ ID NO: 875620 - DNA, 25 bp, Mus musculus
aggagaagcagcagaaggaaggctt

SEQ ID NO: 875621 - DNA, 25 bp, Mus musculus
aggagaagcagcagtaggaaggctt

SEQ ID NO: 875622 - DNA, 25 bp, Mus musculus
aggagaaggagacacaggccattct

SEQ ID NO: 875623 - DNA, 25 bp, Mus musculus
aggagaaggagacagaggccattct

SEQ ID NO: 875624 - DNA, 25 bp, Mus musculus
aggagaaggccacgggccgctttgg

SEQ ID NO: 875625 - DNA, 25 bp, Mus musculus
aggagaaggccaggggccgctttgg

SEQ ID NO: 875626 - DNA, 25 bp, Mus musculus
aggagaagtgctgcatggatgtttt

SEQ ID NO: 875627 - DNA, 25 bp, Mus musculus
aggagaagtgctggcctgcttgatt

SEQ ID NO: 875628 - DNA, 25 bp, Mus musculus
aggagaagtggtgcatggatgtttt

SEQ ID NO: 875629 - DNA, 25 bp, Mus musculus
aggagaagtggtggcctgcttgatt

SEQ ID NO: 875630 - DNA, 25 bp, Mus musculus
aggagaatgactcgtgggtgtgcaa

SEQ ID NO: 875631 - DNA, 25 bp, Mus musculus
aggagaatgactggtgggtgtgcaa

SEQ ID NO: 875632 - DNA, 25 bp, Mus musculus
aggagacaagaacttcatcactgct

SEQ ID NO: 875633 - DNA, 25 bp, Mus musculus
aggagacaagtacttcatcactgct

SEQ ID NO: 875634 - DNA, 25 bp, Mus musculus
aggagacacgcgcttgccaggtgta

SEQ ID NO: 875635 - DNA, 25 bp, Mus musculus
aggagacacgggcttgccaggtgta

SEQ ID NO: 875636 - DNA, 25 bp, Mus musculus
aggagacagagacatttgtgtcaga

SEQ ID NO: 875637 - DNA, 25 bp, Mus musculus
aggagacagagagatttgtgtcaga

SEQ ID NO: 875638 - DNA, 25 bp, Mus musculus
aggagacaggcgtgtaccaggcatc

SEQ ID NO: 875639 - DNA, 25 bp, Mus musculus
aggagacaggcgtgtatttggtgaa

SEQ ID NO: 875640 - DNA, 25 bp, Mus musculus
aggagacaggggtgtaccaggcatc

SEQ ID NO: 875641 - DNA, 25 bp, Mus musculus
aggagacaggggtgtatttggtgaa

SEQ ID NO: 875642 - DNA, 25 bp, Mus musculus
aggagacatgcgggagcctggtctg

SEQ ID NO: 875643 - DNA, 25 bp, Mus musculus
aggagacatgggggagcctggtctg

SEQ ID NO: 875644 - DNA, 25 bp, Mus musculus
aggagaccagaaggactccatgaaa

SEQ ID NO: 875645 - DNA, 25 bp, Mus musculus
aggagaccagcagtcgcatcttctg

SEQ ID NO: 875646 - DNA, 25 bp, Mus musculus
aggagaccagcagtggcatcttctg

SEQ ID NO: 875647 - DNA, 25 bp, Mus musculus
aggagaccagcgagagaaatacatc

SEQ ID NO: 875648 - DNA, 25 bp, Mus musculus
aggagaccagcgcctattttctgga

SEQ ID NO: 875649 - DNA, 25 bp, Mus musculus
aggagaccagggagagaaatacatc

SEQ ID NO: 875650 - DNA, 25 bp, Mus musculus
aggagaccagggcctattttctgga

SEQ ID NO: 875651 - DNA, 25 bp, Mus musculus
aggagaccagtaggactccatgaaa

SEQ ID NO: 875652 - DNA, 25 bp, Mus musculus
aggagacccgagccccaggagacaa

SEQ ID NO: 875653 - DNA, 25 bp, Mus musculus
aggagacccgaggcccaggagacaa

SEQ ID NO: 875654 - DNA, 25 bp, Mus musculus
aggagacctggtcggtgtgaacaaa

SEQ ID NO: 875655 - DNA, 25 bp, Mus musculus
aggagacctggtgggtgtgaacaaa

SEQ ID NO: 875656 - DNA, 25 bp, Mus musculus
aggagacgaaacagcttggattctg

SEQ ID NO: 875657 - DNA, 25 bp, Mus musculus
aggagacgaaactgcttggattctg

SEQ ID NO: 875658 - DNA, 25 bp, Mus musculus
aggagagaaaagcgagctgtgattg

SEQ ID NO: 875659 - DNA, 25 bp, Mus musculus
aggagagaaaagggagctgtgattg

SEQ ID NO: 875660 - DNA, 25 bp, Mus musculus
aggagagaagcgcgctgctggcgct

SEQ ID NO: 875661 - DNA, 25 bp, Mus musculus
aggagagaagggcgctgctggcgct

SEQ ID NO: 875662 - DNA, 25 bp, Mus musculus
aggagagaatatcacctgcaagaaa

SEQ ID NO: 875663 - DNA, 25 bp, Mus musculus
aggagagaatatcagctgcaagaaa

SEQ ID NO: 875664 - DNA, 25 bp, Mus musculus
aggagagaccagaacattcgtaaga

SEQ ID NO: 875665 - DNA, 25 bp, Mus musculus
aggagagaccagaagattcgtaaga

SEQ ID NO: 875666 - DNA, 25 bp, Mus musculus
aggagagagccaacattgacatgta

SEQ ID NO: 875667 - DNA, 25 bp, Mus musculus
aggagagagccatcattgacatgta

SEQ ID NO: 875668 - DNA, 25 bp, Mus musculus
aggagagaggcgagaaaggggagag

SEQ ID NO: 875669 - DNA, 25 bp, Mus musculus
aggagagaggggagaaaggggagag

SEQ ID NO: 875670 - DNA, 25 bp, Mus musculus
aggagagcaacttcccacatgccac

SEQ ID NO: 875671 - DNA, 25 bp, Mus musculus
aggagagcaagttcccacatgccac

SEQ ID NO: 875672 - DNA, 25 bp, Mus musculus
aggagagcacagcattaagttgtca

SEQ ID NO: 875673 - DNA, 25 bp, Mus musculus
aggagagcacaggattaagttgtca

SEQ ID NO: 875674 - DNA, 25 bp, Mus musculus
aggagagcagcaaatgtggtctatg

SEQ ID NO: 875675 - DNA, 25 bp, Mus musculus
aggagagcagcgacgaccaggacct

SEQ ID NO: 875676 - DNA, 25 bp, Mus musculus
aggagagcagcgcgcacctggattg

SEQ ID NO: 875677 - DNA, 25 bp, Mus musculus
aggagagcagctcggcagctctgct

SEQ ID NO: 875678 - DNA, 25 bp, Mus musculus
aggagagcaggaaatgtggtctatg

SEQ ID NO: 875679 - DNA, 25 bp, Mus musculus
aggagagcagggacgaccaggacct

SEQ ID NO: 875680 - DNA, 25 bp, Mus musculus
aggagagcagggcgcacctggattg

SEQ ID NO: 875681 - DNA, 25 bp, Mus musculus
aggagagcaggtcggcagctctgct

SEQ ID NO: 875682 - DNA, 25 bp, Mus musculus
aggagagccaacagatgaagaaaca

SEQ ID NO: 875683 - DNA, 25 bp, Mus musculus
aggagagccaacagttgaagaaaca

SEQ ID NO: 875684 - DNA, 25 bp, Mus musculus
aggagagccgcttgtctggagacgg

SEQ ID NO: 875685 - DNA, 25 bp, Mus musculus
aggagagccggttgtctggagacgg

SEQ ID NO: 875686 - DNA, 25 bp, Mus musculus
aggagagctatgctggtggtgaggc

SEQ ID NO: 875687 - DNA, 25 bp, Mus musculus
aggagagctatggtggtggtgaggc

SEQ ID NO: 875688 - DNA, 25 bp, Mus musculus
aggagagctcaacaatggatttgct

SEQ ID NO: 875689 - DNA, 25 bp, Mus musculus
aggagagctcaagaatggatttgct

SEQ ID NO: 875690 - DNA, 25 bp, Mus musculus
aggagagctgagccacctccaagtg

SEQ ID NO: 875691 - DNA, 25 bp, Mus musculus
aggagagctgaggcacctccaagtg

SEQ ID NO: 875692 - DNA, 25 bp, Mus musculus
aggagaggcgcaggcggaggtcaga

SEQ ID NO: 875693 - DNA, 25 bp, Mus musculus
aggagaggcgcagggggaggtcaga

SEQ ID NO: 875694 - DNA, 25 bp, Mus musculus
aggagaggggggctcatcctgggct

SEQ ID NO: 875695 - DNA, 25 bp, Mus musculus
aggagaggggggctgatcctgggct

SEQ ID NO: 875696 - DNA, 25 bp, Mus musculus
aggagagtcacacctaaagaacgct

SEQ ID NO: 875697 - DNA, 25 bp, Mus musculus
aggagagtcacagctaaagaacgct

SEQ ID NO: 875698 - DNA, 25 bp, Mus musculus
aggagagttccaccgtttgctgcca

SEQ ID NO: 875699 - DNA, 25 bp, Mus musculus
aggagagttccagcgtttgctgcca

SEQ ID NO: 875700 - DNA, 25 bp, Mus musculus
aggagataagcccgatgtggacaag

SEQ ID NO: 875701 - DNA, 25 bp, Mus musculus
aggagataagcgagaagctggtttt

SEQ ID NO: 875702 - DNA, 25 bp, Mus musculus
aggagataaggccgatgtggacaag

SEQ ID NO: 875703 - DNA, 25 bp, Mus musculus
aggagataagggagaagctggtttt

SEQ ID NO: 875704 - DNA, 25 bp, Mus musculus
aggagatacattcgtaggtatgggc

SEQ ID NO: 875705 - DNA, 25 bp, Mus musculus
aggagatacattggtaggtatgggc

SEQ ID NO: 875706 - DNA, 25 bp, Mus musculus
aggagatagtcaaggccatgatgat

SEQ ID NO: 875707 - DNA, 25 bp, Mus musculus
aggagatagtcatggccatgatgat

SEQ ID NO: 875708 - DNA, 25 bp, Mus musculus
aggagatatatgaccacaacatggg

SEQ ID NO: 875709 - DNA, 25 bp, Mus musculus
aggagatatatgtccacaacatggg

SEQ ID NO: 875710 - DNA, 25 bp, Mus musculus
aggagatatgagcaacaaaagcggt

SEQ ID NO: 875711 - DNA, 25 bp, Mus musculus
aggagatatgcgcaacaaaagcggt

SEQ ID NO: 875712 - DNA, 25 bp, Mus musculus
aggagatatgcggaacaaaagcggt

SEQ ID NO: 875713 - DNA, 25 bp, Mus musculus
aggagatatgtgcaacaaaagcggt

SEQ ID NO: 875714 - DNA, 25 bp, Mus musculus
aggagatcctccaagcccacagacg

SEQ ID NO: 875715 - DNA, 25 bp, Mus musculus
aggagatcctcctagcccacagacg

SEQ ID NO: 875716 - DNA, 25 bp, Mus musculus
aggagatcctggagcaaccttcgct

SEQ ID NO: 875717 - DNA, 25 bp, Mus musculus
aggagatcctggaggaaccttcgct

SEQ ID NO: 875718 - DNA, 25 bp, Mus musculus
aggagatgcagacgatcctgctgaa

SEQ ID NO: 875719 - DNA, 25 bp, Mus musculus
aggagatgcagaggatcctgctgaa

SEQ ID NO: 875720 - DNA, 25 bp, Mus musculus
aggagatgcctgatcaacatgacac

SEQ ID NO: 875721 - DNA, 25 bp, Mus musculus
aggagatgcctgttcaacatgacac

SEQ ID NO: 875722 - DNA, 25 bp, Mus musculus
aggagatgtcatcaccatccagcca

SEQ ID NO: 875723 - DNA, 25 bp, Mus musculus
aggagatgtcatcagcatccagcca

SEQ ID NO: 875724 - DNA, 25 bp, Mus musculus
aggagattaaggctgccacctaggc

SEQ ID NO: 875725 - DNA, 25 bp, Mus musculus
aggagattaagggtgccacctaggc

SEQ ID NO: 875726 - DNA, 25 bp, Mus musculus
aggagattctgacaccttgctacat

SEQ ID NO: 875727 - DNA, 25 bp, Mus musculus
aggagattctgacgcgaatggaccc

SEQ ID NO: 875728 - DNA, 25 bp, Mus musculus
aggagattctgagaccttgctacat

SEQ ID NO: 875729 - DNA, 25 bp, Mus musculus
aggagattctgaggcgaatggaccc

SEQ ID NO: 875730 - DNA, 25 bp, Mus musculus
aggagattgaagagctccgagaggc

SEQ ID NO: 875731 - DNA, 25 bp, Mus musculus
aggagattgaagtgctccgagaggc

SEQ ID NO: 875732 - DNA, 25 bp, Mus musculus
aggagattgaatcggacgacctggc

SEQ ID NO: 875733 - DNA, 25 bp, Mus musculus
aggagattgaatgggacgacctggc

SEQ ID NO: 875734 - DNA, 25 bp, Mus musculus
aggagatttcaaaagctgatgtgga

SEQ ID NO: 875735 - DNA, 25 bp, Mus musculus
aggagatttcaatagctgatgtgga

SEQ ID NO: 875736 - DNA, 25 bp, Mus musculus
aggagcaaaagacggaataattctc

SEQ ID NO: 875737 - DNA, 25 bp, Mus musculus
aggagcaaaagagggaataattctc

SEQ ID NO: 875738 - DNA, 25 bp, Mus musculus
aggagcaaaagccacagcccaggct

SEQ ID NO: 875739 - DNA, 25 bp, Mus musculus
aggagcaaaagccactgttggaggt

SEQ ID NO: 875740 - DNA, 25 bp, Mus musculus
aggagcaaaagccagagcccaggct

SEQ ID NO: 875741 - DNA, 25 bp, Mus musculus
aggagcaaaagccagtgttggaggt

SEQ ID NO: 875742 - DNA, 25 bp, Mus musculus
aggagcaaagagcagagctgtcggg

SEQ ID NO: 875743 - DNA, 25 bp, Mus musculus
aggagcaaagaggagagctgtcggg

SEQ ID NO: 875744 - DNA, 25 bp, Mus musculus
aggagcaaagcctgtgaactcctgg

SEQ ID NO: 875745 - DNA, 25 bp, Mus musculus
aggagcaaaggctgtgaactcctgg

SEQ ID NO: 875746 - DNA, 25 bp, Mus musculus
aggagcaaccagagagcaccgtact

SEQ ID NO: 875747 - DNA, 25 bp, Mus musculus
aggagcaaccagtgagcaccgtact

SEQ ID NO: 875748 - DNA, 25 bp, Mus musculus
aggagcacgacattcagctgtctct

SEQ ID NO: 875749 - DNA, 25 bp, Mus musculus
aggagcacgacattgagctgtctct

SEQ ID NO: 875750 - DNA, 25 bp, Mus musculus
aggagcactgaagcacatgctgaag

SEQ ID NO: 875751 - DNA, 25 bp, Mus musculus
aggagcactgcgcggtggccacctg

SEQ ID NO: 875752 - DNA, 25 bp, Mus musculus
aggagcactgcggggtggccacctg

SEQ ID NO: 875753 - DNA, 25 bp, Mus musculus
aggagcactgtagcacatgctgaag

SEQ ID NO: 875754 - DNA, 25 bp, Mus musculus
aggagcagacatcacaaaccttaca

SEQ ID NO: 875755 - DNA, 25 bp, Mus musculus
aggagcagacatcacaaagcacaat

SEQ ID NO: 875756 - DNA, 25 bp, Mus musculus
aggagcagacatcacataatggagg

SEQ ID NO: 875757 - DNA, 25 bp, Mus musculus
aggagcagacatcagaaaccttaca

SEQ ID NO: 875758 - DNA, 25 bp, Mus musculus
aggagcagacatcagaaagcacaat

SEQ ID NO: 875759 - DNA, 25 bp, Mus musculus
aggagcagacatcagataatggagg

SEQ ID NO: 875760 - DNA, 25 bp, Mus musculus
aggagcagcgcgtttattgcctaga

SEQ ID NO: 875761 - DNA, 25 bp, Mus musculus
aggagcagcgggtttattgcctaga

SEQ ID NO: 875762 - DNA, 25 bp, Mus musculus
aggagcagctcacaggtctgatccc

SEQ ID NO: 875763 - DNA, 25 bp, Mus musculus
aggagcagctgacaggtctgatccc

SEQ ID NO: 875764 - DNA, 25 bp, Mus musculus
aggagcagcttgcctatattgtctt

SEQ ID NO: 875765 - DNA, 25 bp, Mus musculus
aggagcagcttggctatattgtctt

SEQ ID NO: 875766 - DNA, 25 bp, Mus musculus
aggagcaggaagcggagaaggacat

SEQ ID NO: 875767 - DNA, 25 bp, Mus musculus
aggagcaggaaggggagaaggacat

SEQ ID NO: 875768 - DNA, 25 bp, Mus musculus
aggagcagtctcatggagccagatc

SEQ ID NO: 875769 - DNA, 25 bp, Mus musculus
aggagcagtctcttggagccagatc

SEQ ID NO: 875770 - DNA, 25 bp, Mus musculus
aggagcatccgtgacgtatttgaat

SEQ ID NO: 875771 - DNA, 25 bp, Mus musculus
aggagcatccgtgaggtatttgaat

SEQ ID NO: 875772 - DNA, 25 bp, Mus musculus
aggagcatctcaagcaaaacgaaga

SEQ ID NO: 875773 - DNA, 25 bp, Mus musculus
aggagcatctcaagcccaagcagta

SEQ ID NO: 875774 - DNA, 25 bp, Mus musculus
aggagcatctcaaggaaaacgaaga

SEQ ID NO: 875775 - DNA, 25 bp, Mus musculus
aggagcatctcaaggccaagcagta

SEQ ID NO: 875776 - DNA, 25 bp, Mus musculus
aggagcattttaataagaagataga

SEQ ID NO: 875777 - DNA, 25 bp, Mus musculus
aggagcattttattaagaagataga

SEQ ID NO: 875778 - DNA, 25 bp, Mus musculus
aggagccaagagagaagaacaatcc

SEQ ID NO: 875779 - DNA, 25 bp, Mus musculus
aggagccaagagctatgagccagaa

SEQ ID NO: 875780 - DNA, 25 bp, Mus musculus
aggagccaagaggtatgagccagaa

SEQ ID NO: 875781 - DNA, 25 bp, Mus musculus
aggagccaagagtgaagaacaatcc

SEQ ID NO: 875782 - DNA, 25 bp, Mus musculus
aggagccaatcacgtgtccggtacc

SEQ ID NO: 875783 - DNA, 25 bp, Mus musculus
aggagccaatcaggtgtccggtacc

SEQ ID NO: 875784 - DNA, 25 bp, Mus musculus
aggagccacgtaaacatggagaaat

SEQ ID NO: 875785 - DNA, 25 bp, Mus musculus
aggagccacgtaaagatggagaaat

SEQ ID NO: 875786 - DNA, 25 bp, Mus musculus
aggagccaggcgccaagccacagac

SEQ ID NO: 875787 - DNA, 25 bp, Mus musculus
aggagccaggggccaagccacagac

SEQ ID NO: 875788 - DNA, 25 bp, Mus musculus
aggagcccagagaactgcctcctga

SEQ ID NO: 875789 - DNA, 25 bp, Mus musculus
aggagcccagagtactgcctcctga

SEQ ID NO: 875790 - DNA, 25 bp, Mus musculus
aggagcccagcccggctcaacatta

SEQ ID NO: 875791 - DNA, 25 bp, Mus musculus
aggagcccaggccggctcaacatta

SEQ ID NO: 875792 - DNA, 25 bp, Mus musculus
aggagcccagggaactggctacaga

SEQ ID NO: 875793 - DNA, 25 bp, Mus musculus
aggagcccagggaagtggctacaga

SEQ ID NO: 875794 - DNA, 25 bp, Mus musculus
aggagccctggacacgtttgcgcag

SEQ ID NO: 875795 - DNA, 25 bp, Mus musculus
aggagccctggacaggtttgcgcag

SEQ ID NO: 875796 - DNA, 25 bp, Mus musculus
aggagccgcagacgtgctttgtctg

SEQ ID NO: 875797 - DNA, 25 bp, Mus musculus
aggagccgcagaggtgctttgtctg

SEQ ID NO: 875798 - DNA, 25 bp, Mus musculus
aggagcgcagaacgctgagaccgct

SEQ ID NO: 875799 - DNA, 25 bp, Mus musculus
aggagcgcagaaggctgagaccgct

SEQ ID NO: 875800 - DNA, 25 bp, Mus musculus
aggagcgcagcttcctcatgagggt

SEQ ID NO: 875801 - DNA, 25 bp, Mus musculus
aggagcgcaggttcctcatgagggt

SEQ ID NO: 875802 - DNA, 25 bp, Mus musculus
aggagcggtgatgaaaaactggaag

SEQ ID NO: 875803 - DNA, 25 bp, Mus musculus
aggagcggtgttgaaaaactggaag

SEQ ID NO: 875804 - DNA, 25 bp, Mus musculus
aggagcggttcacgtctgtgacgag

SEQ ID NO: 875805 - DNA, 25 bp, Mus musculus
aggagcggttcaggtctgtgacgag

SEQ ID NO: 875806 - DNA, 25 bp, Mus musculus
aggagctagaagcggaatacttggc

SEQ ID NO: 875807 - DNA, 25 bp, Mus musculus
aggagctagaaggggaatacttggc

SEQ ID NO: 875808 - DNA, 25 bp, Mus musculus
aggagctcaacgagctggactacta

SEQ ID NO: 875809 - DNA, 25 bp, Mus musculus
aggagctcaaggagctggactacta

SEQ ID NO: 875810 - DNA, 25 bp, Mus musculus
aggagctcacagatcgccactttga

SEQ ID NO: 875811 - DNA, 25 bp, Mus musculus
aggagctcacagatggccactttga

SEQ ID NO: 875812 - DNA, 25 bp, Mus musculus
aggagctcacagcagagaaggagat

SEQ ID NO: 875813 - DNA, 25 bp, Mus musculus
aggagctcacaggagagaaggagat

SEQ ID NO: 875814 - DNA, 25 bp, Mus musculus
aggagctcagacatgccctggacat

SEQ ID NO: 875815 - DNA, 25 bp, Mus musculus
aggagctcagtcatgccctggacat

SEQ ID NO: 875816 - DNA, 25 bp, Mus musculus
aggagctccatgcggaagtcatcag

SEQ ID NO: 875817 - DNA, 25 bp, Mus musculus
aggagctccatggggaagtcatcag

SEQ ID NO: 875818 - DNA, 25 bp, Mus musculus
aggagctcctctacaagcttaagct

SEQ ID NO: 875819 - DNA, 25 bp, Mus musculus
aggagctcctcttcaagcttaagct

SEQ ID NO: 875820 - DNA, 25 bp, Mus musculus
aggagctctgaggtctacgctcagc

SEQ ID NO: 875821 - DNA, 25 bp, Mus musculus
aggagctctgtggtctacgctcagc

SEQ ID NO: 875822 - DNA, 25 bp, Mus musculus
aggagctgaaagcacggcctgtgca

SEQ ID NO: 875823 - DNA, 25 bp, Mus musculus
aggagctgaaagcagggcctgtgca

SEQ ID NO: 875824 - DNA, 25 bp, Mus musculus
aggagctgagacctgatggaaccat

SEQ ID NO: 875825 - DNA, 25 bp, Mus musculus
aggagctgagtcctgatggaaccat

SEQ ID NO: 875826 - DNA, 25 bp, Mus musculus
aggagctgatcaacactggacctcc

SEQ ID NO: 875827 - DNA, 25 bp, Mus musculus
aggagctgatcaactctggacctcc

SEQ ID NO: 875828 - DNA, 25 bp, Mus musculus
aggagctgatcgattaacaggacct

SEQ ID NO: 875829 - DNA, 25 bp, Mus musculus
aggagctgatggattaacaggacct

SEQ ID NO: 875830 - DNA, 25 bp, Mus musculus
aggagctgcagacccattgactact

SEQ ID NO: 875831 - DNA, 25 bp, Mus musculus
aggagctgcagagccattgactact

SEQ ID NO: 875832 - DNA, 25 bp, Mus musculus
aggagctgccaaacccaagctgacc

SEQ ID NO: 875833 - DNA, 25 bp, Mus musculus
aggagctgccaatcccaagctgacc

SEQ ID NO: 875834 - DNA, 25 bp, Mus musculus
aggagctggagacaaaaatatcagg

SEQ ID NO: 875835 - DNA, 25 bp, Mus musculus
aggagctggagacgaaagccataga

SEQ ID NO: 875836 - DNA, 25 bp, Mus musculus
aggagctggagagaaaaatatcagg

SEQ ID NO: 875837 - DNA, 25 bp, Mus musculus
aggagctggagaggaaagccataga

SEQ ID NO: 875838 - DNA, 25 bp, Mus musculus
aggagctggtccgacggctactgac

SEQ ID NO: 875839 - DNA, 25 bp, Mus musculus
aggagctggtccgagggctactgac

SEQ ID NO: 875840 - DNA, 25 bp, Mus musculus
aggagctgtgtcaactgagaaaggc

SEQ ID NO: 875841 - DNA, 25 bp, Mus musculus
aggagctgtgtcaagtgagaaaggc

SEQ ID NO: 875842 - DNA, 25 bp, Mus musculus
aggagctgttcacagttgaagagga

SEQ ID NO: 875843 - DNA, 25 bp, Mus musculus
aggagctgttcagagttgaagagga

SEQ ID NO: 875844 - DNA, 25 bp, Mus musculus
aggagcttgaggcgggcagggagct

SEQ ID NO: 875845 - DNA, 25 bp, Mus musculus
aggagcttgaggggggcagggagct

SEQ ID NO: 875846 - DNA, 25 bp, Mus musculus
aggagcttggcactggccaatttgc

SEQ ID NO: 875847 - DNA, 25 bp, Mus musculus
aggagcttggcagtggccaatttgc

SEQ ID NO: 875848 - DNA, 25 bp, Mus musculus
aggagctttgttatttgccatctct

SEQ ID NO: 875849 - DNA, 25 bp, Mus musculus
aggagctttgttttttgccatctct

SEQ ID NO: 875850 - DNA, 25 bp, Mus musculus
aggaggaaaacgcatgaggatcgtt

SEQ ID NO: 875851 - DNA, 25 bp, Mus musculus
aggaggaaaaggcatgaggatcgtt

SEQ ID NO: 875852 - DNA, 25 bp, Mus musculus
aggaggaactagacacagtgattgg

SEQ ID NO: 875853 - DNA, 25 bp, Mus musculus
aggaggaactagtcacagtgattgg

SEQ ID NO: 875854 - DNA, 25 bp, Mus musculus
aggaggaagaagagcaggaagaggg

SEQ ID NO: 875855 - DNA, 25 bp, Mus musculus
aggaggaagaagaggaggaagaggg

SEQ ID NO: 875856 - DNA, 25 bp, Mus musculus
aggaggaagatgactctgaggaaga

SEQ ID NO: 875857 - DNA, 25 bp, Mus musculus
aggaggaagatgtctctgaggaaga

SEQ ID NO: 875858 - DNA, 25 bp, Mus musculus
aggaggaagtggagcgactgaactt

SEQ ID NO: 875859 - DNA, 25 bp, Mus musculus
aggaggaagtggagggactgaactt

SEQ ID NO: 875860 - DNA, 25 bp, Mus musculus
aggaggacactgaaagtgtcatgtc

SEQ ID NO: 875861 - DNA, 25 bp, Mus musculus
aggaggacactgaactcctacctgg

SEQ ID NO: 875862 - DNA, 25 bp, Mus musculus
aggaggacactgaagaaagtgtcat

SEQ ID NO: 875863 - DNA, 25 bp, Mus musculus
aggaggacactgtaagtgtcatgtc

SEQ ID NO: 875864 - DNA, 25 bp, Mus musculus
aggaggacactgtactcctacctgg

SEQ ID NO: 875865 - DNA, 25 bp, Mus musculus
aggaggacactgtagaaagtgtcat

SEQ ID NO: 875866 - DNA, 25 bp, Mus musculus
aggaggacagctacaagcccatcgt

SEQ ID NO: 875867 - DNA, 25 bp, Mus musculus
aggaggacagctatgacttcatcgg

SEQ ID NO: 875868 - DNA, 25 bp, Mus musculus
aggaggacagctttgacttcatcgg

SEQ ID NO: 875869 - DNA, 25 bp, Mus musculus
aggaggacaggtacaagcccatcgt

SEQ ID NO: 875870 - DNA, 25 bp, Mus musculus
aggaggagaaagccttgtagccgcc

SEQ ID NO: 875871 - DNA, 25 bp, Mus musculus
aggaggagaaaggcttgtagccgcc

SEQ ID NO: 875872 - DNA, 25 bp, Mus musculus
aggaggagaacccagttcatatcca

SEQ ID NO: 875873 - DNA, 25 bp, Mus musculus
aggaggagaaccgagttcatatcca

SEQ ID NO: 875874 - DNA, 25 bp, Mus musculus
aggaggagaacgacaagcctgtggc

SEQ ID NO: 875875 - DNA, 25 bp, Mus musculus
aggaggagaaggacaagcctgtggc

SEQ ID NO: 875876 - DNA, 25 bp, Mus musculus
aggaggagacagatgtgaggtgaga

SEQ ID NO: 875877 - DNA, 25 bp, Mus musculus
aggaggagacagcaaggcgtaggga

SEQ ID NO: 875878 - DNA, 25 bp, Mus musculus
aggaggagacaggaaggcgtaggga

SEQ ID NO: 875879 - DNA, 25 bp, Mus musculus
aggaggagacagttgtgaggtgaga

SEQ ID NO: 875880 - DNA, 25 bp, Mus musculus
aggaggagagagagttcacccatgg

SEQ ID NO: 875881 - DNA, 25 bp, Mus musculus
aggaggagagcctctctcggtatca

SEQ ID NO: 875882 - DNA, 25 bp, Mus musculus
aggaggagagcctgcgcctgtcccc

SEQ ID NO: 875883 - DNA, 25 bp, Mus musculus
aggaggagaggctctctcggtatca

SEQ ID NO: 875884 - DNA, 25 bp, Mus musculus
aggaggagaggctgcgcctgtcccc

SEQ ID NO: 875885 - DNA, 25 bp, Mus musculus
aggaggagagtgagttcacccatgg

SEQ ID NO: 875886 - DNA, 25 bp, Mus musculus
aggaggagctggagatggaagcaaa

SEQ ID NO: 875887 - DNA, 25 bp, Mus musculus
aggaggagctggatggaagcaaaaa

SEQ ID NO: 875888 - DNA, 25 bp, Mus musculus
aggaggagctggtgatggaagcaaa

SEQ ID NO: 875889 - DNA, 25 bp, Mus musculus
aggaggagctggttggaagcaaaaa

SEQ ID NO: 875890 - DNA, 25 bp, Mus musculus
aggaggaggacactcaactcctacc

SEQ ID NO: 875891 - DNA, 25 bp, Mus musculus
aggaggaggacactgaactcctacc

SEQ ID NO: 875892 - DNA, 25 bp, Mus musculus
aggaggaggagtcacatgatctagc

SEQ ID NO: 875893 - DNA, 25 bp, Mus musculus
aggaggaggagtcactgcaagggcc

SEQ ID NO: 875894 - DNA, 25 bp, Mus musculus
aggaggaggagtcagatgatctagc

SEQ ID NO: 875895 - DNA, 25 bp, Mus musculus
aggaggaggagtcagtgcaagggcc

SEQ ID NO: 875896 - DNA, 25 bp, Mus musculus
aggaggaggccgaagaagcacttaa

SEQ ID NO: 875897 - DNA, 25 bp, Mus musculus
aggaggaggccgtagaagcacttaa

SEQ ID NO: 875898 - DNA, 25 bp, Mus musculus
aggaggagtcagagcaagggccatc

SEQ ID NO: 875899 - DNA, 25 bp, Mus musculus
aggaggagtcagatgatctagcact

SEQ ID NO: 875900 - DNA, 25 bp, Mus musculus
aggaggagtcagtgcaagggccatc

SEQ ID NO: 875901 - DNA, 25 bp, Mus musculus
aggaggagtcagttgatctagcact

SEQ ID NO: 875902 - DNA, 25 bp, Mus musculus
aggaggatgaggatggtgggcattg

SEQ ID NO: 875903 - DNA, 25 bp, Mus musculus
aggaggatgaggattttgattgggt

SEQ ID NO: 875904 - DNA, 25 bp, Mus musculus
aggaggatgaggttggtgggcattg

SEQ ID NO: 875905 - DNA, 25 bp, Mus musculus
aggaggatgaggtttttgattgggt

SEQ ID NO: 875906 - DNA, 25 bp, Mus musculus
aggaggatggatcacacagaaagtg

SEQ ID NO: 875907 - DNA, 25 bp, Mus musculus
aggaggatggatcagacagaaagtg

SEQ ID NO: 875908 - DNA, 25 bp, Mus musculus
aggaggcaagcagtgtcgggaacgc

SEQ ID NO: 875909 - DNA, 25 bp, Mus musculus
aggaggcaaggagtgtcgggaacgc

SEQ ID NO: 875910 - DNA, 25 bp, Mus musculus
aggaggcagaggcaagacttgccag

SEQ ID NO: 875911 - DNA, 25 bp, Mus musculus
aggaggcagagggaagacttgccag

SEQ ID NO: 875912 - DNA, 25 bp, Mus musculus
aggaggcagtagcgttgctagatct

SEQ ID NO: 875913 - DNA, 25 bp, Mus musculus
aggaggcagtagggttgctagatct

SEQ ID NO: 875914 - DNA, 25 bp, Mus musculus
aggaggccacagaaagctcctgaga

SEQ ID NO: 875915 - DNA, 25 bp, Mus musculus
aggaggccacagtaagctcctgaga

SEQ ID NO: 875916 - DNA, 25 bp, Mus musculus
aggaggccagagacaagaggaccca

SEQ ID NO: 875917 - DNA, 25 bp, Mus musculus
aggaggccagcaagtccttcttctc

SEQ ID NO: 875918 - DNA, 25 bp, Mus musculus
aggaggccaggaagtccttcttctc

SEQ ID NO: 875919 - DNA, 25 bp, Mus musculus
aggaggccagtgacaagaggaccca

SEQ ID NO: 875920 - DNA, 25 bp, Mus musculus
aggaggccatgaccaacaaggcgtg

SEQ ID NO: 875921 - DNA, 25 bp, Mus musculus
aggaggccatgagcaacaaggcgtg

SEQ ID NO: 875922 - DNA, 25 bp, Mus musculus
aggaggccatttcacgtttggtatg

SEQ ID NO: 875923 - DNA, 25 bp, Mus musculus
aggaggccatttcaggtttggtatg

SEQ ID NO: 875924 - DNA, 25 bp, Mus musculus
aggaggctctgactcttctctctct

SEQ ID NO: 875925 - DNA, 25 bp, Mus musculus
aggaggctctgactgttctctctct

SEQ ID NO: 875926 - DNA, 25 bp, Mus musculus
aggaggctggagagtccttagccag

SEQ ID NO: 875927 - DNA, 25 bp, Mus musculus
aggaggctggagtgtccttagccag

SEQ ID NO: 875928 - DNA, 25 bp, Mus musculus
aggagggacgattctgacgttgggt

SEQ ID NO: 875929 - DNA, 25 bp, Mus musculus
aggagggacgtttctgacgttgggt

SEQ ID NO: 875930 - DNA, 25 bp, Mus musculus
aggagggcagcaatcccagccatct

SEQ ID NO: 875931 - DNA, 25 bp, Mus musculus
aggagggcagcagaaccagacatca

SEQ ID NO: 875932 - DNA, 25 bp, Mus musculus
aggagggcagcttgtctttctactc

SEQ ID NO: 875933 - DNA, 25 bp, Mus musculus
aggagggcaggaatcccagccatct

SEQ ID NO: 875934 - DNA, 25 bp, Mus musculus
aggagggcaggagaaccagacatca

SEQ ID NO: 875935 - DNA, 25 bp, Mus musculus
aggagggcaggttgtctttctactc

SEQ ID NO: 875936 - DNA, 25 bp, Mus musculus
aggagggccatcaacaatgactctg

SEQ ID NO: 875937 - DNA, 25 bp, Mus musculus
aggagggccatcaagaatgactctg

SEQ ID NO: 875938 - DNA, 25 bp, Mus musculus
aggagggctgagctacagtcatgtc

SEQ ID NO: 875939 - DNA, 25 bp, Mus musculus
aggagggctgaggtacagtcatgtc

SEQ ID NO: 875940 - DNA, 25 bp, Mus musculus
aggagggtgatgacacagctcccag

SEQ ID NO: 875941 - DNA, 25 bp, Mus musculus
aggagggtgatgtcacagctcccag

SEQ ID NO: 875942 - DNA, 25 bp, Mus musculus
aggaggtagatgcacgagatccccc

SEQ ID NO: 875943 - DNA, 25 bp, Mus musculus
aggaggtagatgcaggagatccccc

SEQ ID NO: 875944 - DNA, 25 bp, Mus musculus
aggaggtcatgactcccatttgctt

SEQ ID NO: 875945 - DNA, 25 bp, Mus musculus
aggaggtcatgactcgggtgatctg

SEQ ID NO: 875946 - DNA, 25 bp, Mus musculus
aggaggtcatgactgccatttgctt

SEQ ID NO: 875947 - DNA, 25 bp, Mus musculus
aggaggtcatgactggggtgatctg

SEQ ID NO: 875948 - DNA, 25 bp, Mus musculus
aggaggtgacagcttcctgcaatct

SEQ ID NO: 875949 - DNA, 25 bp, Mus musculus
aggaggtgacaggttcctgcaatct

SEQ ID NO: 875950 - DNA, 25 bp, Mus musculus
aggaggtggcaacgtgcaaatagtc

SEQ ID NO: 875951 - DNA, 25 bp, Mus musculus
aggaggtggcaacgtgcagataatt

SEQ ID NO: 875952 - DNA, 25 bp, Mus musculus
aggaggtggcaaggtgcaaatagtc

SEQ ID NO: 875953 - DNA, 25 bp, Mus musculus
aggaggtggcaaggtgcagataatt

SEQ ID NO: 875954 - DNA, 25 bp, Mus musculus
aggaggtggcagcgctctcaaatca

SEQ ID NO: 875955 - DNA, 25 bp, Mus musculus
aggaggtggcagggctctcaaatca

SEQ ID NO: 875956 - DNA, 25 bp, Mus musculus
aggaggttgaggagcgtttcagcga

SEQ ID NO: 875957 - DNA, 25 bp, Mus musculus
aggaggttgaggagggtttcagcga

SEQ ID NO: 875958 - DNA, 25 bp, Mus musculus
aggagtaacgcaccaggaaaccttg

SEQ ID NO: 875959 - DNA, 25 bp, Mus musculus
aggagtaacgcagcaggaaaccttg

SEQ ID NO: 875960 - DNA, 25 bp, Mus musculus
aggagtagcaaactggctgacagag

SEQ ID NO: 875961 - DNA, 25 bp, Mus musculus
aggagtagcatactggctgacagag

SEQ ID NO: 875962 - DNA, 25 bp, Mus musculus
aggagtataatggacgctcactttg

SEQ ID NO: 875963 - DNA, 25 bp, Mus musculus
aggagtataatggaggctcactttg

SEQ ID NO: 875964 - DNA, 25 bp, Mus musculus
aggagtatgaggcagccgtctaccc

SEQ ID NO: 875965 - DNA, 25 bp, Mus musculus
aggagtatgagggagccgtctaccc

SEQ ID NO: 875966 - DNA, 25 bp, Mus musculus
aggagtattaaacattgtcaaaaga

SEQ ID NO: 875967 - DNA, 25 bp, Mus musculus
aggagtattaaagattgtcaaaaga

SEQ ID NO: 875968 - DNA, 25 bp, Mus musculus
aggagtcacctcagtctggtagcag

SEQ ID NO: 875969 - DNA, 25 bp, Mus musculus
aggagtcacctctgtctggtagcag

SEQ ID NO: 875970 - DNA, 25 bp, Mus musculus
aggagtcccgccgtggagcgttact

SEQ ID NO: 875971 - DNA, 25 bp, Mus musculus
aggagtcccgcctcatcactcttcc

SEQ ID NO: 875972 - DNA, 25 bp, Mus musculus
aggagtcccggcgtggagcgttact

SEQ ID NO: 875973 - DNA, 25 bp, Mus musculus
aggagtcccggctcatcactcttcc

SEQ ID NO: 875974 - DNA, 25 bp, Mus musculus
aggagtgaggagacaccactacttt

SEQ ID NO: 875975 - DNA, 25 bp, Mus musculus
aggagtgaggagtcaccactacttt

SEQ ID NO: 875976 - DNA, 25 bp, Mus musculus
aggagtgcaaatcaacctgccagtt

SEQ ID NO: 875977 - DNA, 25 bp, Mus musculus
aggagtgcaaatgaacctgccagtt

SEQ ID NO: 875978 - DNA, 25 bp, Mus musculus
aggagtgccaagatatcgatgagtg

SEQ ID NO: 875979 - DNA, 25 bp, Mus musculus
aggagtgccaagttatcgatgagtg

SEQ ID NO: 875980 - DNA, 25 bp, Mus musculus
aggagtggaaagaactgatatacaa

SEQ ID NO: 875981 - DNA, 25 bp, Mus musculus
aggagtggaaagtactgatatacaa

SEQ ID NO: 875982 - DNA, 25 bp, Mus musculus
aggagtggccagctatggcgtaaac

SEQ ID NO: 875983 - DNA, 25 bp, Mus musculus
aggagtggccaggtatggcgtaaac

SEQ ID NO: 875984 - DNA, 25 bp, Mus musculus
aggagtgtaacacggcagaatgttt

SEQ ID NO: 875985 - DNA, 25 bp, Mus musculus
aggagtgtaacagggcagaatgttt

SEQ ID NO: 875986 - DNA, 25 bp, Mus musculus
aggagttaatctagtctcctcgaag

SEQ ID NO: 875987 - DNA, 25 bp, Mus musculus
aggagttaatctagtctcttctcac

SEQ ID NO: 875988 - DNA, 25 bp, Mus musculus
aggagttaatctagtttgagtcttc

SEQ ID NO: 875989 - DNA, 25 bp, Mus musculus
aggagttaatcttgtctcctcgaag

SEQ ID NO: 875990 - DNA, 25 bp, Mus musculus
aggagttaatcttgtctcttctcac

SEQ ID NO: 875991 - DNA, 25 bp, Mus musculus
aggagttaatcttgtttgagtcttc

SEQ ID NO: 875992 - DNA, 25 bp, Mus musculus
aggagttcaagcgacgcaagtccca

SEQ ID NO: 875993 - DNA, 25 bp, Mus musculus
aggagttcaagcgaggcaagtccca

SEQ ID NO: 875994 - DNA, 25 bp, Mus musculus
aggagttccacgcccacacggtgaa

SEQ ID NO: 875995 - DNA, 25 bp, Mus musculus
aggagttccacggccacacggtgaa

SEQ ID NO: 875996 - DNA, 25 bp, Mus musculus
aggagttctttctgaggtgtcagat

SEQ ID NO: 875997 - DNA, 25 bp, Mus musculus
aggagttctttctgtggtgtcagat

SEQ ID NO: 875998 - DNA, 25 bp, Mus musculus
aggagttgagataaaagaagatgga

SEQ ID NO: 875999 - DNA, 25 bp, Mus musculus
aggagttgagttaaaagaagatgga

SEQ ID NO: 876000 - DNA, 25 bp, Mus musculus
aggagttttcctatacagcaaatac

SEQ ID NO: 876001 - DNA, 25 bp, Mus musculus
aggagttttcctttacagcaaatac

SEQ ID NO: 876002 - DNA, 25 bp, Mus musculus
aggatacgagcaatcatttccatgt

SEQ ID NO: 876003 - DNA, 25 bp, Mus musculus
aggatacgagcactagtaccgttgt

SEQ ID NO: 876004 - DNA, 25 bp, Mus musculus
aggatacgagcagtagtaccgttgt

SEQ ID NO: 876005 - DNA, 25 bp, Mus musculus
aggatacgagcattcatttccatgt

SEQ ID NO: 876006 - DNA, 25 bp, Mus musculus
aggatactacctcattactatagcc

SEQ ID NO: 876007 - DNA, 25 bp, Mus musculus
aggatactacctgattactatagcc

SEQ ID NO: 876008 - DNA, 25 bp, Mus musculus
aggatactggagcttgcctctccac

SEQ ID NO: 876009 - DNA, 25 bp, Mus musculus
aggatactggaggttgcctctccac

SEQ ID NO: 876010 - DNA, 25 bp, Mus musculus
aggatagaggacaacgcccagatct

SEQ ID NO: 876011 - DNA, 25 bp, Mus musculus
aggatagaggacaaggcccagatct

SEQ ID NO: 876012 - DNA, 25 bp, Mus musculus
aggatatcagcccacctgccctccc

SEQ ID NO: 876013 - DNA, 25 bp, Mus musculus
aggatatcagcccagctgccctccc

SEQ ID NO: 876014 - DNA, 25 bp, Mus musculus
aggatatcgatgcccgccctgtcaa

SEQ ID NO: 876015 - DNA, 25 bp, Mus musculus
aggatatcgatggccgccctgtcaa

SEQ ID NO: 876016 - DNA, 25 bp, Mus musculus
aggatatgatggatgagatggatag

SEQ ID NO: 876017 - DNA, 25 bp, Mus musculus
aggatatgatggttgagatggatag

SEQ ID NO: 876018 - DNA, 25 bp, Mus musculus
aggatattttcacgtgaaccagaac

SEQ ID NO: 876019 - DNA, 25 bp, Mus musculus
aggatattttcaggtgaaccagaac

SEQ ID NO: 876020 - DNA, 25 bp, Mus musculus
aggatcaagacgaaactgcagcaga

SEQ ID NO: 876021 - DNA, 25 bp, Mus musculus
aggatcaagacttgaaagcgctggt

SEQ ID NO: 876022 - DNA, 25 bp, Mus musculus
aggatcaagagacgtgacgtgttgc

SEQ ID NO: 876023 - DNA, 25 bp, Mus musculus
aggatcaagagaggtgacgtgttgc

SEQ ID NO: 876024 - DNA, 25 bp, Mus musculus
aggatcaagaggaaactgcagcaga

SEQ ID NO: 876025 - DNA, 25 bp, Mus musculus
aggatcaagagttgaaagcgctggt

SEQ ID NO: 876026 - DNA, 25 bp, Mus musculus
aggatcaaggagacctggggtctgc

SEQ ID NO: 876027 - DNA, 25 bp, Mus musculus
aggatcaaggagtcctggggtctgc

SEQ ID NO: 876028 - DNA, 25 bp, Mus musculus
aggatcacagaacgtccctagcagg

SEQ ID NO: 876029 - DNA, 25 bp, Mus musculus
aggatcacagaaggtccctagcagg

SEQ ID NO: 876030 - DNA, 25 bp, Mus musculus
aggatcagttatcagacttcagact

SEQ ID NO: 876031 - DNA, 25 bp, Mus musculus
aggatcagttatcgcagtaatggaa

SEQ ID NO: 876032 - DNA, 25 bp, Mus musculus
aggatcagttatctttttatttcag

SEQ ID NO: 876033 - DNA, 25 bp, Mus musculus
aggatcagttatgagacttcagact

SEQ ID NO: 876034 - DNA, 25 bp, Mus musculus
aggatcagttatggcagtaatggaa

SEQ ID NO: 876035 - DNA, 25 bp, Mus musculus
aggatcagttatgtttttatttcag

SEQ ID NO: 876036 - DNA, 25 bp, Mus musculus
aggatccaactcaaatattgatctg

SEQ ID NO: 876037 - DNA, 25 bp, Mus musculus
aggatccaactctaatattgatctg

SEQ ID NO: 876038 - DNA, 25 bp, Mus musculus
aggatccaggatttatccagagggg

SEQ ID NO: 876039 - DNA, 25 bp, Mus musculus
aggatccaggcgccaggcagcacga

SEQ ID NO: 876040 - DNA, 25 bp, Mus musculus
aggatccaggggccaggcagcacga

SEQ ID NO: 876041 - DNA, 25 bp, Mus musculus
aggatccaggttttatccagagggg

SEQ ID NO: 876042 - DNA, 25 bp, Mus musculus
aggatcccctcctgtgcccctggcc

SEQ ID NO: 876043 - DNA, 25 bp, Mus musculus
aggatcccctcgcctcgctggaccc

SEQ ID NO: 876044 - DNA, 25 bp, Mus musculus
aggatcccctgctgtgcccctggcc

SEQ ID NO: 876045 - DNA, 25 bp, Mus musculus
aggatcccctggcctcgctggaccc

SEQ ID NO: 876046 - DNA, 25 bp, Mus musculus
aggatccctgcagtccctggctcca

SEQ ID NO: 876047 - DNA, 25 bp, Mus musculus
aggatccctggagtccctggctcca

SEQ ID NO: 876048 - DNA, 25 bp, Mus musculus
aggatccggaagtaaaagccggaag

SEQ ID NO: 876049 - DNA, 25 bp, Mus musculus
aggatccggaagtataagccggaag

SEQ ID NO: 876050 - DNA, 25 bp, Mus musculus
aggatcctccagagtctccagaaca

SEQ ID NO: 876051 - DNA, 25 bp, Mus musculus
aggatcctccagtgtctccagaaca

SEQ ID NO: 876052 - DNA, 25 bp, Mus musculus
aggatcctccgacagttctgtcctt

SEQ ID NO: 876053 - DNA, 25 bp, Mus musculus
aggatcctccgagagttctgtcctt

SEQ ID NO: 876054 - DNA, 25 bp, Mus musculus
aggatcctgcccagagttgaagaaa

SEQ ID NO: 876055 - DNA, 25 bp, Mus musculus
aggatcctgcccagtgttgaagaaa

SEQ ID NO: 876056 - DNA, 25 bp, Mus musculus
aggatcgactcagacctactgcaga

SEQ ID NO: 876057 - DNA, 25 bp, Mus musculus
aggatcgactgagacctactgcaga

SEQ ID NO: 876058 - DNA, 25 bp, Mus musculus
aggatctacaaactattatcaagaa

SEQ ID NO: 876059 - DNA, 25 bp, Mus musculus
aggatctacaaagtattatcaagaa

SEQ ID NO: 876060 - DNA, 25 bp, Mus musculus
aggatctgctccaacgcccacagct

SEQ ID NO: 876061 - DNA, 25 bp, Mus musculus
aggatctgctccaaggcccacagct

SEQ ID NO: 876062 - DNA, 25 bp, Mus musculus
aggatcttctagagaacagcgtcac

SEQ ID NO: 876063 - DNA, 25 bp, Mus musculus
aggatcttctagtgaacagcgtcac

SEQ ID NO: 876064 - DNA, 25 bp, Mus musculus
aggatgaagcccgacatctgcggca

SEQ ID NO: 876065 - DNA, 25 bp, Mus musculus
aggatgaagcccgagatctgcggca

SEQ ID NO: 876066 - DNA, 25 bp, Mus musculus
aggatgacagccccttcttcctgta

SEQ ID NO: 876067 - DNA, 25 bp, Mus musculus
aggatgacaggcccttcttcctgta

SEQ ID NO: 876068 - DNA, 25 bp, Mus musculus
aggatgaccctactgtattatacgt

SEQ ID NO: 876069 - DNA, 25 bp, Mus musculus
aggatgaccctagtgtattatacgt

SEQ ID NO: 876070 - DNA, 25 bp, Mus musculus
aggatgaccctgacatcgtagcttt

SEQ ID NO: 876071 - DNA, 25 bp, Mus musculus
aggatgaccctgtcatcgtagcttt

SEQ ID NO: 876072 - DNA, 25 bp, Mus musculus
aggatgaccgattcttccaggacct

SEQ ID NO: 876073 - DNA, 25 bp, Mus musculus
aggatgaccgtttcttccaggacct

SEQ ID NO: 876074 - DNA, 25 bp, Mus musculus
aggatgacggaaaaatgtttattgg

SEQ ID NO: 876075 - DNA, 25 bp, Mus musculus
aggatgacggtaaaatgtttattgg

SEQ ID NO: 876076 - DNA, 25 bp, Mus musculus
aggatgactggacggagtttcgaac

SEQ ID NO: 876077 - DNA, 25 bp, Mus musculus
aggatgactggagggagtttcgaac

SEQ ID NO: 876078 - DNA, 25 bp, Mus musculus
aggatgagcgcaactaccatgtgtt

SEQ ID NO: 876079 - DNA, 25 bp, Mus musculus
aggatgagcggaactaccatgtgtt

SEQ ID NO: 876080 - DNA, 25 bp, Mus musculus
aggatgagtgcgtggaagagcagag

SEQ ID NO: 876081 - DNA, 25 bp, Mus musculus
aggatgagtgggtggaagagcagag

SEQ ID NO: 876082 - DNA, 25 bp, Mus musculus
aggatgatattgcgtttgatctgtg

SEQ ID NO: 876083 - DNA, 25 bp, Mus musculus
aggatgatattgggtttgatctgtg

SEQ ID NO: 876084 - DNA, 25 bp, Mus musculus
aggatgattgagcatgcaattcgaa

SEQ ID NO: 876085 - DNA, 25 bp, Mus musculus
aggatgattgaggatgcaattcgaa

SEQ ID NO: 876086 - DNA, 25 bp, Mus musculus
aggatgccagcccaaaccaggtggc

SEQ ID NO: 876087 - DNA, 25 bp, Mus musculus
aggatgccagccctccagggccagc

SEQ ID NO: 876088 - DNA, 25 bp, Mus musculus
aggatgccaggccaaaccaggtggc

SEQ ID NO: 876089 - DNA, 25 bp, Mus musculus
aggatgccaggccaccctcctgtgg

SEQ ID NO: 876090 - DNA, 25 bp, Mus musculus
aggatgccaggccagcctcctgtgg

SEQ ID NO: 876091 - DNA, 25 bp, Mus musculus
aggatgccaggcctccagggccagc

SEQ ID NO: 876092 - DNA, 25 bp, Mus musculus
aggatgcgagccatttccaagagtc

SEQ ID NO: 876093 - DNA, 25 bp, Mus musculus
aggatgcgaggcatttccaagagtc

SEQ ID NO: 876094 - DNA, 25 bp, Mus musculus
aggatgcgcggccgaaccgagcagc

SEQ ID NO: 876095 - DNA, 25 bp, Mus musculus
aggatgcgcggcggaaccgagcagc

SEQ ID NO: 876096 - DNA, 25 bp, Mus musculus
aggatgctaacatggctggtattgg

SEQ ID NO: 876097 - DNA, 25 bp, Mus musculus
aggatgctaagatggctggtattgg

SEQ ID NO: 876098 - DNA, 25 bp, Mus musculus
aggatgctgatgcattctctgctct

SEQ ID NO: 876099 - DNA, 25 bp, Mus musculus
aggatgctgatggattctctgctct

SEQ ID NO: 876100 - DNA, 25 bp, Mus musculus
aggatgctggcacgtatctgtgtga

SEQ ID NO: 876101 - DNA, 25 bp, Mus musculus
aggatgctggcaggtatctgtgtga

SEQ ID NO: 876102 - DNA, 25 bp, Mus musculus
aggatggaaccgcgcgcagcgcgtt

SEQ ID NO: 876103 - DNA, 25 bp, Mus musculus
aggatggaaccgggcgcagcgcgtt

SEQ ID NO: 876104 - DNA, 25 bp, Mus musculus
aggatggaagagaagctgaagaagg

SEQ ID NO: 876105 - DNA, 25 bp, Mus musculus
aggatggaagccacttgaagaggcc

SEQ ID NO: 876106 - DNA, 25 bp, Mus musculus
aggatggaaggcacttgaagaggcc

SEQ ID NO: 876107 - DNA, 25 bp, Mus musculus
aggatggaagtgaagctgaagaagg

SEQ ID NO: 876108 - DNA, 25 bp, Mus musculus
aggatggacacattcattacttccg

SEQ ID NO: 876109 - DNA, 25 bp, Mus musculus
aggatggacagattcattacttccg

SEQ ID NO: 876110 - DNA, 25 bp, Mus musculus
aggatggagaagaagtgggaaatat

SEQ ID NO: 876111 - DNA, 25 bp, Mus musculus
aggatggagaagtagtgggaaatat

SEQ ID NO: 876112 - DNA, 25 bp, Mus musculus
aggatggagacacgctgctccacct

SEQ ID NO: 876113 - DNA, 25 bp, Mus musculus
aggatggagacaggctgctccacct

SEQ ID NO: 876114 - DNA, 25 bp, Mus musculus
aggatggatcagacagaaagtgtgg

SEQ ID NO: 876115 - DNA, 25 bp, Mus musculus
aggatggatcagtcagaaagtgtgg

SEQ ID NO: 876116 - DNA, 25 bp, Mus musculus
aggatggcgacgatttccagagcag

SEQ ID NO: 876117 - DNA, 25 bp, Mus musculus
aggatggcgacgttttccagagcag

SEQ ID NO: 876118 - DNA, 25 bp, Mus musculus
aggatggctgatatagacagaatca

SEQ ID NO: 876119 - DNA, 25 bp, Mus musculus
aggatggctgttatagacagaatca

SEQ ID NO: 876120 - DNA, 25 bp, Mus musculus
aggatggtctcccacatcaacaatg

SEQ ID NO: 876121 - DNA, 25 bp, Mus musculus
aggatggtctccgacatcaacaatg

SEQ ID NO: 876122 - DNA, 25 bp, Mus musculus
aggatgtactctataaatggatata

SEQ ID NO: 876123 - DNA, 25 bp, Mus musculus
aggatgtactgtataaatggatata

SEQ ID NO: 876124 - DNA, 25 bp, Mus musculus
aggatgtcaaagcgacccaagagag

SEQ ID NO: 876125 - DNA, 25 bp, Mus musculus
aggatgtcaaagggacccaagagag

SEQ ID NO: 876126 - DNA, 25 bp, Mus musculus
aggatgtcagagagagttgcccacc

SEQ ID NO: 876127 - DNA, 25 bp, Mus musculus
aggatgtcagagagtgttgcccacc

SEQ ID NO: 876128 - DNA, 25 bp, Mus musculus
aggatgtcctcacccccctgagacc

SEQ ID NO: 876129 - DNA, 25 bp, Mus musculus
aggatgtcctcagccccctgagacc

SEQ ID NO: 876130 - DNA, 25 bp, Mus musculus
aggatgtggaagctcaagatgtagt

SEQ ID NO: 876131 - DNA, 25 bp, Mus musculus
aggatgtggaaggtcaagatgtagt

SEQ ID NO: 876132 - DNA, 25 bp, Mus musculus
aggatgtggtgatgactgacagtga

SEQ ID NO: 876133 - DNA, 25 bp, Mus musculus
aggatgtggtgatgtctgacagtga

SEQ ID NO: 876134 - DNA, 25 bp, Mus musculus
aggatgttacggagcacccgagtca

SEQ ID NO: 876135 - DNA, 25 bp, Mus musculus
aggatgttacggaggacccgagtca

SEQ ID NO: 876136 - DNA, 25 bp, Mus musculus
aggatgttccagcggaggaatggag

SEQ ID NO: 876137 - DNA, 25 bp, Mus musculus
aggatgttccaggggaggaatggag

SEQ ID NO: 876138 - DNA, 25 bp, Mus musculus
aggatgttctaccgcgactggtgga

SEQ ID NO: 876139 - DNA, 25 bp, Mus musculus
aggatgttctaccgggactggtgga

SEQ ID NO: 876140 - DNA, 25 bp, Mus musculus
aggattaaaaagcatactcactgtt

SEQ ID NO: 876141 - DNA, 25 bp, Mus musculus
aggattaaaaaggatactcactgtt

SEQ ID NO: 876142 - DNA, 25 bp, Mus musculus
aggattagggatcttggcaaccatg

SEQ ID NO: 876143 - DNA, 25 bp, Mus musculus
aggattagggttcttggcaaccatg

SEQ ID NO: 876144 - DNA, 25 bp, Mus musculus
aggattattccactacttccaggtg

SEQ ID NO: 876145 - DNA, 25 bp, Mus musculus
aggattattccagtacttccaggtg

SEQ ID NO: 876146 - DNA, 25 bp, Mus musculus
aggattcaaaccaggactgttcagt

SEQ ID NO: 876147 - DNA, 25 bp, Mus musculus
aggattcaaacctggactgttcagt

SEQ ID NO: 876148 - DNA, 25 bp, Mus musculus
aggattcacacacattctggaacaa

SEQ ID NO: 876149 - DNA, 25 bp, Mus musculus
aggattcacacagattctggaacaa

SEQ ID NO: 876150 - DNA, 25 bp, Mus musculus
aggattccagcagtccctggctcca

SEQ ID NO: 876151 - DNA, 25 bp, Mus musculus
aggattccaggagtccctggctcca

SEQ ID NO: 876152 - DNA, 25 bp, Mus musculus
aggattccttcatctcgaggctcct

SEQ ID NO: 876153 - DNA, 25 bp, Mus musculus
aggattccttgatctcgaggctcct

SEQ ID NO: 876154 - DNA, 25 bp, Mus musculus
aggattcgcaagctcgctgaccagt

SEQ ID NO: 876155 - DNA, 25 bp, Mus musculus
aggattcgcaagctggctgaccagt

SEQ ID NO: 876156 - DNA, 25 bp, Mus musculus
aggattctgacaacctgcagagcct

SEQ ID NO: 876157 - DNA, 25 bp, Mus musculus
aggattctgacaatgatggcgaggc

SEQ ID NO: 876158 - DNA, 25 bp, Mus musculus
aggattctgacatcctgcagagcct

SEQ ID NO: 876159 - DNA, 25 bp, Mus musculus
aggattctgacattgatggcgaggc

SEQ ID NO: 876160 - DNA, 25 bp, Mus musculus
aggattctgagacggaggagaccga

SEQ ID NO: 876161 - DNA, 25 bp, Mus musculus
aggattctgagagggaggagaccga

SEQ ID NO: 876162 - DNA, 25 bp, Mus musculus
aggattctgtgccccgtggcgtgtg

SEQ ID NO: 876163 - DNA, 25 bp, Mus musculus
aggattctgtgcccggtggcgtgtg

SEQ ID NO: 876164 - DNA, 25 bp, Mus musculus
aggattcttagcaacggtctgtcac

SEQ ID NO: 876165 - DNA, 25 bp, Mus musculus
aggattcttagcaagggtctgtcac

SEQ ID NO: 876166 - DNA, 25 bp, Mus musculus
aggattgcattacgaaagaatgttt

SEQ ID NO: 876167 - DNA, 25 bp, Mus musculus
aggattgcattaggaaagaatgttt

SEQ ID NO: 876168 - DNA, 25 bp, Mus musculus
aggattggaacatcgaagcctgttc

SEQ ID NO: 876169 - DNA, 25 bp, Mus musculus
aggattggaagatcgaagcctgttc

SEQ ID NO: 876170 - DNA, 25 bp, Mus musculus
aggattgtagcctctatcacacggt

SEQ ID NO: 876171 - DNA, 25 bp, Mus musculus
aggattgtaggctctatcacacggt

SEQ ID NO: 876172 - DNA, 25 bp, Mus musculus
aggattgtgtgtctcgcttatggta

SEQ ID NO: 876173 - DNA, 25 bp, Mus musculus
aggattgtgtgtctcggagaagatg

SEQ ID NO: 876174 - DNA, 25 bp, Mus musculus
aggattgtgtgtctggcttatggta

SEQ ID NO: 876175 - DNA, 25 bp, Mus musculus
aggattgtgtgtctgggagaagatg

SEQ ID NO: 876176 - DNA, 25 bp, Mus musculus
aggatttaagaaagaatgccccagt

SEQ ID NO: 876177 - DNA, 25 bp, Mus musculus
aggatttaagaatgaatgccccagt

SEQ ID NO: 876178 - DNA, 25 bp, Mus musculus
aggatttcagattcttcccacggaa

SEQ ID NO: 876179 - DNA, 25 bp, Mus musculus
aggatttcagccaattacctccagt

SEQ ID NO: 876180 - DNA, 25 bp, Mus musculus
aggatttcaggcaattacctccagt

SEQ ID NO: 876181 - DNA, 25 bp, Mus musculus
aggatttcagtttcttcccacggaa

SEQ ID NO: 876182 - DNA, 25 bp, Mus musculus
aggatttgagcaactacagtttctc

SEQ ID NO: 876183 - DNA, 25 bp, Mus musculus
aggatttgagccctacctaggactc

SEQ ID NO: 876184 - DNA, 25 bp, Mus musculus
aggatttgaggaactacagtttctc

SEQ ID NO: 876185 - DNA, 25 bp, Mus musculus
aggatttgaggcctacctaggactc

SEQ ID NO: 876186 - DNA, 25 bp, Mus musculus
aggatttggagtagatcaatcccct

SEQ ID NO: 876187 - DNA, 25 bp, Mus musculus
aggatttggagtagttcaatcccct

SEQ ID NO: 876188 - DNA, 25 bp, Mus musculus
aggattttctcacggaggcgccttg

SEQ ID NO: 876189 - DNA, 25 bp, Mus musculus
aggattttctcacgggccgatcaac

SEQ ID NO: 876190 - DNA, 25 bp, Mus musculus
aggattttctcagggaggcgccttg

SEQ ID NO: 876191 - DNA, 25 bp, Mus musculus
aggattttctcaggggccgatcaac

SEQ ID NO: 876192 - DNA, 25 bp, Mus musculus
aggcaaaactgactgaccttcagaa

SEQ ID NO: 876193 - DNA, 25 bp, Mus musculus
aggcaaaactgagtgaccttcagaa

SEQ ID NO: 876194 - DNA, 25 bp, Mus musculus
aggcaaaagcagctacctgtttgca

SEQ ID NO: 876195 - DNA, 25 bp, Mus musculus
aggcaaaagcaggtacctgtttgca

SEQ ID NO: 876196 - DNA, 25 bp, Mus musculus
aggcaaaatagcgaagtctggaata

SEQ ID NO: 876197 - DNA, 25 bp, Mus musculus
aggcaaaatagcgatgtctggaata

SEQ ID NO: 876198 - DNA, 25 bp, Mus musculus
aggcaaacaacacggcagcagaaga

SEQ ID NO: 876199 - DNA, 25 bp, Mus musculus
aggcaaacaacacggtggcagacga

SEQ ID NO: 876200 - DNA, 25 bp, Mus musculus
aggcaaacaacagggcagcagaaga

SEQ ID NO: 876201 - DNA, 25 bp, Mus musculus
aggcaaacaacagggtggcagacga

SEQ ID NO: 876202 - DNA, 25 bp, Mus musculus
aggcaaagacaaagtactccaatta

SEQ ID NO: 876203 - DNA, 25 bp, Mus musculus
aggcaaagacaatgtactccaatta

SEQ ID NO: 876204 - DNA, 25 bp, Mus musculus
aggcaaagagcgacaactgatggag

SEQ ID NO: 876205 - DNA, 25 bp, Mus musculus
aggcaaagagggacaactgatggag

SEQ ID NO: 876206 - DNA, 25 bp, Mus musculus
aggcaaagttagatccaatgtcttg

SEQ ID NO: 876207 - DNA, 25 bp, Mus musculus
aggcaaagttagttccaatgtcttg

SEQ ID NO: 876208 - DNA, 25 bp, Mus musculus
aggcaaatataaaacgtgacaggag

SEQ ID NO: 876209 - DNA, 25 bp, Mus musculus
aggcaaatataaaaggtgacaggag

SEQ ID NO: 876210 - DNA, 25 bp, Mus musculus
aggcaaatggaacgaaacttcatgg

SEQ ID NO: 876211 - DNA, 25 bp, Mus musculus
aggcaaatggaaggaaacttcatgg

SEQ ID NO: 876212 - DNA, 25 bp, Mus musculus
aggcaacaagcccgatgtaagcagc

SEQ ID NO: 876213 - DNA, 25 bp, Mus musculus
aggcaacaaggccgatgtaagcagc

SEQ ID NO: 876214 - DNA, 25 bp, Mus musculus
aggcaacatggaagagaaggatgcg

SEQ ID NO: 876215 - DNA, 25 bp, Mus musculus
aggcaacatggaagtgaaggatgcg

SEQ ID NO: 876216 - DNA, 25 bp, Mus musculus
aggcaactaagcccatgtgggagct

SEQ ID NO: 876217 - DNA, 25 bp, Mus musculus
aggcaactaagcgcatgtgggagct

SEQ ID NO: 876218 - DNA, 25 bp, Mus musculus
aggcaagaaccgcagacaatcaggc

SEQ ID NO: 876219 - DNA, 25 bp, Mus musculus
aggcaagaaccggagacaatcaggc

SEQ ID NO: 876220 - DNA, 25 bp, Mus musculus
aggcaagaagatcgccaatgccctg

SEQ ID NO: 876221 - DNA, 25 bp, Mus musculus
aggcaagaagttcgccaatgccctg

SEQ ID NO: 876222 - DNA, 25 bp, Mus musculus
aggcaagatgcctttgcggggcctt

SEQ ID NO: 876223 - DNA, 25 bp, Mus musculus
aggcaagatggctttgcggggcctt

SEQ ID NO: 876224 - DNA, 25 bp, Mus musculus
aggcaaggagcgcctcatcggcttt

SEQ ID NO: 876225 - DNA, 25 bp, Mus musculus
aggcaaggagggcctcatcggcttt

SEQ ID NO: 876226 - DNA, 25 bp, Mus musculus
aggcaaggatagcatccatgtctta

SEQ ID NO: 876227 - DNA, 25 bp, Mus musculus
aggcaaggatagcgagcgcctcatc

SEQ ID NO: 876228 - DNA, 25 bp, Mus musculus
aggcaaggataggatccatgtctta

SEQ ID NO: 876229 - DNA, 25 bp, Mus musculus
aggcaaggatagggagcgcctcatc

SEQ ID NO: 876230 - DNA, 25 bp, Mus musculus
aggcaatcagcacgtaaagtatatt

SEQ ID NO: 876231 - DNA, 25 bp, Mus musculus
aggcaatcaggacgtaaagtatatt

SEQ ID NO: 876232 - DNA, 25 bp, Mus musculus
aggcacacaacccctcactggagga

SEQ ID NO: 876233 - DNA, 25 bp, Mus musculus
aggcacacaagccctcactggagga

SEQ ID NO: 876234 - DNA, 25 bp, Mus musculus
aggcacagacggatcaacagtaaaa

SEQ ID NO: 876235 - DNA, 25 bp, Mus musculus
aggcacagacggttcaacagtaaaa

SEQ ID NO: 876236 - DNA, 25 bp, Mus musculus
aggcacagagatgagtcagtctgac

SEQ ID NO: 876237 - DNA, 25 bp, Mus musculus
aggcacagagttgagtcagtctgac

SEQ ID NO: 876238 - DNA, 25 bp, Mus musculus
aggcacaggctccacgctgttggaa

SEQ ID NO: 876239 - DNA, 25 bp, Mus musculus
aggcacaggctccaggctgttggaa

SEQ ID NO: 876240 - DNA, 25 bp, Mus musculus
aggcaccagtctctggggtggcctt

SEQ ID NO: 876241 - DNA, 25 bp, Mus musculus
aggcaccagtgtctggggtggcctt

SEQ ID NO: 876242 - DNA, 25 bp, Mus musculus
aggcaccatcactcacacctatgtc

SEQ ID NO: 876243 - DNA, 25 bp, Mus musculus
aggcaccatcactctcacctatgtc

SEQ ID NO: 876244 - DNA, 25 bp, Mus musculus
aggcacccaagacgtcattggtgat

SEQ ID NO: 876245 - DNA, 25 bp, Mus musculus
aggcacccaagaggtcattggtgat

SEQ ID NO: 876246 - DNA, 25 bp, Mus musculus
aggcaccgaagacagtgtgaacatg

SEQ ID NO: 876247 - DNA, 25 bp, Mus musculus
aggcaccgaagagagtgtgaacatg

SEQ ID NO: 876248 - DNA, 25 bp, Mus musculus
aggcaccgcgatgtgctggctgctg

SEQ ID NO: 876249 - DNA, 25 bp, Mus musculus
aggcaccgcgcaccgtctgggcaga

SEQ ID NO: 876250 - DNA, 25 bp, Mus musculus
aggcaccgcggaccgtctgggcaga

SEQ ID NO: 876251 - DNA, 25 bp, Mus musculus
aggcaccgcgttgtgctggctgctg

SEQ ID NO: 876252 - DNA, 25 bp, Mus musculus
aggcacctactcagctctcagaact

SEQ ID NO: 876253 - DNA, 25 bp, Mus musculus
aggcacctactctgctctcagaact

SEQ ID NO: 876254 - DNA, 25 bp, Mus musculus
aggcacgagcaacagtactgtttgg

SEQ ID NO: 876255 - DNA, 25 bp, Mus musculus
aggcacgagcaagagtactgtttgg

SEQ ID NO: 876256 - DNA, 25 bp, Mus musculus
aggcacggaatgcctattgtgagaa

SEQ ID NO: 876257 - DNA, 25 bp, Mus musculus
aggcacggaatggctattgtgagaa

SEQ ID NO: 876258 - DNA, 25 bp, Mus musculus
aggcacggagagccttccatatgac

SEQ ID NO: 876259 - DNA, 25 bp, Mus musculus
aggcacggagaggcttccatatgac

SEQ ID NO: 876260 - DNA, 25 bp, Mus musculus
aggcactaaaagctacatggcccct

SEQ ID NO: 876261 - DNA, 25 bp, Mus musculus
aggcactaaaaggtacatggcccct

SEQ ID NO: 876262 - DNA, 25 bp, Mus musculus
aggcactacaggaactgggaggtct

SEQ ID NO: 876263 - DNA, 25 bp, Mus musculus
aggcactacaggaagtgggaggtct

SEQ ID NO: 876264 - DNA, 25 bp, Mus musculus
aggcactagatacagcagaagcatt

SEQ ID NO: 876265 - DNA, 25 bp, Mus musculus
aggcactagatagagcagaagcatt

SEQ ID NO: 876266 - DNA, 25 bp, Mus musculus
aggcactcagcacacagcgagggaa

SEQ ID NO: 876267 - DNA, 25 bp, Mus musculus
aggcactcagcacagagcgagggaa

SEQ ID NO: 876268 - DNA, 25 bp, Mus musculus
aggcactcgctgctgtccttcgtgg

SEQ ID NO: 876269 - DNA, 25 bp, Mus musculus
aggcactcgctggtgtccttcgtgg

SEQ ID NO: 876270 - DNA, 25 bp, Mus musculus
aggcactgatatcacgaggagccat

SEQ ID NO: 876271 - DNA, 25 bp, Mus musculus
aggcactgatatcaggaggagccat

SEQ ID NO: 876272 - DNA, 25 bp, Mus musculus
aggcactgcagacacaccctgctgc

SEQ ID NO: 876273 - DNA, 25 bp, Mus musculus
aggcactgcagacagaccctgctgc

SEQ ID NO: 876274 - DNA, 25 bp, Mus musculus
aggcactgccaccgcgttcacattc

SEQ ID NO: 876275 - DNA, 25 bp, Mus musculus
aggcactgccaccgctcacgaagtt

SEQ ID NO: 876276 - DNA, 25 bp, Mus musculus
aggcactgccaccgggttcacattc

SEQ ID NO: 876277 - DNA, 25 bp, Mus musculus
aggcactgccaccggtcacgaagtt

SEQ ID NO: 876278 - DNA, 25 bp, Mus musculus
aggcactgtgagcttctttaactca

SEQ ID NO: 876279 - DNA, 25 bp, Mus musculus
aggcactgtgaggttctttaactca

SEQ ID NO: 876280 - DNA, 25 bp, Mus musculus
aggcactgtgatgatgatgccacga

SEQ ID NO: 876281 - DNA, 25 bp, Mus musculus
aggcactgtgttgatgatgccacga

SEQ ID NO: 876282 - DNA, 25 bp, Mus musculus
aggcacttcgcacagctcctcaggc

SEQ ID NO: 876283 - DNA, 25 bp, Mus musculus
aggcacttcggacagctcctcaggc

SEQ ID NO: 876284 - DNA, 25 bp, Mus musculus
aggcacttgtgaaaccctgcaagag

SEQ ID NO: 876285 - DNA, 25 bp, Mus musculus
aggcacttgtgaaagcctgcaagag

SEQ ID NO: 876286 - DNA, 25 bp, Mus musculus
aggcactttagaccaaattatgaaa

SEQ ID NO: 876287 - DNA, 25 bp, Mus musculus
aggcactttagagcaaattatgaaa

SEQ ID NO: 876288 - DNA, 25 bp, Mus musculus
aggcagaaaagacgtcaaaatgcag

SEQ ID NO: 876289 - DNA, 25 bp, Mus musculus
aggcagaaaagaggtcaaaatgcag

SEQ ID NO: 876290 - DNA, 25 bp, Mus musculus
aggcagaagactggtactttggaaa

SEQ ID NO: 876291 - DNA, 25 bp, Mus musculus
aggcagaagagtggtactttggaaa

SEQ ID NO: 876292 - DNA, 25 bp, Mus musculus
aggcagaatgctatcaaaagcccca

SEQ ID NO: 876293 - DNA, 25 bp, Mus musculus
aggcagaatgctttcaaaagcccca

SEQ ID NO: 876294 - DNA, 25 bp, Mus musculus
aggcagacagaccgcgcatcctcct

SEQ ID NO: 876295 - DNA, 25 bp, Mus musculus
aggcagacagaccgggcatcctcct

SEQ ID NO: 876296 - DNA, 25 bp, Mus musculus
aggcagacccagctttcagttctcc

SEQ ID NO: 876297 - DNA, 25 bp, Mus musculus
aggcagacccaggtttcagttctcc

SEQ ID NO: 876298 - DNA, 25 bp, Mus musculus
aggcagacctaacgattcaggccac

SEQ ID NO: 876299 - DNA, 25 bp, Mus musculus
aggcagacctaaggattcaggccac

SEQ ID NO: 876300 - DNA, 25 bp, Mus musculus
aggcagacctcactggcttggatga

SEQ ID NO: 876301 - DNA, 25 bp, Mus musculus
aggcagacctcagtggcttggatga

SEQ ID NO: 876302 - DNA, 25 bp, Mus musculus
aggcagactccacaatggagaagat

SEQ ID NO: 876303 - DNA, 25 bp, Mus musculus
aggcagactccagaatggagaagat

SEQ ID NO: 876304 - DNA, 25 bp, Mus musculus
aggcagagagtaagaactgtgccaa

SEQ ID NO: 876305 - DNA, 25 bp, Mus musculus
aggcagagagtaagtactgtgccaa

SEQ ID NO: 876306 - DNA, 25 bp, Mus musculus
aggcagagcagatgcgatgagccgg

SEQ ID NO: 876307 - DNA, 25 bp, Mus musculus
aggcagagcagatgggatgagccgg

SEQ ID NO: 876308 - DNA, 25 bp, Mus musculus
aggcagaggcagccgtgcccacact

SEQ ID NO: 876309 - DNA, 25 bp, Mus musculus
aggcagaggcaggcgtgcccacact

SEQ ID NO: 876310 - DNA, 25 bp, Mus musculus
aggcagagtgcagctcttccgaagg

SEQ ID NO: 876311 - DNA, 25 bp, Mus musculus
aggcagagtgctcttccgaaggctg

SEQ ID NO: 876312 - DNA, 25 bp, Mus musculus
aggcagagtggagctcttccgaagg

SEQ ID NO: 876313 - DNA, 25 bp, Mus musculus
aggcagagtggtcttccgaaggctg

SEQ ID NO: 876314 - DNA, 25 bp, Mus musculus
aggcagataaagataatggaggtga

SEQ ID NO: 876315 - DNA, 25 bp, Mus musculus
aggcagataaagttaatggaggtga

SEQ ID NO: 876316 - DNA, 25 bp, Mus musculus
aggcagatctaccgttgttctcaag

SEQ ID NO: 876317 - DNA, 25 bp, Mus musculus
aggcagatctacggttgttctcaag

SEQ ID NO: 876318 - DNA, 25 bp, Mus musculus
aggcagcagaaaccctaaaagcctt

SEQ ID NO: 876319 - DNA, 25 bp, Mus musculus
aggcagcagaaaccgtaaaagcctt

SEQ ID NO: 876320 - DNA, 25 bp, Mus musculus
aggcagccaatgagccaggggattc

SEQ ID NO: 876321 - DNA, 25 bp, Mus musculus
aggcagccaatgagcgggattcttc

SEQ ID NO: 876322 - DNA, 25 bp, Mus musculus
aggcagccaatgaggcaggggattc

SEQ ID NO: 876323 - DNA, 25 bp, Mus musculus
aggcagccaatgagggggattcttc

SEQ ID NO: 876324 - DNA, 25 bp, Mus musculus
aggcagcctttactgtggcagtgtg

SEQ ID NO: 876325 - DNA, 25 bp, Mus musculus
aggcagcctttagtgtggcagtgtg

SEQ ID NO: 876326 - DNA, 25 bp, Mus musculus
aggcagcgtagacctttatgcagag

SEQ ID NO: 876327 - DNA, 25 bp, Mus musculus
aggcagcgtagagctttatgcagag

SEQ ID NO: 876328 - DNA, 25 bp, Mus musculus
aggcagctaaacagtgttatattgc

SEQ ID NO: 876329 - DNA, 25 bp, Mus musculus
aggcagctaaactgtgttatattgc

SEQ ID NO: 876330 - DNA, 25 bp, Mus musculus
aggcagctaaagcaattacacctag

SEQ ID NO: 876331 - DNA, 25 bp, Mus musculus
aggcagctaaaggaattacacctag

SEQ ID NO: 876332 - DNA, 25 bp, Mus musculus
aggcaggcagattgaccttggccca

SEQ ID NO: 876333 - DNA, 25 bp, Mus musculus
aggcaggcagtttgaccttggccca

SEQ ID NO: 876334 - DNA, 25 bp, Mus musculus
aggcagggtgcccagatgatggtag

SEQ ID NO: 876335 - DNA, 25 bp, Mus musculus
aggcagggtgccgagatgatggtag

SEQ ID NO: 876336 - DNA, 25 bp, Mus musculus
aggcaggtcaaccacggaaaatgcc

SEQ ID NO: 876337 - DNA, 25 bp, Mus musculus
aggcaggtcaaccagggaaaatgcc

SEQ ID NO: 876338 - DNA, 25 bp, Mus musculus
aggcaggtccaacgcttgagatttt

SEQ ID NO: 876339 - DNA, 25 bp, Mus musculus
aggcaggtccaaggcttgagatttt

SEQ ID NO: 876340 - DNA, 25 bp, Mus musculus
aggcagtctctgcgttcagacaatg

SEQ ID NO: 876341 - DNA, 25 bp, Mus musculus
aggcagtctctgggttcagacaatg

SEQ ID NO: 876342 - DNA, 25 bp, Mus musculus
aggcagtgggaaagcgagtcatgtg

SEQ ID NO: 876343 - DNA, 25 bp, Mus musculus
aggcagtgggaaagggagtcatgtg

SEQ ID NO: 876344 - DNA, 25 bp, Mus musculus
aggcagtgtgaacacattgacgagt

SEQ ID NO: 876345 - DNA, 25 bp, Mus musculus
aggcagtgtgaagacattgacgagt

SEQ ID NO: 876346 - DNA, 25 bp, Mus musculus
aggcagtgtgagcacatggatgaat

SEQ ID NO: 876347 - DNA, 25 bp, Mus musculus
aggcagtgtgaggacatggatgaat

SEQ ID NO: 876348 - DNA, 25 bp, Mus musculus
aggcagttcaagccaataaaagcga

SEQ ID NO: 876349 - DNA, 25 bp, Mus musculus
aggcagttcaagcgctaacttaaag

SEQ ID NO: 876350 - DNA, 25 bp, Mus musculus
aggcagttcaaggcaataaaagcga

SEQ ID NO: 876351 - DNA, 25 bp, Mus musculus
aggcagttcaagggctaacttaaag

SEQ ID NO: 876352 - DNA, 25 bp, Mus musculus
aggcagtttgagcagtgcatttccc

SEQ ID NO: 876353 - DNA, 25 bp, Mus musculus
aggcagtttgaggagtgcatttccc

SEQ ID NO: 876354 - DNA, 25 bp, Mus musculus
aggcataaaaggaacagagaattca

SEQ ID NO: 876355 - DNA, 25 bp, Mus musculus
aggcataaaaggaaccagagagaat

SEQ ID NO: 876356 - DNA, 25 bp, Mus musculus
aggcataaaaggaagagagaattca

SEQ ID NO: 876357 - DNA, 25 bp, Mus musculus
aggcataaaaggaagcagagagaat

SEQ ID NO: 876358 - DNA, 25 bp, Mus musculus
aggcataatgggaacgaccaaggac

SEQ ID NO: 876359 - DNA, 25 bp, Mus musculus
aggcataatgggaaggaccaaggac

SEQ ID NO: 876360 - DNA, 25 bp, Mus musculus
aggcatatgcttccttggggactga

SEQ ID NO: 876361 - DNA, 25 bp, Mus musculus
aggcatatgcttcggagactcgggc

SEQ ID NO: 876362 - DNA, 25 bp, Mus musculus
aggcatatgcttgcttggggactga

SEQ ID NO: 876363 - DNA, 25 bp, Mus musculus
aggcatatgcttgggagactcgggc

SEQ ID NO: 876364 - DNA, 25 bp, Mus musculus
aggcatatttccctgcataagtgag

SEQ ID NO: 876365 - DNA, 25 bp, Mus musculus
aggcatatttgcctgcataagtgag

SEQ ID NO: 876366 - DNA, 25 bp, Mus musculus
aggcatcaacagaataaccagagct

SEQ ID NO: 876367 - DNA, 25 bp, Mus musculus
aggcatcaacagtataaccagagct

SEQ ID NO: 876368 - DNA, 25 bp, Mus musculus
aggcatcaatgcagttttctactat

SEQ ID NO: 876369 - DNA, 25 bp, Mus musculus
aggcatcaatgctgttttctactat

SEQ ID NO: 876370 - DNA, 25 bp, Mus musculus
aggcatccagggacatgttggtgcc

SEQ ID NO: 876371 - DNA, 25 bp, Mus musculus
aggcatccagggtcatgttggtgcc

SEQ ID NO: 876372 - DNA, 25 bp, Mus musculus
aggcatccggcaagctgaatgcaag

SEQ ID NO: 876373 - DNA, 25 bp, Mus musculus
aggcatccgggaagctgaatgcaag

SEQ ID NO: 876374 - DNA, 25 bp, Mus musculus
aggcatgaagcgctcccgctctggt

SEQ ID NO: 876375 - DNA, 25 bp, Mus musculus
aggcatgaagcggtcccgctctggt

SEQ ID NO: 876376 - DNA, 25 bp, Mus musculus
aggcatgaagtagacaccatccatg

SEQ ID NO: 876377 - DNA, 25 bp, Mus musculus
aggcatgaagtagagaccatccatg

SEQ ID NO: 876378 - DNA, 25 bp, Mus musculus
aggcatgaggcgccataaaggggcg

SEQ ID NO: 876379 - DNA, 25 bp, Mus musculus
aggcatgaggggccataaaggggcg

SEQ ID NO: 876380 - DNA, 25 bp, Mus musculus
aggcatgccgtggacagaaacaagg

SEQ ID NO: 876381 - DNA, 25 bp, Mus musculus
aggcatgccgtggagagaaacaagg

SEQ ID NO: 876382 - DNA, 25 bp, Mus musculus
aggcatggacttgacgtgtcggaaa

SEQ ID NO: 876383 - DNA, 25 bp, Mus musculus
aggcatggacttgaggtgtcggaaa

SEQ ID NO: 876384 - DNA, 25 bp, Mus musculus
aggcattacgtcatctactatgaga

SEQ ID NO: 876385 - DNA, 25 bp, Mus musculus
aggcattacgtcatgtactatgaga

SEQ ID NO: 876386 - DNA, 25 bp, Mus musculus
aggcattatttacacggacctcaag

SEQ ID NO: 876387 - DNA, 25 bp, Mus musculus
aggcattatttacagggacctcaag

SEQ ID NO: 876388 - DNA, 25 bp, Mus musculus
aggcattcggctgcgccaccaacac

SEQ ID NO: 876389 - DNA, 25 bp, Mus musculus
aggcattcgggtgcgccaccaacac

SEQ ID NO: 876390 - DNA, 25 bp, Mus musculus
aggcattgatcaagggccctgaaga

SEQ ID NO: 876391 - DNA, 25 bp, Mus musculus
aggcattgatcatgggccctgaaga

SEQ ID NO: 876392 - DNA, 25 bp, Mus musculus
aggcattgctgtcttacatagtaat

SEQ ID NO: 876393 - DNA, 25 bp, Mus musculus
aggcattgctgtgttacatagtaat

SEQ ID NO: 876394 - DNA, 25 bp, Mus musculus
aggccaacagccgataccaaaagag

SEQ ID NO: 876395 - DNA, 25 bp, Mus musculus
aggccaacaggcgataccaaaagag

SEQ ID NO: 876396 - DNA, 25 bp, Mus musculus
aggccaagaaacagactgcagcccc

SEQ ID NO: 876397 - DNA, 25 bp, Mus musculus
aggccaagaaggaggccttacaaat

SEQ ID NO: 876398 - DNA, 25 bp, Mus musculus
aggccaagaaggtggccttacaaat

SEQ ID NO: 876399 - DNA, 25 bp, Mus musculus
aggccaagaatcagactgcagcccc

SEQ ID NO: 876400 - DNA, 25 bp, Mus musculus
aggccaagacatgcccggaaccgcg

SEQ ID NO: 876401 - DNA, 25 bp, Mus musculus
aggccaagacttgcccggaaccgcg

SEQ ID NO: 876402 - DNA, 25 bp, Mus musculus
aggccaagcacacgaatgaaaggcc

SEQ ID NO: 876403 - DNA, 25 bp, Mus musculus
aggccaagcacaggaatgaaaggcc

SEQ ID NO: 876404 - DNA, 25 bp, Mus musculus
aggccaagctagccctgcttgtcaa

SEQ ID NO: 876405 - DNA, 25 bp, Mus musculus
aggccaagcttgccctgcttgtcaa

SEQ ID NO: 876406 - DNA, 25 bp, Mus musculus
aggccaaggtgacagaacgatttcg

SEQ ID NO: 876407 - DNA, 25 bp, Mus musculus
aggccaaggtgagagaacgatttcg

SEQ ID NO: 876408 - DNA, 25 bp, Mus musculus
aggccaagtctgcaatcagaagagg

SEQ ID NO: 876409 - DNA, 25 bp, Mus musculus
aggccaagtctggaatcagaagagg

SEQ ID NO: 876410 - DNA, 25 bp, Mus musculus
aggccaatcgctccctcttcgcagg

SEQ ID NO: 876411 - DNA, 25 bp, Mus musculus
aggccaatcggtccctcttcgcagg

SEQ ID NO: 876412 - DNA, 25 bp, Mus musculus
aggccaattactgaccaaattgctg

SEQ ID NO: 876413 - DNA, 25 bp, Mus musculus
aggccaattactgagcaaattgctg

SEQ ID NO: 876414 - DNA, 25 bp, Mus musculus
aggccacagaaagctcctgagaggg

SEQ ID NO: 876415 - DNA, 25 bp, Mus musculus
aggccacagatagctcctgagaggg

SEQ ID NO: 876416 - DNA, 25 bp, Mus musculus
aggccacatcctcggagccttaaac

SEQ ID NO: 876417 - DNA, 25 bp, Mus musculus
aggccacatcctgggagccttaaac

SEQ ID NO: 876418 - DNA, 25 bp, Mus musculus
aggccaccacagcacaactgtctgg

SEQ ID NO: 876419 - DNA, 25 bp, Mus musculus
aggccaccacagcagaactgtctgg

SEQ ID NO: 876420 - DNA, 25 bp, Mus musculus
aggccacccattcacggcatatttg

SEQ ID NO: 876421 - DNA, 25 bp, Mus musculus
aggccacccattcagggcatatttg

SEQ ID NO: 876422 - DNA, 25 bp, Mus musculus
aggccacgaaatcaacacgagagct

SEQ ID NO: 876423 - DNA, 25 bp, Mus musculus
aggccacgaaatgaacacgagagct

SEQ ID NO: 876424 - DNA, 25 bp, Mus musculus
aggccactcattcacggagtgttgt

SEQ ID NO: 876425 - DNA, 25 bp, Mus musculus
aggccactcattcagggagtgttgt

SEQ ID NO: 876426 - DNA, 25 bp, Mus musculus
aggccagacctccggacagattgtg

SEQ ID NO: 876427 - DNA, 25 bp, Mus musculus
aggccagacctcgggacagattgtg

SEQ ID NO: 876428 - DNA, 25 bp, Mus musculus
aggccagactatgttggatttgaaa

SEQ ID NO: 876429 - DNA, 25 bp, Mus musculus
aggccagactttgttggatttgaaa

SEQ ID NO: 876430 - DNA, 25 bp, Mus musculus
aggccagagcagatgaagtgagaga

SEQ ID NO: 876431 - DNA, 25 bp, Mus musculus
aggccagagcagcctccttaggctt

SEQ ID NO: 876432 - DNA, 25 bp, Mus musculus
aggccagagcaggctccttaggctt

SEQ ID NO: 876433 - DNA, 25 bp, Mus musculus
aggccagagcagttgaagtgagaga

SEQ ID NO: 876434 - DNA, 25 bp, Mus musculus
aggccagcagagggctctggcaaga

SEQ ID NO: 876435 - DNA, 25 bp, Mus musculus
aggccagcagctgtacagtgggctc

SEQ ID NO: 876436 - DNA, 25 bp, Mus musculus
aggccagcaggtgtacagtgggctc

SEQ ID NO: 876437 - DNA, 25 bp, Mus musculus
aggccagcagtgggctctggcaaga

SEQ ID NO: 876438 - DNA, 25 bp, Mus musculus
aggccaggagagagcggagaaaggg

SEQ ID NO: 876439 - DNA, 25 bp, Mus musculus
aggccaggagagaggggagaaaggg

SEQ ID NO: 876440 - DNA, 25 bp, Mus musculus
aggccaggaggcagttctggctatg

SEQ ID NO: 876441 - DNA, 25 bp, Mus musculus
aggccaggaggctgttctggctatg

SEQ ID NO: 876442 - DNA, 25 bp, Mus musculus
aggccaggttgacgtctggagaatt

SEQ ID NO: 876443 - DNA, 25 bp, Mus musculus
aggccaggttgaggtctggagaatt

SEQ ID NO: 876444 - DNA, 25 bp, Mus musculus
aggccagtgaggctgtcatctggga

SEQ ID NO: 876445 - DNA, 25 bp, Mus musculus
aggccagtgagggtgtcatctggga

SEQ ID NO: 876446 - DNA, 25 bp, Mus musculus
aggccagttcctcagggcagtggct

SEQ ID NO: 876447 - DNA, 25 bp, Mus musculus
aggccagttcctgagggcagtggct

SEQ ID NO: 876448 - DNA, 25 bp, Mus musculus
aggccatcaccacggtgtttccaca

SEQ ID NO: 876449 - DNA, 25 bp, Mus musculus
aggccatcaccagggtgtttccaca

SEQ ID NO: 876450 - DNA, 25 bp, Mus musculus
aggccatcagcgctgcatgcacagt

SEQ ID NO: 876451 - DNA, 25 bp, Mus musculus
aggccatcaggacacacttgaaccg

SEQ ID NO: 876452 - DNA, 25 bp, Mus musculus
aggccatcaggacagacttgaaccg

SEQ ID NO: 876453 - DNA, 25 bp, Mus musculus
aggccatcagggctgcatgcacagt

SEQ ID NO: 876454 - DNA, 25 bp, Mus musculus
aggccatcatcgatcctgcacagga

SEQ ID NO: 876455 - DNA, 25 bp, Mus musculus
aggccatcatcgatgctgcacagga

SEQ ID NO: 876456 - DNA, 25 bp, Mus musculus
aggccatcctggcttgctcttctgg

SEQ ID NO: 876457 - DNA, 25 bp, Mus musculus
aggccatcctgggttgctcttctgg

SEQ ID NO: 876458 - DNA, 25 bp, Mus musculus
aggccatctcagctgatgaagaggc

SEQ ID NO: 876459 - DNA, 25 bp, Mus musculus
aggccatctcaggtgatgaagaggc

SEQ ID NO: 876460 - DNA, 25 bp, Mus musculus
aggccatcttcactgcctcaattga

SEQ ID NO: 876461 - DNA, 25 bp, Mus musculus
aggccatcttcagtgcctcaattga

SEQ ID NO: 876462 - DNA, 25 bp, Mus musculus
aggccatgagcaacaaggcgtgcag

SEQ ID NO: 876463 - DNA, 25 bp, Mus musculus
aggccatgaggaacaaggcgtgcag

SEQ ID NO: 876464 - DNA, 25 bp, Mus musculus
aggccatttcagctttggtatgcct

SEQ ID NO: 876465 - DNA, 25 bp, Mus musculus
aggccatttcaggtttggtatgcct

SEQ ID NO: 876466 - DNA, 25 bp, Mus musculus
aggcccaaacagctatcatcaggac

SEQ ID NO: 876467 - DNA, 25 bp, Mus musculus
aggcccaaacaggtatcatcaggac

SEQ ID NO: 876468 - DNA, 25 bp, Mus musculus
aggcccagacttctcggcttaaggt

SEQ ID NO: 876469 - DNA, 25 bp, Mus musculus
aggcccagacttctgggcttaaggt

SEQ ID NO: 876470 - DNA, 25 bp, Mus musculus
aggcccaggaagaaacatgtatcat

SEQ ID NO: 876471 - DNA, 25 bp, Mus musculus
aggcccaggaagaagaatgtccctt

SEQ ID NO: 876472 - DNA, 25 bp, Mus musculus
aggcccaggaagtaacatgtatcat

SEQ ID NO: 876473 - DNA, 25 bp, Mus musculus
aggcccaggaagtagaatgtccctt

SEQ ID NO: 876474 - DNA, 25 bp, Mus musculus
aggcccaggacacctggatcgccgg

SEQ ID NO: 876475 - DNA, 25 bp, Mus musculus
aggcccaggacagctggatcgccgg

SEQ ID NO: 876476 - DNA, 25 bp, Mus musculus
aggcccagtttacgcagtcatggcc

SEQ ID NO: 876477 - DNA, 25 bp, Mus musculus
aggcccagtttaggcagtcatggcc

SEQ ID NO: 876478 - DNA, 25 bp, Mus musculus
aggccccactggtgcgggccatgta

SEQ ID NO: 876479 - DNA, 25 bp, Mus musculus
aggccccactggtgggggccatgta

SEQ ID NO: 876480 - DNA, 25 bp, Mus musculus
aggccccatgatcgtgttggtgttg

SEQ ID NO: 876481 - DNA, 25 bp, Mus musculus
aggccccatgatggtgttggtgttg

SEQ ID NO: 876482 - DNA, 25 bp, Mus musculus
aggcccccagcattccccctctgtg

SEQ ID NO: 876483 - DNA, 25 bp, Mus musculus
aggcccccaggattccccctctgtg

SEQ ID NO: 876484 - DNA, 25 bp, Mus musculus
aggcccctagccccatctcttctga

SEQ ID NO: 876485 - DNA, 25 bp, Mus musculus
aggcccctaggcccatctcttctga

SEQ ID NO: 876486 - DNA, 25 bp, Mus musculus
aggcccctcgggaatcaggggacat

SEQ ID NO: 876487 - DNA, 25 bp, Mus musculus
aggcccctcgggtatcaggggacat

SEQ ID NO: 876488 - DNA, 25 bp, Mus musculus
aggcccgaagcacatacacagagga

SEQ ID NO: 876489 - DNA, 25 bp, Mus musculus
aggcccgaaggacatacacagagga

SEQ ID NO: 876490 - DNA, 25 bp, Mus musculus
aggcccgactctttcttggaagtag

SEQ ID NO: 876491 - DNA, 25 bp, Mus musculus
aggcccgactgtttcttggaagtag

SEQ ID NO: 876492 - DNA, 25 bp, Mus musculus
aggcccggcttcctgtatcctcaga

SEQ ID NO: 876493 - DNA, 25 bp, Mus musculus
aggcccggcttcgtgtatcctcaga

SEQ ID NO: 876494 - DNA, 25 bp, Mus musculus
aggccctcagatcaatgatgatgtt

SEQ ID NO: 876495 - DNA, 25 bp, Mus musculus
aggccctcagtgcctcccacagata

SEQ ID NO: 876496 - DNA, 25 bp, Mus musculus
aggccctcagtggctcccacagata

SEQ ID NO: 876497 - DNA, 25 bp, Mus musculus
aggccctcagttattatgagaagtc

SEQ ID NO: 876498 - DNA, 25 bp, Mus musculus
aggccctcagttcaatgatgatgtt

SEQ ID NO: 876499 - DNA, 25 bp, Mus musculus
aggccctcagtttttatgagaagtc

SEQ ID NO: 876500 - DNA, 25 bp, Mus musculus
aggccctccgagggccttatggagt

SEQ ID NO: 876501 - DNA, 25 bp, Mus musculus
aggccctccgtgggccttatggagt

SEQ ID NO: 876502 - DNA, 25 bp, Mus musculus
aggccctcgaatctgccgttctctg

SEQ ID NO: 876503 - DNA, 25 bp, Mus musculus
aggccctcgaatgtgccgttctctg

SEQ ID NO: 876504 - DNA, 25 bp, Mus musculus
aggccctgaccgattcacaatgaca

SEQ ID NO: 876505 - DNA, 25 bp, Mus musculus
aggccctgaccgtttcacaatgaca

SEQ ID NO: 876506 - DNA, 25 bp, Mus musculus
aggccctgagacagccagcaaattc

SEQ ID NO: 876507 - DNA, 25 bp, Mus musculus
aggccctgagactgccagcaaattc

SEQ ID NO: 876508 - DNA, 25 bp, Mus musculus
aggccctggagactggaacctgaaa

SEQ ID NO: 876509 - DNA, 25 bp, Mus musculus
aggccctggagagtggaacctgaaa

SEQ ID NO: 876510 - DNA, 25 bp, Mus musculus
aggccctgggcaatgtatcattgat

SEQ ID NO: 876511 - DNA, 25 bp, Mus musculus
aggccctgggcacgctgctggttgt

SEQ ID NO: 876512 - DNA, 25 bp, Mus musculus
aggccctgggcaggctgctggttgt

SEQ ID NO: 876513 - DNA, 25 bp, Mus musculus
aggccctggggaatgtatcattgat

SEQ ID NO: 876514 - DNA, 25 bp, Mus musculus
aggcccttgccaccctttctgcaga

SEQ ID NO: 876515 - DNA, 25 bp, Mus musculus
aggcccttgccagcctttctgcaga

SEQ ID NO: 876516 - DNA, 25 bp, Mus musculus
aggccctttgctaggatctcttgag

SEQ ID NO: 876517 - DNA, 25 bp, Mus musculus
aggccctttgcttggatctcttgag

SEQ ID NO: 876518 - DNA, 25 bp, Mus musculus
aggccgaagccccacttgtaccgag

SEQ ID NO: 876519 - DNA, 25 bp, Mus musculus
aggccgaagccccagttgtaccgag

SEQ ID NO: 876520 - DNA, 25 bp, Mus musculus
aggccgactctgcacaatatgcaca

SEQ ID NO: 876521 - DNA, 25 bp, Mus musculus
aggccgactctgcagaatatgcaca

SEQ ID NO: 876522 - DNA, 25 bp, Mus musculus
aggccgagagcttgcaataaaaata

SEQ ID NO: 876523 - DNA, 25 bp, Mus musculus
aggccgagaggttgcaataaaaata

SEQ ID NO: 876524 - DNA, 25 bp, Mus musculus
aggccgaggccaaccgtccagaagg

SEQ ID NO: 876525 - DNA, 25 bp, Mus musculus
aggccgaggccaaccgtgtgctgct

SEQ ID NO: 876526 - DNA, 25 bp, Mus musculus
aggccgaggccaacggtccagaagg

SEQ ID NO: 876527 - DNA, 25 bp, Mus musculus
aggccgaggccaacggtgtgctgct

SEQ ID NO: 876528 - DNA, 25 bp, Mus musculus
aggccgataggaagaatgaacatca

SEQ ID NO: 876529 - DNA, 25 bp, Mus musculus
aggccgataggaagtatgaacatca

SEQ ID NO: 876530 - DNA, 25 bp, Mus musculus
aggccgctcaagatcctggtatatg

SEQ ID NO: 876531 - DNA, 25 bp, Mus musculus
aggccgctcaagttcctggtatatg

SEQ ID NO: 876532 - DNA, 25 bp, Mus musculus
aggccgctgtctcagcgcaggctgt

SEQ ID NO: 876533 - DNA, 25 bp, Mus musculus
aggccgctgtctgagcgcaggctgt

SEQ ID NO: 876534 - DNA, 25 bp, Mus musculus
aggccgggagtccacgctaagcttc

SEQ ID NO: 876535 - DNA, 25 bp, Mus musculus
aggccgggagtccaggctaagcttc

SEQ ID NO: 876536 - DNA, 25 bp, Mus musculus
aggccgtaggacagtatacaacctg

SEQ ID NO: 876537 - DNA, 25 bp, Mus musculus
aggccgtaggtcagtatacaacctg

SEQ ID NO: 876538 - DNA, 25 bp, Mus musculus
aggccgtcaagtacctccatgataa

SEQ ID NO: 876539 - DNA, 25 bp, Mus musculus
aggccgtcaagttcctccatgataa

SEQ ID NO: 876540 - DNA, 25 bp, Mus musculus
aggccgtcagaaatgtttcacaagc

SEQ ID NO: 876541 - DNA, 25 bp, Mus musculus
aggccgtcagtaatgtttcacaagc

SEQ ID NO: 876542 - DNA, 25 bp, Mus musculus
aggccgtgaagactgagccggtgga

SEQ ID NO: 876543 - DNA, 25 bp, Mus musculus
aggccgtgaagagtgagccggtgga

SEQ ID NO: 876544 - DNA, 25 bp, Mus musculus
aggccgtgccaccgatgatgacatg

SEQ ID NO: 876545 - DNA, 25 bp, Mus musculus
aggccgtgccacggatgatgacatg

SEQ ID NO: 876546 - DNA, 25 bp, Mus musculus
aggcctagctcaagtcttttattca

SEQ ID NO: 876547 - DNA, 25 bp, Mus musculus
aggcctagctcatgtcttttattca

SEQ ID NO: 876548 - DNA, 25 bp, Mus musculus
aggcctcagaaggtcgccttcccag

SEQ ID NO: 876549 - DNA, 25 bp, Mus musculus
aggcctcagaaggtggccttcccag

SEQ ID NO: 876550 - DNA, 25 bp, Mus musculus
aggcctccacagacttcctaccagg

SEQ ID NO: 876551 - DNA, 25 bp, Mus musculus
aggcctccacagtcttcctaccagg

SEQ ID NO: 876552 - DNA, 25 bp, Mus musculus
aggcctccggccatactttcagtgt

SEQ ID NO: 876553 - DNA, 25 bp, Mus musculus
aggcctccggccattctttcagtgt

SEQ ID NO: 876554 - DNA, 25 bp, Mus musculus
aggcctcctcaacctaaagaacgct

SEQ ID NO: 876555 - DNA, 25 bp, Mus musculus
aggcctcctcaagctaaagaacgct

SEQ ID NO: 876556 - DNA, 25 bp, Mus musculus
aggcctctggcacagcctgccccag

SEQ ID NO: 876557 - DNA, 25 bp, Mus musculus
aggcctctggcagagcctgccccag

SEQ ID NO: 876558 - DNA, 25 bp, Mus musculus
aggcctgcagaggcagatataatgg

SEQ ID NO: 876559 - DNA, 25 bp, Mus musculus
aggcctgcagaggctgatataatgg

SEQ ID NO: 876560 - DNA, 25 bp, Mus musculus
aggcctgctgaacacagcctggata

SEQ ID NO: 876561 - DNA, 25 bp, Mus musculus
aggcctgctgaacagagcctggata

SEQ ID NO: 876562 - DNA, 25 bp, Mus musculus
aggcctgctgatgctcctgccagcg

SEQ ID NO: 876563 - DNA, 25 bp, Mus musculus
aggcctgctgttgctcctgccagcg

SEQ ID NO: 876564 - DNA, 25 bp, Mus musculus
aggcctggactgatcggaaggaggc

SEQ ID NO: 876565 - DNA, 25 bp, Mus musculus
aggcctggactgatgggaaggaggc

SEQ ID NO: 876566 - DNA, 25 bp, Mus musculus
aggcctggagaacattgaacagcaa

SEQ ID NO: 876567 - DNA, 25 bp, Mus musculus
aggcctggagaagattgaacagcaa

SEQ ID NO: 876568 - DNA, 25 bp, Mus musculus
aggcctggagagcaagttctccctg

SEQ ID NO: 876569 - DNA, 25 bp, Mus musculus
aggcctggagaggaagttctccctg

SEQ ID NO: 876570 - DNA, 25 bp, Mus musculus
aggcctgttcagcccaaatttgaat

SEQ ID NO: 876571 - DNA, 25 bp, Mus musculus
aggcctgttcaggccaaatttgaat

SEQ ID NO: 876572 - DNA, 25 bp, Mus musculus
aggccttactggcccggggtgctga

SEQ ID NO: 876573 - DNA, 25 bp, Mus musculus
aggccttactgggccggggtgctga

SEQ ID NO: 876574 - DNA, 25 bp, Mus musculus
aggccttagtctcctacatagccca

SEQ ID NO: 876575 - DNA, 25 bp, Mus musculus
aggccttagtctgctacatagccca

SEQ ID NO: 876576 - DNA, 25 bp, Mus musculus
aggccttcaacacagacagttcctt

SEQ ID NO: 876577 - DNA, 25 bp, Mus musculus
aggccttcaagacagacagttcctt

SEQ ID NO: 876578 - DNA, 25 bp, Mus musculus
aggccttcacaaactccagaactac

SEQ ID NO: 876579 - DNA, 25 bp, Mus musculus
aggccttcacaatctccagaactac

SEQ ID NO: 876580 - DNA, 25 bp, Mus musculus
aggccttccagtcacaggacatcct

SEQ ID NO: 876581 - DNA, 25 bp, Mus musculus
aggccttccagtcagaggacatcct

SEQ ID NO: 876582 - DNA, 25 bp, Mus musculus
aggccttccgagccgacagctcctt

SEQ ID NO: 876583 - DNA, 25 bp, Mus musculus
aggccttccgtgccgacagctcctt

SEQ ID NO: 876584 - DNA, 25 bp, Mus musculus
aggccttctggaccacatcttatac

SEQ ID NO: 876585 - DNA, 25 bp, Mus musculus
aggccttctggagcacatcttatac

SEQ ID NO: 876586 - DNA, 25 bp, Mus musculus
aggccttgaaagcttttagcctaga

SEQ ID NO: 876587 - DNA, 25 bp, Mus musculus
aggccttgaaaggttttagcctaga

SEQ ID NO: 876588 - DNA, 25 bp, Mus musculus
aggccttgcaagcaaggtgcagagc

SEQ ID NO: 876589 - DNA, 25 bp, Mus musculus
aggccttgcaagcggagagttagat

SEQ ID NO: 876590 - DNA, 25 bp, Mus musculus
aggccttgcaagctatgtctgagct

SEQ ID NO: 876591 - DNA, 25 bp, Mus musculus
aggccttgcaaggaaggtgcagagc

SEQ ID NO: 876592 - DNA, 25 bp, Mus musculus
aggccttgcaaggggagagttagat

SEQ ID NO: 876593 - DNA, 25 bp, Mus musculus
aggccttgcaaggtatgtctgagct

SEQ ID NO: 876594 - DNA, 25 bp, Mus musculus
aggccttgcgccagttcctgtggag

SEQ ID NO: 876595 - DNA, 25 bp, Mus musculus
aggccttgcggcagttcctgtggag

SEQ ID NO: 876596 - DNA, 25 bp, Mus musculus
aggcctttctgaccaactggtgttc

SEQ ID NO: 876597 - DNA, 25 bp, Mus musculus
aggcctttctgagcaactggtgttc

SEQ ID NO: 876598 - DNA, 25 bp, Mus musculus
aggcctttggctggcacaccatcat

SEQ ID NO: 876599 - DNA, 25 bp, Mus musculus
aggcctttgggtggcacaccatcat

SEQ ID NO: 876600 - DNA, 25 bp, Mus musculus
aggcgacacattcggagaggtgtgc

SEQ ID NO: 876601 - DNA, 25 bp, Mus musculus
aggcgacacattgggagaggtgtgc

SEQ ID NO: 876602 - DNA, 25 bp, Mus musculus
aggcgagaaatgagagaaacgcacc

SEQ ID NO: 876603 - DNA, 25 bp, Mus musculus
aggcgagaaatgcaaacagctgctg

SEQ ID NO: 876604 - DNA, 25 bp, Mus musculus
aggcgagaaatggaaacagctgctg

SEQ ID NO: 876605 - DNA, 25 bp, Mus musculus
aggcgagaaatgtgagaaacgcacc

SEQ ID NO: 876606 - DNA, 25 bp, Mus musculus
aggcgagaggtcaacgccccacgca

SEQ ID NO: 876607 - DNA, 25 bp, Mus musculus
aggcgagaggtcaaggccccacgca

SEQ ID NO: 876608 - DNA, 25 bp, Mus musculus
aggcgagcacccggcatacactttt

SEQ ID NO: 876609 - DNA, 25 bp, Mus musculus
aggcgagcacccggcgaggcagagt

SEQ ID NO: 876610 - DNA, 25 bp, Mus musculus
aggcgagcacccgggatacactttt

SEQ ID NO: 876611 - DNA, 25 bp, Mus musculus
aggcgagcacccggggaggcagagt

SEQ ID NO: 876612 - DNA, 25 bp, Mus musculus
aggcgagcagctggtggcccccgac

SEQ ID NO: 876613 - DNA, 25 bp, Mus musculus
aggcgagcagctgtggcccctcaga

SEQ ID NO: 876614 - DNA, 25 bp, Mus musculus
aggcgagcaggtggtggcccccgac

SEQ ID NO: 876615 - DNA, 25 bp, Mus musculus
aggcgagcaggtgtggcccctcaga

SEQ ID NO: 876616 - DNA, 25 bp, Mus musculus
aggcgagttacacgagggaatcttg

SEQ ID NO: 876617 - DNA, 25 bp, Mus musculus
aggcgagttacaggagggaatcttg

SEQ ID NO: 876618 - DNA, 25 bp, Mus musculus
aggcgataaccgcgtctggtacatg

SEQ ID NO: 876619 - DNA, 25 bp, Mus musculus
aggcgataaccgggtctggtacatg

SEQ ID NO: 876620 - DNA, 25 bp, Mus musculus
aggcgatacaagcaacttgtggaga

SEQ ID NO: 876621 - DNA, 25 bp, Mus musculus
aggcgatacaaggaacttgtggaga

SEQ ID NO: 876622 - DNA, 25 bp, Mus musculus
aggcgcaagcaaagaaacatgctct

SEQ ID NO: 876623 - DNA, 25 bp, Mus musculus
aggcgcaagcaatgaaacatgctct

SEQ ID NO: 876624 - DNA, 25 bp, Mus musculus
aggcgcacagcgcggactcgaggcc

SEQ ID NO: 876625 - DNA, 25 bp, Mus musculus
aggcgcacagcgctaaaatgtcggc

SEQ ID NO: 876626 - DNA, 25 bp, Mus musculus
aggcgcacagcggggactcgaggcc

SEQ ID NO: 876627 - DNA, 25 bp, Mus musculus
aggcgcacagcggtaaaatgtcggc

SEQ ID NO: 876628 - DNA, 25 bp, Mus musculus
aggcgcagagataaaggagagtgct

SEQ ID NO: 876629 - DNA, 25 bp, Mus musculus
aggcgcagagttaaaggagagtgct

SEQ ID NO: 876630 - DNA, 25 bp, Mus musculus
aggcgcagccaccgcacctgcggga

SEQ ID NO: 876631 - DNA, 25 bp, Mus musculus
aggcgcagccaccgcgctcatgcgt

SEQ ID NO: 876632 - DNA, 25 bp, Mus musculus
aggcgcagccaccggacctgcggga

SEQ ID NO: 876633 - DNA, 25 bp, Mus musculus
aggcgcagccaccgggctcatgcgt

SEQ ID NO: 876634 - DNA, 25 bp, Mus musculus
aggcgcaggcacaacgcttgttgga

SEQ ID NO: 876635 - DNA, 25 bp, Mus musculus
aggcgcaggcacaaggcttgttgga

SEQ ID NO: 876636 - DNA, 25 bp, Mus musculus
aggcgcaggccgaggtcagacctga

SEQ ID NO: 876637 - DNA, 25 bp, Mus musculus
aggcgcaggcggaggtcagacctga

SEQ ID NO: 876638 - DNA, 25 bp, Mus musculus
aggcgcatccaggacctcttggaca

SEQ ID NO: 876639 - DNA, 25 bp, Mus musculus
aggcgcatccaggagctcttggaca

SEQ ID NO: 876640 - DNA, 25 bp, Mus musculus
aggcgccaaggaatttgcgtccgac

SEQ ID NO: 876641 - DNA, 25 bp, Mus musculus
aggcgccaaggattttgcgtccgac

SEQ ID NO: 876642 - DNA, 25 bp, Mus musculus
aggcgcccaaagactcaggggccta

SEQ ID NO: 876643 - DNA, 25 bp, Mus musculus
aggcgcccaaagtctcaggggccta

SEQ ID NO: 876644 - DNA, 25 bp, Mus musculus
aggcgcccacgccacacctgcctat

SEQ ID NO: 876645 - DNA, 25 bp, Mus musculus
aggcgcccacgccagacctgcctat

SEQ ID NO: 876646 - DNA, 25 bp, Mus musculus
aggcgcccacgttgcgatctgaacc

SEQ ID NO: 876647 - DNA, 25 bp, Mus musculus
aggcgcccacgttgggatctgaacc

SEQ ID NO: 876648 - DNA, 25 bp, Mus musculus
aggcgccgagcgcgtccctgtctgc

SEQ ID NO: 876649 - DNA, 25 bp, Mus musculus
aggcgccgagggcgtccctgtctgc

SEQ ID NO: 876650 - DNA, 25 bp, Mus musculus
aggcgcgaggagctccagaaatctt

SEQ ID NO: 876651 - DNA, 25 bp, Mus musculus
aggcgcgaggaggtccagaaatctt

SEQ ID NO: 876652 - DNA, 25 bp, Mus musculus
aggcgcgcgagaagctcgcgctgta

SEQ ID NO: 876653 - DNA, 25 bp, Mus musculus
aggcgcgcgagatgctcgcgctgta

SEQ ID NO: 876654 - DNA, 25 bp, Mus musculus
aggcgcggcgcgatatgtggtacat

SEQ ID NO: 876655 - DNA, 25 bp, Mus musculus
aggcgcggcgggatatgtggtacat

SEQ ID NO: 876656 - DNA, 25 bp, Mus musculus
aggcgcgggtcatgcaccggcacca

SEQ ID NO: 876657 - DNA, 25 bp, Mus musculus
aggcgcgggtcatggaccggcacca

SEQ ID NO: 876658 - DNA, 25 bp, Mus musculus
aggcgcttgcagaaggggcgcctaa

SEQ ID NO: 876659 - DNA, 25 bp, Mus musculus
aggcgcttgcagccatgacgagtgt

SEQ ID NO: 876660 - DNA, 25 bp, Mus musculus
aggcgcttgcaggcatgacgagtgt

SEQ ID NO: 876661 - DNA, 25 bp, Mus musculus
aggcgcttgcagtaggggcgcctaa

SEQ ID NO: 876662 - DNA, 25 bp, Mus musculus
aggcgcttggagaatggcagcagca

SEQ ID NO: 876663 - DNA, 25 bp, Mus musculus
aggcgcttggagtatggcagcagca

SEQ ID NO: 876664 - DNA, 25 bp, Mus musculus
aggcggagtggacgtgtgaaattga

SEQ ID NO: 876665 - DNA, 25 bp, Mus musculus
aggcggagtggaggtgtgaaattga

SEQ ID NO: 876666 - DNA, 25 bp, Mus musculus
aggcggatggcacccttatcacatg

SEQ ID NO: 876667 - DNA, 25 bp, Mus musculus
aggcggatgggacccttatcacatg

SEQ ID NO: 876668 - DNA, 25 bp, Mus musculus
aggcggccagcccacggcaaacgct

SEQ ID NO: 876669 - DNA, 25 bp, Mus musculus
aggcggccagcccacgggcacctac

SEQ ID NO: 876670 - DNA, 25 bp, Mus musculus
aggcggccagcccagggcaaacgct

SEQ ID NO: 876671 - DNA, 25 bp, Mus musculus
aggcggccagcccaggggcacctac

SEQ ID NO: 876672 - DNA, 25 bp, Mus musculus
aggcggcccctgcacaagactgcta

SEQ ID NO: 876673 - DNA, 25 bp, Mus musculus
aggcggcccctgcagaagactgcta

SEQ ID NO: 876674 - DNA, 25 bp, Mus musculus
aggcggctggaagaccaacaaagaa

SEQ ID NO: 876675 - DNA, 25 bp, Mus musculus
aggcggctggaagagcaacaaagaa

SEQ ID NO: 876676 - DNA, 25 bp, Mus musculus
aggcgggcggagtatcctcagagat

SEQ ID NO: 876677 - DNA, 25 bp, Mus musculus
aggcgggcggtgtatcctcagagat

SEQ ID NO: 876678 - DNA, 25 bp, Mus musculus
aggcggggcgcacctgggcaccaca

SEQ ID NO: 876679 - DNA, 25 bp, Mus musculus
aggcggggcgcagctgggcaccaca

SEQ ID NO: 876680 - DNA, 25 bp, Mus musculus
aggcgtgaggaaactgctgtcattc

SEQ ID NO: 876681 - DNA, 25 bp, Mus musculus
aggcgtgaggtaactgctgtcattc

SEQ ID NO: 876682 - DNA, 25 bp, Mus musculus
aggcgtgcgggtctgaacaacgtgg

SEQ ID NO: 876683 - DNA, 25 bp, Mus musculus
aggcgtgcgggtgtgaacaacgtgg

SEQ ID NO: 876684 - DNA, 25 bp, Mus musculus
aggcgttctgatctcgttacagaag

SEQ ID NO: 876685 - DNA, 25 bp, Mus musculus
aggcgttctgatgtcgttacagaag

SEQ ID NO: 876686 - DNA, 25 bp, Mus musculus
aggctaatgaagcgctggagagggg

SEQ ID NO: 876687 - DNA, 25 bp, Mus musculus
aggctaatgaagggctggagagggg

SEQ ID NO: 876688 - DNA, 25 bp, Mus musculus
aggctaatgacgaagcattaggggt

SEQ ID NO: 876689 - DNA, 25 bp, Mus musculus
aggctaatgacgtttctggctccct

SEQ ID NO: 876690 - DNA, 25 bp, Mus musculus
aggctaatgaggaagcattaggggt

SEQ ID NO: 876691 - DNA, 25 bp, Mus musculus
aggctaatgaggtttctggctccct

SEQ ID NO: 876692 - DNA, 25 bp, Mus musculus
aggctaattcccaacgattcacacc

SEQ ID NO: 876693 - DNA, 25 bp, Mus musculus
aggctaattcccaaggattcacacc

SEQ ID NO: 876694 - DNA, 25 bp, Mus musculus
aggctacaagatggtaatcttcacc

SEQ ID NO: 876695 - DNA, 25 bp, Mus musculus
aggctacaagcttcgctatgccacc

SEQ ID NO: 876696 - DNA, 25 bp, Mus musculus
aggctacaaggttcgctatgccacc

SEQ ID NO: 876697 - DNA, 25 bp, Mus musculus
aggctacaagttggtaatcttcacc

SEQ ID NO: 876698 - DNA, 25 bp, Mus musculus
aggctaccagaacaatgaagagtca

SEQ ID NO: 876699 - DNA, 25 bp, Mus musculus
aggctaccagaagaatgaagagtca

SEQ ID NO: 876700 - DNA, 25 bp, Mus musculus
aggctaccagagcgtggcttctcag

SEQ ID NO: 876701 - DNA, 25 bp, Mus musculus
aggctaccagtgcgtggcttctcag

SEQ ID NO: 876702 - DNA, 25 bp, Mus musculus
aggctacttggcaccaaagcaatat

SEQ ID NO: 876703 - DNA, 25 bp, Mus musculus
aggctacttggcacgaaagcaatat

SEQ ID NO: 876704 - DNA, 25 bp, Mus musculus
aggctagactggctgcgaagctggg

SEQ ID NO: 876705 - DNA, 25 bp, Mus musculus
aggctagactgggtgcgaagctggg

SEQ ID NO: 876706 - DNA, 25 bp, Mus musculus
aggctagcagaatttctcagagatt

SEQ ID NO: 876707 - DNA, 25 bp, Mus musculus
aggctagcagtatttctcagagatt

SEQ ID NO: 876708 - DNA, 25 bp, Mus musculus
aggctataaaaacaagtaccagcag

SEQ ID NO: 876709 - DNA, 25 bp, Mus musculus
aggctataaaaagaagtaccagcag

SEQ ID NO: 876710 - DNA, 25 bp, Mus musculus
aggctataagctccccagggaggag

SEQ ID NO: 876711 - DNA, 25 bp, Mus musculus
aggctataaggtccccagggaggag

SEQ ID NO: 876712 - DNA, 25 bp, Mus musculus
aggctatctgcggcgctgtccggga

SEQ ID NO: 876713 - DNA, 25 bp, Mus musculus
aggctatctggggcgctgtccggga

SEQ ID NO: 876714 - DNA, 25 bp, Mus musculus
aggctatcttagcacctcggtctcc

SEQ ID NO: 876715 - DNA, 25 bp, Mus musculus
aggctatcttagcagctcggtctcc

SEQ ID NO: 876716 - DNA, 25 bp, Mus musculus
aggctcacagaacagagctgtgaat

SEQ ID NO: 876717 - DNA, 25 bp, Mus musculus
aggctcacagaacgctgttcattta

SEQ ID NO: 876718 - DNA, 25 bp, Mus musculus
aggctcacagaagagagctgtgaat

SEQ ID NO: 876719 - DNA, 25 bp, Mus musculus
aggctcacagaaggctgttcattta

SEQ ID NO: 876720 - DNA, 25 bp, Mus musculus
aggctcagagatgggcccagtgcac

SEQ ID NO: 876721 - DNA, 25 bp, Mus musculus
aggctcagagttgggcccagtgcac

SEQ ID NO: 876722 - DNA, 25 bp, Mus musculus
aggctcaggccgcctccaggtttac

SEQ ID NO: 876723 - DNA, 25 bp, Mus musculus
aggctcaggccggctccaggtttac

SEQ ID NO: 876724 - DNA, 25 bp, Mus musculus
aggctccacggacgttggtcaccta

SEQ ID NO: 876725 - DNA, 25 bp, Mus musculus
aggctccacggaggttggtcaccta

SEQ ID NO: 876726 - DNA, 25 bp, Mus musculus
aggctccactcatgcagctgacctg

SEQ ID NO: 876727 - DNA, 25 bp, Mus musculus
aggctccactcatggagctgacctg

SEQ ID NO: 876728 - DNA, 25 bp, Mus musculus
aggctccagatgatgagaagctgta

SEQ ID NO: 876729 - DNA, 25 bp, Mus musculus
aggctccagatgctgtggccagcgt

SEQ ID NO: 876730 - DNA, 25 bp, Mus musculus
aggctccagatggtgtggccagcgt

SEQ ID NO: 876731 - DNA, 25 bp, Mus musculus
aggctccagatgttgagaagctgta

SEQ ID NO: 876732 - DNA, 25 bp, Mus musculus
aggctccaggaacgtggctgacggt

SEQ ID NO: 876733 - DNA, 25 bp, Mus musculus
aggctccaggaaggtggctgacggt

SEQ ID NO: 876734 - DNA, 25 bp, Mus musculus
aggctcccgagcagaaggagaagac

SEQ ID NO: 876735 - DNA, 25 bp, Mus musculus
aggctcccgagctgaaggagaagac

SEQ ID NO: 876736 - DNA, 25 bp, Mus musculus
aggctccctgcactcgtcctccatc

SEQ ID NO: 876737 - DNA, 25 bp, Mus musculus
aggctccctgcactggtcctccatc

SEQ ID NO: 876738 - DNA, 25 bp, Mus musculus
aggctccggaagcacgataagaaaa

SEQ ID NO: 876739 - DNA, 25 bp, Mus musculus
aggctccggaaggacgataagaaaa

SEQ ID NO: 876740 - DNA, 25 bp, Mus musculus
aggctcgagcagagtccgtctccca

SEQ ID NO: 876741 - DNA, 25 bp, Mus musculus
aggctcgagcagtgtccgtctccca

SEQ ID NO: 876742 - DNA, 25 bp, Mus musculus
aggctcgcagagccaggggtagagc

SEQ ID NO: 876743 - DNA, 25 bp, Mus musculus
aggctcgcagaggcaggggtagagc

SEQ ID NO: 876744 - DNA, 25 bp, Mus musculus
aggctctgactgatctctctcttgc

SEQ ID NO: 876745 - DNA, 25 bp, Mus musculus
aggctctgactgttctctctcttgc

SEQ ID NO: 876746 - DNA, 25 bp, Mus musculus
aggctctgcaggaggtcctggcaca

SEQ ID NO: 876747 - DNA, 25 bp, Mus musculus
aggctctgcaggtggtcctggcaca

SEQ ID NO: 876748 - DNA, 25 bp, Mus musculus
aggctctggagaaacagtttgagag

SEQ ID NO: 876749 - DNA, 25 bp, Mus musculus
aggctctggagaaagagtttgagag

SEQ ID NO: 876750 - DNA, 25 bp, Mus musculus
aggctctttcagccgtggcccactt

SEQ ID NO: 876751 - DNA, 25 bp, Mus musculus
aggctctttcaggcgtggcccactt

SEQ ID NO: 876752 - DNA, 25 bp, Mus musculus
aggctgaacggcaccagcttgggaa

SEQ ID NO: 876753 - DNA, 25 bp, Mus musculus
aggctgaacggcacgagcttgggaa

SEQ ID NO: 876754 - DNA, 25 bp, Mus musculus
aggctgaagttcatcatggcttgtg

SEQ ID NO: 876755 - DNA, 25 bp, Mus musculus
aggctgaagttcatgatggcttgtg

SEQ ID NO: 876756 - DNA, 25 bp, Mus musculus
aggctgacatgtccctgagcggagc

SEQ ID NO: 876757 - DNA, 25 bp, Mus musculus
aggctgacatgtcgagcattggcgt

SEQ ID NO: 876758 - DNA, 25 bp, Mus musculus
aggctgacatgtgcctgagcggagc

SEQ ID NO: 876759 - DNA, 25 bp, Mus musculus
aggctgacatgtggagcattggcgt

SEQ ID NO: 876760 - DNA, 25 bp, Mus musculus
aggctgaggccacgtctcttaacct

SEQ ID NO: 876761 - DNA, 25 bp, Mus musculus
aggctgaggccaggtctcttaacct

SEQ ID NO: 876762 - DNA, 25 bp, Mus musculus
aggctgcaaaaacaaagctcctggg

SEQ ID NO: 876763 - DNA, 25 bp, Mus musculus
aggctgcaaaaacatagctcctggg

SEQ ID NO: 876764 - DNA, 25 bp, Mus musculus
aggctgcaagaattcactgacagaa

SEQ ID NO: 876765 - DNA, 25 bp, Mus musculus
aggctgcaagaattgactgacagaa

SEQ ID NO: 876766 - DNA, 25 bp, Mus musculus
aggctgcaggaatgccttccagacc

SEQ ID NO: 876767 - DNA, 25 bp, Mus musculus
aggctgcaggaatggcttccagacc

SEQ ID NO: 876768 - DNA, 25 bp, Mus musculus
aggctgcaggcctgtgggccgaagc

SEQ ID NO: 876769 - DNA, 25 bp, Mus musculus
aggctgcagggctgtgggccgaagc

SEQ ID NO: 876770 - DNA, 25 bp, Mus musculus
aggctgcgctgacgctccagccttc

SEQ ID NO: 876771 - DNA, 25 bp, Mus musculus
aggctgcgctgaggctccagccttc

SEQ ID NO: 876772 - DNA, 25 bp, Mus musculus
aggctgcggctggacgttttcccgc

SEQ ID NO: 876773 - DNA, 25 bp, Mus musculus
aggctgcggctggactgcccacgat

SEQ ID NO: 876774 - DNA, 25 bp, Mus musculus
aggctgcggctggaggttttcccgc

SEQ ID NO: 876775 - DNA, 25 bp, Mus musculus
aggctgcggctggagtgcccacgat

SEQ ID NO: 876776 - DNA, 25 bp, Mus musculus
aggctgctcgattatgtccccattg

SEQ ID NO: 876777 - DNA, 25 bp, Mus musculus
aggctgctcgtttatgtccccattg

SEQ ID NO: 876778 - DNA, 25 bp, Mus musculus
aggctggaagaactctattcgtcac

SEQ ID NO: 876779 - DNA, 25 bp, Mus musculus
aggctggaagtactctattcgtcac

SEQ ID NO: 876780 - DNA, 25 bp, Mus musculus
aggctggagcagcttctgccactct

SEQ ID NO: 876781 - DNA, 25 bp, Mus musculus
aggctggagcaggttctgccactct

SEQ ID NO: 876782 - DNA, 25 bp, Mus musculus
aggctggagggaccttcctccatgg

SEQ ID NO: 876783 - DNA, 25 bp, Mus musculus
aggctggagggagcttcctccatgg

SEQ ID NO: 876784 - DNA, 25 bp, Mus musculus
aggctggcatgaaatcctggggcag

SEQ ID NO: 876785 - DNA, 25 bp, Mus musculus
aggctggcatgatatcctggggcag

SEQ ID NO: 876786 - DNA, 25 bp, Mus musculus
aggctggccaatatctctgtgtcag

SEQ ID NO: 876787 - DNA, 25 bp, Mus musculus
aggctggccaatttctctgtgtcag

SEQ ID NO: 876788 - DNA, 25 bp, Mus musculus
aggctggcgtagatcgactgtgccg

SEQ ID NO: 876789 - DNA, 25 bp, Mus musculus
aggctggcgtagttcgactgtgccg

SEQ ID NO: 876790 - DNA, 25 bp, Mus musculus
aggctggctgcctttgcggggcctt

SEQ ID NO: 876791 - DNA, 25 bp, Mus musculus
aggctggctggctttgcggggcctt

SEQ ID NO: 876792 - DNA, 25 bp, Mus musculus
aggctgggcaaagacgtgcgtgagc

SEQ ID NO: 876793 - DNA, 25 bp, Mus musculus
aggctgggcaaagaggtgcgtgagc

SEQ ID NO: 876794 - DNA, 25 bp, Mus musculus
aggctgggcgagactcggagccgag

SEQ ID NO: 876795 - DNA, 25 bp, Mus musculus
aggctgggcgagtctcggagccgag

SEQ ID NO: 876796 - DNA, 25 bp, Mus musculus
aggctggggtgtctccggctggatt

SEQ ID NO: 876797 - DNA, 25 bp, Mus musculus
aggctggggtgtctgcggctggatt

SEQ ID NO: 876798 - DNA, 25 bp, Mus musculus
aggctgtaagcgcttctttcggcga

SEQ ID NO: 876799 - DNA, 25 bp, Mus musculus
aggctgtaagggcttctttcggcga

SEQ ID NO: 876800 - DNA, 25 bp, Mus musculus
aggctgtactcaagcagaatctggg

SEQ ID NO: 876801 - DNA, 25 bp, Mus musculus
aggctgtactcaaggagaatctggg

SEQ ID NO: 876802 - DNA, 25 bp, Mus musculus
aggctgtcagagctcctgctgtgag

SEQ ID NO: 876803 - DNA, 25 bp, Mus musculus
aggctgtcagagctgctgctgtgag

SEQ ID NO: 876804 - DNA, 25 bp, Mus musculus
aggctgtcatggcaggcactgggga

SEQ ID NO: 876805 - DNA, 25 bp, Mus musculus
aggctgtcatggccactggggagcc

SEQ ID NO: 876806 - DNA, 25 bp, Mus musculus
aggctgtcatgggaggcactgggga

SEQ ID NO: 876807 - DNA, 25 bp, Mus musculus
aggctgtcatgggcactggggagcc

SEQ ID NO: 876808 - DNA, 25 bp, Mus musculus
aggctgtcggccaagcccgcccctg

SEQ ID NO: 876809 - DNA, 25 bp, Mus musculus
aggctgtcggcctagcccgcccctg

SEQ ID NO: 876810 - DNA, 25 bp, Mus musculus
aggctgtgaaagccgtgttggaaca

SEQ ID NO: 876811 - DNA, 25 bp, Mus musculus
aggctgtgaaaggcgtgttggaaca

SEQ ID NO: 876812 - DNA, 25 bp, Mus musculus
aggctgtgagatatctgtttcaaat

SEQ ID NO: 876813 - DNA, 25 bp, Mus musculus
aggctgtgagttatctgtttcaaat

SEQ ID NO: 876814 - DNA, 25 bp, Mus musculus
aggctgtgtgcccacgccagtatgg

SEQ ID NO: 876815 - DNA, 25 bp, Mus musculus
aggctgtgtgcccaggccagtatgg

SEQ ID NO: 876816 - DNA, 25 bp, Mus musculus
aggctgttacacctaacaattcaag

SEQ ID NO: 876817 - DNA, 25 bp, Mus musculus
aggctgttacacgtaacaattcaag

SEQ ID NO: 876818 - DNA, 25 bp, Mus musculus
aggcttaatatgagaaaggaacata

SEQ ID NO: 876819 - DNA, 25 bp, Mus musculus
aggcttaatatgtgaaaggaacata

SEQ ID NO: 876820 - DNA, 25 bp, Mus musculus
aggcttaccacgcacgcctgaaggc

SEQ ID NO: 876821 - DNA, 25 bp, Mus musculus
aggcttaccacgcaggcctgaaggc

SEQ ID NO: 876822 - DNA, 25 bp, Mus musculus
aggcttcaaactaaattggatgaac

SEQ ID NO: 876823 - DNA, 25 bp, Mus musculus
aggcttcaaacttaattggatgaac

SEQ ID NO: 876824 - DNA, 25 bp, Mus musculus
aggcttccagctccagaaatcttga

SEQ ID NO: 876825 - DNA, 25 bp, Mus musculus
aggcttccaggtccagaaatcttga

SEQ ID NO: 876826 - DNA, 25 bp, Mus musculus
aggcttccctcccactcctctgcaa

SEQ ID NO: 876827 - DNA, 25 bp, Mus musculus
aggcttccctccgactcctctgcaa

SEQ ID NO: 876828 - DNA, 25 bp, Mus musculus
aggcttccggaaagcaatttcctgc

SEQ ID NO: 876829 - DNA, 25 bp, Mus musculus
aggcttccggaatgcaatttcctgc

SEQ ID NO: 876830 - DNA, 25 bp, Mus musculus
aggcttcctgactttggcaccgaac

SEQ ID NO: 876831 - DNA, 25 bp, Mus musculus
aggcttcctgtctttggcaccgaac

SEQ ID NO: 876832 - DNA, 25 bp, Mus musculus
aggcttctacagctggctgtggagg

SEQ ID NO: 876833 - DNA, 25 bp, Mus musculus
aggcttctacaggtggctgtggagg

SEQ ID NO: 876834 - DNA, 25 bp, Mus musculus
aggcttcttatgcgtaccatcggtt

SEQ ID NO: 876835 - DNA, 25 bp, Mus musculus
aggcttcttatgggtaccatcggtt

SEQ ID NO: 876836 - DNA, 25 bp, Mus musculus
aggcttcttccaccccttcatgtca

SEQ ID NO: 876837 - DNA, 25 bp, Mus musculus
aggcttcttccagcccttcatgtca

SEQ ID NO: 876838 - DNA, 25 bp, Mus musculus
aggctttaagctctggtgcaagtgt

SEQ ID NO: 876839 - DNA, 25 bp, Mus musculus
aggctttaaggtctggtgcaagtgt

SEQ ID NO: 876840 - DNA, 25 bp, Mus musculus
aggctttccccacgccctccatgat

SEQ ID NO: 876841 - DNA, 25 bp, Mus musculus
aggctttccccaggccctccatgat

SEQ ID NO: 876842 - DNA, 25 bp, Mus musculus
aggctttgagactaaagacattaaa

SEQ ID NO: 876843 - DNA, 25 bp, Mus musculus
aggctttgagtctaaagacattaaa

SEQ ID NO: 876844 - DNA, 25 bp, Mus musculus
aggcttttgcagcttttagaagatg

SEQ ID NO: 876845 - DNA, 25 bp, Mus musculus
aggcttttgcaggttttagaagatg

SEQ ID NO: 876846 - DNA, 25 bp, Mus musculus
agggaaacagcagaccatgacagct

SEQ ID NO: 876847 - DNA, 25 bp, Mus musculus
agggaaacaggagaccatgacagct

SEQ ID NO: 876848 - DNA, 25 bp, Mus musculus
agggaaactgcgatctgttggcagc

SEQ ID NO: 876849 - DNA, 25 bp, Mus musculus
agggaaactgggatctgttggcagc

SEQ ID NO: 876850 - DNA, 25 bp, Mus musculus
agggaaagccaacatgccagaccag

SEQ ID NO: 876851 - DNA, 25 bp, Mus musculus
agggaaagccaagatgccagaccag

SEQ ID NO: 876852 - DNA, 25 bp, Mus musculus
agggaaagtgtatcaaagcaaagtc

SEQ ID NO: 876853 - DNA, 25 bp, Mus musculus
agggaaagtgtatcacaaagtcctg

SEQ ID NO: 876854 - DNA, 25 bp, Mus musculus
agggaaagtgtatctaagcaaagtc

SEQ ID NO: 876855 - DNA, 25 bp, Mus musculus
agggaaagtgtatctcaaagtcctg

SEQ ID NO: 876856 - DNA, 25 bp, Mus musculus
agggaaatcctcagcggattggcac

SEQ ID NO: 876857 - DNA, 25 bp, Mus musculus
agggaaatcctcaggggattggcac

SEQ ID NO: 876858 - DNA, 25 bp, Mus musculus
agggaacaagcccaggactgtggcg

SEQ ID NO: 876859 - DNA, 25 bp, Mus musculus
agggaacaaggccacgactgtggcg

SEQ ID NO: 876860 - DNA, 25 bp, Mus musculus
agggaacaaggccaggactgtggcg

SEQ ID NO: 876861 - DNA, 25 bp, Mus musculus
agggaaccacagcgcccaactgtga

SEQ ID NO: 876862 - DNA, 25 bp, Mus musculus
agggaaccacagggcccaactgtga

SEQ ID NO: 876863 - DNA, 25 bp, Mus musculus
agggaactcaacaacgagatggctt

SEQ ID NO: 876864 - DNA, 25 bp, Mus musculus
agggaactcaacaaggagatggctt

SEQ ID NO: 876865 - DNA, 25 bp, Mus musculus
agggaactggaccgaggagacgctt

SEQ ID NO: 876866 - DNA, 25 bp, Mus musculus
agggaactggacggaggagacgctt

SEQ ID NO: 876867 - DNA, 25 bp, Mus musculus
agggaagacaagctgatgatgagca

SEQ ID NO: 876868 - DNA, 25 bp, Mus musculus
agggaagacaaggtgatgatgagca

SEQ ID NO: 876869 - DNA, 25 bp, Mus musculus
agggaagattcgcatccctaccgtg

SEQ ID NO: 876870 - DNA, 25 bp, Mus musculus
agggaagattcggatccctaccgtg

SEQ ID NO: 876871 - DNA, 25 bp, Mus musculus
agggaagccttggacaaaacagaga

SEQ ID NO: 876872 - DNA, 25 bp, Mus musculus
agggaagccttggagaaaacagaga

SEQ ID NO: 876873 - DNA, 25 bp, Mus musculus
agggaagtctcacgtgtcggtgacg

SEQ ID NO: 876874 - DNA, 25 bp, Mus musculus
agggaagtctcaggtgtcggtgacg

SEQ ID NO: 876875 - DNA, 25 bp, Mus musculus
agggaagttgatgacgaagatgctg

SEQ ID NO: 876876 - DNA, 25 bp, Mus musculus
agggaagttgatgaggaagatgctg

SEQ ID NO: 876877 - DNA, 25 bp, Mus musculus
agggaatagtctctgctgcgtacga

SEQ ID NO: 876878 - DNA, 25 bp, Mus musculus
agggaatagtctgtgctgcgtacga

SEQ ID NO: 876879 - DNA, 25 bp, Mus musculus
agggaatggactatttgcatgcaaa

SEQ ID NO: 876880 - DNA, 25 bp, Mus musculus
agggaatggagtatttgcatgcaaa

SEQ ID NO: 876881 - DNA, 25 bp, Mus musculus
agggaatgggcaagaaggcatgcaa

SEQ ID NO: 876882 - DNA, 25 bp, Mus musculus
agggaatgggctacataccatctgc

SEQ ID NO: 876883 - DNA, 25 bp, Mus musculus
agggaatgggctacatcccgtatgt

SEQ ID NO: 876884 - DNA, 25 bp, Mus musculus
agggaatgggctacttaccatctgc

SEQ ID NO: 876885 - DNA, 25 bp, Mus musculus
agggaatgggctacttcccgtatgt

SEQ ID NO: 876886 - DNA, 25 bp, Mus musculus
agggaatggggaagaaggcatgcaa

SEQ ID NO: 876887 - DNA, 25 bp, Mus musculus
agggaattgctcagcaggctttaga

SEQ ID NO: 876888 - DNA, 25 bp, Mus musculus
agggaattgctcaggaggctttaga

SEQ ID NO: 876889 - DNA, 25 bp, Mus musculus
agggacaatctcaccctgtggacgt

SEQ ID NO: 876890 - DNA, 25 bp, Mus musculus
agggacaatctcacgctgtggacgt

SEQ ID NO: 876891 - DNA, 25 bp, Mus musculus
agggacacggagcaccccaccttgg

SEQ ID NO: 876892 - DNA, 25 bp, Mus musculus
agggacacggagcagcccaccttgg

SEQ ID NO: 876893 - DNA, 25 bp, Mus musculus
agggacacttgcagcggagactccg

SEQ ID NO: 876894 - DNA, 25 bp, Mus musculus
agggacacttgcaggggagactccg

SEQ ID NO: 876895 - DNA, 25 bp, Mus musculus
agggacagtgcaaccccctgtatga

SEQ ID NO: 876896 - DNA, 25 bp, Mus musculus
agggacagtgcatccccctgtatga

SEQ ID NO: 876897 - DNA, 25 bp, Mus musculus
agggacatagcaatgttctagaact

SEQ ID NO: 876898 - DNA, 25 bp, Mus musculus
agggacataggaatgttctagaact

SEQ ID NO: 876899 - DNA, 25 bp, Mus musculus
agggaccactgacaggcctacgtga

SEQ ID NO: 876900 - DNA, 25 bp, Mus musculus
agggaccactgaccctgagcagatg

SEQ ID NO: 876901 - DNA, 25 bp, Mus musculus
agggaccactgagaggcctacgtga

SEQ ID NO: 876902 - DNA, 25 bp, Mus musculus
agggaccactgagcctgagcagatg

SEQ ID NO: 876903 - DNA, 25 bp, Mus musculus
agggaccagcaacgtctggcgtgga

SEQ ID NO: 876904 - DNA, 25 bp, Mus musculus
agggaccagcaaggtctggcgtgga

SEQ ID NO: 876905 - DNA, 25 bp, Mus musculus
agggacccagaacatgatttttgat

SEQ ID NO: 876906 - DNA, 25 bp, Mus musculus
agggacccagaagatgatttttgat

SEQ ID NO: 876907 - DNA, 25 bp, Mus musculus
agggacccagcacgtggacagtatc

SEQ ID NO: 876908 - DNA, 25 bp, Mus musculus
agggacccagcaggtggacagtatc

SEQ ID NO: 876909 - DNA, 25 bp, Mus musculus
agggaccgagaggccgagcacggct

SEQ ID NO: 876910 - DNA, 25 bp, Mus musculus
agggaccgagcccgagcacggctac

SEQ ID NO: 876911 - DNA, 25 bp, Mus musculus
agggaccgaggccgagcacggctac

SEQ ID NO: 876912 - DNA, 25 bp, Mus musculus
agggaccgagtggccgagcacggct

SEQ ID NO: 876913 - DNA, 25 bp, Mus musculus
agggactagccgcgttattcgcagg

SEQ ID NO: 876914 - DNA, 25 bp, Mus musculus
agggactagccgggttattcgcagg

SEQ ID NO: 876915 - DNA, 25 bp, Mus musculus
agggactcaacgctgcagccccagg

SEQ ID NO: 876916 - DNA, 25 bp, Mus musculus
agggactcaacggtgcagccccagg

SEQ ID NO: 876917 - DNA, 25 bp, Mus musculus
agggactcagagcgcctagatggag

SEQ ID NO: 876918 - DNA, 25 bp, Mus musculus
agggactcagagggcctagatggag

SEQ ID NO: 876919 - DNA, 25 bp, Mus musculus
agggactcccagaacatagtcacat

SEQ ID NO: 876920 - DNA, 25 bp, Mus musculus
agggactcccagaagatagtcacat

SEQ ID NO: 876921 - DNA, 25 bp, Mus musculus
agggactgggctgcaggtcctggtg

SEQ ID NO: 876922 - DNA, 25 bp, Mus musculus
agggactggggtgcaggtcctggtg

SEQ ID NO: 876923 - DNA, 25 bp, Mus musculus
agggactgggtgcacttggcttggg

SEQ ID NO: 876924 - DNA, 25 bp, Mus musculus
agggactgggtggacttggcttggg

SEQ ID NO: 876925 - DNA, 25 bp, Mus musculus
agggacttcaaggacgctgccccct

SEQ ID NO: 876926 - DNA, 25 bp, Mus musculus
agggacttcaaggaggctgccccct

SEQ ID NO: 876927 - DNA, 25 bp, Mus musculus
agggacttcaggcctttgaaggaca

SEQ ID NO: 876928 - DNA, 25 bp, Mus musculus
agggacttcagggctttgaaggaca

SEQ ID NO: 876929 - DNA, 25 bp, Mus musculus
agggagaaagagcctggcccaacta

SEQ ID NO: 876930 - DNA, 25 bp, Mus musculus
agggagaaagtgcctggcccaacta

SEQ ID NO: 876931 - DNA, 25 bp, Mus musculus
agggagacagaagcaggtggcagga

SEQ ID NO: 876932 - DNA, 25 bp, Mus musculus
agggagacagaaggaggtggtggag

SEQ ID NO: 876933 - DNA, 25 bp, Mus musculus
agggagacagtagcaggtggcagga

SEQ ID NO: 876934 - DNA, 25 bp, Mus musculus
agggagacagtaggaggtggtggag

SEQ ID NO: 876935 - DNA, 25 bp, Mus musculus
agggagagacagaacccaataaccc

SEQ ID NO: 876936 - DNA, 25 bp, Mus musculus
agggagagacagaagccaataaccc

SEQ ID NO: 876937 - DNA, 25 bp, Mus musculus
agggagagccaacttccatcgtcaa

SEQ ID NO: 876938 - DNA, 25 bp, Mus musculus
agggagagccaagttccatcgtcaa

SEQ ID NO: 876939 - DNA, 25 bp, Mus musculus
agggagagcgagaagaattttattt

SEQ ID NO: 876940 - DNA, 25 bp, Mus musculus
agggagagcgagtagaattttattt

SEQ ID NO: 876941 - DNA, 25 bp, Mus musculus
agggagaggaggctctggtcagcta

SEQ ID NO: 876942 - DNA, 25 bp, Mus musculus
agggagaggagggtctggtcagcta

SEQ ID NO: 876943 - DNA, 25 bp, Mus musculus
agggagagtaactacctttgcatca

SEQ ID NO: 876944 - DNA, 25 bp, Mus musculus
agggagagtaactagctttgcatca

SEQ ID NO: 876945 - DNA, 25 bp, Mus musculus
agggagcacctgaattctgatggcc

SEQ ID NO: 876946 - DNA, 25 bp, Mus musculus
agggagcacctgtattctgatggcc

SEQ ID NO: 876947 - DNA, 25 bp, Mus musculus
agggagcaggaacacggtcaagtcc

SEQ ID NO: 876948 - DNA, 25 bp, Mus musculus
agggagcaggaacacggtttaatgt

SEQ ID NO: 876949 - DNA, 25 bp, Mus musculus
agggagcaggaacagggtcaagtcc

SEQ ID NO: 876950 - DNA, 25 bp, Mus musculus
agggagcaggaacagggtttaatgt

SEQ ID NO: 876951 - DNA, 25 bp, Mus musculus
agggagccgcagcgtagaggcagtc

SEQ ID NO: 876952 - DNA, 25 bp, Mus musculus
agggagccgcagggtagaggcagtc

SEQ ID NO: 876953 - DNA, 25 bp, Mus musculus
agggagcgagagtgtgaacatggct

SEQ ID NO: 876954 - DNA, 25 bp, Mus musculus
agggagcgagtgtgtgaacatggct

SEQ ID NO: 876955 - DNA, 25 bp, Mus musculus
agggagctcacaccgtgtattttcc

SEQ ID NO: 876956 - DNA, 25 bp, Mus musculus
agggagctcacagcgtgtattttcc

SEQ ID NO: 876957 - DNA, 25 bp, Mus musculus
agggagctcatccacgccaaagggg

SEQ ID NO: 876958 - DNA, 25 bp, Mus musculus
agggagctcatccaggccaaagggg

SEQ ID NO: 876959 - DNA, 25 bp, Mus musculus
agggagctctggatgctgaatgctc

SEQ ID NO: 876960 - DNA, 25 bp, Mus musculus
agggagctctggttgctgaatgctc

SEQ ID NO: 876961 - DNA, 25 bp, Mus musculus
agggagctgctaccccttctctgag

SEQ ID NO: 876962 - DNA, 25 bp, Mus musculus
agggagctgctagcccttctctgag

SEQ ID NO: 876963 - DNA, 25 bp, Mus musculus
agggaggaccagcagggcactcctt

SEQ ID NO: 876964 - DNA, 25 bp, Mus musculus
agggaggaccagcatttaagaagac

SEQ ID NO: 876965 - DNA, 25 bp, Mus musculus
agggaggaccaggagggcactcctt

SEQ ID NO: 876966 - DNA, 25 bp, Mus musculus
agggaggaccaggatttaagaagac

SEQ ID NO: 876967 - DNA, 25 bp, Mus musculus
agggataagattgacaacctagcta

SEQ ID NO: 876968 - DNA, 25 bp, Mus musculus
agggataagattgagaacctagcta

SEQ ID NO: 876969 - DNA, 25 bp, Mus musculus
agggatcaaagcctcggacgtatgt

SEQ ID NO: 876970 - DNA, 25 bp, Mus musculus
agggatcaaagcctgggacgtatgt

SEQ ID NO: 876971 - DNA, 25 bp, Mus musculus
agggatccccagatctggaatggac

SEQ ID NO: 876972 - DNA, 25 bp, Mus musculus
agggatccccagttctggaatggac

SEQ ID NO: 876973 - DNA, 25 bp, Mus musculus
agggatcggcatagcctgcaggtgt

SEQ ID NO: 876974 - DNA, 25 bp, Mus musculus
agggatcggcattgcctgcaggtgt

SEQ ID NO: 876975 - DNA, 25 bp, Mus musculus
agggatcgtacccagatcgccctga

SEQ ID NO: 876976 - DNA, 25 bp, Mus musculus
agggatcgtaccgagatcgccctga

SEQ ID NO: 876977 - DNA, 25 bp, Mus musculus
agggatctgccactgtgcccctgga

SEQ ID NO: 876978 - DNA, 25 bp, Mus musculus
agggatctgccagtgtgcccctgga

SEQ ID NO: 876979 - DNA, 25 bp, Mus musculus
agggatgccatattctttccatcct

SEQ ID NO: 876980 - DNA, 25 bp, Mus musculus
agggatgccatattgtttccatcct

SEQ ID NO: 876981 - DNA, 25 bp, Mus musculus
agggatgctattaacagaggctatg

SEQ ID NO: 876982 - DNA, 25 bp, Mus musculus
agggatgctattaagagaggctatg

SEQ ID NO: 876983 - DNA, 25 bp, Mus musculus
agggatgctcaacgacagtgctatg

SEQ ID NO: 876984 - DNA, 25 bp, Mus musculus
agggatgctcaaggacagtgctatg

SEQ ID NO: 876985 - DNA, 25 bp, Mus musculus
agggatggagacggtccagccttgt

SEQ ID NO: 876986 - DNA, 25 bp, Mus musculus
agggatggagtcggtccagccttgt

SEQ ID NO: 876987 - DNA, 25 bp, Mus musculus
agggatgtcagtcacgggacgtgga

SEQ ID NO: 876988 - DNA, 25 bp, Mus musculus
agggatgtcagtcaggggacgtgga

SEQ ID NO: 876989 - DNA, 25 bp, Mus musculus
agggatgtgatgctctttctcatca

SEQ ID NO: 876990 - DNA, 25 bp, Mus musculus
agggatgtgatggtctttctcatca

SEQ ID NO: 876991 - DNA, 25 bp, Mus musculus
agggattaccaacgtgggcagccga

SEQ ID NO: 876992 - DNA, 25 bp, Mus musculus
agggattaccaaggtgggcagccga

SEQ ID NO: 876993 - DNA, 25 bp, Mus musculus
agggatttgaatcacgtttgtgtca

SEQ ID NO: 876994 - DNA, 25 bp, Mus musculus
agggatttgaatgacgtttgtgtca

SEQ ID NO: 876995 - DNA, 25 bp, Mus musculus
agggatttgcagcgaggaaaagctt

SEQ ID NO: 876996 - DNA, 25 bp, Mus musculus
agggatttgcagggaggaaaagctt

SEQ ID NO: 876997 - DNA, 25 bp, Mus musculus
agggcaaaaaggcctcatcaaagga

SEQ ID NO: 876998 - DNA, 25 bp, Mus musculus
agggcaaaaagggctcatcaaagga

SEQ ID NO: 876999 - DNA, 25 bp, Mus musculus
agggcaaaagagatatatccagtga

SEQ ID NO: 877000 - DNA, 25 bp, Mus musculus
agggcaaaagagttatatccagtga

SEQ ID NO: 877001 - DNA, 25 bp, Mus musculus
agggcaaaatctctgagaaggaccg

SEQ ID NO: 877002 - DNA, 25 bp, Mus musculus
agggcaaaatctgtgagaaggaccg

SEQ ID NO: 877003 - DNA, 25 bp, Mus musculus
agggcaaatgtaaaaagacttgtag

SEQ ID NO: 877004 - DNA, 25 bp, Mus musculus
agggcaaatgtaaatagacttgtag

SEQ ID NO: 877005 - DNA, 25 bp, Mus musculus
agggcaactgtgtgcacatcaacga

SEQ ID NO: 877006 - DNA, 25 bp, Mus musculus
agggcaactgtgtggacatcaacga

SEQ ID NO: 877007 - DNA, 25 bp, Mus musculus
agggcaagggactccgagggagcgc

SEQ ID NO: 877008 - DNA, 25 bp, Mus musculus
agggcaagggatcttggcccagctg

SEQ ID NO: 877009 - DNA, 25 bp, Mus musculus
agggcaagggtctccgagggagcgc

SEQ ID NO: 877010 - DNA, 25 bp, Mus musculus
agggcaagggttcttggcccagctg

SEQ ID NO: 877011 - DNA, 25 bp, Mus musculus
agggcaagtggcatcgagatgttgc

SEQ ID NO: 877012 - DNA, 25 bp, Mus musculus
agggcaagtggcatggagatgttgc

SEQ ID NO: 877013 - DNA, 25 bp, Mus musculus
agggcaccagctcactacttcagtg

SEQ ID NO: 877014 - DNA, 25 bp, Mus musculus
agggcaccaggtcactacttcagtg

SEQ ID NO: 877015 - DNA, 25 bp, Mus musculus
agggcacggcagaattcatgatcac

SEQ ID NO: 877016 - DNA, 25 bp, Mus musculus
agggcacggcagcagtattcatgat

SEQ ID NO: 877017 - DNA, 25 bp, Mus musculus
agggcacggcaggagtattcatgat

SEQ ID NO: 877018 - DNA, 25 bp, Mus musculus
agggcacggcagtattcatgatcac

SEQ ID NO: 877019 - DNA, 25 bp, Mus musculus
agggcactgagacacggctttctga

SEQ ID NO: 877020 - DNA, 25 bp, Mus musculus
agggcactgagacagggctttctga

SEQ ID NO: 877021 - DNA, 25 bp, Mus musculus
agggcaggacccacaggtgactcag

SEQ ID NO: 877022 - DNA, 25 bp, Mus musculus
agggcaggacccactggtgactcag

SEQ ID NO: 877023 - DNA, 25 bp, Mus musculus
agggcataggcagccacctagatca

SEQ ID NO: 877024 - DNA, 25 bp, Mus musculus
agggcatagggagccacctagatca

SEQ ID NO: 877025 - DNA, 25 bp, Mus musculus
agggcatcatccttagcagggagaa

SEQ ID NO: 877026 - DNA, 25 bp, Mus musculus
agggcatcatcctttgcagggagaa

SEQ ID NO: 877027 - DNA, 25 bp, Mus musculus
agggcatcatctataaaaagggggg

SEQ ID NO: 877028 - DNA, 25 bp, Mus musculus
agggcatcatgtataaaaagggggg

SEQ ID NO: 877029 - DNA, 25 bp, Mus musculus
agggcatgaaagcctcagtgcagat

SEQ ID NO: 877030 - DNA, 25 bp, Mus musculus
agggcatgaaaggctcagtgcagat

SEQ ID NO: 877031 - DNA, 25 bp, Mus musculus
agggcatggatgatcggctgtttta

SEQ ID NO: 877032 - DNA, 25 bp, Mus musculus
agggcatggatgttcggctgtttta

SEQ ID NO: 877033 - DNA, 25 bp, Mus musculus
agggccaaaaatctgcggaatgatt

SEQ ID NO: 877034 - DNA, 25 bp, Mus musculus
agggccaaaaatgtgcggaatgatt

SEQ ID NO: 877035 - DNA, 25 bp, Mus musculus
agggccacacaactcgcgagcacag

SEQ ID NO: 877036 - DNA, 25 bp, Mus musculus
agggccacacaagtcgcgagcacag

SEQ ID NO: 877037 - DNA, 25 bp, Mus musculus
agggccacactgctgctgtgacatg

SEQ ID NO: 877038 - DNA, 25 bp, Mus musculus
agggccacactggtgctgtgacatg

SEQ ID NO: 877039 - DNA, 25 bp, Mus musculus
agggccagcaggctctcctgcaagc

SEQ ID NO: 877040 - DNA, 25 bp, Mus musculus
agggccagcagggtctcctgcaagc

SEQ ID NO: 877041 - DNA, 25 bp, Mus musculus
agggccatcaagaatgactctgtgg

SEQ ID NO: 877042 - DNA, 25 bp, Mus musculus
agggccatcaagtatgactctgtgg

SEQ ID NO: 877043 - DNA, 25 bp, Mus musculus
agggccatgaagcgagctggcacgg

SEQ ID NO: 877044 - DNA, 25 bp, Mus musculus
agggccatgaagggagctggcacgg

SEQ ID NO: 877045 - DNA, 25 bp, Mus musculus
agggccatggcgaacgcagggctgt

SEQ ID NO: 877046 - DNA, 25 bp, Mus musculus
agggccatggcgaaggcagggctgt

SEQ ID NO: 877047 - DNA, 25 bp, Mus musculus
agggcccaatgtcgaatcctgtggc

SEQ ID NO: 877048 - DNA, 25 bp, Mus musculus
agggcccaatgtggaatcctgtggc

SEQ ID NO: 877049 - DNA, 25 bp, Mus musculus
agggccccagcacctctactggaca

SEQ ID NO: 877050 - DNA, 25 bp, Mus musculus
agggccccagcagctctactggaca

SEQ ID NO: 877051 - DNA, 25 bp, Mus musculus
agggcccgttcacggctgggcttca

SEQ ID NO: 877052 - DNA, 25 bp, Mus musculus
agggcccgttcagggctgggcttca

SEQ ID NO: 877053 - DNA, 25 bp, Mus musculus
agggccctgcagccctcggtgtctc

SEQ ID NO: 877054 - DNA, 25 bp, Mus musculus
agggccctgcaggcctcggtgtctc

SEQ ID NO: 877055 - DNA, 25 bp, Mus musculus
agggccgcctgtgccggaaggacct

SEQ ID NO: 877056 - DNA, 25 bp, Mus musculus
agggccgcctgtgcgggaaggacct

SEQ ID NO: 877057 - DNA, 25 bp, Mus musculus
agggccgggagactcttggtctttg

SEQ ID NO: 877058 - DNA, 25 bp, Mus musculus
agggccgggagagtcttggtctttg

SEQ ID NO: 877059 - DNA, 25 bp, Mus musculus
agggccgtcgtgatggcgtctggaa

SEQ ID NO: 877060 - DNA, 25 bp, Mus musculus
agggccgtcgtgttggcgtctggaa

SEQ ID NO: 877061 - DNA, 25 bp, Mus musculus
agggcctaatgacactaattatgcc

SEQ ID NO: 877062 - DNA, 25 bp, Mus musculus
agggcctaatgacagtaattatgcc

SEQ ID NO: 877063 - DNA, 25 bp, Mus musculus
agggcctggcctacccggccaagga

SEQ ID NO: 877064 - DNA, 25 bp, Mus musculus
agggcctggcctacgcggccaagga

SEQ ID NO: 877065 - DNA, 25 bp, Mus musculus
agggcctttgctcgggacagtaaat

SEQ ID NO: 877066 - DNA, 25 bp, Mus musculus
agggcctttgctggggacagtaaat

SEQ ID NO: 877067 - DNA, 25 bp, Mus musculus
agggcggagaaacagctctccgagc

SEQ ID NO: 877068 - DNA, 25 bp, Mus musculus
agggcggagaaacctctccgagcag

SEQ ID NO: 877069 - DNA, 25 bp, Mus musculus
agggcggagaaagagctctccgagc

SEQ ID NO: 877070 - DNA, 25 bp, Mus musculus
agggcggagaaagctctccgagcag

SEQ ID NO: 877071 - DNA, 25 bp, Mus musculus
agggcggcagacgccagtgctgtat

SEQ ID NO: 877072 - DNA, 25 bp, Mus musculus
agggcggcagtcgccagtgctgtat

SEQ ID NO: 877073 - DNA, 25 bp, Mus musculus
agggcggctcaccgcgtcgattctg

SEQ ID NO: 877074 - DNA, 25 bp, Mus musculus
agggcggctcaccgggtcgattctg

SEQ ID NO: 877075 - DNA, 25 bp, Mus musculus
agggcgtcttagatgacgtggtctc

SEQ ID NO: 877076 - DNA, 25 bp, Mus musculus
agggcgtcttagttgacgtggtctc

SEQ ID NO: 877077 - DNA, 25 bp, Mus musculus
agggctaatgaccacagtccattcc

SEQ ID NO: 877078 - DNA, 25 bp, Mus musculus
agggctaatgtccacagtccattcc

SEQ ID NO: 877079 - DNA, 25 bp, Mus musculus
agggctacatcaaacaccaggtgtt

SEQ ID NO: 877080 - DNA, 25 bp, Mus musculus
agggctacatcaaagaccaggtgtt

SEQ ID NO: 877081 - DNA, 25 bp, Mus musculus
agggctacatcgtgcttcaggcaaa

SEQ ID NO: 877082 - DNA, 25 bp, Mus musculus
agggctacatggtgcttcaggcaaa

SEQ ID NO: 877083 - DNA, 25 bp, Mus musculus
agggctatgacacacaggtaggtga

SEQ ID NO: 877084 - DNA, 25 bp, Mus musculus
agggctatgacacagaggtaggtga

SEQ ID NO: 877085 - DNA, 25 bp, Mus musculus
agggctcaagacgcaatgtgtcttc

SEQ ID NO: 877086 - DNA, 25 bp, Mus musculus
agggctcaagcaggtagatgacttc

SEQ ID NO: 877087 - DNA, 25 bp, Mus musculus
agggctcaaggaggtagatgacttc

SEQ ID NO: 877088 - DNA, 25 bp, Mus musculus
agggctcaagtcgcaatgtgtcttc

SEQ ID NO: 877089 - DNA, 25 bp, Mus musculus
agggctctgcagcaagcctgctgac

SEQ ID NO: 877090 - DNA, 25 bp, Mus musculus
agggctctgcaggaagcctgctgac

SEQ ID NO: 877091 - DNA, 25 bp, Mus musculus
agggctcttgcgcagcgctcaccac

SEQ ID NO: 877092 - DNA, 25 bp, Mus musculus
agggctcttgctgttccggggcaca

SEQ ID NO: 877093 - DNA, 25 bp, Mus musculus
agggctcttgggcagcgctcaccac

SEQ ID NO: 877094 - DNA, 25 bp, Mus musculus
agggctcttggtgttccggggcaca

SEQ ID NO: 877095 - DNA, 25 bp, Mus musculus
agggctgaagaatatacattcggct

SEQ ID NO: 877096 - DNA, 25 bp, Mus musculus
agggctgaagagaatatccggtctc

SEQ ID NO: 877097 - DNA, 25 bp, Mus musculus
agggctgaagagagatgacattact

SEQ ID NO: 877098 - DNA, 25 bp, Mus musculus
agggctgaagagtatatccggtctc

SEQ ID NO: 877099 - DNA, 25 bp, Mus musculus
agggctgaagagtgatgacattact

SEQ ID NO: 877100 - DNA, 25 bp, Mus musculus
agggctgaagtatatacattcggct

SEQ ID NO: 877101 - DNA, 25 bp, Mus musculus
agggctgcaaagctttcttccgaag

SEQ ID NO: 877102 - DNA, 25 bp, Mus musculus
agggctgcaaaggtttcttccgaag

SEQ ID NO: 877103 - DNA, 25 bp, Mus musculus
agggctgccgagatgtggacgagtg

SEQ ID NO: 877104 - DNA, 25 bp, Mus musculus
agggctgccgagttgtggacgagtg

SEQ ID NO: 877105 - DNA, 25 bp, Mus musculus
agggctgcctcacgtcgcatagggc

SEQ ID NO: 877106 - DNA, 25 bp, Mus musculus
agggctgcctcaggtcgcatagggc

SEQ ID NO: 877107 - DNA, 25 bp, Mus musculus
agggctggccggattggtggaggta

SEQ ID NO: 877108 - DNA, 25 bp, Mus musculus
agggctggccggtttggtggaggta

SEQ ID NO: 877109 - DNA, 25 bp, Mus musculus
agggctgtggagctgatgcctaagt

SEQ ID NO: 877110 - DNA, 25 bp, Mus musculus
agggctgtggaggtgatgcctaagt

SEQ ID NO: 877111 - DNA, 25 bp, Mus musculus
agggctgttgagcttccagagaagc

SEQ ID NO: 877112 - DNA, 25 bp, Mus musculus
agggctgttgtgcttccagagaagc

SEQ ID NO: 877113 - DNA, 25 bp, Mus musculus
agggcttcttcacacgaacagtcag

SEQ ID NO: 877114 - DNA, 25 bp, Mus musculus
agggcttcttcactgatactgtcag

SEQ ID NO: 877115 - DNA, 25 bp, Mus musculus
agggcttcttcagacgaacagtcag

SEQ ID NO: 877116 - DNA, 25 bp, Mus musculus
agggcttcttcagtgatactgtcag

SEQ ID NO: 877117 - DNA, 25 bp, Mus musculus
aggggaaagctgctggaaagtgaga

SEQ ID NO: 877118 - DNA, 25 bp, Mus musculus
aggggaaagctggtggaaagtgaga

SEQ ID NO: 877119 - DNA, 25 bp, Mus musculus
aggggaactccgagtgagcggcctg

SEQ ID NO: 877120 - DNA, 25 bp, Mus musculus
aggggaactccgtgtgagcggcctg

SEQ ID NO: 877121 - DNA, 25 bp, Mus musculus
aggggaagaaaatcggcaccaccaa

SEQ ID NO: 877122 - DNA, 25 bp, Mus musculus
aggggaagaatatcggcaccaccaa

SEQ ID NO: 877123 - DNA, 25 bp, Mus musculus
aggggacaagatcacctttgcagac

SEQ ID NO: 877124 - DNA, 25 bp, Mus musculus
aggggacaagatcacctttgtggat

SEQ ID NO: 877125 - DNA, 25 bp, Mus musculus
aggggacaagttcacctttgcagac

SEQ ID NO: 877126 - DNA, 25 bp, Mus musculus
aggggacaagttcacctttgtggat

SEQ ID NO: 877127 - DNA, 25 bp, Mus musculus
aggggacctggacacagccttccct

SEQ ID NO: 877128 - DNA, 25 bp, Mus musculus
aggggacctggagacagccttccct

SEQ ID NO: 877129 - DNA, 25 bp, Mus musculus
aggggacggtacctccattgtgctt

SEQ ID NO: 877130 - DNA, 25 bp, Mus musculus
aggggacggtacctgcattgtgctt

SEQ ID NO: 877131 - DNA, 25 bp, Mus musculus
aggggagaagcacaccatggtgaat

SEQ ID NO: 877132 - DNA, 25 bp, Mus musculus
aggggagaagcagaccatggtgaat

SEQ ID NO: 877133 - DNA, 25 bp, Mus musculus
aggggagacgtgctactcagttcgt

SEQ ID NO: 877134 - DNA, 25 bp, Mus musculus
aggggagacgtggtactcagttcgt

SEQ ID NO: 877135 - DNA, 25 bp, Mus musculus
aggggaggaggcaaccagtgtcggg

SEQ ID NO: 877136 - DNA, 25 bp, Mus musculus
aggggaggaggcaagcagtgtcggg

SEQ ID NO: 877137 - DNA, 25 bp, Mus musculus
aggggatcgactcgtacatggactt

SEQ ID NO: 877138 - DNA, 25 bp, Mus musculus
aggggatcgactggtacatggactt

SEQ ID NO: 877139 - DNA, 25 bp, Mus musculus
aggggcaacgccatcgccttctccg

SEQ ID NO: 877140 - DNA, 25 bp, Mus musculus
aggggcaacggcatcgccttctccg

SEQ ID NO: 877141 - DNA, 25 bp, Mus musculus
aggggcaggcggctgattatagagc

SEQ ID NO: 877142 - DNA, 25 bp, Mus musculus
aggggcaggcgggtgattatagagc

SEQ ID NO: 877143 - DNA, 25 bp, Mus musculus
aggggcccatttagaacatgaatct

SEQ ID NO: 877144 - DNA, 25 bp, Mus musculus
aggggcccattttgaacatgaatct

SEQ ID NO: 877145 - DNA, 25 bp, Mus musculus
aggggcccccatcctggcccctgag

SEQ ID NO: 877146 - DNA, 25 bp, Mus musculus
aggggcccccatgctggcccctgag

SEQ ID NO: 877147 - DNA, 25 bp, Mus musculus
aggggcctcctggccaggtggccat

SEQ ID NO: 877148 - DNA, 25 bp, Mus musculus
aggggcctcctggcgaggtggccat

SEQ ID NO: 877149 - DNA, 25 bp, Mus musculus
aggggccttccacagtagaggcccg

SEQ ID NO: 877150 - DNA, 25 bp, Mus musculus
aggggccttccacgcagtagaggcc

SEQ ID NO: 877151 - DNA, 25 bp, Mus musculus
aggggccttccagagtagaggcccg

SEQ ID NO: 877152 - DNA, 25 bp, Mus musculus
aggggccttccaggcagtagaggcc

SEQ ID NO: 877153 - DNA, 25 bp, Mus musculus
aggggcgcgggactcaccaggcttg

SEQ ID NO: 877154 - DNA, 25 bp, Mus musculus
aggggcgcgggagtcaccaggcttg

SEQ ID NO: 877155 - DNA, 25 bp, Mus musculus
aggggcgcgtgccattgagctgctg

SEQ ID NO: 877156 - DNA, 25 bp, Mus musculus
aggggcgcgtgcgattgagctgctg

SEQ ID NO: 877157 - DNA, 25 bp, Mus musculus
aggggctttcagcgggactgcaggc

SEQ ID NO: 877158 - DNA, 25 bp, Mus musculus
aggggctttcagggggactgcaggc

SEQ ID NO: 877159 - DNA, 25 bp, Mus musculus
agggggacaagacgttgcctgcagg

SEQ ID NO: 877160 - DNA, 25 bp, Mus musculus
agggggacaagaggttgcctgcagg

SEQ ID NO: 877161 - DNA, 25 bp, Mus musculus
agggggacacacaagcaaaatatgc

SEQ ID NO: 877162 - DNA, 25 bp, Mus musculus
agggggacacactagcaaaatatgc

SEQ ID NO: 877163 - DNA, 25 bp, Mus musculus
agggggacgagaacaacatggagtt

SEQ ID NO: 877164 - DNA, 25 bp, Mus musculus
agggggacgagaactacatggagtt

SEQ ID NO: 877165 - DNA, 25 bp, Mus musculus
agggggagtttggacatgtgatgct

SEQ ID NO: 877166 - DNA, 25 bp, Mus musculus
agggggagtttggagatgtgatgct

SEQ ID NO: 877167 - DNA, 25 bp, Mus musculus
agggggcacagatgcggacagagag

SEQ ID NO: 877168 - DNA, 25 bp, Mus musculus
agggggcacagatggggacagagag

SEQ ID NO: 877169 - DNA, 25 bp, Mus musculus
agggggcaggcacccactcccgaga

SEQ ID NO: 877170 - DNA, 25 bp, Mus musculus
agggggcaggcagccactcccgaga

SEQ ID NO: 877171 - DNA, 25 bp, Mus musculus
agggggccagcatgacgatgatgca

SEQ ID NO: 877172 - DNA, 25 bp, Mus musculus
agggggccaggatgacgatgatgca

SEQ ID NO: 877173 - DNA, 25 bp, Mus musculus
agggggcgggatccagagcaacctg

SEQ ID NO: 877174 - DNA, 25 bp, Mus musculus
agggggcgggttccagagcaacctg

SEQ ID NO: 877175 - DNA, 25 bp, Mus musculus
agggggctgacgcacgagtccggct

SEQ ID NO: 877176 - DNA, 25 bp, Mus musculus
agggggctgacggacgagtccggct

SEQ ID NO: 877177 - DNA, 25 bp, Mus musculus
aggggggctgatcctgggctcaccc

SEQ ID NO: 877178 - DNA, 25 bp, Mus musculus
aggggggctgttcctgggctcaccc

SEQ ID NO: 877179 - DNA, 25 bp, Mus musculus
agggggtaccagatcctacagtcat

SEQ ID NO: 877180 - DNA, 25 bp, Mus musculus
agggggtaccagttcctacagtcat

SEQ ID NO: 877181 - DNA, 25 bp, Mus musculus
agggggtgagctgggcctgcgctgc

SEQ ID NO: 877182 - DNA, 25 bp, Mus musculus
agggggtgaggtgggcctgcgctgc

SEQ ID NO: 877183 - DNA, 25 bp, Mus musculus
aggggtcatcagcctgtctcaggaa

SEQ ID NO: 877184 - DNA, 25 bp, Mus musculus
aggggtcatcaggctgtctcaggaa

SEQ ID NO: 877185 - DNA, 25 bp, Mus musculus
aggggtgaccttcgagatatgggac

SEQ ID NO: 877186 - DNA, 25 bp, Mus musculus
aggggtgaccttggagatatgggac

SEQ ID NO: 877187 - DNA, 25 bp, Mus musculus
aggggtgctgcccacggtccgggag

SEQ ID NO: 877188 - DNA, 25 bp, Mus musculus
aggggtgctgcccactagggtccgg

SEQ ID NO: 877189 - DNA, 25 bp, Mus musculus
aggggtgctgcccagggtccgggag

SEQ ID NO: 877190 - DNA, 25 bp, Mus musculus
aggggtgctgcccagtagggtccgg

SEQ ID NO: 877191 - DNA, 25 bp, Mus musculus
aggggttaagagactgtgaagtctt

SEQ ID NO: 877192 - DNA, 25 bp, Mus musculus
aggggttaagtgactgtgaagtctt

SEQ ID NO: 877193 - DNA, 25 bp, Mus musculus
aggggttcaaacagacccagtcttc

SEQ ID NO: 877194 - DNA, 25 bp, Mus musculus
aggggttcaatcagacccagtcttc

SEQ ID NO: 877195 - DNA, 25 bp, Mus musculus
aggggttcagatgccccatataggc

SEQ ID NO: 877196 - DNA, 25 bp, Mus musculus
aggggttcagccaacaattctcttg

SEQ ID NO: 877197 - DNA, 25 bp, Mus musculus
aggggttcaggcaacaattctcttg

SEQ ID NO: 877198 - DNA, 25 bp, Mus musculus
aggggttcagttgccccatataggc

SEQ ID NO: 877199 - DNA, 25 bp, Mus musculus
aggggttgcacacgatttccctaga

SEQ ID NO: 877200 - DNA, 25 bp, Mus musculus
aggggttgcacaggatttccctaga

SEQ ID NO: 877201 - DNA, 25 bp, Mus musculus
agggtaaggatggacatcccccagg

SEQ ID NO: 877202 - DNA, 25 bp, Mus musculus
agggtaaggatggagatcccccagg

SEQ ID NO: 877203 - DNA, 25 bp, Mus musculus
agggtagaccttctgtctagtgaca

SEQ ID NO: 877204 - DNA, 25 bp, Mus musculus
agggtagaccttgtgtctagtgaca

SEQ ID NO: 877205 - DNA, 25 bp, Mus musculus
agggtagtcactcactgtatccagg

SEQ ID NO: 877206 - DNA, 25 bp, Mus musculus
agggtagtcactgactgtatccagg

SEQ ID NO: 877207 - DNA, 25 bp, Mus musculus
agggtcactgtgactccagctccgt

SEQ ID NO: 877208 - DNA, 25 bp, Mus musculus
agggtcactgtgtctccagctccgt

SEQ ID NO: 877209 - DNA, 25 bp, Mus musculus
agggtcagaactactacgcatccag

SEQ ID NO: 877210 - DNA, 25 bp, Mus musculus
agggtcagaagtactacgcatccag

SEQ ID NO: 877211 - DNA, 25 bp, Mus musculus
agggtcagcgcgagcacctggcgcc

SEQ ID NO: 877212 - DNA, 25 bp, Mus musculus
agggtcagcgggagcacctggcgcc

SEQ ID NO: 877213 - DNA, 25 bp, Mus musculus
agggtcccagaacggtcagaaagca

SEQ ID NO: 877214 - DNA, 25 bp, Mus musculus
agggtcccagaagggtcagaaagca

SEQ ID NO: 877215 - DNA, 25 bp, Mus musculus
agggtctatgagctaattatagata

SEQ ID NO: 877216 - DNA, 25 bp, Mus musculus
agggtctatgaggtaattatagata

SEQ ID NO: 877217 - DNA, 25 bp, Mus musculus
agggtctctgagaggaggtgaagcc

SEQ ID NO: 877218 - DNA, 25 bp, Mus musculus
agggtctctgagtggaggtgaagcc

SEQ ID NO: 877219 - DNA, 25 bp, Mus musculus
agggtcttggcctcgaaatgtgagg

SEQ ID NO: 877220 - DNA, 25 bp, Mus musculus
agggtcttgggctcgaaatgtgagg

SEQ ID NO: 877221 - DNA, 25 bp, Mus musculus
agggtgaagcttcacatctgggaca

SEQ ID NO: 877222 - DNA, 25 bp, Mus musculus
agggtgaagcttcagatctgggaca

SEQ ID NO: 877223 - DNA, 25 bp, Mus musculus
agggtgacgcgacacaaaccgccca

SEQ ID NO: 877224 - DNA, 25 bp, Mus musculus
agggtgacgcgacaccacaccacat

SEQ ID NO: 877225 - DNA, 25 bp, Mus musculus
agggtgacgcgacagaaaccgccca

SEQ ID NO: 877226 - DNA, 25 bp, Mus musculus
agggtgacgcgacagcacaccacat

SEQ ID NO: 877227 - DNA, 25 bp, Mus musculus
agggtgactctaaatctgcatttaa

SEQ ID NO: 877228 - DNA, 25 bp, Mus musculus
agggtgactctatatctgcatttaa

SEQ ID NO: 877229 - DNA, 25 bp, Mus musculus
agggtgaggcaggtcgagggagctc

SEQ ID NO: 877230 - DNA, 25 bp, Mus musculus
agggtgaggcaggtggagggagctc

SEQ ID NO: 877231 - DNA, 25 bp, Mus musculus
agggtgatggcagtgagcctgtacc

SEQ ID NO: 877232 - DNA, 25 bp, Mus musculus
agggtgatgggagtgagcctgtacc

SEQ ID NO: 877233 - DNA, 25 bp, Mus musculus
agggtgattgcgcacgccttcagaa

SEQ ID NO: 877234 - DNA, 25 bp, Mus musculus
agggtgattgcgcaggccttcagaa

SEQ ID NO: 877235 - DNA, 25 bp, Mus musculus
agggtgcaaaagctaccagcaaggt

SEQ ID NO: 877236 - DNA, 25 bp, Mus musculus
agggtgcaaaaggtaccagcaaggt

SEQ ID NO: 877237 - DNA, 25 bp, Mus musculus
agggtgcagggacctgatcacacga

SEQ ID NO: 877238 - DNA, 25 bp, Mus musculus
agggtgcagggagctgatcacacga

SEQ ID NO: 877239 - DNA, 25 bp, Mus musculus
agggtgcccatggacgtcctgtcca

SEQ ID NO: 877240 - DNA, 25 bp, Mus musculus
agggtgcccatggaggtcctgtcca

SEQ ID NO: 877241 - DNA, 25 bp, Mus musculus
agggtgtgagctaaccatcctgttt

SEQ ID NO: 877242 - DNA, 25 bp, Mus musculus
agggtgtgaggtaaccatcctgttt

SEQ ID NO: 877243 - DNA, 25 bp, Mus musculus
agggttatagcatgatgacctgcat

SEQ ID NO: 877244 - DNA, 25 bp, Mus musculus
agggttataggatgatgacctgcat

SEQ ID NO: 877245 - DNA, 25 bp, Mus musculus
agggttcaggctgccatggacacgc

SEQ ID NO: 877246 - DNA, 25 bp, Mus musculus
agggttcagggtgccatggacacgc

SEQ ID NO: 877247 - DNA, 25 bp, Mus musculus
agggttccctagaacttgtgctgcc

SEQ ID NO: 877248 - DNA, 25 bp, Mus musculus
agggttccctagaagttgtgctgcc

SEQ ID NO: 877249 - DNA, 25 bp, Mus musculus
agggttctctgtaacttctccctgt

SEQ ID NO: 877250 - DNA, 25 bp, Mus musculus
agggttctctgtaagttctccctgt

SEQ ID NO: 877251 - DNA, 25 bp, Mus musculus
agggttggacaacgttgctgaagag

SEQ ID NO: 877252 - DNA, 25 bp, Mus musculus
agggttggacaaggttgctgaagag

SEQ ID NO: 877253 - DNA, 25 bp, Mus musculus
agggttgtgatgcgaggctcctatg

SEQ ID NO: 877254 - DNA, 25 bp, Mus musculus
agggttgtgatgcgcggctcctatg

SEQ ID NO: 877255 - DNA, 25 bp, Mus musculus
agggttgtgatgggaggctcctatg

SEQ ID NO: 877256 - DNA, 25 bp, Mus musculus
agggttgtgatgggcggctcctatg

SEQ ID NO: 877257 - DNA, 25 bp, Mus musculus
agggtttgagagaatcgcacgtcca

SEQ ID NO: 877258 - DNA, 25 bp, Mus musculus
agggtttgagtgaatcgcacgtcca

SEQ ID NO: 877259 - DNA, 25 bp, Mus musculus
aggtaaaaagcttggctcatacttt

SEQ ID NO: 877260 - DNA, 25 bp, Mus musculus
aggtaaaaaggttggctcatacttt

SEQ ID NO: 877261 - DNA, 25 bp, Mus musculus
aggtaaaaatggaacgaaatgcaag

SEQ ID NO: 877262 - DNA, 25 bp, Mus musculus
aggtaaaaatggaaggaaatgcaag

SEQ ID NO: 877263 - DNA, 25 bp, Mus musculus
aggtaaacagaatagaatccctcga

SEQ ID NO: 877264 - DNA, 25 bp, Mus musculus
aggtaaacagtatagaatccctcga

SEQ ID NO: 877265 - DNA, 25 bp, Mus musculus
aggtaactgcagagaaattaataga

SEQ ID NO: 877266 - DNA, 25 bp, Mus musculus
aggtaactgcagtgaaattaataga

SEQ ID NO: 877267 - DNA, 25 bp, Mus musculus
aggtaaggtaagatctcaagcatac

SEQ ID NO: 877268 - DNA, 25 bp, Mus musculus
aggtaaggtaagttctcaagcatac

SEQ ID NO: 877269 - DNA, 25 bp, Mus musculus
aggtacacaaacaagtattcctctc

SEQ ID NO: 877270 - DNA, 25 bp, Mus musculus
aggtacacaatcaagtattcctctc

SEQ ID NO: 877271 - DNA, 25 bp, Mus musculus
aggtacacagccgcaggtctgagcg

SEQ ID NO: 877272 - DNA, 25 bp, Mus musculus
aggtacacaggcgcaggtctgagcg

SEQ ID NO: 877273 - DNA, 25 bp, Mus musculus
aggtacagacagccctcctgcttct

SEQ ID NO: 877274 - DNA, 25 bp, Mus musculus
aggtacagacaggcctcctgcttct

SEQ ID NO: 877275 - DNA, 25 bp, Mus musculus
aggtacagagaccacgtctttggcc

SEQ ID NO: 877276 - DNA, 25 bp, Mus musculus
aggtacagagaccaggtctttggcc

SEQ ID NO: 877277 - DNA, 25 bp, Mus musculus
aggtacaggcagccaaaggctcggg

SEQ ID NO: 877278 - DNA, 25 bp, Mus musculus
aggtacaggcaggcaaaggctcggg

SEQ ID NO: 877279 - DNA, 25 bp, Mus musculus
aggtacatctatcacccatggcgag

SEQ ID NO: 877280 - DNA, 25 bp, Mus musculus
aggtacatctatcagccatggcgag

SEQ ID NO: 877281 - DNA, 25 bp, Mus musculus
aggtaccatacacaaatgcgatgaa

SEQ ID NO: 877282 - DNA, 25 bp, Mus musculus
aggtaccatacagaaatgcgatgaa

SEQ ID NO: 877283 - DNA, 25 bp, Mus musculus
aggtacctgacacgggaactctggg

SEQ ID NO: 877284 - DNA, 25 bp, Mus musculus
aggtacctgacaggggaactctggg

SEQ ID NO: 877285 - DNA, 25 bp, Mus musculus
aggtacctgcacagcatatatgtgc

SEQ ID NO: 877286 - DNA, 25 bp, Mus musculus
aggtacctgcacaggatatatgtgc

SEQ ID NO: 877287 - DNA, 25 bp, Mus musculus
aggtagaaataacccatgacgaaca

SEQ ID NO: 877288 - DNA, 25 bp, Mus musculus
aggtagaaataaccgatgacgaaca

SEQ ID NO: 877289 - DNA, 25 bp, Mus musculus
aggtagatgcagcagatcccccaag

SEQ ID NO: 877290 - DNA, 25 bp, Mus musculus
aggtagatgcaggagatcccccaag

SEQ ID NO: 877291 - DNA, 25 bp, Mus musculus
aggtataacgcccatatttctacct

SEQ ID NO: 877292 - DNA, 25 bp, Mus musculus
aggtataacgccgatatttctacct

SEQ ID NO: 877293 - DNA, 25 bp, Mus musculus
aggtatccatgccgctgtgtggaga

SEQ ID NO: 877294 - DNA, 25 bp, Mus musculus
aggtatccatgcggctgtgtggaga

SEQ ID NO: 877295 - DNA, 25 bp, Mus musculus
aggtatcccactacagcttctttgt

SEQ ID NO: 877296 - DNA, 25 bp, Mus musculus
aggtatcccagtacagcttctttgt

SEQ ID NO: 877297 - DNA, 25 bp, Mus musculus
aggtcaacaactggctggaaacttc

SEQ ID NO: 877298 - DNA, 25 bp, Mus musculus
aggtcaacaagtggctggaaacttc

SEQ ID NO: 877299 - DNA, 25 bp, Mus musculus
aggtcaacagatacaagctgtcgct

SEQ ID NO: 877300 - DNA, 25 bp, Mus musculus
aggtcaacagttacaagctgtcgct

SEQ ID NO: 877301 - DNA, 25 bp, Mus musculus
aggtcaactgcccttctcgaacctg

SEQ ID NO: 877302 - DNA, 25 bp, Mus musculus
aggtcaactgccgttctcgaacctg

SEQ ID NO: 877303 - DNA, 25 bp, Mus musculus
aggtcaacttacagataccatggca

SEQ ID NO: 877304 - DNA, 25 bp, Mus musculus
aggtcaacttactgataccatggca

SEQ ID NO: 877305 - DNA, 25 bp, Mus musculus
aggtcaatcattactatgtttgacc

SEQ ID NO: 877306 - DNA, 25 bp, Mus musculus
aggtcaatcatttctatgtttgacc

SEQ ID NO: 877307 - DNA, 25 bp, Mus musculus
aggtcaattatgaacagtttgtaca

SEQ ID NO: 877308 - DNA, 25 bp, Mus musculus
aggtcaattatgaagagtttgtaca

SEQ ID NO: 877309 - DNA, 25 bp, Mus musculus
aggtcacaagaactaaaagaagtca

SEQ ID NO: 877310 - DNA, 25 bp, Mus musculus
aggtcacaagtactaaaagaagtca

SEQ ID NO: 877311 - DNA, 25 bp, Mus musculus
aggtcaccagcatgggattttgcat

SEQ ID NO: 877312 - DNA, 25 bp, Mus musculus
aggtcaccagcgaggccatcagttt

SEQ ID NO: 877313 - DNA, 25 bp, Mus musculus
aggtcaccaggatgggattttgcat

SEQ ID NO: 877314 - DNA, 25 bp, Mus musculus
aggtcaccagggaggccatcagttt

SEQ ID NO: 877315 - DNA, 25 bp, Mus musculus
aggtcacccgactcctcagagactc

SEQ ID NO: 877316 - DNA, 25 bp, Mus musculus
aggtcacccgactcgtcagagactc

SEQ ID NO: 877317 - DNA, 25 bp, Mus musculus
aggtcacctgcacatactttatgca

SEQ ID NO: 877318 - DNA, 25 bp, Mus musculus
aggtcacctgcacgtattttatgca

SEQ ID NO: 877319 - DNA, 25 bp, Mus musculus
aggtcacctgcagatactttatgca

SEQ ID NO: 877320 - DNA, 25 bp, Mus musculus
aggtcacctgcaggtattttatgca

SEQ ID NO: 877321 - DNA, 25 bp, Mus musculus
aggtcagagttcaacgtgatggtga

SEQ ID NO: 877322 - DNA, 25 bp, Mus musculus
aggtcagagttcaaggtgatggtga

SEQ ID NO: 877323 - DNA, 25 bp, Mus musculus
aggtcagtcctgcgctgggccgtcg

SEQ ID NO: 877324 - DNA, 25 bp, Mus musculus
aggtcagtcctgggctgggccgtcg

SEQ ID NO: 877325 - DNA, 25 bp, Mus musculus
aggtcataagttcgcatatgtctgg

SEQ ID NO: 877326 - DNA, 25 bp, Mus musculus
aggtcataagttggcatatgtctgg

SEQ ID NO: 877327 - DNA, 25 bp, Mus musculus
aggtcatcaacacacactttcctgc

SEQ ID NO: 877328 - DNA, 25 bp, Mus musculus
aggtcatcaacacagactttcctgc

SEQ ID NO: 877329 - DNA, 25 bp, Mus musculus
aggtcatcctcttcaatgcggcagg

SEQ ID NO: 877330 - DNA, 25 bp, Mus musculus
aggtcatcctcttcagagcattccg

SEQ ID NO: 877331 - DNA, 25 bp, Mus musculus
aggtcatcctcttctatgcggcagg

SEQ ID NO: 877332 - DNA, 25 bp, Mus musculus
aggtcatcctcttctgagcattccg

SEQ ID NO: 877333 - DNA, 25 bp, Mus musculus
aggtcatcctggagttgggctggtc

SEQ ID NO: 877334 - DNA, 25 bp, Mus musculus
aggtcatcctggtgttgggctggtc

SEQ ID NO: 877335 - DNA, 25 bp, Mus musculus
aggtcatgaacatacgcccttctga

SEQ ID NO: 877336 - DNA, 25 bp, Mus musculus
aggtcatgaacataggcccttctga

SEQ ID NO: 877337 - DNA, 25 bp, Mus musculus
aggtcatgactgccatttgcttcac

SEQ ID NO: 877338 - DNA, 25 bp, Mus musculus
aggtcatgactgcggtgatctgctt

SEQ ID NO: 877339 - DNA, 25 bp, Mus musculus
aggtcatgactggcatttgcttcac

SEQ ID NO: 877340 - DNA, 25 bp, Mus musculus
aggtcatgactggggtgatctgctt

SEQ ID NO: 877341 - DNA, 25 bp, Mus musculus
aggtcatggacgatttaaagcctct

SEQ ID NO: 877342 - DNA, 25 bp, Mus musculus
aggtcatggacgttttaaagcctct

SEQ ID NO: 877343 - DNA, 25 bp, Mus musculus
aggtcattcataaacattgaggaag

SEQ ID NO: 877344 - DNA, 25 bp, Mus musculus
aggtcattcataaagattgaggaag

SEQ ID NO: 877345 - DNA, 25 bp, Mus musculus
aggtcatttcagcggagcgtttgcc

SEQ ID NO: 877346 - DNA, 25 bp, Mus musculus
aggtcatttcaggggagcgtttgcc

SEQ ID NO: 877347 - DNA, 25 bp, Mus musculus
aggtccaatgtgcgaacatcagtta

SEQ ID NO: 877348 - DNA, 25 bp, Mus musculus
aggtccaatgtgggaacatcagtta

SEQ ID NO: 877349 - DNA, 25 bp, Mus musculus
aggtccagagattccctactcctct

SEQ ID NO: 877350 - DNA, 25 bp, Mus musculus
aggtccagagtttccctactcctct

SEQ ID NO: 877351 - DNA, 25 bp, Mus musculus
aggtccatgacccaaatgcgactgt

SEQ ID NO: 877352 - DNA, 25 bp, Mus musculus
aggtccatgaccgaaatgcgactgt

SEQ ID NO: 877353 - DNA, 25 bp, Mus musculus
aggtcccagctgcggtcggagcttc

SEQ ID NO: 877354 - DNA, 25 bp, Mus musculus
aggtcccagctggggtcggagcttc

SEQ ID NO: 877355 - DNA, 25 bp, Mus musculus
aggtcccctctgctctttggattct

SEQ ID NO: 877356 - DNA, 25 bp, Mus musculus
aggtcccctctggtctttggattct

SEQ ID NO: 877357 - DNA, 25 bp, Mus musculus
aggtccctatccacagtgaacggag

SEQ ID NO: 877358 - DNA, 25 bp, Mus musculus
aggtccctatccactgtgaacggag

SEQ ID NO: 877359 - DNA, 25 bp, Mus musculus
aggtcctagacaagcggccctctct

SEQ ID NO: 877360 - DNA, 25 bp, Mus musculus
aggtcctagacaaggggccctctct

SEQ ID NO: 877361 - DNA, 25 bp, Mus musculus
aggtcctgcaagcacctggatgagt

SEQ ID NO: 877362 - DNA, 25 bp, Mus musculus
aggtcctgcaaggacctggatgagt

SEQ ID NO: 877363 - DNA, 25 bp, Mus musculus
aggtccttgagtggcgactgtcagg

SEQ ID NO: 877364 - DNA, 25 bp, Mus musculus
aggtccttgagtggggactgtcagg

SEQ ID NO: 877365 - DNA, 25 bp, Mus musculus
aggtcgaaatgaaacttccagcaat

SEQ ID NO: 877366 - DNA, 25 bp, Mus musculus
aggtcgaaatgaaagttccagcaat

SEQ ID NO: 877367 - DNA, 25 bp, Mus musculus
aggtcgagacccagtaccactccct

SEQ ID NO: 877368 - DNA, 25 bp, Mus musculus
aggtcgagaccctgtaccactccct

SEQ ID NO: 877369 - DNA, 25 bp, Mus musculus
aggtctaactttaaccacatgtact

SEQ ID NO: 877370 - DNA, 25 bp, Mus musculus
aggtctaactttaagcacatgtact

SEQ ID NO: 877371 - DNA, 25 bp, Mus musculus
aggtctccagaacgtagtgtctcgc

SEQ ID NO: 877372 - DNA, 25 bp, Mus musculus
aggtctccagaaggtagtgtctcgc

SEQ ID NO: 877373 - DNA, 25 bp, Mus musculus
aggtctccaggaaacatattctgaa

SEQ ID NO: 877374 - DNA, 25 bp, Mus musculus
aggtctccaggaaagatattctgaa

SEQ ID NO: 877375 - DNA, 25 bp, Mus musculus
aggtctcccgcctctgctttgtgaa

SEQ ID NO: 877376 - DNA, 25 bp, Mus musculus
aggtctcccggctctgctttgtgaa

SEQ ID NO: 877377 - DNA, 25 bp, Mus musculus
aggtctctactgcctacaagaagac

SEQ ID NO: 877378 - DNA, 25 bp, Mus musculus
aggtctctactgcctatgtgaaaac

SEQ ID NO: 877379 - DNA, 25 bp, Mus musculus
aggtctctactggctacaagaagac

SEQ ID NO: 877380 - DNA, 25 bp, Mus musculus
aggtctctactggctatgtgaaaac

SEQ ID NO: 877381 - DNA, 25 bp, Mus musculus
aggtctctgtggatcagggccgggc

SEQ ID NO: 877382 - DNA, 25 bp, Mus musculus
aggtctctgtggatgagggccgggc

SEQ ID NO: 877383 - DNA, 25 bp, Mus musculus
aggtctgcagctgcagttcccttca

SEQ ID NO: 877384 - DNA, 25 bp, Mus musculus
aggtctgcaggtgcagttcccttca

SEQ ID NO: 877385 - DNA, 25 bp, Mus musculus
aggtctggaaatcgcgtgatgagag

SEQ ID NO: 877386 - DNA, 25 bp, Mus musculus
aggtctggaaatggcgtgatgagag

SEQ ID NO: 877387 - DNA, 25 bp, Mus musculus
aggtctggagaacattgggacttgg

SEQ ID NO: 877388 - DNA, 25 bp, Mus musculus
aggtctggagaagattgggacttgg

SEQ ID NO: 877389 - DNA, 25 bp, Mus musculus
aggtctggtaagcggcccatcctga

SEQ ID NO: 877390 - DNA, 25 bp, Mus musculus
aggtctggtaaggggcccatcctga

SEQ ID NO: 877391 - DNA, 25 bp, Mus musculus
aggtcttaagcgtgagccaggcatt

SEQ ID NO: 877392 - DNA, 25 bp, Mus musculus
aggtcttaagggtgagccaggcatt

SEQ ID NO: 877393 - DNA, 25 bp, Mus musculus
aggtcttcacatttggaaataactt

SEQ ID NO: 877394 - DNA, 25 bp, Mus musculus
aggtcttcacttttggaaataactt

SEQ ID NO: 877395 - DNA, 25 bp, Mus musculus
aggtcttccctagacatggctttcc

SEQ ID NO: 877396 - DNA, 25 bp, Mus musculus
aggtcttccctagagatggctttcc

SEQ ID NO: 877397 - DNA, 25 bp, Mus musculus
aggtcttgccaacatgtgaacgagt

SEQ ID NO: 877398 - DNA, 25 bp, Mus musculus
aggtcttgccaagatgtgaacgagt

SEQ ID NO: 877399 - DNA, 25 bp, Mus musculus
aggtcttgcgtgagtgcagttggct

SEQ ID NO: 877400 - DNA, 25 bp, Mus musculus
aggtcttgcgtgtgtgcagttggct

SEQ ID NO: 877401 - DNA, 25 bp, Mus musculus
aggtcttgctagtacctgtggtggt

SEQ ID NO: 877402 - DNA, 25 bp, Mus musculus
aggtcttgcttgtacctgtggtggt

SEQ ID NO: 877403 - DNA, 25 bp, Mus musculus
aggtgaaacttgatgattttggtgt

SEQ ID NO: 877404 - DNA, 25 bp, Mus musculus
aggtgaaacttgttgattttggtgt

SEQ ID NO: 877405 - DNA, 25 bp, Mus musculus
aggtgacagtcgcacataatgagaa

SEQ ID NO: 877406 - DNA, 25 bp, Mus musculus
aggtgacagtcgcagataatgagaa

SEQ ID NO: 877407 - DNA, 25 bp, Mus musculus
aggtgacggtgacaggaggatggag

SEQ ID NO: 877408 - DNA, 25 bp, Mus musculus
aggtgacggtgagaggaggatggag

SEQ ID NO: 877409 - DNA, 25 bp, Mus musculus
aggtgactactacacgaaacttctg

SEQ ID NO: 877410 - DNA, 25 bp, Mus musculus
aggtgactactacaggaaacttctg

SEQ ID NO: 877411 - DNA, 25 bp, Mus musculus
aggtgactccaggacgagcgacagt

SEQ ID NO: 877412 - DNA, 25 bp, Mus musculus
aggtgactccaggacgcttccagct

SEQ ID NO: 877413 - DNA, 25 bp, Mus musculus
aggtgactccaggaggagcgacagt

SEQ ID NO: 877414 - DNA, 25 bp, Mus musculus
aggtgactccaggaggcttccagct

SEQ ID NO: 877415 - DNA, 25 bp, Mus musculus
aggtgactggcctgcgaggggagca

SEQ ID NO: 877416 - DNA, 25 bp, Mus musculus
aggtgactggcctgggaggggagca

SEQ ID NO: 877417 - DNA, 25 bp, Mus musculus
aggtgagcagcatcggaacgtcaat

SEQ ID NO: 877418 - DNA, 25 bp, Mus musculus
aggtgagcaggatcggaacgtcaat

SEQ ID NO: 877419 - DNA, 25 bp, Mus musculus
aggtgatgacagacacctctcctct

SEQ ID NO: 877420 - DNA, 25 bp, Mus musculus
aggtgatgacagaggacaaaggtgt

SEQ ID NO: 877421 - DNA, 25 bp, Mus musculus
aggtgatgacagtcacctctcctct

SEQ ID NO: 877422 - DNA, 25 bp, Mus musculus
aggtgatgacagtggacaaaggtgt

SEQ ID NO: 877423 - DNA, 25 bp, Mus musculus
aggtgatgatcaaactgtcacattc

SEQ ID NO: 877424 - DNA, 25 bp, Mus musculus
aggtgatgatgaaactgtcacattc

SEQ ID NO: 877425 - DNA, 25 bp, Mus musculus
aggtgatgtccgcgtagccaaggtc

SEQ ID NO: 877426 - DNA, 25 bp, Mus musculus
aggtgatgtccgggtagccaaggtc

SEQ ID NO: 877427 - DNA, 25 bp, Mus musculus
aggtgcaccaccgagcctgtcacag

SEQ ID NO: 877428 - DNA, 25 bp, Mus musculus
aggtgcaccagcgagcctgtcacag

SEQ ID NO: 877429 - DNA, 25 bp, Mus musculus
aggtgcacggcaaagatggtccaga

SEQ ID NO: 877430 - DNA, 25 bp, Mus musculus
aggtgcacggcaggaaagatggtcc

SEQ ID NO: 877431 - DNA, 25 bp, Mus musculus
aggtgcacggctgtgtttggatgaa

SEQ ID NO: 877432 - DNA, 25 bp, Mus musculus
aggtgcacgggaaagatggtccaga

SEQ ID NO: 877433 - DNA, 25 bp, Mus musculus
aggtgcacgggaggaaagatggtcc

SEQ ID NO: 877434 - DNA, 25 bp, Mus musculus
aggtgcacgggtgtgtttggatgaa

SEQ ID NO: 877435 - DNA, 25 bp, Mus musculus
aggtgcagctcgtgatcaaggacag

SEQ ID NO: 877436 - DNA, 25 bp, Mus musculus
aggtgcagctggtgatcaaggacag

SEQ ID NO: 877437 - DNA, 25 bp, Mus musculus
aggtgccaagagcgagctccgcttt

SEQ ID NO: 877438 - DNA, 25 bp, Mus musculus
aggtgccaagagggagctccgcttt

SEQ ID NO: 877439 - DNA, 25 bp, Mus musculus
aggtgccaggtaagcaaagtgcacc

SEQ ID NO: 877440 - DNA, 25 bp, Mus musculus
aggtgccaggtatgcaaagtgcacc

SEQ ID NO: 877441 - DNA, 25 bp, Mus musculus
aggtgccctgcgcgcttcgagggtg

SEQ ID NO: 877442 - DNA, 25 bp, Mus musculus
aggtgccctgcgggcttcgagggtg

SEQ ID NO: 877443 - DNA, 25 bp, Mus musculus
aggtgccgtccacggatgcagcctc

SEQ ID NO: 877444 - DNA, 25 bp, Mus musculus
aggtgccgtccagggatgcagcctc

SEQ ID NO: 877445 - DNA, 25 bp, Mus musculus
aggtgctgaaagctattcccaagcc

SEQ ID NO: 877446 - DNA, 25 bp, Mus musculus
aggtgctgaaaggtattcccaagcc

SEQ ID NO: 877447 - DNA, 25 bp, Mus musculus
aggtgctgcaggaggctgtgcctgg

SEQ ID NO: 877448 - DNA, 25 bp, Mus musculus
aggtgctgcaggtggctgtgcctgg

SEQ ID NO: 877449 - DNA, 25 bp, Mus musculus
aggtgctggcccccttgcagttgct

SEQ ID NO: 877450 - DNA, 25 bp, Mus musculus
aggtgctggcccgcttgcagttgct

SEQ ID NO: 877451 - DNA, 25 bp, Mus musculus
aggtggaaagcaagcagaacacaga

SEQ ID NO: 877452 - DNA, 25 bp, Mus musculus
aggtggaaagcatgcagaacacaga

SEQ ID NO: 877453 - DNA, 25 bp, Mus musculus
aggtggacagcaactcaatggaatt

SEQ ID NO: 877454 - DNA, 25 bp, Mus musculus
aggtggacagcatctcaatggaatt

SEQ ID NO: 877455 - DNA, 25 bp, Mus musculus
aggtggacatgaaactggccgaggt

SEQ ID NO: 877456 - DNA, 25 bp, Mus musculus
aggtggacatgaaagtggccgaggt

SEQ ID NO: 877457 - DNA, 25 bp, Mus musculus
aggtggagcaggcctcaaactcaga

SEQ ID NO: 877458 - DNA, 25 bp, Mus musculus
aggtggagcagggctcaaactcaga

SEQ ID NO: 877459 - DNA, 25 bp, Mus musculus
aggtggaggtctacacattccctga

SEQ ID NO: 877460 - DNA, 25 bp, Mus musculus
aggtggaggtctactcattccctga

SEQ ID NO: 877461 - DNA, 25 bp, Mus musculus
aggtggataccacacgcaccttcaa

SEQ ID NO: 877462 - DNA, 25 bp, Mus musculus
aggtggataccacaggcaccttcaa

SEQ ID NO: 877463 - DNA, 25 bp, Mus musculus
aggtggatcacgatgaacgcttgga

SEQ ID NO: 877464 - DNA, 25 bp, Mus musculus
aggtggatcacgttgaacgcttgga

SEQ ID NO: 877465 - DNA, 25 bp, Mus musculus
aggtggatgctgatcagttcttgac

SEQ ID NO: 877466 - DNA, 25 bp, Mus musculus
aggtggatgctgatcgcaatgggac

SEQ ID NO: 877467 - DNA, 25 bp, Mus musculus
aggtggatgctgatgagttcttgac

SEQ ID NO: 877468 - DNA, 25 bp, Mus musculus
aggtggatgctgatggcaatgggac

SEQ ID NO: 877469 - DNA, 25 bp, Mus musculus
aggtggatgtctgggtgcaggtggc

SEQ ID NO: 877470 - DNA, 25 bp, Mus musculus
aggtggatgtgtgggtgcaggtggc

SEQ ID NO: 877471 - DNA, 25 bp, Mus musculus
aggtggcaagccctggcacaagacc

SEQ ID NO: 877472 - DNA, 25 bp, Mus musculus
aggtggcaagctgcaaatagtctac

SEQ ID NO: 877473 - DNA, 25 bp, Mus musculus
aggtggcaagctgcagataattaat

SEQ ID NO: 877474 - DNA, 25 bp, Mus musculus
aggtggcaaggcctggcacaagacc

SEQ ID NO: 877475 - DNA, 25 bp, Mus musculus
aggtggcaaggtgcaaatagtctac

SEQ ID NO: 877476 - DNA, 25 bp, Mus musculus
aggtggcaaggtgcagataattaat

SEQ ID NO: 877477 - DNA, 25 bp, Mus musculus
aggtggccctcccaccgccagccgc

SEQ ID NO: 877478 - DNA, 25 bp, Mus musculus
aggtggccctcccagcgccagccgc

SEQ ID NO: 877479 - DNA, 25 bp, Mus musculus
aggtgggagccacggtggagttcac

SEQ ID NO: 877480 - DNA, 25 bp, Mus musculus
aggtgggagccagggtggagttcac

SEQ ID NO: 877481 - DNA, 25 bp, Mus musculus
aggtgggccccttgcgatcatgcag

SEQ ID NO: 877482 - DNA, 25 bp, Mus musculus
aggtgggccccttgggatcatgcag

SEQ ID NO: 877483 - DNA, 25 bp, Mus musculus
aggtggggccgaccaaccatgaagg

SEQ ID NO: 877484 - DNA, 25 bp, Mus musculus
aggtggggccgagcaaccatgaagg

SEQ ID NO: 877485 - DNA, 25 bp, Mus musculus
aggtggtccccgagtttgcaaatgc

SEQ ID NO: 877486 - DNA, 25 bp, Mus musculus
aggtggtccccgtgtttgcaaatgc

SEQ ID NO: 877487 - DNA, 25 bp, Mus musculus
aggtggtggagagacatatgactcc

SEQ ID NO: 877488 - DNA, 25 bp, Mus musculus
aggtggtggagagagatatgactcc

SEQ ID NO: 877489 - DNA, 25 bp, Mus musculus
aggtggtggctgacaacccctgcca

SEQ ID NO: 877490 - DNA, 25 bp, Mus musculus
aggtggtggctgactacccctgcca

SEQ ID NO: 877491 - DNA, 25 bp, Mus musculus
aggtggttgcaacaaactagtaaag

SEQ ID NO: 877492 - DNA, 25 bp, Mus musculus
aggtggttgcaagaaactagtaaag

SEQ ID NO: 877493 - DNA, 25 bp, Mus musculus
aggtgtacaatgaaaatcttgttca

SEQ ID NO: 877494 - DNA, 25 bp, Mus musculus
aggtgtacaatgagaaacatattca

SEQ ID NO: 877495 - DNA, 25 bp, Mus musculus
aggtgtacaatgtaaatcttgttca

SEQ ID NO: 877496 - DNA, 25 bp, Mus musculus
aggtgtacaatgtgaaacatattca

SEQ ID NO: 877497 - DNA, 25 bp, Mus musculus
aggtgtatacagcaaagcagtcgta

SEQ ID NO: 877498 - DNA, 25 bp, Mus musculus
aggtgtatacaggaaagcagtcgta

SEQ ID NO: 877499 - DNA, 25 bp, Mus musculus
aggtgtatgaaacgctgtcagccgg

SEQ ID NO: 877500 - DNA, 25 bp, Mus musculus
aggtgtatgaaaggctgtcagccgg

SEQ ID NO: 877501 - DNA, 25 bp, Mus musculus
aggtgtcccgacggatcttgaagtg

SEQ ID NO: 877502 - DNA, 25 bp, Mus musculus
aggtgtcccgtcggatcttgaagtg

SEQ ID NO: 877503 - DNA, 25 bp, Mus musculus
aggtgtccggcgtgaagatggccac

SEQ ID NO: 877504 - DNA, 25 bp, Mus musculus
aggtgtccggggtgaagatggccac

SEQ ID NO: 877505 - DNA, 25 bp, Mus musculus
aggtgtgaagatattgacgagtgtc

SEQ ID NO: 877506 - DNA, 25 bp, Mus musculus
aggtgtgaagttattgacgagtgtc

SEQ ID NO: 877507 - DNA, 25 bp, Mus musculus
aggtgtgaatatcgaccactccaca

SEQ ID NO: 877508 - DNA, 25 bp, Mus musculus
aggtgtgaatatggaccactccaca

SEQ ID NO: 877509 - DNA, 25 bp, Mus musculus
aggtgtgctcagaacagcaaagtcc

SEQ ID NO: 877510 - DNA, 25 bp, Mus musculus
aggtgtgctcagaagagcaaagtcc

SEQ ID NO: 877511 - DNA, 25 bp, Mus musculus
aggtgtgctgctgcgatgcatgctg

SEQ ID NO: 877512 - DNA, 25 bp, Mus musculus
aggtgtgctggtgcgatgcatgctg

SEQ ID NO: 877513 - DNA, 25 bp, Mus musculus
aggtgttgatcttcttgtagaaatt

SEQ ID NO: 877514 - DNA, 25 bp, Mus musculus
aggtgttgatgttcttgtagaaatt

SEQ ID NO: 877515 - DNA, 25 bp, Mus musculus
aggttacaagagtgaaacatctttc

SEQ ID NO: 877516 - DNA, 25 bp, Mus musculus
aggttacaagtgtgaaacatctttc

SEQ ID NO: 877517 - DNA, 25 bp, Mus musculus
aggttacagaggatcccctattaag

SEQ ID NO: 877518 - DNA, 25 bp, Mus musculus
aggttacagaggatgccctattaag

SEQ ID NO: 877519 - DNA, 25 bp, Mus musculus
aggttacgaagtcatgggagtctga

SEQ ID NO: 877520 - DNA, 25 bp, Mus musculus
aggttacgaagtgatgggagtctga

SEQ ID NO: 877521 - DNA, 25 bp, Mus musculus
aggttatgcacacacggacctgaag

SEQ ID NO: 877522 - DNA, 25 bp, Mus musculus
aggttatgcacacagggacctgaag

SEQ ID NO: 877523 - DNA, 25 bp, Mus musculus
aggttcaataagacggtgcaggtgc

SEQ ID NO: 877524 - DNA, 25 bp, Mus musculus
aggttcaataagtcggtgcaggtgc

SEQ ID NO: 877525 - DNA, 25 bp, Mus musculus
aggttcagagcagtcggattgtaac

SEQ ID NO: 877526 - DNA, 25 bp, Mus musculus
aggttcagaggagtcggattgtaac

SEQ ID NO: 877527 - DNA, 25 bp, Mus musculus
aggttcagcgattccatttgtaatg

SEQ ID NO: 877528 - DNA, 25 bp, Mus musculus
aggttcagcgtttccatttgtaatg

SEQ ID NO: 877529 - DNA, 25 bp, Mus musculus
aggttccatgatcagaatttaggac

SEQ ID NO: 877530 - DNA, 25 bp, Mus musculus
aggttccatgttcagaatttaggac

SEQ ID NO: 877531 - DNA, 25 bp, Mus musculus
aggttcccagcatcaccgacaacca

SEQ ID NO: 877532 - DNA, 25 bp, Mus musculus
aggttcccaggatcaccgacaacca

SEQ ID NO: 877533 - DNA, 25 bp, Mus musculus
aggttcctgatgatgatgaaccagc

SEQ ID NO: 877534 - DNA, 25 bp, Mus musculus
aggttcctgatgcaaaaccaactct

SEQ ID NO: 877535 - DNA, 25 bp, Mus musculus
aggttcctgatggaaaaccaactct

SEQ ID NO: 877536 - DNA, 25 bp, Mus musculus
aggttcctgatgttgatgaaccagc

SEQ ID NO: 877537 - DNA, 25 bp, Mus musculus
aggttcctgcagcacagtgttgaat

SEQ ID NO: 877538 - DNA, 25 bp, Mus musculus
aggttcctgcaggacagtgttgaat

SEQ ID NO: 877539 - DNA, 25 bp, Mus musculus
aggttcgaagatgtctatcagctgc

SEQ ID NO: 877540 - DNA, 25 bp, Mus musculus
aggttcgaagctcgatccgccaggt

SEQ ID NO: 877541 - DNA, 25 bp, Mus musculus
aggttcgaagctggatccgccaggt

SEQ ID NO: 877542 - DNA, 25 bp, Mus musculus
aggttcgaagttgtctatcagctgc

SEQ ID NO: 877543 - DNA, 25 bp, Mus musculus
aggttctacagaataatcattgcct

SEQ ID NO: 877544 - DNA, 25 bp, Mus musculus
aggttctacagattaatcattgcct

SEQ ID NO: 877545 - DNA, 25 bp, Mus musculus
aggttctcctggcacaactgaagca

SEQ ID NO: 877546 - DNA, 25 bp, Mus musculus
aggttctcctggcagaactgaagca

SEQ ID NO: 877547 - DNA, 25 bp, Mus musculus
aggttctgacagctcgatcactgat

SEQ ID NO: 877548 - DNA, 25 bp, Mus musculus
aggttctgacagctggatcactgat

SEQ ID NO: 877549 - DNA, 25 bp, Mus musculus
aggttctgggaactgcgaaatcaaa

SEQ ID NO: 877550 - DNA, 25 bp, Mus musculus
aggttctgggaagtgcgaaatcaaa

SEQ ID NO: 877551 - DNA, 25 bp, Mus musculus
aggttctgttcccaagagaacccct

SEQ ID NO: 877552 - DNA, 25 bp, Mus musculus
aggttctgttcccaaggaatcattg

SEQ ID NO: 877553 - DNA, 25 bp, Mus musculus
aggttctgttcccatgagaacccct

SEQ ID NO: 877554 - DNA, 25 bp, Mus musculus
aggttctgttcccatggaatcattg

SEQ ID NO: 877555 - DNA, 25 bp, Mus musculus
aggttcttagctcacggaaccatgg

SEQ ID NO: 877556 - DNA, 25 bp, Mus musculus
aggttcttagctcagggaaccatgg

SEQ ID NO: 877557 - DNA, 25 bp, Mus musculus
aggttcttccttaaccatcatggga

SEQ ID NO: 877558 - DNA, 25 bp, Mus musculus
aggttcttccttaagcatcatggga

SEQ ID NO: 877559 - DNA, 25 bp, Mus musculus
aggttgacatctcgtcctttggggt

SEQ ID NO: 877560 - DNA, 25 bp, Mus musculus
aggttgacatctggtcctttggggt

SEQ ID NO: 877561 - DNA, 25 bp, Mus musculus
aggttgaggagcctttcagcgagag

SEQ ID NO: 877562 - DNA, 25 bp, Mus musculus
aggttgaggagcgtttcagcgagag

SEQ ID NO: 877563 - DNA, 25 bp, Mus musculus
aggttgcaagcttgctggtgaaaag

SEQ ID NO: 877564 - DNA, 25 bp, Mus musculus
aggttgcaaggttgctggtgaaaag

SEQ ID NO: 877565 - DNA, 25 bp, Mus musculus
aggttggcaataagtattacaactg

SEQ ID NO: 877566 - DNA, 25 bp, Mus musculus
aggttggcaatatgtattacaactg

SEQ ID NO: 877567 - DNA, 25 bp, Mus musculus
aggttggcggagcgctcactctttg

SEQ ID NO: 877568 - DNA, 25 bp, Mus musculus
aggttggcggagggctcactctttg

SEQ ID NO: 877569 - DNA, 25 bp, Mus musculus
aggttgttaagaacctggaccgctg

SEQ ID NO: 877570 - DNA, 25 bp, Mus musculus
aggttgttaagactactgggaatca

SEQ ID NO: 877571 - DNA, 25 bp, Mus musculus
aggttgttaagagtactgggaatca

SEQ ID NO: 877572 - DNA, 25 bp, Mus musculus
aggttgttaagatcctggaccgctg

SEQ ID NO: 877573 - DNA, 25 bp, Mus musculus
aggtttctggatatggttcaggaag

SEQ ID NO: 877574 - DNA, 25 bp, Mus musculus
aggtttctggttatggttcaggaag

SEQ ID NO: 877575 - DNA, 25 bp, Mus musculus
aggtttggtggaatccatgcagatg

SEQ ID NO: 877576 - DNA, 25 bp, Mus musculus
aggtttggtggaatgcatgcagatg

SEQ ID NO: 877577 - DNA, 25 bp, Mus musculus
aggttttcagctcatcttcacagat

SEQ ID NO: 877578 - DNA, 25 bp, Mus musculus
aggttttcaggtcatcttcacagat

SEQ ID NO: 877579 - DNA, 25 bp, Mus musculus
aggtttttaatgatcaggtccttct

SEQ ID NO: 877580 - DNA, 25 bp, Mus musculus
aggtttttaatgatgaggtccttct

SEQ ID NO: 877581 - DNA, 25 bp, Mus musculus
agtaaaaatgaacaagtgtgtgaag

SEQ ID NO: 877582 - DNA, 25 bp, Mus musculus
agtaaaaatgtacaagtgtgtgaag

SEQ ID NO: 877583 - DNA, 25 bp, Mus musculus
agtaaaatgaaacaaacagcgcatt

SEQ ID NO: 877584 - DNA, 25 bp, Mus musculus
agtaaaatgaaagaaacagcgcatt

SEQ ID NO: 877585 - DNA, 25 bp, Mus musculus
agtaaacaagaattcctcagagaga

SEQ ID NO: 877586 - DNA, 25 bp, Mus musculus
agtaaacaagtattcctcagagaga

SEQ ID NO: 877587 - DNA, 25 bp, Mus musculus
agtaaacccactgatcaggtgtaag

SEQ ID NO: 877588 - DNA, 25 bp, Mus musculus
agtaaacccagtgatcaggtgtaag

SEQ ID NO: 877589 - DNA, 25 bp, Mus musculus
agtaaagagaagtttgaagatactg

SEQ ID NO: 877590 - DNA, 25 bp, Mus musculus
agtaaagagatgtttgaagatactg

SEQ ID NO: 877591 - DNA, 25 bp, Mus musculus
agtaaagccaagctgcagcagctag

SEQ ID NO: 877592 - DNA, 25 bp, Mus musculus
agtaaagccaaggtgcagcagctag

SEQ ID NO: 877593 - DNA, 25 bp, Mus musculus
agtaaatgcttactcattgagaaaa

SEQ ID NO: 877594 - DNA, 25 bp, Mus musculus
agtaaatgcttagtcattgagaaaa

SEQ ID NO: 877595 - DNA, 25 bp, Mus musculus
agtaaatggaagccatacgatgcga

SEQ ID NO: 877596 - DNA, 25 bp, Mus musculus
agtaaatggaaggcatacgatgcga

SEQ ID NO: 877597 - DNA, 25 bp, Mus musculus
agtaacagctgcagcaatagtgatt

SEQ ID NO: 877598 - DNA, 25 bp, Mus musculus
agtaacagctgcaggaatagtgatt

SEQ ID NO: 877599 - DNA, 25 bp, Mus musculus
agtaaccgagctcacgtcgctccag

SEQ ID NO: 877600 - DNA, 25 bp, Mus musculus
agtaaccgaggtcacgtcgctccag

SEQ ID NO: 877601 - DNA, 25 bp, Mus musculus
agtaacgacgaatctcacacgctgc

SEQ ID NO: 877602 - DNA, 25 bp, Mus musculus
agtaacgacgtatctcacacgctgc

SEQ ID NO: 877603 - DNA, 25 bp, Mus musculus
agtaacgcagcaggaaaccttggga

SEQ ID NO: 877604 - DNA, 25 bp, Mus musculus
agtaacgcaggaggaaaccttggga

SEQ ID NO: 877605 - DNA, 25 bp, Mus musculus
agtaactgtgagatgtaccgaaggg

SEQ ID NO: 877606 - DNA, 25 bp, Mus musculus
agtaactgtgagttgtaccgaaggg

SEQ ID NO: 877607 - DNA, 25 bp, Mus musculus
agtaactttgctcaaacggtcaaag

SEQ ID NO: 877608 - DNA, 25 bp, Mus musculus
agtaactttgctgaaacggtcaaag

SEQ ID NO: 877609 - DNA, 25 bp, Mus musculus
agtaagaaagatcgagctgcaagaa

SEQ ID NO: 877610 - DNA, 25 bp, Mus musculus
agtaagaaagttcgagctgcaagaa

SEQ ID NO: 877611 - DNA, 25 bp, Mus musculus
agtaagcagaggagacctgccaggc

SEQ ID NO: 877612 - DNA, 25 bp, Mus musculus
agtaagcagaggtgacctgccaggc

SEQ ID NO: 877613 - DNA, 25 bp, Mus musculus
agtaaggacgaatctcacacgctgc

SEQ ID NO: 877614 - DNA, 25 bp, Mus musculus
agtaaggacgtatctcacacgctgc

SEQ ID NO: 877615 - DNA, 25 bp, Mus musculus
agtaatacatacaaactacaactcc

SEQ ID NO: 877616 - DNA, 25 bp, Mus musculus
agtaatacattcaaactacaactcc

SEQ ID NO: 877617 - DNA, 25 bp, Mus musculus
agtaatcagagactgtcacgatgtc

SEQ ID NO: 877618 - DNA, 25 bp, Mus musculus
agtaatcagagagtgtcacgatgtc

SEQ ID NO: 877619 - DNA, 25 bp, Mus musculus
agtaatgcaactgtggcacctttaa

SEQ ID NO: 877620 - DNA, 25 bp, Mus musculus
agtaatgcaagtgtggcacctttaa

SEQ ID NO: 877621 - DNA, 25 bp, Mus musculus
agtaattcagcctcaaactgcttat

SEQ ID NO: 877622 - DNA, 25 bp, Mus musculus
agtaattcaggctcaaactgcttat

SEQ ID NO: 877623 - DNA, 25 bp, Mus musculus
agtaattccgaaatcaacatgcaga

SEQ ID NO: 877624 - DNA, 25 bp, Mus musculus
agtaattccgagtcctgaagaaagg

SEQ ID NO: 877625 - DNA, 25 bp, Mus musculus
agtaattccgtaatcaacatgcaga

SEQ ID NO: 877626 - DNA, 25 bp, Mus musculus
agtaattccgtgtcctgaagaaagg

SEQ ID NO: 877627 - DNA, 25 bp, Mus musculus
agtaattggctacgtttgagatttc

SEQ ID NO: 877628 - DNA, 25 bp, Mus musculus
agtaattggctaggtttgagatttc

SEQ ID NO: 877629 - DNA, 25 bp, Mus musculus
agtacaagaacaatcgcggcgggag

SEQ ID NO: 877630 - DNA, 25 bp, Mus musculus
agtacaagaagaatcgcggcgggag

SEQ ID NO: 877631 - DNA, 25 bp, Mus musculus
agtacaaggaaactgaggatggaga

SEQ ID NO: 877632 - DNA, 25 bp, Mus musculus
agtacaaggaaagtgaggatggaga

SEQ ID NO: 877633 - DNA, 25 bp, Mus musculus
agtacaatgcagctcgtctcatatc

SEQ ID NO: 877634 - DNA, 25 bp, Mus musculus
agtacaatgcagctggtctcatatc

SEQ ID NO: 877635 - DNA, 25 bp, Mus musculus
agtacacagtgacagttcgatgccc

SEQ ID NO: 877636 - DNA, 25 bp, Mus musculus
agtacacagtgagagttcgatgccc

SEQ ID NO: 877637 - DNA, 25 bp, Mus musculus
agtacagaagagacaggtgagaact

SEQ ID NO: 877638 - DNA, 25 bp, Mus musculus
agtacagaagagtcaggtgagaact

SEQ ID NO: 877639 - DNA, 25 bp, Mus musculus
agtacagagaagctcggacactgat

SEQ ID NO: 877640 - DNA, 25 bp, Mus musculus
agtacagagaaggtcggacactgat

SEQ ID NO: 877641 - DNA, 25 bp, Mus musculus
agtacagcacagcctaaataaaacg

SEQ ID NO: 877642 - DNA, 25 bp, Mus musculus
agtacagcacagcttaccagtgcag

SEQ ID NO: 877643 - DNA, 25 bp, Mus musculus
agtacagcacagcttgctggttgtt

SEQ ID NO: 877644 - DNA, 25 bp, Mus musculus
agtacagcacaggctaaataaaacg

SEQ ID NO: 877645 - DNA, 25 bp, Mus musculus
agtacagcacaggttaccagtgcag

SEQ ID NO: 877646 - DNA, 25 bp, Mus musculus
agtacagcacaggttgctggttgtt

SEQ ID NO: 877647 - DNA, 25 bp, Mus musculus
agtacagctccatgcatggttcctg

SEQ ID NO: 877648 - DNA, 25 bp, Mus musculus
agtacagctccatggatggttcctg

SEQ ID NO: 877649 - DNA, 25 bp, Mus musculus
agtacaggaggccacgaagtccttc

SEQ ID NO: 877650 - DNA, 25 bp, Mus musculus
agtacaggaggccaggaagtccttc

SEQ ID NO: 877651 - DNA, 25 bp, Mus musculus
agtacaggcccacgtccccatcatc

SEQ ID NO: 877652 - DNA, 25 bp, Mus musculus
agtacaggcccaggtccccatcatc

SEQ ID NO: 877653 - DNA, 25 bp, Mus musculus
agtacatatgagacgaacaccaaac

SEQ ID NO: 877654 - DNA, 25 bp, Mus musculus
agtacatatgagtcgaacaccaaac

SEQ ID NO: 877655 - DNA, 25 bp, Mus musculus
agtacatccctgcagccggccctct

SEQ ID NO: 877656 - DNA, 25 bp, Mus musculus
agtacatccctggagccggccctct

SEQ ID NO: 877657 - DNA, 25 bp, Mus musculus
agtacatgagcaaacgaagtttgct

SEQ ID NO: 877658 - DNA, 25 bp, Mus musculus
agtacatgagcaaaggaagtttgct

SEQ ID NO: 877659 - DNA, 25 bp, Mus musculus
agtacatgagcatcccatcctctgt

SEQ ID NO: 877660 - DNA, 25 bp, Mus musculus
agtacatgaggatcccatcctctgt

SEQ ID NO: 877661 - DNA, 25 bp, Mus musculus
agtacattccctccttgttcagtgg

SEQ ID NO: 877662 - DNA, 25 bp, Mus musculus
agtacattccctgcttgttcagtgg

SEQ ID NO: 877663 - DNA, 25 bp, Mus musculus
agtacattgtcacaccttcttctga

SEQ ID NO: 877664 - DNA, 25 bp, Mus musculus
agtacattgtcacagcttcttctga

SEQ ID NO: 877665 - DNA, 25 bp, Mus musculus
agtacatttcaacagttttccagaa

SEQ ID NO: 877666 - DNA, 25 bp, Mus musculus
agtacatttcaagagttttccagaa

SEQ ID NO: 877667 - DNA, 25 bp, Mus musculus
agtacccacggaaacgccatgtaga

SEQ ID NO: 877668 - DNA, 25 bp, Mus musculus
agtacccacggaaaggccatgtaga

SEQ ID NO: 877669 - DNA, 25 bp, Mus musculus
agtacccctatgcaagagctgcaaa

SEQ ID NO: 877670 - DNA, 25 bp, Mus musculus
agtacccctatgcatgagctgcaaa

SEQ ID NO: 877671 - DNA, 25 bp, Mus musculus
agtaccccttcacacgaatcagcag

SEQ ID NO: 877672 - DNA, 25 bp, Mus musculus
agtaccccttcacaggaatcagcag

SEQ ID NO: 877673 - DNA, 25 bp, Mus musculus
agtaccctgaaacagttaaacatct

SEQ ID NO: 877674 - DNA, 25 bp, Mus musculus
agtaccctgaaagagttaaacatct

SEQ ID NO: 877675 - DNA, 25 bp, Mus musculus
agtacccttgctccaatgaagctga

SEQ ID NO: 877676 - DNA, 25 bp, Mus musculus
agtacccttgctgcaatgaagctga

SEQ ID NO: 877677 - DNA, 25 bp, Mus musculus
agtaccgatgctaccagatgctata

SEQ ID NO: 877678 - DNA, 25 bp, Mus musculus
agtaccgatggtaccagatgctata

SEQ ID NO: 877679 - DNA, 25 bp, Mus musculus
agtaccgcggcgctgagaaggagtg

SEQ ID NO: 877680 - DNA, 25 bp, Mus musculus
agtaccgcggggctgagaaggagtg

SEQ ID NO: 877681 - DNA, 25 bp, Mus musculus
agtacctaaaattctctacaataat

SEQ ID NO: 877682 - DNA, 25 bp, Mus musculus
agtacctaaatttctctacaataat

SEQ ID NO: 877683 - DNA, 25 bp, Mus musculus
agtacctcacagactccaaatttgt

SEQ ID NO: 877684 - DNA, 25 bp, Mus musculus
agtacctcactgactccaaatttgt

SEQ ID NO: 877685 - DNA, 25 bp, Mus musculus
agtacctcagcaaatctgtcatcca

SEQ ID NO: 877686 - DNA, 25 bp, Mus musculus
agtacctcagcttcaggaaaagctg

SEQ ID NO: 877687 - DNA, 25 bp, Mus musculus
agtacctcaggaaatctgtcatcca

SEQ ID NO: 877688 - DNA, 25 bp, Mus musculus
agtacctcaggttcaggaaaagctg

SEQ ID NO: 877689 - DNA, 25 bp, Mus musculus
agtacctcgtctggctcacccagaa

SEQ ID NO: 877690 - DNA, 25 bp, Mus musculus
agtacctcgtgtggctcacccagaa

SEQ ID NO: 877691 - DNA, 25 bp, Mus musculus
agtacctgctgacacggcgcgtgta

SEQ ID NO: 877692 - DNA, 25 bp, Mus musculus
agtacctgctgacagggcgcgtgta

SEQ ID NO: 877693 - DNA, 25 bp, Mus musculus
agtacctggcatccaatctgaaaag

SEQ ID NO: 877694 - DNA, 25 bp, Mus musculus
agtacctggcatccagagggaactc

SEQ ID NO: 877695 - DNA, 25 bp, Mus musculus
agtacctggcatcctatctgaaaag

SEQ ID NO: 877696 - DNA, 25 bp, Mus musculus
agtacctggcatcctgagggaactc

SEQ ID NO: 877697 - DNA, 25 bp, Mus musculus
agtacgacctgacgtcccagaagcc

SEQ ID NO: 877698 - DNA, 25 bp, Mus musculus
agtacgacctgaggtcccagaagcc

SEQ ID NO: 877699 - DNA, 25 bp, Mus musculus
agtacggaggcacacctttacacgc

SEQ ID NO: 877700 - DNA, 25 bp, Mus musculus
agtacggaggcacagctttacacgc

SEQ ID NO: 877701 - DNA, 25 bp, Mus musculus
agtacgtgggagcacgaactgtgga

SEQ ID NO: 877702 - DNA, 25 bp, Mus musculus
agtacgtgggagcaggaactgtgga

SEQ ID NO: 877703 - DNA, 25 bp, Mus musculus
agtactctgtttcactggaaacaag

SEQ ID NO: 877704 - DNA, 25 bp, Mus musculus
agtactctgtttcagtggaaacaag

SEQ ID NO: 877705 - DNA, 25 bp, Mus musculus
agtactgaaaccagagctctagaag

SEQ ID NO: 877706 - DNA, 25 bp, Mus musculus
agtactgaaacctgagctctagaag

SEQ ID NO: 877707 - DNA, 25 bp, Mus musculus
agtacttcagactgaacccccagct

SEQ ID NO: 877708 - DNA, 25 bp, Mus musculus
agtacttcagtctgaacccccagct

SEQ ID NO: 877709 - DNA, 25 bp, Mus musculus
agtacttttgggcgagctgaagaag

SEQ ID NO: 877710 - DNA, 25 bp, Mus musculus
agtacttttgggggagctgaagaag

SEQ ID NO: 877711 - DNA, 25 bp, Mus musculus
agtagaagcgctccaaaatcttaaa

SEQ ID NO: 877712 - DNA, 25 bp, Mus musculus
agtagaagcgctgcaaaatcttaaa

SEQ ID NO: 877713 - DNA, 25 bp, Mus musculus
agtagagaagcccacatcgccggtc

SEQ ID NO: 877714 - DNA, 25 bp, Mus musculus
agtagagaagcccagatcgccggtc

SEQ ID NO: 877715 - DNA, 25 bp, Mus musculus
agtagaggagctggaggatgcaata

SEQ ID NO: 877716 - DNA, 25 bp, Mus musculus
agtagaggaggtggaggatgcaata

SEQ ID NO: 877717 - DNA, 25 bp, Mus musculus
agtagcaacaaaacgctgccgtcca

SEQ ID NO: 877718 - DNA, 25 bp, Mus musculus
agtagcaacaaacagcagcggtcag

SEQ ID NO: 877719 - DNA, 25 bp, Mus musculus
agtagcaacaaagagcagcggtcag

SEQ ID NO: 877720 - DNA, 25 bp, Mus musculus
agtagcaacaaatcgctgccgtcca

SEQ ID NO: 877721 - DNA, 25 bp, Mus musculus
agtagcagtaataggaaagccgcaa

SEQ ID NO: 877722 - DNA, 25 bp, Mus musculus
agtagcagtaattggaaagccgcaa

SEQ ID NO: 877723 - DNA, 25 bp, Mus musculus
agtagccaattacagaatctgggag

SEQ ID NO: 877724 - DNA, 25 bp, Mus musculus
agtagccaattagagaatctgggag

SEQ ID NO: 877725 - DNA, 25 bp, Mus musculus
agtagcctagaggtgacaggaacag

SEQ ID NO: 877726 - DNA, 25 bp, Mus musculus
agtagcctagtggtgacaggaacag

SEQ ID NO: 877727 - DNA, 25 bp, Mus musculus
agtagcgaatcactacaaacagaat

SEQ ID NO: 877728 - DNA, 25 bp, Mus musculus
agtagcgaatcagtacaaacagaat

SEQ ID NO: 877729 - DNA, 25 bp, Mus musculus
agtagcttcacacggtgcctggtcc

SEQ ID NO: 877730 - DNA, 25 bp, Mus musculus
agtagcttcacagggtgcctggtcc

SEQ ID NO: 877731 - DNA, 25 bp, Mus musculus
agtagcttccaacaaccccaagatc

SEQ ID NO: 877732 - DNA, 25 bp, Mus musculus
agtagcttccaagaaccccaagatc

SEQ ID NO: 877733 - DNA, 25 bp, Mus musculus
agtagcttccagctggtggtcctca

SEQ ID NO: 877734 - DNA, 25 bp, Mus musculus
agtagcttccaggtggtggtcctca

SEQ ID NO: 877735 - DNA, 25 bp, Mus musculus
agtaggaagaaacatgcttctgatg

SEQ ID NO: 877736 - DNA, 25 bp, Mus musculus
agtaggaagaaagatgcttctgatg

SEQ ID NO: 877737 - DNA, 25 bp, Mus musculus
agtaggacttaggactacagagact

SEQ ID NO: 877738 - DNA, 25 bp, Mus musculus
agtaggacttaggagtacagagact

SEQ ID NO: 877739 - DNA, 25 bp, Mus musculus
agtaggcactaaaacgtacatggcc

SEQ ID NO: 877740 - DNA, 25 bp, Mus musculus
agtaggcactaaaaggtacatggcc

SEQ ID NO: 877741 - DNA, 25 bp, Mus musculus
agtaggctaccgctgatggtgtgga

SEQ ID NO: 877742 - DNA, 25 bp, Mus musculus
agtaggctaccggtgatggtgtgga

SEQ ID NO: 877743 - DNA, 25 bp, Mus musculus
agtagggcagccaatggcatccaca

SEQ ID NO: 877744 - DNA, 25 bp, Mus musculus
agtagggcaggcaatggcatccaca

SEQ ID NO: 877745 - DNA, 25 bp, Mus musculus
agtaggggagatcactattgctagg

SEQ ID NO: 877746 - DNA, 25 bp, Mus musculus
agtaggggagttcactattgctagg

SEQ ID NO: 877747 - DNA, 25 bp, Mus musculus
agtaggtatcagcgtggactcagta

SEQ ID NO: 877748 - DNA, 25 bp, Mus musculus
agtaggtatcagggtggactcagta

SEQ ID NO: 877749 - DNA, 25 bp, Mus musculus
agtagtcaatgacgcaatcagaggc

SEQ ID NO: 877750 - DNA, 25 bp, Mus musculus
agtagtcaatgacggaatcagaggc

SEQ ID NO: 877751 - DNA, 25 bp, Mus musculus
agtagtccaacacagaatgaagcac

SEQ ID NO: 877752 - DNA, 25 bp, Mus musculus
agtagtccaacagagaatgaagcac

SEQ ID NO: 877753 - DNA, 25 bp, Mus musculus
agtagtgaggcgattggtcaaagaa

SEQ ID NO: 877754 - DNA, 25 bp, Mus musculus
agtagtgaggcgtttggtcaaagaa

SEQ ID NO: 877755 - DNA, 25 bp, Mus musculus
agtagtggtcagagtccagctacac

SEQ ID NO: 877756 - DNA, 25 bp, Mus musculus
agtagtggtcagtgtccagctacac

SEQ ID NO: 877757 - DNA, 25 bp, Mus musculus
agtagttcagcctgggaagctcacc

SEQ ID NO: 877758 - DNA, 25 bp, Mus musculus
agtagttcaggctgggaagctcacc

SEQ ID NO: 877759 - DNA, 25 bp, Mus musculus
agtataaacactcgaacttagcagg

SEQ ID NO: 877760 - DNA, 25 bp, Mus musculus
agtataaacactctaaaggatctcc

SEQ ID NO: 877761 - DNA, 25 bp, Mus musculus
agtataaacactggaacttagcagg

SEQ ID NO: 877762 - DNA, 25 bp, Mus musculus
agtataaacactgtaaaggatctcc

SEQ ID NO: 877763 - DNA, 25 bp, Mus musculus
agtataaggatgaacatggagatct

SEQ ID NO: 877764 - DNA, 25 bp, Mus musculus
agtataaggatgaagatggagatct

SEQ ID NO: 877765 - DNA, 25 bp, Mus musculus
agtataaggtagcactggccagctg

SEQ ID NO: 877766 - DNA, 25 bp, Mus musculus
agtataaggtagcagtggccagctg

SEQ ID NO: 877767 - DNA, 25 bp, Mus musculus
agtataatggagcctcactttgttc

SEQ ID NO: 877768 - DNA, 25 bp, Mus musculus
agtataatggaggctcactttgttc

SEQ ID NO: 877769 - DNA, 25 bp, Mus musculus
agtatacaataacgtgtcatccttt

SEQ ID NO: 877770 - DNA, 25 bp, Mus musculus
agtatacaataaggtgtcatccttt

SEQ ID NO: 877771 - DNA, 25 bp, Mus musculus
agtatacatgcgagactctggagga

SEQ ID NO: 877772 - DNA, 25 bp, Mus musculus
agtatacatgggagactctggagga

SEQ ID NO: 877773 - DNA, 25 bp, Mus musculus
agtatagcagctctggaatttgcat

SEQ ID NO: 877774 - DNA, 25 bp, Mus musculus
agtatagcaggtctggaatttgcat

SEQ ID NO: 877775 - DNA, 25 bp, Mus musculus
agtatagtagctatgaccaaggtca

SEQ ID NO: 877776 - DNA, 25 bp, Mus musculus
agtatagtaggtatgaccaaggtca

SEQ ID NO: 877777 - DNA, 25 bp, Mus musculus
agtatatgggaagtactggagaaga

SEQ ID NO: 877778 - DNA, 25 bp, Mus musculus
agtatatgggccagagcccgggctt

SEQ ID NO: 877779 - DNA, 25 bp, Mus musculus
agtatatggggcagagcccgggctt

SEQ ID NO: 877780 - DNA, 25 bp, Mus musculus
agtatatgggtagtactggagaaga

SEQ ID NO: 877781 - DNA, 25 bp, Mus musculus
agtatcaaaacttctctattctcgg

SEQ ID NO: 877782 - DNA, 25 bp, Mus musculus
agtatcaaaagttctctattctcgg

SEQ ID NO: 877783 - DNA, 25 bp, Mus musculus
agtatcacaccaaagatgaccactg

SEQ ID NO: 877784 - DNA, 25 bp, Mus musculus
agtatcacaccatagatgaccactg

SEQ ID NO: 877785 - DNA, 25 bp, Mus musculus
agtatcacagcctgaagctggagtg

SEQ ID NO: 877786 - DNA, 25 bp, Mus musculus
agtatcacagctatccaactggttt

SEQ ID NO: 877787 - DNA, 25 bp, Mus musculus
agtatcacaggctgaagctggagtg

SEQ ID NO: 877788 - DNA, 25 bp, Mus musculus
agtatcacaggtatccaactggttt

SEQ ID NO: 877789 - DNA, 25 bp, Mus musculus
agtatcagagctaatatcggggtat

SEQ ID NO: 877790 - DNA, 25 bp, Mus musculus
agtatcagaggtaatatcggggtat

SEQ ID NO: 877791 - DNA, 25 bp, Mus musculus
agtatcagctagcatcgggacagaa

SEQ ID NO: 877792 - DNA, 25 bp, Mus musculus
agtatcagctaggatcgggacagaa

SEQ ID NO: 877793 - DNA, 25 bp, Mus musculus
agtatccaggacaacagctttatca

SEQ ID NO: 877794 - DNA, 25 bp, Mus musculus
agtatccaggtcaacagctttatca

SEQ ID NO: 877795 - DNA, 25 bp, Mus musculus
agtatccatcatcagaagtactccc

SEQ ID NO: 877796 - DNA, 25 bp, Mus musculus
agtatccatcatctgtatctcagaa

SEQ ID NO: 877797 - DNA, 25 bp, Mus musculus
agtatccatcttcagaagtactccc

SEQ ID NO: 877798 - DNA, 25 bp, Mus musculus
agtatccatcttctgtatctcagaa

SEQ ID NO: 877799 - DNA, 25 bp, Mus musculus
agtatccatgattgccagtagaaaa

SEQ ID NO: 877800 - DNA, 25 bp, Mus musculus
agtatccatgtttgccagtagaaaa

SEQ ID NO: 877801 - DNA, 25 bp, Mus musculus
agtatcgggcttcacggggctgagg

SEQ ID NO: 877802 - DNA, 25 bp, Mus musculus
agtatcgggcttcagggggctgagg

SEQ ID NO: 877803 - DNA, 25 bp, Mus musculus
agtatctcagaaagacccaaatggg

SEQ ID NO: 877804 - DNA, 25 bp, Mus musculus
agtatctcagattgaagaccaaatt

SEQ ID NO: 877805 - DNA, 25 bp, Mus musculus
agtatctcagtaagacccaaatggg

SEQ ID NO: 877806 - DNA, 25 bp, Mus musculus
agtatctcagtttgaagaccaaatt

SEQ ID NO: 877807 - DNA, 25 bp, Mus musculus
agtatctggaacaactacgtcaaca

SEQ ID NO: 877808 - DNA, 25 bp, Mus musculus
agtatctggaacaagtacgtcaaca

SEQ ID NO: 877809 - DNA, 25 bp, Mus musculus
agtatctgtatgctcgtggctctaa

SEQ ID NO: 877810 - DNA, 25 bp, Mus musculus
agtatctgtatggtcgtggctctaa

SEQ ID NO: 877811 - DNA, 25 bp, Mus musculus
agtatgaaaaaacagaagtgagctc

SEQ ID NO: 877812 - DNA, 25 bp, Mus musculus
agtatgaaaaaagagaagtgagctc

SEQ ID NO: 877813 - DNA, 25 bp, Mus musculus
agtatgaaagatacaggtctttcca

SEQ ID NO: 877814 - DNA, 25 bp, Mus musculus
agtatgaaagttacaggtctttcca

SEQ ID NO: 877815 - DNA, 25 bp, Mus musculus
agtatgatgatgccaccccagctac

SEQ ID NO: 877816 - DNA, 25 bp, Mus musculus
agtatgatgatggcaccccagctac

SEQ ID NO: 877817 - DNA, 25 bp, Mus musculus
agtatgccagctactacatgaggcc

SEQ ID NO: 877818 - DNA, 25 bp, Mus musculus
agtatgccaggtactacatgaggcc

SEQ ID NO: 877819 - DNA, 25 bp, Mus musculus
agtatgccagtggccgagaggtgtt

SEQ ID NO: 877820 - DNA, 25 bp, Mus musculus
agtatgccagtggcggagaggtgtt

SEQ ID NO: 877821 - DNA, 25 bp, Mus musculus
agtatgctgtcacatccccctgttt

SEQ ID NO: 877822 - DNA, 25 bp, Mus musculus
agtatgctgtcagatccccctgttt

SEQ ID NO: 877823 - DNA, 25 bp, Mus musculus
agtatggagcagctatgcggtggtg

SEQ ID NO: 877824 - DNA, 25 bp, Mus musculus
agtatggagcaggtatgcggtggtg

SEQ ID NO: 877825 - DNA, 25 bp, Mus musculus
agtatgtgaagacctggttttgggg

SEQ ID NO: 877826 - DNA, 25 bp, Mus musculus
agtatgtgaagacgtttgttgtctc

SEQ ID NO: 877827 - DNA, 25 bp, Mus musculus
agtatgtgaagagctggttttgggg

SEQ ID NO: 877828 - DNA, 25 bp, Mus musculus
agtatgtgaagaggtttgttgtctc

SEQ ID NO: 877829 - DNA, 25 bp, Mus musculus
agtattaaagattgtcaaaagagtg

SEQ ID NO: 877830 - DNA, 25 bp, Mus musculus
agtattaaagtttgtcaaaagagtg

SEQ ID NO: 877831 - DNA, 25 bp, Mus musculus
agtattaattacagttctccaagcc

SEQ ID NO: 877832 - DNA, 25 bp, Mus musculus
agtattaattactgttctccaagcc

SEQ ID NO: 877833 - DNA, 25 bp, Mus musculus
agtattacagaggctggttttgggg

SEQ ID NO: 877834 - DNA, 25 bp, Mus musculus
agtattacagtggctggttttgggg

SEQ ID NO: 877835 - DNA, 25 bp, Mus musculus
agtattataagacgtactcaccaga

SEQ ID NO: 877836 - DNA, 25 bp, Mus musculus
agtattataagaggtactcaccaga

SEQ ID NO: 877837 - DNA, 25 bp, Mus musculus
agtattccaaagattttggccaact

SEQ ID NO: 877838 - DNA, 25 bp, Mus musculus
agtattccaatgattttggccaact

SEQ ID NO: 877839 - DNA, 25 bp, Mus musculus
agtattccagcctctgtgcaaggac

SEQ ID NO: 877840 - DNA, 25 bp, Mus musculus
agtattccaggctctgtgcaaggac

SEQ ID NO: 877841 - DNA, 25 bp, Mus musculus
agtattcgaaacatgcactgctgtc

SEQ ID NO: 877842 - DNA, 25 bp, Mus musculus
agtattcgaaacttgcactgctgtc

SEQ ID NO: 877843 - DNA, 25 bp, Mus musculus
agtattctacagcccaggagtgttc

SEQ ID NO: 877844 - DNA, 25 bp, Mus musculus
agtattctacagctcaagactgcag

SEQ ID NO: 877845 - DNA, 25 bp, Mus musculus
agtattctacagctgaggaatgtgc

SEQ ID NO: 877846 - DNA, 25 bp, Mus musculus
agtattctacaggccaggagtgttc

SEQ ID NO: 877847 - DNA, 25 bp, Mus musculus
agtattctacaggtcaagactgcag

SEQ ID NO: 877848 - DNA, 25 bp, Mus musculus
agtattctacaggtgaggaatgtgc

SEQ ID NO: 877849 - DNA, 25 bp, Mus musculus
agtattctggatcagtctcctcttg

SEQ ID NO: 877850 - DNA, 25 bp, Mus musculus
agtattctggttcagtctcctcttg

SEQ ID NO: 877851 - DNA, 25 bp, Mus musculus
agtattgcatatagtcctgatggga

SEQ ID NO: 877852 - DNA, 25 bp, Mus musculus
agtattgcatattgtcctgatggga

SEQ ID NO: 877853 - DNA, 25 bp, Mus musculus
agtatttccaagattcactcagtgt

SEQ ID NO: 877854 - DNA, 25 bp, Mus musculus
agtatttccaagtttcactcagtgt

SEQ ID NO: 877855 - DNA, 25 bp, Mus musculus
agtatttctgccctcggattacaaa

SEQ ID NO: 877856 - DNA, 25 bp, Mus musculus
agtatttctggcctcggattacaaa

SEQ ID NO: 877857 - DNA, 25 bp, Mus musculus
agtatttgttcaaccagctgtttgg

SEQ ID NO: 877858 - DNA, 25 bp, Mus musculus
agtatttgttcatccagctgtttgg

SEQ ID NO: 877859 - DNA, 25 bp, Mus musculus
agtcaaagagagtgttgatggagtt

SEQ ID NO: 877860 - DNA, 25 bp, Mus musculus
agtcaaagagtgtgttgatggagtt

SEQ ID NO: 877861 - DNA, 25 bp, Mus musculus
agtcaaagccagcgtctcttgtggt

SEQ ID NO: 877862 - DNA, 25 bp, Mus musculus
agtcaaagccagctgccagctggga

SEQ ID NO: 877863 - DNA, 25 bp, Mus musculus
agtcaaagccagggtctcttgtggt

SEQ ID NO: 877864 - DNA, 25 bp, Mus musculus
agtcaaagccaggtgccagctggga

SEQ ID NO: 877865 - DNA, 25 bp, Mus musculus
agtcaaagggcaaggatgtgaacat

SEQ ID NO: 877866 - DNA, 25 bp, Mus musculus
agtcaaaggggaaggatgtgaacat

SEQ ID NO: 877867 - DNA, 25 bp, Mus musculus
agtcaaatgatccagacatgcggtg

SEQ ID NO: 877868 - DNA, 25 bp, Mus musculus
agtcaaatgatcgagacatgcggtg

SEQ ID NO: 877869 - DNA, 25 bp, Mus musculus
agtcaacatcaacacagctgaggcc

SEQ ID NO: 877870 - DNA, 25 bp, Mus musculus
agtcaacatcaagacagctgaggcc

SEQ ID NO: 877871 - DNA, 25 bp, Mus musculus
agtcaaccagaccgtggatttctgg

SEQ ID NO: 877872 - DNA, 25 bp, Mus musculus
agtcaaccagacggtggatttctgg

SEQ ID NO: 877873 - DNA, 25 bp, Mus musculus
agtcaacgatgacatttttgtgctt

SEQ ID NO: 877874 - DNA, 25 bp, Mus musculus
agtcaacgatgagatttttgtgctt

SEQ ID NO: 877875 - DNA, 25 bp, Mus musculus
agtcaagaaacgatgttatcgctgc

SEQ ID NO: 877876 - DNA, 25 bp, Mus musculus
agtcaagaaacgttgttatcgctgc

SEQ ID NO: 877877 - DNA, 25 bp, Mus musculus
agtcaagagcaacaagaagcagacc

SEQ ID NO: 877878 - DNA, 25 bp, Mus musculus
agtcaagagcaactttggcgccgag

SEQ ID NO: 877879 - DNA, 25 bp, Mus musculus
agtcaagagcaagaagaagcagacc

SEQ ID NO: 877880 - DNA, 25 bp, Mus musculus
agtcaagagcaagtttggcgccgag

SEQ ID NO: 877881 - DNA, 25 bp, Mus musculus
agtcaaggactccacgcatgtcatg

SEQ ID NO: 877882 - DNA, 25 bp, Mus musculus
agtcaaggactccaggcatgtcatg

SEQ ID NO: 877883 - DNA, 25 bp, Mus musculus
agtcaaggagggcacgttgtctttc

SEQ ID NO: 877884 - DNA, 25 bp, Mus musculus
agtcaaggagggcaggttgtctttc

SEQ ID NO: 877885 - DNA, 25 bp, Mus musculus
agtcaaggccaacaaagtattatga

SEQ ID NO: 877886 - DNA, 25 bp, Mus musculus
agtcaaggccaagaaagtattatga

SEQ ID NO: 877887 - DNA, 25 bp, Mus musculus
agtcaatgacggaatcagaggcaac

SEQ ID NO: 877888 - DNA, 25 bp, Mus musculus
agtcaatgacggtatcagaggcaac

SEQ ID NO: 877889 - DNA, 25 bp, Mus musculus
agtcaatgagagaaccttttaggtt

SEQ ID NO: 877890 - DNA, 25 bp, Mus musculus
agtcaatgagagaagcttttaggtt

SEQ ID NO: 877891 - DNA, 25 bp, Mus musculus
agtcaattcttacacgtgaatctgt

SEQ ID NO: 877892 - DNA, 25 bp, Mus musculus
agtcaattcttacaggtgaatctgt

SEQ ID NO: 877893 - DNA, 25 bp, Mus musculus
agtcacaaggagaactatgagtctg

SEQ ID NO: 877894 - DNA, 25 bp, Mus musculus
agtcacaaggagtactatgagtctg

SEQ ID NO: 877895 - DNA, 25 bp, Mus musculus
agtcacaagtggcttttattgactt

SEQ ID NO: 877896 - DNA, 25 bp, Mus musculus
agtcacaagtgggttttattgactt
